United States Patent 7,341,835 (METHODS OF ANALYSIS OF ALTERNATIVE SPLICING IN MOUSE) - sequence listing, part 17

SEQ ID NO: 638585 - DNA, 25 bp, Mus musculus
gaatgattgatagagaactgaactc

SEQ ID NO: 638586 - DNA, 25 bp, Mus musculus
gaatgattgctgcagtcttcccatg

SEQ ID NO: 638587 - DNA, 25 bp, Mus musculus
gaatgattgctggagtcttcccatg

SEQ ID NO: 638588 - DNA, 25 bp, Mus musculus
gaatgattggatagtggccccaccc

SEQ ID NO: 638589 - DNA, 25 bp, Mus musculus
gaatgattggattgtggccccaccc

SEQ ID NO: 638590 - DNA, 25 bp, Mus musculus
gaatgattgtctcctcggcactaat

SEQ ID NO: 638591 - DNA, 25 bp, Mus musculus
gaatgattgtctgctcggcactaat

SEQ ID NO: 638592 - DNA, 25 bp, Mus musculus
gaatgattttggcactgatggatga

SEQ ID NO: 638593 - DNA, 25 bp, Mus musculus
gaatgattttgggactgatggatga

SEQ ID NO: 638594 - DNA, 25 bp, Mus musculus
gaatgatttttgattgctctgccac

SEQ ID NO: 638595 - DNA, 25 bp, Mus musculus
gaatgatttttgtttgctctgccac

SEQ ID NO: 638596 - DNA, 25 bp, Mus musculus
gaatgcaaaaccaggcagcactgtt

SEQ ID NO: 638597 - DNA, 25 bp, Mus musculus
gaatgcaaaacctggcagcactgtt

SEQ ID NO: 638598 - DNA, 25 bp, Mus musculus
gaatgcaaagctctcatggttttct

SEQ ID NO: 638599 - DNA, 25 bp, Mus musculus
gaatgcaaagctgtcatggttttct

SEQ ID NO: 638600 - DNA, 25 bp, Mus musculus
gaatgcaagaaaaccatcatgccag

SEQ ID NO: 638601 - DNA, 25 bp, Mus musculus
gaatgcaagaaatccatcatgccag

SEQ ID NO: 638602 - DNA, 25 bp, Mus musculus
gaatgcaagcggattctcacgggcc

SEQ ID NO: 638603 - DNA, 25 bp, Mus musculus
gaatgcaagcggtttctcacgggcc

SEQ ID NO: 638604 - DNA, 25 bp, Mus musculus
gaatgcaagtttagtctgaatccta

SEQ ID NO: 638605 - DNA, 25 bp, Mus musculus
gaatgcaagttttgtctgaatccta

SEQ ID NO: 638606 - DNA, 25 bp, Mus musculus
gaatgcaataagagactccggtccc

SEQ ID NO: 638607 - DNA, 25 bp, Mus musculus
gaatgcaataagtgactccggtccc

SEQ ID NO: 638608 - DNA, 25 bp, Mus musculus
gaatgcaatgatcacggcacctaca

SEQ ID NO: 638609 - DNA, 25 bp, Mus musculus
gaatgcaatgatgacggcacctaca

SEQ ID NO: 638610 - DNA, 25 bp, Mus musculus
gaatgcacacccctctacgtacagt

SEQ ID NO: 638611 - DNA, 25 bp, Mus musculus
gaatgcacacccgtctacgtacagt

SEQ ID NO: 638612 - DNA, 25 bp, Mus musculus
gaatgcacacttatcctgactgagg

SEQ ID NO: 638613 - DNA, 25 bp, Mus musculus
gaatgcacacttttcctgactgagg

SEQ ID NO: 638614 - DNA, 25 bp, Mus musculus
gaatgcacagctccgtgtacttcgt

SEQ ID NO: 638615 - DNA, 25 bp, Mus musculus
gaatgcacagctgcgtgtacttcgt

SEQ ID NO: 638616 - DNA, 25 bp, Mus musculus
gaatgcacatcgatactggagcctt

SEQ ID NO: 638617 - DNA, 25 bp, Mus musculus
gaatgcacatcgttactggagcctt

SEQ ID NO: 638618 - DNA, 25 bp, Mus musculus
gaatgcacatggcaaaatattgcca

SEQ ID NO: 638619 - DNA, 25 bp, Mus musculus
gaatgcacatgggaaaatattgcca

SEQ ID NO: 638620 - DNA, 25 bp, Mus musculus
gaatgcacgtgcagttgtccaccag

SEQ ID NO: 638621 - DNA, 25 bp, Mus musculus
gaatgcacgtgctgttgtccaccag

SEQ ID NO: 638622 - DNA, 25 bp, Mus musculus
gaatgcactcgaccctaatcaaaca

SEQ ID NO: 638623 - DNA, 25 bp, Mus musculus
gaatgcactcgagcctaatcaaaca

SEQ ID NO: 638624 - DNA, 25 bp, Mus musculus
gaatgcactgatccctgctgtgacc

SEQ ID NO: 638625 - DNA, 25 bp, Mus musculus
gaatgcactgatgcctgctgtgacc

SEQ ID NO: 638626 - DNA, 25 bp, Mus musculus
gaatgcactgctctccgtggaagcg

SEQ ID NO: 638627 - DNA, 25 bp, Mus musculus
gaatgcactgctgtccgtggaagcg

SEQ ID NO: 638628 - DNA, 25 bp, Mus musculus
gaatgcactggaagggtttgataaa

SEQ ID NO: 638629 - DNA, 25 bp, Mus musculus
gaatgcactggatgggtttgataaa

SEQ ID NO: 638630 - DNA, 25 bp, Mus musculus
gaatgcacttacatctctacgccct

SEQ ID NO: 638631 - DNA, 25 bp, Mus musculus
gaatgcacttacttctctacgccct

SEQ ID NO: 638632 - DNA, 25 bp, Mus musculus
gaatgcacttcgaggaggctacagc

SEQ ID NO: 638633 - DNA, 25 bp, Mus musculus
gaatgcacttcgtggaggctacagc

SEQ ID NO: 638634 - DNA, 25 bp, Mus musculus
gaatgcagaaaccacctgggaccct

SEQ ID NO: 638635 - DNA, 25 bp, Mus musculus
gaatgcagaaacgacctgggaccct

SEQ ID NO: 638636 - DNA, 25 bp, Mus musculus
gaatgcagagaactcaactggtgga

SEQ ID NO: 638637 - DNA, 25 bp, Mus musculus
gaatgcagagaagtcaactggtgga

SEQ ID NO: 638638 - DNA, 25 bp, Mus musculus
gaatgcaggaagatctaaatgccca

SEQ ID NO: 638639 - DNA, 25 bp, Mus musculus
gaatgcaggaagttctaaatgccca

SEQ ID NO: 638640 - DNA, 25 bp, Mus musculus
gaatgcaggcctcgttttgaactgg

SEQ ID NO: 638641 - DNA, 25 bp, Mus musculus
gaatgcaggcctggttttgaactgg

SEQ ID NO: 638642 - DNA, 25 bp, Mus musculus
gaatgcagtgccagcaatgctgtag

SEQ ID NO: 638643 - DNA, 25 bp, Mus musculus
gaatgcagtgcctgcaatgctgtag

SEQ ID NO: 638644 - DNA, 25 bp, Mus musculus
gaatgcatacccctataaatcaatg

SEQ ID NO: 638645 - DNA, 25 bp, Mus musculus
gaatgcatacccgtataaatcaatg

SEQ ID NO: 638646 - DNA, 25 bp, Mus musculus
gaatgcatcaacagatgtagcagag

SEQ ID NO: 638647 - DNA, 25 bp, Mus musculus
gaatgcatcaactgatgtagcagag

SEQ ID NO: 638648 - DNA, 25 bp, Mus musculus
gaatgcatccatcctttcagagggc

SEQ ID NO: 638649 - DNA, 25 bp, Mus musculus
gaatgcatccatgctttcagagggc

SEQ ID NO: 638650 - DNA, 25 bp, Mus musculus
gaatgcatctttctaattcccagta

SEQ ID NO: 638651 - DNA, 25 bp, Mus musculus
gaatgcatctttgtaattcccagta

SEQ ID NO: 638652 - DNA, 25 bp, Mus musculus
gaatgcatttcgactcctgaacaag

SEQ ID NO: 638653 - DNA, 25 bp, Mus musculus
gaatgcatttcgtctcctgaacaag

SEQ ID NO: 638654 - DNA, 25 bp, Mus musculus
gaatgcatttgtacagcgctgccaa

SEQ ID NO: 638655 - DNA, 25 bp, Mus musculus
gaatgcatttgttcagcgctgccaa

SEQ ID NO: 638656 - DNA, 25 bp, Mus musculus
gaatgccaagacagcccacaacaac

SEQ ID NO: 638657 - DNA, 25 bp, Mus musculus
gaatgccaagactgcccacaacaac

SEQ ID NO: 638658 - DNA, 25 bp, Mus musculus
gaatgccaagagaatcactaagagc

SEQ ID NO: 638659 - DNA, 25 bp, Mus musculus
gaatgccaagagtatcactaagagc

SEQ ID NO: 638660 - DNA, 25 bp, Mus musculus
gaatgccaagcgctactcaagactg

SEQ ID NO: 638661 - DNA, 25 bp, Mus musculus
gaatgccaagcggtactcaagactg

SEQ ID NO: 638662 - DNA, 25 bp, Mus musculus
gaatgccaagggagaagaaaccaaa

SEQ ID NO: 638663 - DNA, 25 bp, Mus musculus
gaatgccaagggtgaagaaaccaaa

SEQ ID NO: 638664 - DNA, 25 bp, Mus musculus
gaatgccactcacactgcgagggtg

SEQ ID NO: 638665 - DNA, 25 bp, Mus musculus
gaatgccactcagactgcgagggtg

SEQ ID NO: 638666 - DNA, 25 bp, Mus musculus
gaatgccagctgcatcgctgtccag

SEQ ID NO: 638667 - DNA, 25 bp, Mus musculus
gaatgccagctggatcgctgtccag

SEQ ID NO: 638668 - DNA, 25 bp, Mus musculus
gaatgccaggccaacttcatctcca

SEQ ID NO: 638669 - DNA, 25 bp, Mus musculus
gaatgccaggcctacttcatctcca

SEQ ID NO: 638670 - DNA, 25 bp, Mus musculus
gaatgccatcggagcagagtacagt

SEQ ID NO: 638671 - DNA, 25 bp, Mus musculus
gaatgccatcggtgcagagtacagt

SEQ ID NO: 638672 - DNA, 25 bp, Mus musculus
gaatgccatgaaccgccgccgctgt

SEQ ID NO: 638673 - DNA, 25 bp, Mus musculus
gaatgccatgaagcgccgccgctgt

SEQ ID NO: 638674 - DNA, 25 bp, Mus musculus
gaatgccatgcaccaacagttccaa

SEQ ID NO: 638675 - DNA, 25 bp, Mus musculus
gaatgccatgcagcaacagttccaa

SEQ ID NO: 638676 - DNA, 25 bp, Mus musculus
gaatgcccacagaatgggcatcggg

SEQ ID NO: 638677 - DNA, 25 bp, Mus musculus
gaatgcccacagtatgggcatcggg

SEQ ID NO: 638678 - DNA, 25 bp, Mus musculus
gaatgcccaggaatcagccaagagt

SEQ ID NO: 638679 - DNA, 25 bp, Mus musculus
gaatgcccaggattcagccaagagt

SEQ ID NO: 638680 - DNA, 25 bp, Mus musculus
gaatgcccatggcagaacagaccga

SEQ ID NO: 638681 - DNA, 25 bp, Mus musculus
gaatgcccatgggagaacagaccga

SEQ ID NO: 638682 - DNA, 25 bp, Mus musculus
gaatgccccagtcgtgttgttaatg

SEQ ID NO: 638683 - DNA, 25 bp, Mus musculus
gaatgccccagtggtgttgttaatg

SEQ ID NO: 638684 - DNA, 25 bp, Mus musculus
gaatgccccgagagaaacatcagag

SEQ ID NO: 638685 - DNA, 25 bp, Mus musculus
gaatgccccgagtgaaacatcagag

SEQ ID NO: 638686 - DNA, 25 bp, Mus musculus
gaatgcccgctgagactgggtacca

SEQ ID NO: 638687 - DNA, 25 bp, Mus musculus
gaatgcccgctgtgactgggtacca

SEQ ID NO: 638688 - DNA, 25 bp, Mus musculus
gaatgccctcaacttttcagtgaac

SEQ ID NO: 638689 - DNA, 25 bp, Mus musculus
gaatgccctcaagttttcagtgaac

SEQ ID NO: 638690 - DNA, 25 bp, Mus musculus
gaatgccctcatcctgcaactagaa

SEQ ID NO: 638691 - DNA, 25 bp, Mus musculus
gaatgccctcatgctgcaactagaa

SEQ ID NO: 638692 - DNA, 25 bp, Mus musculus
gaatgccctcttcgtgtgccccggg

SEQ ID NO: 638693 - DNA, 25 bp, Mus musculus
gaatgccctcttggtgtgccccggg

SEQ ID NO: 638694 - DNA, 25 bp, Mus musculus
gaatgcccttgtccggcttgagagt

SEQ ID NO: 638695 - DNA, 25 bp, Mus musculus
gaatgcccttgtgcggcttgagagt

SEQ ID NO: 638696 - DNA, 25 bp, Mus musculus
gaatgccgacccagaggaactgaag

SEQ ID NO: 638697 - DNA, 25 bp, Mus musculus
gaatgccgaccctgaggaactgaag

SEQ ID NO: 638698 - DNA, 25 bp, Mus musculus
gaatgccgaggcctacgtccttttc

SEQ ID NO: 638699 - DNA, 25 bp, Mus musculus
gaatgccgaggcgtacgtccttttc

SEQ ID NO: 638700 - DNA, 25 bp, Mus musculus
gaatgccgatggaactgtcagatat

SEQ ID NO: 638701 - DNA, 25 bp, Mus musculus
gaatgccgatggtactgtcagatat

SEQ ID NO: 638702 - DNA, 25 bp, Mus musculus
gaatgccgcaataccagcctatcac

SEQ ID NO: 638703 - DNA, 25 bp, Mus musculus
gaatgccgcaattccagcctatcac

SEQ ID NO: 638704 - DNA, 25 bp, Mus musculus
gaatgccgcatcaacgctgccaata

SEQ ID NO: 638705 - DNA, 25 bp, Mus musculus
gaatgccgcatctacgctgccaata

SEQ ID NO: 638706 - DNA, 25 bp, Mus musculus
gaatgccgctgccttgggcttctgc

SEQ ID NO: 638707 - DNA, 25 bp, Mus musculus
gaatgccgctgcgttgggcttctgc

SEQ ID NO: 638708 - DNA, 25 bp, Mus musculus
gaatgccggatcacatctaactttg

SEQ ID NO: 638709 - DNA, 25 bp, Mus musculus
gaatgccggatctcatctaactttg

SEQ ID NO: 638710 - DNA, 25 bp, Mus musculus
gaatgcctacgaactcttcaccaag

SEQ ID NO: 638711 - DNA, 25 bp, Mus musculus
gaatgcctacgatctcttcaccaag

SEQ ID NO: 638712 - DNA, 25 bp, Mus musculus
gaatgcctacttattgctgggccct

SEQ ID NO: 638713 - DNA, 25 bp, Mus musculus
gaatgcctactttttgctgggccct

SEQ ID NO: 638714 - DNA, 25 bp, Mus musculus
gaatgcctatgtactgaagtctgaa

SEQ ID NO: 638715 - DNA, 25 bp, Mus musculus
gaatgcctatgttctgaagtctgaa

SEQ ID NO: 638716 - DNA, 25 bp, Mus musculus
gaatgcctcaccaggagactggccc

SEQ ID NO: 638717 - DNA, 25 bp, Mus musculus
gaatgcctcacctggagactggccc

SEQ ID NO: 638718 - DNA, 25 bp, Mus musculus
gaatgcctcagaaggtgctctgatg

SEQ ID NO: 638719 - DNA, 25 bp, Mus musculus
gaatgcctcagatggtgctctgatg

SEQ ID NO: 638720 - DNA, 25 bp, Mus musculus
gaatgcctccctcgctatggtaggg

SEQ ID NO: 638721 - DNA, 25 bp, Mus musculus
gaatgcctccctggctatggtaggg

SEQ ID NO: 638722 - DNA, 25 bp, Mus musculus
gaatgcctccttaactacatcaaag

SEQ ID NO: 638723 - DNA, 25 bp, Mus musculus
gaatgcctcctttactacatcaaag

SEQ ID NO: 638724 - DNA, 25 bp, Mus musculus
gaatgcctgacgctgcctgatgagt

SEQ ID NO: 638725 - DNA, 25 bp, Mus musculus
gaatgcctgacggtgcctgatgagt

SEQ ID NO: 638726 - DNA, 25 bp, Mus musculus
gaatgcctggttcctggttacctgc

SEQ ID NO: 638727 - DNA, 25 bp, Mus musculus
gaatgcctggttgctggttacctgc

SEQ ID NO: 638728 - DNA, 25 bp, Mus musculus
gaatgccttcatcatcttcagcaag

SEQ ID NO: 638729 - DNA, 25 bp, Mus musculus
gaatgccttcatgatcttcagcaag

SEQ ID NO: 638730 - DNA, 25 bp, Mus musculus
gaatgccttccaaggacgtatgttt

SEQ ID NO: 638731 - DNA, 25 bp, Mus musculus
gaatgccttccatggacgtatgttt

SEQ ID NO: 638732 - DNA, 25 bp, Mus musculus
gaatgccttccgaaggaagcatgac

SEQ ID NO: 638733 - DNA, 25 bp, Mus musculus
gaatgccttccgtaggaagcatgac

SEQ ID NO: 638734 - DNA, 25 bp, Mus musculus
gaatgccttgggagaatactcctgc

SEQ ID NO: 638735 - DNA, 25 bp, Mus musculus
gaatgccttgggtgaatactcctgc

SEQ ID NO: 638736 - DNA, 25 bp, Mus musculus
gaatgccttgttatccagccctcct

SEQ ID NO: 638737 - DNA, 25 bp, Mus musculus
gaatgccttgttttccagccctcct

SEQ ID NO: 638738 - DNA, 25 bp, Mus musculus
gaatgcctttaacaactatggcttc

SEQ ID NO: 638739 - DNA, 25 bp, Mus musculus
gaatgcctttaagaactatggcttc

SEQ ID NO: 638740 - DNA, 25 bp, Mus musculus
gaatgcctttgacttccagtcaggg

SEQ ID NO: 638741 - DNA, 25 bp, Mus musculus
gaatgcctttgagttccagtcaggg

SEQ ID NO: 638742 - DNA, 25 bp, Mus musculus
gaatgcgaaaaacgaagccggctga

SEQ ID NO: 638743 - DNA, 25 bp, Mus musculus
gaatgcgaaaaaggaagccggctga

SEQ ID NO: 638744 - DNA, 25 bp, Mus musculus
gaatgcgaaagcctcgtggagttcc

SEQ ID NO: 638745 - DNA, 25 bp, Mus musculus
gaatgcgaaagcgtcgtggagttcc

SEQ ID NO: 638746 - DNA, 25 bp, Mus musculus
gaatgcgattcaccgtcgatgtctt

SEQ ID NO: 638747 - DNA, 25 bp, Mus musculus
gaatgcgattcagcgtcgatgtctt

SEQ ID NO: 638748 - DNA, 25 bp, Mus musculus
gaatgcggctctctcaggaaactca

SEQ ID NO: 638749 - DNA, 25 bp, Mus musculus
gaatgcggctctgtcaggaaactca

SEQ ID NO: 638750 - DNA, 25 bp, Mus musculus
gaatgcggtacacctaccagcagag

SEQ ID NO: 638751 - DNA, 25 bp, Mus musculus
gaatgcggtacagctaccagcagag

SEQ ID NO: 638752 - DNA, 25 bp, Mus musculus
gaatgcgtacaacaaaaccttcctc

SEQ ID NO: 638753 - DNA, 25 bp, Mus musculus
gaatgcgtacaagaaaaccttcctc

SEQ ID NO: 638754 - DNA, 25 bp, Mus musculus
gaatgcgtgtgaacccatagtgcct

SEQ ID NO: 638755 - DNA, 25 bp, Mus musculus
gaatgcgtgtgatcccatagtgcct

SEQ ID NO: 638756 - DNA, 25 bp, Mus musculus
gaatgcgttccacctgacaccttga

SEQ ID NO: 638757 - DNA, 25 bp, Mus musculus
gaatgcgttccagctgacaccttga

SEQ ID NO: 638758 - DNA, 25 bp, Mus musculus
gaatgctatcatcaacagtggcccc

SEQ ID NO: 638759 - DNA, 25 bp, Mus musculus
gaatgctatcatgaacagtggcccc

SEQ ID NO: 638760 - DNA, 25 bp, Mus musculus
gaatgctatgaaacatggccacaga

SEQ ID NO: 638761 - DNA, 25 bp, Mus musculus
gaatgctatgaatcatggccacaga

SEQ ID NO: 638762 - DNA, 25 bp, Mus musculus
gaatgctatgcaagaggcctgtcaa

SEQ ID NO: 638763 - DNA, 25 bp, Mus musculus
gaatgctatgcatgaggcctgtcaa

SEQ ID NO: 638764 - DNA, 25 bp, Mus musculus
gaatgctcaagtcaattcacagcaa

SEQ ID NO: 638765 - DNA, 25 bp, Mus musculus
gaatgctcaagtgaattcacagcaa

SEQ ID NO: 638766 - DNA, 25 bp, Mus musculus
gaatgctcccagcaattaacaagct

SEQ ID NO: 638767 - DNA, 25 bp, Mus musculus
gaatgctcccaggaattaacaagct

SEQ ID NO: 638768 - DNA, 25 bp, Mus musculus
gaatgctcggccatcagagacagag

SEQ ID NO: 638769 - DNA, 25 bp, Mus musculus
gaatgctcggccttcagagacagag

SEQ ID NO: 638770 - DNA, 25 bp, Mus musculus
gaatgctctgcccatgatgcttgct

SEQ ID NO: 638771 - DNA, 25 bp, Mus musculus
gaatgctctgccgatgatgcttgct

SEQ ID NO: 638772 - DNA, 25 bp, Mus musculus
gaatgctcttataccctatgctctg

SEQ ID NO: 638773 - DNA, 25 bp, Mus musculus
gaatgctcttattccctatgctctg

SEQ ID NO: 638774 - DNA, 25 bp, Mus musculus
gaatgctgagcaatctgattctagc

SEQ ID NO: 638775 - DNA, 25 bp, Mus musculus
gaatgctgagcattctgattctagc

SEQ ID NO: 638776 - DNA, 25 bp, Mus musculus
gaatgctgcacgcatgcttgctcca

SEQ ID NO: 638777 - DNA, 25 bp, Mus musculus
gaatgctgcacggatgcttgctcca

SEQ ID NO: 638778 - DNA, 25 bp, Mus musculus
gaatgctgcaggatgtccagatgcc

SEQ ID NO: 638779 - DNA, 25 bp, Mus musculus
gaatgctgcaggttgtccagatgcc

SEQ ID NO: 638780 - DNA, 25 bp, Mus musculus
gaatgctgcctgctatgagttttga

SEQ ID NO: 638781 - DNA, 25 bp, Mus musculus
gaatgctgcctggtatgagttttga

SEQ ID NO: 638782 - DNA, 25 bp, Mus musculus
gaatgctggagtcgcagatcgctat

SEQ ID NO: 638783 - DNA, 25 bp, Mus musculus
gaatgctggagtggcagatcgctat

SEQ ID NO: 638784 - DNA, 25 bp, Mus musculus
gaatgctggatactataagtccctc

SEQ ID NO: 638785 - DNA, 25 bp, Mus musculus
gaatgctggatagtataagtccctc

SEQ ID NO: 638786 - DNA, 25 bp, Mus musculus
gaatgctggctaccttagagcctga

SEQ ID NO: 638787 - DNA, 25 bp, Mus musculus
gaatgctggctagcttagagcctga

SEQ ID NO: 638788 - DNA, 25 bp, Mus musculus
gaatgctgtactcaccgaattgcac

SEQ ID NO: 638789 - DNA, 25 bp, Mus musculus
gaatgctgtactgaccgaattgcac

SEQ ID NO: 638790 - DNA, 25 bp, Mus musculus
gaatgctgtcaaacaaaacggctgc

SEQ ID NO: 638791 - DNA, 25 bp, Mus musculus
gaatgctgtcaatcaaaacggctgc

SEQ ID NO: 638792 - DNA, 25 bp, Mus musculus
gaatgctgtgaacgcactctccact

SEQ ID NO: 638793 - DNA, 25 bp, Mus musculus
gaatgctgtgaaggcactctccact

SEQ ID NO: 638794 - DNA, 25 bp, Mus musculus
gaatgctgtgcccagatctatcctg

SEQ ID NO: 638795 - DNA, 25 bp, Mus musculus
gaatgctgtgccgagatctatcctg

SEQ ID NO: 638796 - DNA, 25 bp, Mus musculus
gaatgctgtggcaagtatagggccc

SEQ ID NO: 638797 - DNA, 25 bp, Mus musculus
gaatgctgtggctagtatagggccc

SEQ ID NO: 638798 - DNA, 25 bp, Mus musculus
gaatgctgttgcactctgggagctg

SEQ ID NO: 638799 - DNA, 25 bp, Mus musculus
gaatgctgttgcattcagatttaaa

SEQ ID NO: 638800 - DNA, 25 bp, Mus musculus
gaatgctgttgctctctgggagctg

SEQ ID NO: 638801 - DNA, 25 bp, Mus musculus
gaatgctgttgctttcagatttaaa

SEQ ID NO: 638802 - DNA, 25 bp, Mus musculus
gaatgcttacatcgcatatagagta

SEQ ID NO: 638803 - DNA, 25 bp, Mus musculus
gaatgcttacatggcatatagagta

SEQ ID NO: 638804 - DNA, 25 bp, Mus musculus
gaatgcttcagtaactttccttggc

SEQ ID NO: 638805 - DNA, 25 bp, Mus musculus
gaatgcttcagttactttccttggc

SEQ ID NO: 638806 - DNA, 25 bp, Mus musculus
gaatgcttccagactgatacctaaa

SEQ ID NO: 638807 - DNA, 25 bp, Mus musculus
gaatgcttccagtctgatacctaaa

SEQ ID NO: 638808 - DNA, 25 bp, Mus musculus
gaatgcttcctgcttatacaactga

SEQ ID NO: 638809 - DNA, 25 bp, Mus musculus
gaatgcttcctggttatacaactga

SEQ ID NO: 638810 - DNA, 25 bp, Mus musculus
gaatgcttgattagtcaagcgccaa

SEQ ID NO: 638811 - DNA, 25 bp, Mus musculus
gaatgcttgatttgtcaagcgccaa

SEQ ID NO: 638812 - DNA, 25 bp, Mus musculus
gaatgcttggtacctccagccactg

SEQ ID NO: 638813 - DNA, 25 bp, Mus musculus
gaatgcttggtagctccagccactg

SEQ ID NO: 638814 - DNA, 25 bp, Mus musculus
gaatgcttggtgcagaatcttctaa

SEQ ID NO: 638815 - DNA, 25 bp, Mus musculus
gaatgcttggtggagaatcttctaa

SEQ ID NO: 638816 - DNA, 25 bp, Mus musculus
gaatgctttgccaaaatacatctcc

SEQ ID NO: 638817 - DNA, 25 bp, Mus musculus
gaatgctttgcctaaatacatctcc

SEQ ID NO: 638818 - DNA, 25 bp, Mus musculus
gaatgcttttgaacagccctgaaac

SEQ ID NO: 638819 - DNA, 25 bp, Mus musculus
gaatgcttttgatcagccctgaaac

SEQ ID NO: 638820 - DNA, 25 bp, Mus musculus
gaatggaaaaacaccagtatgcagt

SEQ ID NO: 638821 - DNA, 25 bp, Mus musculus
gaatggaaaaactccagtatgcagt

SEQ ID NO: 638822 - DNA, 25 bp, Mus musculus
gaatggaaaacacgtggcgatcttt

SEQ ID NO: 638823 - DNA, 25 bp, Mus musculus
gaatggaaaacaggtggcgatcttt

SEQ ID NO: 638824 - DNA, 25 bp, Mus musculus
gaatggaaacggattctactcccac

SEQ ID NO: 638825 - DNA, 25 bp, Mus musculus
gaatggaaacggtttctactcccac

SEQ ID NO: 638826 - DNA, 25 bp, Mus musculus
gaatggaaatcacttgagatcacca

SEQ ID NO: 638827 - DNA, 25 bp, Mus musculus
gaatggaaatcagttgagatcacca

SEQ ID NO: 638828 - DNA, 25 bp, Mus musculus
gaatggaacaatcctctataccatg

SEQ ID NO: 638829 - DNA, 25 bp, Mus musculus
gaatggaacaatgctctataccatg

SEQ ID NO: 638830 - DNA, 25 bp, Mus musculus
gaatggaagaggacttaagagaaag

SEQ ID NO: 638831 - DNA, 25 bp, Mus musculus
gaatggaagaggtcttaagagaaag

SEQ ID NO: 638832 - DNA, 25 bp, Mus musculus
gaatggaatggtatcatgtatgcaa

SEQ ID NO: 638833 - DNA, 25 bp, Mus musculus
gaatggaatggtttcatgtatgcaa

SEQ ID NO: 638834 - DNA, 25 bp, Mus musculus
gaatggaatgtgctgtcctttcaca

SEQ ID NO: 638835 - DNA, 25 bp, Mus musculus
gaatggaatgtggtgtcctttcaca

SEQ ID NO: 638836 - DNA, 25 bp, Mus musculus
gaatggacaagtcggttagaacccg

SEQ ID NO: 638837 - DNA, 25 bp, Mus musculus
gaatggacaagtgggttagaacccg

SEQ ID NO: 638838 - DNA, 25 bp, Mus musculus
gaatggacaatgagacaggcacaga

SEQ ID NO: 638839 - DNA, 25 bp, Mus musculus
gaatggacaatgtgacaggcacaga

SEQ ID NO: 638840 - DNA, 25 bp, Mus musculus
gaatggacagaacacaccatgtaga

SEQ ID NO: 638841 - DNA, 25 bp, Mus musculus
gaatggacagaagacaccatgtaga

SEQ ID NO: 638842 - DNA, 25 bp, Mus musculus
gaatggacagatcatcacccgacaa

SEQ ID NO: 638843 - DNA, 25 bp, Mus musculus
gaatggacagatgatcacccgacaa

SEQ ID NO: 638844 - DNA, 25 bp, Mus musculus
gaatggacatgtacccgcagtgaaa

SEQ ID NO: 638845 - DNA, 25 bp, Mus musculus
gaatggacatgttcccgcagtgaaa

SEQ ID NO: 638846 - DNA, 25 bp, Mus musculus
gaatggacccgcaaagtgaagagga

SEQ ID NO: 638847 - DNA, 25 bp, Mus musculus
gaatggacccgctaagtgaagagga

SEQ ID NO: 638848 - DNA, 25 bp, Mus musculus
gaatggaccttgatggatctggaca

SEQ ID NO: 638849 - DNA, 25 bp, Mus musculus
gaatggaccttgttggatctggaca

SEQ ID NO: 638850 - DNA, 25 bp, Mus musculus
gaatggacgcacataccccagtgcc

SEQ ID NO: 638851 - DNA, 25 bp, Mus musculus
gaatggacgcacttaccccagtgcc

SEQ ID NO: 638852 - DNA, 25 bp, Mus musculus
gaatggactcacattgactacttca

SEQ ID NO: 638853 - DNA, 25 bp, Mus musculus
gaatggactcactttgactacttca

SEQ ID NO: 638854 - DNA, 25 bp, Mus musculus
gaatggacttgtctgctatgcctgt

SEQ ID NO: 638855 - DNA, 25 bp, Mus musculus
gaatggacttgtgtgctatgcctgt

SEQ ID NO: 638856 - DNA, 25 bp, Mus musculus
gaatggagagagaatgattacaata

SEQ ID NO: 638857 - DNA, 25 bp, Mus musculus
gaatggagagagtatgattacaata

SEQ ID NO: 638858 - DNA, 25 bp, Mus musculus
gaatggagatcgatcagaccatgaa

SEQ ID NO: 638859 - DNA, 25 bp, Mus musculus
gaatggagatcgttcagaccatgaa

SEQ ID NO: 638860 - DNA, 25 bp, Mus musculus
gaatggagcacaatccggaatccag

SEQ ID NO: 638861 - DNA, 25 bp, Mus musculus
gaatggagcacattccggaatccag

SEQ ID NO: 638862 - DNA, 25 bp, Mus musculus
gaatggagcctaaccggtggctctt

SEQ ID NO: 638863 - DNA, 25 bp, Mus musculus
gaatggagcctaagatgcaaaacac

SEQ ID NO: 638864 - DNA, 25 bp, Mus musculus
gaatggagcctatccggtggctctt

SEQ ID NO: 638865 - DNA, 25 bp, Mus musculus
gaatggagcctatgatgcaaaacac

SEQ ID NO: 638866 - DNA, 25 bp, Mus musculus
gaatggagctcacttagtagcgtgc

SEQ ID NO: 638867 - DNA, 25 bp, Mus musculus
gaatggagctcagttagtagcgtgc

SEQ ID NO: 638868 - DNA, 25 bp, Mus musculus
gaatggagctgacattgatgtacag

SEQ ID NO: 638869 - DNA, 25 bp, Mus musculus
gaatggagctgagattgatgtacag

SEQ ID NO: 638870 - DNA, 25 bp, Mus musculus
gaatggagctggctcgcagttccct

SEQ ID NO: 638871 - DNA, 25 bp, Mus musculus
gaatggagctgggtcgcagttccct

SEQ ID NO: 638872 - DNA, 25 bp, Mus musculus
gaatggagcttcagcactctggagg

SEQ ID NO: 638873 - DNA, 25 bp, Mus musculus
gaatggagcttctgcactctggagg

SEQ ID NO: 638874 - DNA, 25 bp, Mus musculus
gaatggaggaccacagtaggccacg

SEQ ID NO: 638875 - DNA, 25 bp, Mus musculus
gaatggaggacctcagtaggccacg

SEQ ID NO: 638876 - DNA, 25 bp, Mus musculus
gaatggaggatgagaatatctctgc

SEQ ID NO: 638877 - DNA, 25 bp, Mus musculus
gaatggaggatgtgaatatctctgc

SEQ ID NO: 638878 - DNA, 25 bp, Mus musculus
gaatggagtccacgctcagatggca

SEQ ID NO: 638879 - DNA, 25 bp, Mus musculus
gaatggagtccaggctcagatggca

SEQ ID NO: 638880 - DNA, 25 bp, Mus musculus
gaatggagtggaccaggtggcggca

SEQ ID NO: 638881 - DNA, 25 bp, Mus musculus
gaatggagtggagcaggtggcggca

SEQ ID NO: 638882 - DNA, 25 bp, Mus musculus
gaatggagttgcacactctgccacg

SEQ ID NO: 638883 - DNA, 25 bp, Mus musculus
gaatggagttgctcactctgccacg

SEQ ID NO: 638884 - DNA, 25 bp, Mus musculus
gaatggatatctagtgcgtccgaga

SEQ ID NO: 638885 - DNA, 25 bp, Mus musculus
gaatggatatcttgtgcgtccgaga

SEQ ID NO: 638886 - DNA, 25 bp, Mus musculus
gaatggatggatcataccgttctgt

SEQ ID NO: 638887 - DNA, 25 bp, Mus musculus
gaatggatggatgataccgttctgt

SEQ ID NO: 638888 - DNA, 25 bp, Mus musculus
gaatggattctcaaacaactactgg

SEQ ID NO: 638889 - DNA, 25 bp, Mus musculus
gaatggattctctaacaactactgg

SEQ ID NO: 638890 - DNA, 25 bp, Mus musculus
gaatggatttgaaagacgtcctctg

SEQ ID NO: 638891 - DNA, 25 bp, Mus musculus
gaatggatttgatagacgtcctctg

SEQ ID NO: 638892 - DNA, 25 bp, Mus musculus
gaatggcaaaggattacacagcaag

SEQ ID NO: 638893 - DNA, 25 bp, Mus musculus
gaatggcaaaggtttacacagcaag

SEQ ID NO: 638894 - DNA, 25 bp, Mus musculus
gaatggcaaatgcagttacccaaac

SEQ ID NO: 638895 - DNA, 25 bp, Mus musculus
gaatggcaaatggagttacccaaac

SEQ ID NO: 638896 - DNA, 25 bp, Mus musculus
gaatggcaacaacttctggatcacc

SEQ ID NO: 638897 - DNA, 25 bp, Mus musculus
gaatggcaacaagttctggatcacc

SEQ ID NO: 638898 - DNA, 25 bp, Mus musculus
gaatggcaccgtcgcttagctgctg

SEQ ID NO: 638899 - DNA, 25 bp, Mus musculus
gaatggcaccgtggcttagctgctg

SEQ ID NO: 638900 - DNA, 25 bp, Mus musculus
gaatggcactaaaatgcaatcctgt

SEQ ID NO: 638901 - DNA, 25 bp, Mus musculus
gaatggcactaatatgcaatcctgt

SEQ ID NO: 638902 - DNA, 25 bp, Mus musculus
gaatggcagcatcaccctgtaaagt

SEQ ID NO: 638903 - DNA, 25 bp, Mus musculus
gaatggcagcatgaccctgtaaagt

SEQ ID NO: 638904 - DNA, 25 bp, Mus musculus
gaatggcaggcactggcctgtatcc

SEQ ID NO: 638905 - DNA, 25 bp, Mus musculus
gaatggcaggcagtggcctgtatcc

SEQ ID NO: 638906 - DNA, 25 bp, Mus musculus
gaatggcaggtgaacagaaaccctc

SEQ ID NO: 638907 - DNA, 25 bp, Mus musculus
gaatggcaggtgtacagaaaccctc

SEQ ID NO: 638908 - DNA, 25 bp, Mus musculus
gaatggcagtaaccttctcacaatg

SEQ ID NO: 638909 - DNA, 25 bp, Mus musculus
gaatggcagtaagcttctcacaatg

SEQ ID NO: 638910 - DNA, 25 bp, Mus musculus
gaatggcatgtaagggctgcaccag

SEQ ID NO: 638911 - DNA, 25 bp, Mus musculus
gaatggcatgtatgggctgcaccag

SEQ ID NO: 638912 - DNA, 25 bp, Mus musculus
gaatggcattcaccaaaagttatca

SEQ ID NO: 638913 - DNA, 25 bp, Mus musculus
gaatggcattcagcaaaagttatca

SEQ ID NO: 638914 - DNA, 25 bp, Mus musculus
gaatggcattccatctaacaggatt

SEQ ID NO: 638915 - DNA, 25 bp, Mus musculus
gaatggcattccttctaacaggatt

SEQ ID NO: 638916 - DNA, 25 bp, Mus musculus
gaatggcattggcatttcccttgat

SEQ ID NO: 638917 - DNA, 25 bp, Mus musculus
gaatggcattgggatttcccttgat

SEQ ID NO: 638918 - DNA, 25 bp, Mus musculus
gaatggccctgcacagaagttacgg

SEQ ID NO: 638919 - DNA, 25 bp, Mus musculus
gaatggccctgctcagaagttacgg

SEQ ID NO: 638920 - DNA, 25 bp, Mus musculus
gaatggccgttaagaaaatgcttcc

SEQ ID NO: 638921 - DNA, 25 bp, Mus musculus
gaatggccgttatgaaaatgcttcc

SEQ ID NO: 638922 - DNA, 25 bp, Mus musculus
gaatggcctcttacaaagccgtagt

SEQ ID NO: 638923 - DNA, 25 bp, Mus musculus
gaatggcctctttcaaagccgtagt

SEQ ID NO: 638924 - DNA, 25 bp, Mus musculus
gaatggcctgccaatacaggccgac

SEQ ID NO: 638925 - DNA, 25 bp, Mus musculus
gaatggcctgcctatacaggccgac

SEQ ID NO: 638926 - DNA, 25 bp, Mus musculus
gaatggcctggaagagaacttctgt

SEQ ID NO: 638927 - DNA, 25 bp, Mus musculus
gaatggcctggatgagaacttctgt

SEQ ID NO: 638928 - DNA, 25 bp, Mus musculus
gaatggccttatatacttgttggcg

SEQ ID NO: 638929 - DNA, 25 bp, Mus musculus
gaatggccttatttacttgttggcg

SEQ ID NO: 638930 - DNA, 25 bp, Mus musculus
gaatggcgcagaccgccatgtccga

SEQ ID NO: 638931 - DNA, 25 bp, Mus musculus
gaatggcgcagagcgccatgtccga

SEQ ID NO: 638932 - DNA, 25 bp, Mus musculus
gaatggcggcacctgccagcagaac

SEQ ID NO: 638933 - DNA, 25 bp, Mus musculus
gaatggcggcacgtgccagcagaac

SEQ ID NO: 638934 - DNA, 25 bp, Mus musculus
gaatggcgtagtcaaaggccagccc

SEQ ID NO: 638935 - DNA, 25 bp, Mus musculus
gaatggcgtagtgaaaggccagccc

SEQ ID NO: 638936 - DNA, 25 bp, Mus musculus
gaatggctaaggaggtataacgccg

SEQ ID NO: 638937 - DNA, 25 bp, Mus musculus
gaatggctaaggtggtataacgccg

SEQ ID NO: 638938 - DNA, 25 bp, Mus musculus
gaatggctagatcaggttcatgcac

SEQ ID NO: 638939 - DNA, 25 bp, Mus musculus
gaatggctagatgaggttcatgcac

SEQ ID NO: 638940 - DNA, 25 bp, Mus musculus
gaatggctataactgcaccacaagt

SEQ ID NO: 638941 - DNA, 25 bp, Mus musculus
gaatggctataagtgcaccacaagt

SEQ ID NO: 638942 - DNA, 25 bp, Mus musculus
gaatggctatataagcgctgccgag

SEQ ID NO: 638943 - DNA, 25 bp, Mus musculus
gaatggctatattagcgctgccgag

SEQ ID NO: 638944 - DNA, 25 bp, Mus musculus
gaatggctatttatgtactctggga

SEQ ID NO: 638945 - DNA, 25 bp, Mus musculus
gaatggctatttttgtactctggga

SEQ ID NO: 638946 - DNA, 25 bp, Mus musculus
gaatggctcaccacattgggaaagc

SEQ ID NO: 638947 - DNA, 25 bp, Mus musculus
gaatggctcacctcattgggaaagc

SEQ ID NO: 638948 - DNA, 25 bp, Mus musculus
gaatggctcggacccaaaaggagcc

SEQ ID NO: 638949 - DNA, 25 bp, Mus musculus
gaatggctcggagccaaaaggagcc

SEQ ID NO: 638950 - DNA, 25 bp, Mus musculus
gaatggctcggccataccaatgcaa

SEQ ID NO: 638951 - DNA, 25 bp, Mus musculus
gaatggctcggcgataccaatgcaa

SEQ ID NO: 638952 - DNA, 25 bp, Mus musculus
gaatggctctgaagatattgatata

SEQ ID NO: 638953 - DNA, 25 bp, Mus musculus
gaatggctctgatgatattgatata

SEQ ID NO: 638954 - DNA, 25 bp, Mus musculus
gaatggctgccactcgatatgaacc

SEQ ID NO: 638955 - DNA, 25 bp, Mus musculus
gaatggctgccagtcgatatgaacc

SEQ ID NO: 638956 - DNA, 25 bp, Mus musculus
gaatggctgcctcaaaatgacctgc

SEQ ID NO: 638957 - DNA, 25 bp, Mus musculus
gaatggctgcctgaaaatgacctgc

SEQ ID NO: 638958 - DNA, 25 bp, Mus musculus
gaatggctggaaaatacactcaaca

SEQ ID NO: 638959 - DNA, 25 bp, Mus musculus
gaatggctggaatatacactcaaca

SEQ ID NO: 638960 - DNA, 25 bp, Mus musculus
gaatggcttcagaccaaggatgccc

SEQ ID NO: 638961 - DNA, 25 bp, Mus musculus
gaatggcttcagtccaaggatgccc

SEQ ID NO: 638962 - DNA, 25 bp, Mus musculus
gaatggctttaccatcaccagcacc

SEQ ID NO: 638963 - DNA, 25 bp, Mus musculus
gaatggctttacgatcaccagcacc

SEQ ID NO: 638964 - DNA, 25 bp, Mus musculus
gaatgggaacatcaccttgctacct

SEQ ID NO: 638965 - DNA, 25 bp, Mus musculus
gaatgggaacatgaccttgctacct

SEQ ID NO: 638966 - DNA, 25 bp, Mus musculus
gaatgggaacgccaatatagccgcc

SEQ ID NO: 638967 - DNA, 25 bp, Mus musculus
gaatgggaacgcgaatatagccgcc

SEQ ID NO: 638968 - DNA, 25 bp, Mus musculus
gaatgggaactcatccacccaggga

SEQ ID NO: 638969 - DNA, 25 bp, Mus musculus
gaatgggaactcttccacccaggga

SEQ ID NO: 638970 - DNA, 25 bp, Mus musculus
gaatgggaaggacctcaatggaaaa

SEQ ID NO: 638971 - DNA, 25 bp, Mus musculus
gaatgggaaggagctcaatggaaaa

SEQ ID NO: 638972 - DNA, 25 bp, Mus musculus
gaatgggaatcactgagaagatcaa

SEQ ID NO: 638973 - DNA, 25 bp, Mus musculus
gaatgggaatcagtgagaagatcaa

SEQ ID NO: 638974 - DNA, 25 bp, Mus musculus
gaatgggacaaaatgaacctgcgct

SEQ ID NO: 638975 - DNA, 25 bp, Mus musculus
gaatgggacaaattgaacctgcgct

SEQ ID NO: 638976 - DNA, 25 bp, Mus musculus
gaatgggacacaagggccgaaaaca

SEQ ID NO: 638977 - DNA, 25 bp, Mus musculus
gaatgggacacatgggccgaaaaca

SEQ ID NO: 638978 - DNA, 25 bp, Mus musculus
gaatgggaccaaagccttgccacac

SEQ ID NO: 638979 - DNA, 25 bp, Mus musculus
gaatgggaccaatgccttgccacac

SEQ ID NO: 638980 - DNA, 25 bp, Mus musculus
gaatgggaccttctggcttccagcc

SEQ ID NO: 638981 - DNA, 25 bp, Mus musculus
gaatgggaccttgtggcttccagcc

SEQ ID NO: 638982 - DNA, 25 bp, Mus musculus
gaatgggactttcggctttggcaat

SEQ ID NO: 638983 - DNA, 25 bp, Mus musculus
gaatgggactttgggctttggcaat

SEQ ID NO: 638984 - DNA, 25 bp, Mus musculus
gaatgggagaataaccgggagtctc

SEQ ID NO: 638985 - DNA, 25 bp, Mus musculus
gaatgggagaattaccgggagtctc

SEQ ID NO: 638986 - DNA, 25 bp, Mus musculus
gaatgggaggacactcactcctgca

SEQ ID NO: 638987 - DNA, 25 bp, Mus musculus
gaatgggaggactctcactcctgca

SEQ ID NO: 638988 - DNA, 25 bp, Mus musculus
gaatgggaggcacctaggaccccaa

SEQ ID NO: 638989 - DNA, 25 bp, Mus musculus
gaatgggaggcaccttgcctaagta

SEQ ID NO: 638990 - DNA, 25 bp, Mus musculus
gaatgggaggcagctaggaccccaa

SEQ ID NO: 638991 - DNA, 25 bp, Mus musculus
gaatgggaggcagcttgcctaagta

SEQ ID NO: 638992 - DNA, 25 bp, Mus musculus
gaatgggcacttctaagactacctg

SEQ ID NO: 638993 - DNA, 25 bp, Mus musculus
gaatgggcacttgtaagactacctg

SEQ ID NO: 638994 - DNA, 25 bp, Mus musculus
gaatgggcagtccattgtcgaccta

SEQ ID NO: 638995 - DNA, 25 bp, Mus musculus
gaatgggcagtcgattgtcgaccta

SEQ ID NO: 638996 - DNA, 25 bp, Mus musculus
gaatgggcatccacaaaaggctctc

SEQ ID NO: 638997 - DNA, 25 bp, Mus musculus
gaatgggcatcctcaaaaggctctc

SEQ ID NO: 638998 - DNA, 25 bp, Mus musculus
gaatgggcccaactaatcctgatga

SEQ ID NO: 638999 - DNA, 25 bp, Mus musculus
gaatgggcccaagtaatcctgatga

SEQ ID NO: 639000 - DNA, 25 bp, Mus musculus
gaatgggcggagatatgatacctac

SEQ ID NO: 639001 - DNA, 25 bp, Mus musculus
gaatgggcggagttatgatacctac

SEQ ID NO: 639002 - DNA, 25 bp, Mus musculus
gaatgggctaagacaactggatatg

SEQ ID NO: 639003 - DNA, 25 bp, Mus musculus
gaatgggctaagtcaactggatatg

SEQ ID NO: 639004 - DNA, 25 bp, Mus musculus
gaatgggctacactgagtagtatac

SEQ ID NO: 639005 - DNA, 25 bp, Mus musculus
gaatgggctacagtgagtagtatac

SEQ ID NO: 639006 - DNA, 25 bp, Mus musculus
gaatgggctcctagatcggccagac

SEQ ID NO: 639007 - DNA, 25 bp, Mus musculus
gaatgggctccttgatcggccagac

SEQ ID NO: 639008 - DNA, 25 bp, Mus musculus
gaatgggcttggaagttgagaacca

SEQ ID NO: 639009 - DNA, 25 bp, Mus musculus
gaatgggcttggtagttgagaacca

SEQ ID NO: 639010 - DNA, 25 bp, Mus musculus
gaatgggtacagacagtgggactca

SEQ ID NO: 639011 - DNA, 25 bp, Mus musculus
gaatgggtacagtcagtgggactca

SEQ ID NO: 639012 - DNA, 25 bp, Mus musculus
gaatgggtagctagggaacccacca

SEQ ID NO: 639013 - DNA, 25 bp, Mus musculus
gaatgggtagcttgggaacccacca

SEQ ID NO: 639014 - DNA, 25 bp, Mus musculus
gaatgggtccatattgcctctccag

SEQ ID NO: 639015 - DNA, 25 bp, Mus musculus
gaatgggtccattttgcctctccag

SEQ ID NO: 639016 - DNA, 25 bp, Mus musculus
gaatgggtccctctttgccttccga

SEQ ID NO: 639017 - DNA, 25 bp, Mus musculus
gaatgggtccctgtttgccttccga

SEQ ID NO: 639018 - DNA, 25 bp, Mus musculus
gaatgggtctgtaccagagggatca

SEQ ID NO: 639019 - DNA, 25 bp, Mus musculus
gaatgggtctgttccagagggatca

SEQ ID NO: 639020 - DNA, 25 bp, Mus musculus
gaatgggtcttaaatggcagctctg

SEQ ID NO: 639021 - DNA, 25 bp, Mus musculus
gaatgggtcttatatggcagctctg

SEQ ID NO: 639022 - DNA, 25 bp, Mus musculus
gaatggtagcctctgctgtttccag

SEQ ID NO: 639023 - DNA, 25 bp, Mus musculus
gaatggtagcctgtgctgtttccag

SEQ ID NO: 639024 - DNA, 25 bp, Mus musculus
gaatggtcagatctcacaggctgag

SEQ ID NO: 639025 - DNA, 25 bp, Mus musculus
gaatggtcagatgtcacaggctgag

SEQ ID NO: 639026 - DNA, 25 bp, Mus musculus
gaatggtcaggaagacagacggctc

SEQ ID NO: 639027 - DNA, 25 bp, Mus musculus
gaatggtcaggatgacagacggctc

SEQ ID NO: 639028 - DNA, 25 bp, Mus musculus
gaatggtcatgcatcaatcccctag

SEQ ID NO: 639029 - DNA, 25 bp, Mus musculus
gaatggtcatgcttcaatcccctag

SEQ ID NO: 639030 - DNA, 25 bp, Mus musculus
gaatggtccctccaatgatgccggg

SEQ ID NO: 639031 - DNA, 25 bp, Mus musculus
gaatggtccctcgaatgatgccggg

SEQ ID NO: 639032 - DNA, 25 bp, Mus musculus
gaatggtgacgaacctttgatgacc

SEQ ID NO: 639033 - DNA, 25 bp, Mus musculus
gaatggtgacgaactctgcaccctt

SEQ ID NO: 639034 - DNA, 25 bp, Mus musculus
gaatggtgacgatcctttgatgacc

SEQ ID NO: 639035 - DNA, 25 bp, Mus musculus
gaatggtgacgatctctgcaccctt

SEQ ID NO: 639036 - DNA, 25 bp, Mus musculus
gaatggtgccagatctttgacggga

SEQ ID NO: 639037 - DNA, 25 bp, Mus musculus
gaatggtgccagttctttgacggga

SEQ ID NO: 639038 - DNA, 25 bp, Mus musculus
gaatggtggctcacctaggaaccgg

SEQ ID NO: 639039 - DNA, 25 bp, Mus musculus
gaatggtggctctcctaggaaccgg

SEQ ID NO: 639040 - DNA, 25 bp, Mus musculus
gaatggtgtaatctctgggcaacca

SEQ ID NO: 639041 - DNA, 25 bp, Mus musculus
gaatggtgtaatgtctgggcaacca

SEQ ID NO: 639042 - DNA, 25 bp, Mus musculus
gaatggttacaacataggcctccag

SEQ ID NO: 639043 - DNA, 25 bp, Mus musculus
gaatggttacaagataggcctccag

SEQ ID NO: 639044 - DNA, 25 bp, Mus musculus
gaatggttacatcagtgcggcagaa

SEQ ID NO: 639045 - DNA, 25 bp, Mus musculus
gaatggttacatgagtgcggcagaa

SEQ ID NO: 639046 - DNA, 25 bp, Mus musculus
gaatggttatacagtgagaaatgct

SEQ ID NO: 639047 - DNA, 25 bp, Mus musculus
gaatggttatactgtgagaaatgct

SEQ ID NO: 639048 - DNA, 25 bp, Mus musculus
gaatggttctcgactcagtgacctt

SEQ ID NO: 639049 - DNA, 25 bp, Mus musculus
gaatggttctcgtctcagtgacctt

SEQ ID NO: 639050 - DNA, 25 bp, Mus musculus
gaatggttctgacggcttagcccag

SEQ ID NO: 639051 - DNA, 25 bp, Mus musculus
gaatggttctgagggcttagcccag

SEQ ID NO: 639052 - DNA, 25 bp, Mus musculus
gaatggtttcccaggtcagatggga

SEQ ID NO: 639053 - DNA, 25 bp, Mus musculus
gaatggtttccctggtcagatggga

SEQ ID NO: 639054 - DNA, 25 bp, Mus musculus
gaatggtttgcaagtctgtccacat

SEQ ID NO: 639055 - DNA, 25 bp, Mus musculus
gaatggtttgcatgtctgtccacat

SEQ ID NO: 639056 - DNA, 25 bp, Mus musculus
gaatggtttgggatcatgagaagac

SEQ ID NO: 639057 - DNA, 25 bp, Mus musculus
gaatggtttgggttcatgagaagac

SEQ ID NO: 639058 - DNA, 25 bp, Mus musculus
gaatggtttgtcattcattgagaca

SEQ ID NO: 639059 - DNA, 25 bp, Mus musculus
gaatggtttgtctttcattgagaca

SEQ ID NO: 639060 - DNA, 25 bp, Mus musculus
gaatgtaacacgaagtaccgaggac

SEQ ID NO: 639061 - DNA, 25 bp, Mus musculus
gaatgtaacacgtagtaccgaggac

SEQ ID NO: 639062 - DNA, 25 bp, Mus musculus
gaatgtaactcaaagctggacccca

SEQ ID NO: 639063 - DNA, 25 bp, Mus musculus
gaatgtaactcaataggctctaggg

SEQ ID NO: 639064 - DNA, 25 bp, Mus musculus
gaatgtaactcatagctggacccca

SEQ ID NO: 639065 - DNA, 25 bp, Mus musculus
gaatgtaactcattaggctctaggg

SEQ ID NO: 639066 - DNA, 25 bp, Mus musculus
gaatgtaactgtcccatgatgtcag

SEQ ID NO: 639067 - DNA, 25 bp, Mus musculus
gaatgtaactgtgccatgatgtcag

SEQ ID NO: 639068 - DNA, 25 bp, Mus musculus
gaatgtaactttagaggatgctggg

SEQ ID NO: 639069 - DNA, 25 bp, Mus musculus
gaatgtaacttttgaggatgctggg

SEQ ID NO: 639070 - DNA, 25 bp, Mus musculus
gaatgtaatagcacctgccatcttg

SEQ ID NO: 639071 - DNA, 25 bp, Mus musculus
gaatgtaatagctcctgccatcttg

SEQ ID NO: 639072 - DNA, 25 bp, Mus musculus
gaatgtaatcctcgtgttcttctgt

SEQ ID NO: 639073 - DNA, 25 bp, Mus musculus
gaatgtaatcctggtgttcttctgt

SEQ ID NO: 639074 - DNA, 25 bp, Mus musculus
gaatgtaattatcgcttctatcctg

SEQ ID NO: 639075 - DNA, 25 bp, Mus musculus
gaatgtaattatggcttctatcctg

SEQ ID NO: 639076 - DNA, 25 bp, Mus musculus
gaatgtaattccactgcctcgtcct

SEQ ID NO: 639077 - DNA, 25 bp, Mus musculus
gaatgtaattcctctgcctcgtcct

SEQ ID NO: 639078 - DNA, 25 bp, Mus musculus
gaatgtaattctagctgagtgcaat

SEQ ID NO: 639079 - DNA, 25 bp, Mus musculus
gaatgtaattctcgcctcgacccta

SEQ ID NO: 639080 - DNA, 25 bp, Mus musculus
gaatgtaattctggcctcgacccta

SEQ ID NO: 639081 - DNA, 25 bp, Mus musculus
gaatgtaattcttgctgagtgcaat

SEQ ID NO: 639082 - DNA, 25 bp, Mus musculus
gaatgtacaggacagacactttatg

SEQ ID NO: 639083 - DNA, 25 bp, Mus musculus
gaatgtacaggagagacactttatg

SEQ ID NO: 639084 - DNA, 25 bp, Mus musculus
gaatgtacagtaacagaccggtggt

SEQ ID NO: 639085 - DNA, 25 bp, Mus musculus
gaatgtacagtatcagaccggtggt

SEQ ID NO: 639086 - DNA, 25 bp, Mus musculus
gaatgtactaggatcagcttttgac

SEQ ID NO: 639087 - DNA, 25 bp, Mus musculus
gaatgtactaggttcagcttttgac

SEQ ID NO: 639088 - DNA, 25 bp, Mus musculus
gaatgtagaacccaccgcagggcta

SEQ ID NO: 639089 - DNA, 25 bp, Mus musculus
gaatgtagaaccgaccgcagggcta

SEQ ID NO: 639090 - DNA, 25 bp, Mus musculus
gaatgtagaaggctgaagccataca

SEQ ID NO: 639091 - DNA, 25 bp, Mus musculus
gaatgtagaagggtgaagccataca

SEQ ID NO: 639092 - DNA, 25 bp, Mus musculus
gaatgtagctcgcaggcagagcact

SEQ ID NO: 639093 - DNA, 25 bp, Mus musculus
gaatgtagctcggaggcagagcact

SEQ ID NO: 639094 - DNA, 25 bp, Mus musculus
gaatgtagtctaagcccttcccaag

SEQ ID NO: 639095 - DNA, 25 bp, Mus musculus
gaatgtagtctatgcccttcccaag

SEQ ID NO: 639096 - DNA, 25 bp, Mus musculus
gaatgtagttcacaataacctggcc

SEQ ID NO: 639097 - DNA, 25 bp, Mus musculus
gaatgtagttcagaataacctggcc

SEQ ID NO: 639098 - DNA, 25 bp, Mus musculus
gaatgtatagcaacaggatgagaag

SEQ ID NO: 639099 - DNA, 25 bp, Mus musculus
gaatgtatagcatcaggatgagaag

SEQ ID NO: 639100 - DNA, 25 bp, Mus musculus
gaatgtatgagtctcagggccacca

SEQ ID NO: 639101 - DNA, 25 bp, Mus musculus
gaatgtatgagtgtcagggccacca

SEQ ID NO: 639102 - DNA, 25 bp, Mus musculus
gaatgtatgattagccacatctgag

SEQ ID NO: 639103 - DNA, 25 bp, Mus musculus
gaatgtatgatttgccacatctgag

SEQ ID NO: 639104 - DNA, 25 bp, Mus musculus
gaatgtcaaagaagtaccctttggg

SEQ ID NO: 639105 - DNA, 25 bp, Mus musculus
gaatgtcaaagatgtaccctttggg

SEQ ID NO: 639106 - DNA, 25 bp, Mus musculus
gaatgtcaagggaaaagtaatcctg

SEQ ID NO: 639107 - DNA, 25 bp, Mus musculus
gaatgtcaagggtaaagtaatcctg

SEQ ID NO: 639108 - DNA, 25 bp, Mus musculus
gaatgtcacagcatagatctctagt

SEQ ID NO: 639109 - DNA, 25 bp, Mus musculus
gaatgtcacagcttagatctctagt

SEQ ID NO: 639110 - DNA, 25 bp, Mus musculus
gaatgtcaccaacaacctcaagtct

SEQ ID NO: 639111 - DNA, 25 bp, Mus musculus
gaatgtcaccaagaacctcaagtct

SEQ ID NO: 639112 - DNA, 25 bp, Mus musculus
gaatgtcaccatacataaaaagccg

SEQ ID NO: 639113 - DNA, 25 bp, Mus musculus
gaatgtcaccattcataaaaagccg

SEQ ID NO: 639114 - DNA, 25 bp, Mus musculus
gaatgtcacccaaaccggtatccag

SEQ ID NO: 639115 - DNA, 25 bp, Mus musculus
gaatgtcacccaaatcttaatcaaa

SEQ ID NO: 639116 - DNA, 25 bp, Mus musculus
gaatgtcacccataccggtatccag

SEQ ID NO: 639117 - DNA, 25 bp, Mus musculus
gaatgtcacccatatcttaatcaaa

SEQ ID NO: 639118 - DNA, 25 bp, Mus musculus
gaatgtcacgttcaagttcgacttt

SEQ ID NO: 639119 - DNA, 25 bp, Mus musculus
gaatgtcacgttgaagttcgacttt

SEQ ID NO: 639120 - DNA, 25 bp, Mus musculus
gaatgtcactagaggagaccaagga

SEQ ID NO: 639121 - DNA, 25 bp, Mus musculus
gaatgtcactagtggagaccaagga

SEQ ID NO: 639122 - DNA, 25 bp, Mus musculus
gaatgtcagcacctcaacagaaagt

SEQ ID NO: 639123 - DNA, 25 bp, Mus musculus
gaatgtcagcacgtcaacagaaagt

SEQ ID NO: 639124 - DNA, 25 bp, Mus musculus
gaatgtcagcctcgtgatctcacgg

SEQ ID NO: 639125 - DNA, 25 bp, Mus musculus
gaatgtcagcctggtgatctcacgg

SEQ ID NO: 639126 - DNA, 25 bp, Mus musculus
gaatgtcagctaagagatcccctcg

SEQ ID NO: 639127 - DNA, 25 bp, Mus musculus
gaatgtcagctatgagatcccctcg

SEQ ID NO: 639128 - DNA, 25 bp, Mus musculus
gaatgtcagctcatgcccaatgcct

SEQ ID NO: 639129 - DNA, 25 bp, Mus musculus
gaatgtcagctcttgcccaatgcct

SEQ ID NO: 639130 - DNA, 25 bp, Mus musculus
gaatgtcagctgcagacagaaaagg

SEQ ID NO: 639131 - DNA, 25 bp, Mus musculus
gaatgtcagctggagacagaaaagg

SEQ ID NO: 639132 - DNA, 25 bp, Mus musculus
gaatgtcaggtccaagattggctct

SEQ ID NO: 639133 - DNA, 25 bp, Mus musculus
gaatgtcaggtcgaagattggctct

SEQ ID NO: 639134 - DNA, 25 bp, Mus musculus
gaatgtcagtgaagcccaagagatg

SEQ ID NO: 639135 - DNA, 25 bp, Mus musculus
gaatgtcagtgatgcccaagagatg

SEQ ID NO: 639136 - DNA, 25 bp, Mus musculus
gaatgtcatggcctcctcttacctg

SEQ ID NO: 639137 - DNA, 25 bp, Mus musculus
gaatgtcatggcgtcctcttacctg

SEQ ID NO: 639138 - DNA, 25 bp, Mus musculus
gaatgtccacaaagtgactgtcctc

SEQ ID NO: 639139 - DNA, 25 bp, Mus musculus
gaatgtccacaatgtgactgtcctc

SEQ ID NO: 639140 - DNA, 25 bp, Mus musculus
gaatgtccagacaacaaaaccagtg

SEQ ID NO: 639141 - DNA, 25 bp, Mus musculus
gaatgtccagactacaaaaccagtg

SEQ ID NO: 639142 - DNA, 25 bp, Mus musculus
gaatgtccagatatgaatagtcgac

SEQ ID NO: 639143 - DNA, 25 bp, Mus musculus
gaatgtccagatttgaatagtcgac

SEQ ID NO: 639144 - DNA, 25 bp, Mus musculus
gaatgtcccacaagtcacaaaaagt

SEQ ID NO: 639145 - DNA, 25 bp, Mus musculus
gaatgtcccacatgtcacaaaaagt

SEQ ID NO: 639146 - DNA, 25 bp, Mus musculus
gaatgtccctgaacatggcagatgc

SEQ ID NO: 639147 - DNA, 25 bp, Mus musculus
gaatgtccctgatcatggcagatgc

SEQ ID NO: 639148 - DNA, 25 bp, Mus musculus
gaatgtcctacacctgaatcctgtt

SEQ ID NO: 639149 - DNA, 25 bp, Mus musculus
gaatgtcctacagctgaatcctgtt

SEQ ID NO: 639150 - DNA, 25 bp, Mus musculus
gaatgtcctaggagtctggtgctca

SEQ ID NO: 639151 - DNA, 25 bp, Mus musculus
gaatgtcctaggtgtctggtgctca

SEQ ID NO: 639152 - DNA, 25 bp, Mus musculus
gaatgtcctcaaagactcagacgat

SEQ ID NO: 639153 - DNA, 25 bp, Mus musculus
gaatgtcctcaatgactcagacgat

SEQ ID NO: 639154 - DNA, 25 bp, Mus musculus
gaatgtcgaagaaaatgccacggcc

SEQ ID NO: 639155 - DNA, 25 bp, Mus musculus
gaatgtcgaagataatgccacggcc

SEQ ID NO: 639156 - DNA, 25 bp, Mus musculus
gaatgtcgacagaccaatccttgat

SEQ ID NO: 639157 - DNA, 25 bp, Mus musculus
gaatgtcgacagtccaatccttgat

SEQ ID NO: 639158 - DNA, 25 bp, Mus musculus
gaatgtcgaggtcccagtgactctg

SEQ ID NO: 639159 - DNA, 25 bp, Mus musculus
gaatgtcgaggtgccagtgactctg

SEQ ID NO: 639160 - DNA, 25 bp, Mus musculus
gaatgtcgctatcgttactgccagc

SEQ ID NO: 639161 - DNA, 25 bp, Mus musculus
gaatgtcgctatggttactgccagc

SEQ ID NO: 639162 - DNA, 25 bp, Mus musculus
gaatgtcgctgcaaagaaggtttct

SEQ ID NO: 639163 - DNA, 25 bp, Mus musculus
gaatgtcgctgctaagaaggtttct

SEQ ID NO: 639164 - DNA, 25 bp, Mus musculus
gaatgtctaccaagaactgacccag

SEQ ID NO: 639165 - DNA, 25 bp, Mus musculus
gaatgtctaccatgaactgacccag

SEQ ID NO: 639166 - DNA, 25 bp, Mus musculus
gaatgtctcaatctcggatgaaggg

SEQ ID NO: 639167 - DNA, 25 bp, Mus musculus
gaatgtctcaatgtcggatgaaggg

SEQ ID NO: 639168 - DNA, 25 bp, Mus musculus
gaatgtctcagaacaagaggctcct

SEQ ID NO: 639169 - DNA, 25 bp, Mus musculus
gaatgtctcagatcaagaggctcct

SEQ ID NO: 639170 - DNA, 25 bp, Mus musculus
gaatgtctcaggctagctagcatgg

SEQ ID NO: 639171 - DNA, 25 bp, Mus musculus
gaatgtctcagggtagctagcatgg

SEQ ID NO: 639172 - DNA, 25 bp, Mus musculus
gaatgtctccaaacgcacctgggac

SEQ ID NO: 639173 - DNA, 25 bp, Mus musculus
gaatgtctccaatcgcacctgggac

SEQ ID NO: 639174 - DNA, 25 bp, Mus musculus
gaatgtctgatgatatgccctctgg

SEQ ID NO: 639175 - DNA, 25 bp, Mus musculus
gaatgtctgatgttatgccctctgg

SEQ ID NO: 639176 - DNA, 25 bp, Mus musculus
gaatgtctgcacagtcagtggaaga

SEQ ID NO: 639177 - DNA, 25 bp, Mus musculus
gaatgtctgcactgtcagtggaaga

SEQ ID NO: 639178 - DNA, 25 bp, Mus musculus
gaatgtctggacctactatgtctcc

SEQ ID NO: 639179 - DNA, 25 bp, Mus musculus
gaatgtctggacgtactatgtctcc

SEQ ID NO: 639180 - DNA, 25 bp, Mus musculus
gaatgtctggatccctacaacagtc

SEQ ID NO: 639181 - DNA, 25 bp, Mus musculus
gaatgtctggatgcctacaacagtc

SEQ ID NO: 639182 - DNA, 25 bp, Mus musculus
gaatgtcttaacagaatggctggca

SEQ ID NO: 639183 - DNA, 25 bp, Mus musculus
gaatgtcttaactgaatggctggca

SEQ ID NO: 639184 - DNA, 25 bp, Mus musculus
gaatgtcttcataatctgcttctac

SEQ ID NO: 639185 - DNA, 25 bp, Mus musculus
gaatgtcttcattatctgcttctac

SEQ ID NO: 639186 - DNA, 25 bp, Mus musculus
gaatgtgaacaacagcccacctgtg

SEQ ID NO: 639187 - DNA, 25 bp, Mus musculus
gaatgtgaacaagagcccacctgtg

SEQ ID NO: 639188 - DNA, 25 bp, Mus musculus
gaatgtgaaccacatccggaccagt

SEQ ID NO: 639189 - DNA, 25 bp, Mus musculus
gaatgtgaaccagatccggaccagt

SEQ ID NO: 639190 - DNA, 25 bp, Mus musculus
gaatgtgaccccaagcatggtggct

SEQ ID NO: 639191 - DNA, 25 bp, Mus musculus
gaatgtgacccctagcatggtggct

SEQ ID NO: 639192 - DNA, 25 bp, Mus musculus
gaatgtgacgaactggttactgact

SEQ ID NO: 639193 - DNA, 25 bp, Mus musculus
gaatgtgacgaagtggttactgact

SEQ ID NO: 639194 - DNA, 25 bp, Mus musculus
gaatgtgacggcatagttgatgccc

SEQ ID NO: 639195 - DNA, 25 bp, Mus musculus
gaatgtgacggcttagttgatgccc

SEQ ID NO: 639196 - DNA, 25 bp, Mus musculus
gaatgtgacggtctctgtctcccca

SEQ ID NO: 639197 - DNA, 25 bp, Mus musculus
gaatgtgacggtgtctgtctcccca

SEQ ID NO: 639198 - DNA, 25 bp, Mus musculus
gaatgtgactacagcagagaagcgg

SEQ ID NO: 639199 - DNA, 25 bp, Mus musculus
gaatgtgactactgcagagaagcgg

SEQ ID NO: 639200 - DNA, 25 bp, Mus musculus
gaatgtgactgacaccaaggctcca

SEQ ID NO: 639201 - DNA, 25 bp, Mus musculus
gaatgtgactgagaccaaggctcca

SEQ ID NO: 639202 - DNA, 25 bp, Mus musculus
gaatgtgagcgtaatcaacacctgg

SEQ ID NO: 639203 - DNA, 25 bp, Mus musculus
gaatgtgagcgtctctttcccgcac

SEQ ID NO: 639204 - DNA, 25 bp, Mus musculus
gaatgtgagcgtgtctttcccgcac

SEQ ID NO: 639205 - DNA, 25 bp, Mus musculus
gaatgtgagcgttatcaacacctgg

SEQ ID NO: 639206 - DNA, 25 bp, Mus musculus
gaatgtgaggttagtctttggaacc

SEQ ID NO: 639207 - DNA, 25 bp, Mus musculus
gaatgtgaggtttgtctttggaacc

SEQ ID NO: 639208 - DNA, 25 bp, Mus musculus
gaatgtgataaacgatacagactgg

SEQ ID NO: 639209 - DNA, 25 bp, Mus musculus
gaatgtgataaaggatacagactgg

SEQ ID NO: 639210 - DNA, 25 bp, Mus musculus
gaatgtgatgatccttctgaaaggg

SEQ ID NO: 639211 - DNA, 25 bp, Mus musculus
gaatgtgatgatgcttctgaaaggg

SEQ ID NO: 639212 - DNA, 25 bp, Mus musculus
gaatgtgcagctctcagaccacacc

SEQ ID NO: 639213 - DNA, 25 bp, Mus musculus
gaatgtgcagctgtcagaccacacc

SEQ ID NO: 639214 - DNA, 25 bp, Mus musculus
gaatgtgccaacatctatggctcct

SEQ ID NO: 639215 - DNA, 25 bp, Mus musculus
gaatgtgccaacttctatggctcct

SEQ ID NO: 639216 - DNA, 25 bp, Mus musculus
gaatgtgccaatcacactgtgtgtg

SEQ ID NO: 639217 - DNA, 25 bp, Mus musculus
gaatgtgccaatgacactgtgtgtg

SEQ ID NO: 639218 - DNA, 25 bp, Mus musculus
gaatgtgccgaaaatacctacaaat

SEQ ID NO: 639219 - DNA, 25 bp, Mus musculus
gaatgtgccgaatatacctacaaat

SEQ ID NO: 639220 - DNA, 25 bp, Mus musculus
gaatgtgcgactcgaagagtctcct

SEQ ID NO: 639221 - DNA, 25 bp, Mus musculus
gaatgtgcgactggaagagtctcct

SEQ ID NO: 639222 - DNA, 25 bp, Mus musculus
gaatgtgctcataacccgggatggg

SEQ ID NO: 639223 - DNA, 25 bp, Mus musculus
gaatgtgctcattacccgggatggg

SEQ ID NO: 639224 - DNA, 25 bp, Mus musculus
gaatgtggaactcctcaacctgctg

SEQ ID NO: 639225 - DNA, 25 bp, Mus musculus
gaatgtggaactgctcaacctgctg

SEQ ID NO: 639226 - DNA, 25 bp, Mus musculus
gaatgtggagaacagctaagcaaac

SEQ ID NO: 639227 - DNA, 25 bp, Mus musculus
gaatgtggagaagagctaagcaaac

SEQ ID NO: 639228 - DNA, 25 bp, Mus musculus
gaatgtggagacagaccttgtgtcg

SEQ ID NO: 639229 - DNA, 25 bp, Mus musculus
gaatgtggagactgaccttgtgtcg

SEQ ID NO: 639230 - DNA, 25 bp, Mus musculus
gaatgtggagcactatggccatgca

SEQ ID NO: 639231 - DNA, 25 bp, Mus musculus
gaatgtggagcagtatggccatgca

SEQ ID NO: 639232 - DNA, 25 bp, Mus musculus
gaatgtggagccaccgatccgaacc

SEQ ID NO: 639233 - DNA, 25 bp, Mus musculus
gaatgtggagcctccgatccgaacc

SEQ ID NO: 639234 - DNA, 25 bp, Mus musculus
gaatgtggagtacagatcgtgttca

SEQ ID NO: 639235 - DNA, 25 bp, Mus musculus
gaatgtggagtagagatcgtgttca

SEQ ID NO: 639236 - DNA, 25 bp, Mus musculus
gaatgtggccatagtgttcggaccc

SEQ ID NO: 639237 - DNA, 25 bp, Mus musculus
gaatgtggccattgtgttcggaccc

SEQ ID NO: 639238 - DNA, 25 bp, Mus musculus
gaatgtggcctcagatttcttctag

SEQ ID NO: 639239 - DNA, 25 bp, Mus musculus
gaatgtggcctctgatttcttctag

SEQ ID NO: 639240 - DNA, 25 bp, Mus musculus
gaatgtgggcaaaggacagatttca

SEQ ID NO: 639241 - DNA, 25 bp, Mus musculus
gaatgtgggcaatggacagatttca

SEQ ID NO: 639242 - DNA, 25 bp, Mus musculus
gaatgtgggttcagtatgtggcact

SEQ ID NO: 639243 - DNA, 25 bp, Mus musculus
gaatgtgggttctgtatgtggcact

SEQ ID NO: 639244 - DNA, 25 bp, Mus musculus
gaatgtggtcacagccttacttaaa

SEQ ID NO: 639245 - DNA, 25 bp, Mus musculus
gaatgtggtcactgccttacttaaa

SEQ ID NO: 639246 - DNA, 25 bp, Mus musculus
gaatgtggtgaacctaattgagatt

SEQ ID NO: 639247 - DNA, 25 bp, Mus musculus
gaatgtggtgaagctaattgagatt

SEQ ID NO: 639248 - DNA, 25 bp, Mus musculus
gaatgtgtaaaacgcaccagcccct

SEQ ID NO: 639249 - DNA, 25 bp, Mus musculus
gaatgtgtaaaaggcaccagcccct

SEQ ID NO: 639250 - DNA, 25 bp, Mus musculus
gaatgtgtaaggaaactgacctggc

SEQ ID NO: 639251 - DNA, 25 bp, Mus musculus
gaatgtgtaaggtaactgacctggc

SEQ ID NO: 639252 - DNA, 25 bp, Mus musculus
gaatgtgtaagtccatcagcttgtc

SEQ ID NO: 639253 - DNA, 25 bp, Mus musculus
gaatgtgtaagtgcatcagcttgtc

SEQ ID NO: 639254 - DNA, 25 bp, Mus musculus
gaatgtgtactgattgggcctgctc

SEQ ID NO: 639255 - DNA, 25 bp, Mus musculus
gaatgtgtactgtttgggcctgctc

SEQ ID NO: 639256 - DNA, 25 bp, Mus musculus
gaatgtgtatccaaatgtcatccca

SEQ ID NO: 639257 - DNA, 25 bp, Mus musculus
gaatgtgtatcctaatgtcatccca

SEQ ID NO: 639258 - DNA, 25 bp, Mus musculus
gaatgtgtcaaaacagcccatcctg

SEQ ID NO: 639259 - DNA, 25 bp, Mus musculus
gaatgtgtcaaatcagcccatcctg

SEQ ID NO: 639260 - DNA, 25 bp, Mus musculus
gaatgtgtccatccagggaagctga

SEQ ID NO: 639261 - DNA, 25 bp, Mus musculus
gaatgtgtccatgcagggaagctga

SEQ ID NO: 639262 - DNA, 25 bp, Mus musculus
gaatgtgtcggcacactcataggct

SEQ ID NO: 639263 - DNA, 25 bp, Mus musculus
gaatgtgtcggctcactcataggct

SEQ ID NO: 639264 - DNA, 25 bp, Mus musculus
gaatgtgtctgaatatacaccactg

SEQ ID NO: 639265 - DNA, 25 bp, Mus musculus
gaatgtgtctgattatacaccactg

SEQ ID NO: 639266 - DNA, 25 bp, Mus musculus
gaatgtgtgaccaggatcgtgctca

SEQ ID NO: 639267 - DNA, 25 bp, Mus musculus
gaatgtgtgacctggatcgtgctca

SEQ ID NO: 639268 - DNA, 25 bp, Mus musculus
gaatgttaaactagggctcgcagca

SEQ ID NO: 639269 - DNA, 25 bp, Mus musculus
gaatgttaaacttgggctcgcagca

SEQ ID NO: 639270 - DNA, 25 bp, Mus musculus
gaatgttactcactgctgaccctga

SEQ ID NO: 639271 - DNA, 25 bp, Mus musculus
gaatgttactcagtgctgaccctga

SEQ ID NO: 639272 - DNA, 25 bp, Mus musculus
gaatgttctcagacttggagcacct

SEQ ID NO: 639273 - DNA, 25 bp, Mus musculus
gaatgttctcagtcttggagcacct

SEQ ID NO: 639274 - DNA, 25 bp, Mus musculus
gaatgttctgaaaaatctacactcc

SEQ ID NO: 639275 - DNA, 25 bp, Mus musculus
gaatgttctgaataatctacactcc

SEQ ID NO: 639276 - DNA, 25 bp, Mus musculus
gaatgttctggaccgagctgagcaa

SEQ ID NO: 639277 - DNA, 25 bp, Mus musculus
gaatgttctggagcgagctgagcaa

SEQ ID NO: 639278 - DNA, 25 bp, Mus musculus
gaatgttgcaacacagaactcttag

SEQ ID NO: 639279 - DNA, 25 bp, Mus musculus
gaatgttgcaactcagaactcttag

SEQ ID NO: 639280 - DNA, 25 bp, Mus musculus
gaatgttgccagcaaaggccggacc

SEQ ID NO: 639281 - DNA, 25 bp, Mus musculus
gaatgttgccaggaaaggccggacc

SEQ ID NO: 639282 - DNA, 25 bp, Mus musculus
gaatgttgcgttctgtcctgatgac

SEQ ID NO: 639283 - DNA, 25 bp, Mus musculus
gaatgttgcgttgtgtcctgatgac

SEQ ID NO: 639284 - DNA, 25 bp, Mus musculus
gaatgttgctgcactgttgaagaga

SEQ ID NO: 639285 - DNA, 25 bp, Mus musculus
gaatgttgctgctctgttgaagaga

SEQ ID NO: 639286 - DNA, 25 bp, Mus musculus
gaatgttgcttaagaacggacatca

SEQ ID NO: 639287 - DNA, 25 bp, Mus musculus
gaatgttgcttatgaacggacatca

SEQ ID NO: 639288 - DNA, 25 bp, Mus musculus
gaatgttggccaaaagtgccatgcc

SEQ ID NO: 639289 - DNA, 25 bp, Mus musculus
gaatgttggccataagtgccatgcc

SEQ ID NO: 639290 - DNA, 25 bp, Mus musculus
gaatgttgtaagacttctacttctc

SEQ ID NO: 639291 - DNA, 25 bp, Mus musculus
gaatgttgtaagtcttctacttctc

SEQ ID NO: 639292 - DNA, 25 bp, Mus musculus
gaatgtttcactcgtgtgcacccaa

SEQ ID NO: 639293 - DNA, 25 bp, Mus musculus
gaatgtttcactggtgtgcacccaa

SEQ ID NO: 639294 - DNA, 25 bp, Mus musculus
gaatgtttgagacaatggcaattga

SEQ ID NO: 639295 - DNA, 25 bp, Mus musculus
gaatgtttgagagaatggcaattga

SEQ ID NO: 639296 - DNA, 25 bp, Mus musculus
gaatgttttcacaccacagaaatcc

SEQ ID NO: 639297 - DNA, 25 bp, Mus musculus
gaatgttttcactccacagaaatcc

SEQ ID NO: 639298 - DNA, 25 bp, Mus musculus
gaatgtttttagaatgtcctgcaag

SEQ ID NO: 639299 - DNA, 25 bp, Mus musculus
gaatgtttttagtatgtcctgcaag

SEQ ID NO: 639300 - DNA, 25 bp, Mus musculus
gaatgtttttgacctaaacttcaag

SEQ ID NO: 639301 - DNA, 25 bp, Mus musculus
gaatgtttttgagctaaacttcaag

SEQ ID NO: 639302 - DNA, 25 bp, Mus musculus
gaattaaaatttcccatcagtgaac

SEQ ID NO: 639303 - DNA, 25 bp, Mus musculus
gaattaaaatttgccatcagtgaac

SEQ ID NO: 639304 - DNA, 25 bp, Mus musculus
gaattaaagtttcatcgactctcag

SEQ ID NO: 639305 - DNA, 25 bp, Mus musculus
gaattaaagtttgatcgactctcag

SEQ ID NO: 639306 - DNA, 25 bp, Mus musculus
gaattaacaagcagaccatcccgga

SEQ ID NO: 639307 - DNA, 25 bp, Mus musculus
gaattaacaagctgaccatcccgga

SEQ ID NO: 639308 - DNA, 25 bp, Mus musculus
gaattaacctggaagctgctaatag

SEQ ID NO: 639309 - DNA, 25 bp, Mus musculus
gaattaacctggtagctgctaatag

SEQ ID NO: 639310 - DNA, 25 bp, Mus musculus
gaattaactgaaaaagatatggagg

SEQ ID NO: 639311 - DNA, 25 bp, Mus musculus
gaattaactgaataagatatggagg

SEQ ID NO: 639312 - DNA, 25 bp, Mus musculus
gaattaactttgaggctaggacact

SEQ ID NO: 639313 - DNA, 25 bp, Mus musculus
gaattaactttgtggctaggacact

SEQ ID NO: 639314 - DNA, 25 bp, Mus musculus
gaattaagaaacagaggaccgatct

SEQ ID NO: 639315 - DNA, 25 bp, Mus musculus
gaattaagaaactgaggaccgatct

SEQ ID NO: 639316 - DNA, 25 bp, Mus musculus
gaattaagatcacagccaccatata

SEQ ID NO: 639317 - DNA, 25 bp, Mus musculus
gaattaagatcagagccaccatata

SEQ ID NO: 639318 - DNA, 25 bp, Mus musculus
gaattaagccctacagcccagagag

SEQ ID NO: 639319 - DNA, 25 bp, Mus musculus
gaattaagcccttcagcccagagag

SEQ ID NO: 639320 - DNA, 25 bp, Mus musculus
gaattaatctcacaggagaaatgga

SEQ ID NO: 639321 - DNA, 25 bp, Mus musculus
gaattaatctcagaggagaaatgga

SEQ ID NO: 639322 - DNA, 25 bp, Mus musculus
gaattaatcttgagcctcaaggccg

SEQ ID NO: 639323 - DNA, 25 bp, Mus musculus
gaattaatcttgtgcctcaaggccg

SEQ ID NO: 639324 - DNA, 25 bp, Mus musculus
gaattaatgtgacgaaatgcagaca

SEQ ID NO: 639325 - DNA, 25 bp, Mus musculus
gaattaatgtgaggaaatgcagaca

SEQ ID NO: 639326 - DNA, 25 bp, Mus musculus
gaattaatttggcatgctactcact

SEQ ID NO: 639327 - DNA, 25 bp, Mus musculus
gaattaatttgggatgctactcact

SEQ ID NO: 639328 - DNA, 25 bp, Mus musculus
gaattacaagcaccgcggaattctc

SEQ ID NO: 639329 - DNA, 25 bp, Mus musculus
gaattacaagcagcgcggaattctc

SEQ ID NO: 639330 - DNA, 25 bp, Mus musculus
gaattacacgaccattccggtctac

SEQ ID NO: 639331 - DNA, 25 bp, Mus musculus
gaattacacgacgattccggtctac

SEQ ID NO: 639332 - DNA, 25 bp, Mus musculus
gaattacactccatcaaatgtcccg

SEQ ID NO: 639333 - DNA, 25 bp, Mus musculus
gaattacactccttcaaatgtcccg

SEQ ID NO: 639334 - DNA, 25 bp, Mus musculus
gaattacagactcctgttgaagaaa

SEQ ID NO: 639335 - DNA, 25 bp, Mus musculus
gaattacagactgctgttgaagaaa

SEQ ID NO: 639336 - DNA, 25 bp, Mus musculus
gaattacatcaaaacgtcagaagtg

SEQ ID NO: 639337 - DNA, 25 bp, Mus musculus
gaattacatcaatacgtcagaagtg

SEQ ID NO: 639338 - DNA, 25 bp, Mus musculus
gaattacctccgagatgacaccatc

SEQ ID NO: 639339 - DNA, 25 bp, Mus musculus
gaattacctccgtgatgacaccatc

SEQ ID NO: 639340 - DNA, 25 bp, Mus musculus
gaattacctggcatccaagggcgag

SEQ ID NO: 639341 - DNA, 25 bp, Mus musculus
gaattacctggcttccaagggcgag

SEQ ID NO: 639342 - DNA, 25 bp, Mus musculus
gaattacgatgacgccttaaagctg

SEQ ID NO: 639343 - DNA, 25 bp, Mus musculus
gaattacgatgaggccttaaagctg

SEQ ID NO: 639344 - DNA, 25 bp, Mus musculus
gaattactctctactgtcctgtcat

SEQ ID NO: 639345 - DNA, 25 bp, Mus musculus
gaattactctcttctgtcctgtcat

SEQ ID NO: 639346 - DNA, 25 bp, Mus musculus
gaattactgaagagaagttctcacc

SEQ ID NO: 639347 - DNA, 25 bp, Mus musculus
gaattactgaagtgaagttctcacc

SEQ ID NO: 639348 - DNA, 25 bp, Mus musculus
gaattactgtgtcgttacatccagc

SEQ ID NO: 639349 - DNA, 25 bp, Mus musculus
gaattactgtgtggttacatccagc

SEQ ID NO: 639350 - DNA, 25 bp, Mus musculus
gaattacttgagcactgccaaatcc

SEQ ID NO: 639351 - DNA, 25 bp, Mus musculus
gaattacttgaggactgccaaatcc

SEQ ID NO: 639352 - DNA, 25 bp, Mus musculus
gaattagaaaataggacagaaggga

SEQ ID NO: 639353 - DNA, 25 bp, Mus musculus
gaattagaaaattggacagaaggga

SEQ ID NO: 639354 - DNA, 25 bp, Mus musculus
gaattagaaccgaggctgcgcagac

SEQ ID NO: 639355 - DNA, 25 bp, Mus musculus
gaattagaaccgtggctgcgcagac

SEQ ID NO: 639356 - DNA, 25 bp, Mus musculus
gaattagaagctcttcggttggcta

SEQ ID NO: 639357 - DNA, 25 bp, Mus musculus
gaattagaagctgttcggttggcta

SEQ ID NO: 639358 - DNA, 25 bp, Mus musculus
gaattagacactattaaccgtgtga

SEQ ID NO: 639359 - DNA, 25 bp, Mus musculus
gaattagacacttttaaccgtgtga

SEQ ID NO: 639360 - DNA, 25 bp, Mus musculus
gaattagaccccatggaccccagct

SEQ ID NO: 639361 - DNA, 25 bp, Mus musculus
gaattagaccccttggaccccagct

SEQ ID NO: 639362 - DNA, 25 bp, Mus musculus
gaattagagcgccaagagaatgtat

SEQ ID NO: 639363 - DNA, 25 bp, Mus musculus
gaattagagcgcgaagagaatgtat

SEQ ID NO: 639364 - DNA, 25 bp, Mus musculus
gaattagcaataatccaagatcaac

SEQ ID NO: 639365 - DNA, 25 bp, Mus musculus
gaattagcaatattccaagatcaac

SEQ ID NO: 639366 - DNA, 25 bp, Mus musculus
gaattagccttaaaactagcaggcc

SEQ ID NO: 639367 - DNA, 25 bp, Mus musculus
gaattagccttataactagcaggcc

SEQ ID NO: 639368 - DNA, 25 bp, Mus musculus
gaattagctttgagaggaaggttac

SEQ ID NO: 639369 - DNA, 25 bp, Mus musculus
gaattagctttgtgaggaaggttac

SEQ ID NO: 639370 - DNA, 25 bp, Mus musculus
gaattaggtccacttcgatgtccac

SEQ ID NO: 639371 - DNA, 25 bp, Mus musculus
gaattaggtccagttcgatgtccac

SEQ ID NO: 639372 - DNA, 25 bp, Mus musculus
gaattaggtggcaagacactggtga

SEQ ID NO: 639373 - DNA, 25 bp, Mus musculus
gaattaggtggctagacactggtga

SEQ ID NO: 639374 - DNA, 25 bp, Mus musculus
gaattagtcaacaatatgctgctga

SEQ ID NO: 639375 - DNA, 25 bp, Mus musculus
gaattagtcaactatatgctgctga

SEQ ID NO: 639376 - DNA, 25 bp, Mus musculus
gaattagtgctaatgatgcagcgag

SEQ ID NO: 639377 - DNA, 25 bp, Mus musculus
gaattagtgctattgatgcagcgag

SEQ ID NO: 639378 - DNA, 25 bp, Mus musculus
gaattatatccaagctgtggaggag

SEQ ID NO: 639379 - DNA, 25 bp, Mus musculus
gaattatatccatgctgtggaggag

SEQ ID NO: 639380 - DNA, 25 bp, Mus musculus
gaattatattatctctcccagcgtg

SEQ ID NO: 639381 - DNA, 25 bp, Mus musculus
gaattatattatgtctcccagcgtg

SEQ ID NO: 639382 - DNA, 25 bp, Mus musculus
gaattatcacatattctatgcactg

SEQ ID NO: 639383 - DNA, 25 bp, Mus musculus
gaattatcacattttctatgcactg

SEQ ID NO: 639384 - DNA, 25 bp, Mus musculus
gaattatcagctacgctggaggccc

SEQ ID NO: 639385 - DNA, 25 bp, Mus musculus
gaattatcagcttcgctggaggccc

SEQ ID NO: 639386 - DNA, 25 bp, Mus musculus
gaattatccccaccaatgtgtacag

SEQ ID NO: 639387 - DNA, 25 bp, Mus musculus
gaattatccccagcaatgtgtacag

SEQ ID NO: 639388 - DNA, 25 bp, Mus musculus
gaattatgccagaaggttctttcca

SEQ ID NO: 639389 - DNA, 25 bp, Mus musculus
gaattatgccagtaggttctttcca

SEQ ID NO: 639390 - DNA, 25 bp, Mus musculus
gaattatgtaacctcattaccctgg

SEQ ID NO: 639391 - DNA, 25 bp, Mus musculus
gaattatgtaacgtcattaccctgg

SEQ ID NO: 639392 - DNA, 25 bp, Mus musculus
gaattatgtcagcaacgtgtccaag

SEQ ID NO: 639393 - DNA, 25 bp, Mus musculus
gaattatgtcaggaacgtgtccaag

SEQ ID NO: 639394 - DNA, 25 bp, Mus musculus
gaattatgtgaaaggatattgcacc

SEQ ID NO: 639395 - DNA, 25 bp, Mus musculus
gaattatgtgaatggatattgcacc

SEQ ID NO: 639396 - DNA, 25 bp, Mus musculus
gaattattccccaaattggagctat

SEQ ID NO: 639397 - DNA, 25 bp, Mus musculus
gaattattcccctaattggagctat

SEQ ID NO: 639398 - DNA, 25 bp, Mus musculus
gaattattctggcaacccctgtgga

SEQ ID NO: 639399 - DNA, 25 bp, Mus musculus
gaattattctgggaacccctgtgga

SEQ ID NO: 639400 - DNA, 25 bp, Mus musculus
gaattattcttaagaaccattgaag

SEQ ID NO: 639401 - DNA, 25 bp, Mus musculus
gaattattcttatgaaccattgaag

SEQ ID NO: 639402 - DNA, 25 bp, Mus musculus
gaattattggctcaaaaggcaccag

SEQ ID NO: 639403 - DNA, 25 bp, Mus musculus
gaattattggctgaaaaggcaccag

SEQ ID NO: 639404 - DNA, 25 bp, Mus musculus
gaattatttaagctggctccggaga

SEQ ID NO: 639405 - DNA, 25 bp, Mus musculus
gaattatttaaggtggctccggaga

SEQ ID NO: 639406 - DNA, 25 bp, Mus musculus
gaattattttatccgtgatagtggc

SEQ ID NO: 639407 - DNA, 25 bp, Mus musculus
gaattattttatgcgtgatagtggc

SEQ ID NO: 639408 - DNA, 25 bp, Mus musculus
gaattcaaagagaagggctctgagc

SEQ ID NO: 639409 - DNA, 25 bp, Mus musculus
gaattcaaagagtagggctctgagc

SEQ ID NO: 639410 - DNA, 25 bp, Mus musculus
gaattcaacagtatgcaagacagag

SEQ ID NO: 639411 - DNA, 25 bp, Mus musculus
gaattcaacagtttgcaagacagag

SEQ ID NO: 639412 - DNA, 25 bp, Mus musculus
gaattcaacattccagaggctggtt

SEQ ID NO: 639413 - DNA, 25 bp, Mus musculus
gaattcaacattgcagaggctggtt

SEQ ID NO: 639414 - DNA, 25 bp, Mus musculus
gaattcaacgacaatgaggccaatg

SEQ ID NO: 639415 - DNA, 25 bp, Mus musculus
gaattcaacgactatgaggccaatg

SEQ ID NO: 639416 - DNA, 25 bp, Mus musculus
gaattcaactatctaacgcaatggt

SEQ ID NO: 639417 - DNA, 25 bp, Mus musculus
gaattcaactatgtaacgcaatggt

SEQ ID NO: 639418 - DNA, 25 bp, Mus musculus
gaattcaactttcgaaacctccata

SEQ ID NO: 639419 - DNA, 25 bp, Mus musculus
gaattcaactttggaaacctccata

SEQ ID NO: 639420 - DNA, 25 bp, Mus musculus
gaattcaagcggctctcataaagat

SEQ ID NO: 639421 - DNA, 25 bp, Mus musculus
gaattcaagcgggtctcataaagat

SEQ ID NO: 639422 - DNA, 25 bp, Mus musculus
gaattcaagtcaaccttcaagcttg

SEQ ID NO: 639423 - DNA, 25 bp, Mus musculus
gaattcaagtcatccttcaagcttg

SEQ ID NO: 639424 - DNA, 25 bp, Mus musculus
gaattcaagttcattctatgactgg

SEQ ID NO: 639425 - DNA, 25 bp, Mus musculus
gaattcaagttctttctatgactgg

SEQ ID NO: 639426 - DNA, 25 bp, Mus musculus
gaattcaatctcatgttggacaaag

SEQ ID NO: 639427 - DNA, 25 bp, Mus musculus
gaattcaatctcttgttggacaaag

SEQ ID NO: 639428 - DNA, 25 bp, Mus musculus
gaattcacaccgagtcttcagccag

SEQ ID NO: 639429 - DNA, 25 bp, Mus musculus
gaattcacaccgtgtcttcagccag

SEQ ID NO: 639430 - DNA, 25 bp, Mus musculus
gaattcaccaatacggcgagtctga

SEQ ID NO: 639431 - DNA, 25 bp, Mus musculus
gaattcaccaattcggcgagtctga

SEQ ID NO: 639432 - DNA, 25 bp, Mus musculus
gaattcacccacctgtatgcacgct

SEQ ID NO: 639433 - DNA, 25 bp, Mus musculus
gaattcacccacgtgtatgcacgct

SEQ ID NO: 639434 - DNA, 25 bp, Mus musculus
gaattcacccggctggagcccgtct

SEQ ID NO: 639435 - DNA, 25 bp, Mus musculus
gaattcacccgggtggagcccgtct

SEQ ID NO: 639436 - DNA, 25 bp, Mus musculus
gaattcacggtcaacactgtcaact

SEQ ID NO: 639437 - DNA, 25 bp, Mus musculus
gaattcacggtctacactgtcaact

SEQ ID NO: 639438 - DNA, 25 bp, Mus musculus
gaattcactgccatggaggactttg

SEQ ID NO: 639439 - DNA, 25 bp, Mus musculus
gaattcactgccttggaggactttg

SEQ ID NO: 639440 - DNA, 25 bp, Mus musculus
gaattcagaaaaagacattactatg

SEQ ID NO: 639441 - DNA, 25 bp, Mus musculus
gaattcagaaaatgacattactatg

SEQ ID NO: 639442 - DNA, 25 bp, Mus musculus
gaattcagaacaaccagagggtgaa

SEQ ID NO: 639443 - DNA, 25 bp, Mus musculus
gaattcagaacatccagagggtgaa

SEQ ID NO: 639444 - DNA, 25 bp, Mus musculus
gaattcagagacaaactctccccaa

SEQ ID NO: 639445 - DNA, 25 bp, Mus musculus
gaattcagagactaactctccccaa

SEQ ID NO: 639446 - DNA, 25 bp, Mus musculus
gaattcagattcaccagtgctggag

SEQ ID NO: 639447 - DNA, 25 bp, Mus musculus
gaattcagattcagtgggatgaggt

SEQ ID NO: 639448 - DNA, 25 bp, Mus musculus
gaattcagattctccagtgctggag

SEQ ID NO: 639449 - DNA, 25 bp, Mus musculus
gaattcagattctgtgggatgaggt

SEQ ID NO: 639450 - DNA, 25 bp, Mus musculus
gaattcagccttctctatgaccaag

SEQ ID NO: 639451 - DNA, 25 bp, Mus musculus
gaattcagccttgtctatgaccaag

SEQ ID NO: 639452 - DNA, 25 bp, Mus musculus
gaattcagctccataaaatcggcag

SEQ ID NO: 639453 - DNA, 25 bp, Mus musculus
gaattcagctccttaaaatcggcag

SEQ ID NO: 639454 - DNA, 25 bp, Mus musculus
gaattcagctttctgcaactctcag

SEQ ID NO: 639455 - DNA, 25 bp, Mus musculus
gaattcagctttgtgcaactctcag

SEQ ID NO: 639456 - DNA, 25 bp, Mus musculus
gaattcaggctcacagtccatcaca

SEQ ID NO: 639457 - DNA, 25 bp, Mus musculus
gaattcaggctctcagtccatcaca

SEQ ID NO: 639458 - DNA, 25 bp, Mus musculus
gaattcagggctacatccatgccag

SEQ ID NO: 639459 - DNA, 25 bp, Mus musculus
gaattcagggcttcatccatgccag

SEQ ID NO: 639460 - DNA, 25 bp, Mus musculus
gaattcagtgaacaaaacatgctct

SEQ ID NO: 639461 - DNA, 25 bp, Mus musculus
gaattcagtgaagaaaacatgctct

SEQ ID NO: 639462 - DNA, 25 bp, Mus musculus
gaattcagtgatctagagagggcca

SEQ ID NO: 639463 - DNA, 25 bp, Mus musculus
gaattcagtgatgtagagagggcca

SEQ ID NO: 639464 - DNA, 25 bp, Mus musculus
gaattcagtgtgaatcccaggctca

SEQ ID NO: 639465 - DNA, 25 bp, Mus musculus
gaattcagtgtgtatcccaggctca

SEQ ID NO: 639466 - DNA, 25 bp, Mus musculus
gaattcataactattcagactggga

SEQ ID NO: 639467 - DNA, 25 bp, Mus musculus
gaattcataacttttcagactggga

SEQ ID NO: 639468 - DNA, 25 bp, Mus musculus
gaattcatacccatgttgggctgca

SEQ ID NO: 639469 - DNA, 25 bp, Mus musculus
gaattcatacccttgttgggctgca

SEQ ID NO: 639470 - DNA, 25 bp, Mus musculus
gaattcatctctacgagagctccaa

SEQ ID NO: 639471 - DNA, 25 bp, Mus musculus
gaattcatctcttcgagagctccaa

SEQ ID NO: 639472 - DNA, 25 bp, Mus musculus
gaattcatgctgcaagttggagcac

SEQ ID NO: 639473 - DNA, 25 bp, Mus musculus
gaattcatgctggaagttggagcac

SEQ ID NO: 639474 - DNA, 25 bp, Mus musculus
gaattcatggttcaccgtcttccta

SEQ ID NO: 639475 - DNA, 25 bp, Mus musculus
gaattcatggttgaccgtcttccta

SEQ ID NO: 639476 - DNA, 25 bp, Mus musculus
gaattcattatcaacatacaagcta

SEQ ID NO: 639477 - DNA, 25 bp, Mus musculus
gaattcattatctacatacaagcta

SEQ ID NO: 639478 - DNA, 25 bp, Mus musculus
gaattcattatgcactcaaggcaca

SEQ ID NO: 639479 - DNA, 25 bp, Mus musculus
gaattcattatggactcaaggcaca

SEQ ID NO: 639480 - DNA, 25 bp, Mus musculus
gaattcattgggacccttcccactt

SEQ ID NO: 639481 - DNA, 25 bp, Mus musculus
gaattcattgggtcccttcccactt

SEQ ID NO: 639482 - DNA, 25 bp, Mus musculus
gaattccaatgaatttatcgatgcc

SEQ ID NO: 639483 - DNA, 25 bp, Mus musculus
gaattccaatgattttatcgatgcc

SEQ ID NO: 639484 - DNA, 25 bp, Mus musculus
gaattccaccgcctcaaggtgggag

SEQ ID NO: 639485 - DNA, 25 bp, Mus musculus
gaattccaccgcgtcaaggtgggag

SEQ ID NO: 639486 - DNA, 25 bp, Mus musculus
gaattccagccaaactgagctccac

SEQ ID NO: 639487 - DNA, 25 bp, Mus musculus
gaattccagccatactgagctccac

SEQ ID NO: 639488 - DNA, 25 bp, Mus musculus
gaattccagtgtccagatggctcct

SEQ ID NO: 639489 - DNA, 25 bp, Mus musculus
gaattccagtgtgcagatggctcct

SEQ ID NO: 639490 - DNA, 25 bp, Mus musculus
gaattccatctgatcccctgacttc

SEQ ID NO: 639491 - DNA, 25 bp, Mus musculus
gaattccatctgttcccctgacttc

SEQ ID NO: 639492 - DNA, 25 bp, Mus musculus
gaattccatgttatcactggaagag

SEQ ID NO: 639493 - DNA, 25 bp, Mus musculus
gaattccatgttttcactggaagag

SEQ ID NO: 639494 - DNA, 25 bp, Mus musculus
gaattcccggttcgtggcttattgc

SEQ ID NO: 639495 - DNA, 25 bp, Mus musculus
gaattcccggttggtggcttattgc

SEQ ID NO: 639496 - DNA, 25 bp, Mus musculus
gaattccctgaacaggctggcagat

SEQ ID NO: 639497 - DNA, 25 bp, Mus musculus
gaattccctgaagaggctggcagat

SEQ ID NO: 639498 - DNA, 25 bp, Mus musculus
gaattccctgagactcataggtcag

SEQ ID NO: 639499 - DNA, 25 bp, Mus musculus
gaattccctgagctcagacgacagg

SEQ ID NO: 639500 - DNA, 25 bp, Mus musculus
gaattccctgaggtcagacgacagg

SEQ ID NO: 639501 - DNA, 25 bp, Mus musculus
gaattccctgagtctcataggtcag

SEQ ID NO: 639502 - DNA, 25 bp, Mus musculus
gaattccctggcagttactatggat

SEQ ID NO: 639503 - DNA, 25 bp, Mus musculus
gaattccctggctgttactatggat

SEQ ID NO: 639504 - DNA, 25 bp, Mus musculus
gaattccctggtctcccgaaacctg

SEQ ID NO: 639505 - DNA, 25 bp, Mus musculus
gaattccctggtgtcccgaaacctg

SEQ ID NO: 639506 - DNA, 25 bp, Mus musculus
gaattccgaaagcatgtggagccct

SEQ ID NO: 639507 - DNA, 25 bp, Mus musculus
gaattccgaaaggatgtggagccct

SEQ ID NO: 639508 - DNA, 25 bp, Mus musculus
gaattccggaggatcatggagaaga

SEQ ID NO: 639509 - DNA, 25 bp, Mus musculus
gaattccggaggttcatggagaaga

SEQ ID NO: 639510 - DNA, 25 bp, Mus musculus
gaattccggatccaagattcccagc

SEQ ID NO: 639511 - DNA, 25 bp, Mus musculus
gaattccggatcgaagattcccagc

SEQ ID NO: 639512 - DNA, 25 bp, Mus musculus
gaattccggcggacagaggttcctc

SEQ ID NO: 639513 - DNA, 25 bp, Mus musculus
gaattccggcggtcagaggttcctc

SEQ ID NO: 639514 - DNA, 25 bp, Mus musculus
gaattcctactcaaagaagactcag

SEQ ID NO: 639515 - DNA, 25 bp, Mus musculus
gaattcctactctaagaagactcag

SEQ ID NO: 639516 - DNA, 25 bp, Mus musculus
gaattcctagctatccgcagacgca

SEQ ID NO: 639517 - DNA, 25 bp, Mus musculus
gaattcctagctttccgcagacgca

SEQ ID NO: 639518 - DNA, 25 bp, Mus musculus
gaattcctccatctccaatggcaca

SEQ ID NO: 639519 - DNA, 25 bp, Mus musculus
gaattcctccatgtccaatggcaca

SEQ ID NO: 639520 - DNA, 25 bp, Mus musculus
gaattcctgcacaccagccatggct

SEQ ID NO: 639521 - DNA, 25 bp, Mus musculus
gaattcctgcactccagccatggct

SEQ ID NO: 639522 - DNA, 25 bp, Mus musculus
gaattcctgccgactggtaacagca

SEQ ID NO: 639523 - DNA, 25 bp, Mus musculus
gaattcctgccgtctggtaacagca

SEQ ID NO: 639524 - DNA, 25 bp, Mus musculus
gaattcctgttgaccaagtcaaagg

SEQ ID NO: 639525 - DNA, 25 bp, Mus musculus
gaattcctgttgtccaagtcaaagg

SEQ ID NO: 639526 - DNA, 25 bp, Mus musculus
gaattcgaagttccacagtcctgag

SEQ ID NO: 639527 - DNA, 25 bp, Mus musculus
gaattcgaagttgcacagtcctgag

SEQ ID NO: 639528 - DNA, 25 bp, Mus musculus
gaattcgagactattcattgggcgt

SEQ ID NO: 639529 - DNA, 25 bp, Mus musculus
gaattcgagacttttcattgggcgt

SEQ ID NO: 639530 - DNA, 25 bp, Mus musculus
gaattcgcaatcagaacccaagtga

SEQ ID NO: 639531 - DNA, 25 bp, Mus musculus
gaattcgcaatctgaacccaagtga

SEQ ID NO: 639532 - DNA, 25 bp, Mus musculus
gaattcggttctctgaagcctcaaa

SEQ ID NO: 639533 - DNA, 25 bp, Mus musculus
gaattcggttctgtgaagcctcaaa

SEQ ID NO: 639534 - DNA, 25 bp, Mus musculus
gaattcggtttcagcttcagcccca

SEQ ID NO: 639535 - DNA, 25 bp, Mus musculus
gaattcggtttctgcttcagcccca

SEQ ID NO: 639536 - DNA, 25 bp, Mus musculus
gaattcgtgagaagagccgcttgtt

SEQ ID NO: 639537 - DNA, 25 bp, Mus musculus
gaattcgtgagatgagccgcttgtt

SEQ ID NO: 639538 - DNA, 25 bp, Mus musculus
gaattctactgacgttatagaagcc

SEQ ID NO: 639539 - DNA, 25 bp, Mus musculus
gaattctactgaggttatagaagcc

SEQ ID NO: 639540 - DNA, 25 bp, Mus musculus
gaattctatcgccattacctgcagc

SEQ ID NO: 639541 - DNA, 25 bp, Mus musculus
gaattctatcgcgattacctgcagc

SEQ ID NO: 639542 - DNA, 25 bp, Mus musculus
gaattctatgatcaagacgtcagct

SEQ ID NO: 639543 - DNA, 25 bp, Mus musculus
gaattctatgatgaagacgtcagct

SEQ ID NO: 639544 - DNA, 25 bp, Mus musculus
gaattctcagagcaaccctttggag

SEQ ID NO: 639545 - DNA, 25 bp, Mus musculus
gaattctcagaggaaccctttggag

SEQ ID NO: 639546 - DNA, 25 bp, Mus musculus
gaattctccaaaagtaggtccagtg

SEQ ID NO: 639547 - DNA, 25 bp, Mus musculus
gaattctccaaatgtaggtccagtg

SEQ ID NO: 639548 - DNA, 25 bp, Mus musculus
gaattctccatgaggaactgttcca

SEQ ID NO: 639549 - DNA, 25 bp, Mus musculus
gaattctccatgtggaactgttcca

SEQ ID NO: 639550 - DNA, 25 bp, Mus musculus
gaattctccccaactcataagtcaa

SEQ ID NO: 639551 - DNA, 25 bp, Mus musculus
gaattctccccatctcataagtcaa

SEQ ID NO: 639552 - DNA, 25 bp, Mus musculus
gaattctccctaaatggtaagatag

SEQ ID NO: 639553 - DNA, 25 bp, Mus musculus
gaattctccctatatggtaagatag

SEQ ID NO: 639554 - DNA, 25 bp, Mus musculus
gaattctcctaacaaaggtgtgctg

SEQ ID NO: 639555 - DNA, 25 bp, Mus musculus
gaattctcctaagaaaggtgtgctg

SEQ ID NO: 639556 - DNA, 25 bp, Mus musculus
gaattctcctttcaggactggagaa

SEQ ID NO: 639557 - DNA, 25 bp, Mus musculus
gaattctcctttgaggactggagaa

SEQ ID NO: 639558 - DNA, 25 bp, Mus musculus
gaattctctggcctgaggctgcaga

SEQ ID NO: 639559 - DNA, 25 bp, Mus musculus
gaattctctggcgtgaggctgcaga

SEQ ID NO: 639560 - DNA, 25 bp, Mus musculus
gaattctgcatcacggcaacataga

SEQ ID NO: 639561 - DNA, 25 bp, Mus musculus
gaattctgcatctcggcaacataga

SEQ ID NO: 639562 - DNA, 25 bp, Mus musculus
gaattctgccatcggtgctccctgc

SEQ ID NO: 639563 - DNA, 25 bp, Mus musculus
gaattctgccatgggtgctccctgc

SEQ ID NO: 639564 - DNA, 25 bp, Mus musculus
gaattctgcgacctgcccagttgcg

SEQ ID NO: 639565 - DNA, 25 bp, Mus musculus
gaattctgcgacgtgcccagttgcg

SEQ ID NO: 639566 - DNA, 25 bp, Mus musculus
gaattctgctctatggccctccagg

SEQ ID NO: 639567 - DNA, 25 bp, Mus musculus
gaattctgctctttggccctccagg

SEQ ID NO: 639568 - DNA, 25 bp, Mus musculus
gaattctggcatcgtccttgagagg

SEQ ID NO: 639569 - DNA, 25 bp, Mus musculus
gaattctggcatggtccttgagagg

SEQ ID NO: 639570 - DNA, 25 bp, Mus musculus
gaattctggcgtcttcaagtagtaa

SEQ ID NO: 639571 - DNA, 25 bp, Mus musculus
gaattctggcgtgttcaagtagtaa

SEQ ID NO: 639572 - DNA, 25 bp, Mus musculus
gaattctgggacagattcctcttta

SEQ ID NO: 639573 - DNA, 25 bp, Mus musculus
gaattctgggactgattcctcttta

SEQ ID NO: 639574 - DNA, 25 bp, Mus musculus
gaattctgggctcattaaccatcag

SEQ ID NO: 639575 - DNA, 25 bp, Mus musculus
gaattctgggctgattaaccatcag

SEQ ID NO: 639576 - DNA, 25 bp, Mus musculus
gaattctggtgcctctaaagcccct

SEQ ID NO: 639577 - DNA, 25 bp, Mus musculus
gaattctggtgcgtctaaagcccct

SEQ ID NO: 639578 - DNA, 25 bp, Mus musculus
gaattctgtctaatgtcacagagaa

SEQ ID NO: 639579 - DNA, 25 bp, Mus musculus
gaattctgtctattgtcacagagaa

SEQ ID NO: 639580 - DNA, 25 bp, Mus musculus
gaattctgtctgctccatgcctgct

SEQ ID NO: 639581 - DNA, 25 bp, Mus musculus
gaattctgtctggtccatgcctgct

SEQ ID NO: 639582 - DNA, 25 bp, Mus musculus
gaattctgttgaagtcgccctgaac

SEQ ID NO: 639583 - DNA, 25 bp, Mus musculus
gaattctgttgatgtcgccctgaac

SEQ ID NO: 639584 - DNA, 25 bp, Mus musculus
gaattcttaaagacatgaagactca

SEQ ID NO: 639585 - DNA, 25 bp, Mus musculus
gaattcttaaagtcatgaagactca

SEQ ID NO: 639586 - DNA, 25 bp, Mus musculus
gaattcttcatgaaacgttttagct

SEQ ID NO: 639587 - DNA, 25 bp, Mus musculus
gaattcttcatgtaacgttttagct

SEQ ID NO: 639588 - DNA, 25 bp, Mus musculus
gaattcttccgcaacctctacctga

SEQ ID NO: 639589 - DNA, 25 bp, Mus musculus
gaattcttccgctacctctacctga

SEQ ID NO: 639590 - DNA, 25 bp, Mus musculus
gaattcttctctatgatcagctgaa

SEQ ID NO: 639591 - DNA, 25 bp, Mus musculus
gaattcttctctttgatcagctgaa

SEQ ID NO: 639592 - DNA, 25 bp, Mus musculus
gaattcttgcagctcagtgtttggg

SEQ ID NO: 639593 - DNA, 25 bp, Mus musculus
gaattcttgcaggtcagtgtttggg

SEQ ID NO: 639594 - DNA, 25 bp, Mus musculus
gaattcttgtctccggaactcaatg

SEQ ID NO: 639595 - DNA, 25 bp, Mus musculus
gaattcttgtctgcggaactcaatg

SEQ ID NO: 639596 - DNA, 25 bp, Mus musculus
gaattctttcgacccactgagcagg

SEQ ID NO: 639597 - DNA, 25 bp, Mus musculus
gaattctttcgagccactgagcagg

SEQ ID NO: 639598 - DNA, 25 bp, Mus musculus
gaattctttgatcctctttatatgg

SEQ ID NO: 639599 - DNA, 25 bp, Mus musculus
gaattctttgatgctctttatatgg

SEQ ID NO: 639600 - DNA, 25 bp, Mus musculus
gaattgaaaacaatttcctctggga

SEQ ID NO: 639601 - DNA, 25 bp, Mus musculus
gaattgaaaacattttcctctggga

SEQ ID NO: 639602 - DNA, 25 bp, Mus musculus
gaattgaaaacgctgacgaacaact

SEQ ID NO: 639603 - DNA, 25 bp, Mus musculus
gaattgaaaacggtgacgaacaact

SEQ ID NO: 639604 - DNA, 25 bp, Mus musculus
gaattgaaatgcaccagcgattgtc

SEQ ID NO: 639605 - DNA, 25 bp, Mus musculus
gaattgaaatgctccagcgattgtc

SEQ ID NO: 639606 - DNA, 25 bp, Mus musculus
gaattgaacagcactactttgaaga

SEQ ID NO: 639607 - DNA, 25 bp, Mus musculus
gaattgaacagctctactttgaaga

SEQ ID NO: 639608 - DNA, 25 bp, Mus musculus
gaattgaacatgcagctatgccaga

SEQ ID NO: 639609 - DNA, 25 bp, Mus musculus
gaattgaacatggagctatgccaga

SEQ ID NO: 639610 - DNA, 25 bp, Mus musculus
gaattgaaccacagaggactgacta

SEQ ID NO: 639611 - DNA, 25 bp, Mus musculus
gaattgaaccactgaggactgacta

SEQ ID NO: 639612 - DNA, 25 bp, Mus musculus
gaattgaactcaaaataccaccaag

SEQ ID NO: 639613 - DNA, 25 bp, Mus musculus
gaattgaactcataataccaccaag

SEQ ID NO: 639614 - DNA, 25 bp, Mus musculus
gaattgaactttacttcagcagaac

SEQ ID NO: 639615 - DNA, 25 bp, Mus musculus
gaattgaacttttcttcagcagaac

SEQ ID NO: 639616 - DNA, 25 bp, Mus musculus
gaattgaagcaacaagttatcagca

SEQ ID NO: 639617 - DNA, 25 bp, Mus musculus
gaattgaagcaagaagttatcagca

SEQ ID NO: 639618 - DNA, 25 bp, Mus musculus
gaattgaatataacatcatccgggt

SEQ ID NO: 639619 - DNA, 25 bp, Mus musculus
gaattgaatatatcatcatccgggt

SEQ ID NO: 639620 - DNA, 25 bp, Mus musculus
gaattgaatcggaacaacctgactg

SEQ ID NO: 639621 - DNA, 25 bp, Mus musculus
gaattgaatcggtacaacctgactg

SEQ ID NO: 639622 - DNA, 25 bp, Mus musculus
gaattgaatttaccgactaatcagc

SEQ ID NO: 639623 - DNA, 25 bp, Mus musculus
gaattgaatttagcgactaatcagc

SEQ ID NO: 639624 - DNA, 25 bp, Mus musculus
gaattgacaaacctgacgtgcgatt

SEQ ID NO: 639625 - DNA, 25 bp, Mus musculus
gaattgacaaacgtgacgtgcgatt

SEQ ID NO: 639626 - DNA, 25 bp, Mus musculus
gaattgaccagaatgctagcagaag

SEQ ID NO: 639627 - DNA, 25 bp, Mus musculus
gaattgaccagattgctagcagaag

SEQ ID NO: 639628 - DNA, 25 bp, Mus musculus
gaattgacctaaagacagactccag

SEQ ID NO: 639629 - DNA, 25 bp, Mus musculus
gaattgacctaatgacagactccag

SEQ ID NO: 639630 - DNA, 25 bp, Mus musculus
gaattgagagtcaacagaaagaaga

SEQ ID NO: 639631 - DNA, 25 bp, Mus musculus
gaattgagagtctacagaaagaaga

SEQ ID NO: 639632 - DNA, 25 bp, Mus musculus
gaattgagcataagaaaagccttca

SEQ ID NO: 639633 - DNA, 25 bp, Mus musculus
gaattgagcatatgaaaagccttca

SEQ ID NO: 639634 - DNA, 25 bp, Mus musculus
gaattgatagataaaatacaggcag

SEQ ID NO: 639635 - DNA, 25 bp, Mus musculus
gaattgatagattaaatacaggcag

SEQ ID NO: 639636 - DNA, 25 bp, Mus musculus
gaattgatcacaccttttcagttat

SEQ ID NO: 639637 - DNA, 25 bp, Mus musculus
gaattgatcacagcttttcagttat

SEQ ID NO: 639638 - DNA, 25 bp, Mus musculus
gaattgcaagcgcaggctctctgca

SEQ ID NO: 639639 - DNA, 25 bp, Mus musculus
gaattgcaagcggaggctctctgca

SEQ ID NO: 639640 - DNA, 25 bp, Mus musculus
gaattgcacatgacaggaaagcgcc

SEQ ID NO: 639641 - DNA, 25 bp, Mus musculus
gaattgcacatgtcaggaaagcgcc

SEQ ID NO: 639642 - DNA, 25 bp, Mus musculus
gaattgcaccacacttcatatgtta

SEQ ID NO: 639643 - DNA, 25 bp, Mus musculus
gaattgcaccactcttcatatgtta

SEQ ID NO: 639644 - DNA, 25 bp, Mus musculus
gaattgcagaatacttccccagggc

SEQ ID NO: 639645 - DNA, 25 bp, Mus musculus
gaattgcagaattcttccccagggc

SEQ ID NO: 639646 - DNA, 25 bp, Mus musculus
gaattgcagatgatactgggattcc

SEQ ID NO: 639647 - DNA, 25 bp, Mus musculus
gaattgcagatgttactgggattcc

SEQ ID NO: 639648 - DNA, 25 bp, Mus musculus
gaattgcagcctacaacattcggac

SEQ ID NO: 639649 - DNA, 25 bp, Mus musculus
gaattgcagccttcaacattcggac

SEQ ID NO: 639650 - DNA, 25 bp, Mus musculus
gaattgcatcatcagcagatggcgg

SEQ ID NO: 639651 - DNA, 25 bp, Mus musculus
gaattgcatcatgagcagatggcgg

SEQ ID NO: 639652 - DNA, 25 bp, Mus musculus
gaattgcatgaaccgctcagaacag

SEQ ID NO: 639653 - DNA, 25 bp, Mus musculus
gaattgcatgaagcgctcagaacag

SEQ ID NO: 639654 - DNA, 25 bp, Mus musculus
gaattgccacagagtttaaccagct

SEQ ID NO: 639655 - DNA, 25 bp, Mus musculus
gaattgccacagtgtttaaccagct

SEQ ID NO: 639656 - DNA, 25 bp, Mus musculus
gaattgccattaagtggaagaggac

SEQ ID NO: 639657 - DNA, 25 bp, Mus musculus
gaattgccattatgtggaagaggac

SEQ ID NO: 639658 - DNA, 25 bp, Mus musculus
gaattgcccagcctgtatgacgaca

SEQ ID NO: 639659 - DNA, 25 bp, Mus musculus
gaattgcccagcgtgtatgacgaca

SEQ ID NO: 639660 - DNA, 25 bp, Mus musculus
gaattgcctccacttgctcatggcg

SEQ ID NO: 639661 - DNA, 25 bp, Mus musculus
gaattgcctccagttgctcatggcg

SEQ ID NO: 639662 - DNA, 25 bp, Mus musculus
gaattgcctcttacaaatccagaat

SEQ ID NO: 639663 - DNA, 25 bp, Mus musculus
gaattgcctctttcaaatccagaat

SEQ ID NO: 639664 - DNA, 25 bp, Mus musculus
gaattgctaaagcaggcaaagcgtg

SEQ ID NO: 639665 - DNA, 25 bp, Mus musculus
gaattgctaaaggaggcaaagcgtg

SEQ ID NO: 639666 - DNA, 25 bp, Mus musculus
gaattgctacttaagtacagagaag

SEQ ID NO: 639667 - DNA, 25 bp, Mus musculus
gaattgctacttccacaacctgacc

SEQ ID NO: 639668 - DNA, 25 bp, Mus musculus
gaattgctacttgcacaacctgacc

SEQ ID NO: 639669 - DNA, 25 bp, Mus musculus
gaattgctactttagtacagagaag

SEQ ID NO: 639670 - DNA, 25 bp, Mus musculus
gaattgctagtaaagatcaacagaa

SEQ ID NO: 639671 - DNA, 25 bp, Mus musculus
gaattgctagtatagatcaacagaa

SEQ ID NO: 639672 - DNA, 25 bp, Mus musculus
gaattgctgcagcttgccagcaggc

SEQ ID NO: 639673 - DNA, 25 bp, Mus musculus
gaattgctgcaggttgccagcaggc

SEQ ID NO: 639674 - DNA, 25 bp, Mus musculus
gaattgctggctcacaagattcatg

SEQ ID NO: 639675 - DNA, 25 bp, Mus musculus
gaattgctggctgacaagattcatg

SEQ ID NO: 639676 - DNA, 25 bp, Mus musculus
gaattgcttgctacggcctggcagc

SEQ ID NO: 639677 - DNA, 25 bp, Mus musculus
gaattgcttgctatgccaaatgcta

SEQ ID NO: 639678 - DNA, 25 bp, Mus musculus
gaattgcttgcttcggcctggcagc

SEQ ID NO: 639679 - DNA, 25 bp, Mus musculus
gaattgcttgctttgccaaatgcta

SEQ ID NO: 639680 - DNA, 25 bp, Mus musculus
gaattgctttctatctattcacaag

SEQ ID NO: 639681 - DNA, 25 bp, Mus musculus
gaattgctttctttctattcacaag

SEQ ID NO: 639682 - DNA, 25 bp, Mus musculus
gaattggaaactcttgacttcaaag

SEQ ID NO: 639683 - DNA, 25 bp, Mus musculus
gaattggaaactgttgacttcaaag

SEQ ID NO: 639684 - DNA, 25 bp, Mus musculus
gaattggaaattccaagtccagcct

SEQ ID NO: 639685 - DNA, 25 bp, Mus musculus
gaattggaaattgcaagtccagcct

SEQ ID NO: 639686 - DNA, 25 bp, Mus musculus
gaattggaagaaaatcagcggagtt

SEQ ID NO: 639687 - DNA, 25 bp, Mus musculus
gaattggaagaatatcagcggagtt

SEQ ID NO: 639688 - DNA, 25 bp, Mus musculus
gaattggagaatctttaacctgccc

SEQ ID NO: 639689 - DNA, 25 bp, Mus musculus
gaattggagaatgtttaacctgccc

SEQ ID NO: 639690 - DNA, 25 bp, Mus musculus
gaattggagtcacgcgcagatccac

SEQ ID NO: 639691 - DNA, 25 bp, Mus musculus
gaattggagtcaggcgcagatccac

SEQ ID NO: 639692 - DNA, 25 bp, Mus musculus
gaattggatgcactataaccagaca

SEQ ID NO: 639693 - DNA, 25 bp, Mus musculus
gaattggatgcagtataaccagaca

SEQ ID NO: 639694 - DNA, 25 bp, Mus musculus
gaattggattccaagggctgttcca

SEQ ID NO: 639695 - DNA, 25 bp, Mus musculus
gaattggattcctagggctgttcca

SEQ ID NO: 639696 - DNA, 25 bp, Mus musculus
gaattggcaaacactgtgccagaag

SEQ ID NO: 639697 - DNA, 25 bp, Mus musculus
gaattggcaaactctgtgccagaag

SEQ ID NO: 639698 - DNA, 25 bp, Mus musculus
gaattggcaaatcaagtagccaaag

SEQ ID NO: 639699 - DNA, 25 bp, Mus musculus
gaattggcaaatctgttaaaaaggc

SEQ ID NO: 639700 - DNA, 25 bp, Mus musculus
gaattggcaaatgaagtagccaaag

SEQ ID NO: 639701 - DNA, 25 bp, Mus musculus
gaattggcaaatgtgttaaaaaggc

SEQ ID NO: 639702 - DNA, 25 bp, Mus musculus
gaattggcagcaacagcaagaggaa

SEQ ID NO: 639703 - DNA, 25 bp, Mus musculus
gaattggcagcatcagcaagaggaa

SEQ ID NO: 639704 - DNA, 25 bp, Mus musculus
gaattggcagtgaatgagattatgc

SEQ ID NO: 639705 - DNA, 25 bp, Mus musculus
gaattggcagtgtatgagattatgc

SEQ ID NO: 639706 - DNA, 25 bp, Mus musculus
gaattggccattccgctgtacagac

SEQ ID NO: 639707 - DNA, 25 bp, Mus musculus
gaattggccattgcgctgtacagac

SEQ ID NO: 639708 - DNA, 25 bp, Mus musculus
gaattggctcatcgactgtgtcggc

SEQ ID NO: 639709 - DNA, 25 bp, Mus musculus
gaattggctcatggactgtgtcggc

SEQ ID NO: 639710 - DNA, 25 bp, Mus musculus
gaattggctccaccccaagaggact

SEQ ID NO: 639711 - DNA, 25 bp, Mus musculus
gaattggctccagcccaagaggact

SEQ ID NO: 639712 - DNA, 25 bp, Mus musculus
gaattggctgctaattttgaccctt

SEQ ID NO: 639713 - DNA, 25 bp, Mus musculus
gaattggctgcttattttgaccctt

SEQ ID NO: 639714 - DNA, 25 bp, Mus musculus
gaattgggacgacaaagtcatcatc

SEQ ID NO: 639715 - DNA, 25 bp, Mus musculus
gaattgggacgagaaagtcatcatc

SEQ ID NO: 639716 - DNA, 25 bp, Mus musculus
gaattgggacgcaggcgcgaccaca

SEQ ID NO: 639717 - DNA, 25 bp, Mus musculus
gaattgggacgctggcgcgaccaca

SEQ ID NO: 639718 - DNA, 25 bp, Mus musculus
gaattgggcaacaacccatagcagt

SEQ ID NO: 639719 - DNA, 25 bp, Mus musculus
gaattgggcaactacccatagcagt

SEQ ID NO: 639720 - DNA, 25 bp, Mus musculus
gaattgggtcttcgtgctctccatt

SEQ ID NO: 639721 - DNA, 25 bp, Mus musculus
gaattgggtcttggtgctctccatt

SEQ ID NO: 639722 - DNA, 25 bp, Mus musculus
gaattggtcctgctaagctggttcc

SEQ ID NO: 639723 - DNA, 25 bp, Mus musculus
gaattggtcctggtaagctggttcc

SEQ ID NO: 639724 - DNA, 25 bp, Mus musculus
gaattggtctttagtctctgtcacg

SEQ ID NO: 639725 - DNA, 25 bp, Mus musculus
gaattggtcttttgtctctgtcacg

SEQ ID NO: 639726 - DNA, 25 bp, Mus musculus
gaattggtgtgtctcccctgctggc

SEQ ID NO: 639727 - DNA, 25 bp, Mus musculus
gaattggtgtgtgtcccctgctggc

SEQ ID NO: 639728 - DNA, 25 bp, Mus musculus
gaattggttaggaaaattgcagccc

SEQ ID NO: 639729 - DNA, 25 bp, Mus musculus
gaattggttaggtaaattgcagccc

SEQ ID NO: 639730 - DNA, 25 bp, Mus musculus
gaattggttgagaaaaggaaggcat

SEQ ID NO: 639731 - DNA, 25 bp, Mus musculus
gaattggttgagtaaaggaaggcat

SEQ ID NO: 639732 - DNA, 25 bp, Mus musculus
gaattggtttcaatcatcacaactg

SEQ ID NO: 639733 - DNA, 25 bp, Mus musculus
gaattggtttcattcatcacaactg

SEQ ID NO: 639734 - DNA, 25 bp, Mus musculus
gaattgtatgctcactttagcacaa

SEQ ID NO: 639735 - DNA, 25 bp, Mus musculus
gaattgtatgctgactttagcacaa

SEQ ID NO: 639736 - DNA, 25 bp, Mus musculus
gaattgtcacctcgagcagaatcgg

SEQ ID NO: 639737 - DNA, 25 bp, Mus musculus
gaattgtcacctggagcagaatcgg

SEQ ID NO: 639738 - DNA, 25 bp, Mus musculus
gaattgtgagcaccttgttatgcta

SEQ ID NO: 639739 - DNA, 25 bp, Mus musculus
gaattgtgagcagcttgttatgcta

SEQ ID NO: 639740 - DNA, 25 bp, Mus musculus
gaattgtgcttaacttcataatgga

SEQ ID NO: 639741 - DNA, 25 bp, Mus musculus
gaattgtgcttatcttcataatgga

SEQ ID NO: 639742 - DNA, 25 bp, Mus musculus
gaattgtggagcaactgctagcccg

SEQ ID NO: 639743 - DNA, 25 bp, Mus musculus
gaattgtggagctactgctagcccg

SEQ ID NO: 639744 - DNA, 25 bp, Mus musculus
gaattgtgtgaccatgtgcacgtgt

SEQ ID NO: 639745 - DNA, 25 bp, Mus musculus
gaattgtgtgacgatgtgcacgtgt

SEQ ID NO: 639746 - DNA, 25 bp, Mus musculus
gaattgtgttacctgcaagctcccc

SEQ ID NO: 639747 - DNA, 25 bp, Mus musculus
gaattgtgttacgtgcaagctcccc

SEQ ID NO: 639748 - DNA, 25 bp, Mus musculus
gaattgttcaagcaggctcctggag

SEQ ID NO: 639749 - DNA, 25 bp, Mus musculus
gaattgttcaaggaggctcctggag

SEQ ID NO: 639750 - DNA, 25 bp, Mus musculus
gaattgttgccacatgccttggaag

SEQ ID NO: 639751 - DNA, 25 bp, Mus musculus
gaattgttgccagatgccttggaag

SEQ ID NO: 639752 - DNA, 25 bp, Mus musculus
gaattgttggcacactccatcagag

SEQ ID NO: 639753 - DNA, 25 bp, Mus musculus
gaattgttggcagactccatcagag

SEQ ID NO: 639754 - DNA, 25 bp, Mus musculus
gaattgtttaccatgtgtacatcaa

SEQ ID NO: 639755 - DNA, 25 bp, Mus musculus
gaattgtttaccttgtgtacatcaa

SEQ ID NO: 639756 - DNA, 25 bp, Mus musculus
gaatttaaaccccactgtgcactgg

SEQ ID NO: 639757 - DNA, 25 bp, Mus musculus
gaatttaaacccgactgtgcactgg

SEQ ID NO: 639758 - DNA, 25 bp, Mus musculus
gaatttaaagcacacacagccccag

SEQ ID NO: 639759 - DNA, 25 bp, Mus musculus
gaatttaaagcagacacagccccag

SEQ ID NO: 639760 - DNA, 25 bp, Mus musculus
gaatttaagcctcaaatcagcatga

SEQ ID NO: 639761 - DNA, 25 bp, Mus musculus
gaatttaagcctgaaatcagcatga

SEQ ID NO: 639762 - DNA, 25 bp, Mus musculus
gaatttaagctacccctatccgtgt

SEQ ID NO: 639763 - DNA, 25 bp, Mus musculus
gaatttaagctagccctatccgtgt

SEQ ID NO: 639764 - DNA, 25 bp, Mus musculus
gaatttaaggaaagtgatgccatgt

SEQ ID NO: 639765 - DNA, 25 bp, Mus musculus
gaatttaaggaatgtgatgccatgt

SEQ ID NO: 639766 - DNA, 25 bp, Mus musculus
gaatttaaggagcatcatctgagcg

SEQ ID NO: 639767 - DNA, 25 bp, Mus musculus
gaatttaaggaggatcatctgagcg

SEQ ID NO: 639768 - DNA, 25 bp, Mus musculus
gaatttacagtaccgccgcctctac

SEQ ID NO: 639769 - DNA, 25 bp, Mus musculus
gaatttacagtagcgccgcctctac

SEQ ID NO: 639770 - DNA, 25 bp, Mus musculus
gaatttacattcaactacaaggaca

SEQ ID NO: 639771 - DNA, 25 bp, Mus musculus
gaatttacattctactacaaggaca

SEQ ID NO: 639772 - DNA, 25 bp, Mus musculus
gaatttacggtcagttcctcagtgg

SEQ ID NO: 639773 - DNA, 25 bp, Mus musculus
gaatttacggtctgttcctcagtgg

SEQ ID NO: 639774 - DNA, 25 bp, Mus musculus
gaatttactgcgcacgacctagagg

SEQ ID NO: 639775 - DNA, 25 bp, Mus musculus
gaatttactgcggacgacctagagg

SEQ ID NO: 639776 - DNA, 25 bp, Mus musculus
gaatttagaaaacctgagtctgtcc

SEQ ID NO: 639777 - DNA, 25 bp, Mus musculus
gaatttagaaaagctgagtctgtcc

SEQ ID NO: 639778 - DNA, 25 bp, Mus musculus
gaatttagcgacaaatcagctcaca

SEQ ID NO: 639779 - DNA, 25 bp, Mus musculus
gaatttagcgactaatcagctcaca

SEQ ID NO: 639780 - DNA, 25 bp, Mus musculus
gaatttagcgtccttcctgagaacg

SEQ ID NO: 639781 - DNA, 25 bp, Mus musculus
gaatttagcgtcgttcctgagaacg

SEQ ID NO: 639782 - DNA, 25 bp, Mus musculus
gaatttaggctacagatgcccactg

SEQ ID NO: 639783 - DNA, 25 bp, Mus musculus
gaatttaggctagagatgcccactg

SEQ ID NO: 639784 - DNA, 25 bp, Mus musculus
gaatttagtgttcagcctcctggga

SEQ ID NO: 639785 - DNA, 25 bp, Mus musculus
gaatttagtgttgagcctcctggga

SEQ ID NO: 639786 - DNA, 25 bp, Mus musculus
gaatttatatcccattgccagagga

SEQ ID NO: 639787 - DNA, 25 bp, Mus musculus
gaatttatatccgattgccagagga

SEQ ID NO: 639788 - DNA, 25 bp, Mus musculus
gaatttatcagtatagcagtgggcc

SEQ ID NO: 639789 - DNA, 25 bp, Mus musculus
gaatttatcagtttagcagtgggcc

SEQ ID NO: 639790 - DNA, 25 bp, Mus musculus
gaatttatcctacctatgcacctaa

SEQ ID NO: 639791 - DNA, 25 bp, Mus musculus
gaatttatcctagctatgcacctaa

SEQ ID NO: 639792 - DNA, 25 bp, Mus musculus
gaatttatgcgtagtggattgaaag

SEQ ID NO: 639793 - DNA, 25 bp, Mus musculus
gaatttatgcgttgtggattgaaag

SEQ ID NO: 639794 - DNA, 25 bp, Mus musculus
gaatttcaacaacggatcagccagg

SEQ ID NO: 639795 - DNA, 25 bp, Mus musculus
gaatttcaacaagggatcagccagg

SEQ ID NO: 639796 - DNA, 25 bp, Mus musculus
gaatttcaatgtctttgactggcta

SEQ ID NO: 639797 - DNA, 25 bp, Mus musculus
gaatttcaatgtgtttgactggcta

SEQ ID NO: 639798 - DNA, 25 bp, Mus musculus
gaatttcaccggaacaattcctgtg

SEQ ID NO: 639799 - DNA, 25 bp, Mus musculus
gaatttcaccggtacaattcctgtg

SEQ ID NO: 639800 - DNA, 25 bp, Mus musculus
gaatttcaccgtcggtgcaccggca

SEQ ID NO: 639801 - DNA, 25 bp, Mus musculus
gaatttcaccgtgggtgcaccggca

SEQ ID NO: 639802 - DNA, 25 bp, Mus musculus
gaatttcactgacgtccaccctgac

SEQ ID NO: 639803 - DNA, 25 bp, Mus musculus
gaatttcactgaggtccaccctgac

SEQ ID NO: 639804 - DNA, 25 bp, Mus musculus
gaatttcagcatctttcttcaagaa

SEQ ID NO: 639805 - DNA, 25 bp, Mus musculus
gaatttcagcatgtttcttcaagaa

SEQ ID NO: 639806 - DNA, 25 bp, Mus musculus
gaatttcagctgaagcagcctcaag

SEQ ID NO: 639807 - DNA, 25 bp, Mus musculus
gaatttcagctgtagcagcctcaag

SEQ ID NO: 639808 - DNA, 25 bp, Mus musculus
gaatttcagtttctgcgctgcccga

SEQ ID NO: 639809 - DNA, 25 bp, Mus musculus
gaatttcagtttgtgcgctgcccga

SEQ ID NO: 639810 - DNA, 25 bp, Mus musculus
gaatttcatatgaactgctggaaaa

SEQ ID NO: 639811 - DNA, 25 bp, Mus musculus
gaatttcatatgtactgctggaaaa

SEQ ID NO: 639812 - DNA, 25 bp, Mus musculus
gaatttccatgacgtcatgctggcc

SEQ ID NO: 639813 - DNA, 25 bp, Mus musculus
gaatttccatgaggtcatgctggcc

SEQ ID NO: 639814 - DNA, 25 bp, Mus musculus
gaatttcccatgactgacctggaca

SEQ ID NO: 639815 - DNA, 25 bp, Mus musculus
gaatttcccatgtctgacctggaca

SEQ ID NO: 639816 - DNA, 25 bp, Mus musculus
gaatttcccctcctggtgtttatgg

SEQ ID NO: 639817 - DNA, 25 bp, Mus musculus
gaatttcccctcgtggtgtttatgg

SEQ ID NO: 639818 - DNA, 25 bp, Mus musculus
gaatttcctctgcaagagcctcagg

SEQ ID NO: 639819 - DNA, 25 bp, Mus musculus
gaatttcctctggaagagcctcagg

SEQ ID NO: 639820 - DNA, 25 bp, Mus musculus
gaatttcgacttactcggagtctgg

SEQ ID NO: 639821 - DNA, 25 bp, Mus musculus
gaatttcgactttctcggagtctgg

SEQ ID NO: 639822 - DNA, 25 bp, Mus musculus
gaatttctcactaagattctgtatt

SEQ ID NO: 639823 - DNA, 25 bp, Mus musculus
gaatttctcacttagattctgtatt

SEQ ID NO: 639824 - DNA, 25 bp, Mus musculus
gaatttctcgctccatctctgaaag

SEQ ID NO: 639825 - DNA, 25 bp, Mus musculus
gaatttctcgctgcatctctgaaag

SEQ ID NO: 639826 - DNA, 25 bp, Mus musculus
gaatttctctggatagtctcctcct

SEQ ID NO: 639827 - DNA, 25 bp, Mus musculus
gaatttctctggttagtctcctcct

SEQ ID NO: 639828 - DNA, 25 bp, Mus musculus
gaatttcttacacttgccggaagcc

SEQ ID NO: 639829 - DNA, 25 bp, Mus musculus
gaatttcttacagttgccggaagcc

SEQ ID NO: 639830 - DNA, 25 bp, Mus musculus
gaatttcttctaacttattaaatgg

SEQ ID NO: 639831 - DNA, 25 bp, Mus musculus
gaatttcttctatcttattaaatgg

SEQ ID NO: 639832 - DNA, 25 bp, Mus musculus
gaatttgaaccgattaaatggcacc

SEQ ID NO: 639833 - DNA, 25 bp, Mus musculus
gaatttgaaccgtttaaatggcacc

SEQ ID NO: 639834 - DNA, 25 bp, Mus musculus
gaatttgaaggccttttcaagcagc

SEQ ID NO: 639835 - DNA, 25 bp, Mus musculus
gaatttgaaggcgttttcaagcagc

SEQ ID NO: 639836 - DNA, 25 bp, Mus musculus
gaatttgaagtactgcccaagcgga

SEQ ID NO: 639837 - DNA, 25 bp, Mus musculus
gaatttgaagtagtgcccaagcgga

SEQ ID NO: 639838 - DNA, 25 bp, Mus musculus
gaatttgactttaaaggcgatccgc

SEQ ID NO: 639839 - DNA, 25 bp, Mus musculus
gaatttgacttttaaggcgatccgc

SEQ ID NO: 639840 - DNA, 25 bp, Mus musculus
gaatttgagataaccctgaaagccc

SEQ ID NO: 639841 - DNA, 25 bp, Mus musculus
gaatttgagatatccctgaaagccc

SEQ ID NO: 639842 - DNA, 25 bp, Mus musculus
gaatttgaggatagagacaggtctc

SEQ ID NO: 639843 - DNA, 25 bp, Mus musculus
gaatttgaggattgagacaggtctc

SEQ ID NO: 639844 - DNA, 25 bp, Mus musculus
gaatttgatactaccctattagaag

SEQ ID NO: 639845 - DNA, 25 bp, Mus musculus
gaatttgatacttccctattagaag

SEQ ID NO: 639846 - DNA, 25 bp, Mus musculus
gaatttgatgacctagatgggatac

SEQ ID NO: 639847 - DNA, 25 bp, Mus musculus
gaatttgatgacgtagatgggatac

SEQ ID NO: 639848 - DNA, 25 bp, Mus musculus
gaatttgatgtgcagccagcctatg

SEQ ID NO: 639849 - DNA, 25 bp, Mus musculus
gaatttgatgtggagccagcctatg

SEQ ID NO: 639850 - DNA, 25 bp, Mus musculus
gaatttgcacgtatatgccgagacc

SEQ ID NO: 639851 - DNA, 25 bp, Mus musculus
gaatttgcacgtttatgccgagacc

SEQ ID NO: 639852 - DNA, 25 bp, Mus musculus
gaatttgccagcagaaataagcaga

SEQ ID NO: 639853 - DNA, 25 bp, Mus musculus
gaatttgccagctgaaataagcaga

SEQ ID NO: 639854 - DNA, 25 bp, Mus musculus
gaatttgccaggacggaattacact

SEQ ID NO: 639855 - DNA, 25 bp, Mus musculus
gaatttgccaggtcggaattacact

SEQ ID NO: 639856 - DNA, 25 bp, Mus musculus
gaatttgcctttaagctttacaaag

SEQ ID NO: 639857 - DNA, 25 bp, Mus musculus
gaatttgccttttagctttacaaag

SEQ ID NO: 639858 - DNA, 25 bp, Mus musculus
gaatttgcgatcctgcccttgcatg

SEQ ID NO: 639859 - DNA, 25 bp, Mus musculus
gaatttgcgatcgtgcccttgcatg

SEQ ID NO: 639860 - DNA, 25 bp, Mus musculus
gaatttgctatcatccctaacggac

SEQ ID NO: 639861 - DNA, 25 bp, Mus musculus
gaatttgctatcttccctaacggac

SEQ ID NO: 639862 - DNA, 25 bp, Mus musculus
gaatttgctccaccggctgctgcaa

SEQ ID NO: 639863 - DNA, 25 bp, Mus musculus
gaatttgctccagcggctgctgcaa

SEQ ID NO: 639864 - DNA, 25 bp, Mus musculus
gaatttgctgctatgctgatgccac

SEQ ID NO: 639865 - DNA, 25 bp, Mus musculus
gaatttgctgctttgctgatgccac

SEQ ID NO: 639866 - DNA, 25 bp, Mus musculus
gaatttggaactcgcccgtctaact

SEQ ID NO: 639867 - DNA, 25 bp, Mus musculus
gaatttggaactggcccgtctaact

SEQ ID NO: 639868 - DNA, 25 bp, Mus musculus
gaatttggaatcaccatctgttgac

SEQ ID NO: 639869 - DNA, 25 bp, Mus musculus
gaatttggaatctccatctgttgac

SEQ ID NO: 639870 - DNA, 25 bp, Mus musculus
gaatttggccagaatccctttaaag

SEQ ID NO: 639871 - DNA, 25 bp, Mus musculus
gaatttggccagtatccctttaaag

SEQ ID NO: 639872 - DNA, 25 bp, Mus musculus
gaatttggccggatctttatgcagg

SEQ ID NO: 639873 - DNA, 25 bp, Mus musculus
gaatttggccggttctttatgcagg

SEQ ID NO: 639874 - DNA, 25 bp, Mus musculus
gaatttggtgtccacattgattcag

SEQ ID NO: 639875 - DNA, 25 bp, Mus musculus
gaatttggtgtcgacattgattcag

SEQ ID NO: 639876 - DNA, 25 bp, Mus musculus
gaatttggttgtaggcaccttatcc

SEQ ID NO: 639877 - DNA, 25 bp, Mus musculus
gaatttggttgttggcaccttatcc

SEQ ID NO: 639878 - DNA, 25 bp, Mus musculus
gaatttgtaaagcatgtacggaagc

SEQ ID NO: 639879 - DNA, 25 bp, Mus musculus
gaatttgtaaaggatgtacggaagc

SEQ ID NO: 639880 - DNA, 25 bp, Mus musculus
gaatttgtactaatgttctctgtgg

SEQ ID NO: 639881 - DNA, 25 bp, Mus musculus
gaatttgtactattgttctctgtgg

SEQ ID NO: 639882 - DNA, 25 bp, Mus musculus
gaatttgtcttaaacaaggacagtg

SEQ ID NO: 639883 - DNA, 25 bp, Mus musculus
gaatttgtcttatacaaggacagtg

SEQ ID NO: 639884 - DNA, 25 bp, Mus musculus
gaatttgtgttcaagggctgcaccc

SEQ ID NO: 639885 - DNA, 25 bp, Mus musculus
gaatttgtgttctagggctgcaccc

SEQ ID NO: 639886 - DNA, 25 bp, Mus musculus
gaatttgttttgaggctggaagaag

SEQ ID NO: 639887 - DNA, 25 bp, Mus musculus
gaatttgttttgtggctggaagaag

SEQ ID NO: 639888 - DNA, 25 bp, Mus musculus
gaattttaaattcgaacacggagca

SEQ ID NO: 639889 - DNA, 25 bp, Mus musculus
gaattttaaattggaacacggagca

SEQ ID NO: 639890 - DNA, 25 bp, Mus musculus
gaattttaagtcattagcaagcaag

SEQ ID NO: 639891 - DNA, 25 bp, Mus musculus
gaattttaagtctttagcaagcaag

SEQ ID NO: 639892 - DNA, 25 bp, Mus musculus
gaattttaatatcgacagagcccca

SEQ ID NO: 639893 - DNA, 25 bp, Mus musculus
gaattttaatatggacagagcccca

SEQ ID NO: 639894 - DNA, 25 bp, Mus musculus
gaattttacagaattgccacagacc

SEQ ID NO: 639895 - DNA, 25 bp, Mus musculus
gaattttacagatttgccacagacc

SEQ ID NO: 639896 - DNA, 25 bp, Mus musculus
gaattttacatcatctctggccctg

SEQ ID NO: 639897 - DNA, 25 bp, Mus musculus
gaattttacatcttctctggccctg

SEQ ID NO: 639898 - DNA, 25 bp, Mus musculus
gaattttaccaacgaagcatctcat

SEQ ID NO: 639899 - DNA, 25 bp, Mus musculus
gaattttaccaaggaagcatctcat

SEQ ID NO: 639900 - DNA, 25 bp, Mus musculus
gaattttaccatctcttgtctctta

SEQ ID NO: 639901 - DNA, 25 bp, Mus musculus
gaattttaccatgtcttgtctctta

SEQ ID NO: 639902 - DNA, 25 bp, Mus musculus
gaattttagcataataacaacagct

SEQ ID NO: 639903 - DNA, 25 bp, Mus musculus
gaattttagcattataacaacagct

SEQ ID NO: 639904 - DNA, 25 bp, Mus musculus
gaattttatctaatccaatttggcc

SEQ ID NO: 639905 - DNA, 25 bp, Mus musculus
gaattttatctattccaatttggcc

SEQ ID NO: 639906 - DNA, 25 bp, Mus musculus
gaattttatggtcattacattgcgg

SEQ ID NO: 639907 - DNA, 25 bp, Mus musculus
gaattttatggtgattacattgcgg

SEQ ID NO: 639908 - DNA, 25 bp, Mus musculus
gaattttcacaaatccggtacgatg

SEQ ID NO: 639909 - DNA, 25 bp, Mus musculus
gaattttcacaattccggtacgatg

SEQ ID NO: 639910 - DNA, 25 bp, Mus musculus
gaattttcaggccattcacagcgag

SEQ ID NO: 639911 - DNA, 25 bp, Mus musculus
gaattttcaggcgattcacagcgag

SEQ ID NO: 639912 - DNA, 25 bp, Mus musculus
gaattttccactatgagacgccatg

SEQ ID NO: 639913 - DNA, 25 bp, Mus musculus
gaattttccactttgagacgccatg

SEQ ID NO: 639914 - DNA, 25 bp, Mus musculus
gaattttccaggatagtatcagaat

SEQ ID NO: 639915 - DNA, 25 bp, Mus musculus
gaattttccaggttagtatcagaat

SEQ ID NO: 639916 - DNA, 25 bp, Mus musculus
gaattttccagtcttgtgcttggaa

SEQ ID NO: 639917 - DNA, 25 bp, Mus musculus
gaattttccagtgttgtgcttggaa

SEQ ID NO: 639918 - DNA, 25 bp, Mus musculus
gaattttccttactgcagtcctaca

SEQ ID NO: 639919 - DNA, 25 bp, Mus musculus
gaattttccttagtgcagtcctaca

SEQ ID NO: 639920 - DNA, 25 bp, Mus musculus
gaattttctccaaagtagctggcca

SEQ ID NO: 639921 - DNA, 25 bp, Mus musculus
gaattttctccactggaagtccggg

SEQ ID NO: 639922 - DNA, 25 bp, Mus musculus
gaattttctccagtggaagtccggg

SEQ ID NO: 639923 - DNA, 25 bp, Mus musculus
gaattttctccatagtagctggcca

SEQ ID NO: 639924 - DNA, 25 bp, Mus musculus
gaattttctcgaattcacgaagaga

SEQ ID NO: 639925 - DNA, 25 bp, Mus musculus
gaattttctcgatttcacgaagaga

SEQ ID NO: 639926 - DNA, 25 bp, Mus musculus
gaattttctgaaacgtcacaaaaag

SEQ ID NO: 639927 - DNA, 25 bp, Mus musculus
gaattttctgaacattgcctgtacc

SEQ ID NO: 639928 - DNA, 25 bp, Mus musculus
gaattttctgaagattgcctgtacc

SEQ ID NO: 639929 - DNA, 25 bp, Mus musculus
gaattttctgaatcgtcacaaaaag

SEQ ID NO: 639930 - DNA, 25 bp, Mus musculus
gaattttctggtcgccaatgtcaca

SEQ ID NO: 639931 - DNA, 25 bp, Mus musculus
gaattttctggtggccaatgtcaca

SEQ ID NO: 639932 - DNA, 25 bp, Mus musculus
gaattttcttggatctagacagaag

SEQ ID NO: 639933 - DNA, 25 bp, Mus musculus
gaattttcttggttctagacagaag

SEQ ID NO: 639934 - DNA, 25 bp, Mus musculus
gaattttgatcccatctgaagcccc

SEQ ID NO: 639935 - DNA, 25 bp, Mus musculus
gaattttgatccgatctgaagcccc

SEQ ID NO: 639936 - DNA, 25 bp, Mus musculus
gaattttgcggacgaattcacccgg

SEQ ID NO: 639937 - DNA, 25 bp, Mus musculus
gaattttgcggaggaattcacccgg

SEQ ID NO: 639938 - DNA, 25 bp, Mus musculus
gaattttgctacattaaacctgaag

SEQ ID NO: 639939 - DNA, 25 bp, Mus musculus
gaattttgctactttaaacctgaag

SEQ ID NO: 639940 - DNA, 25 bp, Mus musculus
gaattttggacgctctggtcgcacc

SEQ ID NO: 639941 - DNA, 25 bp, Mus musculus
gaattttggacggtctggtcgcacc

SEQ ID NO: 639942 - DNA, 25 bp, Mus musculus
gaattttggtgaagtgtataagggc

SEQ ID NO: 639943 - DNA, 25 bp, Mus musculus
gaattttggtgatgtgtataagggc

SEQ ID NO: 639944 - DNA, 25 bp, Mus musculus
gaattttgtcatcaaggttccaaag

SEQ ID NO: 639945 - DNA, 25 bp, Mus musculus
gaattttgtcatcctgaagaccaac

SEQ ID NO: 639946 - DNA, 25 bp, Mus musculus
gaattttgtcatgaaggttccaaag

SEQ ID NO: 639947 - DNA, 25 bp, Mus musculus
gaattttgtcatgctgaagaccaac

SEQ ID NO: 639948 - DNA, 25 bp, Mus musculus
gaattttgtgttcgaaagtcagaac

SEQ ID NO: 639949 - DNA, 25 bp, Mus musculus
gaattttgtgttggaaagtcagaac

SEQ ID NO: 639950 - DNA, 25 bp, Mus musculus
gaatttttataacccgctgctgccc

SEQ ID NO: 639951 - DNA, 25 bp, Mus musculus
gaatttttataagccgctgctgccc

SEQ ID NO: 639952 - DNA, 25 bp, Mus musculus
gaatttttcttaacccttgtgaggc

SEQ ID NO: 639953 - DNA, 25 bp, Mus musculus
gaatttttcttatcccttgtgaggc

SEQ ID NO: 639954 - DNA, 25 bp, Mus musculus
gacaaaaaacggcacgtcattgaga

SEQ ID NO: 639955 - DNA, 25 bp, Mus musculus
gacaaaaaacgggacgtcattgaga

SEQ ID NO: 639956 - DNA, 25 bp, Mus musculus
gacaaaaacaagctgatggatgctc

SEQ ID NO: 639957 - DNA, 25 bp, Mus musculus
gacaaaaacaaggtgatggatgctc

SEQ ID NO: 639958 - DNA, 25 bp, Mus musculus
gacaaaaaccacacctgaagaaatt

SEQ ID NO: 639959 - DNA, 25 bp, Mus musculus
gacaaaaaccactcctgaagaaatt

SEQ ID NO: 639960 - DNA, 25 bp, Mus musculus
gacaaaaaggtccaacgagctgaat

SEQ ID NO: 639961 - DNA, 25 bp, Mus musculus
gacaaaaaggtcgaacgagctgaat

SEQ ID NO: 639962 - DNA, 25 bp, Mus musculus
gacaaaaatactacacaaattgccc

SEQ ID NO: 639963 - DNA, 25 bp, Mus musculus
gacaaaaatacttcacaaattgccc

SEQ ID NO: 639964 - DNA, 25 bp, Mus musculus
gacaaaaatggtcagatgatgttcc

SEQ ID NO: 639965 - DNA, 25 bp, Mus musculus
gacaaaaatggtgagatgatgttcc

SEQ ID NO: 639966 - DNA, 25 bp, Mus musculus
gacaaaacaattcaacatgtagaag

SEQ ID NO: 639967 - DNA, 25 bp, Mus musculus
gacaaaacaattgaacatgtagaag

SEQ ID NO: 639968 - DNA, 25 bp, Mus musculus
gacaaaacagaactgtccggctgtc

SEQ ID NO: 639969 - DNA, 25 bp, Mus musculus
gacaaaacagaagtgtccggctgtc

SEQ ID NO: 639970 - DNA, 25 bp, Mus musculus
gacaaaaccagaacaaatgcaaaaa

SEQ ID NO: 639971 - DNA, 25 bp, Mus musculus
gacaaaaccagatcaaatgcaaaaa

SEQ ID NO: 639972 - DNA, 25 bp, Mus musculus
gacaaaactgcaaacgatcaatctt

SEQ ID NO: 639973 - DNA, 25 bp, Mus musculus
gacaaaactgcatacgatcaatctt

SEQ ID NO: 639974 - DNA, 25 bp, Mus musculus
gacaaaactgggaggaggtcctctt

SEQ ID NO: 639975 - DNA, 25 bp, Mus musculus
gacaaaactgggtggaggtcctctt

SEQ ID NO: 639976 - DNA, 25 bp, Mus musculus
gacaaaagaagaagacactgctgga

SEQ ID NO: 639977 - DNA, 25 bp, Mus musculus
gacaaaagaagatgacactgctgga

SEQ ID NO: 639978 - DNA, 25 bp, Mus musculus
gacaaaagaagtcgagccagaacca

SEQ ID NO: 639979 - DNA, 25 bp, Mus musculus
gacaaaagaagtggagccagaacca

SEQ ID NO: 639980 - DNA, 25 bp, Mus musculus
gacaaaagcattcgaagtatgctgg

SEQ ID NO: 639981 - DNA, 25 bp, Mus musculus
gacaaaagcattggaagtatgctgg

SEQ ID NO: 639982 - DNA, 25 bp, Mus musculus
gacaaaagtatcatgtccagactcg

SEQ ID NO: 639983 - DNA, 25 bp, Mus musculus
gacaaaagtatcttgtccagactcg

SEQ ID NO: 639984 - DNA, 25 bp, Mus musculus
gacaaaagtgccacagctgcatgtg

SEQ ID NO: 639985 - DNA, 25 bp, Mus musculus
gacaaaagtgcctcagctgcatgtg

SEQ ID NO: 639986 - DNA, 25 bp, Mus musculus
gacaaaatacagcagctgaagttct

SEQ ID NO: 639987 - DNA, 25 bp, Mus musculus
gacaaaatacaggagctgaagttct

SEQ ID NO: 639988 - DNA, 25 bp, Mus musculus
gacaaaatagaacagcttgagtgcc

SEQ ID NO: 639989 - DNA, 25 bp, Mus musculus
gacaaaatagaagagcttgagtgcc

SEQ ID NO: 639990 - DNA, 25 bp, Mus musculus
gacaaaatcctccagctgattgaga

SEQ ID NO: 639991 - DNA, 25 bp, Mus musculus
gacaaaatcctcgagctgattgaga

SEQ ID NO: 639992 - DNA, 25 bp, Mus musculus
gacaaaatggcacagtacacccaca

SEQ ID NO: 639993 - DNA, 25 bp, Mus musculus
gacaaaatggcagagtacacccaca

SEQ ID NO: 639994 - DNA, 25 bp, Mus musculus
gacaaaatggccactccaagaaaag

SEQ ID NO: 639995 - DNA, 25 bp, Mus musculus
gacaaaatggcctctccaagaaaag

SEQ ID NO: 639996 - DNA, 25 bp, Mus musculus
gacaaaattaaactgtagtggagcc

SEQ ID NO: 639997 - DNA, 25 bp, Mus musculus
gacaaaattaaagtgtagtggagcc

SEQ ID NO: 639998 - DNA, 25 bp, Mus musculus
gacaaaattcttcaaccacctgaag

SEQ ID NO: 639999 - DNA, 25 bp, Mus musculus
gacaaaattcttgaaccacctgaag

SEQ ID NO: 640000 - DNA, 25 bp, Mus musculus
gacaaaattggaatgaaccttccgg

SEQ ID NO: 640001 - DNA, 25 bp, Mus musculus
gacaaaattggattgaaccttccgg

SEQ ID NO: 640002 - DNA, 25 bp, Mus musculus
gacaaaattgtccatgtggatttga

SEQ ID NO: 640003 - DNA, 25 bp, Mus musculus
gacaaaattgtcgatgtggatttga

SEQ ID NO: 640004 - DNA, 25 bp, Mus musculus
gacaaacaaccccttgccactggag

SEQ ID NO: 640005 - DNA, 25 bp, Mus musculus
gacaaacaacccgttgccactggag

SEQ ID NO: 640006 - DNA, 25 bp, Mus musculus
gacaaacacaagatccacgcgcgcg

SEQ ID NO: 640007 - DNA, 25 bp, Mus musculus
gacaaacacaagttccacgcgcgcg

SEQ ID NO: 640008 - DNA, 25 bp, Mus musculus
gacaaacaccataagttacagtact

SEQ ID NO: 640009 - DNA, 25 bp, Mus musculus
gacaaacaccattagttacagtact

SEQ ID NO: 640010 - DNA, 25 bp, Mus musculus
gacaaacagaaaaagcggcagcgag

SEQ ID NO: 640011 - DNA, 25 bp, Mus musculus
gacaaacagaaatagcggcagcgag

SEQ ID NO: 640012 - DNA, 25 bp, Mus musculus
gacaaacagaagattctcaaagatc

SEQ ID NO: 640013 - DNA, 25 bp, Mus musculus
gacaaacagaagtttctcaaagatc

SEQ ID NO: 640014 - DNA, 25 bp, Mus musculus
gacaaacagtctaatctgcgtgcag

SEQ ID NO: 640015 - DNA, 25 bp, Mus musculus
gacaaacagtcttatctgcgtgcag

SEQ ID NO: 640016 - DNA, 25 bp, Mus musculus
gacaaacagttgcatctacctctag

SEQ ID NO: 640017 - DNA, 25 bp, Mus musculus
gacaaacagttggatctacctctag

SEQ ID NO: 640018 - DNA, 25 bp, Mus musculus
gacaaaccaggcaggtgagcaaagc

SEQ ID NO: 640019 - DNA, 25 bp, Mus musculus
gacaaaccaggctggtgagcaaagc

SEQ ID NO: 640020 - DNA, 25 bp, Mus musculus
gacaaacccaagcaggcggtcaccg

SEQ ID NO: 640021 - DNA, 25 bp, Mus musculus
gacaaacccaaggaggcggtcaccg

SEQ ID NO: 640022 - DNA, 25 bp, Mus musculus
gacaaacccattagtctcccaatga

SEQ ID NO: 640023 - DNA, 25 bp, Mus musculus
gacaaacccatttgtctcccaatga

SEQ ID NO: 640024 - DNA, 25 bp, Mus musculus
gacaaaccccagacctgaggaacat

SEQ ID NO: 640025 - DNA, 25 bp, Mus musculus
gacaaaccccagtcctgaggaacat

SEQ ID NO: 640026 - DNA, 25 bp, Mus musculus
gacaaaccgatacttgtcacagctg

SEQ ID NO: 640027 - DNA, 25 bp, Mus musculus
gacaaaccgatagttgtcacagctg

SEQ ID NO: 640028 - DNA, 25 bp, Mus musculus
gacaaacctctacatccgaggcctg

SEQ ID NO: 640029 - DNA, 25 bp, Mus musculus
gacaaacctctagatccgaggcctg

SEQ ID NO: 640030 - DNA, 25 bp, Mus musculus
gacaaacgatgcagcgactatttta

SEQ ID NO: 640031 - DNA, 25 bp, Mus musculus
gacaaacgatgctgcgactatttta

SEQ ID NO: 640032 - DNA, 25 bp, Mus musculus
gacaaacgttaaatcctgcagctcc

SEQ ID NO: 640033 - DNA, 25 bp, Mus musculus
gacaaacgttaattcctgcagctcc

SEQ ID NO: 640034 - DNA, 25 bp, Mus musculus
gacaaactaagcctgtttatgtata

SEQ ID NO: 640035 - DNA, 25 bp, Mus musculus
gacaaactaagcgtgtttatgtata

SEQ ID NO: 640036 - DNA, 25 bp, Mus musculus
gacaaactacccagcagacaaacct

SEQ ID NO: 640037 - DNA, 25 bp, Mus musculus
gacaaactaccctgcagacaaacct

SEQ ID NO: 640038 - DNA, 25 bp, Mus musculus
gacaaactagtcaggcaactgggtt

SEQ ID NO: 640039 - DNA, 25 bp, Mus musculus
gacaaactagtctggcaactgggtt

SEQ ID NO: 640040 - DNA, 25 bp, Mus musculus
gacaaactgctcagcgtctgcatga

SEQ ID NO: 640041 - DNA, 25 bp, Mus musculus
gacaaactgctctgcgtctgcatga

SEQ ID NO: 640042 - DNA, 25 bp, Mus musculus
gacaaacttccacagtccctagagg

SEQ ID NO: 640043 - DNA, 25 bp, Mus musculus
gacaaacttccagagtccctagagg

SEQ ID NO: 640044 - DNA, 25 bp, Mus musculus
gacaaacttgagacaatgtcgatgc

SEQ ID NO: 640045 - DNA, 25 bp, Mus musculus
gacaaacttgagtcaatgtcgatgc

SEQ ID NO: 640046 - DNA, 25 bp, Mus musculus
gacaaagaacataagaagagtagaa

SEQ ID NO: 640047 - DNA, 25 bp, Mus musculus
gacaaagaacattagaagagtagaa

SEQ ID NO: 640048 - DNA, 25 bp, Mus musculus
gacaaagaacgaaatattagcagtt

SEQ ID NO: 640049 - DNA, 25 bp, Mus musculus
gacaaagaacgatatattagcagtt

SEQ ID NO: 640050 - DNA, 25 bp, Mus musculus
gacaaagaacttcccaggaggtcca

SEQ ID NO: 640051 - DNA, 25 bp, Mus musculus
gacaaagaacttgccaggaggtcca

SEQ ID NO: 640052 - DNA, 25 bp, Mus musculus
gacaaagaagcacctttgcccctat

SEQ ID NO: 640053 - DNA, 25 bp, Mus musculus
gacaaagaagcagctttgcccctat

SEQ ID NO: 640054 - DNA, 25 bp, Mus musculus
gacaaagaagctcttaatggcagcg

SEQ ID NO: 640055 - DNA, 25 bp, Mus musculus
gacaaagaagctgttaatggcagcg

SEQ ID NO: 640056 - DNA, 25 bp, Mus musculus
gacaaagaccctcctaagctaaaag

SEQ ID NO: 640057 - DNA, 25 bp, Mus musculus
gacaaagaccctgctaagctaaaag

SEQ ID NO: 640058 - DNA, 25 bp, Mus musculus
gacaaagagctgataaaccgaatag

SEQ ID NO: 640059 - DNA, 25 bp, Mus musculus
gacaaagagctgttaaaccgaatag

SEQ ID NO: 640060 - DNA, 25 bp, Mus musculus
gacaaagagtgacgatgatgtctct

SEQ ID NO: 640061 - DNA, 25 bp, Mus musculus
gacaaagagtgaggatgatgtctct

SEQ ID NO: 640062 - DNA, 25 bp, Mus musculus
gacaaagagtggatggctgccctgc

SEQ ID NO: 640063 - DNA, 25 bp, Mus musculus
gacaaagagtggttggctgccctgc

SEQ ID NO: 640064 - DNA, 25 bp, Mus musculus
gacaaagatgctattcttcgagcaa

SEQ ID NO: 640065 - DNA, 25 bp, Mus musculus
gacaaagatgcttttcttcgagcaa

SEQ ID NO: 640066 - DNA, 25 bp, Mus musculus
gacaaagatgtgctttcaggagatg

SEQ ID NO: 640067 - DNA, 25 bp, Mus musculus
gacaaagatgtggtttcaggagatg

SEQ ID NO: 640068 - DNA, 25 bp, Mus musculus
gacaaagcacttcgtacctgaccta

SEQ ID NO: 640069 - DNA, 25 bp, Mus musculus
gacaaagcacttggtacctgaccta

SEQ ID NO: 640070 - DNA, 25 bp, Mus musculus
gacaaagcagaaaagtcagaacaaa

SEQ ID NO: 640071 - DNA, 25 bp, Mus musculus
gacaaagcagaaataaattgaatcc

SEQ ID NO: 640072 - DNA, 25 bp, Mus musculus
gacaaagcagaatagtcagaacaaa

SEQ ID NO: 640073 - DNA, 25 bp, Mus musculus
gacaaagcagaattaaattgaatcc

SEQ ID NO: 640074 - DNA, 25 bp, Mus musculus
gacaaagccattatgcaaactcaag

SEQ ID NO: 640075 - DNA, 25 bp, Mus musculus
gacaaagccattttgcaaactcaag

SEQ ID NO: 640076 - DNA, 25 bp, Mus musculus
gacaaagccctcaagatcctaggag

SEQ ID NO: 640077 - DNA, 25 bp, Mus musculus
gacaaagccctctagatcctaggag

SEQ ID NO: 640078 - DNA, 25 bp, Mus musculus
gacaaagcctcgaatgtggcctggg

SEQ ID NO: 640079 - DNA, 25 bp, Mus musculus
gacaaagcctcgtatgtggcctggg

SEQ ID NO: 640080 - DNA, 25 bp, Mus musculus
gacaaagctcctagacccagtacat

SEQ ID NO: 640081 - DNA, 25 bp, Mus musculus
gacaaagctccttgacccagtacat

SEQ ID NO: 640082 - DNA, 25 bp, Mus musculus
gacaaaggcagcaaaatggctgcag

SEQ ID NO: 640083 - DNA, 25 bp, Mus musculus
gacaaaggcagctaaatggctgcag

SEQ ID NO: 640084 - DNA, 25 bp, Mus musculus
gacaaaggccacaacaaattctgtg

SEQ ID NO: 640085 - DNA, 25 bp, Mus musculus
gacaaaggccactacaaattctgtg

SEQ ID NO: 640086 - DNA, 25 bp, Mus musculus
gacaaagggcacattgcttcagttc

SEQ ID NO: 640087 - DNA, 25 bp, Mus musculus
gacaaagggcactttgcttcagttc

SEQ ID NO: 640088 - DNA, 25 bp, Mus musculus
gacaaagggccacccacattctaga

SEQ ID NO: 640089 - DNA, 25 bp, Mus musculus
gacaaagggccagccacattctaga

SEQ ID NO: 640090 - DNA, 25 bp, Mus musculus
gacaaagggcccagacattagagtc

SEQ ID NO: 640091 - DNA, 25 bp, Mus musculus
gacaaagggccctgacattagagtc

SEQ ID NO: 640092 - DNA, 25 bp, Mus musculus
gacaaaggtcacaccctgacttcag

SEQ ID NO: 640093 - DNA, 25 bp, Mus musculus
gacaaaggtcactccctgacttcag

SEQ ID NO: 640094 - DNA, 25 bp, Mus musculus
gacaaagtagacaatctgagctccc

SEQ ID NO: 640095 - DNA, 25 bp, Mus musculus
gacaaagtagactatctgagctccc

SEQ ID NO: 640096 - DNA, 25 bp, Mus musculus
gacaaagtatgcaacggaggaccac

SEQ ID NO: 640097 - DNA, 25 bp, Mus musculus
gacaaagtatgctacggaggaccac

SEQ ID NO: 640098 - DNA, 25 bp, Mus musculus
gacaaagtcttcagccccaaatcta

SEQ ID NO: 640099 - DNA, 25 bp, Mus musculus
gacaaagtcttctgccccaaatcta

SEQ ID NO: 640100 - DNA, 25 bp, Mus musculus
gacaaagtggaacacgtgaaagccc

SEQ ID NO: 640101 - DNA, 25 bp, Mus musculus
gacaaagtggaagacgtgaaagccc

SEQ ID NO: 640102 - DNA, 25 bp, Mus musculus
gacaaagtggcgatcacaggctcca

SEQ ID NO: 640103 - DNA, 25 bp, Mus musculus
gacaaagtggcgttcacaggctcca

SEQ ID NO: 640104 - DNA, 25 bp, Mus musculus
gacaaagttcgacagggaccccgct

SEQ ID NO: 640105 - DNA, 25 bp, Mus musculus
gacaaagttcgagagggaccccgct

SEQ ID NO: 640106 - DNA, 25 bp, Mus musculus
gacaaataccgcctggacctgctca

SEQ ID NO: 640107 - DNA, 25 bp, Mus musculus
gacaaataccgcgtggacctgctca

SEQ ID NO: 640108 - DNA, 25 bp, Mus musculus
gacaaataccttatcataaagcaaa

SEQ ID NO: 640109 - DNA, 25 bp, Mus musculus
gacaaataccttttcataaagcaaa

SEQ ID NO: 640110 - DNA, 25 bp, Mus musculus
gacaaatactcccaggctctcaaag

SEQ ID NO: 640111 - DNA, 25 bp, Mus musculus
gacaaatactccgaggctctcaaag

SEQ ID NO: 640112 - DNA, 25 bp, Mus musculus
gacaaatccaacaccaaagcagtgg

SEQ ID NO: 640113 - DNA, 25 bp, Mus musculus
gacaaatccaactccaaagcagtgg

SEQ ID NO: 640114 - DNA, 25 bp, Mus musculus
gacaaatccctcaccttcaacgaga

SEQ ID NO: 640115 - DNA, 25 bp, Mus musculus
gacaaatccctctccttcaacgaga

SEQ ID NO: 640116 - DNA, 25 bp, Mus musculus
gacaaatcctcaatcactttacccg

SEQ ID NO: 640117 - DNA, 25 bp, Mus musculus
gacaaatcctcattcactttacccg

SEQ ID NO: 640118 - DNA, 25 bp, Mus musculus
gacaaatcgagaaagcaagttacag

SEQ ID NO: 640119 - DNA, 25 bp, Mus musculus
gacaaatcgagatagcaagttacag

SEQ ID NO: 640120 - DNA, 25 bp, Mus musculus
gacaaatcggccaatgcactctgca

SEQ ID NO: 640121 - DNA, 25 bp, Mus musculus
gacaaatcggcctatgcactctgca

SEQ ID NO: 640122 - DNA, 25 bp, Mus musculus
gacaaatctctcagtcatccttggc

SEQ ID NO: 640123 - DNA, 25 bp, Mus musculus
gacaaatctctctgtcatccttggc

SEQ ID NO: 640124 - DNA, 25 bp, Mus musculus
gacaaatgagaaccatgaccatggc

SEQ ID NO: 640125 - DNA, 25 bp, Mus musculus
gacaaatgagaagcatgaccatggc

SEQ ID NO: 640126 - DNA, 25 bp, Mus musculus
gacaaatgagttatggctgggccac

SEQ ID NO: 640127 - DNA, 25 bp, Mus musculus
gacaaatgagttttggctgggccac

SEQ ID NO: 640128 - DNA, 25 bp, Mus musculus
gacaaatgcaccaatctctcggagg

SEQ ID NO: 640129 - DNA, 25 bp, Mus musculus
gacaaatgcacctatctctcggagg

SEQ ID NO: 640130 - DNA, 25 bp, Mus musculus
gacaaatgcaggcattactgccact

SEQ ID NO: 640131 - DNA, 25 bp, Mus musculus
gacaaatgcagggattactgccact

SEQ ID NO: 640132 - DNA, 25 bp, Mus musculus
gacaaatgctggctatgattaccta

SEQ ID NO: 640133 - DNA, 25 bp, Mus musculus
gacaaatgctgggtatgattaccta

SEQ ID NO: 640134 - DNA, 25 bp, Mus musculus
gacaaatgctgtctgacgactctga

SEQ ID NO: 640135 - DNA, 25 bp, Mus musculus
gacaaatgctgtgtgacgactctga

SEQ ID NO: 640136 - DNA, 25 bp, Mus musculus
gacaaatggagccatagccagccgt

SEQ ID NO: 640137 - DNA, 25 bp, Mus musculus
gacaaatggagcctctttggaccac

SEQ ID NO: 640138 - DNA, 25 bp, Mus musculus
gacaaatggagcgatagccagccgt

SEQ ID NO: 640139 - DNA, 25 bp, Mus musculus
gacaaatggagcgtctttggaccac

SEQ ID NO: 640140 - DNA, 25 bp, Mus musculus
gacaaatggcaaccctaagtcttga

SEQ ID NO: 640141 - DNA, 25 bp, Mus musculus
gacaaatggcaagcctaagtcttga

SEQ ID NO: 640142 - DNA, 25 bp, Mus musculus
gacaaatgtcataaaccctgcgtat

SEQ ID NO: 640143 - DNA, 25 bp, Mus musculus
gacaaatgtcattaaccctgcgtat

SEQ ID NO: 640144 - DNA, 25 bp, Mus musculus
gacaaatgtcccatgtgctacaccg

SEQ ID NO: 640145 - DNA, 25 bp, Mus musculus
gacaaatgtcccttgtgctacaccg

SEQ ID NO: 640146 - DNA, 25 bp, Mus musculus
gacaaattcaatactgggagtgaag

SEQ ID NO: 640147 - DNA, 25 bp, Mus musculus
gacaaattcaattctgggagtgaag

SEQ ID NO: 640148 - DNA, 25 bp, Mus musculus
gacaaattcatgaggactgccagac

SEQ ID NO: 640149 - DNA, 25 bp, Mus musculus
gacaaattcatgtggactgccagac

SEQ ID NO: 640150 - DNA, 25 bp, Mus musculus
gacaaattccagaaagctctggccg

SEQ ID NO: 640151 - DNA, 25 bp, Mus musculus
gacaaattccagtaagctctggccg

SEQ ID NO: 640152 - DNA, 25 bp, Mus musculus
gacaaattggatattatttgcccca

SEQ ID NO: 640153 - DNA, 25 bp, Mus musculus
gacaaattggattttatttgcccca

SEQ ID NO: 640154 - DNA, 25 bp, Mus musculus
gacaaattgtccaaatggagtggaa

SEQ ID NO: 640155 - DNA, 25 bp, Mus musculus
gacaaattgtcctaatggagtggaa

SEQ ID NO: 640156 - DNA, 25 bp, Mus musculus
gacaaattgtggctacagcaactct

SEQ ID NO: 640157 - DNA, 25 bp, Mus musculus
gacaaattgtgggtacagcaactct

SEQ ID NO: 640158 - DNA, 25 bp, Mus musculus
gacaacaaaggcatagagagattgg

SEQ ID NO: 640159 - DNA, 25 bp, Mus musculus
gacaacaaaggcttagagagattgg

SEQ ID NO: 640160 - DNA, 25 bp, Mus musculus
gacaacaacaagctgtcccgggtgc

SEQ ID NO: 640161 - DNA, 25 bp, Mus musculus
gacaacaacaaggtgtcccgggtgc

SEQ ID NO: 640162 - DNA, 25 bp, Mus musculus
gacaacaacgtgctgaacggttcca

SEQ ID NO: 640163 - DNA, 25 bp, Mus musculus
gacaacaacgtggtgaacggttcca

SEQ ID NO: 640164 - DNA, 25 bp, Mus musculus
gacaacaaggcactgtatgacactt

SEQ ID NO: 640165 - DNA, 25 bp, Mus musculus
gacaacaaggcagtgtatgacactt

SEQ ID NO: 640166 - DNA, 25 bp, Mus musculus
gacaacaagtccatccgagtcctgg

SEQ ID NO: 640167 - DNA, 25 bp, Mus musculus
gacaacaagtccttccgagtcctgg

SEQ ID NO: 640168 - DNA, 25 bp, Mus musculus
gacaacaagtttcaccatgcaatgg

SEQ ID NO: 640169 - DNA, 25 bp, Mus musculus
gacaacaagtttgaccatgcaatgg

SEQ ID NO: 640170 - DNA, 25 bp, Mus musculus
gacaacaattttaatagtgtagaga

SEQ ID NO: 640171 - DNA, 25 bp, Mus musculus
gacaacaatttttatagtgtagaga

SEQ ID NO: 640172 - DNA, 25 bp, Mus musculus
gacaacaccactcattttcaacggg

SEQ ID NO: 640173 - DNA, 25 bp, Mus musculus
gacaacaccactgattttcaacggg

SEQ ID NO: 640174 - DNA, 25 bp, Mus musculus
gacaacactcacaggtatttctatg

SEQ ID NO: 640175 - DNA, 25 bp, Mus musculus
gacaacactcactggtatttctatg

SEQ ID NO: 640176 - DNA, 25 bp, Mus musculus
gacaacactcatcaatatccgaaac

SEQ ID NO: 640177 - DNA, 25 bp, Mus musculus
gacaacactcatgaatatccgaaac

SEQ ID NO: 640178 - DNA, 25 bp, Mus musculus
gacaacagacccatcttccgggaag

SEQ ID NO: 640179 - DNA, 25 bp, Mus musculus
gacaacagacccttcttccgggaag

SEQ ID NO: 640180 - DNA, 25 bp, Mus musculus
gacaacagagagcatctagccatga

SEQ ID NO: 640181 - DNA, 25 bp, Mus musculus
gacaacagagaggatctagccatga

SEQ ID NO: 640182 - DNA, 25 bp, Mus musculus
gacaacagaggcactttccataaag

SEQ ID NO: 640183 - DNA, 25 bp, Mus musculus
gacaacagaggctctttccataaag

SEQ ID NO: 640184 - DNA, 25 bp, Mus musculus
gacaacagcccacggaagatccagt

SEQ ID NO: 640185 - DNA, 25 bp, Mus musculus
gacaacagcccactgcacgggatgt

SEQ ID NO: 640186 - DNA, 25 bp, Mus musculus
gacaacagcccagggaagatccagt

SEQ ID NO: 640187 - DNA, 25 bp, Mus musculus
gacaacagcccagtgcacgggatgt

SEQ ID NO: 640188 - DNA, 25 bp, Mus musculus
gacaacagcctaagttatcagtact

SEQ ID NO: 640189 - DNA, 25 bp, Mus musculus
gacaacagcctatgttatcagtact

SEQ ID NO: 640190 - DNA, 25 bp, Mus musculus
gacaacagcttaaccaatatccagt

SEQ ID NO: 640191 - DNA, 25 bp, Mus musculus
gacaacagcttatccaatatccagt

SEQ ID NO: 640192 - DNA, 25 bp, Mus musculus
gacaacaggagtccccttgacgggc

SEQ ID NO: 640193 - DNA, 25 bp, Mus musculus
gacaacaggagtcttcgacgtcaca

SEQ ID NO: 640194 - DNA, 25 bp, Mus musculus
gacaacaggagtgcccttgacgggc

SEQ ID NO: 640195 - DNA, 25 bp, Mus musculus
gacaacaggagtgttcgacgtcaca

SEQ ID NO: 640196 - DNA, 25 bp, Mus musculus
gacaacaggcatcatcgagaccaag

SEQ ID NO: 640197 - DNA, 25 bp, Mus musculus
gacaacaggcatgatcgagaccaag

SEQ ID NO: 640198 - DNA, 25 bp, Mus musculus
gacaacatattgctaaaagtggctg

SEQ ID NO: 640199 - DNA, 25 bp, Mus musculus
gacaacatattggtaaaagtggctg

SEQ ID NO: 640200 - DNA, 25 bp, Mus musculus
gacaacatccatatacacccagagg

SEQ ID NO: 640201 - DNA, 25 bp, Mus musculus
gacaacatccatttacacccagagg

SEQ ID NO: 640202 - DNA, 25 bp, Mus musculus
gacaacatggaaacgtgagtagtgg

SEQ ID NO: 640203 - DNA, 25 bp, Mus musculus
gacaacatggaatcgtgagtagtgg

SEQ ID NO: 640204 - DNA, 25 bp, Mus musculus
gacaacatggcccaattctttcgac

SEQ ID NO: 640205 - DNA, 25 bp, Mus musculus
gacaacatggccgaattctttcgac

SEQ ID NO: 640206 - DNA, 25 bp, Mus musculus
gacaacattcatatctgtgggacgg

SEQ ID NO: 640207 - DNA, 25 bp, Mus musculus
gacaacattcatttctgtgggacgg

SEQ ID NO: 640208 - DNA, 25 bp, Mus musculus
gacaaccaagctaccgcggtgggaa

SEQ ID NO: 640209 - DNA, 25 bp, Mus musculus
gacaaccaagcttccgcggtgggaa

SEQ ID NO: 640210 - DNA, 25 bp, Mus musculus
gacaaccagaggcattgccagcctg

SEQ ID NO: 640211 - DNA, 25 bp, Mus musculus
gacaaccagagggattgccagcctg

SEQ ID NO: 640212 - DNA, 25 bp, Mus musculus
gacaaccagtgtacagcagcctaaa

SEQ ID NO: 640213 - DNA, 25 bp, Mus musculus
gacaaccagtgttcagcagcctaaa

SEQ ID NO: 640214 - DNA, 25 bp, Mus musculus
gacaaccatgccagtgtgtgggcat

SEQ ID NO: 640215 - DNA, 25 bp, Mus musculus
gacaaccatgcctgtgtgtgggcat

SEQ ID NO: 640216 - DNA, 25 bp, Mus musculus
gacaacccaccgacagttaacttct

SEQ ID NO: 640217 - DNA, 25 bp, Mus musculus
gacaacccaccgtcagttaacttct

SEQ ID NO: 640218 - DNA, 25 bp, Mus musculus
gacaacccagtacatgaatgaaggg

SEQ ID NO: 640219 - DNA, 25 bp, Mus musculus
gacaacccagtagatgaatgaaggg

SEQ ID NO: 640220 - DNA, 25 bp, Mus musculus
gacaaccccttcatgcagtactacg

SEQ ID NO: 640221 - DNA, 25 bp, Mus musculus
gacaaccccttcttgcagtactacg

SEQ ID NO: 640222 - DNA, 25 bp, Mus musculus
gacaacccgtggacaggcggcattt

SEQ ID NO: 640223 - DNA, 25 bp, Mus musculus
gacaacccgtggtcaggcggcattt

SEQ ID NO: 640224 - DNA, 25 bp, Mus musculus
gacaaccctaatctagctcggacca

SEQ ID NO: 640225 - DNA, 25 bp, Mus musculus
gacaaccctaatgtagctcggacca

SEQ ID NO: 640226 - DNA, 25 bp, Mus musculus
gacaaccctctgaacgaagggacgg

SEQ ID NO: 640227 - DNA, 25 bp, Mus musculus
gacaaccctctgtacgaagggacgg

SEQ ID NO: 640228 - DNA, 25 bp, Mus musculus
gacaaccctgctatcatcgatgacc

SEQ ID NO: 640229 - DNA, 25 bp, Mus musculus
gacaaccctgctttcatcgatgacc

SEQ ID NO: 640230 - DNA, 25 bp, Mus musculus
gacaacccttgacatcgtcagagcg

SEQ ID NO: 640231 - DNA, 25 bp, Mus musculus
gacaacccttgagatcgtcagagcg

SEQ ID NO: 640232 - DNA, 25 bp, Mus musculus
gacaaccgaaaaatcacacctctta

SEQ ID NO: 640233 - DNA, 25 bp, Mus musculus
gacaaccgaaaattcacacctctta

SEQ ID NO: 640234 - DNA, 25 bp, Mus musculus
gacaaccgccaacaatggacattca

SEQ ID NO: 640235 - DNA, 25 bp, Mus musculus
gacaaccgccaagaatggacattca

SEQ ID NO: 640236 - DNA, 25 bp, Mus musculus
gacaaccgtctacggccaggatttg

SEQ ID NO: 640237 - DNA, 25 bp, Mus musculus
gacaaccgtctagggccaggatttg

SEQ ID NO: 640238 - DNA, 25 bp, Mus musculus
gacaaccgttggatctgccaaaagg

SEQ ID NO: 640239 - DNA, 25 bp, Mus musculus
gacaaccgttggttctgccaaaagg

SEQ ID NO: 640240 - DNA, 25 bp, Mus musculus
gacaacctgctgcagatcttcgggc

SEQ ID NO: 640241 - DNA, 25 bp, Mus musculus
gacaacctgctggagatcttcgggc

SEQ ID NO: 640242 - DNA, 25 bp, Mus musculus
gacaacctggagcacgaagagcaga

SEQ ID NO: 640243 - DNA, 25 bp, Mus musculus
gacaacctggaggacgaagagcaga

SEQ ID NO: 640244 - DNA, 25 bp, Mus musculus
gacaacctggcgattgtgactcagt

SEQ ID NO: 640245 - DNA, 25 bp, Mus musculus
gacaacctggcgtttgtgactcagt

SEQ ID NO: 640246 - DNA, 25 bp, Mus musculus
gacaacgacaagaacattgccctgg

SEQ ID NO: 640247 - DNA, 25 bp, Mus musculus
gacaacgacaagtacattgccctgg

SEQ ID NO: 640248 - DNA, 25 bp, Mus musculus
gacaacgagtgtcaggagggcaagg

SEQ ID NO: 640249 - DNA, 25 bp, Mus musculus
gacaacgagtgtgaggagggcaagg

SEQ ID NO: 640250 - DNA, 25 bp, Mus musculus
gacaacgcactgacgtgggagtatt

SEQ ID NO: 640251 - DNA, 25 bp, Mus musculus
gacaacgcactgtcgtgggagtatt

SEQ ID NO: 640252 - DNA, 25 bp, Mus musculus
gacaacgcgccgaaaaagaagttct

SEQ ID NO: 640253 - DNA, 25 bp, Mus musculus
gacaacgcgccgtaaaagaagttct

SEQ ID NO: 640254 - DNA, 25 bp, Mus musculus
gacaacgctctgcaattaaccacag

SEQ ID NO: 640255 - DNA, 25 bp, Mus musculus
gacaacgctctggaattaaccacag

SEQ ID NO: 640256 - DNA, 25 bp, Mus musculus
gacaacggcaaactggtcatcacag

SEQ ID NO: 640257 - DNA, 25 bp, Mus musculus
gacaacggcaaagtggtcatcacag

SEQ ID NO: 640258 - DNA, 25 bp, Mus musculus
gacaacggcactatcacatgtgatg

SEQ ID NO: 640259 - DNA, 25 bp, Mus musculus
gacaacggcactttcacatgtgatg

SEQ ID NO: 640260 - DNA, 25 bp, Mus musculus
gacaacggctatagtggaacagcaa

SEQ ID NO: 640261 - DNA, 25 bp, Mus musculus
gacaacggctattgtggaacagcaa

SEQ ID NO: 640262 - DNA, 25 bp, Mus musculus
gacaacgtccagctggaagtcatcc

SEQ ID NO: 640263 - DNA, 25 bp, Mus musculus
gacaacgtccaggtggaagtcatcc

SEQ ID NO: 640264 - DNA, 25 bp, Mus musculus
gacaacgtgatgattcggaagacag

SEQ ID NO: 640265 - DNA, 25 bp, Mus musculus
gacaacgtgatgtttcggaagacag

SEQ ID NO: 640266 - DNA, 25 bp, Mus musculus
gacaacgtgtccatgaccacacaag

SEQ ID NO: 640267 - DNA, 25 bp, Mus musculus
gacaacgtgtccttgaccacacaag

SEQ ID NO: 640268 - DNA, 25 bp, Mus musculus
gacaactacagtccaccagacacag

SEQ ID NO: 640269 - DNA, 25 bp, Mus musculus
gacaactacagtgcaccagacacag

SEQ ID NO: 640270 - DNA, 25 bp, Mus musculus
gacaactacatcaaactccttacgg

SEQ ID NO: 640271 - DNA, 25 bp, Mus musculus
gacaactacatctaactccttacgg

SEQ ID NO: 640272 - DNA, 25 bp, Mus musculus
gacaactagttgaggacaaccttga

SEQ ID NO: 640273 - DNA, 25 bp, Mus musculus
gacaactagttgtggacaaccttga

SEQ ID NO: 640274 - DNA, 25 bp, Mus musculus
gacaactatgcactcctccagctgg

SEQ ID NO: 640275 - DNA, 25 bp, Mus musculus
gacaactatgcagtcctccagctgg

SEQ ID NO: 640276 - DNA, 25 bp, Mus musculus
gacaactcgagaagagaaacggagg

SEQ ID NO: 640277 - DNA, 25 bp, Mus musculus
gacaactcgagatgagaaacggagg

SEQ ID NO: 640278 - DNA, 25 bp, Mus musculus
gacaactcgcgccttgtcctggaga

SEQ ID NO: 640279 - DNA, 25 bp, Mus musculus
gacaactcgcgcgttgtcctggaga

SEQ ID NO: 640280 - DNA, 25 bp, Mus musculus
gacaactcggaaaaacacgagacat

SEQ ID NO: 640281 - DNA, 25 bp, Mus musculus
gacaactcggaataacacgagacat

SEQ ID NO: 640282 - DNA, 25 bp, Mus musculus
gacaactctattctaacaaaccatg

SEQ ID NO: 640283 - DNA, 25 bp, Mus musculus
gacaactctattgtaacaaaccatg

SEQ ID NO: 640284 - DNA, 25 bp, Mus musculus
gacaactcttgacgtgaagcgcggc

SEQ ID NO: 640285 - DNA, 25 bp, Mus musculus
gacaactcttgaggtgaagcgcggc

SEQ ID NO: 640286 - DNA, 25 bp, Mus musculus
gacaactgacgactatgaggcaatc

SEQ ID NO: 640287 - DNA, 25 bp, Mus musculus
gacaactgacgagtatgaggcaatc

SEQ ID NO: 640288 - DNA, 25 bp, Mus musculus
gacaactgcacacagccaagatgag

SEQ ID NO: 640289 - DNA, 25 bp, Mus musculus
gacaactgcacagagccaagatgag

SEQ ID NO: 640290 - DNA, 25 bp, Mus musculus
gacaactgccagaacgtttacaacg

SEQ ID NO: 640291 - DNA, 25 bp, Mus musculus
gacaactgccagtacgtttacaacg

SEQ ID NO: 640292 - DNA, 25 bp, Mus musculus
gacaactgcgtgacggtgcccaatt

SEQ ID NO: 640293 - DNA, 25 bp, Mus musculus
gacaactgcgtgtcggtgcccaatt

SEQ ID NO: 640294 - DNA, 25 bp, Mus musculus
gacaactggattcctcaccaggatg

SEQ ID NO: 640295 - DNA, 25 bp, Mus musculus
gacaactggattgctcaccaggatg

SEQ ID NO: 640296 - DNA, 25 bp, Mus musculus
gacaactggccaagctggccctcat

SEQ ID NO: 640297 - DNA, 25 bp, Mus musculus
gacaactggccatgctggccctcat

SEQ ID NO: 640298 - DNA, 25 bp, Mus musculus
gacaactgggtcagttttgcagata

SEQ ID NO: 640299 - DNA, 25 bp, Mus musculus
gacaactgggtctgttttgcagata

SEQ ID NO: 640300 - DNA, 25 bp, Mus musculus
gacaactgtcccaatgtgcctaatg

SEQ ID NO: 640301 - DNA, 25 bp, Mus musculus
gacaactgtccctatgtgcctaatg

SEQ ID NO: 640302 - DNA, 25 bp, Mus musculus
gacaacttatccaaacctgtggctg

SEQ ID NO: 640303 - DNA, 25 bp, Mus musculus
gacaacttatcctaacctgtggctg

SEQ ID NO: 640304 - DNA, 25 bp, Mus musculus
gacaacttcaagattatgagcagcc

SEQ ID NO: 640305 - DNA, 25 bp, Mus musculus
gacaacttcaagtttatgagcagcc

SEQ ID NO: 640306 - DNA, 25 bp, Mus musculus
gacaacttcggcctcatgtatgatt

SEQ ID NO: 640307 - DNA, 25 bp, Mus musculus
gacaacttcggcgtcatgtatgatt

SEQ ID NO: 640308 - DNA, 25 bp, Mus musculus
gacaacttcgtgaagcttgttgcct

SEQ ID NO: 640309 - DNA, 25 bp, Mus musculus
gacaacttcgtgtagcttgttgcct

SEQ ID NO: 640310 - DNA, 25 bp, Mus musculus
gacaacttctccaagtttggtcttt

SEQ ID NO: 640311 - DNA, 25 bp, Mus musculus
gacaacttctcctagtttggtcttt

SEQ ID NO: 640312 - DNA, 25 bp, Mus musculus
gacaacttgaatcggaacggaaccg

SEQ ID NO: 640313 - DNA, 25 bp, Mus musculus
gacaacttgaatgggaacggaaccg

SEQ ID NO: 640314 - DNA, 25 bp, Mus musculus
gacaacttgctgcaaggctatgaca

SEQ ID NO: 640315 - DNA, 25 bp, Mus musculus
gacaacttgctggaaggctatgaca

SEQ ID NO: 640316 - DNA, 25 bp, Mus musculus
gacaacttggccacctgagccctgt

SEQ ID NO: 640317 - DNA, 25 bp, Mus musculus
gacaacttggcctcctgagccctgt

SEQ ID NO: 640318 - DNA, 25 bp, Mus musculus
gacaactttaccagctgcgccttct

SEQ ID NO: 640319 - DNA, 25 bp, Mus musculus
gacaactttacctgctgcgccttct

SEQ ID NO: 640320 - DNA, 25 bp, Mus musculus
gacaactttattagttggtgtacaa

SEQ ID NO: 640321 - DNA, 25 bp, Mus musculus
gacaactttatttgttggtgtacaa

SEQ ID NO: 640322 - DNA, 25 bp, Mus musculus
gacaactttcctctgggcaccatgg

SEQ ID NO: 640323 - DNA, 25 bp, Mus musculus
gacaactttcctgtgggcaccatgg

SEQ ID NO: 640324 - DNA, 25 bp, Mus musculus
gacaactttgccatggagtggagct

SEQ ID NO: 640325 - DNA, 25 bp, Mus musculus
gacaactttgccttggagtggagct

SEQ ID NO: 640326 - DNA, 25 bp, Mus musculus
gacaagaaaaatcagcccaatcctc

SEQ ID NO: 640327 - DNA, 25 bp, Mus musculus
gacaagaaaaatgagcccaatcctc

SEQ ID NO: 640328 - DNA, 25 bp, Mus musculus
gacaagaaacgcagcatcatgatga

SEQ ID NO: 640329 - DNA, 25 bp, Mus musculus
gacaagaaacgctgcatcatgatga

SEQ ID NO: 640330 - DNA, 25 bp, Mus musculus
gacaagaaagacacctaccagcctg

SEQ ID NO: 640331 - DNA, 25 bp, Mus musculus
gacaagaaagactcctaccagcctg

SEQ ID NO: 640332 - DNA, 25 bp, Mus musculus
gacaagaacaaactacaggcgattg

SEQ ID NO: 640333 - DNA, 25 bp, Mus musculus
gacaagaacaaagtacaggcgattg

SEQ ID NO: 640334 - DNA, 25 bp, Mus musculus
gacaagaacattcgccaggccttta

SEQ ID NO: 640335 - DNA, 25 bp, Mus musculus
gacaagaacattggccaggccttta

SEQ ID NO: 640336 - DNA, 25 bp, Mus musculus
gacaagaacccacgactgatcaaat

SEQ ID NO: 640337 - DNA, 25 bp, Mus musculus
gacaagaacccaggactgatcaaat

SEQ ID NO: 640338 - DNA, 25 bp, Mus musculus
gacaagaacctcatcgactctatgg

SEQ ID NO: 640339 - DNA, 25 bp, Mus musculus
gacaagaacctcttcgactctatgg

SEQ ID NO: 640340 - DNA, 25 bp, Mus musculus
gacaagaacgcactgaacctgacat

SEQ ID NO: 640341 - DNA, 25 bp, Mus musculus
gacaagaacgcagtgaacctgacat

SEQ ID NO: 640342 - DNA, 25 bp, Mus musculus
gacaagaacggtctggacctcctaa

SEQ ID NO: 640343 - DNA, 25 bp, Mus musculus
gacaagaacggtgtggacctcctaa

SEQ ID NO: 640344 - DNA, 25 bp, Mus musculus
gacaagaagatgcatgcccatcctc

SEQ ID NO: 640345 - DNA, 25 bp, Mus musculus
gacaagaagatggatgcccatcctc

SEQ ID NO: 640346 - DNA, 25 bp, Mus musculus
gacaagaagattcagcgctggcacc

SEQ ID NO: 640347 - DNA, 25 bp, Mus musculus
gacaagaagattgagcgctggcacc

SEQ ID NO: 640348 - DNA, 25 bp, Mus musculus
gacaagaagctgaatctgctgaccg

SEQ ID NO: 640349 - DNA, 25 bp, Mus musculus
gacaagaagctgtatctgctgaccg

SEQ ID NO: 640350 - DNA, 25 bp, Mus musculus
gacaagaagcttcctgagatggaca

SEQ ID NO: 640351 - DNA, 25 bp, Mus musculus
gacaagaagcttgctgagatggaca

SEQ ID NO: 640352 - DNA, 25 bp, Mus musculus
gacaagaaggctatatatccttcta

SEQ ID NO: 640353 - DNA, 25 bp, Mus musculus
gacaagaaggctttatatccttcta

SEQ ID NO: 640354 - DNA, 25 bp, Mus musculus
gacaagaaggtgactgagacccgga

SEQ ID NO: 640355 - DNA, 25 bp, Mus musculus
gacaagaaggtgtctgagacccgga

SEQ ID NO: 640356 - DNA, 25 bp, Mus musculus
gacaagaagtttcttagcaacataa

SEQ ID NO: 640357 - DNA, 25 bp, Mus musculus
gacaagaagtttgttagcaacataa

SEQ ID NO: 640358 - DNA, 25 bp, Mus musculus
gacaagaatccccagaacatcagag

SEQ ID NO: 640359 - DNA, 25 bp, Mus musculus
gacaagaatcccgagaacatcagag

SEQ ID NO: 640360 - DNA, 25 bp, Mus musculus
gacaagacagtgctagtagccgact

SEQ ID NO: 640361 - DNA, 25 bp, Mus musculus
gacaagacagtggtagtagccgact

SEQ ID NO: 640362 - DNA, 25 bp, Mus musculus
gacaagacataaagtcagccgggcc

SEQ ID NO: 640363 - DNA, 25 bp, Mus musculus
gacaagacataatgtcagccgggcc

SEQ ID NO: 640364 - DNA, 25 bp, Mus musculus
gacaagaccaccctaccgggaagag

SEQ ID NO: 640365 - DNA, 25 bp, Mus musculus
gacaagaccaccgtaccgggaagag

SEQ ID NO: 640366 - DNA, 25 bp, Mus musculus
gacaagaccttgcatgaagaggcct

SEQ ID NO: 640367 - DNA, 25 bp, Mus musculus
gacaagaccttggatgaagaggcct

SEQ ID NO: 640368 - DNA, 25 bp, Mus musculus
gacaagacgatcagcgaccaggaat

SEQ ID NO: 640369 - DNA, 25 bp, Mus musculus
gacaagacgatctgcgaccaggaat

SEQ ID NO: 640370 - DNA, 25 bp, Mus musculus
gacaagactctgcaaaataaattga

SEQ ID NO: 640371 - DNA, 25 bp, Mus musculus
gacaagactctggaaaataaattga

SEQ ID NO: 640372 - DNA, 25 bp, Mus musculus
gacaagactgctattctattataca

SEQ ID NO: 640373 - DNA, 25 bp, Mus musculus
gacaagactgcttttctattataca

SEQ ID NO: 640374 - DNA, 25 bp, Mus musculus
gacaagactggacataaacctcgaa

SEQ ID NO: 640375 - DNA, 25 bp, Mus musculus
gacaagactggagataaacctcgaa

SEQ ID NO: 640376 - DNA, 25 bp, Mus musculus
gacaagagaggacctgagaaccaca

SEQ ID NO: 640377 - DNA, 25 bp, Mus musculus
gacaagagaggagctgagaaccaca

SEQ ID NO: 640378 - DNA, 25 bp, Mus musculus
gacaagagaggcaggcgtgaaatcc

SEQ ID NO: 640379 - DNA, 25 bp, Mus musculus
gacaagagaggctggcgtgaaatcc

SEQ ID NO: 640380 - DNA, 25 bp, Mus musculus
gacaagagcaacaccagaaggaaca

SEQ ID NO: 640381 - DNA, 25 bp, Mus musculus
gacaagagcaactccagaaggaaca

SEQ ID NO: 640382 - DNA, 25 bp, Mus musculus
gacaagagcagaattagaagaagtg

SEQ ID NO: 640383 - DNA, 25 bp, Mus musculus
gacaagagcagatttagaagaagtg

SEQ ID NO: 640384 - DNA, 25 bp, Mus musculus
gacaagagccgccaatatgaccagc

SEQ ID NO: 640385 - DNA, 25 bp, Mus musculus
gacaagagccgcgaatatgaccagc

SEQ ID NO: 640386 - DNA, 25 bp, Mus musculus
gacaagagcctgaatgtggcagaat

SEQ ID NO: 640387 - DNA, 25 bp, Mus musculus
gacaagagcctgtatgtggcagaat

SEQ ID NO: 640388 - DNA, 25 bp, Mus musculus
gacaagaggatcatcaccacccgac

SEQ ID NO: 640389 - DNA, 25 bp, Mus musculus
gacaagaggatcttcaccacccgac

SEQ ID NO: 640390 - DNA, 25 bp, Mus musculus
gacaagagggctatgtaccctataa

SEQ ID NO: 640391 - DNA, 25 bp, Mus musculus
gacaagagggctttgtaccctataa

SEQ ID NO: 640392 - DNA, 25 bp, Mus musculus
gacaagagtaataaacttcgtgtgg

SEQ ID NO: 640393 - DNA, 25 bp, Mus musculus
gacaagagtaattaacttcgtgtgg

SEQ ID NO: 640394 - DNA, 25 bp, Mus musculus
gacaagagtggaatttcaggccagg

SEQ ID NO: 640395 - DNA, 25 bp, Mus musculus
gacaagagtggattttcaggccagg

SEQ ID NO: 640396 - DNA, 25 bp, Mus musculus
gacaagatacttataccacggccga

SEQ ID NO: 640397 - DNA, 25 bp, Mus musculus
gacaagatacttttaccacggccga

SEQ ID NO: 640398 - DNA, 25 bp, Mus musculus
gacaagatcaagaacccacggaaag

SEQ ID NO: 640399 - DNA, 25 bp, Mus musculus
gacaagatcaagatctggttggaga

SEQ ID NO: 640400 - DNA, 25 bp, Mus musculus
gacaagatcaagtacccacggaaag

SEQ ID NO: 640401 - DNA, 25 bp, Mus musculus
gacaagatcaagttctggttggaga

SEQ ID NO: 640402 - DNA, 25 bp, Mus musculus
gacaagatcaccatctccaagaact

SEQ ID NO: 640403 - DNA, 25 bp, Mus musculus
gacaagatcaccttctccaagaact

SEQ ID NO: 640404 - DNA, 25 bp, Mus musculus
gacaagatcccaaagggacaggact

SEQ ID NO: 640405 - DNA, 25 bp, Mus musculus
gacaagatcccatagggacaggact

SEQ ID NO: 640406 - DNA, 25 bp, Mus musculus
gacaagatgacccaacgctgattag

SEQ ID NO: 640407 - DNA, 25 bp, Mus musculus
gacaagatgaccgaacgctgattag

SEQ ID NO: 640408 - DNA, 25 bp, Mus musculus
gacaagatgcaacgttgagggcacc

SEQ ID NO: 640409 - DNA, 25 bp, Mus musculus
gacaagatgcaaggttgagggcacc

SEQ ID NO: 640410 - DNA, 25 bp, Mus musculus
gacaagatgcccatggccactggga

SEQ ID NO: 640411 - DNA, 25 bp, Mus musculus
gacaagatgcccttggccactggga

SEQ ID NO: 640412 - DNA, 25 bp, Mus musculus
gacaagatgttcatcctcgacccga

SEQ ID NO: 640413 - DNA, 25 bp, Mus musculus
gacaagatgttcttcctcgacccga

SEQ ID NO: 640414 - DNA, 25 bp, Mus musculus
gacaagcaaaccagacgatgcacag

SEQ ID NO: 640415 - DNA, 25 bp, Mus musculus
gacaagcaaacctgacgatgcacag

SEQ ID NO: 640416 - DNA, 25 bp, Mus musculus
gacaagcaagaaccccataaccgtt

SEQ ID NO: 640417 - DNA, 25 bp, Mus musculus
gacaagcaagaagcccataaccgtt

SEQ ID NO: 640418 - DNA, 25 bp, Mus musculus
gacaagcaaggacgacccgaatctt

SEQ ID NO: 640419 - DNA, 25 bp, Mus musculus
gacaagcaaggaggacccgaatctt

SEQ ID NO: 640420 - DNA, 25 bp, Mus musculus
gacaagcagactccaggcctcaagc

SEQ ID NO: 640421 - DNA, 25 bp, Mus musculus
gacaagcagactgcaggcctcaagc

SEQ ID NO: 640422 - DNA, 25 bp, Mus musculus
gacaagcagataagtgacctgagac

SEQ ID NO: 640423 - DNA, 25 bp, Mus musculus
gacaagcagatatgtgacctgagac

SEQ ID NO: 640424 - DNA, 25 bp, Mus musculus
gacaagcagcaactgaagaagagct

SEQ ID NO: 640425 - DNA, 25 bp, Mus musculus
gacaagcagcaagtgaagaagagct

SEQ ID NO: 640426 - DNA, 25 bp, Mus musculus
gacaagcagctcatcactcttgtgg

SEQ ID NO: 640427 - DNA, 25 bp, Mus musculus
gacaagcagctcttcactcttgtgg

SEQ ID NO: 640428 - DNA, 25 bp, Mus musculus
gacaagcatatgcttctgcctgtgg

SEQ ID NO: 640429 - DNA, 25 bp, Mus musculus
gacaagcatatggttctgcctgtgg

SEQ ID NO: 640430 - DNA, 25 bp, Mus musculus
gacaagcatgaacaaaaccaccggc

SEQ ID NO: 640431 - DNA, 25 bp, Mus musculus
gacaagcatgaagaaaaccaccggc

SEQ ID NO: 640432 - DNA, 25 bp, Mus musculus
gacaagccagagcatgtcttgttga

SEQ ID NO: 640433 - DNA, 25 bp, Mus musculus
gacaagccagaggatgtcttgttga

SEQ ID NO: 640434 - DNA, 25 bp, Mus musculus
gacaagccatctcctaacatgttct

SEQ ID NO: 640435 - DNA, 25 bp, Mus musculus
gacaagccatctgctaacatgttct

SEQ ID NO: 640436 - DNA, 25 bp, Mus musculus
gacaagcccagtaactgtaccaatg

SEQ ID NO: 640437 - DNA, 25 bp, Mus musculus
gacaagcccagttactgtaccaatg

SEQ ID NO: 640438 - DNA, 25 bp, Mus musculus
gacaagcccctgagccacagtgagg

SEQ ID NO: 640439 - DNA, 25 bp, Mus musculus
gacaagcccctgtgccacagtgagg

SEQ ID NO: 640440 - DNA, 25 bp, Mus musculus
gacaagcctggcctatatgaaactc

SEQ ID NO: 640441 - DNA, 25 bp, Mus musculus
gacaagcctggcgtatatgaaactc

SEQ ID NO: 640442 - DNA, 25 bp, Mus musculus
gacaagcctgtcaccagtgtagcaa

SEQ ID NO: 640443 - DNA, 25 bp, Mus musculus
gacaagcctgtctccagtgtagcaa

SEQ ID NO: 640444 - DNA, 25 bp, Mus musculus
gacaagccttctactcatggaacca

SEQ ID NO: 640445 - DNA, 25 bp, Mus musculus
gacaagccttcttctcatggaacca

SEQ ID NO: 640446 - DNA, 25 bp, Mus musculus
gacaagcgagttcgtgtcatcgagc

SEQ ID NO: 640447 - DNA, 25 bp, Mus musculus
gacaagcgagttggtgtcatcgagc

SEQ ID NO: 640448 - DNA, 25 bp, Mus musculus
gacaagcggactaccttctacctgc

SEQ ID NO: 640449 - DNA, 25 bp, Mus musculus
gacaagcggacttccttctacctgc

SEQ ID NO: 640450 - DNA, 25 bp, Mus musculus
gacaagcgggtacagaaaaagaaga

SEQ ID NO: 640451 - DNA, 25 bp, Mus musculus
gacaagcgggtagagaaaaagaaga

SEQ ID NO: 640452 - DNA, 25 bp, Mus musculus
gacaagcgtggtaagctgcctcgct

SEQ ID NO: 640453 - DNA, 25 bp, Mus musculus
gacaagcgtggttagctgcctcgct

SEQ ID NO: 640454 - DNA, 25 bp, Mus musculus
gacaagctaaccatcttacgcatgg

SEQ ID NO: 640455 - DNA, 25 bp, Mus musculus
gacaagctaaccttcttacgcatgg

SEQ ID NO: 640456 - DNA, 25 bp, Mus musculus
gacaagctacagagcgactggcctt

SEQ ID NO: 640457 - DNA, 25 bp, Mus musculus
gacaagctacagtgcgactggcctt

SEQ ID NO: 640458 - DNA, 25 bp, Mus musculus
gacaagctctgacggcaaaacccat

SEQ ID NO: 640459 - DNA, 25 bp, Mus musculus
gacaagctctgagggcaaaacccat

SEQ ID NO: 640460 - DNA, 25 bp, Mus musculus
gacaagctcttgctgtactactacg

SEQ ID NO: 640461 - DNA, 25 bp, Mus musculus
gacaagctcttggtgtactactacg

SEQ ID NO: 640462 - DNA, 25 bp, Mus musculus
gacaagctgaacaacataatgcgcc

SEQ ID NO: 640463 - DNA, 25 bp, Mus musculus
gacaagctgaactacataatgcgcc

SEQ ID NO: 640464 - DNA, 25 bp, Mus musculus
gacaagctgaccagataggacctaa

SEQ ID NO: 640465 - DNA, 25 bp, Mus musculus
gacaagctgacctgataggacctaa

SEQ ID NO: 640466 - DNA, 25 bp, Mus musculus
gacaagctgcagacactcatggagc

SEQ ID NO: 640467 - DNA, 25 bp, Mus musculus
gacaagctgcagtcactcatggagc

SEQ ID NO: 640468 - DNA, 25 bp, Mus musculus
gacaagctggatagtgttcacacca

SEQ ID NO: 640469 - DNA, 25 bp, Mus musculus
gacaagctggatcaggcaagctcca

SEQ ID NO: 640470 - DNA, 25 bp, Mus musculus
gacaagctggatgaggcaagctcca

SEQ ID NO: 640471 - DNA, 25 bp, Mus musculus
gacaagctggattgtgttcacacca

SEQ ID NO: 640472 - DNA, 25 bp, Mus musculus
gacaagctggcacagatacgtgacg

SEQ ID NO: 640473 - DNA, 25 bp, Mus musculus
gacaagctggcagagatacgtgacg

SEQ ID NO: 640474 - DNA, 25 bp, Mus musculus
gacaagctgggacgtgtgatcctgg

SEQ ID NO: 640475 - DNA, 25 bp, Mus musculus
gacaagctgggaggtgtgatcctgg

SEQ ID NO: 640476 - DNA, 25 bp, Mus musculus
gacaagctgtcgcaaagctgatgaa

SEQ ID NO: 640477 - DNA, 25 bp, Mus musculus
gacaagctgtcggaaagctgatgaa

SEQ ID NO: 640478 - DNA, 25 bp, Mus musculus
gacaagctgtctatgctactcccca

SEQ ID NO: 640479 - DNA, 25 bp, Mus musculus
gacaagctgtctttgctactcccca

SEQ ID NO: 640480 - DNA, 25 bp, Mus musculus
gacaagctgtgcatgattctgggaa

SEQ ID NO: 640481 - DNA, 25 bp, Mus musculus
gacaagctgtgcttgattctgggaa

SEQ ID NO: 640482 - DNA, 25 bp, Mus musculus
gacaagcttagtcgtgaatatgaga

SEQ ID NO: 640483 - DNA, 25 bp, Mus musculus
gacaagcttagtggtgaatatgaga

SEQ ID NO: 640484 - DNA, 25 bp, Mus musculus
gacaagcttataccaggatctgaga

SEQ ID NO: 640485 - DNA, 25 bp, Mus musculus
gacaagcttatagcaggatctgaga

SEQ ID NO: 640486 - DNA, 25 bp, Mus musculus
gacaagcttctgaatttcaccgagg

SEQ ID NO: 640487 - DNA, 25 bp, Mus musculus
gacaagcttctgtatttcaccgagg

SEQ ID NO: 640488 - DNA, 25 bp, Mus musculus
gacaaggaaaagcaggtcaccacca

SEQ ID NO: 640489 - DNA, 25 bp, Mus musculus
gacaaggaaaaggaggtcaccacca

SEQ ID NO: 640490 - DNA, 25 bp, Mus musculus
gacaaggaagacctggttattctct

SEQ ID NO: 640491 - DNA, 25 bp, Mus musculus
gacaaggaagacctgtgaagtctct

SEQ ID NO: 640492 - DNA, 25 bp, Mus musculus
gacaaggaagacgtggttattctct

SEQ ID NO: 640493 - DNA, 25 bp, Mus musculus
gacaaggaagacgtgtgaagtctct

SEQ ID NO: 640494 - DNA, 25 bp, Mus musculus
gacaaggaagagaagtgccttcctc

SEQ ID NO: 640495 - DNA, 25 bp, Mus musculus
gacaaggaagagtagtgccttcctc

SEQ ID NO: 640496 - DNA, 25 bp, Mus musculus
gacaaggaagatccacttatctgct

SEQ ID NO: 640497 - DNA, 25 bp, Mus musculus
gacaaggaagatgcacttatctgct

SEQ ID NO: 640498 - DNA, 25 bp, Mus musculus
gacaaggacatgatcagccattcgg

SEQ ID NO: 640499 - DNA, 25 bp, Mus musculus
gacaaggacatgcacgactggctgt

SEQ ID NO: 640500 - DNA, 25 bp, Mus musculus
gacaaggacatggacgactggctgt

SEQ ID NO: 640501 - DNA, 25 bp, Mus musculus
gacaaggacatgttcagccattcgg

SEQ ID NO: 640502 - DNA, 25 bp, Mus musculus
gacaaggacattcgacaaagcaagc

SEQ ID NO: 640503 - DNA, 25 bp, Mus musculus
gacaaggacattggacaaagcaagc

SEQ ID NO: 640504 - DNA, 25 bp, Mus musculus
gacaaggaccacattcttcatcagt

SEQ ID NO: 640505 - DNA, 25 bp, Mus musculus
gacaaggaccactttcttcatcagt

SEQ ID NO: 640506 - DNA, 25 bp, Mus musculus
gacaaggagacaaatcacgatggtg

SEQ ID NO: 640507 - DNA, 25 bp, Mus musculus
gacaaggagacatatcacgatggtg

SEQ ID NO: 640508 - DNA, 25 bp, Mus musculus
gacaaggagacccatgaggagctct

SEQ ID NO: 640509 - DNA, 25 bp, Mus musculus
gacaaggagaccgatgaggagctct

SEQ ID NO: 640510 - DNA, 25 bp, Mus musculus
gacaaggagactaacgaacttcgtt

SEQ ID NO: 640511 - DNA, 25 bp, Mus musculus
gacaaggagactctgatcaacccag

SEQ ID NO: 640512 - DNA, 25 bp, Mus musculus
gacaaggagactgtgatcaacccag

SEQ ID NO: 640513 - DNA, 25 bp, Mus musculus
gacaaggagacttacgaacttcgtt

SEQ ID NO: 640514 - DNA, 25 bp, Mus musculus
gacaaggatcatccaggaatttgaa

SEQ ID NO: 640515 - DNA, 25 bp, Mus musculus
gacaaggatcatgcaggaatttgaa

SEQ ID NO: 640516 - DNA, 25 bp, Mus musculus
gacaaggatcgaaaagcgaatcatc

SEQ ID NO: 640517 - DNA, 25 bp, Mus musculus
gacaaggatcgataagcgaatcatc

SEQ ID NO: 640518 - DNA, 25 bp, Mus musculus
gacaaggcccaactagcagaaagca

SEQ ID NO: 640519 - DNA, 25 bp, Mus musculus
gacaaggcccaagtagcagaaagca

SEQ ID NO: 640520 - DNA, 25 bp, Mus musculus
gacaaggcccctctggtgaaggcta

SEQ ID NO: 640521 - DNA, 25 bp, Mus musculus
gacaaggcccctgtggtgaaggcta

SEQ ID NO: 640522 - DNA, 25 bp, Mus musculus
gacaaggccgttctcttcacctacg

SEQ ID NO: 640523 - DNA, 25 bp, Mus musculus
gacaaggccgttgtcttcacctacg

SEQ ID NO: 640524 - DNA, 25 bp, Mus musculus
gacaaggcctgcctatgagagctct

SEQ ID NO: 640525 - DNA, 25 bp, Mus musculus
gacaaggcctgcgtatgagagctct

SEQ ID NO: 640526 - DNA, 25 bp, Mus musculus
gacaaggcggcacccgagcgctcta

SEQ ID NO: 640527 - DNA, 25 bp, Mus musculus
gacaaggcggcagccgagcgctcta

SEQ ID NO: 640528 - DNA, 25 bp, Mus musculus
gacaaggctgctctgtagatctgaa

SEQ ID NO: 640529 - DNA, 25 bp, Mus musculus
gacaaggctgctgtgtagatctgaa

SEQ ID NO: 640530 - DNA, 25 bp, Mus musculus
gacaaggctgtcaccatgcagcagg

SEQ ID NO: 640531 - DNA, 25 bp, Mus musculus
gacaaggctgtctccatgcagcagg

SEQ ID NO: 640532 - DNA, 25 bp, Mus musculus
gacaagggattaactcagccaaacc

SEQ ID NO: 640533 - DNA, 25 bp, Mus musculus
gacaagggattatctcagccaaacc

SEQ ID NO: 640534 - DNA, 25 bp, Mus musculus
gacaagggcaacaacacctgcatcg

SEQ ID NO: 640535 - DNA, 25 bp, Mus musculus
gacaagggcaactacacctgcatcg

SEQ ID NO: 640536 - DNA, 25 bp, Mus musculus
gacaagggcgacaccaaggaaacgc

SEQ ID NO: 640537 - DNA, 25 bp, Mus musculus
gacaagggcgactccaaggaaacgc

SEQ ID NO: 640538 - DNA, 25 bp, Mus musculus
gacaagggtcaacctctgtgctctc

SEQ ID NO: 640539 - DNA, 25 bp, Mus musculus
gacaagggtcaagctctgtgctctc

SEQ ID NO: 640540 - DNA, 25 bp, Mus musculus
gacaaggtacgcatggatcctccct

SEQ ID NO: 640541 - DNA, 25 bp, Mus musculus
gacaaggtacgcttggatcctccct

SEQ ID NO: 640542 - DNA, 25 bp, Mus musculus
gacaaggtagagagggacaaattat

SEQ ID NO: 640543 - DNA, 25 bp, Mus musculus
gacaaggtagagtgggacaaattat

SEQ ID NO: 640544 - DNA, 25 bp, Mus musculus
gacaaggtgttcctggccacagacg

SEQ ID NO: 640545 - DNA, 25 bp, Mus musculus
gacaaggtgttcgtggccacagacg

SEQ ID NO: 640546 - DNA, 25 bp, Mus musculus
gacaagtaaccacggacaggcctga

SEQ ID NO: 640547 - DNA, 25 bp, Mus musculus
gacaagtaaccagggacaggcctga

SEQ ID NO: 640548 - DNA, 25 bp, Mus musculus
gacaagtacagactgcaactttggg

SEQ ID NO: 640549 - DNA, 25 bp, Mus musculus
gacaagtacagagtgcaactttggg

SEQ ID NO: 640550 - DNA, 25 bp, Mus musculus
gacaagtacagtcttgggaccaggc

SEQ ID NO: 640551 - DNA, 25 bp, Mus musculus
gacaagtacagtgttgggaccaggc

SEQ ID NO: 640552 - DNA, 25 bp, Mus musculus
gacaagtaccagatgctaataaaag

SEQ ID NO: 640553 - DNA, 25 bp, Mus musculus
gacaagtaccagttgctaataaaag

SEQ ID NO: 640554 - DNA, 25 bp, Mus musculus
gacaagtaccatcggaaaaccattc

SEQ ID NO: 640555 - DNA, 25 bp, Mus musculus
gacaagtaccatgggaaaaccattc

SEQ ID NO: 640556 - DNA, 25 bp, Mus musculus
gacaagtactcgctgctgttgccca

SEQ ID NO: 640557 - DNA, 25 bp, Mus musculus
gacaagtactcggtgctgttgccca

SEQ ID NO: 640558 - DNA, 25 bp, Mus musculus
gacaagtactgcctccagaaaagcc

SEQ ID NO: 640559 - DNA, 25 bp, Mus musculus
gacaagtactgcgtccagaaaagcc

SEQ ID NO: 640560 - DNA, 25 bp, Mus musculus
gacaagtacttcatgatcggtggga

SEQ ID NO: 640561 - DNA, 25 bp, Mus musculus
gacaagtacttcttgatcggtggga

SEQ ID NO: 640562 - DNA, 25 bp, Mus musculus
gacaagtataagacgctgcggcaaa

SEQ ID NO: 640563 - DNA, 25 bp, Mus musculus
gacaagtataagtcgctgcggcaaa

SEQ ID NO: 640564 - DNA, 25 bp, Mus musculus
gacaagtatcacaccgtgtgccgcc

SEQ ID NO: 640565 - DNA, 25 bp, Mus musculus
gacaagtatcactccgtgtgccgcc

SEQ ID NO: 640566 - DNA, 25 bp, Mus musculus
gacaagtattcgcaagctttaaagg

SEQ ID NO: 640567 - DNA, 25 bp, Mus musculus
gacaagtattcggaagctttaaagg

SEQ ID NO: 640568 - DNA, 25 bp, Mus musculus
gacaagtcaaatcaactcacaggta

SEQ ID NO: 640569 - DNA, 25 bp, Mus musculus
gacaagtcaaatgaactcacaggta

SEQ ID NO: 640570 - DNA, 25 bp, Mus musculus
gacaagtcacttctgaaccatgccc

SEQ ID NO: 640571 - DNA, 25 bp, Mus musculus
gacaagtcacttgtgaaccatgccc

SEQ ID NO: 640572 - DNA, 25 bp, Mus musculus
gacaagtcatgacataagtttagaa

SEQ ID NO: 640573 - DNA, 25 bp, Mus musculus
gacaagtcatgagataagtttagaa

SEQ ID NO: 640574 - DNA, 25 bp, Mus musculus
gacaagtccatcaccgtgcaggagc

SEQ ID NO: 640575 - DNA, 25 bp, Mus musculus
gacaagtccatctccgtgcaggagc

SEQ ID NO: 640576 - DNA, 25 bp, Mus musculus
gacaagtcccacacagcagcttggt

SEQ ID NO: 640577 - DNA, 25 bp, Mus musculus
gacaagtcccactcagcagcttggt

SEQ ID NO: 640578 - DNA, 25 bp, Mus musculus
gacaagtcctctcccttcaggttct

SEQ ID NO: 640579 - DNA, 25 bp, Mus musculus
gacaagtcctctgccttcaggttct

SEQ ID NO: 640580 - DNA, 25 bp, Mus musculus
gacaagtctcagctaggaagacacg

SEQ ID NO: 640581 - DNA, 25 bp, Mus musculus
gacaagtctcaggtaggaagacacg

SEQ ID NO: 640582 - DNA, 25 bp, Mus musculus
gacaagtctcctaggaaagccggta

SEQ ID NO: 640583 - DNA, 25 bp, Mus musculus
gacaagtctccttggaaagccggta

SEQ ID NO: 640584 - DNA, 25 bp, Mus musculus
gacaagtctctcagacggccgtgaa

SEQ ID NO: 640585 - DNA, 25 bp, Mus musculus
gacaagtctctctgacggccgtgaa

SEQ ID NO: 640586 - DNA, 25 bp, Mus musculus
gacaagtgagaaagtcaggtccaca

SEQ ID NO: 640587 - DNA, 25 bp, Mus musculus
gacaagtgagaatgtcaggtccaca

SEQ ID NO: 640588 - DNA, 25 bp, Mus musculus
gacaagtgcctcacaccagagctgc

SEQ ID NO: 640589 - DNA, 25 bp, Mus musculus
gacaagtgcctctcaccagagctgc

SEQ ID NO: 640590 - DNA, 25 bp, Mus musculus
gacaagtgctgaaccctatagaaga

SEQ ID NO: 640591 - DNA, 25 bp, Mus musculus
gacaagtgctgatccctatagaaga

SEQ ID NO: 640592 - DNA, 25 bp, Mus musculus
gacaagtgctttccacagagccaga

SEQ ID NO: 640593 - DNA, 25 bp, Mus musculus
gacaagtgctttgcacagagccaga

SEQ ID NO: 640594 - DNA, 25 bp, Mus musculus
gacaagtggactatcacagctgtga

SEQ ID NO: 640595 - DNA, 25 bp, Mus musculus
gacaagtggactttcacagctgtga

SEQ ID NO: 640596 - DNA, 25 bp, Mus musculus
gacaagtggatcaggctgaagtgaa

SEQ ID NO: 640597 - DNA, 25 bp, Mus musculus
gacaagtggatctggctgaagtgaa

SEQ ID NO: 640598 - DNA, 25 bp, Mus musculus
gacaagtgtaaccaaaagtgtccac

SEQ ID NO: 640599 - DNA, 25 bp, Mus musculus
gacaagtgtaacgaaaagtgtccac

SEQ ID NO: 640600 - DNA, 25 bp, Mus musculus
gacaagtgtatacggacagggtctc

SEQ ID NO: 640601 - DNA, 25 bp, Mus musculus
gacaagtgtatagggacagggtctc

SEQ ID NO: 640602 - DNA, 25 bp, Mus musculus
gacaagtgtcctcgctctaggagcc

SEQ ID NO: 640603 - DNA, 25 bp, Mus musculus
gacaagtgtcctggctctaggagcc

SEQ ID NO: 640604 - DNA, 25 bp, Mus musculus
gacaagttatttctacaagggtcct

SEQ ID NO: 640605 - DNA, 25 bp, Mus musculus
gacaagttatttgtacaagggtcct

SEQ ID NO: 640606 - DNA, 25 bp, Mus musculus
gacaagttcatgattgagctggacg

SEQ ID NO: 640607 - DNA, 25 bp, Mus musculus
gacaagttcatgtttgagctggacg

SEQ ID NO: 640608 - DNA, 25 bp, Mus musculus
gacaagttccagcttctcctggcag

SEQ ID NO: 640609 - DNA, 25 bp, Mus musculus
gacaagttccaggttctcctggcag

SEQ ID NO: 640610 - DNA, 25 bp, Mus musculus
gacaagttcgctcgccgtgtggcct

SEQ ID NO: 640611 - DNA, 25 bp, Mus musculus
gacaagttcgctggccgtgtggcct

SEQ ID NO: 640612 - DNA, 25 bp, Mus musculus
gacaagttctcaaatatttctgaag

SEQ ID NO: 640613 - DNA, 25 bp, Mus musculus
gacaagttctcatatatttctgaag

SEQ ID NO: 640614 - DNA, 25 bp, Mus musculus
gacaagttggatacacaaggcaaat

SEQ ID NO: 640615 - DNA, 25 bp, Mus musculus
gacaagttggattcacaaggcaaat

SEQ ID NO: 640616 - DNA, 25 bp, Mus musculus
gacaagttgtacaggagaatgtatc

SEQ ID NO: 640617 - DNA, 25 bp, Mus musculus
gacaagttgtactggagaatgtatc

SEQ ID NO: 640618 - DNA, 25 bp, Mus musculus
gacaagtttgttcttggatatgccc

SEQ ID NO: 640619 - DNA, 25 bp, Mus musculus
gacaagtttgttgttggatatgccc

SEQ ID NO: 640620 - DNA, 25 bp, Mus musculus
gacaataaagcactatatgatacgt

SEQ ID NO: 640621 - DNA, 25 bp, Mus musculus
gacaataaagcagtatatgatacgt

SEQ ID NO: 640622 - DNA, 25 bp, Mus musculus
gacaataacacaaggaataataccc

SEQ ID NO: 640623 - DNA, 25 bp, Mus musculus
gacaataacacatggaataataccc

SEQ ID NO: 640624 - DNA, 25 bp, Mus musculus
gacaataccaaaccagccctcaaag

SEQ ID NO: 640625 - DNA, 25 bp, Mus musculus
gacaataccaaagcagccctcaaag

SEQ ID NO: 640626 - DNA, 25 bp, Mus musculus
gacaataccaacatcccagctgcga

SEQ ID NO: 640627 - DNA, 25 bp, Mus musculus
gacaataccaacttcccagctgcga

SEQ ID NO: 640628 - DNA, 25 bp, Mus musculus
gacaatacgggaaacaggccagggt

SEQ ID NO: 640629 - DNA, 25 bp, Mus musculus
gacaatacgggatacaggccagggt

SEQ ID NO: 640630 - DNA, 25 bp, Mus musculus
gacaatactctcatcaagtggatga

SEQ ID NO: 640631 - DNA, 25 bp, Mus musculus
gacaatactctcttcaagtggatga

SEQ ID NO: 640632 - DNA, 25 bp, Mus musculus
gacaatagcatcaagacctttggag

SEQ ID NO: 640633 - DNA, 25 bp, Mus musculus
gacaatagcatctagacctttggag

SEQ ID NO: 640634 - DNA, 25 bp, Mus musculus
gacaatagtacccttgagcgaggac

SEQ ID NO: 640635 - DNA, 25 bp, Mus musculus
gacaatagtaccgttgagcgaggac

SEQ ID NO: 640636 - DNA, 25 bp, Mus musculus
gacaatagtccaagaaagtgagaga

SEQ ID NO: 640637 - DNA, 25 bp, Mus musculus
gacaatagtccatgaaagtgagaga

SEQ ID NO: 640638 - DNA, 25 bp, Mus musculus
gacaatataattactggaggcttgg

SEQ ID NO: 640639 - DNA, 25 bp, Mus musculus
gacaatataatttctggaggcttgg

SEQ ID NO: 640640 - DNA, 25 bp, Mus musculus
gacaatatacatagccgattgctga

SEQ ID NO: 640641 - DNA, 25 bp, Mus musculus
gacaatatacattgccgattgctga

SEQ ID NO: 640642 - DNA, 25 bp, Mus musculus
gacaatatcacaagttggaagcctg

SEQ ID NO: 640643 - DNA, 25 bp, Mus musculus
gacaatatcacatgttggaagcctg

SEQ ID NO: 640644 - DNA, 25 bp, Mus musculus
gacaatatcacgcagtctcctttcc

SEQ ID NO: 640645 - DNA, 25 bp, Mus musculus
gacaatatcacggagtctcctttcc

SEQ ID NO: 640646 - DNA, 25 bp, Mus musculus
gacaatatccggactgtcgtaagag

SEQ ID NO: 640647 - DNA, 25 bp, Mus musculus
gacaatatccggtctgtcgtaagag

SEQ ID NO: 640648 - DNA, 25 bp, Mus musculus
gacaatcaacatctaggactgggca

SEQ ID NO: 640649 - DNA, 25 bp, Mus musculus
gacaatcaacatgtaggactgggca

SEQ ID NO: 640650 - DNA, 25 bp, Mus musculus
gacaatcactgccagcgtccaggct

SEQ ID NO: 640651 - DNA, 25 bp, Mus musculus
gacaatcactgcgagcgtccaggct

SEQ ID NO: 640652 - DNA, 25 bp, Mus musculus
gacaatcagatacttaccagttctg

SEQ ID NO: 640653 - DNA, 25 bp, Mus musculus
gacaatcagatagttaccagttctg

SEQ ID NO: 640654 - DNA, 25 bp, Mus musculus
gacaatcaggtaatgcattacgctg

SEQ ID NO: 640655 - DNA, 25 bp, Mus musculus
gacaatcaggtattgcattacgctg

SEQ ID NO: 640656 - DNA, 25 bp, Mus musculus
gacaatcagttaacatcacttcctt

SEQ ID NO: 640657 - DNA, 25 bp, Mus musculus
gacaatcagttatcatcacttcctt

SEQ ID NO: 640658 - DNA, 25 bp, Mus musculus
gacaatccaaagaaatgccagcagg

SEQ ID NO: 640659 - DNA, 25 bp, Mus musculus
gacaatccaaagtaatgccagcagg

SEQ ID NO: 640660 - DNA, 25 bp, Mus musculus
gacaatcccgctcaagactggtgga

SEQ ID NO: 640661 - DNA, 25 bp, Mus musculus
gacaatcccgctgaagactggtgga

SEQ ID NO: 640662 - DNA, 25 bp, Mus musculus
gacaatccctttcccaagaatgccg

SEQ ID NO: 640663 - DNA, 25 bp, Mus musculus
gacaatccctttgccaagaatgccg

SEQ ID NO: 640664 - DNA, 25 bp, Mus musculus
gacaatccgtatagcttttccagga

SEQ ID NO: 640665 - DNA, 25 bp, Mus musculus
gacaatccgtattgcttttccagga

SEQ ID NO: 640666 - DNA, 25 bp, Mus musculus
gacaatcctcagaccttactttttt

SEQ ID NO: 640667 - DNA, 25 bp, Mus musculus
gacaatcctcagtccttactttttt

SEQ ID NO: 640668 - DNA, 25 bp, Mus musculus
gacaatcgtcaccaagaatgggcag

SEQ ID NO: 640669 - DNA, 25 bp, Mus musculus
gacaatcgtcacgaagaatgggcag

SEQ ID NO: 640670 - DNA, 25 bp, Mus musculus
gacaatctctggagggatgctttca

SEQ ID NO: 640671 - DNA, 25 bp, Mus musculus
gacaatctctggtgggatgctttca

SEQ ID NO: 640672 - DNA, 25 bp, Mus musculus
gacaatctttcactgcactttgagc

SEQ ID NO: 640673 - DNA, 25 bp, Mus musculus
gacaatctttcagtgcactttgagc

SEQ ID NO: 640674 - DNA, 25 bp, Mus musculus
gacaatgaaagtcggtttcccaaga

SEQ ID NO: 640675 - DNA, 25 bp, Mus musculus
gacaatgaaagtgggtttcccaaga

SEQ ID NO: 640676 - DNA, 25 bp, Mus musculus
gacaatgaatatctagaggcctcaa

SEQ ID NO: 640677 - DNA, 25 bp, Mus musculus
gacaatgaatatgtagaggcctcaa

SEQ ID NO: 640678 - DNA, 25 bp, Mus musculus
gacaatgaccaaagtgacactggag

SEQ ID NO: 640679 - DNA, 25 bp, Mus musculus
gacaatgaccaatgtgacactggag

SEQ ID NO: 640680 - DNA, 25 bp, Mus musculus
gacaatgacctgatccagcgagggt

SEQ ID NO: 640681 - DNA, 25 bp, Mus musculus
gacaatgacctgttccagcgagggt

SEQ ID NO: 640682 - DNA, 25 bp, Mus musculus
gacaatgactacatcacttgcataa

SEQ ID NO: 640683 - DNA, 25 bp, Mus musculus
gacaatgactacttcacttgcataa

SEQ ID NO: 640684 - DNA, 25 bp, Mus musculus
gacaatgactgtccagaacctgttt

SEQ ID NO: 640685 - DNA, 25 bp, Mus musculus
gacaatgactgtgcagaacctgttt

SEQ ID NO: 640686 - DNA, 25 bp, Mus musculus
gacaatgagctcatggactacgaag

SEQ ID NO: 640687 - DNA, 25 bp, Mus musculus
gacaatgagctcttggactacgaag

SEQ ID NO: 640688 - DNA, 25 bp, Mus musculus
gacaatgagcttcagcaagcattat

SEQ ID NO: 640689 - DNA, 25 bp, Mus musculus
gacaatgagcttgagcaagcattat

SEQ ID NO: 640690 - DNA, 25 bp, Mus musculus
gacaatgaggaccatggaagcgacc

SEQ ID NO: 640691 - DNA, 25 bp, Mus musculus
gacaatgaggacgatggaagcgacc

SEQ ID NO: 640692 - DNA, 25 bp, Mus musculus
gacaatgatgctcaagtggatgcca

SEQ ID NO: 640693 - DNA, 25 bp, Mus musculus
gacaatgatgctgaagtggatgcca

SEQ ID NO: 640694 - DNA, 25 bp, Mus musculus
gacaatgatgtcagggagcagagaa

SEQ ID NO: 640695 - DNA, 25 bp, Mus musculus
gacaatgatgtctgggagcagagaa

SEQ ID NO: 640696 - DNA, 25 bp, Mus musculus
gacaatgcacctacctgctaccata

SEQ ID NO: 640697 - DNA, 25 bp, Mus musculus
gacaatgcaccttcctgctaccata

SEQ ID NO: 640698 - DNA, 25 bp, Mus musculus
gacaatgcagcaactcttgctgtgc

SEQ ID NO: 640699 - DNA, 25 bp, Mus musculus
gacaatgcagcatctcttgctgtgc

SEQ ID NO: 640700 - DNA, 25 bp, Mus musculus
gacaatgcagttcatcagccaccga

SEQ ID NO: 640701 - DNA, 25 bp, Mus musculus
gacaatgcagttgatcagccaccga

SEQ ID NO: 640702 - DNA, 25 bp, Mus musculus
gacaatgcctttaaagatccaggag

SEQ ID NO: 640703 - DNA, 25 bp, Mus musculus
gacaatgccttttaagatccaggag

SEQ ID NO: 640704 - DNA, 25 bp, Mus musculus
gacaatgcgttgctgctagatgccc

SEQ ID NO: 640705 - DNA, 25 bp, Mus musculus
gacaatgcgttggtgctagatgccc

SEQ ID NO: 640706 - DNA, 25 bp, Mus musculus
gacaatgctaacagtccaagtctac

SEQ ID NO: 640707 - DNA, 25 bp, Mus musculus
gacaatgctaactgtccaagtctac

SEQ ID NO: 640708 - DNA, 25 bp, Mus musculus
gacaatgctctgcaagacctcatgg

SEQ ID NO: 640709 - DNA, 25 bp, Mus musculus
gacaatgctctggaagacctcatgg

SEQ ID NO: 640710 - DNA, 25 bp, Mus musculus
gacaatgctgctatcaccctgtatg

SEQ ID NO: 640711 - DNA, 25 bp, Mus musculus
gacaatgctgctttcaccctgtatg

SEQ ID NO: 640712 - DNA, 25 bp, Mus musculus
gacaatgctggacttttctcctaca

SEQ ID NO: 640713 - DNA, 25 bp, Mus musculus
gacaatgctggagttttctcctaca

SEQ ID NO: 640714 - DNA, 25 bp, Mus musculus
gacaatggaaatcaagatttagcag

SEQ ID NO: 640715 - DNA, 25 bp, Mus musculus
gacaatggaaatgaagatttagcag

SEQ ID NO: 640716 - DNA, 25 bp, Mus musculus
gacaatggaaccctagcagtggcct

SEQ ID NO: 640717 - DNA, 25 bp, Mus musculus
gacaatggaaccgtagcagtggcct

SEQ ID NO: 640718 - DNA, 25 bp, Mus musculus
gacaatggagaaagtctagacctga

SEQ ID NO: 640719 - DNA, 25 bp, Mus musculus
gacaatggagaatgtctagacctga

SEQ ID NO: 640720 - DNA, 25 bp, Mus musculus
gacaatggagctcaagtccaccaac

SEQ ID NO: 640721 - DNA, 25 bp, Mus musculus
gacaatggagctgaagtccaccaac

SEQ ID NO: 640722 - DNA, 25 bp, Mus musculus
gacaatggcaccaacgagtgctccg

SEQ ID NO: 640723 - DNA, 25 bp, Mus musculus
gacaatggcacctacgagtgctccg

SEQ ID NO: 640724 - DNA, 25 bp, Mus musculus
gacaatggcgtcattgctctgcgac

SEQ ID NO: 640725 - DNA, 25 bp, Mus musculus
gacaatggcgtctttgctctgcgac

SEQ ID NO: 640726 - DNA, 25 bp, Mus musculus
gacaatggctacaataccgttaagt

SEQ ID NO: 640727 - DNA, 25 bp, Mus musculus
gacaatggctactataccgttaagt

SEQ ID NO: 640728 - DNA, 25 bp, Mus musculus
gacaatggctggctgcctgtctttg

SEQ ID NO: 640729 - DNA, 25 bp, Mus musculus
gacaatggctgggtgcctgtctttg

SEQ ID NO: 640730 - DNA, 25 bp, Mus musculus
gacaatgggataagctgcatcgatg

SEQ ID NO: 640731 - DNA, 25 bp, Mus musculus
gacaatgggatatgctgcatcgatg

SEQ ID NO: 640732 - DNA, 25 bp, Mus musculus
gacaatgggtccacgtcctgcagct

SEQ ID NO: 640733 - DNA, 25 bp, Mus musculus
gacaatgggtcctcgtcctgcagct

SEQ ID NO: 640734 - DNA, 25 bp, Mus musculus
gacaatgtagacaacaagctggcgt

SEQ ID NO: 640735 - DNA, 25 bp, Mus musculus
gacaatgtagactacaagctggcgt

SEQ ID NO: 640736 - DNA, 25 bp, Mus musculus
gacaatgtcattctcccgggaaccc

SEQ ID NO: 640737 - DNA, 25 bp, Mus musculus
gacaatgtcattgtcccgggaaccc

SEQ ID NO: 640738 - DNA, 25 bp, Mus musculus
gacaatgtccgaagagaacttctgg

SEQ ID NO: 640739 - DNA, 25 bp, Mus musculus
gacaatgtccgatgagaacttctgg

SEQ ID NO: 640740 - DNA, 25 bp, Mus musculus
gacaatgtgagaagtgtcacccagg

SEQ ID NO: 640741 - DNA, 25 bp, Mus musculus
gacaatgtgagatgtgtcacccagg

SEQ ID NO: 640742 - DNA, 25 bp, Mus musculus
gacaatgtgccacatattgatgaca

SEQ ID NO: 640743 - DNA, 25 bp, Mus musculus
gacaatgtgccagatattgatgaca

SEQ ID NO: 640744 - DNA, 25 bp, Mus musculus
gacaatgtggcaaatatcctggcga

SEQ ID NO: 640745 - DNA, 25 bp, Mus musculus
gacaatgtggcatatatcctggcga

SEQ ID NO: 640746 - DNA, 25 bp, Mus musculus
gacaatgtgtgtattccctgagagc

SEQ ID NO: 640747 - DNA, 25 bp, Mus musculus
gacaatgtgtgttttccctgagagc

SEQ ID NO: 640748 - DNA, 25 bp, Mus musculus
gacaatgttgatccagcgttcgccc

SEQ ID NO: 640749 - DNA, 25 bp, Mus musculus
gacaatgttgatgcagcgttcgccc

SEQ ID NO: 640750 - DNA, 25 bp, Mus musculus
gacaattaactgaaacaatgcgttt

SEQ ID NO: 640751 - DNA, 25 bp, Mus musculus
gacaattaactgtaacaatgcgttt

SEQ ID NO: 640752 - DNA, 25 bp, Mus musculus
gacaattaatcactgaagctgcctc

SEQ ID NO: 640753 - DNA, 25 bp, Mus musculus
gacaattaatcagtgaagctgcctc

SEQ ID NO: 640754 - DNA, 25 bp, Mus musculus
gacaattacagccttgccaccctga

SEQ ID NO: 640755 - DNA, 25 bp, Mus musculus
gacaattacagcgttgccaccctga

SEQ ID NO: 640756 - DNA, 25 bp, Mus musculus
gacaattatgagatgcacgttcgag

SEQ ID NO: 640757 - DNA, 25 bp, Mus musculus
gacaattatgagttgcacgttcgag

SEQ ID NO: 640758 - DNA, 25 bp, Mus musculus
gacaattcaaacagcggcatgccag

SEQ ID NO: 640759 - DNA, 25 bp, Mus musculus
gacaattcaaactgcggcatgccag

SEQ ID NO: 640760 - DNA, 25 bp, Mus musculus
gacaattccttactggaggccacaa

SEQ ID NO: 640761 - DNA, 25 bp, Mus musculus
gacaattccttagtggaggccacaa

SEQ ID NO: 640762 - DNA, 25 bp, Mus musculus
gacaattctatgacctcaaggagct

SEQ ID NO: 640763 - DNA, 25 bp, Mus musculus
gacaattctatgtcctcaaggagct

SEQ ID NO: 640764 - DNA, 25 bp, Mus musculus
gacaattgaacacaagaaggcgtat

SEQ ID NO: 640765 - DNA, 25 bp, Mus musculus
gacaattgaacagaagaaggcgtat

SEQ ID NO: 640766 - DNA, 25 bp, Mus musculus
gacaattgcccgctggttcgaaacc

SEQ ID NO: 640767 - DNA, 25 bp, Mus musculus
gacaattgcccggtggttcgaaacc

SEQ ID NO: 640768 - DNA, 25 bp, Mus musculus
gacaattggcctccaagaccgagag

SEQ ID NO: 640769 - DNA, 25 bp, Mus musculus
gacaattggcctgcaagaccgagag

SEQ ID NO: 640770 - DNA, 25 bp, Mus musculus
gacaattgggtcaagcaggatgctt

SEQ ID NO: 640771 - DNA, 25 bp, Mus musculus
gacaattgggtctagcaggatgctt

SEQ ID NO: 640772 - DNA, 25 bp, Mus musculus
gacaatttctagattcgtcaatcct

SEQ ID NO: 640773 - DNA, 25 bp, Mus musculus
gacaatttctagtttcgtcaatcct

SEQ ID NO: 640774 - DNA, 25 bp, Mus musculus
gacaatttgctacagtaatgggcct

SEQ ID NO: 640775 - DNA, 25 bp, Mus musculus
gacaatttgctagagtaatgggcct

SEQ ID NO: 640776 - DNA, 25 bp, Mus musculus
gacaatttttccctccgcagactgg

SEQ ID NO: 640777 - DNA, 25 bp, Mus musculus
gacaatttttccgtccgcagactgg

SEQ ID NO: 640778 - DNA, 25 bp, Mus musculus
gacaatttttgcaccaccaaacatt

SEQ ID NO: 640779 - DNA, 25 bp, Mus musculus
gacaatttttgctccaccaaacatt

SEQ ID NO: 640780 - DNA, 25 bp, Mus musculus
gacacaaacttcactcggaagctca

SEQ ID NO: 640781 - DNA, 25 bp, Mus musculus
gacacaaacttctctcggaagctca

SEQ ID NO: 640782 - DNA, 25 bp, Mus musculus
gacacaaatcttcaatcaagtataa

SEQ ID NO: 640783 - DNA, 25 bp, Mus musculus
gacacaaatcttgaatcaagtataa

SEQ ID NO: 640784 - DNA, 25 bp, Mus musculus
gacacaacaccgctattaaatggat

SEQ ID NO: 640785 - DNA, 25 bp, Mus musculus
gacacaacaccggtattaaatggat

SEQ ID NO: 640786 - DNA, 25 bp, Mus musculus
gacacaacctctcatagtggcccta

SEQ ID NO: 640787 - DNA, 25 bp, Mus musculus
gacacaacctctgatagtggcccta

SEQ ID NO: 640788 - DNA, 25 bp, Mus musculus
gacacaacctgcagctggtcagtga

SEQ ID NO: 640789 - DNA, 25 bp, Mus musculus
gacacaacctgctgctggtcagtga

SEQ ID NO: 640790 - DNA, 25 bp, Mus musculus
gacacaagcacacggttagaagaag

SEQ ID NO: 640791 - DNA, 25 bp, Mus musculus
gacacaagcacagggttagaagaag

SEQ ID NO: 640792 - DNA, 25 bp, Mus musculus
gacacaaggaagaactcaactaagg

SEQ ID NO: 640793 - DNA, 25 bp, Mus musculus
gacacaaggaagtactcaactaagg

SEQ ID NO: 640794 - DNA, 25 bp, Mus musculus
gacacaaggtgcactccaaagaagg

SEQ ID NO: 640795 - DNA, 25 bp, Mus musculus
gacacaaggtgctctccaaagaagg

SEQ ID NO: 640796 - DNA, 25 bp, Mus musculus
gacacaagtcagaacgtgtgcgcag

SEQ ID NO: 640797 - DNA, 25 bp, Mus musculus
gacacaagtcagtacgtgtgcgcag

SEQ ID NO: 640798 - DNA, 25 bp, Mus musculus
gacacaagtgtcagattgcaggctg

SEQ ID NO: 640799 - DNA, 25 bp, Mus musculus
gacacaagtgtctgattgcaggctg

SEQ ID NO: 640800 - DNA, 25 bp, Mus musculus
gacacaatacagaagattttaccct

SEQ ID NO: 640801 - DNA, 25 bp, Mus musculus
gacacaatacagtagattttaccct

SEQ ID NO: 640802 - DNA, 25 bp, Mus musculus
gacacaatagagcttcgggagtctc

SEQ ID NO: 640803 - DNA, 25 bp, Mus musculus
gacacaatagaggttcgggagtctc

SEQ ID NO: 640804 - DNA, 25 bp, Mus musculus
gacacaatagccattgtgaaggaca

SEQ ID NO: 640805 - DNA, 25 bp, Mus musculus
gacacaatagcctttgtgaaggaca

SEQ ID NO: 640806 - DNA, 25 bp, Mus musculus
gacacaatgcacactcgcctgaggt

SEQ ID NO: 640807 - DNA, 25 bp, Mus musculus
gacacaatgcactctcgcctgaggt

SEQ ID NO: 640808 - DNA, 25 bp, Mus musculus
gacacaatgcagaaaaacttttgaa

SEQ ID NO: 640809 - DNA, 25 bp, Mus musculus
gacacaatgcagtaaaacttttgaa

SEQ ID NO: 640810 - DNA, 25 bp, Mus musculus
gacacaatggaaaatgggactctct

SEQ ID NO: 640811 - DNA, 25 bp, Mus musculus
gacacaatggaatatgggactctct

SEQ ID NO: 640812 - DNA, 25 bp, Mus musculus
gacacacaaaacactccaaattcca

SEQ ID NO: 640813 - DNA, 25 bp, Mus musculus
gacacacaaaactctccaaattcca

SEQ ID NO: 640814 - DNA, 25 bp, Mus musculus
gacacacaacagacctcctacaagg

SEQ ID NO: 640815 - DNA, 25 bp, Mus musculus
gacacacaacagtcctcctacaagg

SEQ ID NO: 640816 - DNA, 25 bp, Mus musculus
gacacacacaaaatatttggctttg

SEQ ID NO: 640817 - DNA, 25 bp, Mus musculus
gacacacacaaattatttggctttg

SEQ ID NO: 640818 - DNA, 25 bp, Mus musculus
gacacacactggatggtgctgcatg

SEQ ID NO: 640819 - DNA, 25 bp, Mus musculus
gacacacactggttggtgctgcatg

SEQ ID NO: 640820 - DNA, 25 bp, Mus musculus
gacacacagaacaccaactagaaga

SEQ ID NO: 640821 - DNA, 25 bp, Mus musculus
gacacacagaactccaactagaaga

SEQ ID NO: 640822 - DNA, 25 bp, Mus musculus
gacacacagcacctgattctgaatg

SEQ ID NO: 640823 - DNA, 25 bp, Mus musculus
gacacacagcacgtgattctgaatg

SEQ ID NO: 640824 - DNA, 25 bp, Mus musculus
gacacacagcagctccggaaatagc

SEQ ID NO: 640825 - DNA, 25 bp, Mus musculus
gacacacagcaggtccggaaatagc

SEQ ID NO: 640826 - DNA, 25 bp, Mus musculus
gacacacaggatcttaagtcctaac

SEQ ID NO: 640827 - DNA, 25 bp, Mus musculus
gacacacaggatgttaagtcctaac

SEQ ID NO: 640828 - DNA, 25 bp, Mus musculus
gacacacagtgcaagcgtgtaggga

SEQ ID NO: 640829 - DNA, 25 bp, Mus musculus
gacacacagtgctagcgtgtaggga

SEQ ID NO: 640830 - DNA, 25 bp, Mus musculus
gacacacatcgaaggcaagggatac

SEQ ID NO: 640831 - DNA, 25 bp, Mus musculus
gacacacatcgatggcaagggatac

SEQ ID NO: 640832 - DNA, 25 bp, Mus musculus
gacacacattttctttaaatggtct

SEQ ID NO: 640833 - DNA, 25 bp, Mus musculus
gacacacattttgtttaaatggtct

SEQ ID NO: 640834 - DNA, 25 bp, Mus musculus
gacacaccaatgagaagatcttctc

SEQ ID NO: 640835 - DNA, 25 bp, Mus musculus
gacacaccaatgtgaagatcttctc

SEQ ID NO: 640836 - DNA, 25 bp, Mus musculus
gacacaccagtcatgcatgttcttg

SEQ ID NO: 640837 - DNA, 25 bp, Mus musculus
gacacaccagtcttgcatgttcttg

SEQ ID NO: 640838 - DNA, 25 bp, Mus musculus
gacacaccccatcagactgggtctg

SEQ ID NO: 640839 - DNA, 25 bp, Mus musculus
gacacaccccatgagactgggtctg

SEQ ID NO: 640840 - DNA, 25 bp, Mus musculus
gacacacccgcacaaataaagacag

SEQ ID NO: 640841 - DNA, 25 bp, Mus musculus
gacacacccgcagaaataaagacag

SEQ ID NO: 640842 - DNA, 25 bp, Mus musculus
gacacacccgtcagcttattggctg

SEQ ID NO: 640843 - DNA, 25 bp, Mus musculus
gacacacccgtctgcttattggctg

SEQ ID NO: 640844 - DNA, 25 bp, Mus musculus
gacacaccgactcaacagaggcagc

SEQ ID NO: 640845 - DNA, 25 bp, Mus musculus
gacacaccgactgaacagaggcagc

SEQ ID NO: 640846 - DNA, 25 bp, Mus musculus
gacacaccgattctgatcatcaaac

SEQ ID NO: 640847 - DNA, 25 bp, Mus musculus
gacacaccgattgtgatcatcaaac

SEQ ID NO: 640848 - DNA, 25 bp, Mus musculus
gacacacgactgatctctggcagaa

SEQ ID NO: 640849 - DNA, 25 bp, Mus musculus
gacacacgactgttctctggcagaa

SEQ ID NO: 640850 - DNA, 25 bp, Mus musculus
gacacacgggctctagtggctgact

SEQ ID NO: 640851 - DNA, 25 bp, Mus musculus
gacacacgggctgtagtggctgact

SEQ ID NO: 640852 - DNA, 25 bp, Mus musculus
gacacacggtatacctcgtgcatga

SEQ ID NO: 640853 - DNA, 25 bp, Mus musculus
gacacacggtattcctcgtgcatga

SEQ ID NO: 640854 - DNA, 25 bp, Mus musculus
gacacacgtgtaattcctgcagcag

SEQ ID NO: 640855 - DNA, 25 bp, Mus musculus
gacacacgtgtatttcctgcagcag

SEQ ID NO: 640856 - DNA, 25 bp, Mus musculus
gacacactatgtcgcacgtccgcgg

SEQ ID NO: 640857 - DNA, 25 bp, Mus musculus
gacacactatgtggcacgtccgcgg

SEQ ID NO: 640858 - DNA, 25 bp, Mus musculus
gacacactatttactgccaccagat

SEQ ID NO: 640859 - DNA, 25 bp, Mus musculus
gacacactattttctgccaccagat

SEQ ID NO: 640860 - DNA, 25 bp, Mus musculus
gacacactgaatctgggcttgccgt

SEQ ID NO: 640861 - DNA, 25 bp, Mus musculus
gacacactgaatgtgggcttgccgt

SEQ ID NO: 640862 - DNA, 25 bp, Mus musculus
gacacactggaacggcttagggaac

SEQ ID NO: 640863 - DNA, 25 bp, Mus musculus
gacacactggaagggcttagggaac

SEQ ID NO: 640864 - DNA, 25 bp, Mus musculus
gacacactggagaccacttgccatg

SEQ ID NO: 640865 - DNA, 25 bp, Mus musculus
gacacactggagtccacttgccatg

SEQ ID NO: 640866 - DNA, 25 bp, Mus musculus
gacacactgtccactcatttaacct

SEQ ID NO: 640867 - DNA, 25 bp, Mus musculus
gacacactgtcctctcatttaacct

SEQ ID NO: 640868 - DNA, 25 bp, Mus musculus
gacacacttataaacaaggcagggt

SEQ ID NO: 640869 - DNA, 25 bp, Mus musculus
gacacacttatatacaaggcagggt

SEQ ID NO: 640870 - DNA, 25 bp, Mus musculus
gacacacttggtacagcggctgttc

SEQ ID NO: 640871 - DNA, 25 bp, Mus musculus
gacacacttggttcagcggctgttc

SEQ ID NO: 640872 - DNA, 25 bp, Mus musculus
gacacacttgtactccaggattttg

SEQ ID NO: 640873 - DNA, 25 bp, Mus musculus
gacacacttgtagtccaggattttg

SEQ ID NO: 640874 - DNA, 25 bp, Mus musculus
gacacagaacaacccagctcgaaaa

SEQ ID NO: 640875 - DNA, 25 bp, Mus musculus
gacacagaacaagccagctcgaaaa

SEQ ID NO: 640876 - DNA, 25 bp, Mus musculus
gacacagaagttcggaaattcaaat

SEQ ID NO: 640877 - DNA, 25 bp, Mus musculus
gacacagaagttgggaaattcaaat

SEQ ID NO: 640878 - DNA, 25 bp, Mus musculus
gacacagacatgaaccacagagcac

SEQ ID NO: 640879 - DNA, 25 bp, Mus musculus
gacacagacatgtaccacagagcac

SEQ ID NO: 640880 - DNA, 25 bp, Mus musculus
gacacagagatactatggacttaca

SEQ ID NO: 640881 - DNA, 25 bp, Mus musculus
gacacagagatagtatggacttaca

SEQ ID NO: 640882 - DNA, 25 bp, Mus musculus
gacacagagatgagattcagacgct

SEQ ID NO: 640883 - DNA, 25 bp, Mus musculus
gacacagagatgctcctggtagaca

SEQ ID NO: 640884 - DNA, 25 bp, Mus musculus
gacacagagatggtcctggtagaca

SEQ ID NO: 640885 - DNA, 25 bp, Mus musculus
gacacagagatgtgattcagacgct

SEQ ID NO: 640886 - DNA, 25 bp, Mus musculus
gacacagaggacagtttctctacca

SEQ ID NO: 640887 - DNA, 25 bp, Mus musculus
gacacagaggactgtttctctacca

SEQ ID NO: 640888 - DNA, 25 bp, Mus musculus
gacacagaggagctctttcgaagct

SEQ ID NO: 640889 - DNA, 25 bp, Mus musculus
gacacagaggaggtctttcgaagct

SEQ ID NO: 640890 - DNA, 25 bp, Mus musculus
gacacagagggccttgtaggcctca

SEQ ID NO: 640891 - DNA, 25 bp, Mus musculus
gacacagagggcgttgtaggcctca

SEQ ID NO: 640892 - DNA, 25 bp, Mus musculus
gacacagagtgtccatggtctcctg

SEQ ID NO: 640893 - DNA, 25 bp, Mus musculus
gacacagagtgtgcatggtctcctg

SEQ ID NO: 640894 - DNA, 25 bp, Mus musculus
gacacagatagcaccgaagacgttg

SEQ ID NO: 640895 - DNA, 25 bp, Mus musculus
gacacagatagccaagaagagatcc

SEQ ID NO: 640896 - DNA, 25 bp, Mus musculus
gacacagatagcgaagaagagatcc

SEQ ID NO: 640897 - DNA, 25 bp, Mus musculus
gacacagatagctccgaagacgttg

SEQ ID NO: 640898 - DNA, 25 bp, Mus musculus
gacacagatgggagactcagaagag

SEQ ID NO: 640899 - DNA, 25 bp, Mus musculus
gacacagatgggtgactcagaagag

SEQ ID NO: 640900 - DNA, 25 bp, Mus musculus
gacacagatgtgctgtctgtacact

SEQ ID NO: 640901 - DNA, 25 bp, Mus musculus
gacacagatgtggtgtctgtacact

SEQ ID NO: 640902 - DNA, 25 bp, Mus musculus
gacacagcaccgatggatggaagca

SEQ ID NO: 640903 - DNA, 25 bp, Mus musculus
gacacagcaccgttggatggaagca

SEQ ID NO: 640904 - DNA, 25 bp, Mus musculus
gacacagcactgatgtggatccttg

SEQ ID NO: 640905 - DNA, 25 bp, Mus musculus
gacacagcactgttgtggatccttg

SEQ ID NO: 640906 - DNA, 25 bp, Mus musculus
gacacagcagagaaatccgagtgtg

SEQ ID NO: 640907 - DNA, 25 bp, Mus musculus
gacacagcagagtaatccgagtgtg

SEQ ID NO: 640908 - DNA, 25 bp, Mus musculus
gacacagcaggtaccgagcgctacg

SEQ ID NO: 640909 - DNA, 25 bp, Mus musculus
gacacagcaggttccgagcgctacg

SEQ ID NO: 640910 - DNA, 25 bp, Mus musculus
gacacagcagttcggtattcaggaa

SEQ ID NO: 640911 - DNA, 25 bp, Mus musculus
gacacagcagttgggtattcaggaa

SEQ ID NO: 640912 - DNA, 25 bp, Mus musculus
gacacagccaagaatgacaacagag

SEQ ID NO: 640913 - DNA, 25 bp, Mus musculus
gacacagccaagtatgacaacagag

SEQ ID NO: 640914 - DNA, 25 bp, Mus musculus
gacacagccaatcgaccaagattta

SEQ ID NO: 640915 - DNA, 25 bp, Mus musculus
gacacagccaatggaccaagattta

SEQ ID NO: 640916 - DNA, 25 bp, Mus musculus
gacacagcccacatatctgcactga

SEQ ID NO: 640917 - DNA, 25 bp, Mus musculus
gacacagcccacttatctgcactga

SEQ ID NO: 640918 - DNA, 25 bp, Mus musculus
gacacagcccatcgtggtcacaata

SEQ ID NO: 640919 - DNA, 25 bp, Mus musculus
gacacagcccatggtggtcacaata

SEQ ID NO: 640920 - DNA, 25 bp, Mus musculus
gacacagccccacaagtaggacagt

SEQ ID NO: 640921 - DNA, 25 bp, Mus musculus
gacacagccccagaagtaggacagt

SEQ ID NO: 640922 - DNA, 25 bp, Mus musculus
gacacagcgcttctgtaggacacac

SEQ ID NO: 640923 - DNA, 25 bp, Mus musculus
gacacagcgcttgtgtaggacacac

SEQ ID NO: 640924 - DNA, 25 bp, Mus musculus
gacacagctcaaaactataccatat

SEQ ID NO: 640925 - DNA, 25 bp, Mus musculus
gacacagctcaatactataccatat

SEQ ID NO: 640926 - DNA, 25 bp, Mus musculus
gacacagctgagaatgttgcctatg

SEQ ID NO: 640927 - DNA, 25 bp, Mus musculus
gacacagctgagtatgttgcctatg

SEQ ID NO: 640928 - DNA, 25 bp, Mus musculus
gacacagctgatcaggtcatcgcct

SEQ ID NO: 640929 - DNA, 25 bp, Mus musculus
gacacagctgatgaggtcatcgcct

SEQ ID NO: 640930 - DNA, 25 bp, Mus musculus
gacacagctgcccaaaagctgaagg

SEQ ID NO: 640931 - DNA, 25 bp, Mus musculus
gacacagctgccgaaaagctgaagg

SEQ ID NO: 640932 - DNA, 25 bp, Mus musculus
gacacagctgctacgagccatagaa

SEQ ID NO: 640933 - DNA, 25 bp, Mus musculus
gacacagctgcttcgagccatagaa

SEQ ID NO: 640934 - DNA, 25 bp, Mus musculus
gacacaggacagctgtttgctcatc

SEQ ID NO: 640935 - DNA, 25 bp, Mus musculus
gacacaggacaggtgtttgctcatc

SEQ ID NO: 640936 - DNA, 25 bp, Mus musculus
gacacaggagaaatgcagcaaggag

SEQ ID NO: 640937 - DNA, 25 bp, Mus musculus
gacacaggagaattgcagcaaggag

SEQ ID NO: 640938 - DNA, 25 bp, Mus musculus
gacacaggcaagagtaggcacatac

SEQ ID NO: 640939 - DNA, 25 bp, Mus musculus
gacacaggcaagctgccagtcaaat

SEQ ID NO: 640940 - DNA, 25 bp, Mus musculus
gacacaggcaaggtgccagtcaaat

SEQ ID NO: 640941 - DNA, 25 bp, Mus musculus
gacacaggcaagtgtaggcacatac

SEQ ID NO: 640942 - DNA, 25 bp, Mus musculus
gacacaggcaggatggcattgaact

SEQ ID NO: 640943 - DNA, 25 bp, Mus musculus
gacacaggcaggttggcattgaact

SEQ ID NO: 640944 - DNA, 25 bp, Mus musculus
gacacaggccagaaatgctccgaga

SEQ ID NO: 640945 - DNA, 25 bp, Mus musculus
gacacaggccagtaatgctccgaga

SEQ ID NO: 640946 - DNA, 25 bp, Mus musculus
gacacaggccctatccttcaggaag

SEQ ID NO: 640947 - DNA, 25 bp, Mus musculus
gacacaggccctttccttcaggaag

SEQ ID NO: 640948 - DNA, 25 bp, Mus musculus
gacacaggcgctcctgctacaatgg

SEQ ID NO: 640949 - DNA, 25 bp, Mus musculus
gacacaggcgctgctgctacaatgg

SEQ ID NO: 640950 - DNA, 25 bp, Mus musculus
gacacaggctgtcgagggtgagatc

SEQ ID NO: 640951 - DNA, 25 bp, Mus musculus
gacacaggctgtggagggtgagatc

SEQ ID NO: 640952 - DNA, 25 bp, Mus musculus
gacacagggaacatgagctggcact

SEQ ID NO: 640953 - DNA, 25 bp, Mus musculus
gacacagggaacttgagctggcact

SEQ ID NO: 640954 - DNA, 25 bp, Mus musculus
gacacagggcatctgtacgcaatga

SEQ ID NO: 640955 - DNA, 25 bp, Mus musculus
gacacagggcatgtgtacgcaatga

SEQ ID NO: 640956 - DNA, 25 bp, Mus musculus
gacacagggtttccgtaggcttcac

SEQ ID NO: 640957 - DNA, 25 bp, Mus musculus
gacacagggtttgcgtaggcttcac

SEQ ID NO: 640958 - DNA, 25 bp, Mus musculus
gacacaggtgtgatcagtagcaaga

SEQ ID NO: 640959 - DNA, 25 bp, Mus musculus
gacacaggtgtgttcagtagcaaga

SEQ ID NO: 640960 - DNA, 25 bp, Mus musculus
gacacagtagccattaggcagagct

SEQ ID NO: 640961 - DNA, 25 bp, Mus musculus
gacacagtagcctttaggcagagct

SEQ ID NO: 640962 - DNA, 25 bp, Mus musculus
gacacagtcatcatacctatcaaaa

SEQ ID NO: 640963 - DNA, 25 bp, Mus musculus
gacacagtcatcttacctatcaaaa

SEQ ID NO: 640964 - DNA, 25 bp, Mus musculus
gacacagtctacaccagtccctggt

SEQ ID NO: 640965 - DNA, 25 bp, Mus musculus
gacacagtctactccagtccctggt

SEQ ID NO: 640966 - DNA, 25 bp, Mus musculus
gacacagtcttcaaccgtttcctga

SEQ ID NO: 640967 - DNA, 25 bp, Mus musculus
gacacagtcttctaccgtttcctga

SEQ ID NO: 640968 - DNA, 25 bp, Mus musculus
gacacagtgatgatgtcaagtgttt

SEQ ID NO: 640969 - DNA, 25 bp, Mus musculus
gacacagtgatgttgtcaagtgttt

SEQ ID NO: 640970 - DNA, 25 bp, Mus musculus
gacacagtgcagaagtattcctacc

SEQ ID NO: 640971 - DNA, 25 bp, Mus musculus
gacacagtgcagtagtattcctacc

SEQ ID NO: 640972 - DNA, 25 bp, Mus musculus
gacacagtgctgattgggcctcctc

SEQ ID NO: 640973 - DNA, 25 bp, Mus musculus
gacacagtgctgcaaaagaataaag

SEQ ID NO: 640974 - DNA, 25 bp, Mus musculus
gacacagtgctggaaaagaataaag

SEQ ID NO: 640975 - DNA, 25 bp, Mus musculus
gacacagtgctgtttgggcctcctc

SEQ ID NO: 640976 - DNA, 25 bp, Mus musculus
gacacagtgggaagccaagaatggc

SEQ ID NO: 640977 - DNA, 25 bp, Mus musculus
gacacagtgggatgccaagaatggc

SEQ ID NO: 640978 - DNA, 25 bp, Mus musculus
gacacagtgttcagccataggctaa

SEQ ID NO: 640979 - DNA, 25 bp, Mus musculus
gacacagtgttctgccataggctaa

SEQ ID NO: 640980 - DNA, 25 bp, Mus musculus
gacacagttgaacgtcttgttctca

SEQ ID NO: 640981 - DNA, 25 bp, Mus musculus
gacacagttgaaggtcttgttctca

SEQ ID NO: 640982 - DNA, 25 bp, Mus musculus
gacacatacaagctgccaaagttaa

SEQ ID NO: 640983 - DNA, 25 bp, Mus musculus
gacacatacaaggtgccaaagttaa

SEQ ID NO: 640984 - DNA, 25 bp, Mus musculus
gacacatataccagcttctcaacag

SEQ ID NO: 640985 - DNA, 25 bp, Mus musculus
gacacatatacctgcttctcaacag

SEQ ID NO: 640986 - DNA, 25 bp, Mus musculus
gacacatatgagaatctgcacaaga

SEQ ID NO: 640987 - DNA, 25 bp, Mus musculus
gacacatatgagtatctgcacaaga

SEQ ID NO: 640988 - DNA, 25 bp, Mus musculus
gacacatatgtcaacggcaagaaag

SEQ ID NO: 640989 - DNA, 25 bp, Mus musculus
gacacatatgtctacggcaagaaag

SEQ ID NO: 640990 - DNA, 25 bp, Mus musculus
gacacatcagtaccctatgtccggg

SEQ ID NO: 640991 - DNA, 25 bp, Mus musculus
gacacatcagtagcctatgtccggg

SEQ ID NO: 640992 - DNA, 25 bp, Mus musculus
gacacatcatccatgttctttctgg

SEQ ID NO: 640993 - DNA, 25 bp, Mus musculus
gacacatcatccttgttctttctgg

SEQ ID NO: 640994 - DNA, 25 bp, Mus musculus
gacacatcccctcgaaggtgatcgg

SEQ ID NO: 640995 - DNA, 25 bp, Mus musculus
gacacatcccctggaaggtgatcgg

SEQ ID NO: 640996 - DNA, 25 bp, Mus musculus
gacacatcctatagcactcttctca

SEQ ID NO: 640997 - DNA, 25 bp, Mus musculus
gacacatcctattgcactcttctca

SEQ ID NO: 640998 - DNA, 25 bp, Mus musculus
gacacatccttcatgttccagcgag

SEQ ID NO: 640999 - DNA, 25 bp, Mus musculus
gacacatccttcttgttccagcgag

SEQ ID NO: 641000 - DNA, 25 bp, Mus musculus
gacacatcgatgataaggtcttcct

SEQ ID NO: 641001 - DNA, 25 bp, Mus musculus
gacacatcgatgttaaggtcttcct

SEQ ID NO: 641002 - DNA, 25 bp, Mus musculus
gacacatcgcagatcttgcaggcaa

SEQ ID NO: 641003 - DNA, 25 bp, Mus musculus
gacacatcgcagttcttgcaggcaa

SEQ ID NO: 641004 - DNA, 25 bp, Mus musculus
gacacatctaggctgagggagttat

SEQ ID NO: 641005 - DNA, 25 bp, Mus musculus
gacacatctagggtgagggagttat

SEQ ID NO: 641006 - DNA, 25 bp, Mus musculus
gacacatctcgacaaacgtttgcaa

SEQ ID NO: 641007 - DNA, 25 bp, Mus musculus
gacacatctcgagaaacgtttgcaa

SEQ ID NO: 641008 - DNA, 25 bp, Mus musculus
gacacatcttacctgtttatcactg

SEQ ID NO: 641009 - DNA, 25 bp, Mus musculus
gacacatcttacgtgtttatcactg

SEQ ID NO: 641010 - DNA, 25 bp, Mus musculus
gacacatgacatcgaagcagtggac

SEQ ID NO: 641011 - DNA, 25 bp, Mus musculus
gacacatgacatggaagcagtggac

SEQ ID NO: 641012 - DNA, 25 bp, Mus musculus
gacacatgccctctagctaagcact

SEQ ID NO: 641013 - DNA, 25 bp, Mus musculus
gacacatgccctgtagctaagcact

SEQ ID NO: 641014 - DNA, 25 bp, Mus musculus
gacacatggtgcatggggcaacctt

SEQ ID NO: 641015 - DNA, 25 bp, Mus musculus
gacacatggtgcttggggcaacctt

SEQ ID NO: 641016 - DNA, 25 bp, Mus musculus
gacacattaaggagaatgactacta

SEQ ID NO: 641017 - DNA, 25 bp, Mus musculus
gacacattaaggtgaatgactacta

SEQ ID NO: 641018 - DNA, 25 bp, Mus musculus
gacacattagacatggtctttcttg

SEQ ID NO: 641019 - DNA, 25 bp, Mus musculus
gacacattagacttggtctttcttg

SEQ ID NO: 641020 - DNA, 25 bp, Mus musculus
gacacattcagacatgaccttctca

SEQ ID NO: 641021 - DNA, 25 bp, Mus musculus
gacacattcagagatgaccttctca

SEQ ID NO: 641022 - DNA, 25 bp, Mus musculus
gacaccaaacaaccgcaggtcatcg

SEQ ID NO: 641023 - DNA, 25 bp, Mus musculus
gacaccaaacaagcgcaggtcatcg

SEQ ID NO: 641024 - DNA, 25 bp, Mus musculus
gacaccaaacccctacaaatgatga

SEQ ID NO: 641025 - DNA, 25 bp, Mus musculus
gacaccaaacccgtacaaatgatga

SEQ ID NO: 641026 - DNA, 25 bp, Mus musculus
gacaccaaagaacgatgagagcctt

SEQ ID NO: 641027 - DNA, 25 bp, Mus musculus
gacaccaaagaaggatgagagcctt

SEQ ID NO: 641028 - DNA, 25 bp, Mus musculus
gacaccaaagcacagtctccagcag

SEQ ID NO: 641029 - DNA, 25 bp, Mus musculus
gacaccaaagcagagtctccagcag

SEQ ID NO: 641030 - DNA, 25 bp, Mus musculus
gacaccaaaggcatcgagagcactg

SEQ ID NO: 641031 - DNA, 25 bp, Mus musculus
gacaccaaaggcttcgagagcactg

SEQ ID NO: 641032 - DNA, 25 bp, Mus musculus
gacaccaagagacgtcgccaagtga

SEQ ID NO: 641033 - DNA, 25 bp, Mus musculus
gacaccaagagaggtcgccaagtga

SEQ ID NO: 641034 - DNA, 25 bp, Mus musculus
gacaccaagcgacgagatgcttgtg

SEQ ID NO: 641035 - DNA, 25 bp, Mus musculus
gacaccaagcgaggagatgcttgtg

SEQ ID NO: 641036 - DNA, 25 bp, Mus musculus
gacaccaaggagatctacacgcact

SEQ ID NO: 641037 - DNA, 25 bp, Mus musculus
gacaccaaggagttctacacgcact

SEQ ID NO: 641038 - DNA, 25 bp, Mus musculus
gacaccaaggttccagggagtggcc

SEQ ID NO: 641039 - DNA, 25 bp, Mus musculus
gacaccaaggttgcagggagtggcc

SEQ ID NO: 641040 - DNA, 25 bp, Mus musculus
gacaccaagtcacaagctgatgtgg

SEQ ID NO: 641041 - DNA, 25 bp, Mus musculus
gacaccaagtcagaagctgatgtgg

SEQ ID NO: 641042 - DNA, 25 bp, Mus musculus
gacaccaagtttactgctgtgctgg

SEQ ID NO: 641043 - DNA, 25 bp, Mus musculus
gacaccaagttttctgctgtgctgg

SEQ ID NO: 641044 - DNA, 25 bp, Mus musculus
gacaccaatgccatagtagcagccg

SEQ ID NO: 641045 - DNA, 25 bp, Mus musculus
gacaccaatgccttagtagcagccg

SEQ ID NO: 641046 - DNA, 25 bp, Mus musculus
gacaccacactgctagacctgcaga

SEQ ID NO: 641047 - DNA, 25 bp, Mus musculus
gacaccacactggtagacctgcaga

SEQ ID NO: 641048 - DNA, 25 bp, Mus musculus
gacaccacagtaccagagagaaaga

SEQ ID NO: 641049 - DNA, 25 bp, Mus musculus
gacaccacagtagcagagagaaaga

SEQ ID NO: 641050 - DNA, 25 bp, Mus musculus
gacaccaccaagcagtgggactatt

SEQ ID NO: 641051 - DNA, 25 bp, Mus musculus
gacaccaccaaggagtgggactatt

SEQ ID NO: 641052 - DNA, 25 bp, Mus musculus
gacaccacggccagtggactttcct

SEQ ID NO: 641053 - DNA, 25 bp, Mus musculus
gacaccacggcctgtggactttcct

SEQ ID NO: 641054 - DNA, 25 bp, Mus musculus
gacaccacgggcatcagtctgcact

SEQ ID NO: 641055 - DNA, 25 bp, Mus musculus
gacaccacgggcttcagtctgcact

SEQ ID NO: 641056 - DNA, 25 bp, Mus musculus
gacaccactgcccatctaaagcaaa

SEQ ID NO: 641057 - DNA, 25 bp, Mus musculus
gacaccactgccgatctaaagcaaa

SEQ ID NO: 641058 - DNA, 25 bp, Mus musculus
gacaccagaactctctggagacctg

SEQ ID NO: 641059 - DNA, 25 bp, Mus musculus
gacaccagaactgtctggagacctg

SEQ ID NO: 641060 - DNA, 25 bp, Mus musculus
gacaccagactgcatgagctgcacc

SEQ ID NO: 641061 - DNA, 25 bp, Mus musculus
gacaccagactggatgagctgcacc

SEQ ID NO: 641062 - DNA, 25 bp, Mus musculus
gacaccagacttccttgcaagtcat

SEQ ID NO: 641063 - DNA, 25 bp, Mus musculus
gacaccagacttgcttgcaagtcat

SEQ ID NO: 641064 - DNA, 25 bp, Mus musculus
gacaccagagctaagtcctggaaaa

SEQ ID NO: 641065 - DNA, 25 bp, Mus musculus
gacaccagagcttagtcctggaaaa

SEQ ID NO: 641066 - DNA, 25 bp, Mus musculus
gacaccagcagaaaacaaggcggag

SEQ ID NO: 641067 - DNA, 25 bp, Mus musculus
gacaccagcagataacaaggcggag

SEQ ID NO: 641068 - DNA, 25 bp, Mus musculus
gacaccagcattccacagctttttg

SEQ ID NO: 641069 - DNA, 25 bp, Mus musculus
gacaccagcattgcacagctttttg

SEQ ID NO: 641070 - DNA, 25 bp, Mus musculus
gacaccagccataaacgtcagcgtg

SEQ ID NO: 641071 - DNA, 25 bp, Mus musculus
gacaccagccattaacgtcagcgtg

SEQ ID NO: 641072 - DNA, 25 bp, Mus musculus
gacaccaggtctactgaaagccata

SEQ ID NO: 641073 - DNA, 25 bp, Mus musculus
gacaccaggtcttctgaaagccata

SEQ ID NO: 641074 - DNA, 25 bp, Mus musculus
gacaccagttgaccagagaaatcct

SEQ ID NO: 641075 - DNA, 25 bp, Mus musculus
gacaccagttgacgtgcttctcatc

SEQ ID NO: 641076 - DNA, 25 bp, Mus musculus
gacaccagttgagcagagaaatcct

SEQ ID NO: 641077 - DNA, 25 bp, Mus musculus
gacaccagttgaggtgcttctcatc

SEQ ID NO: 641078 - DNA, 25 bp, Mus musculus
gacaccagtttgacttactggctga

SEQ ID NO: 641079 - DNA, 25 bp, Mus musculus
gacaccagtttgtcttactggctga

SEQ ID NO: 641080 - DNA, 25 bp, Mus musculus
gacaccatacccactgagattggaa

SEQ ID NO: 641081 - DNA, 25 bp, Mus musculus
gacaccataccctctgagattggaa

SEQ ID NO: 641082 - DNA, 25 bp, Mus musculus
gacaccatgatacctgtcctccaag

SEQ ID NO: 641083 - DNA, 25 bp, Mus musculus
gacaccatgatagctgtcctccaag

SEQ ID NO: 641084 - DNA, 25 bp, Mus musculus
gacaccatgatgagccttctgaaga

SEQ ID NO: 641085 - DNA, 25 bp, Mus musculus
gacaccatgatgtgccttctgaaga

SEQ ID NO: 641086 - DNA, 25 bp, Mus musculus
gacaccatgctaagtacctgaatgc

SEQ ID NO: 641087 - DNA, 25 bp, Mus musculus
gacaccatgctatgtacctgaatgc

SEQ ID NO: 641088 - DNA, 25 bp, Mus musculus
gacaccatgctgaggagtccacagc

SEQ ID NO: 641089 - DNA, 25 bp, Mus musculus
gacaccatgctgtggagtccacagc

SEQ ID NO: 641090 - DNA, 25 bp, Mus musculus
gacaccatggtcaagagataccacc

SEQ ID NO: 641091 - DNA, 25 bp, Mus musculus
gacaccatggtctagagataccacc

SEQ ID NO: 641092 - DNA, 25 bp, Mus musculus
gacaccatgtagagaagaggcactt

SEQ ID NO: 641093 - DNA, 25 bp, Mus musculus
gacaccatgtagtgaagaggcactt

SEQ ID NO: 641094 - DNA, 25 bp, Mus musculus
gacaccattcggagaatcatgttgg

SEQ ID NO: 641095 - DNA, 25 bp, Mus musculus
gacaccattcggtgaatcatgttgg

SEQ ID NO: 641096 - DNA, 25 bp, Mus musculus
gacaccattgatctcgtctcccatg

SEQ ID NO: 641097 - DNA, 25 bp, Mus musculus
gacaccattgatgtcgtctcccatg

SEQ ID NO: 641098 - DNA, 25 bp, Mus musculus
gacaccatttccatggagtcctgtg

SEQ ID NO: 641099 - DNA, 25 bp, Mus musculus
gacaccatttccttggagtcctgtg

SEQ ID NO: 641100 - DNA, 25 bp, Mus musculus
gacacccaaatgagcattctttata

SEQ ID NO: 641101 - DNA, 25 bp, Mus musculus
gacacccaaatgtgcattctttata

SEQ ID NO: 641102 - DNA, 25 bp, Mus musculus
gacacccaagagcttcagctttgat

SEQ ID NO: 641103 - DNA, 25 bp, Mus musculus
gacacccaagaggttcagctttgat

SEQ ID NO: 641104 - DNA, 25 bp, Mus musculus
gacacccacagtcctgtatgacgta

SEQ ID NO: 641105 - DNA, 25 bp, Mus musculus
gacacccacagtgctgtatgacgta

SEQ ID NO: 641106 - DNA, 25 bp, Mus musculus
gacacccaccaacatcaaggagctg

SEQ ID NO: 641107 - DNA, 25 bp, Mus musculus
gacacccaccaagatcaaggagctg

SEQ ID NO: 641108 - DNA, 25 bp, Mus musculus
gacacccagaaaacctaccagtggg

SEQ ID NO: 641109 - DNA, 25 bp, Mus musculus
gacacccagaaatcctaccagtggg

SEQ ID NO: 641110 - DNA, 25 bp, Mus musculus
gacacccagactagcgcgtcatgta

SEQ ID NO: 641111 - DNA, 25 bp, Mus musculus
gacacccagacttgcgcgtcatgta

SEQ ID NO: 641112 - DNA, 25 bp, Mus musculus
gacacccagatgattcagaatgcac

SEQ ID NO: 641113 - DNA, 25 bp, Mus musculus
gacacccagatgtttcagaatgcac

SEQ ID NO: 641114 - DNA, 25 bp, Mus musculus
gacacccagcaacgatagtaagact

SEQ ID NO: 641115 - DNA, 25 bp, Mus musculus
gacacccagcaaggatagtaagact

SEQ ID NO: 641116 - DNA, 25 bp, Mus musculus
gacacccagcatcaggtggaactat

SEQ ID NO: 641117 - DNA, 25 bp, Mus musculus
gacacccagcatcgatgtttccttc

SEQ ID NO: 641118 - DNA, 25 bp, Mus musculus
gacacccagcatgaggtggaactat

SEQ ID NO: 641119 - DNA, 25 bp, Mus musculus
gacacccagcatggatgtttccttc

SEQ ID NO: 641120 - DNA, 25 bp, Mus musculus
gacacccaggtcacactgtcacggt

SEQ ID NO: 641121 - DNA, 25 bp, Mus musculus
gacacccaggtctcactgtcacggt

SEQ ID NO: 641122 - DNA, 25 bp, Mus musculus
gacacccagtccaacgtgctgaact

SEQ ID NO: 641123 - DNA, 25 bp, Mus musculus
gacacccagtcctacgtgctgaact

SEQ ID NO: 641124 - DNA, 25 bp, Mus musculus
gacacccatcgaaagcttgttcatt

SEQ ID NO: 641125 - DNA, 25 bp, Mus musculus
gacacccatcgatagcttgttcatt

SEQ ID NO: 641126 - DNA, 25 bp, Mus musculus
gacacccattgcagttttatgccaa

SEQ ID NO: 641127 - DNA, 25 bp, Mus musculus
gacacccattgctgttttatgccaa

SEQ ID NO: 641128 - DNA, 25 bp, Mus musculus
gacaccccgaaccaggaggaccaag

SEQ ID NO: 641129 - DNA, 25 bp, Mus musculus
gacaccccgaacgaggaggaccaag

SEQ ID NO: 641130 - DNA, 25 bp, Mus musculus
gacacccctagacctagcctgtgaa

SEQ ID NO: 641131 - DNA, 25 bp, Mus musculus
gacacccctagagctagcctgtgaa

SEQ ID NO: 641132 - DNA, 25 bp, Mus musculus
gacacccgaatcactgaggccatgg

SEQ ID NO: 641133 - DNA, 25 bp, Mus musculus
gacacccgaatctctgaggccatgg

SEQ ID NO: 641134 - DNA, 25 bp, Mus musculus
gacacccgagctagtacaaaaggct

SEQ ID NO: 641135 - DNA, 25 bp, Mus musculus
gacacccgagcttgtacaaaaggct

SEQ ID NO: 641136 - DNA, 25 bp, Mus musculus
gacacccgatataatcaagaaacac

SEQ ID NO: 641137 - DNA, 25 bp, Mus musculus
gacacccgatattatcaagaaacac

SEQ ID NO: 641138 - DNA, 25 bp, Mus musculus
gacacccgatctatctcaagctgag

SEQ ID NO: 641139 - DNA, 25 bp, Mus musculus
gacacccgatctttctcaagctgag

SEQ ID NO: 641140 - DNA, 25 bp, Mus musculus
gacaccctagaactcaggaggcatg

SEQ ID NO: 641141 - DNA, 25 bp, Mus musculus
gacaccctagaagtcaggaggcatg

SEQ ID NO: 641142 - DNA, 25 bp, Mus musculus
gacaccctcatgaagtgcacctttg

SEQ ID NO: 641143 - DNA, 25 bp, Mus musculus
gacaccctcatgtagtgcacctttg

SEQ ID NO: 641144 - DNA, 25 bp, Mus musculus
gacaccctctctacaggaaatacat

SEQ ID NO: 641145 - DNA, 25 bp, Mus musculus
gacaccctctcttcaggaaatacat

SEQ ID NO: 641146 - DNA, 25 bp, Mus musculus
gacaccctgagtactggcgtgcact

SEQ ID NO: 641147 - DNA, 25 bp, Mus musculus
gacaccctgagttctggcgtgcact

SEQ ID NO: 641148 - DNA, 25 bp, Mus musculus
gacaccctggacaatcctgccatag

SEQ ID NO: 641149 - DNA, 25 bp, Mus musculus
gacaccctggactatcctgccatag

SEQ ID NO: 641150 - DNA, 25 bp, Mus musculus
gacaccctggagaggacaatgggtc

SEQ ID NO: 641151 - DNA, 25 bp, Mus musculus
gacaccctggagtggacaatgggtc

SEQ ID NO: 641152 - DNA, 25 bp, Mus musculus
gacaccctggctcaaggaagacgcc

SEQ ID NO: 641153 - DNA, 25 bp, Mus musculus
gacaccctggctgaaggaagacgcc

SEQ ID NO: 641154 - DNA, 25 bp, Mus musculus
gacacccttaacaatgtcaccgaag

SEQ ID NO: 641155 - DNA, 25 bp, Mus musculus
gacacccttaactatgtcaccgaag

SEQ ID NO: 641156 - DNA, 25 bp, Mus musculus
gacacccttagtctcccaaagtggg

SEQ ID NO: 641157 - DNA, 25 bp, Mus musculus
gacacccttagtgtcccaaagtggg

SEQ ID NO: 641158 - DNA, 25 bp, Mus musculus
gacacccttcacacaaagtccttat

SEQ ID NO: 641159 - DNA, 25 bp, Mus musculus
gacacccttcactcaaagtccttat

SEQ ID NO: 641160 - DNA, 25 bp, Mus musculus
gacaccgactttcaggagtcaggag

SEQ ID NO: 641161 - DNA, 25 bp, Mus musculus
gacaccgactttgaggagtcaggag

SEQ ID NO: 641162 - DNA, 25 bp, Mus musculus
gacaccgagttacctctttccttag

SEQ ID NO: 641163 - DNA, 25 bp, Mus musculus
gacaccgagttagctctttccttag

SEQ ID NO: 641164 - DNA, 25 bp, Mus musculus
gacaccgagtttccaggcgttgttg

SEQ ID NO: 641165 - DNA, 25 bp, Mus musculus
gacaccgagtttgcaggcgttgttg

SEQ ID NO: 641166 - DNA, 25 bp, Mus musculus
gacaccgatgttctcagctttgtgc

SEQ ID NO: 641167 - DNA, 25 bp, Mus musculus
gacaccgatgttgtcagctttgtgc

SEQ ID NO: 641168 - DNA, 25 bp, Mus musculus
gacaccgattatcgattggcaacct

SEQ ID NO: 641169 - DNA, 25 bp, Mus musculus
gacaccgattatggattggcaacct

SEQ ID NO: 641170 - DNA, 25 bp, Mus musculus
gacaccgcccagatacaaggcctgg

SEQ ID NO: 641171 - DNA, 25 bp, Mus musculus
gacaccgcccagttacaaggcctgg

SEQ ID NO: 641172 - DNA, 25 bp, Mus musculus
gacaccgccgacatataataaaacc

SEQ ID NO: 641173 - DNA, 25 bp, Mus musculus
gacaccgccgacttataataaaacc

SEQ ID NO: 641174 - DNA, 25 bp, Mus musculus
gacaccggaacgattagaatctatg

SEQ ID NO: 641175 - DNA, 25 bp, Mus musculus
gacaccggaacgtttagaatctatg

SEQ ID NO: 641176 - DNA, 25 bp, Mus musculus
gacaccggtgaaaacccagaggtgc

SEQ ID NO: 641177 - DNA, 25 bp, Mus musculus
gacaccggtgaatacccagaggtgc

SEQ ID NO: 641178 - DNA, 25 bp, Mus musculus
gacaccggtggtcatcgattacaca

SEQ ID NO: 641179 - DNA, 25 bp, Mus musculus
gacaccggtggtgatcgattacaca

SEQ ID NO: 641180 - DNA, 25 bp, Mus musculus
gacaccgtcaagcaactgtttcgcc

SEQ ID NO: 641181 - DNA, 25 bp, Mus musculus
gacaccgtcaaggaactgtttcgcc

SEQ ID NO: 641182 - DNA, 25 bp, Mus musculus
gacaccgtgcataaagcctgccgga

SEQ ID NO: 641183 - DNA, 25 bp, Mus musculus
gacaccgtgcattaagcctgccgga

SEQ ID NO: 641184 - DNA, 25 bp, Mus musculus
gacaccgtggagcaagctttctaca

SEQ ID NO: 641185 - DNA, 25 bp, Mus musculus
gacaccgtggaggaagctttctaca

SEQ ID NO: 641186 - DNA, 25 bp, Mus musculus
gacaccgtggtgaggaacgagatcc

SEQ ID NO: 641187 - DNA, 25 bp, Mus musculus
gacaccgtggtgtggaacgagatcc

SEQ ID NO: 641188 - DNA, 25 bp, Mus musculus
gacacctagaatcggaactcttcca

SEQ ID NO: 641189 - DNA, 25 bp, Mus musculus
gacacctagaatgggaactcttcca

SEQ ID NO: 641190 - DNA, 25 bp, Mus musculus
gacacctatgttcgctattgggacc

SEQ ID NO: 641191 - DNA, 25 bp, Mus musculus
gacacctatgttggctattgggacc

SEQ ID NO: 641192 - DNA, 25 bp, Mus musculus
gacacctccgttcaagacttccgag

SEQ ID NO: 641193 - DNA, 25 bp, Mus musculus
gacacctccgttgaagacttccgag

SEQ ID NO: 641194 - DNA, 25 bp, Mus musculus
gacacctcgactcccgagagctgaa

SEQ ID NO: 641195 - DNA, 25 bp, Mus musculus
gacacctcgactgccgagagctgaa

SEQ ID NO: 641196 - DNA, 25 bp, Mus musculus
gacacctcgatgaccttctgtgaga

SEQ ID NO: 641197 - DNA, 25 bp, Mus musculus
gacacctcgatgtccttctgtgaga

SEQ ID NO: 641198 - DNA, 25 bp, Mus musculus
gacacctctctgaagttccatggcc

SEQ ID NO: 641199 - DNA, 25 bp, Mus musculus
gacacctctctgtagttccatggcc

SEQ ID NO: 641200 - DNA, 25 bp, Mus musculus
gacacctgcctaactgagttttggg

SEQ ID NO: 641201 - DNA, 25 bp, Mus musculus
gacacctgcctatctgagttttggg

SEQ ID NO: 641202 - DNA, 25 bp, Mus musculus
gacacctgctgacccagtggactgg

SEQ ID NO: 641203 - DNA, 25 bp, Mus musculus
gacacctgctgagccagtggactgg

SEQ ID NO: 641204 - DNA, 25 bp, Mus musculus
gacacctggagcatgaaaccttctg

SEQ ID NO: 641205 - DNA, 25 bp, Mus musculus
gacacctggagcttgaaaccttctg

SEQ ID NO: 641206 - DNA, 25 bp, Mus musculus
gacacctggagtaggttaaatattt

SEQ ID NO: 641207 - DNA, 25 bp, Mus musculus
gacacctggagttggttaaatattt

SEQ ID NO: 641208 - DNA, 25 bp, Mus musculus
gacacctggcaaatggaatagacgt

SEQ ID NO: 641209 - DNA, 25 bp, Mus musculus
gacacctggcaattggaatagacgt

SEQ ID NO: 641210 - DNA, 25 bp, Mus musculus
gacacctggcatcggacactgacat

SEQ ID NO: 641211 - DNA, 25 bp, Mus musculus
gacacctggcatgggacactgacat

SEQ ID NO: 641212 - DNA, 25 bp, Mus musculus
gacacctggctgagacctaagacct

SEQ ID NO: 641213 - DNA, 25 bp, Mus musculus
gacacctggctgtgacctaagacct

SEQ ID NO: 641214 - DNA, 25 bp, Mus musculus
gacacctgggaaaaaatgctacatt

SEQ ID NO: 641215 - DNA, 25 bp, Mus musculus
gacacctgggaataaatgctacatt

SEQ ID NO: 641216 - DNA, 25 bp, Mus musculus
gacacctgggatcagagttctggca

SEQ ID NO: 641217 - DNA, 25 bp, Mus musculus
gacacctgggatgagagttctggca

SEQ ID NO: 641218 - DNA, 25 bp, Mus musculus
gacacctgtttgaccagtgaggctg

SEQ ID NO: 641219 - DNA, 25 bp, Mus musculus
gacacctgtttgtccagtgaggctg

SEQ ID NO: 641220 - DNA, 25 bp, Mus musculus
gacaccttagcactagtattcgaag

SEQ ID NO: 641221 - DNA, 25 bp, Mus musculus
gacaccttagcagtagtattcgaag

SEQ ID NO: 641222 - DNA, 25 bp, Mus musculus
gacaccttatggctcggtcactttt

SEQ ID NO: 641223 - DNA, 25 bp, Mus musculus
gacaccttatgggtcggtcactttt

SEQ ID NO: 641224 - DNA, 25 bp, Mus musculus
gacaccttcaatcagatgcagcctc

SEQ ID NO: 641225 - DNA, 25 bp, Mus musculus
gacaccttcaatgagatgcagcctc

SEQ ID NO: 641226 - DNA, 25 bp, Mus musculus
gacaccttccacatggaaggacgtg

SEQ ID NO: 641227 - DNA, 25 bp, Mus musculus
gacaccttccacttggaaggacgtg

SEQ ID NO: 641228 - DNA, 25 bp, Mus musculus
gacaccttctcacaggacttcaggg

SEQ ID NO: 641229 - DNA, 25 bp, Mus musculus
gacaccttctcagaggacttcaggg

SEQ ID NO: 641230 - DNA, 25 bp, Mus musculus
gacaccttctcccaagagtacacgg

SEQ ID NO: 641231 - DNA, 25 bp, Mus musculus
gacaccttctccgaagagtacacgg

SEQ ID NO: 641232 - DNA, 25 bp, Mus musculus
gacaccttctgacagcagagaggtg

SEQ ID NO: 641233 - DNA, 25 bp, Mus musculus
gacaccttctgaccatgaagaaaga

SEQ ID NO: 641234 - DNA, 25 bp, Mus musculus
gacaccttctgagagcagagaggtg

SEQ ID NO: 641235 - DNA, 25 bp, Mus musculus
gacaccttctgagcatgaagaaaga

SEQ ID NO: 641236 - DNA, 25 bp, Mus musculus
gacaccttcttgctggcctcctcgg

SEQ ID NO: 641237 - DNA, 25 bp, Mus musculus
gacaccttcttggtggcctcctcgg

SEQ ID NO: 641238 - DNA, 25 bp, Mus musculus
gacaccttgaaccatcatttgtatt

SEQ ID NO: 641239 - DNA, 25 bp, Mus musculus
gacaccttgaacgatcatttgtatt

SEQ ID NO: 641240 - DNA, 25 bp, Mus musculus
gacaccttggaactttcattcggaa

SEQ ID NO: 641241 - DNA, 25 bp, Mus musculus
gacaccttggaagtttcattcggaa

SEQ ID NO: 641242 - DNA, 25 bp, Mus musculus
gacacctttacaaggcatcctacag

SEQ ID NO: 641243 - DNA, 25 bp, Mus musculus
gacacctttacatggcatcctacag

SEQ ID NO: 641244 - DNA, 25 bp, Mus musculus
gacacctttggtcctgtcaagcaga

SEQ ID NO: 641245 - DNA, 25 bp, Mus musculus
gacacctttggtgctgtcaagcaga

SEQ ID NO: 641246 - DNA, 25 bp, Mus musculus
gacacgaaccttcctgaccagtgta

SEQ ID NO: 641247 - DNA, 25 bp, Mus musculus
gacacgaaccttgctgaccagtgta

SEQ ID NO: 641248 - DNA, 25 bp, Mus musculus
gacacgaaggaaccatccctgtttg

SEQ ID NO: 641249 - DNA, 25 bp, Mus musculus
gacacgaaggaagcatccctgtttg

SEQ ID NO: 641250 - DNA, 25 bp, Mus musculus
gacacgactttcagtgacccaaggt

SEQ ID NO: 641251 - DNA, 25 bp, Mus musculus
gacacgactttctgtgacccaaggt

SEQ ID NO: 641252 - DNA, 25 bp, Mus musculus
gacacgagattcagagagactcttg

SEQ ID NO: 641253 - DNA, 25 bp, Mus musculus
gacacgagattctgagagactcttg

SEQ ID NO: 641254 - DNA, 25 bp, Mus musculus
gacacgagctgtctcatcagtgcac

SEQ ID NO: 641255 - DNA, 25 bp, Mus musculus
gacacgagctgtgtcatcagtgcac

SEQ ID NO: 641256 - DNA, 25 bp, Mus musculus
gacacgagggacacggattattgct

SEQ ID NO: 641257 - DNA, 25 bp, Mus musculus
gacacgagggactcggattattgct

SEQ ID NO: 641258 - DNA, 25 bp, Mus musculus
gacacgatcacccacggactcatgg

SEQ ID NO: 641259 - DNA, 25 bp, Mus musculus
gacacgatcaccgacggactcatgg

SEQ ID NO: 641260 - DNA, 25 bp, Mus musculus
gacacgatggagcttcgagagtatc

SEQ ID NO: 641261 - DNA, 25 bp, Mus musculus
gacacgatggaggttcgagagtatc

SEQ ID NO: 641262 - DNA, 25 bp, Mus musculus
gacacgccggccagtgtggtcagcc

SEQ ID NO: 641263 - DNA, 25 bp, Mus musculus
gacacgccggcctgtgtggtcagcc

SEQ ID NO: 641264 - DNA, 25 bp, Mus musculus
gacacgcctatactgcctggcctga

SEQ ID NO: 641265 - DNA, 25 bp, Mus musculus
gacacgcctatagtgcctggcctga

SEQ ID NO: 641266 - DNA, 25 bp, Mus musculus
gacacgccttttaactagttcattt

SEQ ID NO: 641267 - DNA, 25 bp, Mus musculus
gacacgcctttttactagttcattt

SEQ ID NO: 641268 - DNA, 25 bp, Mus musculus
gacacgcgctatagcaacagcttct

SEQ ID NO: 641269 - DNA, 25 bp, Mus musculus
gacacgcgctattgcaacagcttct

SEQ ID NO: 641270 - DNA, 25 bp, Mus musculus
gacacgcggctgctttagatacgac

SEQ ID NO: 641271 - DNA, 25 bp, Mus musculus
gacacgcggctggtttagatacgac

SEQ ID NO: 641272 - DNA, 25 bp, Mus musculus
gacacgctagtacaagatgacatct

SEQ ID NO: 641273 - DNA, 25 bp, Mus musculus
gacacgctagtagaagatgacatct

SEQ ID NO: 641274 - DNA, 25 bp, Mus musculus
gacacgctcagcaaagatggcttta

SEQ ID NO: 641275 - DNA, 25 bp, Mus musculus
gacacgctcagctaagatggcttta

SEQ ID NO: 641276 - DNA, 25 bp, Mus musculus
gacacgctcatgaccaaatggagat

SEQ ID NO: 641277 - DNA, 25 bp, Mus musculus
gacacgctcatgtccaaatggagat

SEQ ID NO: 641278 - DNA, 25 bp, Mus musculus
gacacgctctcaccgatgtcgaatc

SEQ ID NO: 641279 - DNA, 25 bp, Mus musculus
gacacgctctcagcgatgtcgaatc

SEQ ID NO: 641280 - DNA, 25 bp, Mus musculus
gacacgctgaggcacagctaaaaca

SEQ ID NO: 641281 - DNA, 25 bp, Mus musculus
gacacgctgaggcagataggcattt

SEQ ID NO: 641282 - DNA, 25 bp, Mus musculus
gacacgctgagggacagctaaaaca

SEQ ID NO: 641283 - DNA, 25 bp, Mus musculus
gacacgctgagggagataggcattt

SEQ ID NO: 641284 - DNA, 25 bp, Mus musculus
gacacgctgcagaaatggatcgaca

SEQ ID NO: 641285 - DNA, 25 bp, Mus musculus
gacacgctgcagtaatggatcgaca

SEQ ID NO: 641286 - DNA, 25 bp, Mus musculus
gacacgctggtcaaagttcgaaaca

SEQ ID NO: 641287 - DNA, 25 bp, Mus musculus
gacacgctggtctaagttcgaaaca

SEQ ID NO: 641288 - DNA, 25 bp, Mus musculus
gacacgctgtgcatcgataaggacg

SEQ ID NO: 641289 - DNA, 25 bp, Mus musculus
gacacgctgtgcttcgataaggacg

SEQ ID NO: 641290 - DNA, 25 bp, Mus musculus
gacacgcttggtcctgcctggcatg

SEQ ID NO: 641291 - DNA, 25 bp, Mus musculus
gacacgcttggtgctgcctggcatg

SEQ ID NO: 641292 - DNA, 25 bp, Mus musculus
gacacggaagccagaaaaagctcgc

SEQ ID NO: 641293 - DNA, 25 bp, Mus musculus
gacacggaagcctgaaaaagctcgc

SEQ ID NO: 641294 - DNA, 25 bp, Mus musculus
gacacggaagcgcaagtcagagcca

SEQ ID NO: 641295 - DNA, 25 bp, Mus musculus
gacacggaagcggaagtcagagcca

SEQ ID NO: 641296 - DNA, 25 bp, Mus musculus
gacacggaagtgactccgaacagga

SEQ ID NO: 641297 - DNA, 25 bp, Mus musculus
gacacggaagtgtctccgaacagga

SEQ ID NO: 641298 - DNA, 25 bp, Mus musculus
gacacggaccacaatggagctgtga

SEQ ID NO: 641299 - DNA, 25 bp, Mus musculus
gacacggaccactatggagctgtga

SEQ ID NO: 641300 - DNA, 25 bp, Mus musculus
gacacggaccggagagtgcgaacca

SEQ ID NO: 641301 - DNA, 25 bp, Mus musculus
gacacggaccggtgagtgcgaacca

SEQ ID NO: 641302 - DNA, 25 bp, Mus musculus
gacacggacctgcacggttttcctg

SEQ ID NO: 641303 - DNA, 25 bp, Mus musculus
gacacggacctggacggttttcctg

SEQ ID NO: 641304 - DNA, 25 bp, Mus musculus
gacacggacttgagccggctgtaca

SEQ ID NO: 641305 - DNA, 25 bp, Mus musculus
gacacggacttgtgccggctgtaca

SEQ ID NO: 641306 - DNA, 25 bp, Mus musculus
gacacggagaaaaaagatgagccca

SEQ ID NO: 641307 - DNA, 25 bp, Mus musculus
gacacggagaaataagatgagccca

SEQ ID NO: 641308 - DNA, 25 bp, Mus musculus
gacacggaggtgaccaacaatagaa

SEQ ID NO: 641309 - DNA, 25 bp, Mus musculus
gacacggaggtgtccaacaatagaa

SEQ ID NO: 641310 - DNA, 25 bp, Mus musculus
gacacggcacggacacagaagaccg

SEQ ID NO: 641311 - DNA, 25 bp, Mus musculus
gacacggcacggtcacagaagaccg

SEQ ID NO: 641312 - DNA, 25 bp, Mus musculus
gacacggcatgaccagtggagacta

SEQ ID NO: 641313 - DNA, 25 bp, Mus musculus
gacacggcatgagcagtggagacta

SEQ ID NO: 641314 - DNA, 25 bp, Mus musculus
gacacggcggaacacttacgtttgc

SEQ ID NO: 641315 - DNA, 25 bp, Mus musculus
gacacggcggaagacttacgtttgc

SEQ ID NO: 641316 - DNA, 25 bp, Mus musculus
gacacgggaacaatggtacctcaca

SEQ ID NO: 641317 - DNA, 25 bp, Mus musculus
gacacgggaacattggtacctcaca

SEQ ID NO: 641318 - DNA, 25 bp, Mus musculus
gacacgggatgacctgttcaacacc

SEQ ID NO: 641319 - DNA, 25 bp, Mus musculus
gacacgggatgagctgttcaacacc

SEQ ID NO: 641320 - DNA, 25 bp, Mus musculus
gacacggtacgactcaaggctctct

SEQ ID NO: 641321 - DNA, 25 bp, Mus musculus
gacacggtacgagtcaaggctctct

SEQ ID NO: 641322 - DNA, 25 bp, Mus musculus
gacacggtcatcattccttaggaaa

SEQ ID NO: 641323 - DNA, 25 bp, Mus musculus
gacacggtcatctttccttaggaaa

SEQ ID NO: 641324 - DNA, 25 bp, Mus musculus
gacacggtgacactgacatgcgaag

SEQ ID NO: 641325 - DNA, 25 bp, Mus musculus
gacacggtgacagtgacatgcgaag

SEQ ID NO: 641326 - DNA, 25 bp, Mus musculus
gacacggtggagagatttgtgctca

SEQ ID NO: 641327 - DNA, 25 bp, Mus musculus
gacacggtggagtgatttgtgctca

SEQ ID NO: 641328 - DNA, 25 bp, Mus musculus
gacacggtgttgctaaaaggaaaga

SEQ ID NO: 641329 - DNA, 25 bp, Mus musculus
gacacggtgttggtaaaaggaaaga

SEQ ID NO: 641330 - DNA, 25 bp, Mus musculus
gacacgtcactcagttctcccgtga

SEQ ID NO: 641331 - DNA, 25 bp, Mus musculus
gacacgtcactctgttctcccgtga

SEQ ID NO: 641332 - DNA, 25 bp, Mus musculus
gacacgtcctgtcactatgggtacc

SEQ ID NO: 641333 - DNA, 25 bp, Mus musculus
gacacgtcctgtgactatgggtacc

SEQ ID NO: 641334 - DNA, 25 bp, Mus musculus
gacacgtctccacatgaaggactga

SEQ ID NO: 641335 - DNA, 25 bp, Mus musculus
gacacgtctccagatgaaggactga

SEQ ID NO: 641336 - DNA, 25 bp, Mus musculus
gacacgtctgaacaggatagcagcc

SEQ ID NO: 641337 - DNA, 25 bp, Mus musculus
gacacgtctgaagaggatagcagcc

SEQ ID NO: 641338 - DNA, 25 bp, Mus musculus
gacacgtggcctcgagttcattctt

SEQ ID NO: 641339 - DNA, 25 bp, Mus musculus
gacacgtggcctggagttcattctt

SEQ ID NO: 641340 - DNA, 25 bp, Mus musculus
gacacgtggctcacaataaatgcat

SEQ ID NO: 641341 - DNA, 25 bp, Mus musculus
gacacgtggctctcaataaatgcat

SEQ ID NO: 641342 - DNA, 25 bp, Mus musculus
gacacgttcatgctgaagcaccagt

SEQ ID NO: 641343 - DNA, 25 bp, Mus musculus
gacacgttcatggtgaagcaccagt

SEQ ID NO: 641344 - DNA, 25 bp, Mus musculus
gacacgttctttcttatcacctgga

SEQ ID NO: 641345 - DNA, 25 bp, Mus musculus
gacacgttctttgttatcacctgga

SEQ ID NO: 641346 - DNA, 25 bp, Mus musculus
gacacgttgccgacccagctgggca

SEQ ID NO: 641347 - DNA, 25 bp, Mus musculus
gacacgttgccgtcccagctgggca

SEQ ID NO: 641348 - DNA, 25 bp, Mus musculus
gacacgtttcctctcaagatggcgg

SEQ ID NO: 641349 - DNA, 25 bp, Mus musculus
gacacgtttcctgtcaagatggcgg

SEQ ID NO: 641350 - DNA, 25 bp, Mus musculus
gacactaaaacaaaggtgtggctct

SEQ ID NO: 641351 - DNA, 25 bp, Mus musculus
gacactaaaacataggtgtggctct

SEQ ID NO: 641352 - DNA, 25 bp, Mus musculus
gacactaaagctagcggcttgctgt

SEQ ID NO: 641353 - DNA, 25 bp, Mus musculus
gacactaaagcttgcggcttgctgt

SEQ ID NO: 641354 - DNA, 25 bp, Mus musculus
gacactaaccagaagctacggctct

SEQ ID NO: 641355 - DNA, 25 bp, Mus musculus
gacactaaccagtagctacggctct

SEQ ID NO: 641356 - DNA, 25 bp, Mus musculus
gacactaacctgctaatactcttta

SEQ ID NO: 641357 - DNA, 25 bp, Mus musculus
gacactaacctggtaatactcttta

SEQ ID NO: 641358 - DNA, 25 bp, Mus musculus
gacactaagagcaaaaccaagagga

SEQ ID NO: 641359 - DNA, 25 bp, Mus musculus
gacactaagagctaaaccaagagga

SEQ ID NO: 641360 - DNA, 25 bp, Mus musculus
gacactacaatacgtttttcccaag

SEQ ID NO: 641361 - DNA, 25 bp, Mus musculus
gacactacaataggtttttcccaag

SEQ ID NO: 641362 - DNA, 25 bp, Mus musculus
gacactacagtccagacaaccaaga

SEQ ID NO: 641363 - DNA, 25 bp, Mus musculus
gacactacagtcgagacaaccaaga

SEQ ID NO: 641364 - DNA, 25 bp, Mus musculus
gacactaccaataagcagtgcgtta

SEQ ID NO: 641365 - DNA, 25 bp, Mus musculus
gacactaccaattagcagtgcgtta

SEQ ID NO: 641366 - DNA, 25 bp, Mus musculus
gacactagaaaaccttggctttccc

SEQ ID NO: 641367 - DNA, 25 bp, Mus musculus
gacactagaaaagcttggctttccc

SEQ ID NO: 641368 - DNA, 25 bp, Mus musculus
gacactagacagagcaactccagcg

SEQ ID NO: 641369 - DNA, 25 bp, Mus musculus
gacactagacagtgcaactccagcg

SEQ ID NO: 641370 - DNA, 25 bp, Mus musculus
gacactatcattcagaatgctctcc

SEQ ID NO: 641371 - DNA, 25 bp, Mus musculus
gacactatcattgagaatgctctcc

SEQ ID NO: 641372 - DNA, 25 bp, Mus musculus
gacactatcgatctcagcaacctca

SEQ ID NO: 641373 - DNA, 25 bp, Mus musculus
gacactatcgatgtcagcaacctca

SEQ ID NO: 641374 - DNA, 25 bp, Mus musculus
gacactatgaagaagtagagctgac

SEQ ID NO: 641375 - DNA, 25 bp, Mus musculus
gacactatgaagtagtagagctgac

SEQ ID NO: 641376 - DNA, 25 bp, Mus musculus
gacactatgacgcaagtaaaggctt

SEQ ID NO: 641377 - DNA, 25 bp, Mus musculus
gacactatgacggaagtaaaggctt

SEQ ID NO: 641378 - DNA, 25 bp, Mus musculus
gacactatggacctatggtgcaatg

SEQ ID NO: 641379 - DNA, 25 bp, Mus musculus
gacactatggacgtatggtgcaatg

SEQ ID NO: 641380 - DNA, 25 bp, Mus musculus
gacactatgtccaaaggaattcagc

SEQ ID NO: 641381 - DNA, 25 bp, Mus musculus
gacactatgtcctaaggaattcagc

SEQ ID NO: 641382 - DNA, 25 bp, Mus musculus
gacactattacaatgctgctgagga

SEQ ID NO: 641383 - DNA, 25 bp, Mus musculus
gacactattacattgctgctgagga

SEQ ID NO: 641384 - DNA, 25 bp, Mus musculus
gacactcactctaaccacctgtggt

SEQ ID NO: 641385 - DNA, 25 bp, Mus musculus
gacactcactcttaccacctgtggt

SEQ ID NO: 641386 - DNA, 25 bp, Mus musculus
gacactcacttaagacccgactaca

SEQ ID NO: 641387 - DNA, 25 bp, Mus musculus
gacactcacttatgacccgactaca

SEQ ID NO: 641388 - DNA, 25 bp, Mus musculus
gacactcagaatcttttgcgcacac

SEQ ID NO: 641389 - DNA, 25 bp, Mus musculus
gacactcagaatgttttgcgcacac

SEQ ID NO: 641390 - DNA, 25 bp, Mus musculus
gacactcagcttcggccctgagcgg

SEQ ID NO: 641391 - DNA, 25 bp, Mus musculus
gacactcagcttgggccctgagcgg

SEQ ID NO: 641392 - DNA, 25 bp, Mus musculus
gacactcagggtagatgtattggac

SEQ ID NO: 641393 - DNA, 25 bp, Mus musculus
gacactcagggttgatgtattggac

SEQ ID NO: 641394 - DNA, 25 bp, Mus musculus
gacactcatcaacaacttccataaa

SEQ ID NO: 641395 - DNA, 25 bp, Mus musculus
gacactcatcaagaacttccataaa

SEQ ID NO: 641396 - DNA, 25 bp, Mus musculus
gacactcatctacttcactgtgcct

SEQ ID NO: 641397 - DNA, 25 bp, Mus musculus
gacactcatctagttcactgtgcct

SEQ ID NO: 641398 - DNA, 25 bp, Mus musculus
gacactcatgcgactacagggagga

SEQ ID NO: 641399 - DNA, 25 bp, Mus musculus
gacactcatgcgtctacagggagga

SEQ ID NO: 641400 - DNA, 25 bp, Mus musculus
gacactcgcagaagacaatatggcc

SEQ ID NO: 641401 - DNA, 25 bp, Mus musculus
gacactcgcagatgacaatatggcc

SEQ ID NO: 641402 - DNA, 25 bp, Mus musculus
gacactcggtatatcttcaagatgg

SEQ ID NO: 641403 - DNA, 25 bp, Mus musculus
gacactcggtatttcttcaagatgg

SEQ ID NO: 641404 - DNA, 25 bp, Mus musculus
gacactctaccaactgggcatgcgg

SEQ ID NO: 641405 - DNA, 25 bp, Mus musculus
gacactctaccatctgggcatgcgg

SEQ ID NO: 641406 - DNA, 25 bp, Mus musculus
gacactctggtgcttaaggctgctg

SEQ ID NO: 641407 - DNA, 25 bp, Mus musculus
gacactctggtggttaaggctgctg

SEQ ID NO: 641408 - DNA, 25 bp, Mus musculus
gacactcttatccagcatgctcaca

SEQ ID NO: 641409 - DNA, 25 bp, Mus musculus
gacactcttatcgagcatgctcaca

SEQ ID NO: 641410 - DNA, 25 bp, Mus musculus
gacactcttcatactctatgtactg

SEQ ID NO: 641411 - DNA, 25 bp, Mus musculus
gacactcttcattctctatgtactg

SEQ ID NO: 641412 - DNA, 25 bp, Mus musculus
gacactcttgatcacctgatagcag

SEQ ID NO: 641413 - DNA, 25 bp, Mus musculus
gacactcttgatgacctgatagcag

SEQ ID NO: 641414 - DNA, 25 bp, Mus musculus
gacactgaaccgatctctgcagaac

SEQ ID NO: 641415 - DNA, 25 bp, Mus musculus
gacactgaaccgttctctgcagaac

SEQ ID NO: 641416 - DNA, 25 bp, Mus musculus
gacactgaacttcgtaaagacgtcc

SEQ ID NO: 641417 - DNA, 25 bp, Mus musculus
gacactgaacttggtaaagacgtcc

SEQ ID NO: 641418 - DNA, 25 bp, Mus musculus
gacactgaagagatacgtttaccag

SEQ ID NO: 641419 - DNA, 25 bp, Mus musculus
gacactgaagagttacgtttaccag

SEQ ID NO: 641420 - DNA, 25 bp, Mus musculus
gacactgaaggaccacactgaccag

SEQ ID NO: 641421 - DNA, 25 bp, Mus musculus
gacactgaaggagcacactgaccag

SEQ ID NO: 641422 - DNA, 25 bp, Mus musculus
gacactgaagtcagctccttgaaca

SEQ ID NO: 641423 - DNA, 25 bp, Mus musculus
gacactgaagtctgctccttgaaca

SEQ ID NO: 641424 - DNA, 25 bp, Mus musculus
gacactgacagacatgctgcagagc

SEQ ID NO: 641425 - DNA, 25 bp, Mus musculus
gacactgacagagatgctgcagagc

SEQ ID NO: 641426 - DNA, 25 bp, Mus musculus
gacactgacatgcaataagcccagc

SEQ ID NO: 641427 - DNA, 25 bp, Mus musculus
gacactgacatggaataagcccagc

SEQ ID NO: 641428 - DNA, 25 bp, Mus musculus
gacactgagacacaaccccaggttg

SEQ ID NO: 641429 - DNA, 25 bp, Mus musculus
gacactgagacagaaccccaggttg

SEQ ID NO: 641430 - DNA, 25 bp, Mus musculus
gacactgagattcctggaccctttt

SEQ ID NO: 641431 - DNA, 25 bp, Mus musculus
gacactgagattgctggaccctttt

SEQ ID NO: 641432 - DNA, 25 bp, Mus musculus
gacactgatctcatctgggccaaaa

SEQ ID NO: 641433 - DNA, 25 bp, Mus musculus
gacactgatctcttctgggccaaaa

SEQ ID NO: 641434 - DNA, 25 bp, Mus musculus
gacactgcaaccaggaaaggccaga

SEQ ID NO: 641435 - DNA, 25 bp, Mus musculus
gacactgcaacctggaaaggccaga

SEQ ID NO: 641436 - DNA, 25 bp, Mus musculus
gacactgcaggcagtgttcacgctg

SEQ ID NO: 641437 - DNA, 25 bp, Mus musculus
gacactgcaggctgtgttcacgctg

SEQ ID NO: 641438 - DNA, 25 bp, Mus musculus
gacactgcagtcctaacgtgttcag

SEQ ID NO: 641439 - DNA, 25 bp, Mus musculus
gacactgcagtcgtaacgtgttcag

SEQ ID NO: 641440 - DNA, 25 bp, Mus musculus
gacactgccaaaacgcaatggcact

SEQ ID NO: 641441 - DNA, 25 bp, Mus musculus
gacactgccaaatcgcaatggcact

SEQ ID NO: 641442 - DNA, 25 bp, Mus musculus
gacactgccactcgcgtgcggtgca

SEQ ID NO: 641443 - DNA, 25 bp, Mus musculus
gacactgccactggcgtgcggtgca

SEQ ID NO: 641444 - DNA, 25 bp, Mus musculus
gacactgctactcatggtgctgcgg

SEQ ID NO: 641445 - DNA, 25 bp, Mus musculus
gacactgctactgatggtgctgcgg

SEQ ID NO: 641446 - DNA, 25 bp, Mus musculus
gacactgctcatatggctaccaaaa

SEQ ID NO: 641447 - DNA, 25 bp, Mus musculus
gacactgctcatttggctaccaaaa

SEQ ID NO: 641448 - DNA, 25 bp, Mus musculus
gacactggaaaacatcttcctacag

SEQ ID NO: 641449 - DNA, 25 bp, Mus musculus
gacactggaaaagatcttcctacag

SEQ ID NO: 641450 - DNA, 25 bp, Mus musculus
gacactggaccccagactggagtct

SEQ ID NO: 641451 - DNA, 25 bp, Mus musculus
gacactggacccgagactggagtct

SEQ ID NO: 641452 - DNA, 25 bp, Mus musculus
gacactggatagacccacaagggca

SEQ ID NO: 641453 - DNA, 25 bp, Mus musculus
gacactggatagacttcgaacattt

SEQ ID NO: 641454 - DNA, 25 bp, Mus musculus
gacactggatagtcccacaagggca

SEQ ID NO: 641455 - DNA, 25 bp, Mus musculus
gacactggatagtcttcgaacattt

SEQ ID NO: 641456 - DNA, 25 bp, Mus musculus
gacactggattcagccgagtgaatg

SEQ ID NO: 641457 - DNA, 25 bp, Mus musculus
gacactggattcctctcctataaag

SEQ ID NO: 641458 - DNA, 25 bp, Mus musculus
gacactggattcgtctcctataaag

SEQ ID NO: 641459 - DNA, 25 bp, Mus musculus
gacactggattctgccgagtgaatg

SEQ ID NO: 641460 - DNA, 25 bp, Mus musculus
gacactggcccaacaggcttcaaag

SEQ ID NO: 641461 - DNA, 25 bp, Mus musculus
gacactggcccatcaggcttcaaag

SEQ ID NO: 641462 - DNA, 25 bp, Mus musculus
gacactggcgagcatcttggcctgc

SEQ ID NO: 641463 - DNA, 25 bp, Mus musculus
gacactggcgaggatcttggcctgc

SEQ ID NO: 641464 - DNA, 25 bp, Mus musculus
gacactggctgaactgcaactggag

SEQ ID NO: 641465 - DNA, 25 bp, Mus musculus
gacactggctgatctgcaactggag

SEQ ID NO: 641466 - DNA, 25 bp, Mus musculus
gacactgggaccagcagttctgcct

SEQ ID NO: 641467 - DNA, 25 bp, Mus musculus
gacactgggacctgcagttctgcct

SEQ ID NO: 641468 - DNA, 25 bp, Mus musculus
gacactgggagaagtagaaattgct

SEQ ID NO: 641469 - DNA, 25 bp, Mus musculus
gacactgggagatgtagaaattgct

SEQ ID NO: 641470 - DNA, 25 bp, Mus musculus
gacactggtacaaggagtcctgaaa

SEQ ID NO: 641471 - DNA, 25 bp, Mus musculus
gacactggtacatggagtcctgaaa

SEQ ID NO: 641472 - DNA, 25 bp, Mus musculus
gacactggtctcaacggttggaagc

SEQ ID NO: 641473 - DNA, 25 bp, Mus musculus
gacactggtctctacggttggaagc

SEQ ID NO: 641474 - DNA, 25 bp, Mus musculus
gacactggtgatcgctgtgtatgat

SEQ ID NO: 641475 - DNA, 25 bp, Mus musculus
gacactggtgatggctgtgtatgat

SEQ ID NO: 641476 - DNA, 25 bp, Mus musculus
gacactggtgtcagcgagagctgct

SEQ ID NO: 641477 - DNA, 25 bp, Mus musculus
gacactggtgtctgcgagagctgct

SEQ ID NO: 641478 - DNA, 25 bp, Mus musculus
gacactgtaaccaaaaatggcagag

SEQ ID NO: 641479 - DNA, 25 bp, Mus musculus
gacactgtaacctaaaatggcagag

SEQ ID NO: 641480 - DNA, 25 bp, Mus musculus
gacactgtactacagcatgagaacc

SEQ ID NO: 641481 - DNA, 25 bp, Mus musculus
gacactgtactagagcatgagaacc

SEQ ID NO: 641482 - DNA, 25 bp, Mus musculus
gacactgtatgcagccctgctggta

SEQ ID NO: 641483 - DNA, 25 bp, Mus musculus
gacactgtatgctgccctgctggta

SEQ ID NO: 641484 - DNA, 25 bp, Mus musculus
gacactgtcattcagaccgtttgct

SEQ ID NO: 641485 - DNA, 25 bp, Mus musculus
gacactgtcattgagaccgtttgct

SEQ ID NO: 641486 - DNA, 25 bp, Mus musculus
gacactgtccttcgacaggtacatc

SEQ ID NO: 641487 - DNA, 25 bp, Mus musculus
gacactgtccttggacaggtacatc

SEQ ID NO: 641488 - DNA, 25 bp, Mus musculus
gacactgtctatctctgctctgttg

SEQ ID NO: 641489 - DNA, 25 bp, Mus musculus
gacactgtctatgtctgctctgttg

SEQ ID NO: 641490 - DNA, 25 bp, Mus musculus
gacactgtctccattgggtttcgga

SEQ ID NO: 641491 - DNA, 25 bp, Mus musculus
gacactgtctcctttgggtttcgga

SEQ ID NO: 641492 - DNA, 25 bp, Mus musculus
gacactgtgacaatacacgctgcca

SEQ ID NO: 641493 - DNA, 25 bp, Mus musculus
gacactgtgacattacacgctgcca

SEQ ID NO: 641494 - DNA, 25 bp, Mus musculus
gacactgtgaccatagcatctctta

SEQ ID NO: 641495 - DNA, 25 bp, Mus musculus
gacactgtgaccttagcatctctta

SEQ ID NO: 641496 - DNA, 25 bp, Mus musculus
gacactgtgcaccagctgtgctatg

SEQ ID NO: 641497 - DNA, 25 bp, Mus musculus
gacactgtgcacgagctgtgctatg

SEQ ID NO: 641498 - DNA, 25 bp, Mus musculus
gacactgtgcagaccttcgtcattc

SEQ ID NO: 641499 - DNA, 25 bp, Mus musculus
gacactgtgcagtccttcgtcattc

SEQ ID NO: 641500 - DNA, 25 bp, Mus musculus
gacactgtggaaaagatcaaatcta

SEQ ID NO: 641501 - DNA, 25 bp, Mus musculus
gacactgtggaatagatcaaatcta

SEQ ID NO: 641502 - DNA, 25 bp, Mus musculus
gacactgtggttcgtcatccttcca

SEQ ID NO: 641503 - DNA, 25 bp, Mus musculus
gacactgtggttggtcatccttcca

SEQ ID NO: 641504 - DNA, 25 bp, Mus musculus
gacactgtgtatagagaaaactgcc

SEQ ID NO: 641505 - DNA, 25 bp, Mus musculus
gacactgtgtattgagaaaactgcc

SEQ ID NO: 641506 - DNA, 25 bp, Mus musculus
gacactgtgttgcatattctaagag

SEQ ID NO: 641507 - DNA, 25 bp, Mus musculus
gacactgtgttggatattctaagag

SEQ ID NO: 641508 - DNA, 25 bp, Mus musculus
gacactgtttgtcgcgctttatgac

SEQ ID NO: 641509 - DNA, 25 bp, Mus musculus
gacactgtttgtggcgctttatgac

SEQ ID NO: 641510 - DNA, 25 bp, Mus musculus
gacacttaaagtcaccagagctagc

SEQ ID NO: 641511 - DNA, 25 bp, Mus musculus
gacacttaaagtgaccagagctagc

SEQ ID NO: 641512 - DNA, 25 bp, Mus musculus
gacacttaacatcgagacactagac

SEQ ID NO: 641513 - DNA, 25 bp, Mus musculus
gacacttaacatggagacactagac

SEQ ID NO: 641514 - DNA, 25 bp, Mus musculus
gacacttaccaacgacgatatcatc

SEQ ID NO: 641515 - DNA, 25 bp, Mus musculus
gacacttaccaaggacgatatcatc

SEQ ID NO: 641516 - DNA, 25 bp, Mus musculus
gacacttacctgacaacagctccgg

SEQ ID NO: 641517 - DNA, 25 bp, Mus musculus
gacacttacctgtcaacagctccgg

SEQ ID NO: 641518 - DNA, 25 bp, Mus musculus
gacacttcagcaagaccatgctgct

SEQ ID NO: 641519 - DNA, 25 bp, Mus musculus
gacacttcagcatgaccatgctgct

SEQ ID NO: 641520 - DNA, 25 bp, Mus musculus
gacacttcatcaaagaggagcactg

SEQ ID NO: 641521 - DNA, 25 bp, Mus musculus
gacacttcatcatagaggagcactg

SEQ ID NO: 641522 - DNA, 25 bp, Mus musculus
gacacttccaacatctctgactaca

SEQ ID NO: 641523 - DNA, 25 bp, Mus musculus
gacacttccaacttctctgactaca

SEQ ID NO: 641524 - DNA, 25 bp, Mus musculus
gacacttccaagcaccaaacctgag

SEQ ID NO: 641525 - DNA, 25 bp, Mus musculus
gacacttccaaggaccaaacctgag

SEQ ID NO: 641526 - DNA, 25 bp, Mus musculus
gacacttctcagcaggatccacata

SEQ ID NO: 641527 - DNA, 25 bp, Mus musculus
gacacttctcaggaggatccacata

SEQ ID NO: 641528 - DNA, 25 bp, Mus musculus
gacacttctctgatcattttagcgg

SEQ ID NO: 641529 - DNA, 25 bp, Mus musculus
gacacttctctgttcattttagcgg

SEQ ID NO: 641530 - DNA, 25 bp, Mus musculus
gacacttctgttatcatgaccacca

SEQ ID NO: 641531 - DNA, 25 bp, Mus musculus
gacacttctgttttcatgaccacca

SEQ ID NO: 641532 - DNA, 25 bp, Mus musculus
gacacttgagagaagtaacttgaac

SEQ ID NO: 641533 - DNA, 25 bp, Mus musculus
gacacttgagagtagtaacttgaac

SEQ ID NO: 641534 - DNA, 25 bp, Mus musculus
gacacttgctggcatggtctcctcg

SEQ ID NO: 641535 - DNA, 25 bp, Mus musculus
gacacttgctgggatggtctcctcg

SEQ ID NO: 641536 - DNA, 25 bp, Mus musculus
gacacttgctgtcgcgcagggactc

SEQ ID NO: 641537 - DNA, 25 bp, Mus musculus
gacacttgctgtggcgcagggactc

SEQ ID NO: 641538 - DNA, 25 bp, Mus musculus
gacacttggaaaatgtgcaccctga

SEQ ID NO: 641539 - DNA, 25 bp, Mus musculus
gacacttggaaattgtgcaccctga

SEQ ID NO: 641540 - DNA, 25 bp, Mus musculus
gacacttggataattcgaagccgac

SEQ ID NO: 641541 - DNA, 25 bp, Mus musculus
gacacttggatatttcgaagccgac

SEQ ID NO: 641542 - DNA, 25 bp, Mus musculus
gacacttggccccaaacatagaagc

SEQ ID NO: 641543 - DNA, 25 bp, Mus musculus
gacacttggcccgaaacatagaagc

SEQ ID NO: 641544 - DNA, 25 bp, Mus musculus
gacacttgtgcacgagccattagct

SEQ ID NO: 641545 - DNA, 25 bp, Mus musculus
gacacttgtgcaggagccattagct

SEQ ID NO: 641546 - DNA, 25 bp, Mus musculus
gacacttgtgcgctaagacaaaccc

SEQ ID NO: 641547 - DNA, 25 bp, Mus musculus
gacacttgtgcggtaagacaaaccc

SEQ ID NO: 641548 - DNA, 25 bp, Mus musculus
gacacttgttagcagtgccaccttt

SEQ ID NO: 641549 - DNA, 25 bp, Mus musculus
gacacttgttaggagtgccaccttt

SEQ ID NO: 641550 - DNA, 25 bp, Mus musculus
gacactttaaggaaactccaacttg

SEQ ID NO: 641551 - DNA, 25 bp, Mus musculus
gacactttaaggtaactccaacttg

SEQ ID NO: 641552 - DNA, 25 bp, Mus musculus
gacactttacccattgctgagcgag

SEQ ID NO: 641553 - DNA, 25 bp, Mus musculus
gacactttaccctttgctgagcgag

SEQ ID NO: 641554 - DNA, 25 bp, Mus musculus
gacactttaggcattccacgctaca

SEQ ID NO: 641555 - DNA, 25 bp, Mus musculus
gacactttaggctttccacgctaca

SEQ ID NO: 641556 - DNA, 25 bp, Mus musculus
gacactttccggctggagttcctcg

SEQ ID NO: 641557 - DNA, 25 bp, Mus musculus
gacactttccgggtggagttcctcg

SEQ ID NO: 641558 - DNA, 25 bp, Mus musculus
gacactttcttcacagagcagattg

SEQ ID NO: 641559 - DNA, 25 bp, Mus musculus
gacactttcttctcagagcagattg

SEQ ID NO: 641560 - DNA, 25 bp, Mus musculus
gacactttgcacatagaagcctagg

SEQ ID NO: 641561 - DNA, 25 bp, Mus musculus
gacactttgcacttagaagcctagg

SEQ ID NO: 641562 - DNA, 25 bp, Mus musculus
gacactttgcagactctgggcctag

SEQ ID NO: 641563 - DNA, 25 bp, Mus musculus
gacactttgcagtctctgggcctag

SEQ ID NO: 641564 - DNA, 25 bp, Mus musculus
gacactttgccccattgagacattg

SEQ ID NO: 641565 - DNA, 25 bp, Mus musculus
gacactttgcccgattgagacattg

SEQ ID NO: 641566 - DNA, 25 bp, Mus musculus
gacactttttctaatttgaatgatg

SEQ ID NO: 641567 - DNA, 25 bp, Mus musculus
gacactttttcttatttgaatgatg

SEQ ID NO: 641568 - DNA, 25 bp, Mus musculus
gacagaaaaagacgttgctatgatt

SEQ ID NO: 641569 - DNA, 25 bp, Mus musculus
gacagaaaaagaggttgctatgatt

SEQ ID NO: 641570 - DNA, 25 bp, Mus musculus
gacagaaaacaacatatacagcaca

SEQ ID NO: 641571 - DNA, 25 bp, Mus musculus
gacagaaaacaagatatacagcaca

SEQ ID NO: 641572 - DNA, 25 bp, Mus musculus
gacagaaaacagactcgccaactta

SEQ ID NO: 641573 - DNA, 25 bp, Mus musculus
gacagaaaacagtctcgccaactta

SEQ ID NO: 641574 - DNA, 25 bp, Mus musculus
gacagaaacatcaggtgatgggtga

SEQ ID NO: 641575 - DNA, 25 bp, Mus musculus
gacagaaacatctggtgatgggtga

SEQ ID NO: 641576 - DNA, 25 bp, Mus musculus
gacagaaactacatcaatttgcctg

SEQ ID NO: 641577 - DNA, 25 bp, Mus musculus
gacagaaactacttcaatttgcctg

SEQ ID NO: 641578 - DNA, 25 bp, Mus musculus
gacagaaagagcaccctgctacatt

SEQ ID NO: 641579 - DNA, 25 bp, Mus musculus
gacagaaagagctccctgctacatt

SEQ ID NO: 641580 - DNA, 25 bp, Mus musculus
gacagaaagagtctgcaacgaatta

SEQ ID NO: 641581 - DNA, 25 bp, Mus musculus
gacagaaagagtgtgcaacgaatta

SEQ ID NO: 641582 - DNA, 25 bp, Mus musculus
gacagaaagttcaccctaagttgca

SEQ ID NO: 641583 - DNA, 25 bp, Mus musculus
gacagaaagttctccctaagttgca

SEQ ID NO: 641584 - DNA, 25 bp, Mus musculus
gacagaaatggaaggcatgtctaca

SEQ ID NO: 641585 - DNA, 25 bp, Mus musculus
gacagaaatggatggcatgtctaca

SEQ ID NO: 641586 - DNA, 25 bp, Mus musculus
gacagaaatgtcagaggtgctaacg

SEQ ID NO: 641587 - DNA, 25 bp, Mus musculus
gacagaaatgtctgaggtgctaacg

SEQ ID NO: 641588 - DNA, 25 bp, Mus musculus
gacagaacaagaataggcactctct

SEQ ID NO: 641589 - DNA, 25 bp, Mus musculus
gacagaacaagattaggcactctct

SEQ ID NO: 641590 - DNA, 25 bp, Mus musculus
gacagaacagaacgatgaaatcaag

SEQ ID NO: 641591 - DNA, 25 bp, Mus musculus
gacagaacagaaggatgaaatcaag

SEQ ID NO: 641592 - DNA, 25 bp, Mus musculus
gacagaacagggatgaactacatga

SEQ ID NO: 641593 - DNA, 25 bp, Mus musculus
gacagaacagggttgaactacatga

SEQ ID NO: 641594 - DNA, 25 bp, Mus musculus
gacagaacagtaccaatggtagaat

SEQ ID NO: 641595 - DNA, 25 bp, Mus musculus
gacagaacagtagcaatggtagaat

SEQ ID NO: 641596 - DNA, 25 bp, Mus musculus
gacagaacccaaacaagtacatccc

SEQ ID NO: 641597 - DNA, 25 bp, Mus musculus
gacagaacccaatcaagtacatccc

SEQ ID NO: 641598 - DNA, 25 bp, Mus musculus
gacagaaccccactgaggcggagct

SEQ ID NO: 641599 - DNA, 25 bp, Mus musculus
gacagaaccccagtgaggcggagct

SEQ ID NO: 641600 - DNA, 25 bp, Mus musculus
gacagaacgggtcagccttatggct

SEQ ID NO: 641601 - DNA, 25 bp, Mus musculus
gacagaacgggtgagccttatggct

SEQ ID NO: 641602 - DNA, 25 bp, Mus musculus
gacagaactcagctcgtccgtgttt

SEQ ID NO: 641603 - DNA, 25 bp, Mus musculus
gacagaactcaggtcgtccgtgttt

SEQ ID NO: 641604 - DNA, 25 bp, Mus musculus
gacagaagaaacactgccacttgta

SEQ ID NO: 641605 - DNA, 25 bp, Mus musculus
gacagaagaaactctgccacttgta

SEQ ID NO: 641606 - DNA, 25 bp, Mus musculus
gacagaagaactacactgcctgctt

SEQ ID NO: 641607 - DNA, 25 bp, Mus musculus
gacagaagaacttcactgcctgctt

SEQ ID NO: 641608 - DNA, 25 bp, Mus musculus
gacagaagaagaacctacatatgaa

SEQ ID NO: 641609 - DNA, 25 bp, Mus musculus
gacagaagaagatcctacatatgaa

SEQ ID NO: 641610 - DNA, 25 bp, Mus musculus
gacagaagattgaaatgtgggacag

SEQ ID NO: 641611 - DNA, 25 bp, Mus musculus
gacagaagattgcagaaaatcaacg

SEQ ID NO: 641612 - DNA, 25 bp, Mus musculus
gacagaagattggagaaaatcaacg

SEQ ID NO: 641613 - DNA, 25 bp, Mus musculus
gacagaagattgtaatgtgggacag

SEQ ID NO: 641614 - DNA, 25 bp, Mus musculus
gacagaagcacactaccggtttatc

SEQ ID NO: 641615 - DNA, 25 bp, Mus musculus
gacagaagcacagtaccggtttatc

SEQ ID NO: 641616 - DNA, 25 bp, Mus musculus
gacagaagcagcctataatcgacca

SEQ ID NO: 641617 - DNA, 25 bp, Mus musculus
gacagaagcagcgtataatcgacca

SEQ ID NO: 641618 - DNA, 25 bp, Mus musculus
gacagaagctatcgcatctcctatt

SEQ ID NO: 641619 - DNA, 25 bp, Mus musculus
gacagaagctatggcatctcctatt

SEQ ID NO: 641620 - DNA, 25 bp, Mus musculus
gacagaagctctccggtcgttcaac

SEQ ID NO: 641621 - DNA, 25 bp, Mus musculus
gacagaagctctgcggtcgttcaac

SEQ ID NO: 641622 - DNA, 25 bp, Mus musculus
gacagaaggaccagtatccactccc

SEQ ID NO: 641623 - DNA, 25 bp, Mus musculus
gacagaaggacctgtatccactccc

SEQ ID NO: 641624 - DNA, 25 bp, Mus musculus
gacagaaggactatgagctggaaaa

SEQ ID NO: 641625 - DNA, 25 bp, Mus musculus
gacagaaggactttgagctggaaaa

SEQ ID NO: 641626 - DNA, 25 bp, Mus musculus
gacagaaggcttaaagaatgtatcg

SEQ ID NO: 641627 - DNA, 25 bp, Mus musculus
gacagaaggctttaagaatgtatcg

SEQ ID NO: 641628 - DNA, 25 bp, Mus musculus
gacagaaggtatctccacatcagac

SEQ ID NO: 641629 - DNA, 25 bp, Mus musculus
gacagaaggtatgtccacatcagac

SEQ ID NO: 641630 - DNA, 25 bp, Mus musculus
gacagaagtactcgagccaacccca

SEQ ID NO: 641631 - DNA, 25 bp, Mus musculus
gacagaagtactggagccaacccca

SEQ ID NO: 641632 - DNA, 25 bp, Mus musculus
gacagaagtgccacttatgcagact

SEQ ID NO: 641633 - DNA, 25 bp, Mus musculus
gacagaagtgcctcttatgcagact

SEQ ID NO: 641634 - DNA, 25 bp, Mus musculus
gacagaagtgctcaattacacgacc

SEQ ID NO: 641635 - DNA, 25 bp, Mus musculus
gacagaagtgctgaattacacgacc

SEQ ID NO: 641636 - DNA, 25 bp, Mus musculus
gacagaagtggaatttgtgtccggt

SEQ ID NO: 641637 - DNA, 25 bp, Mus musculus
gacagaagtggattttgtgtccggt

SEQ ID NO: 641638 - DNA, 25 bp, Mus musculus
gacagaagttggcactcggaagctt

SEQ ID NO: 641639 - DNA, 25 bp, Mus musculus
gacagaagttgggactcggaagctt

SEQ ID NO: 641640 - DNA, 25 bp, Mus musculus
gacagaatcagtaccaggcctgcta

SEQ ID NO: 641641 - DNA, 25 bp, Mus musculus
gacagaatcagttccaggcctgcta

SEQ ID NO: 641642 - DNA, 25 bp, Mus musculus
gacagaatcatcagagggaaccagc

SEQ ID NO: 641643 - DNA, 25 bp, Mus musculus
gacagaatcatctgagggaaccagc

SEQ ID NO: 641644 - DNA, 25 bp, Mus musculus
gacagaatccgtactagaagaacag

SEQ ID NO: 641645 - DNA, 25 bp, Mus musculus
gacagaatccgttctagaagaacag

SEQ ID NO: 641646 - DNA, 25 bp, Mus musculus
gacagaatcctacagctctagccag

SEQ ID NO: 641647 - DNA, 25 bp, Mus musculus
gacagaatcctagagctctagccag

SEQ ID NO: 641648 - DNA, 25 bp, Mus musculus
gacagaatcgcaactgtggatttct

SEQ ID NO: 641649 - DNA, 25 bp, Mus musculus
gacagaatcgcatctgtggatttct

SEQ ID NO: 641650 - DNA, 25 bp, Mus musculus
gacagaatggtgcagctttaaaaca

SEQ ID NO: 641651 - DNA, 25 bp, Mus musculus
gacagaatggtggagctttaaaaca

SEQ ID NO: 641652 - DNA, 25 bp, Mus musculus
gacagaatgtagagacgatattgaa

SEQ ID NO: 641653 - DNA, 25 bp, Mus musculus
gacagaatgtagtgacgatattgaa

SEQ ID NO: 641654 - DNA, 25 bp, Mus musculus
gacagaatgtttcagacaatggcaa

SEQ ID NO: 641655 - DNA, 25 bp, Mus musculus
gacagaatgtttgagacaatggcaa

SEQ ID NO: 641656 - DNA, 25 bp, Mus musculus
gacagaattctgagtgctttcttgc

SEQ ID NO: 641657 - DNA, 25 bp, Mus musculus
gacagaattctgtgtgctttcttgc

SEQ ID NO: 641658 - DNA, 25 bp, Mus musculus
gacagaatttacctgtaggcctcag

SEQ ID NO: 641659 - DNA, 25 bp, Mus musculus
gacagaatttacgtgtaggcctcag

SEQ ID NO: 641660 - DNA, 25 bp, Mus musculus
gacagacaaacccacagcctgacaa

SEQ ID NO: 641661 - DNA, 25 bp, Mus musculus
gacagacaaaccgacagcctgacaa

SEQ ID NO: 641662 - DNA, 25 bp, Mus musculus
gacagacacaaaatggccgctcagg

SEQ ID NO: 641663 - DNA, 25 bp, Mus musculus
gacagacacaaattggccgctcagg

SEQ ID NO: 641664 - DNA, 25 bp, Mus musculus
gacagacagtagcaggattcggatt

SEQ ID NO: 641665 - DNA, 25 bp, Mus musculus
gacagacagtaggaggattcggatt

SEQ ID NO: 641666 - DNA, 25 bp, Mus musculus
gacagacatgcgctgtcggactacc

SEQ ID NO: 641667 - DNA, 25 bp, Mus musculus
gacagacatgcggtgtcggactacc

SEQ ID NO: 641668 - DNA, 25 bp, Mus musculus
gacagacatgggaaaactgctgtgg

SEQ ID NO: 641669 - DNA, 25 bp, Mus musculus
gacagacatgggtaaactgctgtgg

SEQ ID NO: 641670 - DNA, 25 bp, Mus musculus
gacagacatgttacctgaaatccca

SEQ ID NO: 641671 - DNA, 25 bp, Mus musculus
gacagacatgtttcctgaaatccca

SEQ ID NO: 641672 - DNA, 25 bp, Mus musculus
gacagaccacgccttcaagaaggag

SEQ ID NO: 641673 - DNA, 25 bp, Mus musculus
gacagaccacgcgttcaagaaggag

SEQ ID NO: 641674 - DNA, 25 bp, Mus musculus
gacagacccagcaaatcagtttgaa

SEQ ID NO: 641675 - DNA, 25 bp, Mus musculus
gacagacccagctaatcagtttgaa

SEQ ID NO: 641676 - DNA, 25 bp, Mus musculus
gacagaccgaaccaaggtcagttcc

SEQ ID NO: 641677 - DNA, 25 bp, Mus musculus
gacagaccgaacgaaggtcagttcc

SEQ ID NO: 641678 - DNA, 25 bp, Mus musculus
gacagacctgggaaacacagtgctc

SEQ ID NO: 641679 - DNA, 25 bp, Mus musculus
gacagacctgggacttaccaactac

SEQ ID NO: 641680 - DNA, 25 bp, Mus musculus
gacagacctgggtaacacagtgctc

SEQ ID NO: 641681 - DNA, 25 bp, Mus musculus
gacagacctgggtcttaccaactac

SEQ ID NO: 641682 - DNA, 25 bp, Mus musculus
gacagacgaagacattgacctggct

SEQ ID NO: 641683 - DNA, 25 bp, Mus musculus
gacagacgaagagattgacctggct

SEQ ID NO: 641684 - DNA, 25 bp, Mus musculus
gacagacgctatcatctacttaaag

SEQ ID NO: 641685 - DNA, 25 bp, Mus musculus
gacagacgctatgatctacttaaag

SEQ ID NO: 641686 - DNA, 25 bp, Mus musculus
gacagacgctccctgaatgtaatag

SEQ ID NO: 641687 - DNA, 25 bp, Mus musculus
gacagacgctccgtgaatgtaatag

SEQ ID NO: 641688 - DNA, 25 bp, Mus musculus
gacagacggctcatcgttgcgagcc

SEQ ID NO: 641689 - DNA, 25 bp, Mus musculus
gacagacggctcttcgttgcgagcc

SEQ ID NO: 641690 - DNA, 25 bp, Mus musculus
gacagacggctgaaagaactgcaca

SEQ ID NO: 641691 - DNA, 25 bp, Mus musculus
gacagacggctgtaagaactgcaca

SEQ ID NO: 641692 - DNA, 25 bp, Mus musculus
gacagactacctctttggagtgccc

SEQ ID NO: 641693 - DNA, 25 bp, Mus musculus
gacagactacctgtttggagtgccc

SEQ ID NO: 641694 - DNA, 25 bp, Mus musculus
gacagactacgaccgctaagttatc

SEQ ID NO: 641695 - DNA, 25 bp, Mus musculus
gacagactacgagcgctaagttatc

SEQ ID NO: 641696 - DNA, 25 bp, Mus musculus
gacagactactcacctgtgctccag

SEQ ID NO: 641697 - DNA, 25 bp, Mus musculus
gacagactactctcctgtgctccag

SEQ ID NO: 641698 - DNA, 25 bp, Mus musculus
gacagactccacacatggccattct

SEQ ID NO: 641699 - DNA, 25 bp, Mus musculus
gacagactccactcatggccattct

SEQ ID NO: 641700 - DNA, 25 bp, Mus musculus
gacagactcgccctatgtggtggcc

SEQ ID NO: 641701 - DNA, 25 bp, Mus musculus
gacagactcgccgtatgtggtggcc

SEQ ID NO: 641702 - DNA, 25 bp, Mus musculus
gacagactgaggcatctagcagaca

SEQ ID NO: 641703 - DNA, 25 bp, Mus musculus
gacagactgagggatctagcagaca

SEQ ID NO: 641704 - DNA, 25 bp, Mus musculus
gacagactgggactccattctacag

SEQ ID NO: 641705 - DNA, 25 bp, Mus musculus
gacagactgggagtccattctacag

SEQ ID NO: 641706 - DNA, 25 bp, Mus musculus
gacagactggtccttcaagctggat

SEQ ID NO: 641707 - DNA, 25 bp, Mus musculus
gacagactggtcgttcaagctggat

SEQ ID NO: 641708 - DNA, 25 bp, Mus musculus
gacagacttactcatccaggagacc

SEQ ID NO: 641709 - DNA, 25 bp, Mus musculus
gacagacttactgatccaggagacc

SEQ ID NO: 641710 - DNA, 25 bp, Mus musculus
gacagacttagaacccctggaggga

SEQ ID NO: 641711 - DNA, 25 bp, Mus musculus
gacagacttagatcccctggaggga

SEQ ID NO: 641712 - DNA, 25 bp, Mus musculus
gacagacttcacataaaaagcgaaa

SEQ ID NO: 641713 - DNA, 25 bp, Mus musculus
gacagacttcacttaaaaagcgaaa

SEQ ID NO: 641714 - DNA, 25 bp, Mus musculus
gacagacttgacagacagaaccgtc

SEQ ID NO: 641715 - DNA, 25 bp, Mus musculus
gacagacttgactgacagaaccgtc

SEQ ID NO: 641716 - DNA, 25 bp, Mus musculus
gacagagaaaagatacagcgggcac

SEQ ID NO: 641717 - DNA, 25 bp, Mus musculus
gacagagaaaagttacagcgggcac

SEQ ID NO: 641718 - DNA, 25 bp, Mus musculus
gacagagaaacgatcgctacttatc

SEQ ID NO: 641719 - DNA, 25 bp, Mus musculus
gacagagaaacgttcgctacttatc

SEQ ID NO: 641720 - DNA, 25 bp, Mus musculus
gacagagaacctctgactccatctt

SEQ ID NO: 641721 - DNA, 25 bp, Mus musculus
gacagagaacctgtgactccatctt

SEQ ID NO: 641722 - DNA, 25 bp, Mus musculus
gacagagaatccagggctaagtaca

SEQ ID NO: 641723 - DNA, 25 bp, Mus musculus
gacagagaatcctgggctaagtaca

SEQ ID NO: 641724 - DNA, 25 bp, Mus musculus
gacagagaatgcacggccttcagag

SEQ ID NO: 641725 - DNA, 25 bp, Mus musculus
gacagagaatgctcggccttcagag

SEQ ID NO: 641726 - DNA, 25 bp, Mus musculus
gacagagaccccagataattaagga

SEQ ID NO: 641727 - DNA, 25 bp, Mus musculus
gacagagacccctgataattaagga

SEQ ID NO: 641728 - DNA, 25 bp, Mus musculus
gacagagagattaaaaagtggcaac

SEQ ID NO: 641729 - DNA, 25 bp, Mus musculus
gacagagagatttaaaagtggcaac

SEQ ID NO: 641730 - DNA, 25 bp, Mus musculus
gacagagagccgagtaaggaacagc

SEQ ID NO: 641731 - DNA, 25 bp, Mus musculus
gacagagagccgtgtaaggaacagc

SEQ ID NO: 641732 - DNA, 25 bp, Mus musculus
gacagagagttcattgaatttccgg

SEQ ID NO: 641733 - DNA, 25 bp, Mus musculus
gacagagagttctttgaatttccgg

SEQ ID NO: 641734 - DNA, 25 bp, Mus musculus
gacagagatcgacttctacagaaat

SEQ ID NO: 641735 - DNA, 25 bp, Mus musculus
gacagagatcgagttctacagaaat

SEQ ID NO: 641736 - DNA, 25 bp, Mus musculus
gacagagatgacctgtggctcacca

SEQ ID NO: 641737 - DNA, 25 bp, Mus musculus
gacagagatgacgtgtggctcacca

SEQ ID NO: 641738 - DNA, 25 bp, Mus musculus
gacagagattgtacccgacagggat

SEQ ID NO: 641739 - DNA, 25 bp, Mus musculus
gacagagattgttcccgacagggat

SEQ ID NO: 641740 - DNA, 25 bp, Mus musculus
gacagagcaaatcaggagacccagc

SEQ ID NO: 641741 - DNA, 25 bp, Mus musculus
gacagagcaaatgaggagacccagc

SEQ ID NO: 641742 - DNA, 25 bp, Mus musculus
gacagagcagccattggaaggacta

SEQ ID NO: 641743 - DNA, 25 bp, Mus musculus
gacagagcagcctttggaaggacta

SEQ ID NO: 641744 - DNA, 25 bp, Mus musculus
gacagagcaggaatcattgtgtact

SEQ ID NO: 641745 - DNA, 25 bp, Mus musculus
gacagagcaggattcattgtgtact

SEQ ID NO: 641746 - DNA, 25 bp, Mus musculus
gacagagccctcaaccaactttctg

SEQ ID NO: 641747 - DNA, 25 bp, Mus musculus
gacagagccctctaccaactttctg

SEQ ID NO: 641748 - DNA, 25 bp, Mus musculus
gacagagcgcatactccagctagtg

SEQ ID NO: 641749 - DNA, 25 bp, Mus musculus
gacagagcgcattctccagctagtg

SEQ ID NO: 641750 - DNA, 25 bp, Mus musculus
gacagagctgaaatgacggtgttcg

SEQ ID NO: 641751 - DNA, 25 bp, Mus musculus
gacagagctgaaccagacagtgcag

SEQ ID NO: 641752 - DNA, 25 bp, Mus musculus
gacagagctgaagcagacagtgcag

SEQ ID NO: 641753 - DNA, 25 bp, Mus musculus
gacagagctgaattgacggtgttcg

SEQ ID NO: 641754 - DNA, 25 bp, Mus musculus
gacagagctggacatctttgcaata

SEQ ID NO: 641755 - DNA, 25 bp, Mus musculus
gacagagctggagatctttgcaata

SEQ ID NO: 641756 - DNA, 25 bp, Mus musculus
gacagagcttcgcagtccctgcgaa

SEQ ID NO: 641757 - DNA, 25 bp, Mus musculus
gacagagcttcggagtccctgcgaa

SEQ ID NO: 641758 - DNA, 25 bp, Mus musculus
gacagaggaaaaagaggaagcaatg

SEQ ID NO: 641759 - DNA, 25 bp, Mus musculus
gacagaggaaaatgaggaagcaatg

SEQ ID NO: 641760 - DNA, 25 bp, Mus musculus
gacagaggacacaggatagacttcg

SEQ ID NO: 641761 - DNA, 25 bp, Mus musculus
gacagaggacactggatagacttcg

SEQ ID NO: 641762 - DNA, 25 bp, Mus musculus
gacagaggagatctccttaaacctc

SEQ ID NO: 641763 - DNA, 25 bp, Mus musculus
gacagaggagatgtccttaaacctc

SEQ ID NO: 641764 - DNA, 25 bp, Mus musculus
gacagaggataacgcgtatctccgg

SEQ ID NO: 641765 - DNA, 25 bp, Mus musculus
gacagaggataaggcgtatctccgg

SEQ ID NO: 641766 - DNA, 25 bp, Mus musculus
gacagaggcagaccttggagtatct

SEQ ID NO: 641767 - DNA, 25 bp, Mus musculus
gacagaggcagagcttggagtatct

SEQ ID NO: 641768 - DNA, 25 bp, Mus musculus
gacagaggcatgagggaccatacta

SEQ ID NO: 641769 - DNA, 25 bp, Mus musculus
gacagaggcatgtgggaccatacta

SEQ ID NO: 641770 - DNA, 25 bp, Mus musculus
gacagaggccgtcctggccatcgat

SEQ ID NO: 641771 - DNA, 25 bp, Mus musculus
gacagaggccgtgctggccatcgat

SEQ ID NO: 641772 - DNA, 25 bp, Mus musculus
gacagaggcggacattgcccacatt

SEQ ID NO: 641773 - DNA, 25 bp, Mus musculus
gacagaggcggagattgcccacatt

SEQ ID NO: 641774 - DNA, 25 bp, Mus musculus
gacagagggatcaagaccagcagca

SEQ ID NO: 641775 - DNA, 25 bp, Mus musculus
gacagagggatctagaccagcagca

SEQ ID NO: 641776 - DNA, 25 bp, Mus musculus
gacagagggccgcacctttgtccct

SEQ ID NO: 641777 - DNA, 25 bp, Mus musculus
gacagagggccggacctttgtccct

SEQ ID NO: 641778 - DNA, 25 bp, Mus musculus
gacagaggtcctcacatactgtcac

SEQ ID NO: 641779 - DNA, 25 bp, Mus musculus
gacagaggtcctgacatactgtcac

SEQ ID NO: 641780 - DNA, 25 bp, Mus musculus
gacagaggtgccaagtcaaggccaa

SEQ ID NO: 641781 - DNA, 25 bp, Mus musculus
gacagaggtgcctagtcaaggccaa

SEQ ID NO: 641782 - DNA, 25 bp, Mus musculus
gacagagtaaaacctggagactctc

SEQ ID NO: 641783 - DNA, 25 bp, Mus musculus
gacagagtaaaagctggagactctc

SEQ ID NO: 641784 - DNA, 25 bp, Mus musculus
gacagagtacatctgtggagatcag

SEQ ID NO: 641785 - DNA, 25 bp, Mus musculus
gacagagtacatgtgtggagatcag

SEQ ID NO: 641786 - DNA, 25 bp, Mus musculus
gacagagtcattcaaaacccacagg

SEQ ID NO: 641787 - DNA, 25 bp, Mus musculus
gacagagtcattgaaaacccacagg

SEQ ID NO: 641788 - DNA, 25 bp, Mus musculus
gacagagtcggtccagtatgaccac

SEQ ID NO: 641789 - DNA, 25 bp, Mus musculus
gacagagtcggtgcagtatgaccac

SEQ ID NO: 641790 - DNA, 25 bp, Mus musculus
gacagagtcgttcctacctaaacta

SEQ ID NO: 641791 - DNA, 25 bp, Mus musculus
gacagagtcgttgctacctaaacta

SEQ ID NO: 641792 - DNA, 25 bp, Mus musculus
gacagagtctgtcccgtcagatatc

SEQ ID NO: 641793 - DNA, 25 bp, Mus musculus
gacagagtctgtgccgtcagatatc

SEQ ID NO: 641794 - DNA, 25 bp, Mus musculus
gacagagtctttactgaactggcaa

SEQ ID NO: 641795 - DNA, 25 bp, Mus musculus
gacagagtcttttctgaactggcaa

SEQ ID NO: 641796 - DNA, 25 bp, Mus musculus
gacagagtgaaccaatatgctaatg

SEQ ID NO: 641797 - DNA, 25 bp, Mus musculus
gacagagtgaacgaatatgctaatg

SEQ ID NO: 641798 - DNA, 25 bp, Mus musculus
gacagagtgccgactttatgccccg

SEQ ID NO: 641799 - DNA, 25 bp, Mus musculus
gacagagtgccgtctttatgccccg

SEQ ID NO: 641800 - DNA, 25 bp, Mus musculus
gacagagtggacagtgcagatgctc

SEQ ID NO: 641801 - DNA, 25 bp, Mus musculus
gacagagtggactgtgcagatgctc

SEQ ID NO: 641802 - DNA, 25 bp, Mus musculus
gacagagtgtcacgcattcatgcag

SEQ ID NO: 641803 - DNA, 25 bp, Mus musculus
gacagagtgtcaggcattcatgcag

SEQ ID NO: 641804 - DNA, 25 bp, Mus musculus
gacagagttagtcctcgataattgc

SEQ ID NO: 641805 - DNA, 25 bp, Mus musculus
gacagagttagtgctcgataattgc

SEQ ID NO: 641806 - DNA, 25 bp, Mus musculus
gacagagttcgccaacaccagatac

SEQ ID NO: 641807 - DNA, 25 bp, Mus musculus
gacagagttcgcgaacaccagatac

SEQ ID NO: 641808 - DNA, 25 bp, Mus musculus
gacagagttgtcaacagtgagacac

SEQ ID NO: 641809 - DNA, 25 bp, Mus musculus
gacagagttgtctacagtgagacac

SEQ ID NO: 641810 - DNA, 25 bp, Mus musculus
gacagagttttaacgtcttctttgg

SEQ ID NO: 641811 - DNA, 25 bp, Mus musculus
gacagagttttatcgtcttctttgg

SEQ ID NO: 641812 - DNA, 25 bp, Mus musculus
gacagataccggctagacgatggcc

SEQ ID NO: 641813 - DNA, 25 bp, Mus musculus
gacagataccgggtagacgatggcc

SEQ ID NO: 641814 - DNA, 25 bp, Mus musculus
gacagataccttcttataatccttg

SEQ ID NO: 641815 - DNA, 25 bp, Mus musculus
gacagataccttgttataatccttg

SEQ ID NO: 641816 - DNA, 25 bp, Mus musculus
gacagatagtttccagagtacgcca

SEQ ID NO: 641817 - DNA, 25 bp, Mus musculus
gacagatagtttgcagagtacgcca

SEQ ID NO: 641818 - DNA, 25 bp, Mus musculus
gacagatatttacaaaggcaagccc

SEQ ID NO: 641819 - DNA, 25 bp, Mus musculus
gacagatatttagaaaggcaagccc

SEQ ID NO: 641820 - DNA, 25 bp, Mus musculus
gacagatcaggtaagtttctagaga

SEQ ID NO: 641821 - DNA, 25 bp, Mus musculus
gacagatcaggttagtttctagaga

SEQ ID NO: 641822 - DNA, 25 bp, Mus musculus
gacagatccactactcagcgcattg

SEQ ID NO: 641823 - DNA, 25 bp, Mus musculus
gacagatccacttctcagcgcattg

SEQ ID NO: 641824 - DNA, 25 bp, Mus musculus
gacagatcctggagcatcagcagat

SEQ ID NO: 641825 - DNA, 25 bp, Mus musculus
gacagatcctggtgcatcagcagat

SEQ ID NO: 641826 - DNA, 25 bp, Mus musculus
gacagatcgcggacttcatggccag

SEQ ID NO: 641827 - DNA, 25 bp, Mus musculus
gacagatcgcggtcttcatggccag

SEQ ID NO: 641828 - DNA, 25 bp, Mus musculus
gacagatcgttacgaccagaggaga

SEQ ID NO: 641829 - DNA, 25 bp, Mus musculus
gacagatcgttaggaccagaggaga

SEQ ID NO: 641830 - DNA, 25 bp, Mus musculus
gacagatctagaagtggttttggcc

SEQ ID NO: 641831 - DNA, 25 bp, Mus musculus
gacagatctagatgtggttttggcc

SEQ ID NO: 641832 - DNA, 25 bp, Mus musculus
gacagatctccgctcacttcatggg

SEQ ID NO: 641833 - DNA, 25 bp, Mus musculus
gacagatctccggtcacttcatggg

SEQ ID NO: 641834 - DNA, 25 bp, Mus musculus
gacagatctgcaacggcaacttact

SEQ ID NO: 641835 - DNA, 25 bp, Mus musculus
gacagatctgcatcggcaacttact

SEQ ID NO: 641836 - DNA, 25 bp, Mus musculus
gacagatctgccactgaagtagaca

SEQ ID NO: 641837 - DNA, 25 bp, Mus musculus
gacagatctgcctctgaagtagaca

SEQ ID NO: 641838 - DNA, 25 bp, Mus musculus
gacagatctgtcattgacctaaagc

SEQ ID NO: 641839 - DNA, 25 bp, Mus musculus
gacagatctgtctttgacctaaagc

SEQ ID NO: 641840 - DNA, 25 bp, Mus musculus
gacagatcttgcagcacctggacat

SEQ ID NO: 641841 - DNA, 25 bp, Mus musculus
gacagatcttgctgcacctggacat

SEQ ID NO: 641842 - DNA, 25 bp, Mus musculus
gacagatcttgtaccaccacttccg

SEQ ID NO: 641843 - DNA, 25 bp, Mus musculus
gacagatcttgttccaccacttccg

SEQ ID NO: 641844 - DNA, 25 bp, Mus musculus
gacagatgaaagaggaaaatccaaa

SEQ ID NO: 641845 - DNA, 25 bp, Mus musculus
gacagatgaaagtggaaaatccaaa

SEQ ID NO: 641846 - DNA, 25 bp, Mus musculus
gacagatgacagctcaatcagaagt

SEQ ID NO: 641847 - DNA, 25 bp, Mus musculus
gacagatgacaggtcaatcagaagt

SEQ ID NO: 641848 - DNA, 25 bp, Mus musculus
gacagatgacctagaccactacaac

SEQ ID NO: 641849 - DNA, 25 bp, Mus musculus
gacagatgaccttgaccactacaac

SEQ ID NO: 641850 - DNA, 25 bp, Mus musculus
gacagatgcacaattaagaaggaga

SEQ ID NO: 641851 - DNA, 25 bp, Mus musculus
gacagatgcacatttaagaaggaga

SEQ ID NO: 641852 - DNA, 25 bp, Mus musculus
gacagatgcagtcttagctcgagtg

SEQ ID NO: 641853 - DNA, 25 bp, Mus musculus
gacagatgcagtgttagctcgagtg

SEQ ID NO: 641854 - DNA, 25 bp, Mus musculus
gacagatgctaccagacctgcggga

SEQ ID NO: 641855 - DNA, 25 bp, Mus musculus
gacagatgctacgagacctgcggga

SEQ ID NO: 641856 - DNA, 25 bp, Mus musculus
gacagatgctgcacttgggcacctg

SEQ ID NO: 641857 - DNA, 25 bp, Mus musculus
gacagatgctgctcttgggcacctg

SEQ ID NO: 641858 - DNA, 25 bp, Mus musculus
gacagatggcaaaaagggcacctcc

SEQ ID NO: 641859 - DNA, 25 bp, Mus musculus
gacagatggcaataagggcacctcc

SEQ ID NO: 641860 - DNA, 25 bp, Mus musculus
gacagatggcagcaactgaataaag

SEQ ID NO: 641861 - DNA, 25 bp, Mus musculus
gacagatggcaggaactgaataaag

SEQ ID NO: 641862 - DNA, 25 bp, Mus musculus
gacagatggcccagaatgctacata

SEQ ID NO: 641863 - DNA, 25 bp, Mus musculus
gacagatggccctgaatgctacata

SEQ ID NO: 641864 - DNA, 25 bp, Mus musculus
gacagatgtcataaacgaagccatt

SEQ ID NO: 641865 - DNA, 25 bp, Mus musculus
gacagatgtcattaacgaagccatt

SEQ ID NO: 641866 - DNA, 25 bp, Mus musculus
gacagatgtgaccaagaccttcgca

SEQ ID NO: 641867 - DNA, 25 bp, Mus musculus
gacagatgtgacgaagaccttcgca

SEQ ID NO: 641868 - DNA, 25 bp, Mus musculus
gacagatgtgctcgtgtttctccag

SEQ ID NO: 641869 - DNA, 25 bp, Mus musculus
gacagatgtgctggtgtttctccag

SEQ ID NO: 641870 - DNA, 25 bp, Mus musculus
gacagatgtgtgagtggccccgacc

SEQ ID NO: 641871 - DNA, 25 bp, Mus musculus
gacagatgtgtgtgtggccccgacc

SEQ ID NO: 641872 - DNA, 25 bp, Mus musculus
gacagatgttccataagaccggcaa

SEQ ID NO: 641873 - DNA, 25 bp, Mus musculus
gacagatgttccttaagaccggcaa

SEQ ID NO: 641874 - DNA, 25 bp, Mus musculus
gacagattagccatcgcagggacct

SEQ ID NO: 641875 - DNA, 25 bp, Mus musculus
gacagattagccttcgcagggacct

SEQ ID NO: 641876 - DNA, 25 bp, Mus musculus
gacagattcaggcaagccacccatg

SEQ ID NO: 641877 - DNA, 25 bp, Mus musculus
gacagattcagggaagccacccatg

SEQ ID NO: 641878 - DNA, 25 bp, Mus musculus
gacagattcagtcatcaagcacctg

SEQ ID NO: 641879 - DNA, 25 bp, Mus musculus
gacagattcagtcccaggcagcgta

SEQ ID NO: 641880 - DNA, 25 bp, Mus musculus
gacagattcagtgatcaagcacctg

SEQ ID NO: 641881 - DNA, 25 bp, Mus musculus
gacagattcagtgccaggcagcgta

SEQ ID NO: 641882 - DNA, 25 bp, Mus musculus
gacagattccccatccaggaagaaa

SEQ ID NO: 641883 - DNA, 25 bp, Mus musculus
gacagattccccttccaggaagaaa

SEQ ID NO: 641884 - DNA, 25 bp, Mus musculus
gacagattctcacctaccgtggatg

SEQ ID NO: 641885 - DNA, 25 bp, Mus musculus
gacagattctcagctaccgtggatg

SEQ ID NO: 641886 - DNA, 25 bp, Mus musculus
gacagattcttcacaaacatatcaa

SEQ ID NO: 641887 - DNA, 25 bp, Mus musculus
gacagattcttccaacgccagctca

SEQ ID NO: 641888 - DNA, 25 bp, Mus musculus
gacagattcttcgaacgccagctca

SEQ ID NO: 641889 - DNA, 25 bp, Mus musculus
gacagattcttctcaaacatatcaa

SEQ ID NO: 641890 - DNA, 25 bp, Mus musculus
gacagattctttcactgaactcaga

SEQ ID NO: 641891 - DNA, 25 bp, Mus musculus
gacagattctttgactgaactcaga

SEQ ID NO: 641892 - DNA, 25 bp, Mus musculus
gacagattgactaactagagcgtct

SEQ ID NO: 641893 - DNA, 25 bp, Mus musculus
gacagattgacttactagagcgtct

SEQ ID NO: 641894 - DNA, 25 bp, Mus musculus
gacagattgcgcatcctggaggacc

SEQ ID NO: 641895 - DNA, 25 bp, Mus musculus
gacagattgcgcttcctggaggacc

SEQ ID NO: 641896 - DNA, 25 bp, Mus musculus
gacagattggacagatacagactct

SEQ ID NO: 641897 - DNA, 25 bp, Mus musculus
gacagattggactgatacagactct

SEQ ID NO: 641898 - DNA, 25 bp, Mus musculus
gacagattggtaagggtttcagacc

SEQ ID NO: 641899 - DNA, 25 bp, Mus musculus
gacagattggtatgggtttcagacc

SEQ ID NO: 641900 - DNA, 25 bp, Mus musculus
gacagattggttacagtcccagatg

SEQ ID NO: 641901 - DNA, 25 bp, Mus musculus
gacagattggtttcagtcccagatg

SEQ ID NO: 641902 - DNA, 25 bp, Mus musculus
gacagatttccacctgacagcttcg

SEQ ID NO: 641903 - DNA, 25 bp, Mus musculus
gacagatttccagctgacagcttcg

SEQ ID NO: 641904 - DNA, 25 bp, Mus musculus
gacagatttttaactccagaagcac

SEQ ID NO: 641905 - DNA, 25 bp, Mus musculus
gacagatttttatctccagaagcac

SEQ ID NO: 641906 - DNA, 25 bp, Mus musculus
gacagcaaagaacataacgcccggc

SEQ ID NO: 641907 - DNA, 25 bp, Mus musculus
gacagcaaagaagataacgcccggc

SEQ ID NO: 641908 - DNA, 25 bp, Mus musculus
gacagcaaaggaaaagacaaggaat

SEQ ID NO: 641909 - DNA, 25 bp, Mus musculus
gacagcaaaggataagacaaggaat

SEQ ID NO: 641910 - DNA, 25 bp, Mus musculus
gacagcaaagtgagcttccccaaga

SEQ ID NO: 641911 - DNA, 25 bp, Mus musculus
gacagcaaagtgtgcttccccaaga

SEQ ID NO: 641912 - DNA, 25 bp, Mus musculus
gacagcaacaatctgacagacatgt

SEQ ID NO: 641913 - DNA, 25 bp, Mus musculus
gacagcaacaatgtgacagacatgt

SEQ ID NO: 641914 - DNA, 25 bp, Mus musculus
gacagcaactgaacaatggattttt

SEQ ID NO: 641915 - DNA, 25 bp, Mus musculus
gacagcaactgatcaatggattttt

SEQ ID NO: 641916 - DNA, 25 bp, Mus musculus
gacagcaagccgctctttaaagaag

SEQ ID NO: 641917 - DNA, 25 bp, Mus musculus
gacagcaagccggtctttaaagaag

SEQ ID NO: 641918 - DNA, 25 bp, Mus musculus
gacagcaagctcaggtggcatagcc

SEQ ID NO: 641919 - DNA, 25 bp, Mus musculus
gacagcaagctctggtggcatagcc

SEQ ID NO: 641920 - DNA, 25 bp, Mus musculus
gacagcaaggtactcaacagcctgg

SEQ ID NO: 641921 - DNA, 25 bp, Mus musculus
gacagcaaggtagtcaacagcctgg

SEQ ID NO: 641922 - DNA, 25 bp, Mus musculus
gacagcaatgacagagagcgtgtga

SEQ ID NO: 641923 - DNA, 25 bp, Mus musculus
gacagcaatgactgagagcgtgtga

SEQ ID NO: 641924 - DNA, 25 bp, Mus musculus
gacagcaatttccacatggatttca

SEQ ID NO: 641925 - DNA, 25 bp, Mus musculus
gacagcaatttcgacatggatttca

SEQ ID NO: 641926 - DNA, 25 bp, Mus musculus
gacagcacaattcctcgaacagtca

SEQ ID NO: 641927 - DNA, 25 bp, Mus musculus
gacagcacaattgctcgaacagtca

SEQ ID NO: 641928 - DNA, 25 bp, Mus musculus
gacagcacacgtcacactactctga

SEQ ID NO: 641929 - DNA, 25 bp, Mus musculus
gacagcacacgtgacactactctga

SEQ ID NO: 641930 - DNA, 25 bp, Mus musculus
gacagcacagccaaggaggtctacc

SEQ ID NO: 641931 - DNA, 25 bp, Mus musculus
gacagcacagcctaggaggtctacc

SEQ ID NO: 641932 - DNA, 25 bp, Mus musculus
gacagcaccagtctagcagctatgc

SEQ ID NO: 641933 - DNA, 25 bp, Mus musculus
gacagcaccagtgtagcagctatgc

SEQ ID NO: 641934 - DNA, 25 bp, Mus musculus
gacagcacgtgcctgagctaatttg

SEQ ID NO: 641935 - DNA, 25 bp, Mus musculus
gacagcacgtgcgtgagctaatttg

SEQ ID NO: 641936 - DNA, 25 bp, Mus musculus
gacagcactagactgtaatgaccct

SEQ ID NO: 641937 - DNA, 25 bp, Mus musculus
gacagcactagagtgtaatgaccct

SEQ ID NO: 641938 - DNA, 25 bp, Mus musculus
gacagcactgtaagcctggtagatg

SEQ ID NO: 641939 - DNA, 25 bp, Mus musculus
gacagcactgtatgcctggtagatg

SEQ ID NO: 641940 - DNA, 25 bp, Mus musculus
gacagcacttttcctgacatgtgaa

SEQ ID NO: 641941 - DNA, 25 bp, Mus musculus
gacagcacttttgctgacatgtgaa

SEQ ID NO: 641942 - DNA, 25 bp, Mus musculus
gacagcagcactcagacgttggact

SEQ ID NO: 641943 - DNA, 25 bp, Mus musculus
gacagcagcactgagacgttggact

SEQ ID NO: 641944 - DNA, 25 bp, Mus musculus
gacagcagccttctatagttcctat

SEQ ID NO: 641945 - DNA, 25 bp, Mus musculus
gacagcagccttgtatagttcctat

SEQ ID NO: 641946 - DNA, 25 bp, Mus musculus
gacagcagctcaagcggaagtggca

SEQ ID NO: 641947 - DNA, 25 bp, Mus musculus
gacagcagctcatgcggaagtggca

SEQ ID NO: 641948 - DNA, 25 bp, Mus musculus
gacagcagctctctatggacggttg

SEQ ID NO: 641949 - DNA, 25 bp, Mus musculus
gacagcagctctgtatggacggttg

SEQ ID NO: 641950 - DNA, 25 bp, Mus musculus
gacagcagcttcaagaggattcttg

SEQ ID NO: 641951 - DNA, 25 bp, Mus musculus
gacagcagcttctagaggattcttg

SEQ ID NO: 641952 - DNA, 25 bp, Mus musculus
gacagcaggaacatgtttgccttgt

SEQ ID NO: 641953 - DNA, 25 bp, Mus musculus
gacagcaggaacttgtttgccttgt

SEQ ID NO: 641954 - DNA, 25 bp, Mus musculus
gacagcaggcatagctgccgcagca

SEQ ID NO: 641955 - DNA, 25 bp, Mus musculus
gacagcaggcattgctgccgcagca

SEQ ID NO: 641956 - DNA, 25 bp, Mus musculus
gacagcaggcttagctgtatccctg

SEQ ID NO: 641957 - DNA, 25 bp, Mus musculus
gacagcaggctttgctgtatccctg

SEQ ID NO: 641958 - DNA, 25 bp, Mus musculus
gacagcagggaaacaaccagccttc

SEQ ID NO: 641959 - DNA, 25 bp, Mus musculus
gacagcagggaatcaaccagccttc

SEQ ID NO: 641960 - DNA, 25 bp, Mus musculus
gacagcaggtttcagctgctgaatt

SEQ ID NO: 641961 - DNA, 25 bp, Mus musculus
gacagcaggtttgagctgctgaatt

SEQ ID NO: 641962 - DNA, 25 bp, Mus musculus
gacagcagtgcaaattccttcacag

SEQ ID NO: 641963 - DNA, 25 bp, Mus musculus
gacagcagtgcatattccttcacag

SEQ ID NO: 641964 - DNA, 25 bp, Mus musculus
gacagcagtggcatgtttcactggt

SEQ ID NO: 641965 - DNA, 25 bp, Mus musculus
gacagcagtggcttgtttcactggt

SEQ ID NO: 641966 - DNA, 25 bp, Mus musculus
gacagcagtgtcacaaacctaccca

SEQ ID NO: 641967 - DNA, 25 bp, Mus musculus
gacagcagtgtctcaaacctaccca

SEQ ID NO: 641968 - DNA, 25 bp, Mus musculus
gacagcagttgaacattcatggatt

SEQ ID NO: 641969 - DNA, 25 bp, Mus musculus
gacagcagttgatcattcatggatt

SEQ ID NO: 641970 - DNA, 25 bp, Mus musculus
gacagcatcggcagccacaggaaga

SEQ ID NO: 641971 - DNA, 25 bp, Mus musculus
gacagcatcggctgccacaggaaga

SEQ ID NO: 641972 - DNA, 25 bp, Mus musculus
gacagcatctccctccctgaagagt

SEQ ID NO: 641973 - DNA, 25 bp, Mus musculus
gacagcatctccgtccctgaagagt

SEQ ID NO: 641974 - DNA, 25 bp, Mus musculus
gacagcatctggcatctatttatga

SEQ ID NO: 641975 - DNA, 25 bp, Mus musculus
gacagcatctgggatctatttatga

SEQ ID NO: 641976 - DNA, 25 bp, Mus musculus
gacagcatgagcctaaccactggag

SEQ ID NO: 641977 - DNA, 25 bp, Mus musculus
gacagcatgagcgtaaccactggag

SEQ ID NO: 641978 - DNA, 25 bp, Mus musculus
gacagcatgaggaagcaaataaaac

SEQ ID NO: 641979 - DNA, 25 bp, Mus musculus
gacagcatgaggtagcaaataaaac

SEQ ID NO: 641980 - DNA, 25 bp, Mus musculus
gacagcatgagtatcccgcgaggct

SEQ ID NO: 641981 - DNA, 25 bp, Mus musculus
gacagcatgagtttcccgcgaggct

SEQ ID NO: 641982 - DNA, 25 bp, Mus musculus
gacagcatgcctacgctgcgatgcc

SEQ ID NO: 641983 - DNA, 25 bp, Mus musculus
gacagcatgccttcgctgcgatgcc

SEQ ID NO: 641984 - DNA, 25 bp, Mus musculus
gacagcatggaacaggctctgatcc

SEQ ID NO: 641985 - DNA, 25 bp, Mus musculus
gacagcatggaagaggctctgatcc

SEQ ID NO: 641986 - DNA, 25 bp, Mus musculus
gacagcatggcacgcaactttgaag

SEQ ID NO: 641987 - DNA, 25 bp, Mus musculus
gacagcatggcaggcaactttgaag

SEQ ID NO: 641988 - DNA, 25 bp, Mus musculus
gacagcattgtcacttcctagctgc

SEQ ID NO: 641989 - DNA, 25 bp, Mus musculus
gacagcattgtctcttcctagctgc

SEQ ID NO: 641990 - DNA, 25 bp, Mus musculus
gacagccaagcactcaaaaccagga

SEQ ID NO: 641991 - DNA, 25 bp, Mus musculus
gacagccaagcagtcaaaaccagga

SEQ ID NO: 641992 - DNA, 25 bp, Mus musculus
gacagccaaggtcccagtgcttgtc

SEQ ID NO: 641993 - DNA, 25 bp, Mus musculus
gacagccaaggtgccagtgcttgtc

SEQ ID NO: 641994 - DNA, 25 bp, Mus musculus
gacagccaatgacccgcctcaagat

SEQ ID NO: 641995 - DNA, 25 bp, Mus musculus
gacagccaatgagccgcctcaagat

SEQ ID NO: 641996 - DNA, 25 bp, Mus musculus
gacagccaatttatccctagagatg

SEQ ID NO: 641997 - DNA, 25 bp, Mus musculus
gacagccaatttttccctagagatg

SEQ ID NO: 641998 - DNA, 25 bp, Mus musculus
gacagccagcatctcatccacaaat

SEQ ID NO: 641999 - DNA, 25 bp, Mus musculus
gacagccagcatgtcatccacaaat

SEQ ID NO: 642000 - DNA, 25 bp, Mus musculus
gacagccagccaaggctgaccagtg

SEQ ID NO: 642001 - DNA, 25 bp, Mus musculus
gacagccagccatggctgaccagtg

SEQ ID NO: 642002 - DNA, 25 bp, Mus musculus
gacagccatcagactgagcagactc

SEQ ID NO: 642003 - DNA, 25 bp, Mus musculus
gacagccatcagtctgagcagactc

SEQ ID NO: 642004 - DNA, 25 bp, Mus musculus
gacagccatgaaaaccgggtgtgcc

SEQ ID NO: 642005 - DNA, 25 bp, Mus musculus
gacagccatgaataccgggtgtgcc

SEQ ID NO: 642006 - DNA, 25 bp, Mus musculus
gacagcccaactcgacagaaggtga

SEQ ID NO: 642007 - DNA, 25 bp, Mus musculus
gacagcccaactggacagaaggtga

SEQ ID NO: 642008 - DNA, 25 bp, Mus musculus
gacagcccacagcagtagtctagag

SEQ ID NO: 642009 - DNA, 25 bp, Mus musculus
gacagcccacaggagtagtctagag

SEQ ID NO: 642010 - DNA, 25 bp, Mus musculus
gacagcccagttagctgagggtggg

SEQ ID NO: 642011 - DNA, 25 bp, Mus musculus
gacagcccagtttgctgagggtggg

SEQ ID NO: 642012 - DNA, 25 bp, Mus musculus
gacagccccgagatgtcacagtcaa

SEQ ID NO: 642013 - DNA, 25 bp, Mus musculus
gacagccccgagttgtcacagtcaa

SEQ ID NO: 642014 - DNA, 25 bp, Mus musculus
gacagccctaacctaactggaacca

SEQ ID NO: 642015 - DNA, 25 bp, Mus musculus
gacagccctaacgtaactggaacca

SEQ ID NO: 642016 - DNA, 25 bp, Mus musculus
gacagccctgagcatattcttttct

SEQ ID NO: 642017 - DNA, 25 bp, Mus musculus
gacagccctgaggatattcttttct

SEQ ID NO: 642018 - DNA, 25 bp, Mus musculus
gacagccgcagaacgtattcactag

SEQ ID NO: 642019 - DNA, 25 bp, Mus musculus
gacagccgcagatcgtattcactag

SEQ ID NO: 642020 - DNA, 25 bp, Mus musculus
gacagccgcttacgtgggaatcgca

SEQ ID NO: 642021 - DNA, 25 bp, Mus musculus
gacagccgcttaggtgggaatcgca

SEQ ID NO: 642022 - DNA, 25 bp, Mus musculus
gacagcctagaaccatgggatctcg

SEQ ID NO: 642023 - DNA, 25 bp, Mus musculus
gacagcctagaagcatgggatctcg

SEQ ID NO: 642024 - DNA, 25 bp, Mus musculus
gacagcctaggaccaagtgagcact

SEQ ID NO: 642025 - DNA, 25 bp, Mus musculus
gacagcctaggagcaagtgagcact

SEQ ID NO: 642026 - DNA, 25 bp, Mus musculus
gacagcctagtgactaaggccctag

SEQ ID NO: 642027 - DNA, 25 bp, Mus musculus
gacagcctagtgtctaaggccctag

SEQ ID NO: 642028 - DNA, 25 bp, Mus musculus
gacagcctgtggatgtacgtgtgta

SEQ ID NO: 642029 - DNA, 25 bp, Mus musculus
gacagcctgtggttgtacgtgtgta

SEQ ID NO: 642030 - DNA, 25 bp, Mus musculus
gacagccttatgctcctttcagata

SEQ ID NO: 642031 - DNA, 25 bp, Mus musculus
gacagccttatggtcctttcagata

SEQ ID NO: 642032 - DNA, 25 bp, Mus musculus
gacagccttcgcacagatgtctttg

SEQ ID NO: 642033 - DNA, 25 bp, Mus musculus
gacagccttcgctcagatgtctttg

SEQ ID NO: 642034 - DNA, 25 bp, Mus musculus
gacagccttctgcaactcggacctg

SEQ ID NO: 642035 - DNA, 25 bp, Mus musculus
gacagccttctggaactcggacctg

SEQ ID NO: 642036 - DNA, 25 bp, Mus musculus
gacagccttgtgaggaatggcactg

SEQ ID NO: 642037 - DNA, 25 bp, Mus musculus
gacagccttgtgtggaatggcactg

SEQ ID NO: 642038 - DNA, 25 bp, Mus musculus
gacagcgaaactctggaatggttcc

SEQ ID NO: 642039 - DNA, 25 bp, Mus musculus
gacagcgaaactgtggaatggttcc

SEQ ID NO: 642040 - DNA, 25 bp, Mus musculus
gacagcgagagtcacaacagcgcag

SEQ ID NO: 642041 - DNA, 25 bp, Mus musculus
gacagcgagagtgacaacagcgcag

SEQ ID NO: 642042 - DNA, 25 bp, Mus musculus
gacagcgagcgcaggaaagccatca

SEQ ID NO: 642043 - DNA, 25 bp, Mus musculus
gacagcgagcgctggaaagccatca

SEQ ID NO: 642044 - DNA, 25 bp, Mus musculus
gacagcgaggagcacttcgactcca

SEQ ID NO: 642045 - DNA, 25 bp, Mus musculus
gacagcgaggaggacttcgactcca

SEQ ID NO: 642046 - DNA, 25 bp, Mus musculus
gacagcgatgatcaggaagctctta

SEQ ID NO: 642047 - DNA, 25 bp, Mus musculus
gacagcgatgatgaggaagctctta

SEQ ID NO: 642048 - DNA, 25 bp, Mus musculus
gacagcgattgaaatgagagctcac

SEQ ID NO: 642049 - DNA, 25 bp, Mus musculus
gacagcgattgatatgagagctcac

SEQ ID NO: 642050 - DNA, 25 bp, Mus musculus
gacagcgcccgactctatgagaacg

SEQ ID NO: 642051 - DNA, 25 bp, Mus musculus
gacagcgcccgagtctatgagaacg

SEQ ID NO: 642052 - DNA, 25 bp, Mus musculus
gacagcgcggccagctgtgactact

SEQ ID NO: 642053 - DNA, 25 bp, Mus musculus
gacagcgcggcctgctgtgactact

SEQ ID NO: 642054 - DNA, 25 bp, Mus musculus
gacagcgctcgcagaagagctacac

SEQ ID NO: 642055 - DNA, 25 bp, Mus musculus
gacagcgctcgctgaagagctacac

SEQ ID NO: 642056 - DNA, 25 bp, Mus musculus
gacagcgctgctatgtacacaccca

SEQ ID NO: 642057 - DNA, 25 bp, Mus musculus
gacagcgctgctttgtacacaccca

SEQ ID NO: 642058 - DNA, 25 bp, Mus musculus
gacagcgctgttctcctaacccgat

SEQ ID NO: 642059 - DNA, 25 bp, Mus musculus
gacagcgctgttgtcctaacccgat

SEQ ID NO: 642060 - DNA, 25 bp, Mus musculus
gacagcggaaggaactggccacagt

SEQ ID NO: 642061 - DNA, 25 bp, Mus musculus
gacagcggaaggtactggccacagt

SEQ ID NO: 642062 - DNA, 25 bp, Mus musculus
gacagcgggaacaggataggatcat

SEQ ID NO: 642063 - DNA, 25 bp, Mus musculus
gacagcgggaactggataggatcat

SEQ ID NO: 642064 - DNA, 25 bp, Mus musculus
gacagcgggttactacatctgcacc

SEQ ID NO: 642065 - DNA, 25 bp, Mus musculus
gacagcgggttagtacatctgcacc

SEQ ID NO: 642066 - DNA, 25 bp, Mus musculus
gacagcgtgaacagtctgaggacac

SEQ ID NO: 642067 - DNA, 25 bp, Mus musculus
gacagcgtgaactgtctgaggacac

SEQ ID NO: 642068 - DNA, 25 bp, Mus musculus
gacagcgtggagattgcgtttatgt

SEQ ID NO: 642069 - DNA, 25 bp, Mus musculus
gacagcgtggagtttgcgtttatgt

SEQ ID NO: 642070 - DNA, 25 bp, Mus musculus
gacagcgtttgaagcagatgacccg

SEQ ID NO: 642071 - DNA, 25 bp, Mus musculus
gacagcgtttgatgcagatgacccg

SEQ ID NO: 642072 - DNA, 25 bp, Mus musculus
gacagctaatgacgacgacagcgaa

SEQ ID NO: 642073 - DNA, 25 bp, Mus musculus
gacagctaatgaggacgacagcgaa

SEQ ID NO: 642074 - DNA, 25 bp, Mus musculus
gacagctacagccatgatgattaaa

SEQ ID NO: 642075 - DNA, 25 bp, Mus musculus
gacagctacagcgatgatgattaaa

SEQ ID NO: 642076 - DNA, 25 bp, Mus musculus
gacagctacatgctcgtgatgcgca

SEQ ID NO: 642077 - DNA, 25 bp, Mus musculus
gacagctacatggtcgtgatgcgca

SEQ ID NO: 642078 - DNA, 25 bp, Mus musculus
gacagctacgcccagtttgaggaga

SEQ ID NO: 642079 - DNA, 25 bp, Mus musculus
gacagctacgccgagtttgaggaga

SEQ ID NO: 642080 - DNA, 25 bp, Mus musculus
gacagctactataacgggaagttgg

SEQ ID NO: 642081 - DNA, 25 bp, Mus musculus
gacagctactattacgggaagttgg

SEQ ID NO: 642082 - DNA, 25 bp, Mus musculus
gacagctacttcacactctggctga

SEQ ID NO: 642083 - DNA, 25 bp, Mus musculus
gacagctacttctcactctggctga

SEQ ID NO: 642084 - DNA, 25 bp, Mus musculus
gacagctaggttctcctttctggtc

SEQ ID NO: 642085 - DNA, 25 bp, Mus musculus
gacagctaggttgtcctttctggtc

SEQ ID NO: 642086 - DNA, 25 bp, Mus musculus
gacagctataacagcagggagaagc

SEQ ID NO: 642087 - DNA, 25 bp, Mus musculus
gacagctataactgcagggagaagc

SEQ ID NO: 642088 - DNA, 25 bp, Mus musculus
gacagctatgctaacactagaaacc

SEQ ID NO: 642089 - DNA, 25 bp, Mus musculus
gacagctatgcttacactagaaacc

SEQ ID NO: 642090 - DNA, 25 bp, Mus musculus
gacagctcaccgaagctcagatttg

SEQ ID NO: 642091 - DNA, 25 bp, Mus musculus
gacagctcaccgtagctcagatttg

SEQ ID NO: 642092 - DNA, 25 bp, Mus musculus
gacagctcacgtacttggatgtttc

SEQ ID NO: 642093 - DNA, 25 bp, Mus musculus
gacagctcacgttcttggatgtttc

SEQ ID NO: 642094 - DNA, 25 bp, Mus musculus
gacagctccactagtgggacgccac

SEQ ID NO: 642095 - DNA, 25 bp, Mus musculus
gacagctccacttgtgggacgccac

SEQ ID NO: 642096 - DNA, 25 bp, Mus musculus
gacagctccagaatgcctatggcag

SEQ ID NO: 642097 - DNA, 25 bp, Mus musculus
gacagctccagattgcctatggcag

SEQ ID NO: 642098 - DNA, 25 bp, Mus musculus
gacagctccggtcctgatgttggag

SEQ ID NO: 642099 - DNA, 25 bp, Mus musculus
gacagctccggtgctgatgttggag

SEQ ID NO: 642100 - DNA, 25 bp, Mus musculus
gacagctcctcacgcaatgtgtctg

SEQ ID NO: 642101 - DNA, 25 bp, Mus musculus
gacagctcctcaggcaatgtgtctg

SEQ ID NO: 642102 - DNA, 25 bp, Mus musculus
gacagctcctttaacttcatgacat

SEQ ID NO: 642103 - DNA, 25 bp, Mus musculus
gacagctccttttacttcatgacat

SEQ ID NO: 642104 - DNA, 25 bp, Mus musculus
gacagctcgactatgggcacacgtg

SEQ ID NO: 642105 - DNA, 25 bp, Mus musculus
gacagctcgactttgggcacacgtg

SEQ ID NO: 642106 - DNA, 25 bp, Mus musculus
gacagctcggacaggatcgtctggc

SEQ ID NO: 642107 - DNA, 25 bp, Mus musculus
gacagctcggactggatcgtctggc

SEQ ID NO: 642108 - DNA, 25 bp, Mus musculus
gacagctctcccaaaggacaaggac

SEQ ID NO: 642109 - DNA, 25 bp, Mus musculus
gacagctctccctaaggacaaggac

SEQ ID NO: 642110 - DNA, 25 bp, Mus musculus
gacagctctgcaatgggcaacagaa

SEQ ID NO: 642111 - DNA, 25 bp, Mus musculus
gacagctctgcattgggcaacagaa

SEQ ID NO: 642112 - DNA, 25 bp, Mus musculus
gacagctcttacatcagcagcgatg

SEQ ID NO: 642113 - DNA, 25 bp, Mus musculus
gacagctcttacttcagcagcgatg

SEQ ID NO: 642114 - DNA, 25 bp, Mus musculus
gacagctgatttaggtctggtcaga

SEQ ID NO: 642115 - DNA, 25 bp, Mus musculus
gacagctgattttggtctggtcaga

SEQ ID NO: 642116 - DNA, 25 bp, Mus musculus
gacagctgcctgatgtcctagccag

SEQ ID NO: 642117 - DNA, 25 bp, Mus musculus
gacagctgcctgttgtcctagccag

SEQ ID NO: 642118 - DNA, 25 bp, Mus musculus
gacagctgctgtaagactatggtag

SEQ ID NO: 642119 - DNA, 25 bp, Mus musculus
gacagctgctgttagactatggtag

SEQ ID NO: 642120 - DNA, 25 bp, Mus musculus
gacagctggaccaagccgagactgt

SEQ ID NO: 642121 - DNA, 25 bp, Mus musculus
gacagctggacctagccgagactgt

SEQ ID NO: 642122 - DNA, 25 bp, Mus musculus
gacagctggagcagtgtccctcagc

SEQ ID NO: 642123 - DNA, 25 bp, Mus musculus
gacagctggagctgtgtccctcagc

SEQ ID NO: 642124 - DNA, 25 bp, Mus musculus
gacagctggcaaagcaaattagaga

SEQ ID NO: 642125 - DNA, 25 bp, Mus musculus
gacagctggcaatgcaaattagaga

SEQ ID NO: 642126 - DNA, 25 bp, Mus musculus
gacagctgggagaacattttcgaac

SEQ ID NO: 642127 - DNA, 25 bp, Mus musculus
gacagctgggagtacattttcgaac

SEQ ID NO: 642128 - DNA, 25 bp, Mus musculus
gacagctggtttcagtcagtgccac

SEQ ID NO: 642129 - DNA, 25 bp, Mus musculus
gacagctggtttgagtcagtgccac

SEQ ID NO: 642130 - DNA, 25 bp, Mus musculus
gacagctgtagaaatgccatcctgg

SEQ ID NO: 642131 - DNA, 25 bp, Mus musculus
gacagctgtagatatgccatcctgg

SEQ ID NO: 642132 - DNA, 25 bp, Mus musculus
gacagctgtccacgaaaatctcatg

SEQ ID NO: 642133 - DNA, 25 bp, Mus musculus
gacagctgtccaggaaaatctcatg

SEQ ID NO: 642134 - DNA, 25 bp, Mus musculus
gacagctgtgctcctatctcaggag

SEQ ID NO: 642135 - DNA, 25 bp, Mus musculus
gacagctgtgctgctatctcaggag

SEQ ID NO: 642136 - DNA, 25 bp, Mus musculus
gacagctgttctctggctcattgga

SEQ ID NO: 642137 - DNA, 25 bp, Mus musculus
gacagctgttctgtggctcattgga

SEQ ID NO: 642138 - DNA, 25 bp, Mus musculus
gacagctgttgtaaccccatgagca

SEQ ID NO: 642139 - DNA, 25 bp, Mus musculus
gacagctgttgttaccccatgagca

SEQ ID NO: 642140 - DNA, 25 bp, Mus musculus
gacagcttcaatctggtgtccacac

SEQ ID NO: 642141 - DNA, 25 bp, Mus musculus
gacagcttcaatgtggtgtccacac

SEQ ID NO: 642142 - DNA, 25 bp, Mus musculus
gacagcttcatcaagccttacgcca

SEQ ID NO: 642143 - DNA, 25 bp, Mus musculus
gacagcttcatctagccttacgcca

SEQ ID NO: 642144 - DNA, 25 bp, Mus musculus
gacagcttccctaaacccaagcgtg

SEQ ID NO: 642145 - DNA, 25 bp, Mus musculus
gacagcttcccttaacccaagcgtg

SEQ ID NO: 642146 - DNA, 25 bp, Mus musculus
gacagcttctacatcgtggatgacc

SEQ ID NO: 642147 - DNA, 25 bp, Mus musculus
gacagcttctacttcgtggatgacc

SEQ ID NO: 642148 - DNA, 25 bp, Mus musculus
gacagcttctcaacaaagggctaca

SEQ ID NO: 642149 - DNA, 25 bp, Mus musculus
gacagcttctcatcaaagggctaca

SEQ ID NO: 642150 - DNA, 25 bp, Mus musculus
gacagcttctgtcaacacgatgccg

SEQ ID NO: 642151 - DNA, 25 bp, Mus musculus
gacagcttctgtgaacacgatgccg

SEQ ID NO: 642152 - DNA, 25 bp, Mus musculus
gacagcttgcctcaccagctggtga

SEQ ID NO: 642153 - DNA, 25 bp, Mus musculus
gacagcttgcctgaccagctggtga

SEQ ID NO: 642154 - DNA, 25 bp, Mus musculus
gacagcttgtaaaggagacacccat

SEQ ID NO: 642155 - DNA, 25 bp, Mus musculus
gacagcttgtaatggagacacccat

SEQ ID NO: 642156 - DNA, 25 bp, Mus musculus
gacaggaaaaacagctggcatggaa

SEQ ID NO: 642157 - DNA, 25 bp, Mus musculus
gacaggaaaaactgctggcatggaa

SEQ ID NO: 642158 - DNA, 25 bp, Mus musculus
gacaggaaactccacctgaccgtgg

SEQ ID NO: 642159 - DNA, 25 bp, Mus musculus
gacaggaaactcgacctgaccgtgg

SEQ ID NO: 642160 - DNA, 25 bp, Mus musculus
gacaggaacacacgcagatcaaggt

SEQ ID NO: 642161 - DNA, 25 bp, Mus musculus
gacaggaacacaggcagatcaaggt

SEQ ID NO: 642162 - DNA, 25 bp, Mus musculus
gacaggaacagcaccctcgggtgtt

SEQ ID NO: 642163 - DNA, 25 bp, Mus musculus
gacaggaacagctccctcgggtgtt

SEQ ID NO: 642164 - DNA, 25 bp, Mus musculus
gacaggaaccagatgcgacgggtcc

SEQ ID NO: 642165 - DNA, 25 bp, Mus musculus
gacaggaaccagttgcgacgggtcc

SEQ ID NO: 642166 - DNA, 25 bp, Mus musculus
gacaggaaccctcctcttggaggtg

SEQ ID NO: 642167 - DNA, 25 bp, Mus musculus
gacaggaaccctgctcttggaggtg

SEQ ID NO: 642168 - DNA, 25 bp, Mus musculus
gacaggaaccgaagggagcgcttct

SEQ ID NO: 642169 - DNA, 25 bp, Mus musculus
gacaggaaccgatgggagcgcttct

SEQ ID NO: 642170 - DNA, 25 bp, Mus musculus
gacaggaactcccatggtggctgct

SEQ ID NO: 642171 - DNA, 25 bp, Mus musculus
gacaggaactccgatggtggctgct

SEQ ID NO: 642172 - DNA, 25 bp, Mus musculus
gacaggaagaagaccactcctgccc

SEQ ID NO: 642173 - DNA, 25 bp, Mus musculus
gacaggaagaagtccactcctgccc

SEQ ID NO: 642174 - DNA, 25 bp, Mus musculus
gacaggacagatatccagtgcctca

SEQ ID NO: 642175 - DNA, 25 bp, Mus musculus
gacaggacagatttccagtgcctca

SEQ ID NO: 642176 - DNA, 25 bp, Mus musculus
gacaggacaggaaatgacgagaaga

SEQ ID NO: 642177 - DNA, 25 bp, Mus musculus
gacaggacaggatatgacgagaaga

SEQ ID NO: 642178 - DNA, 25 bp, Mus musculus
gacaggacctcaatatcttacccag

SEQ ID NO: 642179 - DNA, 25 bp, Mus musculus
gacaggacctcattatcttacccag

SEQ ID NO: 642180 - DNA, 25 bp, Mus musculus
gacaggaccttccatctcatcgcgg

SEQ ID NO: 642181 - DNA, 25 bp, Mus musculus
gacaggaccttcgatctcatcgcgg

SEQ ID NO: 642182 - DNA, 25 bp, Mus musculus
gacaggagaacaatgtgcgcaccct

SEQ ID NO: 642183 - DNA, 25 bp, Mus musculus
gacaggagaacattgtgcgcaccct

SEQ ID NO: 642184 - DNA, 25 bp, Mus musculus
gacaggagacctcccatggcctgcg

SEQ ID NO: 642185 - DNA, 25 bp, Mus musculus
gacaggagacctgccatggcctgcg

SEQ ID NO: 642186 - DNA, 25 bp, Mus musculus
gacaggagataaaccaagactctga

SEQ ID NO: 642187 - DNA, 25 bp, Mus musculus
gacaggagataatccaagactctga

SEQ ID NO: 642188 - DNA, 25 bp, Mus musculus
gacaggagcaaaccgagctttcatg

SEQ ID NO: 642189 - DNA, 25 bp, Mus musculus
gacaggagcaaagcgagctttcatg

SEQ ID NO: 642190 - DNA, 25 bp, Mus musculus
gacaggagcagcatatccatcaccg

SEQ ID NO: 642191 - DNA, 25 bp, Mus musculus
gacaggagcagcttatccatcaccg

SEQ ID NO: 642192 - DNA, 25 bp, Mus musculus
gacaggatactcattcatgacagga

SEQ ID NO: 642193 - DNA, 25 bp, Mus musculus
gacaggatactctttcatgacagga

SEQ ID NO: 642194 - DNA, 25 bp, Mus musculus
gacaggatctatccatatgcagcca

SEQ ID NO: 642195 - DNA, 25 bp, Mus musculus
gacaggatctatgcatatgcagcca

SEQ ID NO: 642196 - DNA, 25 bp, Mus musculus
gacaggatctccagaaagactttgc

SEQ ID NO: 642197 - DNA, 25 bp, Mus musculus
gacaggatctcctgaaagactttgc

SEQ ID NO: 642198 - DNA, 25 bp, Mus musculus
gacaggatggcactcaaggctccag

SEQ ID NO: 642199 - DNA, 25 bp, Mus musculus
gacaggatggcagtcaaggctccag

SEQ ID NO: 642200 - DNA, 25 bp, Mus musculus
gacaggatggtgctcatgtctccag

SEQ ID NO: 642201 - DNA, 25 bp, Mus musculus
gacaggatggtggtcatgtctccag

SEQ ID NO: 642202 - DNA, 25 bp, Mus musculus
gacaggatgtttagacagttcacac

SEQ ID NO: 642203 - DNA, 25 bp, Mus musculus
gacaggatgttttgacagttcacac

SEQ ID NO: 642204 - DNA, 25 bp, Mus musculus
gacaggattccccatgctggcaaag

SEQ ID NO: 642205 - DNA, 25 bp, Mus musculus
gacaggattcccgatgctggcaaag

SEQ ID NO: 642206 - DNA, 25 bp, Mus musculus
gacaggattcgtaggctaccgtccc

SEQ ID NO: 642207 - DNA, 25 bp, Mus musculus
gacaggattcgttggctaccgtccc

SEQ ID NO: 642208 - DNA, 25 bp, Mus musculus
gacaggatttacaagctaaccacgt

SEQ ID NO: 642209 - DNA, 25 bp, Mus musculus
gacaggatttactagctaaccacgt

SEQ ID NO: 642210 - DNA, 25 bp, Mus musculus
gacaggcaaagcaggagatcacatg

SEQ ID NO: 642211 - DNA, 25 bp, Mus musculus
gacaggcaaagctggagatcacatg

SEQ ID NO: 642212 - DNA, 25 bp, Mus musculus
gacaggcaagagacatggagagata

SEQ ID NO: 642213 - DNA, 25 bp, Mus musculus
gacaggcaagagctggccagtccca

SEQ ID NO: 642214 - DNA, 25 bp, Mus musculus
gacaggcaagaggtggccagtccca

SEQ ID NO: 642215 - DNA, 25 bp, Mus musculus
gacaggcaagagtcatggagagata

SEQ ID NO: 642216 - DNA, 25 bp, Mus musculus
gacaggcaatacagcactgttggcc

SEQ ID NO: 642217 - DNA, 25 bp, Mus musculus
gacaggcaatactgcactgttggcc

SEQ ID NO: 642218 - DNA, 25 bp, Mus musculus
gacaggcacaaccacaacattatga

SEQ ID NO: 642219 - DNA, 25 bp, Mus musculus
gacaggcacaacgacaacattatga

SEQ ID NO: 642220 - DNA, 25 bp, Mus musculus
gacaggcacacacgtccagcctgga

SEQ ID NO: 642221 - DNA, 25 bp, Mus musculus
gacaggcacacaggtccagcctgga

SEQ ID NO: 642222 - DNA, 25 bp, Mus musculus
gacaggcacagactctatggtcagt

SEQ ID NO: 642223 - DNA, 25 bp, Mus musculus
gacaggcacagagtctatggtcagt

SEQ ID NO: 642224 - DNA, 25 bp, Mus musculus
gacaggcacatgcaaatacccacat

SEQ ID NO: 642225 - DNA, 25 bp, Mus musculus
gacaggcacatggaaatacccacat

SEQ ID NO: 642226 - DNA, 25 bp, Mus musculus
gacaggcagcatcgactcagatgac

SEQ ID NO: 642227 - DNA, 25 bp, Mus musculus
gacaggcagcatggactcagatgac

SEQ ID NO: 642228 - DNA, 25 bp, Mus musculus
gacaggcaggtcactcagaattccc

SEQ ID NO: 642229 - DNA, 25 bp, Mus musculus
gacaggcaggtctctcagaattccc

SEQ ID NO: 642230 - DNA, 25 bp, Mus musculus
gacaggcatcctcctgaacaacgag

SEQ ID NO: 642231 - DNA, 25 bp, Mus musculus
gacaggcatcctgctgaacaacgag

SEQ ID NO: 642232 - DNA, 25 bp, Mus musculus
gacaggcatctcagtgtgcatgagg

SEQ ID NO: 642233 - DNA, 25 bp, Mus musculus
gacaggcatctctgtgtgcatgagg

SEQ ID NO: 642234 - DNA, 25 bp, Mus musculus
gacaggcattctaagctgagacacc

SEQ ID NO: 642235 - DNA, 25 bp, Mus musculus
gacaggcattcttagctgagacacc

SEQ ID NO: 642236 - DNA, 25 bp, Mus musculus
gacaggccaagcagaagcaccctga

SEQ ID NO: 642237 - DNA, 25 bp, Mus musculus
gacaggccaagctgaagcaccctga

SEQ ID NO: 642238 - DNA, 25 bp, Mus musculus
gacaggccacatcattgctgttaag

SEQ ID NO: 642239 - DNA, 25 bp, Mus musculus
gacaggccacatgattgctgttaag

SEQ ID NO: 642240 - DNA, 25 bp, Mus musculus
gacaggccagaaaacgcatgcgtac

SEQ ID NO: 642241 - DNA, 25 bp, Mus musculus
gacaggccagaatacgcatgcgtac

SEQ ID NO: 642242 - DNA, 25 bp, Mus musculus
gacaggccccttactttccatagaa

SEQ ID NO: 642243 - DNA, 25 bp, Mus musculus
gacaggcccctttctttccatagaa

SEQ ID NO: 642244 - DNA, 25 bp, Mus musculus
gacaggccgaagcattgtatactcc

SEQ ID NO: 642245 - DNA, 25 bp, Mus musculus
gacaggccgaaggattgtatactcc

SEQ ID NO: 642246 - DNA, 25 bp, Mus musculus
gacaggcctccgcatctgtgacctt

SEQ ID NO: 642247 - DNA, 25 bp, Mus musculus
gacaggcctccggatctgtgacctt

SEQ ID NO: 642248 - DNA, 25 bp, Mus musculus
gacaggcctgacctttgaatcccag

SEQ ID NO: 642249 - DNA, 25 bp, Mus musculus
gacaggcctgacgtttgaatcccag

SEQ ID NO: 642250 - DNA, 25 bp, Mus musculus
gacaggccttccacggggagaatcg

SEQ ID NO: 642251 - DNA, 25 bp, Mus musculus
gacaggccttcctcggggagaatcg

SEQ ID NO: 642252 - DNA, 25 bp, Mus musculus
gacaggcggcctcttaacattacag

SEQ ID NO: 642253 - DNA, 25 bp, Mus musculus
gacaggcggcctgttaacattacag

SEQ ID NO: 642254 - DNA, 25 bp, Mus musculus
gacaggcggctcaaaccagaagtct

SEQ ID NO: 642255 - DNA, 25 bp, Mus musculus
gacaggcggctctaaccagaagtct

SEQ ID NO: 642256 - DNA, 25 bp, Mus musculus
gacaggctacaacacgctgaccatg

SEQ ID NO: 642257 - DNA, 25 bp, Mus musculus
gacaggctacaagacgctgaccatg

SEQ ID NO: 642258 - DNA, 25 bp, Mus musculus
gacaggctcattcaatcctccacaa

SEQ ID NO: 642259 - DNA, 25 bp, Mus musculus
gacaggctcattgaatcctccacaa

SEQ ID NO: 642260 - DNA, 25 bp, Mus musculus
gacaggctctagcttagaagtaccc

SEQ ID NO: 642261 - DNA, 25 bp, Mus musculus
gacaggctctaggttagaagtaccc

SEQ ID NO: 642262 - DNA, 25 bp, Mus musculus
gacaggctctgaatggagaccacag

SEQ ID NO: 642263 - DNA, 25 bp, Mus musculus
gacaggctctgattggagaccacag

SEQ ID NO: 642264 - DNA, 25 bp, Mus musculus
gacaggctgaaaatcattctgcaaa

SEQ ID NO: 642265 - DNA, 25 bp, Mus musculus
gacaggctgaaattcattctgcaaa

SEQ ID NO: 642266 - DNA, 25 bp, Mus musculus
gacaggctgagcagggactattgcg

SEQ ID NO: 642267 - DNA, 25 bp, Mus musculus
gacaggctgagctgggactattgcg

SEQ ID NO: 642268 - DNA, 25 bp, Mus musculus
gacaggctttttaccggtagccgag

SEQ ID NO: 642269 - DNA, 25 bp, Mus musculus
gacaggcttttttccggtagccgag

SEQ ID NO: 642270 - DNA, 25 bp, Mus musculus
gacagggacagacacgagagttcta

SEQ ID NO: 642271 - DNA, 25 bp, Mus musculus
gacagggacagagacgagagttcta

SEQ ID NO: 642272 - DNA, 25 bp, Mus musculus
gacagggacggccacatcaagatcg

SEQ ID NO: 642273 - DNA, 25 bp, Mus musculus
gacagggacggcgacatcaagatcg

SEQ ID NO: 642274 - DNA, 25 bp, Mus musculus
gacagggatcacataaacagtctgc

SEQ ID NO: 642275 - DNA, 25 bp, Mus musculus
gacagggatcacttaaacagtctgc

SEQ ID NO: 642276 - DNA, 25 bp, Mus musculus
gacagggatgggactgacccctacc

SEQ ID NO: 642277 - DNA, 25 bp, Mus musculus
gacagggatgggtctgacccctacc

SEQ ID NO: 642278 - DNA, 25 bp, Mus musculus
gacagggccttcagaagcagccaag

SEQ ID NO: 642279 - DNA, 25 bp, Mus musculus
gacagggccttctgaagcagccaag

SEQ ID NO: 642280 - DNA, 25 bp, Mus musculus
gacagggcgattcactcacaaagag

SEQ ID NO: 642281 - DNA, 25 bp, Mus musculus
gacagggcgattgactcacaaagag

SEQ ID NO: 642282 - DNA, 25 bp, Mus musculus
gacagggctacaccttccaaacctt

SEQ ID NO: 642283 - DNA, 25 bp, Mus musculus
gacagggctacagcttccaaacctt

SEQ ID NO: 642284 - DNA, 25 bp, Mus musculus
gacagggctcgaaattcctttaccc

SEQ ID NO: 642285 - DNA, 25 bp, Mus musculus
gacagggctcgatattcctttaccc

SEQ ID NO: 642286 - DNA, 25 bp, Mus musculus
gacagggctgcaattctgtgccacc

SEQ ID NO: 642287 - DNA, 25 bp, Mus musculus
gacagggctgcatttctgtgccacc

SEQ ID NO: 642288 - DNA, 25 bp, Mus musculus
gacagggcttgcctacctgtggctt

SEQ ID NO: 642289 - DNA, 25 bp, Mus musculus
gacagggcttgcgtacctgtggctt

SEQ ID NO: 642290 - DNA, 25 bp, Mus musculus
gacagggttgtgacctcggtacttc

SEQ ID NO: 642291 - DNA, 25 bp, Mus musculus
gacagggttgtgtcctcggtacttc

SEQ ID NO: 642292 - DNA, 25 bp, Mus musculus
gacaggtaggtgataaagtttgaaa

SEQ ID NO: 642293 - DNA, 25 bp, Mus musculus
gacaggtaggtgttaaagtttgaaa

SEQ ID NO: 642294 - DNA, 25 bp, Mus musculus
gacaggtcaaagcatcaaggtggcc

SEQ ID NO: 642295 - DNA, 25 bp, Mus musculus
gacaggtcaaaggatcaaggtggcc

SEQ ID NO: 642296 - DNA, 25 bp, Mus musculus
gacaggtcagctacattcgctggga

SEQ ID NO: 642297 - DNA, 25 bp, Mus musculus
gacaggtcagcttcattcgctggga

SEQ ID NO: 642298 - DNA, 25 bp, Mus musculus
gacaggtcccgaatctgaggtgaag

SEQ ID NO: 642299 - DNA, 25 bp, Mus musculus
gacaggtcccgattctgaggtgaag

SEQ ID NO: 642300 - DNA, 25 bp, Mus musculus
gacaggtctgatccccggtgaccat

SEQ ID NO: 642301 - DNA, 25 bp, Mus musculus
gacaggtctgatgcccggtgaccat

SEQ ID NO: 642302 - DNA, 25 bp, Mus musculus
gacaggtgccagagtactgacggtc

SEQ ID NO: 642303 - DNA, 25 bp, Mus musculus
gacaggtgccagtgtactgacggtc

SEQ ID NO: 642304 - DNA, 25 bp, Mus musculus
gacaggtgcgctcccttcaaggagc

SEQ ID NO: 642305 - DNA, 25 bp, Mus musculus
gacaggtgcgctgccttcaaggagc

SEQ ID NO: 642306 - DNA, 25 bp, Mus musculus
gacaggtggatcaatgcaggccatg

SEQ ID NO: 642307 - DNA, 25 bp, Mus musculus
gacaggtggatctatgcaggccatg

SEQ ID NO: 642308 - DNA, 25 bp, Mus musculus
gacaggtggtcaaggcagaagctat

SEQ ID NO: 642309 - DNA, 25 bp, Mus musculus
gacaggtggtcatggcagaagctat

SEQ ID NO: 642310 - DNA, 25 bp, Mus musculus
gacaggtgtagtcgtgctttgattc

SEQ ID NO: 642311 - DNA, 25 bp, Mus musculus
gacaggtgtagtggtgctttgattc

SEQ ID NO: 642312 - DNA, 25 bp, Mus musculus
gacaggtgtcagcatgactgaacgc

SEQ ID NO: 642313 - DNA, 25 bp, Mus musculus
gacaggtgtcaggatgactgaacgc

SEQ ID NO: 642314 - DNA, 25 bp, Mus musculus
gacaggttaaatagagagctttctc

SEQ ID NO: 642315 - DNA, 25 bp, Mus musculus
gacaggttaaattgagagctttctc

SEQ ID NO: 642316 - DNA, 25 bp, Mus musculus
gacaggttcagccatctgcagcaga

SEQ ID NO: 642317 - DNA, 25 bp, Mus musculus
gacaggttcagcgatctgcagcaga

SEQ ID NO: 642318 - DNA, 25 bp, Mus musculus
gacaggttctcaccagttatgtcag

SEQ ID NO: 642319 - DNA, 25 bp, Mus musculus
gacaggttctcagcagttatgtcag

SEQ ID NO: 642320 - DNA, 25 bp, Mus musculus
gacaggtttttcacgattaatccag

SEQ ID NO: 642321 - DNA, 25 bp, Mus musculus
gacaggtttttctcgattaatccag

SEQ ID NO: 642322 - DNA, 25 bp, Mus musculus
gacagtaaactgaggaatgcccctc

SEQ ID NO: 642323 - DNA, 25 bp, Mus musculus
gacagtaaactgtggaatgcccctc

SEQ ID NO: 642324 - DNA, 25 bp, Mus musculus
gacagtaacatgctcgctttggcca

SEQ ID NO: 642325 - DNA, 25 bp, Mus musculus
gacagtaacatggtcgctttggcca

SEQ ID NO: 642326 - DNA, 25 bp, Mus musculus
gacagtaagactatctgccgggctc

SEQ ID NO: 642327 - DNA, 25 bp, Mus musculus
gacagtaagactttctgccgggctc

SEQ ID NO: 642328 - DNA, 25 bp, Mus musculus
gacagtaaggacactcactgcagat

SEQ ID NO: 642329 - DNA, 25 bp, Mus musculus
gacagtaaggactctcactgcagat

SEQ ID NO: 642330 - DNA, 25 bp, Mus musculus
gacagtaatacaacaccgggaagat

SEQ ID NO: 642331 - DNA, 25 bp, Mus musculus
gacagtaatacatcaccgggaagat

SEQ ID NO: 642332 - DNA, 25 bp, Mus musculus
gacagtaataggaaccaggcagcag

SEQ ID NO: 642333 - DNA, 25 bp, Mus musculus
gacagtaataggtaccaggcagcag

SEQ ID NO: 642334 - DNA, 25 bp, Mus musculus
gacagtacatctctggacaaagcag

SEQ ID NO: 642335 - DNA, 25 bp, Mus musculus
gacagtacatctgtggacaaagcag

SEQ ID NO: 642336 - DNA, 25 bp, Mus musculus
gacagtaccttcaactgcctacaga

SEQ ID NO: 642337 - DNA, 25 bp, Mus musculus
gacagtaccttctactgcctacaga

SEQ ID NO: 642338 - DNA, 25 bp, Mus musculus
gacagtacggacagtagcctcagct

SEQ ID NO: 642339 - DNA, 25 bp, Mus musculus
gacagtacggactgtagcctcagct

SEQ ID NO: 642340 - DNA, 25 bp, Mus musculus
gacagtactgatcatggagctaatc

SEQ ID NO: 642341 - DNA, 25 bp, Mus musculus
gacagtactgatgatggagctaatc

SEQ ID NO: 642342 - DNA, 25 bp, Mus musculus
gacagtagagtacaaaaacatcagc

SEQ ID NO: 642343 - DNA, 25 bp, Mus musculus
gacagtagagtagaaaaacatcagc

SEQ ID NO: 642344 - DNA, 25 bp, Mus musculus
gacagtaggaggattcggattaagc

SEQ ID NO: 642345 - DNA, 25 bp, Mus musculus
gacagtaggaggtttcggattaagc

SEQ ID NO: 642346 - DNA, 25 bp, Mus musculus
gacagtaggctcattcctgcaggac

SEQ ID NO: 642347 - DNA, 25 bp, Mus musculus
gacagtaggctctttcctgcaggac

SEQ ID NO: 642348 - DNA, 25 bp, Mus musculus
gacagtagtcaacatgggctactca

SEQ ID NO: 642349 - DNA, 25 bp, Mus musculus
gacagtagtcaagatgggctactca

SEQ ID NO: 642350 - DNA, 25 bp, Mus musculus
gacagtatacccaggtgctgaccgc

SEQ ID NO: 642351 - DNA, 25 bp, Mus musculus
gacagtataccctggtgctgaccgc

SEQ ID NO: 642352 - DNA, 25 bp, Mus musculus
gacagtatacttcgttcggagaccc

SEQ ID NO: 642353 - DNA, 25 bp, Mus musculus
gacagtatacttggttcggagaccc

SEQ ID NO: 642354 - DNA, 25 bp, Mus musculus
gacagtatcaccagcggctcttcaa

SEQ ID NO: 642355 - DNA, 25 bp, Mus musculus
gacagtatcacctgcggctcttcaa

SEQ ID NO: 642356 - DNA, 25 bp, Mus musculus
gacagtatcgccagctttagcaact

SEQ ID NO: 642357 - DNA, 25 bp, Mus musculus
gacagtatcgcctgctttagcaact

SEQ ID NO: 642358 - DNA, 25 bp, Mus musculus
gacagtatctacaacctggaagaga

SEQ ID NO: 642359 - DNA, 25 bp, Mus musculus
gacagtatctactacctggaagaga

SEQ ID NO: 642360 - DNA, 25 bp, Mus musculus
gacagtatgaatatgaatagctccc

SEQ ID NO: 642361 - DNA, 25 bp, Mus musculus
gacagtatgaatttgaatagctccc

SEQ ID NO: 642362 - DNA, 25 bp, Mus musculus
gacagtcaatccaacctcttttagc

SEQ ID NO: 642363 - DNA, 25 bp, Mus musculus
gacagtcaatcctacctcttttagc

SEQ ID NO: 642364 - DNA, 25 bp, Mus musculus
gacagtcacactccgccagacgttt

SEQ ID NO: 642365 - DNA, 25 bp, Mus musculus
gacagtcacactgcgccagacgttt

SEQ ID NO: 642366 - DNA, 25 bp, Mus musculus
gacagtcacagaatggccttttgcg

SEQ ID NO: 642367 - DNA, 25 bp, Mus musculus
gacagtcacagattggccttttgcg

SEQ ID NO: 642368 - DNA, 25 bp, Mus musculus
gacagtcagcgcctctgatgctgcg

SEQ ID NO: 642369 - DNA, 25 bp, Mus musculus
gacagtcagcgcgtctgatgctgcg

SEQ ID NO: 642370 - DNA, 25 bp, Mus musculus
gacagtcagctccttgcaatgcaat

SEQ ID NO: 642371 - DNA, 25 bp, Mus musculus
gacagtcagctcgttgcaatgcaat

SEQ ID NO: 642372 - DNA, 25 bp, Mus musculus
gacagtcatattctgctagggcagc

SEQ ID NO: 642373 - DNA, 25 bp, Mus musculus
gacagtcatattgtgctagggcagc

SEQ ID NO: 642374 - DNA, 25 bp, Mus musculus
gacagtcatcttatgccgaatgaag

SEQ ID NO: 642375 - DNA, 25 bp, Mus musculus
gacagtcatcttttgccgaatgaag

SEQ ID NO: 642376 - DNA, 25 bp, Mus musculus
gacagtcattctatctcaagtgtct

SEQ ID NO: 642377 - DNA, 25 bp, Mus musculus
gacagtcattctccacccaaggtat

SEQ ID NO: 642378 - DNA, 25 bp, Mus musculus
gacagtcattctgcacccaaggtat

SEQ ID NO: 642379 - DNA, 25 bp, Mus musculus
gacagtcattctttctcaagtgtct

SEQ ID NO: 642380 - DNA, 25 bp, Mus musculus
gacagtccatgaagaagtggccaac

SEQ ID NO: 642381 - DNA, 25 bp, Mus musculus
gacagtccatgatgaagtggccaac

SEQ ID NO: 642382 - DNA, 25 bp, Mus musculus
gacagtccctgaaaaagtctggaag

SEQ ID NO: 642383 - DNA, 25 bp, Mus musculus
gacagtccctgataaagtctggaag

SEQ ID NO: 642384 - DNA, 25 bp, Mus musculus
gacagtcccttacaggtggagattt

SEQ ID NO: 642385 - DNA, 25 bp, Mus musculus
gacagtcccttagaggtggagattt

SEQ ID NO: 642386 - DNA, 25 bp, Mus musculus
gacagtcctgctaccctgagggctc

SEQ ID NO: 642387 - DNA, 25 bp, Mus musculus
gacagtcctgcttccctgagggctc

SEQ ID NO: 642388 - DNA, 25 bp, Mus musculus
gacagtcctggcatatcttcgagga

SEQ ID NO: 642389 - DNA, 25 bp, Mus musculus
gacagtcctggcttatcttcgagga

SEQ ID NO: 642390 - DNA, 25 bp, Mus musculus
gacagtcctgtcataggagcacagc

SEQ ID NO: 642391 - DNA, 25 bp, Mus musculus
gacagtcctgtcttaggagcacagc

SEQ ID NO: 642392 - DNA, 25 bp, Mus musculus
gacagtcctgtgagttcatctcaaa

SEQ ID NO: 642393 - DNA, 25 bp, Mus musculus
gacagtcctgtgtgttcatctcaaa

SEQ ID NO: 642394 - DNA, 25 bp, Mus musculus
gacagtcggcctcacatctgtgtat

SEQ ID NO: 642395 - DNA, 25 bp, Mus musculus
gacagtcggcctgacatctgtgtat

SEQ ID NO: 642396 - DNA, 25 bp, Mus musculus
gacagtcgtgtacttcggtcccctg

SEQ ID NO: 642397 - DNA, 25 bp, Mus musculus
gacagtcgtgtagttcggtcccctg

SEQ ID NO: 642398 - DNA, 25 bp, Mus musculus
gacagtctaaacagtttggatccca

SEQ ID NO: 642399 - DNA, 25 bp, Mus musculus
gacagtctaaactgtttggatccca

SEQ ID NO: 642400 - DNA, 25 bp, Mus musculus
gacagtctataacctgaaccgcacc

SEQ ID NO: 642401 - DNA, 25 bp, Mus musculus
gacagtctataagctgaaccgcacc

SEQ ID NO: 642402 - DNA, 25 bp, Mus musculus
gacagtctatttccacttacaaagg

SEQ ID NO: 642403 - DNA, 25 bp, Mus musculus
gacagtctatttgcacttacaaagg

SEQ ID NO: 642404 - DNA, 25 bp, Mus musculus
gacagtctcaaaattatcctgatgg

SEQ ID NO: 642405 - DNA, 25 bp, Mus musculus
gacagtctcaaatttatcctgatgg

SEQ ID NO: 642406 - DNA, 25 bp, Mus musculus
gacagtctccaccattttcctggtg

SEQ ID NO: 642407 - DNA, 25 bp, Mus musculus
gacagtctccacgattttcctggtg

SEQ ID NO: 642408 - DNA, 25 bp, Mus musculus
gacagtctctcaagttctatggaag

SEQ ID NO: 642409 - DNA, 25 bp, Mus musculus
gacagtctctcatgttctatggaag

SEQ ID NO: 642410 - DNA, 25 bp, Mus musculus
gacagtctgcagagagaactcaact

SEQ ID NO: 642411 - DNA, 25 bp, Mus musculus
gacagtctgcagcatgagatcaact

SEQ ID NO: 642412 - DNA, 25 bp, Mus musculus
gacagtctgcaggatgagatcaact

SEQ ID NO: 642413 - DNA, 25 bp, Mus musculus
gacagtctgcagtgagaactcaact

SEQ ID NO: 642414 - DNA, 25 bp, Mus musculus
gacagtctgtatacaagctgcccag

SEQ ID NO: 642415 - DNA, 25 bp, Mus musculus
gacagtctgtattcaagctgcccag

SEQ ID NO: 642416 - DNA, 25 bp, Mus musculus
gacagtgaacaactggatagttgga

SEQ ID NO: 642417 - DNA, 25 bp, Mus musculus
gacagtgaacaagtggatagttgga

SEQ ID NO: 642418 - DNA, 25 bp, Mus musculus
gacagtgaacttatgaccttcaatc

SEQ ID NO: 642419 - DNA, 25 bp, Mus musculus
gacagtgaacttttgaccttcaatc

SEQ ID NO: 642420 - DNA, 25 bp, Mus musculus
gacagtgaagacagtactgtatcaa

SEQ ID NO: 642421 - DNA, 25 bp, Mus musculus
gacagtgaagactgtactgtatcaa

SEQ ID NO: 642422 - DNA, 25 bp, Mus musculus
gacagtgaatgcaacagtaagccgg

SEQ ID NO: 642423 - DNA, 25 bp, Mus musculus
gacagtgaatgctacagtaagccgg

SEQ ID NO: 642424 - DNA, 25 bp, Mus musculus
gacagtgaattacacttttcagctc

SEQ ID NO: 642425 - DNA, 25 bp, Mus musculus
gacagtgaattagacttttcagctc

SEQ ID NO: 642426 - DNA, 25 bp, Mus musculus
gacagtgacagtaaggactctcact

SEQ ID NO: 642427 - DNA, 25 bp, Mus musculus
gacagtgacagttaggactctcact

SEQ ID NO: 642428 - DNA, 25 bp, Mus musculus
gacagtgaccctccgatcagtgaga

SEQ ID NO: 642429 - DNA, 25 bp, Mus musculus
gacagtgaccctgcgatcagtgaga

SEQ ID NO: 642430 - DNA, 25 bp, Mus musculus
gacagtgactgactatggatcattt

SEQ ID NO: 642431 - DNA, 25 bp, Mus musculus
gacagtgactgagtatggatcattt

SEQ ID NO: 642432 - DNA, 25 bp, Mus musculus
gacagtgactgcaaagggtccaggc

SEQ ID NO: 642433 - DNA, 25 bp, Mus musculus
gacagtgactgctaagggtccaggc

SEQ ID NO: 642434 - DNA, 25 bp, Mus musculus
gacagtgagaagacttcccgggcag

SEQ ID NO: 642435 - DNA, 25 bp, Mus musculus
gacagtgagaagtcttcccgggcag

SEQ ID NO: 642436 - DNA, 25 bp, Mus musculus
gacagtgagacccagagtgatcatg

SEQ ID NO: 642437 - DNA, 25 bp, Mus musculus
gacagtgagaccgagagtgatcatg

SEQ ID NO: 642438 - DNA, 25 bp, Mus musculus
gacagtgagattccccgcctgagaa

SEQ ID NO: 642439 - DNA, 25 bp, Mus musculus
gacagtgagattgcccgcctgagaa

SEQ ID NO: 642440 - DNA, 25 bp, Mus musculus
gacagtgagcggaggccgcacttcc

SEQ ID NO: 642441 - DNA, 25 bp, Mus musculus
gacagtgagcggtggccgcacttcc

SEQ ID NO: 642442 - DNA, 25 bp, Mus musculus
gacagtgaggagagagcctcctaca

SEQ ID NO: 642443 - DNA, 25 bp, Mus musculus
gacagtgaggagtgagcctcctaca

SEQ ID NO: 642444 - DNA, 25 bp, Mus musculus
gacagtgaggcacatttccaaatcc

SEQ ID NO: 642445 - DNA, 25 bp, Mus musculus
gacagtgaggcagatttccaaatcc

SEQ ID NO: 642446 - DNA, 25 bp, Mus musculus
gacagtgagggcacgcctgtcaaca

SEQ ID NO: 642447 - DNA, 25 bp, Mus musculus
gacagtgagggctcgcctgtcaaca

SEQ ID NO: 642448 - DNA, 25 bp, Mus musculus
gacagtgatgatcaatacgaccgaa

SEQ ID NO: 642449 - DNA, 25 bp, Mus musculus
gacagtgatgatgaatacgaccgaa

SEQ ID NO: 642450 - DNA, 25 bp, Mus musculus
gacagtgatgttccattggacattt

SEQ ID NO: 642451 - DNA, 25 bp, Mus musculus
gacagtgatgttgcattggacattt

SEQ ID NO: 642452 - DNA, 25 bp, Mus musculus
gacagtgattagcttgaccagtcaa

SEQ ID NO: 642453 - DNA, 25 bp, Mus musculus
gacagtgattaggttgaccagtcaa

SEQ ID NO: 642454 - DNA, 25 bp, Mus musculus
gacagtgcacttcattgaccccgag

SEQ ID NO: 642455 - DNA, 25 bp, Mus musculus
gacagtgcacttgattgaccccgag

SEQ ID NO: 642456 - DNA, 25 bp, Mus musculus
gacagtgcaggtcggaatctctgca

SEQ ID NO: 642457 - DNA, 25 bp, Mus musculus
gacagtgcaggtgggaatctctgca

SEQ ID NO: 642458 - DNA, 25 bp, Mus musculus
gacagtgcatgcaatgcttgaccac

SEQ ID NO: 642459 - DNA, 25 bp, Mus musculus
gacagtgcatgctatgcttgaccac

SEQ ID NO: 642460 - DNA, 25 bp, Mus musculus
gacagtgccagcagaaagtcatgag

SEQ ID NO: 642461 - DNA, 25 bp, Mus musculus
gacagtgccagctgaaagtcatgag

SEQ ID NO: 642462 - DNA, 25 bp, Mus musculus
gacagtgccaggatccgtatcctcc

SEQ ID NO: 642463 - DNA, 25 bp, Mus musculus
gacagtgccaggttccgtatcctcc

SEQ ID NO: 642464 - DNA, 25 bp, Mus musculus
gacagtgccgggagcaacacctgca

SEQ ID NO: 642465 - DNA, 25 bp, Mus musculus
gacagtgccgggtgcaacacctgca

SEQ ID NO: 642466 - DNA, 25 bp, Mus musculus
gacagtgccgtgctttcaattccaa

SEQ ID NO: 642467 - DNA, 25 bp, Mus musculus
gacagtgccgtggtttcaattccaa

SEQ ID NO: 642468 - DNA, 25 bp, Mus musculus
gacagtgcgagacaaaatcctgaag

SEQ ID NO: 642469 - DNA, 25 bp, Mus musculus
gacagtgcgagagaaaatcctgaag

SEQ ID NO: 642470 - DNA, 25 bp, Mus musculus
gacagtgcggccagctttgctatcc

SEQ ID NO: 642471 - DNA, 25 bp, Mus musculus
gacagtgcggcctgctttgctatcc

SEQ ID NO: 642472 - DNA, 25 bp, Mus musculus
gacagtgcggctacatccacctatg

SEQ ID NO: 642473 - DNA, 25 bp, Mus musculus
gacagtgcggcttcatccacctatg

SEQ ID NO: 642474 - DNA, 25 bp, Mus musculus
gacagtgcgtctaagtgatggtcac

SEQ ID NO: 642475 - DNA, 25 bp, Mus musculus
gacagtgcgtcttagtgatggtcac

SEQ ID NO: 642476 - DNA, 25 bp, Mus musculus
gacagtgctattatcgtccagtctc

SEQ ID NO: 642477 - DNA, 25 bp, Mus musculus
gacagtgctattttcgtccagtctc

SEQ ID NO: 642478 - DNA, 25 bp, Mus musculus
gacagtgctctacgctgtccccggt

SEQ ID NO: 642479 - DNA, 25 bp, Mus musculus
gacagtgctctaggctgtccccggt

SEQ ID NO: 642480 - DNA, 25 bp, Mus musculus
gacagtgctctgaaatggaccttac

SEQ ID NO: 642481 - DNA, 25 bp, Mus musculus
gacagtgctctgtaatggaccttac

SEQ ID NO: 642482 - DNA, 25 bp, Mus musculus
gacagtgctgcccaggatggacaac

SEQ ID NO: 642483 - DNA, 25 bp, Mus musculus
gacagtgctgccgaggatggacaac

SEQ ID NO: 642484 - DNA, 25 bp, Mus musculus
gacagtggaggaccttttgtcatga

SEQ ID NO: 642485 - DNA, 25 bp, Mus musculus
gacagtggaggagcttttgtcatga

SEQ ID NO: 642486 - DNA, 25 bp, Mus musculus
gacagtggaggcaggccaaatctaa

SEQ ID NO: 642487 - DNA, 25 bp, Mus musculus
gacagtggaggctggccaaatctaa

SEQ ID NO: 642488 - DNA, 25 bp, Mus musculus
gacagtggagtgaccacaacttctg

SEQ ID NO: 642489 - DNA, 25 bp, Mus musculus
gacagtggagtgtccacaacttctg

SEQ ID NO: 642490 - DNA, 25 bp, Mus musculus
gacagtggccccatctgtctcctga

SEQ ID NO: 642491 - DNA, 25 bp, Mus musculus
gacagtggccccttctgtctcctga

SEQ ID NO: 642492 - DNA, 25 bp, Mus musculus
gacagtggcgtacctcatgcagaag

SEQ ID NO: 642493 - DNA, 25 bp, Mus musculus
gacagtggcgtagctcatgcagaag

SEQ ID NO: 642494 - DNA, 25 bp, Mus musculus
gacagtgggaagaaactttgccttt

SEQ ID NO: 642495 - DNA, 25 bp, Mus musculus
gacagtgggaagtaactttgccttt

SEQ ID NO: 642496 - DNA, 25 bp, Mus musculus
gacagtggtctcatgtctgtttaac

SEQ ID NO: 642497 - DNA, 25 bp, Mus musculus
gacagtggtctcttgtctgtttaac

SEQ ID NO: 642498 - DNA, 25 bp, Mus musculus
gacagtggtgtcagggaccaccctg

SEQ ID NO: 642499 - DNA, 25 bp, Mus musculus
gacagtggtgtctgggaccaccctg

SEQ ID NO: 642500 - DNA, 25 bp, Mus musculus
gacagtggttcccagacaagctcag

SEQ ID NO: 642501 - DNA, 25 bp, Mus musculus
gacagtggttccgagacaagctcag

SEQ ID NO: 642502 - DNA, 25 bp, Mus musculus
gacagtggttggctacagcgctttc

SEQ ID NO: 642503 - DNA, 25 bp, Mus musculus
gacagtggttgggtacagcgctttc

SEQ ID NO: 642504 - DNA, 25 bp, Mus musculus
gacagtgtcactagcttgtctctta

SEQ ID NO: 642505 - DNA, 25 bp, Mus musculus
gacagtgtcacttgcttgtctctta

SEQ ID NO: 642506 - DNA, 25 bp, Mus musculus
gacagtgtcattcttaaaacgagca

SEQ ID NO: 642507 - DNA, 25 bp, Mus musculus
gacagtgtcattgttaaaacgagca

SEQ ID NO: 642508 - DNA, 25 bp, Mus musculus
gacagtgtccctattggccctgatt

SEQ ID NO: 642509 - DNA, 25 bp, Mus musculus
gacagtgtcccttttggccctgatt

SEQ ID NO: 642510 - DNA, 25 bp, Mus musculus
gacagtgtcgagaacctgacgctca

SEQ ID NO: 642511 - DNA, 25 bp, Mus musculus
gacagtgtcgagtacctgacgctca

SEQ ID NO: 642512 - DNA, 25 bp, Mus musculus
gacagtgtggaaagctatgacccgg

SEQ ID NO: 642513 - DNA, 25 bp, Mus musculus
gacagtgtggaatgctatgacccgg

SEQ ID NO: 642514 - DNA, 25 bp, Mus musculus
gacagtgtggataccatacccaaag

SEQ ID NO: 642515 - DNA, 25 bp, Mus musculus
gacagtgtggattccatacccaaag

SEQ ID NO: 642516 - DNA, 25 bp, Mus musculus
gacagtgtggccagtctggtcattg

SEQ ID NO: 642517 - DNA, 25 bp, Mus musculus
gacagtgtggcctgtctggtcattg

SEQ ID NO: 642518 - DNA, 25 bp, Mus musculus
gacagtgtgttaagcaacgccggca

SEQ ID NO: 642519 - DNA, 25 bp, Mus musculus
gacagtgtgttatgcaacgccggca

SEQ ID NO: 642520 - DNA, 25 bp, Mus musculus
gacagtgttactcctttcctgagga

SEQ ID NO: 642521 - DNA, 25 bp, Mus musculus
gacagtgttactgctttcctgagga

SEQ ID NO: 642522 - DNA, 25 bp, Mus musculus
gacagtgttcctcgcttgcgtgctg

SEQ ID NO: 642523 - DNA, 25 bp, Mus musculus
gacagtgttcctggcttgcgtgctg

SEQ ID NO: 642524 - DNA, 25 bp, Mus musculus
gacagtgttgaaaactgcatcattg

SEQ ID NO: 642525 - DNA, 25 bp, Mus musculus
gacagtgttgaatactgcatcattg

SEQ ID NO: 642526 - DNA, 25 bp, Mus musculus
gacagtgtttctccctcagctatga

SEQ ID NO: 642527 - DNA, 25 bp, Mus musculus
gacagtgtttctgcctcagctatga

SEQ ID NO: 642528 - DNA, 25 bp, Mus musculus
gacagttaacttctgtttacatgga

SEQ ID NO: 642529 - DNA, 25 bp, Mus musculus
gacagttaacttgtgtttacatgga

SEQ ID NO: 642530 - DNA, 25 bp, Mus musculus
gacagttaccttctacaactccaga

SEQ ID NO: 642531 - DNA, 25 bp, Mus musculus
gacagttaccttgtacaactccaga

SEQ ID NO: 642532 - DNA, 25 bp, Mus musculus
gacagttacgcacccatttcagaag

SEQ ID NO: 642533 - DNA, 25 bp, Mus musculus
gacagttacgcagccatttcagaag

SEQ ID NO: 642534 - DNA, 25 bp, Mus musculus
gacagttacttgaaatatgtaggat

SEQ ID NO: 642535 - DNA, 25 bp, Mus musculus
gacagttacttgtaatatgtaggat

SEQ ID NO: 642536 - DNA, 25 bp, Mus musculus
gacagttcagacaaggcccctgtgg

SEQ ID NO: 642537 - DNA, 25 bp, Mus musculus
gacagttcagactaggcccctgtgg

SEQ ID NO: 642538 - DNA, 25 bp, Mus musculus
gacagttcagctccccgtgtggaga

SEQ ID NO: 642539 - DNA, 25 bp, Mus musculus
gacagttcagctgcccgtgtggaga

SEQ ID NO: 642540 - DNA, 25 bp, Mus musculus
gacagttccaaccatgacaaaacta

SEQ ID NO: 642541 - DNA, 25 bp, Mus musculus
gacagttccaacgatgacaaaacta

SEQ ID NO: 642542 - DNA, 25 bp, Mus musculus
gacagttccaggagtattataagag

SEQ ID NO: 642543 - DNA, 25 bp, Mus musculus
gacagttccaggtgtattataagag

SEQ ID NO: 642544 - DNA, 25 bp, Mus musculus
gacagttcccacaacacaacataaa

SEQ ID NO: 642545 - DNA, 25 bp, Mus musculus
gacagttcccactacacaacataaa

SEQ ID NO: 642546 - DNA, 25 bp, Mus musculus
gacagttcgtcgctatccggccact

SEQ ID NO: 642547 - DNA, 25 bp, Mus musculus
gacagttcgtcggtatccggccact

SEQ ID NO: 642548 - DNA, 25 bp, Mus musculus
gacagttcgttaagcatcaatcaat

SEQ ID NO: 642549 - DNA, 25 bp, Mus musculus
gacagttcgttatgcatcaatcaat

SEQ ID NO: 642550 - DNA, 25 bp, Mus musculus
gacagttctggtccagagttccagt

SEQ ID NO: 642551 - DNA, 25 bp, Mus musculus
gacagttctggtgcagagttccagt

SEQ ID NO: 642552 - DNA, 25 bp, Mus musculus
gacagttgcatcctgtgtctttcta

SEQ ID NO: 642553 - DNA, 25 bp, Mus musculus
gacagttgcatcgtgtgtctttcta

SEQ ID NO: 642554 - DNA, 25 bp, Mus musculus
gacagttgccaactgaggatctgac

SEQ ID NO: 642555 - DNA, 25 bp, Mus musculus
gacagttgccaagtgaggatctgac

SEQ ID NO: 642556 - DNA, 25 bp, Mus musculus
gacagttgcgacagtctaaacagtt

SEQ ID NO: 642557 - DNA, 25 bp, Mus musculus
gacagttgcgactgtctaaacagtt

SEQ ID NO: 642558 - DNA, 25 bp, Mus musculus
gacagttggtacaacaagtggcaca

SEQ ID NO: 642559 - DNA, 25 bp, Mus musculus
gacagttggtactacaagtggcaca

SEQ ID NO: 642560 - DNA, 25 bp, Mus musculus
gacagttgtgctatgctcagagaca

SEQ ID NO: 642561 - DNA, 25 bp, Mus musculus
gacagttgtgctttgctcagagaca

SEQ ID NO: 642562 - DNA, 25 bp, Mus musculus
gacagttgtttaacacgtgaagaga

SEQ ID NO: 642563 - DNA, 25 bp, Mus musculus
gacagttgtttatcacgtgaagaga

SEQ ID NO: 642564 - DNA, 25 bp, Mus musculus
gacagtttaagtacaaccaacttct

SEQ ID NO: 642565 - DNA, 25 bp, Mus musculus
gacagtttaagttcaaccaacttct

SEQ ID NO: 642566 - DNA, 25 bp, Mus musculus
gacagtttatataggtcatgaatgc

SEQ ID NO: 642567 - DNA, 25 bp, Mus musculus
gacagtttatattggtcatgaatgc

SEQ ID NO: 642568 - DNA, 25 bp, Mus musculus
gacagtttcatgcaaggaggacaag

SEQ ID NO: 642569 - DNA, 25 bp, Mus musculus
gacagtttcatggaaggaggacaag

SEQ ID NO: 642570 - DNA, 25 bp, Mus musculus
gacagtttgggcagcgacagctcca

SEQ ID NO: 642571 - DNA, 25 bp, Mus musculus
gacagtttgggctgcgacagctcca

SEQ ID NO: 642572 - DNA, 25 bp, Mus musculus
gacagtttgtacaccgaaggaatcc

SEQ ID NO: 642573 - DNA, 25 bp, Mus musculus
gacagtttgtactccgaaggaatcc

SEQ ID NO: 642574 - DNA, 25 bp, Mus musculus
gacagttttcgaaatacagtggaag

SEQ ID NO: 642575 - DNA, 25 bp, Mus musculus
gacagttttcgatatacagtggaag

SEQ ID NO: 642576 - DNA, 25 bp, Mus musculus
gacagttttgaaccatctaagaaag

SEQ ID NO: 642577 - DNA, 25 bp, Mus musculus
gacagttttgaagcatctaagaaag

SEQ ID NO: 642578 - DNA, 25 bp, Mus musculus
gacagttttgagaatccagtcctgc

SEQ ID NO: 642579 - DNA, 25 bp, Mus musculus
gacagttttgagtatccagtcctgc

SEQ ID NO: 642580 - DNA, 25 bp, Mus musculus
gacataaaacccaaggtactgggca

SEQ ID NO: 642581 - DNA, 25 bp, Mus musculus
gacataaaaccctaggtactgggca

SEQ ID NO: 642582 - DNA, 25 bp, Mus musculus
gacataaacaaacatggctacatca

SEQ ID NO: 642583 - DNA, 25 bp, Mus musculus
gacataaacaaagatggctacatca

SEQ ID NO: 642584 - DNA, 25 bp, Mus musculus
gacataaagctgcttgccgccatag

SEQ ID NO: 642585 - DNA, 25 bp, Mus musculus
gacataaagctggttgccgccatag

SEQ ID NO: 642586 - DNA, 25 bp, Mus musculus
gacataaagtcaaatgccgccgaac

SEQ ID NO: 642587 - DNA, 25 bp, Mus musculus
gacataaagtcacccgggcctcagt

SEQ ID NO: 642588 - DNA, 25 bp, Mus musculus
gacataaagtcagccgggcctcagt

SEQ ID NO: 642589 - DNA, 25 bp, Mus musculus
gacataaagtcatatgccgccgaac

SEQ ID NO: 642590 - DNA, 25 bp, Mus musculus
gacataaagtgtctgtccatgttct

SEQ ID NO: 642591 - DNA, 25 bp, Mus musculus
gacataaagtgtgtgtccatgttct

SEQ ID NO: 642592 - DNA, 25 bp, Mus musculus
gacataaagttcaaggcactttccc

SEQ ID NO: 642593 - DNA, 25 bp, Mus musculus
gacataaagttctaggcactttccc

SEQ ID NO: 642594 - DNA, 25 bp, Mus musculus
gacataaattgcacagtgcagaatt

SEQ ID NO: 642595 - DNA, 25 bp, Mus musculus
gacataaattgctcagtgcagaatt

SEQ ID NO: 642596 - DNA, 25 bp, Mus musculus
gacataagccagagcatcgttcttc

SEQ ID NO: 642597 - DNA, 25 bp, Mus musculus
gacataagccagatcttgaccagat

SEQ ID NO: 642598 - DNA, 25 bp, Mus musculus
gacataagccagtgcatcgttcttc

SEQ ID NO: 642599 - DNA, 25 bp, Mus musculus
gacataagccagttcttgaccagat

SEQ ID NO: 642600 - DNA, 25 bp, Mus musculus
gacataatcagaagacatatctacc

SEQ ID NO: 642601 - DNA, 25 bp, Mus musculus
gacataatcagatgacatatctacc

SEQ ID NO: 642602 - DNA, 25 bp, Mus musculus
gacatacaagccacacctacaggac

SEQ ID NO: 642603 - DNA, 25 bp, Mus musculus
gacatacaagcctcacctacaggac

SEQ ID NO: 642604 - DNA, 25 bp, Mus musculus
gacatacagtgcaccccagttttga

SEQ ID NO: 642605 - DNA, 25 bp, Mus musculus
gacatacagtgctccccagttttga

SEQ ID NO: 642606 - DNA, 25 bp, Mus musculus
gacatacatctcaagcccgtgacat

SEQ ID NO: 642607 - DNA, 25 bp, Mus musculus
gacatacatctctagcccgtgacat

SEQ ID NO: 642608 - DNA, 25 bp, Mus musculus
gacataccacagagggaagtcttct

SEQ ID NO: 642609 - DNA, 25 bp, Mus musculus
gacataccacagtgggaagtcttct

SEQ ID NO: 642610 - DNA, 25 bp, Mus musculus
gacataccacgacattgggctcaac

SEQ ID NO: 642611 - DNA, 25 bp, Mus musculus
gacataccacgagattgggctcaac

SEQ ID NO: 642612 - DNA, 25 bp, Mus musculus
gacataccagacagtctcctaccta

SEQ ID NO: 642613 - DNA, 25 bp, Mus musculus
gacataccagactgtctcctaccta

SEQ ID NO: 642614 - DNA, 25 bp, Mus musculus
gacataccctatcccactgctagag

SEQ ID NO: 642615 - DNA, 25 bp, Mus musculus
gacataccctatgccactgctagag

SEQ ID NO: 642616 - DNA, 25 bp, Mus musculus
gacatacctgttccggaggagactg

SEQ ID NO: 642617 - DNA, 25 bp, Mus musculus
gacatacctgttgcggaggagactg

SEQ ID NO: 642618 - DNA, 25 bp, Mus musculus
gacatacgaagaagctttatacaga

SEQ ID NO: 642619 - DNA, 25 bp, Mus musculus
gacatacgaagatgctttatacaga

SEQ ID NO: 642620 - DNA, 25 bp, Mus musculus
gacatacgtggacttcctaggaccc

SEQ ID NO: 642621 - DNA, 25 bp, Mus musculus
gacatacgtggagttcctaggaccc

SEQ ID NO: 642622 - DNA, 25 bp, Mus musculus
gacatactgacccttctaaagcttg

SEQ ID NO: 642623 - DNA, 25 bp, Mus musculus
gacatactgaccgttctaaagcttg

SEQ ID NO: 642624 - DNA, 25 bp, Mus musculus
gacatactgcgcctgcgccagcttt

SEQ ID NO: 642625 - DNA, 25 bp, Mus musculus
gacatactgcgcgtgcgccagcttt

SEQ ID NO: 642626 - DNA, 25 bp, Mus musculus
gacatactggatctcctgagcgaga

SEQ ID NO: 642627 - DNA, 25 bp, Mus musculus
gacatactggatgtcctgagcgaga

SEQ ID NO: 642628 - DNA, 25 bp, Mus musculus
gacatactgtcacagccgctctgat

SEQ ID NO: 642629 - DNA, 25 bp, Mus musculus
gacatactgtcagagccgctctgat

SEQ ID NO: 642630 - DNA, 25 bp, Mus musculus
gacatacttgaacctaaacaacaaa

SEQ ID NO: 642631 - DNA, 25 bp, Mus musculus
gacatacttgaacggccagagctgg

SEQ ID NO: 642632 - DNA, 25 bp, Mus musculus
gacatacttgaagctaaacaacaaa

SEQ ID NO: 642633 - DNA, 25 bp, Mus musculus
gacatacttgaagggccagagctgg

SEQ ID NO: 642634 - DNA, 25 bp, Mus musculus
gacatagaaacacaagaaatagact

SEQ ID NO: 642635 - DNA, 25 bp, Mus musculus
gacatagaaacagaagaaatagact

SEQ ID NO: 642636 - DNA, 25 bp, Mus musculus
gacatagaatgactcaggctggcac

SEQ ID NO: 642637 - DNA, 25 bp, Mus musculus
gacatagaatgagtcaggctggcac

SEQ ID NO: 642638 - DNA, 25 bp, Mus musculus
gacatagaatggactcacattgact

SEQ ID NO: 642639 - DNA, 25 bp, Mus musculus
gacatagaatggtctcacattgact

SEQ ID NO: 642640 - DNA, 25 bp, Mus musculus
gacatagaccctcaaagtttccaga

SEQ ID NO: 642641 - DNA, 25 bp, Mus musculus
gacatagaccctgaaagtttccaga

SEQ ID NO: 642642 - DNA, 25 bp, Mus musculus
gacatagacgagagcctttactccc

SEQ ID NO: 642643 - DNA, 25 bp, Mus musculus
gacatagacgagtgcctttactccc

SEQ ID NO: 642644 - DNA, 25 bp, Mus musculus
gacatagagagtctgccaggagcca

SEQ ID NO: 642645 - DNA, 25 bp, Mus musculus
gacatagagagtgtgccaggagcca

SEQ ID NO: 642646 - DNA, 25 bp, Mus musculus
gacatagagatccttgagcacggag

SEQ ID NO: 642647 - DNA, 25 bp, Mus musculus
gacatagagatcgttgagcacggag

SEQ ID NO: 642648 - DNA, 25 bp, Mus musculus
gacatagatcttcgagtaagtcgag

SEQ ID NO: 642649 - DNA, 25 bp, Mus musculus
gacatagatcttggagtaagtcgag

SEQ ID NO: 642650 - DNA, 25 bp, Mus musculus
gacatagcctttcggcaaaacgaaa

SEQ ID NO: 642651 - DNA, 25 bp, Mus musculus
gacatagcctttgggcaaaacgaaa

SEQ ID NO: 642652 - DNA, 25 bp, Mus musculus
gacatagcgcgaagccagatcttcg

SEQ ID NO: 642653 - DNA, 25 bp, Mus musculus
gacatagcgcgatgccagatcttcg

SEQ ID NO: 642654 - DNA, 25 bp, Mus musculus
gacatagcgtgtcccaagaagatcc

SEQ ID NO: 642655 - DNA, 25 bp, Mus musculus
gacatagcgtgtgccaagaagatcc

SEQ ID NO: 642656 - DNA, 25 bp, Mus musculus
gacatagctcaacacctgggtttct

SEQ ID NO: 642657 - DNA, 25 bp, Mus musculus
gacatagctcaagacctgggtttct

SEQ ID NO: 642658 - DNA, 25 bp, Mus musculus
gacatagctggtattgagaattact

SEQ ID NO: 642659 - DNA, 25 bp, Mus musculus
gacatagctggttttgagaattact

SEQ ID NO: 642660 - DNA, 25 bp, Mus musculus
gacatagctttcattggcctcgggc

SEQ ID NO: 642661 - DNA, 25 bp, Mus musculus
gacatagctttctttggcctcgggc

SEQ ID NO: 642662 - DNA, 25 bp, Mus musculus
gacatagggaatacctgtcaccttc

SEQ ID NO: 642663 - DNA, 25 bp, Mus musculus
gacatagggaattcctgtcaccttc

SEQ ID NO: 642664 - DNA, 25 bp, Mus musculus
gacatagtaattcgtatcctggagc

SEQ ID NO: 642665 - DNA, 25 bp, Mus musculus
gacatagtaattggtatcctggagc

SEQ ID NO: 642666 - DNA, 25 bp, Mus musculus
gacatagtagcactgcagaaagcaa

SEQ ID NO: 642667 - DNA, 25 bp, Mus musculus
gacatagtagcagtgcagaaagcaa

SEQ ID NO: 642668 - DNA, 25 bp, Mus musculus
gacatagtcaatcagttcaccacct

SEQ ID NO: 642669 - DNA, 25 bp, Mus musculus
gacatagtcaatgagttcaccacct

SEQ ID NO: 642670 - DNA, 25 bp, Mus musculus
gacatagtcgagatagagaaaaaag

SEQ ID NO: 642671 - DNA, 25 bp, Mus musculus
gacatagtcgagttagagaaaaaag

SEQ ID NO: 642672 - DNA, 25 bp, Mus musculus
gacatagtgaaactaggtcagagaa

SEQ ID NO: 642673 - DNA, 25 bp, Mus musculus
gacatagtgaaagtaggtcagagaa

SEQ ID NO: 642674 - DNA, 25 bp, Mus musculus
gacatagtgtatctggaccatgagg

SEQ ID NO: 642675 - DNA, 25 bp, Mus musculus
gacatagtgtatgtggaccatgagg

SEQ ID NO: 642676 - DNA, 25 bp, Mus musculus
gacatagttcctcgtgatatagtgg

SEQ ID NO: 642677 - DNA, 25 bp, Mus musculus
gacatagttcctggtgatatagtgg

SEQ ID NO: 642678 - DNA, 25 bp, Mus musculus
gacatagttcgacatggcaggctct

SEQ ID NO: 642679 - DNA, 25 bp, Mus musculus
gacatagttcgagatggcaggctct

SEQ ID NO: 642680 - DNA, 25 bp, Mus musculus
gacatatacaacaatagtcctgtga

SEQ ID NO: 642681 - DNA, 25 bp, Mus musculus
gacatatacaactatagtcctgtga

SEQ ID NO: 642682 - DNA, 25 bp, Mus musculus
gacatatatcatcaccatggcggtg

SEQ ID NO: 642683 - DNA, 25 bp, Mus musculus
gacatatatcatgaccatggcggtg

SEQ ID NO: 642684 - DNA, 25 bp, Mus musculus
gacatatcaggccatggtccatgaa

SEQ ID NO: 642685 - DNA, 25 bp, Mus musculus
gacatatcaggcgatggtccatgaa

SEQ ID NO: 642686 - DNA, 25 bp, Mus musculus
gacatatccccaacggtggacgcat

SEQ ID NO: 642687 - DNA, 25 bp, Mus musculus
gacatatccccatcggtggacgcat

SEQ ID NO: 642688 - DNA, 25 bp, Mus musculus
gacatatctaccagaagactttaag

SEQ ID NO: 642689 - DNA, 25 bp, Mus musculus
gacatatctacctgaagactttaag

SEQ ID NO: 642690 - DNA, 25 bp, Mus musculus
gacatatctagtatttgttcagggc

SEQ ID NO: 642691 - DNA, 25 bp, Mus musculus
gacatatctagtttttgttcagggc

SEQ ID NO: 642692 - DNA, 25 bp, Mus musculus
gacatatgaaacatctctgctggta

SEQ ID NO: 642693 - DNA, 25 bp, Mus musculus
gacatatgaaacttctctgctggta

SEQ ID NO: 642694 - DNA, 25 bp, Mus musculus
gacatatgagatccagttttcccag

SEQ ID NO: 642695 - DNA, 25 bp, Mus musculus
gacatatgagatgcagttttcccag

SEQ ID NO: 642696 - DNA, 25 bp, Mus musculus
gacatatggataatccaggagccac

SEQ ID NO: 642697 - DNA, 25 bp, Mus musculus
gacatatggatattccaggagccac

SEQ ID NO: 642698 - DNA, 25 bp, Mus musculus
gacatatgtgtccagcttctaccat

SEQ ID NO: 642699 - DNA, 25 bp, Mus musculus
gacatatgtgtcgagcttctaccat

SEQ ID NO: 642700 - DNA, 25 bp, Mus musculus
gacatcaaacatcgttgggctgagc

SEQ ID NO: 642701 - DNA, 25 bp, Mus musculus
gacatcaaacatggttgggctgagc

SEQ ID NO: 642702 - DNA, 25 bp, Mus musculus
gacatcaaactcaccaaagacggca

SEQ ID NO: 642703 - DNA, 25 bp, Mus musculus
gacatcaaactctccaaagacggca

SEQ ID NO: 642704 - DNA, 25 bp, Mus musculus
gacatcaaagcaccgtttgcaccat

SEQ ID NO: 642705 - DNA, 25 bp, Mus musculus
gacatcaaagcagcgtttgcaccat

SEQ ID NO: 642706 - DNA, 25 bp, Mus musculus
gacatcaaatttcagtatcgtggga

SEQ ID NO: 642707 - DNA, 25 bp, Mus musculus
gacatcaaatttgagtatcgtggga

SEQ ID NO: 642708 - DNA, 25 bp, Mus musculus
gacatcaacaagcatctggtgatct

SEQ ID NO: 642709 - DNA, 25 bp, Mus musculus
gacatcaacaagcatgcctgtctgt

SEQ ID NO: 642710 - DNA, 25 bp, Mus musculus
gacatcaacaaggatctggtgatct

SEQ ID NO: 642711 - DNA, 25 bp, Mus musculus
gacatcaacaaggatgcctgtctgt

SEQ ID NO: 642712 - DNA, 25 bp, Mus musculus
gacatcaactatatggctttatcag

SEQ ID NO: 642713 - DNA, 25 bp, Mus musculus
gacatcaactatccctctcagaagc

SEQ ID NO: 642714 - DNA, 25 bp, Mus musculus
gacatcaactatgcctctcagaagc

SEQ ID NO: 642715 - DNA, 25 bp, Mus musculus
gacatcaactatttggctttatcag

SEQ ID NO: 642716 - DNA, 25 bp, Mus musculus
gacatcaagaaacaccagggctcca

SEQ ID NO: 642717 - DNA, 25 bp, Mus musculus
gacatcaagaaagaccagggctcca

SEQ ID NO: 642718 - DNA, 25 bp, Mus musculus
gacatcaagaacaaccccgaatatt

SEQ ID NO: 642719 - DNA, 25 bp, Mus musculus
gacatcaagaactaccccgaatatt

SEQ ID NO: 642720 - DNA, 25 bp, Mus musculus
gacatcaagaggactgtgcctacct

SEQ ID NO: 642721 - DNA, 25 bp, Mus musculus
gacatcaagaggtctgtgcctacct

SEQ ID NO: 642722 - DNA, 25 bp, Mus musculus
gacatcaagtctaacaacggccttg

SEQ ID NO: 642723 - DNA, 25 bp, Mus musculus
gacatcaagtcttacaacggccttg

SEQ ID NO: 642724 - DNA, 25 bp, Mus musculus
gacatcacaaatcaagaatccttca

SEQ ID NO: 642725 - DNA, 25 bp, Mus musculus
gacatcacaaatgaagaatccttca

SEQ ID NO: 642726 - DNA, 25 bp, Mus musculus
gacatcacagaaccgatcaaactgg

SEQ ID NO: 642727 - DNA, 25 bp, Mus musculus
gacatcacagaagcgatcaaactgg

SEQ ID NO: 642728 - DNA, 25 bp, Mus musculus
gacatcacagcaaatcgtacacgtt

SEQ ID NO: 642729 - DNA, 25 bp, Mus musculus
gacatcacagcatatcgtacacgtt

SEQ ID NO: 642730 - DNA, 25 bp, Mus musculus
gacatcaccaaccagtcctcttttg

SEQ ID NO: 642731 - DNA, 25 bp, Mus musculus
gacatcaccaacgagtcctcttttg

SEQ ID NO: 642732 - DNA, 25 bp, Mus musculus
gacatcaccttgaagatccagtttt

SEQ ID NO: 642733 - DNA, 25 bp, Mus musculus
gacatcaccttgattgctgaacagc

SEQ ID NO: 642734 - DNA, 25 bp, Mus musculus
gacatcaccttgtagatccagtttt

SEQ ID NO: 642735 - DNA, 25 bp, Mus musculus
gacatcaccttgtttgctgaacagc

SEQ ID NO: 642736 - DNA, 25 bp, Mus musculus
gacatcacctttccaacagacattg

SEQ ID NO: 642737 - DNA, 25 bp, Mus musculus
gacatcacctttgcaacagacattg

SEQ ID NO: 642738 - DNA, 25 bp, Mus musculus
gacatcacgcatcttgctacgccag

SEQ ID NO: 642739 - DNA, 25 bp, Mus musculus
gacatcacgcatgttgctacgccag

SEQ ID NO: 642740 - DNA, 25 bp, Mus musculus
gacatcactaagaggccttgagtag

SEQ ID NO: 642741 - DNA, 25 bp, Mus musculus
gacatcactaagatccgttccaaca

SEQ ID NO: 642742 - DNA, 25 bp, Mus musculus
gacatcactaagtggccttgagtag

SEQ ID NO: 642743 - DNA, 25 bp, Mus musculus
gacatcactaagttccgttccaaca

SEQ ID NO: 642744 - DNA, 25 bp, Mus musculus
gacatcactggccataaacgaagtg

SEQ ID NO: 642745 - DNA, 25 bp, Mus musculus
gacatcactggcgataaacgaagtg

SEQ ID NO: 642746 - DNA, 25 bp, Mus musculus
gacatcactgggactgctgatgtta

SEQ ID NO: 642747 - DNA, 25 bp, Mus musculus
gacatcactgggtctgctgatgtta

SEQ ID NO: 642748 - DNA, 25 bp, Mus musculus
gacatcagaacaccctagaaggcgt

SEQ ID NO: 642749 - DNA, 25 bp, Mus musculus
gacatcagaacagcctagaaggcgt

SEQ ID NO: 642750 - DNA, 25 bp, Mus musculus
gacatcagaaccatcaatgtgaggt

SEQ ID NO: 642751 - DNA, 25 bp, Mus musculus
gacatcagaaccttcaatgtgaggt

SEQ ID NO: 642752 - DNA, 25 bp, Mus musculus
gacatcagagccatggagaacggag

SEQ ID NO: 642753 - DNA, 25 bp, Mus musculus
gacatcagagccttggagaacggag

SEQ ID NO: 642754 - DNA, 25 bp, Mus musculus
gacatcagcagcctttaccagatct

SEQ ID NO: 642755 - DNA, 25 bp, Mus musculus
gacatcagcagcgtttaccagatct

SEQ ID NO: 642756 - DNA, 25 bp, Mus musculus
gacatcagccagagggccgggccct

SEQ ID NO: 642757 - DNA, 25 bp, Mus musculus
gacatcagccagtgggccgggccct

SEQ ID NO: 642758 - DNA, 25 bp, Mus musculus
gacatcagccctaacatgctctgtg

SEQ ID NO: 642759 - DNA, 25 bp, Mus musculus
gacatcagcccttacatgctctgtg

SEQ ID NO: 642760 - DNA, 25 bp, Mus musculus
gacatcagcgcaagatgctggccgc

SEQ ID NO: 642761 - DNA, 25 bp, Mus musculus
gacatcagcgcatgatgctggccgc

SEQ ID NO: 642762 - DNA, 25 bp, Mus musculus
gacatcaggaaaccaaagtcccagt

SEQ ID NO: 642763 - DNA, 25 bp, Mus musculus
gacatcaggaaagcaaagtcccagt

SEQ ID NO: 642764 - DNA, 25 bp, Mus musculus
gacatcaggaagattggcctagaga

SEQ ID NO: 642765 - DNA, 25 bp, Mus musculus
gacatcaggaagtttggcctagaga

SEQ ID NO: 642766 - DNA, 25 bp, Mus musculus
gacatcagggagcactatgaacgga

SEQ ID NO: 642767 - DNA, 25 bp, Mus musculus
gacatcagggaggactatgaacgga

SEQ ID NO: 642768 - DNA, 25 bp, Mus musculus
gacatcagtctgaggctggagctct

SEQ ID NO: 642769 - DNA, 25 bp, Mus musculus
gacatcagtctgtggctggagctct

SEQ ID NO: 642770 - DNA, 25 bp, Mus musculus
gacatcatcaaaacagtccaggcag

SEQ ID NO: 642771 - DNA, 25 bp, Mus musculus
gacatcatcaaatcagtccaggcag

SEQ ID NO: 642772 - DNA, 25 bp, Mus musculus
gacatcatcagcctggaatcaagtt

SEQ ID NO: 642773 - DNA, 25 bp, Mus musculus
gacatcatcagcgtggaatcaagtt

SEQ ID NO: 642774 - DNA, 25 bp, Mus musculus
gacatcatcatgctgacctctgacg

SEQ ID NO: 642775 - DNA, 25 bp, Mus musculus
gacatcatcatggtgacctctgacg

SEQ ID NO: 642776 - DNA, 25 bp, Mus musculus
gacatcatgaggcactcaaactaca

SEQ ID NO: 642777 - DNA, 25 bp, Mus musculus
gacatcatgagggactcaaactaca

SEQ ID NO: 642778 - DNA, 25 bp, Mus musculus
gacatcatgcagcactctagccagc

SEQ ID NO: 642779 - DNA, 25 bp, Mus musculus
gacatcatgcaggactctagccagc

SEQ ID NO: 642780 - DNA, 25 bp, Mus musculus
gacatcatgttcatgggagacttca

SEQ ID NO: 642781 - DNA, 25 bp, Mus musculus
gacatcatgttcttgggagacttca

SEQ ID NO: 642782 - DNA, 25 bp, Mus musculus
gacatcattcagcaaatctctccag

SEQ ID NO: 642783 - DNA, 25 bp, Mus musculus
gacatcattcaggaaatctctccag

SEQ ID NO: 642784 - DNA, 25 bp, Mus musculus
gacatcattcgcaactacactgcca

SEQ ID NO: 642785 - DNA, 25 bp, Mus musculus
gacatcattcgctactacactgcca

SEQ ID NO: 642786 - DNA, 25 bp, Mus musculus
gacatcattgctcggagaactccag

SEQ ID NO: 642787 - DNA, 25 bp, Mus musculus
gacatcattgctgggagaactccag

SEQ ID NO: 642788 - DNA, 25 bp, Mus musculus
gacatcattggacagttcaaagttc

SEQ ID NO: 642789 - DNA, 25 bp, Mus musculus
gacatcattggagagttcaaagttc

SEQ ID NO: 642790 - DNA, 25 bp, Mus musculus
gacatccaagcaaaagaagaactgt

SEQ ID NO: 642791 - DNA, 25 bp, Mus musculus
gacatccaagcataagaagaactgt

SEQ ID NO: 642792 - DNA, 25 bp, Mus musculus
gacatccaagctctggaatactaag

SEQ ID NO: 642793 - DNA, 25 bp, Mus musculus
gacatccaagctgtggaatactaag

SEQ ID NO: 642794 - DNA, 25 bp, Mus musculus
gacatccaatcaatccagtggtttg

SEQ ID NO: 642795 - DNA, 25 bp, Mus musculus
gacatccaatcattccagtggtttg

SEQ ID NO: 642796 - DNA, 25 bp, Mus musculus
gacatccaccttccgcatggtgaca

SEQ ID NO: 642797 - DNA, 25 bp, Mus musculus
gacatccaccttgcgcatggtgaca

SEQ ID NO: 642798 - DNA, 25 bp, Mus musculus
gacatccagaggaatttgaactgct

SEQ ID NO: 642799 - DNA, 25 bp, Mus musculus
gacatccagaggtatttgaactgct

SEQ ID NO: 642800 - DNA, 25 bp, Mus musculus
gacatccagattctgggagatgacc

SEQ ID NO: 642801 - DNA, 25 bp, Mus musculus
gacatccagattgtgggagatgacc

SEQ ID NO: 642802 - DNA, 25 bp, Mus musculus
gacatccagcaaagggagtacgtcc

SEQ ID NO: 642803 - DNA, 25 bp, Mus musculus
gacatccagcaatgggagtacgtcc

SEQ ID NO: 642804 - DNA, 25 bp, Mus musculus
gacatccagcctagcgtcaaatctc

SEQ ID NO: 642805 - DNA, 25 bp, Mus musculus
gacatccagccttgcgtcaaatctc

SEQ ID NO: 642806 - DNA, 25 bp, Mus musculus
gacatccagcgccaggacctcagtg

SEQ ID NO: 642807 - DNA, 25 bp, Mus musculus
gacatccagcgcgaggacctcagtg

SEQ ID NO: 642808 - DNA, 25 bp, Mus musculus
gacatccagcgtccttgtctcaggc

SEQ ID NO: 642809 - DNA, 25 bp, Mus musculus
gacatccagcgtgcttgtctcaggc

SEQ ID NO: 642810 - DNA, 25 bp, Mus musculus
gacatccatagcagtgtttctcgag

SEQ ID NO: 642811 - DNA, 25 bp, Mus musculus
gacatccatagctgtgtttctcgag

SEQ ID NO: 642812 - DNA, 25 bp, Mus musculus
gacatccatataattggagacatca

SEQ ID NO: 642813 - DNA, 25 bp, Mus musculus
gacatccatatatttggagacatca

SEQ ID NO: 642814 - DNA, 25 bp, Mus musculus
gacatccatgagcaagatgtttgtg

SEQ ID NO: 642815 - DNA, 25 bp, Mus musculus
gacatccatgaggaagatgtttgtg

SEQ ID NO: 642816 - DNA, 25 bp, Mus musculus
gacatcccctacatgtttgaggccc

SEQ ID NO: 642817 - DNA, 25 bp, Mus musculus
gacatcccctacttgtttgaggccc

SEQ ID NO: 642818 - DNA, 25 bp, Mus musculus
gacatcccctatacttctgcaggga

SEQ ID NO: 642819 - DNA, 25 bp, Mus musculus
gacatcccctattcttctgcaggga

SEQ ID NO: 642820 - DNA, 25 bp, Mus musculus
gacatcccgagacattaaattccaa

SEQ ID NO: 642821 - DNA, 25 bp, Mus musculus
gacatcccgagagattaaattccaa

SEQ ID NO: 642822 - DNA, 25 bp, Mus musculus
gacatccctcctctaggtcgagaca

SEQ ID NO: 642823 - DNA, 25 bp, Mus musculus
gacatccctcctgtaggtcgagaca

SEQ ID NO: 642824 - DNA, 25 bp, Mus musculus
gacatccgaatgctgcctgaggaca

SEQ ID NO: 642825 - DNA, 25 bp, Mus musculus
gacatccgaatggtgcctgaggaca

SEQ ID NO: 642826 - DNA, 25 bp, Mus musculus
gacatccgatgtccaattcccagga

SEQ ID NO: 642827 - DNA, 25 bp, Mus musculus
gacatccgatgtgcaattcccagga

SEQ ID NO: 642828 - DNA, 25 bp, Mus musculus
gacatccgcctgactatgaggaaag

SEQ ID NO: 642829 - DNA, 25 bp, Mus musculus
gacatccgcctgtctatgaggaaag

SEQ ID NO: 642830 - DNA, 25 bp, Mus musculus
gacatccgcttcaggttggagctgg

SEQ ID NO: 642831 - DNA, 25 bp, Mus musculus
gacatccgcttctggttggagctgg

SEQ ID NO: 642832 - DNA, 25 bp, Mus musculus
gacatccggtgtcacatcgggccga

SEQ ID NO: 642833 - DNA, 25 bp, Mus musculus
gacatccggtgtgacatcgggccga

SEQ ID NO: 642834 - DNA, 25 bp, Mus musculus
gacatccgtaaaccgctggatgttt

SEQ ID NO: 642835 - DNA, 25 bp, Mus musculus
gacatccgtaaagcgctggatgttt

SEQ ID NO: 642836 - DNA, 25 bp, Mus musculus
gacatccgtgcaaggcaggaatcct

SEQ ID NO: 642837 - DNA, 25 bp, Mus musculus
gacatccgtgcatggcaggaatcct

SEQ ID NO: 642838 - DNA, 25 bp, Mus musculus
gacatcctatgactgtagtggatca

SEQ ID NO: 642839 - DNA, 25 bp, Mus musculus
gacatcctatgagtgtagtggatca

SEQ ID NO: 642840 - DNA, 25 bp, Mus musculus
gacatcctcagaagacccttgggat

SEQ ID NO: 642841 - DNA, 25 bp, Mus musculus
gacatcctcagatgacccttgggat

SEQ ID NO: 642842 - DNA, 25 bp, Mus musculus
gacatcctctggaacgggacaggaa

SEQ ID NO: 642843 - DNA, 25 bp, Mus musculus
gacatcctctggtacgggacaggaa

SEQ ID NO: 642844 - DNA, 25 bp, Mus musculus
gacatcctgagccaccgcttcaatg

SEQ ID NO: 642845 - DNA, 25 bp, Mus musculus
gacatcctgagcgaccgcttcaatg

SEQ ID NO: 642846 - DNA, 25 bp, Mus musculus
gacatcctgcctcaccgcttagtga

SEQ ID NO: 642847 - DNA, 25 bp, Mus musculus
gacatcctgcctgaccgcttagtga

SEQ ID NO: 642848 - DNA, 25 bp, Mus musculus
gacatccttggacctgctgagacag

SEQ ID NO: 642849 - DNA, 25 bp, Mus musculus
gacatccttggagctgctgagacag

SEQ ID NO: 642850 - DNA, 25 bp, Mus musculus
gacatccttggtcctctcaaatgaa

SEQ ID NO: 642851 - DNA, 25 bp, Mus musculus
gacatccttggtgctctcaaatgaa

SEQ ID NO: 642852 - DNA, 25 bp, Mus musculus
gacatcgaaagacagttccacaagg

SEQ ID NO: 642853 - DNA, 25 bp, Mus musculus
gacatcgaaagagagttccacaagg

SEQ ID NO: 642854 - DNA, 25 bp, Mus musculus
gacatcgagcagatctttaacatcg

SEQ ID NO: 642855 - DNA, 25 bp, Mus musculus
gacatcgagcagttctttaacatcg

SEQ ID NO: 642856 - DNA, 25 bp, Mus musculus
gacatcgaggcgctcaagaagctta

SEQ ID NO: 642857 - DNA, 25 bp, Mus musculus
gacatcgaggcggtcaagaagctta

SEQ ID NO: 642858 - DNA, 25 bp, Mus musculus
gacatcgaggtcaacacccggcgag

SEQ ID NO: 642859 - DNA, 25 bp, Mus musculus
gacatcgaggtctacacccggcgag

SEQ ID NO: 642860 - DNA, 25 bp, Mus musculus
gacatcgatgctatagagttctacc

SEQ ID NO: 642861 - DNA, 25 bp, Mus musculus
gacatcgatgctttagagttctacc

SEQ ID NO: 642862 - DNA, 25 bp, Mus musculus
gacatcgcagctatcaacaagatct

SEQ ID NO: 642863 - DNA, 25 bp, Mus musculus
gacatcgcagctttcaacaagatct

SEQ ID NO: 642864 - DNA, 25 bp, Mus musculus
gacatcgccaaactgtccatcgggc

SEQ ID NO: 642865 - DNA, 25 bp, Mus musculus
gacatcgccaaagtgtccatcgggc

SEQ ID NO: 642866 - DNA, 25 bp, Mus musculus
gacatcgccatccaggcagaggaaa

SEQ ID NO: 642867 - DNA, 25 bp, Mus musculus
gacatcgccatcgaggcagaggaaa

SEQ ID NO: 642868 - DNA, 25 bp, Mus musculus
gacatcgcccgcatgactgtcaacg

SEQ ID NO: 642869 - DNA, 25 bp, Mus musculus
gacatcgcccgcttgactgtcaacg

SEQ ID NO: 642870 - DNA, 25 bp, Mus musculus
gacatcgctgatcgtaagtctcctg

SEQ ID NO: 642871 - DNA, 25 bp, Mus musculus
gacatcgctgatggtaagtctcctg

SEQ ID NO: 642872 - DNA, 25 bp, Mus musculus
gacatcgtcagaccgaacacgtttg

SEQ ID NO: 642873 - DNA, 25 bp, Mus musculus
gacatcgtcagagcgaacacgtttg

SEQ ID NO: 642874 - DNA, 25 bp, Mus musculus
gacatcgtcccaacaaatttaccac

SEQ ID NO: 642875 - DNA, 25 bp, Mus musculus
gacatcgtcccatcaaatttaccac

SEQ ID NO: 642876 - DNA, 25 bp, Mus musculus
gacatcgtgaggatgctgcttgacc

SEQ ID NO: 642877 - DNA, 25 bp, Mus musculus
gacatcgtgaggttgctgcttgacc

SEQ ID NO: 642878 - DNA, 25 bp, Mus musculus
gacatcgtgagtcagatcaacgcct

SEQ ID NO: 642879 - DNA, 25 bp, Mus musculus
gacatcgtgagtgagatcaacgcct

SEQ ID NO: 642880 - DNA, 25 bp, Mus musculus
gacatcgtgcgtcatgggcgcttat

SEQ ID NO: 642881 - DNA, 25 bp, Mus musculus
gacatcgtgcgtgatgggcgcttat

SEQ ID NO: 642882 - DNA, 25 bp, Mus musculus
gacatcgtggccattatcttgaacg

SEQ ID NO: 642883 - DNA, 25 bp, Mus musculus
gacatcgtggcctttatcttgaacg

SEQ ID NO: 642884 - DNA, 25 bp, Mus musculus
gacatctactatattggaggccaaa

SEQ ID NO: 642885 - DNA, 25 bp, Mus musculus
gacatctactattttggaggccaaa

SEQ ID NO: 642886 - DNA, 25 bp, Mus musculus
gacatctcaagaaccttggccaccg

SEQ ID NO: 642887 - DNA, 25 bp, Mus musculus
gacatctcaagatccttggccaccg

SEQ ID NO: 642888 - DNA, 25 bp, Mus musculus
gacatctcagttaagcaaaggaaaa

SEQ ID NO: 642889 - DNA, 25 bp, Mus musculus
gacatctcagtttagcaaaggaaaa

SEQ ID NO: 642890 - DNA, 25 bp, Mus musculus
gacatctccactcaaggctggttta

SEQ ID NO: 642891 - DNA, 25 bp, Mus musculus
gacatctccactgaaggctggttta

SEQ ID NO: 642892 - DNA, 25 bp, Mus musculus
gacatctcccagcatctggacaaca

SEQ ID NO: 642893 - DNA, 25 bp, Mus musculus
gacatctcccaggatctggacaaca

SEQ ID NO: 642894 - DNA, 25 bp, Mus musculus
gacatctcctccatgttatgcgcaa

SEQ ID NO: 642895 - DNA, 25 bp, Mus musculus
gacatctcctccttgttatgcgcaa

SEQ ID NO: 642896 - DNA, 25 bp, Mus musculus
gacatctcctctacaagtacctaac

SEQ ID NO: 642897 - DNA, 25 bp, Mus musculus
gacatctcctcttcaagtacctaac

SEQ ID NO: 642898 - DNA, 25 bp, Mus musculus
gacatctcggacattctatgtgcag

SEQ ID NO: 642899 - DNA, 25 bp, Mus musculus
gacatctcggactttctatgtgcag

SEQ ID NO: 642900 - DNA, 25 bp, Mus musculus
gacatctcggccagaacttggtgga

SEQ ID NO: 642901 - DNA, 25 bp, Mus musculus
gacatctcggcctgaacttggtgga

SEQ ID NO: 642902 - DNA, 25 bp, Mus musculus
gacatctctactcgttcagtttgac

SEQ ID NO: 642903 - DNA, 25 bp, Mus musculus
gacatctctactggttcagtttgac

SEQ ID NO: 642904 - DNA, 25 bp, Mus musculus
gacatctctgctctagtagacaaag

SEQ ID NO: 642905 - DNA, 25 bp, Mus musculus
gacatctctgctgtagtagacaaag

SEQ ID NO: 642906 - DNA, 25 bp, Mus musculus
gacatctcttccatcagctataaga

SEQ ID NO: 642907 - DNA, 25 bp, Mus musculus
gacatctcttccttcagctataaga

SEQ ID NO: 642908 - DNA, 25 bp, Mus musculus
gacatctgaggcacattcggctgcc

SEQ ID NO: 642909 - DNA, 25 bp, Mus musculus
gacatctgaggctcattcggctgcc

SEQ ID NO: 642910 - DNA, 25 bp, Mus musculus
gacatctgatgaaacagttgtggct

SEQ ID NO: 642911 - DNA, 25 bp, Mus musculus
gacatctgatgatacagttgtggct

SEQ ID NO: 642912 - DNA, 25 bp, Mus musculus
gacatctgatttcaaggcagactca

SEQ ID NO: 642913 - DNA, 25 bp, Mus musculus
gacatctgatttgaaggcagactca

SEQ ID NO: 642914 - DNA, 25 bp, Mus musculus
gacatctgccaaaggcaaggtctcc

SEQ ID NO: 642915 - DNA, 25 bp, Mus musculus
gacatctgccaatggcaaggtctcc

SEQ ID NO: 642916 - DNA, 25 bp, Mus musculus
gacatctgccacaaggcatttcgga

SEQ ID NO: 642917 - DNA, 25 bp, Mus musculus
gacatctgccactaggcatttcgga

SEQ ID NO: 642918 - DNA, 25 bp, Mus musculus
gacatctgcgacattctcctgggaa

SEQ ID NO: 642919 - DNA, 25 bp, Mus musculus
gacatctgcgactttctcctgggaa

SEQ ID NO: 642920 - DNA, 25 bp, Mus musculus
gacatctgctggaaaaaagtcacca

SEQ ID NO: 642921 - DNA, 25 bp, Mus musculus
gacatctgctggtaaaaagtcacca

SEQ ID NO: 642922 - DNA, 25 bp, Mus musculus
gacatctgggtgagctacgtgacct

SEQ ID NO: 642923 - DNA, 25 bp, Mus musculus
gacatctgggtgtgctacgtgacct

SEQ ID NO: 642924 - DNA, 25 bp, Mus musculus
gacatctgtaccaccttgcgctacg

SEQ ID NO: 642925 - DNA, 25 bp, Mus musculus
gacatctgtacctccttgcgctacg

SEQ ID NO: 642926 - DNA, 25 bp, Mus musculus
gacatctgtggacatctggccagcg

SEQ ID NO: 642927 - DNA, 25 bp, Mus musculus
gacatctgtggagatctggccagcg

SEQ ID NO: 642928 - DNA, 25 bp, Mus musculus
gacatctgtgtactttgcagttgca

SEQ ID NO: 642929 - DNA, 25 bp, Mus musculus
gacatctgtgtagtttgcagttgca

SEQ ID NO: 642930 - DNA, 25 bp, Mus musculus
gacatctgtgtgcacggagtctgcc

SEQ ID NO: 642931 - DNA, 25 bp, Mus musculus
gacatctgtgtggacggagtctgcc

SEQ ID NO: 642932 - DNA, 25 bp, Mus musculus
gacatctgttctctatcatgcgaga

SEQ ID NO: 642933 - DNA, 25 bp, Mus musculus
gacatctgttctgtatcatgcgaga

SEQ ID NO: 642934 - DNA, 25 bp, Mus musculus
gacatcttccaccagcacatgcagg

SEQ ID NO: 642935 - DNA, 25 bp, Mus musculus
gacatcttccacgagcacatgcagg

SEQ ID NO: 642936 - DNA, 25 bp, Mus musculus
gacatcttcctcagcaagtccgcta

SEQ ID NO: 642937 - DNA, 25 bp, Mus musculus
gacatcttcctctgcaagtccgcta

SEQ ID NO: 642938 - DNA, 25 bp, Mus musculus
gacatcttgaaacctcccaagcctg

SEQ ID NO: 642939 - DNA, 25 bp, Mus musculus
gacatcttgaaagctcccaagcctg

SEQ ID NO: 642940 - DNA, 25 bp, Mus musculus
gacatcttggacctgaagttctgca

SEQ ID NO: 642941 - DNA, 25 bp, Mus musculus
gacatcttggacgtgaagttctgca

SEQ ID NO: 642942 - DNA, 25 bp, Mus musculus
gacatcttggcacgagccttcagcc

SEQ ID NO: 642943 - DNA, 25 bp, Mus musculus
gacatcttggcaggagccttcagcc

SEQ ID NO: 642944 - DNA, 25 bp, Mus musculus
gacatcttgtgtcttttattactga

SEQ ID NO: 642945 - DNA, 25 bp, Mus musculus
gacatcttgtgtgttttattactga

SEQ ID NO: 642946 - DNA, 25 bp, Mus musculus
gacatcttttcccttggacaagctg

SEQ ID NO: 642947 - DNA, 25 bp, Mus musculus
gacatcttttccgttggacaagctg

SEQ ID NO: 642948 - DNA, 25 bp, Mus musculus
gacatgaaacctcagaacttgctct

SEQ ID NO: 642949 - DNA, 25 bp, Mus musculus
gacatgaaacctgagaacttgctct

SEQ ID NO: 642950 - DNA, 25 bp, Mus musculus
gacatgaaagtcctcgatgacctga

SEQ ID NO: 642951 - DNA, 25 bp, Mus musculus
gacatgaaagtcgtcgatgacctga

SEQ ID NO: 642952 - DNA, 25 bp, Mus musculus
gacatgaacagcatgatgctgacac

SEQ ID NO: 642953 - DNA, 25 bp, Mus musculus
gacatgaacagcttgatgctgacac

SEQ ID NO: 642954 - DNA, 25 bp, Mus musculus
gacatgaaccaaatccgaatgttgt

SEQ ID NO: 642955 - DNA, 25 bp, Mus musculus
gacatgaaccaattccgaatgttgt

SEQ ID NO: 642956 - DNA, 25 bp, Mus musculus
gacatgaacgaaccgtccaacttcg

SEQ ID NO: 642957 - DNA, 25 bp, Mus musculus
gacatgaacgaagcgtccaacttcg

SEQ ID NO: 642958 - DNA, 25 bp, Mus musculus
gacatgaacgccattcagatggagg

SEQ ID NO: 642959 - DNA, 25 bp, Mus musculus
gacatgaacgcctttcagatggagg

SEQ ID NO: 642960 - DNA, 25 bp, Mus musculus
gacatgaagatgagaagaaggcgct

SEQ ID NO: 642961 - DNA, 25 bp, Mus musculus
gacatgaagatgtgaagaaggcgct

SEQ ID NO: 642962 - DNA, 25 bp, Mus musculus
gacatgaagattcatctcatgagca

SEQ ID NO: 642963 - DNA, 25 bp, Mus musculus
gacatgaagattgatctcatgagca

SEQ ID NO: 642964 - DNA, 25 bp, Mus musculus
gacatgaagcggcactgtttgcaca

SEQ ID NO: 642965 - DNA, 25 bp, Mus musculus
gacatgaagcgggactgtttgcaca

SEQ ID NO: 642966 - DNA, 25 bp, Mus musculus
gacatgaaggatcagatgtcagctt

SEQ ID NO: 642967 - DNA, 25 bp, Mus musculus
gacatgaaggatgagatgtcagctt

SEQ ID NO: 642968 - DNA, 25 bp, Mus musculus
gacatgaaggctccgaatgtgctca

SEQ ID NO: 642969 - DNA, 25 bp, Mus musculus
gacatgaaggctgcgaatgtgctca

SEQ ID NO: 642970 - DNA, 25 bp, Mus musculus
gacatgaatgcacctaaagcaccaa

SEQ ID NO: 642971 - DNA, 25 bp, Mus musculus
gacatgaatgcagctaaagcaccaa

SEQ ID NO: 642972 - DNA, 25 bp, Mus musculus
gacatgaattctatagtttatcgga

SEQ ID NO: 642973 - DNA, 25 bp, Mus musculus
gacatgaattctttagtttatcgga

SEQ ID NO: 642974 - DNA, 25 bp, Mus musculus
gacatgacaggcaacaccatacagt

SEQ ID NO: 642975 - DNA, 25 bp, Mus musculus
gacatgacaggctacaccatacagt

SEQ ID NO: 642976 - DNA, 25 bp, Mus musculus
gacatgacatttatacgcttcctga

SEQ ID NO: 642977 - DNA, 25 bp, Mus musculus
gacatgacatttccggagcaattta

SEQ ID NO: 642978 - DNA, 25 bp, Mus musculus
gacatgacatttgcggagcaattta

SEQ ID NO: 642979 - DNA, 25 bp, Mus musculus
gacatgacatttttacgcttcctga

SEQ ID NO: 642980 - DNA, 25 bp, Mus musculus
gacatgacggacagcatcccgctgc

SEQ ID NO: 642981 - DNA, 25 bp, Mus musculus
gacatgacggactgcatcccgctgc

SEQ ID NO: 642982 - DNA, 25 bp, Mus musculus
gacatgagactcattgggtgatcat

SEQ ID NO: 642983 - DNA, 25 bp, Mus musculus
gacatgagactctttgggtgatcat

SEQ ID NO: 642984 - DNA, 25 bp, Mus musculus
gacatgagcccactggtggctgccc

SEQ ID NO: 642985 - DNA, 25 bp, Mus musculus
gacatgagcccagtggtggctgccc

SEQ ID NO: 642986 - DNA, 25 bp, Mus musculus
gacatgagcgtcattgatgcctaca

SEQ ID NO: 642987 - DNA, 25 bp, Mus musculus
gacatgagcgtctttgatgcctaca

SEQ ID NO: 642988 - DNA, 25 bp, Mus musculus
gacatgagctgcagaagttggctcc

SEQ ID NO: 642989 - DNA, 25 bp, Mus musculus
gacatgagctgctgaagttggctcc

SEQ ID NO: 642990 - DNA, 25 bp, Mus musculus
gacatgagtaatcaacgcgtcacct

SEQ ID NO: 642991 - DNA, 25 bp, Mus musculus
gacatgagtaatgaacgcgtcacct

SEQ ID NO: 642992 - DNA, 25 bp, Mus musculus
gacatgagtcttcccctctagaagg

SEQ ID NO: 642993 - DNA, 25 bp, Mus musculus
gacatgagtcttgccctctagaagg

SEQ ID NO: 642994 - DNA, 25 bp, Mus musculus
gacatgagtgccattgtccgcgtca

SEQ ID NO: 642995 - DNA, 25 bp, Mus musculus
gacatgagtgcctttgtccgcgtca

SEQ ID NO: 642996 - DNA, 25 bp, Mus musculus
gacatgatatgtcgctatgcttgcc

SEQ ID NO: 642997 - DNA, 25 bp, Mus musculus
gacatgatatgtggctatgcttgcc

SEQ ID NO: 642998 - DNA, 25 bp, Mus musculus
gacatgatcaaacaccttccatcct

SEQ ID NO: 642999 - DNA, 25 bp, Mus musculus
gacatgatcaaagaccttccatcct

SEQ ID NO: 643000 - DNA, 25 bp, Mus musculus
gacatgatcctgactgcgtctcgag

SEQ ID NO: 643001 - DNA, 25 bp, Mus musculus
gacatgatcctgtctgcgtctcgag

SEQ ID NO: 643002 - DNA, 25 bp, Mus musculus
gacatgatcgtaccagtaaacggcc

SEQ ID NO: 643003 - DNA, 25 bp, Mus musculus
gacatgatcgtagcagtaaacggcc

SEQ ID NO: 643004 - DNA, 25 bp, Mus musculus
gacatgatgtttccgcaaagccggc

SEQ ID NO: 643005 - DNA, 25 bp, Mus musculus
gacatgatgtttgcgcaaagccggc

SEQ ID NO: 643006 - DNA, 25 bp, Mus musculus
gacatgattaatcaggtggatgctg

SEQ ID NO: 643007 - DNA, 25 bp, Mus musculus
gacatgattaatgaggtggatgctg

SEQ ID NO: 643008 - DNA, 25 bp, Mus musculus
gacatgattcctagcatcctgcagt

SEQ ID NO: 643009 - DNA, 25 bp, Mus musculus
gacatgattccttgcatcctgcagt

SEQ ID NO: 643010 - DNA, 25 bp, Mus musculus
gacatgatttttagctcaaggctta

SEQ ID NO: 643011 - DNA, 25 bp, Mus musculus
gacatgattttttgctcaaggctta

SEQ ID NO: 643012 - DNA, 25 bp, Mus musculus
gacatgcaagagcttgttctgagcc

SEQ ID NO: 643013 - DNA, 25 bp, Mus musculus
gacatgcaagaggttgttctgagcc

SEQ ID NO: 643014 - DNA, 25 bp, Mus musculus
gacatgcacgacaggctgtatgcct

SEQ ID NO: 643015 - DNA, 25 bp, Mus musculus
gacatgcacgactggctgtatgcct

SEQ ID NO: 643016 - DNA, 25 bp, Mus musculus
gacatgcagacgaccggtgtgttgc

SEQ ID NO: 643017 - DNA, 25 bp, Mus musculus
gacatgcagacgtccggtgtgttgc

SEQ ID NO: 643018 - DNA, 25 bp, Mus musculus
gacatgccactcagcagagggctct

SEQ ID NO: 643019 - DNA, 25 bp, Mus musculus
gacatgccactctgcagagggctct

SEQ ID NO: 643020 - DNA, 25 bp, Mus musculus
gacatgccacttcagctaaagctag

SEQ ID NO: 643021 - DNA, 25 bp, Mus musculus
gacatgccacttgagctaaagctag

SEQ ID NO: 643022 - DNA, 25 bp, Mus musculus
gacatgcccagtcgcgagtcctgca

SEQ ID NO: 643023 - DNA, 25 bp, Mus musculus
gacatgcccagtggcgagtcctgca

SEQ ID NO: 643024 - DNA, 25 bp, Mus musculus
gacatgcccatgcatattgacagta

SEQ ID NO: 643025 - DNA, 25 bp, Mus musculus
gacatgcccatggatattgacagta

SEQ ID NO: 643026 - DNA, 25 bp, Mus musculus
gacatgccctgtacagtgcaccctg

SEQ ID NO: 643027 - DNA, 25 bp, Mus musculus
gacatgccctgttcagtgcaccctg

SEQ ID NO: 643028 - DNA, 25 bp, Mus musculus
gacatgcccttcactgctgttgaca

SEQ ID NO: 643029 - DNA, 25 bp, Mus musculus
gacatgcccttctctgctgttgaca

SEQ ID NO: 643030 - DNA, 25 bp, Mus musculus
gacatgcctggacttcttctccaat

SEQ ID NO: 643031 - DNA, 25 bp, Mus musculus
gacatgcctggagttcttctccaat

SEQ ID NO: 643032 - DNA, 25 bp, Mus musculus
gacatgcctggtactgtttacagga

SEQ ID NO: 643033 - DNA, 25 bp, Mus musculus
gacatgcctggtccgagctttcaac

SEQ ID NO: 643034 - DNA, 25 bp, Mus musculus
gacatgcctggtgcgagctttcaac

SEQ ID NO: 643035 - DNA, 25 bp, Mus musculus
gacatgcctggttctgtttacagga

SEQ ID NO: 643036 - DNA, 25 bp, Mus musculus
gacatgcctgtacagaagattctgg

SEQ ID NO: 643037 - DNA, 25 bp, Mus musculus
gacatgcctgtagagaagattctgg

SEQ ID NO: 643038 - DNA, 25 bp, Mus musculus
gacatgcgctggacgtgtgagcacc

SEQ ID NO: 643039 - DNA, 25 bp, Mus musculus
gacatgcgctggtcgtgtgagcacc

SEQ ID NO: 643040 - DNA, 25 bp, Mus musculus
gacatgcggaaaccccttttcagct

SEQ ID NO: 643041 - DNA, 25 bp, Mus musculus
gacatgcggaaagcccttttcagct

SEQ ID NO: 643042 - DNA, 25 bp, Mus musculus
gacatgcggcatcatcgagtgagat

SEQ ID NO: 643043 - DNA, 25 bp, Mus musculus
gacatgcggcatgatcgagtgagat

SEQ ID NO: 643044 - DNA, 25 bp, Mus musculus
gacatgcggtggaacaagggaacca

SEQ ID NO: 643045 - DNA, 25 bp, Mus musculus
gacatgcggtggtacaagggaacca

SEQ ID NO: 643046 - DNA, 25 bp, Mus musculus
gacatgcggtgtcggactaccttct

SEQ ID NO: 643047 - DNA, 25 bp, Mus musculus
gacatgcggtgtgggactaccttct

SEQ ID NO: 643048 - DNA, 25 bp, Mus musculus
gacatgctctacctcaaagacttgg

SEQ ID NO: 643049 - DNA, 25 bp, Mus musculus
gacatgctctacgtcaaagacttgg

SEQ ID NO: 643050 - DNA, 25 bp, Mus musculus
gacatgctggagaatccgcttaaca

SEQ ID NO: 643051 - DNA, 25 bp, Mus musculus
gacatgctggagtatccgcttaaca

SEQ ID NO: 643052 - DNA, 25 bp, Mus musculus
gacatgctgtttctgggtgacttta

SEQ ID NO: 643053 - DNA, 25 bp, Mus musculus
gacatgctgtttgtgggtgacttta

SEQ ID NO: 643054 - DNA, 25 bp, Mus musculus
gacatgcttgttaaggtaagtccgt

SEQ ID NO: 643055 - DNA, 25 bp, Mus musculus
gacatgcttgtttaggtaagtccgt

SEQ ID NO: 643056 - DNA, 25 bp, Mus musculus
gacatgctttttaagttataggtgc

SEQ ID NO: 643057 - DNA, 25 bp, Mus musculus
gacatgcttttttagttataggtgc

SEQ ID NO: 643058 - DNA, 25 bp, Mus musculus
gacatggaaggccagctcagctgca

SEQ ID NO: 643059 - DNA, 25 bp, Mus musculus
gacatggaaggcgagctcagctgca

SEQ ID NO: 643060 - DNA, 25 bp, Mus musculus
gacatggaagtcagagggcttaact

SEQ ID NO: 643061 - DNA, 25 bp, Mus musculus
gacatggaagtctgagggcttaact

SEQ ID NO: 643062 - DNA, 25 bp, Mus musculus
gacatggaataaccccagccttagt

SEQ ID NO: 643063 - DNA, 25 bp, Mus musculus
gacatggaataagcccagccttagt

SEQ ID NO: 643064 - DNA, 25 bp, Mus musculus
gacatggaatatcctctgcgtaaac

SEQ ID NO: 643065 - DNA, 25 bp, Mus musculus
gacatggaatatgctctgcgtaaac

SEQ ID NO: 643066 - DNA, 25 bp, Mus musculus
gacatggactcacggactgtccttt

SEQ ID NO: 643067 - DNA, 25 bp, Mus musculus
gacatggactcagggactgtccttt

SEQ ID NO: 643068 - DNA, 25 bp, Mus musculus
gacatggactgtaacactgcgaact

SEQ ID NO: 643069 - DNA, 25 bp, Mus musculus
gacatggactgttacactgcgaact

SEQ ID NO: 643070 - DNA, 25 bp, Mus musculus
gacatggactttaagcctgagttgc

SEQ ID NO: 643071 - DNA, 25 bp, Mus musculus
gacatggacttttagcctgagttgc

SEQ ID NO: 643072 - DNA, 25 bp, Mus musculus
gacatggagcaacgatggagacact

SEQ ID NO: 643073 - DNA, 25 bp, Mus musculus
gacatggagcaaggatggagacact

SEQ ID NO: 643074 - DNA, 25 bp, Mus musculus
gacatggaggtgacagtcctaactc

SEQ ID NO: 643075 - DNA, 25 bp, Mus musculus
gacatggaggtgtcagtcctaactc

SEQ ID NO: 643076 - DNA, 25 bp, Mus musculus
gacatggatttgattgacatccttt

SEQ ID NO: 643077 - DNA, 25 bp, Mus musculus
gacatggatttgtttgacatccttt

SEQ ID NO: 643078 - DNA, 25 bp, Mus musculus
gacatggcaggcagaagagtcttcc

SEQ ID NO: 643079 - DNA, 25 bp, Mus musculus
gacatggcaggctgaagagtcttcc

SEQ ID NO: 643080 - DNA, 25 bp, Mus musculus
gacatggccaatcctgatcctgatg

SEQ ID NO: 643081 - DNA, 25 bp, Mus musculus
gacatggccaatgctgatcctgatg

SEQ ID NO: 643082 - DNA, 25 bp, Mus musculus
gacatggcggcacactttgaagaga

SEQ ID NO: 643083 - DNA, 25 bp, Mus musculus
gacatggcggcagactttgaagaga

SEQ ID NO: 643084 - DNA, 25 bp, Mus musculus
gacatggctatgattccttcaggtt

SEQ ID NO: 643085 - DNA, 25 bp, Mus musculus
gacatggctatgtttccttcaggtt

SEQ ID NO: 643086 - DNA, 25 bp, Mus musculus
gacatggcttctaggagcgcgcctt

SEQ ID NO: 643087 - DNA, 25 bp, Mus musculus
gacatggcttctcttgcttgtatga

SEQ ID NO: 643088 - DNA, 25 bp, Mus musculus
gacatggcttctgttgcttgtatga

SEQ ID NO: 643089 - DNA, 25 bp, Mus musculus
gacatggcttcttggagcgcgcctt

SEQ ID NO: 643090 - DNA, 25 bp, Mus musculus
gacatggcttgtcttctgcttgtga

SEQ ID NO: 643091 - DNA, 25 bp, Mus musculus
gacatggcttgtgttctgcttgtga

SEQ ID NO: 643092 - DNA, 25 bp, Mus musculus
gacatggctttcaacgtgttcttcc

SEQ ID NO: 643093 - DNA, 25 bp, Mus musculus
gacatggctttctacgtgttcttcc

SEQ ID NO: 643094 - DNA, 25 bp, Mus musculus
gacatggctttgagtggtgctcaga

SEQ ID NO: 643095 - DNA, 25 bp, Mus musculus
gacatggctttgtgtggtgctcaga

SEQ ID NO: 643096 - DNA, 25 bp, Mus musculus
gacatgggaagtatattccccgcca

SEQ ID NO: 643097 - DNA, 25 bp, Mus musculus
gacatgggaagtttattccccgcca

SEQ ID NO: 643098 - DNA, 25 bp, Mus musculus
gacatgggacttcctacctcgctgg

SEQ ID NO: 643099 - DNA, 25 bp, Mus musculus
gacatgggacttgctacctcgctgg

SEQ ID NO: 643100 - DNA, 25 bp, Mus musculus
gacatgggatagcatcatactttca

SEQ ID NO: 643101 - DNA, 25 bp, Mus musculus
gacatgggataggatcatactttca

SEQ ID NO: 643102 - DNA, 25 bp, Mus musculus
gacatgggcacaatgcaggaaagga

SEQ ID NO: 643103 - DNA, 25 bp, Mus musculus
gacatgggcacattgcaggaaagga

SEQ ID NO: 643104 - DNA, 25 bp, Mus musculus
gacatgggcagtagagaagtcttga

SEQ ID NO: 643105 - DNA, 25 bp, Mus musculus
gacatgggcagttgagaagtcttga

SEQ ID NO: 643106 - DNA, 25 bp, Mus musculus
gacatggtaaatcgccaagcaagag

SEQ ID NO: 643107 - DNA, 25 bp, Mus musculus
gacatggtaaatggccaagcaagag

SEQ ID NO: 643108 - DNA, 25 bp, Mus musculus
gacatggtattaagacttccgacat

SEQ ID NO: 643109 - DNA, 25 bp, Mus musculus
gacatggtattatgacttccgacat

SEQ ID NO: 643110 - DNA, 25 bp, Mus musculus
gacatggtctttcttgaccactgga

SEQ ID NO: 643111 - DNA, 25 bp, Mus musculus
gacatggtctttgttgaccactgga

SEQ ID NO: 643112 - DNA, 25 bp, Mus musculus
gacatggtgcataatggccactcca

SEQ ID NO: 643113 - DNA, 25 bp, Mus musculus
gacatggtgcattatggccactcca

SEQ ID NO: 643114 - DNA, 25 bp, Mus musculus
gacatgtacagacaatggctggtcc

SEQ ID NO: 643115 - DNA, 25 bp, Mus musculus
gacatgtacagagaatggctggtcc

SEQ ID NO: 643116 - DNA, 25 bp, Mus musculus
gacatgtactccaatgtgtgggaca

SEQ ID NO: 643117 - DNA, 25 bp, Mus musculus
gacatgtactcctatgtgtgggaca

SEQ ID NO: 643118 - DNA, 25 bp, Mus musculus
gacatgtagttgagttgcagcggaa

SEQ ID NO: 643119 - DNA, 25 bp, Mus musculus
gacatgtagttgtgttgcagcggaa

SEQ ID NO: 643120 - DNA, 25 bp, Mus musculus
gacatgtatattcggtgggctgcac

SEQ ID NO: 643121 - DNA, 25 bp, Mus musculus
gacatgtatattgggtgggctgcac

SEQ ID NO: 643122 - DNA, 25 bp, Mus musculus
gacatgtatctaaacaaccgcctgg

SEQ ID NO: 643123 - DNA, 25 bp, Mus musculus
gacatgtatctatacaaccgcctgg

SEQ ID NO: 643124 - DNA, 25 bp, Mus musculus
gacatgtatgaacttggagcagaga

SEQ ID NO: 643125 - DNA, 25 bp, Mus musculus
gacatgtatgaagttggagcagaga

SEQ ID NO: 643126 - DNA, 25 bp, Mus musculus
gacatgtatgatctgcccaaaaaag

SEQ ID NO: 643127 - DNA, 25 bp, Mus musculus
gacatgtatgatgtgcccaaaaaag

SEQ ID NO: 643128 - DNA, 25 bp, Mus musculus
gacatgtcaatcaaacaatgttagg

SEQ ID NO: 643129 - DNA, 25 bp, Mus musculus
gacatgtcaatctaacaatgttagg

SEQ ID NO: 643130 - DNA, 25 bp, Mus musculus
gacatgtcacagctgttctgagcga

SEQ ID NO: 643131 - DNA, 25 bp, Mus musculus
gacatgtcacaggtgttctgagcga

SEQ ID NO: 643132 - DNA, 25 bp, Mus musculus
gacatgtcacctcaaaaattttggg

SEQ ID NO: 643133 - DNA, 25 bp, Mus musculus
gacatgtcacctgaaaaattttggg

SEQ ID NO: 643134 - DNA, 25 bp, Mus musculus
gacatgtccagcatgaatcccgaat

SEQ ID NO: 643135 - DNA, 25 bp, Mus musculus
gacatgtccagcctgatgcacacca

SEQ ID NO: 643136 - DNA, 25 bp, Mus musculus
gacatgtccagcgtgatgcacacca

SEQ ID NO: 643137 - DNA, 25 bp, Mus musculus
gacatgtccagcttgaatcccgaat

SEQ ID NO: 643138 - DNA, 25 bp, Mus musculus
gacatgtcctgaactgagcttggta

SEQ ID NO: 643139 - DNA, 25 bp, Mus musculus
gacatgtcctgatctgagcttggta

SEQ ID NO: 643140 - DNA, 25 bp, Mus musculus
gacatgtctcagaactggcctcgat

SEQ ID NO: 643141 - DNA, 25 bp, Mus musculus
gacatgtctcagtactggcctcgat

SEQ ID NO: 643142 - DNA, 25 bp, Mus musculus
gacatgtctcgcaatgggagcaact

SEQ ID NO: 643143 - DNA, 25 bp, Mus musculus
gacatgtctcgctatgggagcaact

SEQ ID NO: 643144 - DNA, 25 bp, Mus musculus
gacatgtcttccctgaatttaagga

SEQ ID NO: 643145 - DNA, 25 bp, Mus musculus
gacatgtcttccgtgaatttaagga

SEQ ID NO: 643146 - DNA, 25 bp, Mus musculus
gacatgtgaaaacttctgggatccc

SEQ ID NO: 643147 - DNA, 25 bp, Mus musculus
gacatgtgaaaagttctgggatccc

SEQ ID NO: 643148 - DNA, 25 bp, Mus musculus
gacatgtgcaagagagcttctttgg

SEQ ID NO: 643149 - DNA, 25 bp, Mus musculus
gacatgtgcaagtgagcttctttgg

SEQ ID NO: 643150 - DNA, 25 bp, Mus musculus
gacatgtgcagtcaacaacggaggc

SEQ ID NO: 643151 - DNA, 25 bp, Mus musculus
gacatgtgcagtgaacaacggaggc

SEQ ID NO: 643152 - DNA, 25 bp, Mus musculus
gacatgtgcccacatgaggctgtta

SEQ ID NO: 643153 - DNA, 25 bp, Mus musculus
gacatgtgcccagatgaggctgtta

SEQ ID NO: 643154 - DNA, 25 bp, Mus musculus
gacatgtgccgcatccattctgagg

SEQ ID NO: 643155 - DNA, 25 bp, Mus musculus
gacatgtgccgcttccattctgagg

SEQ ID NO: 643156 - DNA, 25 bp, Mus musculus
gacatgtgcgttatcctgtcagcca

SEQ ID NO: 643157 - DNA, 25 bp, Mus musculus
gacatgtgcgttttcctgtcagcca

SEQ ID NO: 643158 - DNA, 25 bp, Mus musculus
gacatgtggacaattggcctccaag

SEQ ID NO: 643159 - DNA, 25 bp, Mus musculus
gacatgtggacatttggcctccaag

SEQ ID NO: 643160 - DNA, 25 bp, Mus musculus
gacatgtgggaaatttccctcacca

SEQ ID NO: 643161 - DNA, 25 bp, Mus musculus
gacatgtgggaattttccctcacca

SEQ ID NO: 643162 - DNA, 25 bp, Mus musculus
gacatgtgggcccttcagaccccta

SEQ ID NO: 643163 - DNA, 25 bp, Mus musculus
gacatgtgggccgttcagaccccta

SEQ ID NO: 643164 - DNA, 25 bp, Mus musculus
gacatgtgtccacttttctatgaag

SEQ ID NO: 643165 - DNA, 25 bp, Mus musculus
gacatgtgtccagttttctatgaag

SEQ ID NO: 643166 - DNA, 25 bp, Mus musculus
gacatgtgtgcaatagcagccaatg

SEQ ID NO: 643167 - DNA, 25 bp, Mus musculus
gacatgtgtgcattagcagccaatg

SEQ ID NO: 643168 - DNA, 25 bp, Mus musculus
gacatgtgtttaatattcctcctgc

SEQ ID NO: 643169 - DNA, 25 bp, Mus musculus
gacatgtgtttattattcctcctgc

SEQ ID NO: 643170 - DNA, 25 bp, Mus musculus
gacatgttcagcatcagatatacac

SEQ ID NO: 643171 - DNA, 25 bp, Mus musculus
gacatgttcagcttcagatatacac

SEQ ID NO: 643172 - DNA, 25 bp, Mus musculus
gacatgttccacactcgcaactgct

SEQ ID NO: 643173 - DNA, 25 bp, Mus musculus
gacatgttccactctcgcaactgct

SEQ ID NO: 643174 - DNA, 25 bp, Mus musculus
gacatgttcgcccatgtggccgaag

SEQ ID NO: 643175 - DNA, 25 bp, Mus musculus
gacatgttcgccgatgtggccgaag

SEQ ID NO: 643176 - DNA, 25 bp, Mus musculus
gacatgttcgttcttggagcaacat

SEQ ID NO: 643177 - DNA, 25 bp, Mus musculus
gacatgttcgttgttggagcaacat

SEQ ID NO: 643178 - DNA, 25 bp, Mus musculus
gacatgttcttcagaatttagaaac

SEQ ID NO: 643179 - DNA, 25 bp, Mus musculus
gacatgttcttctgaatttagaaac

SEQ ID NO: 643180 - DNA, 25 bp, Mus musculus
gacatgtttacaccaatgccaagaa

SEQ ID NO: 643181 - DNA, 25 bp, Mus musculus
gacatgtttacagcaatgccaagaa

SEQ ID NO: 643182 - DNA, 25 bp, Mus musculus
gacatgtttcaaccacagtagtgaa

SEQ ID NO: 643183 - DNA, 25 bp, Mus musculus
gacatgtttcaagcacagtagtgaa

SEQ ID NO: 643184 - DNA, 25 bp, Mus musculus
gacatgtttcgaaataatgaagaga

SEQ ID NO: 643185 - DNA, 25 bp, Mus musculus
gacatgtttcgatataatgaagaga

SEQ ID NO: 643186 - DNA, 25 bp, Mus musculus
gacatgtttgtgacgttcgcggcca

SEQ ID NO: 643187 - DNA, 25 bp, Mus musculus
gacatgtttgtgtcgttcgcggcca

SEQ ID NO: 643188 - DNA, 25 bp, Mus musculus
gacatgttttctcggtttgggcgaa

SEQ ID NO: 643189 - DNA, 25 bp, Mus musculus
gacatgttttctgggtttgggcgaa

SEQ ID NO: 643190 - DNA, 25 bp, Mus musculus
gacattaaaaatcggatcggcaatc

SEQ ID NO: 643191 - DNA, 25 bp, Mus musculus
gacattaaaaatgggatcggcaatc

SEQ ID NO: 643192 - DNA, 25 bp, Mus musculus
gacattaacagaactgtcagtgatc

SEQ ID NO: 643193 - DNA, 25 bp, Mus musculus
gacattaacagatctgtcagtgatc

SEQ ID NO: 643194 - DNA, 25 bp, Mus musculus
gacattaagactcctgctaggttga

SEQ ID NO: 643195 - DNA, 25 bp, Mus musculus
gacattaagactgctgctaggttga

SEQ ID NO: 643196 - DNA, 25 bp, Mus musculus
gacattaagcgtatttccactaagg

SEQ ID NO: 643197 - DNA, 25 bp, Mus musculus
gacattaagcgtttttccactaagg

SEQ ID NO: 643198 - DNA, 25 bp, Mus musculus
gacattaaggaccagccagaaaatg

SEQ ID NO: 643199 - DNA, 25 bp, Mus musculus
gacattaaggacgagccagaaaatg

SEQ ID NO: 643200 - DNA, 25 bp, Mus musculus
gacattaattgtaggtatctctgcg

SEQ ID NO: 643201 - DNA, 25 bp, Mus musculus
gacattaattgttggtatctctgcg

SEQ ID NO: 643202 - DNA, 25 bp, Mus musculus
gacattaccctgacttcagaagctt

SEQ ID NO: 643203 - DNA, 25 bp, Mus musculus
gacattaccctgtcttcagaagctt

SEQ ID NO: 643204 - DNA, 25 bp, Mus musculus
gacattacgacgacagtactgacag

SEQ ID NO: 643205 - DNA, 25 bp, Mus musculus
gacattacgacgtcagtactgacag

SEQ ID NO: 643206 - DNA, 25 bp, Mus musculus
gacattacgtgtctcgttctatcac

SEQ ID NO: 643207 - DNA, 25 bp, Mus musculus
gacattacgtgtgtcgttctatcac

SEQ ID NO: 643208 - DNA, 25 bp, Mus musculus
gacattactacaataccaaacctga

SEQ ID NO: 643209 - DNA, 25 bp, Mus musculus
gacattactacattaccaaacctga

SEQ ID NO: 643210 - DNA, 25 bp, Mus musculus
gacattactatgaggccttacctga

SEQ ID NO: 643211 - DNA, 25 bp, Mus musculus
gacattactatgcaaagcttgccaa

SEQ ID NO: 643212 - DNA, 25 bp, Mus musculus
gacattactatggaaagcttgccaa

SEQ ID NO: 643213 - DNA, 25 bp, Mus musculus
gacattactatgtggccttacctga

SEQ ID NO: 643214 - DNA, 25 bp, Mus musculus
gacattactattaagatgacacaaa

SEQ ID NO: 643215 - DNA, 25 bp, Mus musculus
gacattactatttagatgacacaaa

SEQ ID NO: 643216 - DNA, 25 bp, Mus musculus
gacattactgctcaagggacaccaa

SEQ ID NO: 643217 - DNA, 25 bp, Mus musculus
gacattactgctgaagggacaccaa

SEQ ID NO: 643218 - DNA, 25 bp, Mus musculus
gacattagagtcaattgagatagac

SEQ ID NO: 643219 - DNA, 25 bp, Mus musculus
gacattagagtctattgagatagac

SEQ ID NO: 643220 - DNA, 25 bp, Mus musculus
gacattagcagtcgcactgtcctct

SEQ ID NO: 643221 - DNA, 25 bp, Mus musculus
gacattagcagtggcactgtcctct

SEQ ID NO: 643222 - DNA, 25 bp, Mus musculus
gacattaggagtcttcccacagatg

SEQ ID NO: 643223 - DNA, 25 bp, Mus musculus
gacattaggagtgttcccacagatg

SEQ ID NO: 643224 - DNA, 25 bp, Mus musculus
gacattagggtcactgaaacttgga

SEQ ID NO: 643225 - DNA, 25 bp, Mus musculus
gacattagggtctctgaaacttgga

SEQ ID NO: 643226 - DNA, 25 bp, Mus musculus
gacattagtgatctcacattgagaa

SEQ ID NO: 643227 - DNA, 25 bp, Mus musculus
gacattagtgatgtcacattgagaa

SEQ ID NO: 643228 - DNA, 25 bp, Mus musculus
gacattataaatccagctcgagcga

SEQ ID NO: 643229 - DNA, 25 bp, Mus musculus
gacattataaatgcagctcgagcga

SEQ ID NO: 643230 - DNA, 25 bp, Mus musculus
gacattattgaccttgaggacctca

SEQ ID NO: 643231 - DNA, 25 bp, Mus musculus
gacattattgacgttgaggacctca

SEQ ID NO: 643232 - DNA, 25 bp, Mus musculus
gacattcaacgactgtcgggaccca

SEQ ID NO: 643233 - DNA, 25 bp, Mus musculus
gacattcaacgagtgtcgggaccca

SEQ ID NO: 643234 - DNA, 25 bp, Mus musculus
gacattcaacttcctggcatccaca

SEQ ID NO: 643235 - DNA, 25 bp, Mus musculus
gacattcaacttgctggcatccaca

SEQ ID NO: 643236 - DNA, 25 bp, Mus musculus
gacattcacaagatgaaccagtgcc

SEQ ID NO: 643237 - DNA, 25 bp, Mus musculus
gacattcacaagttgaaccagtgcc

SEQ ID NO: 643238 - DNA, 25 bp, Mus musculus
gacattcaccgaacactcatggttg

SEQ ID NO: 643239 - DNA, 25 bp, Mus musculus
gacattcaccgatcactcatggttg

SEQ ID NO: 643240 - DNA, 25 bp, Mus musculus
gacattcagagtacagcacgtgcat

SEQ ID NO: 643241 - DNA, 25 bp, Mus musculus
gacattcagagttcagcacgtgcat

SEQ ID NO: 643242 - DNA, 25 bp, Mus musculus
gacattcaggttcagtatgtccagc

SEQ ID NO: 643243 - DNA, 25 bp, Mus musculus
gacattcaggttgagtatgtccagc

SEQ ID NO: 643244 - DNA, 25 bp, Mus musculus
gacattccacatctctcagccaaga

SEQ ID NO: 643245 - DNA, 25 bp, Mus musculus
gacattccacatgtctcagccaaga

SEQ ID NO: 643246 - DNA, 25 bp, Mus musculus
gacattcccgccaagttcatcacaa

SEQ ID NO: 643247 - DNA, 25 bp, Mus musculus
gacattcccgcctagttcatcacaa

SEQ ID NO: 643248 - DNA, 25 bp, Mus musculus
gacattcctcgcaggcacgagagca

SEQ ID NO: 643249 - DNA, 25 bp, Mus musculus
gacattcctcgctggcacgagagca

SEQ ID NO: 643250 - DNA, 25 bp, Mus musculus
gacattcctctgctggacagggaca

SEQ ID NO: 643251 - DNA, 25 bp, Mus musculus
gacattcctctggtggacagggaca

SEQ ID NO: 643252 - DNA, 25 bp, Mus musculus
gacattcctgaacaggctaatcaga

SEQ ID NO: 643253 - DNA, 25 bp, Mus musculus
gacattcctgaagaggctaatcaga

SEQ ID NO: 643254 - DNA, 25 bp, Mus musculus
gacattcctgcacattttgtgaccc

SEQ ID NO: 643255 - DNA, 25 bp, Mus musculus
gacattcctgcagattttgtgaccc

SEQ ID NO: 643256 - DNA, 25 bp, Mus musculus
gacattcggagccactggacaaacc

SEQ ID NO: 643257 - DNA, 25 bp, Mus musculus
gacattcggagcgactggacaaacc

SEQ ID NO: 643258 - DNA, 25 bp, Mus musculus
gacattcggcaacacagttggaccg

SEQ ID NO: 643259 - DNA, 25 bp, Mus musculus
gacattcggcaagacagttggaccg

SEQ ID NO: 643260 - DNA, 25 bp, Mus musculus
gacattcgggacattgtgcgtcagg

SEQ ID NO: 643261 - DNA, 25 bp, Mus musculus
gacattcgggactttgtgcgtcagg

SEQ ID NO: 643262 - DNA, 25 bp, Mus musculus
gacattcgggcaaagaagattgcca

SEQ ID NO: 643263 - DNA, 25 bp, Mus musculus
gacattcgggcatagaagattgcca

SEQ ID NO: 643264 - DNA, 25 bp, Mus musculus
gacattcggtacagatcttgctgga

SEQ ID NO: 643265 - DNA, 25 bp, Mus musculus
gacattcggtactgatcttgctgga

SEQ ID NO: 643266 - DNA, 25 bp, Mus musculus
gacattctacagacaactgccaggg

SEQ ID NO: 643267 - DNA, 25 bp, Mus musculus
gacattctacagtcaactgccaggg

SEQ ID NO: 643268 - DNA, 25 bp, Mus musculus
gacattctacgaactagtggactgg

SEQ ID NO: 643269 - DNA, 25 bp, Mus musculus
gacattctacgatctagtggactgg

SEQ ID NO: 643270 - DNA, 25 bp, Mus musculus
gacattctatccattcttcgggatc

SEQ ID NO: 643271 - DNA, 25 bp, Mus musculus
gacattctatcctttcttcgggatc

SEQ ID NO: 643272 - DNA, 25 bp, Mus musculus
gacattctcaatcaactcacgtgca

SEQ ID NO: 643273 - DNA, 25 bp, Mus musculus
gacattctcaatgaactcacgtgca

SEQ ID NO: 643274 - DNA, 25 bp, Mus musculus
gacattctcattcgcggcctgaaac

SEQ ID NO: 643275 - DNA, 25 bp, Mus musculus
gacattctcattggcggcctgaaac

SEQ ID NO: 643276 - DNA, 25 bp, Mus musculus
gacattctcctaagtaggcttccct

SEQ ID NO: 643277 - DNA, 25 bp, Mus musculus
gacattctcctatgtaggcttccct

SEQ ID NO: 643278 - DNA, 25 bp, Mus musculus
gacattctgacacagtatgatgcca

SEQ ID NO: 643279 - DNA, 25 bp, Mus musculus
gacattctgacagagtatgatgcca

SEQ ID NO: 643280 - DNA, 25 bp, Mus musculus
gacattctggacaagatcaacagcc

SEQ ID NO: 643281 - DNA, 25 bp, Mus musculus
gacattctggactagatcaacagcc

SEQ ID NO: 643282 - DNA, 25 bp, Mus musculus
gacattctgtttcaggacacagcga

SEQ ID NO: 643283 - DNA, 25 bp, Mus musculus
gacattctgtttgaggacacagcga

SEQ ID NO: 643284 - DNA, 25 bp, Mus musculus
gacattcttacaaacagcgactctc

SEQ ID NO: 643285 - DNA, 25 bp, Mus musculus
gacattcttacatacagcgactctc

SEQ ID NO: 643286 - DNA, 25 bp, Mus musculus
gacattcttggcagagcacgttcac

SEQ ID NO: 643287 - DNA, 25 bp, Mus musculus
gacattcttggctgagcacgttcac

SEQ ID NO: 643288 - DNA, 25 bp, Mus musculus
gacattgaaacaccgcatggtatgg

SEQ ID NO: 643289 - DNA, 25 bp, Mus musculus
gacattgaaacagcgcatggtatgg

SEQ ID NO: 643290 - DNA, 25 bp, Mus musculus
gacattgaaagaatttagcaccaca

SEQ ID NO: 643291 - DNA, 25 bp, Mus musculus
gacattgaaagattttagcaccaca

SEQ ID NO: 643292 - DNA, 25 bp, Mus musculus
gacattgaacagagcattaagtctg

SEQ ID NO: 643293 - DNA, 25 bp, Mus musculus
gacattgaacagtgcattaagtctg

SEQ ID NO: 643294 - DNA, 25 bp, Mus musculus
gacattgaagaaagaggccccagga

SEQ ID NO: 643295 - DNA, 25 bp, Mus musculus
gacattgaagaatgaggccccagga

SEQ ID NO: 643296 - DNA, 25 bp, Mus musculus
gacattgaatatatccgggatgccc

SEQ ID NO: 643297 - DNA, 25 bp, Mus musculus
gacattgaatatctggacttctaca

SEQ ID NO: 643298 - DNA, 25 bp, Mus musculus
gacattgaatatgtggacttctaca

SEQ ID NO: 643299 - DNA, 25 bp, Mus musculus
gacattgaatatttccgggatgccc

SEQ ID NO: 643300 - DNA, 25 bp, Mus musculus
gacattgacaatcacggctttgaag

SEQ ID NO: 643301 - DNA, 25 bp, Mus musculus
gacattgacaatgacggctttgaag

SEQ ID NO: 643302 - DNA, 25 bp, Mus musculus
gacattgacacgctcatgaccaaat

SEQ ID NO: 643303 - DNA, 25 bp, Mus musculus
gacattgacacggtcatgaccaaat

SEQ ID NO: 643304 - DNA, 25 bp, Mus musculus
gacattgacaggcatgggaccatca

SEQ ID NO: 643305 - DNA, 25 bp, Mus musculus
gacattgacagggatgggaccatca

SEQ ID NO: 643306 - DNA, 25 bp, Mus musculus
gacattgacctgacagctccacaaa

SEQ ID NO: 643307 - DNA, 25 bp, Mus musculus
gacattgacctgtcagctccacaaa

SEQ ID NO: 643308 - DNA, 25 bp, Mus musculus
gacattgactacaacctgggccaga

SEQ ID NO: 643309 - DNA, 25 bp, Mus musculus
gacattgactactacctgggccaga

SEQ ID NO: 643310 - DNA, 25 bp, Mus musculus
gacattgagactcatgttctctaca

SEQ ID NO: 643311 - DNA, 25 bp, Mus musculus
gacattgagactgatgttctctaca

SEQ ID NO: 643312 - DNA, 25 bp, Mus musculus
gacattgagcaacagcagataacag

SEQ ID NO: 643313 - DNA, 25 bp, Mus musculus
gacattgagcaagagcagataacag

SEQ ID NO: 643314 - DNA, 25 bp, Mus musculus
gacattgagtctcaccttgaccgag

SEQ ID NO: 643315 - DNA, 25 bp, Mus musculus
gacattgagtctgaccttgaccgag

SEQ ID NO: 643316 - DNA, 25 bp, Mus musculus
gacattgatatgatctgccgtgccc

SEQ ID NO: 643317 - DNA, 25 bp, Mus musculus
gacattgatatgttctgccgtgccc

SEQ ID NO: 643318 - DNA, 25 bp, Mus musculus
gacattgatccaagggtagtcactg

SEQ ID NO: 643319 - DNA, 25 bp, Mus musculus
gacattgatccatgggtagtcactg

SEQ ID NO: 643320 - DNA, 25 bp, Mus musculus
gacattgatgctcatgtgctgcaga

SEQ ID NO: 643321 - DNA, 25 bp, Mus musculus
gacattgatgctgatgtgctgcaga

SEQ ID NO: 643322 - DNA, 25 bp, Mus musculus
gacattgcactgacagctgggatct

SEQ ID NO: 643323 - DNA, 25 bp, Mus musculus
gacattgcactgtcagctgggatct

SEQ ID NO: 643324 - DNA, 25 bp, Mus musculus
gacattgccaacaaactggcaggag

SEQ ID NO: 643325 - DNA, 25 bp, Mus musculus
gacattgccaactaactggcaggag

SEQ ID NO: 643326 - DNA, 25 bp, Mus musculus
gacattgccatacagctggctggga

SEQ ID NO: 643327 - DNA, 25 bp, Mus musculus
gacattgccatagagctggctggga

SEQ ID NO: 643328 - DNA, 25 bp, Mus musculus
gacattgccatcattatcagcgcag

SEQ ID NO: 643329 - DNA, 25 bp, Mus musculus
gacattgccatctttatcagcgcag

SEQ ID NO: 643330 - DNA, 25 bp, Mus musculus
gacattgccgccaagtacaaggagc

SEQ ID NO: 643331 - DNA, 25 bp, Mus musculus
gacattgccgcctagtacaaggagc

SEQ ID NO: 643332 - DNA, 25 bp, Mus musculus
gacattgcgagtcatgaaccacgga

SEQ ID NO: 643333 - DNA, 25 bp, Mus musculus
gacattgcgagtgatgaaccacgga

SEQ ID NO: 643334 - DNA, 25 bp, Mus musculus
gacattgcggctcgctggtacccag

SEQ ID NO: 643335 - DNA, 25 bp, Mus musculus
gacattgcggctggctggtacccag

SEQ ID NO: 643336 - DNA, 25 bp, Mus musculus
gacattgctcggattctctaattaa

SEQ ID NO: 643337 - DNA, 25 bp, Mus musculus
gacattgctcggtttctctaattaa

SEQ ID NO: 643338 - DNA, 25 bp, Mus musculus
gacattgctgcgagggcctatggct

SEQ ID NO: 643339 - DNA, 25 bp, Mus musculus
gacattgctgcgtgggcctatggct

SEQ ID NO: 643340 - DNA, 25 bp, Mus musculus
gacattgcttcacgatcctgactta

SEQ ID NO: 643341 - DNA, 25 bp, Mus musculus
gacattgcttcaggatcctgactta

SEQ ID NO: 643342 - DNA, 25 bp, Mus musculus
gacattgctttcattgatgccaaaa

SEQ ID NO: 643343 - DNA, 25 bp, Mus musculus
gacattgctttctttgatgccaaaa

SEQ ID NO: 643344 - DNA, 25 bp, Mus musculus
gacattggaacaaccttggttcaaa

SEQ ID NO: 643345 - DNA, 25 bp, Mus musculus
gacattggaacatccttggttcaaa

SEQ ID NO: 643346 - DNA, 25 bp, Mus musculus
gacattggacaaagcaagctagagg

SEQ ID NO: 643347 - DNA, 25 bp, Mus musculus
gacattggacaatgcaagctagagg

SEQ ID NO: 643348 - DNA, 25 bp, Mus musculus
gacattggatcgaacacagtgaggg

SEQ ID NO: 643349 - DNA, 25 bp, Mus musculus
gacattggatcgtacacagtgaggg

SEQ ID NO: 643350 - DNA, 25 bp, Mus musculus
gacattggcaatcctgaccagttag

SEQ ID NO: 643351 - DNA, 25 bp, Mus musculus
gacattggcaatgctgaccagttag

SEQ ID NO: 643352 - DNA, 25 bp, Mus musculus
gacattggctcaattgccccagaag

SEQ ID NO: 643353 - DNA, 25 bp, Mus musculus
gacattggctcatttgccccagaag

SEQ ID NO: 643354 - DNA, 25 bp, Mus musculus
gacattgggaagcacacctacgaca

SEQ ID NO: 643355 - DNA, 25 bp, Mus musculus
gacattgggaaggacacctacgaca

SEQ ID NO: 643356 - DNA, 25 bp, Mus musculus
gacattgggatgagaatgagttgtt

SEQ ID NO: 643357 - DNA, 25 bp, Mus musculus
gacattgggatgtgaatgagttgtt

SEQ ID NO: 643358 - DNA, 25 bp, Mus musculus
gacattggtcccatgagatcaccgg

SEQ ID NO: 643359 - DNA, 25 bp, Mus musculus
gacattggtcccttgagatcaccgg

SEQ ID NO: 643360 - DNA, 25 bp, Mus musculus
gacattggtcgcagtctcctgactt

SEQ ID NO: 643361 - DNA, 25 bp, Mus musculus
gacattggtcgctgtctcctgactt

SEQ ID NO: 643362 - DNA, 25 bp, Mus musculus
gacattggttctccaagagttcccc

SEQ ID NO: 643363 - DNA, 25 bp, Mus musculus
gacattggttctgcaagagttcccc

SEQ ID NO: 643364 - DNA, 25 bp, Mus musculus
gacattgtcaccatgtaacggttaa

SEQ ID NO: 643365 - DNA, 25 bp, Mus musculus
gacattgtcaccttgtaacggttaa

SEQ ID NO: 643366 - DNA, 25 bp, Mus musculus
gacattgtcatcaatgttattgaca

SEQ ID NO: 643367 - DNA, 25 bp, Mus musculus
gacattgtcatctatgttattgaca

SEQ ID NO: 643368 - DNA, 25 bp, Mus musculus
gacattgtcccacaaaagataaaag

SEQ ID NO: 643369 - DNA, 25 bp, Mus musculus
gacattgtcccagaaaagataaaag

SEQ ID NO: 643370 - DNA, 25 bp, Mus musculus
gacattgtcctgagtggacacttca

SEQ ID NO: 643371 - DNA, 25 bp, Mus musculus
gacattgtcctgtgtggacacttca

SEQ ID NO: 643372 - DNA, 25 bp, Mus musculus
gacattgtgaatcagtactctggaa

SEQ ID NO: 643373 - DNA, 25 bp, Mus musculus
gacattgtgaatgagtactctggaa

SEQ ID NO: 643374 - DNA, 25 bp, Mus musculus
gacattgtgacactgtttacctctc

SEQ ID NO: 643375 - DNA, 25 bp, Mus musculus
gacattgtgacagtgtttacctctc

SEQ ID NO: 643376 - DNA, 25 bp, Mus musculus
gacattgtgattcagcaggacgatg

SEQ ID NO: 643377 - DNA, 25 bp, Mus musculus
gacattgtgattgagcaggacgatg

SEQ ID NO: 643378 - DNA, 25 bp, Mus musculus
gacattgtgcaccaggtcgccatct

SEQ ID NO: 643379 - DNA, 25 bp, Mus musculus
gacattgtgcacgaggtcgccatct

SEQ ID NO: 643380 - DNA, 25 bp, Mus musculus
gacattgttggtcgtgtgcccatca

SEQ ID NO: 643381 - DNA, 25 bp, Mus musculus
gacattgttggtggtgtgcccatca

SEQ ID NO: 643382 - DNA, 25 bp, Mus musculus
gacattgtttgactggcctgacaaa

SEQ ID NO: 643383 - DNA, 25 bp, Mus musculus
gacattgtttgagtggcctgacaaa

SEQ ID NO: 643384 - DNA, 25 bp, Mus musculus
gacatttaagctcgactacagccgg

SEQ ID NO: 643385 - DNA, 25 bp, Mus musculus
gacatttaagctggactacagccgg

SEQ ID NO: 643386 - DNA, 25 bp, Mus musculus
gacatttaaggacttgggttcctcg

SEQ ID NO: 643387 - DNA, 25 bp, Mus musculus
gacatttaaggagttgggttcctcg

SEQ ID NO: 643388 - DNA, 25 bp, Mus musculus
gacatttacccactttacaggctgg

SEQ ID NO: 643389 - DNA, 25 bp, Mus musculus
gacatttacccagtttacaggctgg

SEQ ID NO: 643390 - DNA, 25 bp, Mus musculus
gacatttaccgactatctaatatga

SEQ ID NO: 643391 - DNA, 25 bp, Mus musculus
gacatttaccgagtatctaatatga

SEQ ID NO: 643392 - DNA, 25 bp, Mus musculus
gacatttactaaaacatctcaaaag

SEQ ID NO: 643393 - DNA, 25 bp, Mus musculus
gacatttactaatacatctcaaaag

SEQ ID NO: 643394 - DNA, 25 bp, Mus musculus
gacatttaggcgcttccccgaaagg

SEQ ID NO: 643395 - DNA, 25 bp, Mus musculus
gacatttaggcggttccccgaaagg

SEQ ID NO: 643396 - DNA, 25 bp, Mus musculus
gacatttagtgaacgctcttcaagc

SEQ ID NO: 643397 - DNA, 25 bp, Mus musculus
gacatttagtgatcgctcttcaagc

SEQ ID NO: 643398 - DNA, 25 bp, Mus musculus
gacatttcaactcctcctacagctg

SEQ ID NO: 643399 - DNA, 25 bp, Mus musculus
gacatttcaactgctcctacagctg

SEQ ID NO: 643400 - DNA, 25 bp, Mus musculus
gacatttcaggccagagcttgagga

SEQ ID NO: 643401 - DNA, 25 bp, Mus musculus
gacatttcaggcgagagcttgagga

SEQ ID NO: 643402 - DNA, 25 bp, Mus musculus
gacatttcagggactagggcactca

SEQ ID NO: 643403 - DNA, 25 bp, Mus musculus
gacatttcagggtctagggcactca

SEQ ID NO: 643404 - DNA, 25 bp, Mus musculus
gacatttcaggtctcactggccctg

SEQ ID NO: 643405 - DNA, 25 bp, Mus musculus
gacatttcaggtgtcactggccctg

SEQ ID NO: 643406 - DNA, 25 bp, Mus musculus
gacatttcccgcagttaagatggag

SEQ ID NO: 643407 - DNA, 25 bp, Mus musculus
gacatttcccgctgttaagatggag

SEQ ID NO: 643408 - DNA, 25 bp, Mus musculus
gacatttccctgattgtggctgcta

SEQ ID NO: 643409 - DNA, 25 bp, Mus musculus
gacatttccctgtttgtggctgcta

SEQ ID NO: 643410 - DNA, 25 bp, Mus musculus
gacatttcgccaagggaaacaactg

SEQ ID NO: 643411 - DNA, 25 bp, Mus musculus
gacatttcgccatgggaaacaactg

SEQ ID NO: 643412 - DNA, 25 bp, Mus musculus
gacatttctcatcctgatcatttgg

SEQ ID NO: 643413 - DNA, 25 bp, Mus musculus
gacatttctcatgctgatcatttgg

SEQ ID NO: 643414 - DNA, 25 bp, Mus musculus
gacatttctgtcacgaggttttctg

SEQ ID NO: 643415 - DNA, 25 bp, Mus musculus
gacatttctgtctcgaggttttctg

SEQ ID NO: 643416 - DNA, 25 bp, Mus musculus
gacatttcttgaccctggctgactc

SEQ ID NO: 643417 - DNA, 25 bp, Mus musculus
gacatttcttgagcctggctgactc

SEQ ID NO: 643418 - DNA, 25 bp, Mus musculus
gacatttcttggcagcaaccctacc

SEQ ID NO: 643419 - DNA, 25 bp, Mus musculus
gacatttcttgggagcaaccctacc

SEQ ID NO: 643420 - DNA, 25 bp, Mus musculus
gacatttgaaacagaaatcagaggg

SEQ ID NO: 643421 - DNA, 25 bp, Mus musculus
gacatttgaaactgaaatcagaggg

SEQ ID NO: 643422 - DNA, 25 bp, Mus musculus
gacatttgacatcagcactggagac

SEQ ID NO: 643423 - DNA, 25 bp, Mus musculus
gacatttgacatgagcactggagac

SEQ ID NO: 643424 - DNA, 25 bp, Mus musculus
gacatttgggctctcagcttcgggc

SEQ ID NO: 643425 - DNA, 25 bp, Mus musculus
gacatttgggctgtcagcttcgggc

SEQ ID NO: 643426 - DNA, 25 bp, Mus musculus
gacatttggttcaccagtcattggc

SEQ ID NO: 643427 - DNA, 25 bp, Mus musculus
gacatttggttctccagtcattggc

SEQ ID NO: 643428 - DNA, 25 bp, Mus musculus
gacatttgtgctcacaatggagtat

SEQ ID NO: 643429 - DNA, 25 bp, Mus musculus
gacatttgtgctgacaatggagtat

SEQ ID NO: 643430 - DNA, 25 bp, Mus musculus
gacatttgtttcatgcgaccaaaga

SEQ ID NO: 643431 - DNA, 25 bp, Mus musculus
gacatttgtttcttgcgaccaaaga

SEQ ID NO: 643432 - DNA, 25 bp, Mus musculus
gacattttaagtctaaaggatatga

SEQ ID NO: 643433 - DNA, 25 bp, Mus musculus
gacattttaagtgtaaaggatatga

SEQ ID NO: 643434 - DNA, 25 bp, Mus musculus
gacattttaggacgagaagcaaggc

SEQ ID NO: 643435 - DNA, 25 bp, Mus musculus
gacattttaggaggagaagcaaggc

SEQ ID NO: 643436 - DNA, 25 bp, Mus musculus
gacattttgcaaaagggaatgcatc

SEQ ID NO: 643437 - DNA, 25 bp, Mus musculus
gacattttgcaatagggaatgcatc

SEQ ID NO: 643438 - DNA, 25 bp, Mus musculus
gacatttttgagcatctgcccggag

SEQ ID NO: 643439 - DNA, 25 bp, Mus musculus
gacatttttgaggatctgcccggag

SEQ ID NO: 643440 - DNA, 25 bp, Mus musculus
gaccaaaaacgaagaccctggctca

SEQ ID NO: 643441 - DNA, 25 bp, Mus musculus
gaccaaaaacgatgaccctggctca

SEQ ID NO: 643442 - DNA, 25 bp, Mus musculus
gaccaaaacagacatcttaaacaag

SEQ ID NO: 643443 - DNA, 25 bp, Mus musculus
gaccaaaacagagatcttaaacaag

SEQ ID NO: 643444 - DNA, 25 bp, Mus musculus
gaccaaaagcgaaaactcatccggg

SEQ ID NO: 643445 - DNA, 25 bp, Mus musculus
gaccaaaagcgataactcatccggg

SEQ ID NO: 643446 - DNA, 25 bp, Mus musculus
gaccaaaattacaggaagacccatc

SEQ ID NO: 643447 - DNA, 25 bp, Mus musculus
gaccaaaattactggaagacccatc

SEQ ID NO: 643448 - DNA, 25 bp, Mus musculus
gaccaaaattcgaacaagtgaacct

SEQ ID NO: 643449 - DNA, 25 bp, Mus musculus
gaccaaaattcgtacaagtgaacct

SEQ ID NO: 643450 - DNA, 25 bp, Mus musculus
gaccaaacccatctagaagattgaa

SEQ ID NO: 643451 - DNA, 25 bp, Mus musculus
gaccaaacccatgtagaagattgaa

SEQ ID NO: 643452 - DNA, 25 bp, Mus musculus
gaccaaaccgttctatcaggcatta

SEQ ID NO: 643453 - DNA, 25 bp, Mus musculus
gaccaaaccgttgtatcaggcatta

SEQ ID NO: 643454 - DNA, 25 bp, Mus musculus
gaccaaacctgacaaggctgtatcc

SEQ ID NO: 643455 - DNA, 25 bp, Mus musculus
gaccaaacctgagaaggctgtatcc

SEQ ID NO: 643456 - DNA, 25 bp, Mus musculus
gaccaaactcatcatctccagcaat

SEQ ID NO: 643457 - DNA, 25 bp, Mus musculus
gaccaaactcatgatctccagcaat

SEQ ID NO: 643458 - DNA, 25 bp, Mus musculus
gaccaaacttatctactgctcacgg

SEQ ID NO: 643459 - DNA, 25 bp, Mus musculus
gaccaaacttatgtactgctcacgg

SEQ ID NO: 643460 - DNA, 25 bp, Mus musculus
gaccaaagaacccttagtgcaggtt

SEQ ID NO: 643461 - DNA, 25 bp, Mus musculus
gaccaaagaaccgttagtgcaggtt

SEQ ID NO: 643462 - DNA, 25 bp, Mus musculus
gaccaaagacggacaggccttgcag

SEQ ID NO: 643463 - DNA, 25 bp, Mus musculus
gaccaaagacggtcaggccttgcag

SEQ ID NO: 643464 - DNA, 25 bp, Mus musculus
gaccaaagagtgagttcactgtcct

SEQ ID NO: 643465 - DNA, 25 bp, Mus musculus
gaccaaagagtgtgttcactgtcct

SEQ ID NO: 643466 - DNA, 25 bp, Mus musculus
gaccaaagatcactgagcaacgaca

SEQ ID NO: 643467 - DNA, 25 bp, Mus musculus
gaccaaagatcagtgagcaacgaca

SEQ ID NO: 643468 - DNA, 25 bp, Mus musculus
gaccaaagatgcactcaatttccag

SEQ ID NO: 643469 - DNA, 25 bp, Mus musculus
gaccaaagatgctctcaatttccag

SEQ ID NO: 643470 - DNA, 25 bp, Mus musculus
gaccaaagatggcagaacaccaagc

SEQ ID NO: 643471 - DNA, 25 bp, Mus musculus
gaccaaagatgggagaacaccaagc

SEQ ID NO: 643472 - DNA, 25 bp, Mus musculus
gaccaaagcctaatgctaaccatgg

SEQ ID NO: 643473 - DNA, 25 bp, Mus musculus
gaccaaagcctattgctaaccatgg

SEQ ID NO: 643474 - DNA, 25 bp, Mus musculus
gaccaaagccttagctgagtcaccc

SEQ ID NO: 643475 - DNA, 25 bp, Mus musculus
gaccaaagcctttgctgagtcaccc

SEQ ID NO: 643476 - DNA, 25 bp, Mus musculus
gaccaaagcttcactttaagtagtt

SEQ ID NO: 643477 - DNA, 25 bp, Mus musculus
gaccaaagcttctctttaagtagtt

SEQ ID NO: 643478 - DNA, 25 bp, Mus musculus
gaccaaaggagacggaaactgcttc

SEQ ID NO: 643479 - DNA, 25 bp, Mus musculus
gaccaaaggagagggaaactgcttc

SEQ ID NO: 643480 - DNA, 25 bp, Mus musculus
gaccaaagtgacactggagaatttt

SEQ ID NO: 643481 - DNA, 25 bp, Mus musculus
gaccaaagtgactctggagaatttt

SEQ ID NO: 643482 - DNA, 25 bp, Mus musculus
gaccaaagtgggatggagattcctg

SEQ ID NO: 643483 - DNA, 25 bp, Mus musculus
gaccaaagtgggttggagattcctg

SEQ ID NO: 643484 - DNA, 25 bp, Mus musculus
gaccaaatctacactgagttccgtg

SEQ ID NO: 643485 - DNA, 25 bp, Mus musculus
gaccaaatctactctgagttccgtg

SEQ ID NO: 643486 - DNA, 25 bp, Mus musculus
gaccaaattcatctcgcgctatggg

SEQ ID NO: 643487 - DNA, 25 bp, Mus musculus
gaccaaattcatgtcgcgctatggg

SEQ ID NO: 643488 - DNA, 25 bp, Mus musculus
gaccaacaacttctaagagacagct

SEQ ID NO: 643489 - DNA, 25 bp, Mus musculus
gaccaacaacttgtaagagacagct

SEQ ID NO: 643490 - DNA, 25 bp, Mus musculus
gaccaacaaggcatgtgtccccagg

SEQ ID NO: 643491 - DNA, 25 bp, Mus musculus
gaccaacaaggcttgtgtccccagg

SEQ ID NO: 643492 - DNA, 25 bp, Mus musculus
gaccaacaatgacagccagtcagca

SEQ ID NO: 643493 - DNA, 25 bp, Mus musculus
gaccaacaatgagagccagtcagca

SEQ ID NO: 643494 - DNA, 25 bp, Mus musculus
gaccaacacctaagatgtgaagagg

SEQ ID NO: 643495 - DNA, 25 bp, Mus musculus
gaccaacacctatgatgtgaagagg

SEQ ID NO: 643496 - DNA, 25 bp, Mus musculus
gaccaacatgtaagcagaactaggg

SEQ ID NO: 643497 - DNA, 25 bp, Mus musculus
gaccaacatgtatgcagaactaggg

SEQ ID NO: 643498 - DNA, 25 bp, Mus musculus
gaccaaccaccccagtttcagagat

SEQ ID NO: 643499 - DNA, 25 bp, Mus musculus
gaccaaccacccgagtttcagagat

SEQ ID NO: 643500 - DNA, 25 bp, Mus musculus
gaccaaccccgaaacagtgatacat

SEQ ID NO: 643501 - DNA, 25 bp, Mus musculus
gaccaaccccgatacagtgatacat

SEQ ID NO: 643502 - DNA, 25 bp, Mus musculus
gaccaacctgcgacttcagaccttg

SEQ ID NO: 643503 - DNA, 25 bp, Mus musculus
gaccaacctgcgtcttcagaccttg

SEQ ID NO: 643504 - DNA, 25 bp, Mus musculus
gaccaacctgtacaagaccctgatc

SEQ ID NO: 643505 - DNA, 25 bp, Mus musculus
gaccaacctgtactggcccggtaca

SEQ ID NO: 643506 - DNA, 25 bp, Mus musculus
gaccaacctgtagaagaccctgatc

SEQ ID NO: 643507 - DNA, 25 bp, Mus musculus
gaccaacctgtagtggcccggtaca

SEQ ID NO: 643508 - DNA, 25 bp, Mus musculus
gaccaacgagtgattggacaacaat

SEQ ID NO: 643509 - DNA, 25 bp, Mus musculus
gaccaacgagtgtttggacaacaat

SEQ ID NO: 643510 - DNA, 25 bp, Mus musculus
gaccaacgcgacaagaaatcaggct

SEQ ID NO: 643511 - DNA, 25 bp, Mus musculus
gaccaacgcgactagaaatcaggct

SEQ ID NO: 643512 - DNA, 25 bp, Mus musculus
gaccaacggtctaaaaagcatctgc

SEQ ID NO: 643513 - DNA, 25 bp, Mus musculus
gaccaacggtcttaaaagcatctgc

SEQ ID NO: 643514 - DNA, 25 bp, Mus musculus
gaccaactacctcttcatgggagac

SEQ ID NO: 643515 - DNA, 25 bp, Mus musculus
gaccaactacctgttcatgggagac

SEQ ID NO: 643516 - DNA, 25 bp, Mus musculus
gaccaactccccaaccgtgattgtg

SEQ ID NO: 643517 - DNA, 25 bp, Mus musculus
gaccaactcccctaccgtgattgtg

SEQ ID NO: 643518 - DNA, 25 bp, Mus musculus
gaccaactctaacttgcctgaggaa

SEQ ID NO: 643519 - DNA, 25 bp, Mus musculus
gaccaactctaagttgcctgaggaa

SEQ ID NO: 643520 - DNA, 25 bp, Mus musculus
gaccaactgcagaaatacattaggg

SEQ ID NO: 643521 - DNA, 25 bp, Mus musculus
gaccaactgcagtaatacattaggg

SEQ ID NO: 643522 - DNA, 25 bp, Mus musculus
gaccaactggaccaggaaaatgatg

SEQ ID NO: 643523 - DNA, 25 bp, Mus musculus
gaccaactggacgaggaaaatgatg

SEQ ID NO: 643524 - DNA, 25 bp, Mus musculus
gaccaactgtagcagactgcatgac

SEQ ID NO: 643525 - DNA, 25 bp, Mus musculus
gaccaactgtaggagactgcatgac

SEQ ID NO: 643526 - DNA, 25 bp, Mus musculus
gaccaactgtgtctttacccgctag

SEQ ID NO: 643527 - DNA, 25 bp, Mus musculus
gaccaactgtgtgtttacccgctag

SEQ ID NO: 643528 - DNA, 25 bp, Mus musculus
gaccaacttagcctcgcatatctct

SEQ ID NO: 643529 - DNA, 25 bp, Mus musculus
gaccaacttagcgtcgcatatctct

SEQ ID NO: 643530 - DNA, 25 bp, Mus musculus
gaccaacttgtgatgatatttgctg

SEQ ID NO: 643531 - DNA, 25 bp, Mus musculus
gaccaacttgtgttgatatttgctg

SEQ ID NO: 643532 - DNA, 25 bp, Mus musculus
gaccaagaagccagcaatctcgtgg

SEQ ID NO: 643533 - DNA, 25 bp, Mus musculus
gaccaagaagcctgcaatctcgtgg

SEQ ID NO: 643534 - DNA, 25 bp, Mus musculus
gaccaagaagttcgaactctatatg

SEQ ID NO: 643535 - DNA, 25 bp, Mus musculus
gaccaagaagttggaactctatatg

SEQ ID NO: 643536 - DNA, 25 bp, Mus musculus
gaccaagaattgatgagatgactcc

SEQ ID NO: 643537 - DNA, 25 bp, Mus musculus
gaccaagaattgttgagatgactcc

SEQ ID NO: 643538 - DNA, 25 bp, Mus musculus
gaccaagacccacatccaggagtgc

SEQ ID NO: 643539 - DNA, 25 bp, Mus musculus
gaccaagacccagatccaggagtgc

SEQ ID NO: 643540 - DNA, 25 bp, Mus musculus
gaccaagaccttcgcatggacaatt

SEQ ID NO: 643541 - DNA, 25 bp, Mus musculus
gaccaagaccttggcatggacaatt

SEQ ID NO: 643542 - DNA, 25 bp, Mus musculus
gaccaagagagaagacttagtatga

SEQ ID NO: 643543 - DNA, 25 bp, Mus musculus
gaccaagagagatgacttagtatga

SEQ ID NO: 643544 - DNA, 25 bp, Mus musculus
gaccaagagcccaatggaaagggat

SEQ ID NO: 643545 - DNA, 25 bp, Mus musculus
gaccaagagccctatggaaagggat

SEQ ID NO: 643546 - DNA, 25 bp, Mus musculus
gaccaagaggcacaatgccggcgct

SEQ ID NO: 643547 - DNA, 25 bp, Mus musculus
gaccaagaggcagaatgccggcgct

SEQ ID NO: 643548 - DNA, 25 bp, Mus musculus
gaccaagagggactgtgtatatatt

SEQ ID NO: 643549 - DNA, 25 bp, Mus musculus
gaccaagagggagtgtgtatatatt

SEQ ID NO: 643550 - DNA, 25 bp, Mus musculus
gaccaagaggtacccaagccagaat

SEQ ID NO: 643551 - DNA, 25 bp, Mus musculus
gaccaagaggtagccaagccagaat

SEQ ID NO: 643552 - DNA, 25 bp, Mus musculus
gaccaagataatcgcgccagtatat

SEQ ID NO: 643553 - DNA, 25 bp, Mus musculus
gaccaagataatggcgccagtatat

SEQ ID NO: 643554 - DNA, 25 bp, Mus musculus
gaccaagatacgatgtaggttgtcg

SEQ ID NO: 643555 - DNA, 25 bp, Mus musculus
gaccaagatacgttgtaggttgtcg

SEQ ID NO: 643556 - DNA, 25 bp, Mus musculus
gaccaagatagtaaagaagccagaa

SEQ ID NO: 643557 - DNA, 25 bp, Mus musculus
gaccaagatagttaagaagccagaa

SEQ ID NO: 643558 - DNA, 25 bp, Mus musculus
gaccaagatcttccatgggctgctg

SEQ ID NO: 643559 - DNA, 25 bp, Mus musculus
gaccaagatcttgcatgggctgctg

SEQ ID NO: 643560 - DNA, 25 bp, Mus musculus
gaccaagatgagcacgccaccctta

SEQ ID NO: 643561 - DNA, 25 bp, Mus musculus
gaccaagatgaggacgccaccctta

SEQ ID NO: 643562 - DNA, 25 bp, Mus musculus
gaccaagattccagttattgaaaac

SEQ ID NO: 643563 - DNA, 25 bp, Mus musculus
gaccaagattcctgttattgaaaac

SEQ ID NO: 643564 - DNA, 25 bp, Mus musculus
gaccaagatttcaatgtctcgccga

SEQ ID NO: 643565 - DNA, 25 bp, Mus musculus
gaccaagatttctatgtctcgccga

SEQ ID NO: 643566 - DNA, 25 bp, Mus musculus
gaccaagcagctccttcactgtatg

SEQ ID NO: 643567 - DNA, 25 bp, Mus musculus
gaccaagcagctgcttcactgtatg

SEQ ID NO: 643568 - DNA, 25 bp, Mus musculus
gaccaagcagtacgatttggccttg

SEQ ID NO: 643569 - DNA, 25 bp, Mus musculus
gaccaagcagtaggatttggccttg

SEQ ID NO: 643570 - DNA, 25 bp, Mus musculus
gaccaagccatactgagctggactt

SEQ ID NO: 643571 - DNA, 25 bp, Mus musculus
gaccaagccatagtgagctggactt

SEQ ID NO: 643572 - DNA, 25 bp, Mus musculus
gaccaagcgcagctattaggacccc

SEQ ID NO: 643573 - DNA, 25 bp, Mus musculus
gaccaagcgcaggtattaggacccc

SEQ ID NO: 643574 - DNA, 25 bp, Mus musculus
gaccaagctcgcacgactagcagtg

SEQ ID NO: 643575 - DNA, 25 bp, Mus musculus
gaccaagctcgctcgactagcagtg

SEQ ID NO: 643576 - DNA, 25 bp, Mus musculus
gaccaaggaagccatgcttcagaag

SEQ ID NO: 643577 - DNA, 25 bp, Mus musculus
gaccaaggaagcgatgcttcagaag

SEQ ID NO: 643578 - DNA, 25 bp, Mus musculus
gaccaaggagagctggcaagcaccc

SEQ ID NO: 643579 - DNA, 25 bp, Mus musculus
gaccaaggagaggtggcaagcaccc

SEQ ID NO: 643580 - DNA, 25 bp, Mus musculus
gaccaaggcagcagctcgggccaag

SEQ ID NO: 643581 - DNA, 25 bp, Mus musculus
gaccaaggcagctgctcgggccaag

SEQ ID NO: 643582 - DNA, 25 bp, Mus musculus
gaccaaggcagtcaacagcctcttt

SEQ ID NO: 643583 - DNA, 25 bp, Mus musculus
gaccaaggcagtgaacagcctcttt

SEQ ID NO: 643584 - DNA, 25 bp, Mus musculus
gaccaagggcttaaccacggcagtc

SEQ ID NO: 643585 - DNA, 25 bp, Mus musculus
gaccaagggctttaccacggcagtc

SEQ ID NO: 643586 - DNA, 25 bp, Mus musculus
gaccaaggtgacaggactcagcaac

SEQ ID NO: 643587 - DNA, 25 bp, Mus musculus
gaccaaggtgactggactcagcaac

SEQ ID NO: 643588 - DNA, 25 bp, Mus musculus
gaccaaggttgtacagattcgctga

SEQ ID NO: 643589 - DNA, 25 bp, Mus musculus
gaccaaggttgttcagattcgctga

SEQ ID NO: 643590 - DNA, 25 bp, Mus musculus
gaccaagtatgaaatggcgtgtgca

SEQ ID NO: 643591 - DNA, 25 bp, Mus musculus
gaccaagtatgatatggcgtgtgca

SEQ ID NO: 643592 - DNA, 25 bp, Mus musculus
gaccaagtccttcatcgaatacatc

SEQ ID NO: 643593 - DNA, 25 bp, Mus musculus
gaccaagtccttgatcgaatacatc

SEQ ID NO: 643594 - DNA, 25 bp, Mus musculus
gaccaagtggaaatccaatgatttt

SEQ ID NO: 643595 - DNA, 25 bp, Mus musculus
gaccaagtggaattccaatgatttt

SEQ ID NO: 643596 - DNA, 25 bp, Mus musculus
gaccaagtggctcctctgcattggg

SEQ ID NO: 643597 - DNA, 25 bp, Mus musculus
gaccaagtggctgctctgcattggg

SEQ ID NO: 643598 - DNA, 25 bp, Mus musculus
gaccaagtgtggcttgtccacgact

SEQ ID NO: 643599 - DNA, 25 bp, Mus musculus
gaccaagtgtgggttgtccacgact

SEQ ID NO: 643600 - DNA, 25 bp, Mus musculus
gaccaagttatccatagcaaccctg

SEQ ID NO: 643601 - DNA, 25 bp, Mus musculus
gaccaagttatcgatagcaaccctg

SEQ ID NO: 643602 - DNA, 25 bp, Mus musculus
gaccaagtttaaagagaccatcgag

SEQ ID NO: 643603 - DNA, 25 bp, Mus musculus
gaccaagtttaatgagaccatcgag

SEQ ID NO: 643604 - DNA, 25 bp, Mus musculus
gaccaataccacattcctgctcatg

SEQ ID NO: 643605 - DNA, 25 bp, Mus musculus
gaccaataccactttcctgctcatg

SEQ ID NO: 643606 - DNA, 25 bp, Mus musculus
gaccaatagaccagatttgatagac

SEQ ID NO: 643607 - DNA, 25 bp, Mus musculus
gaccaatagacctgatttgatagac

SEQ ID NO: 643608 - DNA, 25 bp, Mus musculus
gaccaatagggcatccgcaggatct

SEQ ID NO: 643609 - DNA, 25 bp, Mus musculus
gaccaatagggcttccgcaggatct

SEQ ID NO: 643610 - DNA, 25 bp, Mus musculus
gaccaatcagatcggtggagcatgt

SEQ ID NO: 643611 - DNA, 25 bp, Mus musculus
gaccaatcagatgggtggagcatgt

SEQ ID NO: 643612 - DNA, 25 bp, Mus musculus
gaccaatctcctcttgttaaatcaa

SEQ ID NO: 643613 - DNA, 25 bp, Mus musculus
gaccaatctcctgttgttaaatcaa

SEQ ID NO: 643614 - DNA, 25 bp, Mus musculus
gaccaatgacacaggattcctctcc

SEQ ID NO: 643615 - DNA, 25 bp, Mus musculus
gaccaatgacactggattcctctcc

SEQ ID NO: 643616 - DNA, 25 bp, Mus musculus
gaccaatgaccacgttgacccttcg

SEQ ID NO: 643617 - DNA, 25 bp, Mus musculus
gaccaatgaccaggttgacccttcg

SEQ ID NO: 643618 - DNA, 25 bp, Mus musculus
gaccaatgatggaggcctggcagct

SEQ ID NO: 643619 - DNA, 25 bp, Mus musculus
gaccaatgatggtggcctggcagct

SEQ ID NO: 643620 - DNA, 25 bp, Mus musculus
gaccaatgccatatctgagatcaag

SEQ ID NO: 643621 - DNA, 25 bp, Mus musculus
gaccaatgccatttctgagatcaag

SEQ ID NO: 643622 - DNA, 25 bp, Mus musculus
gaccaatgcgcaagagttaccgcgg

SEQ ID NO: 643623 - DNA, 25 bp, Mus musculus
gaccaatgcgcatgagttaccgcgg

SEQ ID NO: 643624 - DNA, 25 bp, Mus musculus
gaccaatggcaaacaccggaggtgt

SEQ ID NO: 643625 - DNA, 25 bp, Mus musculus
gaccaatggcaatcaccggaggtgt

SEQ ID NO: 643626 - DNA, 25 bp, Mus musculus
gaccaatggcttatctgatcgctct

SEQ ID NO: 643627 - DNA, 25 bp, Mus musculus
gaccaatggcttttctgatcgctct

SEQ ID NO: 643628 - DNA, 25 bp, Mus musculus
gaccaatgtggcctattacagtgtg

SEQ ID NO: 643629 - DNA, 25 bp, Mus musculus
gaccaatgtggcgtattacagtgtg

SEQ ID NO: 643630 - DNA, 25 bp, Mus musculus
gaccaattaccgctgtcgctttcgc

SEQ ID NO: 643631 - DNA, 25 bp, Mus musculus
gaccaattaccggtgtcgctttcgc

SEQ ID NO: 643632 - DNA, 25 bp, Mus musculus
gaccaatttgcacgaccatcagaga

SEQ ID NO: 643633 - DNA, 25 bp, Mus musculus
gaccaatttgcaggaccatcagaga

SEQ ID NO: 643634 - DNA, 25 bp, Mus musculus
gaccacaacagaacactggaccgat

SEQ ID NO: 643635 - DNA, 25 bp, Mus musculus
gaccacaacagatcactggaccgat

SEQ ID NO: 643636 - DNA, 25 bp, Mus musculus
gaccacaacaggcagtgacaactgc

SEQ ID NO: 643637 - DNA, 25 bp, Mus musculus
gaccacaacagggagtgacaactgc

SEQ ID NO: 643638 - DNA, 25 bp, Mus musculus
gaccacaagccgatctggatgcatg

SEQ ID NO: 643639 - DNA, 25 bp, Mus musculus
gaccacaagccgttctggatgcatg

SEQ ID NO: 643640 - DNA, 25 bp, Mus musculus
gaccacacacaactctgatgcagga

SEQ ID NO: 643641 - DNA, 25 bp, Mus musculus
gaccacacacaagtctgatgcagga

SEQ ID NO: 643642 - DNA, 25 bp, Mus musculus
gaccacaccgtgagctatctgctct

SEQ ID NO: 643643 - DNA, 25 bp, Mus musculus
gaccacaccgtgtgctatctgctct

SEQ ID NO: 643644 - DNA, 25 bp, Mus musculus
gaccacagaatgacctacacctgaa

SEQ ID NO: 643645 - DNA, 25 bp, Mus musculus
gaccacagaatgtcctacacctgaa

SEQ ID NO: 643646 - DNA, 25 bp, Mus musculus
gaccacagaggccacaacttaacct

SEQ ID NO: 643647 - DNA, 25 bp, Mus musculus
gaccacagaggcgacaacttaacct

SEQ ID NO: 643648 - DNA, 25 bp, Mus musculus
gaccacagcaagacccctttcatga

SEQ ID NO: 643649 - DNA, 25 bp, Mus musculus
gaccacagcaagtcccctttcatga

SEQ ID NO: 643650 - DNA, 25 bp, Mus musculus
gaccacagcagtatcagaagtcagt

SEQ ID NO: 643651 - DNA, 25 bp, Mus musculus
gaccacagcagtttcagaagtcagt

SEQ ID NO: 643652 - DNA, 25 bp, Mus musculus
gaccacagccgaagcaccaaagctg

SEQ ID NO: 643653 - DNA, 25 bp, Mus musculus
gaccacagccgatgcaccaaagctg

SEQ ID NO: 643654 - DNA, 25 bp, Mus musculus
gaccacagccgcattgtcaactgtg

SEQ ID NO: 643655 - DNA, 25 bp, Mus musculus
gaccacagccgctttgtcaactgtg

SEQ ID NO: 643656 - DNA, 25 bp, Mus musculus
gaccacagcggcaagtgggccactt

SEQ ID NO: 643657 - DNA, 25 bp, Mus musculus
gaccacagcggctagtgggccactt

SEQ ID NO: 643658 - DNA, 25 bp, Mus musculus
gaccacagggttaggtcactaagat

SEQ ID NO: 643659 - DNA, 25 bp, Mus musculus
gaccacagggtttggtcactaagat

SEQ ID NO: 643660 - DNA, 25 bp, Mus musculus
gaccacagtcatagagcgcaccttc

SEQ ID NO: 643661 - DNA, 25 bp, Mus musculus
gaccacagtcattgagcgcaccttc

SEQ ID NO: 643662 - DNA, 25 bp, Mus musculus
gaccacagtggaccgacagcctgca

SEQ ID NO: 643663 - DNA, 25 bp, Mus musculus
gaccacagtggagcgacagcctgca

SEQ ID NO: 643664 - DNA, 25 bp, Mus musculus
gaccacagttgcctccttgctggaa

SEQ ID NO: 643665 - DNA, 25 bp, Mus musculus
gaccacagttgcgtccttgctggaa

SEQ ID NO: 643666 - DNA, 25 bp, Mus musculus
gaccacagtttgacctaatagatga

SEQ ID NO: 643667 - DNA, 25 bp, Mus musculus
gaccacagtttgtcctaatagatga

SEQ ID NO: 643668 - DNA, 25 bp, Mus musculus
gaccacatatgcattacagagtctt

SEQ ID NO: 643669 - DNA, 25 bp, Mus musculus
gaccacatatgctttacagagtctt

SEQ ID NO: 643670 - DNA, 25 bp, Mus musculus
gaccacatcgtgagaagcctggcca

SEQ ID NO: 643671 - DNA, 25 bp, Mus musculus
gaccacatcgtgtgaagcctggcca

SEQ ID NO: 643672 - DNA, 25 bp, Mus musculus
gaccaccaccatcgaggcggtaaag

SEQ ID NO: 643673 - DNA, 25 bp, Mus musculus
gaccaccaccatggaggcggtaaag

SEQ ID NO: 643674 - DNA, 25 bp, Mus musculus
gaccaccacgtcagccgtcattgtt

SEQ ID NO: 643675 - DNA, 25 bp, Mus musculus
gaccaccacgtctgccgtcattgtt

SEQ ID NO: 643676 - DNA, 25 bp, Mus musculus
gaccaccagcaacacagctcgttat

SEQ ID NO: 643677 - DNA, 25 bp, Mus musculus
gaccaccagcaagacagctcgttat

SEQ ID NO: 643678 - DNA, 25 bp, Mus musculus
gaccaccagccgcaaagatgtcctg

SEQ ID NO: 643679 - DNA, 25 bp, Mus musculus
gaccaccagccggaaagatgtcctg

SEQ ID NO: 643680 - DNA, 25 bp, Mus musculus
gaccaccagcgacgtttcactggta

SEQ ID NO: 643681 - DNA, 25 bp, Mus musculus
gaccaccagcgaggtttcactggta

SEQ ID NO: 643682 - DNA, 25 bp, Mus musculus
gaccaccaggaactatatctttgga

SEQ ID NO: 643683 - DNA, 25 bp, Mus musculus
gaccaccaggaagtatatctttgga

SEQ ID NO: 643684 - DNA, 25 bp, Mus musculus
gaccacccaactaacacaaggaaag

SEQ ID NO: 643685 - DNA, 25 bp, Mus musculus
gaccacccaacttacacaaggaaag

SEQ ID NO: 643686 - DNA, 25 bp, Mus musculus
gaccaccctgggaaaggtcatctct

SEQ ID NO: 643687 - DNA, 25 bp, Mus musculus
gaccaccctgggtaaggtcatctct

SEQ ID NO: 643688 - DNA, 25 bp, Mus musculus
gaccaccggagaaatttctttagtt

SEQ ID NO: 643689 - DNA, 25 bp, Mus musculus
gaccaccggagatatttctttagtt

SEQ ID NO: 643690 - DNA, 25 bp, Mus musculus
gaccaccgtggaacaaaaattcctg

SEQ ID NO: 643691 - DNA, 25 bp, Mus musculus
gaccaccgtggatcaaaaattcctg

SEQ ID NO: 643692 - DNA, 25 bp, Mus musculus
gaccaccgtggtcgcatgccgtgca

SEQ ID NO: 643693 - DNA, 25 bp, Mus musculus
gaccaccgtggtggcatgccgtgca

SEQ ID NO: 643694 - DNA, 25 bp, Mus musculus
gaccaccgttaaaccgcactgaaac

SEQ ID NO: 643695 - DNA, 25 bp, Mus musculus
gaccaccgttaatccgcactgaaac

SEQ ID NO: 643696 - DNA, 25 bp, Mus musculus
gaccacctacttataaagacaatca

SEQ ID NO: 643697 - DNA, 25 bp, Mus musculus
gaccacctacttttaaagacaatca

SEQ ID NO: 643698 - DNA, 25 bp, Mus musculus
gaccacctgagcattcgttcttact

SEQ ID NO: 643699 - DNA, 25 bp, Mus musculus
gaccacctgagctttcgttcttact

SEQ ID NO: 643700 - DNA, 25 bp, Mus musculus
gaccacctgagtatgaattcttctg

SEQ ID NO: 643701 - DNA, 25 bp, Mus musculus
gaccacctgagtttgaattcttctg

SEQ ID NO: 643702 - DNA, 25 bp, Mus musculus
gaccacctgcaccagagacagtttt

SEQ ID NO: 643703 - DNA, 25 bp, Mus musculus
gaccacctgcacgagagacagtttt

SEQ ID NO: 643704 - DNA, 25 bp, Mus musculus
gaccacctgggactcaccctttgaa

SEQ ID NO: 643705 - DNA, 25 bp, Mus musculus
gaccacctgggagtcaccctttgaa

SEQ ID NO: 643706 - DNA, 25 bp, Mus musculus
gaccacctgttcatcgtgatggagt

SEQ ID NO: 643707 - DNA, 25 bp, Mus musculus
gaccacctgttcttcgtgatggagt

SEQ ID NO: 643708 - DNA, 25 bp, Mus musculus
gaccaccttataccagcgttataag

SEQ ID NO: 643709 - DNA, 25 bp, Mus musculus
gaccaccttatagcagcgttataag

SEQ ID NO: 643710 - DNA, 25 bp, Mus musculus
gaccaccttcggcaagatgtggaag

SEQ ID NO: 643711 - DNA, 25 bp, Mus musculus
gaccaccttcgggaagatgtggaag

SEQ ID NO: 643712 - DNA, 25 bp, Mus musculus
gaccacgaacaccatagcaccattg

SEQ ID NO: 643713 - DNA, 25 bp, Mus musculus
gaccacgaacacgatagcaccattg

SEQ ID NO: 643714 - DNA, 25 bp, Mus musculus
gaccacgagcggatgtcttacttgc

SEQ ID NO: 643715 - DNA, 25 bp, Mus musculus
gaccacgagcggttgtcttacttgc

SEQ ID NO: 643716 - DNA, 25 bp, Mus musculus
gaccacgagctgctgcatccatcag

SEQ ID NO: 643717 - DNA, 25 bp, Mus musculus
gaccacgagctggtgcatccatcag

SEQ ID NO: 643718 - DNA, 25 bp, Mus musculus
gaccacgaggctatacgtccaagat

SEQ ID NO: 643719 - DNA, 25 bp, Mus musculus
gaccacgaggctttacgtccaagat

SEQ ID NO: 643720 - DNA, 25 bp, Mus musculus
gaccacgctcaacattcagtatgga

SEQ ID NO: 643721 - DNA, 25 bp, Mus musculus
gaccacgctcaagattcagtatgga

SEQ ID NO: 643722 - DNA, 25 bp, Mus musculus
gaccacgctcgtattcttcttggca

SEQ ID NO: 643723 - DNA, 25 bp, Mus musculus
gaccacgctcgttttcttcttggca

SEQ ID NO: 643724 - DNA, 25 bp, Mus musculus
gaccacgctctcaacgatatgactt

SEQ ID NO: 643725 - DNA, 25 bp, Mus musculus
gaccacgctctctacgatatgactt

SEQ ID NO: 643726 - DNA, 25 bp, Mus musculus
gaccacggatctaagggaacacgag

SEQ ID NO: 643727 - DNA, 25 bp, Mus musculus
gaccacggatcttagggaacacgag

SEQ ID NO: 643728 - DNA, 25 bp, Mus musculus
gaccacggcaacatggccttgaacg

SEQ ID NO: 643729 - DNA, 25 bp, Mus musculus
gaccacggcaacttggccttgaacg

SEQ ID NO: 643730 - DNA, 25 bp, Mus musculus
gaccacggtggccaaaattcttagc

SEQ ID NO: 643731 - DNA, 25 bp, Mus musculus
gaccacggtggcgaaaattcttagc

SEQ ID NO: 643732 - DNA, 25 bp, Mus musculus
gaccacgtggagaaccgctatggca

SEQ ID NO: 643733 - DNA, 25 bp, Mus musculus
gaccacgtggagtaccgctatggca

SEQ ID NO: 643734 - DNA, 25 bp, Mus musculus
gaccacgtgtatcacttatgcccct

SEQ ID NO: 643735 - DNA, 25 bp, Mus musculus
gaccacgtgtatgacttatgcccct

SEQ ID NO: 643736 - DNA, 25 bp, Mus musculus
gaccacgttgagattcagcatccga

SEQ ID NO: 643737 - DNA, 25 bp, Mus musculus
gaccacgttgagtttcagcatccga

SEQ ID NO: 643738 - DNA, 25 bp, Mus musculus
gaccacgttggcctgtttgcacaca

SEQ ID NO: 643739 - DNA, 25 bp, Mus musculus
gaccacgttggcgtgtttgcacaca

SEQ ID NO: 643740 - DNA, 25 bp, Mus musculus
gaccacgttgtactggagcgacctc

SEQ ID NO: 643741 - DNA, 25 bp, Mus musculus
gaccacgttgtagtggagcgacctc

SEQ ID NO: 643742 - DNA, 25 bp, Mus musculus
gaccactaaaggagcctgttggcct

SEQ ID NO: 643743 - DNA, 25 bp, Mus musculus
gaccactaaaggtgcctgttggcct

SEQ ID NO: 643744 - DNA, 25 bp, Mus musculus
gaccactacaacaacacttatctag

SEQ ID NO: 643745 - DNA, 25 bp, Mus musculus
gaccactacaactacacttatctag

SEQ ID NO: 643746 - DNA, 25 bp, Mus musculus
gaccactagacgcacggagaccaca

SEQ ID NO: 643747 - DNA, 25 bp, Mus musculus
gaccactagacggacggagaccaca

SEQ ID NO: 643748 - DNA, 25 bp, Mus musculus
gaccactagtagcttgaatcccacc

SEQ ID NO: 643749 - DNA, 25 bp, Mus musculus
gaccactagtaggttgaatcccacc

SEQ ID NO: 643750 - DNA, 25 bp, Mus musculus
gaccactatgacactgagaatatcg

SEQ ID NO: 643751 - DNA, 25 bp, Mus musculus
gaccactatgactctgagaatatcg

SEQ ID NO: 643752 - DNA, 25 bp, Mus musculus
gaccactatggacgccgggagtact

SEQ ID NO: 643753 - DNA, 25 bp, Mus musculus
gaccactatggaggccgggagtact

SEQ ID NO: 643754 - DNA, 25 bp, Mus musculus
gaccactatgttcggattgcccggg

SEQ ID NO: 643755 - DNA, 25 bp, Mus musculus
gaccactatgttgggattgcccggg

SEQ ID NO: 643756 - DNA, 25 bp, Mus musculus
gaccactcaatgaaaccttttcttg

SEQ ID NO: 643757 - DNA, 25 bp, Mus musculus
gaccactcaatgtaaccttttcttg

SEQ ID NO: 643758 - DNA, 25 bp, Mus musculus
gaccactccacaagcatcttaggcg

SEQ ID NO: 643759 - DNA, 25 bp, Mus musculus
gaccactccacatgcatcttaggcg

SEQ ID NO: 643760 - DNA, 25 bp, Mus musculus
gaccactggagcaaaggcctagcga

SEQ ID NO: 643761 - DNA, 25 bp, Mus musculus
gaccactggagctaaggcctagcga

SEQ ID NO: 643762 - DNA, 25 bp, Mus musculus
gaccactgggttattcacctcgacg

SEQ ID NO: 643763 - DNA, 25 bp, Mus musculus
gaccactgggtttttcacctcgacg

SEQ ID NO: 643764 - DNA, 25 bp, Mus musculus
gaccactgtgtcatcttacagaaag

SEQ ID NO: 643765 - DNA, 25 bp, Mus musculus
gaccactgtgtcttcttacagaaag

SEQ ID NO: 643766 - DNA, 25 bp, Mus musculus
gaccactttgtgactgactgcagga

SEQ ID NO: 643767 - DNA, 25 bp, Mus musculus
gaccactttgtgtctgactgcagga

SEQ ID NO: 643768 - DNA, 25 bp, Mus musculus
gaccagaaccgcagggacttcaact

SEQ ID NO: 643769 - DNA, 25 bp, Mus musculus
gaccagaaccgctgggacttcaact

SEQ ID NO: 643770 - DNA, 25 bp, Mus musculus
gaccagaagccaagcacaaaactac

SEQ ID NO: 643771 - DNA, 25 bp, Mus musculus
gaccagaagccatgcacaaaactac

SEQ ID NO: 643772 - DNA, 25 bp, Mus musculus
gaccagaaggtaactgcatcataca

SEQ ID NO: 643773 - DNA, 25 bp, Mus musculus
gaccagaaggtatctgcatcataca

SEQ ID NO: 643774 - DNA, 25 bp, Mus musculus
gaccagaatcgtcgagcataccaac

SEQ ID NO: 643775 - DNA, 25 bp, Mus musculus
gaccagaatcgtggagcataccaac

SEQ ID NO: 643776 - DNA, 25 bp, Mus musculus
gaccagaatcttagtcctgggaaag

SEQ ID NO: 643777 - DNA, 25 bp, Mus musculus
gaccagaatctttgtcctgggaaag

SEQ ID NO: 643778 - DNA, 25 bp, Mus musculus
gaccagaatgaaccccggaaatacg

SEQ ID NO: 643779 - DNA, 25 bp, Mus musculus
gaccagaatgaagcccggaaatacg

SEQ ID NO: 643780 - DNA, 25 bp, Mus musculus
gaccagaatgctagcagaagatgag

SEQ ID NO: 643781 - DNA, 25 bp, Mus musculus
gaccagaatgcttgcagaagatgag

SEQ ID NO: 643782 - DNA, 25 bp, Mus musculus
gaccagacacggcagctttgtcaat

SEQ ID NO: 643783 - DNA, 25 bp, Mus musculus
gaccagacacgggagctttgtcaat

SEQ ID NO: 643784 - DNA, 25 bp, Mus musculus
gaccagacatgtaaaatctggagga

SEQ ID NO: 643785 - DNA, 25 bp, Mus musculus
gaccagacatgttaaatctggagga

SEQ ID NO: 643786 - DNA, 25 bp, Mus musculus
gaccagacctggatcttgtttcttc

SEQ ID NO: 643787 - DNA, 25 bp, Mus musculus
gaccagacctggttcttgtttcttc

SEQ ID NO: 643788 - DNA, 25 bp, Mus musculus
gaccagacctgtagagaagatttac

SEQ ID NO: 643789 - DNA, 25 bp, Mus musculus
gaccagacctgttgagaagatttac

SEQ ID NO: 643790 - DNA, 25 bp, Mus musculus
gaccagacgacactacggactgtag

SEQ ID NO: 643791 - DNA, 25 bp, Mus musculus
gaccagacgacagtacggactgtag

SEQ ID NO: 643792 - DNA, 25 bp, Mus musculus
gaccagactacgaactttgaggaga

SEQ ID NO: 643793 - DNA, 25 bp, Mus musculus
gaccagactacgtactttgaggaga

SEQ ID NO: 643794 - DNA, 25 bp, Mus musculus
gaccagactggtactcgtccagggc

SEQ ID NO: 643795 - DNA, 25 bp, Mus musculus
gaccagactggttctcgtccagggc

SEQ ID NO: 643796 - DNA, 25 bp, Mus musculus
gaccagacttctccgactactcgtg

SEQ ID NO: 643797 - DNA, 25 bp, Mus musculus
gaccagacttctgcgactactcgtg

SEQ ID NO: 643798 - DNA, 25 bp, Mus musculus
gaccagacttgtattggatccctac

SEQ ID NO: 643799 - DNA, 25 bp, Mus musculus
gaccagacttgttttggatccctac

SEQ ID NO: 643800 - DNA, 25 bp, Mus musculus
gaccagagccctaatgtcacttctg

SEQ ID NO: 643801 - DNA, 25 bp, Mus musculus
gaccagagcccttatgtcacttctg

SEQ ID NO: 643802 - DNA, 25 bp, Mus musculus
gaccagagcgtcactgaagtttcag

SEQ ID NO: 643803 - DNA, 25 bp, Mus musculus
gaccagagcgtctctgaagtttcag

SEQ ID NO: 643804 - DNA, 25 bp, Mus musculus
gaccagaggtctacacactacgatg

SEQ ID NO: 643805 - DNA, 25 bp, Mus musculus
gaccagaggtcttcacactacgatg

SEQ ID NO: 643806 - DNA, 25 bp, Mus musculus
gaccagaggttgctgtattctggca

SEQ ID NO: 643807 - DNA, 25 bp, Mus musculus
gaccagaggttggtgtattctggca

SEQ ID NO: 643808 - DNA, 25 bp, Mus musculus
gaccagagtaagatctgatgacttc

SEQ ID NO: 643809 - DNA, 25 bp, Mus musculus
gaccagagtaagttctgatgacttc

SEQ ID NO: 643810 - DNA, 25 bp, Mus musculus
gaccagagtaatccggagcagcacg

SEQ ID NO: 643811 - DNA, 25 bp, Mus musculus
gaccagagtaatgcggagcagcacg

SEQ ID NO: 643812 - DNA, 25 bp, Mus musculus
gaccagagtccccaattcactcagt

SEQ ID NO: 643813 - DNA, 25 bp, Mus musculus
gaccagagtcccgaattcactcagt

SEQ ID NO: 643814 - DNA, 25 bp, Mus musculus
gaccagagtgaccaactggtctgga

SEQ ID NO: 643815 - DNA, 25 bp, Mus musculus
gaccagagtgacgaactggtctgga

SEQ ID NO: 643816 - DNA, 25 bp, Mus musculus
gaccagagttctcgttgccagaccg

SEQ ID NO: 643817 - DNA, 25 bp, Mus musculus
gaccagagttctggttgccagaccg

SEQ ID NO: 643818 - DNA, 25 bp, Mus musculus
gaccagagtttgaccgtggctataa

SEQ ID NO: 643819 - DNA, 25 bp, Mus musculus
gaccagagtttgtccgtggctataa

SEQ ID NO: 643820 - DNA, 25 bp, Mus musculus
gaccagatcattcacatgctccgag

SEQ ID NO: 643821 - DNA, 25 bp, Mus musculus
gaccagatcattgacatgctccgag

SEQ ID NO: 643822 - DNA, 25 bp, Mus musculus
gaccagatccagcttgcagctcagc

SEQ ID NO: 643823 - DNA, 25 bp, Mus musculus
gaccagatccaggttgcagctcagc

SEQ ID NO: 643824 - DNA, 25 bp, Mus musculus
gaccagatccgccagacaatctttg

SEQ ID NO: 643825 - DNA, 25 bp, Mus musculus
gaccagatccgcgagacaatctttg

SEQ ID NO: 643826 - DNA, 25 bp, Mus musculus
gaccagatccggacaattgaccgaa

SEQ ID NO: 643827 - DNA, 25 bp, Mus musculus
gaccagatccggtcaattgaccgaa

SEQ ID NO: 643828 - DNA, 25 bp, Mus musculus
gaccagatccttcgtctcagcgtag

SEQ ID NO: 643829 - DNA, 25 bp, Mus musculus
gaccagatccttggtctcagcgtag

SEQ ID NO: 643830 - DNA, 25 bp, Mus musculus
gaccagatcttccaagatgagacag

SEQ ID NO: 643831 - DNA, 25 bp, Mus musculus
gaccagatcttcgaagatgagacag

SEQ ID NO: 643832 - DNA, 25 bp, Mus musculus
gaccagatcttgcacctgagtgtca

SEQ ID NO: 643833 - DNA, 25 bp, Mus musculus
gaccagatcttggacctgagtgtca

SEQ ID NO: 643834 - DNA, 25 bp, Mus musculus
gaccagatgaggctcaacaaacagt

SEQ ID NO: 643835 - DNA, 25 bp, Mus musculus
gaccagatgagggtcaacaaacagt

SEQ ID NO: 643836 - DNA, 25 bp, Mus musculus
gaccagatgctgacttgaacaagct

SEQ ID NO: 643837 - DNA, 25 bp, Mus musculus
gaccagatgctgtcttgaacaagct

SEQ ID NO: 643838 - DNA, 25 bp, Mus musculus
gaccagatgtccaagaagaagccat

SEQ ID NO: 643839 - DNA, 25 bp, Mus musculus
gaccagatgtcctagaagaagccat

SEQ ID NO: 643840 - DNA, 25 bp, Mus musculus
gaccagatgtgtaatgacaaagagc

SEQ ID NO: 643841 - DNA, 25 bp, Mus musculus
gaccagatgtgttatgacaaagagc

SEQ ID NO: 643842 - DNA, 25 bp, Mus musculus
gaccagcaacttcggaaacttcatg

SEQ ID NO: 643843 - DNA, 25 bp, Mus musculus
gaccagcaacttgggaaacttcatg

SEQ ID NO: 643844 - DNA, 25 bp, Mus musculus
gaccagcaatataaaggagcagctc

SEQ ID NO: 643845 - DNA, 25 bp, Mus musculus
gaccagcaatattaaggagcagctc

SEQ ID NO: 643846 - DNA, 25 bp, Mus musculus
gaccagcacagcagcgagtatgttg

SEQ ID NO: 643847 - DNA, 25 bp, Mus musculus
gaccagcacagctgcgagtatgttg

SEQ ID NO: 643848 - DNA, 25 bp, Mus musculus
gaccagcacatcaagcaggtttgca

SEQ ID NO: 643849 - DNA, 25 bp, Mus musculus
gaccagcacatctagcaggtttgca

SEQ ID NO: 643850 - DNA, 25 bp, Mus musculus
gaccagcacgggaagccatatttct

SEQ ID NO: 643851 - DNA, 25 bp, Mus musculus
gaccagcacgggtagccatatttct

SEQ ID NO: 643852 - DNA, 25 bp, Mus musculus
gaccagcagctcaagtctgttctaa

SEQ ID NO: 643853 - DNA, 25 bp, Mus musculus
gaccagcagctctagtctgttctaa

SEQ ID NO: 643854 - DNA, 25 bp, Mus musculus
gaccagcaggaaaagctgctcgcag

SEQ ID NO: 643855 - DNA, 25 bp, Mus musculus
gaccagcaggaatagctgctcgcag

SEQ ID NO: 643856 - DNA, 25 bp, Mus musculus
gaccagcaggagcatgactatggac

SEQ ID NO: 643857 - DNA, 25 bp, Mus musculus
gaccagcaggaggatgactatggac

SEQ ID NO: 643858 - DNA, 25 bp, Mus musculus
gaccagcaggctctagtgggaaaaa

SEQ ID NO: 643859 - DNA, 25 bp, Mus musculus
gaccagcaggctgtagtgggaaaaa

SEQ ID NO: 643860 - DNA, 25 bp, Mus musculus
gaccagccagctatgcgcgctggac

SEQ ID NO: 643861 - DNA, 25 bp, Mus musculus
gaccagccagctcaaaagtaccatt

SEQ ID NO: 643862 - DNA, 25 bp, Mus musculus
gaccagccagctgaaaagtaccatt

SEQ ID NO: 643863 - DNA, 25 bp, Mus musculus
gaccagccagctttgcgcgctggac

SEQ ID NO: 643864 - DNA, 25 bp, Mus musculus
gaccagcccaagcaagaatatttcc

SEQ ID NO: 643865 - DNA, 25 bp, Mus musculus
gaccagcccaaggaagaatatttcc

SEQ ID NO: 643866 - DNA, 25 bp, Mus musculus
gaccagcccctgaaaattgccagag

SEQ ID NO: 643867 - DNA, 25 bp, Mus musculus
gaccagcccctgtaaattgccagag

SEQ ID NO: 643868 - DNA, 25 bp, Mus musculus
gaccagccgaccagtcaagggtcag

SEQ ID NO: 643869 - DNA, 25 bp, Mus musculus
gaccagccgacctgtcaagggtcag

SEQ ID NO: 643870 - DNA, 25 bp, Mus musculus
gaccagcctgacaggtaaggacagg

SEQ ID NO: 643871 - DNA, 25 bp, Mus musculus
gaccagcctgactggtaaggacagg

SEQ ID NO: 643872 - DNA, 25 bp, Mus musculus
gaccagcctgtaccagatagccatg

SEQ ID NO: 643873 - DNA, 25 bp, Mus musculus
gaccagcctgtagcagatagccatg

SEQ ID NO: 643874 - DNA, 25 bp, Mus musculus
gaccagcgaatcagccaggatgtgg

SEQ ID NO: 643875 - DNA, 25 bp, Mus musculus
gaccagcgaatctgccaggatgtgg

SEQ ID NO: 643876 - DNA, 25 bp, Mus musculus
gaccagcgatgacatagagagtgca

SEQ ID NO: 643877 - DNA, 25 bp, Mus musculus
gaccagcgatgagatagagagtgca

SEQ ID NO: 643878 - DNA, 25 bp, Mus musculus
gaccagcgccacatcttcacgttga

SEQ ID NO: 643879 - DNA, 25 bp, Mus musculus
gaccagcgccacttcttcacgttga

SEQ ID NO: 643880 - DNA, 25 bp, Mus musculus
gaccagcgccttcccggtttctcag

SEQ ID NO: 643881 - DNA, 25 bp, Mus musculus
gaccagcgccttgccggtttctcag

SEQ ID NO: 643882 - DNA, 25 bp, Mus musculus
gaccagcgcgaacaatgccattaac

SEQ ID NO: 643883 - DNA, 25 bp, Mus musculus
gaccagcgcgaagaatgccattaac

SEQ ID NO: 643884 - DNA, 25 bp, Mus musculus
gaccagcgctgtaccaagtgaaaac

SEQ ID NO: 643885 - DNA, 25 bp, Mus musculus
gaccagcgctgttccaagtgaaaac

SEQ ID NO: 643886 - DNA, 25 bp, Mus musculus
gaccagcggaccatcatttctgcca

SEQ ID NO: 643887 - DNA, 25 bp, Mus musculus
gaccagcggaccttcatttctgcca

SEQ ID NO: 643888 - DNA, 25 bp, Mus musculus
gaccagcggagccaaaatggagcta

SEQ ID NO: 643889 - DNA, 25 bp, Mus musculus
gaccagcggagcgaaaatggagcta

SEQ ID NO: 643890 - DNA, 25 bp, Mus musculus
gaccagcgtaacacggacagtgata

SEQ ID NO: 643891 - DNA, 25 bp, Mus musculus
gaccagcgtaactcggacagtgata

SEQ ID NO: 643892 - DNA, 25 bp, Mus musculus
gaccagcgtgtaacagttaattccc

SEQ ID NO: 643893 - DNA, 25 bp, Mus musculus
gaccagcgtgtatcagttaattccc

SEQ ID NO: 643894 - DNA, 25 bp, Mus musculus
gaccagctaaagaatgatgtccagc

SEQ ID NO: 643895 - DNA, 25 bp, Mus musculus
gaccagctaaagtatgatgtccagc

SEQ ID NO: 643896 - DNA, 25 bp, Mus musculus
gaccagctacatatggagtatgcca

SEQ ID NO: 643897 - DNA, 25 bp, Mus musculus
gaccagctacatttggagtatgcca

SEQ ID NO: 643898 - DNA, 25 bp, Mus musculus
gaccagctagcaactcagacttcaa

SEQ ID NO: 643899 - DNA, 25 bp, Mus musculus
gaccagctagcatctcagacttcaa

SEQ ID NO: 643900 - DNA, 25 bp, Mus musculus
gaccagctcatccacttttacaaga

SEQ ID NO: 643901 - DNA, 25 bp, Mus musculus
gaccagctcatcgacttttacaaga

SEQ ID NO: 643902 - DNA, 25 bp, Mus musculus
gaccagctcatgaacagacaggagt

SEQ ID NO: 643903 - DNA, 25 bp, Mus musculus
gaccagctcatgaacttggcgctgt

SEQ ID NO: 643904 - DNA, 25 bp, Mus musculus
gaccagctcatgtacagacaggagt

SEQ ID NO: 643905 - DNA, 25 bp, Mus musculus
gaccagctcatgtacttggcgctgt

SEQ ID NO: 643906 - DNA, 25 bp, Mus musculus
gaccagctcctgagctagccaggct

SEQ ID NO: 643907 - DNA, 25 bp, Mus musculus
gaccagctcctgtgctagccaggct

SEQ ID NO: 643908 - DNA, 25 bp, Mus musculus
gaccagctctttaataccaagatct

SEQ ID NO: 643909 - DNA, 25 bp, Mus musculus
gaccagctcttttataccaagatct

SEQ ID NO: 643910 - DNA, 25 bp, Mus musculus
gaccagctgaccatggacgacaatg

SEQ ID NO: 643911 - DNA, 25 bp, Mus musculus
gaccagctgaccttggacgacaatg

SEQ ID NO: 643912 - DNA, 25 bp, Mus musculus
gaccagctgccaatagtcaccagta

SEQ ID NO: 643913 - DNA, 25 bp, Mus musculus
gaccagctgccattagtcaccagta

SEQ ID NO: 643914 - DNA, 25 bp, Mus musculus
gaccagctgcgtatgcagaaccaga

SEQ ID NO: 643915 - DNA, 25 bp, Mus musculus
gaccagctgcgtttgcagaaccaga

SEQ ID NO: 643916 - DNA, 25 bp, Mus musculus
gaccagctgggaatggctttacctg

SEQ ID NO: 643917 - DNA, 25 bp, Mus musculus
gaccagctgggattggctttacctg

SEQ ID NO: 643918 - DNA, 25 bp, Mus musculus
gaccagctgggcatgtttacacaca

SEQ ID NO: 643919 - DNA, 25 bp, Mus musculus
gaccagctgggcttgtttacacaca

SEQ ID NO: 643920 - DNA, 25 bp, Mus musculus
gaccagctgggtcactctcaaagat

SEQ ID NO: 643921 - DNA, 25 bp, Mus musculus
gaccagctgggtgactctcaaagat

SEQ ID NO: 643922 - DNA, 25 bp, Mus musculus
gaccagctggtgaataagtcagtca

SEQ ID NO: 643923 - DNA, 25 bp, Mus musculus
gaccagctggtgtataagtcagtca

SEQ ID NO: 643924 - DNA, 25 bp, Mus musculus
gaccagcttcggacacgtgagagaa

SEQ ID NO: 643925 - DNA, 25 bp, Mus musculus
gaccagcttcggtcacgtgagagaa

SEQ ID NO: 643926 - DNA, 25 bp, Mus musculus
gaccagctttggacctgtgtcagat

SEQ ID NO: 643927 - DNA, 25 bp, Mus musculus
gaccagctttggtcctgtgtcagat

SEQ ID NO: 643928 - DNA, 25 bp, Mus musculus
gaccaggaaattccattcccttagg

SEQ ID NO: 643929 - DNA, 25 bp, Mus musculus
gaccaggaaattgcattcccttagg

SEQ ID NO: 643930 - DNA, 25 bp, Mus musculus
gaccaggaatccatcagacaagtta

SEQ ID NO: 643931 - DNA, 25 bp, Mus musculus
gaccaggaatccttcagacaagtta

SEQ ID NO: 643932 - DNA, 25 bp, Mus musculus
gaccaggacaagcaatactacgagc

SEQ ID NO: 643933 - DNA, 25 bp, Mus musculus
gaccaggacaaggaatactacgagc

SEQ ID NO: 643934 - DNA, 25 bp, Mus musculus
gaccaggagaaactcatcacctttc

SEQ ID NO: 643935 - DNA, 25 bp, Mus musculus
gaccaggagaaagtcatcacctttc

SEQ ID NO: 643936 - DNA, 25 bp, Mus musculus
gaccaggagacccatgtttcagtga

SEQ ID NO: 643937 - DNA, 25 bp, Mus musculus
gaccaggagaccgatgtttcagtga

SEQ ID NO: 643938 - DNA, 25 bp, Mus musculus
gaccaggagatcagagaaatgcatg

SEQ ID NO: 643939 - DNA, 25 bp, Mus musculus
gaccaggagatctgagaaatgcatg

SEQ ID NO: 643940 - DNA, 25 bp, Mus musculus
gaccaggagcccagggcctttagag

SEQ ID NO: 643941 - DNA, 25 bp, Mus musculus
gaccaggagccctgggcctttagag

SEQ ID NO: 643942 - DNA, 25 bp, Mus musculus
gaccaggagctcctgctatactctc

SEQ ID NO: 643943 - DNA, 25 bp, Mus musculus
gaccaggagctcgtgctatactctc

SEQ ID NO: 643944 - DNA, 25 bp, Mus musculus
gaccaggagtcaagttcagcgtaga

SEQ ID NO: 643945 - DNA, 25 bp, Mus musculus
gaccaggagtcatgttcagcgtaga

SEQ ID NO: 643946 - DNA, 25 bp, Mus musculus
gaccaggagtctatcaggcctctga

SEQ ID NO: 643947 - DNA, 25 bp, Mus musculus
gaccaggagtctttcaggcctctga

SEQ ID NO: 643948 - DNA, 25 bp, Mus musculus
gaccaggagtttaaagtcagccttg

SEQ ID NO: 643949 - DNA, 25 bp, Mus musculus
gaccaggagttttaagtcagccttg

SEQ ID NO: 643950 - DNA, 25 bp, Mus musculus
gaccaggatccgaacttcagaatga

SEQ ID NO: 643951 - DNA, 25 bp, Mus musculus
gaccaggatccgtacttcagaatga

SEQ ID NO: 643952 - DNA, 25 bp, Mus musculus
gaccaggcacgacaaggttgccaat

SEQ ID NO: 643953 - DNA, 25 bp, Mus musculus
gaccaggcacgagaaggttgccaat

SEQ ID NO: 643954 - DNA, 25 bp, Mus musculus
gaccaggcagagctagatcaaattg

SEQ ID NO: 643955 - DNA, 25 bp, Mus musculus
gaccaggcagaggtagatcaaattg

SEQ ID NO: 643956 - DNA, 25 bp, Mus musculus
gaccaggcagatagataaaattcag

SEQ ID NO: 643957 - DNA, 25 bp, Mus musculus
gaccaggcagattgataaaattcag

SEQ ID NO: 643958 - DNA, 25 bp, Mus musculus
gaccaggcagctcgaatgacccaga

SEQ ID NO: 643959 - DNA, 25 bp, Mus musculus
gaccaggcagctggaatgacccaga

SEQ ID NO: 643960 - DNA, 25 bp, Mus musculus
gaccaggcatcgattgccagccaga

SEQ ID NO: 643961 - DNA, 25 bp, Mus musculus
gaccaggcatcgtttgccagccaga

SEQ ID NO: 643962 - DNA, 25 bp, Mus musculus
gaccaggcatggctatggcattctg

SEQ ID NO: 643963 - DNA, 25 bp, Mus musculus
gaccaggcatgggtatggcattctg

SEQ ID NO: 643964 - DNA, 25 bp, Mus musculus
gaccaggcattgctgccagtgaaca

SEQ ID NO: 643965 - DNA, 25 bp, Mus musculus
gaccaggcattggtgccagtgaaca

SEQ ID NO: 643966 - DNA, 25 bp, Mus musculus
gaccaggctcctaggtgacaagtcc

SEQ ID NO: 643967 - DNA, 25 bp, Mus musculus
gaccaggctccttggtgacaagtcc

SEQ ID NO: 643968 - DNA, 25 bp, Mus musculus
gaccaggctggcatatgaatagtcc

SEQ ID NO: 643969 - DNA, 25 bp, Mus musculus
gaccaggctggcttatgaatagtcc

SEQ ID NO: 643970 - DNA, 25 bp, Mus musculus
gaccagggtcagctaggaaacttcc

SEQ ID NO: 643971 - DNA, 25 bp, Mus musculus
gaccagggtcaggtaggaaacttcc

SEQ ID NO: 643972 - DNA, 25 bp, Mus musculus
gaccagggtcccacaagaaggacct

SEQ ID NO: 643973 - DNA, 25 bp, Mus musculus
gaccagggtccctcaagaaggacct

SEQ ID NO: 643974 - DNA, 25 bp, Mus musculus
gaccagggtgttcctttctcacaaa

SEQ ID NO: 643975 - DNA, 25 bp, Mus musculus
gaccagggtgttgctttctcacaaa

SEQ ID NO: 643976 - DNA, 25 bp, Mus musculus
gaccagggttggaacgagtgccgtg

SEQ ID NO: 643977 - DNA, 25 bp, Mus musculus
gaccagggttggtacgagtgccgtg

SEQ ID NO: 643978 - DNA, 25 bp, Mus musculus
gaccagggttgtagccaccatgttg

SEQ ID NO: 643979 - DNA, 25 bp, Mus musculus
gaccagggttgttgccaccatgttg

SEQ ID NO: 643980 - DNA, 25 bp, Mus musculus
gaccaggtatgaacgcctctctctc

SEQ ID NO: 643981 - DNA, 25 bp, Mus musculus
gaccaggtatgatcgcctctctctc

SEQ ID NO: 643982 - DNA, 25 bp, Mus musculus
gaccaggtcaaacctgcaggagatt

SEQ ID NO: 643983 - DNA, 25 bp, Mus musculus
gaccaggtcaaagctgcaggagatt

SEQ ID NO: 643984 - DNA, 25 bp, Mus musculus
gaccaggtcatcctgctacgggcag

SEQ ID NO: 643985 - DNA, 25 bp, Mus musculus
gaccaggtcatcgtgctacgggcag

SEQ ID NO: 643986 - DNA, 25 bp, Mus musculus
gaccaggtccgtaggaattgcaacc

SEQ ID NO: 643987 - DNA, 25 bp, Mus musculus
gaccaggtccgttggaattgcaacc

SEQ ID NO: 643988 - DNA, 25 bp, Mus musculus
gaccaggtctctcaccaggtcaagt

SEQ ID NO: 643989 - DNA, 25 bp, Mus musculus
gaccaggtctctgaccaggtcaagt

SEQ ID NO: 643990 - DNA, 25 bp, Mus musculus
gaccaggtgcgcaagtctgtggata

SEQ ID NO: 643991 - DNA, 25 bp, Mus musculus
gaccaggtgcgctagtctgtggata

SEQ ID NO: 643992 - DNA, 25 bp, Mus musculus
gaccaggtgctccacgaggacgaaa

SEQ ID NO: 643993 - DNA, 25 bp, Mus musculus
gaccaggtgctcgacgaggacgaaa

SEQ ID NO: 643994 - DNA, 25 bp, Mus musculus
gaccaggttctgcacagtgctgcga

SEQ ID NO: 643995 - DNA, 25 bp, Mus musculus
gaccaggttctggacagtgctgcga

SEQ ID NO: 643996 - DNA, 25 bp, Mus musculus
gaccaggttcttcacaggctacata

SEQ ID NO: 643997 - DNA, 25 bp, Mus musculus
gaccaggttcttgacaggctacata

SEQ ID NO: 643998 - DNA, 25 bp, Mus musculus
gaccagtaaaatcaagaatgcttac

SEQ ID NO: 643999 - DNA, 25 bp, Mus musculus
gaccagtaaaatgaagaatgcttac

SEQ ID NO: 644000 - DNA, 25 bp, Mus musculus
gaccagtaccggaagggcatcatct

SEQ ID NO: 644001 - DNA, 25 bp, Mus musculus
gaccagtaccggtagggcatcatct

SEQ ID NO: 644002 - DNA, 25 bp, Mus musculus
gaccagtattatctaacatcgccag

SEQ ID NO: 644003 - DNA, 25 bp, Mus musculus
gaccagtattatgtaacatcgccag

SEQ ID NO: 644004 - DNA, 25 bp, Mus musculus
gaccagtcattgagcaggacctcag

SEQ ID NO: 644005 - DNA, 25 bp, Mus musculus
gaccagtcattgtgcaggacctcag

SEQ ID NO: 644006 - DNA, 25 bp, Mus musculus
gaccagtcatttctgcccattacga

SEQ ID NO: 644007 - DNA, 25 bp, Mus musculus
gaccagtcatttgtgcccattacga

SEQ ID NO: 644008 - DNA, 25 bp, Mus musculus
gaccagtccaacctgagacggatgc

SEQ ID NO: 644009 - DNA, 25 bp, Mus musculus
gaccagtccaacgtgagacggatgc

SEQ ID NO: 644010 - DNA, 25 bp, Mus musculus
gaccagtcctaaaaagtgagcctga

SEQ ID NO: 644011 - DNA, 25 bp, Mus musculus
gaccagtcctaataagtgagcctga

SEQ ID NO: 644012 - DNA, 25 bp, Mus musculus
gaccagtcctccatgcagctgagga

SEQ ID NO: 644013 - DNA, 25 bp, Mus musculus
gaccagtcctccttgcagctgagga

SEQ ID NO: 644014 - DNA, 25 bp, Mus musculus
gaccagtcctttcatgctgatctgt

SEQ ID NO: 644015 - DNA, 25 bp, Mus musculus
gaccagtcctttgatgctgatctgt

SEQ ID NO: 644016 - DNA, 25 bp, Mus musculus
gaccagtctcacagcatggagccag

SEQ ID NO: 644017 - DNA, 25 bp, Mus musculus
gaccagtctcactgcatggagccag

SEQ ID NO: 644018 - DNA, 25 bp, Mus musculus
gaccagtgaagccaccgagatcatt

SEQ ID NO: 644019 - DNA, 25 bp, Mus musculus
gaccagtgaagcgaccgagatcatt

SEQ ID NO: 644020 - DNA, 25 bp, Mus musculus
gaccagtgacctctcacttttaaga

SEQ ID NO: 644021 - DNA, 25 bp, Mus musculus
gaccagtgacctgtcacttttaaga

SEQ ID NO: 644022 - DNA, 25 bp, Mus musculus
gaccagtgagatacccctataagcc

SEQ ID NO: 644023 - DNA, 25 bp, Mus musculus
gaccagtgagattcccctataagcc

SEQ ID NO: 644024 - DNA, 25 bp, Mus musculus
gaccagtgagggattgccaaagcgc

SEQ ID NO: 644025 - DNA, 25 bp, Mus musculus
gaccagtgagggtttgccaaagcgc

SEQ ID NO: 644026 - DNA, 25 bp, Mus musculus
gaccagtgatccctgtgctgaggat

SEQ ID NO: 644027 - DNA, 25 bp, Mus musculus
gaccagtgatccgtgtgctgaggat

SEQ ID NO: 644028 - DNA, 25 bp, Mus musculus
gaccagtgatttatatgggagggcc

SEQ ID NO: 644029 - DNA, 25 bp, Mus musculus
gaccagtgatttttatgggagggcc

SEQ ID NO: 644030 - DNA, 25 bp, Mus musculus
gaccagtgccatcaccctgggcaat

SEQ ID NO: 644031 - DNA, 25 bp, Mus musculus
gaccagtgccatgaccctgggcaat

SEQ ID NO: 644032 - DNA, 25 bp, Mus musculus
gaccagtgctgcaacagaagaccac

SEQ ID NO: 644033 - DNA, 25 bp, Mus musculus
gaccagtgctgctacagaagaccac

SEQ ID NO: 644034 - DNA, 25 bp, Mus musculus
gaccagtggaaacactgggtctacc

SEQ ID NO: 644035 - DNA, 25 bp, Mus musculus
gaccagtggaaagactgggtctacc

SEQ ID NO: 644036 - DNA, 25 bp, Mus musculus
gaccagtgtgaaagctctggttcca

SEQ ID NO: 644037 - DNA, 25 bp, Mus musculus
gaccagtgtgaatgctctggttcca

SEQ ID NO: 644038 - DNA, 25 bp, Mus musculus
gaccagtgtgtaaaagtgtccccac

SEQ ID NO: 644039 - DNA, 25 bp, Mus musculus
gaccagtgtgtataagtgtccccac

SEQ ID NO: 644040 - DNA, 25 bp, Mus musculus
gaccagttaaagaggcagcaagtgt

SEQ ID NO: 644041 - DNA, 25 bp, Mus musculus
gaccagttaaagtggcagcaagtgt

SEQ ID NO: 644042 - DNA, 25 bp, Mus musculus
gaccagttacctcttgatcacaaag

SEQ ID NO: 644043 - DNA, 25 bp, Mus musculus
gaccagttacctgttgatcacaaag

SEQ ID NO: 644044 - DNA, 25 bp, Mus musculus
gaccagttatgaaggctttggaccc

SEQ ID NO: 644045 - DNA, 25 bp, Mus musculus
gaccagttatgatggctttggaccc

SEQ ID NO: 644046 - DNA, 25 bp, Mus musculus
gaccagttcatccagctttccaaag

SEQ ID NO: 644047 - DNA, 25 bp, Mus musculus
gaccagttcatcgagctttccaaag

SEQ ID NO: 644048 - DNA, 25 bp, Mus musculus
gaccagttccgtcgcacaccataaa

SEQ ID NO: 644049 - DNA, 25 bp, Mus musculus
gaccagttccgtggcacaccataaa

SEQ ID NO: 644050 - DNA, 25 bp, Mus musculus
gaccagttccttcaaaatttcctca

SEQ ID NO: 644051 - DNA, 25 bp, Mus musculus
gaccagttccttgaaaatttcctca

SEQ ID NO: 644052 - DNA, 25 bp, Mus musculus
gaccagttgggtacatctttgacac

SEQ ID NO: 644053 - DNA, 25 bp, Mus musculus
gaccagttgggttcatctttgacac

SEQ ID NO: 644054 - DNA, 25 bp, Mus musculus
gaccagttgtgtatcttcagcacgg

SEQ ID NO: 644055 - DNA, 25 bp, Mus musculus
gaccagttgtgtttcttcagcacgg

SEQ ID NO: 644056 - DNA, 25 bp, Mus musculus
gaccagtttaagacagtgcagaccg

SEQ ID NO: 644057 - DNA, 25 bp, Mus musculus
gaccagtttaagagttccagctcca

SEQ ID NO: 644058 - DNA, 25 bp, Mus musculus
gaccagtttaagtcagtgcagaccg

SEQ ID NO: 644059 - DNA, 25 bp, Mus musculus
gaccagtttaagtgttccagctcca

SEQ ID NO: 644060 - DNA, 25 bp, Mus musculus
gaccagtttaatcaccttgttatca

SEQ ID NO: 644061 - DNA, 25 bp, Mus musculus
gaccagtttaatgaccttgttatca

SEQ ID NO: 644062 - DNA, 25 bp, Mus musculus
gaccataagcaccttgcacagcctg

SEQ ID NO: 644063 - DNA, 25 bp, Mus musculus
gaccataagcacgttgcacagcctg

SEQ ID NO: 644064 - DNA, 25 bp, Mus musculus
gaccatacaggtaggcctttccctg

SEQ ID NO: 644065 - DNA, 25 bp, Mus musculus
gaccatacaggttggcctttccctg

SEQ ID NO: 644066 - DNA, 25 bp, Mus musculus
gaccataccagcattagaagaacta

SEQ ID NO: 644067 - DNA, 25 bp, Mus musculus
gaccataccagctttagaagaacta

SEQ ID NO: 644068 - DNA, 25 bp, Mus musculus
gaccatagccagcacacactgaggc

SEQ ID NO: 644069 - DNA, 25 bp, Mus musculus
gaccatagccaggacacactgaggc

SEQ ID NO: 644070 - DNA, 25 bp, Mus musculus
gaccatattcgtcggcccatgaatg

SEQ ID NO: 644071 - DNA, 25 bp, Mus musculus
gaccatattcgtgggcccatgaatg

SEQ ID NO: 644072 - DNA, 25 bp, Mus musculus
gaccatcaaaccactagatgactgc

SEQ ID NO: 644073 - DNA, 25 bp, Mus musculus
gaccatcaaacctctagatgactgc

SEQ ID NO: 644074 - DNA, 25 bp, Mus musculus
gaccatcaatctatccgagttccag

SEQ ID NO: 644075 - DNA, 25 bp, Mus musculus
gaccatcaatctttccgagttccag

SEQ ID NO: 644076 - DNA, 25 bp, Mus musculus
gaccatcacatgcatgaagaatggg

SEQ ID NO: 644077 - DNA, 25 bp, Mus musculus
gaccatcacatggatgaagaatggg

SEQ ID NO: 644078 - DNA, 25 bp, Mus musculus
gaccatcagccgcatgacacctgag

SEQ ID NO: 644079 - DNA, 25 bp, Mus musculus
gaccatcagccggatgacacctgag

SEQ ID NO: 644080 - DNA, 25 bp, Mus musculus
gaccatcatcatctggaagctgacc

SEQ ID NO: 644081 - DNA, 25 bp, Mus musculus
gaccatcatcatgtggaagctgacc

SEQ ID NO: 644082 - DNA, 25 bp, Mus musculus
gaccatcatctaaaacatcctgctc

SEQ ID NO: 644083 - DNA, 25 bp, Mus musculus
gaccatcatctataacatcctgctc

SEQ ID NO: 644084 - DNA, 25 bp, Mus musculus
gaccatcatgaaactccaccagcag

SEQ ID NO: 644085 - DNA, 25 bp, Mus musculus
gaccatcatgaatctccaccagcag

SEQ ID NO: 644086 - DNA, 25 bp, Mus musculus
gaccatcatgtcaagcctgaacagg

SEQ ID NO: 644087 - DNA, 25 bp, Mus musculus
gaccatcatgtctagcctgaacagg

SEQ ID NO: 644088 - DNA, 25 bp, Mus musculus
gaccatccacaaccgctgtaaagac

SEQ ID NO: 644089 - DNA, 25 bp, Mus musculus
gaccatccacaagcgctgtaaagac

SEQ ID NO: 644090 - DNA, 25 bp, Mus musculus
gaccatcccagaaaacacaaaaggg

SEQ ID NO: 644091 - DNA, 25 bp, Mus musculus
gaccatcccagataacacaaaaggg

SEQ ID NO: 644092 - DNA, 25 bp, Mus musculus
gaccatccctgacgcttgtcgtggg

SEQ ID NO: 644093 - DNA, 25 bp, Mus musculus
gaccatccctgaggcttgtcgtggg

SEQ ID NO: 644094 - DNA, 25 bp, Mus musculus
gaccatccggcgagtgctttgggca

SEQ ID NO: 644095 - DNA, 25 bp, Mus musculus
gaccatccggcgtgtgctttgggca

SEQ ID NO: 644096 - DNA, 25 bp, Mus musculus
gaccatccgggaaaaaatcaacact

SEQ ID NO: 644097 - DNA, 25 bp, Mus musculus
gaccatccgggataaaatcaacact

SEQ ID NO: 644098 - DNA, 25 bp, Mus musculus
gaccatcctgatcggcattcccaat

SEQ ID NO: 644099 - DNA, 25 bp, Mus musculus
gaccatcctgatgggcattcccaat

SEQ ID NO: 644100 - DNA, 25 bp, Mus musculus
gaccatcgagttagttacccagcgg

SEQ ID NO: 644101 - DNA, 25 bp, Mus musculus
gaccatcgagtttgttacccagcgg

SEQ ID NO: 644102 - DNA, 25 bp, Mus musculus
gaccatcgtcagaggccttctcatg

SEQ ID NO: 644103 - DNA, 25 bp, Mus musculus
gaccatcgtcagtggccttctcatg

SEQ ID NO: 644104 - DNA, 25 bp, Mus musculus
gaccatctaacaccactttggtgga

SEQ ID NO: 644105 - DNA, 25 bp, Mus musculus
gaccatctaacagcactttggtgga

SEQ ID NO: 644106 - DNA, 25 bp, Mus musculus
gaccatctcagacggttgccccaaa

SEQ ID NO: 644107 - DNA, 25 bp, Mus musculus
gaccatctcagagggttgccccaaa

SEQ ID NO: 644108 - DNA, 25 bp, Mus musculus
gaccatctgcagctgaaagacatcc

SEQ ID NO: 644109 - DNA, 25 bp, Mus musculus
gaccatctgcaggtgaaagacatcc

SEQ ID NO: 644110 - DNA, 25 bp, Mus musculus
gaccatctgcatagagccattctca

SEQ ID NO: 644111 - DNA, 25 bp, Mus musculus
gaccatctgcattgagccattctca

SEQ ID NO: 644112 - DNA, 25 bp, Mus musculus
gaccatctgcttacccgaataccca

SEQ ID NO: 644113 - DNA, 25 bp, Mus musculus
gaccatctgctttcccgaataccca

SEQ ID NO: 644114 - DNA, 25 bp, Mus musculus
gaccatctgtttccctgagtacacg

SEQ ID NO: 644115 - DNA, 25 bp, Mus musculus
gaccatctgtttgcctgagtacacg

SEQ ID NO: 644116 - DNA, 25 bp, Mus musculus
gaccatcttagcagcaaagccatcc

SEQ ID NO: 644117 - DNA, 25 bp, Mus musculus
gaccatcttagctgcaaagccatcc

SEQ ID NO: 644118 - DNA, 25 bp, Mus musculus
gaccatcttgttagccatcgtagga

SEQ ID NO: 644119 - DNA, 25 bp, Mus musculus
gaccatcttgtttgccatcgtagga

SEQ ID NO: 644120 - DNA, 25 bp, Mus musculus
gaccatctttgtagttgagctgccg

SEQ ID NO: 644121 - DNA, 25 bp, Mus musculus
gaccatctttgttgttgagctgccg

SEQ ID NO: 644122 - DNA, 25 bp, Mus musculus
gaccatgaacaaaaagagggcagta

SEQ ID NO: 644123 - DNA, 25 bp, Mus musculus
gaccatgaacaataagagggcagta

SEQ ID NO: 644124 - DNA, 25 bp, Mus musculus
gaccatgaagaaagacgagcttaca

SEQ ID NO: 644125 - DNA, 25 bp, Mus musculus
gaccatgaagaatgacgagcttaca

SEQ ID NO: 644126 - DNA, 25 bp, Mus musculus
gaccatgaagacacatctctgcagt

SEQ ID NO: 644127 - DNA, 25 bp, Mus musculus
gaccatgaagacacccggcgtcttg

SEQ ID NO: 644128 - DNA, 25 bp, Mus musculus
gaccatgaagactcatctctgcagt

SEQ ID NO: 644129 - DNA, 25 bp, Mus musculus
gaccatgaagactcccggcgtcttg

SEQ ID NO: 644130 - DNA, 25 bp, Mus musculus
gaccatgacccacgtgttggcagga

SEQ ID NO: 644131 - DNA, 25 bp, Mus musculus
gaccatgacccaggtgttggcagga

SEQ ID NO: 644132 - DNA, 25 bp, Mus musculus
gaccatgacctgatctgttttctcc

SEQ ID NO: 644133 - DNA, 25 bp, Mus musculus
gaccatgacctgttctgttttctcc

SEQ ID NO: 644134 - DNA, 25 bp, Mus musculus
gaccatgagagcctggaacattcca

SEQ ID NO: 644135 - DNA, 25 bp, Mus musculus
gaccatgagagcgtggaacattcca

SEQ ID NO: 644136 - DNA, 25 bp, Mus musculus
gaccatgaggagcaattggctgctt

SEQ ID NO: 644137 - DNA, 25 bp, Mus musculus
gaccatgaggaggaattggctgctt

SEQ ID NO: 644138 - DNA, 25 bp, Mus musculus
gaccatgatccccactcagtgcaat

SEQ ID NO: 644139 - DNA, 25 bp, Mus musculus
gaccatgatcccgactcagtgcaat

SEQ ID NO: 644140 - DNA, 25 bp, Mus musculus
gaccatgatggtcacgatgctgaga

SEQ ID NO: 644141 - DNA, 25 bp, Mus musculus
gaccatgatggtgacgatgctgaga

SEQ ID NO: 644142 - DNA, 25 bp, Mus musculus
gaccatgatgtgaggtccgggccat

SEQ ID NO: 644143 - DNA, 25 bp, Mus musculus
gaccatgatgtgtggtccgggccat

SEQ ID NO: 644144 - DNA, 25 bp, Mus musculus
gaccatgattctcccgggcacagct

SEQ ID NO: 644145 - DNA, 25 bp, Mus musculus
gaccatgattctgccgggcacagct

SEQ ID NO: 644146 - DNA, 25 bp, Mus musculus
gaccatgcaatgctagcttttctgg

SEQ ID NO: 644147 - DNA, 25 bp, Mus musculus
gaccatgcaatggtagcttttctgg

SEQ ID NO: 644148 - DNA, 25 bp, Mus musculus
gaccatgcaccaccagtctgttctg

SEQ ID NO: 644149 - DNA, 25 bp, Mus musculus
gaccatgcaccagcagtctgttctg

SEQ ID NO: 644150 - DNA, 25 bp, Mus musculus
gaccatgcagatcatgtctactctg

SEQ ID NO: 644151 - DNA, 25 bp, Mus musculus
gaccatgcagatgatgtctactctg

SEQ ID NO: 644152 - DNA, 25 bp, Mus musculus
gaccatgccattctcaccaggacaa

SEQ ID NO: 644153 - DNA, 25 bp, Mus musculus
gaccatgccattgtcaccaggacaa

SEQ ID NO: 644154 - DNA, 25 bp, Mus musculus
gaccatgcccagcatatccagcaga

SEQ ID NO: 644155 - DNA, 25 bp, Mus musculus
gaccatgcccaggatatccagcaga

SEQ ID NO: 644156 - DNA, 25 bp, Mus musculus
gaccatgccgtgctgctacaggtga

SEQ ID NO: 644157 - DNA, 25 bp, Mus musculus
gaccatgccgtggtgctacaggtga

SEQ ID NO: 644158 - DNA, 25 bp, Mus musculus
gaccatgcgctacatgccttgacag

SEQ ID NO: 644159 - DNA, 25 bp, Mus musculus
gaccatgcgctagatgccttgacag

SEQ ID NO: 644160 - DNA, 25 bp, Mus musculus
gaccatgctctgatgaagccccaca

SEQ ID NO: 644161 - DNA, 25 bp, Mus musculus
gaccatgctctgttgaagccccaca

SEQ ID NO: 644162 - DNA, 25 bp, Mus musculus
gaccatgctggacattacactctgc

SEQ ID NO: 644163 - DNA, 25 bp, Mus musculus
gaccatgctggacctactgaaccag

SEQ ID NO: 644164 - DNA, 25 bp, Mus musculus
gaccatgctggagattacactctgc

SEQ ID NO: 644165 - DNA, 25 bp, Mus musculus
gaccatgctggagctactgaaccag

SEQ ID NO: 644166 - DNA, 25 bp, Mus musculus
gaccatggaagacatccgggacaaa

SEQ ID NO: 644167 - DNA, 25 bp, Mus musculus
gaccatggaagagatccgggacaaa

SEQ ID NO: 644168 - DNA, 25 bp, Mus musculus
gaccatggacttaggcagtgactaa

SEQ ID NO: 644169 - DNA, 25 bp, Mus musculus
gaccatggactttggcagtgactaa

SEQ ID NO: 644170 - DNA, 25 bp, Mus musculus
gaccatggagcacaaattgtgtata

SEQ ID NO: 644171 - DNA, 25 bp, Mus musculus
gaccatggagcagaaattgtgtata

SEQ ID NO: 644172 - DNA, 25 bp, Mus musculus
gaccatggccgaaccgctgaaggag

SEQ ID NO: 644173 - DNA, 25 bp, Mus musculus
gaccatggccgatccgctgaaggag

SEQ ID NO: 644174 - DNA, 25 bp, Mus musculus
gaccatggcggccactacagctaac

SEQ ID NO: 644175 - DNA, 25 bp, Mus musculus
gaccatggcggcgactacagctaac

SEQ ID NO: 644176 - DNA, 25 bp, Mus musculus
gaccatggctgtcagttccagtgtg

SEQ ID NO: 644177 - DNA, 25 bp, Mus musculus
gaccatggctgtgagttccagtgtg

SEQ ID NO: 644178 - DNA, 25 bp, Mus musculus
gaccatgggcaaagccacagccatc

SEQ ID NO: 644179 - DNA, 25 bp, Mus musculus
gaccatgggcaatgccacagccatc

SEQ ID NO: 644180 - DNA, 25 bp, Mus musculus
gaccatgggcatctccgacgtgtac

SEQ ID NO: 644181 - DNA, 25 bp, Mus musculus
gaccatgggcatgtccgacgtgtac

SEQ ID NO: 644182 - DNA, 25 bp, Mus musculus
gaccatggtcagaggctggataccc

SEQ ID NO: 644183 - DNA, 25 bp, Mus musculus
gaccatggtcagtggctggataccc

SEQ ID NO: 644184 - DNA, 25 bp, Mus musculus
gaccatggtgtcaacccagtcaagg

SEQ ID NO: 644185 - DNA, 25 bp, Mus musculus
gaccatggtgtctacccagtcaagg

SEQ ID NO: 644186 - DNA, 25 bp, Mus musculus
gaccatgtaccaaggatgggtcctt

SEQ ID NO: 644187 - DNA, 25 bp, Mus musculus
gaccatgtaccatggatgggtcctt

SEQ ID NO: 644188 - DNA, 25 bp, Mus musculus
gaccatgtaggcctcagattagctg

SEQ ID NO: 644189 - DNA, 25 bp, Mus musculus
gaccatgtaggcgtcagattagctg

SEQ ID NO: 644190 - DNA, 25 bp, Mus musculus
gaccatgtcagcctcactggcatct

SEQ ID NO: 644191 - DNA, 25 bp, Mus musculus
gaccatgtcagcgtcactggcatct

SEQ ID NO: 644192 - DNA, 25 bp, Mus musculus
gaccatgtccagatgatagtgctag

SEQ ID NO: 644193 - DNA, 25 bp, Mus musculus
gaccatgtccagttgatagtgctag

SEQ ID NO: 644194 - DNA, 25 bp, Mus musculus
gaccatgtctataatggaccacagc

SEQ ID NO: 644195 - DNA, 25 bp, Mus musculus
gaccatgtctattatggaccacagc

SEQ ID NO: 644196 - DNA, 25 bp, Mus musculus
gaccatgtcttgaccattctctgta

SEQ ID NO: 644197 - DNA, 25 bp, Mus musculus
gaccatgtcttgtccattctctgta

SEQ ID NO: 644198 - DNA, 25 bp, Mus musculus
gaccatgtttgcctcagttacttgc

SEQ ID NO: 644199 - DNA, 25 bp, Mus musculus
gaccatgtttgcgtcagttacttgc

SEQ ID NO: 644200 - DNA, 25 bp, Mus musculus
gaccattaaccacaccattggtggt

SEQ ID NO: 644201 - DNA, 25 bp, Mus musculus
gaccattaaccagaccattggtggt

SEQ ID NO: 644202 - DNA, 25 bp, Mus musculus
gaccattaatcgatctgctcgactg

SEQ ID NO: 644203 - DNA, 25 bp, Mus musculus
gaccattaatcgttctgctcgactg

SEQ ID NO: 644204 - DNA, 25 bp, Mus musculus
gaccattcccagatgatgtctgcat

SEQ ID NO: 644205 - DNA, 25 bp, Mus musculus
gaccattcccagttgatgtctgcat

SEQ ID NO: 644206 - DNA, 25 bp, Mus musculus
gaccattccccgagagacctgtgaa

SEQ ID NO: 644207 - DNA, 25 bp, Mus musculus
gaccattccccgtgagacctgtgaa

SEQ ID NO: 644208 - DNA, 25 bp, Mus musculus
gaccattcccctattcgcttctgtg

SEQ ID NO: 644209 - DNA, 25 bp, Mus musculus
gaccattccccttttcgcttctgtg

SEQ ID NO: 644210 - DNA, 25 bp, Mus musculus
gaccattcctgaagtctcaaaggag

SEQ ID NO: 644211 - DNA, 25 bp, Mus musculus
gaccattcctgatgtctcaaaggag

SEQ ID NO: 644212 - DNA, 25 bp, Mus musculus
gaccattctataaaggactgctgct

SEQ ID NO: 644213 - DNA, 25 bp, Mus musculus
gaccattctatataggactgctgct

SEQ ID NO: 644214 - DNA, 25 bp, Mus musculus
gaccattctgatacaactgcttttc

SEQ ID NO: 644215 - DNA, 25 bp, Mus musculus
gaccattctgattcaactgcttttc

SEQ ID NO: 644216 - DNA, 25 bp, Mus musculus
gaccattctggccatcgtgactaca

SEQ ID NO: 644217 - DNA, 25 bp, Mus musculus
gaccattctggcgatcgtgactaca

SEQ ID NO: 644218 - DNA, 25 bp, Mus musculus
gaccattctgggaagagtgccaacg

SEQ ID NO: 644219 - DNA, 25 bp, Mus musculus
gaccattctgggtagagtgccaacg

SEQ ID NO: 644220 - DNA, 25 bp, Mus musculus
gaccattgaactccatcgtcgccgt

SEQ ID NO: 644221 - DNA, 25 bp, Mus musculus
gaccattgaactgcatcgtcgccgt

SEQ ID NO: 644222 - DNA, 25 bp, Mus musculus
gaccattgctgtcgacttttcattg

SEQ ID NO: 644223 - DNA, 25 bp, Mus musculus
gaccattgctgtggacttttcattg

SEQ ID NO: 644224 - DNA, 25 bp, Mus musculus
gaccattggcaacggtaactttgcc

SEQ ID NO: 644225 - DNA, 25 bp, Mus musculus
gaccattggcaagggtaactttgcc

SEQ ID NO: 644226 - DNA, 25 bp, Mus musculus
gaccattgtcaacccagactatcaa

SEQ ID NO: 644227 - DNA, 25 bp, Mus musculus
gaccattgtcaagccagactatcaa

SEQ ID NO: 644228 - DNA, 25 bp, Mus musculus
gaccatttagctacctctgcaccgt

SEQ ID NO: 644229 - DNA, 25 bp, Mus musculus
gaccatttagcttcctctgcaccgt

SEQ ID NO: 644230 - DNA, 25 bp, Mus musculus
gaccatttatgtctcaatgagaggc

SEQ ID NO: 644231 - DNA, 25 bp, Mus musculus
gaccatttatgtgtcaatgagaggc

SEQ ID NO: 644232 - DNA, 25 bp, Mus musculus
gaccatttcagacgagacctcggag

SEQ ID NO: 644233 - DNA, 25 bp, Mus musculus
gaccatttcagaggagacctcggag

SEQ ID NO: 644234 - DNA, 25 bp, Mus musculus
gaccatttctatactggatgtgcct

SEQ ID NO: 644235 - DNA, 25 bp, Mus musculus
gaccatttctattctggatgtgcct

SEQ ID NO: 644236 - DNA, 25 bp, Mus musculus
gaccatttgaagatctgtccccagg

SEQ ID NO: 644237 - DNA, 25 bp, Mus musculus
gaccatttgaagttctgtccccagg

SEQ ID NO: 644238 - DNA, 25 bp, Mus musculus
gaccatttgcagagcctgaccacct

SEQ ID NO: 644239 - DNA, 25 bp, Mus musculus
gaccatttgcagtgcctgaccacct

SEQ ID NO: 644240 - DNA, 25 bp, Mus musculus
gaccatttggagctagttctcaccg

SEQ ID NO: 644241 - DNA, 25 bp, Mus musculus
gaccatttggaggtagttctcaccg

SEQ ID NO: 644242 - DNA, 25 bp, Mus musculus
gaccatttgtaaactgttggccaca

SEQ ID NO: 644243 - DNA, 25 bp, Mus musculus
gaccatttgtaatctgttggccaca

SEQ ID NO: 644244 - DNA, 25 bp, Mus musculus
gaccattttccaactactgcactgg

SEQ ID NO: 644245 - DNA, 25 bp, Mus musculus
gaccattttccatctactgcactgg

SEQ ID NO: 644246 - DNA, 25 bp, Mus musculus
gacccaaaactcattgcaggctgag

SEQ ID NO: 644247 - DNA, 25 bp, Mus musculus
gacccaaaactctttgcaggctgag

SEQ ID NO: 644248 - DNA, 25 bp, Mus musculus
gacccaaacaggagacattcacctt

SEQ ID NO: 644249 - DNA, 25 bp, Mus musculus
gacccaaacaggtgacattcacctt

SEQ ID NO: 644250 - DNA, 25 bp, Mus musculus
gacccaaaccgacgaagtaactgtg

SEQ ID NO: 644251 - DNA, 25 bp, Mus musculus
gacccaaaccgaggaagtaactgtg

SEQ ID NO: 644252 - DNA, 25 bp, Mus musculus
gacccaaacgacatttcaccatcat

SEQ ID NO: 644253 - DNA, 25 bp, Mus musculus
gacccaaacgacttttcaccatcat

SEQ ID NO: 644254 - DNA, 25 bp, Mus musculus
gacccaaagctaaacttcaaggtgg

SEQ ID NO: 644255 - DNA, 25 bp, Mus musculus
gacccaaagctatacttcaaggtgg

SEQ ID NO: 644256 - DNA, 25 bp, Mus musculus
gacccaaatgggaccagtagtttgc

SEQ ID NO: 644257 - DNA, 25 bp, Mus musculus
gacccaaatgggtccagtagtttgc

SEQ ID NO: 644258 - DNA, 25 bp, Mus musculus
gacccaacagtactaattggctcag

SEQ ID NO: 644259 - DNA, 25 bp, Mus musculus
gacccaacagtactctgatcatcag

SEQ ID NO: 644260 - DNA, 25 bp, Mus musculus
gacccaacagtagtaattggctcag

SEQ ID NO: 644261 - DNA, 25 bp, Mus musculus
gacccaacagtagtctgatcatcag

SEQ ID NO: 644262 - DNA, 25 bp, Mus musculus
gacccaacagtgaaacatagcacct

SEQ ID NO: 644263 - DNA, 25 bp, Mus musculus
gacccaacagtgtaacatagcacct

SEQ ID NO: 644264 - DNA, 25 bp, Mus musculus
gacccaacctgtcgctatggtaaaa

SEQ ID NO: 644265 - DNA, 25 bp, Mus musculus
gacccaacctgtggctatggtaaaa

SEQ ID NO: 644266 - DNA, 25 bp, Mus musculus
gacccaactagtctagctatcgcca

SEQ ID NO: 644267 - DNA, 25 bp, Mus musculus
gacccaactagtgtagctatcgcca

SEQ ID NO: 644268 - DNA, 25 bp, Mus musculus
gacccaagaatgaagtaggagacca

SEQ ID NO: 644269 - DNA, 25 bp, Mus musculus
gacccaagaatgtagtaggagacca

SEQ ID NO: 644270 - DNA, 25 bp, Mus musculus
gacccaagagatcagacttacaagc

SEQ ID NO: 644271 - DNA, 25 bp, Mus musculus
gacccaagagatgagacttacaagc

SEQ ID NO: 644272 - DNA, 25 bp, Mus musculus
gacccaaggagcagccagtctctgc

SEQ ID NO: 644273 - DNA, 25 bp, Mus musculus
gacccaaggagctgccagtctctgc

SEQ ID NO: 644274 - DNA, 25 bp, Mus musculus
gacccaaggctgcaattgatcacca

SEQ ID NO: 644275 - DNA, 25 bp, Mus musculus
gacccaaggctggaattgatcacca

SEQ ID NO: 644276 - DNA, 25 bp, Mus musculus
gacccaaggtttaatcagatcccaa

SEQ ID NO: 644277 - DNA, 25 bp, Mus musculus
gacccaaggttttatcagatcccaa

SEQ ID NO: 644278 - DNA, 25 bp, Mus musculus
gacccaagtcagaaagaaccatttg

SEQ ID NO: 644279 - DNA, 25 bp, Mus musculus
gacccaagtcagtaagaaccatttg

SEQ ID NO: 644280 - DNA, 25 bp, Mus musculus
gacccaagtggtaagattggtccca

SEQ ID NO: 644281 - DNA, 25 bp, Mus musculus
gacccaagtggttagattggtccca

SEQ ID NO: 644282 - DNA, 25 bp, Mus musculus
gacccaagttggatgaagcctagga

SEQ ID NO: 644283 - DNA, 25 bp, Mus musculus
gacccaagttggttgaagcctagga

SEQ ID NO: 644284 - DNA, 25 bp, Mus musculus
gacccaatatagattgcaaagcctg

SEQ ID NO: 644285 - DNA, 25 bp, Mus musculus
gacccaatatagtttgcaaagcctg

SEQ ID NO: 644286 - DNA, 25 bp, Mus musculus
gacccaatattaaggctctgcatgg

SEQ ID NO: 644287 - DNA, 25 bp, Mus musculus
gacccaatattatggctctgcatgg

SEQ ID NO: 644288 - DNA, 25 bp, Mus musculus
gacccaatatttagcagaacttctt

SEQ ID NO: 644289 - DNA, 25 bp, Mus musculus
gacccaatattttgcagaacttctt

SEQ ID NO: 644290 - DNA, 25 bp, Mus musculus
gacccaatcatcaagcttttgtatg

SEQ ID NO: 644291 - DNA, 25 bp, Mus musculus
gacccaatcatctagcttttgtatg

SEQ ID NO: 644292 - DNA, 25 bp, Mus musculus
gacccaatcctgagctccatagaaa

SEQ ID NO: 644293 - DNA, 25 bp, Mus musculus
gacccaatcctgtgctccatagaaa

SEQ ID NO: 644294 - DNA, 25 bp, Mus musculus
gacccaatgactaggttcccgctga

SEQ ID NO: 644295 - DNA, 25 bp, Mus musculus
gacccaatgacttggttcccgctga

SEQ ID NO: 644296 - DNA, 25 bp, Mus musculus
gacccaatgctgctttataacaaaa

SEQ ID NO: 644297 - DNA, 25 bp, Mus musculus
gacccaatgctggtttataacaaaa

SEQ ID NO: 644298 - DNA, 25 bp, Mus musculus
gacccaatggagagttccctgggag

SEQ ID NO: 644299 - DNA, 25 bp, Mus musculus
gacccaatggagtgttccctgggag

SEQ ID NO: 644300 - DNA, 25 bp, Mus musculus
gacccaattcgaattctgccgtgca

SEQ ID NO: 644301 - DNA, 25 bp, Mus musculus
gacccaattcgatttctgccgtgca

SEQ ID NO: 644302 - DNA, 25 bp, Mus musculus
gacccacaagcaaggaagtctgagt

SEQ ID NO: 644303 - DNA, 25 bp, Mus musculus
gacccacaagcatggaagtctgagt

SEQ ID NO: 644304 - DNA, 25 bp, Mus musculus
gacccacacaccagggtctgcaagg

SEQ ID NO: 644305 - DNA, 25 bp, Mus musculus
gacccacacacctgggtctgcaagg

SEQ ID NO: 644306 - DNA, 25 bp, Mus musculus
gacccacacgatcctttctaaacta

SEQ ID NO: 644307 - DNA, 25 bp, Mus musculus
gacccacacgatgctttctaaacta

SEQ ID NO: 644308 - DNA, 25 bp, Mus musculus
gacccacacggcagagaacactggg

SEQ ID NO: 644309 - DNA, 25 bp, Mus musculus
gacccacacggctgagaacactggg

SEQ ID NO: 644310 - DNA, 25 bp, Mus musculus
gacccacacttacgaagttggaagt

SEQ ID NO: 644311 - DNA, 25 bp, Mus musculus
gacccacacttaggaagttggaagt

SEQ ID NO: 644312 - DNA, 25 bp, Mus musculus
gacccacagtttctgaaactcacca

SEQ ID NO: 644313 - DNA, 25 bp, Mus musculus
gacccacagtttgtgaaactcacca

SEQ ID NO: 644314 - DNA, 25 bp, Mus musculus
gacccacatcacagtagttgcccat

SEQ ID NO: 644315 - DNA, 25 bp, Mus musculus
gacccacatcactgtagttgcccat

SEQ ID NO: 644316 - DNA, 25 bp, Mus musculus
gacccacatcagagtcgtagtgaaa

SEQ ID NO: 644317 - DNA, 25 bp, Mus musculus
gacccacatcagtgtcgtagtgaaa

SEQ ID NO: 644318 - DNA, 25 bp, Mus musculus
gacccacatggcaccagaagtggtg

SEQ ID NO: 644319 - DNA, 25 bp, Mus musculus
gacccacatggctccagaagtggtg

SEQ ID NO: 644320 - DNA, 25 bp, Mus musculus
gacccacattggaacagtgaacccg

SEQ ID NO: 644321 - DNA, 25 bp, Mus musculus
gacccacattggtacagtgaacccg

SEQ ID NO: 644322 - DNA, 25 bp, Mus musculus
gacccaccgacgattccttgagaag

SEQ ID NO: 644323 - DNA, 25 bp, Mus musculus
gacccaccgacgtttccttgagaag

SEQ ID NO: 644324 - DNA, 25 bp, Mus musculus
gacccacctgatctctataccgaga

SEQ ID NO: 644325 - DNA, 25 bp, Mus musculus
gacccacctgatgtctataccgaga

SEQ ID NO: 644326 - DNA, 25 bp, Mus musculus
gacccacgtgctacttatttcgcct

SEQ ID NO: 644327 - DNA, 25 bp, Mus musculus
gacccacgtgcttcttatttcgcct

SEQ ID NO: 644328 - DNA, 25 bp, Mus musculus
gacccactcatcatggtctttgagt

SEQ ID NO: 644329 - DNA, 25 bp, Mus musculus
gacccactcatcttggtctttgagt

SEQ ID NO: 644330 - DNA, 25 bp, Mus musculus
gacccactccctcagggcgtgaaag

SEQ ID NO: 644331 - DNA, 25 bp, Mus musculus
gacccactccctgagggcgtgaaag

SEQ ID NO: 644332 - DNA, 25 bp, Mus musculus
gacccactgcctctggatctgaagg

SEQ ID NO: 644333 - DNA, 25 bp, Mus musculus
gacccactgcctgtggatctgaagg

SEQ ID NO: 644334 - DNA, 25 bp, Mus musculus
gacccactgcgaagtggacattgac

SEQ ID NO: 644335 - DNA, 25 bp, Mus musculus
gacccactgcgatgtggacattgac

SEQ ID NO: 644336 - DNA, 25 bp, Mus musculus
gacccagaaactaaaccatcttgag

SEQ ID NO: 644337 - DNA, 25 bp, Mus musculus
gacccagaaacttaaccatcttgag

SEQ ID NO: 644338 - DNA, 25 bp, Mus musculus
gacccagaatctcacgtaaccttta

SEQ ID NO: 644339 - DNA, 25 bp, Mus musculus
gacccagaatctgacgtaaccttta

SEQ ID NO: 644340 - DNA, 25 bp, Mus musculus
gacccagacaccagtgtggtctatg

SEQ ID NO: 644341 - DNA, 25 bp, Mus musculus
gacccagacacctgtgtggtctatg

SEQ ID NO: 644342 - DNA, 25 bp, Mus musculus
gacccagacctaagtgcagtgtcct

SEQ ID NO: 644343 - DNA, 25 bp, Mus musculus
gacccagacctatgtgcagtgtcct

SEQ ID NO: 644344 - DNA, 25 bp, Mus musculus
gacccagagattcccttagtgtcca

SEQ ID NO: 644345 - DNA, 25 bp, Mus musculus
gacccagagattgccttagtgtcca

SEQ ID NO: 644346 - DNA, 25 bp, Mus musculus
gacccagagcagagggccttgttcc

SEQ ID NO: 644347 - DNA, 25 bp, Mus musculus
gacccagagcagtgggccttgttcc

SEQ ID NO: 644348 - DNA, 25 bp, Mus musculus
gacccagaggatcacaggacggaaa

SEQ ID NO: 644349 - DNA, 25 bp, Mus musculus
gacccagaggatgacaggacggaaa

SEQ ID NO: 644350 - DNA, 25 bp, Mus musculus
gacccagatactctatgtgatgctt

SEQ ID NO: 644351 - DNA, 25 bp, Mus musculus
gacccagatactgtatgtgatgctt

SEQ ID NO: 644352 - DNA, 25 bp, Mus musculus
gacccagatgctagctacatggcag

SEQ ID NO: 644353 - DNA, 25 bp, Mus musculus
gacccagatgcttgctacatggcag

SEQ ID NO: 644354 - DNA, 25 bp, Mus musculus
gacccagattcaagcaataaaacat

SEQ ID NO: 644355 - DNA, 25 bp, Mus musculus
gacccagattcatgcaataaaacat

SEQ ID NO: 644356 - DNA, 25 bp, Mus musculus
gacccagcaacaatggacaagccca

SEQ ID NO: 644357 - DNA, 25 bp, Mus musculus
gacccagcaacattggacaagccca

SEQ ID NO: 644358 - DNA, 25 bp, Mus musculus
gacccagcaggacacgaggcctgct

SEQ ID NO: 644359 - DNA, 25 bp, Mus musculus
gacccagcaggagacgaggcctgct

SEQ ID NO: 644360 - DNA, 25 bp, Mus musculus
gacccagcatctccaaaatatcgag

SEQ ID NO: 644361 - DNA, 25 bp, Mus musculus
gacccagcatctgcaaaatatcgag

SEQ ID NO: 644362 - DNA, 25 bp, Mus musculus
gacccagccaaaccgtgagaagatt

SEQ ID NO: 644363 - DNA, 25 bp, Mus musculus
gacccagccaaagcgtgagaagatt

SEQ ID NO: 644364 - DNA, 25 bp, Mus musculus
gacccagccaagaggaaggccaacc

SEQ ID NO: 644365 - DNA, 25 bp, Mus musculus
gacccagccaagtggaaggccaacc

SEQ ID NO: 644366 - DNA, 25 bp, Mus musculus
gacccagcccacactattttttgtt

SEQ ID NO: 644367 - DNA, 25 bp, Mus musculus
gacccagcccactctattttttgtt

SEQ ID NO: 644368 - DNA, 25 bp, Mus musculus
gacccagcccggaggcgaatgctga

SEQ ID NO: 644369 - DNA, 25 bp, Mus musculus
gacccagcccggtggcgaatgctga

SEQ ID NO: 644370 - DNA, 25 bp, Mus musculus
gacccagcctagaatggagcattca

SEQ ID NO: 644371 - DNA, 25 bp, Mus musculus
gacccagcctagagttgagggcaag

SEQ ID NO: 644372 - DNA, 25 bp, Mus musculus
gacccagcctagtatggagcattca

SEQ ID NO: 644373 - DNA, 25 bp, Mus musculus
gacccagcctagtgttgagggcaag

SEQ ID NO: 644374 - DNA, 25 bp, Mus musculus
gacccagcctctcggattaatcccg

SEQ ID NO: 644375 - DNA, 25 bp, Mus musculus
gacccagcctctgggattaatcccg

SEQ ID NO: 644376 - DNA, 25 bp, Mus musculus
gacccagcgctaactagaagtgcag

SEQ ID NO: 644377 - DNA, 25 bp, Mus musculus
gacccagcgctatctagaagtgcag

SEQ ID NO: 644378 - DNA, 25 bp, Mus musculus
gacccagcggagagccttgctgcct

SEQ ID NO: 644379 - DNA, 25 bp, Mus musculus
gacccagcggagtgccttgctgcct

SEQ ID NO: 644380 - DNA, 25 bp, Mus musculus
gacccagctaaaaggaaggctcagc

SEQ ID NO: 644381 - DNA, 25 bp, Mus musculus
gacccagctaaatggaaggctcagc

SEQ ID NO: 644382 - DNA, 25 bp, Mus musculus
gacccagctgctatgggctcactac

SEQ ID NO: 644383 - DNA, 25 bp, Mus musculus
gacccagctgctttgggctcactac

SEQ ID NO: 644384 - DNA, 25 bp, Mus musculus
gacccagctgtgcaaatggcaccaa

SEQ ID NO: 644385 - DNA, 25 bp, Mus musculus
gacccagctgtggaaatggcaccaa

SEQ ID NO: 644386 - DNA, 25 bp, Mus musculus
gacccaggagagaaacctgtcatga

SEQ ID NO: 644387 - DNA, 25 bp, Mus musculus
gacccaggagagacggactaggacc

SEQ ID NO: 644388 - DNA, 25 bp, Mus musculus
gacccaggagagtaacctgtcatga

SEQ ID NO: 644389 - DNA, 25 bp, Mus musculus
gacccaggagagtcggactaggacc

SEQ ID NO: 644390 - DNA, 25 bp, Mus musculus
gacccaggcagacttgctgttgaaa

SEQ ID NO: 644391 - DNA, 25 bp, Mus musculus
gacccaggcagagttgctgttgaaa

SEQ ID NO: 644392 - DNA, 25 bp, Mus musculus
gacccaggctcacataagctctcag

SEQ ID NO: 644393 - DNA, 25 bp, Mus musculus
gacccaggctcagataagctctcag

SEQ ID NO: 644394 - DNA, 25 bp, Mus musculus
gacccaggctggagggcagggcttc

SEQ ID NO: 644395 - DNA, 25 bp, Mus musculus
gacccaggctggtgggcagggcttc

SEQ ID NO: 644396 - DNA, 25 bp, Mus musculus
gacccagggctcaatcagatgctac

SEQ ID NO: 644397 - DNA, 25 bp, Mus musculus
gacccagggctctatcagatgctac

SEQ ID NO: 644398 - DNA, 25 bp, Mus musculus
gacccaggtcctaggttcacatgga

SEQ ID NO: 644399 - DNA, 25 bp, Mus musculus
gacccaggtccttggttcacatgga

SEQ ID NO: 644400 - DNA, 25 bp, Mus musculus
gacccagtaaacagactgtctccag

SEQ ID NO: 644401 - DNA, 25 bp, Mus musculus
gacccagtaaactgactgtctccag

SEQ ID NO: 644402 - DNA, 25 bp, Mus musculus
gacccagtacgaagtcctgcctagc

SEQ ID NO: 644403 - DNA, 25 bp, Mus musculus
gacccagtacgatgtcctgcctagc

SEQ ID NO: 644404 - DNA, 25 bp, Mus musculus
gacccagtagcacgtcagctcgctg

SEQ ID NO: 644405 - DNA, 25 bp, Mus musculus
gacccagtagcaggtcagctcgctg

SEQ ID NO: 644406 - DNA, 25 bp, Mus musculus
gacccagtatccagatgtcaatcat

SEQ ID NO: 644407 - DNA, 25 bp, Mus musculus
gacccagtatcctgatgtcaatcat

SEQ ID NO: 644408 - DNA, 25 bp, Mus musculus
gacccagtgataatcggctgcctga

SEQ ID NO: 644409 - DNA, 25 bp, Mus musculus
gacccagtgatattcggctgcctga

SEQ ID NO: 644410 - DNA, 25 bp, Mus musculus
gacccagtgggcacctccttggttc

SEQ ID NO: 644411 - DNA, 25 bp, Mus musculus
gacccagtgggctcctccttggttc

SEQ ID NO: 644412 - DNA, 25 bp, Mus musculus
gacccagttgccaatgtccgcttca

SEQ ID NO: 644413 - DNA, 25 bp, Mus musculus
gacccagttgcctatgtccgcttca

SEQ ID NO: 644414 - DNA, 25 bp, Mus musculus
gacccagtttccaactttggatata

SEQ ID NO: 644415 - DNA, 25 bp, Mus musculus
gacccagtttcctactttggatata

SEQ ID NO: 644416 - DNA, 25 bp, Mus musculus
gacccagtttctaggctgtctgtga

SEQ ID NO: 644417 - DNA, 25 bp, Mus musculus
gacccagtttcttggctgtctgtga

SEQ ID NO: 644418 - DNA, 25 bp, Mus musculus
gacccataccacagtggctatgaca

SEQ ID NO: 644419 - DNA, 25 bp, Mus musculus
gacccataccactgtggctatgaca

SEQ ID NO: 644420 - DNA, 25 bp, Mus musculus
gacccatagactcacccttacggaa

SEQ ID NO: 644421 - DNA, 25 bp, Mus musculus
gacccatagactgacccttacggaa

SEQ ID NO: 644422 - DNA, 25 bp, Mus musculus
gacccatcaaagcaagatgagctga

SEQ ID NO: 644423 - DNA, 25 bp, Mus musculus
gacccatcaaaggaagatgagctga

SEQ ID NO: 644424 - DNA, 25 bp, Mus musculus
gacccatcatggagttacacccaga

SEQ ID NO: 644425 - DNA, 25 bp, Mus musculus
gacccatcatggtgttacacccaga

SEQ ID NO: 644426 - DNA, 25 bp, Mus musculus
gacccatccgtcagtggttccagga

SEQ ID NO: 644427 - DNA, 25 bp, Mus musculus
gacccatccgtctgtggttccagga

SEQ ID NO: 644428 - DNA, 25 bp, Mus musculus
gacccatcctgaacttgagccagag

SEQ ID NO: 644429 - DNA, 25 bp, Mus musculus
gacccatcctgatcttgagccagag

SEQ ID NO: 644430 - DNA, 25 bp, Mus musculus
gacccatctgtgaatcatgcagaca

SEQ ID NO: 644431 - DNA, 25 bp, Mus musculus
gacccatctgtgtatcatgcagaca

SEQ ID NO: 644432 - DNA, 25 bp, Mus musculus
gacccatgcggactgcccgcagctc

SEQ ID NO: 644433 - DNA, 25 bp, Mus musculus
gacccatgcggagtgcccgcagctc

SEQ ID NO: 644434 - DNA, 25 bp, Mus musculus
gacccatgctcacggacctggaaaa

SEQ ID NO: 644435 - DNA, 25 bp, Mus musculus
gacccatgctcagggacctggaaaa

SEQ ID NO: 644436 - DNA, 25 bp, Mus musculus
gacccatgctgaattctgcccttcg

SEQ ID NO: 644437 - DNA, 25 bp, Mus musculus
gacccatgctgatttctgcccttcg

SEQ ID NO: 644438 - DNA, 25 bp, Mus musculus
gacccattatcacctcatgatgttg

SEQ ID NO: 644439 - DNA, 25 bp, Mus musculus
gacccattatcagctcatgatgttg

SEQ ID NO: 644440 - DNA, 25 bp, Mus musculus
gacccattcggtcagcacgcggaat

SEQ ID NO: 644441 - DNA, 25 bp, Mus musculus
gacccattcggtgagcacgcggaat

SEQ ID NO: 644442 - DNA, 25 bp, Mus musculus
gacccattggagaattcagaagcaa

SEQ ID NO: 644443 - DNA, 25 bp, Mus musculus
gacccattggagtattcagaagcaa

SEQ ID NO: 644444 - DNA, 25 bp, Mus musculus
gacccatttcgaagaccaagaaccc

SEQ ID NO: 644445 - DNA, 25 bp, Mus musculus
gacccatttcgatgaccaagaaccc

SEQ ID NO: 644446 - DNA, 25 bp, Mus musculus
gaccccaaacgaagcaatggcagca

SEQ ID NO: 644447 - DNA, 25 bp, Mus musculus
gaccccaaacgatgcaatggcagca

SEQ ID NO: 644448 - DNA, 25 bp, Mus musculus
gaccccaacaacaagctgattagag

SEQ ID NO: 644449 - DNA, 25 bp, Mus musculus
gaccccaacaactagctgattagag

SEQ ID NO: 644450 - DNA, 25 bp, Mus musculus
gaccccaacagcaatgatgggctag

SEQ ID NO: 644451 - DNA, 25 bp, Mus musculus
gaccccaacagctatgatgggctag

SEQ ID NO: 644452 - DNA, 25 bp, Mus musculus
gaccccaagtggcagctatccagga

SEQ ID NO: 644453 - DNA, 25 bp, Mus musculus
gaccccaagtgggagctatccagga

SEQ ID NO: 644454 - DNA, 25 bp, Mus musculus
gaccccaatccaatgcacatcgatg

SEQ ID NO: 644455 - DNA, 25 bp, Mus musculus
gaccccaatccattgcacatcgatg

SEQ ID NO: 644456 - DNA, 25 bp, Mus musculus
gaccccaatcgcagtgagagctgct

SEQ ID NO: 644457 - DNA, 25 bp, Mus musculus
gaccccaatcgctgtgagagctgct

SEQ ID NO: 644458 - DNA, 25 bp, Mus musculus
gaccccaatgacatgtttcgatata

SEQ ID NO: 644459 - DNA, 25 bp, Mus musculus
gaccccaatgacttgtttcgatata

SEQ ID NO: 644460 - DNA, 25 bp, Mus musculus
gaccccaatgctcagcttatgtacg

SEQ ID NO: 644461 - DNA, 25 bp, Mus musculus
gaccccaatgctgagcttatgtacg

SEQ ID NO: 644462 - DNA, 25 bp, Mus musculus
gaccccaattatagagcaggcaagg

SEQ ID NO: 644463 - DNA, 25 bp, Mus musculus
gaccccaattattgagcaggcaagg

SEQ ID NO: 644464 - DNA, 25 bp, Mus musculus
gaccccaccgcaacgcctggaagag

SEQ ID NO: 644465 - DNA, 25 bp, Mus musculus
gaccccaccgcatcgcctggaagag

SEQ ID NO: 644466 - DNA, 25 bp, Mus musculus
gaccccactgaacgagcgtgtatcc

SEQ ID NO: 644467 - DNA, 25 bp, Mus musculus
gaccccactgaaggagcgtgtatcc

SEQ ID NO: 644468 - DNA, 25 bp, Mus musculus
gaccccagactcaagctacctagtg

SEQ ID NO: 644469 - DNA, 25 bp, Mus musculus
gaccccagactctagctacctagtg

SEQ ID NO: 644470 - DNA, 25 bp, Mus musculus
gaccccagatgcatgggtcctctgc

SEQ ID NO: 644471 - DNA, 25 bp, Mus musculus
gaccccagatgcttgggtcctctgc

SEQ ID NO: 644472 - DNA, 25 bp, Mus musculus
gaccccagcctgcatcgacatttgt

SEQ ID NO: 644473 - DNA, 25 bp, Mus musculus
gaccccagcctggatcgacatttgt

SEQ ID NO: 644474 - DNA, 25 bp, Mus musculus
gaccccaggatcctagtgtgcacta

SEQ ID NO: 644475 - DNA, 25 bp, Mus musculus
gaccccaggatcgtagtgtgcacta

SEQ ID NO: 644476 - DNA, 25 bp, Mus musculus
gaccccagggatagttgtggcgtca

SEQ ID NO: 644477 - DNA, 25 bp, Mus musculus
gaccccagggattgttgtggcgtca

SEQ ID NO: 644478 - DNA, 25 bp, Mus musculus
gaccccagggcgaatcaaagaccat

SEQ ID NO: 644479 - DNA, 25 bp, Mus musculus
gaccccagggcgtatcaaagaccat

SEQ ID NO: 644480 - DNA, 25 bp, Mus musculus
gaccccaggttactacagatctctc

SEQ ID NO: 644481 - DNA, 25 bp, Mus musculus
gaccccaggttagtacagatctctc

SEQ ID NO: 644482 - DNA, 25 bp, Mus musculus
gaccccatggagacatcacctgtga

SEQ ID NO: 644483 - DNA, 25 bp, Mus musculus
gaccccatggagactgaaacccaac

SEQ ID NO: 644484 - DNA, 25 bp, Mus musculus
gaccccatggagtcatcacctgtga

SEQ ID NO: 644485 - DNA, 25 bp, Mus musculus
gaccccatggagtctgaaacccaac

SEQ ID NO: 644486 - DNA, 25 bp, Mus musculus
gaccccctgccaattattctgtgtg

SEQ ID NO: 644487 - DNA, 25 bp, Mus musculus
gaccccctgccatttattctgtgtg

SEQ ID NO: 644488 - DNA, 25 bp, Mus musculus
gaccccgactctacgtgagacgtac

SEQ ID NO: 644489 - DNA, 25 bp, Mus musculus
gaccccgactcttcgtgagacgtac

SEQ ID NO: 644490 - DNA, 25 bp, Mus musculus
gaccccgagactcaggtaaaaatgg

SEQ ID NO: 644491 - DNA, 25 bp, Mus musculus
gaccccgagactgaggtaaaaatgg

SEQ ID NO: 644492 - DNA, 25 bp, Mus musculus
gaccccgaggcaagctgaaaagctc

SEQ ID NO: 644493 - DNA, 25 bp, Mus musculus
gaccccgaggcatgctgaaaagctc

SEQ ID NO: 644494 - DNA, 25 bp, Mus musculus
gaccccgagtacatactggaccagc

SEQ ID NO: 644495 - DNA, 25 bp, Mus musculus
gaccccgagtacttactggaccagc

SEQ ID NO: 644496 - DNA, 25 bp, Mus musculus
gaccccgatgtcatcaagctacaag

SEQ ID NO: 644497 - DNA, 25 bp, Mus musculus
gaccccgatgtcttcaagctacaag

SEQ ID NO: 644498 - DNA, 25 bp, Mus musculus
gaccccgccgtgagtaggttccagt

SEQ ID NO: 644499 - DNA, 25 bp, Mus musculus
gaccccgccgtgtgtaggttccagt

SEQ ID NO: 644500 - DNA, 25 bp, Mus musculus
gaccccgcgcaaacgtctgagatga

SEQ ID NO: 644501 - DNA, 25 bp, Mus musculus
gaccccgcgcaatcgtctgagatga

SEQ ID NO: 644502 - DNA, 25 bp, Mus musculus
gaccccgtggctccactctatgaag

SEQ ID NO: 644503 - DNA, 25 bp, Mus musculus
gaccccgtggctgcactctatgaag

SEQ ID NO: 644504 - DNA, 25 bp, Mus musculus
gaccccgtgggcatagctcttgctc

SEQ ID NO: 644505 - DNA, 25 bp, Mus musculus
gaccccgtgggcttagctcttgctc

SEQ ID NO: 644506 - DNA, 25 bp, Mus musculus
gacccctacactcaaagggttgagg

SEQ ID NO: 644507 - DNA, 25 bp, Mus musculus
gacccctacactgaaagggttgagg

SEQ ID NO: 644508 - DNA, 25 bp, Mus musculus
gacccctaccctagcaatacgagga

SEQ ID NO: 644509 - DNA, 25 bp, Mus musculus
gacccctacccttgcaatacgagga

SEQ ID NO: 644510 - DNA, 25 bp, Mus musculus
gacccctactgcaagtgcctctgga

SEQ ID NO: 644511 - DNA, 25 bp, Mus musculus
gacccctactgctagtgcctctgga

SEQ ID NO: 644512 - DNA, 25 bp, Mus musculus
gacccctcagtacaatgctggtggt

SEQ ID NO: 644513 - DNA, 25 bp, Mus musculus
gacccctcagtagaatgctggtggt

SEQ ID NO: 644514 - DNA, 25 bp, Mus musculus
gacccctcctatagagccagtggtg

SEQ ID NO: 644515 - DNA, 25 bp, Mus musculus
gacccctcctattgagccagtggtg

SEQ ID NO: 644516 - DNA, 25 bp, Mus musculus
gacccctcctggcatgctgtgtatg

SEQ ID NO: 644517 - DNA, 25 bp, Mus musculus
gacccctcctgggatgctgtgtatg

SEQ ID NO: 644518 - DNA, 25 bp, Mus musculus
gacccctccttactggtagcttttg

SEQ ID NO: 644519 - DNA, 25 bp, Mus musculus
gacccctccttagtggtagcttttg

SEQ ID NO: 644520 - DNA, 25 bp, Mus musculus
gacccctcgcctcagaagaagacga

SEQ ID NO: 644521 - DNA, 25 bp, Mus musculus
gacccctcgcctgagaagaagacga

SEQ ID NO: 644522 - DNA, 25 bp, Mus musculus
gacccctctgtgcagcctagtgagg

SEQ ID NO: 644523 - DNA, 25 bp, Mus musculus
gacccctctgtggagcctagtgagg

SEQ ID NO: 644524 - DNA, 25 bp, Mus musculus
gacccctgacatcaagctctttggg

SEQ ID NO: 644525 - DNA, 25 bp, Mus musculus
gacccctgacatgaagctctttggg

SEQ ID NO: 644526 - DNA, 25 bp, Mus musculus
gacccctgctctcgctgtaaaagct

SEQ ID NO: 644527 - DNA, 25 bp, Mus musculus
gacccctgctctggctgtaaaagct

SEQ ID NO: 644528 - DNA, 25 bp, Mus musculus
gacccctggagtcctgtcttgactg

SEQ ID NO: 644529 - DNA, 25 bp, Mus musculus
gacccctggagtgctgtcttgactg

SEQ ID NO: 644530 - DNA, 25 bp, Mus musculus
gacccctggctcataccctaatgga

SEQ ID NO: 644531 - DNA, 25 bp, Mus musculus
gacccctggctcttaccctaatgga

SEQ ID NO: 644532 - DNA, 25 bp, Mus musculus
gacccctgggatatgtacccatgga

SEQ ID NO: 644533 - DNA, 25 bp, Mus musculus
gacccctgggatttgtacccatgga

SEQ ID NO: 644534 - DNA, 25 bp, Mus musculus
gacccctgtctgagcctgagcttac

SEQ ID NO: 644535 - DNA, 25 bp, Mus musculus
gacccctgtctgtgcctgagcttac

SEQ ID NO: 644536 - DNA, 25 bp, Mus musculus
gaccccttcgggaaacagtgatcta

SEQ ID NO: 644537 - DNA, 25 bp, Mus musculus
gaccccttcgggtaacagtgatcta

SEQ ID NO: 644538 - DNA, 25 bp, Mus musculus
gaccccttttcactctggagttatc

SEQ ID NO: 644539 - DNA, 25 bp, Mus musculus
gaccccttttcagtctggagttatc

SEQ ID NO: 644540 - DNA, 25 bp, Mus musculus
gacccgaaagtcagctgtgactata

SEQ ID NO: 644541 - DNA, 25 bp, Mus musculus
gacccgaaagtctgctgtgactata

SEQ ID NO: 644542 - DNA, 25 bp, Mus musculus
gacccgaaattaaagtggatccaag

SEQ ID NO: 644543 - DNA, 25 bp, Mus musculus
gacccgaaattatagtggatccaag

SEQ ID NO: 644544 - DNA, 25 bp, Mus musculus
gacccgaaccacagcttcatcgaga

SEQ ID NO: 644545 - DNA, 25 bp, Mus musculus
gacccgaaccactgcttcatcgaga

SEQ ID NO: 644546 - DNA, 25 bp, Mus musculus
gacccgaactcaatgttatgggaag

SEQ ID NO: 644547 - DNA, 25 bp, Mus musculus
gacccgaactcattgttatgggaag

SEQ ID NO: 644548 - DNA, 25 bp, Mus musculus
gacccgaagatgagttgtgcagaga

SEQ ID NO: 644549 - DNA, 25 bp, Mus musculus
gacccgaagatgtgttgtgcagaga

SEQ ID NO: 644550 - DNA, 25 bp, Mus musculus
gacccgaagcggacattgtcatcca

SEQ ID NO: 644551 - DNA, 25 bp, Mus musculus
gacccgaagcggtcattgtcatcca

SEQ ID NO: 644552 - DNA, 25 bp, Mus musculus
gacccgaagctcaaaggcgtcttca

SEQ ID NO: 644553 - DNA, 25 bp, Mus musculus
gacccgaagctctaaggcgtcttca

SEQ ID NO: 644554 - DNA, 25 bp, Mus musculus
gacccgaaggaaaagcagacatgtg

SEQ ID NO: 644555 - DNA, 25 bp, Mus musculus
gacccgaaggaatagcagacatgtg

SEQ ID NO: 644556 - DNA, 25 bp, Mus musculus
gacccgaaggagatgccaatatcaa

SEQ ID NO: 644557 - DNA, 25 bp, Mus musculus
gacccgaaggagttgccaatatcaa

SEQ ID NO: 644558 - DNA, 25 bp, Mus musculus
gacccgacctctcagctatacattg

SEQ ID NO: 644559 - DNA, 25 bp, Mus musculus
gacccgacctctgagctatacattg

SEQ ID NO: 644560 - DNA, 25 bp, Mus musculus
gacccgactgctacaggactcactg

SEQ ID NO: 644561 - DNA, 25 bp, Mus musculus
gacccgactgctatggacctagatg

SEQ ID NO: 644562 - DNA, 25 bp, Mus musculus
gacccgactgcttcaggactcactg

SEQ ID NO: 644563 - DNA, 25 bp, Mus musculus
gacccgactgctttggacctagatg

SEQ ID NO: 644564 - DNA, 25 bp, Mus musculus
gacccgactgtcaaagtactacgag

SEQ ID NO: 644565 - DNA, 25 bp, Mus musculus
gacccgactgtctaagtactacgag

SEQ ID NO: 644566 - DNA, 25 bp, Mus musculus
gacccgaggcttagttctggacctg

SEQ ID NO: 644567 - DNA, 25 bp, Mus musculus
gacccgaggctttgttctggacctg

SEQ ID NO: 644568 - DNA, 25 bp, Mus musculus
gacccgagggagagatcacggacta

SEQ ID NO: 644569 - DNA, 25 bp, Mus musculus
gacccgagggagtgatcacggacta

SEQ ID NO: 644570 - DNA, 25 bp, Mus musculus
gacccgagggccagtactcagagga

SEQ ID NO: 644571 - DNA, 25 bp, Mus musculus
gacccgagggcctgtactcagagga

SEQ ID NO: 644572 - DNA, 25 bp, Mus musculus
gacccgagggtcacaccatcgtagt

SEQ ID NO: 644573 - DNA, 25 bp, Mus musculus
gacccgagggtctcaccatcgtagt

SEQ ID NO: 644574 - DNA, 25 bp, Mus musculus
gacccgatctcgatcaccttctcat

SEQ ID NO: 644575 - DNA, 25 bp, Mus musculus
gacccgatctcgttcaccttctcat

SEQ ID NO: 644576 - DNA, 25 bp, Mus musculus
gacccgattcgcattggcgtgtaat

SEQ ID NO: 644577 - DNA, 25 bp, Mus musculus
gacccgattcgctttggcgtgtaat

SEQ ID NO: 644578 - DNA, 25 bp, Mus musculus
gacccgcagacacaacctgaaactg

SEQ ID NO: 644579 - DNA, 25 bp, Mus musculus
gacccgcagacagaacctgaaactg

SEQ ID NO: 644580 - DNA, 25 bp, Mus musculus
gacccgcagcacagctgtctttggg

SEQ ID NO: 644581 - DNA, 25 bp, Mus musculus
gacccgcagcactgctgtctttggg

SEQ ID NO: 644582 - DNA, 25 bp, Mus musculus
gacccgcctctcaacgtggataaaa

SEQ ID NO: 644583 - DNA, 25 bp, Mus musculus
gacccgcctctctacgtggataaaa

SEQ ID NO: 644584 - DNA, 25 bp, Mus musculus
gacccgcctgagagagaccagttac

SEQ ID NO: 644585 - DNA, 25 bp, Mus musculus
gacccgcctgagtgagaccagttac

SEQ ID NO: 644586 - DNA, 25 bp, Mus musculus
gacccgcggttcattggattctgca

SEQ ID NO: 644587 - DNA, 25 bp, Mus musculus
gacccgcggttctttggattctgca

SEQ ID NO: 644588 - DNA, 25 bp, Mus musculus
gacccgctggaaccaccaggtgtca

SEQ ID NO: 644589 - DNA, 25 bp, Mus musculus
gacccgctggaagcaccaggtgtca

SEQ ID NO: 644590 - DNA, 25 bp, Mus musculus
gacccgcttgcaagtcactggtaga

SEQ ID NO: 644591 - DNA, 25 bp, Mus musculus
gacccgcttgcatgtcactggtaga

SEQ ID NO: 644592 - DNA, 25 bp, Mus musculus
gacccggaagctctttgggcacctg

SEQ ID NO: 644593 - DNA, 25 bp, Mus musculus
gacccggaagctgtttgggcacctg

SEQ ID NO: 644594 - DNA, 25 bp, Mus musculus
gacccggacataaagagcctgcatg

SEQ ID NO: 644595 - DNA, 25 bp, Mus musculus
gacccggacatatagagcctgcatg

SEQ ID NO: 644596 - DNA, 25 bp, Mus musculus
gacccggaggcacatctatgacacc

SEQ ID NO: 644597 - DNA, 25 bp, Mus musculus
gacccggaggcagatctatgacacc

SEQ ID NO: 644598 - DNA, 25 bp, Mus musculus
gacccggaggtgctgtccctcttaa

SEQ ID NO: 644599 - DNA, 25 bp, Mus musculus
gacccggaggtggtgtccctcttaa

SEQ ID NO: 644600 - DNA, 25 bp, Mus musculus
gacccggcagcactagctgtgtcct

SEQ ID NO: 644601 - DNA, 25 bp, Mus musculus
gacccggcagcagtagctgtgtcct

SEQ ID NO: 644602 - DNA, 25 bp, Mus musculus
gacccgggacaactatgcatacacg

SEQ ID NO: 644603 - DNA, 25 bp, Mus musculus
gacccgggacaagtatgcatacacg

SEQ ID NO: 644604 - DNA, 25 bp, Mus musculus
gacccgggctgaaatgatccttaag

SEQ ID NO: 644605 - DNA, 25 bp, Mus musculus
gacccgggctgatatgatccttaag

SEQ ID NO: 644606 - DNA, 25 bp, Mus musculus
gacccggtccccagctcgaggatgg

SEQ ID NO: 644607 - DNA, 25 bp, Mus musculus
gacccggtcccctgctcgaggatgg

SEQ ID NO: 644608 - DNA, 25 bp, Mus musculus
gacccggttcaactggatccacatt

SEQ ID NO: 644609 - DNA, 25 bp, Mus musculus
gacccggttcaagtggatccacatt

SEQ ID NO: 644610 - DNA, 25 bp, Mus musculus
gacccggttggcagtgttcaagtca

SEQ ID NO: 644611 - DNA, 25 bp, Mus musculus
gacccggttggctgtgttcaagtca

SEQ ID NO: 644612 - DNA, 25 bp, Mus musculus
gacccgtccggaacagacttgtgcc

SEQ ID NO: 644613 - DNA, 25 bp, Mus musculus
gacccgtccggatcagacttgtgcc

SEQ ID NO: 644614 - DNA, 25 bp, Mus musculus
gacccgtcgttgcagagtcaaacag

SEQ ID NO: 644615 - DNA, 25 bp, Mus musculus
gacccgtcgttggagagtcaaacag

SEQ ID NO: 644616 - DNA, 25 bp, Mus musculus
gacccgttctacaggatgcgagtga

SEQ ID NO: 644617 - DNA, 25 bp, Mus musculus
gacccgttctactggatgcgagtga

SEQ ID NO: 644618 - DNA, 25 bp, Mus musculus
gacccgtttctaactaggctctgct

SEQ ID NO: 644619 - DNA, 25 bp, Mus musculus
gacccgtttctatctaggctctgct

SEQ ID NO: 644620 - DNA, 25 bp, Mus musculus
gaccctaaacagagcagcagtgcag

SEQ ID NO: 644621 - DNA, 25 bp, Mus musculus
gaccctaaacagtgcagcagtgcag

SEQ ID NO: 644622 - DNA, 25 bp, Mus musculus
gaccctaaagaaatcccctggagct

SEQ ID NO: 644623 - DNA, 25 bp, Mus musculus
gaccctaaagaattcccctggagct

SEQ ID NO: 644624 - DNA, 25 bp, Mus musculus
gaccctaaaggtattgtcaccatag

SEQ ID NO: 644625 - DNA, 25 bp, Mus musculus
gaccctaaaggttttgtcaccatag

SEQ ID NO: 644626 - DNA, 25 bp, Mus musculus
gaccctaagacaagaaacccagcct

SEQ ID NO: 644627 - DNA, 25 bp, Mus musculus
gaccctaagacatgaaacccagcct

SEQ ID NO: 644628 - DNA, 25 bp, Mus musculus
gaccctaagtgtcaaggtgatgaga

SEQ ID NO: 644629 - DNA, 25 bp, Mus musculus
gaccctaagtgtgaaggtgatgaga

SEQ ID NO: 644630 - DNA, 25 bp, Mus musculus
gaccctacaggaaggtttgccatcc

SEQ ID NO: 644631 - DNA, 25 bp, Mus musculus
gaccctacaggatggtttgccatcc

SEQ ID NO: 644632 - DNA, 25 bp, Mus musculus
gaccctacatatatcaagattgaag

SEQ ID NO: 644633 - DNA, 25 bp, Mus musculus
gaccctacatatttcaagattgaag

SEQ ID NO: 644634 - DNA, 25 bp, Mus musculus
gaccctaccctgagccttgggaagc

SEQ ID NO: 644635 - DNA, 25 bp, Mus musculus
gaccctaccctgtgccttgggaagc

SEQ ID NO: 644636 - DNA, 25 bp, Mus musculus
gaccctactcgtcaggcttctgtct

SEQ ID NO: 644637 - DNA, 25 bp, Mus musculus
gaccctactcgtgaggcttctgtct

SEQ ID NO: 644638 - DNA, 25 bp, Mus musculus
gaccctacttaccacattacagatg

SEQ ID NO: 644639 - DNA, 25 bp, Mus musculus
gaccctacttacgacattacagatg

SEQ ID NO: 644640 - DNA, 25 bp, Mus musculus
gaccctagcacccaatataataatt

SEQ ID NO: 644641 - DNA, 25 bp, Mus musculus
gaccctagcaccgaatataataatt

SEQ ID NO: 644642 - DNA, 25 bp, Mus musculus
gaccctagcagtacacaaaacttta

SEQ ID NO: 644643 - DNA, 25 bp, Mus musculus
gaccctagcagttcacaaaacttta

SEQ ID NO: 644644 - DNA, 25 bp, Mus musculus
gaccctagcgaacgttgcggtagac

SEQ ID NO: 644645 - DNA, 25 bp, Mus musculus
gaccctagcgaaggttgcggtagac

SEQ ID NO: 644646 - DNA, 25 bp, Mus musculus
gaccctagggtaaggagcaattcca

SEQ ID NO: 644647 - DNA, 25 bp, Mus musculus
gaccctagggtatggagcaattcca

SEQ ID NO: 644648 - DNA, 25 bp, Mus musculus
gaccctagtgagatccgtgcacctc

SEQ ID NO: 644649 - DNA, 25 bp, Mus musculus
gaccctagtgagttccgtgcacctc

SEQ ID NO: 644650 - DNA, 25 bp, Mus musculus
gaccctataaatacaactttgctaa

SEQ ID NO: 644651 - DNA, 25 bp, Mus musculus
gaccctataaattcaactttgctaa

SEQ ID NO: 644652 - DNA, 25 bp, Mus musculus
gaccctatacttcggggagaagaga

SEQ ID NO: 644653 - DNA, 25 bp, Mus musculus
gaccctatacttgggggagaagaga

SEQ ID NO: 644654 - DNA, 25 bp, Mus musculus
gaccctatattcagtcagggtgagg

SEQ ID NO: 644655 - DNA, 25 bp, Mus musculus
gaccctatattctgtcagggtgagg

SEQ ID NO: 644656 - DNA, 25 bp, Mus musculus
gaccctcaagacctcaggcacaatg

SEQ ID NO: 644657 - DNA, 25 bp, Mus musculus
gaccctcaagacgtcaggcacaatg

SEQ ID NO: 644658 - DNA, 25 bp, Mus musculus
gaccctcaataacttcctccagtgg

SEQ ID NO: 644659 - DNA, 25 bp, Mus musculus
gaccctcaataagttcctccagtgg

SEQ ID NO: 644660 - DNA, 25 bp, Mus musculus
gaccctcaatgtcaagagtgaaaag

SEQ ID NO: 644661 - DNA, 25 bp, Mus musculus
gaccctcaatgtgaagagtgaaaag

SEQ ID NO: 644662 - DNA, 25 bp, Mus musculus
gaccctcagtatcgaacatactacg

SEQ ID NO: 644663 - DNA, 25 bp, Mus musculus
gaccctcagtatggaacatactacg

SEQ ID NO: 644664 - DNA, 25 bp, Mus musculus
gaccctcagtgcaagatctgcaagc

SEQ ID NO: 644665 - DNA, 25 bp, Mus musculus
gaccctcagtgctagatctgcaagc

SEQ ID NO: 644666 - DNA, 25 bp, Mus musculus
gaccctcataagaaccagactctgg

SEQ ID NO: 644667 - DNA, 25 bp, Mus musculus
gaccctcataagtaccagactctgg

SEQ ID NO: 644668 - DNA, 25 bp, Mus musculus
gaccctcatcaacttgctacttaaa

SEQ ID NO: 644669 - DNA, 25 bp, Mus musculus
gaccctcatcaagttgctacttaaa

SEQ ID NO: 644670 - DNA, 25 bp, Mus musculus
gaccctcatgtgcaccagtatgaaa

SEQ ID NO: 644671 - DNA, 25 bp, Mus musculus
gaccctcatgtggaccagtatgaaa

SEQ ID NO: 644672 - DNA, 25 bp, Mus musculus
gaccctccaaagaggatcagcctcg

SEQ ID NO: 644673 - DNA, 25 bp, Mus musculus
gaccctccaaagtggatcagcctcg

SEQ ID NO: 644674 - DNA, 25 bp, Mus musculus
gaccctccaggtagcatctgacagg

SEQ ID NO: 644675 - DNA, 25 bp, Mus musculus
gaccctccaggttgcatctgacagg

SEQ ID NO: 644676 - DNA, 25 bp, Mus musculus
gaccctccggaaacatctcacgtgt

SEQ ID NO: 644677 - DNA, 25 bp, Mus musculus
gaccctccggaatcatctcacgtgt

SEQ ID NO: 644678 - DNA, 25 bp, Mus musculus
gaccctccgttactgcttgtacacg

SEQ ID NO: 644679 - DNA, 25 bp, Mus musculus
gaccctccgttagtgcttgtacacg

SEQ ID NO: 644680 - DNA, 25 bp, Mus musculus
gaccctcctaagaacagcgtggcta

SEQ ID NO: 644681 - DNA, 25 bp, Mus musculus
gaccctcctaagtacagcgtggcta

SEQ ID NO: 644682 - DNA, 25 bp, Mus musculus
gaccctcctcgcaggacaatggaga

SEQ ID NO: 644683 - DNA, 25 bp, Mus musculus
gaccctcctcgctggacaatggaga

SEQ ID NO: 644684 - DNA, 25 bp, Mus musculus
gaccctcctgaacttcctgtgctgg

SEQ ID NO: 644685 - DNA, 25 bp, Mus musculus
gaccctcctgaagttcctgtgctgg

SEQ ID NO: 644686 - DNA, 25 bp, Mus musculus
gaccctcggtgcaaaggaatgcctc

SEQ ID NO: 644687 - DNA, 25 bp, Mus musculus
gaccctcggtgctaaggaatgcctc

SEQ ID NO: 644688 - DNA, 25 bp, Mus musculus
gaccctctacacctgcctggatgtt

SEQ ID NO: 644689 - DNA, 25 bp, Mus musculus
gaccctctacacgtgcctggatgtt

SEQ ID NO: 644690 - DNA, 25 bp, Mus musculus
gaccctctatgaaatacaagtgctg

SEQ ID NO: 644691 - DNA, 25 bp, Mus musculus
gaccctctatgatatacaagtgctg

SEQ ID NO: 644692 - DNA, 25 bp, Mus musculus
gaccctctctgaccctttatgcaaa

SEQ ID NO: 644693 - DNA, 25 bp, Mus musculus
gaccctctctgagcctttatgcaaa

SEQ ID NO: 644694 - DNA, 25 bp, Mus musculus
gaccctctggctcgactggtgctca

SEQ ID NO: 644695 - DNA, 25 bp, Mus musculus
gaccctctggctggactggtgctca

SEQ ID NO: 644696 - DNA, 25 bp, Mus musculus
gaccctgaaaacaatagccgccaag

SEQ ID NO: 644697 - DNA, 25 bp, Mus musculus
gaccctgaaaactatagccgccaag

SEQ ID NO: 644698 - DNA, 25 bp, Mus musculus
gaccctgaaagcattggctccatgc

SEQ ID NO: 644699 - DNA, 25 bp, Mus musculus
gaccctgaaagctttggctccatgc

SEQ ID NO: 644700 - DNA, 25 bp, Mus musculus
gaccctgaagctcgctcggtgacgt

SEQ ID NO: 644701 - DNA, 25 bp, Mus musculus
gaccctgaagctctcctggctgaag

SEQ ID NO: 644702 - DNA, 25 bp, Mus musculus
gaccctgaagctggctcggtgacgt

SEQ ID NO: 644703 - DNA, 25 bp, Mus musculus
gaccctgaagctgtcctggctgaag

SEQ ID NO: 644704 - DNA, 25 bp, Mus musculus
gaccctgaaggcagaaatgaacatt

SEQ ID NO: 644705 - DNA, 25 bp, Mus musculus
gaccctgaaggctgaaatgaacatt

SEQ ID NO: 644706 - DNA, 25 bp, Mus musculus
gaccctgaagttaggatcctccagc

SEQ ID NO: 644707 - DNA, 25 bp, Mus musculus
gaccctgaagtttggatcctccagc

SEQ ID NO: 644708 - DNA, 25 bp, Mus musculus
gaccctgaccgtcaactggcagctt

SEQ ID NO: 644709 - DNA, 25 bp, Mus musculus
gaccctgaccgtgaactggcagctt

SEQ ID NO: 644710 - DNA, 25 bp, Mus musculus
gaccctgacctccttagtgactcta

SEQ ID NO: 644711 - DNA, 25 bp, Mus musculus
gaccctgacctcgttagtgactcta

SEQ ID NO: 644712 - DNA, 25 bp, Mus musculus
gaccctgaccttagggcgagatgga

SEQ ID NO: 644713 - DNA, 25 bp, Mus musculus
gaccctgacctttgggcgagatgga

SEQ ID NO: 644714 - DNA, 25 bp, Mus musculus
gaccctgagatgcaaatggcctatg

SEQ ID NO: 644715 - DNA, 25 bp, Mus musculus
gaccctgagatggaaatggcctatg

SEQ ID NO: 644716 - DNA, 25 bp, Mus musculus
gaccctgagcgacaccttggaattc

SEQ ID NO: 644717 - DNA, 25 bp, Mus musculus
gaccctgagcgagaccttggaattc

SEQ ID NO: 644718 - DNA, 25 bp, Mus musculus
gaccctgagggaatcaaggatctaa

SEQ ID NO: 644719 - DNA, 25 bp, Mus musculus
gaccctgagggattcaaggatctaa

SEQ ID NO: 644720 - DNA, 25 bp, Mus musculus
gaccctgagtccaggcaattcagca

SEQ ID NO: 644721 - DNA, 25 bp, Mus musculus
gaccctgagtcctggcaattcagca

SEQ ID NO: 644722 - DNA, 25 bp, Mus musculus
gaccctgatccacaagacttcgctg

SEQ ID NO: 644723 - DNA, 25 bp, Mus musculus
gaccctgatccagaagacttcgctg

SEQ ID NO: 644724 - DNA, 25 bp, Mus musculus
gaccctgatctcagttggaggacaa

SEQ ID NO: 644725 - DNA, 25 bp, Mus musculus
gaccctgatctctgttggaggacaa

SEQ ID NO: 644726 - DNA, 25 bp, Mus musculus
gaccctgatgctaagaagcctgagg

SEQ ID NO: 644727 - DNA, 25 bp, Mus musculus
gaccctgatgctaggtgcgacctga

SEQ ID NO: 644728 - DNA, 25 bp, Mus musculus
gaccctgatgcttagaagcctgagg

SEQ ID NO: 644729 - DNA, 25 bp, Mus musculus
gaccctgatgcttggtgcgacctga

SEQ ID NO: 644730 - DNA, 25 bp, Mus musculus
gaccctgatggaccacactggagaa

SEQ ID NO: 644731 - DNA, 25 bp, Mus musculus
gaccctgatggagcacactggagaa

SEQ ID NO: 644732 - DNA, 25 bp, Mus musculus
gaccctgcaaaactgtgagattgcg

SEQ ID NO: 644733 - DNA, 25 bp, Mus musculus
gaccctgcaaaagtgtgagattgcg

SEQ ID NO: 644734 - DNA, 25 bp, Mus musculus
gaccctgcagcaattcctggaacag

SEQ ID NO: 644735 - DNA, 25 bp, Mus musculus
gaccctgcagcatttcctggaacag

SEQ ID NO: 644736 - DNA, 25 bp, Mus musculus
gaccctgccactattgatgcttaca

SEQ ID NO: 644737 - DNA, 25 bp, Mus musculus
gaccctgccacttttgatgcttaca

SEQ ID NO: 644738 - DNA, 25 bp, Mus musculus
gaccctgccattccaaggagcagaa

SEQ ID NO: 644739 - DNA, 25 bp, Mus musculus
gaccctgccattgcaaggagcagaa

SEQ ID NO: 644740 - DNA, 25 bp, Mus musculus
gaccctgcctggcaatctccagaag

SEQ ID NO: 644741 - DNA, 25 bp, Mus musculus
gaccctgcctgggaatctccagaag

SEQ ID NO: 644742 - DNA, 25 bp, Mus musculus
gaccctgcggtcacctgtgggactt

SEQ ID NO: 644743 - DNA, 25 bp, Mus musculus
gaccctgcggtctcctgtgggactt

SEQ ID NO: 644744 - DNA, 25 bp, Mus musculus
gaccctgcgtcaacactgccagata

SEQ ID NO: 644745 - DNA, 25 bp, Mus musculus
gaccctgcgtcatcactgccagata

SEQ ID NO: 644746 - DNA, 25 bp, Mus musculus
gaccctgctggcatgggtggcacct

SEQ ID NO: 644747 - DNA, 25 bp, Mus musculus
gaccctgctggcttgggtggcacct

SEQ ID NO: 644748 - DNA, 25 bp, Mus musculus
gaccctggacaacggcaagccttat

SEQ ID NO: 644749 - DNA, 25 bp, Mus musculus
gaccctggacaagggcaagccttat

SEQ ID NO: 644750 - DNA, 25 bp, Mus musculus
gaccctggaggtctgctggacttcc

SEQ ID NO: 644751 - DNA, 25 bp, Mus musculus
gaccctggaggtgtgctggacttcc

SEQ ID NO: 644752 - DNA, 25 bp, Mus musculus
gaccctggctgactccctagggcaa

SEQ ID NO: 644753 - DNA, 25 bp, Mus musculus
gaccctggctgagtccctagggcaa

SEQ ID NO: 644754 - DNA, 25 bp, Mus musculus
gaccctgggaaaagaggaccacctg

SEQ ID NO: 644755 - DNA, 25 bp, Mus musculus
gaccctgggaaatgaggaccacctg

SEQ ID NO: 644756 - DNA, 25 bp, Mus musculus
gaccctgggtatccgcaactcttaa

SEQ ID NO: 644757 - DNA, 25 bp, Mus musculus
gaccctgggtatgcgcaactcttaa

SEQ ID NO: 644758 - DNA, 25 bp, Mus musculus
gaccctggtgaaagcaccatataag

SEQ ID NO: 644759 - DNA, 25 bp, Mus musculus
gaccctggtgaatgcaccatataag

SEQ ID NO: 644760 - DNA, 25 bp, Mus musculus
gaccctggtgacaacgagaatgtca

SEQ ID NO: 644761 - DNA, 25 bp, Mus musculus
gaccctggtgactacgagaatgtca

SEQ ID NO: 644762 - DNA, 25 bp, Mus musculus
gaccctggtggacgtcttaaccaag

SEQ ID NO: 644763 - DNA, 25 bp, Mus musculus
gaccctggtggaggtcttaaccaag

SEQ ID NO: 644764 - DNA, 25 bp, Mus musculus
gaccctggttttctttgacctcaag

SEQ ID NO: 644765 - DNA, 25 bp, Mus musculus
gaccctggttttgtttgacctcaag

SEQ ID NO: 644766 - DNA, 25 bp, Mus musculus
gaccctgtaataagcctaagcctgg

SEQ ID NO: 644767 - DNA, 25 bp, Mus musculus
gaccctgtaatatgcctaagcctgg

SEQ ID NO: 644768 - DNA, 25 bp, Mus musculus
gaccctgtaccacttgtactgcagc

SEQ ID NO: 644769 - DNA, 25 bp, Mus musculus
gaccctgtaccagttgtactgcagc

SEQ ID NO: 644770 - DNA, 25 bp, Mus musculus
gaccctgtagcaattctgaaacgcc

SEQ ID NO: 644771 - DNA, 25 bp, Mus musculus
gaccctgtagcatttctgaaacgcc

SEQ ID NO: 644772 - DNA, 25 bp, Mus musculus
gaccctgtcaccagagccttggaac

SEQ ID NO: 644773 - DNA, 25 bp, Mus musculus
gaccctgtcacctgagccttggaac

SEQ ID NO: 644774 - DNA, 25 bp, Mus musculus
gaccctgtccgactcgatatcactt

SEQ ID NO: 644775 - DNA, 25 bp, Mus musculus
gaccctgtccgagtcgatatcactt

SEQ ID NO: 644776 - DNA, 25 bp, Mus musculus
gaccctgtctcgatgaaacagtatg

SEQ ID NO: 644777 - DNA, 25 bp, Mus musculus
gaccctgtctcgttgaaacagtatg

SEQ ID NO: 644778 - DNA, 25 bp, Mus musculus
gaccctgtgagtatacttctttctc

SEQ ID NO: 644779 - DNA, 25 bp, Mus musculus
gaccctgtgagtcatcctctgtggg

SEQ ID NO: 644780 - DNA, 25 bp, Mus musculus
gaccctgtgagtgatcctctgtggg

SEQ ID NO: 644781 - DNA, 25 bp, Mus musculus
gaccctgtgagtttacttctttctc

SEQ ID NO: 644782 - DNA, 25 bp, Mus musculus
gaccctgtgcgtatcttcagacatg

SEQ ID NO: 644783 - DNA, 25 bp, Mus musculus
gaccctgtgcgtcactgcactggaa

SEQ ID NO: 644784 - DNA, 25 bp, Mus musculus
gaccctgtgcgtgactgcactggaa

SEQ ID NO: 644785 - DNA, 25 bp, Mus musculus
gaccctgtgcgtttcttcagacatg

SEQ ID NO: 644786 - DNA, 25 bp, Mus musculus
gaccctgtggtaagacagtctgcta

SEQ ID NO: 644787 - DNA, 25 bp, Mus musculus
gaccctgtggtatgacagtctgcta

SEQ ID NO: 644788 - DNA, 25 bp, Mus musculus
gaccctgttgtccatgaactgggcc

SEQ ID NO: 644789 - DNA, 25 bp, Mus musculus
gaccctgttgtcgatgaactgggcc

SEQ ID NO: 644790 - DNA, 25 bp, Mus musculus
gaccctgtttccatgaatagactga

SEQ ID NO: 644791 - DNA, 25 bp, Mus musculus
gaccctgtttccttgaatagactga

SEQ ID NO: 644792 - DNA, 25 bp, Mus musculus
gacccttaatgtcggagcagggact

SEQ ID NO: 644793 - DNA, 25 bp, Mus musculus
gacccttaatgtgggagcagggact

SEQ ID NO: 644794 - DNA, 25 bp, Mus musculus
gacccttaccataagagcccatttg

SEQ ID NO: 644795 - DNA, 25 bp, Mus musculus
gacccttaccattagagcccatttg

SEQ ID NO: 644796 - DNA, 25 bp, Mus musculus
gacccttattacacggagaatggtg

SEQ ID NO: 644797 - DNA, 25 bp, Mus musculus
gacccttattactcggagaatggtg

SEQ ID NO: 644798 - DNA, 25 bp, Mus musculus
gacccttcgggaacaggatatcatg

SEQ ID NO: 644799 - DNA, 25 bp, Mus musculus
gacccttcgggatcaggatatcatg

SEQ ID NO: 644800 - DNA, 25 bp, Mus musculus
gacccttcggttaggctctgtctta

SEQ ID NO: 644801 - DNA, 25 bp, Mus musculus
gacccttcggtttggctctgtctta

SEQ ID NO: 644802 - DNA, 25 bp, Mus musculus
gacccttctctgaacacattctgtg

SEQ ID NO: 644803 - DNA, 25 bp, Mus musculus
gacccttctctgtacacattctgtg

SEQ ID NO: 644804 - DNA, 25 bp, Mus musculus
gacccttgaagaagtagcttccgaa

SEQ ID NO: 644805 - DNA, 25 bp, Mus musculus
gacccttgaagatgtagcttccgaa

SEQ ID NO: 644806 - DNA, 25 bp, Mus musculus
gacccttgcctgctgtttattgccc

SEQ ID NO: 644807 - DNA, 25 bp, Mus musculus
gacccttgcctggtgtttattgccc

SEQ ID NO: 644808 - DNA, 25 bp, Mus musculus
gacccttggacaccaggacgtttcc

SEQ ID NO: 644809 - DNA, 25 bp, Mus musculus
gacccttggacagcaggacgtttcc

SEQ ID NO: 644810 - DNA, 25 bp, Mus musculus
gacccttggaggcacctgttcctct

SEQ ID NO: 644811 - DNA, 25 bp, Mus musculus
gacccttggagggacctgttcctct

SEQ ID NO: 644812 - DNA, 25 bp, Mus musculus
gacccttgggaacagcatgcgaagt

SEQ ID NO: 644813 - DNA, 25 bp, Mus musculus
gacccttgggaagagcatgcgaagt

SEQ ID NO: 644814 - DNA, 25 bp, Mus musculus
gacccttgggtcaaggcaagcttcg

SEQ ID NO: 644815 - DNA, 25 bp, Mus musculus
gacccttgggtctaggcaagcttcg

SEQ ID NO: 644816 - DNA, 25 bp, Mus musculus
gacccttgtgtcctaaaccatgagg

SEQ ID NO: 644817 - DNA, 25 bp, Mus musculus
gacccttgtgtcgtaaaccatgagg

SEQ ID NO: 644818 - DNA, 25 bp, Mus musculus
gacccttgtttaagtcttctgagcc

SEQ ID NO: 644819 - DNA, 25 bp, Mus musculus
gacccttgtttatgtcttctgagcc

SEQ ID NO: 644820 - DNA, 25 bp, Mus musculus
gaccctttcaaccagtacacggaag

SEQ ID NO: 644821 - DNA, 25 bp, Mus musculus
gaccctttcaacgagtacacggaag

SEQ ID NO: 644822 - DNA, 25 bp, Mus musculus
gaccctttcctcaagagcttgtcag

SEQ ID NO: 644823 - DNA, 25 bp, Mus musculus
gaccctttcctctagagcttgtcag

SEQ ID NO: 644824 - DNA, 25 bp, Mus musculus
gaccctttctaccagatgcttgcag

SEQ ID NO: 644825 - DNA, 25 bp, Mus musculus
gaccctttctacgagatgcttgcag

SEQ ID NO: 644826 - DNA, 25 bp, Mus musculus
gaccctttcttcaacaggatgctca

SEQ ID NO: 644827 - DNA, 25 bp, Mus musculus
gaccctttcttctacaggatgctca

SEQ ID NO: 644828 - DNA, 25 bp, Mus musculus
gaccctttgacacggagtatccacg

SEQ ID NO: 644829 - DNA, 25 bp, Mus musculus
gaccctttgacagggagtatccacg

SEQ ID NO: 644830 - DNA, 25 bp, Mus musculus
gaccctttgatgaccgaatgcctcc

SEQ ID NO: 644831 - DNA, 25 bp, Mus musculus
gaccctttgatgtccgaatgcctcc

SEQ ID NO: 644832 - DNA, 25 bp, Mus musculus
gaccctttgctcagtgattcaacag

SEQ ID NO: 644833 - DNA, 25 bp, Mus musculus
gaccctttgctctgtgattcaacag

SEQ ID NO: 644834 - DNA, 25 bp, Mus musculus
gaccctttgcttagcaaatttgctg

SEQ ID NO: 644835 - DNA, 25 bp, Mus musculus
gaccctttgctttgcaaatttgctg

SEQ ID NO: 644836 - DNA, 25 bp, Mus musculus
gacccttttccacaggcgactagat

SEQ ID NO: 644837 - DNA, 25 bp, Mus musculus
gacccttttccagaggcgactagat

SEQ ID NO: 644838 - DNA, 25 bp, Mus musculus
gacccttttcggagttttgcatctg

SEQ ID NO: 644839 - DNA, 25 bp, Mus musculus
gacccttttcggtgttttgcatctg

SEQ ID NO: 644840 - DNA, 25 bp, Mus musculus
gacccttttgacctggatgtcttca

SEQ ID NO: 644841 - DNA, 25 bp, Mus musculus
gacccttttgacgtggatgtcttca

SEQ ID NO: 644842 - DNA, 25 bp, Mus musculus
gacccttttggacgaccacattgtg

SEQ ID NO: 644843 - DNA, 25 bp, Mus musculus
gacccttttggaggaccacattgtg

SEQ ID NO: 644844 - DNA, 25 bp, Mus musculus
gaccctttttctcttgatgttcata

SEQ ID NO: 644845 - DNA, 25 bp, Mus musculus
gaccctttttctgttgatgttcata

SEQ ID NO: 644846 - DNA, 25 bp, Mus musculus
gaccgaaagagtactctcctcacag

SEQ ID NO: 644847 - DNA, 25 bp, Mus musculus
gaccgaaagagttctctcctcacag

SEQ ID NO: 644848 - DNA, 25 bp, Mus musculus
gaccgaaagcaacaggtaccccatg

SEQ ID NO: 644849 - DNA, 25 bp, Mus musculus
gaccgaaagcaagaggtaccccatg

SEQ ID NO: 644850 - DNA, 25 bp, Mus musculus
gaccgaaatgtcaaatttaggaagt

SEQ ID NO: 644851 - DNA, 25 bp, Mus musculus
gaccgaaatgtctaatttaggaagt

SEQ ID NO: 644852 - DNA, 25 bp, Mus musculus
gaccgaacgcctattgaggcaagag

SEQ ID NO: 644853 - DNA, 25 bp, Mus musculus
gaccgaacgccttttgaggcaagag

SEQ ID NO: 644854 - DNA, 25 bp, Mus musculus
gaccgaagacacattcatcgctgac

SEQ ID NO: 644855 - DNA, 25 bp, Mus musculus
gaccgaagacactttcatcgctgac

SEQ ID NO: 644856 - DNA, 25 bp, Mus musculus
gaccgaagaggcaaatgtgaacgac

SEQ ID NO: 644857 - DNA, 25 bp, Mus musculus
gaccgaagaggctaatgtgaacgac

SEQ ID NO: 644858 - DNA, 25 bp, Mus musculus
gaccgaagcatgattgctgctgcag

SEQ ID NO: 644859 - DNA, 25 bp, Mus musculus
gaccgaagcatgtttgctgctgcag

SEQ ID NO: 644860 - DNA, 25 bp, Mus musculus
gaccgaaggctccacaggtgtacac

SEQ ID NO: 644861 - DNA, 25 bp, Mus musculus
gaccgaaggctcgacaggtgtacac

SEQ ID NO: 644862 - DNA, 25 bp, Mus musculus
gaccgaataactcagtctggtgtgg

SEQ ID NO: 644863 - DNA, 25 bp, Mus musculus
gaccgaataactgagtctggtgtgg

SEQ ID NO: 644864 - DNA, 25 bp, Mus musculus
gaccgaatcaacatgcagaagtgcc

SEQ ID NO: 644865 - DNA, 25 bp, Mus musculus
gaccgaatcaacttgcagaagtgcc

SEQ ID NO: 644866 - DNA, 25 bp, Mus musculus
gaccgaatcgtcctaaaccaagagg

SEQ ID NO: 644867 - DNA, 25 bp, Mus musculus
gaccgaatcgtcgtaaaccaagagg

SEQ ID NO: 644868 - DNA, 25 bp, Mus musculus
gaccgacacaagatgctcagttaga

SEQ ID NO: 644869 - DNA, 25 bp, Mus musculus
gaccgacacaagttgctcagttaga

SEQ ID NO: 644870 - DNA, 25 bp, Mus musculus
gaccgacactggcaagatgcaggcc

SEQ ID NO: 644871 - DNA, 25 bp, Mus musculus
gaccgacactgggaagatgcaggcc

SEQ ID NO: 644872 - DNA, 25 bp, Mus musculus
gaccgacagaggaggatgctgaaat

SEQ ID NO: 644873 - DNA, 25 bp, Mus musculus
gaccgacagaggtggatgctgaaat

SEQ ID NO: 644874 - DNA, 25 bp, Mus musculus
gaccgacagtggattcaccttctcc

SEQ ID NO: 644875 - DNA, 25 bp, Mus musculus
gaccgacagtggtttcaccttctcc

SEQ ID NO: 644876 - DNA, 25 bp, Mus musculus
gaccgacatgctctccaattttggg

SEQ ID NO: 644877 - DNA, 25 bp, Mus musculus
gaccgacatgctgtccaattttggg

SEQ ID NO: 644878 - DNA, 25 bp, Mus musculus
gaccgaccagcacatcaagcaggtt

SEQ ID NO: 644879 - DNA, 25 bp, Mus musculus
gaccgaccagcagatcaagcaggtt

SEQ ID NO: 644880 - DNA, 25 bp, Mus musculus
gaccgacgaggacctggtaaccatg

SEQ ID NO: 644881 - DNA, 25 bp, Mus musculus
gaccgacgaggagctggtaaccatg

SEQ ID NO: 644882 - DNA, 25 bp, Mus musculus
gaccgacgctgtaatcagctgcctc

SEQ ID NO: 644883 - DNA, 25 bp, Mus musculus
gaccgacgctgttatcagctgcctc

SEQ ID NO: 644884 - DNA, 25 bp, Mus musculus
gaccgacggctcagtgaagaggcct

SEQ ID NO: 644885 - DNA, 25 bp, Mus musculus
gaccgacggctctgtgaagaggcct

SEQ ID NO: 644886 - DNA, 25 bp, Mus musculus
gaccgactgggaatatatacatttg

SEQ ID NO: 644887 - DNA, 25 bp, Mus musculus
gaccgactgggattatatacatttg

SEQ ID NO: 644888 - DNA, 25 bp, Mus musculus
gaccgagaatataggcagctcctcc

SEQ ID NO: 644889 - DNA, 25 bp, Mus musculus
gaccgagaatattggcagctcctcc

SEQ ID NO: 644890 - DNA, 25 bp, Mus musculus
gaccgagaggctcacgtcttcacca

SEQ ID NO: 644891 - DNA, 25 bp, Mus musculus
gaccgagaggctgacgtcttcacca

SEQ ID NO: 644892 - DNA, 25 bp, Mus musculus
gaccgagagggaagcacttttgtct

SEQ ID NO: 644893 - DNA, 25 bp, Mus musculus
gaccgagagggatgcacttttgtct

SEQ ID NO: 644894 - DNA, 25 bp, Mus musculus
gaccgagaggtaaccatcgtgttca

SEQ ID NO: 644895 - DNA, 25 bp, Mus musculus
gaccgagaggtatccatcgtgttca

SEQ ID NO: 644896 - DNA, 25 bp, Mus musculus
gaccgagatcagacatatcttacaa

SEQ ID NO: 644897 - DNA, 25 bp, Mus musculus
gaccgagatcagtcatatcttacaa

SEQ ID NO: 644898 - DNA, 25 bp, Mus musculus
gaccgagatctgatcagccaacccg

SEQ ID NO: 644899 - DNA, 25 bp, Mus musculus
gaccgagatctgttcagccaacccg

SEQ ID NO: 644900 - DNA, 25 bp, Mus musculus
gaccgagcacaacggtaagcgagac

SEQ ID NO: 644901 - DNA, 25 bp, Mus musculus
gaccgagcacaagggtaagcgagac

SEQ ID NO: 644902 - DNA, 25 bp, Mus musculus
gaccgagcagaaaatacccagtttg

SEQ ID NO: 644903 - DNA, 25 bp, Mus musculus
gaccgagcagaatatacccagtttg

SEQ ID NO: 644904 - DNA, 25 bp, Mus musculus
gaccgagcgtttctgagcactttcc

SEQ ID NO: 644905 - DNA, 25 bp, Mus musculus
gaccgagcgtttgtgagcactttcc

SEQ ID NO: 644906 - DNA, 25 bp, Mus musculus
gaccgagctctcatcaatggagccc

SEQ ID NO: 644907 - DNA, 25 bp, Mus musculus
gaccgagctctcttcaatggagccc

SEQ ID NO: 644908 - DNA, 25 bp, Mus musculus
gaccgagctgagaatctgcttcatg

SEQ ID NO: 644909 - DNA, 25 bp, Mus musculus
gaccgagctgagtatctgcttcatg

SEQ ID NO: 644910 - DNA, 25 bp, Mus musculus
gaccgaggacgaatcggcgtcacct

SEQ ID NO: 644911 - DNA, 25 bp, Mus musculus
gaccgaggacgattcggcgtcacct

SEQ ID NO: 644912 - DNA, 25 bp, Mus musculus
gaccgaggagccatagtgaggaact

SEQ ID NO: 644913 - DNA, 25 bp, Mus musculus
gaccgaggagccttagtgaggaact

SEQ ID NO: 644914 - DNA, 25 bp, Mus musculus
gaccgaggcagcagcagtcaccaca

SEQ ID NO: 644915 - DNA, 25 bp, Mus musculus
gaccgaggcagctgcagtcaccaca

SEQ ID NO: 644916 - DNA, 25 bp, Mus musculus
gaccgaggtcagaggtttgctagct

SEQ ID NO: 644917 - DNA, 25 bp, Mus musculus
gaccgaggtcagtggtttgctagct

SEQ ID NO: 644918 - DNA, 25 bp, Mus musculus
gaccgaggtctcaataaacaaggac

SEQ ID NO: 644919 - DNA, 25 bp, Mus musculus
gaccgaggtctctataaacaaggac

SEQ ID NO: 644920 - DNA, 25 bp, Mus musculus
gaccgagtaccacacattcttctgg

SEQ ID NO: 644921 - DNA, 25 bp, Mus musculus
gaccgagtaccagacattcttctgg

SEQ ID NO: 644922 - DNA, 25 bp, Mus musculus
gaccgagtcctaaacaaaagccgtc

SEQ ID NO: 644923 - DNA, 25 bp, Mus musculus
gaccgagtcctatacaaaagccgtc

SEQ ID NO: 644924 - DNA, 25 bp, Mus musculus
gaccgagtctacacccaccagagtg

SEQ ID NO: 644925 - DNA, 25 bp, Mus musculus
gaccgagtctactcccaccagagtg

SEQ ID NO: 644926 - DNA, 25 bp, Mus musculus
gaccgagtcttaagcagcctcacgg

SEQ ID NO: 644927 - DNA, 25 bp, Mus musculus
gaccgagtcttatgcagcctcacgg

SEQ ID NO: 644928 - DNA, 25 bp, Mus musculus
gaccgagtgacacagttcctccagc

SEQ ID NO: 644929 - DNA, 25 bp, Mus musculus
gaccgagtgacagagttcctccagc

SEQ ID NO: 644930 - DNA, 25 bp, Mus musculus
gaccgagtgattcactcaagactcc

SEQ ID NO: 644931 - DNA, 25 bp, Mus musculus
gaccgagtgattgactcaagactcc

SEQ ID NO: 644932 - DNA, 25 bp, Mus musculus
gaccgagtgcacagctggttgctgc

SEQ ID NO: 644933 - DNA, 25 bp, Mus musculus
gaccgagtgcactgctggttgctgc

SEQ ID NO: 644934 - DNA, 25 bp, Mus musculus
gaccgatatagtcaaattcctatca

SEQ ID NO: 644935 - DNA, 25 bp, Mus musculus
gaccgatatagtgaaattcctatca

SEQ ID NO: 644936 - DNA, 25 bp, Mus musculus
gaccgatcacgcctccagatgtgca

SEQ ID NO: 644937 - DNA, 25 bp, Mus musculus
gaccgatcacgcgtccagatgtgca

SEQ ID NO: 644938 - DNA, 25 bp, Mus musculus
gaccgatctggcaaggccaggccag

SEQ ID NO: 644939 - DNA, 25 bp, Mus musculus
gaccgatctggctaggccaggccag

SEQ ID NO: 644940 - DNA, 25 bp, Mus musculus
gaccgatggtttcctgatctcttag

SEQ ID NO: 644941 - DNA, 25 bp, Mus musculus
gaccgatggtttgctgatctcttag

SEQ ID NO: 644942 - DNA, 25 bp, Mus musculus
gaccgatgtgcaccggctacagtct

SEQ ID NO: 644943 - DNA, 25 bp, Mus musculus
gaccgatgtgcagcggctacagtct

SEQ ID NO: 644944 - DNA, 25 bp, Mus musculus
gaccgatgtgtaaccaagtacttgg

SEQ ID NO: 644945 - DNA, 25 bp, Mus musculus
gaccgatgtgtatccaagtacttgg

SEQ ID NO: 644946 - DNA, 25 bp, Mus musculus
gaccgcaaggtcaacaacgttacca

SEQ ID NO: 644947 - DNA, 25 bp, Mus musculus
gaccgcaaggtctacaacgttacca

SEQ ID NO: 644948 - DNA, 25 bp, Mus musculus
gaccgcaagtcgcaagacaaacttg

SEQ ID NO: 644949 - DNA, 25 bp, Mus musculus
gaccgcaagtcggaagacaaacttg

SEQ ID NO: 644950 - DNA, 25 bp, Mus musculus
gaccgcacctgtaaggacacgtcca

SEQ ID NO: 644951 - DNA, 25 bp, Mus musculus
gaccgcacctgttaggacacgtcca

SEQ ID NO: 644952 - DNA, 25 bp, Mus musculus
gaccgcacgggcaagagtcatgtct

SEQ ID NO: 644953 - DNA, 25 bp, Mus musculus
gaccgcacgggctagagtcatgtct

SEQ ID NO: 644954 - DNA, 25 bp, Mus musculus
gaccgcactctgctcatcaaggaag

SEQ ID NO: 644955 - DNA, 25 bp, Mus musculus
gaccgcactctggtcatcaaggaag

SEQ ID NO: 644956 - DNA, 25 bp, Mus musculus
gaccgcagcgagaacaccagtctgc

SEQ ID NO: 644957 - DNA, 25 bp, Mus musculus
gaccgcagcgagtacaccagtctgc

SEQ ID NO: 644958 - DNA, 25 bp, Mus musculus
gaccgcagctgtcatacgggagcct

SEQ ID NO: 644959 - DNA, 25 bp, Mus musculus
gaccgcagctgtgatacgggagcct

SEQ ID NO: 644960 - DNA, 25 bp, Mus musculus
gaccgcagtgttaacattaaggaga

SEQ ID NO: 644961 - DNA, 25 bp, Mus musculus
gaccgcagtgtttacattaaggaga

SEQ ID NO: 644962 - DNA, 25 bp, Mus musculus
gaccgcagttgtccagaagcgcttt

SEQ ID NO: 644963 - DNA, 25 bp, Mus musculus
gaccgcagttgtgcagaagcgcttt

SEQ ID NO: 644964 - DNA, 25 bp, Mus musculus
gaccgcatacagagaaggttctcag

SEQ ID NO: 644965 - DNA, 25 bp, Mus musculus
gaccgcatacagtgaaggttctcag

SEQ ID NO: 644966 - DNA, 25 bp, Mus musculus
gaccgcatctttcgtggcgagctga

SEQ ID NO: 644967 - DNA, 25 bp, Mus musculus
gaccgcatctttggtggcgagctga

SEQ ID NO: 644968 - DNA, 25 bp, Mus musculus
gaccgcattgtgcatgaccgggtta

SEQ ID NO: 644969 - DNA, 25 bp, Mus musculus
gaccgcattgtggatgaccgggtta

SEQ ID NO: 644970 - DNA, 25 bp, Mus musculus
gaccgccagtcacgacagtgtctag

SEQ ID NO: 644971 - DNA, 25 bp, Mus musculus
gaccgccagtcaggacagtgtctag

SEQ ID NO: 644972 - DNA, 25 bp, Mus musculus
gaccgccattgtccgccaggtagtg

SEQ ID NO: 644973 - DNA, 25 bp, Mus musculus
gaccgccattgtgcgccaggtagtg

SEQ ID NO: 644974 - DNA, 25 bp, Mus musculus
gaccgccctacgaagccagggttca

SEQ ID NO: 644975 - DNA, 25 bp, Mus musculus
gaccgccctacgtagccagggttca

SEQ ID NO: 644976 - DNA, 25 bp, Mus musculus
gaccgccgcacacacttagtattta

SEQ ID NO: 644977 - DNA, 25 bp, Mus musculus
gaccgccgcacagacttagtattta

SEQ ID NO: 644978 - DNA, 25 bp, Mus musculus
gaccgccggatcactctgagagcct

SEQ ID NO: 644979 - DNA, 25 bp, Mus musculus
gaccgccggatctctctgagagcct

SEQ ID NO: 644980 - DNA, 25 bp, Mus musculus
gaccgcctacctcaagcaagagctt

SEQ ID NO: 644981 - DNA, 25 bp, Mus musculus
gaccgcctacctgaagcaagagctt

SEQ ID NO: 644982 - DNA, 25 bp, Mus musculus
gaccgcctatggcatgaaggacatg

SEQ ID NO: 644983 - DNA, 25 bp, Mus musculus
gaccgcctatgggatgaaggacatg

SEQ ID NO: 644984 - DNA, 25 bp, Mus musculus
gaccgcctctttagttacacgtact

SEQ ID NO: 644985 - DNA, 25 bp, Mus musculus
gaccgcctcttttgttacacgtact

SEQ ID NO: 644986 - DNA, 25 bp, Mus musculus
gaccgcctgactaggactttctagg

SEQ ID NO: 644987 - DNA, 25 bp, Mus musculus
gaccgcctgacttggactttctagg

SEQ ID NO: 644988 - DNA, 25 bp, Mus musculus
gaccgcctggccatccaatttggaa

SEQ ID NO: 644989 - DNA, 25 bp, Mus musculus
gaccgcctggccttccaatttggaa

SEQ ID NO: 644990 - DNA, 25 bp, Mus musculus
gaccgcctggtgactgcttgttgcc

SEQ ID NO: 644991 - DNA, 25 bp, Mus musculus
gaccgcctggtgtctgcttgttgcc

SEQ ID NO: 644992 - DNA, 25 bp, Mus musculus
gaccgcctgtggcatacaagttctg

SEQ ID NO: 644993 - DNA, 25 bp, Mus musculus
gaccgcctgtgggatacaagttctg

SEQ ID NO: 644994 - DNA, 25 bp, Mus musculus
gaccgcgactgcagttccaacggaa

SEQ ID NO: 644995 - DNA, 25 bp, Mus musculus
gaccgcgactgctgttccaacggaa

SEQ ID NO: 644996 - DNA, 25 bp, Mus musculus
gaccgcggctcactgcctgcagaat

SEQ ID NO: 644997 - DNA, 25 bp, Mus musculus
gaccgcggctcagtgcctgcagaat

SEQ ID NO: 644998 - DNA, 25 bp, Mus musculus
gaccgctcagttactgtttaccatg

SEQ ID NO: 644999 - DNA, 25 bp, Mus musculus
gaccgctcagtttctgtttaccatg

SEQ ID NO: 645000 - DNA, 25 bp, Mus musculus
gaccgctcggatatggcgcaaggcc

SEQ ID NO: 645001 - DNA, 25 bp, Mus musculus
gaccgctcggatttggcgcaaggcc

SEQ ID NO: 645002 - DNA, 25 bp, Mus musculus
gaccgctcggtacccttgtgacttg

SEQ ID NO: 645003 - DNA, 25 bp, Mus musculus
gaccgctcggtagccttgtgacttg

SEQ ID NO: 645004 - DNA, 25 bp, Mus musculus
gaccgctgaggaaactgtaaaagct

SEQ ID NO: 645005 - DNA, 25 bp, Mus musculus
gaccgctgaggatactgtaaaagct

SEQ ID NO: 645006 - DNA, 25 bp, Mus musculus
gaccgcttacagagacagctaaatc

SEQ ID NO: 645007 - DNA, 25 bp, Mus musculus
gaccgcttacagtgacagctaaatc

SEQ ID NO: 645008 - DNA, 25 bp, Mus musculus
gaccgcttgcagctgtcggttgtct

SEQ ID NO: 645009 - DNA, 25 bp, Mus musculus
gaccgcttgcaggtgtcggttgtct

SEQ ID NO: 645010 - DNA, 25 bp, Mus musculus
gaccgcttggatctcaccgtttctc

SEQ ID NO: 645011 - DNA, 25 bp, Mus musculus
gaccgcttggatgtcaccgtttctc

SEQ ID NO: 645012 - DNA, 25 bp, Mus musculus
gaccgcttgtgcctagacctatgaa

SEQ ID NO: 645013 - DNA, 25 bp, Mus musculus
gaccgcttgtgcgtagacctatgaa

SEQ ID NO: 645014 - DNA, 25 bp, Mus musculus
gaccggaaactcacttggacgagga

SEQ ID NO: 645015 - DNA, 25 bp, Mus musculus
gaccggaaactctcttggacgagga

SEQ ID NO: 645016 - DNA, 25 bp, Mus musculus
gaccggaaatgccagtgccaaatag

SEQ ID NO: 645017 - DNA, 25 bp, Mus musculus
gaccggaaatgccagtgccgaacag

SEQ ID NO: 645018 - DNA, 25 bp, Mus musculus
gaccggaaatgcgagtgccaaatag

SEQ ID NO: 645019 - DNA, 25 bp, Mus musculus
gaccggaaatgcgagtgccgaacag

SEQ ID NO: 645020 - DNA, 25 bp, Mus musculus
gaccggaactatcggaccaaactgg

SEQ ID NO: 645021 - DNA, 25 bp, Mus musculus
gaccggaactatgggaccaaactgg

SEQ ID NO: 645022 - DNA, 25 bp, Mus musculus
gaccggaaggatcgtcacactatcg

SEQ ID NO: 645023 - DNA, 25 bp, Mus musculus
gaccggaaggatggtcacactatcg

SEQ ID NO: 645024 - DNA, 25 bp, Mus musculus
gaccggaaggcacatgaagacagca

SEQ ID NO: 645025 - DNA, 25 bp, Mus musculus
gaccggaaggcagatgaagacagca

SEQ ID NO: 645026 - DNA, 25 bp, Mus musculus
gaccggaagtgcacccgaaaccaag

SEQ ID NO: 645027 - DNA, 25 bp, Mus musculus
gaccggaagtgctcccgaaaccaag

SEQ ID NO: 645028 - DNA, 25 bp, Mus musculus
gaccggaatcccaactgctgtgcct

SEQ ID NO: 645029 - DNA, 25 bp, Mus musculus
gaccggaatccctactgctgtgcct

SEQ ID NO: 645030 - DNA, 25 bp, Mus musculus
gaccggaattccatgcatgtagata

SEQ ID NO: 645031 - DNA, 25 bp, Mus musculus
gaccggaattccttgcatgtagata

SEQ ID NO: 645032 - DNA, 25 bp, Mus musculus
gaccggacggtgactctgggcattt

SEQ ID NO: 645033 - DNA, 25 bp, Mus musculus
gaccggacggtgtctctgggcattt

SEQ ID NO: 645034 - DNA, 25 bp, Mus musculus
gaccggactcctacaggcctgcaaa

SEQ ID NO: 645035 - DNA, 25 bp, Mus musculus
gaccggactccttcaggcctgcaaa

SEQ ID NO: 645036 - DNA, 25 bp, Mus musculus
gaccggagaatcagagacatgatcg

SEQ ID NO: 645037 - DNA, 25 bp, Mus musculus
gaccggagaatctgagacatgatcg

SEQ ID NO: 645038 - DNA, 25 bp, Mus musculus
gaccggagaccaaggttgtacagat

SEQ ID NO: 645039 - DNA, 25 bp, Mus musculus
gaccggagaccatggttgtacagat

SEQ ID NO: 645040 - DNA, 25 bp, Mus musculus
gaccggagcagtagccagattgcct

SEQ ID NO: 645041 - DNA, 25 bp, Mus musculus
gaccggagcagttgccagattgcct

SEQ ID NO: 645042 - DNA, 25 bp, Mus musculus
gaccggaggctgatcgacttagagc

SEQ ID NO: 645043 - DNA, 25 bp, Mus musculus
gaccggaggctgttcgacttagagc

SEQ ID NO: 645044 - DNA, 25 bp, Mus musculus
gaccggagtagacacctggtgaccc

SEQ ID NO: 645045 - DNA, 25 bp, Mus musculus
gaccggagtagagacctggtgaccc

SEQ ID NO: 645046 - DNA, 25 bp, Mus musculus
gaccggatctttaccaacctgtatg

SEQ ID NO: 645047 - DNA, 25 bp, Mus musculus
gaccggatcttttccaacctgtatg

SEQ ID NO: 645048 - DNA, 25 bp, Mus musculus
gaccggatgcgcacctttggcatga

SEQ ID NO: 645049 - DNA, 25 bp, Mus musculus
gaccggatgcgctcctttggcatga

SEQ ID NO: 645050 - DNA, 25 bp, Mus musculus
gaccggccccgactgtaatcggaag

SEQ ID NO: 645051 - DNA, 25 bp, Mus musculus
gaccggccccgagtgtaatcggaag

SEQ ID NO: 645052 - DNA, 25 bp, Mus musculus
gaccggcctagcatttccaacctgg

SEQ ID NO: 645053 - DNA, 25 bp, Mus musculus
gaccggcctagcttttccaacctgg

SEQ ID NO: 645054 - DNA, 25 bp, Mus musculus
gaccggcctgaactcggacaagcag

SEQ ID NO: 645055 - DNA, 25 bp, Mus musculus
gaccggcctgaagtcggacaagcag

SEQ ID NO: 645056 - DNA, 25 bp, Mus musculus
gaccggctacacagaacaactgcaa

SEQ ID NO: 645057 - DNA, 25 bp, Mus musculus
gaccggctacactgaacaactgcaa

SEQ ID NO: 645058 - DNA, 25 bp, Mus musculus
gaccggctccagagggacgccttcg

SEQ ID NO: 645059 - DNA, 25 bp, Mus musculus
gaccggctccagtgggacgccttcg

SEQ ID NO: 645060 - DNA, 25 bp, Mus musculus
gaccggctccttaatgcacttttgg

SEQ ID NO: 645061 - DNA, 25 bp, Mus musculus
gaccggctcctttatgcacttttgg

SEQ ID NO: 645062 - DNA, 25 bp, Mus musculus
gaccggctgaggattattgacaagc

SEQ ID NO: 645063 - DNA, 25 bp, Mus musculus
gaccggctgaggtttattgacaagc

SEQ ID NO: 645064 - DNA, 25 bp, Mus musculus
gaccggctggtgatgcataacaaag

SEQ ID NO: 645065 - DNA, 25 bp, Mus musculus
gaccggctggtgttgcataacaaag

SEQ ID NO: 645066 - DNA, 25 bp, Mus musculus
gaccggcttttcaacgcaggtagaa

SEQ ID NO: 645067 - DNA, 25 bp, Mus musculus
gaccggcttttctacgcaggtagaa

SEQ ID NO: 645068 - DNA, 25 bp, Mus musculus
gaccgggaagtaagcaatccactaa

SEQ ID NO: 645069 - DNA, 25 bp, Mus musculus
gaccgggaagtatgcaatccactaa

SEQ ID NO: 645070 - DNA, 25 bp, Mus musculus
gaccgggacaaacataacgagccca

SEQ ID NO: 645071 - DNA, 25 bp, Mus musculus
gaccgggacaaagataacgagccca

SEQ ID NO: 645072 - DNA, 25 bp, Mus musculus
gaccgggaggtgcatagcatctcat

SEQ ID NO: 645073 - DNA, 25 bp, Mus musculus
gaccgggaggtggatagcatctcat

SEQ ID NO: 645074 - DNA, 25 bp, Mus musculus
gaccgggcatcccagtgaaccatag

SEQ ID NO: 645075 - DNA, 25 bp, Mus musculus
gaccgggcatccgagtgaaccatag

SEQ ID NO: 645076 - DNA, 25 bp, Mus musculus
gaccgggcgacaaatgctgcctgaa

SEQ ID NO: 645077 - DNA, 25 bp, Mus musculus
gaccgggcgacatatgctgcctgaa

SEQ ID NO: 645078 - DNA, 25 bp, Mus musculus
gaccgggtccatcgtggccattgct

SEQ ID NO: 645079 - DNA, 25 bp, Mus musculus
gaccgggtccatggtggccattgct

SEQ ID NO: 645080 - DNA, 25 bp, Mus musculus
gaccgggtcgtgaactactgggctt

SEQ ID NO: 645081 - DNA, 25 bp, Mus musculus
gaccgggtcgtgtactactgggctt

SEQ ID NO: 645082 - DNA, 25 bp, Mus musculus
gaccgggtggtcatcttcagctatc

SEQ ID NO: 645083 - DNA, 25 bp, Mus musculus
gaccgggtggtcttcttcagctatc

SEQ ID NO: 645084 - DNA, 25 bp, Mus musculus
gaccggtactgcctcgaccagaact

SEQ ID NO: 645085 - DNA, 25 bp, Mus musculus
gaccggtactgcgtcgaccagaact

SEQ ID NO: 645086 - DNA, 25 bp, Mus musculus
gaccggttaatgacctccctggatg

SEQ ID NO: 645087 - DNA, 25 bp, Mus musculus
gaccggttaatgtcctccctggatg

SEQ ID NO: 645088 - DNA, 25 bp, Mus musculus
gaccggttctctcaagatgatcctg

SEQ ID NO: 645089 - DNA, 25 bp, Mus musculus
gaccggttctctgaagatgatcctg

SEQ ID NO: 645090 - DNA, 25 bp, Mus musculus
gaccggtttgacatttcatccctgc

SEQ ID NO: 645091 - DNA, 25 bp, Mus musculus
gaccggtttgacttttcatccctgc

SEQ ID NO: 645092 - DNA, 25 bp, Mus musculus
gaccgtaaccctcgcttgcaatggc

SEQ ID NO: 645093 - DNA, 25 bp, Mus musculus
gaccgtaaccctggcttgcaatggc

SEQ ID NO: 645094 - DNA, 25 bp, Mus musculus
gaccgtacctagagctggccagtta

SEQ ID NO: 645095 - DNA, 25 bp, Mus musculus
gaccgtacctagtgctggccagtta

SEQ ID NO: 645096 - DNA, 25 bp, Mus musculus
gaccgtagcttgccgtcgcacgcgt

SEQ ID NO: 645097 - DNA, 25 bp, Mus musculus
gaccgtagcttggcgtcgcacgcgt

SEQ ID NO: 645098 - DNA, 25 bp, Mus musculus
gaccgtaggcttcggaatgctcaag

SEQ ID NO: 645099 - DNA, 25 bp, Mus musculus
gaccgtaggcttgggaatgctcaag

SEQ ID NO: 645100 - DNA, 25 bp, Mus musculus
gaccgtatcattcccctggatggag

SEQ ID NO: 645101 - DNA, 25 bp, Mus musculus
gaccgtatcattgccctggatggag

SEQ ID NO: 645102 - DNA, 25 bp, Mus musculus
gaccgtcaccatcgagttgtcaccg

SEQ ID NO: 645103 - DNA, 25 bp, Mus musculus
gaccgtcaccatggagttgtcaccg

SEQ ID NO: 645104 - DNA, 25 bp, Mus musculus
gaccgtcacggacctcacagaattt

SEQ ID NO: 645105 - DNA, 25 bp, Mus musculus
gaccgtcacggagctcacagaattt

SEQ ID NO: 645106 - DNA, 25 bp, Mus musculus
gaccgtcagtgacctcgttataggc

SEQ ID NO: 645107 - DNA, 25 bp, Mus musculus
gaccgtcagtgagctcgttataggc

SEQ ID NO: 645108 - DNA, 25 bp, Mus musculus
gaccgtcatgcgctcactgggtcag

SEQ ID NO: 645109 - DNA, 25 bp, Mus musculus
gaccgtcatgcggtcactgggtcag

SEQ ID NO: 645110 - DNA, 25 bp, Mus musculus
gaccgtccacagatggagaccgcct

SEQ ID NO: 645111 - DNA, 25 bp, Mus musculus
gaccgtccacagttggagaccgcct

SEQ ID NO: 645112 - DNA, 25 bp, Mus musculus
gaccgtccggagcacctggatgtcc

SEQ ID NO: 645113 - DNA, 25 bp, Mus musculus
gaccgtccggaggacctggatgtcc

SEQ ID NO: 645114 - DNA, 25 bp, Mus musculus
gaccgtcgatgccaccagtgaaacg

SEQ ID NO: 645115 - DNA, 25 bp, Mus musculus
gaccgtcgatgcgaccagtgaaacg

SEQ ID NO: 645116 - DNA, 25 bp, Mus musculus
gaccgtctgaagaaactgcaccagg

SEQ ID NO: 645117 - DNA, 25 bp, Mus musculus
gaccgtctgaagtaactgcaccagg

SEQ ID NO: 645118 - DNA, 25 bp, Mus musculus
gaccgtctgggcagaatgtcacgat

SEQ ID NO: 645119 - DNA, 25 bp, Mus musculus
gaccgtctgggctgaatgtcacgat

SEQ ID NO: 645120 - DNA, 25 bp, Mus musculus
gaccgtgaaggtcaagagttcaaac

SEQ ID NO: 645121 - DNA, 25 bp, Mus musculus
gaccgtgaaggtgaagagttcaaac

SEQ ID NO: 645122 - DNA, 25 bp, Mus musculus
gaccgtgacgtgcacatcaacatct

SEQ ID NO: 645123 - DNA, 25 bp, Mus musculus
gaccgtgacgtggacatcaacatct

SEQ ID NO: 645124 - DNA, 25 bp, Mus musculus
gaccgtgagggtccaggaacacctc

SEQ ID NO: 645125 - DNA, 25 bp, Mus musculus
gaccgtgagggtgcaggaacacctc

SEQ ID NO: 645126 - DNA, 25 bp, Mus musculus
gaccgtgcagacacatctttgtaaa

SEQ ID NO: 645127 - DNA, 25 bp, Mus musculus
gaccgtgcagactcatctttgtaaa

SEQ ID NO: 645128 - DNA, 25 bp, Mus musculus
gaccgtgccagtcttgttctgggtt

SEQ ID NO: 645129 - DNA, 25 bp, Mus musculus
gaccgtgccagtgttgttctgggtt

SEQ ID NO: 645130 - DNA, 25 bp, Mus musculus
gaccgtgcccgtcggcctcattttg

SEQ ID NO: 645131 - DNA, 25 bp, Mus musculus
gaccgtgcccgtgggcctcattttg

SEQ ID NO: 645132 - DNA, 25 bp, Mus musculus
gaccgtgctaatcgacttcgatgca

SEQ ID NO: 645133 - DNA, 25 bp, Mus musculus
gaccgtgctaatggacttcgatgca

SEQ ID NO: 645134 - DNA, 25 bp, Mus musculus
gaccgtgctgataaagactgccgag

SEQ ID NO: 645135 - DNA, 25 bp, Mus musculus
gaccgtgctgattaagactgccgag

SEQ ID NO: 645136 - DNA, 25 bp, Mus musculus
gaccgtggacaacaaaatgatggtt

SEQ ID NO: 645137 - DNA, 25 bp, Mus musculus
gaccgtggacaagaaaatgatggtt

SEQ ID NO: 645138 - DNA, 25 bp, Mus musculus
gaccgtggcacaaacacatgccttg

SEQ ID NO: 645139 - DNA, 25 bp, Mus musculus
gaccgtggcacatacacatgccttg

SEQ ID NO: 645140 - DNA, 25 bp, Mus musculus
gaccgtggcactatcttccccatgg

SEQ ID NO: 645141 - DNA, 25 bp, Mus musculus
gaccgtggcactttcttccccatgg

SEQ ID NO: 645142 - DNA, 25 bp, Mus musculus
gaccgtggccgcatcgcgcttggtc

SEQ ID NO: 645143 - DNA, 25 bp, Mus musculus
gaccgtggccgcttcgcgcttggtc

SEQ ID NO: 645144 - DNA, 25 bp, Mus musculus
gaccgtggccttaattaaaacacag

SEQ ID NO: 645145 - DNA, 25 bp, Mus musculus
gaccgtggcctttattaaaacacag

SEQ ID NO: 645146 - DNA, 25 bp, Mus musculus
gaccgtgggccaagtggtcaaagcc

SEQ ID NO: 645147 - DNA, 25 bp, Mus musculus
gaccgtgggccatgtggtcaaagcc

SEQ ID NO: 645148 - DNA, 25 bp, Mus musculus
gaccgtggtttcaacagtgttgaaa

SEQ ID NO: 645149 - DNA, 25 bp, Mus musculus
gaccgtggtttctacagtgttgaaa

SEQ ID NO: 645150 - DNA, 25 bp, Mus musculus
gaccgtgtcttcctgcctcgtctaa

SEQ ID NO: 645151 - DNA, 25 bp, Mus musculus
gaccgtgtcttcgtgcctcgtctaa

SEQ ID NO: 645152 - DNA, 25 bp, Mus musculus
gaccgtgtggctaccttctactgcg

SEQ ID NO: 645153 - DNA, 25 bp, Mus musculus
gaccgtgtggcttccttctactgcg

SEQ ID NO: 645154 - DNA, 25 bp, Mus musculus
gaccgtgtggtgagctttggtaaca

SEQ ID NO: 645155 - DNA, 25 bp, Mus musculus
gaccgtgtggtgtgctttggtaaca

SEQ ID NO: 645156 - DNA, 25 bp, Mus musculus
gaccgtgttatgcactcccacaagt

SEQ ID NO: 645157 - DNA, 25 bp, Mus musculus
gaccgtgttatggactcccacaagt

SEQ ID NO: 645158 - DNA, 25 bp, Mus musculus
gaccgtgttgcaatccatgaggcta

SEQ ID NO: 645159 - DNA, 25 bp, Mus musculus
gaccgtgttgcattccatgaggcta

SEQ ID NO: 645160 - DNA, 25 bp, Mus musculus
gaccgtgtttaccaggaaccctatg

SEQ ID NO: 645161 - DNA, 25 bp, Mus musculus
gaccgtgtttacgaggaaccctatg

SEQ ID NO: 645162 - DNA, 25 bp, Mus musculus
gaccgttctatcactgtggatggag

SEQ ID NO: 645163 - DNA, 25 bp, Mus musculus
gaccgttctatctctgtggatggag

SEQ ID NO: 645164 - DNA, 25 bp, Mus musculus
gaccgttctggccattgacttcatg

SEQ ID NO: 645165 - DNA, 25 bp, Mus musculus
gaccgttctggcgattgacttcatg

SEQ ID NO: 645166 - DNA, 25 bp, Mus musculus
gaccgttgcctacaagaaaatctta

SEQ ID NO: 645167 - DNA, 25 bp, Mus musculus
gaccgttgcctagaagaaaatctta

SEQ ID NO: 645168 - DNA, 25 bp, Mus musculus
gaccgtttctacctggtgtttgaga

SEQ ID NO: 645169 - DNA, 25 bp, Mus musculus
gaccgtttctacgtggtgtttgaga

SEQ ID NO: 645170 - DNA, 25 bp, Mus musculus
gaccgttttctcacctctgagccat

SEQ ID NO: 645171 - DNA, 25 bp, Mus musculus
gaccgttttctctcctctgagccat

SEQ ID NO: 645172 - DNA, 25 bp, Mus musculus
gacctaaaaaacatgattaatgacg

SEQ ID NO: 645173 - DNA, 25 bp, Mus musculus
gacctaaaaaacttgattaatgacg

SEQ ID NO: 645174 - DNA, 25 bp, Mus musculus
gacctaaagaccattgcacttcgtg

SEQ ID NO: 645175 - DNA, 25 bp, Mus musculus
gacctaaagacctttgcacttcgtg

SEQ ID NO: 645176 - DNA, 25 bp, Mus musculus
gacctaaagcccagcaacctagctg

SEQ ID NO: 645177 - DNA, 25 bp, Mus musculus
gacctaaagccctgcaacctagctg

SEQ ID NO: 645178 - DNA, 25 bp, Mus musculus
gacctaaagtggaaaagcagccttg

SEQ ID NO: 645179 - DNA, 25 bp, Mus musculus
gacctaaagtggtaaagcagccttg

SEQ ID NO: 645180 - DNA, 25 bp, Mus musculus
gacctaactcggagtgggctagcct

SEQ ID NO: 645181 - DNA, 25 bp, Mus musculus
gacctaactcggtgtgggctagcct

SEQ ID NO: 645182 - DNA, 25 bp, Mus musculus
gacctaagacatccactactttgac

SEQ ID NO: 645183 - DNA, 25 bp, Mus musculus
gacctaagacatgcactactttgac

SEQ ID NO: 645184 - DNA, 25 bp, Mus musculus
gacctaagtatcaggctgtgccata

SEQ ID NO: 645185 - DNA, 25 bp, Mus musculus
gacctaagtatctggctgtgccata

SEQ ID NO: 645186 - DNA, 25 bp, Mus musculus
gacctaagtcaaaggcaagtgaagg

SEQ ID NO: 645187 - DNA, 25 bp, Mus musculus
gacctaagtcaatggcaagtgaagg

SEQ ID NO: 645188 - DNA, 25 bp, Mus musculus
gacctaagtgggaagctgattatca

SEQ ID NO: 645189 - DNA, 25 bp, Mus musculus
gacctaagtgggtagctgattatca

SEQ ID NO: 645190 - DNA, 25 bp, Mus musculus
gacctaagtgtgaaataccctggag

SEQ ID NO: 645191 - DNA, 25 bp, Mus musculus
gacctaagtgtgtaataccctggag

SEQ ID NO: 645192 - DNA, 25 bp, Mus musculus
gacctaatcgagacctgttgtgcag

SEQ ID NO: 645193 - DNA, 25 bp, Mus musculus
gacctaatcgagtcctgttgtgcag

SEQ ID NO: 645194 - DNA, 25 bp, Mus musculus
gacctaatgaggatccccagcagct

SEQ ID NO: 645195 - DNA, 25 bp, Mus musculus
gacctaatgaggttccccagcagct

SEQ ID NO: 645196 - DNA, 25 bp, Mus musculus
gacctaattctcaatggtaccaagg

SEQ ID NO: 645197 - DNA, 25 bp, Mus musculus
gacctaattctctatggtaccaagg

SEQ ID NO: 645198 - DNA, 25 bp, Mus musculus
gacctaatttggatctactgagaac

SEQ ID NO: 645199 - DNA, 25 bp, Mus musculus
gacctaatttggttctactgagaac

SEQ ID NO: 645200 - DNA, 25 bp, Mus musculus
gacctacaactcagcgcatgactac

SEQ ID NO: 645201 - DNA, 25 bp, Mus musculus
gacctacaactctgcgcatgactac

SEQ ID NO: 645202 - DNA, 25 bp, Mus musculus
gacctacaaggtctgcgcagcatca

SEQ ID NO: 645203 - DNA, 25 bp, Mus musculus
gacctacaaggtgtgcgcagcatca

SEQ ID NO: 645204 - DNA, 25 bp, Mus musculus
gacctacaagtgagtgttttctcct

SEQ ID NO: 645205 - DNA, 25 bp, Mus musculus
gacctacaagtgtgtgttttctcct

SEQ ID NO: 645206 - DNA, 25 bp, Mus musculus
gacctacaccgtatacctagagctg

SEQ ID NO: 645207 - DNA, 25 bp, Mus musculus
gacctacaccgtttacctagagctg

SEQ ID NO: 645208 - DNA, 25 bp, Mus musculus
gacctacacttaagagaagcttctg

SEQ ID NO: 645209 - DNA, 25 bp, Mus musculus
gacctacacttatgagaagcttctg

SEQ ID NO: 645210 - DNA, 25 bp, Mus musculus
gacctacagcaacgccggcgtgtct

SEQ ID NO: 645211 - DNA, 25 bp, Mus musculus
gacctacagcaaggccggcgtgtct

SEQ ID NO: 645212 - DNA, 25 bp, Mus musculus
gacctacagttgcaccggagactcc

SEQ ID NO: 645213 - DNA, 25 bp, Mus musculus
gacctacagttggaccggagactcc

SEQ ID NO: 645214 - DNA, 25 bp, Mus musculus
gacctacatgagatgtatcacttga

SEQ ID NO: 645215 - DNA, 25 bp, Mus musculus
gacctacatgagttgtatcacttga

SEQ ID NO: 645216 - DNA, 25 bp, Mus musculus
gacctaccaagaactacctgagcta

SEQ ID NO: 645217 - DNA, 25 bp, Mus musculus
gacctaccaagatctacctgagcta

SEQ ID NO: 645218 - DNA, 25 bp, Mus musculus
gacctaccaataaggaatcccaacc

SEQ ID NO: 645219 - DNA, 25 bp, Mus musculus
gacctaccaatatggaatcccaacc

SEQ ID NO: 645220 - DNA, 25 bp, Mus musculus
gacctaccatgacacagcactagta

SEQ ID NO: 645221 - DNA, 25 bp, Mus musculus
gacctaccatgagacagcactagta

SEQ ID NO: 645222 - DNA, 25 bp, Mus musculus
gacctacctgctacaattaactaca

SEQ ID NO: 645223 - DNA, 25 bp, Mus musculus
gacctacctgcttcaattaactaca

SEQ ID NO: 645224 - DNA, 25 bp, Mus musculus
gacctacgccagaggtgtcaaaccc

SEQ ID NO: 645225 - DNA, 25 bp, Mus musculus
gacctacgccagtggtgtcaaaccc

SEQ ID NO: 645226 - DNA, 25 bp, Mus musculus
gacctacggcggagggatctggagc

SEQ ID NO: 645227 - DNA, 25 bp, Mus musculus
gacctacggcggtgggatctggagc

SEQ ID NO: 645228 - DNA, 25 bp, Mus musculus
gacctacggtgtcgcaaatccagca

SEQ ID NO: 645229 - DNA, 25 bp, Mus musculus
gacctacggtgtggcaaatccagca

SEQ ID NO: 645230 - DNA, 25 bp, Mus musculus
gacctactaaatcagcagagaatga

SEQ ID NO: 645231 - DNA, 25 bp, Mus musculus
gacctactaaatgagcagagaatga

SEQ ID NO: 645232 - DNA, 25 bp, Mus musculus
gacctactacctctgtcaacaagaa

SEQ ID NO: 645233 - DNA, 25 bp, Mus musculus
gacctactacctgtgtcaacaagaa

SEQ ID NO: 645234 - DNA, 25 bp, Mus musculus
gacctactgcagaagagacattgga

SEQ ID NO: 645235 - DNA, 25 bp, Mus musculus
gacctactgcagtagagacattgga

SEQ ID NO: 645236 - DNA, 25 bp, Mus musculus
gacctagaagatcagaccattgatg

SEQ ID NO: 645237 - DNA, 25 bp, Mus musculus
gacctagaagatgagaccattgatg

SEQ ID NO: 645238 - DNA, 25 bp, Mus musculus
gacctagaagtaaccaacaaaagtg

SEQ ID NO: 645239 - DNA, 25 bp, Mus musculus
gacctagaagtatccaacaaaagtg

SEQ ID NO: 645240 - DNA, 25 bp, Mus musculus
gacctagacaaccacaagtacattg

SEQ ID NO: 645241 - DNA, 25 bp, Mus musculus
gacctagacaacgacaagtacattg

SEQ ID NO: 645242 - DNA, 25 bp, Mus musculus
gacctagacacgacaattgctccag

SEQ ID NO: 645243 - DNA, 25 bp, Mus musculus
gacctagacacgtcaattgctccag

SEQ ID NO: 645244 - DNA, 25 bp, Mus musculus
gacctagagcgtctggtgactccag

SEQ ID NO: 645245 - DNA, 25 bp, Mus musculus
gacctagagcgtgtggtgactccag

SEQ ID NO: 645246 - DNA, 25 bp, Mus musculus
gacctagaggccatcgccatggtta

SEQ ID NO: 645247 - DNA, 25 bp, Mus musculus
gacctagaggccttcgccatggtta

SEQ ID NO: 645248 - DNA, 25 bp, Mus musculus
gacctagatttgatttgtataccta

SEQ ID NO: 645249 - DNA, 25 bp, Mus musculus
gacctagatttgttttgtataccta

SEQ ID NO: 645250 - DNA, 25 bp, Mus musculus
gacctagccagccatctcctgatga

SEQ ID NO: 645251 - DNA, 25 bp, Mus musculus
gacctagccagcgatctcctgatga

SEQ ID NO: 645252 - DNA, 25 bp, Mus musculus
gacctagcctgtcaatttgggcggc

SEQ ID NO: 645253 - DNA, 25 bp, Mus musculus
gacctagcctgtgaatttgggcggc

SEQ ID NO: 645254 - DNA, 25 bp, Mus musculus
gacctagctgggactagaacttgct

SEQ ID NO: 645255 - DNA, 25 bp, Mus musculus
gacctagctgggtctagaacttgct

SEQ ID NO: 645256 - DNA, 25 bp, Mus musculus
gacctagctgtacctttgggctaca

SEQ ID NO: 645257 - DNA, 25 bp, Mus musculus
gacctagctgtagctttgggctaca

SEQ ID NO: 645258 - DNA, 25 bp, Mus musculus
gacctaggatccctggccttggaga

SEQ ID NO: 645259 - DNA, 25 bp, Mus musculus
gacctaggatccgtggccttggaga

SEQ ID NO: 645260 - DNA, 25 bp, Mus musculus
gacctatatccgagaactctcgtgt

SEQ ID NO: 645261 - DNA, 25 bp, Mus musculus
gacctatatccgtgaactctcgtgt

SEQ ID NO: 645262 - DNA, 25 bp, Mus musculus
gacctatatgcgacaagtgctagag

SEQ ID NO: 645263 - DNA, 25 bp, Mus musculus
gacctatatgcgtcaagtgctagag

SEQ ID NO: 645264 - DNA, 25 bp, Mus musculus
gacctatctctacacgacactgtca

SEQ ID NO: 645265 - DNA, 25 bp, Mus musculus
gacctatctctagacgacactgtca

SEQ ID NO: 645266 - DNA, 25 bp, Mus musculus
gacctatcttggcttctcgactggg

SEQ ID NO: 645267 - DNA, 25 bp, Mus musculus
gacctatcttgggttctcgactggg

SEQ ID NO: 645268 - DNA, 25 bp, Mus musculus
gacctatgaaggaggtgtagacttg

SEQ ID NO: 645269 - DNA, 25 bp, Mus musculus
gacctatgaaggtggtgtagacttg

SEQ ID NO: 645270 - DNA, 25 bp, Mus musculus
gacctatgaagtcctgccgtcgtcc

SEQ ID NO: 645271 - DNA, 25 bp, Mus musculus
gacctatgaagtgctgccgtcgtcc

SEQ ID NO: 645272 - DNA, 25 bp, Mus musculus
gacctatgagccactctttggtgca

SEQ ID NO: 645273 - DNA, 25 bp, Mus musculus
gacctatgagcctctctttggtgca

SEQ ID NO: 645274 - DNA, 25 bp, Mus musculus
gacctattacttctctgggcctcag

SEQ ID NO: 645275 - DNA, 25 bp, Mus musculus
gacctattacttgtctgggcctcag

SEQ ID NO: 645276 - DNA, 25 bp, Mus musculus
gacctcaactgcctagctgaaggcc

SEQ ID NO: 645277 - DNA, 25 bp, Mus musculus
gacctcaactgcgtagctgaaggcc

SEQ ID NO: 645278 - DNA, 25 bp, Mus musculus
gacctcaagacccagtggccgaagt

SEQ ID NO: 645279 - DNA, 25 bp, Mus musculus
gacctcaagaccgagtggccgaagt

SEQ ID NO: 645280 - DNA, 25 bp, Mus musculus
gacctcaagattcgctctgagtgcc

SEQ ID NO: 645281 - DNA, 25 bp, Mus musculus
gacctcaagattggctctgagtgcc

SEQ ID NO: 645282 - DNA, 25 bp, Mus musculus
gacctcaaggtccaagatgccaatc

SEQ ID NO: 645283 - DNA, 25 bp, Mus musculus
gacctcaaggtcgaagatgccaatc

SEQ ID NO: 645284 - DNA, 25 bp, Mus musculus
gacctcaatcacaaacaactatttt

SEQ ID NO: 645285 - DNA, 25 bp, Mus musculus
gacctcaatcactaacaactatttt

SEQ ID NO: 645286 - DNA, 25 bp, Mus musculus
gacctcacagtacggtatgaccttc

SEQ ID NO: 645287 - DNA, 25 bp, Mus musculus
gacctcacagtagggtatgaccttc

SEQ ID NO: 645288 - DNA, 25 bp, Mus musculus
gacctcaccaacaaagcttcgatgg

SEQ ID NO: 645289 - DNA, 25 bp, Mus musculus
gacctcaccaactaagcttcgatgg

SEQ ID NO: 645290 - DNA, 25 bp, Mus musculus
gacctcaccgagagcaaggtcttcc

SEQ ID NO: 645291 - DNA, 25 bp, Mus musculus
gacctcaccgagtgcaaggtcttcc

SEQ ID NO: 645292 - DNA, 25 bp, Mus musculus
gacctcactaagaagtattttgctc

SEQ ID NO: 645293 - DNA, 25 bp, Mus musculus
gacctcactaagtagtattttgctc

SEQ ID NO: 645294 - DNA, 25 bp, Mus musculus
gacctcactgggaagctataacaag

SEQ ID NO: 645295 - DNA, 25 bp, Mus musculus
gacctcactgggtagctataacaag

SEQ ID NO: 645296 - DNA, 25 bp, Mus musculus
gacctcacttatcgacattgacacg

SEQ ID NO: 645297 - DNA, 25 bp, Mus musculus
gacctcacttatggacattgacacg

SEQ ID NO: 645298 - DNA, 25 bp, Mus musculus
gacctcacttccaaaggcgcagaag

SEQ ID NO: 645299 - DNA, 25 bp, Mus musculus
gacctcacttcctaaggcgcagaag

SEQ ID NO: 645300 - DNA, 25 bp, Mus musculus
gacctcagacaacatcccaaaggga

SEQ ID NO: 645301 - DNA, 25 bp, Mus musculus
gacctcagacaagatcccaaaggga

SEQ ID NO: 645302 - DNA, 25 bp, Mus musculus
gacctcagacacatgacatggaagc

SEQ ID NO: 645303 - DNA, 25 bp, Mus musculus
gacctcagacacttgacatggaagc

SEQ ID NO: 645304 - DNA, 25 bp, Mus musculus
gacctcagactcagacactgagatt

SEQ ID NO: 645305 - DNA, 25 bp, Mus musculus
gacctcagactctgacactgagatt

SEQ ID NO: 645306 - DNA, 25 bp, Mus musculus
gacctcagcgctacgggtgtttccg

SEQ ID NO: 645307 - DNA, 25 bp, Mus musculus
gacctcagcgcttcgggtgtttccg

SEQ ID NO: 645308 - DNA, 25 bp, Mus musculus
gacctcagctggatcctgtgttcta

SEQ ID NO: 645309 - DNA, 25 bp, Mus musculus
gacctcagctggttcctgtgttcta

SEQ ID NO: 645310 - DNA, 25 bp, Mus musculus
gacctcaggaagagtgacgtggttc

SEQ ID NO: 645311 - DNA, 25 bp, Mus musculus
gacctcaggaagtgtgacgtggttc

SEQ ID NO: 645312 - DNA, 25 bp, Mus musculus
gacctcaggagtaaaggtgttgctg

SEQ ID NO: 645313 - DNA, 25 bp, Mus musculus
gacctcaggagttaaggtgttgctg

SEQ ID NO: 645314 - DNA, 25 bp, Mus musculus
gacctcaggcggacagggctgccct

SEQ ID NO: 645315 - DNA, 25 bp, Mus musculus
gacctcaggcggtcagggctgccct

SEQ ID NO: 645316 - DNA, 25 bp, Mus musculus
gacctcaggctgagtaaaatcagaa

SEQ ID NO: 645317 - DNA, 25 bp, Mus musculus
gacctcaggctgtgtaaaatcagaa

SEQ ID NO: 645318 - DNA, 25 bp, Mus musculus
gacctcagggcaatccaggtgcagc

SEQ ID NO: 645319 - DNA, 25 bp, Mus musculus
gacctcagggcattccaggtgcagc

SEQ ID NO: 645320 - DNA, 25 bp, Mus musculus
gacctcagtacaagccgatctctgc

SEQ ID NO: 645321 - DNA, 25 bp, Mus musculus
gacctcagtacatgccgatctctgc

SEQ ID NO: 645322 - DNA, 25 bp, Mus musculus
gacctcagtagtcttcaacaagctg

SEQ ID NO: 645323 - DNA, 25 bp, Mus musculus
gacctcagtagtgttcaacaagctg

SEQ ID NO: 645324 - DNA, 25 bp, Mus musculus
gacctcagtgtgatctaccctggga

SEQ ID NO: 645325 - DNA, 25 bp, Mus musculus
gacctcagtgtgttctaccctggga

SEQ ID NO: 645326 - DNA, 25 bp, Mus musculus
gacctcatcactcaagtttgaaata

SEQ ID NO: 645327 - DNA, 25 bp, Mus musculus
gacctcatcactgaagtttgaaata

SEQ ID NO: 645328 - DNA, 25 bp, Mus musculus
gacctcatcagtacttcacctgctg

SEQ ID NO: 645329 - DNA, 25 bp, Mus musculus
gacctcatcagttcttcacctgctg

SEQ ID NO: 645330 - DNA, 25 bp, Mus musculus
gacctcatctacaacgtgagctgga

SEQ ID NO: 645331 - DNA, 25 bp, Mus musculus
gacctcatctactacgtgagctgga

SEQ ID NO: 645332 - DNA, 25 bp, Mus musculus
gacctcatggtcaggaatgactccc

SEQ ID NO: 645333 - DNA, 25 bp, Mus musculus
gacctcatggtctggaatgactccc

SEQ ID NO: 645334 - DNA, 25 bp, Mus musculus
gacctcatgtccatcctggtggctt

SEQ ID NO: 645335 - DNA, 25 bp, Mus musculus
gacctcatgtccttcctggtggctt

SEQ ID NO: 645336 - DNA, 25 bp, Mus musculus
gacctcattgacagactgactagaa

SEQ ID NO: 645337 - DNA, 25 bp, Mus musculus
gacctcattgactgactgactagaa

SEQ ID NO: 645338 - DNA, 25 bp, Mus musculus
gacctcattggacgcgggcacagta

SEQ ID NO: 645339 - DNA, 25 bp, Mus musculus
gacctcattggaggcgggcacagta

SEQ ID NO: 645340 - DNA, 25 bp, Mus musculus
gacctccaaaataccatctatggga

SEQ ID NO: 645341 - DNA, 25 bp, Mus musculus
gacctccaaaattccatctatggga

SEQ ID NO: 645342 - DNA, 25 bp, Mus musculus
gacctccacaaccaagttttgcagg

SEQ ID NO: 645343 - DNA, 25 bp, Mus musculus
gacctccacaacgaagttttgcagg

SEQ ID NO: 645344 - DNA, 25 bp, Mus musculus
gacctccacagacagcttcttatga

SEQ ID NO: 645345 - DNA, 25 bp, Mus musculus
gacctccacagagagcttcttatga

SEQ ID NO: 645346 - DNA, 25 bp, Mus musculus
gacctccaggagaagattgcgcatg

SEQ ID NO: 645347 - DNA, 25 bp, Mus musculus
gacctccaggagtagattgcgcatg

SEQ ID NO: 645348 - DNA, 25 bp, Mus musculus
gacctccaggcccaaatctatagga

SEQ ID NO: 645349 - DNA, 25 bp, Mus musculus
gacctccaggccctgacggtagcag

SEQ ID NO: 645350 - DNA, 25 bp, Mus musculus
gacctccaggccgaaatctatagga

SEQ ID NO: 645351 - DNA, 25 bp, Mus musculus
gacctccaggccgtgacggtagcag

SEQ ID NO: 645352 - DNA, 25 bp, Mus musculus
gacctccagtctcttgtgccagaag

SEQ ID NO: 645353 - DNA, 25 bp, Mus musculus
gacctccagtctgttgtgccagaag

SEQ ID NO: 645354 - DNA, 25 bp, Mus musculus
gacctccagtggaggagtcaccggc

SEQ ID NO: 645355 - DNA, 25 bp, Mus musculus
gacctccagtggtggagtcaccggc

SEQ ID NO: 645356 - DNA, 25 bp, Mus musculus
gacctccatggtccatgagctcaac

SEQ ID NO: 645357 - DNA, 25 bp, Mus musculus
gacctccatggtgcatgagctcaac

SEQ ID NO: 645358 - DNA, 25 bp, Mus musculus
gacctccattaaatgaatcctcgat

SEQ ID NO: 645359 - DNA, 25 bp, Mus musculus
gacctccattaattgaatcctcgat

SEQ ID NO: 645360 - DNA, 25 bp, Mus musculus
gacctccccagacgaatctggcaaa

SEQ ID NO: 645361 - DNA, 25 bp, Mus musculus
gacctccccagaggaatctggcaaa

SEQ ID NO: 645362 - DNA, 25 bp, Mus musculus
gacctccccgacagcataaaaactg

SEQ ID NO: 645363 - DNA, 25 bp, Mus musculus
gacctccccgactgcataaaaactg

SEQ ID NO: 645364 - DNA, 25 bp, Mus musculus
gacctcccgtcaatcactctggaat

SEQ ID NO: 645365 - DNA, 25 bp, Mus musculus
gacctcccgtcattcactctggaat

SEQ ID NO: 645366 - DNA, 25 bp, Mus musculus
gacctccgaagcaaactggccatca

SEQ ID NO: 645367 - DNA, 25 bp, Mus musculus
gacctccgaagctaactggccatca

SEQ ID NO: 645368 - DNA, 25 bp, Mus musculus
gacctccgatctaggacttcctcgt

SEQ ID NO: 645369 - DNA, 25 bp, Mus musculus
gacctccgatcttggacttcctcgt

SEQ ID NO: 645370 - DNA, 25 bp, Mus musculus
gacctccgatgcaaagagcactcca

SEQ ID NO: 645371 - DNA, 25 bp, Mus musculus
gacctccgatgctaagagcactcca

SEQ ID NO: 645372 - DNA, 25 bp, Mus musculus
gacctccgcaacacccggaatgaga

SEQ ID NO: 645373 - DNA, 25 bp, Mus musculus
gacctccgcaactcccggaatgaga

SEQ ID NO: 645374 - DNA, 25 bp, Mus musculus
gacctccggagtataaacaatgcat

SEQ ID NO: 645375 - DNA, 25 bp, Mus musculus
gacctccggagtttaaacaatgcat

SEQ ID NO: 645376 - DNA, 25 bp, Mus musculus
gacctccgtagtctgctggtcacga

SEQ ID NO: 645377 - DNA, 25 bp, Mus musculus
gacctccgtagtgtgctggtcacga

SEQ ID NO: 645378 - DNA, 25 bp, Mus musculus
gacctcctcatactcgtgcatgctg

SEQ ID NO: 645379 - DNA, 25 bp, Mus musculus
gacctcctcatagtcgtgcatgctg

SEQ ID NO: 645380 - DNA, 25 bp, Mus musculus
gacctcctcatgctgctgacacagg

SEQ ID NO: 645381 - DNA, 25 bp, Mus musculus
gacctcctcatggtgctgacacagg

SEQ ID NO: 645382 - DNA, 25 bp, Mus musculus
gacctcctgaacaagttctaccagg

SEQ ID NO: 645383 - DNA, 25 bp, Mus musculus
gacctcctgaactagttctaccagg

SEQ ID NO: 645384 - DNA, 25 bp, Mus musculus
gacctcctgagtctcttcagtgaca

SEQ ID NO: 645385 - DNA, 25 bp, Mus musculus
gacctcctgagtgtcttcagtgaca

SEQ ID NO: 645386 - DNA, 25 bp, Mus musculus
gacctcctgcagattcggtcctatg

SEQ ID NO: 645387 - DNA, 25 bp, Mus musculus
gacctcctgcagtttcggtcctatg

SEQ ID NO: 645388 - DNA, 25 bp, Mus musculus
gacctcctggacacaagggtgccaa

SEQ ID NO: 645389 - DNA, 25 bp, Mus musculus
gacctcctggactcaagggtgccaa

SEQ ID NO: 645390 - DNA, 25 bp, Mus musculus
gacctcctggcgatcacgctgttgc

SEQ ID NO: 645391 - DNA, 25 bp, Mus musculus
gacctcctggcgttcacgctgttgc

SEQ ID NO: 645392 - DNA, 25 bp, Mus musculus
gacctcctgtgtacacatgatggaa

SEQ ID NO: 645393 - DNA, 25 bp, Mus musculus
gacctcctgtgttcacatgatggaa

SEQ ID NO: 645394 - DNA, 25 bp, Mus musculus
gacctccttcaaccggaaatatcca

SEQ ID NO: 645395 - DNA, 25 bp, Mus musculus
gacctccttcaagcggaaatatcca

SEQ ID NO: 645396 - DNA, 25 bp, Mus musculus
gacctcgaaggtacttcctctgctg

SEQ ID NO: 645397 - DNA, 25 bp, Mus musculus
gacctcgaaggttcttcctctgctg

SEQ ID NO: 645398 - DNA, 25 bp, Mus musculus
gacctcgacaggattttcacgatta

SEQ ID NO: 645399 - DNA, 25 bp, Mus musculus
gacctcgacaggtttttcacgatta

SEQ ID NO: 645400 - DNA, 25 bp, Mus musculus
gacctcgaggatactgggtacccag

SEQ ID NO: 645401 - DNA, 25 bp, Mus musculus
gacctcgaggattctgggtacccag

SEQ ID NO: 645402 - DNA, 25 bp, Mus musculus
gacctcgcgggtaaaaatctgcacc

SEQ ID NO: 645403 - DNA, 25 bp, Mus musculus
gacctcgcgggttaaaatctgcacc

SEQ ID NO: 645404 - DNA, 25 bp, Mus musculus
gacctcggctttcggaaggccaaga

SEQ ID NO: 645405 - DNA, 25 bp, Mus musculus
gacctcggctttgggaaggccaaga

SEQ ID NO: 645406 - DNA, 25 bp, Mus musculus
gacctcgttatacgcttactcgatg

SEQ ID NO: 645407 - DNA, 25 bp, Mus musculus
gacctcgttataggcttactcgatg

SEQ ID NO: 645408 - DNA, 25 bp, Mus musculus
gacctcgttcagcatataacattta

SEQ ID NO: 645409 - DNA, 25 bp, Mus musculus
gacctcgttcaggatataacattta

SEQ ID NO: 645410 - DNA, 25 bp, Mus musculus
gacctcgtttctccctgtgacattc

SEQ ID NO: 645411 - DNA, 25 bp, Mus musculus
gacctcgtttctgcctgtgacattc

SEQ ID NO: 645412 - DNA, 25 bp, Mus musculus
gacctctacggcagggcgcagctca

SEQ ID NO: 645413 - DNA, 25 bp, Mus musculus
gacctctacggctgggcgcagctca

SEQ ID NO: 645414 - DNA, 25 bp, Mus musculus
gacctctagtgcctcgacagatgaa

SEQ ID NO: 645415 - DNA, 25 bp, Mus musculus
gacctctagtgcgtcgacagatgaa

SEQ ID NO: 645416 - DNA, 25 bp, Mus musculus
gacctctataaaaaactctaccaca

SEQ ID NO: 645417 - DNA, 25 bp, Mus musculus
gacctctataaataactctaccaca

SEQ ID NO: 645418 - DNA, 25 bp, Mus musculus
gacctctcaagccttgaagaggtag

SEQ ID NO: 645419 - DNA, 25 bp, Mus musculus
gacctctcaagcgttgaagaggtag

SEQ ID NO: 645420 - DNA, 25 bp, Mus musculus
gacctctccatcctacactagaggg

SEQ ID NO: 645421 - DNA, 25 bp, Mus musculus
gacctctccatcgtacactagaggg

SEQ ID NO: 645422 - DNA, 25 bp, Mus musculus
gacctctccctccaggaaaggtgga

SEQ ID NO: 645423 - DNA, 25 bp, Mus musculus
gacctctccctcgaggaaaggtgga

SEQ ID NO: 645424 - DNA, 25 bp, Mus musculus
gacctctcgaagagttggatacagg

SEQ ID NO: 645425 - DNA, 25 bp, Mus musculus
gacctctcgaagtgttggatacagg

SEQ ID NO: 645426 - DNA, 25 bp, Mus musculus
gacctctctacaaggacgtacaggc

SEQ ID NO: 645427 - DNA, 25 bp, Mus musculus
gacctctctacatggacgtacaggc

SEQ ID NO: 645428 - DNA, 25 bp, Mus musculus
gacctctctacgacatagttgaata

SEQ ID NO: 645429 - DNA, 25 bp, Mus musculus
gacctctctacgtcatagttgaata

SEQ ID NO: 645430 - DNA, 25 bp, Mus musculus
gacctctctggaacccatgaagcag

SEQ ID NO: 645431 - DNA, 25 bp, Mus musculus
gacctctctggatcccatgaagcag

SEQ ID NO: 645432 - DNA, 25 bp, Mus musculus
gacctctgacctaagacaggcctat

SEQ ID NO: 645433 - DNA, 25 bp, Mus musculus
gacctctgaccttagacaggcctat

SEQ ID NO: 645434 - DNA, 25 bp, Mus musculus
gacctctgagataggctggctcacc

SEQ ID NO: 645435 - DNA, 25 bp, Mus musculus
gacctctgagattggctggctcacc

SEQ ID NO: 645436 - DNA, 25 bp, Mus musculus
gacctctgagtaacctgatgacctg

SEQ ID NO: 645437 - DNA, 25 bp, Mus musculus
gacctctgagtatcctgatgacctg

SEQ ID NO: 645438 - DNA, 25 bp, Mus musculus
gacctctgccggaggaggcactttt

SEQ ID NO: 645439 - DNA, 25 bp, Mus musculus
gacctctgccggtggaggcactttt

SEQ ID NO: 645440 - DNA, 25 bp, Mus musculus
gacctctgcggccatgacaagtgcc

SEQ ID NO: 645441 - DNA, 25 bp, Mus musculus
gacctctgcggcgatgacaagtgcc

SEQ ID NO: 645442 - DNA, 25 bp, Mus musculus
gacctctgctaacgaaggactcctc

SEQ ID NO: 645443 - DNA, 25 bp, Mus musculus
gacctctgctaaggaaggactcctc

SEQ ID NO: 645444 - DNA, 25 bp, Mus musculus
gacctctggatacacagttaactgg

SEQ ID NO: 645445 - DNA, 25 bp, Mus musculus
gacctctggatagacagttaactgg

SEQ ID NO: 645446 - DNA, 25 bp, Mus musculus
gacctctggcttagagacatgccca

SEQ ID NO: 645447 - DNA, 25 bp, Mus musculus
gacctctggctttgagacatgccca

SEQ ID NO: 645448 - DNA, 25 bp, Mus musculus
gacctctggtccagtggcatcacag

SEQ ID NO: 645449 - DNA, 25 bp, Mus musculus
gacctctggtcctgtggcatcacag

SEQ ID NO: 645450 - DNA, 25 bp, Mus musculus
gacctctgtggacacttcatctggg

SEQ ID NO: 645451 - DNA, 25 bp, Mus musculus
gacctctgtggagacttcatctggg

SEQ ID NO: 645452 - DNA, 25 bp, Mus musculus
gacctctgttgaaccctgacatgag

SEQ ID NO: 645453 - DNA, 25 bp, Mus musculus
gacctctgttgatccctgacatgag

SEQ ID NO: 645454 - DNA, 25 bp, Mus musculus
gacctcttcagcaaggacaagcgag

SEQ ID NO: 645455 - DNA, 25 bp, Mus musculus
gacctcttcagctaggacaagcgag

SEQ ID NO: 645456 - DNA, 25 bp, Mus musculus
gacctcttcaggatggagatattat

SEQ ID NO: 645457 - DNA, 25 bp, Mus musculus
gacctcttcaggttggagatattat

SEQ ID NO: 645458 - DNA, 25 bp, Mus musculus
gacctcttccacaacagcattgctg

SEQ ID NO: 645459 - DNA, 25 bp, Mus musculus
gacctcttccactacagcattgctg

SEQ ID NO: 645460 - DNA, 25 bp, Mus musculus
gacctcttccgtaagactaaggcag

SEQ ID NO: 645461 - DNA, 25 bp, Mus musculus
gacctcttccgtaatgcgggatgtg

SEQ ID NO: 645462 - DNA, 25 bp, Mus musculus
gacctcttccgttagactaaggcag

SEQ ID NO: 645463 - DNA, 25 bp, Mus musculus
gacctcttccgttatgcgggatgtg

SEQ ID NO: 645464 - DNA, 25 bp, Mus musculus
gacctcttcgacagggtggcaggaa

SEQ ID NO: 645465 - DNA, 25 bp, Mus musculus
gacctcttcgactgggtggcaggaa

SEQ ID NO: 645466 - DNA, 25 bp, Mus musculus
gacctcttctctcgaatcaacgaca

SEQ ID NO: 645467 - DNA, 25 bp, Mus musculus
gacctcttctctggaatcaacgaca

SEQ ID NO: 645468 - DNA, 25 bp, Mus musculus
gacctcttgattctcctctcggacg

SEQ ID NO: 645469 - DNA, 25 bp, Mus musculus
gacctcttgattgtcctctcggacg

SEQ ID NO: 645470 - DNA, 25 bp, Mus musculus
gacctcttgtcacagaataaccgcc

SEQ ID NO: 645471 - DNA, 25 bp, Mus musculus
gacctcttgtcagagaataaccgcc

SEQ ID NO: 645472 - DNA, 25 bp, Mus musculus
gacctctttcaccattgccatattg

SEQ ID NO: 645473 - DNA, 25 bp, Mus musculus
gacctctttcacgattgccatattg

SEQ ID NO: 645474 - DNA, 25 bp, Mus musculus
gacctctttggccagaagattaaga

SEQ ID NO: 645475 - DNA, 25 bp, Mus musculus
gacctctttggcgagaagattaaga

SEQ ID NO: 645476 - DNA, 25 bp, Mus musculus
gacctgaaaatgaggtgcctgagcc

SEQ ID NO: 645477 - DNA, 25 bp, Mus musculus
gacctgaaaatgtggtgcctgagcc

SEQ ID NO: 645478 - DNA, 25 bp, Mus musculus
gacctgaaaccgcagaaccttctca

SEQ ID NO: 645479 - DNA, 25 bp, Mus musculus
gacctgaaaccggagaaccttctca

SEQ ID NO: 645480 - DNA, 25 bp, Mus musculus
gacctgaaactcctttccttcagta

SEQ ID NO: 645481 - DNA, 25 bp, Mus musculus
gacctgaaactcgtttccttcagta

SEQ ID NO: 645482 - DNA, 25 bp, Mus musculus
gacctgaagaagcagtatcgaaatg

SEQ ID NO: 645483 - DNA, 25 bp, Mus musculus
gacctgaagaagcatggttgcaccg

SEQ ID NO: 645484 - DNA, 25 bp, Mus musculus
gacctgaagaaggagtatcgaaatg

SEQ ID NO: 645485 - DNA, 25 bp, Mus musculus
gacctgaagaaggatggttgcaccg

SEQ ID NO: 645486 - DNA, 25 bp, Mus musculus
gacctgaagagtactttggtcactc

SEQ ID NO: 645487 - DNA, 25 bp, Mus musculus
gacctgaagagttctttggtcactc

SEQ ID NO: 645488 - DNA, 25 bp, Mus musculus
gacctgaagccccagaatcttctca

SEQ ID NO: 645489 - DNA, 25 bp, Mus musculus
gacctgaagcccgagaatcttctca

SEQ ID NO: 645490 - DNA, 25 bp, Mus musculus
gacctgaaggaaatccagcgggctg

SEQ ID NO: 645491 - DNA, 25 bp, Mus musculus
gacctgaaggaattccagcgggctg

SEQ ID NO: 645492 - DNA, 25 bp, Mus musculus
gacctgaagttcagcatggatggag

SEQ ID NO: 645493 - DNA, 25 bp, Mus musculus
gacctgaagttctgcatggatggag

SEQ ID NO: 645494 - DNA, 25 bp, Mus musculus
gacctgaatcgacggcgcactggac

SEQ ID NO: 645495 - DNA, 25 bp, Mus musculus
gacctgaatcgagggcgcactggac

SEQ ID NO: 645496 - DNA, 25 bp, Mus musculus
gacctgaatggtcaagatcgtagga

SEQ ID NO: 645497 - DNA, 25 bp, Mus musculus
gacctgaatggtgaagatcgtagga

SEQ ID NO: 645498 - DNA, 25 bp, Mus musculus
gacctgaattaaccacagcctgaga

SEQ ID NO: 645499 - DNA, 25 bp, Mus musculus
gacctgaattaagcacagcctgaga

SEQ ID NO: 645500 - DNA, 25 bp, Mus musculus
gacctgacagaacctatcgcatctc

SEQ ID NO: 645501 - DNA, 25 bp, Mus musculus
gacctgacagaagctatcgcatctc

SEQ ID NO: 645502 - DNA, 25 bp, Mus musculus
gacctgacagccatgaggacgacct

SEQ ID NO: 645503 - DNA, 25 bp, Mus musculus
gacctgacagccttgaggacgacct

SEQ ID NO: 645504 - DNA, 25 bp, Mus musculus
gacctgacatgtacgacaactctgg

SEQ ID NO: 645505 - DNA, 25 bp, Mus musculus
gacctgacatgttcgacaactctgg

SEQ ID NO: 645506 - DNA, 25 bp, Mus musculus
gacctgaccacaaagaaagtagtag

SEQ ID NO: 645507 - DNA, 25 bp, Mus musculus
gacctgaccacatagaaagtagtag

SEQ ID NO: 645508 - DNA, 25 bp, Mus musculus
gacctgacccgaaccttgtctgaca

SEQ ID NO: 645509 - DNA, 25 bp, Mus musculus
gacctgacccgatccttgtctgaca

SEQ ID NO: 645510 - DNA, 25 bp, Mus musculus
gacctgacctatattgtcgcacaga

SEQ ID NO: 645511 - DNA, 25 bp, Mus musculus
gacctgacctattttgtcgcacaga

SEQ ID NO: 645512 - DNA, 25 bp, Mus musculus
gacctgaccttgctgttacaaaccc

SEQ ID NO: 645513 - DNA, 25 bp, Mus musculus
gacctgaccttggtgttacaaaccc

SEQ ID NO: 645514 - DNA, 25 bp, Mus musculus
gacctgactaacatcactagtgcca

SEQ ID NO: 645515 - DNA, 25 bp, Mus musculus
gacctgactaacttcactagtgcca

SEQ ID NO: 645516 - DNA, 25 bp, Mus musculus
gacctgactcttctctgggctggaa

SEQ ID NO: 645517 - DNA, 25 bp, Mus musculus
gacctgactcttgtctgggctggaa

SEQ ID NO: 645518 - DNA, 25 bp, Mus musculus
gacctgactgcacaagagcgtcaag

SEQ ID NO: 645519 - DNA, 25 bp, Mus musculus
gacctgactgcagaagagcgtcaag

SEQ ID NO: 645520 - DNA, 25 bp, Mus musculus
gacctgacttgaccatcggtggcca

SEQ ID NO: 645521 - DNA, 25 bp, Mus musculus
gacctgacttgagcatcggtggcca

SEQ ID NO: 645522 - DNA, 25 bp, Mus musculus
gacctgactttgagaacatccagct

SEQ ID NO: 645523 - DNA, 25 bp, Mus musculus
gacctgactttgtgaacatccagct

SEQ ID NO: 645524 - DNA, 25 bp, Mus musculus
gacctgagaaataatcgcctcttag

SEQ ID NO: 645525 - DNA, 25 bp, Mus musculus
gacctgagaaatctttgtactgaag

SEQ ID NO: 645526 - DNA, 25 bp, Mus musculus
gacctgagaaatgtttgtactgaag

SEQ ID NO: 645527 - DNA, 25 bp, Mus musculus
gacctgagaaattatcgcctcttag

SEQ ID NO: 645528 - DNA, 25 bp, Mus musculus
gacctgagactgatttcttgactaa

SEQ ID NO: 645529 - DNA, 25 bp, Mus musculus
gacctgagactgttttcttgactaa

SEQ ID NO: 645530 - DNA, 25 bp, Mus musculus
gacctgagagctattatgccacaaa

SEQ ID NO: 645531 - DNA, 25 bp, Mus musculus
gacctgagagcttttatgccacaaa

SEQ ID NO: 645532 - DNA, 25 bp, Mus musculus
gacctgagagggatagcctttgcct

SEQ ID NO: 645533 - DNA, 25 bp, Mus musculus
gacctgagagggttagcctttgcct

SEQ ID NO: 645534 - DNA, 25 bp, Mus musculus
gacctgagcaacaatgatattagta

SEQ ID NO: 645535 - DNA, 25 bp, Mus musculus
gacctgagcaactatgatattagta

SEQ ID NO: 645536 - DNA, 25 bp, Mus musculus
gacctgagcgctcccctgggtgttt

SEQ ID NO: 645537 - DNA, 25 bp, Mus musculus
gacctgagcgctgccctgggtgttt

SEQ ID NO: 645538 - DNA, 25 bp, Mus musculus
gacctgagtaaaattgaccttcctg

SEQ ID NO: 645539 - DNA, 25 bp, Mus musculus
gacctgagtaaatttgaccttcctg

SEQ ID NO: 645540 - DNA, 25 bp, Mus musculus
gacctgagtctgaacccatataagg

SEQ ID NO: 645541 - DNA, 25 bp, Mus musculus
gacctgagtctgtacccatataagg

SEQ ID NO: 645542 - DNA, 25 bp, Mus musculus
gacctgagttttcacaaaggagaaa

SEQ ID NO: 645543 - DNA, 25 bp, Mus musculus
gacctgagttttgacaaaggagaaa

SEQ ID NO: 645544 - DNA, 25 bp, Mus musculus
gacctgatcaataaagggcggagga

SEQ ID NO: 645545 - DNA, 25 bp, Mus musculus
gacctgatcaattaagggcggagga

SEQ ID NO: 645546 - DNA, 25 bp, Mus musculus
gacctgatcggtcctaacttccggg

SEQ ID NO: 645547 - DNA, 25 bp, Mus musculus
gacctgatcggtgctaacttccggg

SEQ ID NO: 645548 - DNA, 25 bp, Mus musculus
gacctgatcttgaagatctaaaatg

SEQ ID NO: 645549 - DNA, 25 bp, Mus musculus
gacctgatcttgtagatctaaaatg

SEQ ID NO: 645550 - DNA, 25 bp, Mus musculus
gacctgatgaagaacaacccttggg

SEQ ID NO: 645551 - DNA, 25 bp, Mus musculus
gacctgatgaagtacaacccttggg

SEQ ID NO: 645552 - DNA, 25 bp, Mus musculus
gacctgatgcgcctgtccttgtgga

SEQ ID NO: 645553 - DNA, 25 bp, Mus musculus
gacctgatgcgcgtgtccttgtgga

SEQ ID NO: 645554 - DNA, 25 bp, Mus musculus
gacctgatgcggcaaatgtacgaca

SEQ ID NO: 645555 - DNA, 25 bp, Mus musculus
gacctgatgcggcaattgattatgg

SEQ ID NO: 645556 - DNA, 25 bp, Mus musculus
gacctgatgcgggaaatgtacgaca

SEQ ID NO: 645557 - DNA, 25 bp, Mus musculus
gacctgatgcgggaattgattatgg

SEQ ID NO: 645558 - DNA, 25 bp, Mus musculus
gacctgatggagatggacatggcca

SEQ ID NO: 645559 - DNA, 25 bp, Mus musculus
gacctgatggagctgaaactcatga

SEQ ID NO: 645560 - DNA, 25 bp, Mus musculus
gacctgatggaggtgaaactcatga

SEQ ID NO: 645561 - DNA, 25 bp, Mus musculus
gacctgatggagttggacatggcca

SEQ ID NO: 645562 - DNA, 25 bp, Mus musculus
gacctgatggatcccctggctctgt

SEQ ID NO: 645563 - DNA, 25 bp, Mus musculus
gacctgatggatgccctggctctgt

SEQ ID NO: 645564 - DNA, 25 bp, Mus musculus
gacctgatgttgatgagagtcagcc

SEQ ID NO: 645565 - DNA, 25 bp, Mus musculus
gacctgatgttgttgagagtcagcc

SEQ ID NO: 645566 - DNA, 25 bp, Mus musculus
gacctgattagcatgggatccaacg

SEQ ID NO: 645567 - DNA, 25 bp, Mus musculus
gacctgattagcttgggatccaacg

SEQ ID NO: 645568 - DNA, 25 bp, Mus musculus
gacctgattgagcacttgaagtcgg

SEQ ID NO: 645569 - DNA, 25 bp, Mus musculus
gacctgattgaggacttgaagtcgg

SEQ ID NO: 645570 - DNA, 25 bp, Mus musculus
gacctgatttctcagttccaaattg

SEQ ID NO: 645571 - DNA, 25 bp, Mus musculus
gacctgatttctgagttccaaattg

SEQ ID NO: 645572 - DNA, 25 bp, Mus musculus
gacctgcagagcaaggtggcacacc

SEQ ID NO: 645573 - DNA, 25 bp, Mus musculus
gacctgcagagctaggtggcacacc

SEQ ID NO: 645574 - DNA, 25 bp, Mus musculus
gacctgcaggaaacactgataaaaa

SEQ ID NO: 645575 - DNA, 25 bp, Mus musculus
gacctgcaggaatcactgataaaaa

SEQ ID NO: 645576 - DNA, 25 bp, Mus musculus
gacctgcaggatcgaaaacgcctcc

SEQ ID NO: 645577 - DNA, 25 bp, Mus musculus
gacctgcaggatggaaaacgcctcc

SEQ ID NO: 645578 - DNA, 25 bp, Mus musculus
gacctgcaggccaaggctgtggaac

SEQ ID NO: 645579 - DNA, 25 bp, Mus musculus
gacctgcaggcctaggctgtggaac

SEQ ID NO: 645580 - DNA, 25 bp, Mus musculus
gacctgcagtgcaacacggtgctga

SEQ ID NO: 645581 - DNA, 25 bp, Mus musculus
gacctgcagtgctacacggtgctga

SEQ ID NO: 645582 - DNA, 25 bp, Mus musculus
gacctgcattgaagatgtcgctgga

SEQ ID NO: 645583 - DNA, 25 bp, Mus musculus
gacctgcattgatgatgtcgctgga

SEQ ID NO: 645584 - DNA, 25 bp, Mus musculus
gacctgcattgtcagtagacagctg

SEQ ID NO: 645585 - DNA, 25 bp, Mus musculus
gacctgcattgtgagtagacagctg

SEQ ID NO: 645586 - DNA, 25 bp, Mus musculus
gacctgccacaacaaatgcgtgcac

SEQ ID NO: 645587 - DNA, 25 bp, Mus musculus
gacctgccacaagaaatgcgtgcac

SEQ ID NO: 645588 - DNA, 25 bp, Mus musculus
gacctgccctcacttttgatgactg

SEQ ID NO: 645589 - DNA, 25 bp, Mus musculus
gacctgccctcagttttgatgactg

SEQ ID NO: 645590 - DNA, 25 bp, Mus musculus
gacctgccgcttatggagtggctga

SEQ ID NO: 645591 - DNA, 25 bp, Mus musculus
gacctgccgcttttggagtggctga

SEQ ID NO: 645592 - DNA, 25 bp, Mus musculus
gacctgcctcgaaccagatgctgaa

SEQ ID NO: 645593 - DNA, 25 bp, Mus musculus
gacctgcctcgatccagatgctgaa

SEQ ID NO: 645594 - DNA, 25 bp, Mus musculus
gacctgcctgctcagttactagacg

SEQ ID NO: 645595 - DNA, 25 bp, Mus musculus
gacctgcctgctgagttactagacg

SEQ ID NO: 645596 - DNA, 25 bp, Mus musculus
gacctgccttctcatgctgcctggg

SEQ ID NO: 645597 - DNA, 25 bp, Mus musculus
gacctgccttctgatgctgcctggg

SEQ ID NO: 645598 - DNA, 25 bp, Mus musculus
gacctgcgaaggaagggcctagaat

SEQ ID NO: 645599 - DNA, 25 bp, Mus musculus
gacctgcgaaggtagggcctagaat

SEQ ID NO: 645600 - DNA, 25 bp, Mus musculus
gacctgcggatactcaagcgatcag

SEQ ID NO: 645601 - DNA, 25 bp, Mus musculus
gacctgcggatagtcaagcgatcag

SEQ ID NO: 645602 - DNA, 25 bp, Mus musculus
gacctgcgtaatctgaaactaaaac

SEQ ID NO: 645603 - DNA, 25 bp, Mus musculus
gacctgcgtaatgtgaaactaaaac

SEQ ID NO: 645604 - DNA, 25 bp, Mus musculus
gacctgcgtgcaacagagtcttcaa

SEQ ID NO: 645605 - DNA, 25 bp, Mus musculus
gacctgcgtgcatcagagtcttcaa

SEQ ID NO: 645606 - DNA, 25 bp, Mus musculus
gacctgctaaaacaccagagggaaa

SEQ ID NO: 645607 - DNA, 25 bp, Mus musculus
gacctgctaaaagaccagagggaaa

SEQ ID NO: 645608 - DNA, 25 bp, Mus musculus
gacctgctaagactcgagatggaga

SEQ ID NO: 645609 - DNA, 25 bp, Mus musculus
gacctgctaagagtcgagatggaga

SEQ ID NO: 645610 - DNA, 25 bp, Mus musculus
gacctgctaaggaaggttcgagcca

SEQ ID NO: 645611 - DNA, 25 bp, Mus musculus
gacctgctaaggtaggttcgagcca

SEQ ID NO: 645612 - DNA, 25 bp, Mus musculus
gacctgctacacatttctcactgga

SEQ ID NO: 645613 - DNA, 25 bp, Mus musculus
gacctgctacacttttctcactgga

SEQ ID NO: 645614 - DNA, 25 bp, Mus musculus
gacctgctacctcatgggagaagct

SEQ ID NO: 645615 - DNA, 25 bp, Mus musculus
gacctgctacctgatgggagaagct

SEQ ID NO: 645616 - DNA, 25 bp, Mus musculus
gacctgctactgcttgaccccaatg

SEQ ID NO: 645617 - DNA, 25 bp, Mus musculus
gacctgctactggttgaccccaatg

SEQ ID NO: 645618 - DNA, 25 bp, Mus musculus
gacctgctatcaccagcgctgggag

SEQ ID NO: 645619 - DNA, 25 bp, Mus musculus
gacctgctatcagcagcgctgggag

SEQ ID NO: 645620 - DNA, 25 bp, Mus musculus
gacctgctcaagagatgggatacca

SEQ ID NO: 645621 - DNA, 25 bp, Mus musculus
gacctgctcaagtgatgggatacca

SEQ ID NO: 645622 - DNA, 25 bp, Mus musculus
gacctgctgagcacggagcctgagc

SEQ ID NO: 645623 - DNA, 25 bp, Mus musculus
gacctgctgagccaggctcaaactc

SEQ ID NO: 645624 - DNA, 25 bp, Mus musculus
gacctgctgagcgaggctcaaactc

SEQ ID NO: 645625 - DNA, 25 bp, Mus musculus
gacctgctgagctcggagcctgagc

SEQ ID NO: 645626 - DNA, 25 bp, Mus musculus
gacctgctgcacattggactcaaaa

SEQ ID NO: 645627 - DNA, 25 bp, Mus musculus
gacctgctgcactttggactcaaaa

SEQ ID NO: 645628 - DNA, 25 bp, Mus musculus
gacctgctggaacatttactctgaa

SEQ ID NO: 645629 - DNA, 25 bp, Mus musculus
gacctgctggaagatttactctgaa

SEQ ID NO: 645630 - DNA, 25 bp, Mus musculus
gacctgctgtatcctataagccgtg

SEQ ID NO: 645631 - DNA, 25 bp, Mus musculus
gacctgctgtatgctataagccgtg

SEQ ID NO: 645632 - DNA, 25 bp, Mus musculus
gacctgctgtgtccacatcctgcag

SEQ ID NO: 645633 - DNA, 25 bp, Mus musculus
gacctgctgtgtgcacatcctgcag

SEQ ID NO: 645634 - DNA, 25 bp, Mus musculus
gacctgctgttaagaagccttgctg

SEQ ID NO: 645635 - DNA, 25 bp, Mus musculus
gacctgctgttatgaagccttgctg

SEQ ID NO: 645636 - DNA, 25 bp, Mus musculus
gacctgcttcagctagacacggcgc

SEQ ID NO: 645637 - DNA, 25 bp, Mus musculus
gacctgcttcaggtagacacggcgc

SEQ ID NO: 645638 - DNA, 25 bp, Mus musculus
gacctgcttggcaaagaagaagagg

SEQ ID NO: 645639 - DNA, 25 bp, Mus musculus
gacctgcttggctaagaagaagagg

SEQ ID NO: 645640 - DNA, 25 bp, Mus musculus
gacctgcttttaagccttcgtgggc

SEQ ID NO: 645641 - DNA, 25 bp, Mus musculus
gacctgcttttatgccttcgtgggc

SEQ ID NO: 645642 - DNA, 25 bp, Mus musculus
gacctggaagtccatttcaactccc

SEQ ID NO: 645643 - DNA, 25 bp, Mus musculus
gacctggaagtcgatttcaactccc

SEQ ID NO: 645644 - DNA, 25 bp, Mus musculus
gacctggacaacataggcatgggca

SEQ ID NO: 645645 - DNA, 25 bp, Mus musculus
gacctggacaacttaggcatgggca

SEQ ID NO: 645646 - DNA, 25 bp, Mus musculus
gacctggaccaacacggctacaatg

SEQ ID NO: 645647 - DNA, 25 bp, Mus musculus
gacctggaccaagacggctacaatg

SEQ ID NO: 645648 - DNA, 25 bp, Mus musculus
gacctggaccagatgataacccaca

SEQ ID NO: 645649 - DNA, 25 bp, Mus musculus
gacctggaccagttgataacccaca

SEQ ID NO: 645650 - DNA, 25 bp, Mus musculus
gacctggaccgccagtcaggacagt

SEQ ID NO: 645651 - DNA, 25 bp, Mus musculus
gacctggaccgcgagtcaggacagt

SEQ ID NO: 645652 - DNA, 25 bp, Mus musculus
gacctggacggcaggcctaatgaaa

SEQ ID NO: 645653 - DNA, 25 bp, Mus musculus
gacctggacggctggcctaatgaaa

SEQ ID NO: 645654 - DNA, 25 bp, Mus musculus
gacctggacggtattcctgacgaga

SEQ ID NO: 645655 - DNA, 25 bp, Mus musculus
gacctggacggttttcctgacgaga

SEQ ID NO: 645656 - DNA, 25 bp, Mus musculus
gacctggactctctctttgaaatga

SEQ ID NO: 645657 - DNA, 25 bp, Mus musculus
gacctggactctgtctttgaaatga

SEQ ID NO: 645658 - DNA, 25 bp, Mus musculus
gacctggacttcctgggcaagttct

SEQ ID NO: 645659 - DNA, 25 bp, Mus musculus
gacctggacttcgtgggcaagttct

SEQ ID NO: 645660 - DNA, 25 bp, Mus musculus
gacctggagagcagtatccctctgg

SEQ ID NO: 645661 - DNA, 25 bp, Mus musculus
gacctggagagctgtatccctctgg

SEQ ID NO: 645662 - DNA, 25 bp, Mus musculus
gacctggagatccaaaggcctatac

SEQ ID NO: 645663 - DNA, 25 bp, Mus musculus
gacctggagatcgaaaggcctatac

SEQ ID NO: 645664 - DNA, 25 bp, Mus musculus
gacctggagcctaaacctggtggac

SEQ ID NO: 645665 - DNA, 25 bp, Mus musculus
gacctggagccttaacctggtggac

SEQ ID NO: 645666 - DNA, 25 bp, Mus musculus
gacctggagctaactcttgctggca

SEQ ID NO: 645667 - DNA, 25 bp, Mus musculus
gacctggagctactgagaaagcata

SEQ ID NO: 645668 - DNA, 25 bp, Mus musculus
gacctggagctagtgagaaagcata

SEQ ID NO: 645669 - DNA, 25 bp, Mus musculus
gacctggagctatctcttgctggca

SEQ ID NO: 645670 - DNA, 25 bp, Mus musculus
gacctggaggtaatagcagaaccac

SEQ ID NO: 645671 - DNA, 25 bp, Mus musculus
gacctggaggtattagcagaaccac

SEQ ID NO: 645672 - DNA, 25 bp, Mus musculus
gacctggagtatacgggaacgtgac

SEQ ID NO: 645673 - DNA, 25 bp, Mus musculus
gacctggagtattcgggaacgtgac

SEQ ID NO: 645674 - DNA, 25 bp, Mus musculus
gacctggagtctcagctagagccca

SEQ ID NO: 645675 - DNA, 25 bp, Mus musculus
gacctggagtctgagctagagccca

SEQ ID NO: 645676 - DNA, 25 bp, Mus musculus
gacctggatggtacctgcagtgcga

SEQ ID NO: 645677 - DNA, 25 bp, Mus musculus
gacctggatggttcctgcagtgcga

SEQ ID NO: 645678 - DNA, 25 bp, Mus musculus
gacctggattccacaactatctcct

SEQ ID NO: 645679 - DNA, 25 bp, Mus musculus
gacctggattcctcaactatctcct

SEQ ID NO: 645680 - DNA, 25 bp, Mus musculus
gacctggattttaagcaccacaact

SEQ ID NO: 645681 - DNA, 25 bp, Mus musculus
gacctggatttttagcaccacaact

SEQ ID NO: 645682 - DNA, 25 bp, Mus musculus
gacctggcacgcagacagtaccttg

SEQ ID NO: 645683 - DNA, 25 bp, Mus musculus
gacctggcacgctgacagtaccttg

SEQ ID NO: 645684 - DNA, 25 bp, Mus musculus
gacctggccactcttgtgcagcctg

SEQ ID NO: 645685 - DNA, 25 bp, Mus musculus
gacctggccactgttgtgcagcctg

SEQ ID NO: 645686 - DNA, 25 bp, Mus musculus
gacctggccaggagattcctgatcc

SEQ ID NO: 645687 - DNA, 25 bp, Mus musculus
gacctggccaggtgattcctgatcc

SEQ ID NO: 645688 - DNA, 25 bp, Mus musculus
gacctggccatgacctacaaacaga

SEQ ID NO: 645689 - DNA, 25 bp, Mus musculus
gacctggccatgtcctacaaacaga

SEQ ID NO: 645690 - DNA, 25 bp, Mus musculus
gacctggccggtaacctgctctact

SEQ ID NO: 645691 - DNA, 25 bp, Mus musculus
gacctggccggttacctgctctact

SEQ ID NO: 645692 - DNA, 25 bp, Mus musculus
gacctggctactcatgacgtcatgc

SEQ ID NO: 645693 - DNA, 25 bp, Mus musculus
gacctggctactgatgacgtcatgc

SEQ ID NO: 645694 - DNA, 25 bp, Mus musculus
gacctggctcatcagccaggcgaga

SEQ ID NO: 645695 - DNA, 25 bp, Mus musculus
gacctggctcatgagccaggcgaga

SEQ ID NO: 645696 - DNA, 25 bp, Mus musculus
gacctggctgctccactgctttagt

SEQ ID NO: 645697 - DNA, 25 bp, Mus musculus
gacctggctgctgcactgctttagt

SEQ ID NO: 645698 - DNA, 25 bp, Mus musculus
gacctggcttcgcaattctctgcgg

SEQ ID NO: 645699 - DNA, 25 bp, Mus musculus
gacctggcttcggaattctctgcgg

SEQ ID NO: 645700 - DNA, 25 bp, Mus musculus
gacctggcttctcttgctaagtaga

SEQ ID NO: 645701 - DNA, 25 bp, Mus musculus
gacctggcttctgttgctaagtaga

SEQ ID NO: 645702 - DNA, 25 bp, Mus musculus
gacctggctttcacgggatttcttc

SEQ ID NO: 645703 - DNA, 25 bp, Mus musculus
gacctggctttccagcagtcgggca

SEQ ID NO: 645704 - DNA, 25 bp, Mus musculus
gacctggctttcgagcagtcgggca

SEQ ID NO: 645705 - DNA, 25 bp, Mus musculus
gacctggctttctcgggatttcttc

SEQ ID NO: 645706 - DNA, 25 bp, Mus musculus
gacctgggacttaccaactacagat

SEQ ID NO: 645707 - DNA, 25 bp, Mus musculus
gacctgggactttccaactacagat

SEQ ID NO: 645708 - DNA, 25 bp, Mus musculus
gacctgggagccaccttggtgatac

SEQ ID NO: 645709 - DNA, 25 bp, Mus musculus
gacctgggagcctccttggtgatac

SEQ ID NO: 645710 - DNA, 25 bp, Mus musculus
gacctgggcaacatggtgcccactg

SEQ ID NO: 645711 - DNA, 25 bp, Mus musculus
gacctgggcaacttggtgcccactg

SEQ ID NO: 645712 - DNA, 25 bp, Mus musculus
gacctgggcccaacaagtgtgtggc

SEQ ID NO: 645713 - DNA, 25 bp, Mus musculus
gacctgggcccatcaagtgtgtggc

SEQ ID NO: 645714 - DNA, 25 bp, Mus musculus
gacctgggcgcaccagtttcgtctg

SEQ ID NO: 645715 - DNA, 25 bp, Mus musculus
gacctgggcgcagcagtttcgtctg

SEQ ID NO: 645716 - DNA, 25 bp, Mus musculus
gacctggtagaacttgtcctgtcag

SEQ ID NO: 645717 - DNA, 25 bp, Mus musculus
gacctggtagaagttgtcctgtcag

SEQ ID NO: 645718 - DNA, 25 bp, Mus musculus
gacctggtaggtcatagcatgctat

SEQ ID NO: 645719 - DNA, 25 bp, Mus musculus
gacctggtaggtgatagcatgctat

SEQ ID NO: 645720 - DNA, 25 bp, Mus musculus
gacctggtctggatatgccctcagt

SEQ ID NO: 645721 - DNA, 25 bp, Mus musculus
gacctggtctggttatgccctcagt

SEQ ID NO: 645722 - DNA, 25 bp, Mus musculus
gacctggtgaaacactgccattccg

SEQ ID NO: 645723 - DNA, 25 bp, Mus musculus
gacctggtgaaagactgccattccg

SEQ ID NO: 645724 - DNA, 25 bp, Mus musculus
gacctggtgatcatcaatgacgacc

SEQ ID NO: 645725 - DNA, 25 bp, Mus musculus
gacctggtgatcttcaatgacgacc

SEQ ID NO: 645726 - DNA, 25 bp, Mus musculus
gacctggtggagaccacagtgagct

SEQ ID NO: 645727 - DNA, 25 bp, Mus musculus
gacctggtggagtccacagtgagct

SEQ ID NO: 645728 - DNA, 25 bp, Mus musculus
gacctggtggatactattataaaca

SEQ ID NO: 645729 - DNA, 25 bp, Mus musculus
gacctggtggattctattataaaca

SEQ ID NO: 645730 - DNA, 25 bp, Mus musculus
gacctggttacaaagcccaggagcc

SEQ ID NO: 645731 - DNA, 25 bp, Mus musculus
gacctggttacatagcccaggagcc

SEQ ID NO: 645732 - DNA, 25 bp, Mus musculus
gacctggttattctcttcgttgaca

SEQ ID NO: 645733 - DNA, 25 bp, Mus musculus
gacctggttattgtcttcgttgaca

SEQ ID NO: 645734 - DNA, 25 bp, Mus musculus
gacctggttcagcaaacacgagttc

SEQ ID NO: 645735 - DNA, 25 bp, Mus musculus
gacctggttcaggaaacacgagttc

SEQ ID NO: 645736 - DNA, 25 bp, Mus musculus
gacctgtaaccgagtccatgtggca

SEQ ID NO: 645737 - DNA, 25 bp, Mus musculus
gacctgtaaccgtgtccatgtggca

SEQ ID NO: 645738 - DNA, 25 bp, Mus musculus
gacctgtagctgattggatgagaac

SEQ ID NO: 645739 - DNA, 25 bp, Mus musculus
gacctgtagctgtttggatgagaac

SEQ ID NO: 645740 - DNA, 25 bp, Mus musculus
gacctgtagcttaggcacgtccaga

SEQ ID NO: 645741 - DNA, 25 bp, Mus musculus
gacctgtagctttggcacgtccaga

SEQ ID NO: 645742 - DNA, 25 bp, Mus musculus
gacctgtagttgatggcctgggcaa

SEQ ID NO: 645743 - DNA, 25 bp, Mus musculus
gacctgtagttgttggcctgggcaa

SEQ ID NO: 645744 - DNA, 25 bp, Mus musculus
gacctgtataggaaactctggccct

SEQ ID NO: 645745 - DNA, 25 bp, Mus musculus
gacctgtataggtaactctggccct

SEQ ID NO: 645746 - DNA, 25 bp, Mus musculus
gacctgtattgtccggcaccagacc

SEQ ID NO: 645747 - DNA, 25 bp, Mus musculus
gacctgtattgtgcggcaccagacc

SEQ ID NO: 645748 - DNA, 25 bp, Mus musculus
gacctgtccggtctcatccggaggc

SEQ ID NO: 645749 - DNA, 25 bp, Mus musculus
gacctgtccggtgtcatccggaggc

SEQ ID NO: 645750 - DNA, 25 bp, Mus musculus
gacctgtcggacctggtatctgaga

SEQ ID NO: 645751 - DNA, 25 bp, Mus musculus
gacctgtcggacgtggtatctgaga

SEQ ID NO: 645752 - DNA, 25 bp, Mus musculus
gacctgtcggatctgatctcggaga

SEQ ID NO: 645753 - DNA, 25 bp, Mus musculus
gacctgtcggatgtgatctcggaga

SEQ ID NO: 645754 - DNA, 25 bp, Mus musculus
gacctgtctctacgcaggaaaggag

SEQ ID NO: 645755 - DNA, 25 bp, Mus musculus
gacctgtctctaggcaggaaaggag

SEQ ID NO: 645756 - DNA, 25 bp, Mus musculus
gacctgtctctgcagggatcctgcc

SEQ ID NO: 645757 - DNA, 25 bp, Mus musculus
gacctgtctctggagggatcctgcc

SEQ ID NO: 645758 - DNA, 25 bp, Mus musculus
gacctgtctgacacccgcactaggt

SEQ ID NO: 645759 - DNA, 25 bp, Mus musculus
gacctgtctgactcccgcactaggt

SEQ ID NO: 645760 - DNA, 25 bp, Mus musculus
gacctgtctgatctggtatcagaga

SEQ ID NO: 645761 - DNA, 25 bp, Mus musculus
gacctgtctgatcttcccaccaagt

SEQ ID NO: 645762 - DNA, 25 bp, Mus musculus
gacctgtctgatgtggtatcagaga

SEQ ID NO: 645763 - DNA, 25 bp, Mus musculus
gacctgtctgatgttcccaccaagt

SEQ ID NO: 645764 - DNA, 25 bp, Mus musculus
gacctgtgacctagacaacgacaag

SEQ ID NO: 645765 - DNA, 25 bp, Mus musculus
gacctgtgacctattacagatggaa

SEQ ID NO: 645766 - DNA, 25 bp, Mus musculus
gacctgtgaccttgacaacgacaag

SEQ ID NO: 645767 - DNA, 25 bp, Mus musculus
gacctgtgaccttttacagatggaa

SEQ ID NO: 645768 - DNA, 25 bp, Mus musculus
gacctgtgaggtcatgggacctacc

SEQ ID NO: 645769 - DNA, 25 bp, Mus musculus
gacctgtgaggtgatgggacctacc

SEQ ID NO: 645770 - DNA, 25 bp, Mus musculus
gacctgtgcaccaaggtatctttcc

SEQ ID NO: 645771 - DNA, 25 bp, Mus musculus
gacctgtgcacctaggtatctttcc

SEQ ID NO: 645772 - DNA, 25 bp, Mus musculus
gacctgtgccgtcaggaccaaactt

SEQ ID NO: 645773 - DNA, 25 bp, Mus musculus
gacctgtgccgtgaggaccaaactt

SEQ ID NO: 645774 - DNA, 25 bp, Mus musculus
gacctgtgcctgatattccgggcta

SEQ ID NO: 645775 - DNA, 25 bp, Mus musculus
gacctgtgcctgttattccgggcta

SEQ ID NO: 645776 - DNA, 25 bp, Mus musculus
gacctgtggaaacctggatgtgaat

SEQ ID NO: 645777 - DNA, 25 bp, Mus musculus
gacctgtggaaagctggatgtgaat

SEQ ID NO: 645778 - DNA, 25 bp, Mus musculus
gacctgtggccaagttcttagtagc

SEQ ID NO: 645779 - DNA, 25 bp, Mus musculus
gacctgtggccatgttcttagtagc

SEQ ID NO: 645780 - DNA, 25 bp, Mus musculus
gacctgtggtggatccacgaggact

SEQ ID NO: 645781 - DNA, 25 bp, Mus musculus
gacctgtggtggttccacgaggact

SEQ ID NO: 645782 - DNA, 25 bp, Mus musculus
gacctgtggtttctcttttgcctaa

SEQ ID NO: 645783 - DNA, 25 bp, Mus musculus
gacctgtggtttgtcttttgcctaa

SEQ ID NO: 645784 - DNA, 25 bp, Mus musculus
gacctgtgtacactgcagatcccca

SEQ ID NO: 645785 - DNA, 25 bp, Mus musculus
gacctgtgtacagtgcagatcccca

SEQ ID NO: 645786 - DNA, 25 bp, Mus musculus
gacctgtgttttcggttacaccaat

SEQ ID NO: 645787 - DNA, 25 bp, Mus musculus
gacctgtgttttgggttacaccaat

SEQ ID NO: 645788 - DNA, 25 bp, Mus musculus
gacctgttctcacactcatcagctg

SEQ ID NO: 645789 - DNA, 25 bp, Mus musculus
gacctgttctcagactcatcagctg

SEQ ID NO: 645790 - DNA, 25 bp, Mus musculus
gacctgtttgagatatttgaaatcg

SEQ ID NO: 645791 - DNA, 25 bp, Mus musculus
gacctgtttgagttatttgaaatcg

SEQ ID NO: 645792 - DNA, 25 bp, Mus musculus
gaccttaagtttcatcgtggatgga

SEQ ID NO: 645793 - DNA, 25 bp, Mus musculus
gaccttaagtttgatcgtggatgga

SEQ ID NO: 645794 - DNA, 25 bp, Mus musculus
gaccttaattaaccaacaccaggaa

SEQ ID NO: 645795 - DNA, 25 bp, Mus musculus
gaccttaattaagcaacaccaggaa

SEQ ID NO: 645796 - DNA, 25 bp, Mus musculus
gaccttacccatcttagaagaactt

SEQ ID NO: 645797 - DNA, 25 bp, Mus musculus
gaccttacccatgttagaagaactt

SEQ ID NO: 645798 - DNA, 25 bp, Mus musculus
gaccttaccctgctactcgcgggag

SEQ ID NO: 645799 - DNA, 25 bp, Mus musculus
gaccttaccctggtactcgcgggag

SEQ ID NO: 645800 - DNA, 25 bp, Mus musculus
gaccttacctgtacttggattcgac

SEQ ID NO: 645801 - DNA, 25 bp, Mus musculus
gaccttacctgttcttggattcgac

SEQ ID NO: 645802 - DNA, 25 bp, Mus musculus
gaccttagaagaatgggatctagcc

SEQ ID NO: 645803 - DNA, 25 bp, Mus musculus
gaccttagaagattgggatctagcc

SEQ ID NO: 645804 - DNA, 25 bp, Mus musculus
gaccttagcaggagtctaactccaa

SEQ ID NO: 645805 - DNA, 25 bp, Mus musculus
gaccttagcaggtgtctaactccaa

SEQ ID NO: 645806 - DNA, 25 bp, Mus musculus
gaccttaggatcatacaggtgacag

SEQ ID NO: 645807 - DNA, 25 bp, Mus musculus
gaccttaggatcttacaggtgacag

SEQ ID NO: 645808 - DNA, 25 bp, Mus musculus
gaccttatcagtcctaacatggaga

SEQ ID NO: 645809 - DNA, 25 bp, Mus musculus
gaccttatcagtgctaacatggaga

SEQ ID NO: 645810 - DNA, 25 bp, Mus musculus
gaccttatcattcaggctgtctaca

SEQ ID NO: 645811 - DNA, 25 bp, Mus musculus
gaccttatcattgaggctgtctaca

SEQ ID NO: 645812 - DNA, 25 bp, Mus musculus
gaccttatgagaccccactccattt

SEQ ID NO: 645813 - DNA, 25 bp, Mus musculus
gaccttatgagagcccactccattt

SEQ ID NO: 645814 - DNA, 25 bp, Mus musculus
gaccttattcggaagctagcttatg

SEQ ID NO: 645815 - DNA, 25 bp, Mus musculus
gaccttattcggtagctagcttatg

SEQ ID NO: 645816 - DNA, 25 bp, Mus musculus
gaccttatttggagactgagccagg

SEQ ID NO: 645817 - DNA, 25 bp, Mus musculus
gaccttatttggtgactgagccagg

SEQ ID NO: 645818 - DNA, 25 bp, Mus musculus
gaccttcaaagaccgcatccagtgg

SEQ ID NO: 645819 - DNA, 25 bp, Mus musculus
gaccttcaaagagcgcatccagtgg

SEQ ID NO: 645820 - DNA, 25 bp, Mus musculus
gaccttcaaagcctttgacaagcac

SEQ ID NO: 645821 - DNA, 25 bp, Mus musculus
gaccttcaaagcgtttgacaagcac

SEQ ID NO: 645822 - DNA, 25 bp, Mus musculus
gaccttcaactaccttctcgacatg

SEQ ID NO: 645823 - DNA, 25 bp, Mus musculus
gaccttcaactagcttctcgacatg

SEQ ID NO: 645824 - DNA, 25 bp, Mus musculus
gaccttcaagcaccaacatgggaag

SEQ ID NO: 645825 - DNA, 25 bp, Mus musculus
gaccttcaagcagcaacatgggaag

SEQ ID NO: 645826 - DNA, 25 bp, Mus musculus
gaccttcacagcatgatcatcttcc

SEQ ID NO: 645827 - DNA, 25 bp, Mus musculus
gaccttcacagcttgatcatcttcc

SEQ ID NO: 645828 - DNA, 25 bp, Mus musculus
gaccttcaccagcagtgatgagaat

SEQ ID NO: 645829 - DNA, 25 bp, Mus musculus
gaccttcaccaggagtgatgagaat

SEQ ID NO: 645830 - DNA, 25 bp, Mus musculus
gaccttcacgggacactcgggtgac

SEQ ID NO: 645831 - DNA, 25 bp, Mus musculus
gaccttcacgggtcactcgggtgac

SEQ ID NO: 645832 - DNA, 25 bp, Mus musculus
gaccttcagatacactcatgtggca

SEQ ID NO: 645833 - DNA, 25 bp, Mus musculus
gaccttcagatagactcatgtggca

SEQ ID NO: 645834 - DNA, 25 bp, Mus musculus
gaccttcaggaaatggatgaactcc

SEQ ID NO: 645835 - DNA, 25 bp, Mus musculus
gaccttcaggaattggatgaactcc

SEQ ID NO: 645836 - DNA, 25 bp, Mus musculus
gaccttcaggtaccagtggtcctgg

SEQ ID NO: 645837 - DNA, 25 bp, Mus musculus
gaccttcaggtagcagtggtcctgg

SEQ ID NO: 645838 - DNA, 25 bp, Mus musculus
gaccttcaggtgaaactcatcccta

SEQ ID NO: 645839 - DNA, 25 bp, Mus musculus
gaccttcaggtgtaactcatcccta

SEQ ID NO: 645840 - DNA, 25 bp, Mus musculus
gaccttcataagaatctgcagccat

SEQ ID NO: 645841 - DNA, 25 bp, Mus musculus
gaccttcataagtatctgcagccat

SEQ ID NO: 645842 - DNA, 25 bp, Mus musculus
gaccttccaccactattcctgaaaa

SEQ ID NO: 645843 - DNA, 25 bp, Mus musculus
gaccttccaccagtattcctgaaaa

SEQ ID NO: 645844 - DNA, 25 bp, Mus musculus
gaccttccagcaagatttggttata

SEQ ID NO: 645845 - DNA, 25 bp, Mus musculus
gaccttccagcatgatttggttata

SEQ ID NO: 645846 - DNA, 25 bp, Mus musculus
gaccttccccttcatcatgctgacg

SEQ ID NO: 645847 - DNA, 25 bp, Mus musculus
gaccttccccttgatcatgctgacg

SEQ ID NO: 645848 - DNA, 25 bp, Mus musculus
gaccttcccttcagcaaaggagatg

SEQ ID NO: 645849 - DNA, 25 bp, Mus musculus
gaccttcccttctgcaaaggagatg

SEQ ID NO: 645850 - DNA, 25 bp, Mus musculus
gaccttccggaaatatgacaacatt

SEQ ID NO: 645851 - DNA, 25 bp, Mus musculus
gaccttccggaattatgacaacatt

SEQ ID NO: 645852 - DNA, 25 bp, Mus musculus
gaccttcctcttacaccgaacttga

SEQ ID NO: 645853 - DNA, 25 bp, Mus musculus
gaccttcctctttcaccgaacttga

SEQ ID NO: 645854 - DNA, 25 bp, Mus musculus
gaccttcctgatcgccttacgtgga

SEQ ID NO: 645855 - DNA, 25 bp, Mus musculus
gaccttcctgatggccttacgtgga

SEQ ID NO: 645856 - DNA, 25 bp, Mus musculus
gaccttcctggtccagatacatcct

SEQ ID NO: 645857 - DNA, 25 bp, Mus musculus
gaccttcctggtgcagatacatcct

SEQ ID NO: 645858 - DNA, 25 bp, Mus musculus
gaccttcgaagcatgccacgttgca

SEQ ID NO: 645859 - DNA, 25 bp, Mus musculus
gaccttcgaagcttgccacgttgca

SEQ ID NO: 645860 - DNA, 25 bp, Mus musculus
gaccttcgagtgctcaatgctatta

SEQ ID NO: 645861 - DNA, 25 bp, Mus musculus
gaccttcgagtggtcaatgctatta

SEQ ID NO: 645862 - DNA, 25 bp, Mus musculus
gaccttcgcgaacccattttgcgtg

SEQ ID NO: 645863 - DNA, 25 bp, Mus musculus
gaccttcgcgaagccattttgcgtg

SEQ ID NO: 645864 - DNA, 25 bp, Mus musculus
gaccttcgctaactccaacaaacaa

SEQ ID NO: 645865 - DNA, 25 bp, Mus musculus
gaccttcgctaagtccaacaaacaa

SEQ ID NO: 645866 - DNA, 25 bp, Mus musculus
gaccttcggccgagttgtgcagtgt

SEQ ID NO: 645867 - DNA, 25 bp, Mus musculus
gaccttcggccgtgttgtgcagtgt

SEQ ID NO: 645868 - DNA, 25 bp, Mus musculus
gaccttcgggccatgactggccgca

SEQ ID NO: 645869 - DNA, 25 bp, Mus musculus
gaccttcgggccttgactggccgca

SEQ ID NO: 645870 - DNA, 25 bp, Mus musculus
gaccttctcaaactcatcacagagc

SEQ ID NO: 645871 - DNA, 25 bp, Mus musculus
gaccttctcaaagtcatcacagagc

SEQ ID NO: 645872 - DNA, 25 bp, Mus musculus
gaccttctctcgcattttgacgagt

SEQ ID NO: 645873 - DNA, 25 bp, Mus musculus
gaccttctctcggattttgacgagt

SEQ ID NO: 645874 - DNA, 25 bp, Mus musculus
gaccttctgagtaccagactatccc

SEQ ID NO: 645875 - DNA, 25 bp, Mus musculus
gaccttctgagttccagactatccc

SEQ ID NO: 645876 - DNA, 25 bp, Mus musculus
gaccttctggatccagacccagggc

SEQ ID NO: 645877 - DNA, 25 bp, Mus musculus
gaccttctggatgcagacccagggc

SEQ ID NO: 645878 - DNA, 25 bp, Mus musculus
gaccttcttactcagataggagcca

SEQ ID NO: 645879 - DNA, 25 bp, Mus musculus
gaccttcttactgagataggagcca

SEQ ID NO: 645880 - DNA, 25 bp, Mus musculus
gaccttgaaagcattaatggctgca

SEQ ID NO: 645881 - DNA, 25 bp, Mus musculus
gaccttgaaagctttaatggctgca

SEQ ID NO: 645882 - DNA, 25 bp, Mus musculus
gaccttgaatgccagtgacacacag

SEQ ID NO: 645883 - DNA, 25 bp, Mus musculus
gaccttgaatgcgagtgacacacag

SEQ ID NO: 645884 - DNA, 25 bp, Mus musculus
gaccttgagtcgagaaactgtctct

SEQ ID NO: 645885 - DNA, 25 bp, Mus musculus
gaccttgagtcgtgaaactgtctct

SEQ ID NO: 645886 - DNA, 25 bp, Mus musculus
gaccttgcagatctttttgactatc

SEQ ID NO: 645887 - DNA, 25 bp, Mus musculus
gaccttgcagatgtttttgactatc

SEQ ID NO: 645888 - DNA, 25 bp, Mus musculus
gaccttgctaagaagtactctgagc

SEQ ID NO: 645889 - DNA, 25 bp, Mus musculus
gaccttgctaagtagtactctgagc

SEQ ID NO: 645890 - DNA, 25 bp, Mus musculus
gaccttgctgtacccaccagagtct

SEQ ID NO: 645891 - DNA, 25 bp, Mus musculus
gaccttgctgtagccaccagagtct

SEQ ID NO: 645892 - DNA, 25 bp, Mus musculus
gaccttgctttgcaactgactacta

SEQ ID NO: 645893 - DNA, 25 bp, Mus musculus
gaccttgctttggaactgactacta

SEQ ID NO: 645894 - DNA, 25 bp, Mus musculus
gaccttggaagactgaacagagtga

SEQ ID NO: 645895 - DNA, 25 bp, Mus musculus
gaccttggaagagtgaacagagtga

SEQ ID NO: 645896 - DNA, 25 bp, Mus musculus
gaccttggacaacctccctctgtgg

SEQ ID NO: 645897 - DNA, 25 bp, Mus musculus
gaccttggacaagctccctctgtgg

SEQ ID NO: 645898 - DNA, 25 bp, Mus musculus
gaccttggcagtcgtatcaaactca

SEQ ID NO: 645899 - DNA, 25 bp, Mus musculus
gaccttggcagtggtatcaaactca

SEQ ID NO: 645900 - DNA, 25 bp, Mus musculus
gaccttggcctacgataatggcatc

SEQ ID NO: 645901 - DNA, 25 bp, Mus musculus
gaccttggcctaggataatggcatc

SEQ ID NO: 645902 - DNA, 25 bp, Mus musculus
gaccttggcgccaatgtatatttgg

SEQ ID NO: 645903 - DNA, 25 bp, Mus musculus
gaccttggcgcctatgtatatttgg

SEQ ID NO: 645904 - DNA, 25 bp, Mus musculus
gaccttggctttcttgtgcttagga

SEQ ID NO: 645905 - DNA, 25 bp, Mus musculus
gaccttggctttgttgtgcttagga

SEQ ID NO: 645906 - DNA, 25 bp, Mus musculus
gaccttgggagacacagcacgaaat

SEQ ID NO: 645907 - DNA, 25 bp, Mus musculus
gaccttgggagagacagcacgaaat

SEQ ID NO: 645908 - DNA, 25 bp, Mus musculus
gaccttggggtgcacatcctgtccg

SEQ ID NO: 645909 - DNA, 25 bp, Mus musculus
gaccttggggtggacatcctgtccg

SEQ ID NO: 645910 - DNA, 25 bp, Mus musculus
gaccttgggttaaggagcagagaaa

SEQ ID NO: 645911 - DNA, 25 bp, Mus musculus
gaccttgggttatggagcagagaaa

SEQ ID NO: 645912 - DNA, 25 bp, Mus musculus
gaccttgggtttaggctcatctcag

SEQ ID NO: 645913 - DNA, 25 bp, Mus musculus
gaccttgggttttggctcatctcag

SEQ ID NO: 645914 - DNA, 25 bp, Mus musculus
gaccttggtccgctgcagtactctg

SEQ ID NO: 645915 - DNA, 25 bp, Mus musculus
gaccttggtccggtgcagtactctg

SEQ ID NO: 645916 - DNA, 25 bp, Mus musculus
gaccttgtaaagaagggcaaccata

SEQ ID NO: 645917 - DNA, 25 bp, Mus musculus
gaccttgtaaagtagggcaaccata

SEQ ID NO: 645918 - DNA, 25 bp, Mus musculus
gaccttgtatgaattgctacagctg

SEQ ID NO: 645919 - DNA, 25 bp, Mus musculus
gaccttgtatgatttgctacagctg

SEQ ID NO: 645920 - DNA, 25 bp, Mus musculus
gaccttgtcattccatacaatgaga

SEQ ID NO: 645921 - DNA, 25 bp, Mus musculus
gaccttgtcattgcatacaatgaga

SEQ ID NO: 645922 - DNA, 25 bp, Mus musculus
gaccttgtccatctgctgatcctca

SEQ ID NO: 645923 - DNA, 25 bp, Mus musculus
gaccttgtccatgtgctgatcctca

SEQ ID NO: 645924 - DNA, 25 bp, Mus musculus
gaccttgtgaatatcgagatgttcc

SEQ ID NO: 645925 - DNA, 25 bp, Mus musculus
gaccttgtgaatttcgagatgttcc

SEQ ID NO: 645926 - DNA, 25 bp, Mus musculus
gaccttgtgtatcgccgagaagacg

SEQ ID NO: 645927 - DNA, 25 bp, Mus musculus
gaccttgtgtatggccgagaagacg

SEQ ID NO: 645928 - DNA, 25 bp, Mus musculus
gaccttgtgtggcacccctgagtac

SEQ ID NO: 645929 - DNA, 25 bp, Mus musculus
gaccttgtgtgggacccctgagtac

SEQ ID NO: 645930 - DNA, 25 bp, Mus musculus
gaccttgttgctcggctggatgaac

SEQ ID NO: 645931 - DNA, 25 bp, Mus musculus
gaccttgttgctgggctggatgaac

SEQ ID NO: 645932 - DNA, 25 bp, Mus musculus
gacctttaacgtccaggatggacct

SEQ ID NO: 645933 - DNA, 25 bp, Mus musculus
gacctttaacgtgcaggatggacct

SEQ ID NO: 645934 - DNA, 25 bp, Mus musculus
gacctttacaatcaggacgacaatc

SEQ ID NO: 645935 - DNA, 25 bp, Mus musculus
gacctttacaatgaggacgacaatc

SEQ ID NO: 645936 - DNA, 25 bp, Mus musculus
gacctttacactatgggtgacccag

SEQ ID NO: 645937 - DNA, 25 bp, Mus musculus
gacctttacactttgggtgacccag

SEQ ID NO: 645938 - DNA, 25 bp, Mus musculus
gacctttacaggacacgagtctgac

SEQ ID NO: 645939 - DNA, 25 bp, Mus musculus
gacctttacaggtcacgagtctgac

SEQ ID NO: 645940 - DNA, 25 bp, Mus musculus
gacctttagtctctgaaatctggga

SEQ ID NO: 645941 - DNA, 25 bp, Mus musculus
gacctttagtctgtgaaatctggga

SEQ ID NO: 645942 - DNA, 25 bp, Mus musculus
gacctttcaattatggtagcgcgca

SEQ ID NO: 645943 - DNA, 25 bp, Mus musculus
gacctttcaattttggtagcgcgca

SEQ ID NO: 645944 - DNA, 25 bp, Mus musculus
gacctttccagactgagggagaatt

SEQ ID NO: 645945 - DNA, 25 bp, Mus musculus
gacctttccagagtgagggagaatt

SEQ ID NO: 645946 - DNA, 25 bp, Mus musculus
gacctttccttaagcaatgtgtgca

SEQ ID NO: 645947 - DNA, 25 bp, Mus musculus
gacctttccttatgcaatgtgtgca

SEQ ID NO: 645948 - DNA, 25 bp, Mus musculus
gacctttctgggacgggcagcactg

SEQ ID NO: 645949 - DNA, 25 bp, Mus musculus
gacctttctgggtcgggcagcactg

SEQ ID NO: 645950 - DNA, 25 bp, Mus musculus
gacctttgacatagacctgtcagct

SEQ ID NO: 645951 - DNA, 25 bp, Mus musculus
gacctttgacattgacctgtcagct

SEQ ID NO: 645952 - DNA, 25 bp, Mus musculus
gacctttgagcgcatgctttggcga

SEQ ID NO: 645953 - DNA, 25 bp, Mus musculus
gacctttgagcggatgctttggcga

SEQ ID NO: 645954 - DNA, 25 bp, Mus musculus
gacctttgaggaccagttcaaacag

SEQ ID NO: 645955 - DNA, 25 bp, Mus musculus
gacctttgaggagcagttcaaacag

SEQ ID NO: 645956 - DNA, 25 bp, Mus musculus
gacctttgcaatcaacatctgtgag

SEQ ID NO: 645957 - DNA, 25 bp, Mus musculus
gacctttgcaatgaacatctgtgag

SEQ ID NO: 645958 - DNA, 25 bp, Mus musculus
gacctttggagaacgcctagcaacc

SEQ ID NO: 645959 - DNA, 25 bp, Mus musculus
gacctttggagatcgcctagcaacc

SEQ ID NO: 645960 - DNA, 25 bp, Mus musculus
gacctttggatacctagtgctgctg

SEQ ID NO: 645961 - DNA, 25 bp, Mus musculus
gacctttggatagctagtgctgctg

SEQ ID NO: 645962 - DNA, 25 bp, Mus musculus
gacctttggcctatgtaagacacac

SEQ ID NO: 645963 - DNA, 25 bp, Mus musculus
gacctttggcctttgtaagacacac

SEQ ID NO: 645964 - DNA, 25 bp, Mus musculus
gacctttggctaagaagtcgtggct

SEQ ID NO: 645965 - DNA, 25 bp, Mus musculus
gacctttggctatgaagtcgtggct

SEQ ID NO: 645966 - DNA, 25 bp, Mus musculus
gacctttggcttcgagtcgatgccc

SEQ ID NO: 645967 - DNA, 25 bp, Mus musculus
gacctttggcttggagtcgatgccc

SEQ ID NO: 645968 - DNA, 25 bp, Mus musculus
gacctttgggcaactagcttttatc

SEQ ID NO: 645969 - DNA, 25 bp, Mus musculus
gacctttgggcatctagcttttatc

SEQ ID NO: 645970 - DNA, 25 bp, Mus musculus
gacctttgtcccatgggcccgcgag

SEQ ID NO: 645971 - DNA, 25 bp, Mus musculus
gacctttgtcccttgggcccgcgag

SEQ ID NO: 645972 - DNA, 25 bp, Mus musculus
gacctttgtgtcaggtgcttgtgat

SEQ ID NO: 645973 - DNA, 25 bp, Mus musculus
gacctttgtgtccaaactggatgtc

SEQ ID NO: 645974 - DNA, 25 bp, Mus musculus
gacctttgtgtcgaaactggatgtc

SEQ ID NO: 645975 - DNA, 25 bp, Mus musculus
gacctttgtgtctggtgcttgtgat

SEQ ID NO: 645976 - DNA, 25 bp, Mus musculus
gaccttttccacaacagcaagctgg

SEQ ID NO: 645977 - DNA, 25 bp, Mus musculus
gaccttttccactacagcaagctgg

SEQ ID NO: 645978 - DNA, 25 bp, Mus musculus
gaccttttccagaccgcacacaatg

SEQ ID NO: 645979 - DNA, 25 bp, Mus musculus
gaccttttccagtccgcacacaatg

SEQ ID NO: 645980 - DNA, 25 bp, Mus musculus
gaccttttctccatggatgaaagca

SEQ ID NO: 645981 - DNA, 25 bp, Mus musculus
gaccttttctccttggatgaaagca

SEQ ID NO: 645982 - DNA, 25 bp, Mus musculus
gacctttttctactccgaagctttg

SEQ ID NO: 645983 - DNA, 25 bp, Mus musculus
gacctttttctagtccgaagctttg

SEQ ID NO: 645984 - DNA, 25 bp, Mus musculus
gaccttttttgaacaacaaagctag

SEQ ID NO: 645985 - DNA, 25 bp, Mus musculus
gaccttttttgatcaacaaagctag

SEQ ID NO: 645986 - DNA, 25 bp, Mus musculus
gacgaaaaccatccaacaacttcta

SEQ ID NO: 645987 - DNA, 25 bp, Mus musculus
gacgaaaaccatgcaacaacttcta

SEQ ID NO: 645988 - DNA, 25 bp, Mus musculus
gacgaaaatcaacatggtgtcatgc

SEQ ID NO: 645989 - DNA, 25 bp, Mus musculus
gacgaaaatcaagatggtgtcatgc

SEQ ID NO: 645990 - DNA, 25 bp, Mus musculus
gacgaaactgtgagtgactgttccc

SEQ ID NO: 645991 - DNA, 25 bp, Mus musculus
gacgaaactgtgtgtgactgttccc

SEQ ID NO: 645992 - DNA, 25 bp, Mus musculus
gacgaaaggaccatcagcctgtgct

SEQ ID NO: 645993 - DNA, 25 bp, Mus musculus
gacgaaaggaccttcagcctgtgct

SEQ ID NO: 645994 - DNA, 25 bp, Mus musculus
gacgaaatgcgaaatcatgtgcgac

SEQ ID NO: 645995 - DNA, 25 bp, Mus musculus
gacgaaatgcgatatcatgtgcgac

SEQ ID NO: 645996 - DNA, 25 bp, Mus musculus
gacgaacaacttcaagtcactggag

SEQ ID NO: 645997 - DNA, 25 bp, Mus musculus
gacgaacaacttgaagtcactggag

SEQ ID NO: 645998 - DNA, 25 bp, Mus musculus
gacgaacaatttctatgcagcaatc

SEQ ID NO: 645999 - DNA, 25 bp, Mus musculus
gacgaacaatttgtatgcagcaatc

SEQ ID NO: 646000 - DNA, 25 bp, Mus musculus
gacgaacacagaaatcccaggactg

SEQ ID NO: 646001 - DNA, 25 bp, Mus musculus
gacgaacacagatatcccaggactg

SEQ ID NO: 646002 - DNA, 25 bp, Mus musculus
gacgaacagggacgatccgtgtcct

SEQ ID NO: 646003 - DNA, 25 bp, Mus musculus
gacgaacagggaggatccgtgtcct

SEQ ID NO: 646004 - DNA, 25 bp, Mus musculus
gacgaacatctcagcagtgaactat

SEQ ID NO: 646005 - DNA, 25 bp, Mus musculus
gacgaacatctctgcagtgaactat

SEQ ID NO: 646006 - DNA, 25 bp, Mus musculus
gacgaaccggacctgggctcggtag

SEQ ID NO: 646007 - DNA, 25 bp, Mus musculus
gacgaaccggacgtgggctcggtag

SEQ ID NO: 646008 - DNA, 25 bp, Mus musculus
gacgaactacacctgtacaacactg

SEQ ID NO: 646009 - DNA, 25 bp, Mus musculus
gacgaactacacgtgtacaacactg

SEQ ID NO: 646010 - DNA, 25 bp, Mus musculus
gacgaactatctagctagatgcaga

SEQ ID NO: 646011 - DNA, 25 bp, Mus musculus
gacgaactatcttgctagatgcaga

SEQ ID NO: 646012 - DNA, 25 bp, Mus musculus
gacgaagacaacacaaacattatga

SEQ ID NO: 646013 - DNA, 25 bp, Mus musculus
gacgaagacaactcaaacattatga

SEQ ID NO: 646014 - DNA, 25 bp, Mus musculus
gacgaagagagtatgagtagtgtta

SEQ ID NO: 646015 - DNA, 25 bp, Mus musculus
gacgaagagagtttgagtagtgtta

SEQ ID NO: 646016 - DNA, 25 bp, Mus musculus
gacgaagagatcagcagttgaagga

SEQ ID NO: 646017 - DNA, 25 bp, Mus musculus
gacgaagagatctgcagttgaagga

SEQ ID NO: 646018 - DNA, 25 bp, Mus musculus
gacgaagagattcacctggctttcc

SEQ ID NO: 646019 - DNA, 25 bp, Mus musculus
gacgaagagattgacctggctttcc

SEQ ID NO: 646020 - DNA, 25 bp, Mus musculus
gacgaagagcgaaacagatacaggg

SEQ ID NO: 646021 - DNA, 25 bp, Mus musculus
gacgaagagcgatacagatacaggg

SEQ ID NO: 646022 - DNA, 25 bp, Mus musculus
gacgaagatgggaattctcagctcc

SEQ ID NO: 646023 - DNA, 25 bp, Mus musculus
gacgaagatgggtattctcagctcc

SEQ ID NO: 646024 - DNA, 25 bp, Mus musculus
gacgaagattcgaatcatctccacc

SEQ ID NO: 646025 - DNA, 25 bp, Mus musculus
gacgaagattcgtatcatctccacc

SEQ ID NO: 646026 - DNA, 25 bp, Mus musculus
gacgaagcctcccttagaggaactg

SEQ ID NO: 646027 - DNA, 25 bp, Mus musculus
gacgaagcctccgttagaggaactg

SEQ ID NO: 646028 - DNA, 25 bp, Mus musculus
gacgaagctgatccggatctcatca

SEQ ID NO: 646029 - DNA, 25 bp, Mus musculus
gacgaagctgatgcggatctcatca

SEQ ID NO: 646030 - DNA, 25 bp, Mus musculus
gacgaagttgatccttatgtccaga

SEQ ID NO: 646031 - DNA, 25 bp, Mus musculus
gacgaagttgatgcttatgtccaga

SEQ ID NO: 646032 - DNA, 25 bp, Mus musculus
gacgaatggcagaagaattactgtg

SEQ ID NO: 646033 - DNA, 25 bp, Mus musculus
gacgaatggcagtagaattactgtg

SEQ ID NO: 646034 - DNA, 25 bp, Mus musculus
gacgaattatctcacctcaagtatg

SEQ ID NO: 646035 - DNA, 25 bp, Mus musculus
gacgaattatctgacctcaagtatg

SEQ ID NO: 646036 - DNA, 25 bp, Mus musculus
gacgaattcataccagtgtgcactg

SEQ ID NO: 646037 - DNA, 25 bp, Mus musculus
gacgaattcatagcagtgtgcactg

SEQ ID NO: 646038 - DNA, 25 bp, Mus musculus
gacgaattggatcccattggtacca

SEQ ID NO: 646039 - DNA, 25 bp, Mus musculus
gacgaattggatgccattggtacca

SEQ ID NO: 646040 - DNA, 25 bp, Mus musculus
gacgaatttgtgaccggcaatctct

SEQ ID NO: 646041 - DNA, 25 bp, Mus musculus
gacgaatttgtgtccggcaatctct

SEQ ID NO: 646042 - DNA, 25 bp, Mus musculus
gacgacaagccacacgggaggttgg

SEQ ID NO: 646043 - DNA, 25 bp, Mus musculus
gacgacaagccagacgggaggttgg

SEQ ID NO: 646044 - DNA, 25 bp, Mus musculus
gacgacacaatgcagaaaaactttt

SEQ ID NO: 646045 - DNA, 25 bp, Mus musculus
gacgacacaatggagaaaaactttt

SEQ ID NO: 646046 - DNA, 25 bp, Mus musculus
gacgacacagatagctccgaagacg

SEQ ID NO: 646047 - DNA, 25 bp, Mus musculus
gacgacacagattgctccgaagacg

SEQ ID NO: 646048 - DNA, 25 bp, Mus musculus
gacgacacagccaatggaccaagat

SEQ ID NO: 646049 - DNA, 25 bp, Mus musculus
gacgacacagcctatggaccaagat

SEQ ID NO: 646050 - DNA, 25 bp, Mus musculus
gacgacaccgatcagtcccactgtg

SEQ ID NO: 646051 - DNA, 25 bp, Mus musculus
gacgacaccgatgagtcccactgtg

SEQ ID NO: 646052 - DNA, 25 bp, Mus musculus
gacgacactaccaaaaagctgtgga

SEQ ID NO: 646053 - DNA, 25 bp, Mus musculus
gacgacactacctaaaagctgtgga

SEQ ID NO: 646054 - DNA, 25 bp, Mus musculus
gacgacagcaccatcacaatcactg

SEQ ID NO: 646055 - DNA, 25 bp, Mus musculus
gacgacagcaccttcacaatcactg

SEQ ID NO: 646056 - DNA, 25 bp, Mus musculus
gacgacatcaagaccatcatggaca

SEQ ID NO: 646057 - DNA, 25 bp, Mus musculus
gacgacatcaagtccatcatggaca

SEQ ID NO: 646058 - DNA, 25 bp, Mus musculus
gacgacatccccaattcttctgcag

SEQ ID NO: 646059 - DNA, 25 bp, Mus musculus
gacgacatcccctattcttctgcag

SEQ ID NO: 646060 - DNA, 25 bp, Mus musculus
gacgacatccgacggaagtgcactg

SEQ ID NO: 646061 - DNA, 25 bp, Mus musculus
gacgacatccgagggaagtgcactg

SEQ ID NO: 646062 - DNA, 25 bp, Mus musculus
gacgacatctcgcactttctatgtg

SEQ ID NO: 646063 - DNA, 25 bp, Mus musculus
gacgacatctcggactttctatgtg

SEQ ID NO: 646064 - DNA, 25 bp, Mus musculus
gacgacatgcctcgagttcttctcc

SEQ ID NO: 646065 - DNA, 25 bp, Mus musculus
gacgacatgcctggagttcttctcc

SEQ ID NO: 646066 - DNA, 25 bp, Mus musculus
gacgacatggtcctaaatccgccat

SEQ ID NO: 646067 - DNA, 25 bp, Mus musculus
gacgacatggtcgtaaatccgccat

SEQ ID NO: 646068 - DNA, 25 bp, Mus musculus
gacgaccagaagatagtcagcggcc

SEQ ID NO: 646069 - DNA, 25 bp, Mus musculus
gacgaccagaagttagtcagcggcc

SEQ ID NO: 646070 - DNA, 25 bp, Mus musculus
gacgacccacctccaatggattttg

SEQ ID NO: 646071 - DNA, 25 bp, Mus musculus
gacgacccacctgcaatggattttg

SEQ ID NO: 646072 - DNA, 25 bp, Mus musculus
gacgacccgggcattttctacagcg

SEQ ID NO: 646073 - DNA, 25 bp, Mus musculus
gacgacccgggctttttctacagcg

SEQ ID NO: 646074 - DNA, 25 bp, Mus musculus
gacgaccctagccaaggttgcggta

SEQ ID NO: 646075 - DNA, 25 bp, Mus musculus
gacgaccctagcgaaggttgcggta

SEQ ID NO: 646076 - DNA, 25 bp, Mus musculus
gacgaccgcacacgctttgtttgga

SEQ ID NO: 646077 - DNA, 25 bp, Mus musculus
gacgaccgcacaggctttgtttgga

SEQ ID NO: 646078 - DNA, 25 bp, Mus musculus
gacgaccggatcctccagtgtgcct

SEQ ID NO: 646079 - DNA, 25 bp, Mus musculus
gacgaccggatcgtccagtgtgcct

SEQ ID NO: 646080 - DNA, 25 bp, Mus musculus
gacgaccggtttcggcagatcatga

SEQ ID NO: 646081 - DNA, 25 bp, Mus musculus
gacgaccggtttgggcagatcatga

SEQ ID NO: 646082 - DNA, 25 bp, Mus musculus
gacgacctcactaacctggtggtga

SEQ ID NO: 646083 - DNA, 25 bp, Mus musculus
gacgacctcacttacctggtggtga

SEQ ID NO: 646084 - DNA, 25 bp, Mus musculus
gacgacctggagctgtattacaagc

SEQ ID NO: 646085 - DNA, 25 bp, Mus musculus
gacgacctggaggtgtattacaagc

SEQ ID NO: 646086 - DNA, 25 bp, Mus musculus
gacgacgactagatgacgagtggcc

SEQ ID NO: 646087 - DNA, 25 bp, Mus musculus
gacgacgactagttgacgagtggcc

SEQ ID NO: 646088 - DNA, 25 bp, Mus musculus
gacgacgactcaagcgcttcaacgg

SEQ ID NO: 646089 - DNA, 25 bp, Mus musculus
gacgacgactcatgcgcttcaacgg

SEQ ID NO: 646090 - DNA, 25 bp, Mus musculus
gacgacgagatcaatgacggaatag

SEQ ID NO: 646091 - DNA, 25 bp, Mus musculus
gacgacgagatctatgacggaatag

SEQ ID NO: 646092 - DNA, 25 bp, Mus musculus
gacgacgagtaccactacctcttta

SEQ ID NO: 646093 - DNA, 25 bp, Mus musculus
gacgacgagtacgactacctcttta

SEQ ID NO: 646094 - DNA, 25 bp, Mus musculus
gacgacgatgagaagaaagtgacag

SEQ ID NO: 646095 - DNA, 25 bp, Mus musculus
gacgacgatgagtagaaagtgacag

SEQ ID NO: 646096 - DNA, 25 bp, Mus musculus
gacgacgccgataactaagaggacg

SEQ ID NO: 646097 - DNA, 25 bp, Mus musculus
gacgacgccgattactaagaggacg

SEQ ID NO: 646098 - DNA, 25 bp, Mus musculus
gacgacgctgcaactgtttcacaaa

SEQ ID NO: 646099 - DNA, 25 bp, Mus musculus
gacgacgctgcatctgtttcacaaa

SEQ ID NO: 646100 - DNA, 25 bp, Mus musculus
gacgacggacacaccatctgttggg

SEQ ID NO: 646101 - DNA, 25 bp, Mus musculus
gacgacggacactccatctgttggg

SEQ ID NO: 646102 - DNA, 25 bp, Mus musculus
gacgacgtgcccatcattctcgtgg

SEQ ID NO: 646103 - DNA, 25 bp, Mus musculus
gacgacgtgcccttcattctcgtgg

SEQ ID NO: 646104 - DNA, 25 bp, Mus musculus
gacgactacagcctgagatctggga

SEQ ID NO: 646105 - DNA, 25 bp, Mus musculus
gacgactacagcgtgagatctggga

SEQ ID NO: 646106 - DNA, 25 bp, Mus musculus
gacgactactgccactgtaaggacg

SEQ ID NO: 646107 - DNA, 25 bp, Mus musculus
gacgactactgcgactgtaaggacg

SEQ ID NO: 646108 - DNA, 25 bp, Mus musculus
gacgactatactccccgtctctttg

SEQ ID NO: 646109 - DNA, 25 bp, Mus musculus
gacgactatactgcccgtctctttg

SEQ ID NO: 646110 - DNA, 25 bp, Mus musculus
gacgactccggactgatagctatct

SEQ ID NO: 646111 - DNA, 25 bp, Mus musculus
gacgactccggagtgatagctatct

SEQ ID NO: 646112 - DNA, 25 bp, Mus musculus
gacgactgacgtcgttagtctatat

SEQ ID NO: 646113 - DNA, 25 bp, Mus musculus
gacgactgacgtggttagtctatat

SEQ ID NO: 646114 - DNA, 25 bp, Mus musculus
gacgactgtcataccgtgcactcca

SEQ ID NO: 646115 - DNA, 25 bp, Mus musculus
gacgactgtcattccgtgcactcca

SEQ ID NO: 646116 - DNA, 25 bp, Mus musculus
gacgacttcacacaggaacgcctgg

SEQ ID NO: 646117 - DNA, 25 bp, Mus musculus
gacgacttcacagaggaacgcctgg

SEQ ID NO: 646118 - DNA, 25 bp, Mus musculus
gacgacttcctaaggtatgcatgga

SEQ ID NO: 646119 - DNA, 25 bp, Mus musculus
gacgacttcctatggtatgcatgga

SEQ ID NO: 646120 - DNA, 25 bp, Mus musculus
gacgacttcctcagcgaaaccaaat

SEQ ID NO: 646121 - DNA, 25 bp, Mus musculus
gacgacttcctctgcgaaaccaaat

SEQ ID NO: 646122 - DNA, 25 bp, Mus musculus
gacgacttgttgaaacttgggaagg

SEQ ID NO: 646123 - DNA, 25 bp, Mus musculus
gacgacttgttgtaacttgggaagg

SEQ ID NO: 646124 - DNA, 25 bp, Mus musculus
gacgactttactattgtaactggca

SEQ ID NO: 646125 - DNA, 25 bp, Mus musculus
gacgactttacttttgtaactggca

SEQ ID NO: 646126 - DNA, 25 bp, Mus musculus
gacgactttgaccatgacaatgtgc

SEQ ID NO: 646127 - DNA, 25 bp, Mus musculus
gacgactttgacgatgacaatgtgc

SEQ ID NO: 646128 - DNA, 25 bp, Mus musculus
gacgacttttcgaaatcattgtcca

SEQ ID NO: 646129 - DNA, 25 bp, Mus musculus
gacgacttttcgtaatcattgtcca

SEQ ID NO: 646130 - DNA, 25 bp, Mus musculus
gacgagaacacgctagctaaggatt

SEQ ID NO: 646131 - DNA, 25 bp, Mus musculus
gacgagaacacggtagctaaggatt

SEQ ID NO: 646132 - DNA, 25 bp, Mus musculus
gacgagaagctactacagaggtgca

SEQ ID NO: 646133 - DNA, 25 bp, Mus musculus
gacgagaagctagtacagaggtgca

SEQ ID NO: 646134 - DNA, 25 bp, Mus musculus
gacgagaagggcattcaccactctg

SEQ ID NO: 646135 - DNA, 25 bp, Mus musculus
gacgagaagggctttcaccactctg

SEQ ID NO: 646136 - DNA, 25 bp, Mus musculus
gacgagaatggaccttgatggatct

SEQ ID NO: 646137 - DNA, 25 bp, Mus musculus
gacgagaatggagcttgatggatct

SEQ ID NO: 646138 - DNA, 25 bp, Mus musculus
gacgagaccaagagataaagcagaa

SEQ ID NO: 646139 - DNA, 25 bp, Mus musculus
gacgagaccaagtgataaagcagaa

SEQ ID NO: 646140 - DNA, 25 bp, Mus musculus
gacgagacctggcaccccttacttg

SEQ ID NO: 646141 - DNA, 25 bp, Mus musculus
gacgagacctgggaccccttacttg

SEQ ID NO: 646142 - DNA, 25 bp, Mus musculus
gacgagagacttatcacgtatctgg

SEQ ID NO: 646143 - DNA, 25 bp, Mus musculus
gacgagagacttttcacgtatctgg

SEQ ID NO: 646144 - DNA, 25 bp, Mus musculus
gacgagagcatcaagtatcccctga

SEQ ID NO: 646145 - DNA, 25 bp, Mus musculus
gacgagagcatctagtatcccctga

SEQ ID NO: 646146 - DNA, 25 bp, Mus musculus
gacgagaggccaaacacctgtgaca

SEQ ID NO: 646147 - DNA, 25 bp, Mus musculus
gacgagaggccatacacctgtgaca

SEQ ID NO: 646148 - DNA, 25 bp, Mus musculus
gacgagaggtccaactgagaacctt

SEQ ID NO: 646149 - DNA, 25 bp, Mus musculus
gacgagaggtcctactgagaacctt

SEQ ID NO: 646150 - DNA, 25 bp, Mus musculus
gacgagatattgaagcccgcaaaag

SEQ ID NO: 646151 - DNA, 25 bp, Mus musculus
gacgagatattgtagcccgcaaaag

SEQ ID NO: 646152 - DNA, 25 bp, Mus musculus
gacgagatgaacctgtttccctgct

SEQ ID NO: 646153 - DNA, 25 bp, Mus musculus
gacgagatgaacgtgtttccctgct

SEQ ID NO: 646154 - DNA, 25 bp, Mus musculus
gacgagatgtgcagagttttgccca

SEQ ID NO: 646155 - DNA, 25 bp, Mus musculus
gacgagatgtgctgagttttgccca

SEQ ID NO: 646156 - DNA, 25 bp, Mus musculus
gacgagcaaaccaaaaactatagag

SEQ ID NO: 646157 - DNA, 25 bp, Mus musculus
gacgagcaaacctaaaactatagag

SEQ ID NO: 646158 - DNA, 25 bp, Mus musculus
gacgagcagccccatattggcaact

SEQ ID NO: 646159 - DNA, 25 bp, Mus musculus
gacgagcagcccgatattggcaact

SEQ ID NO: 646160 - DNA, 25 bp, Mus musculus
gacgagccatcactgaagaccatga

SEQ ID NO: 646161 - DNA, 25 bp, Mus musculus
gacgagccatcagtgaagaccatga

SEQ ID NO: 646162 - DNA, 25 bp, Mus musculus
gacgagccatgaagtgccaaggata

SEQ ID NO: 646163 - DNA, 25 bp, Mus musculus
gacgagccatgatgtgccaaggata

SEQ ID NO: 646164 - DNA, 25 bp, Mus musculus
gacgagcccgccatcggtgttccga

SEQ ID NO: 646165 - DNA, 25 bp, Mus musculus
gacgagcccgccttcggtgttccga

SEQ ID NO: 646166 - DNA, 25 bp, Mus musculus
gacgagccgcaaagatgaagaatta

SEQ ID NO: 646167 - DNA, 25 bp, Mus musculus
gacgagccgcaatgatgaagaatta

SEQ ID NO: 646168 - DNA, 25 bp, Mus musculus
gacgagccgcacattcgcatggtgg

SEQ ID NO: 646169 - DNA, 25 bp, Mus musculus
gacgagccgcactttcgcatggtgg

SEQ ID NO: 646170 - DNA, 25 bp, Mus musculus
gacgagccggaaccgcttaccctga

SEQ ID NO: 646171 - DNA, 25 bp, Mus musculus
gacgagccggaagcgcttaccctga

SEQ ID NO: 646172 - DNA, 25 bp, Mus musculus
gacgagccgggaccaccatgcgttt

SEQ ID NO: 646173 - DNA, 25 bp, Mus musculus
gacgagccgggagcaccatgcgttt

SEQ ID NO: 646174 - DNA, 25 bp, Mus musculus
gacgagcggaaaagtaactacgagc

SEQ ID NO: 646175 - DNA, 25 bp, Mus musculus
gacgagcggaaatgtaactacgagc

SEQ ID NO: 646176 - DNA, 25 bp, Mus musculus
gacgagcgtacaagagtctttgtct

SEQ ID NO: 646177 - DNA, 25 bp, Mus musculus
gacgagcgtacatgagtctttgtct

SEQ ID NO: 646178 - DNA, 25 bp, Mus musculus
gacgagctggaccacgccctcaatg

SEQ ID NO: 646179 - DNA, 25 bp, Mus musculus
gacgagctggacgacgccctcaatg

SEQ ID NO: 646180 - DNA, 25 bp, Mus musculus
gacgagctggagcattgcgcctact

SEQ ID NO: 646181 - DNA, 25 bp, Mus musculus
gacgagctggaggattgcgcctact

SEQ ID NO: 646182 - DNA, 25 bp, Mus musculus
gacgagctgggcaacatgtatttcc

SEQ ID NO: 646183 - DNA, 25 bp, Mus musculus
gacgagctgggctacatgtatttcc

SEQ ID NO: 646184 - DNA, 25 bp, Mus musculus
gacgagcttctcatcacgctttggc

SEQ ID NO: 646185 - DNA, 25 bp, Mus musculus
gacgagcttctcttcacgctttggc

SEQ ID NO: 646186 - DNA, 25 bp, Mus musculus
gacgagcttctgacggccgtgttga

SEQ ID NO: 646187 - DNA, 25 bp, Mus musculus
gacgagcttctgactcgcaccttca

SEQ ID NO: 646188 - DNA, 25 bp, Mus musculus
gacgagcttctgtcggccgtgttga

SEQ ID NO: 646189 - DNA, 25 bp, Mus musculus
gacgagcttctgtctcgcaccttca

SEQ ID NO: 646190 - DNA, 25 bp, Mus musculus
gacgagctttgcacttactatcaga

SEQ ID NO: 646191 - DNA, 25 bp, Mus musculus
gacgagctttgctcttactatcaga

SEQ ID NO: 646192 - DNA, 25 bp, Mus musculus
gacgaggaaatgatggaaatccgac

SEQ ID NO: 646193 - DNA, 25 bp, Mus musculus
gacgaggaaatgttggaaatccgac

SEQ ID NO: 646194 - DNA, 25 bp, Mus musculus
gacgaggaagtcaagtactgtagct

SEQ ID NO: 646195 - DNA, 25 bp, Mus musculus
gacgaggaagtctagtactgtagct

SEQ ID NO: 646196 - DNA, 25 bp, Mus musculus
gacgaggacatgaggaaacagatgc

SEQ ID NO: 646197 - DNA, 25 bp, Mus musculus
gacgaggacatgtggaaacagatgc

SEQ ID NO: 646198 - DNA, 25 bp, Mus musculus
gacgaggacgacagcaccttcacaa

SEQ ID NO: 646199 - DNA, 25 bp, Mus musculus
gacgaggacgactgcaccttcacaa

SEQ ID NO: 646200 - DNA, 25 bp, Mus musculus
gacgaggcagaacaagacgttaagc

SEQ ID NO: 646201 - DNA, 25 bp, Mus musculus
gacgaggcagaagaagacgttaagc

SEQ ID NO: 646202 - DNA, 25 bp, Mus musculus
gacgaggcatataccattggccctg

SEQ ID NO: 646203 - DNA, 25 bp, Mus musculus
gacgaggcatattccattggccctg

SEQ ID NO: 646204 - DNA, 25 bp, Mus musculus
gacgaggccccaatgtttggtgaca

SEQ ID NO: 646205 - DNA, 25 bp, Mus musculus
gacgaggccccattgtttggtgaca

SEQ ID NO: 646206 - DNA, 25 bp, Mus musculus
gacgaggcccctcctttgtgttgaa

SEQ ID NO: 646207 - DNA, 25 bp, Mus musculus
gacgaggcccctgctttgtgttgaa

SEQ ID NO: 646208 - DNA, 25 bp, Mus musculus
gacgaggctaggaataagcacgcta

SEQ ID NO: 646209 - DNA, 25 bp, Mus musculus
gacgaggctaggtataagcacgcta

SEQ ID NO: 646210 - DNA, 25 bp, Mus musculus
gacgaggcttccacacagagagaga

SEQ ID NO: 646211 - DNA, 25 bp, Mus musculus
gacgaggcttccagctctggtacag

SEQ ID NO: 646212 - DNA, 25 bp, Mus musculus
gacgaggcttcctcacagagagaga

SEQ ID NO: 646213 - DNA, 25 bp, Mus musculus
gacgaggcttcctgctctggtacag

SEQ ID NO: 646214 - DNA, 25 bp, Mus musculus
gacgagggtcccaccggcatcaagg

SEQ ID NO: 646215 - DNA, 25 bp, Mus musculus
gacgagggtccctccggcatcaagg

SEQ ID NO: 646216 - DNA, 25 bp, Mus musculus
gacgaggtgttcacaactcaaggcc

SEQ ID NO: 646217 - DNA, 25 bp, Mus musculus
gacgaggtgttctcaactcaaggcc

SEQ ID NO: 646218 - DNA, 25 bp, Mus musculus
gacgagtaccagatggacttccacc

SEQ ID NO: 646219 - DNA, 25 bp, Mus musculus
gacgagtaccagttggacttccacc

SEQ ID NO: 646220 - DNA, 25 bp, Mus musculus
gacgagtacgacaacctctttaaag

SEQ ID NO: 646221 - DNA, 25 bp, Mus musculus
gacgagtacgactacctctttaaag

SEQ ID NO: 646222 - DNA, 25 bp, Mus musculus
gacgagtagacaagaacgtgcccct

SEQ ID NO: 646223 - DNA, 25 bp, Mus musculus
gacgagtagacatgaacgtgcccct

SEQ ID NO: 646224 - DNA, 25 bp, Mus musculus
gacgagtaggctcgactgaatactc

SEQ ID NO: 646225 - DNA, 25 bp, Mus musculus
gacgagtaggctggactgaatactc

SEQ ID NO: 646226 - DNA, 25 bp, Mus musculus
gacgagtatcaactggcccagctct

SEQ ID NO: 646227 - DNA, 25 bp, Mus musculus
gacgagtatcaagtggcccagctct

SEQ ID NO: 646228 - DNA, 25 bp, Mus musculus
gacgagtatgcccaaaacacttact

SEQ ID NO: 646229 - DNA, 25 bp, Mus musculus
gacgagtatgccgaaaacacttact

SEQ ID NO: 646230 - DNA, 25 bp, Mus musculus
gacgagtctgtgaatggcatcctca

SEQ ID NO: 646231 - DNA, 25 bp, Mus musculus
gacgagtctgtgtatggcatcctca

SEQ ID NO: 646232 - DNA, 25 bp, Mus musculus
gacgagtgaccacagccctgtcttt

SEQ ID NO: 646233 - DNA, 25 bp, Mus musculus
gacgagtgaccagagccctgtcttt

SEQ ID NO: 646234 - DNA, 25 bp, Mus musculus
gacgagtgagatctactcttggcca

SEQ ID NO: 646235 - DNA, 25 bp, Mus musculus
gacgagtgagatgtactcttggcca

SEQ ID NO: 646236 - DNA, 25 bp, Mus musculus
gacgagtggcacagtcgattcttag

SEQ ID NO: 646237 - DNA, 25 bp, Mus musculus
gacgagtggcactgtcgattcttag

SEQ ID NO: 646238 - DNA, 25 bp, Mus musculus
gacgagtggcatctagtcgcgccaa

SEQ ID NO: 646239 - DNA, 25 bp, Mus musculus
gacgagtggcatgtagtcgcgccaa

SEQ ID NO: 646240 - DNA, 25 bp, Mus musculus
gacgagtgtgacaagatgcttgaac

SEQ ID NO: 646241 - DNA, 25 bp, Mus musculus
gacgagtgtgactagatgcttgaac

SEQ ID NO: 646242 - DNA, 25 bp, Mus musculus
gacgagtgtgagaatgactactaca

SEQ ID NO: 646243 - DNA, 25 bp, Mus musculus
gacgagtgtgagtatgactactaca

SEQ ID NO: 646244 - DNA, 25 bp, Mus musculus
gacgagttcataagtgattacctct

SEQ ID NO: 646245 - DNA, 25 bp, Mus musculus
gacgagttcatatgtgattacctct

SEQ ID NO: 646246 - DNA, 25 bp, Mus musculus
gacgagttctggaggtttcctcaca

SEQ ID NO: 646247 - DNA, 25 bp, Mus musculus
gacgagttctggtggtttcctcaca

SEQ ID NO: 646248 - DNA, 25 bp, Mus musculus
gacgataagcctattgatctttctg

SEQ ID NO: 646249 - DNA, 25 bp, Mus musculus
gacgataagccttttgatctttctg

SEQ ID NO: 646250 - DNA, 25 bp, Mus musculus
gacgatacgctgactgcgggacact

SEQ ID NO: 646251 - DNA, 25 bp, Mus musculus
gacgatacgctgtctgcgggacact

SEQ ID NO: 646252 - DNA, 25 bp, Mus musculus
gacgatatggctatgctgccttgaa

SEQ ID NO: 646253 - DNA, 25 bp, Mus musculus
gacgatatggctttgctgccttgaa

SEQ ID NO: 646254 - DNA, 25 bp, Mus musculus
gacgatatgtcacgaactttgctag

SEQ ID NO: 646255 - DNA, 25 bp, Mus musculus
gacgatatgtcaggaactttgctag

SEQ ID NO: 646256 - DNA, 25 bp, Mus musculus
gacgatatgtttccggttggatagc

SEQ ID NO: 646257 - DNA, 25 bp, Mus musculus
gacgatatgtttgcggttggatagc

SEQ ID NO: 646258 - DNA, 25 bp, Mus musculus
gacgatcaaacaccgttacagtgat

SEQ ID NO: 646259 - DNA, 25 bp, Mus musculus
gacgatcaaacagcgttacagtgat

SEQ ID NO: 646260 - DNA, 25 bp, Mus musculus
gacgatcaatccaggatgctgcaga

SEQ ID NO: 646261 - DNA, 25 bp, Mus musculus
gacgatcaatcctggatgctgcaga

SEQ ID NO: 646262 - DNA, 25 bp, Mus musculus
gacgatcacacacaccttgccattg

SEQ ID NO: 646263 - DNA, 25 bp, Mus musculus
gacgatcacacagaccttgccattg

SEQ ID NO: 646264 - DNA, 25 bp, Mus musculus
gacgatcacattcccagacgtacgg

SEQ ID NO: 646265 - DNA, 25 bp, Mus musculus
gacgatcacattgccagacgtacgg

SEQ ID NO: 646266 - DNA, 25 bp, Mus musculus
gacgatcactctcactgatgtcaac

SEQ ID NO: 646267 - DNA, 25 bp, Mus musculus
gacgatcactctgactgatgtcaac

SEQ ID NO: 646268 - DNA, 25 bp, Mus musculus
gacgatcagaaacatacagacctgg

SEQ ID NO: 646269 - DNA, 25 bp, Mus musculus
gacgatcagaaagatacagacctgg

SEQ ID NO: 646270 - DNA, 25 bp, Mus musculus
gacgatcagcgaccaggaatccttc

SEQ ID NO: 646271 - DNA, 25 bp, Mus musculus
gacgatcagcgagcaggaatccttc

SEQ ID NO: 646272 - DNA, 25 bp, Mus musculus
gacgatccagcactatctgcggtga

SEQ ID NO: 646273 - DNA, 25 bp, Mus musculus
gacgatccagcagtatctgcggtga

SEQ ID NO: 646274 - DNA, 25 bp, Mus musculus
gacgatccctacaaaaaggctgtcg

SEQ ID NO: 646275 - DNA, 25 bp, Mus musculus
gacgatccctactaaaaggctgtcg

SEQ ID NO: 646276 - DNA, 25 bp, Mus musculus
gacgatcctcatcaatgactatcct

SEQ ID NO: 646277 - DNA, 25 bp, Mus musculus
gacgatcctcatgaatgactatcct

SEQ ID NO: 646278 - DNA, 25 bp, Mus musculus
gacgatcctttgatgacctatcgct

SEQ ID NO: 646279 - DNA, 25 bp, Mus musculus
gacgatcctttgttgacctatcgct

SEQ ID NO: 646280 - DNA, 25 bp, Mus musculus
gacgatctctggacccgttttgttt

SEQ ID NO: 646281 - DNA, 25 bp, Mus musculus
gacgatctctggtcccgttttgttt

SEQ ID NO: 646282 - DNA, 25 bp, Mus musculus
gacgatctgccaagccttacggtgt

SEQ ID NO: 646283 - DNA, 25 bp, Mus musculus
gacgatctgccatgccttacggtgt

SEQ ID NO: 646284 - DNA, 25 bp, Mus musculus
gacgatcttcagacgtgtggaacct

SEQ ID NO: 646285 - DNA, 25 bp, Mus musculus
gacgatcttcagtcgtgtggaacct

SEQ ID NO: 646286 - DNA, 25 bp, Mus musculus
gacgatgacaaccacaagatccccg

SEQ ID NO: 646287 - DNA, 25 bp, Mus musculus
gacgatgacaacgacaagatccccg

SEQ ID NO: 646288 - DNA, 25 bp, Mus musculus
gacgatgacgacctcttctgaggca

SEQ ID NO: 646289 - DNA, 25 bp, Mus musculus
gacgatgacgacgtcttctgaggca

SEQ ID NO: 646290 - DNA, 25 bp, Mus musculus
gacgatgagagaacacccgatgtga

SEQ ID NO: 646291 - DNA, 25 bp, Mus musculus
gacgatgagagatcacccgatgtga

SEQ ID NO: 646292 - DNA, 25 bp, Mus musculus
gacgatgagatacgcttgaagattg

SEQ ID NO: 646293 - DNA, 25 bp, Mus musculus
gacgatgagataggcttgaagattg

SEQ ID NO: 646294 - DNA, 25 bp, Mus musculus
gacgatgagcgtctgctcaccatca

SEQ ID NO: 646295 - DNA, 25 bp, Mus musculus
gacgatgagcgtgtgctcaccatca

SEQ ID NO: 646296 - DNA, 25 bp, Mus musculus
gacgatgagctaaagccttatgtgg

SEQ ID NO: 646297 - DNA, 25 bp, Mus musculus
gacgatgagctatagccttatgtgg

SEQ ID NO: 646298 - DNA, 25 bp, Mus musculus
gacgatgaggaccagctcttcgagt

SEQ ID NO: 646299 - DNA, 25 bp, Mus musculus
gacgatgaggacgagctcttcgagt

SEQ ID NO: 646300 - DNA, 25 bp, Mus musculus
gacgatgatatcaacgggctaaacg

SEQ ID NO: 646301 - DNA, 25 bp, Mus musculus
gacgatgatatctacgggctaaacg

SEQ ID NO: 646302 - DNA, 25 bp, Mus musculus
gacgatgatcttcttgtcagcacat

SEQ ID NO: 646303 - DNA, 25 bp, Mus musculus
gacgatgatcttgttgtcagcacat

SEQ ID NO: 646304 - DNA, 25 bp, Mus musculus
gacgatgatgacaacgttgatgaag

SEQ ID NO: 646305 - DNA, 25 bp, Mus musculus
gacgatgatgactacgttgatgaag

SEQ ID NO: 646306 - DNA, 25 bp, Mus musculus
gacgatgatgatatctacaatgttc

SEQ ID NO: 646307 - DNA, 25 bp, Mus musculus
gacgatgatgatttctacaatgttc

SEQ ID NO: 646308 - DNA, 25 bp, Mus musculus
gacgatgatgcacagacaggcctga

SEQ ID NO: 646309 - DNA, 25 bp, Mus musculus
gacgatgatgcagagacaggcctga

SEQ ID NO: 646310 - DNA, 25 bp, Mus musculus
gacgatgatgtacagtgtaccatgg

SEQ ID NO: 646311 - DNA, 25 bp, Mus musculus
gacgatgatgtagagtgtaccatgg

SEQ ID NO: 646312 - DNA, 25 bp, Mus musculus
gacgatgctcaaagatcttctgcgt

SEQ ID NO: 646313 - DNA, 25 bp, Mus musculus
gacgatgctcaatgatcttctgcgt

SEQ ID NO: 646314 - DNA, 25 bp, Mus musculus
gacgatggacttccgatcaggctca

SEQ ID NO: 646315 - DNA, 25 bp, Mus musculus
gacgatggacttgcgatcaggctca

SEQ ID NO: 646316 - DNA, 25 bp, Mus musculus
gacgatggaggaaagtgaaaacaat

SEQ ID NO: 646317 - DNA, 25 bp, Mus musculus
gacgatggaggatagtgaaaacaat

SEQ ID NO: 646318 - DNA, 25 bp, Mus musculus
gacgatgggaatccagtgccagcaa

SEQ ID NO: 646319 - DNA, 25 bp, Mus musculus
gacgatgggaatgcagtgccagcaa

SEQ ID NO: 646320 - DNA, 25 bp, Mus musculus
gacgatgggcgcagacttcatcatg

SEQ ID NO: 646321 - DNA, 25 bp, Mus musculus
gacgatgggcgctgacttcatcatg

SEQ ID NO: 646322 - DNA, 25 bp, Mus musculus
gacgatggtgctcagtgtcttcata

SEQ ID NO: 646323 - DNA, 25 bp, Mus musculus
gacgatggtgctgagtgtcttcata

SEQ ID NO: 646324 - DNA, 25 bp, Mus musculus
gacgatggtgtgaatgctgtgcccc

SEQ ID NO: 646325 - DNA, 25 bp, Mus musculus
gacgatggtgtgtatgctgtgcccc

SEQ ID NO: 646326 - DNA, 25 bp, Mus musculus
gacgatggttgaacatcacctaggg

SEQ ID NO: 646327 - DNA, 25 bp, Mus musculus
gacgatggttgatcatcacctaggg

SEQ ID NO: 646328 - DNA, 25 bp, Mus musculus
gacgatgtcccaattaagataggag

SEQ ID NO: 646329 - DNA, 25 bp, Mus musculus
gacgatgtcccatttaagataggag

SEQ ID NO: 646330 - DNA, 25 bp, Mus musculus
gacgatgtctttaccaaagaggaac

SEQ ID NO: 646331 - DNA, 25 bp, Mus musculus
gacgatgtcttttccaaagaggaac

SEQ ID NO: 646332 - DNA, 25 bp, Mus musculus
gacgatgtgcgaccggtttggcgtg

SEQ ID NO: 646333 - DNA, 25 bp, Mus musculus
gacgatgtgcgagcggtttggcgtg

SEQ ID NO: 646334 - DNA, 25 bp, Mus musculus
gacgattacgagcatggcgccatca

SEQ ID NO: 646335 - DNA, 25 bp, Mus musculus
gacgattacgaggatggcgccatca

SEQ ID NO: 646336 - DNA, 25 bp, Mus musculus
gacgattatcccacgatgagaccaa

SEQ ID NO: 646337 - DNA, 25 bp, Mus musculus
gacgattatccctcgatgagaccaa

SEQ ID NO: 646338 - DNA, 25 bp, Mus musculus
gacgattatgttcgagtaacccagc

SEQ ID NO: 646339 - DNA, 25 bp, Mus musculus
gacgattatgttggagtaacccagc

SEQ ID NO: 646340 - DNA, 25 bp, Mus musculus
gacgattcagatcctcctcaagctg

SEQ ID NO: 646341 - DNA, 25 bp, Mus musculus
gacgattcagatgctcctcaagctg

SEQ ID NO: 646342 - DNA, 25 bp, Mus musculus
gacgattccattcttaacatagtga

SEQ ID NO: 646343 - DNA, 25 bp, Mus musculus
gacgattccattgttaacatagtga

SEQ ID NO: 646344 - DNA, 25 bp, Mus musculus
gacgattcgctcaatcctattgcgg

SEQ ID NO: 646345 - DNA, 25 bp, Mus musculus
gacgattcgctctatcctattgcgg

SEQ ID NO: 646346 - DNA, 25 bp, Mus musculus
gacgattgtgacagtcatcctgaat

SEQ ID NO: 646347 - DNA, 25 bp, Mus musculus
gacgattgtgactgtcatcctgaat

SEQ ID NO: 646348 - DNA, 25 bp, Mus musculus
gacgatttaaagctatcgcgccacc

SEQ ID NO: 646349 - DNA, 25 bp, Mus musculus
gacgatttaaaggtatcgcgccacc

SEQ ID NO: 646350 - DNA, 25 bp, Mus musculus
gacgatttattcagctattggcatt

SEQ ID NO: 646351 - DNA, 25 bp, Mus musculus
gacgatttattctgctattggcatt

SEQ ID NO: 646352 - DNA, 25 bp, Mus musculus
gacgatttcctgaagactttcagct

SEQ ID NO: 646353 - DNA, 25 bp, Mus musculus
gacgatttcctgtagactttcagct

SEQ ID NO: 646354 - DNA, 25 bp, Mus musculus
gacgcaaaaacgaaggagtgattga

SEQ ID NO: 646355 - DNA, 25 bp, Mus musculus
gacgcaaaaacgtaggagtgattga

SEQ ID NO: 646356 - DNA, 25 bp, Mus musculus
gacgcaaaggaaactcagcggagtg

SEQ ID NO: 646357 - DNA, 25 bp, Mus musculus
gacgcaaaggaatctcagcggagtg

SEQ ID NO: 646358 - DNA, 25 bp, Mus musculus
gacgcaacgcagaagctaaggatga

SEQ ID NO: 646359 - DNA, 25 bp, Mus musculus
gacgcaacgcagtagctaaggatga

SEQ ID NO: 646360 - DNA, 25 bp, Mus musculus
gacgcaactccgcagagctggacgt

SEQ ID NO: 646361 - DNA, 25 bp, Mus musculus
gacgcaactccggagagctggacgt

SEQ ID NO: 646362 - DNA, 25 bp, Mus musculus
gacgcaattcagctgcctcaacttt

SEQ ID NO: 646363 - DNA, 25 bp, Mus musculus
gacgcaattcaggtgcctcaacttt

SEQ ID NO: 646364 - DNA, 25 bp, Mus musculus
gacgcacagaagaataagcttcgac

SEQ ID NO: 646365 - DNA, 25 bp, Mus musculus
gacgcacagaagtataagcttcgac

SEQ ID NO: 646366 - DNA, 25 bp, Mus musculus
gacgcacatgtgcatgctcattact

SEQ ID NO: 646367 - DNA, 25 bp, Mus musculus
gacgcacatgtggatgctcattact

SEQ ID NO: 646368 - DNA, 25 bp, Mus musculus
gacgcacattctaatgataacggag

SEQ ID NO: 646369 - DNA, 25 bp, Mus musculus
gacgcacattcttatgataacggag

SEQ ID NO: 646370 - DNA, 25 bp, Mus musculus
gacgcaccaccgatgcggagttcca

SEQ ID NO: 646371 - DNA, 25 bp, Mus musculus
gacgcaccaccgttgcggagttcca

SEQ ID NO: 646372 - DNA, 25 bp, Mus musculus
gacgcaccgaggagacataaagtgt

SEQ ID NO: 646373 - DNA, 25 bp, Mus musculus
gacgcaccgaggtgacataaagtgt

SEQ ID NO: 646374 - DNA, 25 bp, Mus musculus
gacgcacctgctcgagaatctcaaa

SEQ ID NO: 646375 - DNA, 25 bp, Mus musculus
gacgcacctgctggagaatctcaaa

SEQ ID NO: 646376 - DNA, 25 bp, Mus musculus
gacgcacctgttctctatctgggaa

SEQ ID NO: 646377 - DNA, 25 bp, Mus musculus
gacgcacctgttgtctatctgggaa

SEQ ID NO: 646378 - DNA, 25 bp, Mus musculus
gacgcactagctcagctgaaggatg

SEQ ID NO: 646379 - DNA, 25 bp, Mus musculus
gacgcactagctgagctgaaggatg

SEQ ID NO: 646380 - DNA, 25 bp, Mus musculus
gacgcactgccgcagcttctctgag

SEQ ID NO: 646381 - DNA, 25 bp, Mus musculus
gacgcactgccggagcttctctgag

SEQ ID NO: 646382 - DNA, 25 bp, Mus musculus
gacgcactggagcacattatggaac

SEQ ID NO: 646383 - DNA, 25 bp, Mus musculus
gacgcactggaggacattatggaac

SEQ ID NO: 646384 - DNA, 25 bp, Mus musculus
gacgcactgtgaagttgcacctcta

SEQ ID NO: 646385 - DNA, 25 bp, Mus musculus
gacgcactgtgatgttgcacctcta

SEQ ID NO: 646386 - DNA, 25 bp, Mus musculus
gacgcagaacaaaaagcagccaggg

SEQ ID NO: 646387 - DNA, 25 bp, Mus musculus
gacgcagaacaataagcagccaggg

SEQ ID NO: 646388 - DNA, 25 bp, Mus musculus
gacgcagacacacctataatcaatg

SEQ ID NO: 646389 - DNA, 25 bp, Mus musculus
gacgcagacacagctataatcaatg

SEQ ID NO: 646390 - DNA, 25 bp, Mus musculus
gacgcagactgtacagaccaatcag

SEQ ID NO: 646391 - DNA, 25 bp, Mus musculus
gacgcagactgttcagaccaatcag

SEQ ID NO: 646392 - DNA, 25 bp, Mus musculus
gacgcagagatgcatgtgaaacctt

SEQ ID NO: 646393 - DNA, 25 bp, Mus musculus
gacgcagagatggatgtgaaacctt

SEQ ID NO: 646394 - DNA, 25 bp, Mus musculus
gacgcagagcccaaaggagcatcag

SEQ ID NO: 646395 - DNA, 25 bp, Mus musculus
gacgcagagccctaaggagcatcag

SEQ ID NO: 646396 - DNA, 25 bp, Mus musculus
gacgcagaggatctatgacaagttt

SEQ ID NO: 646397 - DNA, 25 bp, Mus musculus
gacgcagaggatgtatgacaagttt

SEQ ID NO: 646398 - DNA, 25 bp, Mus musculus
gacgcagagtggacgaacgtcacgt

SEQ ID NO: 646399 - DNA, 25 bp, Mus musculus
gacgcagagtggtcgaacgtcacgt

SEQ ID NO: 646400 - DNA, 25 bp, Mus musculus
gacgcagcacttcgaggtgcccctt

SEQ ID NO: 646401 - DNA, 25 bp, Mus musculus
gacgcagcacttggaggtgcccctt

SEQ ID NO: 646402 - DNA, 25 bp, Mus musculus
gacgcagccacactcagtgagatcg

SEQ ID NO: 646403 - DNA, 25 bp, Mus musculus
gacgcagccacagtcagtgagatcg

SEQ ID NO: 646404 - DNA, 25 bp, Mus musculus
gacgcagctgaacagttccatccct

SEQ ID NO: 646405 - DNA, 25 bp, Mus musculus
gacgcagctgaagagttccatccct

SEQ ID NO: 646406 - DNA, 25 bp, Mus musculus
gacgcaggcagtagatttcatcaac

SEQ ID NO: 646407 - DNA, 25 bp, Mus musculus
gacgcaggcagttgatttcatcaac

SEQ ID NO: 646408 - DNA, 25 bp, Mus musculus
gacgcagtcatcagcgcgcgcagca

SEQ ID NO: 646409 - DNA, 25 bp, Mus musculus
gacgcagtcatctgcgcgcgcagca

SEQ ID NO: 646410 - DNA, 25 bp, Mus musculus
gacgcagtcctgaaccatttcatag

SEQ ID NO: 646411 - DNA, 25 bp, Mus musculus
gacgcagtcctgtaccatttcatag

SEQ ID NO: 646412 - DNA, 25 bp, Mus musculus
gacgcagtgatgaatgcctccacgg

SEQ ID NO: 646413 - DNA, 25 bp, Mus musculus
gacgcagtgatgtatgcctccacgg

SEQ ID NO: 646414 - DNA, 25 bp, Mus musculus
gacgcatcaagcagcaaaattctgg

SEQ ID NO: 646415 - DNA, 25 bp, Mus musculus
gacgcatcaagctgcaaaattctgg

SEQ ID NO: 646416 - DNA, 25 bp, Mus musculus
gacgcatcgctcagaaagtacttcg

SEQ ID NO: 646417 - DNA, 25 bp, Mus musculus
gacgcatcgctctgaaagtacttcg

SEQ ID NO: 646418 - DNA, 25 bp, Mus musculus
gacgcatcggataagaaggctgcct

SEQ ID NO: 646419 - DNA, 25 bp, Mus musculus
gacgcatcggattagaaggctgcct

SEQ ID NO: 646420 - DNA, 25 bp, Mus musculus
gacgcatggaccctggtctccctag

SEQ ID NO: 646421 - DNA, 25 bp, Mus musculus
gacgcatggaccgtggtctccctag

SEQ ID NO: 646422 - DNA, 25 bp, Mus musculus
gacgcattcatgcaggcctatgaca

SEQ ID NO: 646423 - DNA, 25 bp, Mus musculus
gacgcattcatggaggcctatgaca

SEQ ID NO: 646424 - DNA, 25 bp, Mus musculus
gacgcattttacaaacagcccatgt

SEQ ID NO: 646425 - DNA, 25 bp, Mus musculus
gacgcattttactaacagcccatgt

SEQ ID NO: 646426 - DNA, 25 bp, Mus musculus
gacgccaaagggatctgggagccaa

SEQ ID NO: 646427 - DNA, 25 bp, Mus musculus
gacgccaaagggttctgggagccaa

SEQ ID NO: 646428 - DNA, 25 bp, Mus musculus
gacgccaacattcacgaggcctata

SEQ ID NO: 646429 - DNA, 25 bp, Mus musculus
gacgccaacattgacgaggcctata

SEQ ID NO: 646430 - DNA, 25 bp, Mus musculus
gacgccaacgttagcacctctagtt

SEQ ID NO: 646431 - DNA, 25 bp, Mus musculus
gacgccaacgtttgcacctctagtt

SEQ ID NO: 646432 - DNA, 25 bp, Mus musculus
gacgccaagatacactgatgggaca

SEQ ID NO: 646433 - DNA, 25 bp, Mus musculus
gacgccaagatagactgatgggaca

SEQ ID NO: 646434 - DNA, 25 bp, Mus musculus
gacgccaagcaaaagtacaagtgca

SEQ ID NO: 646435 - DNA, 25 bp, Mus musculus
gacgccaagcaatagtacaagtgca

SEQ ID NO: 646436 - DNA, 25 bp, Mus musculus
gacgccaagcgcagctcagagattg

SEQ ID NO: 646437 - DNA, 25 bp, Mus musculus
gacgccaagcgctgctcagagattg

SEQ ID NO: 646438 - DNA, 25 bp, Mus musculus
gacgccacccttcatgatataaaag

SEQ ID NO: 646439 - DNA, 25 bp, Mus musculus
gacgccacccttgatgatataaaag

SEQ ID NO: 646440 - DNA, 25 bp, Mus musculus
gacgccactgttccgaaaccaggtc

SEQ ID NO: 646441 - DNA, 25 bp, Mus musculus
gacgccactgttgcgaaaccaggtc

SEQ ID NO: 646442 - DNA, 25 bp, Mus musculus
gacgccagaactatgaaatggcctt

SEQ ID NO: 646443 - DNA, 25 bp, Mus musculus
gacgccagaactttgaaatggcctt

SEQ ID NO: 646444 - DNA, 25 bp, Mus musculus
gacgccaggcccagtatacctgagc

SEQ ID NO: 646445 - DNA, 25 bp, Mus musculus
gacgccaggccctgtatacctgagc

SEQ ID NO: 646446 - DNA, 25 bp, Mus musculus
gacgccatcagcaaaatggatccca

SEQ ID NO: 646447 - DNA, 25 bp, Mus musculus
gacgccatcagctaaatggatccca

SEQ ID NO: 646448 - DNA, 25 bp, Mus musculus
gacgccatcagtctcatgtccgagg

SEQ ID NO: 646449 - DNA, 25 bp, Mus musculus
gacgccatcagtgtcatgtccgagg

SEQ ID NO: 646450 - DNA, 25 bp, Mus musculus
gacgccatccggaccagaaaaagcc

SEQ ID NO: 646451 - DNA, 25 bp, Mus musculus
gacgccatccggtccagaaaaagcc

SEQ ID NO: 646452 - DNA, 25 bp, Mus musculus
gacgccatcggcaaagtctttgtgg

SEQ ID NO: 646453 - DNA, 25 bp, Mus musculus
gacgccatcggctaagtctttgtgg

SEQ ID NO: 646454 - DNA, 25 bp, Mus musculus
gacgccatgctgaccatcactttct

SEQ ID NO: 646455 - DNA, 25 bp, Mus musculus
gacgccatgctgtccatcactttct

SEQ ID NO: 646456 - DNA, 25 bp, Mus musculus
gacgccattcagattcagagaggtg

SEQ ID NO: 646457 - DNA, 25 bp, Mus musculus
gacgccattcagtttcagagaggtg

SEQ ID NO: 646458 - DNA, 25 bp, Mus musculus
gacgccattgtgcaagctgtgaaag

SEQ ID NO: 646459 - DNA, 25 bp, Mus musculus
gacgccattgtggaagctgtgaaag

SEQ ID NO: 646460 - DNA, 25 bp, Mus musculus
gacgcccgagagaccagtgactcgg

SEQ ID NO: 646461 - DNA, 25 bp, Mus musculus
gacgcccgagagtccagtgactcgg

SEQ ID NO: 646462 - DNA, 25 bp, Mus musculus
gacgcccgcacacaggacgggacta

SEQ ID NO: 646463 - DNA, 25 bp, Mus musculus
gacgcccgcacagaggacgggacta

SEQ ID NO: 646464 - DNA, 25 bp, Mus musculus
gacgccctctaccatgtttacctag

SEQ ID NO: 646465 - DNA, 25 bp, Mus musculus
gacgccctctacgatgtttacctag

SEQ ID NO: 646466 - DNA, 25 bp, Mus musculus
gacgccgccgacaccgtttgtctgg

SEQ ID NO: 646467 - DNA, 25 bp, Mus musculus
gacgccgccgactccgtttgtctgg

SEQ ID NO: 646468 - DNA, 25 bp, Mus musculus
gacgccgctgtgagtcagtcatcaa

SEQ ID NO: 646469 - DNA, 25 bp, Mus musculus
gacgccgctgtgtgtcagtcatcaa

SEQ ID NO: 646470 - DNA, 25 bp, Mus musculus
gacgccggcctcattattgtgagca

SEQ ID NO: 646471 - DNA, 25 bp, Mus musculus
gacgccggcctctttattgtgagca

SEQ ID NO: 646472 - DNA, 25 bp, Mus musculus
gacgccgggctgacattctgaaatt

SEQ ID NO: 646473 - DNA, 25 bp, Mus musculus
gacgccgggctgtcattctgaaatt

SEQ ID NO: 646474 - DNA, 25 bp, Mus musculus
gacgccggtagaaagtccagatgac

SEQ ID NO: 646475 - DNA, 25 bp, Mus musculus
gacgccggtagatagtccagatgac

SEQ ID NO: 646476 - DNA, 25 bp, Mus musculus
gacgccggtgacagtcccattctga

SEQ ID NO: 646477 - DNA, 25 bp, Mus musculus
gacgccggtgactgtcccattctga

SEQ ID NO: 646478 - DNA, 25 bp, Mus musculus
gacgcctagaccagcggtggtgata

SEQ ID NO: 646479 - DNA, 25 bp, Mus musculus
gacgcctagacctgcggtggtgata

SEQ ID NO: 646480 - DNA, 25 bp, Mus musculus
gacgcctcccgtaacttctttgatg

SEQ ID NO: 646481 - DNA, 25 bp, Mus musculus
gacgcctcccgttacttctttgatg

SEQ ID NO: 646482 - DNA, 25 bp, Mus musculus
gacgcctctaggagagacagaagcc

SEQ ID NO: 646483 - DNA, 25 bp, Mus musculus
gacgcctctaggtgagacagaagcc

SEQ ID NO: 646484 - DNA, 25 bp, Mus musculus
gacgcctgagggaaaccaccaggca

SEQ ID NO: 646485 - DNA, 25 bp, Mus musculus
gacgcctgagggtaaccaccaggca

SEQ ID NO: 646486 - DNA, 25 bp, Mus musculus
gacgcctgccatcttagaagcctcg

SEQ ID NO: 646487 - DNA, 25 bp, Mus musculus
gacgcctgccatgttagaagcctcg

SEQ ID NO: 646488 - DNA, 25 bp, Mus musculus
gacgcctgctccagaatgtcctagg

SEQ ID NO: 646489 - DNA, 25 bp, Mus musculus
gacgcctgctcctgaatgtcctagg

SEQ ID NO: 646490 - DNA, 25 bp, Mus musculus
gacgcctggttcatcgccttcatgg

SEQ ID NO: 646491 - DNA, 25 bp, Mus musculus
gacgcctggttcttcgccttcatgg

SEQ ID NO: 646492 - DNA, 25 bp, Mus musculus
gacgccttacttaaccagagcaagg

SEQ ID NO: 646493 - DNA, 25 bp, Mus musculus
gacgccttactttaccagagcaagg

SEQ ID NO: 646494 - DNA, 25 bp, Mus musculus
gacgccttgccactgtaggcacaga

SEQ ID NO: 646495 - DNA, 25 bp, Mus musculus
gacgccttgccagtgtaggcacaga

SEQ ID NO: 646496 - DNA, 25 bp, Mus musculus
gacgccttgtgccttcctaaggcgg

SEQ ID NO: 646497 - DNA, 25 bp, Mus musculus
gacgccttgtgcgttcctaaggcgg

SEQ ID NO: 646498 - DNA, 25 bp, Mus musculus
gacgcctttgatcgttctcttgcca

SEQ ID NO: 646499 - DNA, 25 bp, Mus musculus
gacgcctttgatggttctcttgcca

SEQ ID NO: 646500 - DNA, 25 bp, Mus musculus
gacgcctttgttattagccatttgg

SEQ ID NO: 646501 - DNA, 25 bp, Mus musculus
gacgcctttgtttttagccatttgg

SEQ ID NO: 646502 - DNA, 25 bp, Mus musculus
gacgcgagacgcagtcatcagcgcg

SEQ ID NO: 646503 - DNA, 25 bp, Mus musculus
gacgcgagacgccagcaagcgtttc

SEQ ID NO: 646504 - DNA, 25 bp, Mus musculus
gacgcgagacgcgagcaagcgtttc

SEQ ID NO: 646505 - DNA, 25 bp, Mus musculus
gacgcgagacgctgtcatcagcgcg

SEQ ID NO: 646506 - DNA, 25 bp, Mus musculus
gacgcgatagaacacagcacacatg

SEQ ID NO: 646507 - DNA, 25 bp, Mus musculus
gacgcgatagaagacagcacacatg

SEQ ID NO: 646508 - DNA, 25 bp, Mus musculus
gacgcgcgttgtcgcccgcagactt

SEQ ID NO: 646509 - DNA, 25 bp, Mus musculus
gacgcgcgttgtggcccgcagactt

SEQ ID NO: 646510 - DNA, 25 bp, Mus musculus
gacgcggatctacggcctttgtccc

SEQ ID NO: 646511 - DNA, 25 bp, Mus musculus
gacgcggatctagggcctttgtccc

SEQ ID NO: 646512 - DNA, 25 bp, Mus musculus
gacgcggcgcggacgtttttataca

SEQ ID NO: 646513 - DNA, 25 bp, Mus musculus
gacgcggcgcggtcgtttttataca

SEQ ID NO: 646514 - DNA, 25 bp, Mus musculus
gacgcggcttgtcgagatcgataac

SEQ ID NO: 646515 - DNA, 25 bp, Mus musculus
gacgcggcttgtggagatcgataac

SEQ ID NO: 646516 - DNA, 25 bp, Mus musculus
gacgcgggtcctacttgtgcagata

SEQ ID NO: 646517 - DNA, 25 bp, Mus musculus
gacgcgggtccttcttgtgcagata

SEQ ID NO: 646518 - DNA, 25 bp, Mus musculus
gacgcgggtgacctctcacagatga

SEQ ID NO: 646519 - DNA, 25 bp, Mus musculus
gacgcgggtgacgtctcacagatga

SEQ ID NO: 646520 - DNA, 25 bp, Mus musculus
gacgcgtaccgtcgatatactcaaa

SEQ ID NO: 646521 - DNA, 25 bp, Mus musculus
gacgcgtaccgtggatatactcaaa

SEQ ID NO: 646522 - DNA, 25 bp, Mus musculus
gacgcgtacctgcagatcttgatag

SEQ ID NO: 646523 - DNA, 25 bp, Mus musculus
gacgcgtacctggagatcttgatag

SEQ ID NO: 646524 - DNA, 25 bp, Mus musculus
gacgcgtctttgcaatacatattag

SEQ ID NO: 646525 - DNA, 25 bp, Mus musculus
gacgcgtctttggaatacatattag

SEQ ID NO: 646526 - DNA, 25 bp, Mus musculus
gacgctaacaatcacgggcataatg

SEQ ID NO: 646527 - DNA, 25 bp, Mus musculus
gacgctaacaatgacgggcataatg

SEQ ID NO: 646528 - DNA, 25 bp, Mus musculus
gacgctaacccacgtgagacgctaa

SEQ ID NO: 646529 - DNA, 25 bp, Mus musculus
gacgctaacccaggtgagacgctaa

SEQ ID NO: 646530 - DNA, 25 bp, Mus musculus
gacgctaaggagaacgctgaatcca

SEQ ID NO: 646531 - DNA, 25 bp, Mus musculus
gacgctaaggagtacgctgaatcca

SEQ ID NO: 646532 - DNA, 25 bp, Mus musculus
gacgctaatctccacaacactgttg

SEQ ID NO: 646533 - DNA, 25 bp, Mus musculus
gacgctaatctcgacaacactgttg

SEQ ID NO: 646534 - DNA, 25 bp, Mus musculus
gacgctatctatattgtggttatca

SEQ ID NO: 646535 - DNA, 25 bp, Mus musculus
gacgctatctattttgtggttatca

SEQ ID NO: 646536 - DNA, 25 bp, Mus musculus
gacgctatggttcccttgggtctct

SEQ ID NO: 646537 - DNA, 25 bp, Mus musculus
gacgctatggttgccttgggtctct

SEQ ID NO: 646538 - DNA, 25 bp, Mus musculus
gacgctcaagccatcgagagagagg

SEQ ID NO: 646539 - DNA, 25 bp, Mus musculus
gacgctcaagccttcgagagagagg

SEQ ID NO: 646540 - DNA, 25 bp, Mus musculus
gacgctcaatgaatgggactccagg

SEQ ID NO: 646541 - DNA, 25 bp, Mus musculus
gacgctcaatgattgggactccagg

SEQ ID NO: 646542 - DNA, 25 bp, Mus musculus
gacgctccatgaaaaagcctgcagt

SEQ ID NO: 646543 - DNA, 25 bp, Mus musculus
gacgctccatgataaagcctgcagt

SEQ ID NO: 646544 - DNA, 25 bp, Mus musculus
gacgctccatgtcctggaagccaga

SEQ ID NO: 646545 - DNA, 25 bp, Mus musculus
gacgctccatgtgctggaagccaga

SEQ ID NO: 646546 - DNA, 25 bp, Mus musculus
gacgctcccaggattgcatcagcct

SEQ ID NO: 646547 - DNA, 25 bp, Mus musculus
gacgctcccaggtttgcatcagcct

SEQ ID NO: 646548 - DNA, 25 bp, Mus musculus
gacgctcccgggaaacgaatgagga

SEQ ID NO: 646549 - DNA, 25 bp, Mus musculus
gacgctcccgggtaacgaatgagga

SEQ ID NO: 646550 - DNA, 25 bp, Mus musculus
gacgctccgttcctgctgacatctt

SEQ ID NO: 646551 - DNA, 25 bp, Mus musculus
gacgctccgttcgtgctgacatctt

SEQ ID NO: 646552 - DNA, 25 bp, Mus musculus
gacgctcgctctcctttttctgcag

SEQ ID NO: 646553 - DNA, 25 bp, Mus musculus
gacgctcgctctgctttttctgcag

SEQ ID NO: 646554 - DNA, 25 bp, Mus musculus
gacgctctgactcttctggaatacc

SEQ ID NO: 646555 - DNA, 25 bp, Mus musculus
gacgctctgactgttctggaatacc

SEQ ID NO: 646556 - DNA, 25 bp, Mus musculus
gacgctctggctacagcgccaagta

SEQ ID NO: 646557 - DNA, 25 bp, Mus musculus
gacgctctggcttcagcgccaagta

SEQ ID NO: 646558 - DNA, 25 bp, Mus musculus
gacgctcttcgaatccaacaaggac

SEQ ID NO: 646559 - DNA, 25 bp, Mus musculus
gacgctcttcgattccaacaaggac

SEQ ID NO: 646560 - DNA, 25 bp, Mus musculus
gacgctgaaacaagttattgaagca

SEQ ID NO: 646561 - DNA, 25 bp, Mus musculus
gacgctgaaacatgttattgaagca

SEQ ID NO: 646562 - DNA, 25 bp, Mus musculus
gacgctgacattcaggcaagtggat

SEQ ID NO: 646563 - DNA, 25 bp, Mus musculus
gacgctgacattgaggcaagtggat

SEQ ID NO: 646564 - DNA, 25 bp, Mus musculus
gacgctgactacattgctgctttcc

SEQ ID NO: 646565 - DNA, 25 bp, Mus musculus
gacgctgactactttgctgctttcc

SEQ ID NO: 646566 - DNA, 25 bp, Mus musculus
gacgctgcacctccagcacaatgag

SEQ ID NO: 646567 - DNA, 25 bp, Mus musculus
gacgctgcacctgcagcacaatgag

SEQ ID NO: 646568 - DNA, 25 bp, Mus musculus
gacgctgcatctctttcacaaattc

SEQ ID NO: 646569 - DNA, 25 bp, Mus musculus
gacgctgcatctgtttcacaaattc

SEQ ID NO: 646570 - DNA, 25 bp, Mus musculus
gacgctgccccgacagagtctttac

SEQ ID NO: 646571 - DNA, 25 bp, Mus musculus
gacgctgccccgtcagagtctttac

SEQ ID NO: 646572 - DNA, 25 bp, Mus musculus
gacgctgcgcaacgctggcatcaag

SEQ ID NO: 646573 - DNA, 25 bp, Mus musculus
gacgctgcgcaaggctggcatcaag

SEQ ID NO: 646574 - DNA, 25 bp, Mus musculus
gacgctgcgcatctacaagaccatt

SEQ ID NO: 646575 - DNA, 25 bp, Mus musculus
gacgctgcgcatgtacaagaccatt

SEQ ID NO: 646576 - DNA, 25 bp, Mus musculus
gacgctgctcgccatttatgtagcc

SEQ ID NO: 646577 - DNA, 25 bp, Mus musculus
gacgctgctcgcgatttatgtagcc

SEQ ID NO: 646578 - DNA, 25 bp, Mus musculus
gacgctgctgcactcatacaacaag

SEQ ID NO: 646579 - DNA, 25 bp, Mus musculus
gacgctgctgcagtcatacaacaag

SEQ ID NO: 646580 - DNA, 25 bp, Mus musculus
gacgctggaaaaatgtgggcacaac

SEQ ID NO: 646581 - DNA, 25 bp, Mus musculus
gacgctggaaaattgtgggcacaac

SEQ ID NO: 646582 - DNA, 25 bp, Mus musculus
gacgctggaagaccgtacatccatg

SEQ ID NO: 646583 - DNA, 25 bp, Mus musculus
gacgctggaagagcgtacatccatg

SEQ ID NO: 646584 - DNA, 25 bp, Mus musculus
gacgctggacaaagatgtgctttca

SEQ ID NO: 646585 - DNA, 25 bp, Mus musculus
gacgctggacaatgatgtgctttca

SEQ ID NO: 646586 - DNA, 25 bp, Mus musculus
gacgctggtttccattgtccccaag

SEQ ID NO: 646587 - DNA, 25 bp, Mus musculus
gacgctggtttcgattgtccccaag

SEQ ID NO: 646588 - DNA, 25 bp, Mus musculus
gacgctgtcaacaaaatgacaatca

SEQ ID NO: 646589 - DNA, 25 bp, Mus musculus
gacgctgtcaactaaatgacaatca

SEQ ID NO: 646590 - DNA, 25 bp, Mus musculus
gacgctgtcattattggaatgacca

SEQ ID NO: 646591 - DNA, 25 bp, Mus musculus
gacgctgtcatttttggaatgacca

SEQ ID NO: 646592 - DNA, 25 bp, Mus musculus
gacgctgtctgaccaggtccaggaa

SEQ ID NO: 646593 - DNA, 25 bp, Mus musculus
gacgctgtctgagcaggtccaggaa

SEQ ID NO: 646594 - DNA, 25 bp, Mus musculus
gacgctgtggctctgccgattgtta

SEQ ID NO: 646595 - DNA, 25 bp, Mus musculus
gacgctgtggctgtgccgattgtta

SEQ ID NO: 646596 - DNA, 25 bp, Mus musculus
gacgctgtgtgcaaccaccagcagc

SEQ ID NO: 646597 - DNA, 25 bp, Mus musculus
gacgctgtgtgctaccaccagcagc

SEQ ID NO: 646598 - DNA, 25 bp, Mus musculus
gacgctgttgagataagaccccttt

SEQ ID NO: 646599 - DNA, 25 bp, Mus musculus
gacgctgttgagttaagaccccttt

SEQ ID NO: 646600 - DNA, 25 bp, Mus musculus
gacgcttcagttcatgtatgatgag

SEQ ID NO: 646601 - DNA, 25 bp, Mus musculus
gacgcttcagttgatgtatgatgag

SEQ ID NO: 646602 - DNA, 25 bp, Mus musculus
gacgcttcatgaaaattctccccga

SEQ ID NO: 646603 - DNA, 25 bp, Mus musculus
gacgcttcatgataattctccccga

SEQ ID NO: 646604 - DNA, 25 bp, Mus musculus
gacgcttcccagagagttccggctc

SEQ ID NO: 646605 - DNA, 25 bp, Mus musculus
gacgcttcccagtgagttccggctc

SEQ ID NO: 646606 - DNA, 25 bp, Mus musculus
gacgctttccgaaagatggctgcag

SEQ ID NO: 646607 - DNA, 25 bp, Mus musculus
gacgctttccgatagatggctgcag

SEQ ID NO: 646608 - DNA, 25 bp, Mus musculus
gacgctttttacctctccgccagag

SEQ ID NO: 646609 - DNA, 25 bp, Mus musculus
gacgctttttacgtctccgccagag

SEQ ID NO: 646610 - DNA, 25 bp, Mus musculus
gacggaaaatgcatcgctagcaagt

SEQ ID NO: 646611 - DNA, 25 bp, Mus musculus
gacggaaaatgcttcgctagcaagt

SEQ ID NO: 646612 - DNA, 25 bp, Mus musculus
gacggaaacgtcatgtacaatcgaa

SEQ ID NO: 646613 - DNA, 25 bp, Mus musculus
gacggaaacgtcttgtacaatcgaa

SEQ ID NO: 646614 - DNA, 25 bp, Mus musculus
gacggaaatttccacgttgccctgg

SEQ ID NO: 646615 - DNA, 25 bp, Mus musculus
gacggaaatttcgacgttgccctgg

SEQ ID NO: 646616 - DNA, 25 bp, Mus musculus
gacggaacactgcactctcaagtca

SEQ ID NO: 646617 - DNA, 25 bp, Mus musculus
gacggaacactggactctcaagtca

SEQ ID NO: 646618 - DNA, 25 bp, Mus musculus
gacggaactgaactcaacggcagaa

SEQ ID NO: 646619 - DNA, 25 bp, Mus musculus
gacggaactgaagtcaacggcagaa

SEQ ID NO: 646620 - DNA, 25 bp, Mus musculus
gacggaagacagaaagaggatcgcc

SEQ ID NO: 646621 - DNA, 25 bp, Mus musculus
gacggaagacagtaagaggatcgcc

SEQ ID NO: 646622 - DNA, 25 bp, Mus musculus
gacggaagatgacctgagttttcac

SEQ ID NO: 646623 - DNA, 25 bp, Mus musculus
gacggaagatgagctgagttttcac

SEQ ID NO: 646624 - DNA, 25 bp, Mus musculus
gacggaagccacagttgctatggag

SEQ ID NO: 646625 - DNA, 25 bp, Mus musculus
gacggaagccactgttgctatggag

SEQ ID NO: 646626 - DNA, 25 bp, Mus musculus
gacggaagcttcctgttgaccgaaa

SEQ ID NO: 646627 - DNA, 25 bp, Mus musculus
gacggaagcttcgtgttgaccgaaa

SEQ ID NO: 646628 - DNA, 25 bp, Mus musculus
gacggaagtctcacgggagccaacc

SEQ ID NO: 646629 - DNA, 25 bp, Mus musculus
gacggaagtctctcgggagccaacc

SEQ ID NO: 646630 - DNA, 25 bp, Mus musculus
gacggaatcatcaatatttttgaca

SEQ ID NO: 646631 - DNA, 25 bp, Mus musculus
gacggaatcatctatatttttgaca

SEQ ID NO: 646632 - DNA, 25 bp, Mus musculus
gacggaatccgtccaaccttccaga

SEQ ID NO: 646633 - DNA, 25 bp, Mus musculus
gacggaatccgtgcaaccttccaga

SEQ ID NO: 646634 - DNA, 25 bp, Mus musculus
gacggaatgatgaatggcccaccag

SEQ ID NO: 646635 - DNA, 25 bp, Mus musculus
gacggaatgatgtatggcccaccag

SEQ ID NO: 646636 - DNA, 25 bp, Mus musculus
gacggaatggacaatgagacaggca

SEQ ID NO: 646637 - DNA, 25 bp, Mus musculus
gacggaatggactatgagacaggca

SEQ ID NO: 646638 - DNA, 25 bp, Mus musculus
gacggaatgggacctgtgaatatct

SEQ ID NO: 646639 - DNA, 25 bp, Mus musculus
gacggaatgggagctgtgaatatct

SEQ ID NO: 646640 - DNA, 25 bp, Mus musculus
gacggacactccatctgttgggcct

SEQ ID NO: 646641 - DNA, 25 bp, Mus musculus
gacggacactccttctgttgggcct

SEQ ID NO: 646642 - DNA, 25 bp, Mus musculus
gacggacagacgaggaagatctacc

SEQ ID NO: 646643 - DNA, 25 bp, Mus musculus
gacggacagacgtggaagatctacc

SEQ ID NO: 646644 - DNA, 25 bp, Mus musculus
gacggacaggtcaaagccttccagg

SEQ ID NO: 646645 - DNA, 25 bp, Mus musculus
gacggacaggtctaagccttccagg

SEQ ID NO: 646646 - DNA, 25 bp, Mus musculus
gacggacatcaaacatggttgggct

SEQ ID NO: 646647 - DNA, 25 bp, Mus musculus
gacggacatcaatcatggttgggct

SEQ ID NO: 646648 - DNA, 25 bp, Mus musculus
gacggacatcgaaggaaagttcctc

SEQ ID NO: 646649 - DNA, 25 bp, Mus musculus
gacggacatcgatggaaagttcctc

SEQ ID NO: 646650 - DNA, 25 bp, Mus musculus
gacggacatgtcctgtatagcagac

SEQ ID NO: 646651 - DNA, 25 bp, Mus musculus
gacggacatgtcgtgtatagcagac

SEQ ID NO: 646652 - DNA, 25 bp, Mus musculus
gacggacccctacacagctggattg

SEQ ID NO: 646653 - DNA, 25 bp, Mus musculus
gacggacccctagacagctggattg

SEQ ID NO: 646654 - DNA, 25 bp, Mus musculus
gacggacgactgcttcccgggcctt

SEQ ID NO: 646655 - DNA, 25 bp, Mus musculus
gacggacgactggttcccgggcctt

SEQ ID NO: 646656 - DNA, 25 bp, Mus musculus
gacggacgcggaagatggcggacgc

SEQ ID NO: 646657 - DNA, 25 bp, Mus musculus
gacggacgcggatgatggcggacgc

SEQ ID NO: 646658 - DNA, 25 bp, Mus musculus
gacggacggcacactaaagccgaca

SEQ ID NO: 646659 - DNA, 25 bp, Mus musculus
gacggacggcactctaaagccgaca

SEQ ID NO: 646660 - DNA, 25 bp, Mus musculus
gacggactcctgcttaggaactgcg

SEQ ID NO: 646661 - DNA, 25 bp, Mus musculus
gacggactcctggttaggaactgcg

SEQ ID NO: 646662 - DNA, 25 bp, Mus musculus
gacggactctgtatcctggccaagg

SEQ ID NO: 646663 - DNA, 25 bp, Mus musculus
gacggactctgtttcctggccaagg

SEQ ID NO: 646664 - DNA, 25 bp, Mus musculus
gacggactgttcatcattggctgga

SEQ ID NO: 646665 - DNA, 25 bp, Mus musculus
gacggactgttcttcattggctgga

SEQ ID NO: 646666 - DNA, 25 bp, Mus musculus
gacggagaaatacgttcataggcac

SEQ ID NO: 646667 - DNA, 25 bp, Mus musculus
gacggagaaataggttcataggcac

SEQ ID NO: 646668 - DNA, 25 bp, Mus musculus
gacggagacatacatcccgatcaag

SEQ ID NO: 646669 - DNA, 25 bp, Mus musculus
gacggagacatagatcccgatcaag

SEQ ID NO: 646670 - DNA, 25 bp, Mus musculus
gacggagacattaagcgtatttcca

SEQ ID NO: 646671 - DNA, 25 bp, Mus musculus
gacggagacattagtgctcacaatg

SEQ ID NO: 646672 - DNA, 25 bp, Mus musculus
gacggagacatttagcgtatttcca

SEQ ID NO: 646673 - DNA, 25 bp, Mus musculus
gacggagacatttgtgctcacaatg

SEQ ID NO: 646674 - DNA, 25 bp, Mus musculus
gacggagaggtgaacccaccttccg

SEQ ID NO: 646675 - DNA, 25 bp, Mus musculus
gacggagaggtgtacccaccttccg

SEQ ID NO: 646676 - DNA, 25 bp, Mus musculus
gacggagataagctaaggatcctcc

SEQ ID NO: 646677 - DNA, 25 bp, Mus musculus
gacggagataaggtaaggatcctcc

SEQ ID NO: 646678 - DNA, 25 bp, Mus musculus
gacggagatcacagtctggactccc

SEQ ID NO: 646679 - DNA, 25 bp, Mus musculus
gacggagatcactgtctggactccc

SEQ ID NO: 646680 - DNA, 25 bp, Mus musculus
gacggagatcatcgagacctggcac

SEQ ID NO: 646681 - DNA, 25 bp, Mus musculus
gacggagatcatggagacctggcac

SEQ ID NO: 646682 - DNA, 25 bp, Mus musculus
gacggagcaggaagagtacgacacc

SEQ ID NO: 646683 - DNA, 25 bp, Mus musculus
gacggagcaggatgagtacgacacc

SEQ ID NO: 646684 - DNA, 25 bp, Mus musculus
gacggagccttcaacgccgtgaagg

SEQ ID NO: 646685 - DNA, 25 bp, Mus musculus
gacggagccttctacgccgtgaagg

SEQ ID NO: 646686 - DNA, 25 bp, Mus musculus
gacggagcttacctgaccatatcta

SEQ ID NO: 646687 - DNA, 25 bp, Mus musculus
gacggagcttacgtgaccatatcta

SEQ ID NO: 646688 - DNA, 25 bp, Mus musculus
gacggaggaggtcatgttcaatccc

SEQ ID NO: 646689 - DNA, 25 bp, Mus musculus
gacggaggaggtgatgttcaatccc

SEQ ID NO: 646690 - DNA, 25 bp, Mus musculus
gacggaggttacaagctgactagag

SEQ ID NO: 646691 - DNA, 25 bp, Mus musculus
gacggaggttactagctgactagag

SEQ ID NO: 646692 - DNA, 25 bp, Mus musculus
gacggagtaagcaggcttgcctcaa

SEQ ID NO: 646693 - DNA, 25 bp, Mus musculus
gacggagtaagctggcttgcctcaa

SEQ ID NO: 646694 - DNA, 25 bp, Mus musculus
gacggagtatcaccaagtcagacta

SEQ ID NO: 646695 - DNA, 25 bp, Mus musculus
gacggagtatcagcaagtcagacta

SEQ ID NO: 646696 - DNA, 25 bp, Mus musculus
gacggagtcaccacggcctaaaaag

SEQ ID NO: 646697 - DNA, 25 bp, Mus musculus
gacggagtcacctcggcctaaaaag

SEQ ID NO: 646698 - DNA, 25 bp, Mus musculus
gacggagtcggaagatcctaattac

SEQ ID NO: 646699 - DNA, 25 bp, Mus musculus
gacggagtcggatgatcctaattac

SEQ ID NO: 646700 - DNA, 25 bp, Mus musculus
gacggagtgatgaatggtgaatact

SEQ ID NO: 646701 - DNA, 25 bp, Mus musculus
gacggagtgatgtatggtgaatact

SEQ ID NO: 646702 - DNA, 25 bp, Mus musculus
gacggagtgtttcacatccacttat

SEQ ID NO: 646703 - DNA, 25 bp, Mus musculus
gacggagtgtttgacatccacttat

SEQ ID NO: 646704 - DNA, 25 bp, Mus musculus
gacggagttaagctcttctttatcg

SEQ ID NO: 646705 - DNA, 25 bp, Mus musculus
gacggagttaaggtcttctttatcg

SEQ ID NO: 646706 - DNA, 25 bp, Mus musculus
gacggataactgagacactgttaca

SEQ ID NO: 646707 - DNA, 25 bp, Mus musculus
gacggataactgtgacactgttaca

SEQ ID NO: 646708 - DNA, 25 bp, Mus musculus
gacggatacgtgaagccacagatca

SEQ ID NO: 646709 - DNA, 25 bp, Mus musculus
gacggatacgtgtagccacagatca

SEQ ID NO: 646710 - DNA, 25 bp, Mus musculus
gacggatcaatgagatcgtctactt

SEQ ID NO: 646711 - DNA, 25 bp, Mus musculus
gacggatcaatgtgatcgtctactt

SEQ ID NO: 646712 - DNA, 25 bp, Mus musculus
gacggatcagaaagcaaaggaagag

SEQ ID NO: 646713 - DNA, 25 bp, Mus musculus
gacggatcagaatgcaaaggaagag

SEQ ID NO: 646714 - DNA, 25 bp, Mus musculus
gacggatcctggctagcctatgaag

SEQ ID NO: 646715 - DNA, 25 bp, Mus musculus
gacggatcctgggtagcctatgaag

SEQ ID NO: 646716 - DNA, 25 bp, Mus musculus
gacggatctcgtagctgtttgggac

SEQ ID NO: 646717 - DNA, 25 bp, Mus musculus
gacggatctcgttgctgtttgggac

SEQ ID NO: 646718 - DNA, 25 bp, Mus musculus
gacggatcttgtaaatacagagccg

SEQ ID NO: 646719 - DNA, 25 bp, Mus musculus
gacggatcttgttaatacagagccg

SEQ ID NO: 646720 - DNA, 25 bp, Mus musculus
gacggatggaaacatcgttcagtac

SEQ ID NO: 646721 - DNA, 25 bp, Mus musculus
gacggatggaaagatcgttcagtac

SEQ ID NO: 646722 - DNA, 25 bp, Mus musculus
gacggatgtgcaccggcgcttcctc

SEQ ID NO: 646723 - DNA, 25 bp, Mus musculus
gacggatgtgcagcggcgcttcctc

SEQ ID NO: 646724 - DNA, 25 bp, Mus musculus
gacggatttaagatctacagagatg

SEQ ID NO: 646725 - DNA, 25 bp, Mus musculus
gacggatttaagttctacagagatg

SEQ ID NO: 646726 - DNA, 25 bp, Mus musculus
gacggcaaccgtcgctatgccaaga

SEQ ID NO: 646727 - DNA, 25 bp, Mus musculus
gacggcaaccgtggctatgccaaga

SEQ ID NO: 646728 - DNA, 25 bp, Mus musculus
gacggcaaggagaatgactttcacc

SEQ ID NO: 646729 - DNA, 25 bp, Mus musculus
gacggcaaggagtatgactttcacc

SEQ ID NO: 646730 - DNA, 25 bp, Mus musculus
gacggcaatgtactgcttcatgaga

SEQ ID NO: 646731 - DNA, 25 bp, Mus musculus
gacggcaatgtagtgcttcatgaga

SEQ ID NO: 646732 - DNA, 25 bp, Mus musculus
gacggcaccgacatccagggtcggc

SEQ ID NO: 646733 - DNA, 25 bp, Mus musculus
gacggcaccgacttccagggtcggc

SEQ ID NO: 646734 - DNA, 25 bp, Mus musculus
gacggccaccatagtatacatgaag

SEQ ID NO: 646735 - DNA, 25 bp, Mus musculus
gacggccaccattgtatacatgaag

SEQ ID NO: 646736 - DNA, 25 bp, Mus musculus
gacggccagacccaactcaggcttt

SEQ ID NO: 646737 - DNA, 25 bp, Mus musculus
gacggccagaccgaactcaggcttt

SEQ ID NO: 646738 - DNA, 25 bp, Mus musculus
gacggccagtaaagcccgggaaact

SEQ ID NO: 646739 - DNA, 25 bp, Mus musculus
gacggccagtaatgcccgggaaact

SEQ ID NO: 646740 - DNA, 25 bp, Mus musculus
gacggccagtggcttttctcccaaa

SEQ ID NO: 646741 - DNA, 25 bp, Mus musculus
gacggccagtgggttttctcccaaa

SEQ ID NO: 646742 - DNA, 25 bp, Mus musculus
gacggccagttcagggtgatgcaca

SEQ ID NO: 646743 - DNA, 25 bp, Mus musculus
gacggccagttctgggtgatgcaca

SEQ ID NO: 646744 - DNA, 25 bp, Mus musculus
gacggccatggtcgagctcatcaac

SEQ ID NO: 646745 - DNA, 25 bp, Mus musculus
gacggccatggtggagctcatcaac

SEQ ID NO: 646746 - DNA, 25 bp, Mus musculus
gacggccgcatcatcggcgtccgag

SEQ ID NO: 646747 - DNA, 25 bp, Mus musculus
gacggccgcatcttcggcgtccgag

SEQ ID NO: 646748 - DNA, 25 bp, Mus musculus
gacggcctaagaagtctccatcagc

SEQ ID NO: 646749 - DNA, 25 bp, Mus musculus
gacggcctaagatgtctccatcagc

SEQ ID NO: 646750 - DNA, 25 bp, Mus musculus
gacggcctggaacccattatcttca

SEQ ID NO: 646751 - DNA, 25 bp, Mus musculus
gacggcctggaagccattatcttca

SEQ ID NO: 646752 - DNA, 25 bp, Mus musculus
gacggcctgggtacagagagaccac

SEQ ID NO: 646753 - DNA, 25 bp, Mus musculus
gacggcctgggttcagagagaccac

SEQ ID NO: 646754 - DNA, 25 bp, Mus musculus
gacggcgatgaactcatcataacag

SEQ ID NO: 646755 - DNA, 25 bp, Mus musculus
gacggcgatgaagtcatcataacag

SEQ ID NO: 646756 - DNA, 25 bp, Mus musculus
gacggcgcattaaggttcaagagga

SEQ ID NO: 646757 - DNA, 25 bp, Mus musculus
gacggcgcattatggttcaagagga

SEQ ID NO: 646758 - DNA, 25 bp, Mus musculus
gacggcgctatgattttccactggc

SEQ ID NO: 646759 - DNA, 25 bp, Mus musculus
gacggcgctatgtttttccactggc

SEQ ID NO: 646760 - DNA, 25 bp, Mus musculus
gacggcgggcaactctactatcacg

SEQ ID NO: 646761 - DNA, 25 bp, Mus musculus
gacggcgggcaagtctactatcacg

SEQ ID NO: 646762 - DNA, 25 bp, Mus musculus
gacggctaccgtcttggctttggcc

SEQ ID NO: 646763 - DNA, 25 bp, Mus musculus
gacggctaccgtgttggctttggcc

SEQ ID NO: 646764 - DNA, 25 bp, Mus musculus
gacggctagagaaactgcgatgcca

SEQ ID NO: 646765 - DNA, 25 bp, Mus musculus
gacggctagagatactgcgatgcca

SEQ ID NO: 646766 - DNA, 25 bp, Mus musculus
gacggctcatttctgcttcatcata

SEQ ID NO: 646767 - DNA, 25 bp, Mus musculus
gacggctcatttgtgcttcatcata

SEQ ID NO: 646768 - DNA, 25 bp, Mus musculus
gacggctcttttctgtcattccaac

SEQ ID NO: 646769 - DNA, 25 bp, Mus musculus
gacggctcttttgtgtcattccaac

SEQ ID NO: 646770 - DNA, 25 bp, Mus musculus
gacggctgctgtacaatgcagggaa

SEQ ID NO: 646771 - DNA, 25 bp, Mus musculus
gacggctgctgttcaatgcagggaa

SEQ ID NO: 646772 - DNA, 25 bp, Mus musculus
gacggctgtttcaggtctcccagtg

SEQ ID NO: 646773 - DNA, 25 bp, Mus musculus
gacggctgtttctggtctcccagtg

SEQ ID NO: 646774 - DNA, 25 bp, Mus musculus
gacggcttagtgaaggatcctctcg

SEQ ID NO: 646775 - DNA, 25 bp, Mus musculus
gacggcttagtgtaggatcctctcg

SEQ ID NO: 646776 - DNA, 25 bp, Mus musculus
gacggcttccgcatcttcactaact

SEQ ID NO: 646777 - DNA, 25 bp, Mus musculus
gacggcttccgcttcttcactaact

SEQ ID NO: 646778 - DNA, 25 bp, Mus musculus
gacggctttgaacgattcgccaatg

SEQ ID NO: 646779 - DNA, 25 bp, Mus musculus
gacggctttgaaggattcgccaatg

SEQ ID NO: 646780 - DNA, 25 bp, Mus musculus
gacgggaaaaccaactgcaagcggg

SEQ ID NO: 646781 - DNA, 25 bp, Mus musculus
gacgggaaaacctactgcaagcggg

SEQ ID NO: 646782 - DNA, 25 bp, Mus musculus
gacgggaaacccaagccacattgga

SEQ ID NO: 646783 - DNA, 25 bp, Mus musculus
gacgggaaaccctagccacattgga

SEQ ID NO: 646784 - DNA, 25 bp, Mus musculus
gacgggaagagtatcacttacgaag

SEQ ID NO: 646785 - DNA, 25 bp, Mus musculus
gacgggaagagtttcacttacgaag

SEQ ID NO: 646786 - DNA, 25 bp, Mus musculus
gacgggaatgaacgatgtcagttct

SEQ ID NO: 646787 - DNA, 25 bp, Mus musculus
gacgggaatgaaggatgtcagttct

SEQ ID NO: 646788 - DNA, 25 bp, Mus musculus
gacgggaccccaacgtggaagttca

SEQ ID NO: 646789 - DNA, 25 bp, Mus musculus
gacgggaccccatcgtggaagttca

SEQ ID NO: 646790 - DNA, 25 bp, Mus musculus
gacgggacgtctccgtgaagactca

SEQ ID NO: 646791 - DNA, 25 bp, Mus musculus
gacgggacgtctgcgtgaagactca

SEQ ID NO: 646792 - DNA, 25 bp, Mus musculus
gacgggactacacctttgatgctgg

SEQ ID NO: 646793 - DNA, 25 bp, Mus musculus
gacgggactacagctttgatgctgg

SEQ ID NO: 646794 - DNA, 25 bp, Mus musculus
gacgggactattcaaggctgtgacc

SEQ ID NO: 646795 - DNA, 25 bp, Mus musculus
gacgggactattgaaggctgtgacc

SEQ ID NO: 646796 - DNA, 25 bp, Mus musculus
gacgggactctaagatgaagttatg

SEQ ID NO: 646797 - DNA, 25 bp, Mus musculus
gacgggactctatgatgaagttatg

SEQ ID NO: 646798 - DNA, 25 bp, Mus musculus
gacgggactgacatgacagcagcat

SEQ ID NO: 646799 - DNA, 25 bp, Mus musculus
gacgggactgacttgacagcagcat

SEQ ID NO: 646800 - DNA, 25 bp, Mus musculus
gacgggagaataattggagaatcca

SEQ ID NO: 646801 - DNA, 25 bp, Mus musculus
gacgggagaatatttggagaatcca

SEQ ID NO: 646802 - DNA, 25 bp, Mus musculus
gacgggagcctgaggctacaagcca

SEQ ID NO: 646803 - DNA, 25 bp, Mus musculus
gacgggagcctgtggctacaagcca

SEQ ID NO: 646804 - DNA, 25 bp, Mus musculus
gacgggaggaccatcctgtcccgat

SEQ ID NO: 646805 - DNA, 25 bp, Mus musculus
gacgggaggaccttcctgtcccgat

SEQ ID NO: 646806 - DNA, 25 bp, Mus musculus
gacgggagtaatcactgaagctgaa

SEQ ID NO: 646807 - DNA, 25 bp, Mus musculus
gacgggagtaatgactgaagctgaa

SEQ ID NO: 646808 - DNA, 25 bp, Mus musculus
gacgggatggtaaatggacaagaca

SEQ ID NO: 646809 - DNA, 25 bp, Mus musculus
gacgggatggtatatggacaagaca

SEQ ID NO: 646810 - DNA, 25 bp, Mus musculus
gacgggatggttccctgcaaactat

SEQ ID NO: 646811 - DNA, 25 bp, Mus musculus
gacgggatggttgcctgcaaactat

SEQ ID NO: 646812 - DNA, 25 bp, Mus musculus
gacgggatttctaccagctgatgta

SEQ ID NO: 646813 - DNA, 25 bp, Mus musculus
gacgggatttcttccagctgatgta

SEQ ID NO: 646814 - DNA, 25 bp, Mus musculus
gacgggcatcgcatctgggtgcaca

SEQ ID NO: 646815 - DNA, 25 bp, Mus musculus
gacgggcatcgcttctgggtgcaca

SEQ ID NO: 646816 - DNA, 25 bp, Mus musculus
gacgggcctaatattcttggatgat

SEQ ID NO: 646817 - DNA, 25 bp, Mus musculus
gacgggcctaattttcttggatgat

SEQ ID NO: 646818 - DNA, 25 bp, Mus musculus
gacgggctctctctgcatacgaaaa

SEQ ID NO: 646819 - DNA, 25 bp, Mus musculus
gacgggctctctgtgcatacgaaaa

SEQ ID NO: 646820 - DNA, 25 bp, Mus musculus
gacgggctctggacgaccatcacca

SEQ ID NO: 646821 - DNA, 25 bp, Mus musculus
gacgggctctggtcgaccatcacca

SEQ ID NO: 646822 - DNA, 25 bp, Mus musculus
gacgggctgcttagggagacctcat

SEQ ID NO: 646823 - DNA, 25 bp, Mus musculus
gacgggctgctttgggagacctcat

SEQ ID NO: 646824 - DNA, 25 bp, Mus musculus
gacggggacagtactatgacaacaa

SEQ ID NO: 646825 - DNA, 25 bp, Mus musculus
gacggggacagttctatgacaacaa

SEQ ID NO: 646826 - DNA, 25 bp, Mus musculus
gacgggtaagcactcaagacacaat

SEQ ID NO: 646827 - DNA, 25 bp, Mus musculus
gacgggtaagcagtcaagacacaat

SEQ ID NO: 646828 - DNA, 25 bp, Mus musculus
gacgggtcaaccactgtcctgagaa

SEQ ID NO: 646829 - DNA, 25 bp, Mus musculus
gacgggtcaacctctgtcctgagaa

SEQ ID NO: 646830 - DNA, 25 bp, Mus musculus
gacgggtcaagaaagccgtggccaa

SEQ ID NO: 646831 - DNA, 25 bp, Mus musculus
gacgggtcaagatagccgtggccaa

SEQ ID NO: 646832 - DNA, 25 bp, Mus musculus
gacgggtcggcgcagacagaaaagt

SEQ ID NO: 646833 - DNA, 25 bp, Mus musculus
gacgggtcggcggagacagaaaagt

SEQ ID NO: 646834 - DNA, 25 bp, Mus musculus
gacgggttacaacaagctctgcgat

SEQ ID NO: 646835 - DNA, 25 bp, Mus musculus
gacgggttacaagaagctctgcgat

SEQ ID NO: 646836 - DNA, 25 bp, Mus musculus
gacggtaaaaataaggcagacaaga

SEQ ID NO: 646837 - DNA, 25 bp, Mus musculus
gacggtaaaaattaggcagacaaga

SEQ ID NO: 646838 - DNA, 25 bp, Mus musculus
gacggtacgtgacttttctgaagca

SEQ ID NO: 646839 - DNA, 25 bp, Mus musculus
gacggtacgtgagttttctgaagca

SEQ ID NO: 646840 - DNA, 25 bp, Mus musculus
gacggtagcctgacgcctgcctgct

SEQ ID NO: 646841 - DNA, 25 bp, Mus musculus
gacggtagcctgtcgcctgcctgct

SEQ ID NO: 646842 - DNA, 25 bp, Mus musculus
gacggtagttcacttcaacaaggct

SEQ ID NO: 646843 - DNA, 25 bp, Mus musculus
gacggtagttcagttcaacaaggct

SEQ ID NO: 646844 - DNA, 25 bp, Mus musculus
gacggtatatgcagccagtgcaccg

SEQ ID NO: 646845 - DNA, 25 bp, Mus musculus
gacggtatatgctgccagtgcaccg

SEQ ID NO: 646846 - DNA, 25 bp, Mus musculus
gacggtcaagcacaaactcgaaatg

SEQ ID NO: 646847 - DNA, 25 bp, Mus musculus
gacggtcaagcagaaactcgaaatg

SEQ ID NO: 646848 - DNA, 25 bp, Mus musculus
gacggtcacatcacccaggaggagt

SEQ ID NO: 646849 - DNA, 25 bp, Mus musculus
gacggtcacatctcccaggaggagt

SEQ ID NO: 646850 - DNA, 25 bp, Mus musculus
gacggtcaggaaacactggaatgcg

SEQ ID NO: 646851 - DNA, 25 bp, Mus musculus
gacggtcaggaatcactggaatgcg

SEQ ID NO: 646852 - DNA, 25 bp, Mus musculus
gacggtcatactcaggttgtggctc

SEQ ID NO: 646853 - DNA, 25 bp, Mus musculus
gacggtcatactgaggttgtggctc

SEQ ID NO: 646854 - DNA, 25 bp, Mus musculus
gacggtcatttacgagatacctcgg

SEQ ID NO: 646855 - DNA, 25 bp, Mus musculus
gacggtcatttaggagatacctcgg

SEQ ID NO: 646856 - DNA, 25 bp, Mus musculus
gacggtccaggaagcgctaagtagc

SEQ ID NO: 646857 - DNA, 25 bp, Mus musculus
gacggtccaggatgcgctaagtagc

SEQ ID NO: 646858 - DNA, 25 bp, Mus musculus
gacggtcctgagcaagtgttacaag

SEQ ID NO: 646859 - DNA, 25 bp, Mus musculus
gacggtcctgaggaagtgttacaag

SEQ ID NO: 646860 - DNA, 25 bp, Mus musculus
gacggtcgacctccaattcttcgga

SEQ ID NO: 646861 - DNA, 25 bp, Mus musculus
gacggtcgacctgcaattcttcgga

SEQ ID NO: 646862 - DNA, 25 bp, Mus musculus
gacggtcgtccccagcgataggcct

SEQ ID NO: 646863 - DNA, 25 bp, Mus musculus
gacggtcgtcccgagcgataggcct

SEQ ID NO: 646864 - DNA, 25 bp, Mus musculus
gacggtctaccgacatgacaagagg

SEQ ID NO: 646865 - DNA, 25 bp, Mus musculus
gacggtctaccgtcatgacaagagg

SEQ ID NO: 646866 - DNA, 25 bp, Mus musculus
gacggtgaacggcaaaatgtctcca

SEQ ID NO: 646867 - DNA, 25 bp, Mus musculus
gacggtgaacgggaaaatgtctcca

SEQ ID NO: 646868 - DNA, 25 bp, Mus musculus
gacggtgactatcccgaagctggct

SEQ ID NO: 646869 - DNA, 25 bp, Mus musculus
gacggtgactatgccgaagctggct

SEQ ID NO: 646870 - DNA, 25 bp, Mus musculus
gacggtgactttccattaattaaca

SEQ ID NO: 646871 - DNA, 25 bp, Mus musculus
gacggtgactttgcattaattaaca

SEQ ID NO: 646872 - DNA, 25 bp, Mus musculus
gacggtgagagtatccactacgcgc

SEQ ID NO: 646873 - DNA, 25 bp, Mus musculus
gacggtgagagtttccactacgcgc

SEQ ID NO: 646874 - DNA, 25 bp, Mus musculus
gacggtgcctgtcctgacgagacta

SEQ ID NO: 646875 - DNA, 25 bp, Mus musculus
gacggtgcctgtgctgacgagacta

SEQ ID NO: 646876 - DNA, 25 bp, Mus musculus
gacggtggagtgaattcatcttctg

SEQ ID NO: 646877 - DNA, 25 bp, Mus musculus
gacggtggagtgtattcatcttctg

SEQ ID NO: 646878 - DNA, 25 bp, Mus musculus
gacggtggggtcagacagtcttcaa

SEQ ID NO: 646879 - DNA, 25 bp, Mus musculus
gacggtggggtctgacagtcttcaa

SEQ ID NO: 646880 - DNA, 25 bp, Mus musculus
gacggtggtactccgcaagaagttc

SEQ ID NO: 646881 - DNA, 25 bp, Mus musculus
gacggtggtactgcgcaagaagttc

SEQ ID NO: 646882 - DNA, 25 bp, Mus musculus
gacggtggtgagatcacaagtaatt

SEQ ID NO: 646883 - DNA, 25 bp, Mus musculus
gacggtggtgagttcacaagtaatt

SEQ ID NO: 646884 - DNA, 25 bp, Mus musculus
gacggtgtatccctttgactttgca

SEQ ID NO: 646885 - DNA, 25 bp, Mus musculus
gacggtgtatccgtttgactttgca

SEQ ID NO: 646886 - DNA, 25 bp, Mus musculus
gacggtgtcaacatctccaaggagg

SEQ ID NO: 646887 - DNA, 25 bp, Mus musculus
gacggtgtcaacttctccaaggagg

SEQ ID NO: 646888 - DNA, 25 bp, Mus musculus
gacggtgtcattacacggagttcct

SEQ ID NO: 646889 - DNA, 25 bp, Mus musculus
gacggtgtcatttcacggagttcct

SEQ ID NO: 646890 - DNA, 25 bp, Mus musculus
gacggtgtcctgatggaactgcaag

SEQ ID NO: 646891 - DNA, 25 bp, Mus musculus
gacggtgtcctgttggaactgcaag

SEQ ID NO: 646892 - DNA, 25 bp, Mus musculus
gacggtgtgatcacaaggatccggc

SEQ ID NO: 646893 - DNA, 25 bp, Mus musculus
gacggtgtgatctcaaggatccggc

SEQ ID NO: 646894 - DNA, 25 bp, Mus musculus
gacggtgtggatcgtttccaattcc

SEQ ID NO: 646895 - DNA, 25 bp, Mus musculus
gacggtgtggatggtttccaattcc

SEQ ID NO: 646896 - DNA, 25 bp, Mus musculus
gacggttcaagcatcccagacatgt

SEQ ID NO: 646897 - DNA, 25 bp, Mus musculus
gacggttcaagcttcccagacatgt

SEQ ID NO: 646898 - DNA, 25 bp, Mus musculus
gacggttctgatcaaagccctgaac

SEQ ID NO: 646899 - DNA, 25 bp, Mus musculus
gacggttctgatgaaagccctgaac

SEQ ID NO: 646900 - DNA, 25 bp, Mus musculus
gacggttcttctaatcacccagcag

SEQ ID NO: 646901 - DNA, 25 bp, Mus musculus
gacggttcttcttatcacccagcag

SEQ ID NO: 646902 - DNA, 25 bp, Mus musculus
gacggttttcctcacgagaagcttc

SEQ ID NO: 646903 - DNA, 25 bp, Mus musculus
gacggttttcctgacgagaagcttc

SEQ ID NO: 646904 - DNA, 25 bp, Mus musculus
gacgtaaagtatattcagacagacg

SEQ ID NO: 646905 - DNA, 25 bp, Mus musculus
gacgtaaagtattttcagacagacg

SEQ ID NO: 646906 - DNA, 25 bp, Mus musculus
gacgtaacaattcgctctctaagag

SEQ ID NO: 646907 - DNA, 25 bp, Mus musculus
gacgtaacaattggctctctaagag

SEQ ID NO: 646908 - DNA, 25 bp, Mus musculus
gacgtaaccgacatccgcttctgga

SEQ ID NO: 646909 - DNA, 25 bp, Mus musculus
gacgtaaccgacttccgcttctgga

SEQ ID NO: 646910 - DNA, 25 bp, Mus musculus
gacgtaataacgcagctggagccca

SEQ ID NO: 646911 - DNA, 25 bp, Mus musculus
gacgtaataacggagctggagccca

SEQ ID NO: 646912 - DNA, 25 bp, Mus musculus
gacgtaatccaaacccatgggaggc

SEQ ID NO: 646913 - DNA, 25 bp, Mus musculus
gacgtaatccaatcccatgggaggc

SEQ ID NO: 646914 - DNA, 25 bp, Mus musculus
gacgtacagcgacttagccagcact

SEQ ID NO: 646915 - DNA, 25 bp, Mus musculus
gacgtacagcgagttagccagcact

SEQ ID NO: 646916 - DNA, 25 bp, Mus musculus
gacgtacagggcatgtctgaaggca

SEQ ID NO: 646917 - DNA, 25 bp, Mus musculus
gacgtacagggcttgtctgaaggca

SEQ ID NO: 646918 - DNA, 25 bp, Mus musculus
gacgtaccagcgaatggagaaccca

SEQ ID NO: 646919 - DNA, 25 bp, Mus musculus
gacgtaccagcgtatggagaaccca

SEQ ID NO: 646920 - DNA, 25 bp, Mus musculus
gacgtacggctcagaagatcatggc

SEQ ID NO: 646921 - DNA, 25 bp, Mus musculus
gacgtacggctctgaagatcatggc

SEQ ID NO: 646922 - DNA, 25 bp, Mus musculus
gacgtacgtattccatcacaactga

SEQ ID NO: 646923 - DNA, 25 bp, Mus musculus
gacgtacgtattgcatcacaactga

SEQ ID NO: 646924 - DNA, 25 bp, Mus musculus
gacgtacgtgcacctcaccatgctg

SEQ ID NO: 646925 - DNA, 25 bp, Mus musculus
gacgtacgtgcagctcaccatgctg

SEQ ID NO: 646926 - DNA, 25 bp, Mus musculus
gacgtactgctgactgtcacaggag

SEQ ID NO: 646927 - DNA, 25 bp, Mus musculus
gacgtactgctgtctgtcacaggag

SEQ ID NO: 646928 - DNA, 25 bp, Mus musculus
gacgtagcaatgcttgaacttacag

SEQ ID NO: 646929 - DNA, 25 bp, Mus musculus
gacgtagcaatggttgaacttacag

SEQ ID NO: 646930 - DNA, 25 bp, Mus musculus
gacgtagtagccacgtctactaaga

SEQ ID NO: 646931 - DNA, 25 bp, Mus musculus
gacgtagtagcctcgtctactaaga

SEQ ID NO: 646932 - DNA, 25 bp, Mus musculus
gacgtatcaccgaatcgtggaggcc

SEQ ID NO: 646933 - DNA, 25 bp, Mus musculus
gacgtatcaccgtatcgtggaggcc

SEQ ID NO: 646934 - DNA, 25 bp, Mus musculus
gacgtatgtgatcacggtcactgcc

SEQ ID NO: 646935 - DNA, 25 bp, Mus musculus
gacgtatgtgatgacggtcactgcc

SEQ ID NO: 646936 - DNA, 25 bp, Mus musculus
gacgtattgcctagggctctcagca

SEQ ID NO: 646937 - DNA, 25 bp, Mus musculus
gacgtattgccttgggctctcagca

SEQ ID NO: 646938 - DNA, 25 bp, Mus musculus
gacgtcaaagggaacctgtccaagg

SEQ ID NO: 646939 - DNA, 25 bp, Mus musculus
gacgtcaaagggtacctgtccaagg

SEQ ID NO: 646940 - DNA, 25 bp, Mus musculus
gacgtcaaatgtcggtgtacacagg

SEQ ID NO: 646941 - DNA, 25 bp, Mus musculus
gacgtcaaatgtgggtgtacacagg

SEQ ID NO: 646942 - DNA, 25 bp, Mus musculus
gacgtcaagggcacctacgtctcca

SEQ ID NO: 646943 - DNA, 25 bp, Mus musculus
gacgtcaagggctcctacgtctcca

SEQ ID NO: 646944 - DNA, 25 bp, Mus musculus
gacgtcaatgccctggatgacctag

SEQ ID NO: 646945 - DNA, 25 bp, Mus musculus
gacgtcaatgccgtggatgacctag

SEQ ID NO: 646946 - DNA, 25 bp, Mus musculus
gacgtcactggaatggagctaccat

SEQ ID NO: 646947 - DNA, 25 bp, Mus musculus
gacgtcactggattggagctaccat

SEQ ID NO: 646948 - DNA, 25 bp, Mus musculus
gacgtcagaagaatcccagtgggcc

SEQ ID NO: 646949 - DNA, 25 bp, Mus musculus
gacgtcagaagattcccagtgggcc

SEQ ID NO: 646950 - DNA, 25 bp, Mus musculus
gacgtcagcgtcaaccggattccgc

SEQ ID NO: 646951 - DNA, 25 bp, Mus musculus
gacgtcagcgtctaccggattccgc

SEQ ID NO: 646952 - DNA, 25 bp, Mus musculus
gacgtcatcacccttctggaacagc

SEQ ID NO: 646953 - DNA, 25 bp, Mus musculus
gacgtcatcaccgttctggaacagc

SEQ ID NO: 646954 - DNA, 25 bp, Mus musculus
gacgtcatcctcatgtgtttctcca

SEQ ID NO: 646955 - DNA, 25 bp, Mus musculus
gacgtcatcctcttgtgtttctcca

SEQ ID NO: 646956 - DNA, 25 bp, Mus musculus
gacgtcatgaaacatactccactgt

SEQ ID NO: 646957 - DNA, 25 bp, Mus musculus
gacgtcatgaaagatactccactgt

SEQ ID NO: 646958 - DNA, 25 bp, Mus musculus
gacgtcatgcctaatgttgatatcc

SEQ ID NO: 646959 - DNA, 25 bp, Mus musculus
gacgtcatgccttatgttgatatcc

SEQ ID NO: 646960 - DNA, 25 bp, Mus musculus
gacgtcatgggcatcggacctgcct

SEQ ID NO: 646961 - DNA, 25 bp, Mus musculus
gacgtcatgggcttcggacctgcct

SEQ ID NO: 646962 - DNA, 25 bp, Mus musculus
gacgtccaaggacagatacggctca

SEQ ID NO: 646963 - DNA, 25 bp, Mus musculus
gacgtccaaggagagatacggctca

SEQ ID NO: 646964 - DNA, 25 bp, Mus musculus
gacgtccacatcatgcagcaccatg

SEQ ID NO: 646965 - DNA, 25 bp, Mus musculus
gacgtccacatcttgcagcaccatg

SEQ ID NO: 646966 - DNA, 25 bp, Mus musculus
gacgtccacgtgatcacgggtgccc

SEQ ID NO: 646967 - DNA, 25 bp, Mus musculus
gacgtccacgtgttcacgggtgccc

SEQ ID NO: 646968 - DNA, 25 bp, Mus musculus
gacgtccactacaaggagatccccg

SEQ ID NO: 646969 - DNA, 25 bp, Mus musculus
gacgtccactactaggagatccccg

SEQ ID NO: 646970 - DNA, 25 bp, Mus musculus
gacgtccagagcaagaagctggtac

SEQ ID NO: 646971 - DNA, 25 bp, Mus musculus
gacgtccagagctagaagctggtac

SEQ ID NO: 646972 - DNA, 25 bp, Mus musculus
gacgtccaggccaagaggcgaagat

SEQ ID NO: 646973 - DNA, 25 bp, Mus musculus
gacgtccaggcctagaggcgaagat

SEQ ID NO: 646974 - DNA, 25 bp, Mus musculus
gacgtccatacaacaattgtcaatg

SEQ ID NO: 646975 - DNA, 25 bp, Mus musculus
gacgtccatacatcaattgtcaatg

SEQ ID NO: 646976 - DNA, 25 bp, Mus musculus
gacgtcccaattccacacattaaag

SEQ ID NO: 646977 - DNA, 25 bp, Mus musculus
gacgtcccaattgcacacattaaag

SEQ ID NO: 646978 - DNA, 25 bp, Mus musculus
gacgtccctggccttagatgagtcc

SEQ ID NO: 646979 - DNA, 25 bp, Mus musculus
gacgtccctggcgttagatgagtcc

SEQ ID NO: 646980 - DNA, 25 bp, Mus musculus
gacgtccctttgaacttgggcatat

SEQ ID NO: 646981 - DNA, 25 bp, Mus musculus
gacgtccctttgtacttgggcatat

SEQ ID NO: 646982 - DNA, 25 bp, Mus musculus
gacgtccgactcactggctatgtgg

SEQ ID NO: 646983 - DNA, 25 bp, Mus musculus
gacgtccgactctctggctatgtgg

SEQ ID NO: 646984 - DNA, 25 bp, Mus musculus
gacgtccgcagtatgttctgaaaaa

SEQ ID NO: 646985 - DNA, 25 bp, Mus musculus
gacgtccgcagtttgttctgaaaaa

SEQ ID NO: 646986 - DNA, 25 bp, Mus musculus
gacgtcctagagctgaagccctccg

SEQ ID NO: 646987 - DNA, 25 bp, Mus musculus
gacgtcctagaggtgaagccctccg

SEQ ID NO: 646988 - DNA, 25 bp, Mus musculus
gacgtcctcagaatgagttggagaa

SEQ ID NO: 646989 - DNA, 25 bp, Mus musculus
gacgtcctcagattgagttggagaa

SEQ ID NO: 646990 - DNA, 25 bp, Mus musculus
gacgtcctccccagggagccggtgt

SEQ ID NO: 646991 - DNA, 25 bp, Mus musculus
gacgtcctcccctgggagccggtgt

SEQ ID NO: 646992 - DNA, 25 bp, Mus musculus
gacgtcgatacgcagacgggactcc

SEQ ID NO: 646993 - DNA, 25 bp, Mus musculus
gacgtcgatacggagacgggactcc

SEQ ID NO: 646994 - DNA, 25 bp, Mus musculus
gacgtcgcatttacagctgcagcct

SEQ ID NO: 646995 - DNA, 25 bp, Mus musculus
gacgtcgcattttcagctgcagcct

SEQ ID NO: 646996 - DNA, 25 bp, Mus musculus
gacgtcgccggacacggtggctgtg

SEQ ID NO: 646997 - DNA, 25 bp, Mus musculus
gacgtcgccggagacggtggctgtg

SEQ ID NO: 646998 - DNA, 25 bp, Mus musculus
gacgtcggacaaaaaagctgggaag

SEQ ID NO: 646999 - DNA, 25 bp, Mus musculus
gacgtcggacaataaagctgggaag

SEQ ID NO: 647000 - DNA, 25 bp, Mus musculus
gacgtcggatgtagacctggacaag

SEQ ID NO: 647001 - DNA, 25 bp, Mus musculus
gacgtcggatgttgacctggacaag

SEQ ID NO: 647002 - DNA, 25 bp, Mus musculus
gacgtcgtcctactctccgctgggt

SEQ ID NO: 647003 - DNA, 25 bp, Mus musculus
gacgtcgtcctagtctccgctgggt

SEQ ID NO: 647004 - DNA, 25 bp, Mus musculus
gacgtctaatgaccattctccatat

SEQ ID NO: 647005 - DNA, 25 bp, Mus musculus
gacgtctaatgagcattctccatat

SEQ ID NO: 647006 - DNA, 25 bp, Mus musculus
gacgtctaggacctccatgggcatt

SEQ ID NO: 647007 - DNA, 25 bp, Mus musculus
gacgtctaggacgtccatgggcatt

SEQ ID NO: 647008 - DNA, 25 bp, Mus musculus
gacgtctcactcacgaggcagcatg

SEQ ID NO: 647009 - DNA, 25 bp, Mus musculus
gacgtctcactctcgaggcagcatg

SEQ ID NO: 647010 - DNA, 25 bp, Mus musculus
gacgtctctgaacgcctggaagttg

SEQ ID NO: 647011 - DNA, 25 bp, Mus musculus
gacgtctctgaaggcctggaagttg

SEQ ID NO: 647012 - DNA, 25 bp, Mus musculus
gacgtctgccagatactgatagaaa

SEQ ID NO: 647013 - DNA, 25 bp, Mus musculus
gacgtctgccagttactgatagaaa

SEQ ID NO: 647014 - DNA, 25 bp, Mus musculus
gacgtctgcgtgaagactcactgga

SEQ ID NO: 647015 - DNA, 25 bp, Mus musculus
gacgtctgcgtgtagactcactgga

SEQ ID NO: 647016 - DNA, 25 bp, Mus musculus
gacgtctgtaagatttcgccctgag

SEQ ID NO: 647017 - DNA, 25 bp, Mus musculus
gacgtctgtaagttttcgccctgag

SEQ ID NO: 647018 - DNA, 25 bp, Mus musculus
gacgtctgtagccatcccggtgact

SEQ ID NO: 647019 - DNA, 25 bp, Mus musculus
gacgtctgtagcgatcccggtgact

SEQ ID NO: 647020 - DNA, 25 bp, Mus musculus
gacgtctgtcaaatgtatctctgcc

SEQ ID NO: 647021 - DNA, 25 bp, Mus musculus
gacgtctgtcaattgtatctctgcc

SEQ ID NO: 647022 - DNA, 25 bp, Mus musculus
gacgtctgtgaacccatggagtacc

SEQ ID NO: 647023 - DNA, 25 bp, Mus musculus
gacgtctgtgaagccatggagtacc

SEQ ID NO: 647024 - DNA, 25 bp, Mus musculus
gacgtctgttgcaagaactgttctg

SEQ ID NO: 647025 - DNA, 25 bp, Mus musculus
gacgtctgttgctagaactgttctg

SEQ ID NO: 647026 - DNA, 25 bp, Mus musculus
gacgtcttatctcttctttgggagc

SEQ ID NO: 647027 - DNA, 25 bp, Mus musculus
gacgtcttatctgttctttgggagc

SEQ ID NO: 647028 - DNA, 25 bp, Mus musculus
gacgtgaaagacatagggaagacca

SEQ ID NO: 647029 - DNA, 25 bp, Mus musculus
gacgtgaaagacttagggaagacca

SEQ ID NO: 647030 - DNA, 25 bp, Mus musculus
gacgtgaaagccctggtcaagattg

SEQ ID NO: 647031 - DNA, 25 bp, Mus musculus
gacgtgaaagccgtggtcaagattg

SEQ ID NO: 647032 - DNA, 25 bp, Mus musculus
gacgtgaaattgacaatactctcca

SEQ ID NO: 647033 - DNA, 25 bp, Mus musculus
gacgtgaaattgtcaatactctcca

SEQ ID NO: 647034 - DNA, 25 bp, Mus musculus
gacgtgaacagcaaaagggccgaaa

SEQ ID NO: 647035 - DNA, 25 bp, Mus musculus
gacgtgaacagctaaagggccgaaa

SEQ ID NO: 647036 - DNA, 25 bp, Mus musculus
gacgtgaaccagcatgttttccggg

SEQ ID NO: 647037 - DNA, 25 bp, Mus musculus
gacgtgaaccaggatgttttccggg

SEQ ID NO: 647038 - DNA, 25 bp, Mus musculus
gacgtgaagatgagtgaacttgacc

SEQ ID NO: 647039 - DNA, 25 bp, Mus musculus
gacgtgaagatgtgtgaacttgacc

SEQ ID NO: 647040 - DNA, 25 bp, Mus musculus
gacgtgaagcagaacaagcctgtgg

SEQ ID NO: 647041 - DNA, 25 bp, Mus musculus
gacgtgaagcagtacaagcctgtgg

SEQ ID NO: 647042 - DNA, 25 bp, Mus musculus
gacgtgaagccccagaacttcctgg

SEQ ID NO: 647043 - DNA, 25 bp, Mus musculus
gacgtgaagcccgagaacttcctgg

SEQ ID NO: 647044 - DNA, 25 bp, Mus musculus
gacgtgaagtttccctctgagatga

SEQ ID NO: 647045 - DNA, 25 bp, Mus musculus
gacgtgaagtttgcctctgagatga

SEQ ID NO: 647046 - DNA, 25 bp, Mus musculus
gacgtgaatcggacagacttcgaaa

SEQ ID NO: 647047 - DNA, 25 bp, Mus musculus
gacgtgaatcggtcagacttcgaaa

SEQ ID NO: 647048 - DNA, 25 bp, Mus musculus
gacgtgacacttatcatcctggaga

SEQ ID NO: 647049 - DNA, 25 bp, Mus musculus
gacgtgacacttttcatcctggaga

SEQ ID NO: 647050 - DNA, 25 bp, Mus musculus
gacgtgaccaagataacaagatcgc

SEQ ID NO: 647051 - DNA, 25 bp, Mus musculus
gacgtgaccaagttaacaagatcgc

SEQ ID NO: 647052 - DNA, 25 bp, Mus musculus
gacgtgaccctgaacttcagaggga

SEQ ID NO: 647053 - DNA, 25 bp, Mus musculus
gacgtgaccctgtacttcagaggga

SEQ ID NO: 647054 - DNA, 25 bp, Mus musculus
gacgtgactgctctggagcaaccca

SEQ ID NO: 647055 - DNA, 25 bp, Mus musculus
gacgtgactgctgtggagcaaccca

SEQ ID NO: 647056 - DNA, 25 bp, Mus musculus
gacgtgatcctcaggcctttgcaga

SEQ ID NO: 647057 - DNA, 25 bp, Mus musculus
gacgtgatcctctggcctttgcaga

SEQ ID NO: 647058 - DNA, 25 bp, Mus musculus
gacgtgatgaatcagaataacccac

SEQ ID NO: 647059 - DNA, 25 bp, Mus musculus
gacgtgatgaatgagaataacccac

SEQ ID NO: 647060 - DNA, 25 bp, Mus musculus
gacgtgatgacaacaggcccgggct

SEQ ID NO: 647061 - DNA, 25 bp, Mus musculus
gacgtgatgacatcaggcccgggct

SEQ ID NO: 647062 - DNA, 25 bp, Mus musculus
gacgtgcaaacgctgagcacagcct

SEQ ID NO: 647063 - DNA, 25 bp, Mus musculus
gacgtgcaaacggtgagcacagcct

SEQ ID NO: 647064 - DNA, 25 bp, Mus musculus
gacgtgcaatggaatgacctggact

SEQ ID NO: 647065 - DNA, 25 bp, Mus musculus
gacgtgcaatggtatgacctggact

SEQ ID NO: 647066 - DNA, 25 bp, Mus musculus
gacgtgcagatcaacgatatttctc

SEQ ID NO: 647067 - DNA, 25 bp, Mus musculus
gacgtgcagatctacgatatttctc

SEQ ID NO: 647068 - DNA, 25 bp, Mus musculus
gacgtgcatcatattcatcgctgcg

SEQ ID NO: 647069 - DNA, 25 bp, Mus musculus
gacgtgcatcattttcatcgctgcg

SEQ ID NO: 647070 - DNA, 25 bp, Mus musculus
gacgtgcattggcttcagcatgaag

SEQ ID NO: 647071 - DNA, 25 bp, Mus musculus
gacgtgcattgggttcagcatgaag

SEQ ID NO: 647072 - DNA, 25 bp, Mus musculus
gacgtgccagctcccttgagaggct

SEQ ID NO: 647073 - DNA, 25 bp, Mus musculus
gacgtgccagctgccttgagaggct

SEQ ID NO: 647074 - DNA, 25 bp, Mus musculus
gacgtgccggagctgcatgagtgga

SEQ ID NO: 647075 - DNA, 25 bp, Mus musculus
gacgtgccggaggtgcatgagtgga

SEQ ID NO: 647076 - DNA, 25 bp, Mus musculus
gacgtgcctatcctcctggtgggta

SEQ ID NO: 647077 - DNA, 25 bp, Mus musculus
gacgtgcctatcgtcctggtgggta

SEQ ID NO: 647078 - DNA, 25 bp, Mus musculus
gacgtgctcaccatctcggggactg

SEQ ID NO: 647079 - DNA, 25 bp, Mus musculus
gacgtgctcaccttctcggggactg

SEQ ID NO: 647080 - DNA, 25 bp, Mus musculus
gacgtgctgaacacagtgaagaaga

SEQ ID NO: 647081 - DNA, 25 bp, Mus musculus
gacgtgctgaactcagtgaagaaga

SEQ ID NO: 647082 - DNA, 25 bp, Mus musculus
gacgtgctgcagatccgcatcggct

SEQ ID NO: 647083 - DNA, 25 bp, Mus musculus
gacgtgctgcagttccgcatcggct

SEQ ID NO: 647084 - DNA, 25 bp, Mus musculus
gacgtgctgtcacccatggaagaga

SEQ ID NO: 647085 - DNA, 25 bp, Mus musculus
gacgtgctgtcagccatggaagaga

SEQ ID NO: 647086 - DNA, 25 bp, Mus musculus
gacgtgctttcccactgtctttgat

SEQ ID NO: 647087 - DNA, 25 bp, Mus musculus
gacgtgctttccgactgtctttgat

SEQ ID NO: 647088 - DNA, 25 bp, Mus musculus
gacgtggcccagatgtatgagaata

SEQ ID NO: 647089 - DNA, 25 bp, Mus musculus
gacgtggcccagttgtatgagaata

SEQ ID NO: 647090 - DNA, 25 bp, Mus musculus
gacgtggctcctatgcagacagatg

SEQ ID NO: 647091 - DNA, 25 bp, Mus musculus
gacgtggctcctttgcagacagatg

SEQ ID NO: 647092 - DNA, 25 bp, Mus musculus
gacgtggctcgccatcaagtgctcg

SEQ ID NO: 647093 - DNA, 25 bp, Mus musculus
gacgtggctcgcgatcaagtgctcg

SEQ ID NO: 647094 - DNA, 25 bp, Mus musculus
gacgtgggccacatggcactggaca

SEQ ID NO: 647095 - DNA, 25 bp, Mus musculus
gacgtgggccacttggcactggaca

SEQ ID NO: 647096 - DNA, 25 bp, Mus musculus
gacgtgggctctctagatgaaaaga

SEQ ID NO: 647097 - DNA, 25 bp, Mus musculus
gacgtgggctctgtagatgaaaaga

SEQ ID NO: 647098 - DNA, 25 bp, Mus musculus
gacgtgggcttcaaccttgtcaaca

SEQ ID NO: 647099 - DNA, 25 bp, Mus musculus
gacgtgggcttctaccttgtcaaca

SEQ ID NO: 647100 - DNA, 25 bp, Mus musculus
gacgtgggtcgaatccaaaccttca

SEQ ID NO: 647101 - DNA, 25 bp, Mus musculus
gacgtgggtcgattccaaaccttca

SEQ ID NO: 647102 - DNA, 25 bp, Mus musculus
gacgtggtacttcctagagatcgta

SEQ ID NO: 647103 - DNA, 25 bp, Mus musculus
gacgtggtacttgctagagatcgta

SEQ ID NO: 647104 - DNA, 25 bp, Mus musculus
gacgtggtcaaacgacaggtccgat

SEQ ID NO: 647105 - DNA, 25 bp, Mus musculus
gacgtggtcaaaggacaggtccgat

SEQ ID NO: 647106 - DNA, 25 bp, Mus musculus
gacgtggtcaataatgtaatagacc

SEQ ID NO: 647107 - DNA, 25 bp, Mus musculus
gacgtggtcaattatgtaatagacc

SEQ ID NO: 647108 - DNA, 25 bp, Mus musculus
gacgtggtcaggaaggaccctcagc

SEQ ID NO: 647109 - DNA, 25 bp, Mus musculus
gacgtggtcaggtaggaccctcagc

SEQ ID NO: 647110 - DNA, 25 bp, Mus musculus
gacgtggtccttaccaatgttactg

SEQ ID NO: 647111 - DNA, 25 bp, Mus musculus
gacgtggtcctttccaatgttactg

SEQ ID NO: 647112 - DNA, 25 bp, Mus musculus
gacgtggtcgcccagttcaatgcag

SEQ ID NO: 647113 - DNA, 25 bp, Mus musculus
gacgtggtcgccgagttcaatgcag

SEQ ID NO: 647114 - DNA, 25 bp, Mus musculus
gacgtggtcgtgagatgtttgaaat

SEQ ID NO: 647115 - DNA, 25 bp, Mus musculus
gacgtggtcgtgtgatgtttgaaat

SEQ ID NO: 647116 - DNA, 25 bp, Mus musculus
gacgtggtgattatgcttctaggca

SEQ ID NO: 647117 - DNA, 25 bp, Mus musculus
gacgtggtgattttgcttctaggca

SEQ ID NO: 647118 - DNA, 25 bp, Mus musculus
gacgtggtgttcctcttgcatgcca

SEQ ID NO: 647119 - DNA, 25 bp, Mus musculus
gacgtggtgttcgtcttgcatgcca

SEQ ID NO: 647120 - DNA, 25 bp, Mus musculus
gacgtggttatcaagttccctgagg

SEQ ID NO: 647121 - DNA, 25 bp, Mus musculus
gacgtggttatctagttccctgagg

SEQ ID NO: 647122 - DNA, 25 bp, Mus musculus
gacgtggttgtcactgtcccatttg

SEQ ID NO: 647123 - DNA, 25 bp, Mus musculus
gacgtggttgtctctgtcccatttg

SEQ ID NO: 647124 - DNA, 25 bp, Mus musculus
gacgtgtcccagaatgtgtcctcgg

SEQ ID NO: 647125 - DNA, 25 bp, Mus musculus
gacgtgtcccagtatgtgtcctcgg

SEQ ID NO: 647126 - DNA, 25 bp, Mus musculus
gacgtgtctgttaccatctcccagg

SEQ ID NO: 647127 - DNA, 25 bp, Mus musculus
gacgtgtctgtttccatctcccagg

SEQ ID NO: 647128 - DNA, 25 bp, Mus musculus
gacgtgtgctgaagagactgtgtct

SEQ ID NO: 647129 - DNA, 25 bp, Mus musculus
gacgtgtgctgatgagactgtgtct

SEQ ID NO: 647130 - DNA, 25 bp, Mus musculus
gacgtgtgtccccttggcgaattaa

SEQ ID NO: 647131 - DNA, 25 bp, Mus musculus
gacgtgtgtcccgttggcgaattaa

SEQ ID NO: 647132 - DNA, 25 bp, Mus musculus
gacgtgttcactatgccagaggatg

SEQ ID NO: 647133 - DNA, 25 bp, Mus musculus
gacgtgttcactttgccagaggatg

SEQ ID NO: 647134 - DNA, 25 bp, Mus musculus
gacgtgttctggctagcgctcatcg

SEQ ID NO: 647135 - DNA, 25 bp, Mus musculus
gacgtgttctgggtagcgctcatcg

SEQ ID NO: 647136 - DNA, 25 bp, Mus musculus
gacgtgttctttcaggtcacctctt

SEQ ID NO: 647137 - DNA, 25 bp, Mus musculus
gacgtgttctttgaggtcacctctt

SEQ ID NO: 647138 - DNA, 25 bp, Mus musculus
gacgtgttgcgtactcgtgtcaaaa

SEQ ID NO: 647139 - DNA, 25 bp, Mus musculus
gacgtgttgcgttctcgtgtcaaaa

SEQ ID NO: 647140 - DNA, 25 bp, Mus musculus
gacgtgttgctgaacatcaacggca

SEQ ID NO: 647141 - DNA, 25 bp, Mus musculus
gacgtgttgctgtacatcaacggca

SEQ ID NO: 647142 - DNA, 25 bp, Mus musculus
gacgtgttttcaacagagagcaggt

SEQ ID NO: 647143 - DNA, 25 bp, Mus musculus
gacgtgttttcatcagagagcaggt

SEQ ID NO: 647144 - DNA, 25 bp, Mus musculus
gacgttagtggaaaacaatttcctg

SEQ ID NO: 647145 - DNA, 25 bp, Mus musculus
gacgttagtggataacaatttcctg

SEQ ID NO: 647146 - DNA, 25 bp, Mus musculus
gacgttcagctactctgactttctc

SEQ ID NO: 647147 - DNA, 25 bp, Mus musculus
gacgttcagctagtctgactttctc

SEQ ID NO: 647148 - DNA, 25 bp, Mus musculus
gacgttcaggtaccactgaagctag

SEQ ID NO: 647149 - DNA, 25 bp, Mus musculus
gacgttcaggtagcactgaagctag

SEQ ID NO: 647150 - DNA, 25 bp, Mus musculus
gacgttcagtaacgataactcattc

SEQ ID NO: 647151 - DNA, 25 bp, Mus musculus
gacgttcagtaaggataactcattc

SEQ ID NO: 647152 - DNA, 25 bp, Mus musculus
gacgttcagttgcagaaccagatgg

SEQ ID NO: 647153 - DNA, 25 bp, Mus musculus
gacgttcagttggagaaccagatgg

SEQ ID NO: 647154 - DNA, 25 bp, Mus musculus
gacgttcatgcaacactcaaccttg

SEQ ID NO: 647155 - DNA, 25 bp, Mus musculus
gacgttcatgcatcactcaaccttg

SEQ ID NO: 647156 - DNA, 25 bp, Mus musculus
gacgttccagacaccacctcgggat

SEQ ID NO: 647157 - DNA, 25 bp, Mus musculus
gacgttccagactccacctcgggat

SEQ ID NO: 647158 - DNA, 25 bp, Mus musculus
gacgttcctgttagcaggccacaca

SEQ ID NO: 647159 - DNA, 25 bp, Mus musculus
gacgttcctgtttgcaggccacaca

SEQ ID NO: 647160 - DNA, 25 bp, Mus musculus
gacgttcgagctccagctcagagcc

SEQ ID NO: 647161 - DNA, 25 bp, Mus musculus
gacgttcgagctgcagctcagagcc

SEQ ID NO: 647162 - DNA, 25 bp, Mus musculus
gacgttctcagcagatttccccttg

SEQ ID NO: 647163 - DNA, 25 bp, Mus musculus
gacgttctcagctgatttccccttg

SEQ ID NO: 647164 - DNA, 25 bp, Mus musculus
gacgttctctatcagtttcgcctcg

SEQ ID NO: 647165 - DNA, 25 bp, Mus musculus
gacgttctctatgagtttcgcctcg

SEQ ID NO: 647166 - DNA, 25 bp, Mus musculus
gacgttctgctgctctattatacac

SEQ ID NO: 647167 - DNA, 25 bp, Mus musculus
gacgttctgctggtctattatacac

SEQ ID NO: 647168 - DNA, 25 bp, Mus musculus
gacgttgacagacggtatttttagg

SEQ ID NO: 647169 - DNA, 25 bp, Mus musculus
gacgttgacagagggtatttttagg

SEQ ID NO: 647170 - DNA, 25 bp, Mus musculus
gacgttgagcgtcctctggacgcct

SEQ ID NO: 647171 - DNA, 25 bp, Mus musculus
gacgttgagcgtgctctggacgcct

SEQ ID NO: 647172 - DNA, 25 bp, Mus musculus
gacgttgatcaaagccttcggcatc

SEQ ID NO: 647173 - DNA, 25 bp, Mus musculus
gacgttgatcaatgccttcggcatc

SEQ ID NO: 647174 - DNA, 25 bp, Mus musculus
gacgttgatgccctgttcaccacaa

SEQ ID NO: 647175 - DNA, 25 bp, Mus musculus
gacgttgatgccgtgttcaccacaa

SEQ ID NO: 647176 - DNA, 25 bp, Mus musculus
gacgttggacccatgatggcatcga

SEQ ID NO: 647177 - DNA, 25 bp, Mus musculus
gacgttggacccttgatggcatcga

SEQ ID NO: 647178 - DNA, 25 bp, Mus musculus
gacgttggtaacagacaaagtgaaa

SEQ ID NO: 647179 - DNA, 25 bp, Mus musculus
gacgttggtaactgacaaagtgaaa

SEQ ID NO: 647180 - DNA, 25 bp, Mus musculus
gacgtttagcccctagtctgcagaa

SEQ ID NO: 647181 - DNA, 25 bp, Mus musculus
gacgtttagcccgtagtctgcagaa

SEQ ID NO: 647182 - DNA, 25 bp, Mus musculus
gacgtttcacccacttggcagaatg

SEQ ID NO: 647183 - DNA, 25 bp, Mus musculus
gacgtttcaccctcttggcagaatg

SEQ ID NO: 647184 - DNA, 25 bp, Mus musculus
gacgtttcagttctcggtgcccctg

SEQ ID NO: 647185 - DNA, 25 bp, Mus musculus
gacgtttcagttgtcggtgcccctg

SEQ ID NO: 647186 - DNA, 25 bp, Mus musculus
gacgtttcattgaactcacaccacc

SEQ ID NO: 647187 - DNA, 25 bp, Mus musculus
gacgtttcattgtactcacaccacc

SEQ ID NO: 647188 - DNA, 25 bp, Mus musculus
gacgtttccaaactcctgctgggac

SEQ ID NO: 647189 - DNA, 25 bp, Mus musculus
gacgtttccaaagtcctgctgggac

SEQ ID NO: 647190 - DNA, 25 bp, Mus musculus
gacgtttcgtggagactactttgcc

SEQ ID NO: 647191 - DNA, 25 bp, Mus musculus
gacgtttcgtggtgactactttgcc

SEQ ID NO: 647192 - DNA, 25 bp, Mus musculus
gacgtttctatcattccacccctgt

SEQ ID NO: 647193 - DNA, 25 bp, Mus musculus
gacgtttctatctttccacccctgt

SEQ ID NO: 647194 - DNA, 25 bp, Mus musculus
gacgtttgctctaccggaacagctt

SEQ ID NO: 647195 - DNA, 25 bp, Mus musculus
gacgtttgctcttccggaacagctt

SEQ ID NO: 647196 - DNA, 25 bp, Mus musculus
gacgtttggagaaaagatctgaaga

SEQ ID NO: 647197 - DNA, 25 bp, Mus musculus
gacgtttggagataagatctgaaga

SEQ ID NO: 647198 - DNA, 25 bp, Mus musculus
gacgttttcgacagtggtgtagcca

SEQ ID NO: 647199 - DNA, 25 bp, Mus musculus
gacgttttcgactgtggtgtagcca

SEQ ID NO: 647200 - DNA, 25 bp, Mus musculus
gacgttttttgcagcgttcttggcc

SEQ ID NO: 647201 - DNA, 25 bp, Mus musculus
gacgttttttgctgcgttcttggcc

SEQ ID NO: 647202 - DNA, 25 bp, Mus musculus
gactaaacagcaagaccttctggca

SEQ ID NO: 647203 - DNA, 25 bp, Mus musculus
gactaaacagcatgaccttctggca

SEQ ID NO: 647204 - DNA, 25 bp, Mus musculus
gactaaacctttctgggtgctctgg

SEQ ID NO: 647205 - DNA, 25 bp, Mus musculus
gactaaacctttgtgggtgctctgg

SEQ ID NO: 647206 - DNA, 25 bp, Mus musculus
gactaaactcttctcctgggaagag

SEQ ID NO: 647207 - DNA, 25 bp, Mus musculus
gactaaactcttgtcctgggaagag

SEQ ID NO: 647208 - DNA, 25 bp, Mus musculus
gactaaagagctcagtgatgcagtg

SEQ ID NO: 647209 - DNA, 25 bp, Mus musculus
gactaaagagctgagtgatgcagtg

SEQ ID NO: 647210 - DNA, 25 bp, Mus musculus
gactaaagttccagtgtgaacgcaa

SEQ ID NO: 647211 - DNA, 25 bp, Mus musculus
gactaaagttcctgtgtgaacgcaa

SEQ ID NO: 647212 - DNA, 25 bp, Mus musculus
gactaaataaatcacgctcctagtg

SEQ ID NO: 647213 - DNA, 25 bp, Mus musculus
gactaaataaatgacgctcctagtg

SEQ ID NO: 647214 - DNA, 25 bp, Mus musculus
gactaaatcaaaattccttgggatg

SEQ ID NO: 647215 - DNA, 25 bp, Mus musculus
gactaaatcaaatttccttgggatg

SEQ ID NO: 647216 - DNA, 25 bp, Mus musculus
gactaaattcggaggcaagctgggc

SEQ ID NO: 647217 - DNA, 25 bp, Mus musculus
gactaaattcggtggcaagctgggc

SEQ ID NO: 647218 - DNA, 25 bp, Mus musculus
gactaacagtgaagctgagaccaca

SEQ ID NO: 647219 - DNA, 25 bp, Mus musculus
gactaacagtgatgctgagaccaca

SEQ ID NO: 647220 - DNA, 25 bp, Mus musculus
gactaacatgatactggctcttgga

SEQ ID NO: 647221 - DNA, 25 bp, Mus musculus
gactaacatgattctggctcttgga

SEQ ID NO: 647222 - DNA, 25 bp, Mus musculus
gactaaccggctaaactccgcagaa

SEQ ID NO: 647223 - DNA, 25 bp, Mus musculus
gactaaccggcttaactccgcagaa

SEQ ID NO: 647224 - DNA, 25 bp, Mus musculus
gactaacctcttactgtaactgtcc

SEQ ID NO: 647225 - DNA, 25 bp, Mus musculus
gactaacctctttctgtaactgtcc

SEQ ID NO: 647226 - DNA, 25 bp, Mus musculus
gactaacgacacaaaagagaaaggc

SEQ ID NO: 647227 - DNA, 25 bp, Mus musculus
gactaacgacactaaagagaaaggc

SEQ ID NO: 647228 - DNA, 25 bp, Mus musculus
gactaacgcacaactcctctttggg

SEQ ID NO: 647229 - DNA, 25 bp, Mus musculus
gactaacgcacatctcctctttggg

SEQ ID NO: 647230 - DNA, 25 bp, Mus musculus
gactaactgactaacgatgccaccg

SEQ ID NO: 647231 - DNA, 25 bp, Mus musculus
gactaactgacttacgatgccaccg

SEQ ID NO: 647232 - DNA, 25 bp, Mus musculus
gactaacttcacaagtgccactggg

SEQ ID NO: 647233 - DNA, 25 bp, Mus musculus
gactaacttcactagtgccactggg

SEQ ID NO: 647234 - DNA, 25 bp, Mus musculus
gactaactttctaaagaagcatgag

SEQ ID NO: 647235 - DNA, 25 bp, Mus musculus
gactaactttcttaagaagcatgag

SEQ ID NO: 647236 - DNA, 25 bp, Mus musculus
gactaagagaagaaaccactggtca

SEQ ID NO: 647237 - DNA, 25 bp, Mus musculus
gactaagagaagtaaccactggtca

SEQ ID NO: 647238 - DNA, 25 bp, Mus musculus
gactaagcaaacaacaggaagcagg

SEQ ID NO: 647239 - DNA, 25 bp, Mus musculus
gactaagcaaactacaggaagcagg

SEQ ID NO: 647240 - DNA, 25 bp, Mus musculus
gactaagcttgcaaacacaggaacc

SEQ ID NO: 647241 - DNA, 25 bp, Mus musculus
gactaagcttgctaacacaggaacc

SEQ ID NO: 647242 - DNA, 25 bp, Mus musculus
gactaaggccctaggatctcctcct

SEQ ID NO: 647243 - DNA, 25 bp, Mus musculus
gactaaggcccttggatctcctcct

SEQ ID NO: 647244 - DNA, 25 bp, Mus musculus
gactaagtggtcagcggtgtctcct

SEQ ID NO: 647245 - DNA, 25 bp, Mus musculus
gactaagtggtctgcggtgtctcct

SEQ ID NO: 647246 - DNA, 25 bp, Mus musculus
gactaagtgttcagctctttgaaat

SEQ ID NO: 647247 - DNA, 25 bp, Mus musculus
gactaagtgttctgctctttgaaat

SEQ ID NO: 647248 - DNA, 25 bp, Mus musculus
gactaataaagtcgttgccgcaaca

SEQ ID NO: 647249 - DNA, 25 bp, Mus musculus
gactaataaagtggttgccgcaaca

SEQ ID NO: 647250 - DNA, 25 bp, Mus musculus
gactaatctagaccagaacccaaga

SEQ ID NO: 647251 - DNA, 25 bp, Mus musculus
gactaatctagagcagaacccaaga

SEQ ID NO: 647252 - DNA, 25 bp, Mus musculus
gactaatgccatctgatcctctatt

SEQ ID NO: 647253 - DNA, 25 bp, Mus musculus
gactaatgccatgtgatcctctatt

SEQ ID NO: 647254 - DNA, 25 bp, Mus musculus
gactaattgcccagctgtttactgg

SEQ ID NO: 647255 - DNA, 25 bp, Mus musculus
gactaattgccctgctgtttactgg

SEQ ID NO: 647256 - DNA, 25 bp, Mus musculus
gactaattggtaacgattccctgga

SEQ ID NO: 647257 - DNA, 25 bp, Mus musculus
gactaattggtatcgattccctgga

SEQ ID NO: 647258 - DNA, 25 bp, Mus musculus
gactaatttcacagtatttccaagg

SEQ ID NO: 647259 - DNA, 25 bp, Mus musculus
gactaatttcactgtatttccaagg

SEQ ID NO: 647260 - DNA, 25 bp, Mus musculus
gactacaaacaccactggagtgacg

SEQ ID NO: 647261 - DNA, 25 bp, Mus musculus
gactacaaacacgactggagtgacg

SEQ ID NO: 647262 - DNA, 25 bp, Mus musculus
gactacaaacagagcccctgaagtg

SEQ ID NO: 647263 - DNA, 25 bp, Mus musculus
gactacaaacagtgcccctgaagtg

SEQ ID NO: 647264 - DNA, 25 bp, Mus musculus
gactacaaacctctgtgattcacta

SEQ ID NO: 647265 - DNA, 25 bp, Mus musculus
gactacaaacctgtgtgattcacta

SEQ ID NO: 647266 - DNA, 25 bp, Mus musculus
gactacaaagtgcaagcctggctgg

SEQ ID NO: 647267 - DNA, 25 bp, Mus musculus
gactacaaagtggaagcctggctgg

SEQ ID NO: 647268 - DNA, 25 bp, Mus musculus
gactacaaatctctccaggacatca

SEQ ID NO: 647269 - DNA, 25 bp, Mus musculus
gactacaaatctgtccaggacatca

SEQ ID NO: 647270 - DNA, 25 bp, Mus musculus
gactacaaccggatccgcagtggca

SEQ ID NO: 647271 - DNA, 25 bp, Mus musculus
gactacaaccggttccgcagtggca

SEQ ID NO: 647272 - DNA, 25 bp, Mus musculus
gactacaaggccattgggcgtctca

SEQ ID NO: 647273 - DNA, 25 bp, Mus musculus
gactacaaggcctttgggcgtctca

SEQ ID NO: 647274 - DNA, 25 bp, Mus musculus
gactacaataagctggctctcaagg

SEQ ID NO: 647275 - DNA, 25 bp, Mus musculus
gactacaataaggtggctctcaagg

SEQ ID NO: 647276 - DNA, 25 bp, Mus musculus
gactacaatgcacggctgctctcct

SEQ ID NO: 647277 - DNA, 25 bp, Mus musculus
gactacaatgcagggctgctctcct

SEQ ID NO: 647278 - DNA, 25 bp, Mus musculus
gactacaatggccagatcaacagca

SEQ ID NO: 647279 - DNA, 25 bp, Mus musculus
gactacaatggcgagatcaacagca

SEQ ID NO: 647280 - DNA, 25 bp, Mus musculus
gactacacagatcgccgagtgtgca

SEQ ID NO: 647281 - DNA, 25 bp, Mus musculus
gactacacagatggccgagtgtgca

SEQ ID NO: 647282 - DNA, 25 bp, Mus musculus
gactacacctctcgacgtggctaag

SEQ ID NO: 647283 - DNA, 25 bp, Mus musculus
gactacacctctggacgtggctaag

SEQ ID NO: 647284 - DNA, 25 bp, Mus musculus
gactacacctttcatgctggctgcc

SEQ ID NO: 647285 - DNA, 25 bp, Mus musculus
gactacacctttgatgctggctgcc

SEQ ID NO: 647286 - DNA, 25 bp, Mus musculus
gactacacggcgcagaagtgcatcc

SEQ ID NO: 647287 - DNA, 25 bp, Mus musculus
gactacacggcggagaagtgcatcc

SEQ ID NO: 647288 - DNA, 25 bp, Mus musculus
gactacactttacgagagctcaaac

SEQ ID NO: 647289 - DNA, 25 bp, Mus musculus
gactacactttaggagagctcaaac

SEQ ID NO: 647290 - DNA, 25 bp, Mus musculus
gactacagaacgcaagccagtggct

SEQ ID NO: 647291 - DNA, 25 bp, Mus musculus
gactacagaacggaagccagtggct

SEQ ID NO: 647292 - DNA, 25 bp, Mus musculus
gactacagatacacaaatggcctag

SEQ ID NO: 647293 - DNA, 25 bp, Mus musculus
gactacagatactcaaatggcctag

SEQ ID NO: 647294 - DNA, 25 bp, Mus musculus
gactacagcaacattgacccagagt

SEQ ID NO: 647295 - DNA, 25 bp, Mus musculus
gactacagcaactttgacccagagt

SEQ ID NO: 647296 - DNA, 25 bp, Mus musculus
gactacagcaccacgccggtactgt

SEQ ID NO: 647297 - DNA, 25 bp, Mus musculus
gactacagcacctcgccggtactgt

SEQ ID NO: 647298 - DNA, 25 bp, Mus musculus
gactacagccagacagacttcaggg

SEQ ID NO: 647299 - DNA, 25 bp, Mus musculus
gactacagccagtcagacttcaggg

SEQ ID NO: 647300 - DNA, 25 bp, Mus musculus
gactacagcggtcatcctgggtcat

SEQ ID NO: 647301 - DNA, 25 bp, Mus musculus
gactacagcggtgatcctgggtcat

SEQ ID NO: 647302 - DNA, 25 bp, Mus musculus
gactacagctacctccaagagtcag

SEQ ID NO: 647303 - DNA, 25 bp, Mus musculus
gactacagctacgtccaagagtcag

SEQ ID NO: 647304 - DNA, 25 bp, Mus musculus
gactacaggttaagctgggaccccg

SEQ ID NO: 647305 - DNA, 25 bp, Mus musculus
gactacaggttatgctgggaccccg

SEQ ID NO: 647306 - DNA, 25 bp, Mus musculus
gactacatccacagaaatgctgagg

SEQ ID NO: 647307 - DNA, 25 bp, Mus musculus
gactacatccactgaaatgctgagg

SEQ ID NO: 647308 - DNA, 25 bp, Mus musculus
gactacatccagattttacacaagg

SEQ ID NO: 647309 - DNA, 25 bp, Mus musculus
gactacatccagtttttacacaagg

SEQ ID NO: 647310 - DNA, 25 bp, Mus musculus
gactacatccctacacagcaggatg

SEQ ID NO: 647311 - DNA, 25 bp, Mus musculus
gactacatcccttcacagcaggatg

SEQ ID NO: 647312 - DNA, 25 bp, Mus musculus
gactacatccggaagttgcaacggg

SEQ ID NO: 647313 - DNA, 25 bp, Mus musculus
gactacatccggtagttgcaacggg

SEQ ID NO: 647314 - DNA, 25 bp, Mus musculus
gactacatccgtccggcggaaaagc

SEQ ID NO: 647315 - DNA, 25 bp, Mus musculus
gactacatccgtcgaggcatcgtca

SEQ ID NO: 647316 - DNA, 25 bp, Mus musculus
gactacatccgtgcggcggaaaagc

SEQ ID NO: 647317 - DNA, 25 bp, Mus musculus
gactacatccgtggaggcatcgtca

SEQ ID NO: 647318 - DNA, 25 bp, Mus musculus
gactacatgcctcagattcttccaa

SEQ ID NO: 647319 - DNA, 25 bp, Mus musculus
gactacatgcctgagattcttccaa

SEQ ID NO: 647320 - DNA, 25 bp, Mus musculus
gactacatggagcagtgcaagcccc

SEQ ID NO: 647321 - DNA, 25 bp, Mus musculus
gactacatggaggagtgcaagcccc

SEQ ID NO: 647322 - DNA, 25 bp, Mus musculus
gactacatggcccaggaggatgact

SEQ ID NO: 647323 - DNA, 25 bp, Mus musculus
gactacatggccgaggaggatgact

SEQ ID NO: 647324 - DNA, 25 bp, Mus musculus
gactacatgtggatctcagacctaa

SEQ ID NO: 647325 - DNA, 25 bp, Mus musculus
gactacatgtggttctcagacctaa

SEQ ID NO: 647326 - DNA, 25 bp, Mus musculus
gactacattagaccagccagcccag

SEQ ID NO: 647327 - DNA, 25 bp, Mus musculus
gactacattagagcagccagcccag

SEQ ID NO: 647328 - DNA, 25 bp, Mus musculus
gactacattcgtctcattgctgcag

SEQ ID NO: 647329 - DNA, 25 bp, Mus musculus
gactacattcgtgtcattgctgcag

SEQ ID NO: 647330 - DNA, 25 bp, Mus musculus
gactacattgcaaatgcccatagta

SEQ ID NO: 647331 - DNA, 25 bp, Mus musculus
gactacattgcacaaaggattactt

SEQ ID NO: 647332 - DNA, 25 bp, Mus musculus
gactacattgcagaaaggattactt

SEQ ID NO: 647333 - DNA, 25 bp, Mus musculus
gactacattgcatatgcccatagta

SEQ ID NO: 647334 - DNA, 25 bp, Mus musculus
gactacattgccctttaagcctgtc

SEQ ID NO: 647335 - DNA, 25 bp, Mus musculus
gactacattgccgtttaagcctgtc

SEQ ID NO: 647336 - DNA, 25 bp, Mus musculus
gactacattgctcctttcctgcaca

SEQ ID NO: 647337 - DNA, 25 bp, Mus musculus
gactacattgctgctttcctgcaca

SEQ ID NO: 647338 - DNA, 25 bp, Mus musculus
gactaccaggtacacagcgcaatct

SEQ ID NO: 647339 - DNA, 25 bp, Mus musculus
gactaccaggtagacagcgcaatct

SEQ ID NO: 647340 - DNA, 25 bp, Mus musculus
gactacccagccaatgcagagtgtg

SEQ ID NO: 647341 - DNA, 25 bp, Mus musculus
gactacccagcctatgcagagtgtg

SEQ ID NO: 647342 - DNA, 25 bp, Mus musculus
gactaccccgaaatactggccagtt

SEQ ID NO: 647343 - DNA, 25 bp, Mus musculus
gactaccccgaattactggccagtt

SEQ ID NO: 647344 - DNA, 25 bp, Mus musculus
gactaccccgccagtatcgctatgg

SEQ ID NO: 647345 - DNA, 25 bp, Mus musculus
gactaccccgcctgtatcgctatgg

SEQ ID NO: 647346 - DNA, 25 bp, Mus musculus
gactacccggggactgactgatcga

SEQ ID NO: 647347 - DNA, 25 bp, Mus musculus
gactacccggggtctgactgatcga

SEQ ID NO: 647348 - DNA, 25 bp, Mus musculus
gactaccgatgcatcgtggagctcg

SEQ ID NO: 647349 - DNA, 25 bp, Mus musculus
gactaccgatgcttcgtggagctcg

SEQ ID NO: 647350 - DNA, 25 bp, Mus musculus
gactaccgtgtaagggtttcgcaaa

SEQ ID NO: 647351 - DNA, 25 bp, Mus musculus
gactaccgtgtatgggtttcgcaaa

SEQ ID NO: 647352 - DNA, 25 bp, Mus musculus
gactacctacaaagctgtgattcag

SEQ ID NO: 647353 - DNA, 25 bp, Mus musculus
gactacctacaatgctgtgattcag

SEQ ID NO: 647354 - DNA, 25 bp, Mus musculus
gactacctaggtcgctctggccaac

SEQ ID NO: 647355 - DNA, 25 bp, Mus musculus
gactacctaggtggctctggccaac

SEQ ID NO: 647356 - DNA, 25 bp, Mus musculus
gactacctcagtaccacaaaagaag

SEQ ID NO: 647357 - DNA, 25 bp, Mus musculus
gactacctcagttccacaaaagaag

SEQ ID NO: 647358 - DNA, 25 bp, Mus musculus
gactacctcatcctgggtgtgcata

SEQ ID NO: 647359 - DNA, 25 bp, Mus musculus
gactacctcatcgtgggtgtgcata

SEQ ID NO: 647360 - DNA, 25 bp, Mus musculus
gactacctgatcagcggcggcaccg

SEQ ID NO: 647361 - DNA, 25 bp, Mus musculus
gactacctgatctgcggcggcaccg

SEQ ID NO: 647362 - DNA, 25 bp, Mus musculus
gactacctggtgatgcggaaaacct

SEQ ID NO: 647363 - DNA, 25 bp, Mus musculus
gactacctggtgttgcggaaaacct

SEQ ID NO: 647364 - DNA, 25 bp, Mus musculus
gactacctgttgagtgctattgccc

SEQ ID NO: 647365 - DNA, 25 bp, Mus musculus
gactacctgttgtgtgctattgccc

SEQ ID NO: 647366 - DNA, 25 bp, Mus musculus
gactacctttctccagccgagcggt

SEQ ID NO: 647367 - DNA, 25 bp, Mus musculus
gactacctttctgcagccgagcggt

SEQ ID NO: 647368 - DNA, 25 bp, Mus musculus
gactacgaactcacctacaacctag

SEQ ID NO: 647369 - DNA, 25 bp, Mus musculus
gactacgaactctcctacaacctag

SEQ ID NO: 647370 - DNA, 25 bp, Mus musculus
gactacgacagccacattaagagca

SEQ ID NO: 647371 - DNA, 25 bp, Mus musculus
gactacgacagcgacattaagagca

SEQ ID NO: 647372 - DNA, 25 bp, Mus musculus
gactacgaccgcaaagttatccaca

SEQ ID NO: 647373 - DNA, 25 bp, Mus musculus
gactacgaccgctaagttatccaca

SEQ ID NO: 647374 - DNA, 25 bp, Mus musculus
gactacgactacctgaggaagctct

SEQ ID NO: 647375 - DNA, 25 bp, Mus musculus
gactacgactacgtgaggaagctct

SEQ ID NO: 647376 - DNA, 25 bp, Mus musculus
gactacgactatctacagaactggg

SEQ ID NO: 647377 - DNA, 25 bp, Mus musculus
gactacgactatgtacagaactggg

SEQ ID NO: 647378 - DNA, 25 bp, Mus musculus
gactacgagcagaagaccaagaggg

SEQ ID NO: 647379 - DNA, 25 bp, Mus musculus
gactacgagcagtagaccaagaggg

SEQ ID NO: 647380 - DNA, 25 bp, Mus musculus
gactacgagtctcatgagttcacag

SEQ ID NO: 647381 - DNA, 25 bp, Mus musculus
gactacgagtctgatgagttcacag

SEQ ID NO: 647382 - DNA, 25 bp, Mus musculus
gactacgccgacattgtcaacctct

SEQ ID NO: 647383 - DNA, 25 bp, Mus musculus
gactacgccgactttgtcaacctct

SEQ ID NO: 647384 - DNA, 25 bp, Mus musculus
gactacgccttcctgggtacagcac

SEQ ID NO: 647385 - DNA, 25 bp, Mus musculus
gactacgccttcgtgggtacagcac

SEQ ID NO: 647386 - DNA, 25 bp, Mus musculus
gactacggataaaacatcatccaga

SEQ ID NO: 647387 - DNA, 25 bp, Mus musculus
gactacggataatacatcatccaga

SEQ ID NO: 647388 - DNA, 25 bp, Mus musculus
gactacggcgctcagcgacttcgaa

SEQ ID NO: 647389 - DNA, 25 bp, Mus musculus
gactacggcgctgagcgacttcgaa

SEQ ID NO: 647390 - DNA, 25 bp, Mus musculus
gactacgtgacgacaggcattgtgc

SEQ ID NO: 647391 - DNA, 25 bp, Mus musculus
gactacgtgacgtcaggcattgtgc

SEQ ID NO: 647392 - DNA, 25 bp, Mus musculus
gactacgtggacattgtgcagggcc

SEQ ID NO: 647393 - DNA, 25 bp, Mus musculus
gactacgtggactttgtgcagggcc

SEQ ID NO: 647394 - DNA, 25 bp, Mus musculus
gactacgttcctcagtctgagcagg

SEQ ID NO: 647395 - DNA, 25 bp, Mus musculus
gactacgttcctgagtctgagcagg

SEQ ID NO: 647396 - DNA, 25 bp, Mus musculus
gactacgttttgctggccggccact

SEQ ID NO: 647397 - DNA, 25 bp, Mus musculus
gactacgttttggtggccggccact

SEQ ID NO: 647398 - DNA, 25 bp, Mus musculus
gactactacacgcaggtcctggacc

SEQ ID NO: 647399 - DNA, 25 bp, Mus musculus
gactactacacggaggtcctggacc

SEQ ID NO: 647400 - DNA, 25 bp, Mus musculus
gactactacgacatccaccaagaga

SEQ ID NO: 647401 - DNA, 25 bp, Mus musculus
gactactacgacttccaccaagaga

SEQ ID NO: 647402 - DNA, 25 bp, Mus musculus
gactactagccaatgtgagcaggga

SEQ ID NO: 647403 - DNA, 25 bp, Mus musculus
gactactagccattgtgagcaggga

SEQ ID NO: 647404 - DNA, 25 bp, Mus musculus
gactactaggagctgcgacacggcc

SEQ ID NO: 647405 - DNA, 25 bp, Mus musculus
gactactaggaggtgcgacacggcc

SEQ ID NO: 647406 - DNA, 25 bp, Mus musculus
gactactatgagagcactggaatat

SEQ ID NO: 647407 - DNA, 25 bp, Mus musculus
gactactatgagtgcactggaatat

SEQ ID NO: 647408 - DNA, 25 bp, Mus musculus
gactactatgttctggacgatgctg

SEQ ID NO: 647409 - DNA, 25 bp, Mus musculus
gactactatgttgtggacgatgctg

SEQ ID NO: 647410 - DNA, 25 bp, Mus musculus
gactactccattagcacttcaggga

SEQ ID NO: 647411 - DNA, 25 bp, Mus musculus
gactactccatttgcacttcaggga

SEQ ID NO: 647412 - DNA, 25 bp, Mus musculus
gactactcctttcatgcctgcaggc

SEQ ID NO: 647413 - DNA, 25 bp, Mus musculus
gactactcctttgatgcctgcaggc

SEQ ID NO: 647414 - DNA, 25 bp, Mus musculus
gactactcgcccaatggctattacg

SEQ ID NO: 647415 - DNA, 25 bp, Mus musculus
gactactcgccctatggctattacg

SEQ ID NO: 647416 - DNA, 25 bp, Mus musculus
gactactctctaaatgctaccagga

SEQ ID NO: 647417 - DNA, 25 bp, Mus musculus
gactactctctatatgctaccagga

SEQ ID NO: 647418 - DNA, 25 bp, Mus musculus
gactactcttctcgacaagttctca

SEQ ID NO: 647419 - DNA, 25 bp, Mus musculus
gactactcttctggacaagttctca

SEQ ID NO: 647420 - DNA, 25 bp, Mus musculus
gactactggaatatgccacgttgca

SEQ ID NO: 647421 - DNA, 25 bp, Mus musculus
gactactggaatttgccacgttgca

SEQ ID NO: 647422 - DNA, 25 bp, Mus musculus
gactactggacaaaccctggctctc

SEQ ID NO: 647423 - DNA, 25 bp, Mus musculus
gactactggacataccctggctctc

SEQ ID NO: 647424 - DNA, 25 bp, Mus musculus
gactactgtgccctacagcgctgtg

SEQ ID NO: 647425 - DNA, 25 bp, Mus musculus
gactactgtgccgtacagcgctgtg

SEQ ID NO: 647426 - DNA, 25 bp, Mus musculus
gactacttcactagcataactaaag

SEQ ID NO: 647427 - DNA, 25 bp, Mus musculus
gactacttcacttgcataactaaag

SEQ ID NO: 647428 - DNA, 25 bp, Mus musculus
gactacttccgcatcagaaacttgg

SEQ ID NO: 647429 - DNA, 25 bp, Mus musculus
gactacttccgcttcagaaacttgg

SEQ ID NO: 647430 - DNA, 25 bp, Mus musculus
gactacttcggtctgacctactgtg

SEQ ID NO: 647431 - DNA, 25 bp, Mus musculus
gactacttcggtgtgacctactgtg

SEQ ID NO: 647432 - DNA, 25 bp, Mus musculus
gactactttaccaaccagggccacg

SEQ ID NO: 647433 - DNA, 25 bp, Mus musculus
gactactttacctaccagggccacg

SEQ ID NO: 647434 - DNA, 25 bp, Mus musculus
gactacttttctctgggctatgccc

SEQ ID NO: 647435 - DNA, 25 bp, Mus musculus
gactacttttctgtgggctatgccc

SEQ ID NO: 647436 - DNA, 25 bp, Mus musculus
gactagaaagaaaggctgttggtca

SEQ ID NO: 647437 - DNA, 25 bp, Mus musculus
gactagaaagaatggctgttggtca

SEQ ID NO: 647438 - DNA, 25 bp, Mus musculus
gactagaaaggactgcgattcaccc

SEQ ID NO: 647439 - DNA, 25 bp, Mus musculus
gactagaaaggagtgcgattcaccc

SEQ ID NO: 647440 - DNA, 25 bp, Mus musculus
gactagaaatcaacgtgctggagaa

SEQ ID NO: 647441 - DNA, 25 bp, Mus musculus
gactagaaatcatcgtgctggagaa

SEQ ID NO: 647442 - DNA, 25 bp, Mus musculus
gactagaataccatcattttatgag

SEQ ID NO: 647443 - DNA, 25 bp, Mus musculus
gactagaataccttcattttatgag

SEQ ID NO: 647444 - DNA, 25 bp, Mus musculus
gactagaatccaaggctcctgctgt

SEQ ID NO: 647445 - DNA, 25 bp, Mus musculus
gactagaatccatggctcctgctgt

SEQ ID NO: 647446 - DNA, 25 bp, Mus musculus
gactagaattagagagtccggagcc

SEQ ID NO: 647447 - DNA, 25 bp, Mus musculus
gactagaattagtgagtccggagcc

SEQ ID NO: 647448 - DNA, 25 bp, Mus musculus
gactagacaataattactgtgatca

SEQ ID NO: 647449 - DNA, 25 bp, Mus musculus
gactagacaatatttactgtgatca

SEQ ID NO: 647450 - DNA, 25 bp, Mus musculus
gactagacccgcactcttggatata

SEQ ID NO: 647451 - DNA, 25 bp, Mus musculus
gactagacccgctctcttggatata

SEQ ID NO: 647452 - DNA, 25 bp, Mus musculus
gactagagaacgaccttatgtcctg

SEQ ID NO: 647453 - DNA, 25 bp, Mus musculus
gactagagaacgtccttatgtcctg

SEQ ID NO: 647454 - DNA, 25 bp, Mus musculus
gactagagaagcatgtgaacaactg

SEQ ID NO: 647455 - DNA, 25 bp, Mus musculus
gactagagaagcttgtgaacaactg

SEQ ID NO: 647456 - DNA, 25 bp, Mus musculus
gactagagatcaattgccaggaccc

SEQ ID NO: 647457 - DNA, 25 bp, Mus musculus
gactagagatcatttgccaggaccc

SEQ ID NO: 647458 - DNA, 25 bp, Mus musculus
gactagagatggaggcgttcctgaa

SEQ ID NO: 647459 - DNA, 25 bp, Mus musculus
gactagagatggtggcgttcctgaa

SEQ ID NO: 647460 - DNA, 25 bp, Mus musculus
gactagaggcctaaaagcatgcact

SEQ ID NO: 647461 - DNA, 25 bp, Mus musculus
gactagaggccttaaagcatgcact

SEQ ID NO: 647462 - DNA, 25 bp, Mus musculus
gactagatagggaaatttacaactt

SEQ ID NO: 647463 - DNA, 25 bp, Mus musculus
gactagatagggtaatttacaactt

SEQ ID NO: 647464 - DNA, 25 bp, Mus musculus
gactagatttggacttaagtcagtt

SEQ ID NO: 647465 - DNA, 25 bp, Mus musculus
gactagatttggtcttaagtcagtt

SEQ ID NO: 647466 - DNA, 25 bp, Mus musculus
gactagcaaggaaaaggtgccagct

SEQ ID NO: 647467 - DNA, 25 bp, Mus musculus
gactagcaaggataaggtgccagct

SEQ ID NO: 647468 - DNA, 25 bp, Mus musculus
gactagcacgtaattcatcacaggg

SEQ ID NO: 647469 - DNA, 25 bp, Mus musculus
gactagcacgtatttcatcacaggg

SEQ ID NO: 647470 - DNA, 25 bp, Mus musculus
gactagcagccaaaatagatctacc

SEQ ID NO: 647471 - DNA, 25 bp, Mus musculus
gactagcagccataatagatctacc

SEQ ID NO: 647472 - DNA, 25 bp, Mus musculus
gactagcatcgaaaggcatatcaac

SEQ ID NO: 647473 - DNA, 25 bp, Mus musculus
gactagcatcgataggcatatcaac

SEQ ID NO: 647474 - DNA, 25 bp, Mus musculus
gactagcatctcacagtgggttcca

SEQ ID NO: 647475 - DNA, 25 bp, Mus musculus
gactagcatctctcagtgggttcca

SEQ ID NO: 647476 - DNA, 25 bp, Mus musculus
gactagccacgtcaccatggtggta

SEQ ID NO: 647477 - DNA, 25 bp, Mus musculus
gactagccacgtgaccatggtggta

SEQ ID NO: 647478 - DNA, 25 bp, Mus musculus
gactagccagtcaattccaagatcc

SEQ ID NO: 647479 - DNA, 25 bp, Mus musculus
gactagccagtctattccaagatcc

SEQ ID NO: 647480 - DNA, 25 bp, Mus musculus
gactagccagttaagggaggtgccc

SEQ ID NO: 647481 - DNA, 25 bp, Mus musculus
gactagccagtttagggaggtgccc

SEQ ID NO: 647482 - DNA, 25 bp, Mus musculus
gactagccatcccaagcaagatagc

SEQ ID NO: 647483 - DNA, 25 bp, Mus musculus
gactagccatccgaagcaagatagc

SEQ ID NO: 647484 - DNA, 25 bp, Mus musculus
gactagctcacaccaacttgaaggt

SEQ ID NO: 647485 - DNA, 25 bp, Mus musculus
gactagctcacagcaacttgaaggt

SEQ ID NO: 647486 - DNA, 25 bp, Mus musculus
gactagctcatcacatggccctggg

SEQ ID NO: 647487 - DNA, 25 bp, Mus musculus
gactagctcatctcatggccctggg

SEQ ID NO: 647488 - DNA, 25 bp, Mus musculus
gactagctcgttagacggacagaca

SEQ ID NO: 647489 - DNA, 25 bp, Mus musculus
gactagctcgtttgacggacagaca

SEQ ID NO: 647490 - DNA, 25 bp, Mus musculus
gactagcttattcagattagaagac

SEQ ID NO: 647491 - DNA, 25 bp, Mus musculus
gactagcttattgagattagaagac

SEQ ID NO: 647492 - DNA, 25 bp, Mus musculus
gactaggacccaagatgtcttgaag

SEQ ID NO: 647493 - DNA, 25 bp, Mus musculus
gactaggacccatgatgtcttgaag

SEQ ID NO: 647494 - DNA, 25 bp, Mus musculus
gactaggactttctaggagctccgg

SEQ ID NO: 647495 - DNA, 25 bp, Mus musculus
gactaggactttgtaggagctccgg

SEQ ID NO: 647496 - DNA, 25 bp, Mus musculus
gactaggaggccatccttgaatcca

SEQ ID NO: 647497 - DNA, 25 bp, Mus musculus
gactaggaggccttccttgaatcca

SEQ ID NO: 647498 - DNA, 25 bp, Mus musculus
gactaggcaagcaggaccctgtgag

SEQ ID NO: 647499 - DNA, 25 bp, Mus musculus
gactaggcaagctggaccctgtgag

SEQ ID NO: 647500 - DNA, 25 bp, Mus musculus
gactaggcagatcgcccaggagatc

SEQ ID NO: 647501 - DNA, 25 bp, Mus musculus
gactaggcagatggcccaggagatc

SEQ ID NO: 647502 - DNA, 25 bp, Mus musculus
gactaggcagctaaccagtgtcacc

SEQ ID NO: 647503 - DNA, 25 bp, Mus musculus
gactaggcagcttaccagtgtcacc

SEQ ID NO: 647504 - DNA, 25 bp, Mus musculus
gactagggcctgagatcatattctg

SEQ ID NO: 647505 - DNA, 25 bp, Mus musculus
gactagggcctgtgatcatattctg

SEQ ID NO: 647506 - DNA, 25 bp, Mus musculus
gactagggcgttcagcacaagcatg

SEQ ID NO: 647507 - DNA, 25 bp, Mus musculus
gactagggcgttgagcacaagcatg

SEQ ID NO: 647508 - DNA, 25 bp, Mus musculus
gactagggctggatctggcttaccg

SEQ ID NO: 647509 - DNA, 25 bp, Mus musculus
gactagggctggttctggcttaccg

SEQ ID NO: 647510 - DNA, 25 bp, Mus musculus
gactaggggacaacttccaggaagc

SEQ ID NO: 647511 - DNA, 25 bp, Mus musculus
gactaggggacatcttccaggaagc

SEQ ID NO: 647512 - DNA, 25 bp, Mus musculus
gactaggtcccacaaaccatccggg

SEQ ID NO: 647513 - DNA, 25 bp, Mus musculus
gactaggtcccagaaaccatccggg

SEQ ID NO: 647514 - DNA, 25 bp, Mus musculus
gactaggtgtccagttcctgttgca

SEQ ID NO: 647515 - DNA, 25 bp, Mus musculus
gactaggtgtcctgttcctgttgca

SEQ ID NO: 647516 - DNA, 25 bp, Mus musculus
gactagtaatctctacaagatccag

SEQ ID NO: 647517 - DNA, 25 bp, Mus musculus
gactagtaatctgtacaagatccag

SEQ ID NO: 647518 - DNA, 25 bp, Mus musculus
gactagtgatggcagcgccattttc

SEQ ID NO: 647519 - DNA, 25 bp, Mus musculus
gactagtgatgggagcgccattttc

SEQ ID NO: 647520 - DNA, 25 bp, Mus musculus
gactagtgcactaacagttcagcag

SEQ ID NO: 647521 - DNA, 25 bp, Mus musculus
gactagtgcacttacagttcagcag

SEQ ID NO: 647522 - DNA, 25 bp, Mus musculus
gactagtgcagtcaactccctcgtg

SEQ ID NO: 647523 - DNA, 25 bp, Mus musculus
gactagtgcagtgaactccctcgtg

SEQ ID NO: 647524 - DNA, 25 bp, Mus musculus
gactagttcctaagtagccctgcac

SEQ ID NO: 647525 - DNA, 25 bp, Mus musculus
gactagttcctatgtagccctgcac

SEQ ID NO: 647526 - DNA, 25 bp, Mus musculus
gactataaacggctgcagaccttcc

SEQ ID NO: 647527 - DNA, 25 bp, Mus musculus
gactataaacgggtgcagaccttcc

SEQ ID NO: 647528 - DNA, 25 bp, Mus musculus
gactataacacactcccaggaagct

SEQ ID NO: 647529 - DNA, 25 bp, Mus musculus
gactataacacagtcccaggaagct

SEQ ID NO: 647530 - DNA, 25 bp, Mus musculus
gactataatgagaacttcagggatt

SEQ ID NO: 647531 - DNA, 25 bp, Mus musculus
gactataatgagtacttcagggatt

SEQ ID NO: 647532 - DNA, 25 bp, Mus musculus
gactataatgtgcagttttttcgac

SEQ ID NO: 647533 - DNA, 25 bp, Mus musculus
gactataatgtggagttttttcgac

SEQ ID NO: 647534 - DNA, 25 bp, Mus musculus
gactatacaaaacaccctgcaaaac

SEQ ID NO: 647535 - DNA, 25 bp, Mus musculus
gactatacaaaagaccctgcaaaac

SEQ ID NO: 647536 - DNA, 25 bp, Mus musculus
gactatacaactcctccagtgaccg

SEQ ID NO: 647537 - DNA, 25 bp, Mus musculus
gactatacaactgctccagtgaccg

SEQ ID NO: 647538 - DNA, 25 bp, Mus musculus
gactatacagcgagttcaagactag

SEQ ID NO: 647539 - DNA, 25 bp, Mus musculus
gactatacagcgtgttcaagactag

SEQ ID NO: 647540 - DNA, 25 bp, Mus musculus
gactataccccaaaagccaattact

SEQ ID NO: 647541 - DNA, 25 bp, Mus musculus
gactataccccataagccaattact

SEQ ID NO: 647542 - DNA, 25 bp, Mus musculus
gactatacgcctatcagttgcatga

SEQ ID NO: 647543 - DNA, 25 bp, Mus musculus
gactatacgcctttcagttgcatga

SEQ ID NO: 647544 - DNA, 25 bp, Mus musculus
gactatactacaaagcctgccatca

SEQ ID NO: 647545 - DNA, 25 bp, Mus musculus
gactatactacatagcctgccatca

SEQ ID NO: 647546 - DNA, 25 bp, Mus musculus
gactatactgaaaagctcaaattca

SEQ ID NO: 647547 - DNA, 25 bp, Mus musculus
gactatactgaatagctcaaattca

SEQ ID NO: 647548 - DNA, 25 bp, Mus musculus
gactatagccagataaccagccttg

SEQ ID NO: 647549 - DNA, 25 bp, Mus musculus
gactatagccagttaaccagccttg

SEQ ID NO: 647550 - DNA, 25 bp, Mus musculus
gactatagcgtacaaaaacaaggct

SEQ ID NO: 647551 - DNA, 25 bp, Mus musculus
gactatagcgtagaaaaacaaggct

SEQ ID NO: 647552 - DNA, 25 bp, Mus musculus
gactataggcgtcaatgaagatgat

SEQ ID NO: 647553 - DNA, 25 bp, Mus musculus
gactataggcgtgaatgaagatgat

SEQ ID NO: 647554 - DNA, 25 bp, Mus musculus
gactatataaggcaaagccctagaa

SEQ ID NO: 647555 - DNA, 25 bp, Mus musculus
gactatataagggaaagccctagaa

SEQ ID NO: 647556 - DNA, 25 bp, Mus musculus
gactatatcacacgccctgaagtga

SEQ ID NO: 647557 - DNA, 25 bp, Mus musculus
gactatatcacaggccctgaagtga

SEQ ID NO: 647558 - DNA, 25 bp, Mus musculus
gactatatcctgagcgaagcctccc

SEQ ID NO: 647559 - DNA, 25 bp, Mus musculus
gactatatcctgtgcgaagcctccc

SEQ ID NO: 647560 - DNA, 25 bp, Mus musculus
gactatattttgctgccggacgaaa

SEQ ID NO: 647561 - DNA, 25 bp, Mus musculus
gactatattttggtgccggacgaaa

SEQ ID NO: 647562 - DNA, 25 bp, Mus musculus
gactatcaacccctgaaaggtcaat

SEQ ID NO: 647563 - DNA, 25 bp, Mus musculus
gactatcaacccgtgaaaggtcaat

SEQ ID NO: 647564 - DNA, 25 bp, Mus musculus
gactatcaactgctccctcctggag

SEQ ID NO: 647565 - DNA, 25 bp, Mus musculus
gactatcaactggtccctcctggag

SEQ ID NO: 647566 - DNA, 25 bp, Mus musculus
gactatcacaggactggagcccaag

SEQ ID NO: 647567 - DNA, 25 bp, Mus musculus
gactatcacaggtctggagcccaag

SEQ ID NO: 647568 - DNA, 25 bp, Mus musculus
gactatcacattcaggcgggtgcca

SEQ ID NO: 647569 - DNA, 25 bp, Mus musculus
gactatcacattgaggcgggtgcca

SEQ ID NO: 647570 - DNA, 25 bp, Mus musculus
gactatcatatgataccaaacctga

SEQ ID NO: 647571 - DNA, 25 bp, Mus musculus
gactatcatatgttaccaaacctga

SEQ ID NO: 647572 - DNA, 25 bp, Mus musculus
gactatccagttcatgggctgcctg

SEQ ID NO: 647573 - DNA, 25 bp, Mus musculus
gactatccagttgatgggctgcctg

SEQ ID NO: 647574 - DNA, 25 bp, Mus musculus
gactatcccaatcgcacctggctgg

SEQ ID NO: 647575 - DNA, 25 bp, Mus musculus
gactatcccaatggcacctggctgg

SEQ ID NO: 647576 - DNA, 25 bp, Mus musculus
gactatccctctctgggtcaagtag

SEQ ID NO: 647577 - DNA, 25 bp, Mus musculus
gactatccctctgtgggtcaagtag

SEQ ID NO: 647578 - DNA, 25 bp, Mus musculus
gactatccctgcacgcttgtgggca

SEQ ID NO: 647579 - DNA, 25 bp, Mus musculus
gactatccctgctcgcttgtgggca

SEQ ID NO: 647580 - DNA, 25 bp, Mus musculus
gactatcctgttaagtgtgatctca

SEQ ID NO: 647581 - DNA, 25 bp, Mus musculus
gactatcctgtttagtgtgatctca

SEQ ID NO: 647582 - DNA, 25 bp, Mus musculus
gactatctccctaccactgtgaacg

SEQ ID NO: 647583 - DNA, 25 bp, Mus musculus
gactatctcccttccactgtgaacg

SEQ ID NO: 647584 - DNA, 25 bp, Mus musculus
gactatctctttccacacggacagc

SEQ ID NO: 647585 - DNA, 25 bp, Mus musculus
gactatctctttgcacacggacagc

SEQ ID NO: 647586 - DNA, 25 bp, Mus musculus
gactatctgaggagctaagtatttt

SEQ ID NO: 647587 - DNA, 25 bp, Mus musculus
gactatctgaggtgctaagtatttt

SEQ ID NO: 647588 - DNA, 25 bp, Mus musculus
gactatctgcagctgagcacctcag

SEQ ID NO: 647589 - DNA, 25 bp, Mus musculus
gactatctgcaggtgagcacctcag

SEQ ID NO: 647590 - DNA, 25 bp, Mus musculus
gactatctggatcactggacagtgc

SEQ ID NO: 647591 - DNA, 25 bp, Mus musculus
gactatctggatgactggacagtgc

SEQ ID NO: 647592 - DNA, 25 bp, Mus musculus
gactatctttcacggcaaagagccc

SEQ ID NO: 647593 - DNA, 25 bp, Mus musculus
gactatctttcagggcaaagagccc

SEQ ID NO: 647594 - DNA, 25 bp, Mus musculus
gactatgaaatgaagttaatggact

SEQ ID NO: 647595 - DNA, 25 bp, Mus musculus
gactatgaaatgtagttaatggact

SEQ ID NO: 647596 - DNA, 25 bp, Mus musculus
gactatgaacacagccaaagccgtg

SEQ ID NO: 647597 - DNA, 25 bp, Mus musculus
gactatgaacactgccaaagccgtg

SEQ ID NO: 647598 - DNA, 25 bp, Mus musculus
gactatgaagagaagtatggccgga

SEQ ID NO: 647599 - DNA, 25 bp, Mus musculus
gactatgaagagtagtatggccgga

SEQ ID NO: 647600 - DNA, 25 bp, Mus musculus
gactatgaagccatgagctttgtct

SEQ ID NO: 647601 - DNA, 25 bp, Mus musculus
gactatgaagccttgagctttgtct

SEQ ID NO: 647602 - DNA, 25 bp, Mus musculus
gactatgacatcagcaaatcctggg

SEQ ID NO: 647603 - DNA, 25 bp, Mus musculus
gactatgacatctgcaaatcctggg

SEQ ID NO: 647604 - DNA, 25 bp, Mus musculus
gactatgaccacatcttcgaggatg

SEQ ID NO: 647605 - DNA, 25 bp, Mus musculus
gactatgaccacttcttcgaggatg

SEQ ID NO: 647606 - DNA, 25 bp, Mus musculus
gactatgagagtatttcctgtgtct

SEQ ID NO: 647607 - DNA, 25 bp, Mus musculus
gactatgagagtttttcctgtgtct

SEQ ID NO: 647608 - DNA, 25 bp, Mus musculus
gactatgagctgagtcagcgccacg

SEQ ID NO: 647609 - DNA, 25 bp, Mus musculus
gactatgagctgtgtcagcgccacg

SEQ ID NO: 647610 - DNA, 25 bp, Mus musculus
gactatgaggagctcccgaatccta

SEQ ID NO: 647611 - DNA, 25 bp, Mus musculus
gactatgaggaggtcccgaatccta

SEQ ID NO: 647612 - DNA, 25 bp, Mus musculus
gactatgaggatcagagcacaatgc

SEQ ID NO: 647613 - DNA, 25 bp, Mus musculus
gactatgaggatgagagcacaatgc

SEQ ID NO: 647614 - DNA, 25 bp, Mus musculus
gactatgaggtcagctgccctgagc

SEQ ID NO: 647615 - DNA, 25 bp, Mus musculus
gactatgaggtctgctgccctgagc

SEQ ID NO: 647616 - DNA, 25 bp, Mus musculus
gactatgatgaacaaagctcagaag

SEQ ID NO: 647617 - DNA, 25 bp, Mus musculus
gactatgatgaagaaagctcagaag

SEQ ID NO: 647618 - DNA, 25 bp, Mus musculus
gactatgatgcccaggaacacgtgg

SEQ ID NO: 647619 - DNA, 25 bp, Mus musculus
gactatgatgccgaggaacacgtgg

SEQ ID NO: 647620 - DNA, 25 bp, Mus musculus
gactatgattcgctgaaacggaaga

SEQ ID NO: 647621 - DNA, 25 bp, Mus musculus
gactatgattcggtgaaacggaaga

SEQ ID NO: 647622 - DNA, 25 bp, Mus musculus
gactatgattttactgagacctggg

SEQ ID NO: 647623 - DNA, 25 bp, Mus musculus
gactatgatttttctgagacctggg

SEQ ID NO: 647624 - DNA, 25 bp, Mus musculus
gactatgccaccaagaaagggcgga

SEQ ID NO: 647625 - DNA, 25 bp, Mus musculus
gactatgccacctagaaagggcgga

SEQ ID NO: 647626 - DNA, 25 bp, Mus musculus
gactatgccgctataaaggcttgtt

SEQ ID NO: 647627 - DNA, 25 bp, Mus musculus
gactatgccgctttaaaggcttgtt

SEQ ID NO: 647628 - DNA, 25 bp, Mus musculus
gactatgcctgtaccctagagagtg

SEQ ID NO: 647629 - DNA, 25 bp, Mus musculus
gactatgcctgttccctagagagtg

SEQ ID NO: 647630 - DNA, 25 bp, Mus musculus
gactatgcggccatccgtgacaact

SEQ ID NO: 647631 - DNA, 25 bp, Mus musculus
gactatgcggccttccgtgacaact

SEQ ID NO: 647632 - DNA, 25 bp, Mus musculus
gactatgcggctaatgaagaattct

SEQ ID NO: 647633 - DNA, 25 bp, Mus musculus
gactatgcggcttatgaagaattct

SEQ ID NO: 647634 - DNA, 25 bp, Mus musculus
gactatgctgacctcaaacagttct

SEQ ID NO: 647635 - DNA, 25 bp, Mus musculus
gactatgctgacgtcaaacagttct

SEQ ID NO: 647636 - DNA, 25 bp, Mus musculus
gactatggactcatggtctttgctg

SEQ ID NO: 647637 - DNA, 25 bp, Mus musculus
gactatggactcttggtctttgctg

SEQ ID NO: 647638 - DNA, 25 bp, Mus musculus
gactatggactgaagtcggccctcc

SEQ ID NO: 647639 - DNA, 25 bp, Mus musculus
gactatggactgtagtcggccctcc

SEQ ID NO: 647640 - DNA, 25 bp, Mus musculus
gactatggcaggctctgtccactac

SEQ ID NO: 647641 - DNA, 25 bp, Mus musculus
gactatggcagggtctgtccactac

SEQ ID NO: 647642 - DNA, 25 bp, Mus musculus
gactatggcgagcttgaccctgaga

SEQ ID NO: 647643 - DNA, 25 bp, Mus musculus
gactatggcgaggttgaccctgaga

SEQ ID NO: 647644 - DNA, 25 bp, Mus musculus
gactatggctcaactgcacctcagg

SEQ ID NO: 647645 - DNA, 25 bp, Mus musculus
gactatggctcatctgcacctcagg

SEQ ID NO: 647646 - DNA, 25 bp, Mus musculus
gactatggttttagctcacagaatg

SEQ ID NO: 647647 - DNA, 25 bp, Mus musculus
gactatggttttcgaccaagaggac

SEQ ID NO: 647648 - DNA, 25 bp, Mus musculus
gactatggttttggaccaagaggac

SEQ ID NO: 647649 - DNA, 25 bp, Mus musculus
gactatggtttttgctcacagaatg

SEQ ID NO: 647650 - DNA, 25 bp, Mus musculus
gactatgtgagtctacaggattctg

SEQ ID NO: 647651 - DNA, 25 bp, Mus musculus
gactatgtgagtgtacaggattctg

SEQ ID NO: 647652 - DNA, 25 bp, Mus musculus
gactatgtgattacaaatctgaacc

SEQ ID NO: 647653 - DNA, 25 bp, Mus musculus
gactatgtgatttcaaatctgaacc

SEQ ID NO: 647654 - DNA, 25 bp, Mus musculus
gactatgtgcaacttaccttcagag

SEQ ID NO: 647655 - DNA, 25 bp, Mus musculus
gactatgtgcaagttaccttcagag

SEQ ID NO: 647656 - DNA, 25 bp, Mus musculus
gactatgtgcaccactgaagatgga

SEQ ID NO: 647657 - DNA, 25 bp, Mus musculus
gactatgtgcacgactgaagatgga

SEQ ID NO: 647658 - DNA, 25 bp, Mus musculus
gactatgtgcccaagctgtacgagc

SEQ ID NO: 647659 - DNA, 25 bp, Mus musculus
gactatgtgccctagctgtacgagc

SEQ ID NO: 647660 - DNA, 25 bp, Mus musculus
gactatgtgcttagcgtctccgaaa

SEQ ID NO: 647661 - DNA, 25 bp, Mus musculus
gactatgtgctttgcgtctccgaaa

SEQ ID NO: 647662 - DNA, 25 bp, Mus musculus
gactatgttcctatcccaatgactg

SEQ ID NO: 647663 - DNA, 25 bp, Mus musculus
gactatgttcctttcccaatgactg

SEQ ID NO: 647664 - DNA, 25 bp, Mus musculus
gactattaccgcatggatggttcta

SEQ ID NO: 647665 - DNA, 25 bp, Mus musculus
gactattaccgcttggatggttcta

SEQ ID NO: 647666 - DNA, 25 bp, Mus musculus
gactattcaccaaagatggatctta

SEQ ID NO: 647667 - DNA, 25 bp, Mus musculus
gactattcaccatagatggatctta

SEQ ID NO: 647668 - DNA, 25 bp, Mus musculus
gactattgaagactggaattgaaca

SEQ ID NO: 647669 - DNA, 25 bp, Mus musculus
gactattgaagagtggaattgaaca

SEQ ID NO: 647670 - DNA, 25 bp, Mus musculus
gactattggtctagtgggtcttgac

SEQ ID NO: 647671 - DNA, 25 bp, Mus musculus
gactattggtcttgtgggtcttgac

SEQ ID NO: 647672 - DNA, 25 bp, Mus musculus
gactattgtggaccttcctgatgaa

SEQ ID NO: 647673 - DNA, 25 bp, Mus musculus
gactattgtggagcttcctgatgaa

SEQ ID NO: 647674 - DNA, 25 bp, Mus musculus
gactatttaagaactcaacttgtgg

SEQ ID NO: 647675 - DNA, 25 bp, Mus musculus
gactatttaagatctcaacttgtgg

SEQ ID NO: 647676 - DNA, 25 bp, Mus musculus
gactatttccgccacatctgtcact

SEQ ID NO: 647677 - DNA, 25 bp, Mus musculus
gactatttccgcgacatctgtcact

SEQ ID NO: 647678 - DNA, 25 bp, Mus musculus
gactatttgaaaaggctcttcccca

SEQ ID NO: 647679 - DNA, 25 bp, Mus musculus
gactatttgaaatggctcttcccca

SEQ ID NO: 647680 - DNA, 25 bp, Mus musculus
gactatttgcgtctgggtgccctac

SEQ ID NO: 647681 - DNA, 25 bp, Mus musculus
gactatttgcgtgtgggtgccctac

SEQ ID NO: 647682 - DNA, 25 bp, Mus musculus
gactatttggttccacatggaagaa

SEQ ID NO: 647683 - DNA, 25 bp, Mus musculus
gactatttggttgcacatggaagaa

SEQ ID NO: 647684 - DNA, 25 bp, Mus musculus
gactattttttcagattaactctcc

SEQ ID NO: 647685 - DNA, 25 bp, Mus musculus
gactattttttctgattaactctcc

SEQ ID NO: 647686 - DNA, 25 bp, Mus musculus
gactcaaatcataccataggagtgg

SEQ ID NO: 647687 - DNA, 25 bp, Mus musculus
gactcaaatcattccataggagtgg

SEQ ID NO: 647688 - DNA, 25 bp, Mus musculus
gactcaaattctagttatgggcagg

SEQ ID NO: 647689 - DNA, 25 bp, Mus musculus
gactcaaattcttgttatgggcagg

SEQ ID NO: 647690 - DNA, 25 bp, Mus musculus
gactcaacagttaccttccttctct

SEQ ID NO: 647691 - DNA, 25 bp, Mus musculus
gactcaacagtttccttccttctct

SEQ ID NO: 647692 - DNA, 25 bp, Mus musculus
gactcaacattaactaccaggatgc

SEQ ID NO: 647693 - DNA, 25 bp, Mus musculus
gactcaacattatctaccaggatgc

SEQ ID NO: 647694 - DNA, 25 bp, Mus musculus
gactcaacgaaacactccaacggtt

SEQ ID NO: 647695 - DNA, 25 bp, Mus musculus
gactcaacgaaagactccaacggtt

SEQ ID NO: 647696 - DNA, 25 bp, Mus musculus
gactcaagaaacactttcacaggct

SEQ ID NO: 647697 - DNA, 25 bp, Mus musculus
gactcaagaaactctttcacaggct

SEQ ID NO: 647698 - DNA, 25 bp, Mus musculus
gactcaagaactcgtgatgccgggc

SEQ ID NO: 647699 - DNA, 25 bp, Mus musculus
gactcaagaactggtgatgccgggc

SEQ ID NO: 647700 - DNA, 25 bp, Mus musculus
gactcaagaagccagtgcccggact

SEQ ID NO: 647701 - DNA, 25 bp, Mus musculus
gactcaagaagcgagtgcccggact

SEQ ID NO: 647702 - DNA, 25 bp, Mus musculus
gactcaagggctcacagctctcctt

SEQ ID NO: 647703 - DNA, 25 bp, Mus musculus
gactcaagggctgacagctctcctt

SEQ ID NO: 647704 - DNA, 25 bp, Mus musculus
gactcaagggtaaaaagctgtatcc

SEQ ID NO: 647705 - DNA, 25 bp, Mus musculus
gactcaagggtataaagctgtatcc

SEQ ID NO: 647706 - DNA, 25 bp, Mus musculus
gactcaaggtcactggcccaaatcg

SEQ ID NO: 647707 - DNA, 25 bp, Mus musculus
gactcaaggtcagtggcccaaatcg

SEQ ID NO: 647708 - DNA, 25 bp, Mus musculus
gactcaagtgatagaccaggctcag

SEQ ID NO: 647709 - DNA, 25 bp, Mus musculus
gactcaagtgattgaccaggctcag

SEQ ID NO: 647710 - DNA, 25 bp, Mus musculus
gactcaatagatcttgataatccac

SEQ ID NO: 647711 - DNA, 25 bp, Mus musculus
gactcaatagatgttgataatccac

SEQ ID NO: 647712 - DNA, 25 bp, Mus musculus
gactcaatcaaaatttgccactgct

SEQ ID NO: 647713 - DNA, 25 bp, Mus musculus
gactcaatcaaattttgccactgct

SEQ ID NO: 647714 - DNA, 25 bp, Mus musculus
gactcaatgcttaggcctccttttg

SEQ ID NO: 647715 - DNA, 25 bp, Mus musculus
gactcaatgctttggcctccttttg

SEQ ID NO: 647716 - DNA, 25 bp, Mus musculus
gactcaattattctaggccgaccta

SEQ ID NO: 647717 - DNA, 25 bp, Mus musculus
gactcaattattgtaggccgaccta

SEQ ID NO: 647718 - DNA, 25 bp, Mus musculus
gactcacaaccccagaaacagacat

SEQ ID NO: 647719 - DNA, 25 bp, Mus musculus
gactcacaacccgagaaacagacat

SEQ ID NO: 647720 - DNA, 25 bp, Mus musculus
gactcacaactcatgcaactggaaa

SEQ ID NO: 647721 - DNA, 25 bp, Mus musculus
gactcacaactcttgcaactggaaa

SEQ ID NO: 647722 - DNA, 25 bp, Mus musculus
gactcacagatccagaaggaacgag

SEQ ID NO: 647723 - DNA, 25 bp, Mus musculus
gactcacagatcgagaaggaacgag

SEQ ID NO: 647724 - DNA, 25 bp, Mus musculus
gactcacagattacaagccaggcta

SEQ ID NO: 647725 - DNA, 25 bp, Mus musculus
gactcacagatttcaagccaggcta

SEQ ID NO: 647726 - DNA, 25 bp, Mus musculus
gactcacagttcagcgtcggtggaa

SEQ ID NO: 647727 - DNA, 25 bp, Mus musculus
gactcacagttctgcgtcggtggaa

SEQ ID NO: 647728 - DNA, 25 bp, Mus musculus
gactcacataggctgcagcaaccag

SEQ ID NO: 647729 - DNA, 25 bp, Mus musculus
gactcacatagggtgcagcaaccag

SEQ ID NO: 647730 - DNA, 25 bp, Mus musculus
gactcacatcaaagctgggtgcatc

SEQ ID NO: 647731 - DNA, 25 bp, Mus musculus
gactcacatcaatgctgggtgcatc

SEQ ID NO: 647732 - DNA, 25 bp, Mus musculus
gactcacattgactacttcaacaat

SEQ ID NO: 647733 - DNA, 25 bp, Mus musculus
gactcacattgagtacttcaacaat

SEQ ID NO: 647734 - DNA, 25 bp, Mus musculus
gactcaccagtgctcagctacacag

SEQ ID NO: 647735 - DNA, 25 bp, Mus musculus
gactcaccagtggtcagctacacag

SEQ ID NO: 647736 - DNA, 25 bp, Mus musculus
gactcaccatttacatccacctaag

SEQ ID NO: 647737 - DNA, 25 bp, Mus musculus
gactcaccattttcatccacctaag

SEQ ID NO: 647738 - DNA, 25 bp, Mus musculus
gactcaccctgaagactctgtaaaa

SEQ ID NO: 647739 - DNA, 25 bp, Mus musculus
gactcaccctgatgactctgtaaaa

SEQ ID NO: 647740 - DNA, 25 bp, Mus musculus
gactcacctgaacgatcctgacatg

SEQ ID NO: 647741 - DNA, 25 bp, Mus musculus
gactcacctgaaggatcctgacatg

SEQ ID NO: 647742 - DNA, 25 bp, Mus musculus
gactcacgggccctttcttcacttt

SEQ ID NO: 647743 - DNA, 25 bp, Mus musculus
gactcacgggccgtttcttcacttt

SEQ ID NO: 647744 - DNA, 25 bp, Mus musculus
gactcacgggttcagatgtgaattt

SEQ ID NO: 647745 - DNA, 25 bp, Mus musculus
gactcacgggttgagatgtgaattt

SEQ ID NO: 647746 - DNA, 25 bp, Mus musculus
gactcactacaacttccacaagatt

SEQ ID NO: 647747 - DNA, 25 bp, Mus musculus
gactcactacaagttccacaagatt

SEQ ID NO: 647748 - DNA, 25 bp, Mus musculus
gactcactccgtagtgatactttaa

SEQ ID NO: 647749 - DNA, 25 bp, Mus musculus
gactcactccgttgtgatactttaa

SEQ ID NO: 647750 - DNA, 25 bp, Mus musculus
gactcactctcgaccagtgctgcta

SEQ ID NO: 647751 - DNA, 25 bp, Mus musculus
gactcactctcgtccagtgctgcta

SEQ ID NO: 647752 - DNA, 25 bp, Mus musculus
gactcagaaactaacgccgtttggg

SEQ ID NO: 647753 - DNA, 25 bp, Mus musculus
gactcagaaacttacgccgtttggg

SEQ ID NO: 647754 - DNA, 25 bp, Mus musculus
gactcagaagctccaaatatttacc

SEQ ID NO: 647755 - DNA, 25 bp, Mus musculus
gactcagaagctgcaaatatttacc

SEQ ID NO: 647756 - DNA, 25 bp, Mus musculus
gactcagaaggtcacatcgtcctta

SEQ ID NO: 647757 - DNA, 25 bp, Mus musculus
gactcagaaggtgacatcgtcctta

SEQ ID NO: 647758 - DNA, 25 bp, Mus musculus
gactcagaagtcaaaccacagaatg

SEQ ID NO: 647759 - DNA, 25 bp, Mus musculus
gactcagaagtctaaccacagaatg

SEQ ID NO: 647760 - DNA, 25 bp, Mus musculus
gactcagaatcccaactcccaataa

SEQ ID NO: 647761 - DNA, 25 bp, Mus musculus
gactcagaatccgaactcccaataa

SEQ ID NO: 647762 - DNA, 25 bp, Mus musculus
gactcagacatacgaagaagcttta

SEQ ID NO: 647763 - DNA, 25 bp, Mus musculus
gactcagacataggaagaagcttta

SEQ ID NO: 647764 - DNA, 25 bp, Mus musculus
gactcagacatcacctctacaagta

SEQ ID NO: 647765 - DNA, 25 bp, Mus musculus
gactcagacatctcctctacaagta

SEQ ID NO: 647766 - DNA, 25 bp, Mus musculus
gactcagacgtgctggaaaacaatt

SEQ ID NO: 647767 - DNA, 25 bp, Mus musculus
gactcagacgtggtggaaaacaatt

SEQ ID NO: 647768 - DNA, 25 bp, Mus musculus
gactcagacttgagcctagtggtcg

SEQ ID NO: 647769 - DNA, 25 bp, Mus musculus
gactcagacttgtgcctagtggtcg

SEQ ID NO: 647770 - DNA, 25 bp, Mus musculus
gactcagagaccctaattgaccaga

SEQ ID NO: 647771 - DNA, 25 bp, Mus musculus
gactcagagaccgtaattgaccaga

SEQ ID NO: 647772 - DNA, 25 bp, Mus musculus
gactcagagcataacaaacttaaag

SEQ ID NO: 647773 - DNA, 25 bp, Mus musculus
gactcagagcattacaaacttaaag

SEQ ID NO: 647774 - DNA, 25 bp, Mus musculus
gactcagatctcacatctgctagaa

SEQ ID NO: 647775 - DNA, 25 bp, Mus musculus
gactcagatctctcatctgctagaa

SEQ ID NO: 647776 - DNA, 25 bp, Mus musculus
gactcagatcttcccctgcatcaag

SEQ ID NO: 647777 - DNA, 25 bp, Mus musculus
gactcagatcttgccctgcatcaag

SEQ ID NO: 647778 - DNA, 25 bp, Mus musculus
gactcagatgacctaaaaacctgga

SEQ ID NO: 647779 - DNA, 25 bp, Mus musculus
gactcagatgacgtaaaaacctgga

SEQ ID NO: 647780 - DNA, 25 bp, Mus musculus
gactcagatggaatggatgaacaat

SEQ ID NO: 647781 - DNA, 25 bp, Mus musculus
gactcagatggattggatgaacaat

SEQ ID NO: 647782 - DNA, 25 bp, Mus musculus
gactcagcaaggactctaccaagcc

SEQ ID NO: 647783 - DNA, 25 bp, Mus musculus
gactcagcaaggtctctaccaagcc

SEQ ID NO: 647784 - DNA, 25 bp, Mus musculus
gactcagcacaaagtcatccagtgt

SEQ ID NO: 647785 - DNA, 25 bp, Mus musculus
gactcagcacaatgtcatccagtgt

SEQ ID NO: 647786 - DNA, 25 bp, Mus musculus
gactcagcagctctccaagtctcag

SEQ ID NO: 647787 - DNA, 25 bp, Mus musculus
gactcagcagctgtccaagtctcag

SEQ ID NO: 647788 - DNA, 25 bp, Mus musculus
gactcagcatcacgtagaagcattt

SEQ ID NO: 647789 - DNA, 25 bp, Mus musculus
gactcagcatcaggtagaagcattt

SEQ ID NO: 647790 - DNA, 25 bp, Mus musculus
gactcagccccaaggagatgaagaa

SEQ ID NO: 647791 - DNA, 25 bp, Mus musculus
gactcagccccatggagatgaagaa

SEQ ID NO: 647792 - DNA, 25 bp, Mus musculus
gactcagcgggcatctggtggcctc

SEQ ID NO: 647793 - DNA, 25 bp, Mus musculus
gactcagcgggcttctggtggcctc

SEQ ID NO: 647794 - DNA, 25 bp, Mus musculus
gactcagctccgaattacgtataga

SEQ ID NO: 647795 - DNA, 25 bp, Mus musculus
gactcagctccgtattacgtataga

SEQ ID NO: 647796 - DNA, 25 bp, Mus musculus
gactcagctctgaggtcacgggatg

SEQ ID NO: 647797 - DNA, 25 bp, Mus musculus
gactcagctctgtggtcacgggatg

SEQ ID NO: 647798 - DNA, 25 bp, Mus musculus
gactcagctcttagggtttgcccga

SEQ ID NO: 647799 - DNA, 25 bp, Mus musculus
gactcagctctttgggtttgcccga

SEQ ID NO: 647800 - DNA, 25 bp, Mus musculus
gactcagctgtaagaagctaaccag

SEQ ID NO: 647801 - DNA, 25 bp, Mus musculus
gactcagctgtatgaagctaaccag

SEQ ID NO: 647802 - DNA, 25 bp, Mus musculus
gactcagctgtgattgagggacctc

SEQ ID NO: 647803 - DNA, 25 bp, Mus musculus
gactcagctgtgtttgagggacctc

SEQ ID NO: 647804 - DNA, 25 bp, Mus musculus
gactcagctgttactatgggaatac

SEQ ID NO: 647805 - DNA, 25 bp, Mus musculus
gactcagctgtttctatgggaatac

SEQ ID NO: 647806 - DNA, 25 bp, Mus musculus
gactcaggcacgctacttggacaag

SEQ ID NO: 647807 - DNA, 25 bp, Mus musculus
gactcaggcacggtacttggacaag

SEQ ID NO: 647808 - DNA, 25 bp, Mus musculus
gactcaggcagtcttagcactacca

SEQ ID NO: 647809 - DNA, 25 bp, Mus musculus
gactcaggcagtgttagcactacca

SEQ ID NO: 647810 - DNA, 25 bp, Mus musculus
gactcaggcatgaactccagaactg

SEQ ID NO: 647811 - DNA, 25 bp, Mus musculus
gactcaggcatgtactccagaactg

SEQ ID NO: 647812 - DNA, 25 bp, Mus musculus
gactcaggcccaagaggtggcagca

SEQ ID NO: 647813 - DNA, 25 bp, Mus musculus
gactcaggcccatgaggtggcagca

SEQ ID NO: 647814 - DNA, 25 bp, Mus musculus
gactcaggccggattgttatcttgg

SEQ ID NO: 647815 - DNA, 25 bp, Mus musculus
gactcaggccggtttgttatcttgg

SEQ ID NO: 647816 - DNA, 25 bp, Mus musculus
gactcagggccacttgtggcaacaa

SEQ ID NO: 647817 - DNA, 25 bp, Mus musculus
gactcagggccagttgtggcaacaa

SEQ ID NO: 647818 - DNA, 25 bp, Mus musculus
gactcagggtgacccggtccgcatc

SEQ ID NO: 647819 - DNA, 25 bp, Mus musculus
gactcagggtgagccggtccgcatc

SEQ ID NO: 647820 - DNA, 25 bp, Mus musculus
gactcaggtaaaatccttcctggga

SEQ ID NO: 647821 - DNA, 25 bp, Mus musculus
gactcaggtaaattccttcctggga

SEQ ID NO: 647822 - DNA, 25 bp, Mus musculus
gactcagtctcgcattgatctaatg

SEQ ID NO: 647823 - DNA, 25 bp, Mus musculus
gactcagtctcggattgatctaatg

SEQ ID NO: 647824 - DNA, 25 bp, Mus musculus
gactcagtgatccagctcctgaacc

SEQ ID NO: 647825 - DNA, 25 bp, Mus musculus
gactcagtgatcgagctcctgaacc

SEQ ID NO: 647826 - DNA, 25 bp, Mus musculus
gactcagtgcgacttctctcatctt

SEQ ID NO: 647827 - DNA, 25 bp, Mus musculus
gactcagtgcgagttctctcatctt

SEQ ID NO: 647828 - DNA, 25 bp, Mus musculus
gactcagtgtgcaacctggtggctg

SEQ ID NO: 647829 - DNA, 25 bp, Mus musculus
gactcagtgtgctacctggtggctg

SEQ ID NO: 647830 - DNA, 25 bp, Mus musculus
gactcagtttctaagggaagacaga

SEQ ID NO: 647831 - DNA, 25 bp, Mus musculus
gactcagtttcttagggaagacaga

SEQ ID NO: 647832 - DNA, 25 bp, Mus musculus
gactcataaaaaccgggagcgcctc

SEQ ID NO: 647833 - DNA, 25 bp, Mus musculus
gactcataaaaagcgggagcgcctc

SEQ ID NO: 647834 - DNA, 25 bp, Mus musculus
gactcataggtcagctaccctggcg

SEQ ID NO: 647835 - DNA, 25 bp, Mus musculus
gactcataggtctgctaccctggcg

SEQ ID NO: 647836 - DNA, 25 bp, Mus musculus
gactcatcatctaattccttttcag

SEQ ID NO: 647837 - DNA, 25 bp, Mus musculus
gactcatcatcttattccttttcag

SEQ ID NO: 647838 - DNA, 25 bp, Mus musculus
gactcatccttgctgtttgcaactg

SEQ ID NO: 647839 - DNA, 25 bp, Mus musculus
gactcatccttggtgtttgcaactg

SEQ ID NO: 647840 - DNA, 25 bp, Mus musculus
gactcatcgtggaagtggagaaccg

SEQ ID NO: 647841 - DNA, 25 bp, Mus musculus
gactcatcgtggtagtggagaaccg

SEQ ID NO: 647842 - DNA, 25 bp, Mus musculus
gactcatctacaatgactgcttttc

SEQ ID NO: 647843 - DNA, 25 bp, Mus musculus
gactcatctacattgactgcttttc

SEQ ID NO: 647844 - DNA, 25 bp, Mus musculus
gactcatgaggcaaggctgcagtca

SEQ ID NO: 647845 - DNA, 25 bp, Mus musculus
gactcatgaggctaggctgcagtca

SEQ ID NO: 647846 - DNA, 25 bp, Mus musculus
gactcatgctggcagtcatgctggc

SEQ ID NO: 647847 - DNA, 25 bp, Mus musculus
gactcatgctgggagtcatgctggc

SEQ ID NO: 647848 - DNA, 25 bp, Mus musculus
gactcatgcttaaaaaggatgcctc

SEQ ID NO: 647849 - DNA, 25 bp, Mus musculus
gactcatgcttataaaggatgcctc

SEQ ID NO: 647850 - DNA, 25 bp, Mus musculus
gactcatggaaacttggcccaaacc

SEQ ID NO: 647851 - DNA, 25 bp, Mus musculus
gactcatggaaagttggcccaaacc

SEQ ID NO: 647852 - DNA, 25 bp, Mus musculus
gactcatggtgtcctgcacaccaag

SEQ ID NO: 647853 - DNA, 25 bp, Mus musculus
gactcatggtgtgctgcacaccaag

SEQ ID NO: 647854 - DNA, 25 bp, Mus musculus
gactcatgtcccacatgttcgtgct

SEQ ID NO: 647855 - DNA, 25 bp, Mus musculus
gactcatgtccctcatgttcgtgct

SEQ ID NO: 647856 - DNA, 25 bp, Mus musculus
gactcatgttcaacccgcatggtgg

SEQ ID NO: 647857 - DNA, 25 bp, Mus musculus
gactcatgttcatcccgcatggtgg

SEQ ID NO: 647858 - DNA, 25 bp, Mus musculus
gactcattatccatttccgagatat

SEQ ID NO: 647859 - DNA, 25 bp, Mus musculus
gactcattatccttttccgagatat

SEQ ID NO: 647860 - DNA, 25 bp, Mus musculus
gactcattcccacacaaagcaatag

SEQ ID NO: 647861 - DNA, 25 bp, Mus musculus
gactcattcccagacaaagcaatag

SEQ ID NO: 647862 - DNA, 25 bp, Mus musculus
gactcattgctgacaagatcaacag

SEQ ID NO: 647863 - DNA, 25 bp, Mus musculus
gactcattgctgtcaagatcaacag

SEQ ID NO: 647864 - DNA, 25 bp, Mus musculus
gactcattggaaactgattgacatc

SEQ ID NO: 647865 - DNA, 25 bp, Mus musculus
gactcattggaacaatagaaaattg

SEQ ID NO: 647866 - DNA, 25 bp, Mus musculus
gactcattggaagaatagaaaattg

SEQ ID NO: 647867 - DNA, 25 bp, Mus musculus
gactcattggaatctgattgacatc

SEQ ID NO: 647868 - DNA, 25 bp, Mus musculus
gactcattgtggctgcccaacatga

SEQ ID NO: 647869 - DNA, 25 bp, Mus musculus
gactcattgtgggtgcccaacatga

SEQ ID NO: 647870 - DNA, 25 bp, Mus musculus
gactcatttaatcctacttacgtgc

SEQ ID NO: 647871 - DNA, 25 bp, Mus musculus
gactcatttaatgctacttacgtgc

SEQ ID NO: 647872 - DNA, 25 bp, Mus musculus
gactcatttagaataaagacactta

SEQ ID NO: 647873 - DNA, 25 bp, Mus musculus
gactcatttagattaaagacactta

SEQ ID NO: 647874 - DNA, 25 bp, Mus musculus
gactccaaaagccaacttcacaggg

SEQ ID NO: 647875 - DNA, 25 bp, Mus musculus
gactccaaaagcgaacttcacaggg

SEQ ID NO: 647876 - DNA, 25 bp, Mus musculus
gactccaaactcatcagctttagag

SEQ ID NO: 647877 - DNA, 25 bp, Mus musculus
gactccaaactcttcagctttagag

SEQ ID NO: 647878 - DNA, 25 bp, Mus musculus
gactccaaagctaattaccacctgc

SEQ ID NO: 647879 - DNA, 25 bp, Mus musculus
gactccaaagcttattaccacctgc

SEQ ID NO: 647880 - DNA, 25 bp, Mus musculus
gactccaaaggacatcgcaaaaatg

SEQ ID NO: 647881 - DNA, 25 bp, Mus musculus
gactccaaaggagatcgcaaaaatg

SEQ ID NO: 647882 - DNA, 25 bp, Mus musculus
gactccaacataaacaaaagaccag

SEQ ID NO: 647883 - DNA, 25 bp, Mus musculus
gactccaacatatacaaaagaccag

SEQ ID NO: 647884 - DNA, 25 bp, Mus musculus
gactccaacatgaccagctggtggg

SEQ ID NO: 647885 - DNA, 25 bp, Mus musculus
gactccaacatgctggtgcgctgtg

SEQ ID NO: 647886 - DNA, 25 bp, Mus musculus
gactccaacatggtggtgcgctgtg

SEQ ID NO: 647887 - DNA, 25 bp, Mus musculus
gactccaacatgtccagctggtggg

SEQ ID NO: 647888 - DNA, 25 bp, Mus musculus
gactccaacctccaaagtttatact

SEQ ID NO: 647889 - DNA, 25 bp, Mus musculus
gactccaacctcgaaagtttatact

SEQ ID NO: 647890 - DNA, 25 bp, Mus musculus
gactccaacggtaattcataaacat

SEQ ID NO: 647891 - DNA, 25 bp, Mus musculus
gactccaacggttattcataaacat

SEQ ID NO: 647892 - DNA, 25 bp, Mus musculus
gactccaagaaaattaaggacgcac

SEQ ID NO: 647893 - DNA, 25 bp, Mus musculus
gactccaagaaatttaaggacgcac

SEQ ID NO: 647894 - DNA, 25 bp, Mus musculus
gactccaagcaaaatccacatgcag

SEQ ID NO: 647895 - DNA, 25 bp, Mus musculus
gactccaagcaatatccacatgcag

SEQ ID NO: 647896 - DNA, 25 bp, Mus musculus
gactccaagcatatggccccaggag

SEQ ID NO: 647897 - DNA, 25 bp, Mus musculus
gactccaagcatttggccccaggag

SEQ ID NO: 647898 - DNA, 25 bp, Mus musculus
gactccaatggacactgcacggacg

SEQ ID NO: 647899 - DNA, 25 bp, Mus musculus
gactccaatggagactgcacggacg

SEQ ID NO: 647900 - DNA, 25 bp, Mus musculus
gactccaatgggatctcagacccct

SEQ ID NO: 647901 - DNA, 25 bp, Mus musculus
gactccaatgggttctcagacccct

SEQ ID NO: 647902 - DNA, 25 bp, Mus musculus
gactccaatttgatgtttcatctcc

SEQ ID NO: 647903 - DNA, 25 bp, Mus musculus
gactccaatttgttgtttcatctcc

SEQ ID NO: 647904 - DNA, 25 bp, Mus musculus
gactccacacatcgtagatacaaag

SEQ ID NO: 647905 - DNA, 25 bp, Mus musculus
gactccacacatggtagatacaaag

SEQ ID NO: 647906 - DNA, 25 bp, Mus musculus
gactccaccaatcttgagctagcct

SEQ ID NO: 647907 - DNA, 25 bp, Mus musculus
gactccaccaatgttgagctagcct

SEQ ID NO: 647908 - DNA, 25 bp, Mus musculus
gactccaccacaagaatggttcttc

SEQ ID NO: 647909 - DNA, 25 bp, Mus musculus
gactccaccacatgaatggttcttc

SEQ ID NO: 647910 - DNA, 25 bp, Mus musculus
gactccaccgacctggttgccaagt

SEQ ID NO: 647911 - DNA, 25 bp, Mus musculus
gactccaccgacgtggttgccaagt

SEQ ID NO: 647912 - DNA, 25 bp, Mus musculus
gactccaccgggacgactcatttcg

SEQ ID NO: 647913 - DNA, 25 bp, Mus musculus
gactccaccgggtcgactcatttcg

SEQ ID NO: 647914 - DNA, 25 bp, Mus musculus
gactccacctcgacctggtttgata

SEQ ID NO: 647915 - DNA, 25 bp, Mus musculus
gactccacctcgtcctggtttgata

SEQ ID NO: 647916 - DNA, 25 bp, Mus musculus
gactccacgactcttgaacatcaga

SEQ ID NO: 647917 - DNA, 25 bp, Mus musculus
gactccacgactgttgaacatcaga

SEQ ID NO: 647918 - DNA, 25 bp, Mus musculus
gactccactaggagcgctcagcgtc

SEQ ID NO: 647919 - DNA, 25 bp, Mus musculus
gactccactaggtgcgctcagcgtc

SEQ ID NO: 647920 - DNA, 25 bp, Mus musculus
gactccactgcgctttgggaaggat

SEQ ID NO: 647921 - DNA, 25 bp, Mus musculus
gactccactgcggtttgggaaggat

SEQ ID NO: 647922 - DNA, 25 bp, Mus musculus
gactccactggaatgtttcactggt

SEQ ID NO: 647923 - DNA, 25 bp, Mus musculus
gactccactggattgtttcactggt

SEQ ID NO: 647924 - DNA, 25 bp, Mus musculus
gactccactgtcacggacatcctgg

SEQ ID NO: 647925 - DNA, 25 bp, Mus musculus
gactccactgtctcggacatcctgg

SEQ ID NO: 647926 - DNA, 25 bp, Mus musculus
gactccactgtgcagatatttaagt

SEQ ID NO: 647927 - DNA, 25 bp, Mus musculus
gactccactgtggagatatttaagt

SEQ ID NO: 647928 - DNA, 25 bp, Mus musculus
gactccagagccaagcctgttgctg

SEQ ID NO: 647929 - DNA, 25 bp, Mus musculus
gactccagagcctagcctgttgctg

SEQ ID NO: 647930 - DNA, 25 bp, Mus musculus
gactccagagctcagaagtccaaga

SEQ ID NO: 647931 - DNA, 25 bp, Mus musculus
gactccagagctgagaagtccaaga

SEQ ID NO: 647932 - DNA, 25 bp, Mus musculus
gactccagcgccactcagagttaag

SEQ ID NO: 647933 - DNA, 25 bp, Mus musculus
gactccagcgcctctcagagttaag

SEQ ID NO: 647934 - DNA, 25 bp, Mus musculus
gactccaggatgactatgacccgta

SEQ ID NO: 647935 - DNA, 25 bp, Mus musculus
gactccaggatgtctatgacccgta

SEQ ID NO: 647936 - DNA, 25 bp, Mus musculus
gactccaggccaaaaaagatctaga

SEQ ID NO: 647937 - DNA, 25 bp, Mus musculus
gactccaggccacattggcgaacac

SEQ ID NO: 647938 - DNA, 25 bp, Mus musculus
gactccaggccagattggcgaacac

SEQ ID NO: 647939 - DNA, 25 bp, Mus musculus
gactccaggccataaaagatctaga

SEQ ID NO: 647940 - DNA, 25 bp, Mus musculus
gactccagggagaaatgatgaagct

SEQ ID NO: 647941 - DNA, 25 bp, Mus musculus
gactccagggagtaatgatgaagct

SEQ ID NO: 647942 - DNA, 25 bp, Mus musculus
gactccagggctcctatagaagacc

SEQ ID NO: 647943 - DNA, 25 bp, Mus musculus
gactccagggctgctatagaagacc

SEQ ID NO: 647944 - DNA, 25 bp, Mus musculus
gactccaggtggcattcggtaccga

SEQ ID NO: 647945 - DNA, 25 bp, Mus musculus
gactccaggtgggattcggtaccga

SEQ ID NO: 647946 - DNA, 25 bp, Mus musculus
gactccagtgcaaccatgaactctg

SEQ ID NO: 647947 - DNA, 25 bp, Mus musculus
gactccagtgcatccatgaactctg

SEQ ID NO: 647948 - DNA, 25 bp, Mus musculus
gactccatagccagcgttggcgatg

SEQ ID NO: 647949 - DNA, 25 bp, Mus musculus
gactccatagcctgcgttggcgatg

SEQ ID NO: 647950 - DNA, 25 bp, Mus musculus
gactccatcaagaacccttacaagg

SEQ ID NO: 647951 - DNA, 25 bp, Mus musculus
gactccatcaagtacccttacaagg

SEQ ID NO: 647952 - DNA, 25 bp, Mus musculus
gactccatccaaccacagaagaatg

SEQ ID NO: 647953 - DNA, 25 bp, Mus musculus
gactccatccaagcacagaagaatg

SEQ ID NO: 647954 - DNA, 25 bp, Mus musculus
gactccatctgtaacagacactgca

SEQ ID NO: 647955 - DNA, 25 bp, Mus musculus
gactccatctgttacagacactgca

SEQ ID NO: 647956 - DNA, 25 bp, Mus musculus
gactccatctttaggtccctgcagc

SEQ ID NO: 647957 - DNA, 25 bp, Mus musculus
gactccatcttttggtccctgcagc

SEQ ID NO: 647958 - DNA, 25 bp, Mus musculus
gactccatgaatatcaaggcccata

SEQ ID NO: 647959 - DNA, 25 bp, Mus musculus
gactccatgaatttcaaggcccata

SEQ ID NO: 647960 - DNA, 25 bp, Mus musculus
gactccatggaaacaaagacacagc

SEQ ID NO: 647961 - DNA, 25 bp, Mus musculus
gactccatggaatcaaagacacagc

SEQ ID NO: 647962 - DNA, 25 bp, Mus musculus
gactccattcaccagctgggattca

SEQ ID NO: 647963 - DNA, 25 bp, Mus musculus
gactccattcacgagctgggattca

SEQ ID NO: 647964 - DNA, 25 bp, Mus musculus
gactccatttaacccagtgactgtg

SEQ ID NO: 647965 - DNA, 25 bp, Mus musculus
gactccatttaagccagtgactgtg

SEQ ID NO: 647966 - DNA, 25 bp, Mus musculus
gactccatttctacaagcagtctac

SEQ ID NO: 647967 - DNA, 25 bp, Mus musculus
gactccatttcttcaagcagtctac

SEQ ID NO: 647968 - DNA, 25 bp, Mus musculus
gactcccaaggacacctaagaatgg

SEQ ID NO: 647969 - DNA, 25 bp, Mus musculus
gactcccaaggagacctaagaatgg

SEQ ID NO: 647970 - DNA, 25 bp, Mus musculus
gactcccaagtacccctcataattg

SEQ ID NO: 647971 - DNA, 25 bp, Mus musculus
gactcccaagtagccctcataattg

SEQ ID NO: 647972 - DNA, 25 bp, Mus musculus
gactcccagtatctggccacaggaa

SEQ ID NO: 647973 - DNA, 25 bp, Mus musculus
gactcccagtatgtggccacaggaa

SEQ ID NO: 647974 - DNA, 25 bp, Mus musculus
gactccccactgatcaactcgagat

SEQ ID NO: 647975 - DNA, 25 bp, Mus musculus
gactccccactgttcaactcgagat

SEQ ID NO: 647976 - DNA, 25 bp, Mus musculus
gactccccagaacatgagaatgcag

SEQ ID NO: 647977 - DNA, 25 bp, Mus musculus
gactccccagaagatgagaatgcag

SEQ ID NO: 647978 - DNA, 25 bp, Mus musculus
gactccccatggctgttctgtgacc

SEQ ID NO: 647979 - DNA, 25 bp, Mus musculus
gactccccatgggtgttctgtgacc

SEQ ID NO: 647980 - DNA, 25 bp, Mus musculus
gactcccctaaccatagtggacaga

SEQ ID NO: 647981 - DNA, 25 bp, Mus musculus
gactcccctaacgatagtggacaga

SEQ ID NO: 647982 - DNA, 25 bp, Mus musculus
gactcccctacaatgcgcggtcgtg

SEQ ID NO: 647983 - DNA, 25 bp, Mus musculus
gactcccctacattgcgcggtcgtg

SEQ ID NO: 647984 - DNA, 25 bp, Mus musculus
gactcccctctcaaggctgtgcaga

SEQ ID NO: 647985 - DNA, 25 bp, Mus musculus
gactcccctctctaggctgtgcaga

SEQ ID NO: 647986 - DNA, 25 bp, Mus musculus
gactcccggcaacaaaacgattgtg

SEQ ID NO: 647987 - DNA, 25 bp, Mus musculus
gactcccggcaagaaaacgattgtg

SEQ ID NO: 647988 - DNA, 25 bp, Mus musculus
gactcccggcgtcttgctgctcatt

SEQ ID NO: 647989 - DNA, 25 bp, Mus musculus
gactcccggcgtgttgctgctcatt

SEQ ID NO: 647990 - DNA, 25 bp, Mus musculus
gactcccggtggcataagctcatga

SEQ ID NO: 647991 - DNA, 25 bp, Mus musculus
gactcccggtgggataagctcatga

SEQ ID NO: 647992 - DNA, 25 bp, Mus musculus
gactccctcaacatgcggaaccgaa

SEQ ID NO: 647993 - DNA, 25 bp, Mus musculus
gactccctcaacttgcggaaccgaa

SEQ ID NO: 647994 - DNA, 25 bp, Mus musculus
gactccctgcaacatcaaactatca

SEQ ID NO: 647995 - DNA, 25 bp, Mus musculus
gactccctgcaagatcaaactatca

SEQ ID NO: 647996 - DNA, 25 bp, Mus musculus
gactccctggagcttttccgtggta

SEQ ID NO: 647997 - DNA, 25 bp, Mus musculus
gactccctggaggttttccgtggta

SEQ ID NO: 647998 - DNA, 25 bp, Mus musculus
gactccctgggcagtgatcgattag

SEQ ID NO: 647999 - DNA, 25 bp, Mus musculus
gactccctgggctgtgatcgattag

SEQ ID NO: 648000 - DNA, 25 bp, Mus musculus
gactccgaatccaagccagaagttt

SEQ ID NO: 648001 - DNA, 25 bp, Mus musculus
gactccgaatcctagccagaagttt

SEQ ID NO: 648002 - DNA, 25 bp, Mus musculus
gactccgaggacctgttcatttttg

SEQ ID NO: 648003 - DNA, 25 bp, Mus musculus
gactccgaggacgtgttcatttttg

SEQ ID NO: 648004 - DNA, 25 bp, Mus musculus
gactccgcaaagagagacaaaacca

SEQ ID NO: 648005 - DNA, 25 bp, Mus musculus
gactccgcaaagtgagacaaaacca

SEQ ID NO: 648006 - DNA, 25 bp, Mus musculus
gactccgcctttcaggatccgcaga

SEQ ID NO: 648007 - DNA, 25 bp, Mus musculus
gactccgcctttgaggatccgcaga

SEQ ID NO: 648008 - DNA, 25 bp, Mus musculus
gactccgctatgagcatcatgactg

SEQ ID NO: 648009 - DNA, 25 bp, Mus musculus
gactccgctatgtgcatcatgactg

SEQ ID NO: 648010 - DNA, 25 bp, Mus musculus
gactccgctgtcaccgtggccgtgg

SEQ ID NO: 648011 - DNA, 25 bp, Mus musculus
gactccgctgtctccgtggccgtgg

SEQ ID NO: 648012 - DNA, 25 bp, Mus musculus
gactccggacagaggtacatcaccg

SEQ ID NO: 648013 - DNA, 25 bp, Mus musculus
gactccggacagtggtacatcaccg

SEQ ID NO: 648014 - DNA, 25 bp, Mus musculus
gactccgggttaaaaggagccgagt

SEQ ID NO: 648015 - DNA, 25 bp, Mus musculus
gactccgggttataaggagccgagt

SEQ ID NO: 648016 - DNA, 25 bp, Mus musculus
gactccggtatcaatcagtgtgtta

SEQ ID NO: 648017 - DNA, 25 bp, Mus musculus
gactccggtatctatcagtgtgtta

SEQ ID NO: 648018 - DNA, 25 bp, Mus musculus
gactccgtgcaaaagatgcaagaag

SEQ ID NO: 648019 - DNA, 25 bp, Mus musculus
gactccgtgcaatagatgcaagaag

SEQ ID NO: 648020 - DNA, 25 bp, Mus musculus
gactccgtgcggacaaaaatgctat

SEQ ID NO: 648021 - DNA, 25 bp, Mus musculus
gactccgtgcggtcaaaaatgctat

SEQ ID NO: 648022 - DNA, 25 bp, Mus musculus
gactccgttcaacgataccaacgtg

SEQ ID NO: 648023 - DNA, 25 bp, Mus musculus
gactccgttcaaggataccaacgtg

SEQ ID NO: 648024 - DNA, 25 bp, Mus musculus
gactcctaaggtcacgtgtgttgtg

SEQ ID NO: 648025 - DNA, 25 bp, Mus musculus
gactcctaaggtgacgtgtgttgtg

SEQ ID NO: 648026 - DNA, 25 bp, Mus musculus
gactcctacagaatgatccagtttc

SEQ ID NO: 648027 - DNA, 25 bp, Mus musculus
gactcctacagattgatccagtttc

SEQ ID NO: 648028 - DNA, 25 bp, Mus musculus
gactcctaccaaatcttccgagatg

SEQ ID NO: 648029 - DNA, 25 bp, Mus musculus
gactcctaccaattcttccgagatg

SEQ ID NO: 648030 - DNA, 25 bp, Mus musculus
gactcctaccggaaacaggtggtca

SEQ ID NO: 648031 - DNA, 25 bp, Mus musculus
gactcctaccggtaacaggtggtca

SEQ ID NO: 648032 - DNA, 25 bp, Mus musculus
gactcctacggcagtgatctggtgg

SEQ ID NO: 648033 - DNA, 25 bp, Mus musculus
gactcctacggctgtgatctggtgg

SEQ ID NO: 648034 - DNA, 25 bp, Mus musculus
gactcctatctgaatgccaacccag

SEQ ID NO: 648035 - DNA, 25 bp, Mus musculus
gactcctatctgtatgccaacccag

SEQ ID NO: 648036 - DNA, 25 bp, Mus musculus
gactcctcaaccctagctgcggagg

SEQ ID NO: 648037 - DNA, 25 bp, Mus musculus
gactcctcaaccgtagctgcggagg

SEQ ID NO: 648038 - DNA, 25 bp, Mus musculus
gactcctcagaactaagacctggaa

SEQ ID NO: 648039 - DNA, 25 bp, Mus musculus
gactcctcagaagtaagacctggaa

SEQ ID NO: 648040 - DNA, 25 bp, Mus musculus
gactcctccaagcaaagtgaataat

SEQ ID NO: 648041 - DNA, 25 bp, Mus musculus
gactcctccaaggaaagtgaataat

SEQ ID NO: 648042 - DNA, 25 bp, Mus musculus
gactcctcgcaactgatgaggcgaa

SEQ ID NO: 648043 - DNA, 25 bp, Mus musculus
gactcctcgcaagtgatgaggcgaa

SEQ ID NO: 648044 - DNA, 25 bp, Mus musculus
gactcctctcggaggagtctccggg

SEQ ID NO: 648045 - DNA, 25 bp, Mus musculus
gactcctctcggtggagtctccggg

SEQ ID NO: 648046 - DNA, 25 bp, Mus musculus
gactcctctctccagctggagctga

SEQ ID NO: 648047 - DNA, 25 bp, Mus musculus
gactcctctctcgagctggagctga

SEQ ID NO: 648048 - DNA, 25 bp, Mus musculus
gactcctctcttatccttgtatgcc

SEQ ID NO: 648049 - DNA, 25 bp, Mus musculus
gactcctctcttttccttgtatgcc

SEQ ID NO: 648050 - DNA, 25 bp, Mus musculus
gactcctctgggacttgagctaaaa

SEQ ID NO: 648051 - DNA, 25 bp, Mus musculus
gactcctctgggtcttgagctaaaa

SEQ ID NO: 648052 - DNA, 25 bp, Mus musculus
gactcctgaaccagggcctctcggt

SEQ ID NO: 648053 - DNA, 25 bp, Mus musculus
gactcctgaacctgggcctctcggt

SEQ ID NO: 648054 - DNA, 25 bp, Mus musculus
gactcctgaagccatgcgctgcggt

SEQ ID NO: 648055 - DNA, 25 bp, Mus musculus
gactcctgaagcgatgcgctgcggt

SEQ ID NO: 648056 - DNA, 25 bp, Mus musculus
gactcctgatgaccctcaagggact

SEQ ID NO: 648057 - DNA, 25 bp, Mus musculus
gactcctgatgagcctcaagggact

SEQ ID NO: 648058 - DNA, 25 bp, Mus musculus
gactcctgcattcatagcctccaag

SEQ ID NO: 648059 - DNA, 25 bp, Mus musculus
gactcctgcattgatagcctccaag

SEQ ID NO: 648060 - DNA, 25 bp, Mus musculus
gactcctgccggagcggaccctgag

SEQ ID NO: 648061 - DNA, 25 bp, Mus musculus
gactcctgccggtgcggaccctgag

SEQ ID NO: 648062 - DNA, 25 bp, Mus musculus
gactcctgctgtcactagagtatga

SEQ ID NO: 648063 - DNA, 25 bp, Mus musculus
gactcctgctgtgactagagtatga

SEQ ID NO: 648064 - DNA, 25 bp, Mus musculus
gactcctggccgaattctagccctg

SEQ ID NO: 648065 - DNA, 25 bp, Mus musculus
gactcctggccgtattctagccctg

SEQ ID NO: 648066 - DNA, 25 bp, Mus musculus
gactcctgggtcagcattcctgagc

SEQ ID NO: 648067 - DNA, 25 bp, Mus musculus
gactcctgggtctgcattcctgagc

SEQ ID NO: 648068 - DNA, 25 bp, Mus musculus
gactcctggtgtcaaacagaagatt

SEQ ID NO: 648069 - DNA, 25 bp, Mus musculus
gactcctggtgtgaaacagaagatt

SEQ ID NO: 648070 - DNA, 25 bp, Mus musculus
gactcctggttacgaactgcgctca

SEQ ID NO: 648071 - DNA, 25 bp, Mus musculus
gactcctggttaggaactgcgctca

SEQ ID NO: 648072 - DNA, 25 bp, Mus musculus
gactcctgtagacgtgttccagaac

SEQ ID NO: 648073 - DNA, 25 bp, Mus musculus
gactcctgtagaggtgttccagaac

SEQ ID NO: 648074 - DNA, 25 bp, Mus musculus
gactcctgtcgtacagaaatattgg

SEQ ID NO: 648075 - DNA, 25 bp, Mus musculus
gactcctgtcgttcagaaatattgg

SEQ ID NO: 648076 - DNA, 25 bp, Mus musculus
gactccttatgacccaaggcatcgg

SEQ ID NO: 648077 - DNA, 25 bp, Mus musculus
gactccttatgagccaaggcatcgg

SEQ ID NO: 648078 - DNA, 25 bp, Mus musculus
gactccttcagacccagagagagct

SEQ ID NO: 648079 - DNA, 25 bp, Mus musculus
gactccttcagagccagagagagct

SEQ ID NO: 648080 - DNA, 25 bp, Mus musculus
gactccttccacagagcatgacaag

SEQ ID NO: 648081 - DNA, 25 bp, Mus musculus
gactccttccactgagcatgacaag

SEQ ID NO: 648082 - DNA, 25 bp, Mus musculus
gactccttcgtcatgtctggtctgt

SEQ ID NO: 648083 - DNA, 25 bp, Mus musculus
gactccttcgtcttgtctggtctgt

SEQ ID NO: 648084 - DNA, 25 bp, Mus musculus
gactccttggagagtgtatcacctc

SEQ ID NO: 648085 - DNA, 25 bp, Mus musculus
gactccttggagtgtgtatcacctc

SEQ ID NO: 648086 - DNA, 25 bp, Mus musculus
gactccttggcgcttggtgcttcaa

SEQ ID NO: 648087 - DNA, 25 bp, Mus musculus
gactccttggcggttggtgcttcaa

SEQ ID NO: 648088 - DNA, 25 bp, Mus musculus
gactccttgtataaagacttcgatg

SEQ ID NO: 648089 - DNA, 25 bp, Mus musculus
gactccttgtattaagacttcgatg

SEQ ID NO: 648090 - DNA, 25 bp, Mus musculus
gactccttgtgcagtcactatgcca

SEQ ID NO: 648091 - DNA, 25 bp, Mus musculus
gactccttgtgctgtcactatgcca

SEQ ID NO: 648092 - DNA, 25 bp, Mus musculus
gactcctttcttccttgttgggacc

SEQ ID NO: 648093 - DNA, 25 bp, Mus musculus
gactcctttcttgcttgttgggacc

SEQ ID NO: 648094 - DNA, 25 bp, Mus musculus
gactcgaagacacggctgtatgaac

SEQ ID NO: 648095 - DNA, 25 bp, Mus musculus
gactcgaagacagggctgtatgaac

SEQ ID NO: 648096 - DNA, 25 bp, Mus musculus
gactcgaattctcaagaggtcagca

SEQ ID NO: 648097 - DNA, 25 bp, Mus musculus
gactcgaattctgaagaggtcagca

SEQ ID NO: 648098 - DNA, 25 bp, Mus musculus
gactcgaccaagatctcggtcacga

SEQ ID NO: 648099 - DNA, 25 bp, Mus musculus
gactcgaccaagttctcggtcacga

SEQ ID NO: 648100 - DNA, 25 bp, Mus musculus
gactcgacgtccaacaacaacacgg

SEQ ID NO: 648101 - DNA, 25 bp, Mus musculus
gactcgacgtcctacaacaacacgg

SEQ ID NO: 648102 - DNA, 25 bp, Mus musculus
gactcgacttctatcctgtttacag

SEQ ID NO: 648103 - DNA, 25 bp, Mus musculus
gactcgacttctttcctgtttacag

SEQ ID NO: 648104 - DNA, 25 bp, Mus musculus
gactcgagatggacagaaccttgga

SEQ ID NO: 648105 - DNA, 25 bp, Mus musculus
gactcgagatggtcagaaccttgga

SEQ ID NO: 648106 - DNA, 25 bp, Mus musculus
gactcgagctgacagacagcagccc

SEQ ID NO: 648107 - DNA, 25 bp, Mus musculus
gactcgagctgagagacagcagccc

SEQ ID NO: 648108 - DNA, 25 bp, Mus musculus
gactcgaggagcacgggtcctacct

SEQ ID NO: 648109 - DNA, 25 bp, Mus musculus
gactcgaggagctcgggtcctacct

SEQ ID NO: 648110 - DNA, 25 bp, Mus musculus
gactcgatctttctttcctccatgg

SEQ ID NO: 648111 - DNA, 25 bp, Mus musculus
gactcgatctttgtttcctccatgg

SEQ ID NO: 648112 - DNA, 25 bp, Mus musculus
gactcgattctgagaagtagcctat

SEQ ID NO: 648113 - DNA, 25 bp, Mus musculus
gactcgattctgtgaagtagcctat

SEQ ID NO: 648114 - DNA, 25 bp, Mus musculus
gactcgccaactaagaaatctatga

SEQ ID NO: 648115 - DNA, 25 bp, Mus musculus
gactcgccaacttagaaatctatga

SEQ ID NO: 648116 - DNA, 25 bp, Mus musculus
gactcgcccggaccgaatggataag

SEQ ID NO: 648117 - DNA, 25 bp, Mus musculus
gactcgcccggagcgaatggataag

SEQ ID NO: 648118 - DNA, 25 bp, Mus musculus
gactcgccgcctatgttcgcaggtg

SEQ ID NO: 648119 - DNA, 25 bp, Mus musculus
gactcgccgcctttgttcgcaggtg

SEQ ID NO: 648120 - DNA, 25 bp, Mus musculus
gactcgcgatttcaaacctggagac

SEQ ID NO: 648121 - DNA, 25 bp, Mus musculus
gactcgcgatttgaaacctggagac

SEQ ID NO: 648122 - DNA, 25 bp, Mus musculus
gactcgctactacagagcaccagag

SEQ ID NO: 648123 - DNA, 25 bp, Mus musculus
gactcgctactagagagcaccagag

SEQ ID NO: 648124 - DNA, 25 bp, Mus musculus
gactcgctgaatctgtaaacagcac

SEQ ID NO: 648125 - DNA, 25 bp, Mus musculus
gactcgctgaatgtgtaaacagcac

SEQ ID NO: 648126 - DNA, 25 bp, Mus musculus
gactcgctgctcaaaagtttgaggg

SEQ ID NO: 648127 - DNA, 25 bp, Mus musculus
gactcgctgctctaaagtttgaggg

SEQ ID NO: 648128 - DNA, 25 bp, Mus musculus
gactcgctgctgcacaaccgattga

SEQ ID NO: 648129 - DNA, 25 bp, Mus musculus
gactcgctgctggacaaccgattga

SEQ ID NO: 648130 - DNA, 25 bp, Mus musculus
gactcgcttcccaccctgggagatg

SEQ ID NO: 648131 - DNA, 25 bp, Mus musculus
gactcgcttccctccctgggagatg

SEQ ID NO: 648132 - DNA, 25 bp, Mus musculus
gactcgcttggaccacaaccgagca

SEQ ID NO: 648133 - DNA, 25 bp, Mus musculus
gactcgcttggagcacaaccgagca

SEQ ID NO: 648134 - DNA, 25 bp, Mus musculus
gactcggaaaggaggatcgcaaatt

SEQ ID NO: 648135 - DNA, 25 bp, Mus musculus
gactcggaaaggtggatcgcaaatt

SEQ ID NO: 648136 - DNA, 25 bp, Mus musculus
gactcggacgagagaaactagaaga

SEQ ID NO: 648137 - DNA, 25 bp, Mus musculus
gactcggacgagtgaaactagaaga

SEQ ID NO: 648138 - DNA, 25 bp, Mus musculus
gactcggactcgcagctcgagcagt

SEQ ID NO: 648139 - DNA, 25 bp, Mus musculus
gactcggactcggagctcgagcagt

SEQ ID NO: 648140 - DNA, 25 bp, Mus musculus
gactcggagccgacatggaggatct

SEQ ID NO: 648141 - DNA, 25 bp, Mus musculus
gactcggagccgtcatggaggatct

SEQ ID NO: 648142 - DNA, 25 bp, Mus musculus
gactcggataacatagatagcacag

SEQ ID NO: 648143 - DNA, 25 bp, Mus musculus
gactcggataacttagatagcacag

SEQ ID NO: 648144 - DNA, 25 bp, Mus musculus
gactcggattatagctggacatttt

SEQ ID NO: 648145 - DNA, 25 bp, Mus musculus
gactcggattattgctggacatttt

SEQ ID NO: 648146 - DNA, 25 bp, Mus musculus
gactcggattcccacatgacggtcg

SEQ ID NO: 648147 - DNA, 25 bp, Mus musculus
gactcggattccgacatgacggtcg

SEQ ID NO: 648148 - DNA, 25 bp, Mus musculus
gactcggcacaacaatctagacctg

SEQ ID NO: 648149 - DNA, 25 bp, Mus musculus
gactcggcacaagaatctagacctg

SEQ ID NO: 648150 - DNA, 25 bp, Mus musculus
gactcgggacccatctatgacaaaa

SEQ ID NO: 648151 - DNA, 25 bp, Mus musculus
gactcgggacccttctatgacaaaa

SEQ ID NO: 648152 - DNA, 25 bp, Mus musculus
gactcgggcagtaccgcaacgaggt

SEQ ID NO: 648153 - DNA, 25 bp, Mus musculus
gactcgggcagttccgcaacgaggt

SEQ ID NO: 648154 - DNA, 25 bp, Mus musculus
gactcgggcctacaatggacagcca

SEQ ID NO: 648155 - DNA, 25 bp, Mus musculus
gactcgggcctagaatggacagcca

SEQ ID NO: 648156 - DNA, 25 bp, Mus musculus
gactcgggtcagcttcttcaaacta

SEQ ID NO: 648157 - DNA, 25 bp, Mus musculus
gactcgggtcaggttcttcaaacta

SEQ ID NO: 648158 - DNA, 25 bp, Mus musculus
gactcggtctgcagtactcccaggg

SEQ ID NO: 648159 - DNA, 25 bp, Mus musculus
gactcggtctgctgtactcccaggg

SEQ ID NO: 648160 - DNA, 25 bp, Mus musculus
gactcggtgactccctgaggagcat

SEQ ID NO: 648161 - DNA, 25 bp, Mus musculus
gactcggtgactcttcgggattata

SEQ ID NO: 648162 - DNA, 25 bp, Mus musculus
gactcggtgactgcctgaggagcat

SEQ ID NO: 648163 - DNA, 25 bp, Mus musculus
gactcggtgactgttcgggattata

SEQ ID NO: 648164 - DNA, 25 bp, Mus musculus
gactcggtgcggctgctggcagtgg

SEQ ID NO: 648165 - DNA, 25 bp, Mus musculus
gactcggtgcgggtgctggcagtgg

SEQ ID NO: 648166 - DNA, 25 bp, Mus musculus
gactcggtggtcatggttactcagg

SEQ ID NO: 648167 - DNA, 25 bp, Mus musculus
gactcggtggtcttggttactcagg

SEQ ID NO: 648168 - DNA, 25 bp, Mus musculus
gactcgtagcccaatcatgcagggt

SEQ ID NO: 648169 - DNA, 25 bp, Mus musculus
gactcgtagccctatcatgcagggt

SEQ ID NO: 648170 - DNA, 25 bp, Mus musculus
gactcgtatagtcacaattcaagga

SEQ ID NO: 648171 - DNA, 25 bp, Mus musculus
gactcgtatagtgacaattcaagga

SEQ ID NO: 648172 - DNA, 25 bp, Mus musculus
gactcgtatcagcactatttctacg

SEQ ID NO: 648173 - DNA, 25 bp, Mus musculus
gactcgtatcaggactatttctacg

SEQ ID NO: 648174 - DNA, 25 bp, Mus musculus
gactcgtcgggaagcatgtacatgc

SEQ ID NO: 648175 - DNA, 25 bp, Mus musculus
gactcgtcgggatgcatgtacatgc

SEQ ID NO: 648176 - DNA, 25 bp, Mus musculus
gactcgtgagatataccagccctgt

SEQ ID NO: 648177 - DNA, 25 bp, Mus musculus
gactcgtgagatttaccagccctgt

SEQ ID NO: 648178 - DNA, 25 bp, Mus musculus
gactcgtggctccaaatttgttaaa

SEQ ID NO: 648179 - DNA, 25 bp, Mus musculus
gactcgtggctcgaaatttgttaaa

SEQ ID NO: 648180 - DNA, 25 bp, Mus musculus
gactcgtggtgcaaagacaacagct

SEQ ID NO: 648181 - DNA, 25 bp, Mus musculus
gactcgtggtgctaagacaacagct

SEQ ID NO: 648182 - DNA, 25 bp, Mus musculus
gactcgtgtgggaggagaataagaa

SEQ ID NO: 648183 - DNA, 25 bp, Mus musculus
gactcgtgtgggtggagaataagaa

SEQ ID NO: 648184 - DNA, 25 bp, Mus musculus
gactcgtgtgtaatgtgtgccacca

SEQ ID NO: 648185 - DNA, 25 bp, Mus musculus
gactcgtgtgtattgtgtgccacca

SEQ ID NO: 648186 - DNA, 25 bp, Mus musculus
gactcgtgttcgctctcagggattt

SEQ ID NO: 648187 - DNA, 25 bp, Mus musculus
gactcgtgttcggtctcagggattt

SEQ ID NO: 648188 - DNA, 25 bp, Mus musculus
gactcgttaatgatgcagtatttaa

SEQ ID NO: 648189 - DNA, 25 bp, Mus musculus
gactcgttaatgttgcagtatttaa

SEQ ID NO: 648190 - DNA, 25 bp, Mus musculus
gactctaaaactcttggccagtatg

SEQ ID NO: 648191 - DNA, 25 bp, Mus musculus
gactctaaaactgttggccagtatg

SEQ ID NO: 648192 - DNA, 25 bp, Mus musculus
gactctaaacaaaggccaggcctcc

SEQ ID NO: 648193 - DNA, 25 bp, Mus musculus
gactctaaacaatggccaggcctcc

SEQ ID NO: 648194 - DNA, 25 bp, Mus musculus
gactctaaagatcagattccgcctg

SEQ ID NO: 648195 - DNA, 25 bp, Mus musculus
gactctaaagatgagattccgcctg

SEQ ID NO: 648196 - DNA, 25 bp, Mus musculus
gactctaacgccctccaagaattgg

SEQ ID NO: 648197 - DNA, 25 bp, Mus musculus
gactctaacgccgtccaagaattgg

SEQ ID NO: 648198 - DNA, 25 bp, Mus musculus
gactctaagagaccctttgagcttc

SEQ ID NO: 648199 - DNA, 25 bp, Mus musculus
gactctaagagagcctttgagcttc

SEQ ID NO: 648200 - DNA, 25 bp, Mus musculus
gactctaagggtcccaccggaccag

SEQ ID NO: 648201 - DNA, 25 bp, Mus musculus
gactctaagggtgccaccggaccag

SEQ ID NO: 648202 - DNA, 25 bp, Mus musculus
gactctaatgagctgaccaggacca

SEQ ID NO: 648203 - DNA, 25 bp, Mus musculus
gactctaatgaggtgaccaggacca

SEQ ID NO: 648204 - DNA, 25 bp, Mus musculus
gactctacacatcacatgtggtgta

SEQ ID NO: 648205 - DNA, 25 bp, Mus musculus
gactctacacatgacatgtggtgta

SEQ ID NO: 648206 - DNA, 25 bp, Mus musculus
gactctacatagacaaatctctgaa

SEQ ID NO: 648207 - DNA, 25 bp, Mus musculus
gactctacatagtcaaatctctgaa

SEQ ID NO: 648208 - DNA, 25 bp, Mus musculus
gactctacctatatgcaatcctcac

SEQ ID NO: 648209 - DNA, 25 bp, Mus musculus
gactctacctatttgcaatcctcac

SEQ ID NO: 648210 - DNA, 25 bp, Mus musculus
gactctactggaatttggtgcaagc

SEQ ID NO: 648211 - DNA, 25 bp, Mus musculus
gactctactggaccctagtgcaaag

SEQ ID NO: 648212 - DNA, 25 bp, Mus musculus
gactctactggagcctagtgcaaag

SEQ ID NO: 648213 - DNA, 25 bp, Mus musculus
gactctactggattttggtgcaagc

SEQ ID NO: 648214 - DNA, 25 bp, Mus musculus
gactctacttatccaggctctgcag

SEQ ID NO: 648215 - DNA, 25 bp, Mus musculus
gactctacttatgcaggctctgcag

SEQ ID NO: 648216 - DNA, 25 bp, Mus musculus
gactctactttccaggacaatcctg

SEQ ID NO: 648217 - DNA, 25 bp, Mus musculus
gactctactttcgaggacaatcctg

SEQ ID NO: 648218 - DNA, 25 bp, Mus musculus
gactctagaaagcaggccatgtgac

SEQ ID NO: 648219 - DNA, 25 bp, Mus musculus
gactctagaaaggaggccatgtgac

SEQ ID NO: 648220 - DNA, 25 bp, Mus musculus
gactctagcaagactgttgtggatg

SEQ ID NO: 648221 - DNA, 25 bp, Mus musculus
gactctagcaagtctgttgtggatg

SEQ ID NO: 648222 - DNA, 25 bp, Mus musculus
gactctatgaagacagtgccaccaa

SEQ ID NO: 648223 - DNA, 25 bp, Mus musculus
gactctatgaagtcagtgccaccaa

SEQ ID NO: 648224 - DNA, 25 bp, Mus musculus
gactctatggaccaggaagccttcc

SEQ ID NO: 648225 - DNA, 25 bp, Mus musculus
gactctatggacgaggaagccttcc

SEQ ID NO: 648226 - DNA, 25 bp, Mus musculus
gactctcacaacagacagggtctgg

SEQ ID NO: 648227 - DNA, 25 bp, Mus musculus
gactctcacaactgacagggtctgg

SEQ ID NO: 648228 - DNA, 25 bp, Mus musculus
gactctcactgaaagcgatttgaag

SEQ ID NO: 648229 - DNA, 25 bp, Mus musculus
gactctcactgatagcgatttgaag

SEQ ID NO: 648230 - DNA, 25 bp, Mus musculus
gactctcagaagatctgggattgaa

SEQ ID NO: 648231 - DNA, 25 bp, Mus musculus
gactctcagaagttctgggattgaa

SEQ ID NO: 648232 - DNA, 25 bp, Mus musculus
gactctcagccaaactaaacagaag

SEQ ID NO: 648233 - DNA, 25 bp, Mus musculus
gactctcagccatactaaacagaag

SEQ ID NO: 648234 - DNA, 25 bp, Mus musculus
gactctcagtagcatcacaagccaa

SEQ ID NO: 648235 - DNA, 25 bp, Mus musculus
gactctcagtaggatcacaagccaa

SEQ ID NO: 648236 - DNA, 25 bp, Mus musculus
gactctcagtgtcctggcctgccgg

SEQ ID NO: 648237 - DNA, 25 bp, Mus musculus
gactctcagtgtgctggcctgccgg

SEQ ID NO: 648238 - DNA, 25 bp, Mus musculus
gactctcatggtatatgatccatct

SEQ ID NO: 648239 - DNA, 25 bp, Mus musculus
gactctcatggtttatgatccatct

SEQ ID NO: 648240 - DNA, 25 bp, Mus musculus
gactctccacttatgatctgaacca

SEQ ID NO: 648241 - DNA, 25 bp, Mus musculus
gactctccacttttgatctgaacca

SEQ ID NO: 648242 - DNA, 25 bp, Mus musculus
gactctccagaactcgattctaaag

SEQ ID NO: 648243 - DNA, 25 bp, Mus musculus
gactctccagaagtcgattctaaag

SEQ ID NO: 648244 - DNA, 25 bp, Mus musculus
gactctccgcaacaaacccagataa

SEQ ID NO: 648245 - DNA, 25 bp, Mus musculus
gactctccgcaagaaacccagataa

SEQ ID NO: 648246 - DNA, 25 bp, Mus musculus
gactctcctgagctgtgatttgagg

SEQ ID NO: 648247 - DNA, 25 bp, Mus musculus
gactctcctgaggtgtgatttgagg

SEQ ID NO: 648248 - DNA, 25 bp, Mus musculus
gactctcgccagatagaccatatca

SEQ ID NO: 648249 - DNA, 25 bp, Mus musculus
gactctcgccagttagaccatatca

SEQ ID NO: 648250 - DNA, 25 bp, Mus musculus
gactctcggcccaaactacctcaga

SEQ ID NO: 648251 - DNA, 25 bp, Mus musculus
gactctcggccctaactacctcaga

SEQ ID NO: 648252 - DNA, 25 bp, Mus musculus
gactctcgggagcactgaattttgg

SEQ ID NO: 648253 - DNA, 25 bp, Mus musculus
gactctcgggaggactgaattttgg

SEQ ID NO: 648254 - DNA, 25 bp, Mus musculus
gactctcggtgcaaactaaggtttg

SEQ ID NO: 648255 - DNA, 25 bp, Mus musculus
gactctcggtgctaactaaggtttg

SEQ ID NO: 648256 - DNA, 25 bp, Mus musculus
gactctctgtctccggacacttgtg

SEQ ID NO: 648257 - DNA, 25 bp, Mus musculus
gactctctgtctgcggacacttgtg

SEQ ID NO: 648258 - DNA, 25 bp, Mus musculus
gactctcttaccagctggtcactgc

SEQ ID NO: 648259 - DNA, 25 bp, Mus musculus
gactctcttacctgctggtcactgc

SEQ ID NO: 648260 - DNA, 25 bp, Mus musculus
gactctcttcttcactaggtacctg

SEQ ID NO: 648261 - DNA, 25 bp, Mus musculus
gactctcttcttgactaggtacctg

SEQ ID NO: 648262 - DNA, 25 bp, Mus musculus
gactctgaaactccaggagctgcct

SEQ ID NO: 648263 - DNA, 25 bp, Mus musculus
gactctgaaactgcaggagctgcct

SEQ ID NO: 648264 - DNA, 25 bp, Mus musculus
gactctgaaatccagtcccgatgaa

SEQ ID NO: 648265 - DNA, 25 bp, Mus musculus
gactctgaaatcgagtcccgatgaa

SEQ ID NO: 648266 - DNA, 25 bp, Mus musculus
gactctgaacaaagtggaagtctgc

SEQ ID NO: 648267 - DNA, 25 bp, Mus musculus
gactctgaacaatgtggaagtctgc

SEQ ID NO: 648268 - DNA, 25 bp, Mus musculus
gactctgaaggaagaacgaaatgga

SEQ ID NO: 648269 - DNA, 25 bp, Mus musculus
gactctgaaggatgaacgaaatgga

SEQ ID NO: 648270 - DNA, 25 bp, Mus musculus
gactctgaattgacctccaagctga

SEQ ID NO: 648271 - DNA, 25 bp, Mus musculus
gactctgaattgtcctccaagctga

SEQ ID NO: 648272 - DNA, 25 bp, Mus musculus
gactctgacaccctcaggcagacat

SEQ ID NO: 648273 - DNA, 25 bp, Mus musculus
gactctgacaccgtcaggcagacat

SEQ ID NO: 648274 - DNA, 25 bp, Mus musculus
gactctgacattcagtggctgcaga

SEQ ID NO: 648275 - DNA, 25 bp, Mus musculus
gactctgacattgagtggctgcaga

SEQ ID NO: 648276 - DNA, 25 bp, Mus musculus
gactctgaccctctgaaagcctgga

SEQ ID NO: 648277 - DNA, 25 bp, Mus musculus
gactctgaccctgtgaaagcctgga

SEQ ID NO: 648278 - DNA, 25 bp, Mus musculus
gactctgaccgtccttctctgcgtg

SEQ ID NO: 648279 - DNA, 25 bp, Mus musculus
gactctgaccgtgcttctctgcgtg

SEQ ID NO: 648280 - DNA, 25 bp, Mus musculus
gactctgacctgattgggcaaactg

SEQ ID NO: 648281 - DNA, 25 bp, Mus musculus
gactctgacctgtttgggcaaactg

SEQ ID NO: 648282 - DNA, 25 bp, Mus musculus
gactctgacgccagagttcctggca

SEQ ID NO: 648283 - DNA, 25 bp, Mus musculus
gactctgacgcctgagttcctggca

SEQ ID NO: 648284 - DNA, 25 bp, Mus musculus
gactctgactctcgacaaagggaca

SEQ ID NO: 648285 - DNA, 25 bp, Mus musculus
gactctgactctggacaaagggaca

SEQ ID NO: 648286 - DNA, 25 bp, Mus musculus
gactctgactggaaactcctggact

SEQ ID NO: 648287 - DNA, 25 bp, Mus musculus
gactctgactggtaactcctggact

SEQ ID NO: 648288 - DNA, 25 bp, Mus musculus
gactctgagaatagcagccttcaac

SEQ ID NO: 648289 - DNA, 25 bp, Mus musculus
gactctgagaatatcgctgctattc

SEQ ID NO: 648290 - DNA, 25 bp, Mus musculus
gactctgagaattgcagccttcaac

SEQ ID NO: 648291 - DNA, 25 bp, Mus musculus
gactctgagaatttcgctgctattc

SEQ ID NO: 648292 - DNA, 25 bp, Mus musculus
gactctgagagtcaagacgaggaaa

SEQ ID NO: 648293 - DNA, 25 bp, Mus musculus
gactctgagagtgaagacgaggaaa

SEQ ID NO: 648294 - DNA, 25 bp, Mus musculus
gactctgagatgcagatgccttacc

SEQ ID NO: 648295 - DNA, 25 bp, Mus musculus
gactctgagatggagatgccttacc

SEQ ID NO: 648296 - DNA, 25 bp, Mus musculus
gactctgagattatagacccaagcc

SEQ ID NO: 648297 - DNA, 25 bp, Mus musculus
gactctgagattttagacccaagcc

SEQ ID NO: 648298 - DNA, 25 bp, Mus musculus
gactctgagcaacgatgatgtgaac

SEQ ID NO: 648299 - DNA, 25 bp, Mus musculus
gactctgagcaaggatgatgtgaac

SEQ ID NO: 648300 - DNA, 25 bp, Mus musculus
gactctgagcagcttcacaaagggt

SEQ ID NO: 648301 - DNA, 25 bp, Mus musculus
gactctgagcaggttcacaaagggt

SEQ ID NO: 648302 - DNA, 25 bp, Mus musculus
gactctgaggacaccccaactattg

SEQ ID NO: 648303 - DNA, 25 bp, Mus musculus
gactctgaggactccccaactattg

SEQ ID NO: 648304 - DNA, 25 bp, Mus musculus
gactctgaggccaggagtgcccact

SEQ ID NO: 648305 - DNA, 25 bp, Mus musculus
gactctgaggcctggagtgcccact

SEQ ID NO: 648306 - DNA, 25 bp, Mus musculus
gactctgaggtgctcacccagggca

SEQ ID NO: 648307 - DNA, 25 bp, Mus musculus
gactctgaggtggtcacccagggca

SEQ ID NO: 648308 - DNA, 25 bp, Mus musculus
gactctgaggttctgcacgccatca

SEQ ID NO: 648309 - DNA, 25 bp, Mus musculus
gactctgaggttgtgcacgccatca

SEQ ID NO: 648310 - DNA, 25 bp, Mus musculus
gactctgatgacctgattagcatgg

SEQ ID NO: 648311 - DNA, 25 bp, Mus musculus
gactctgatgacgtgattagcatgg

SEQ ID NO: 648312 - DNA, 25 bp, Mus musculus
gactctgatgatctttgtcaccgtg

SEQ ID NO: 648313 - DNA, 25 bp, Mus musculus
gactctgatgatgtttgtcaccgtg

SEQ ID NO: 648314 - DNA, 25 bp, Mus musculus
gactctgattcacttggcgattcca

SEQ ID NO: 648315 - DNA, 25 bp, Mus musculus
gactctgattcagttggcgattcca

SEQ ID NO: 648316 - DNA, 25 bp, Mus musculus
gactctgcactacagcgggatacga

SEQ ID NO: 648317 - DNA, 25 bp, Mus musculus
gactctgcactagagcgggatacga

SEQ ID NO: 648318 - DNA, 25 bp, Mus musculus
gactctgcagcaccaactgtgggac

SEQ ID NO: 648319 - DNA, 25 bp, Mus musculus
gactctgcagcagcaactgtgggac

SEQ ID NO: 648320 - DNA, 25 bp, Mus musculus
gactctgcagctcttttttgacctg

SEQ ID NO: 648321 - DNA, 25 bp, Mus musculus
gactctgcagctgttttttgacctg

SEQ ID NO: 648322 - DNA, 25 bp, Mus musculus
gactctgcagttaacaagattcctt

SEQ ID NO: 648323 - DNA, 25 bp, Mus musculus
gactctgcagtttacaagattcctt

SEQ ID NO: 648324 - DNA, 25 bp, Mus musculus
gactctgccctccttctaggaactg

SEQ ID NO: 648325 - DNA, 25 bp, Mus musculus
gactctgccctcgttctaggaactg

SEQ ID NO: 648326 - DNA, 25 bp, Mus musculus
gactctgccgagctttctgacacgc

SEQ ID NO: 648327 - DNA, 25 bp, Mus musculus
gactctgccgaggtttctgacacgc

SEQ ID NO: 648328 - DNA, 25 bp, Mus musculus
gactctgccgtcctggacaaactag

SEQ ID NO: 648329 - DNA, 25 bp, Mus musculus
gactctgccgtcgtggacaaactag

SEQ ID NO: 648330 - DNA, 25 bp, Mus musculus
gactctgcctgaagaggctgccctt

SEQ ID NO: 648331 - DNA, 25 bp, Mus musculus
gactctgcctgatgaggctgccctt

SEQ ID NO: 648332 - DNA, 25 bp, Mus musculus
gactctgcggctatcttcagcacca

SEQ ID NO: 648333 - DNA, 25 bp, Mus musculus
gactctgcggctttcttcagcacca

SEQ ID NO: 648334 - DNA, 25 bp, Mus musculus
gactctgctaaacttaatggtgtgg

SEQ ID NO: 648335 - DNA, 25 bp, Mus musculus
gactctgctaaagttaatggtgtgg

SEQ ID NO: 648336 - DNA, 25 bp, Mus musculus
gactctgctaacatcatcaaatacg

SEQ ID NO: 648337 - DNA, 25 bp, Mus musculus
gactctgctaacttcatcaaatacg

SEQ ID NO: 648338 - DNA, 25 bp, Mus musculus
gactctgctacccaataccacgtta

SEQ ID NO: 648339 - DNA, 25 bp, Mus musculus
gactctgctaccgaataccacgtta

SEQ ID NO: 648340 - DNA, 25 bp, Mus musculus
gactctgctcctaactccggtttgg

SEQ ID NO: 648341 - DNA, 25 bp, Mus musculus
gactctgctccttactccggtttgg

SEQ ID NO: 648342 - DNA, 25 bp, Mus musculus
gactctgctgagctagcaatgccat

SEQ ID NO: 648343 - DNA, 25 bp, Mus musculus
gactctgctgaggtagcaatgccat

SEQ ID NO: 648344 - DNA, 25 bp, Mus musculus
gactctgctgcacccgtagtagttt

SEQ ID NO: 648345 - DNA, 25 bp, Mus musculus
gactctgctgcagccgtagtagttt

SEQ ID NO: 648346 - DNA, 25 bp, Mus musculus
gactctgcttttctgtgggtatcca

SEQ ID NO: 648347 - DNA, 25 bp, Mus musculus
gactctgcttttgtgtgggtatcca

SEQ ID NO: 648348 - DNA, 25 bp, Mus musculus
gactctggatacatgggtgtggatc

SEQ ID NO: 648349 - DNA, 25 bp, Mus musculus
gactctggatacttgggtgtggatc

SEQ ID NO: 648350 - DNA, 25 bp, Mus musculus
gactctggattcaccgacggcgggt

SEQ ID NO: 648351 - DNA, 25 bp, Mus musculus
gactctggattctccgacggcgggt

SEQ ID NO: 648352 - DNA, 25 bp, Mus musculus
gactctggcaccagtctggacaaga

SEQ ID NO: 648353 - DNA, 25 bp, Mus musculus
gactctggcacctgtctggacaaga

SEQ ID NO: 648354 - DNA, 25 bp, Mus musculus
gactctggcagcacgggactcagtg

SEQ ID NO: 648355 - DNA, 25 bp, Mus musculus
gactctggcagctcgggactcagtg

SEQ ID NO: 648356 - DNA, 25 bp, Mus musculus
gactctggcatccttgctgagactc

SEQ ID NO: 648357 - DNA, 25 bp, Mus musculus
gactctggcatcgttgctgagactc

SEQ ID NO: 648358 - DNA, 25 bp, Mus musculus
gactctggcctcaacgcttgcgtga

SEQ ID NO: 648359 - DNA, 25 bp, Mus musculus
gactctggcctctacgcttgcgtga

SEQ ID NO: 648360 - DNA, 25 bp, Mus musculus
gactctggcctgcatttattcggtg

SEQ ID NO: 648361 - DNA, 25 bp, Mus musculus
gactctggcctggatttattcggtg

SEQ ID NO: 648362 - DNA, 25 bp, Mus musculus
gactctggctacctttccctggcag

SEQ ID NO: 648363 - DNA, 25 bp, Mus musculus
gactctggctacgtttccctggcag

SEQ ID NO: 648364 - DNA, 25 bp, Mus musculus
gactctggctataattctatggacc

SEQ ID NO: 648365 - DNA, 25 bp, Mus musculus
gactctggctattattctatggacc

SEQ ID NO: 648366 - DNA, 25 bp, Mus musculus
gactctggctggcatcatgtacatc

SEQ ID NO: 648367 - DNA, 25 bp, Mus musculus
gactctggctgggatcatgtacatc

SEQ ID NO: 648368 - DNA, 25 bp, Mus musculus
gactctgggaatcagaccacagccc

SEQ ID NO: 648369 - DNA, 25 bp, Mus musculus
gactctgggaatgagaccacagccc

SEQ ID NO: 648370 - DNA, 25 bp, Mus musculus
gactctgggaggcaaaagtagccaa

SEQ ID NO: 648371 - DNA, 25 bp, Mus musculus
gactctgggagggaaaagtagccaa

SEQ ID NO: 648372 - DNA, 25 bp, Mus musculus
gactctgggctaatcgtgcctggga

SEQ ID NO: 648373 - DNA, 25 bp, Mus musculus
gactctgggctattcgtgcctggga

SEQ ID NO: 648374 - DNA, 25 bp, Mus musculus
gactctgggctgagtctactgtagc

SEQ ID NO: 648375 - DNA, 25 bp, Mus musculus
gactctgggctgtgtctactgtagc

SEQ ID NO: 648376 - DNA, 25 bp, Mus musculus
gactctgtaataaattgcttgctga

SEQ ID NO: 648377 - DNA, 25 bp, Mus musculus
gactctgtaatatattgcttgctga

SEQ ID NO: 648378 - DNA, 25 bp, Mus musculus
gactctgtagcgaaactctgggaga

SEQ ID NO: 648379 - DNA, 25 bp, Mus musculus
gactctgtagcgtaactctgggaga

SEQ ID NO: 648380 - DNA, 25 bp, Mus musculus
gactctgtagtgacctttaggcctt

SEQ ID NO: 648381 - DNA, 25 bp, Mus musculus
gactctgtagtgtcctttaggcctt

SEQ ID NO: 648382 - DNA, 25 bp, Mus musculus
gactctgtatttcgtttttgagact

SEQ ID NO: 648383 - DNA, 25 bp, Mus musculus
gactctgtatttggtttttgagact

SEQ ID NO: 648384 - DNA, 25 bp, Mus musculus
gactctgtcaagcactggtgcaact

SEQ ID NO: 648385 - DNA, 25 bp, Mus musculus
gactctgtcaaggactggtgcaact

SEQ ID NO: 648386 - DNA, 25 bp, Mus musculus
gactctgtcacacctaccttcagtg

SEQ ID NO: 648387 - DNA, 25 bp, Mus musculus
gactctgtcacagctaccttcagtg

SEQ ID NO: 648388 - DNA, 25 bp, Mus musculus
gactctgtcagtctgtttaacggag

SEQ ID NO: 648389 - DNA, 25 bp, Mus musculus
gactctgtcagtgtgtttaacggag

SEQ ID NO: 648390 - DNA, 25 bp, Mus musculus
gactctgtctacagaggctgctcct

SEQ ID NO: 648391 - DNA, 25 bp, Mus musculus
gactctgtctactgaggctgctcct

SEQ ID NO: 648392 - DNA, 25 bp, Mus musculus
gactctgtgaatccccgcccgggtg

SEQ ID NO: 648393 - DNA, 25 bp, Mus musculus
gactctgtgaatgcccgcccgggtg

SEQ ID NO: 648394 - DNA, 25 bp, Mus musculus
gactctgtggatcgatcagagaaaa

SEQ ID NO: 648395 - DNA, 25 bp, Mus musculus
gactctgtggatggatcagagaaaa

SEQ ID NO: 648396 - DNA, 25 bp, Mus musculus
gactctgtggtcagcctattggatg

SEQ ID NO: 648397 - DNA, 25 bp, Mus musculus
gactctgtggtctgcctattggatg

SEQ ID NO: 648398 - DNA, 25 bp, Mus musculus
gactctgtgtaaaatgtgacatccg

SEQ ID NO: 648399 - DNA, 25 bp, Mus musculus
gactctgtgtaatatgtgacatccg

SEQ ID NO: 648400 - DNA, 25 bp, Mus musculus
gactctgttagaatggcctgcctga

SEQ ID NO: 648401 - DNA, 25 bp, Mus musculus
gactctgttagattggcctgcctga

SEQ ID NO: 648402 - DNA, 25 bp, Mus musculus
gactctgttccgcaagacaacatct

SEQ ID NO: 648403 - DNA, 25 bp, Mus musculus
gactctgttccggaagacaacatct

SEQ ID NO: 648404 - DNA, 25 bp, Mus musculus
gactctgtttccaggccaaggcaac

SEQ ID NO: 648405 - DNA, 25 bp, Mus musculus
gactctgtttccatgtcagcccaag

SEQ ID NO: 648406 - DNA, 25 bp, Mus musculus
gactctgtttcctggccaaggcaac

SEQ ID NO: 648407 - DNA, 25 bp, Mus musculus
gactctgtttccttgtcagcccaag

SEQ ID NO: 648408 - DNA, 25 bp, Mus musculus
gactcttacatacacgggcgcatcg

SEQ ID NO: 648409 - DNA, 25 bp, Mus musculus
gactcttacatagacgggcgcatcg

SEQ ID NO: 648410 - DNA, 25 bp, Mus musculus
gactcttagacaaggagttggaaat

SEQ ID NO: 648411 - DNA, 25 bp, Mus musculus
gactcttagacatggagttggaaat

SEQ ID NO: 648412 - DNA, 25 bp, Mus musculus
gactcttagctcaggttcctgccca

SEQ ID NO: 648413 - DNA, 25 bp, Mus musculus
gactcttagctctggttcctgccca

SEQ ID NO: 648414 - DNA, 25 bp, Mus musculus
gactcttagggcctttctttccatg

SEQ ID NO: 648415 - DNA, 25 bp, Mus musculus
gactcttagggcgtttctttccatg

SEQ ID NO: 648416 - DNA, 25 bp, Mus musculus
gactcttatattctgcctttctctg

SEQ ID NO: 648417 - DNA, 25 bp, Mus musculus
gactcttatattgtgcctttctctg

SEQ ID NO: 648418 - DNA, 25 bp, Mus musculus
gactcttatcctcaactcactggag

SEQ ID NO: 648419 - DNA, 25 bp, Mus musculus
gactcttatcctgaactcactggag

SEQ ID NO: 648420 - DNA, 25 bp, Mus musculus
gactcttcaaagcagggtacagggc

SEQ ID NO: 648421 - DNA, 25 bp, Mus musculus
gactcttcaaaggagggtacagggc

SEQ ID NO: 648422 - DNA, 25 bp, Mus musculus
gactcttcaagtagtgcagagcggg

SEQ ID NO: 648423 - DNA, 25 bp, Mus musculus
gactcttcaagttgtgcagagcggg

SEQ ID NO: 648424 - DNA, 25 bp, Mus musculus
gactcttcaatcagctcatcaagtg

SEQ ID NO: 648425 - DNA, 25 bp, Mus musculus
gactcttcaatctgctcatcaagtg

SEQ ID NO: 648426 - DNA, 25 bp, Mus musculus
gactcttcagaaaccacgggtgtgg

SEQ ID NO: 648427 - DNA, 25 bp, Mus musculus
gactcttcagaatccacgggtgtgg

SEQ ID NO: 648428 - DNA, 25 bp, Mus musculus
gactcttcagtaatctggttctaga

SEQ ID NO: 648429 - DNA, 25 bp, Mus musculus
gactcttcagtattctggttctaga

SEQ ID NO: 648430 - DNA, 25 bp, Mus musculus
gactcttcctctcatgggaccgaga

SEQ ID NO: 648431 - DNA, 25 bp, Mus musculus
gactcttcctctgatgggaccgaga

SEQ ID NO: 648432 - DNA, 25 bp, Mus musculus
gactcttcgcttctctagatgtagg

SEQ ID NO: 648433 - DNA, 25 bp, Mus musculus
gactcttcgcttgtctagatgtagg

SEQ ID NO: 648434 - DNA, 25 bp, Mus musculus
gactcttctcaacgtgctcatgtga

SEQ ID NO: 648435 - DNA, 25 bp, Mus musculus
gactcttctcaaggtgctcatgtga

SEQ ID NO: 648436 - DNA, 25 bp, Mus musculus
gactcttgaacaacagaagactttc

SEQ ID NO: 648437 - DNA, 25 bp, Mus musculus
gactcttgaacatcagaagactttc

SEQ ID NO: 648438 - DNA, 25 bp, Mus musculus
gactcttgagagacgtgcgcttgga

SEQ ID NO: 648439 - DNA, 25 bp, Mus musculus
gactcttgagagtcgtgcgcttgga

SEQ ID NO: 648440 - DNA, 25 bp, Mus musculus
gactcttgagctcggcgccctggaa

SEQ ID NO: 648441 - DNA, 25 bp, Mus musculus
gactcttgagctgggcgccctggaa

SEQ ID NO: 648442 - DNA, 25 bp, Mus musculus
gactcttgatatactgaagcacttt

SEQ ID NO: 648443 - DNA, 25 bp, Mus musculus
gactcttgatattctgaagcacttt

SEQ ID NO: 648444 - DNA, 25 bp, Mus musculus
gactcttgatccattcctggacgag

SEQ ID NO: 648445 - DNA, 25 bp, Mus musculus
gactcttgatcctttcctggacgag

SEQ ID NO: 648446 - DNA, 25 bp, Mus musculus
gactcttgcacacatgctaaaatgc

SEQ ID NO: 648447 - DNA, 25 bp, Mus musculus
gactcttgcacagatgctaaaatgc

SEQ ID NO: 648448 - DNA, 25 bp, Mus musculus
gactcttgcaggaataagcgttagg

SEQ ID NO: 648449 - DNA, 25 bp, Mus musculus
gactcttgcaggtataagcgttagg

SEQ ID NO: 648450 - DNA, 25 bp, Mus musculus
gactcttgccgccagctgtactaga

SEQ ID NO: 648451 - DNA, 25 bp, Mus musculus
gactcttgccgcgagctgtactaga

SEQ ID NO: 648452 - DNA, 25 bp, Mus musculus
gactcttgcctgatcgtgcagcgcg

SEQ ID NO: 648453 - DNA, 25 bp, Mus musculus
gactcttgcctgttcgtgcagcgcg

SEQ ID NO: 648454 - DNA, 25 bp, Mus musculus
gactcttgcgagaataagcccttct

SEQ ID NO: 648455 - DNA, 25 bp, Mus musculus
gactcttgcgagtataagcccttct

SEQ ID NO: 648456 - DNA, 25 bp, Mus musculus
gactcttggcctcgtactacatgtg

SEQ ID NO: 648457 - DNA, 25 bp, Mus musculus
gactcttggcctggtactacatgtg

SEQ ID NO: 648458 - DNA, 25 bp, Mus musculus
gactcttggtgtctctgcaggtgcc

SEQ ID NO: 648459 - DNA, 25 bp, Mus musculus
gactcttggtgtgtctgcaggtgcc

SEQ ID NO: 648460 - DNA, 25 bp, Mus musculus
gactcttgtctaactatttccctgc

SEQ ID NO: 648461 - DNA, 25 bp, Mus musculus
gactcttgtctatctatttccctgc

SEQ ID NO: 648462 - DNA, 25 bp, Mus musculus
gactctttgtgacaaggatcatgca

SEQ ID NO: 648463 - DNA, 25 bp, Mus musculus
gactctttgtgagaaggatcatgca

SEQ ID NO: 648464 - DNA, 25 bp, Mus musculus
gactgaaaaccaccatcgataccgc

SEQ ID NO: 648465 - DNA, 25 bp, Mus musculus
gactgaaaaccagcatcgataccgc

SEQ ID NO: 648466 - DNA, 25 bp, Mus musculus
gactgaaaaccgctgcctgttggca

SEQ ID NO: 648467 - DNA, 25 bp, Mus musculus
gactgaaaaccggtgcctgttggca

SEQ ID NO: 648468 - DNA, 25 bp, Mus musculus
gactgaaactcacggttggagacct

SEQ ID NO: 648469 - DNA, 25 bp, Mus musculus
gactgaaactcagggttggagacct

SEQ ID NO: 648470 - DNA, 25 bp, Mus musculus
gactgaaagccacatacttctcttg

SEQ ID NO: 648471 - DNA, 25 bp, Mus musculus
gactgaaagccagatacttctcttg

SEQ ID NO: 648472 - DNA, 25 bp, Mus musculus
gactgaaagttgcagatcacatctc

SEQ ID NO: 648473 - DNA, 25 bp, Mus musculus
gactgaaagttggagatcacatctc

SEQ ID NO: 648474 - DNA, 25 bp, Mus musculus
gactgaaatttaaaggccctgctga

SEQ ID NO: 648475 - DNA, 25 bp, Mus musculus
gactgaaatttataggccctgctga

SEQ ID NO: 648476 - DNA, 25 bp, Mus musculus
gactgaaccacgagtcagcaataga

SEQ ID NO: 648477 - DNA, 25 bp, Mus musculus
gactgaaccacgtgtcagcaataga

SEQ ID NO: 648478 - DNA, 25 bp, Mus musculus
gactgaacgaataaatctcacagga

SEQ ID NO: 648479 - DNA, 25 bp, Mus musculus
gactgaacgaattaatctcacagga

SEQ ID NO: 648480 - DNA, 25 bp, Mus musculus
gactgaacgagcacttacaggaaca

SEQ ID NO: 648481 - DNA, 25 bp, Mus musculus
gactgaacgagctcttacaggaaca

SEQ ID NO: 648482 - DNA, 25 bp, Mus musculus
gactgaacgcccctaaggaaatgtt

SEQ ID NO: 648483 - DNA, 25 bp, Mus musculus
gactgaacgcccgtaaggaaatgtt

SEQ ID NO: 648484 - DNA, 25 bp, Mus musculus
gactgaactctgaacgtgagctaca

SEQ ID NO: 648485 - DNA, 25 bp, Mus musculus
gactgaactctgtacgtgagctaca

SEQ ID NO: 648486 - DNA, 25 bp, Mus musculus
gactgaactggcctcctttcgggtt

SEQ ID NO: 648487 - DNA, 25 bp, Mus musculus
gactgaactggcgtcctttcgggtt

SEQ ID NO: 648488 - DNA, 25 bp, Mus musculus
gactgaactttcacctcggcccggg

SEQ ID NO: 648489 - DNA, 25 bp, Mus musculus
gactgaactttctcctcggcccggg

SEQ ID NO: 648490 - DNA, 25 bp, Mus musculus
gactgaagaccgctggattgtttta

SEQ ID NO: 648491 - DNA, 25 bp, Mus musculus
gactgaagaccggtggattgtttta

SEQ ID NO: 648492 - DNA, 25 bp, Mus musculus
gactgaagacgacagtgatagtgac

SEQ ID NO: 648493 - DNA, 25 bp, Mus musculus
gactgaagacgagagtgatagtgac

SEQ ID NO: 648494 - DNA, 25 bp, Mus musculus
gactgaagactcaaactcagaggat

SEQ ID NO: 648495 - DNA, 25 bp, Mus musculus
gactgaagactctaactcagaggat

SEQ ID NO: 648496 - DNA, 25 bp, Mus musculus
gactgaagatacagggatggcacag

SEQ ID NO: 648497 - DNA, 25 bp, Mus musculus
gactgaagatactgggatggcacag

SEQ ID NO: 648498 - DNA, 25 bp, Mus musculus
gactgaagatggagcagaagagaac

SEQ ID NO: 648499 - DNA, 25 bp, Mus musculus
gactgaagatggtgcagaagagaac

SEQ ID NO: 648500 - DNA, 25 bp, Mus musculus
gactgaagattaaggaatactacga

SEQ ID NO: 648501 - DNA, 25 bp, Mus musculus
gactgaagattatggaatactacga

SEQ ID NO: 648502 - DNA, 25 bp, Mus musculus
gactgaagccacattggcacccctg

SEQ ID NO: 648503 - DNA, 25 bp, Mus musculus
gactgaagccactttggcacccctg

SEQ ID NO: 648504 - DNA, 25 bp, Mus musculus
gactgaagcgctcatgacagagcta

SEQ ID NO: 648505 - DNA, 25 bp, Mus musculus
gactgaagcgctgatgacagagcta

SEQ ID NO: 648506 - DNA, 25 bp, Mus musculus
gactgaaggagtccaacagctgtgt

SEQ ID NO: 648507 - DNA, 25 bp, Mus musculus
gactgaaggagtgcaacagctgtgt

SEQ ID NO: 648508 - DNA, 25 bp, Mus musculus
gactgaaggctaaggaccaggagat

SEQ ID NO: 648509 - DNA, 25 bp, Mus musculus
gactgaaggctatggaccaggagat

SEQ ID NO: 648510 - DNA, 25 bp, Mus musculus
gactgaagtacactgtggtgtgcca

SEQ ID NO: 648511 - DNA, 25 bp, Mus musculus
gactgaagtacagtgtggtgtgcca

SEQ ID NO: 648512 - DNA, 25 bp, Mus musculus
gactgaagtcagaaagtttctacca

SEQ ID NO: 648513 - DNA, 25 bp, Mus musculus
gactgaagtcagtaagtttctacca

SEQ ID NO: 648514 - DNA, 25 bp, Mus musculus
gactgaagtgcccaggtacttttgt

SEQ ID NO: 648515 - DNA, 25 bp, Mus musculus
gactgaagtgccgaggtacttttgt

SEQ ID NO: 648516 - DNA, 25 bp, Mus musculus
gactgaagttaaaggtgtcaccacc

SEQ ID NO: 648517 - DNA, 25 bp, Mus musculus
gactgaagttaatggtgtcaccacc

SEQ ID NO: 648518 - DNA, 25 bp, Mus musculus
gactgaatactcaggtccgaggccg

SEQ ID NO: 648519 - DNA, 25 bp, Mus musculus
gactgaatactctggtccgaggccg

SEQ ID NO: 648520 - DNA, 25 bp, Mus musculus
gactgaatatcaactccaacctgga

SEQ ID NO: 648521 - DNA, 25 bp, Mus musculus
gactgaatatcatctccaacctgga

SEQ ID NO: 648522 - DNA, 25 bp, Mus musculus
gactgaatatctcttacaccaggaa

SEQ ID NO: 648523 - DNA, 25 bp, Mus musculus
gactgaatatctgttacaccaggaa

SEQ ID NO: 648524 - DNA, 25 bp, Mus musculus
gactgaatattgctcaactccgtgg

SEQ ID NO: 648525 - DNA, 25 bp, Mus musculus
gactgaatattggtcaactccgtgg

SEQ ID NO: 648526 - DNA, 25 bp, Mus musculus
gactgaatatttctctcgatttggg

SEQ ID NO: 648527 - DNA, 25 bp, Mus musculus
gactgaatatttgtctcgatttggg

SEQ ID NO: 648528 - DNA, 25 bp, Mus musculus
gactgaatctcactgacttgggata

SEQ ID NO: 648529 - DNA, 25 bp, Mus musculus
gactgaatctcagtgacttgggata

SEQ ID NO: 648530 - DNA, 25 bp, Mus musculus
gactgaatctgactgtagaccacac

SEQ ID NO: 648531 - DNA, 25 bp, Mus musculus
gactgaatctgagtgtagaccacac

SEQ ID NO: 648532 - DNA, 25 bp, Mus musculus
gactgacaaacgctagtggtcggta

SEQ ID NO: 648533 - DNA, 25 bp, Mus musculus
gactgacaaacggtagtggtcggta

SEQ ID NO: 648534 - DNA, 25 bp, Mus musculus
gactgacaccagctatttcgatgag

SEQ ID NO: 648535 - DNA, 25 bp, Mus musculus
gactgacaccaggtatttcgatgag

SEQ ID NO: 648536 - DNA, 25 bp, Mus musculus
gactgacactgaagcaggcacccaa

SEQ ID NO: 648537 - DNA, 25 bp, Mus musculus
gactgacactgatgcaggcacccaa

SEQ ID NO: 648538 - DNA, 25 bp, Mus musculus
gactgacagaaactaaagatggctc

SEQ ID NO: 648539 - DNA, 25 bp, Mus musculus
gactgacagaaagtaaagatggctc

SEQ ID NO: 648540 - DNA, 25 bp, Mus musculus
gactgacagacaataaagcgatgct

SEQ ID NO: 648541 - DNA, 25 bp, Mus musculus
gactgacagacattaaagcgatgct

SEQ ID NO: 648542 - DNA, 25 bp, Mus musculus
gactgacagacgaagagattgacct

SEQ ID NO: 648543 - DNA, 25 bp, Mus musculus
gactgacagacgtagagattgacct

SEQ ID NO: 648544 - DNA, 25 bp, Mus musculus
gactgacagcagagagggaactcat

SEQ ID NO: 648545 - DNA, 25 bp, Mus musculus
gactgacagcagtgagggaactcat

SEQ ID NO: 648546 - DNA, 25 bp, Mus musculus
gactgacagcgcaacatacagaaga

SEQ ID NO: 648547 - DNA, 25 bp, Mus musculus
gactgacagcgctacatacagaaga

SEQ ID NO: 648548 - DNA, 25 bp, Mus musculus
gactgacaggtgattcccaggacca

SEQ ID NO: 648549 - DNA, 25 bp, Mus musculus
gactgacaggtgtttcccaggacca

SEQ ID NO: 648550 - DNA, 25 bp, Mus musculus
gactgacatcaaccatcttcgaaag

SEQ ID NO: 648551 - DNA, 25 bp, Mus musculus
gactgacatcaagcatcttcgaaag

SEQ ID NO: 648552 - DNA, 25 bp, Mus musculus
gactgacatgggaaggaaacaaaac

SEQ ID NO: 648553 - DNA, 25 bp, Mus musculus
gactgacatgggtaggaaacaaaac

SEQ ID NO: 648554 - DNA, 25 bp, Mus musculus
gactgaccacggatctaagggaaca

SEQ ID NO: 648555 - DNA, 25 bp, Mus musculus
gactgaccacggttctaagggaaca

SEQ ID NO: 648556 - DNA, 25 bp, Mus musculus
gactgaccatgcctttcaacatacc

SEQ ID NO: 648557 - DNA, 25 bp, Mus musculus
gactgaccatgcgtttcaacatacc

SEQ ID NO: 648558 - DNA, 25 bp, Mus musculus
gactgacccatcagtaataaaagct

SEQ ID NO: 648559 - DNA, 25 bp, Mus musculus
gactgacccatctgtaataaaagct

SEQ ID NO: 648560 - DNA, 25 bp, Mus musculus
gactgacccgggacaagtatgcata

SEQ ID NO: 648561 - DNA, 25 bp, Mus musculus
gactgacccgggtcaagtatgcata

SEQ ID NO: 648562 - DNA, 25 bp, Mus musculus
gactgacccgtaaactgcagcagga

SEQ ID NO: 648563 - DNA, 25 bp, Mus musculus
gactgacccgtatactgcagcagga

SEQ ID NO: 648564 - DNA, 25 bp, Mus musculus
gactgaccctgaccatgctgagttg

SEQ ID NO: 648565 - DNA, 25 bp, Mus musculus
gactgaccctgagcatgctgagttg

SEQ ID NO: 648566 - DNA, 25 bp, Mus musculus
gactgacccttgaggctcatcatca

SEQ ID NO: 648567 - DNA, 25 bp, Mus musculus
gactgacccttgtggctcatcatca

SEQ ID NO: 648568 - DNA, 25 bp, Mus musculus
gactgaccctttccacaacatctgg

SEQ ID NO: 648569 - DNA, 25 bp, Mus musculus
gactgaccctttgcacaacatctgg

SEQ ID NO: 648570 - DNA, 25 bp, Mus musculus
gactgaccgatcagtgttggacaca

SEQ ID NO: 648571 - DNA, 25 bp, Mus musculus
gactgaccgatctgtgttggacaca

SEQ ID NO: 648572 - DNA, 25 bp, Mus musculus
gactgacgtctacctgttgaacatg

SEQ ID NO: 648573 - DNA, 25 bp, Mus musculus
gactgacgtctagctgttgaacatg

SEQ ID NO: 648574 - DNA, 25 bp, Mus musculus
gactgacgtggtaagtctatatcat

SEQ ID NO: 648575 - DNA, 25 bp, Mus musculus
gactgacgtggttagtctatatcat

SEQ ID NO: 648576 - DNA, 25 bp, Mus musculus
gactgacgttttcctagtcactgga

SEQ ID NO: 648577 - DNA, 25 bp, Mus musculus
gactgacgttttgctagtcactgga

SEQ ID NO: 648578 - DNA, 25 bp, Mus musculus
gactgactcagaagctgcaaatatt

SEQ ID NO: 648579 - DNA, 25 bp, Mus musculus
gactgactcagatgctgcaaatatt

SEQ ID NO: 648580 - DNA, 25 bp, Mus musculus
gactgactcttaagatgcagaattg

SEQ ID NO: 648581 - DNA, 25 bp, Mus musculus
gactgactcttatgatgcagaattg

SEQ ID NO: 648582 - DNA, 25 bp, Mus musculus
gactgactgagactcgagtgttagt

SEQ ID NO: 648583 - DNA, 25 bp, Mus musculus
gactgactgagagtcgagtgttagt

SEQ ID NO: 648584 - DNA, 25 bp, Mus musculus
gactgactgccaagcattgctgtga

SEQ ID NO: 648585 - DNA, 25 bp, Mus musculus
gactgactgccatgcattgctgtga

SEQ ID NO: 648586 - DNA, 25 bp, Mus musculus
gactgactggatagccatctatcag

SEQ ID NO: 648587 - DNA, 25 bp, Mus musculus
gactgactggattgccatctatcag

SEQ ID NO: 648588 - DNA, 25 bp, Mus musculus
gactgactggccagctaagaacaca

SEQ ID NO: 648589 - DNA, 25 bp, Mus musculus
gactgactggcctgctaagaacaca

SEQ ID NO: 648590 - DNA, 25 bp, Mus musculus
gactgactgggaccctcaagttttg

SEQ ID NO: 648591 - DNA, 25 bp, Mus musculus
gactgactgggagcctcaagttttg

SEQ ID NO: 648592 - DNA, 25 bp, Mus musculus
gactgactgtacctcatcacatggc

SEQ ID NO: 648593 - DNA, 25 bp, Mus musculus
gactgactgtacgtcatcacatggc

SEQ ID NO: 648594 - DNA, 25 bp, Mus musculus
gactgacttacaactagaccctact

SEQ ID NO: 648595 - DNA, 25 bp, Mus musculus
gactgacttacatctagaccctact

SEQ ID NO: 648596 - DNA, 25 bp, Mus musculus
gactgacttctcatcccagagtaca

SEQ ID NO: 648597 - DNA, 25 bp, Mus musculus
gactgacttctccttgatgcctctg

SEQ ID NO: 648598 - DNA, 25 bp, Mus musculus
gactgacttctcgttgatgcctctg

SEQ ID NO: 648599 - DNA, 25 bp, Mus musculus
gactgacttctcttcccagagtaca

SEQ ID NO: 648600 - DNA, 25 bp, Mus musculus
gactgacttggtcgagtggcaactc

SEQ ID NO: 648601 - DNA, 25 bp, Mus musculus
gactgacttggtggagtggcaactc

SEQ ID NO: 648602 - DNA, 25 bp, Mus musculus
gactgagaaactctcttgttactca

SEQ ID NO: 648603 - DNA, 25 bp, Mus musculus
gactgagaaactgtcttgttactca

SEQ ID NO: 648604 - DNA, 25 bp, Mus musculus
gactgagaacctagatgtcattgtc

SEQ ID NO: 648605 - DNA, 25 bp, Mus musculus
gactgagaaccttgatgtcattgtc

SEQ ID NO: 648606 - DNA, 25 bp, Mus musculus
gactgagaagcaagcgctaagctgg

SEQ ID NO: 648607 - DNA, 25 bp, Mus musculus
gactgagaagcatgcgctaagctgg

SEQ ID NO: 648608 - DNA, 25 bp, Mus musculus
gactgagaagctattagaatcttgg

SEQ ID NO: 648609 - DNA, 25 bp, Mus musculus
gactgagaagcttttagaatcttgg

SEQ ID NO: 648610 - DNA, 25 bp, Mus musculus
gactgagacgagatacaggccagag

SEQ ID NO: 648611 - DNA, 25 bp, Mus musculus
gactgagacgagttacaggccagag

SEQ ID NO: 648612 - DNA, 25 bp, Mus musculus
gactgagacgttatgggccacgcac

SEQ ID NO: 648613 - DNA, 25 bp, Mus musculus
gactgagacgttttgggccacgcac

SEQ ID NO: 648614 - DNA, 25 bp, Mus musculus
gactgagactagcagcgtgcctgaa

SEQ ID NO: 648615 - DNA, 25 bp, Mus musculus
gactgagactaggagcgtgcctgaa

SEQ ID NO: 648616 - DNA, 25 bp, Mus musculus
gactgagagctcaggcatagtgaag

SEQ ID NO: 648617 - DNA, 25 bp, Mus musculus
gactgagagctctggcatagtgaag

SEQ ID NO: 648618 - DNA, 25 bp, Mus musculus
gactgagaggacatagggaatacct

SEQ ID NO: 648619 - DNA, 25 bp, Mus musculus
gactgagaggacttagggaatacct

SEQ ID NO: 648620 - DNA, 25 bp, Mus musculus
gactgagaggctatcctggtcttct

SEQ ID NO: 648621 - DNA, 25 bp, Mus musculus
gactgagaggctttcctggtcttct

SEQ ID NO: 648622 - DNA, 25 bp, Mus musculus
gactgagagtgaaagattatcatca

SEQ ID NO: 648623 - DNA, 25 bp, Mus musculus
gactgagagtgatagattatcatca

SEQ ID NO: 648624 - DNA, 25 bp, Mus musculus
gactgagatactagccctaaagagc

SEQ ID NO: 648625 - DNA, 25 bp, Mus musculus
gactgagatacttgccctaaagagc

SEQ ID NO: 648626 - DNA, 25 bp, Mus musculus
gactgagcaaggacatccgtgagac

SEQ ID NO: 648627 - DNA, 25 bp, Mus musculus
gactgagcaaggtcatccgtgagac

SEQ ID NO: 648628 - DNA, 25 bp, Mus musculus
gactgagcacacagagataccgcct

SEQ ID NO: 648629 - DNA, 25 bp, Mus musculus
gactgagcacactgagataccgcct

SEQ ID NO: 648630 - DNA, 25 bp, Mus musculus
gactgagcagctatagagggcctga

SEQ ID NO: 648631 - DNA, 25 bp, Mus musculus
gactgagcagctttagagggcctga

SEQ ID NO: 648632 - DNA, 25 bp, Mus musculus
gactgagccactaataactgggacc

SEQ ID NO: 648633 - DNA, 25 bp, Mus musculus
gactgagccacttataactgggacc

SEQ ID NO: 648634 - DNA, 25 bp, Mus musculus
gactgagcccaaagaggaaaagcca

SEQ ID NO: 648635 - DNA, 25 bp, Mus musculus
gactgagcccaatgaggaaaagcca

SEQ ID NO: 648636 - DNA, 25 bp, Mus musculus
gactgagcgatgcactgaatctgca

SEQ ID NO: 648637 - DNA, 25 bp, Mus musculus
gactgagcgatggactgaatctgca

SEQ ID NO: 648638 - DNA, 25 bp, Mus musculus
gactgagcgcctctgctgttcacgt

SEQ ID NO: 648639 - DNA, 25 bp, Mus musculus
gactgagcgcctgtgctgttcacgt

SEQ ID NO: 648640 - DNA, 25 bp, Mus musculus
gactgagcgggtcgacttcacagct

SEQ ID NO: 648641 - DNA, 25 bp, Mus musculus
gactgagcgggtggacttcacagct

SEQ ID NO: 648642 - DNA, 25 bp, Mus musculus
gactgagctagtaagagtgtcacaa

SEQ ID NO: 648643 - DNA, 25 bp, Mus musculus
gactgagctagttagagtgtcacaa

SEQ ID NO: 648644 - DNA, 25 bp, Mus musculus
gactgaggaaagcagaactctggcc

SEQ ID NO: 648645 - DNA, 25 bp, Mus musculus
gactgaggaaaggagaactctggcc

SEQ ID NO: 648646 - DNA, 25 bp, Mus musculus
gactgaggacttagggccacatcag

SEQ ID NO: 648647 - DNA, 25 bp, Mus musculus
gactgaggactttgggccacatcag

SEQ ID NO: 648648 - DNA, 25 bp, Mus musculus
gactgaggatcacggtcttgaaacc

SEQ ID NO: 648649 - DNA, 25 bp, Mus musculus
gactgaggatcagggtcttgaaacc

SEQ ID NO: 648650 - DNA, 25 bp, Mus musculus
gactgaggcctcacgccaagagttg

SEQ ID NO: 648651 - DNA, 25 bp, Mus musculus
gactgaggcctctcgccaagagttg

SEQ ID NO: 648652 - DNA, 25 bp, Mus musculus
gactgagggacaccattcatggtga

SEQ ID NO: 648653 - DNA, 25 bp, Mus musculus
gactgagggacagcattcatggtga

SEQ ID NO: 648654 - DNA, 25 bp, Mus musculus
gactgagggagactcagcaaaaact

SEQ ID NO: 648655 - DNA, 25 bp, Mus musculus
gactgagggagagtcagcaaaaact

SEQ ID NO: 648656 - DNA, 25 bp, Mus musculus
gactgagggtcacagctttgcttgt

SEQ ID NO: 648657 - DNA, 25 bp, Mus musculus
gactgagggtcagagctttgcttgt

SEQ ID NO: 648658 - DNA, 25 bp, Mus musculus
gactgaggtcacatcacacatggcc

SEQ ID NO: 648659 - DNA, 25 bp, Mus musculus
gactgaggtcacttcacacatggcc

SEQ ID NO: 648660 - DNA, 25 bp, Mus musculus
gactgaggtgggagtcaccgcaggg

SEQ ID NO: 648661 - DNA, 25 bp, Mus musculus
gactgaggtgggtgtcaccgcaggg

SEQ ID NO: 648662 - DNA, 25 bp, Mus musculus
gactgagtcaggctctactccagct

SEQ ID NO: 648663 - DNA, 25 bp, Mus musculus
gactgagtcagggtctactccagct

SEQ ID NO: 648664 - DNA, 25 bp, Mus musculus
gactgagtcctacccctgaatctgc

SEQ ID NO: 648665 - DNA, 25 bp, Mus musculus
gactgagtcctagccctgaatctgc

SEQ ID NO: 648666 - DNA, 25 bp, Mus musculus
gactgagtgataagacttctaggat

SEQ ID NO: 648667 - DNA, 25 bp, Mus musculus
gactgagtgatatgacttctaggat

SEQ ID NO: 648668 - DNA, 25 bp, Mus musculus
gactgagttgaaaaccttcttcttg

SEQ ID NO: 648669 - DNA, 25 bp, Mus musculus
gactgagttgaataccttcttcttg

SEQ ID NO: 648670 - DNA, 25 bp, Mus musculus
gactgagtttgtagtgtgcagagcc

SEQ ID NO: 648671 - DNA, 25 bp, Mus musculus
gactgagtttgttgtgtgcagagcc

SEQ ID NO: 648672 - DNA, 25 bp, Mus musculus
gactgataccaacatgacccttggc

SEQ ID NO: 648673 - DNA, 25 bp, Mus musculus
gactgataccaagatgacccttggc

SEQ ID NO: 648674 - DNA, 25 bp, Mus musculus
gactgataccctcgaacatgaactg

SEQ ID NO: 648675 - DNA, 25 bp, Mus musculus
gactgataccctggaacatgaactg

SEQ ID NO: 648676 - DNA, 25 bp, Mus musculus
gactgatatccacaataaggaaaaa

SEQ ID NO: 648677 - DNA, 25 bp, Mus musculus
gactgatatccagaataaggaaaaa

SEQ ID NO: 648678 - DNA, 25 bp, Mus musculus
gactgatatcttccggaagcacccc

SEQ ID NO: 648679 - DNA, 25 bp, Mus musculus
gactgatatcttgcggaagcacccc

SEQ ID NO: 648680 - DNA, 25 bp, Mus musculus
gactgatatgacagagagtgaaaga

SEQ ID NO: 648681 - DNA, 25 bp, Mus musculus
gactgatatgactgagagtgaaaga

SEQ ID NO: 648682 - DNA, 25 bp, Mus musculus
gactgatccctcatctacctcaggg

SEQ ID NO: 648683 - DNA, 25 bp, Mus musculus
gactgatccctcttctacctcaggg

SEQ ID NO: 648684 - DNA, 25 bp, Mus musculus
gactgatcgaatccaaagtcggcat

SEQ ID NO: 648685 - DNA, 25 bp, Mus musculus
gactgatcgaatgcaaagtcggcat

SEQ ID NO: 648686 - DNA, 25 bp, Mus musculus
gactgatcgatgcatagtgactgag

SEQ ID NO: 648687 - DNA, 25 bp, Mus musculus
gactgatcgatggatagtgactgag

SEQ ID NO: 648688 - DNA, 25 bp, Mus musculus
gactgatcgcgcccgtcaaggagat

SEQ ID NO: 648689 - DNA, 25 bp, Mus musculus
gactgatcgcgcgcgtcaaggagat

SEQ ID NO: 648690 - DNA, 25 bp, Mus musculus
gactgatctcccctttcagggccat

SEQ ID NO: 648691 - DNA, 25 bp, Mus musculus
gactgatctcccgtttcagggccat

SEQ ID NO: 648692 - DNA, 25 bp, Mus musculus
gactgatgaaatacagcaacaaatt

SEQ ID NO: 648693 - DNA, 25 bp, Mus musculus
gactgatgaaattcagcaacaaatt

SEQ ID NO: 648694 - DNA, 25 bp, Mus musculus
gactgatgaacacttcaagcggttg

SEQ ID NO: 648695 - DNA, 25 bp, Mus musculus
gactgatgaacagttcaagcggttg

SEQ ID NO: 648696 - DNA, 25 bp, Mus musculus
gactgatgaattagctaaaggaaga

SEQ ID NO: 648697 - DNA, 25 bp, Mus musculus
gactgatgaatttgctaaaggaaga

SEQ ID NO: 648698 - DNA, 25 bp, Mus musculus
gactgatgaccaactggacccagaa

SEQ ID NO: 648699 - DNA, 25 bp, Mus musculus
gactgatgaccatctggacccagaa

SEQ ID NO: 648700 - DNA, 25 bp, Mus musculus
gactgatgcagaagaccctttgctc

SEQ ID NO: 648701 - DNA, 25 bp, Mus musculus
gactgatgcagatgaccctttgctc

SEQ ID NO: 648702 - DNA, 25 bp, Mus musculus
gactgatggacgagtccgaactctg

SEQ ID NO: 648703 - DNA, 25 bp, Mus musculus
gactgatggacgtgtccgaactctg

SEQ ID NO: 648704 - DNA, 25 bp, Mus musculus
gactgatggcgtacctgttcccagg

SEQ ID NO: 648705 - DNA, 25 bp, Mus musculus
gactgatggcgttcctgttcccagg

SEQ ID NO: 648706 - DNA, 25 bp, Mus musculus
gactgatggctcagcgcgagcgcaa

SEQ ID NO: 648707 - DNA, 25 bp, Mus musculus
gactgatggctctgcgcgagcgcaa

SEQ ID NO: 648708 - DNA, 25 bp, Mus musculus
gactgcaaaactagcgactcggacg

SEQ ID NO: 648709 - DNA, 25 bp, Mus musculus
gactgcaaaacttgcgactcggacg

SEQ ID NO: 648710 - DNA, 25 bp, Mus musculus
gactgcaaacatctcaaaagactac

SEQ ID NO: 648711 - DNA, 25 bp, Mus musculus
gactgcaaacatgtcaaaagactac

SEQ ID NO: 648712 - DNA, 25 bp, Mus musculus
gactgcaacgtgcttcttaagctgg

SEQ ID NO: 648713 - DNA, 25 bp, Mus musculus
gactgcaacgtggttcttaagctgg

SEQ ID NO: 648714 - DNA, 25 bp, Mus musculus
gactgcaactgcatataaggaatat

SEQ ID NO: 648715 - DNA, 25 bp, Mus musculus
gactgcaactgcttataaggaatat

SEQ ID NO: 648716 - DNA, 25 bp, Mus musculus
gactgcaagctaagaagtaagaaca

SEQ ID NO: 648717 - DNA, 25 bp, Mus musculus
gactgcaagctatgaagtaagaaca

SEQ ID NO: 648718 - DNA, 25 bp, Mus musculus
gactgcaatcccctggatctgcaca

SEQ ID NO: 648719 - DNA, 25 bp, Mus musculus
gactgcaatcccgtggatctgcaca

SEQ ID NO: 648720 - DNA, 25 bp, Mus musculus
gactgcaccgtgagaatctcattgc

SEQ ID NO: 648721 - DNA, 25 bp, Mus musculus
gactgcaccgtgtgaatctcattgc

SEQ ID NO: 648722 - DNA, 25 bp, Mus musculus
gactgcactgacagtactgacggga

SEQ ID NO: 648723 - DNA, 25 bp, Mus musculus
gactgcactgactgtactgacggga

SEQ ID NO: 648724 - DNA, 25 bp, Mus musculus
gactgcagaagaccgtcaagaactg

SEQ ID NO: 648725 - DNA, 25 bp, Mus musculus
gactgcagaagagcgtcaagaactg

SEQ ID NO: 648726 - DNA, 25 bp, Mus musculus
gactgcagacacagcccccatgggt

SEQ ID NO: 648727 - DNA, 25 bp, Mus musculus
gactgcagacactgcccccatgggt

SEQ ID NO: 648728 - DNA, 25 bp, Mus musculus
gactgcagaggtataagaggataag

SEQ ID NO: 648729 - DNA, 25 bp, Mus musculus
gactgcagaggtttaagaggataag

SEQ ID NO: 648730 - DNA, 25 bp, Mus musculus
gactgcagatgcacatcaaggccaa

SEQ ID NO: 648731 - DNA, 25 bp, Mus musculus
gactgcagatgctcatcaaggccaa

SEQ ID NO: 648732 - DNA, 25 bp, Mus musculus
gactgcagcaaaactcagccctgcg

SEQ ID NO: 648733 - DNA, 25 bp, Mus musculus
gactgcagcaaatctcagccctgcg

SEQ ID NO: 648734 - DNA, 25 bp, Mus musculus
gactgcagccccaacaaagaagttg

SEQ ID NO: 648735 - DNA, 25 bp, Mus musculus
gactgcagcccctacaaagaagttg

SEQ ID NO: 648736 - DNA, 25 bp, Mus musculus
gactgcagctggattcatccacttg

SEQ ID NO: 648737 - DNA, 25 bp, Mus musculus
gactgcagctggtttcatccacttg

SEQ ID NO: 648738 - DNA, 25 bp, Mus musculus
gactgcaggcagagaaagccttggt

SEQ ID NO: 648739 - DNA, 25 bp, Mus musculus
gactgcaggcagtgaaagccttggt

SEQ ID NO: 648740 - DNA, 25 bp, Mus musculus
gactgcaggcctcaagcccactgtg

SEQ ID NO: 648741 - DNA, 25 bp, Mus musculus
gactgcaggcctgaagcccactgtg

SEQ ID NO: 648742 - DNA, 25 bp, Mus musculus
gactgcagtgctacgagtgctatgg

SEQ ID NO: 648743 - DNA, 25 bp, Mus musculus
gactgcagtgcttcgagtgctatgg

SEQ ID NO: 648744 - DNA, 25 bp, Mus musculus
gactgcagttcaacttgagccatct

SEQ ID NO: 648745 - DNA, 25 bp, Mus musculus
gactgcagttcatcttgagccatct

SEQ ID NO: 648746 - DNA, 25 bp, Mus musculus
gactgcatccggatcactgagaaga

SEQ ID NO: 648747 - DNA, 25 bp, Mus musculus
gactgcatccggttcactgagaaga

SEQ ID NO: 648748 - DNA, 25 bp, Mus musculus
gactgcatctccaggagcctgagta

SEQ ID NO: 648749 - DNA, 25 bp, Mus musculus
gactgcatctcctggagcctgagta

SEQ ID NO: 648750 - DNA, 25 bp, Mus musculus
gactgcatgaacaagctaaaaaaca

SEQ ID NO: 648751 - DNA, 25 bp, Mus musculus
gactgcatgaactagctaaaaaaca

SEQ ID NO: 648752 - DNA, 25 bp, Mus musculus
gactgcatgacacggagggcatctt

SEQ ID NO: 648753 - DNA, 25 bp, Mus musculus
gactgcatgacagggagggcatctt

SEQ ID NO: 648754 - DNA, 25 bp, Mus musculus
gactgcatgcaaccacgcactataa

SEQ ID NO: 648755 - DNA, 25 bp, Mus musculus
gactgcatgcaagcacgcactataa

SEQ ID NO: 648756 - DNA, 25 bp, Mus musculus
gactgcatggataggctccaagcaa

SEQ ID NO: 648757 - DNA, 25 bp, Mus musculus
gactgcatggattggctccaagcaa

SEQ ID NO: 648758 - DNA, 25 bp, Mus musculus
gactgcatgtaacctcgctcgtcgt

SEQ ID NO: 648759 - DNA, 25 bp, Mus musculus
gactgcatgtaagctcgctcgtcgt

SEQ ID NO: 648760 - DNA, 25 bp, Mus musculus
gactgcattatcagtatggagaaac

SEQ ID NO: 648761 - DNA, 25 bp, Mus musculus
gactgcattatcatctgtggccacc

SEQ ID NO: 648762 - DNA, 25 bp, Mus musculus
gactgcattatctgtatggagaaac

SEQ ID NO: 648763 - DNA, 25 bp, Mus musculus
gactgcattatcttctgtggccacc

SEQ ID NO: 648764 - DNA, 25 bp, Mus musculus
gactgccaatgaagcctggcatggc

SEQ ID NO: 648765 - DNA, 25 bp, Mus musculus
gactgccaatgatgcctggcatggc

SEQ ID NO: 648766 - DNA, 25 bp, Mus musculus
gactgccagcatcgtacagagggcc

SEQ ID NO: 648767 - DNA, 25 bp, Mus musculus
gactgccagcatggtacagagggcc

SEQ ID NO: 648768 - DNA, 25 bp, Mus musculus
gactgccagctccagagagtaaaga

SEQ ID NO: 648769 - DNA, 25 bp, Mus musculus
gactgccagctcgagagagtaaaga

SEQ ID NO: 648770 - DNA, 25 bp, Mus musculus
gactgccaggcacattaactgtaca

SEQ ID NO: 648771 - DNA, 25 bp, Mus musculus
gactgccaggcagattaactgtaca

SEQ ID NO: 648772 - DNA, 25 bp, Mus musculus
gactgccagtggattgatattacag

SEQ ID NO: 648773 - DNA, 25 bp, Mus musculus
gactgccagtggtttgatattacag

SEQ ID NO: 648774 - DNA, 25 bp, Mus musculus
gactgccatgctattgtcgaaactg

SEQ ID NO: 648775 - DNA, 25 bp, Mus musculus
gactgccatgcttttgtcgaaactg

SEQ ID NO: 648776 - DNA, 25 bp, Mus musculus
gactgcccaaggacatcgggaacca

SEQ ID NO: 648777 - DNA, 25 bp, Mus musculus
gactgcccaaggtcatcgggaacca

SEQ ID NO: 648778 - DNA, 25 bp, Mus musculus
gactgccccgaacggagcgtaagct

SEQ ID NO: 648779 - DNA, 25 bp, Mus musculus
gactgccccgaagggagcgtaagct

SEQ ID NO: 648780 - DNA, 25 bp, Mus musculus
gactgccccggacgacaatggagtc

SEQ ID NO: 648781 - DNA, 25 bp, Mus musculus
gactgccccggaggacaatggagtc

SEQ ID NO: 648782 - DNA, 25 bp, Mus musculus
gactgcccgcgcagccagtgaaggc

SEQ ID NO: 648783 - DNA, 25 bp, Mus musculus
gactgcccgcgctgccagtgaaggc

SEQ ID NO: 648784 - DNA, 25 bp, Mus musculus
gactgcccggcaatgcatctggtca

SEQ ID NO: 648785 - DNA, 25 bp, Mus musculus
gactgcccggcattgcatctggtca

SEQ ID NO: 648786 - DNA, 25 bp, Mus musculus
gactgccctctgctccttatgtgtg

SEQ ID NO: 648787 - DNA, 25 bp, Mus musculus
gactgccctctggtccttatgtgtg

SEQ ID NO: 648788 - DNA, 25 bp, Mus musculus
gactgccctggaatgtgggtccctg

SEQ ID NO: 648789 - DNA, 25 bp, Mus musculus
gactgccctggattgtgggtccctg

SEQ ID NO: 648790 - DNA, 25 bp, Mus musculus
gactgccgaggaagacatcagcgat

SEQ ID NO: 648791 - DNA, 25 bp, Mus musculus
gactgccgaggacctaatgaacttc

SEQ ID NO: 648792 - DNA, 25 bp, Mus musculus
gactgccgaggagctaatgaacttc

SEQ ID NO: 648793 - DNA, 25 bp, Mus musculus
gactgccgaggatgacatcagcgat

SEQ ID NO: 648794 - DNA, 25 bp, Mus musculus
gactgccggacacagtagaaaccag

SEQ ID NO: 648795 - DNA, 25 bp, Mus musculus
gactgccggacagagtagaaaccag

SEQ ID NO: 648796 - DNA, 25 bp, Mus musculus
gactgccggaggatttaccgagagc

SEQ ID NO: 648797 - DNA, 25 bp, Mus musculus
gactgccggaggttttaccgagagc

SEQ ID NO: 648798 - DNA, 25 bp, Mus musculus
gactgccgggagaatgtgatcatga

SEQ ID NO: 648799 - DNA, 25 bp, Mus musculus
gactgccgggagtatgtgatcatga

SEQ ID NO: 648800 - DNA, 25 bp, Mus musculus
gactgccgggctcttgtagtctccg

SEQ ID NO: 648801 - DNA, 25 bp, Mus musculus
gactgccgggctgttgtagtctccg

SEQ ID NO: 648802 - DNA, 25 bp, Mus musculus
gactgccgtggaacagatctacccg

SEQ ID NO: 648803 - DNA, 25 bp, Mus musculus
gactgccgtggatcagatctacccg

SEQ ID NO: 648804 - DNA, 25 bp, Mus musculus
gactgcctggaaatacacttgctgg

SEQ ID NO: 648805 - DNA, 25 bp, Mus musculus
gactgcctggaattacacttgctgg

SEQ ID NO: 648806 - DNA, 25 bp, Mus musculus
gactgcctgttgaggttaaactcct

SEQ ID NO: 648807 - DNA, 25 bp, Mus musculus
gactgcctgttgtggttaaactcct

SEQ ID NO: 648808 - DNA, 25 bp, Mus musculus
gactgccttatgaaagctctgaagg

SEQ ID NO: 648809 - DNA, 25 bp, Mus musculus
gactgccttatgtaagctctgaagg

SEQ ID NO: 648810 - DNA, 25 bp, Mus musculus
gactgccttcagatcttagcttatg

SEQ ID NO: 648811 - DNA, 25 bp, Mus musculus
gactgccttcagttcttagcttatg

SEQ ID NO: 648812 - DNA, 25 bp, Mus musculus
gactgccttggcagtacaaagccct

SEQ ID NO: 648813 - DNA, 25 bp, Mus musculus
gactgccttggccaagttactttca

SEQ ID NO: 648814 - DNA, 25 bp, Mus musculus
gactgccttggcgaagttactttca

SEQ ID NO: 648815 - DNA, 25 bp, Mus musculus
gactgccttggctgtacaaagccct

SEQ ID NO: 648816 - DNA, 25 bp, Mus musculus
gactgcctttatactacggaccccg

SEQ ID NO: 648817 - DNA, 25 bp, Mus musculus
gactgcctttattctacggaccccg

SEQ ID NO: 648818 - DNA, 25 bp, Mus musculus
gactgccttttgcaggtgcagagat

SEQ ID NO: 648819 - DNA, 25 bp, Mus musculus
gactgccttttggaggtgcagagat

SEQ ID NO: 648820 - DNA, 25 bp, Mus musculus
gactgcgaccacatcctagcaggga

SEQ ID NO: 648821 - DNA, 25 bp, Mus musculus
gactgcgaccacttcctagcaggga

SEQ ID NO: 648822 - DNA, 25 bp, Mus musculus
gactgcgaggtgctgggtggccttg

SEQ ID NO: 648823 - DNA, 25 bp, Mus musculus
gactgcgaggtggtgggtggccttg

SEQ ID NO: 648824 - DNA, 25 bp, Mus musculus
gactgcgatggcatttccacctttg

SEQ ID NO: 648825 - DNA, 25 bp, Mus musculus
gactgcgatggcttttccacctttg

SEQ ID NO: 648826 - DNA, 25 bp, Mus musculus
gactgcgccttgcacctgatgaggc

SEQ ID NO: 648827 - DNA, 25 bp, Mus musculus
gactgcgccttggacctgatgaggc

SEQ ID NO: 648828 - DNA, 25 bp, Mus musculus
gactgcgcgttgatgccatccaggg

SEQ ID NO: 648829 - DNA, 25 bp, Mus musculus
gactgcgcgttgttgccatccaggg

SEQ ID NO: 648830 - DNA, 25 bp, Mus musculus
gactgcgctcttcagatggctccag

SEQ ID NO: 648831 - DNA, 25 bp, Mus musculus
gactgcgctcttgagatggctccag

SEQ ID NO: 648832 - DNA, 25 bp, Mus musculus
gactgcgcttcgcatgtgttaccaa

SEQ ID NO: 648833 - DNA, 25 bp, Mus musculus
gactgcgcttcggatgtgttaccaa

SEQ ID NO: 648834 - DNA, 25 bp, Mus musculus
gactgcggcaacctatctataaact

SEQ ID NO: 648835 - DNA, 25 bp, Mus musculus
gactgcggcaacgtatctataaact

SEQ ID NO: 648836 - DNA, 25 bp, Mus musculus
gactgcggccctacagttccactgg

SEQ ID NO: 648837 - DNA, 25 bp, Mus musculus
gactgcggcccttcagttccactgg

SEQ ID NO: 648838 - DNA, 25 bp, Mus musculus
gactgcggggctccatcagctcttc

SEQ ID NO: 648839 - DNA, 25 bp, Mus musculus
gactgcggggctgcatcagctcttc

SEQ ID NO: 648840 - DNA, 25 bp, Mus musculus
gactgcgtaggcagtggttctcccc

SEQ ID NO: 648841 - DNA, 25 bp, Mus musculus
gactgcgtaggctgtggttctcccc

SEQ ID NO: 648842 - DNA, 25 bp, Mus musculus
gactgcgtcagtacgattggtcagc

SEQ ID NO: 648843 - DNA, 25 bp, Mus musculus
gactgcgtcagttcgattggtcagc

SEQ ID NO: 648844 - DNA, 25 bp, Mus musculus
gactgcgtctcgctcattccagatg

SEQ ID NO: 648845 - DNA, 25 bp, Mus musculus
gactgcgtctcggtcattccagatg

SEQ ID NO: 648846 - DNA, 25 bp, Mus musculus
gactgcgtgctgacctttctggcca

SEQ ID NO: 648847 - DNA, 25 bp, Mus musculus
gactgcgtgctgtcctttctggcca

SEQ ID NO: 648848 - DNA, 25 bp, Mus musculus
gactgctaactccttgcagccctat

SEQ ID NO: 648849 - DNA, 25 bp, Mus musculus
gactgctaactcgttgcagccctat

SEQ ID NO: 648850 - DNA, 25 bp, Mus musculus
gactgctaagagcagagacagcatg

SEQ ID NO: 648851 - DNA, 25 bp, Mus musculus
gactgctaagaggagagacagcatg

SEQ ID NO: 648852 - DNA, 25 bp, Mus musculus
gactgctacatcctggaccaaagtg

SEQ ID NO: 648853 - DNA, 25 bp, Mus musculus
gactgctacatcgtggaccaaagtg

SEQ ID NO: 648854 - DNA, 25 bp, Mus musculus
gactgctaggagatccccacttgga

SEQ ID NO: 648855 - DNA, 25 bp, Mus musculus
gactgctaggagttccccacttgga

SEQ ID NO: 648856 - DNA, 25 bp, Mus musculus
gactgctcagaaagtagagactgtg

SEQ ID NO: 648857 - DNA, 25 bp, Mus musculus
gactgctcagaatgtagagactgtg

SEQ ID NO: 648858 - DNA, 25 bp, Mus musculus
gactgctccaatattgacaaaattc

SEQ ID NO: 648859 - DNA, 25 bp, Mus musculus
gactgctccaattttgacaaaattc

SEQ ID NO: 648860 - DNA, 25 bp, Mus musculus
gactgctccctcaggatgaaggtcg

SEQ ID NO: 648861 - DNA, 25 bp, Mus musculus
gactgctccctctggatgaaggtcg

SEQ ID NO: 648862 - DNA, 25 bp, Mus musculus
gactgctccgccacctaaagtagaa

SEQ ID NO: 648863 - DNA, 25 bp, Mus musculus
gactgctccgcctcctaaagtagaa

SEQ ID NO: 648864 - DNA, 25 bp, Mus musculus
gactgctcgtgcatgtcaggccgtg

SEQ ID NO: 648865 - DNA, 25 bp, Mus musculus
gactgctcgtgcttgtcaggccgtg

SEQ ID NO: 648866 - DNA, 25 bp, Mus musculus
gactgctctgatcaatgctgatgag

SEQ ID NO: 648867 - DNA, 25 bp, Mus musculus
gactgctctgatgaatgctgatgag

SEQ ID NO: 648868 - DNA, 25 bp, Mus musculus
gactgctcttggaggtgctgcatcc

SEQ ID NO: 648869 - DNA, 25 bp, Mus musculus
gactgctcttggtggtgctgcatcc

SEQ ID NO: 648870 - DNA, 25 bp, Mus musculus
gactgctgattaaggaggtgcctcg

SEQ ID NO: 648871 - DNA, 25 bp, Mus musculus
gactgctgattatggaggtgcctcg

SEQ ID NO: 648872 - DNA, 25 bp, Mus musculus
gactgctgcatgactctcaggacct

SEQ ID NO: 648873 - DNA, 25 bp, Mus musculus
gactgctgcatgtctctcaggacct

SEQ ID NO: 648874 - DNA, 25 bp, Mus musculus
gactgctgcccgatgctctttaact

SEQ ID NO: 648875 - DNA, 25 bp, Mus musculus
gactgctgcccgttgctctttaact

SEQ ID NO: 648876 - DNA, 25 bp, Mus musculus
gactgctgctatctatacctcctgg

SEQ ID NO: 648877 - DNA, 25 bp, Mus musculus
gactgctgctatgtatacctcctgg

SEQ ID NO: 648878 - DNA, 25 bp, Mus musculus
gactgctgctgaagatcatctgcta

SEQ ID NO: 648879 - DNA, 25 bp, Mus musculus
gactgctgctgatgatcatctgcta

SEQ ID NO: 648880 - DNA, 25 bp, Mus musculus
gactgctgctgtcgttctctgacga

SEQ ID NO: 648881 - DNA, 25 bp, Mus musculus
gactgctgctgtggttctctgacga

SEQ ID NO: 648882 - DNA, 25 bp, Mus musculus
gactgctggctcagacaacaagaac

SEQ ID NO: 648883 - DNA, 25 bp, Mus musculus
gactgctggctctgacaacaagaac

SEQ ID NO: 648884 - DNA, 25 bp, Mus musculus
gactgctggtccctgacatccaaga

SEQ ID NO: 648885 - DNA, 25 bp, Mus musculus
gactgctggtccgtgacatccaaga

SEQ ID NO: 648886 - DNA, 25 bp, Mus musculus
gactgctgtactcgagaccatgacg

SEQ ID NO: 648887 - DNA, 25 bp, Mus musculus
gactgctgtactggagaccatgacg

SEQ ID NO: 648888 - DNA, 25 bp, Mus musculus
gactgctgtcccaataggcgtcttg

SEQ ID NO: 648889 - DNA, 25 bp, Mus musculus
gactgctgtccctataggcgtcttg

SEQ ID NO: 648890 - DNA, 25 bp, Mus musculus
gactgctgtggaccaacccatcgta

SEQ ID NO: 648891 - DNA, 25 bp, Mus musculus
gactgctgtggagcaacccatcgta

SEQ ID NO: 648892 - DNA, 25 bp, Mus musculus
gactgctgtgttcataggcctgtga

SEQ ID NO: 648893 - DNA, 25 bp, Mus musculus
gactgctgtgttgataggcctgtga

SEQ ID NO: 648894 - DNA, 25 bp, Mus musculus
gactgcttcgctcgctctatcaaca

SEQ ID NO: 648895 - DNA, 25 bp, Mus musculus
gactgcttcgctggctctatcaaca

SEQ ID NO: 648896 - DNA, 25 bp, Mus musculus
gactgcttgagcatcctgtacaata

SEQ ID NO: 648897 - DNA, 25 bp, Mus musculus
gactgcttgagcttcctgtacaata

SEQ ID NO: 648898 - DNA, 25 bp, Mus musculus
gactgcttggtgacgctgcgcttgt

SEQ ID NO: 648899 - DNA, 25 bp, Mus musculus
gactgcttggtgtcgctgcgcttgt

SEQ ID NO: 648900 - DNA, 25 bp, Mus musculus
gactgctttatcctaatgcccactg

SEQ ID NO: 648901 - DNA, 25 bp, Mus musculus
gactgctttatcgtaatgcccactg

SEQ ID NO: 648902 - DNA, 25 bp, Mus musculus
gactgctttatgctggactccggca

SEQ ID NO: 648903 - DNA, 25 bp, Mus musculus
gactgctttatggtggactccggca

SEQ ID NO: 648904 - DNA, 25 bp, Mus musculus
gactgctttggacttcaatgacttc

SEQ ID NO: 648905 - DNA, 25 bp, Mus musculus
gactgctttggagttcaatgacttc

SEQ ID NO: 648906 - DNA, 25 bp, Mus musculus
gactggaaatggcagaccatatgat

SEQ ID NO: 648907 - DNA, 25 bp, Mus musculus
gactggaaatgggagaccatatgat

SEQ ID NO: 648908 - DNA, 25 bp, Mus musculus
gactggaacactcgtcctagctgta

SEQ ID NO: 648909 - DNA, 25 bp, Mus musculus
gactggaacactggtcctagctgta

SEQ ID NO: 648910 - DNA, 25 bp, Mus musculus
gactggaacagtcacctcatatggg

SEQ ID NO: 648911 - DNA, 25 bp, Mus musculus
gactggaacagtgacctcatatggg

SEQ ID NO: 648912 - DNA, 25 bp, Mus musculus
gactggaagtaaactaggtatttct

SEQ ID NO: 648913 - DNA, 25 bp, Mus musculus
gactggaagtaatctaggtatttct

SEQ ID NO: 648914 - DNA, 25 bp, Mus musculus
gactggaataacaggaaggaatttg

SEQ ID NO: 648915 - DNA, 25 bp, Mus musculus
gactggaataactggaaggaatttg

SEQ ID NO: 648916 - DNA, 25 bp, Mus musculus
gactggaattgaacatggagctatg

SEQ ID NO: 648917 - DNA, 25 bp, Mus musculus
gactggaattgatcatggagctatg

SEQ ID NO: 648918 - DNA, 25 bp, Mus musculus
gactggacactgatcacagctgcca

SEQ ID NO: 648919 - DNA, 25 bp, Mus musculus
gactggacactgttcacagctgcca

SEQ ID NO: 648920 - DNA, 25 bp, Mus musculus
gactggacagaaccatttacagaag

SEQ ID NO: 648921 - DNA, 25 bp, Mus musculus
gactggacagaagcatttacagaag

SEQ ID NO: 648922 - DNA, 25 bp, Mus musculus
gactggacatttatacactgtttgc

SEQ ID NO: 648923 - DNA, 25 bp, Mus musculus
gactggacatttttacactgtttgc

SEQ ID NO: 648924 - DNA, 25 bp, Mus musculus
gactggaccagaatgcgagacagaa

SEQ ID NO: 648925 - DNA, 25 bp, Mus musculus
gactggaccagattgcgagacagaa

SEQ ID NO: 648926 - DNA, 25 bp, Mus musculus
gactggacctgacgcacaagggaga

SEQ ID NO: 648927 - DNA, 25 bp, Mus musculus
gactggacctgaggcacaagggaga

SEQ ID NO: 648928 - DNA, 25 bp, Mus musculus
gactggacgcacatccaaggaagct

SEQ ID NO: 648929 - DNA, 25 bp, Mus musculus
gactggacgcacttccaaggaagct

SEQ ID NO: 648930 - DNA, 25 bp, Mus musculus
gactggactcgaagctagaactggc

SEQ ID NO: 648931 - DNA, 25 bp, Mus musculus
gactggactcgaccagagaaaacct

SEQ ID NO: 648932 - DNA, 25 bp, Mus musculus
gactggactcgagcagagaaaacct

SEQ ID NO: 648933 - DNA, 25 bp, Mus musculus
gactggactcgatgctagaactggc

SEQ ID NO: 648934 - DNA, 25 bp, Mus musculus
gactggacttatcatgatttccgaa

SEQ ID NO: 648935 - DNA, 25 bp, Mus musculus
gactggacttatgatgatttccgaa

SEQ ID NO: 648936 - DNA, 25 bp, Mus musculus
gactggacttttctaagccatggag

SEQ ID NO: 648937 - DNA, 25 bp, Mus musculus
gactggacttttgtaagccatggag

SEQ ID NO: 648938 - DNA, 25 bp, Mus musculus
gactggagaataagcctgtggccga

SEQ ID NO: 648939 - DNA, 25 bp, Mus musculus
gactggagaatatgcctgtggccga

SEQ ID NO: 648940 - DNA, 25 bp, Mus musculus
gactggagacagaacttagagagct

SEQ ID NO: 648941 - DNA, 25 bp, Mus musculus
gactggagacagtacttagagagct

SEQ ID NO: 648942 - DNA, 25 bp, Mus musculus
gactggagagaaacggaatcacaga

SEQ ID NO: 648943 - DNA, 25 bp, Mus musculus
gactggagagaatcggaatcacaga

SEQ ID NO: 648944 - DNA, 25 bp, Mus musculus
gactggagagagctcatacagagct

SEQ ID NO: 648945 - DNA, 25 bp, Mus musculus
gactggagagaggtcatacagagct

SEQ ID NO: 648946 - DNA, 25 bp, Mus musculus
gactggagagcaagcgggcatctcc

SEQ ID NO: 648947 - DNA, 25 bp, Mus musculus
gactggagagcatgcgggcatctcc

SEQ ID NO: 648948 - DNA, 25 bp, Mus musculus
gactggagcagcaggtcaaattgca

SEQ ID NO: 648949 - DNA, 25 bp, Mus musculus
gactggagcagctggtcaaattgca

SEQ ID NO: 648950 - DNA, 25 bp, Mus musculus
gactggagcccaaggaggttcccct

SEQ ID NO: 648951 - DNA, 25 bp, Mus musculus
gactggagcccatggaggttcccct

SEQ ID NO: 648952 - DNA, 25 bp, Mus musculus
gactggagccctctactgtaattga

SEQ ID NO: 648953 - DNA, 25 bp, Mus musculus
gactggagccctgtactgtaattga

SEQ ID NO: 648954 - DNA, 25 bp, Mus musculus
gactggagcctgcataaccactgag

SEQ ID NO: 648955 - DNA, 25 bp, Mus musculus
gactggagcctggataaccactgag

SEQ ID NO: 648956 - DNA, 25 bp, Mus musculus
gactggaggatgattctaagtaccc

SEQ ID NO: 648957 - DNA, 25 bp, Mus musculus
gactggaggatgtttctaagtaccc

SEQ ID NO: 648958 - DNA, 25 bp, Mus musculus
gactggaggtccacaggcattgacc

SEQ ID NO: 648959 - DNA, 25 bp, Mus musculus
gactggaggtcctcaggcattgacc

SEQ ID NO: 648960 - DNA, 25 bp, Mus musculus
gactggagtaaaagatctaactgca

SEQ ID NO: 648961 - DNA, 25 bp, Mus musculus
gactggagtaaatgatctaactgca

SEQ ID NO: 648962 - DNA, 25 bp, Mus musculus
gactggagtcagaatacagctatat

SEQ ID NO: 648963 - DNA, 25 bp, Mus musculus
gactggagtcagtatacagctatat

SEQ ID NO: 648964 - DNA, 25 bp, Mus musculus
gactggagtccaagaatgatgtcga

SEQ ID NO: 648965 - DNA, 25 bp, Mus musculus
gactggagtccatgaatgatgtcga

SEQ ID NO: 648966 - DNA, 25 bp, Mus musculus
gactggagttgtagaatatctggag

SEQ ID NO: 648967 - DNA, 25 bp, Mus musculus
gactggagttgttgaatatctggag

SEQ ID NO: 648968 - DNA, 25 bp, Mus musculus
gactggatatgcacaggactgccct

SEQ ID NO: 648969 - DNA, 25 bp, Mus musculus
gactggatatgctcaggactgccct

SEQ ID NO: 648970 - DNA, 25 bp, Mus musculus
gactggatgacaatatccggactgt

SEQ ID NO: 648971 - DNA, 25 bp, Mus musculus
gactggatgacattatccggactgt

SEQ ID NO: 648972 - DNA, 25 bp, Mus musculus
gactggatggcactgaatggcatca

SEQ ID NO: 648973 - DNA, 25 bp, Mus musculus
gactggatggcagtgaatggcatca

SEQ ID NO: 648974 - DNA, 25 bp, Mus musculus
gactggatgtggagaagacatctga

SEQ ID NO: 648975 - DNA, 25 bp, Mus musculus
gactggatgtggtgaagacatctga

SEQ ID NO: 648976 - DNA, 25 bp, Mus musculus
gactggattaacaaggtcatgcagc

SEQ ID NO: 648977 - DNA, 25 bp, Mus musculus
gactggattaactaggtcatgcagc

SEQ ID NO: 648978 - DNA, 25 bp, Mus musculus
gactggattcaaaacgtgctgcggg

SEQ ID NO: 648979 - DNA, 25 bp, Mus musculus
gactggattcaatacgtgctgcggg

SEQ ID NO: 648980 - DNA, 25 bp, Mus musculus
gactggattcacagcagatgatatc

SEQ ID NO: 648981 - DNA, 25 bp, Mus musculus
gactggattcactgcagatgatatc

SEQ ID NO: 648982 - DNA, 25 bp, Mus musculus
gactggattcttcaggataagacag

SEQ ID NO: 648983 - DNA, 25 bp, Mus musculus
gactggattcttgaggataagacag

SEQ ID NO: 648984 - DNA, 25 bp, Mus musculus
gactggattgtgctaaggatcaacc

SEQ ID NO: 648985 - DNA, 25 bp, Mus musculus
gactggattgtggtaaggatcaacc

SEQ ID NO: 648986 - DNA, 25 bp, Mus musculus
gactggcaaaagcagaagcttccag

SEQ ID NO: 648987 - DNA, 25 bp, Mus musculus
gactggcaaaaggagaagcttccag

SEQ ID NO: 648988 - DNA, 25 bp, Mus musculus
gactggcacgaaaccaagagtggaa

SEQ ID NO: 648989 - DNA, 25 bp, Mus musculus
gactggcacgaatccaagagtggaa

SEQ ID NO: 648990 - DNA, 25 bp, Mus musculus
gactggcaggtgagttccatatgac

SEQ ID NO: 648991 - DNA, 25 bp, Mus musculus
gactggcaggtgtgttccatatgac

SEQ ID NO: 648992 - DNA, 25 bp, Mus musculus
gactggcatcatatttaccctgctt

SEQ ID NO: 648993 - DNA, 25 bp, Mus musculus
gactggcatcatttttaccctgctt

SEQ ID NO: 648994 - DNA, 25 bp, Mus musculus
gactggcatcggagacagaagcacg

SEQ ID NO: 648995 - DNA, 25 bp, Mus musculus
gactggcatcggtgacagaagcacg

SEQ ID NO: 648996 - DNA, 25 bp, Mus musculus
gactggcatggcactcccaagattg

SEQ ID NO: 648997 - DNA, 25 bp, Mus musculus
gactggcatggctctcccaagattg

SEQ ID NO: 648998 - DNA, 25 bp, Mus musculus
gactggcatttcatcacctattgag

SEQ ID NO: 648999 - DNA, 25 bp, Mus musculus
gactggcatttcttcacctattgag

SEQ ID NO: 649000 - DNA, 25 bp, Mus musculus
gactggccaataaccccgatatcgt

SEQ ID NO: 649001 - DNA, 25 bp, Mus musculus
gactggccaatatccccgatatcgt

SEQ ID NO: 649002 - DNA, 25 bp, Mus musculus
gactggcccagcaatgggatcagct

SEQ ID NO: 649003 - DNA, 25 bp, Mus musculus
gactggcccagctatgggatcagct

SEQ ID NO: 649004 - DNA, 25 bp, Mus musculus
gactggcccaggcaactgttctaga

SEQ ID NO: 649005 - DNA, 25 bp, Mus musculus
gactggcccagggaactgttctaga

SEQ ID NO: 649006 - DNA, 25 bp, Mus musculus
gactggcccggtctggaataaacac

SEQ ID NO: 649007 - DNA, 25 bp, Mus musculus
gactggcccggtgtggaataaacac

SEQ ID NO: 649008 - DNA, 25 bp, Mus musculus
gactggcccttgcataccatcaagc

SEQ ID NO: 649009 - DNA, 25 bp, Mus musculus
gactggcccttggataccatcaagc

SEQ ID NO: 649010 - DNA, 25 bp, Mus musculus
gactggccctttcatgatggagcgc

SEQ ID NO: 649011 - DNA, 25 bp, Mus musculus
gactggccctttgatgatggagcgc

SEQ ID NO: 649012 - DNA, 25 bp, Mus musculus
gactggcctatgctgtccgaaactg

SEQ ID NO: 649013 - DNA, 25 bp, Mus musculus
gactggcctatggtgtccgaaactg

SEQ ID NO: 649014 - DNA, 25 bp, Mus musculus
gactggcctggaccatttgaagaag

SEQ ID NO: 649015 - DNA, 25 bp, Mus musculus
gactggcctggagcatttgaagaag

SEQ ID NO: 649016 - DNA, 25 bp, Mus musculus
gactggccttccactgattcagcta

SEQ ID NO: 649017 - DNA, 25 bp, Mus musculus
gactggccttcctctgattcagcta

SEQ ID NO: 649018 - DNA, 25 bp, Mus musculus
gactggccttggattcactatggag

SEQ ID NO: 649019 - DNA, 25 bp, Mus musculus
gactggccttggtttcactatggag

SEQ ID NO: 649020 - DNA, 25 bp, Mus musculus
gactggcgcactcacagctttccag

SEQ ID NO: 649021 - DNA, 25 bp, Mus musculus
gactggcgcactgacagctttccag

SEQ ID NO: 649022 - DNA, 25 bp, Mus musculus
gactggcgccgcatcaagcagttgg

SEQ ID NO: 649023 - DNA, 25 bp, Mus musculus
gactggcgccgcttcaagcagttgg

SEQ ID NO: 649024 - DNA, 25 bp, Mus musculus
gactggcgctatcaccgttatcttg

SEQ ID NO: 649025 - DNA, 25 bp, Mus musculus
gactggcgctatgaccgttatcttg

SEQ ID NO: 649026 - DNA, 25 bp, Mus musculus
gactggcggcaacaatatgtgctta

SEQ ID NO: 649027 - DNA, 25 bp, Mus musculus
gactggcggcaagaatatgtgctta

SEQ ID NO: 649028 - DNA, 25 bp, Mus musculus
gactggctacggctgatctctaaga

SEQ ID NO: 649029 - DNA, 25 bp, Mus musculus
gactggctacgggtgatctctaaga

SEQ ID NO: 649030 - DNA, 25 bp, Mus musculus
gactggctcgtgcagtctttgcgat

SEQ ID NO: 649031 - DNA, 25 bp, Mus musculus
gactggctcgtggagtctttgcgat

SEQ ID NO: 649032 - DNA, 25 bp, Mus musculus
gactggctgcacaggtagtattgtg

SEQ ID NO: 649033 - DNA, 25 bp, Mus musculus
gactggctgcactggtagtattgtg

SEQ ID NO: 649034 - DNA, 25 bp, Mus musculus
gactggctgtacatcttcaacgtga

SEQ ID NO: 649035 - DNA, 25 bp, Mus musculus
gactggctgtacttcttcaacgtga

SEQ ID NO: 649036 - DNA, 25 bp, Mus musculus
gactgggaaaatctactgggaaata

SEQ ID NO: 649037 - DNA, 25 bp, Mus musculus
gactgggaaaatgtactgggaaata

SEQ ID NO: 649038 - DNA, 25 bp, Mus musculus
gactgggaacacaaccatacttctt

SEQ ID NO: 649039 - DNA, 25 bp, Mus musculus
gactgggaacactaccatacttctt

SEQ ID NO: 649040 - DNA, 25 bp, Mus musculus
gactgggaagacaccgtgaatatag

SEQ ID NO: 649041 - DNA, 25 bp, Mus musculus
gactgggaagactccgtgaatatag

SEQ ID NO: 649042 - DNA, 25 bp, Mus musculus
gactgggaagggaaccgagcctact

SEQ ID NO: 649043 - DNA, 25 bp, Mus musculus
gactgggaagggtaccgagcctact

SEQ ID NO: 649044 - DNA, 25 bp, Mus musculus
gactgggaccctcaagttttgccct

SEQ ID NO: 649045 - DNA, 25 bp, Mus musculus
gactgggaccctgaagttttgccct

SEQ ID NO: 649046 - DNA, 25 bp, Mus musculus
gactgggatttcagtggcattagaa

SEQ ID NO: 649047 - DNA, 25 bp, Mus musculus
gactgggatttctgtggcattagaa

SEQ ID NO: 649048 - DNA, 25 bp, Mus musculus
gactgggcagcacgctttcgggact

SEQ ID NO: 649049 - DNA, 25 bp, Mus musculus
gactgggcagcaggctttcgggact

SEQ ID NO: 649050 - DNA, 25 bp, Mus musculus
gactgggccctcaacatggaaatct

SEQ ID NO: 649051 - DNA, 25 bp, Mus musculus
gactgggccctctacatggaaatct

SEQ ID NO: 649052 - DNA, 25 bp, Mus musculus
gactgggcctaaactggctgattga

SEQ ID NO: 649053 - DNA, 25 bp, Mus musculus
gactgggcctaatctggctgattga

SEQ ID NO: 649054 - DNA, 25 bp, Mus musculus
gactgggcctttcgtcttagagttg

SEQ ID NO: 649055 - DNA, 25 bp, Mus musculus
gactgggcctttggtcttagagttg

SEQ ID NO: 649056 - DNA, 25 bp, Mus musculus
gactgggctccgaatcctcttagag

SEQ ID NO: 649057 - DNA, 25 bp, Mus musculus
gactgggctccgtatcctcttagag

SEQ ID NO: 649058 - DNA, 25 bp, Mus musculus
gactgggctcctaagagcgaccgta

SEQ ID NO: 649059 - DNA, 25 bp, Mus musculus
gactgggctccttagagcgaccgta

SEQ ID NO: 649060 - DNA, 25 bp, Mus musculus
gactgggctcgtatcaccctctgga

SEQ ID NO: 649061 - DNA, 25 bp, Mus musculus
gactgggctcgtttcaccctctgga

SEQ ID NO: 649062 - DNA, 25 bp, Mus musculus
gactggggctagaccacagagactg

SEQ ID NO: 649063 - DNA, 25 bp, Mus musculus
gactggggctagtccacagagactg

SEQ ID NO: 649064 - DNA, 25 bp, Mus musculus
gactgggtcattcatgactgcattg

SEQ ID NO: 649065 - DNA, 25 bp, Mus musculus
gactgggtcattgatgactgcattg

SEQ ID NO: 649066 - DNA, 25 bp, Mus musculus
gactgggtcgctagcccagtgttcc

SEQ ID NO: 649067 - DNA, 25 bp, Mus musculus
gactgggtcgcttgcccagtgttcc

SEQ ID NO: 649068 - DNA, 25 bp, Mus musculus
gactgggtgcacatcttcccagaag

SEQ ID NO: 649069 - DNA, 25 bp, Mus musculus
gactgggtgcacttcttcccagaag

SEQ ID NO: 649070 - DNA, 25 bp, Mus musculus
gactgggtgcctcctcatggctcaa

SEQ ID NO: 649071 - DNA, 25 bp, Mus musculus
gactgggtgcctgctcatggctcaa

SEQ ID NO: 649072 - DNA, 25 bp, Mus musculus
gactgggttctcatgcggtactaac

SEQ ID NO: 649073 - DNA, 25 bp, Mus musculus
gactgggttctcttgcggtactaac

SEQ ID NO: 649074 - DNA, 25 bp, Mus musculus
gactggtacgtcaaggattaaaatg

SEQ ID NO: 649075 - DNA, 25 bp, Mus musculus
gactggtacgtctaggattaaaatg

SEQ ID NO: 649076 - DNA, 25 bp, Mus musculus
gactggtactgaattcctctgggta

SEQ ID NO: 649077 - DNA, 25 bp, Mus musculus
gactggtactgatttcctctgggta

SEQ ID NO: 649078 - DNA, 25 bp, Mus musculus
gactggtatcctaagtgcactctgg

SEQ ID NO: 649079 - DNA, 25 bp, Mus musculus
gactggtatccttagtgcactctgg

SEQ ID NO: 649080 - DNA, 25 bp, Mus musculus
gactggtatcttcgaaatctctgga

SEQ ID NO: 649081 - DNA, 25 bp, Mus musculus
gactggtatcttggaaatctctgga

SEQ ID NO: 649082 - DNA, 25 bp, Mus musculus
gactggtatgcaatcagcactctga

SEQ ID NO: 649083 - DNA, 25 bp, Mus musculus
gactggtatgcattcagcactctga

SEQ ID NO: 649084 - DNA, 25 bp, Mus musculus
gactggtattatcctcaacttcaga

SEQ ID NO: 649085 - DNA, 25 bp, Mus musculus
gactggtattatgctcaacttcaga

SEQ ID NO: 649086 - DNA, 25 bp, Mus musculus
gactggtattgaaagccgagtcttc

SEQ ID NO: 649087 - DNA, 25 bp, Mus musculus
gactggtattgatagccgagtcttc

SEQ ID NO: 649088 - DNA, 25 bp, Mus musculus
gactggtcaattccagtttacaccc

SEQ ID NO: 649089 - DNA, 25 bp, Mus musculus
gactggtcaattgcagtttacaccc

SEQ ID NO: 649090 - DNA, 25 bp, Mus musculus
gactggtcacgcagaaactgttagc

SEQ ID NO: 649091 - DNA, 25 bp, Mus musculus
gactggtcacgctgaaactgttagc

SEQ ID NO: 649092 - DNA, 25 bp, Mus musculus
gactggtcccacatctcctttgctg

SEQ ID NO: 649093 - DNA, 25 bp, Mus musculus
gactggtcccacttctcctttgctg

SEQ ID NO: 649094 - DNA, 25 bp, Mus musculus
gactggtccctgatagtcctgctgg

SEQ ID NO: 649095 - DNA, 25 bp, Mus musculus
gactggtccctgttagtcctgctgg

SEQ ID NO: 649096 - DNA, 25 bp, Mus musculus
gactggtcctccatagtgcaacatg

SEQ ID NO: 649097 - DNA, 25 bp, Mus musculus
gactggtcctccttagtgcaacatg

SEQ ID NO: 649098 - DNA, 25 bp, Mus musculus
gactggtgaactccatcatcctggt

SEQ ID NO: 649099 - DNA, 25 bp, Mus musculus
gactggtgaactgcatcatcctggt

SEQ ID NO: 649100 - DNA, 25 bp, Mus musculus
gactggtgacctcttgagtctgtaa

SEQ ID NO: 649101 - DNA, 25 bp, Mus musculus
gactggtgacctgttgagtctgtaa

SEQ ID NO: 649102 - DNA, 25 bp, Mus musculus
gactggtgcaacaggactttgatta

SEQ ID NO: 649103 - DNA, 25 bp, Mus musculus
gactggtgcaactggactttgatta

SEQ ID NO: 649104 - DNA, 25 bp, Mus musculus
gactggtgcatcactcggcagctgt

SEQ ID NO: 649105 - DNA, 25 bp, Mus musculus
gactggtgcatctctcggcagctgt

SEQ ID NO: 649106 - DNA, 25 bp, Mus musculus
gactggtgctccaagctgaagttca

SEQ ID NO: 649107 - DNA, 25 bp, Mus musculus
gactggtgctcctagctgaagttca

SEQ ID NO: 649108 - DNA, 25 bp, Mus musculus
gactggtgctgactcctactcgaga

SEQ ID NO: 649109 - DNA, 25 bp, Mus musculus
gactggtgctgagtcctactcgaga

SEQ ID NO: 649110 - DNA, 25 bp, Mus musculus
gactggtggaacacgacttccttct

SEQ ID NO: 649111 - DNA, 25 bp, Mus musculus
gactggtggaactcgacttccttct

SEQ ID NO: 649112 - DNA, 25 bp, Mus musculus
gactggtggatgagcatgatcatca

SEQ ID NO: 649113 - DNA, 25 bp, Mus musculus
gactggtggatgtgcatgatcatca

SEQ ID NO: 649114 - DNA, 25 bp, Mus musculus
gactggtgggccaggatatccaatg

SEQ ID NO: 649115 - DNA, 25 bp, Mus musculus
gactggtgggcctggatatccaatg

SEQ ID NO: 649116 - DNA, 25 bp, Mus musculus
gactggtggtctatgagtcaatgcc

SEQ ID NO: 649117 - DNA, 25 bp, Mus musculus
gactggtggtctctgacactctgga

SEQ ID NO: 649118 - DNA, 25 bp, Mus musculus
gactggtggtctgtgacactctgga

SEQ ID NO: 649119 - DNA, 25 bp, Mus musculus
gactggtggtctttgagtcaatgcc

SEQ ID NO: 649120 - DNA, 25 bp, Mus musculus
gactggtggttgagccaatctctag

SEQ ID NO: 649121 - DNA, 25 bp, Mus musculus
gactggtggttgtgccaatctctag

SEQ ID NO: 649122 - DNA, 25 bp, Mus musculus
gactggtgtccccacaatgatgaag

SEQ ID NO: 649123 - DNA, 25 bp, Mus musculus
gactggtgtcccgacaatgatgaag

SEQ ID NO: 649124 - DNA, 25 bp, Mus musculus
gactggtgtgtaagagctcagcctt

SEQ ID NO: 649125 - DNA, 25 bp, Mus musculus
gactggtgtgtatgagctcagcctt

SEQ ID NO: 649126 - DNA, 25 bp, Mus musculus
gactggtgtgtccacaggattcttc

SEQ ID NO: 649127 - DNA, 25 bp, Mus musculus
gactggtgtgtcgacaggattcttc

SEQ ID NO: 649128 - DNA, 25 bp, Mus musculus
gactggttatccatgctcatttctg

SEQ ID NO: 649129 - DNA, 25 bp, Mus musculus
gactggttatccttgctcatttctg

SEQ ID NO: 649130 - DNA, 25 bp, Mus musculus
gactggttctatcagaaggagtcag

SEQ ID NO: 649131 - DNA, 25 bp, Mus musculus
gactggttctatgagaaggagtcag

SEQ ID NO: 649132 - DNA, 25 bp, Mus musculus
gactggtttcacaaaattgaatggc

SEQ ID NO: 649133 - DNA, 25 bp, Mus musculus
gactggtttcactaaattgaatggc

SEQ ID NO: 649134 - DNA, 25 bp, Mus musculus
gactggtttcctatctcccaggatt

SEQ ID NO: 649135 - DNA, 25 bp, Mus musculus
gactggtttcctttctcccaggatt

SEQ ID NO: 649136 - DNA, 25 bp, Mus musculus
gactggtttcttcagtgtggactaa

SEQ ID NO: 649137 - DNA, 25 bp, Mus musculus
gactggtttcttgagtgtggactaa

SEQ ID NO: 649138 - DNA, 25 bp, Mus musculus
gactggtttgacaaccatggccaca

SEQ ID NO: 649139 - DNA, 25 bp, Mus musculus
gactggtttgactaccatggccaca

SEQ ID NO: 649140 - DNA, 25 bp, Mus musculus
gactggtttgctacagccatcggga

SEQ ID NO: 649141 - DNA, 25 bp, Mus musculus
gactggtttgcttcagccatcggga

SEQ ID NO: 649142 - DNA, 25 bp, Mus musculus
gactgtaaagcgaatccgggaacag

SEQ ID NO: 649143 - DNA, 25 bp, Mus musculus
gactgtaaagcgtatccgggaacag

SEQ ID NO: 649144 - DNA, 25 bp, Mus musculus
gactgtaactatagcaacctggaga

SEQ ID NO: 649145 - DNA, 25 bp, Mus musculus
gactgtaactattgcaacctggaga

SEQ ID NO: 649146 - DNA, 25 bp, Mus musculus
gactgtaactcccagtgtaaccaaa

SEQ ID NO: 649147 - DNA, 25 bp, Mus musculus
gactgtaactccgagtgtaaccaaa

SEQ ID NO: 649148 - DNA, 25 bp, Mus musculus
gactgtaactcgaaatcctcccggg

SEQ ID NO: 649149 - DNA, 25 bp, Mus musculus
gactgtaactcgtaatcctcccggg

SEQ ID NO: 649150 - DNA, 25 bp, Mus musculus
gactgtaagactcacaataaagtga

SEQ ID NO: 649151 - DNA, 25 bp, Mus musculus
gactgtaagactgacaataaagtga

SEQ ID NO: 649152 - DNA, 25 bp, Mus musculus
gactgtaagcctcagtccctcgcat

SEQ ID NO: 649153 - DNA, 25 bp, Mus musculus
gactgtaagcctgagtccctcgcat

SEQ ID NO: 649154 - DNA, 25 bp, Mus musculus
gactgtacaaaaaacctatgggcaa

SEQ ID NO: 649155 - DNA, 25 bp, Mus musculus
gactgtacaaaatacctatgggcaa

SEQ ID NO: 649156 - DNA, 25 bp, Mus musculus
gactgtacaataaaaatggatccca

SEQ ID NO: 649157 - DNA, 25 bp, Mus musculus
gactgtacaatataaatggatccca

SEQ ID NO: 649158 - DNA, 25 bp, Mus musculus
gactgtacacctaatgtttgccaag

SEQ ID NO: 649159 - DNA, 25 bp, Mus musculus
gactgtacaccttatgtttgccaag

SEQ ID NO: 649160 - DNA, 25 bp, Mus musculus
gactgtacattaactcacttagaga

SEQ ID NO: 649161 - DNA, 25 bp, Mus musculus
gactgtacattatctcacttagaga

SEQ ID NO: 649162 - DNA, 25 bp, Mus musculus
gactgtacatttattacaaaaggag

SEQ ID NO: 649163 - DNA, 25 bp, Mus musculus
gactgtacattttttacaaaaggag

SEQ ID NO: 649164 - DNA, 25 bp, Mus musculus
gactgtaccaggagagcagatgcct

SEQ ID NO: 649165 - DNA, 25 bp, Mus musculus
gactgtaccaggtgagcagatgcct

SEQ ID NO: 649166 - DNA, 25 bp, Mus musculus
gactgtaccgccagttttccgaggg

SEQ ID NO: 649167 - DNA, 25 bp, Mus musculus
gactgtaccgcctgttttccgaggg

SEQ ID NO: 649168 - DNA, 25 bp, Mus musculus
gactgtacttgcacttggaaaccta

SEQ ID NO: 649169 - DNA, 25 bp, Mus musculus
gactgtacttgctcttggaaaccta

SEQ ID NO: 649170 - DNA, 25 bp, Mus musculus
gactgtagaagaagctcaacacaaa

SEQ ID NO: 649171 - DNA, 25 bp, Mus musculus
gactgtagaagatgctcaacacaaa

SEQ ID NO: 649172 - DNA, 25 bp, Mus musculus
gactgtagatttaatcagactgaag

SEQ ID NO: 649173 - DNA, 25 bp, Mus musculus
gactgtagattttatcagactgaag

SEQ ID NO: 649174 - DNA, 25 bp, Mus musculus
gactgtagccaacgagggtgcggag

SEQ ID NO: 649175 - DNA, 25 bp, Mus musculus
gactgtagccaaggagggtgcggag

SEQ ID NO: 649176 - DNA, 25 bp, Mus musculus
gactgtagccgcattgatagcccgg

SEQ ID NO: 649177 - DNA, 25 bp, Mus musculus
gactgtagccgctttgatagcccgg

SEQ ID NO: 649178 - DNA, 25 bp, Mus musculus
gactgtatacgacctcactggcctg

SEQ ID NO: 649179 - DNA, 25 bp, Mus musculus
gactgtatacgagctcactggcctg

SEQ ID NO: 649180 - DNA, 25 bp, Mus musculus
gactgtatgcagcttttggcagaga

SEQ ID NO: 649181 - DNA, 25 bp, Mus musculus
gactgtatgcaggttttggcagaga

SEQ ID NO: 649182 - DNA, 25 bp, Mus musculus
gactgtattactcttctcatggctg

SEQ ID NO: 649183 - DNA, 25 bp, Mus musculus
gactgtattactgttctcatggctg

SEQ ID NO: 649184 - DNA, 25 bp, Mus musculus
gactgtattcatcgtggagatttca

SEQ ID NO: 649185 - DNA, 25 bp, Mus musculus
gactgtattcatggtggagatttca

SEQ ID NO: 649186 - DNA, 25 bp, Mus musculus
gactgtcaaagaagtgctgcctgcc

SEQ ID NO: 649187 - DNA, 25 bp, Mus musculus
gactgtcaaagatgtgctgcctgcc

SEQ ID NO: 649188 - DNA, 25 bp, Mus musculus
gactgtcaatcacctacaagccctg

SEQ ID NO: 649189 - DNA, 25 bp, Mus musculus
gactgtcaatcagctacaagccctg

SEQ ID NO: 649190 - DNA, 25 bp, Mus musculus
gactgtcaccagaggtgggaagcct

SEQ ID NO: 649191 - DNA, 25 bp, Mus musculus
gactgtcaccagtggtgggaagcct

SEQ ID NO: 649192 - DNA, 25 bp, Mus musculus
gactgtcaccatcttggaatccaaa

SEQ ID NO: 649193 - DNA, 25 bp, Mus musculus
gactgtcaccatgttggaatccaaa

SEQ ID NO: 649194 - DNA, 25 bp, Mus musculus
gactgtcacttcaaacagagcaaga

SEQ ID NO: 649195 - DNA, 25 bp, Mus musculus
gactgtcacttctaacagagcaaga

SEQ ID NO: 649196 - DNA, 25 bp, Mus musculus
gactgtcagcgacttcctgctttgg

SEQ ID NO: 649197 - DNA, 25 bp, Mus musculus
gactgtcagcgagttcctgctttgg

SEQ ID NO: 649198 - DNA, 25 bp, Mus musculus
gactgtcagggtacaggctgtagca

SEQ ID NO: 649199 - DNA, 25 bp, Mus musculus
gactgtcagggttcaggctgtagca

SEQ ID NO: 649200 - DNA, 25 bp, Mus musculus
gactgtcagtggatcgacatcacag

SEQ ID NO: 649201 - DNA, 25 bp, Mus musculus
gactgtcagtggttcgacatcacag

SEQ ID NO: 649202 - DNA, 25 bp, Mus musculus
gactgtcataccctgcactccaggg

SEQ ID NO: 649203 - DNA, 25 bp, Mus musculus
gactgtcataccgtgcactccaggg

SEQ ID NO: 649204 - DNA, 25 bp, Mus musculus
gactgtcatcctcaatttctgccac

SEQ ID NO: 649205 - DNA, 25 bp, Mus musculus
gactgtcatcctgaatttctgccac

SEQ ID NO: 649206 - DNA, 25 bp, Mus musculus
gactgtcatgctcagatcgtggcga

SEQ ID NO: 649207 - DNA, 25 bp, Mus musculus
gactgtcatgctgagatcgtggcga

SEQ ID NO: 649208 - DNA, 25 bp, Mus musculus
gactgtcattcacgccattggcttc

SEQ ID NO: 649209 - DNA, 25 bp, Mus musculus
gactgtcattcaggccattggcttc

SEQ ID NO: 649210 - DNA, 25 bp, Mus musculus
gactgtccagatccgcgcccagatg

SEQ ID NO: 649211 - DNA, 25 bp, Mus musculus
gactgtccagatgcgcgcccagatg

SEQ ID NO: 649212 - DNA, 25 bp, Mus musculus
gactgtccaggcactattttgtcct

SEQ ID NO: 649213 - DNA, 25 bp, Mus musculus
gactgtccaggctctattttgtcct

SEQ ID NO: 649214 - DNA, 25 bp, Mus musculus
gactgtcccaggaatatgctatgat

SEQ ID NO: 649215 - DNA, 25 bp, Mus musculus
gactgtcccaggtatatgctatgat

SEQ ID NO: 649216 - DNA, 25 bp, Mus musculus
gactgtccctcaagtgagtgacttt

SEQ ID NO: 649217 - DNA, 25 bp, Mus musculus
gactgtccctcatgtgagtgacttt

SEQ ID NO: 649218 - DNA, 25 bp, Mus musculus
gactgtcctagaccctgttactggg

SEQ ID NO: 649219 - DNA, 25 bp, Mus musculus
gactgtcctagagcctgttactggg

SEQ ID NO: 649220 - DNA, 25 bp, Mus musculus
gactgtcctcaccttacaggataag

SEQ ID NO: 649221 - DNA, 25 bp, Mus musculus
gactgtcctcacgttacaggataag

SEQ ID NO: 649222 - DNA, 25 bp, Mus musculus
gactgtcctctgaaattgtataatc

SEQ ID NO: 649223 - DNA, 25 bp, Mus musculus
gactgtcctctgtaattgtataatc

SEQ ID NO: 649224 - DNA, 25 bp, Mus musculus
gactgtcctgacattttgagttcca

SEQ ID NO: 649225 - DNA, 25 bp, Mus musculus
gactgtcctgactttttgagttcca

SEQ ID NO: 649226 - DNA, 25 bp, Mus musculus
gactgtcctgccagaaggtcttgat

SEQ ID NO: 649227 - DNA, 25 bp, Mus musculus
gactgtcctgcctgaaggtcttgat

SEQ ID NO: 649228 - DNA, 25 bp, Mus musculus
gactgtcctggcctgattcaggtgc

SEQ ID NO: 649229 - DNA, 25 bp, Mus musculus
gactgtcctggcgtgattcaggtgc

SEQ ID NO: 649230 - DNA, 25 bp, Mus musculus
gactgtccttttagaaatcaagaag

SEQ ID NO: 649231 - DNA, 25 bp, Mus musculus
gactgtcctttttgaaatcaagaag

SEQ ID NO: 649232 - DNA, 25 bp, Mus musculus
gactgtcgagctctcctggctttga

SEQ ID NO: 649233 - DNA, 25 bp, Mus musculus
gactgtcgagctgtcctggctttga

SEQ ID NO: 649234 - DNA, 25 bp, Mus musculus
gactgtcgcgccacgtgtccttcag

SEQ ID NO: 649235 - DNA, 25 bp, Mus musculus
gactgtcgcgcctcgtgtccttcag

SEQ ID NO: 649236 - DNA, 25 bp, Mus musculus
gactgtctacgcattcagcattgag

SEQ ID NO: 649237 - DNA, 25 bp, Mus musculus
gactgtctacgctttcagcattgag

SEQ ID NO: 649238 - DNA, 25 bp, Mus musculus
gactgtctcaccacgagaactctga

SEQ ID NO: 649239 - DNA, 25 bp, Mus musculus
gactgtctcacctcgagaactctga

SEQ ID NO: 649240 - DNA, 25 bp, Mus musculus
gactgtctgactacaagcaagttct

SEQ ID NO: 649241 - DNA, 25 bp, Mus musculus
gactgtctgacttcaagcaagttct

SEQ ID NO: 649242 - DNA, 25 bp, Mus musculus
gactgtctgagcaatgggcgaaaaa

SEQ ID NO: 649243 - DNA, 25 bp, Mus musculus
gactgtctgagctatgggcgaaaaa

SEQ ID NO: 649244 - DNA, 25 bp, Mus musculus
gactgtctgatcaatgctgctaaga

SEQ ID NO: 649245 - DNA, 25 bp, Mus musculus
gactgtctgatctatgctgctaaga

SEQ ID NO: 649246 - DNA, 25 bp, Mus musculus
gactgtctggctctctaagcttggg

SEQ ID NO: 649247 - DNA, 25 bp, Mus musculus
gactgtctggctgtctaagcttggg

SEQ ID NO: 649248 - DNA, 25 bp, Mus musculus
gactgtctgtacagattgcatctaa

SEQ ID NO: 649249 - DNA, 25 bp, Mus musculus
gactgtctgtactgattgcatctaa

SEQ ID NO: 649250 - DNA, 25 bp, Mus musculus
gactgtctgtagatgcggacagctt

SEQ ID NO: 649251 - DNA, 25 bp, Mus musculus
gactgtctgtagttgcggacagctt

SEQ ID NO: 649252 - DNA, 25 bp, Mus musculus
gactgtctgtataggaaaggaggcc

SEQ ID NO: 649253 - DNA, 25 bp, Mus musculus
gactgtctgtattggaaaggaggcc

SEQ ID NO: 649254 - DNA, 25 bp, Mus musculus
gactgtcttacaaccaccagcgtta

SEQ ID NO: 649255 - DNA, 25 bp, Mus musculus
gactgtcttacatccaccagcgtta

SEQ ID NO: 649256 - DNA, 25 bp, Mus musculus
gactgtcttagtctagcctctggta

SEQ ID NO: 649257 - DNA, 25 bp, Mus musculus
gactgtcttagtgtagcctctggta

SEQ ID NO: 649258 - DNA, 25 bp, Mus musculus
gactgtcttccaacgaggtggcaat

SEQ ID NO: 649259 - DNA, 25 bp, Mus musculus
gactgtcttccatcgaggtggcaat

SEQ ID NO: 649260 - DNA, 25 bp, Mus musculus
gactgtgaacagcactgtctctgta

SEQ ID NO: 649261 - DNA, 25 bp, Mus musculus
gactgtgaacaggactgtctctgta

SEQ ID NO: 649262 - DNA, 25 bp, Mus musculus
gactgtgaacataccgttctggcta

SEQ ID NO: 649263 - DNA, 25 bp, Mus musculus
gactgtgaacattccgttctggcta

SEQ ID NO: 649264 - DNA, 25 bp, Mus musculus
gactgtgaagagagacatgagtgcc

SEQ ID NO: 649265 - DNA, 25 bp, Mus musculus
gactgtgaagagtgacatgagtgcc

SEQ ID NO: 649266 - DNA, 25 bp, Mus musculus
gactgtgaatgacatagacatcttt

SEQ ID NO: 649267 - DNA, 25 bp, Mus musculus
gactgtgaatgagatagacatcttt

SEQ ID NO: 649268 - DNA, 25 bp, Mus musculus
gactgtgacatccacgttcctaaaa

SEQ ID NO: 649269 - DNA, 25 bp, Mus musculus
gactgtgacatcgacgttcctaaaa

SEQ ID NO: 649270 - DNA, 25 bp, Mus musculus
gactgtgagttgaaatggaagccat

SEQ ID NO: 649271 - DNA, 25 bp, Mus musculus
gactgtgagttgtaatggaagccat

SEQ ID NO: 649272 - DNA, 25 bp, Mus musculus
gactgtgatacaacgctttgagagg

SEQ ID NO: 649273 - DNA, 25 bp, Mus musculus
gactgtgatacatcgctttgagagg

SEQ ID NO: 649274 - DNA, 25 bp, Mus musculus
gactgtgatcctaccaggaatggac

SEQ ID NO: 649275 - DNA, 25 bp, Mus musculus
gactgtgatccttccaggaatggac

SEQ ID NO: 649276 - DNA, 25 bp, Mus musculus
gactgtgatctgcacgtggcttgca

SEQ ID NO: 649277 - DNA, 25 bp, Mus musculus
gactgtgatctggacgtggcttgca

SEQ ID NO: 649278 - DNA, 25 bp, Mus musculus
gactgtgatgagataccagctctct

SEQ ID NO: 649279 - DNA, 25 bp, Mus musculus
gactgtgatgagttaccagctctct

SEQ ID NO: 649280 - DNA, 25 bp, Mus musculus
gactgtgcacgtcttgtgtacctca

SEQ ID NO: 649281 - DNA, 25 bp, Mus musculus
gactgtgcacgtgttgtgtacctca

SEQ ID NO: 649282 - DNA, 25 bp, Mus musculus
gactgtgcattacctcctttataag

SEQ ID NO: 649283 - DNA, 25 bp, Mus musculus
gactgtgcattagctcctttataag

SEQ ID NO: 649284 - DNA, 25 bp, Mus musculus
gactgtgccagtcttgaaggcccag

SEQ ID NO: 649285 - DNA, 25 bp, Mus musculus
gactgtgccagtgttgaaggcccag

SEQ ID NO: 649286 - DNA, 25 bp, Mus musculus
gactgtgccctgcttggaaattaaa

SEQ ID NO: 649287 - DNA, 25 bp, Mus musculus
gactgtgccctggttggaaattaaa

SEQ ID NO: 649288 - DNA, 25 bp, Mus musculus
gactgtgccggtctgattctgtatg

SEQ ID NO: 649289 - DNA, 25 bp, Mus musculus
gactgtgccggtgtgattctgtatg

SEQ ID NO: 649290 - DNA, 25 bp, Mus musculus
gactgtgcgaatagtcaagcatgcc

SEQ ID NO: 649291 - DNA, 25 bp, Mus musculus
gactgtgcgaattgtcaagcatgcc

SEQ ID NO: 649292 - DNA, 25 bp, Mus musculus
gactgtgcgcatcctttccgagctg

SEQ ID NO: 649293 - DNA, 25 bp, Mus musculus
gactgtgcgcatgctttccgagctg

SEQ ID NO: 649294 - DNA, 25 bp, Mus musculus
gactgtgcgctgctgaaccgctttc

SEQ ID NO: 649295 - DNA, 25 bp, Mus musculus
gactgtgcgctggtgaaccgctttc

SEQ ID NO: 649296 - DNA, 25 bp, Mus musculus
gactgtgctagcctaagttgtcgct

SEQ ID NO: 649297 - DNA, 25 bp, Mus musculus
gactgtgctagcgtaagttgtcgct

SEQ ID NO: 649298 - DNA, 25 bp, Mus musculus
gactgtgctggacctcttcaggtca

SEQ ID NO: 649299 - DNA, 25 bp, Mus musculus
gactgtgctggagctcttcaggtca

SEQ ID NO: 649300 - DNA, 25 bp, Mus musculus
gactgtgctggcatcgagaaacttt

SEQ ID NO: 649301 - DNA, 25 bp, Mus musculus
gactgtgctggcttcgagaaacttt

SEQ ID NO: 649302 - DNA, 25 bp, Mus musculus
gactgtgctgggacatgtacagcga

SEQ ID NO: 649303 - DNA, 25 bp, Mus musculus
gactgtgctgggtcatgtacagcga

SEQ ID NO: 649304 - DNA, 25 bp, Mus musculus
gactgtgcttgcactcatggctgta

SEQ ID NO: 649305 - DNA, 25 bp, Mus musculus
gactgtgcttgctctcatggctgta

SEQ ID NO: 649306 - DNA, 25 bp, Mus musculus
gactgtggagtgcacggtcacctat

SEQ ID NO: 649307 - DNA, 25 bp, Mus musculus
gactgtggagtggacggtcacctat

SEQ ID NO: 649308 - DNA, 25 bp, Mus musculus
gactgtggcaatcgctctgcttcca

SEQ ID NO: 649309 - DNA, 25 bp, Mus musculus
gactgtggcaatggctctgcttcca

SEQ ID NO: 649310 - DNA, 25 bp, Mus musculus
gactgtggcagcagcgttcaagatc

SEQ ID NO: 649311 - DNA, 25 bp, Mus musculus
gactgtggcagctgcgttcaagatc

SEQ ID NO: 649312 - DNA, 25 bp, Mus musculus
gactgtggcaggaagtaggccattt

SEQ ID NO: 649313 - DNA, 25 bp, Mus musculus
gactgtggcaggtagtaggccattt

SEQ ID NO: 649314 - DNA, 25 bp, Mus musculus
gactgtggcatgacattctgcaata

SEQ ID NO: 649315 - DNA, 25 bp, Mus musculus
gactgtggcatgtcattctgcaata

SEQ ID NO: 649316 - DNA, 25 bp, Mus musculus
gactgtggccttagaagaatttaag

SEQ ID NO: 649317 - DNA, 25 bp, Mus musculus
gactgtggcctttgaagaatttaag

SEQ ID NO: 649318 - DNA, 25 bp, Mus musculus
gactgtggcggccacaaacatgaat

SEQ ID NO: 649319 - DNA, 25 bp, Mus musculus
gactgtggcggcgacaaacatgaat

SEQ ID NO: 649320 - DNA, 25 bp, Mus musculus
gactgtgggcccaacggccagtgtc

SEQ ID NO: 649321 - DNA, 25 bp, Mus musculus
gactgtgggccctacggccagtgtc

SEQ ID NO: 649322 - DNA, 25 bp, Mus musculus
gactgtggtctcaactttcttcacc

SEQ ID NO: 649323 - DNA, 25 bp, Mus musculus
gactgtggtctctactttcttcacc

SEQ ID NO: 649324 - DNA, 25 bp, Mus musculus
gactgtgtacagagaacctggtgtg

SEQ ID NO: 649325 - DNA, 25 bp, Mus musculus
gactgtgtacagtgaacctggtgtg

SEQ ID NO: 649326 - DNA, 25 bp, Mus musculus
gactgtgtacatccacaaagttccg

SEQ ID NO: 649327 - DNA, 25 bp, Mus musculus
gactgtgtacatgcacaaagttccg

SEQ ID NO: 649328 - DNA, 25 bp, Mus musculus
gactgtgtatctcagggagatctca

SEQ ID NO: 649329 - DNA, 25 bp, Mus musculus
gactgtgtatctgagggagatctca

SEQ ID NO: 649330 - DNA, 25 bp, Mus musculus
gactgtgtcaagcaaattggtctcc

SEQ ID NO: 649331 - DNA, 25 bp, Mus musculus
gactgtgtcaaggaaattggtctcc

SEQ ID NO: 649332 - DNA, 25 bp, Mus musculus
gactgtgtcacaccagggctttatg

SEQ ID NO: 649333 - DNA, 25 bp, Mus musculus
gactgtgtcacagcagggctttatg

SEQ ID NO: 649334 - DNA, 25 bp, Mus musculus
gactgtgtcactcttaggtgactag

SEQ ID NO: 649335 - DNA, 25 bp, Mus musculus
gactgtgtcactgttaggtgactag

SEQ ID NO: 649336 - DNA, 25 bp, Mus musculus
gactgtgtccaacgactcaaaggac

SEQ ID NO: 649337 - DNA, 25 bp, Mus musculus
gactgtgtccaaggactcaaaggac

SEQ ID NO: 649338 - DNA, 25 bp, Mus musculus
gactgtgtctccagcattctgcaag

SEQ ID NO: 649339 - DNA, 25 bp, Mus musculus
gactgtgtctcctgcattctgcaag

SEQ ID NO: 649340 - DNA, 25 bp, Mus musculus
gactgtgtctcgaaagagcaaccct

SEQ ID NO: 649341 - DNA, 25 bp, Mus musculus
gactgtgtctcgtaagagcaaccct

SEQ ID NO: 649342 - DNA, 25 bp, Mus musculus
gactgtgtctctcctcacaaggtgg

SEQ ID NO: 649343 - DNA, 25 bp, Mus musculus
gactgtgtctctgctcacaaggtgg

SEQ ID NO: 649344 - DNA, 25 bp, Mus musculus
gactgtgtggccagagcggtctcat

SEQ ID NO: 649345 - DNA, 25 bp, Mus musculus
gactgtgtggcctgagcggtctcat

SEQ ID NO: 649346 - DNA, 25 bp, Mus musculus
gactgtgtggtaagaactacaggca

SEQ ID NO: 649347 - DNA, 25 bp, Mus musculus
gactgtgtggtatgaactacaggca

SEQ ID NO: 649348 - DNA, 25 bp, Mus musculus
gactgtgtgttaccaagacccatga

SEQ ID NO: 649349 - DNA, 25 bp, Mus musculus
gactgtgtgttagcaagacccatga

SEQ ID NO: 649350 - DNA, 25 bp, Mus musculus
gactgtgtgtttccaaaatggcggc

SEQ ID NO: 649351 - DNA, 25 bp, Mus musculus
gactgtgtgtttgcaaaatggcggc

SEQ ID NO: 649352 - DNA, 25 bp, Mus musculus
gactgtgttcagaggagagctttgc

SEQ ID NO: 649353 - DNA, 25 bp, Mus musculus
gactgtgttcagtggagagctttgc

SEQ ID NO: 649354 - DNA, 25 bp, Mus musculus
gactgttcaaaccattgtacataga

SEQ ID NO: 649355 - DNA, 25 bp, Mus musculus
gactgttcaaacgattgtacataga

SEQ ID NO: 649356 - DNA, 25 bp, Mus musculus
gactgttccaacatcacctggaagg

SEQ ID NO: 649357 - DNA, 25 bp, Mus musculus
gactgttccaacttcacctggaagg

SEQ ID NO: 649358 - DNA, 25 bp, Mus musculus
gactgttccccgatcttatcgggag

SEQ ID NO: 649359 - DNA, 25 bp, Mus musculus
gactgttccccgttcttatcgggag

SEQ ID NO: 649360 - DNA, 25 bp, Mus musculus
gactgttcccgacgccgggctgtca

SEQ ID NO: 649361 - DNA, 25 bp, Mus musculus
gactgttcccgaggccgggctgtca

SEQ ID NO: 649362 - DNA, 25 bp, Mus musculus
gactgttcgcagaagtccccgaaga

SEQ ID NO: 649363 - DNA, 25 bp, Mus musculus
gactgttcgcagtagtccccgaaga

SEQ ID NO: 649364 - DNA, 25 bp, Mus musculus
gactgttctaccagttcgcgcgcct

SEQ ID NO: 649365 - DNA, 25 bp, Mus musculus
gactgttctacctgttcgcgcgcct

SEQ ID NO: 649366 - DNA, 25 bp, Mus musculus
gactgttgaaaacaatcggcaaggg

SEQ ID NO: 649367 - DNA, 25 bp, Mus musculus
gactgttgaaaagaatcggcaaggg

SEQ ID NO: 649368 - DNA, 25 bp, Mus musculus
gactgttgcagtacatcatcctcag

SEQ ID NO: 649369 - DNA, 25 bp, Mus musculus
gactgttgcagttcatcatcctcag

SEQ ID NO: 649370 - DNA, 25 bp, Mus musculus
gactgttgctaacgagttgcgttcg

SEQ ID NO: 649371 - DNA, 25 bp, Mus musculus
gactgttgctaaggagttgcgttcg

SEQ ID NO: 649372 - DNA, 25 bp, Mus musculus
gactgttgggatacctccagctcct

SEQ ID NO: 649373 - DNA, 25 bp, Mus musculus
gactgttgggattcctccagctcct

SEQ ID NO: 649374 - DNA, 25 bp, Mus musculus
gactgtttagcaagagagaataccc

SEQ ID NO: 649375 - DNA, 25 bp, Mus musculus
gactgtttagcatgagagaataccc

SEQ ID NO: 649376 - DNA, 25 bp, Mus musculus
gactgtttcctcctagattttccac

SEQ ID NO: 649377 - DNA, 25 bp, Mus musculus
gactgtttcctcgtagattttccac

SEQ ID NO: 649378 - DNA, 25 bp, Mus musculus
gactgtttctgcacacagtaacagc

SEQ ID NO: 649379 - DNA, 25 bp, Mus musculus
gactgtttctgctcacagtaacagc

SEQ ID NO: 649380 - DNA, 25 bp, Mus musculus
gactgttttaccacctctttccctg

SEQ ID NO: 649381 - DNA, 25 bp, Mus musculus
gactgttttacctcctctttccctg

SEQ ID NO: 649382 - DNA, 25 bp, Mus musculus
gactgttttgagatctaccagaggt

SEQ ID NO: 649383 - DNA, 25 bp, Mus musculus
gactgttttgagcaaacgctgtaca

SEQ ID NO: 649384 - DNA, 25 bp, Mus musculus
gactgttttgaggaaacgctgtaca

SEQ ID NO: 649385 - DNA, 25 bp, Mus musculus
gactgttttgagttctaccagaggt

SEQ ID NO: 649386 - DNA, 25 bp, Mus musculus
gacttaaaacccagtaacattgtag

SEQ ID NO: 649387 - DNA, 25 bp, Mus musculus
gacttaaaaccctgtaacattgtag

SEQ ID NO: 649388 - DNA, 25 bp, Mus musculus
gacttaaaaggcaccgtcttgccac

SEQ ID NO: 649389 - DNA, 25 bp, Mus musculus
gacttaaaaggctccgtcttgccac

SEQ ID NO: 649390 - DNA, 25 bp, Mus musculus
gacttaaaattcctcagctgccagc

SEQ ID NO: 649391 - DNA, 25 bp, Mus musculus
gacttaaaattcgtcagctgccagc

SEQ ID NO: 649392 - DNA, 25 bp, Mus musculus
gacttaaagcctagtaatatagtag

SEQ ID NO: 649393 - DNA, 25 bp, Mus musculus
gacttaaagccttgtaatatagtag

SEQ ID NO: 649394 - DNA, 25 bp, Mus musculus
gacttaaccactctgacatcagctg

SEQ ID NO: 649395 - DNA, 25 bp, Mus musculus
gacttaaccactgtgacatcagctg

SEQ ID NO: 649396 - DNA, 25 bp, Mus musculus
gacttaactctgattcccatggaca

SEQ ID NO: 649397 - DNA, 25 bp, Mus musculus
gacttaactctgtttcccatggaca

SEQ ID NO: 649398 - DNA, 25 bp, Mus musculus
gacttaactggcacagagatcttgc

SEQ ID NO: 649399 - DNA, 25 bp, Mus musculus
gacttaactggctcagagatcttgc

SEQ ID NO: 649400 - DNA, 25 bp, Mus musculus
gacttaactttcattacagagactt

SEQ ID NO: 649401 - DNA, 25 bp, Mus musculus
gacttaactttctttacagagactt

SEQ ID NO: 649402 - DNA, 25 bp, Mus musculus
gacttaagagaaagcaatccaccta

SEQ ID NO: 649403 - DNA, 25 bp, Mus musculus
gacttaagagaatgcaatccaccta

SEQ ID NO: 649404 - DNA, 25 bp, Mus musculus
gacttaagcagtccatgaaagtgga

SEQ ID NO: 649405 - DNA, 25 bp, Mus musculus
gacttaagcagtgcatgaaagtgga

SEQ ID NO: 649406 - DNA, 25 bp, Mus musculus
gacttaaggactcttctcagcatag

SEQ ID NO: 649407 - DNA, 25 bp, Mus musculus
gacttaaggactgttctcagcatag

SEQ ID NO: 649408 - DNA, 25 bp, Mus musculus
gacttaagtaagatgaagagcctgc

SEQ ID NO: 649409 - DNA, 25 bp, Mus musculus
gacttaagtaagttgaagagcctgc

SEQ ID NO: 649410 - DNA, 25 bp, Mus musculus
gacttaatcgggagctttctcagaa

SEQ ID NO: 649411 - DNA, 25 bp, Mus musculus
gacttaatcgggtgctttctcagaa

SEQ ID NO: 649412 - DNA, 25 bp, Mus musculus
gacttaatgataaaagaatatccag

SEQ ID NO: 649413 - DNA, 25 bp, Mus musculus
gacttaatgatataagaatatccag

SEQ ID NO: 649414 - DNA, 25 bp, Mus musculus
gacttacaagacaacaaggcccatg

SEQ ID NO: 649415 - DNA, 25 bp, Mus musculus
gacttacaagactacaaggcccatg

SEQ ID NO: 649416 - DNA, 25 bp, Mus musculus
gacttacacagaacaatgtgtgcag

SEQ ID NO: 649417 - DNA, 25 bp, Mus musculus
gacttacacagatcaatgtgtgcag

SEQ ID NO: 649418 - DNA, 25 bp, Mus musculus
gacttacagcatcacgggtaccaag

SEQ ID NO: 649419 - DNA, 25 bp, Mus musculus
gacttacagcatgacgggtaccaag

SEQ ID NO: 649420 - DNA, 25 bp, Mus musculus
gacttacagtgacacaaaagatatc

SEQ ID NO: 649421 - DNA, 25 bp, Mus musculus
gacttacagtgagacaaaagatatc

SEQ ID NO: 649422 - DNA, 25 bp, Mus musculus
gacttacatgaccaagacaactcaa

SEQ ID NO: 649423 - DNA, 25 bp, Mus musculus
gacttacatgacgaagacaactcaa

SEQ ID NO: 649424 - DNA, 25 bp, Mus musculus
gacttaccagtacatgggagcctgt

SEQ ID NO: 649425 - DNA, 25 bp, Mus musculus
gacttaccagtagatgggagcctgt

SEQ ID NO: 649426 - DNA, 25 bp, Mus musculus
gacttaccatttcctctcccctgga

SEQ ID NO: 649427 - DNA, 25 bp, Mus musculus
gacttaccatttgctctcccctgga

SEQ ID NO: 649428 - DNA, 25 bp, Mus musculus
gacttaccgctaccatggacacagc

SEQ ID NO: 649429 - DNA, 25 bp, Mus musculus
gacttaccgctagcatggacacagc

SEQ ID NO: 649430 - DNA, 25 bp, Mus musculus
gacttacctaagatgccagtgcccc

SEQ ID NO: 649431 - DNA, 25 bp, Mus musculus
gacttacctaagttgccagtgcccc

SEQ ID NO: 649432 - DNA, 25 bp, Mus musculus
gacttacgaactacgttatttccag

SEQ ID NO: 649433 - DNA, 25 bp, Mus musculus
gacttacgaacttcgttatttccag

SEQ ID NO: 649434 - DNA, 25 bp, Mus musculus
gacttacgatatctggtccttcaga

SEQ ID NO: 649435 - DNA, 25 bp, Mus musculus
gacttacgatatgtggtccttcaga

SEQ ID NO: 649436 - DNA, 25 bp, Mus musculus
gacttacgccttctggtcaacaacc

SEQ ID NO: 649437 - DNA, 25 bp, Mus musculus
gacttacgccttgtggtcaacaacc

SEQ ID NO: 649438 - DNA, 25 bp, Mus musculus
gacttacgtcagctggtttgatccc

SEQ ID NO: 649439 - DNA, 25 bp, Mus musculus
gacttacgtcaggtggtttgatccc

SEQ ID NO: 649440 - DNA, 25 bp, Mus musculus
gacttacgtcatcatcttcatccca

SEQ ID NO: 649441 - DNA, 25 bp, Mus musculus
gacttacgtcatgatcttcatccca

SEQ ID NO: 649442 - DNA, 25 bp, Mus musculus
gacttactacatctgggcaatggct

SEQ ID NO: 649443 - DNA, 25 bp, Mus musculus
gacttactacatgtgggcaatggct

SEQ ID NO: 649444 - DNA, 25 bp, Mus musculus
gacttactgcgtagaagacacccca

SEQ ID NO: 649445 - DNA, 25 bp, Mus musculus
gacttactgcgttgaagacacccca

SEQ ID NO: 649446 - DNA, 25 bp, Mus musculus
gacttagaaattaggagcaccttcc

SEQ ID NO: 649447 - DNA, 25 bp, Mus musculus
gacttagaaatttggagcaccttcc

SEQ ID NO: 649448 - DNA, 25 bp, Mus musculus
gacttagaagatctaacctctccag

SEQ ID NO: 649449 - DNA, 25 bp, Mus musculus
gacttagaagatgtaacctctccag

SEQ ID NO: 649450 - DNA, 25 bp, Mus musculus
gacttagaccatccccacgttgtaa

SEQ ID NO: 649451 - DNA, 25 bp, Mus musculus
gacttagaccatgcccacgttgtaa

SEQ ID NO: 649452 - DNA, 25 bp, Mus musculus
gacttagagattctgcctaatggac

SEQ ID NO: 649453 - DNA, 25 bp, Mus musculus
gacttagagattgtgcctaatggac

SEQ ID NO: 649454 - DNA, 25 bp, Mus musculus
gacttagagtatctgtgactgttga

SEQ ID NO: 649455 - DNA, 25 bp, Mus musculus
gacttagagtatgtgtgactgttga

SEQ ID NO: 649456 - DNA, 25 bp, Mus musculus
gacttagatgatcttcgagctgggc

SEQ ID NO: 649457 - DNA, 25 bp, Mus musculus
gacttagatgatgttcgagctgggc

SEQ ID NO: 649458 - DNA, 25 bp, Mus musculus
gacttagatgtgcagcaacttggaa

SEQ ID NO: 649459 - DNA, 25 bp, Mus musculus
gacttagatgtggagcaacttggaa

SEQ ID NO: 649460 - DNA, 25 bp, Mus musculus
gacttagcaagaagcacttgaacat

SEQ ID NO: 649461 - DNA, 25 bp, Mus musculus
gacttagcaagatgcacttgaacat

SEQ ID NO: 649462 - DNA, 25 bp, Mus musculus
gacttagcatcaaaatcgtccatgt

SEQ ID NO: 649463 - DNA, 25 bp, Mus musculus
gacttagcatcataatcgtccatgt

SEQ ID NO: 649464 - DNA, 25 bp, Mus musculus
gacttagcattcaggcctttgagtt

SEQ ID NO: 649465 - DNA, 25 bp, Mus musculus
gacttagcattctggcctttgagtt

SEQ ID NO: 649466 - DNA, 25 bp, Mus musculus
gacttagccaagcttagagcggatg

SEQ ID NO: 649467 - DNA, 25 bp, Mus musculus
gacttagccaaggttagagcggatg

SEQ ID NO: 649468 - DNA, 25 bp, Mus musculus
gacttagcgactactacgacatcca

SEQ ID NO: 649469 - DNA, 25 bp, Mus musculus
gacttagcgacttctacgacatcca

SEQ ID NO: 649470 - DNA, 25 bp, Mus musculus
gacttagcgccacactcatttgatg

SEQ ID NO: 649471 - DNA, 25 bp, Mus musculus
gacttagcgccagactcatttgatg

SEQ ID NO: 649472 - DNA, 25 bp, Mus musculus
gacttagctcaacagaacctaattg

SEQ ID NO: 649473 - DNA, 25 bp, Mus musculus
gacttagctcaagagaacctaattg

SEQ ID NO: 649474 - DNA, 25 bp, Mus musculus
gacttagctgaacaggttggcaata

SEQ ID NO: 649475 - DNA, 25 bp, Mus musculus
gacttagctgaagaggttggcaata

SEQ ID NO: 649476 - DNA, 25 bp, Mus musculus
gacttagctgcgacctgagcctgga

SEQ ID NO: 649477 - DNA, 25 bp, Mus musculus
gacttagctgcgtcctgagcctgga

SEQ ID NO: 649478 - DNA, 25 bp, Mus musculus
gacttaggagccacccactccaaga

SEQ ID NO: 649479 - DNA, 25 bp, Mus musculus
gacttaggagcctcccactccaaga

SEQ ID NO: 649480 - DNA, 25 bp, Mus musculus
gacttaggccaactggcacacctca

SEQ ID NO: 649481 - DNA, 25 bp, Mus musculus
gacttaggccaagtggcacacctca

SEQ ID NO: 649482 - DNA, 25 bp, Mus musculus
gacttaggctccaacgtaactgcaa

SEQ ID NO: 649483 - DNA, 25 bp, Mus musculus
gacttaggctcctacgtaactgcaa

SEQ ID NO: 649484 - DNA, 25 bp, Mus musculus
gacttaggtcccaggaggccctgcc

SEQ ID NO: 649485 - DNA, 25 bp, Mus musculus
gacttaggtccctggaggccctgcc

SEQ ID NO: 649486 - DNA, 25 bp, Mus musculus
gacttagtggagagggtaaatgtct

SEQ ID NO: 649487 - DNA, 25 bp, Mus musculus
gacttagtggagtgggtaaatgtct

SEQ ID NO: 649488 - DNA, 25 bp, Mus musculus
gacttatacaagatattcgatcggt

SEQ ID NO: 649489 - DNA, 25 bp, Mus musculus
gacttatacaagttattcgatcggt

SEQ ID NO: 649490 - DNA, 25 bp, Mus musculus
gacttatatatcaatgccaatgacc

SEQ ID NO: 649491 - DNA, 25 bp, Mus musculus
gacttatatatctatgccaatgacc

SEQ ID NO: 649492 - DNA, 25 bp, Mus musculus
gacttatatctgagagctggagaac

SEQ ID NO: 649493 - DNA, 25 bp, Mus musculus
gacttatatctgtgagctggagaac

SEQ ID NO: 649494 - DNA, 25 bp, Mus musculus
gacttatcaatcacaccttcctgga

SEQ ID NO: 649495 - DNA, 25 bp, Mus musculus
gacttatcaatctcaccttcctgga

SEQ ID NO: 649496 - DNA, 25 bp, Mus musculus
gacttatcgaacagccttgaggaga

SEQ ID NO: 649497 - DNA, 25 bp, Mus musculus
gacttatcgaactgccttgaggaga

SEQ ID NO: 649498 - DNA, 25 bp, Mus musculus
gacttatcttccattagtagaagag

SEQ ID NO: 649499 - DNA, 25 bp, Mus musculus
gacttatcttcctttagtagaagag

SEQ ID NO: 649500 - DNA, 25 bp, Mus musculus
gacttatgacgccaatcatgtatgc

SEQ ID NO: 649501 - DNA, 25 bp, Mus musculus
gacttatgacgcgaatcatgtatgc

SEQ ID NO: 649502 - DNA, 25 bp, Mus musculus
gacttatgatgaattccgaaacgtc

SEQ ID NO: 649503 - DNA, 25 bp, Mus musculus
gacttatgatgatttccgaaacgtc

SEQ ID NO: 649504 - DNA, 25 bp, Mus musculus
gacttatgctggagacacatgccaa

SEQ ID NO: 649505 - DNA, 25 bp, Mus musculus
gacttatgctggtgacacatgccaa

SEQ ID NO: 649506 - DNA, 25 bp, Mus musculus
gacttatggacacctacctcaggga

SEQ ID NO: 649507 - DNA, 25 bp, Mus musculus
gacttatggacagctacctcaggga

SEQ ID NO: 649508 - DNA, 25 bp, Mus musculus
gacttatgttgaaaacaggcctaaa

SEQ ID NO: 649509 - DNA, 25 bp, Mus musculus
gacttatgttgataacaggcctaaa

SEQ ID NO: 649510 - DNA, 25 bp, Mus musculus
gacttattacaaagccacagaacct

SEQ ID NO: 649511 - DNA, 25 bp, Mus musculus
gacttattacaatgccacagaacct

SEQ ID NO: 649512 - DNA, 25 bp, Mus musculus
gacttattgaacaaccggaattggc

SEQ ID NO: 649513 - DNA, 25 bp, Mus musculus
gacttattgaactaccggaattggc

SEQ ID NO: 649514 - DNA, 25 bp, Mus musculus
gacttcaacacgcaggttcatccca

SEQ ID NO: 649515 - DNA, 25 bp, Mus musculus
gacttcaacacggaggttcatccca

SEQ ID NO: 649516 - DNA, 25 bp, Mus musculus
gacttcaacatactggtggatgctg

SEQ ID NO: 649517 - DNA, 25 bp, Mus musculus
gacttcaacatagtggtggatgctg

SEQ ID NO: 649518 - DNA, 25 bp, Mus musculus
gacttcaacctcaacacctgcggtg

SEQ ID NO: 649519 - DNA, 25 bp, Mus musculus
gacttcaacctctacacctgcggtg

SEQ ID NO: 649520 - DNA, 25 bp, Mus musculus
gacttcaacgcccttccattcagag

SEQ ID NO: 649521 - DNA, 25 bp, Mus musculus
gacttcaacgccgttccattcagag

SEQ ID NO: 649522 - DNA, 25 bp, Mus musculus
gacttcaacttccagcaggatgtgc

SEQ ID NO: 649523 - DNA, 25 bp, Mus musculus
gacttcaacttcgagcaggatgtgc

SEQ ID NO: 649524 - DNA, 25 bp, Mus musculus
gacttcaagaagctatttcctggct

SEQ ID NO: 649525 - DNA, 25 bp, Mus musculus
gacttcaagaaggtatttcctggct

SEQ ID NO: 649526 - DNA, 25 bp, Mus musculus
gacttcaagatcaaggccgtgggtc

SEQ ID NO: 649527 - DNA, 25 bp, Mus musculus
gacttcaagatctaggccgtgggtc

SEQ ID NO: 649528 - DNA, 25 bp, Mus musculus
gacttcaagcaacttcttttgcggg

SEQ ID NO: 649529 - DNA, 25 bp, Mus musculus
gacttcaagcaagttcttttgcggg

SEQ ID NO: 649530 - DNA, 25 bp, Mus musculus
gacttcaagcgcaagtttgcagact

SEQ ID NO: 649531 - DNA, 25 bp, Mus musculus
gacttcaagcgctagtttgcagact

SEQ ID NO: 649532 - DNA, 25 bp, Mus musculus
gacttcaaggtcaagacggtctacc

SEQ ID NO: 649533 - DNA, 25 bp, Mus musculus
gacttcaaggtctagacggtctacc

SEQ ID NO: 649534 - DNA, 25 bp, Mus musculus
gacttcaagtacctgctgttgcccg

SEQ ID NO: 649535 - DNA, 25 bp, Mus musculus
gacttcaagtacgtgctgttgcccg

SEQ ID NO: 649536 - DNA, 25 bp, Mus musculus
gacttcaagtcacccgatgaccctg

SEQ ID NO: 649537 - DNA, 25 bp, Mus musculus
gacttcaagtcagccgatgaccctg

SEQ ID NO: 649538 - DNA, 25 bp, Mus musculus
gacttcaatcaacctcggcagacga

SEQ ID NO: 649539 - DNA, 25 bp, Mus musculus
gacttcaatcaagctcggcagacga

SEQ ID NO: 649540 - DNA, 25 bp, Mus musculus
gacttcaatgaaactctcagaaacc

SEQ ID NO: 649541 - DNA, 25 bp, Mus musculus
gacttcaatgaatctctcagaaacc

SEQ ID NO: 649542 - DNA, 25 bp, Mus musculus
gacttcaatgcccttgagtatatca

SEQ ID NO: 649543 - DNA, 25 bp, Mus musculus
gacttcaatgccgttgagtatatca

SEQ ID NO: 649544 - DNA, 25 bp, Mus musculus
gacttcacggagcagttccaggtgt

SEQ ID NO: 649545 - DNA, 25 bp, Mus musculus
gacttcacggaggagttccaggtgt

SEQ ID NO: 649546 - DNA, 25 bp, Mus musculus
gacttcactggaactgtggctggct

SEQ ID NO: 649547 - DNA, 25 bp, Mus musculus
gacttcactggatctgtggctggct

SEQ ID NO: 649548 - DNA, 25 bp, Mus musculus
gacttcagaaatctttattaccgtt

SEQ ID NO: 649549 - DNA, 25 bp, Mus musculus
gacttcagaaatgtttattaccgtt

SEQ ID NO: 649550 - DNA, 25 bp, Mus musculus
gacttcagaagaacacctagatgac

SEQ ID NO: 649551 - DNA, 25 bp, Mus musculus
gacttcagaagaatccaaatcacct

SEQ ID NO: 649552 - DNA, 25 bp, Mus musculus
gacttcagaagatcacctagatgac

SEQ ID NO: 649553 - DNA, 25 bp, Mus musculus
gacttcagaagattccaaatcacct

SEQ ID NO: 649554 - DNA, 25 bp, Mus musculus
gacttcagcccgatgatgaccaacg

SEQ ID NO: 649555 - DNA, 25 bp, Mus musculus
gacttcagcccgttgatgaccaacg

SEQ ID NO: 649556 - DNA, 25 bp, Mus musculus
gacttcagcggtactagtgacccct

SEQ ID NO: 649557 - DNA, 25 bp, Mus musculus
gacttcagcggttctagtgacccct

SEQ ID NO: 649558 - DNA, 25 bp, Mus musculus
gacttcagctacaactcacaggctg

SEQ ID NO: 649559 - DNA, 25 bp, Mus musculus
gacttcagctactactcacaggctg

SEQ ID NO: 649560 - DNA, 25 bp, Mus musculus
gacttcagctatcgccagccctgtg

SEQ ID NO: 649561 - DNA, 25 bp, Mus musculus
gacttcagctatggccagccctgtg

SEQ ID NO: 649562 - DNA, 25 bp, Mus musculus
gacttcaggagtctcaggagaagct

SEQ ID NO: 649563 - DNA, 25 bp, Mus musculus
gacttcaggagtgtcaggagaagct

SEQ ID NO: 649564 - DNA, 25 bp, Mus musculus
gacttcagggccctgcttatctcca

SEQ ID NO: 649565 - DNA, 25 bp, Mus musculus
gacttcagggccgtgcttatctcca

SEQ ID NO: 649566 - DNA, 25 bp, Mus musculus
gacttcagtagcagtctaagactag

SEQ ID NO: 649567 - DNA, 25 bp, Mus musculus
gacttcagtagctgtctaagactag

SEQ ID NO: 649568 - DNA, 25 bp, Mus musculus
gacttcagtgaacagcgctggtatg

SEQ ID NO: 649569 - DNA, 25 bp, Mus musculus
gacttcagtgaagagcgctggtatg

SEQ ID NO: 649570 - DNA, 25 bp, Mus musculus
gacttcagtgagatgcaagctggct

SEQ ID NO: 649571 - DNA, 25 bp, Mus musculus
gacttcagtgagttgcaagctggct

SEQ ID NO: 649572 - DNA, 25 bp, Mus musculus
gacttcagtgtgcaagcgcctgcag

SEQ ID NO: 649573 - DNA, 25 bp, Mus musculus
gacttcagtgtggaagcgcctgcag

SEQ ID NO: 649574 - DNA, 25 bp, Mus musculus
gacttcataaaacaagccatgcaaa

SEQ ID NO: 649575 - DNA, 25 bp, Mus musculus
gacttcataaaagaagccatgcaaa

SEQ ID NO: 649576 - DNA, 25 bp, Mus musculus
gacttcataaatcgatgatgcagac

SEQ ID NO: 649577 - DNA, 25 bp, Mus musculus
gacttcataaatggatgatgcagac

SEQ ID NO: 649578 - DNA, 25 bp, Mus musculus
gacttcatacgaatagaattacgct

SEQ ID NO: 649579 - DNA, 25 bp, Mus musculus
gacttcatacgattagaattacgct

SEQ ID NO: 649580 - DNA, 25 bp, Mus musculus
gacttcatcaggcaccgcatgcgat

SEQ ID NO: 649581 - DNA, 25 bp, Mus musculus
gacttcatcagggaccgcatgcgat

SEQ ID NO: 649582 - DNA, 25 bp, Mus musculus
gacttcatcgccagcaagggagtca

SEQ ID NO: 649583 - DNA, 25 bp, Mus musculus
gacttcatcgcctgcaagggagtca

SEQ ID NO: 649584 - DNA, 25 bp, Mus musculus
gacttcatctaccagctctactcag

SEQ ID NO: 649585 - DNA, 25 bp, Mus musculus
gacttcatctacgagctctactcag

SEQ ID NO: 649586 - DNA, 25 bp, Mus musculus
gacttcatctccatgcagtgccggg

SEQ ID NO: 649587 - DNA, 25 bp, Mus musculus
gacttcatctccttgcagtgccggg

SEQ ID NO: 649588 - DNA, 25 bp, Mus musculus
gacttcatctctctctgtaagaaca

SEQ ID NO: 649589 - DNA, 25 bp, Mus musculus
gacttcatctctgtctgtaagaaca

SEQ ID NO: 649590 - DNA, 25 bp, Mus musculus
gacttcatgcctcctgttgagaact

SEQ ID NO: 649591 - DNA, 25 bp, Mus musculus
gacttcatgcctgctgttgagaact

SEQ ID NO: 649592 - DNA, 25 bp, Mus musculus
gacttcatgctacaagatgaggctt

SEQ ID NO: 649593 - DNA, 25 bp, Mus musculus
gacttcatgctagaagatgaggctt

SEQ ID NO: 649594 - DNA, 25 bp, Mus musculus
gacttcatggaaattgattccataa

SEQ ID NO: 649595 - DNA, 25 bp, Mus musculus
gacttcatggaatttgattccataa

SEQ ID NO: 649596 - DNA, 25 bp, Mus musculus
gacttcatggatcaccccaaatgga

SEQ ID NO: 649597 - DNA, 25 bp, Mus musculus
gacttcatggatgaccccaaatgga

SEQ ID NO: 649598 - DNA, 25 bp, Mus musculus
gacttcatggctagtttccacaagg

SEQ ID NO: 649599 - DNA, 25 bp, Mus musculus
gacttcatggcttgtttccacaagg

SEQ ID NO: 649600 - DNA, 25 bp, Mus musculus
gacttcatgggaacgtgagctgcac

SEQ ID NO: 649601 - DNA, 25 bp, Mus musculus
gacttcatgggatcgtgagctgcac

SEQ ID NO: 649602 - DNA, 25 bp, Mus musculus
gacttcatgtcaagggagaccacag

SEQ ID NO: 649603 - DNA, 25 bp, Mus musculus
gacttcatgtcatgggagaccacag

SEQ ID NO: 649604 - DNA, 25 bp, Mus musculus
gacttcattgagcatgctgagttct

SEQ ID NO: 649605 - DNA, 25 bp, Mus musculus
gacttcattgaggatgctgagttct

SEQ ID NO: 649606 - DNA, 25 bp, Mus musculus
gacttcatttacaggctcacaccac

SEQ ID NO: 649607 - DNA, 25 bp, Mus musculus
gacttcatttactggctcacaccac

SEQ ID NO: 649608 - DNA, 25 bp, Mus musculus
gacttcattttgcagaagcttaacc

SEQ ID NO: 649609 - DNA, 25 bp, Mus musculus
gacttcattttggagaagcttaacc

SEQ ID NO: 649610 - DNA, 25 bp, Mus musculus
gacttccaagctcagaggcatgccc

SEQ ID NO: 649611 - DNA, 25 bp, Mus musculus
gacttccaagctgagaggcatgccc

SEQ ID NO: 649612 - DNA, 25 bp, Mus musculus
gacttccacaccatagactggctga

SEQ ID NO: 649613 - DNA, 25 bp, Mus musculus
gacttccacaccttagactggctga

SEQ ID NO: 649614 - DNA, 25 bp, Mus musculus
gacttccactccagtcagagtcatg

SEQ ID NO: 649615 - DNA, 25 bp, Mus musculus
gacttccactcctgtcagagtcatg

SEQ ID NO: 649616 - DNA, 25 bp, Mus musculus
gacttccagctgatctatgatggcc

SEQ ID NO: 649617 - DNA, 25 bp, Mus musculus
gacttccagctgttctatgatggcc

SEQ ID NO: 649618 - DNA, 25 bp, Mus musculus
gacttccaggccctgaagtacgtcc

SEQ ID NO: 649619 - DNA, 25 bp, Mus musculus
gacttccaggccgtgaagtacgtcc

SEQ ID NO: 649620 - DNA, 25 bp, Mus musculus
gacttccagttaaccaacttcagcc

SEQ ID NO: 649621 - DNA, 25 bp, Mus musculus
gacttccagttatccaacttcagcc

SEQ ID NO: 649622 - DNA, 25 bp, Mus musculus
gacttccatctactgcactctagaa

SEQ ID NO: 649623 - DNA, 25 bp, Mus musculus
gacttccatctagtgcactctagaa

SEQ ID NO: 649624 - DNA, 25 bp, Mus musculus
gacttccatgatcttcaggactatg

SEQ ID NO: 649625 - DNA, 25 bp, Mus musculus
gacttccatgatgttcaggactatg

SEQ ID NO: 649626 - DNA, 25 bp, Mus musculus
gacttccatgcaattgacctctcag

SEQ ID NO: 649627 - DNA, 25 bp, Mus musculus
gacttccatgcatttgacctctcag

SEQ ID NO: 649628 - DNA, 25 bp, Mus musculus
gacttcccgtctctgaatgaagcca

SEQ ID NO: 649629 - DNA, 25 bp, Mus musculus
gacttcccgtctgtgaatgaagcca

SEQ ID NO: 649630 - DNA, 25 bp, Mus musculus
gacttccctggtcaagattccaaca

SEQ ID NO: 649631 - DNA, 25 bp, Mus musculus
gacttccctggtgaagattccaaca

SEQ ID NO: 649632 - DNA, 25 bp, Mus musculus
gacttccctgtgcacgatagagctg

SEQ ID NO: 649633 - DNA, 25 bp, Mus musculus
gacttccctgtgctgctgctagaga

SEQ ID NO: 649634 - DNA, 25 bp, Mus musculus
gacttccctgtggacgatagagctg

SEQ ID NO: 649635 - DNA, 25 bp, Mus musculus
gacttccctgtggtgctgctagaga

SEQ ID NO: 649636 - DNA, 25 bp, Mus musculus
gacttccgagaaccgtattattggc

SEQ ID NO: 649637 - DNA, 25 bp, Mus musculus
gacttccgagaagcgtattattggc

SEQ ID NO: 649638 - DNA, 25 bp, Mus musculus
gacttccgagtcatgtatgtcttcg

SEQ ID NO: 649639 - DNA, 25 bp, Mus musculus
gacttccgagtcttgtatgtcttcg

SEQ ID NO: 649640 - DNA, 25 bp, Mus musculus
gacttccgcagtatccggtcagagt

SEQ ID NO: 649641 - DNA, 25 bp, Mus musculus
gacttccgcagtttccggtcagagt

SEQ ID NO: 649642 - DNA, 25 bp, Mus musculus
gacttccggaaactgttcagcaaac

SEQ ID NO: 649643 - DNA, 25 bp, Mus musculus
gacttccggaaagtgttcagcaaac

SEQ ID NO: 649644 - DNA, 25 bp, Mus musculus
gacttccgtcgtattctacagccca

SEQ ID NO: 649645 - DNA, 25 bp, Mus musculus
gacttccgtcgttttctacagccca

SEQ ID NO: 649646 - DNA, 25 bp, Mus musculus
gacttcctacagcaggtgcacaagc

SEQ ID NO: 649647 - DNA, 25 bp, Mus musculus
gacttcctacaggaggtgcacaagc

SEQ ID NO: 649648 - DNA, 25 bp, Mus musculus
gacttcctcgtcaatgatgtccttg

SEQ ID NO: 649649 - DNA, 25 bp, Mus musculus
gacttcctcgtctatgatgtccttg

SEQ ID NO: 649650 - DNA, 25 bp, Mus musculus
gacttcctcgtgctataactacaga

SEQ ID NO: 649651 - DNA, 25 bp, Mus musculus
gacttcctcgtggtataactacaga

SEQ ID NO: 649652 - DNA, 25 bp, Mus musculus
gacttcctctgccaaaccaaatcgg

SEQ ID NO: 649653 - DNA, 25 bp, Mus musculus
gacttcctctgcgaaaccaaatcgg

SEQ ID NO: 649654 - DNA, 25 bp, Mus musculus
gacttcctcttccataagtcaggtg

SEQ ID NO: 649655 - DNA, 25 bp, Mus musculus
gacttcctcttcgataagtcaggtg

SEQ ID NO: 649656 - DNA, 25 bp, Mus musculus
gacttcctgaacctggtgacctgcg

SEQ ID NO: 649657 - DNA, 25 bp, Mus musculus
gacttcctgaacgtggtgacctgcg

SEQ ID NO: 649658 - DNA, 25 bp, Mus musculus
gacttcctgcaacagtatgtcacgc

SEQ ID NO: 649659 - DNA, 25 bp, Mus musculus
gacttcctgcaagagtatgtcacgc

SEQ ID NO: 649660 - DNA, 25 bp, Mus musculus
gacttcctgcgcagtgtcaccgctg

SEQ ID NO: 649661 - DNA, 25 bp, Mus musculus
gacttcctgcgctgtgtcaccgctg

SEQ ID NO: 649662 - DNA, 25 bp, Mus musculus
gacttcctggcaattcagctcaaag

SEQ ID NO: 649663 - DNA, 25 bp, Mus musculus
gacttcctggcatttcagctcaaag

SEQ ID NO: 649664 - DNA, 25 bp, Mus musculus
gacttcctgggtaaccagtgggcac

SEQ ID NO: 649665 - DNA, 25 bp, Mus musculus
gacttcctgggttaccagtgggcac

SEQ ID NO: 649666 - DNA, 25 bp, Mus musculus
gacttcctggtgcactatggtcaca

SEQ ID NO: 649667 - DNA, 25 bp, Mus musculus
gacttcctggtggactatggtcaca

SEQ ID NO: 649668 - DNA, 25 bp, Mus musculus
gacttccttctccaactactaccgc

SEQ ID NO: 649669 - DNA, 25 bp, Mus musculus
gacttccttctcgaactactaccgc

SEQ ID NO: 649670 - DNA, 25 bp, Mus musculus
gacttcgaaacactattctcacagg

SEQ ID NO: 649671 - DNA, 25 bp, Mus musculus
gacttcgaaacagtattctcacagg

SEQ ID NO: 649672 - DNA, 25 bp, Mus musculus
gacttcgaacttccaatgattatcc

SEQ ID NO: 649673 - DNA, 25 bp, Mus musculus
gacttcgaacttgcaatgattatcc

SEQ ID NO: 649674 - DNA, 25 bp, Mus musculus
gacttcgaccttcgcagtggtatca

SEQ ID NO: 649675 - DNA, 25 bp, Mus musculus
gacttcgaccttggcagtggtatca

SEQ ID NO: 649676 - DNA, 25 bp, Mus musculus
gacttcgactcgaatcagcactatt

SEQ ID NO: 649677 - DNA, 25 bp, Mus musculus
gacttcgactcgtatcagcactatt

SEQ ID NO: 649678 - DNA, 25 bp, Mus musculus
gacttcgagggcacattccatgtaa

SEQ ID NO: 649679 - DNA, 25 bp, Mus musculus
gacttcgagggctcattccatgtaa

SEQ ID NO: 649680 - DNA, 25 bp, Mus musculus
gacttcgatgctcacaaggttatag

SEQ ID NO: 649681 - DNA, 25 bp, Mus musculus
gacttcgatgctgacaaggttatag

SEQ ID NO: 649682 - DNA, 25 bp, Mus musculus
gacttcgatggtcatactgaaccac

SEQ ID NO: 649683 - DNA, 25 bp, Mus musculus
gacttcgatggtgatactgaaccac

SEQ ID NO: 649684 - DNA, 25 bp, Mus musculus
gacttcgattccatcagtggatgcc

SEQ ID NO: 649685 - DNA, 25 bp, Mus musculus
gacttcgattccttcagtggatgcc

SEQ ID NO: 649686 - DNA, 25 bp, Mus musculus
gacttcgcaaataaccgtgagttta

SEQ ID NO: 649687 - DNA, 25 bp, Mus musculus
gacttcgcaaattaccgtgagttta

SEQ ID NO: 649688 - DNA, 25 bp, Mus musculus
gacttcgcccacctcataagctttg

SEQ ID NO: 649689 - DNA, 25 bp, Mus musculus
gacttcgcccacgtcataagctttg

SEQ ID NO: 649690 - DNA, 25 bp, Mus musculus
gacttcgccttgcaaagcgacatag

SEQ ID NO: 649691 - DNA, 25 bp, Mus musculus
gacttcgccttggaaagcgacatag

SEQ ID NO: 649692 - DNA, 25 bp, Mus musculus
gacttcgctataacaagcagctggg

SEQ ID NO: 649693 - DNA, 25 bp, Mus musculus
gacttcgctatatcaagcagctggg

SEQ ID NO: 649694 - DNA, 25 bp, Mus musculus
gacttcgctctcagcagcgggcgcg

SEQ ID NO: 649695 - DNA, 25 bp, Mus musculus
gacttcgctctctgcagcgggcgcg

SEQ ID NO: 649696 - DNA, 25 bp, Mus musculus
gacttcggacacattcttgggaatt

SEQ ID NO: 649697 - DNA, 25 bp, Mus musculus
gacttcggacactttcttgggaatt

SEQ ID NO: 649698 - DNA, 25 bp, Mus musculus
gacttcggactcaatgtggtgaaca

SEQ ID NO: 649699 - DNA, 25 bp, Mus musculus
gacttcggactctatgtggtgaaca

SEQ ID NO: 649700 - DNA, 25 bp, Mus musculus
gacttcggatggaagacattgtgga

SEQ ID NO: 649701 - DNA, 25 bp, Mus musculus
gacttcggatggtagacattgtgga

SEQ ID NO: 649702 - DNA, 25 bp, Mus musculus
gacttcggcagtcctcagccctata

SEQ ID NO: 649703 - DNA, 25 bp, Mus musculus
gacttcggcagtgctcagccctata

SEQ ID NO: 649704 - DNA, 25 bp, Mus musculus
gacttcgggaatccgctgaggaaat

SEQ ID NO: 649705 - DNA, 25 bp, Mus musculus
gacttcgggaatgcgctgaggaaat

SEQ ID NO: 649706 - DNA, 25 bp, Mus musculus
gacttcggttttcccaagcgtgtga

SEQ ID NO: 649707 - DNA, 25 bp, Mus musculus
gacttcggttttgccaagcgtgtga

SEQ ID NO: 649708 - DNA, 25 bp, Mus musculus
gacttcgtatgtactttcgtataca

SEQ ID NO: 649709 - DNA, 25 bp, Mus musculus
gacttcgtatgttctttcgtataca

SEQ ID NO: 649710 - DNA, 25 bp, Mus musculus
gacttcgtcaggatcaagatccgtg

SEQ ID NO: 649711 - DNA, 25 bp, Mus musculus
gacttcgtcaggttcaagatccgtg

SEQ ID NO: 649712 - DNA, 25 bp, Mus musculus
gacttcgtccaccagggatctcttc

SEQ ID NO: 649713 - DNA, 25 bp, Mus musculus
gacttcgtccacgagggatctcttc

SEQ ID NO: 649714 - DNA, 25 bp, Mus musculus
gacttcgtgtatcatcaggcaatga

SEQ ID NO: 649715 - DNA, 25 bp, Mus musculus
gacttcgtgtatgatcaggcaatga

SEQ ID NO: 649716 - DNA, 25 bp, Mus musculus
gacttcgttgagagccaaagcattc

SEQ ID NO: 649717 - DNA, 25 bp, Mus musculus
gacttcgttgagtgccaaagcattc

SEQ ID NO: 649718 - DNA, 25 bp, Mus musculus
gacttctaacttatgcatcgcccgt

SEQ ID NO: 649719 - DNA, 25 bp, Mus musculus
gacttctaacttttgcatcgcccgt

SEQ ID NO: 649720 - DNA, 25 bp, Mus musculus
gacttctaccctcctggtgtgcatc

SEQ ID NO: 649721 - DNA, 25 bp, Mus musculus
gacttctaccctgctggtgtgcatc

SEQ ID NO: 649722 - DNA, 25 bp, Mus musculus
gacttctacctgatctttaatgaag

SEQ ID NO: 649723 - DNA, 25 bp, Mus musculus
gacttctacctgttctttaatgaag

SEQ ID NO: 649724 - DNA, 25 bp, Mus musculus
gacttctactctactcggcagcatg

SEQ ID NO: 649725 - DNA, 25 bp, Mus musculus
gacttctactcttctcggcagcatg

SEQ ID NO: 649726 - DNA, 25 bp, Mus musculus
gacttctagcttactctgacccagc

SEQ ID NO: 649727 - DNA, 25 bp, Mus musculus
gacttctagctttctctgacccagc

SEQ ID NO: 649728 - DNA, 25 bp, Mus musculus
gacttctattggctcaaactcacat

SEQ ID NO: 649729 - DNA, 25 bp, Mus musculus
gacttctattgggtcaaactcacat

SEQ ID NO: 649730 - DNA, 25 bp, Mus musculus
gacttctcaaagctagacccaggca

SEQ ID NO: 649731 - DNA, 25 bp, Mus musculus
gacttctcaaaggtagacccaggca

SEQ ID NO: 649732 - DNA, 25 bp, Mus musculus
gacttctcagagacaaggatcttgc

SEQ ID NO: 649733 - DNA, 25 bp, Mus musculus
gacttctcagagacccttactcggg

SEQ ID NO: 649734 - DNA, 25 bp, Mus musculus
gacttctcagagtcaaggatcttgc

SEQ ID NO: 649735 - DNA, 25 bp, Mus musculus
gacttctcagagtcccttactcggg

SEQ ID NO: 649736 - DNA, 25 bp, Mus musculus
gacttctccagaaaacgacagtaaa

SEQ ID NO: 649737 - DNA, 25 bp, Mus musculus
gacttctccagactttcagtgacca

SEQ ID NO: 649738 - DNA, 25 bp, Mus musculus
gacttctccagagtttcagtgacca

SEQ ID NO: 649739 - DNA, 25 bp, Mus musculus
gacttctccagataacgacagtaaa

SEQ ID NO: 649740 - DNA, 25 bp, Mus musculus
gacttctcccagaacaccagagtgc

SEQ ID NO: 649741 - DNA, 25 bp, Mus musculus
gacttctcccagtacaccagagtgc

SEQ ID NO: 649742 - DNA, 25 bp, Mus musculus
gacttctctagcatgctctctgagg

SEQ ID NO: 649743 - DNA, 25 bp, Mus musculus
gacttctctagcttgctctctgagg

SEQ ID NO: 649744 - DNA, 25 bp, Mus musculus
gacttctctcatctttctaaatacg

SEQ ID NO: 649745 - DNA, 25 bp, Mus musculus
gacttctctcatgtttctaaatacg

SEQ ID NO: 649746 - DNA, 25 bp, Mus musculus
gacttctctccgcatgagtgggaat

SEQ ID NO: 649747 - DNA, 25 bp, Mus musculus
gacttctctccggatgagtgggaat

SEQ ID NO: 649748 - DNA, 25 bp, Mus musculus
gacttctctgaaaatgccgccaggc

SEQ ID NO: 649749 - DNA, 25 bp, Mus musculus
gacttctctgaatatgccgccaggc

SEQ ID NO: 649750 - DNA, 25 bp, Mus musculus
gacttctctgataggtccagcttta

SEQ ID NO: 649751 - DNA, 25 bp, Mus musculus
gacttctctgattggtccagcttta

SEQ ID NO: 649752 - DNA, 25 bp, Mus musculus
gacttctctgtaccggagctcgagt

SEQ ID NO: 649753 - DNA, 25 bp, Mus musculus
gacttctctgtagcggagctcgagt

SEQ ID NO: 649754 - DNA, 25 bp, Mus musculus
gacttctgattccagacctgttgga

SEQ ID NO: 649755 - DNA, 25 bp, Mus musculus
gacttctgattcgagacctgttgga

SEQ ID NO: 649756 - DNA, 25 bp, Mus musculus
gacttctgcagacgaattgtgcagt

SEQ ID NO: 649757 - DNA, 25 bp, Mus musculus
gacttctgcagaggaattgtgcagt

SEQ ID NO: 649758 - DNA, 25 bp, Mus musculus
gacttctgcaggcaatcgcgaagct

SEQ ID NO: 649759 - DNA, 25 bp, Mus musculus
gacttctgcagggaatcgcgaagct

SEQ ID NO: 649760 - DNA, 25 bp, Mus musculus
gacttctgcgacaactcgtgacaat

SEQ ID NO: 649761 - DNA, 25 bp, Mus musculus
gacttctgcgactactcgtgacaat

SEQ ID NO: 649762 - DNA, 25 bp, Mus musculus
gacttctgcgtgcatactgttagca

SEQ ID NO: 649763 - DNA, 25 bp, Mus musculus
gacttctgcgtggatactgttagca

SEQ ID NO: 649764 - DNA, 25 bp, Mus musculus
gacttctgctatcttcctggccatg

SEQ ID NO: 649765 - DNA, 25 bp, Mus musculus
gacttctgctatgttcctggccatg

SEQ ID NO: 649766 - DNA, 25 bp, Mus musculus
gacttctgctctcagttcctggaga

SEQ ID NO: 649767 - DNA, 25 bp, Mus musculus
gacttctgctctgagttcctggaga

SEQ ID NO: 649768 - DNA, 25 bp, Mus musculus
gacttctgctgcaagcgctggagct

SEQ ID NO: 649769 - DNA, 25 bp, Mus musculus
gacttctgctgctagcgctggagct

SEQ ID NO: 649770 - DNA, 25 bp, Mus musculus
gacttctggagtcttcgtcccgagt

SEQ ID NO: 649771 - DNA, 25 bp, Mus musculus
gacttctggagtgttcgtcccgagt

SEQ ID NO: 649772 - DNA, 25 bp, Mus musculus
gacttctgtcctatgggcttcggag

SEQ ID NO: 649773 - DNA, 25 bp, Mus musculus
gacttctgtcctttgggcttcggag

SEQ ID NO: 649774 - DNA, 25 bp, Mus musculus
gacttctgtgcacagactatttaga

SEQ ID NO: 649775 - DNA, 25 bp, Mus musculus
gacttctgtgcagagactatttaga

SEQ ID NO: 649776 - DNA, 25 bp, Mus musculus
gacttctgtttgaagactggactta

SEQ ID NO: 649777 - DNA, 25 bp, Mus musculus
gacttctgtttgtagactggactta

SEQ ID NO: 649778 - DNA, 25 bp, Mus musculus
gacttcttatacatgggtgccaatg

SEQ ID NO: 649779 - DNA, 25 bp, Mus musculus
gacttcttatacttgggtgccaatg

SEQ ID NO: 649780 - DNA, 25 bp, Mus musculus
gacttcttcagcaatacccgccatg

SEQ ID NO: 649781 - DNA, 25 bp, Mus musculus
gacttcttcagctatacccgccatg

SEQ ID NO: 649782 - DNA, 25 bp, Mus musculus
gacttcttcgtgatgagtgattaca

SEQ ID NO: 649783 - DNA, 25 bp, Mus musculus
gacttcttcgtgttgagtgattaca

SEQ ID NO: 649784 - DNA, 25 bp, Mus musculus
gacttcttctggacggaccccatgc

SEQ ID NO: 649785 - DNA, 25 bp, Mus musculus
gacttcttctggtcggaccccatgc

SEQ ID NO: 649786 - DNA, 25 bp, Mus musculus
gacttcttgattaaggtgctggaga

SEQ ID NO: 649787 - DNA, 25 bp, Mus musculus
gacttcttgatttaggtgctggaga

SEQ ID NO: 649788 - DNA, 25 bp, Mus musculus
gacttcttgccaaggctgccgtaag

SEQ ID NO: 649789 - DNA, 25 bp, Mus musculus
gacttcttgccatggctgccgtaag

SEQ ID NO: 649790 - DNA, 25 bp, Mus musculus
gacttcttgcccatgagcactgctg

SEQ ID NO: 649791 - DNA, 25 bp, Mus musculus
gacttcttgcccttgagcactgctg

SEQ ID NO: 649792 - DNA, 25 bp, Mus musculus
gacttcttggatcgcagcgccagtt

SEQ ID NO: 649793 - DNA, 25 bp, Mus musculus
gacttcttggatggcagcgccagtt

SEQ ID NO: 649794 - DNA, 25 bp, Mus musculus
gacttcttgtctcctgataaccctc

SEQ ID NO: 649795 - DNA, 25 bp, Mus musculus
gacttcttgtctgctgataaccctc

SEQ ID NO: 649796 - DNA, 25 bp, Mus musculus
gacttctttgacactgcagctatca

SEQ ID NO: 649797 - DNA, 25 bp, Mus musculus
gacttctttgactctgcagctatca

SEQ ID NO: 649798 - DNA, 25 bp, Mus musculus
gacttgaaaacaattactactgggc

SEQ ID NO: 649799 - DNA, 25 bp, Mus musculus
gacttgaaaacatttactactgggc

SEQ ID NO: 649800 - DNA, 25 bp, Mus musculus
gacttgaaagggacccgagtctcgg

SEQ ID NO: 649801 - DNA, 25 bp, Mus musculus
gacttgaaagggtcccgagtctcgg

SEQ ID NO: 649802 - DNA, 25 bp, Mus musculus
gacttgaaagtgacttcctggctgt

SEQ ID NO: 649803 - DNA, 25 bp, Mus musculus
gacttgaaagtgtcttcctggctgt

SEQ ID NO: 649804 - DNA, 25 bp, Mus musculus
gacttgaaatataccctaaattgtg

SEQ ID NO: 649805 - DNA, 25 bp, Mus musculus
gacttgaaatattccctaaattgtg

SEQ ID NO: 649806 - DNA, 25 bp, Mus musculus
gacttgaaatccacagcaatggctc

SEQ ID NO: 649807 - DNA, 25 bp, Mus musculus
gacttgaaatcctcagcaatggctc

SEQ ID NO: 649808 - DNA, 25 bp, Mus musculus
gacttgaacttgcacctgaccctag

SEQ ID NO: 649809 - DNA, 25 bp, Mus musculus
gacttgaacttggacctgaccctag

SEQ ID NO: 649810 - DNA, 25 bp, Mus musculus
gacttgaaggagctgctccgttctg

SEQ ID NO: 649811 - DNA, 25 bp, Mus musculus
gacttgaaggaggtgctccgttctg

SEQ ID NO: 649812 - DNA, 25 bp, Mus musculus
gacttgaagtctatcatccttcaga

SEQ ID NO: 649813 - DNA, 25 bp, Mus musculus
gacttgaagtctttcatccttcaga

SEQ ID NO: 649814 - DNA, 25 bp, Mus musculus
gacttgaatcaactggatgttggca

SEQ ID NO: 649815 - DNA, 25 bp, Mus musculus
gacttgaatcaagtggatgttggca

SEQ ID NO: 649816 - DNA, 25 bp, Mus musculus
gacttgaatcggaaggacagaacag

SEQ ID NO: 649817 - DNA, 25 bp, Mus musculus
gacttgaatcggtaggacagaacag

SEQ ID NO: 649818 - DNA, 25 bp, Mus musculus
gacttgacctcaatcacaaacaact

SEQ ID NO: 649819 - DNA, 25 bp, Mus musculus
gacttgacctcattcacaaacaact

SEQ ID NO: 649820 - DNA, 25 bp, Mus musculus
gacttgacctccctcacctttggtg

SEQ ID NO: 649821 - DNA, 25 bp, Mus musculus
gacttgacctccgtcacctttggtg

SEQ ID NO: 649822 - DNA, 25 bp, Mus musculus
gacttgactgacaacctcaacagac

SEQ ID NO: 649823 - DNA, 25 bp, Mus musculus
gacttgactgactacctcaacagac

SEQ ID NO: 649824 - DNA, 25 bp, Mus musculus
gacttgactgatatccagaataagg

SEQ ID NO: 649825 - DNA, 25 bp, Mus musculus
gacttgactgatttccagaataagg

SEQ ID NO: 649826 - DNA, 25 bp, Mus musculus
gacttgactgcgatggccaaagagc

SEQ ID NO: 649827 - DNA, 25 bp, Mus musculus
gacttgactgcgttggccaaagagc

SEQ ID NO: 649828 - DNA, 25 bp, Mus musculus
gacttgactggacagtggctccaaa

SEQ ID NO: 649829 - DNA, 25 bp, Mus musculus
gacttgactggagagtggctccaaa

SEQ ID NO: 649830 - DNA, 25 bp, Mus musculus
gacttgactttacagacagctgtct

SEQ ID NO: 649831 - DNA, 25 bp, Mus musculus
gacttgactttagagacagctgtct

SEQ ID NO: 649832 - DNA, 25 bp, Mus musculus
gacttgagacccacaagactgatcc

SEQ ID NO: 649833 - DNA, 25 bp, Mus musculus
gacttgagaccctcaagactgatcc

SEQ ID NO: 649834 - DNA, 25 bp, Mus musculus
gacttgagagaaatgctcctaagga

SEQ ID NO: 649835 - DNA, 25 bp, Mus musculus
gacttgagagaattgctcctaagga

SEQ ID NO: 649836 - DNA, 25 bp, Mus musculus
gacttgagccggctgtacacagcaa

SEQ ID NO: 649837 - DNA, 25 bp, Mus musculus
gacttgagccgggtgtacacagcaa

SEQ ID NO: 649838 - DNA, 25 bp, Mus musculus
gacttgatattaattcctctggaca

SEQ ID NO: 649839 - DNA, 25 bp, Mus musculus
gacttgatattatttcctctggaca

SEQ ID NO: 649840 - DNA, 25 bp, Mus musculus
gacttgatgagactcaggaacactc

SEQ ID NO: 649841 - DNA, 25 bp, Mus musculus
gacttgatgagagtcaggaacactc

SEQ ID NO: 649842 - DNA, 25 bp, Mus musculus
gacttgatgccgatctccactcgtg

SEQ ID NO: 649843 - DNA, 25 bp, Mus musculus
gacttgatgccgttctccactcgtg

SEQ ID NO: 649844 - DNA, 25 bp, Mus musculus
gacttgatggacagagggaacccag

SEQ ID NO: 649845 - DNA, 25 bp, Mus musculus
gacttgatggactgagggaacccag

SEQ ID NO: 649846 - DNA, 25 bp, Mus musculus
gacttgattgcaattttgatataaa

SEQ ID NO: 649847 - DNA, 25 bp, Mus musculus
gacttgattgcacaaatccgggaag

SEQ ID NO: 649848 - DNA, 25 bp, Mus musculus
gacttgattgcagaaatccgggaag

SEQ ID NO: 649849 - DNA, 25 bp, Mus musculus
gacttgattgcatttttgatataaa

SEQ ID NO: 649850 - DNA, 25 bp, Mus musculus
gacttgcaaacaacacaaagctgac

SEQ ID NO: 649851 - DNA, 25 bp, Mus musculus
gacttgcaaacatcacaaagctgac

SEQ ID NO: 649852 - DNA, 25 bp, Mus musculus
gacttgcaaagcacttgattccgga

SEQ ID NO: 649853 - DNA, 25 bp, Mus musculus
gacttgcaaagctcttgattccgga

SEQ ID NO: 649854 - DNA, 25 bp, Mus musculus
gacttgcaacttacttcaggagctg

SEQ ID NO: 649855 - DNA, 25 bp, Mus musculus
gacttgcaactttcttcaggagctg

SEQ ID NO: 649856 - DNA, 25 bp, Mus musculus
gacttgcaccagaggatagataggt

SEQ ID NO: 649857 - DNA, 25 bp, Mus musculus
gacttgcaccagtggatagataggt

SEQ ID NO: 649858 - DNA, 25 bp, Mus musculus
gacttgcactaacaagaagcctatg

SEQ ID NO: 649859 - DNA, 25 bp, Mus musculus
gacttgcactaagaagaagcctatg

SEQ ID NO: 649860 - DNA, 25 bp, Mus musculus
gacttgcagcaaagcagagatgtca

SEQ ID NO: 649861 - DNA, 25 bp, Mus musculus
gacttgcagcaatgcagagatgtca

SEQ ID NO: 649862 - DNA, 25 bp, Mus musculus
gacttgcagcacaatgacctactgg

SEQ ID NO: 649863 - DNA, 25 bp, Mus musculus
gacttgcagcacagggcttccggat

SEQ ID NO: 649864 - DNA, 25 bp, Mus musculus
gacttgcagcactatgacctactgg

SEQ ID NO: 649865 - DNA, 25 bp, Mus musculus
gacttgcagcactgggcttccggat

SEQ ID NO: 649866 - DNA, 25 bp, Mus musculus
gacttgcatctcattatggtcctga

SEQ ID NO: 649867 - DNA, 25 bp, Mus musculus
gacttgcatctctttatggtcctga

SEQ ID NO: 649868 - DNA, 25 bp, Mus musculus
gacttgcccagcaatacccttggtg

SEQ ID NO: 649869 - DNA, 25 bp, Mus musculus
gacttgcccagctatacccttggtg

SEQ ID NO: 649870 - DNA, 25 bp, Mus musculus
gacttgccgcgacacatgatcgatg

SEQ ID NO: 649871 - DNA, 25 bp, Mus musculus
gacttgccgcgagacatgatcgatg

SEQ ID NO: 649872 - DNA, 25 bp, Mus musculus
gacttgcctcctcaacaatggtcgc

SEQ ID NO: 649873 - DNA, 25 bp, Mus musculus
gacttgcctcctgaacaatggtcgc

SEQ ID NO: 649874 - DNA, 25 bp, Mus musculus
gacttgctcaggacaaactaggcca

SEQ ID NO: 649875 - DNA, 25 bp, Mus musculus
gacttgctcaggtcaaactaggcca

SEQ ID NO: 649876 - DNA, 25 bp, Mus musculus
gacttgctcgagatgtcatgaagga

SEQ ID NO: 649877 - DNA, 25 bp, Mus musculus
gacttgctcgagttgtcatgaagga

SEQ ID NO: 649878 - DNA, 25 bp, Mus musculus
gacttgctctctcttcatgcgcaac

SEQ ID NO: 649879 - DNA, 25 bp, Mus musculus
gacttgctctctgttcatgcgcaac

SEQ ID NO: 649880 - DNA, 25 bp, Mus musculus
gacttgctgaagaaacgttatagaa

SEQ ID NO: 649881 - DNA, 25 bp, Mus musculus
gacttgctgaagtaacgttatagaa

SEQ ID NO: 649882 - DNA, 25 bp, Mus musculus
gacttgctgcccagttgggagcccc

SEQ ID NO: 649883 - DNA, 25 bp, Mus musculus
gacttgctgccctgttgggagcccc

SEQ ID NO: 649884 - DNA, 25 bp, Mus musculus
gacttgctgcgcagtgggatttgct

SEQ ID NO: 649885 - DNA, 25 bp, Mus musculus
gacttgctgcgctgtgggatttgct

SEQ ID NO: 649886 - DNA, 25 bp, Mus musculus
gacttgctggccaatatcacaaaaa

SEQ ID NO: 649887 - DNA, 25 bp, Mus musculus
gacttgctggcctatatcacaaaaa

SEQ ID NO: 649888 - DNA, 25 bp, Mus musculus
gacttgctggtcaacaactgtgagc

SEQ ID NO: 649889 - DNA, 25 bp, Mus musculus
gacttgctggtctacaactgtgagc

SEQ ID NO: 649890 - DNA, 25 bp, Mus musculus
gacttgcttcgacaaaatacagatg

SEQ ID NO: 649891 - DNA, 25 bp, Mus musculus
gacttgcttcgagaaaatacagatg

SEQ ID NO: 649892 - DNA, 25 bp, Mus musculus
gacttggaacgtctgcgccagctag

SEQ ID NO: 649893 - DNA, 25 bp, Mus musculus
gacttggaacgtgtgcgccagctag

SEQ ID NO: 649894 - DNA, 25 bp, Mus musculus
gacttggaccaacgataaatacatg

SEQ ID NO: 649895 - DNA, 25 bp, Mus musculus
gacttggaccaaggataaatacatg

SEQ ID NO: 649896 - DNA, 25 bp, Mus musculus
gacttggactttaccatcgacctgg

SEQ ID NO: 649897 - DNA, 25 bp, Mus musculus
gacttggacttttccatcgacctgg

SEQ ID NO: 649898 - DNA, 25 bp, Mus musculus
gacttggagaggactgtcttggatc

SEQ ID NO: 649899 - DNA, 25 bp, Mus musculus
gacttggagaggtctgtcttggatc

SEQ ID NO: 649900 - DNA, 25 bp, Mus musculus
gacttggagcatcttttctaggaag

SEQ ID NO: 649901 - DNA, 25 bp, Mus musculus
gacttggagcatgttttctaggaag

SEQ ID NO: 649902 - DNA, 25 bp, Mus musculus
gacttggaggacagcgaggtgctgg

SEQ ID NO: 649903 - DNA, 25 bp, Mus musculus
gacttggaggactgcgaggtgctgg

SEQ ID NO: 649904 - DNA, 25 bp, Mus musculus
gacttggatcaacgcctttgacttc

SEQ ID NO: 649905 - DNA, 25 bp, Mus musculus
gacttggatcaaggcctttgacttc

SEQ ID NO: 649906 - DNA, 25 bp, Mus musculus
gacttggatcctctgagtaagccta

SEQ ID NO: 649907 - DNA, 25 bp, Mus musculus
gacttggatcctgtgagtaagccta

SEQ ID NO: 649908 - DNA, 25 bp, Mus musculus
gacttggatcgaattctgactctca

SEQ ID NO: 649909 - DNA, 25 bp, Mus musculus
gacttggatcgatttctgactctca

SEQ ID NO: 649910 - DNA, 25 bp, Mus musculus
gacttggatgaccagacctgtagag

SEQ ID NO: 649911 - DNA, 25 bp, Mus musculus
gacttggatgacgagacctgtagag

SEQ ID NO: 649912 - DNA, 25 bp, Mus musculus
gacttggccaccacagataagagtg

SEQ ID NO: 649913 - DNA, 25 bp, Mus musculus
gacttggccacctcagataagagtg

SEQ ID NO: 649914 - DNA, 25 bp, Mus musculus
gacttggcccagaaaaggatctatg

SEQ ID NO: 649915 - DNA, 25 bp, Mus musculus
gacttggcccagtaaaggatctatg

SEQ ID NO: 649916 - DNA, 25 bp, Mus musculus
gacttggcctcccttccagagacta

SEQ ID NO: 649917 - DNA, 25 bp, Mus musculus
gacttggcctccgttccagagacta

SEQ ID NO: 649918 - DNA, 25 bp, Mus musculus
gacttgggacttcctgtgagacatg

SEQ ID NO: 649919 - DNA, 25 bp, Mus musculus
gacttgggacttgctgtgagacatg

SEQ ID NO: 649920 - DNA, 25 bp, Mus musculus
gacttgggagccagtccatgcaaga

SEQ ID NO: 649921 - DNA, 25 bp, Mus musculus
gacttgggagcctgtccatgcaaga

SEQ ID NO: 649922 - DNA, 25 bp, Mus musculus
gacttgggatatattattcacagcc

SEQ ID NO: 649923 - DNA, 25 bp, Mus musculus
gacttgggatattttattcacagcc

SEQ ID NO: 649924 - DNA, 25 bp, Mus musculus
gacttgggattaccttgaatttgaa

SEQ ID NO: 649925 - DNA, 25 bp, Mus musculus
gacttgggattagcttgaatttgaa

SEQ ID NO: 649926 - DNA, 25 bp, Mus musculus
gacttgggcttcagactgtgagatg

SEQ ID NO: 649927 - DNA, 25 bp, Mus musculus
gacttgggcttctgactgtgagatg

SEQ ID NO: 649928 - DNA, 25 bp, Mus musculus
gacttgggtcaccagtatgtgccca

SEQ ID NO: 649929 - DNA, 25 bp, Mus musculus
gacttgggtcacgagtatgtgccca

SEQ ID NO: 649930 - DNA, 25 bp, Mus musculus
gacttggtacagctgatgactcaga

SEQ ID NO: 649931 - DNA, 25 bp, Mus musculus
gacttggtacaggtgatgactcaga

SEQ ID NO: 649932 - DNA, 25 bp, Mus musculus
gacttggtactgacccttcatgccc

SEQ ID NO: 649933 - DNA, 25 bp, Mus musculus
gacttggtactgtcccttcatgccc

SEQ ID NO: 649934 - DNA, 25 bp, Mus musculus
gacttggtacttcatgctgcacatg

SEQ ID NO: 649935 - DNA, 25 bp, Mus musculus
gacttggtacttgatgctgcacatg

SEQ ID NO: 649936 - DNA, 25 bp, Mus musculus
gacttggtccgacctgtgtccatcc

SEQ ID NO: 649937 - DNA, 25 bp, Mus musculus
gacttggtccgagctgtgtccatcc

SEQ ID NO: 649938 - DNA, 25 bp, Mus musculus
gacttggtgaaaacgagtctgggcc

SEQ ID NO: 649939 - DNA, 25 bp, Mus musculus
gacttggtgaaatcgagtctgggcc

SEQ ID NO: 649940 - DNA, 25 bp, Mus musculus
gacttggtgacaattcaaagactgt

SEQ ID NO: 649941 - DNA, 25 bp, Mus musculus
gacttggtgacatttcaaagactgt

SEQ ID NO: 649942 - DNA, 25 bp, Mus musculus
gacttggtgcaaaggactcgacata

SEQ ID NO: 649943 - DNA, 25 bp, Mus musculus
gacttggtgcaatggactcgacata

SEQ ID NO: 649944 - DNA, 25 bp, Mus musculus
gacttggttctacacagcagtgcca

SEQ ID NO: 649945 - DNA, 25 bp, Mus musculus
gacttggttctagacagcagtgcca

SEQ ID NO: 649946 - DNA, 25 bp, Mus musculus
gacttggttgcacccaagaatcttc

SEQ ID NO: 649947 - DNA, 25 bp, Mus musculus
gacttggttgcagccaagaatcttc

SEQ ID NO: 649948 - DNA, 25 bp, Mus musculus
gacttggtttaaacactctcttcaa

SEQ ID NO: 649949 - DNA, 25 bp, Mus musculus
gacttggtttaatcactctcttcaa

SEQ ID NO: 649950 - DNA, 25 bp, Mus musculus
gacttggttttaactgtacacagcc

SEQ ID NO: 649951 - DNA, 25 bp, Mus musculus
gacttggttttatctgtacacagcc

SEQ ID NO: 649952 - DNA, 25 bp, Mus musculus
gacttgtaaagcctgagacctgcct

SEQ ID NO: 649953 - DNA, 25 bp, Mus musculus
gacttgtaaagcgtgagacctgcct

SEQ ID NO: 649954 - DNA, 25 bp, Mus musculus
gacttgtcctacaaggatcggcact

SEQ ID NO: 649955 - DNA, 25 bp, Mus musculus
gacttgtcctactaggatcggcact

SEQ ID NO: 649956 - DNA, 25 bp, Mus musculus
gacttgtcctcgcttgcgtcagtct

SEQ ID NO: 649957 - DNA, 25 bp, Mus musculus
gacttgtcctcggttgcgtcagtct

SEQ ID NO: 649958 - DNA, 25 bp, Mus musculus
gacttgtcttcaagtgcaacgtggc

SEQ ID NO: 649959 - DNA, 25 bp, Mus musculus
gacttgtcttcatgtgcaacgtggc

SEQ ID NO: 649960 - DNA, 25 bp, Mus musculus
gacttgtgacatagggacataccag

SEQ ID NO: 649961 - DNA, 25 bp, Mus musculus
gacttgtgacattgggacataccag

SEQ ID NO: 649962 - DNA, 25 bp, Mus musculus
gacttgtgagttcttcgaatctcag

SEQ ID NO: 649963 - DNA, 25 bp, Mus musculus
gacttgtgagttgttcgaatctcag

SEQ ID NO: 649964 - DNA, 25 bp, Mus musculus
gacttgtgcagtacaataggagtaa

SEQ ID NO: 649965 - DNA, 25 bp, Mus musculus
gacttgtgcagttcaataggagtaa

SEQ ID NO: 649966 - DNA, 25 bp, Mus musculus
gacttgtgcctactggtcggagaca

SEQ ID NO: 649967 - DNA, 25 bp, Mus musculus
gacttgtgcctagtggtcggagaca

SEQ ID NO: 649968 - DNA, 25 bp, Mus musculus
gacttgtgctatcagttccggcgag

SEQ ID NO: 649969 - DNA, 25 bp, Mus musculus
gacttgtgctatgagttccggcgag

SEQ ID NO: 649970 - DNA, 25 bp, Mus musculus
gacttgtggccgaagtgagaatgaa

SEQ ID NO: 649971 - DNA, 25 bp, Mus musculus
gacttgtggccgtagtgagaatgaa

SEQ ID NO: 649972 - DNA, 25 bp, Mus musculus
gacttgtgtttccttattcctaagg

SEQ ID NO: 649973 - DNA, 25 bp, Mus musculus
gacttgtgtttcgttattcctaagg

SEQ ID NO: 649974 - DNA, 25 bp, Mus musculus
gacttgttagtccaaggtcagatgg

SEQ ID NO: 649975 - DNA, 25 bp, Mus musculus
gacttgttagtcgaaggtcagatgg

SEQ ID NO: 649976 - DNA, 25 bp, Mus musculus
gacttgttcaagatctatgtggagg

SEQ ID NO: 649977 - DNA, 25 bp, Mus musculus
gacttgttcaagttctatgtggagg

SEQ ID NO: 649978 - DNA, 25 bp, Mus musculus
gacttgttccctatggaaatcattc

SEQ ID NO: 649979 - DNA, 25 bp, Mus musculus
gacttgttccctttggaaatcattc

SEQ ID NO: 649980 - DNA, 25 bp, Mus musculus
gacttgttcgagaagttgtgtctga

SEQ ID NO: 649981 - DNA, 25 bp, Mus musculus
gacttgttcgagtagttgtgtctga

SEQ ID NO: 649982 - DNA, 25 bp, Mus musculus
gacttgtttagaacccatgagctag

SEQ ID NO: 649983 - DNA, 25 bp, Mus musculus
gacttgtttagatcccatgagctag

SEQ ID NO: 649984 - DNA, 25 bp, Mus musculus
gactttaaaggccatccgctgggag

SEQ ID NO: 649985 - DNA, 25 bp, Mus musculus
gactttaaaggcgatccgctgggag

SEQ ID NO: 649986 - DNA, 25 bp, Mus musculus
gactttaaccaacggcggtgagcag

SEQ ID NO: 649987 - DNA, 25 bp, Mus musculus
gactttaaccaagggcggtgagcag

SEQ ID NO: 649988 - DNA, 25 bp, Mus musculus
gactttaacggcaatccccattctt

SEQ ID NO: 649989 - DNA, 25 bp, Mus musculus
gactttaacggctatccccattctt

SEQ ID NO: 649990 - DNA, 25 bp, Mus musculus
gactttaagacaatctagcttggct

SEQ ID NO: 649991 - DNA, 25 bp, Mus musculus
gactttaagacattctagcttggct

SEQ ID NO: 649992 - DNA, 25 bp, Mus musculus
gactttaagcctcagttgcctcctg

SEQ ID NO: 649993 - DNA, 25 bp, Mus musculus
gactttaagcctgagttgcctcctg

SEQ ID NO: 649994 - DNA, 25 bp, Mus musculus
gactttaatagtcaggaagatgcca

SEQ ID NO: 649995 - DNA, 25 bp, Mus musculus
gactttaatagtgaggaagatgcca

SEQ ID NO: 649996 - DNA, 25 bp, Mus musculus
gactttaatattcctgtggatctgg

SEQ ID NO: 649997 - DNA, 25 bp, Mus musculus
gactttaatattgctgtggatctgg

SEQ ID NO: 649998 - DNA, 25 bp, Mus musculus
gactttaatgagaacgacgaggagg

SEQ ID NO: 649999 - DNA, 25 bp, Mus musculus
gactttaatgagtacgacgaggagg

SEQ ID NO: 650000 - DNA, 25 bp, Mus musculus
gactttaattagacgtctccctgga

SEQ ID NO: 650001 - DNA, 25 bp, Mus musculus
gactttaattagtcgtctccctgga

SEQ ID NO: 650002 - DNA, 25 bp, Mus musculus
gactttacaagccaagagctttgga

SEQ ID NO: 650003 - DNA, 25 bp, Mus musculus
gactttacaagcgaagagctttgga

SEQ ID NO: 650004 - DNA, 25 bp, Mus musculus
gactttaccactctcaagattgtca

SEQ ID NO: 650005 - DNA, 25 bp, Mus musculus
gactttaccactgtcaagattgtca

SEQ ID NO: 650006 - DNA, 25 bp, Mus musculus
gactttaccatcattcgaagccttg

SEQ ID NO: 650007 - DNA, 25 bp, Mus musculus
gactttaccatctttcgaagccttg

SEQ ID NO: 650008 - DNA, 25 bp, Mus musculus
gactttacccgcagtccgcggtcag

SEQ ID NO: 650009 - DNA, 25 bp, Mus musculus
gactttacccgctgtccgcggtcag

SEQ ID NO: 650010 - DNA, 25 bp, Mus musculus
gactttacggctccaagaatgcact

SEQ ID NO: 650011 - DNA, 25 bp, Mus musculus
gactttacggctgcaagaatgcact

SEQ ID NO: 650012 - DNA, 25 bp, Mus musculus
gactttacttctctgagtcctccaa

SEQ ID NO: 650013 - DNA, 25 bp, Mus musculus
gactttacttctgtgagtcctccaa

SEQ ID NO: 650014 - DNA, 25 bp, Mus musculus
gactttagcaagcaagtgcagccga

SEQ ID NO: 650015 - DNA, 25 bp, Mus musculus
gactttagcaaggaagtgcagccga

SEQ ID NO: 650016 - DNA, 25 bp, Mus musculus
gactttagccacagagcatcatgaa

SEQ ID NO: 650017 - DNA, 25 bp, Mus musculus
gactttagccactgagcatcatgaa

SEQ ID NO: 650018 - DNA, 25 bp, Mus musculus
gactttagtggacatagccaagtcc

SEQ ID NO: 650019 - DNA, 25 bp, Mus musculus
gactttagtggagatagccaagtcc

SEQ ID NO: 650020 - DNA, 25 bp, Mus musculus
gactttatccccatgtactgctggg

SEQ ID NO: 650021 - DNA, 25 bp, Mus musculus
gactttatccccttgtactgctggg

SEQ ID NO: 650022 - DNA, 25 bp, Mus musculus
gactttatggcaatgggagccgcag

SEQ ID NO: 650023 - DNA, 25 bp, Mus musculus
gactttatggcattgggagccgcag

SEQ ID NO: 650024 - DNA, 25 bp, Mus musculus
gactttattgacctaacattatcca

SEQ ID NO: 650025 - DNA, 25 bp, Mus musculus
gactttattgacgtaacattatcca

SEQ ID NO: 650026 - DNA, 25 bp, Mus musculus
gactttcaaaagagagctgctgccc

SEQ ID NO: 650027 - DNA, 25 bp, Mus musculus
gactttcaaaagtgagctgctgccc

SEQ ID NO: 650028 - DNA, 25 bp, Mus musculus
gactttcaagtccatctccagtaaa

SEQ ID NO: 650029 - DNA, 25 bp, Mus musculus
gactttcaagtcgatctccagtaaa

SEQ ID NO: 650030 - DNA, 25 bp, Mus musculus
gactttcacctcagaatagtgctgc

SEQ ID NO: 650031 - DNA, 25 bp, Mus musculus
gactttcacctctgaatagtgctgc

SEQ ID NO: 650032 - DNA, 25 bp, Mus musculus
gactttcacgatcagcctgagctgg

SEQ ID NO: 650033 - DNA, 25 bp, Mus musculus
gactttcacgatgagcctgagctgg

SEQ ID NO: 650034 - DNA, 25 bp, Mus musculus
gactttcactaccataaattcattc

SEQ ID NO: 650035 - DNA, 25 bp, Mus musculus
gactttcactacgataaattcattc

SEQ ID NO: 650036 - DNA, 25 bp, Mus musculus
gactttcagaggcaggcggccctca

SEQ ID NO: 650037 - DNA, 25 bp, Mus musculus
gactttcagagggaggcggccctca

SEQ ID NO: 650038 - DNA, 25 bp, Mus musculus
gactttcagcttctcgaactcgagg

SEQ ID NO: 650039 - DNA, 25 bp, Mus musculus
gactttcagcttgtcgaactcgagg

SEQ ID NO: 650040 - DNA, 25 bp, Mus musculus
gactttcaggaacggactttggcca

SEQ ID NO: 650041 - DNA, 25 bp, Mus musculus
gactttcaggaagggactttggcca

SEQ ID NO: 650042 - DNA, 25 bp, Mus musculus
gactttcaggagcacatcgagttcc

SEQ ID NO: 650043 - DNA, 25 bp, Mus musculus
gactttcaggaggacatcgagttcc

SEQ ID NO: 650044 - DNA, 25 bp, Mus musculus
gactttccaatgatagtcacaagaa

SEQ ID NO: 650045 - DNA, 25 bp, Mus musculus
gactttccaatgttagtcacaagaa

SEQ ID NO: 650046 - DNA, 25 bp, Mus musculus
gactttccctatctgtgacctgtct

SEQ ID NO: 650047 - DNA, 25 bp, Mus musculus
gactttccctatgtgtgacctgtct

SEQ ID NO: 650048 - DNA, 25 bp, Mus musculus
gactttccgaacagagcgtcctgtc

SEQ ID NO: 650049 - DNA, 25 bp, Mus musculus
gactttccgaactgagcgtcctgtc

SEQ ID NO: 650050 - DNA, 25 bp, Mus musculus
gactttccggagcacatagacagcg

SEQ ID NO: 650051 - DNA, 25 bp, Mus musculus
gactttccggaggacatagacagcg

SEQ ID NO: 650052 - DNA, 25 bp, Mus musculus
gactttcctgccactcttggccatg

SEQ ID NO: 650053 - DNA, 25 bp, Mus musculus
gactttcctgcctctcttggccatg

SEQ ID NO: 650054 - DNA, 25 bp, Mus musculus
gactttcgacagcaaataggcctgg

SEQ ID NO: 650055 - DNA, 25 bp, Mus musculus
gactttcgacaggaaataggcctgg

SEQ ID NO: 650056 - DNA, 25 bp, Mus musculus
gactttcggaagagccatctgacca

SEQ ID NO: 650057 - DNA, 25 bp, Mus musculus
gactttcggaagtgccatctgacca

SEQ ID NO: 650058 - DNA, 25 bp, Mus musculus
gactttcgtgacatgactttagaga

SEQ ID NO: 650059 - DNA, 25 bp, Mus musculus
gactttcgtgacttgactttagaga

SEQ ID NO: 650060 - DNA, 25 bp, Mus musculus
gactttctagaccatgtgcggcgga

SEQ ID NO: 650061 - DNA, 25 bp, Mus musculus
gactttctagacgatgtgcggcgga

SEQ ID NO: 650062 - DNA, 25 bp, Mus musculus
gactttctagccctaaatcaacagg

SEQ ID NO: 650063 - DNA, 25 bp, Mus musculus
gactttctagccgtaaatcaacagg

SEQ ID NO: 650064 - DNA, 25 bp, Mus musculus
gactttctattgcacaggacataga

SEQ ID NO: 650065 - DNA, 25 bp, Mus musculus
gactttctattggacaggacataga

SEQ ID NO: 650066 - DNA, 25 bp, Mus musculus
gactttctcacaacaagcacctgac

SEQ ID NO: 650067 - DNA, 25 bp, Mus musculus
gactttctcacatcaagcacctgac

SEQ ID NO: 650068 - DNA, 25 bp, Mus musculus
gactttctcagaatgatgctgggca

SEQ ID NO: 650069 - DNA, 25 bp, Mus musculus
gactttctcagattgatgctgggca

SEQ ID NO: 650070 - DNA, 25 bp, Mus musculus
gactttctgattctgacatatcact

SEQ ID NO: 650071 - DNA, 25 bp, Mus musculus
gactttctgattgtgacatatcact

SEQ ID NO: 650072 - DNA, 25 bp, Mus musculus
gactttctggacacagtcccttgcc

SEQ ID NO: 650073 - DNA, 25 bp, Mus musculus
gactttctggactcagtcccttgcc

SEQ ID NO: 650074 - DNA, 25 bp, Mus musculus
gactttctggatcgcttcttcagag

SEQ ID NO: 650075 - DNA, 25 bp, Mus musculus
gactttctggatggcttcttcagag

SEQ ID NO: 650076 - DNA, 25 bp, Mus musculus
gactttctgtgacccaaggttttat

SEQ ID NO: 650077 - DNA, 25 bp, Mus musculus
gactttctgtgagccaaggttttat

SEQ ID NO: 650078 - DNA, 25 bp, Mus musculus
gactttcttaacaacactttggaag

SEQ ID NO: 650079 - DNA, 25 bp, Mus musculus
gactttcttaactacactttggaag

SEQ ID NO: 650080 - DNA, 25 bp, Mus musculus
gactttgaacagcaaagctccacag

SEQ ID NO: 650081 - DNA, 25 bp, Mus musculus
gactttgaacaggaaagctccacag

SEQ ID NO: 650082 - DNA, 25 bp, Mus musculus
gactttgaacttctcatcctcttgt

SEQ ID NO: 650083 - DNA, 25 bp, Mus musculus
gactttgaacttgtcatcctcttgt

SEQ ID NO: 650084 - DNA, 25 bp, Mus musculus
gactttgaagaaccatttccttcgc

SEQ ID NO: 650085 - DNA, 25 bp, Mus musculus
gactttgaagaagcatttccttcgc

SEQ ID NO: 650086 - DNA, 25 bp, Mus musculus
gactttgaagacaggagactgacat

SEQ ID NO: 650087 - DNA, 25 bp, Mus musculus
gactttgaagactggagactgacat

SEQ ID NO: 650088 - DNA, 25 bp, Mus musculus
gactttgaagcacgcgtccttggac

SEQ ID NO: 650089 - DNA, 25 bp, Mus musculus
gactttgaagcaggcgtccttggac

SEQ ID NO: 650090 - DNA, 25 bp, Mus musculus
gactttgaagttactacattagtgg

SEQ ID NO: 650091 - DNA, 25 bp, Mus musculus
gactttgaagtttctacattagtgg

SEQ ID NO: 650092 - DNA, 25 bp, Mus musculus
gactttgaatccatttcttagagct

SEQ ID NO: 650093 - DNA, 25 bp, Mus musculus
gactttgaatccttttcttagagct

SEQ ID NO: 650094 - DNA, 25 bp, Mus musculus
gactttgacaacctgtccatgacca

SEQ ID NO: 650095 - DNA, 25 bp, Mus musculus
gactttgacaacgtgtccatgacca

SEQ ID NO: 650096 - DNA, 25 bp, Mus musculus
gactttgacatgactctaagtaggt

SEQ ID NO: 650097 - DNA, 25 bp, Mus musculus
gactttgacatgattgctctgactc

SEQ ID NO: 650098 - DNA, 25 bp, Mus musculus
gactttgacatgtctctaagtaggt

SEQ ID NO: 650099 - DNA, 25 bp, Mus musculus
gactttgacatgtttgctctgactc

SEQ ID NO: 650100 - DNA, 25 bp, Mus musculus
gactttgacctgacagaaggtgacg

SEQ ID NO: 650101 - DNA, 25 bp, Mus musculus
gactttgacctgtcagaaggtgacg

SEQ ID NO: 650102 - DNA, 25 bp, Mus musculus
gactttgaccttatctccttggatg

SEQ ID NO: 650103 - DNA, 25 bp, Mus musculus
gactttgaccttttctccttggatg

SEQ ID NO: 650104 - DNA, 25 bp, Mus musculus
gactttgactgccatcttgatgaca

SEQ ID NO: 650105 - DNA, 25 bp, Mus musculus
gactttgactgcgatcttgatgaca

SEQ ID NO: 650106 - DNA, 25 bp, Mus musculus
gactttgagaatacagcaatcttac

SEQ ID NO: 650107 - DNA, 25 bp, Mus musculus
gactttgagaattcagcaatcttac

SEQ ID NO: 650108 - DNA, 25 bp, Mus musculus
gactttgagccaagaaaacacacag

SEQ ID NO: 650109 - DNA, 25 bp, Mus musculus
gactttgagccatgaaaacacacag

SEQ ID NO: 650110 - DNA, 25 bp, Mus musculus
gactttgagccgactcagaaccaca

SEQ ID NO: 650111 - DNA, 25 bp, Mus musculus
gactttgagccgtctcagaaccaca

SEQ ID NO: 650112 - DNA, 25 bp, Mus musculus
gactttgaggcgcattcttggagcc

SEQ ID NO: 650113 - DNA, 25 bp, Mus musculus
gactttgaggcggattcttggagcc

SEQ ID NO: 650114 - DNA, 25 bp, Mus musculus
gactttgaggctacaagggaaaagc

SEQ ID NO: 650115 - DNA, 25 bp, Mus musculus
gactttgaggcttcaagggaaaagc

SEQ ID NO: 650116 - DNA, 25 bp, Mus musculus
gactttgataagaaacttaccgagg

SEQ ID NO: 650117 - DNA, 25 bp, Mus musculus
gactttgataagtaacttaccgagg

SEQ ID NO: 650118 - DNA, 25 bp, Mus musculus
gactttgatgttagttcaccattga

SEQ ID NO: 650119 - DNA, 25 bp, Mus musculus
gactttgatgtttgttcaccattga

SEQ ID NO: 650120 - DNA, 25 bp, Mus musculus
gactttgattctctgtactcccgcc

SEQ ID NO: 650121 - DNA, 25 bp, Mus musculus
gactttgattctgtgtactcccgcc

SEQ ID NO: 650122 - DNA, 25 bp, Mus musculus
gactttgcaacactggccagcatgg

SEQ ID NO: 650123 - DNA, 25 bp, Mus musculus
gactttgcaacagtggccagcatgg

SEQ ID NO: 650124 - DNA, 25 bp, Mus musculus
gactttgcaagaaacagaacccagg

SEQ ID NO: 650125 - DNA, 25 bp, Mus musculus
gactttgcaagatacagaacccagg

SEQ ID NO: 650126 - DNA, 25 bp, Mus musculus
gactttgcaaggagtccattcatga

SEQ ID NO: 650127 - DNA, 25 bp, Mus musculus
gactttgcaaggtgtccattcatga

SEQ ID NO: 650128 - DNA, 25 bp, Mus musculus
gactttgcaccgcagtttacaggaa

SEQ ID NO: 650129 - DNA, 25 bp, Mus musculus
gactttgcaccggagtttacaggaa

SEQ ID NO: 650130 - DNA, 25 bp, Mus musculus
gactttgcagatcatgagagctaaa

SEQ ID NO: 650131 - DNA, 25 bp, Mus musculus
gactttgcagatgatgagagctaaa

SEQ ID NO: 650132 - DNA, 25 bp, Mus musculus
gactttgcattaattaacaagctgg

SEQ ID NO: 650133 - DNA, 25 bp, Mus musculus
gactttgcattatttaacaagctgg

SEQ ID NO: 650134 - DNA, 25 bp, Mus musculus
gactttgccaagaattctcgccctg

SEQ ID NO: 650135 - DNA, 25 bp, Mus musculus
gactttgccaagtattctcgccctg

SEQ ID NO: 650136 - DNA, 25 bp, Mus musculus
gactttgccctacagaaccctggtg

SEQ ID NO: 650137 - DNA, 25 bp, Mus musculus
gactttgccctagagaaccctggtg

SEQ ID NO: 650138 - DNA, 25 bp, Mus musculus
gactttgccctcaacccaggtgtga

SEQ ID NO: 650139 - DNA, 25 bp, Mus musculus
gactttgccctcaagaatccattct

SEQ ID NO: 650140 - DNA, 25 bp, Mus musculus
gactttgccctctacccaggtgtga

SEQ ID NO: 650141 - DNA, 25 bp, Mus musculus
gactttgccctctagaatccattct

SEQ ID NO: 650142 - DNA, 25 bp, Mus musculus
gactttgccctgaatgtatgatgac

SEQ ID NO: 650143 - DNA, 25 bp, Mus musculus
gactttgccctgtatgtatgatgac

SEQ ID NO: 650144 - DNA, 25 bp, Mus musculus
gactttgcccttcacccgagggtat

SEQ ID NO: 650145 - DNA, 25 bp, Mus musculus
gactttgcccttgacccgagggtat

SEQ ID NO: 650146 - DNA, 25 bp, Mus musculus
gactttgcgattattcaggagtgcc

SEQ ID NO: 650147 - DNA, 25 bp, Mus musculus
gactttgcgatttttcaggagtgcc

SEQ ID NO: 650148 - DNA, 25 bp, Mus musculus
gactttgctatcaactttgacccag

SEQ ID NO: 650149 - DNA, 25 bp, Mus musculus
gactttgctatctactttgacccag

SEQ ID NO: 650150 - DNA, 25 bp, Mus musculus
gactttgctgaaaatgcctctgtgg

SEQ ID NO: 650151 - DNA, 25 bp, Mus musculus
gactttgctgaatatgcctctgtgg

SEQ ID NO: 650152 - DNA, 25 bp, Mus musculus
gactttgctgtgcacaagaaccggg

SEQ ID NO: 650153 - DNA, 25 bp, Mus musculus
gactttgctgtggacaagaaccggg

SEQ ID NO: 650154 - DNA, 25 bp, Mus musculus
gactttgcttctcgccaggaaatcg

SEQ ID NO: 650155 - DNA, 25 bp, Mus musculus
gactttgcttctggccaggaaatcg

SEQ ID NO: 650156 - DNA, 25 bp, Mus musculus
gactttggaaacctacagcttggac

SEQ ID NO: 650157 - DNA, 25 bp, Mus musculus
gactttggaaacgtacagcttggac

SEQ ID NO: 650158 - DNA, 25 bp, Mus musculus
gactttggactgctgtcttcatcct

SEQ ID NO: 650159 - DNA, 25 bp, Mus musculus
gactttggactggtgtcttcatcct

SEQ ID NO: 650160 - DNA, 25 bp, Mus musculus
gactttggacttagcaaggagtcca

SEQ ID NO: 650161 - DNA, 25 bp, Mus musculus
gactttggactttgcaaggagtcca

SEQ ID NO: 650162 - DNA, 25 bp, Mus musculus
gactttggagcaccgcggtcccttg

SEQ ID NO: 650163 - DNA, 25 bp, Mus musculus
gactttggagcagcgcggtcccttg

SEQ ID NO: 650164 - DNA, 25 bp, Mus musculus
gactttggataacccctctgcagag

SEQ ID NO: 650165 - DNA, 25 bp, Mus musculus
gactttggataagccctctgcagag

SEQ ID NO: 650166 - DNA, 25 bp, Mus musculus
gactttggccaaagcgtgctgccct

SEQ ID NO: 650167 - DNA, 25 bp, Mus musculus
gactttggccaatgcgtgctgccct

SEQ ID NO: 650168 - DNA, 25 bp, Mus musculus
gactttggctggcatccctgctttc

SEQ ID NO: 650169 - DNA, 25 bp, Mus musculus
gactttggctgggatccctgctttc

SEQ ID NO: 650170 - DNA, 25 bp, Mus musculus
gactttgggaacctatatctccctg

SEQ ID NO: 650171 - DNA, 25 bp, Mus musculus
gactttgggaacgtatatctccctg

SEQ ID NO: 650172 - DNA, 25 bp, Mus musculus
gactttgggcacacgtgtacgctgg

SEQ ID NO: 650173 - DNA, 25 bp, Mus musculus
gactttgggcactcgtgtacgctgg

SEQ ID NO: 650174 - DNA, 25 bp, Mus musculus
gactttgggtttccccgcatcattg

SEQ ID NO: 650175 - DNA, 25 bp, Mus musculus
gactttgggtttgcccgcatcattg

SEQ ID NO: 650176 - DNA, 25 bp, Mus musculus
gactttggtacacaacttatagaca

SEQ ID NO: 650177 - DNA, 25 bp, Mus musculus
gactttggtacagaacttatagaca

SEQ ID NO: 650178 - DNA, 25 bp, Mus musculus
gactttggtccaatgtacaggccaa

SEQ ID NO: 650179 - DNA, 25 bp, Mus musculus
gactttggtccattgtacaggccaa

SEQ ID NO: 650180 - DNA, 25 bp, Mus musculus
gactttggtgagaagacctgactct

SEQ ID NO: 650181 - DNA, 25 bp, Mus musculus
gactttggtgagtagacctgactct

SEQ ID NO: 650182 - DNA, 25 bp, Mus musculus
gactttggtggacaaatggcctgat

SEQ ID NO: 650183 - DNA, 25 bp, Mus musculus
gactttggtggagaaatggcctgat

SEQ ID NO: 650184 - DNA, 25 bp, Mus musculus
gactttgtagagaatgtgctggtga

SEQ ID NO: 650185 - DNA, 25 bp, Mus musculus
gactttgtagagtatgtgctggtga

SEQ ID NO: 650186 - DNA, 25 bp, Mus musculus
gactttgtccagcacaagattcaga

SEQ ID NO: 650187 - DNA, 25 bp, Mus musculus
gactttgtccaggacaagattcaga

SEQ ID NO: 650188 - DNA, 25 bp, Mus musculus
gactttgtcctaacatctgagatac

SEQ ID NO: 650189 - DNA, 25 bp, Mus musculus
gactttgtcctatcatctgagatac

SEQ ID NO: 650190 - DNA, 25 bp, Mus musculus
gactttgtctccaaacagggaagca

SEQ ID NO: 650191 - DNA, 25 bp, Mus musculus
gactttgtctcctaacagggaagca

SEQ ID NO: 650192 - DNA, 25 bp, Mus musculus
gactttgtgaacatccagctgtacc

SEQ ID NO: 650193 - DNA, 25 bp, Mus musculus
gactttgtgaacttccagctgtacc

SEQ ID NO: 650194 - DNA, 25 bp, Mus musculus
gactttgtgacacagtgtcacgcat

SEQ ID NO: 650195 - DNA, 25 bp, Mus musculus
gactttgtgacagagtgtcacgcat

SEQ ID NO: 650196 - DNA, 25 bp, Mus musculus
gactttgtgatgactgactttgcca

SEQ ID NO: 650197 - DNA, 25 bp, Mus musculus
gactttgtgatgtctgactttgcca

SEQ ID NO: 650198 - DNA, 25 bp, Mus musculus
gactttgtgcctccaaggaaacagc

SEQ ID NO: 650199 - DNA, 25 bp, Mus musculus
gactttgtgcctgcaaggaaacagc

SEQ ID NO: 650200 - DNA, 25 bp, Mus musculus
gactttgtggtgcttgtgtcacgaa

SEQ ID NO: 650201 - DNA, 25 bp, Mus musculus
gactttgtggtggttgtgtcacgaa

SEQ ID NO: 650202 - DNA, 25 bp, Mus musculus
gactttgttgcacggagtagctccc

SEQ ID NO: 650203 - DNA, 25 bp, Mus musculus
gactttgttgcagggagtagctccc

SEQ ID NO: 650204 - DNA, 25 bp, Mus musculus
gactttgtttaaatgaaaggtgcgc

SEQ ID NO: 650205 - DNA, 25 bp, Mus musculus
gactttgtttaattgaaaggtgcgc

SEQ ID NO: 650206 - DNA, 25 bp, Mus musculus
gacttttaccacacgatccatagga

SEQ ID NO: 650207 - DNA, 25 bp, Mus musculus
gacttttaccactcgatccatagga

SEQ ID NO: 650208 - DNA, 25 bp, Mus musculus
gacttttacttcatggacttcagag

SEQ ID NO: 650209 - DNA, 25 bp, Mus musculus
gacttttacttcttggacttcagag

SEQ ID NO: 650210 - DNA, 25 bp, Mus musculus
gacttttagggcatgcaagacggct

SEQ ID NO: 650211 - DNA, 25 bp, Mus musculus
gacttttagggcttgcaagacggct

SEQ ID NO: 650212 - DNA, 25 bp, Mus musculus
gacttttagtataggacacttggcc

SEQ ID NO: 650213 - DNA, 25 bp, Mus musculus
gacttttagtattggacacttggcc

SEQ ID NO: 650214 - DNA, 25 bp, Mus musculus
gacttttagtccacgaattcggcct

SEQ ID NO: 650215 - DNA, 25 bp, Mus musculus
gacttttagtcctcgaattcggcct

SEQ ID NO: 650216 - DNA, 25 bp, Mus musculus
gacttttatggccagagtcccaagt

SEQ ID NO: 650217 - DNA, 25 bp, Mus musculus
gacttttatggcgagagtcccaagt

SEQ ID NO: 650218 - DNA, 25 bp, Mus musculus
gacttttattccaggcctccgttag

SEQ ID NO: 650219 - DNA, 25 bp, Mus musculus
gacttttattcctggcctccgttag

SEQ ID NO: 650220 - DNA, 25 bp, Mus musculus
gacttttccactagaagacgagaga

SEQ ID NO: 650221 - DNA, 25 bp, Mus musculus
gacttttccacttgaagacgagaga

SEQ ID NO: 650222 - DNA, 25 bp, Mus musculus
gacttttcgagtactgctcccgtta

SEQ ID NO: 650223 - DNA, 25 bp, Mus musculus
gacttttcgagttctgctcccgtta

SEQ ID NO: 650224 - DNA, 25 bp, Mus musculus
gacttttctttccaacatgcttcga

SEQ ID NO: 650225 - DNA, 25 bp, Mus musculus
gacttttctttcgaacatgcttcga

SEQ ID NO: 650226 - DNA, 25 bp, Mus musculus
gacttttgaccgcagtgttaacatt

SEQ ID NO: 650227 - DNA, 25 bp, Mus musculus
gacttttgaccggagtgttaacatt

SEQ ID NO: 650228 - DNA, 25 bp, Mus musculus
gacttttgatgtagagtgccttaca

SEQ ID NO: 650229 - DNA, 25 bp, Mus musculus
gacttttgatgttgagtgccttaca

SEQ ID NO: 650230 - DNA, 25 bp, Mus musculus
gacttttggagcagatgactccgga

SEQ ID NO: 650231 - DNA, 25 bp, Mus musculus
gacttttggagctgatgactccgga

SEQ ID NO: 650232 - DNA, 25 bp, Mus musculus
gacttttggaggatcagccggaacg

SEQ ID NO: 650233 - DNA, 25 bp, Mus musculus
gacttttggaggttcagccggaacg

SEQ ID NO: 650234 - DNA, 25 bp, Mus musculus
gacttttgtaccactttgcagagaa

SEQ ID NO: 650235 - DNA, 25 bp, Mus musculus
gacttttgtacctctttgcagagaa

SEQ ID NO: 650236 - DNA, 25 bp, Mus musculus
gacttttgtggcaagtcatcaagat

SEQ ID NO: 650237 - DNA, 25 bp, Mus musculus
gacttttgtggctagtcatcaagat

SEQ ID NO: 650238 - DNA, 25 bp, Mus musculus
gactttttcagtaggctggctctca

SEQ ID NO: 650239 - DNA, 25 bp, Mus musculus
gactttttcagttggctggctctca

SEQ ID NO: 650240 - DNA, 25 bp, Mus musculus
gactttttcgcacatccagacctgt

SEQ ID NO: 650241 - DNA, 25 bp, Mus musculus
gactttttcgcagatccagacctgt

SEQ ID NO: 650242 - DNA, 25 bp, Mus musculus
gactttttgaagacgggctccagca

SEQ ID NO: 650243 - DNA, 25 bp, Mus musculus
gactttttgaagtcgggctccagca

SEQ ID NO: 650244 - DNA, 25 bp, Mus musculus
gacttttttgagaagccagactacg

SEQ ID NO: 650245 - DNA, 25 bp, Mus musculus
gacttttttgagtagccagactacg

SEQ ID NO: 650246 - DNA, 25 bp, Mus musculus
gacttttttggacctagggttacag

SEQ ID NO: 650247 - DNA, 25 bp, Mus musculus
gacttttttggagctagggttacag

SEQ ID NO: 650248 - DNA, 25 bp, Mus musculus
gagaaaaaccacagaaggaaaggag

SEQ ID NO: 650249 - DNA, 25 bp, Mus musculus
gagaaaaaccactgaaggaaaggag

SEQ ID NO: 650250 - DNA, 25 bp, Mus musculus
gagaaaaactcaaccctggaccaca

SEQ ID NO: 650251 - DNA, 25 bp, Mus musculus
gagaaaaactcatccctggaccaca

SEQ ID NO: 650252 - DNA, 25 bp, Mus musculus
gagaaaaagacacggctctgaacca

SEQ ID NO: 650253 - DNA, 25 bp, Mus musculus
gagaaaaagacagggctctgaacca

SEQ ID NO: 650254 - DNA, 25 bp, Mus musculus
gagaaaaagagccagatcccaagac

SEQ ID NO: 650255 - DNA, 25 bp, Mus musculus
gagaaaaagagcgagatcccaagac

SEQ ID NO: 650256 - DNA, 25 bp, Mus musculus
gagaaaaagcaaaaaggagaaggtt

SEQ ID NO: 650257 - DNA, 25 bp, Mus musculus
gagaaaaagcaataaggagaaggtt

SEQ ID NO: 650258 - DNA, 25 bp, Mus musculus
gagaaaaagccccacccaatatgga

SEQ ID NO: 650259 - DNA, 25 bp, Mus musculus
gagaaaaagcccgacccaatatgga

SEQ ID NO: 650260 - DNA, 25 bp, Mus musculus
gagaaaaagcgcatactagaaatga

SEQ ID NO: 650261 - DNA, 25 bp, Mus musculus
gagaaaaagcgcttactagaaatga

SEQ ID NO: 650262 - DNA, 25 bp, Mus musculus
gagaaaaagctgaacttggcccaga

SEQ ID NO: 650263 - DNA, 25 bp, Mus musculus
gagaaaaagctgtacttggcccaga

SEQ ID NO: 650264 - DNA, 25 bp, Mus musculus
gagaaaaagttactcaagacagctt

SEQ ID NO: 650265 - DNA, 25 bp, Mus musculus
gagaaaaagttagtcaagacagctt

SEQ ID NO: 650266 - DNA, 25 bp, Mus musculus
gagaaaaatacccactcattgtctt

SEQ ID NO: 650267 - DNA, 25 bp, Mus musculus
gagaaaaataccgactcattgtctt

SEQ ID NO: 650268 - DNA, 25 bp, Mus musculus
gagaaaaatattcaccaagaatttg

SEQ ID NO: 650269 - DNA, 25 bp, Mus musculus
gagaaaaatattgaccaagaatttg

SEQ ID NO: 650270 - DNA, 25 bp, Mus musculus
gagaaaaatggcaactcaagcaatg

SEQ ID NO: 650271 - DNA, 25 bp, Mus musculus
gagaaaaatggctactcaagcaatg

SEQ ID NO: 650272 - DNA, 25 bp, Mus musculus
gagaaaaatggtcaaaagaggtcat

SEQ ID NO: 650273 - DNA, 25 bp, Mus musculus
gagaaaaatggtgaaaagaggtcat

SEQ ID NO: 650274 - DNA, 25 bp, Mus musculus
gagaaaacacctctgacccgtccag

SEQ ID NO: 650275 - DNA, 25 bp, Mus musculus
gagaaaacacctgtgacccgtccag

SEQ ID NO: 650276 - DNA, 25 bp, Mus musculus
gagaaaacaggtaagactctgctgc

SEQ ID NO: 650277 - DNA, 25 bp, Mus musculus
gagaaaacaggttagactctgctgc

SEQ ID NO: 650278 - DNA, 25 bp, Mus musculus
gagaaaacagttacccatggatctg

SEQ ID NO: 650279 - DNA, 25 bp, Mus musculus
gagaaaacagtttcccatggatctg

SEQ ID NO: 650280 - DNA, 25 bp, Mus musculus
gagaaaacatcgcaactcagctatt

SEQ ID NO: 650281 - DNA, 25 bp, Mus musculus
gagaaaacatcggaactcagctatt

SEQ ID NO: 650282 - DNA, 25 bp, Mus musculus
gagaaaaccagtagaaaatgttgcc

SEQ ID NO: 650283 - DNA, 25 bp, Mus musculus
gagaaaaccagttgaaaatgttgcc

SEQ ID NO: 650284 - DNA, 25 bp, Mus musculus
gagaaaacccatagttaaagctctt

SEQ ID NO: 650285 - DNA, 25 bp, Mus musculus
gagaaaacccattgttaaagctctt

SEQ ID NO: 650286 - DNA, 25 bp, Mus musculus
gagaaaaccctcagaagagtttaat

SEQ ID NO: 650287 - DNA, 25 bp, Mus musculus
gagaaaaccctctgaagagtttaat

SEQ ID NO: 650288 - DNA, 25 bp, Mus musculus
gagaaaacctgccatcgtttaccaa

SEQ ID NO: 650289 - DNA, 25 bp, Mus musculus
gagaaaacctgcgatcgtttaccaa

SEQ ID NO: 650290 - DNA, 25 bp, Mus musculus
gagaaaaccttcaccgtgtgtgaga

SEQ ID NO: 650291 - DNA, 25 bp, Mus musculus
gagaaaaccttctccgtgtgtgaga

SEQ ID NO: 650292 - DNA, 25 bp, Mus musculus
gagaaaacgcttcaccatctggaga

SEQ ID NO: 650293 - DNA, 25 bp, Mus musculus
gagaaaacgcttgaccatctggaga

SEQ ID NO: 650294 - DNA, 25 bp, Mus musculus
gagaaaacggaactcacggcagacc

SEQ ID NO: 650295 - DNA, 25 bp, Mus musculus
gagaaaacggaagtcacggcagacc

SEQ ID NO: 650296 - DNA, 25 bp, Mus musculus
gagaaaactcccaacagcatcagca

SEQ ID NO: 650297 - DNA, 25 bp, Mus musculus
gagaaaactccctacagcatcagca

SEQ ID NO: 650298 - DNA, 25 bp, Mus musculus
gagaaaactgagatggtatgtgcct

SEQ ID NO: 650299 - DNA, 25 bp, Mus musculus
gagaaaactgagttggtatgtgcct

SEQ ID NO: 650300 - DNA, 25 bp, Mus musculus
gagaaaactgtgaatgagggattca

SEQ ID NO: 650301 - DNA, 25 bp, Mus musculus
gagaaaactgtgtatgagggattca

SEQ ID NO: 650302 - DNA, 25 bp, Mus musculus
gagaaaactttgataccactaatgc

SEQ ID NO: 650303 - DNA, 25 bp, Mus musculus
gagaaaactttgttaccactaatgc

SEQ ID NO: 650304 - DNA, 25 bp, Mus musculus
gagaaaagagagacaccttctccag

SEQ ID NO: 650305 - DNA, 25 bp, Mus musculus
gagaaaagagagtcaccttctccag

SEQ ID NO: 650306 - DNA, 25 bp, Mus musculus
gagaaaagcattcatgacttagaag

SEQ ID NO: 650307 - DNA, 25 bp, Mus musculus
gagaaaagcattgatgacttagaag

SEQ ID NO: 650308 - DNA, 25 bp, Mus musculus
gagaaaagcccgagaagaatgcttc

SEQ ID NO: 650309 - DNA, 25 bp, Mus musculus
gagaaaagcccgtgaagaatgcttc

SEQ ID NO: 650310 - DNA, 25 bp, Mus musculus
gagaaaaggaaacagtacgaccagt

SEQ ID NO: 650311 - DNA, 25 bp, Mus musculus
gagaaaaggaaagagtacgaccagt

SEQ ID NO: 650312 - DNA, 25 bp, Mus musculus
gagaaaagtcaaatttactcaacag

SEQ ID NO: 650313 - DNA, 25 bp, Mus musculus
gagaaaagtcaattttactcaacag

SEQ ID NO: 650314 - DNA, 25 bp, Mus musculus
gagaaaagtgccataggagaccagc

SEQ ID NO: 650315 - DNA, 25 bp, Mus musculus
gagaaaagtgccttaggagaccagc

SEQ ID NO: 650316 - DNA, 25 bp, Mus musculus
gagaaaagttcactaccgcaaaggc

SEQ ID NO: 650317 - DNA, 25 bp, Mus musculus
gagaaaagttcagtaccgcaaaggc

SEQ ID NO: 650318 - DNA, 25 bp, Mus musculus
gagaaaatacacaagattgtaaatg

SEQ ID NO: 650319 - DNA, 25 bp, Mus musculus
gagaaaatacactagattgtaaatg

SEQ ID NO: 650320 - DNA, 25 bp, Mus musculus
gagaaaatcaatcagaaagatcctg

SEQ ID NO: 650321 - DNA, 25 bp, Mus musculus
gagaaaatcaatgagaaagatcctg

SEQ ID NO: 650322 - DNA, 25 bp, Mus musculus
gagaaaatcaggacgatgatattgg

SEQ ID NO: 650323 - DNA, 25 bp, Mus musculus
gagaaaatcaggtcgatgatattgg

SEQ ID NO: 650324 - DNA, 25 bp, Mus musculus
gagaaaatcctgaggaaggaatatg

SEQ ID NO: 650325 - DNA, 25 bp, Mus musculus
gagaaaatcctgtggaaggaatatg

SEQ ID NO: 650326 - DNA, 25 bp, Mus musculus
gagaaaatctggcttcggctccgcg

SEQ ID NO: 650327 - DNA, 25 bp, Mus musculus
gagaaaatctgggttcggctccgcg

SEQ ID NO: 650328 - DNA, 25 bp, Mus musculus
gagaaaatggcgcaacaggagacac

SEQ ID NO: 650329 - DNA, 25 bp, Mus musculus
gagaaaatggcggaacaggagacac

SEQ ID NO: 650330 - DNA, 25 bp, Mus musculus
gagaaaatggtgctagagacaagta

SEQ ID NO: 650331 - DNA, 25 bp, Mus musculus
gagaaaatggtggtagagacaagta

SEQ ID NO: 650332 - DNA, 25 bp, Mus musculus
gagaaaatgtcaactagagagaggg

SEQ ID NO: 650333 - DNA, 25 bp, Mus musculus
gagaaaatgtcatctagagagaggg

SEQ ID NO: 650334 - DNA, 25 bp, Mus musculus
gagaaaattagtcagacggccccgg

SEQ ID NO: 650335 - DNA, 25 bp, Mus musculus
gagaaaattagtgagacggccccgg

SEQ ID NO: 650336 - DNA, 25 bp, Mus musculus
gagaaaattatgactttggatggac

SEQ ID NO: 650337 - DNA, 25 bp, Mus musculus
gagaaaattatgtctttggatggac

SEQ ID NO: 650338 - DNA, 25 bp, Mus musculus
gagaaaattctgaggcctctgtagg

SEQ ID NO: 650339 - DNA, 25 bp, Mus musculus
gagaaaattctgtggcctctgtagg

SEQ ID NO: 650340 - DNA, 25 bp, Mus musculus
gagaaaattggcatagagtccccat

SEQ ID NO: 650341 - DNA, 25 bp, Mus musculus
gagaaaattggcttagagtccccat

SEQ ID NO: 650342 - DNA, 25 bp, Mus musculus
gagaaaatttcaaacctgccagtca

SEQ ID NO: 650343 - DNA, 25 bp, Mus musculus
gagaaaatttcatacctgccagtca

SEQ ID NO: 650344 - DNA, 25 bp, Mus musculus
gagaaacaacaaatactggtaacag

SEQ ID NO: 650345 - DNA, 25 bp, Mus musculus
gagaaacaacaattactggtaacag

SEQ ID NO: 650346 - DNA, 25 bp, Mus musculus
gagaaacaacccatccacagatgcc

SEQ ID NO: 650347 - DNA, 25 bp, Mus musculus
gagaaacaacccttccacagatgcc

SEQ ID NO: 650348 - DNA, 25 bp, Mus musculus
gagaaacacaaaataagtactgctt

SEQ ID NO: 650349 - DNA, 25 bp, Mus musculus
gagaaacacaaattaagtactgctt

SEQ ID NO: 650350 - DNA, 25 bp, Mus musculus
gagaaacaccacagcttttcctaag

SEQ ID NO: 650351 - DNA, 25 bp, Mus musculus
gagaaacaccactgcttttcctaag

SEQ ID NO: 650352 - DNA, 25 bp, Mus musculus
gagaaacaccggactaagccatgag

SEQ ID NO: 650353 - DNA, 25 bp, Mus musculus
gagaaacaccggtctaagccatgag

SEQ ID NO: 650354 - DNA, 25 bp, Mus musculus
gagaaacagaaaagcttctacatct

SEQ ID NO: 650355 - DNA, 25 bp, Mus musculus
gagaaacagaaatgcttctacatct

SEQ ID NO: 650356 - DNA, 25 bp, Mus musculus
gagaaacagatactcagtgaccagt

SEQ ID NO: 650357 - DNA, 25 bp, Mus musculus
gagaaacagatagtcagtgaccagt

SEQ ID NO: 650358 - DNA, 25 bp, Mus musculus
gagaaacaggtcatggacactcgaa

SEQ ID NO: 650359 - DNA, 25 bp, Mus musculus
gagaaacaggtcttggacactcgaa

SEQ ID NO: 650360 - DNA, 25 bp, Mus musculus
gagaaacatcctaagttaccagaga

SEQ ID NO: 650361 - DNA, 25 bp, Mus musculus
gagaaacatccttagttaccagaga

SEQ ID NO: 650362 - DNA, 25 bp, Mus musculus
gagaaacatgatcgcctctatccag

SEQ ID NO: 650363 - DNA, 25 bp, Mus musculus
gagaaacatgatggcctctatccag

SEQ ID NO: 650364 - DNA, 25 bp, Mus musculus
gagaaacatgtacaatcagatgtcc

SEQ ID NO: 650365 - DNA, 25 bp, Mus musculus
gagaaacatgtagaatcagatgtcc

SEQ ID NO: 650366 - DNA, 25 bp, Mus musculus
gagaaaccagtgaccaccagatgaa

SEQ ID NO: 650367 - DNA, 25 bp, Mus musculus
gagaaaccagtgtccaccagatgaa

SEQ ID NO: 650368 - DNA, 25 bp, Mus musculus
gagaaaccctacagacgtcggcagt

SEQ ID NO: 650369 - DNA, 25 bp, Mus musculus
gagaaaccctactgacgtcggcagt

SEQ ID NO: 650370 - DNA, 25 bp, Mus musculus
gagaaacccttccagtgtcccaaat

SEQ ID NO: 650371 - DNA, 25 bp, Mus musculus
gagaaacccttcgagtgtcccaaat

SEQ ID NO: 650372 - DNA, 25 bp, Mus musculus
gagaaaccggaaccggccttccact

SEQ ID NO: 650373 - DNA, 25 bp, Mus musculus
gagaaaccggaagcggccttccact

SEQ ID NO: 650374 - DNA, 25 bp, Mus musculus
gagaaaccgggcaagaggacaagcc

SEQ ID NO: 650375 - DNA, 25 bp, Mus musculus
gagaaaccgggctagaggacaagcc

SEQ ID NO: 650376 - DNA, 25 bp, Mus musculus
gagaaacctgcaatgcgcttactaa

SEQ ID NO: 650377 - DNA, 25 bp, Mus musculus
gagaaacctgcattgcgcttactaa

SEQ ID NO: 650378 - DNA, 25 bp, Mus musculus
gagaaacctgtcatgagctgccaat

SEQ ID NO: 650379 - DNA, 25 bp, Mus musculus
gagaaacctgtcttgagctgccaat

SEQ ID NO: 650380 - DNA, 25 bp, Mus musculus
gagaaaccttctaaatggacattta

SEQ ID NO: 650381 - DNA, 25 bp, Mus musculus
gagaaaccttcttaatggacattta

SEQ ID NO: 650382 - DNA, 25 bp, Mus musculus
gagaaacggctaccccattcctcaa

SEQ ID NO: 650383 - DNA, 25 bp, Mus musculus
gagaaacggctagcccattcctcaa

SEQ ID NO: 650384 - DNA, 25 bp, Mus musculus
gagaaacgtgtgaaattgcttaagg

SEQ ID NO: 650385 - DNA, 25 bp, Mus musculus
gagaaacgtgtgtaattgcttaagg

SEQ ID NO: 650386 - DNA, 25 bp, Mus musculus
gagaaactaacacgcccaatggagg

SEQ ID NO: 650387 - DNA, 25 bp, Mus musculus
gagaaactaacaggcccaatggagg

SEQ ID NO: 650388 - DNA, 25 bp, Mus musculus
gagaaactcactcctttgcacagta

SEQ ID NO: 650389 - DNA, 25 bp, Mus musculus
gagaaactcactgctttgcacagta

SEQ ID NO: 650390 - DNA, 25 bp, Mus musculus
gagaaactcattcctggtaccctgg

SEQ ID NO: 650391 - DNA, 25 bp, Mus musculus
gagaaactcattgctggtaccctgg

SEQ ID NO: 650392 - DNA, 25 bp, Mus musculus
gagaaactccgtaccctagtgctgg

SEQ ID NO: 650393 - DNA, 25 bp, Mus musculus
gagaaactccgttccctagtgctgg

SEQ ID NO: 650394 - DNA, 25 bp, Mus musculus
gagaaactctacattgtgcttgact

SEQ ID NO: 650395 - DNA, 25 bp, Mus musculus
gagaaactctaccaggagcccagag

SEQ ID NO: 650396 - DNA, 25 bp, Mus musculus
gagaaactctacgaggagcccagag

SEQ ID NO: 650397 - DNA, 25 bp, Mus musculus
gagaaactctactttgtgcttgact

SEQ ID NO: 650398 - DNA, 25 bp, Mus musculus
gagaaactctctcctaagagaatag

SEQ ID NO: 650399 - DNA, 25 bp, Mus musculus
gagaaactctctgctaagagaatag

SEQ ID NO: 650400 - DNA, 25 bp, Mus musculus
gagaaactgaacatcctcagaaggt

SEQ ID NO: 650401 - DNA, 25 bp, Mus musculus
gagaaactgaacttcctcagaaggt

SEQ ID NO: 650402 - DNA, 25 bp, Mus musculus
gagaaactgctcaaagtcctttacc

SEQ ID NO: 650403 - DNA, 25 bp, Mus musculus
gagaaactgctctaagtcctttacc

SEQ ID NO: 650404 - DNA, 25 bp, Mus musculus
gagaaactggaacctcacgaaagag

SEQ ID NO: 650405 - DNA, 25 bp, Mus musculus
gagaaactggaagctcacgaaagag

SEQ ID NO: 650406 - DNA, 25 bp, Mus musculus
gagaaactgtccatctacgactcca

SEQ ID NO: 650407 - DNA, 25 bp, Mus musculus
gagaaactgtccttctacgactcca

SEQ ID NO: 650408 - DNA, 25 bp, Mus musculus
gagaaacttcagagtgtgcacgcag

SEQ ID NO: 650409 - DNA, 25 bp, Mus musculus
gagaaacttcagtgtgtgcacgcag

SEQ ID NO: 650410 - DNA, 25 bp, Mus musculus
gagaaacttccaccattgaacccct

SEQ ID NO: 650411 - DNA, 25 bp, Mus musculus
gagaaacttccagcattgaacccct

SEQ ID NO: 650412 - DNA, 25 bp, Mus musculus
gagaaacttcgcctgtctgacgact

SEQ ID NO: 650413 - DNA, 25 bp, Mus musculus
gagaaacttcgcgtgtctgacgact

SEQ ID NO: 650414 - DNA, 25 bp, Mus musculus
gagaaactttagacagacgctcgct

SEQ ID NO: 650415 - DNA, 25 bp, Mus musculus
gagaaactttagtcagacgctcgct

SEQ ID NO: 650416 - DNA, 25 bp, Mus musculus
gagaaactttgcaggagaggtccta

SEQ ID NO: 650417 - DNA, 25 bp, Mus musculus
gagaaactttgctggagaggtccta

SEQ ID NO: 650418 - DNA, 25 bp, Mus musculus
gagaaacttttcacggctcagtctg

SEQ ID NO: 650419 - DNA, 25 bp, Mus musculus
gagaaacttttctcggctcagtctg

SEQ ID NO: 650420 - DNA, 25 bp, Mus musculus
gagaaagaaaagcactctggggccc

SEQ ID NO: 650421 - DNA, 25 bp, Mus musculus
gagaaagaaaaggactctggggccc

SEQ ID NO: 650422 - DNA, 25 bp, Mus musculus
gagaaagaacccattgtagacaaca

SEQ ID NO: 650423 - DNA, 25 bp, Mus musculus
gagaaagaaccctttgtagacaaca

SEQ ID NO: 650424 - DNA, 25 bp, Mus musculus
gagaaagaagagacactgcaaacct

SEQ ID NO: 650425 - DNA, 25 bp, Mus musculus
gagaaagaagagtcactgcaaacct

SEQ ID NO: 650426 - DNA, 25 bp, Mus musculus
gagaaagaagctcgcgccttcttgc

SEQ ID NO: 650427 - DNA, 25 bp, Mus musculus
gagaaagaagctggcgccttcttgc

SEQ ID NO: 650428 - DNA, 25 bp, Mus musculus
gagaaagaaggcacatgatccttaa

SEQ ID NO: 650429 - DNA, 25 bp, Mus musculus
gagaaagaaggctcatgatccttaa

SEQ ID NO: 650430 - DNA, 25 bp, Mus musculus
gagaaagaaggtatatcaaaggaga

SEQ ID NO: 650431 - DNA, 25 bp, Mus musculus
gagaaagaaggtttatcaaaggaga

SEQ ID NO: 650432 - DNA, 25 bp, Mus musculus
gagaaagaatggctgcctggcccct

SEQ ID NO: 650433 - DNA, 25 bp, Mus musculus
gagaaagaatgggtgcctggcccct

SEQ ID NO: 650434 - DNA, 25 bp, Mus musculus
gagaaagacccaattgctcatccag

SEQ ID NO: 650435 - DNA, 25 bp, Mus musculus
gagaaagacccatttgctcatccag

SEQ ID NO: 650436 - DNA, 25 bp, Mus musculus
gagaaagagacgcacaacaccaaac

SEQ ID NO: 650437 - DNA, 25 bp, Mus musculus
gagaaagagacggacaacaccaaac

SEQ ID NO: 650438 - DNA, 25 bp, Mus musculus
gagaaagagcatagttaaacggcta

SEQ ID NO: 650439 - DNA, 25 bp, Mus musculus
gagaaagagcattgttaaacggcta

SEQ ID NO: 650440 - DNA, 25 bp, Mus musculus
gagaaagaggcaagccttgccaaga

SEQ ID NO: 650441 - DNA, 25 bp, Mus musculus
gagaaagaggcatgccttgccaaga

SEQ ID NO: 650442 - DNA, 25 bp, Mus musculus
gagaaagcaatccacctaaaaatga

SEQ ID NO: 650443 - DNA, 25 bp, Mus musculus
gagaaagcaatcgacctaaaaatga

SEQ ID NO: 650444 - DNA, 25 bp, Mus musculus
gagaaagcagacagaaatcccgggt

SEQ ID NO: 650445 - DNA, 25 bp, Mus musculus
gagaaagcagactgaaatcccgggt

SEQ ID NO: 650446 - DNA, 25 bp, Mus musculus
gagaaagcagggaacccactggaga

SEQ ID NO: 650447 - DNA, 25 bp, Mus musculus
gagaaagcagggtacccactggaga

SEQ ID NO: 650448 - DNA, 25 bp, Mus musculus
gagaaagcatcccaacattgcaaga

SEQ ID NO: 650449 - DNA, 25 bp, Mus musculus
gagaaagcatccgaacattgcaaga

SEQ ID NO: 650450 - DNA, 25 bp, Mus musculus
gagaaagccaaaatggttcacccag

SEQ ID NO: 650451 - DNA, 25 bp, Mus musculus
gagaaagccaaattggttcacccag

SEQ ID NO: 650452 - DNA, 25 bp, Mus musculus
gagaaagccattcccttggagacag

SEQ ID NO: 650453 - DNA, 25 bp, Mus musculus
gagaaagccattcgcacactcattg

SEQ ID NO: 650454 - DNA, 25 bp, Mus musculus
gagaaagccattgccttggagacag

SEQ ID NO: 650455 - DNA, 25 bp, Mus musculus
gagaaagccattggcacactcattg

SEQ ID NO: 650456 - DNA, 25 bp, Mus musculus
gagaaagccgcacttacctagcggc

SEQ ID NO: 650457 - DNA, 25 bp, Mus musculus
gagaaagccgcagttacctagcggc

SEQ ID NO: 650458 - DNA, 25 bp, Mus musculus
gagaaagcgagacgaaataaagata

SEQ ID NO: 650459 - DNA, 25 bp, Mus musculus
gagaaagcgagaggaaataaagata

SEQ ID NO: 650460 - DNA, 25 bp, Mus musculus
gagaaagcgcagactctgtcttccc

SEQ ID NO: 650461 - DNA, 25 bp, Mus musculus
gagaaagcgcagtctctgtcttccc

SEQ ID NO: 650462 - DNA, 25 bp, Mus musculus
gagaaaggaaagagcaatccaaacc

SEQ ID NO: 650463 - DNA, 25 bp, Mus musculus
gagaaaggaaagtgcaatccaaacc

SEQ ID NO: 650464 - DNA, 25 bp, Mus musculus
gagaaaggacagaggtcctgacata

SEQ ID NO: 650465 - DNA, 25 bp, Mus musculus
gagaaaggacagtggtcctgacata

SEQ ID NO: 650466 - DNA, 25 bp, Mus musculus
gagaaaggcaagacggctaggaaca

SEQ ID NO: 650467 - DNA, 25 bp, Mus musculus
gagaaaggcaagtcggctaggaaca

SEQ ID NO: 650468 - DNA, 25 bp, Mus musculus
gagaaaggcccacggcagtgtggaa

SEQ ID NO: 650469 - DNA, 25 bp, Mus musculus
gagaaaggcccagggcagtgtggaa

SEQ ID NO: 650470 - DNA, 25 bp, Mus musculus
gagaaaggctcgacatgggctttgc

SEQ ID NO: 650471 - DNA, 25 bp, Mus musculus
gagaaaggctcgtcatgggctttgc

SEQ ID NO: 650472 - DNA, 25 bp, Mus musculus
gagaaagggcggctctacagaacca

SEQ ID NO: 650473 - DNA, 25 bp, Mus musculus
gagaaagggcgggtctacagaacca

SEQ ID NO: 650474 - DNA, 25 bp, Mus musculus
gagaaagggttgagatacactcctg

SEQ ID NO: 650475 - DNA, 25 bp, Mus musculus
gagaaagggttgtgatacactcctg

SEQ ID NO: 650476 - DNA, 25 bp, Mus musculus
gagaaagtaattcaggtcctgcagg

SEQ ID NO: 650477 - DNA, 25 bp, Mus musculus
gagaaagtaattgaggtcctgcagg

SEQ ID NO: 650478 - DNA, 25 bp, Mus musculus
gagaaagtccaactccagccgagac

SEQ ID NO: 650479 - DNA, 25 bp, Mus musculus
gagaaagtccaagtccagccgagac

SEQ ID NO: 650480 - DNA, 25 bp, Mus musculus
gagaaagtccggatgcatgaaaagc

SEQ ID NO: 650481 - DNA, 25 bp, Mus musculus
gagaaagtccggttgcatgaaaagc

SEQ ID NO: 650482 - DNA, 25 bp, Mus musculus
gagaaagtctaaatgctggagtgga

SEQ ID NO: 650483 - DNA, 25 bp, Mus musculus
gagaaagtctaattgctggagtgga

SEQ ID NO: 650484 - DNA, 25 bp, Mus musculus
gagaaagtctagcatccattcccag

SEQ ID NO: 650485 - DNA, 25 bp, Mus musculus
gagaaagtctaggatccattcccag

SEQ ID NO: 650486 - DNA, 25 bp, Mus musculus
gagaaagtgacacaacacattgtcg

SEQ ID NO: 650487 - DNA, 25 bp, Mus musculus
gagaaagtgacagaacacattgtcg

SEQ ID NO: 650488 - DNA, 25 bp, Mus musculus
gagaaagtgagtccgtcccttgcag

SEQ ID NO: 650489 - DNA, 25 bp, Mus musculus
gagaaagtgagtgcgtcccttgcag

SEQ ID NO: 650490 - DNA, 25 bp, Mus musculus
gagaaagtgcacagtctcttccggc

SEQ ID NO: 650491 - DNA, 25 bp, Mus musculus
gagaaagtgcactgtctcttccggc

SEQ ID NO: 650492 - DNA, 25 bp, Mus musculus
gagaaagtggccacaagaggtctgt

SEQ ID NO: 650493 - DNA, 25 bp, Mus musculus
gagaaagtggcctcaagaggtctgt

SEQ ID NO: 650494 - DNA, 25 bp, Mus musculus
gagaaagtgggaatcctggtgacaa

SEQ ID NO: 650495 - DNA, 25 bp, Mus musculus
gagaaagtgggattcctggtgacaa

SEQ ID NO: 650496 - DNA, 25 bp, Mus musculus
gagaaagtgtgaacatccggtggtc

SEQ ID NO: 650497 - DNA, 25 bp, Mus musculus
gagaaagtgtgatcatccggtggtc

SEQ ID NO: 650498 - DNA, 25 bp, Mus musculus
gagaaagttctaatcttgggatgag

SEQ ID NO: 650499 - DNA, 25 bp, Mus musculus
gagaaagttctattcttgggatgag

SEQ ID NO: 650500 - DNA, 25 bp, Mus musculus
gagaaagttctcagatgctatcagg

SEQ ID NO: 650501 - DNA, 25 bp, Mus musculus
gagaaagttctctgatgctatcagg

SEQ ID NO: 650502 - DNA, 25 bp, Mus musculus
gagaaataaaagacagaggccggtg

SEQ ID NO: 650503 - DNA, 25 bp, Mus musculus
gagaaataaaagtcagaggccggtg

SEQ ID NO: 650504 - DNA, 25 bp, Mus musculus
gagaaataaacacgagttcacaatc

SEQ ID NO: 650505 - DNA, 25 bp, Mus musculus
gagaaataaacaggagttcacaatc

SEQ ID NO: 650506 - DNA, 25 bp, Mus musculus
gagaaatacgttcataggcacaccc

SEQ ID NO: 650507 - DNA, 25 bp, Mus musculus
gagaaatacgttgataggcacaccc

SEQ ID NO: 650508 - DNA, 25 bp, Mus musculus
gagaaatataaacaagccttagcga

SEQ ID NO: 650509 - DNA, 25 bp, Mus musculus
gagaaatataaagaagccttagcga

SEQ ID NO: 650510 - DNA, 25 bp, Mus musculus
gagaaatcagagctctttggcctta

SEQ ID NO: 650511 - DNA, 25 bp, Mus musculus
gagaaatcagaggtctttggcctta

SEQ ID NO: 650512 - DNA, 25 bp, Mus musculus
gagaaatcaggacacctaaccctct

SEQ ID NO: 650513 - DNA, 25 bp, Mus musculus
gagaaatcaggagacctaaccctct

SEQ ID NO: 650514 - DNA, 25 bp, Mus musculus
gagaaatccattccacaactgaatt

SEQ ID NO: 650515 - DNA, 25 bp, Mus musculus
gagaaatccattgcacaactgaatt

SEQ ID NO: 650516 - DNA, 25 bp, Mus musculus
gagaaatccgtgatacagcctatag

SEQ ID NO: 650517 - DNA, 25 bp, Mus musculus
gagaaatccgtgttacagcctatag

SEQ ID NO: 650518 - DNA, 25 bp, Mus musculus
gagaaatcctttctgcaggtacatg

SEQ ID NO: 650519 - DNA, 25 bp, Mus musculus
gagaaatcctttgtgcaggtacatg

SEQ ID NO: 650520 - DNA, 25 bp, Mus musculus
gagaaatcgattccagagtagccat

SEQ ID NO: 650521 - DNA, 25 bp, Mus musculus
gagaaatcgattgcagagtagccat

SEQ ID NO: 650522 - DNA, 25 bp, Mus musculus
gagaaatcggaaaacctggctaaag

SEQ ID NO: 650523 - DNA, 25 bp, Mus musculus
gagaaatcggaatacctggctaaag

SEQ ID NO: 650524 - DNA, 25 bp, Mus musculus
gagaaatcggcgagccaggaagaca

SEQ ID NO: 650525 - DNA, 25 bp, Mus musculus
gagaaatcggcgtgccaggaagaca

SEQ ID NO: 650526 - DNA, 25 bp, Mus musculus
gagaaatctatgacgacatcgctga

SEQ ID NO: 650527 - DNA, 25 bp, Mus musculus
gagaaatctatgtcgacatcgctga

SEQ ID NO: 650528 - DNA, 25 bp, Mus musculus
gagaaatctattcaaataccaaatg

SEQ ID NO: 650529 - DNA, 25 bp, Mus musculus
gagaaatctattgaaataccaaatg

SEQ ID NO: 650530 - DNA, 25 bp, Mus musculus
gagaaatctctgatggtttctggag

SEQ ID NO: 650531 - DNA, 25 bp, Mus musculus
gagaaatctctgttggtttctggag

SEQ ID NO: 650532 - DNA, 25 bp, Mus musculus
gagaaatcttcaaaccccgagggat

SEQ ID NO: 650533 - DNA, 25 bp, Mus musculus
gagaaatcttcataccccgagggat

SEQ ID NO: 650534 - DNA, 25 bp, Mus musculus
gagaaatgacgaaagtaccatgcct

SEQ ID NO: 650535 - DNA, 25 bp, Mus musculus
gagaaatgacgatagtaccatgcct

SEQ ID NO: 650536 - DNA, 25 bp, Mus musculus
gagaaatgagatctaccttggtacc

SEQ ID NO: 650537 - DNA, 25 bp, Mus musculus
gagaaatgagatgtaccttggtacc

SEQ ID NO: 650538 - DNA, 25 bp, Mus musculus
gagaaatgctagataccctcacagc

SEQ ID NO: 650539 - DNA, 25 bp, Mus musculus
gagaaatgctagttaccctcacagc

SEQ ID NO: 650540 - DNA, 25 bp, Mus musculus
gagaaatgcttgaagttgtcccgta

SEQ ID NO: 650541 - DNA, 25 bp, Mus musculus
gagaaatgcttgtagttgtcccgta

SEQ ID NO: 650542 - DNA, 25 bp, Mus musculus
gagaaatgctttacagtgtgccttc

SEQ ID NO: 650543 - DNA, 25 bp, Mus musculus
gagaaatgcttttcagtgtgccttc

SEQ ID NO: 650544 - DNA, 25 bp, Mus musculus
gagaaatgtcgcctctcccacctgt

SEQ ID NO: 650545 - DNA, 25 bp, Mus musculus
gagaaatgtcgcgtctcccacctgt

SEQ ID NO: 650546 - DNA, 25 bp, Mus musculus
gagaaattaaacatactgcatgaat

SEQ ID NO: 650547 - DNA, 25 bp, Mus musculus
gagaaattaaacttactgcatgaat

SEQ ID NO: 650548 - DNA, 25 bp, Mus musculus
gagaaattaagtcacttggccacag

SEQ ID NO: 650549 - DNA, 25 bp, Mus musculus
gagaaattaagtgacttggccacag

SEQ ID NO: 650550 - DNA, 25 bp, Mus musculus
gagaaattccataccagactgaggc

SEQ ID NO: 650551 - DNA, 25 bp, Mus musculus
gagaaattccattccagactgaggc

SEQ ID NO: 650552 - DNA, 25 bp, Mus musculus
gagaaattccctaatattaactgct

SEQ ID NO: 650553 - DNA, 25 bp, Mus musculus
gagaaattcccttatattaactgct

SEQ ID NO: 650554 - DNA, 25 bp, Mus musculus
gagaaattctgtcagtgggagcctt

SEQ ID NO: 650555 - DNA, 25 bp, Mus musculus
gagaaattctgtgagtgggagcctt

SEQ ID NO: 650556 - DNA, 25 bp, Mus musculus
gagaaattgagacagttcgcttcct

SEQ ID NO: 650557 - DNA, 25 bp, Mus musculus
gagaaattgagagagttcgcttcct

SEQ ID NO: 650558 - DNA, 25 bp, Mus musculus
gagaaattggaccaaattagacaga

SEQ ID NO: 650559 - DNA, 25 bp, Mus musculus
gagaaattggacgaaattagacaga

SEQ ID NO: 650560 - DNA, 25 bp, Mus musculus
gagaaattggtaaaagctgaaagaa

SEQ ID NO: 650561 - DNA, 25 bp, Mus musculus
gagaaattggtataagctgaaagaa

SEQ ID NO: 650562 - DNA, 25 bp, Mus musculus
gagaaattgtgactctgatgccaca

SEQ ID NO: 650563 - DNA, 25 bp, Mus musculus
gagaaattgtgagtctgatgccaca

SEQ ID NO: 650564 - DNA, 25 bp, Mus musculus
gagaaattttcactgtctgcaatcc

SEQ ID NO: 650565 - DNA, 25 bp, Mus musculus
gagaaattttcagtgtctgcaatcc

SEQ ID NO: 650566 - DNA, 25 bp, Mus musculus
gagaacaaacccacccacgcagaaa

SEQ ID NO: 650567 - DNA, 25 bp, Mus musculus
gagaacaaaccctcccacgcagaaa

SEQ ID NO: 650568 - DNA, 25 bp, Mus musculus
gagaacaacaagaattcggacaatg

SEQ ID NO: 650569 - DNA, 25 bp, Mus musculus
gagaacaacaagtattcggacaatg

SEQ ID NO: 650570 - DNA, 25 bp, Mus musculus
gagaacaacagtcagaaatccatgg

SEQ ID NO: 650571 - DNA, 25 bp, Mus musculus
gagaacaacagtgagaaatccatgg

SEQ ID NO: 650572 - DNA, 25 bp, Mus musculus
gagaacaacatcacaggcaagcggt

SEQ ID NO: 650573 - DNA, 25 bp, Mus musculus
gagaacaacatctcaggcaagcggt

SEQ ID NO: 650574 - DNA, 25 bp, Mus musculus
gagaacaaccccattgacaacgacg

SEQ ID NO: 650575 - DNA, 25 bp, Mus musculus
gagaacaacccctttgacaacgacg

SEQ ID NO: 650576 - DNA, 25 bp, Mus musculus
gagaacaactggaaaatttacaagc

SEQ ID NO: 650577 - DNA, 25 bp, Mus musculus
gagaacaactggtaaatttacaagc

SEQ ID NO: 650578 - DNA, 25 bp, Mus musculus
gagaacaagcctcctggagacggct

SEQ ID NO: 650579 - DNA, 25 bp, Mus musculus
gagaacaagcctgctggagacggct

SEQ ID NO: 650580 - DNA, 25 bp, Mus musculus
gagaacaagtaaacgacctcttcag

SEQ ID NO: 650581 - DNA, 25 bp, Mus musculus
gagaacaagtaatcgacctcttcag

SEQ ID NO: 650582 - DNA, 25 bp, Mus musculus
gagaacaagtctcccgcttgggagt

SEQ ID NO: 650583 - DNA, 25 bp, Mus musculus
gagaacaagtctgccgcttgggagt

SEQ ID NO: 650584 - DNA, 25 bp, Mus musculus
gagaacaatgtgcaaaagcggacgt

SEQ ID NO: 650585 - DNA, 25 bp, Mus musculus
gagaacaatgtggaaaagcggacgt

SEQ ID NO: 650586 - DNA, 25 bp, Mus musculus
gagaacacaagaattgcccagcctg

SEQ ID NO: 650587 - DNA, 25 bp, Mus musculus
gagaacacaagatttgcccagcctg

SEQ ID NO: 650588 - DNA, 25 bp, Mus musculus
gagaacaccacgctagtgtctggac

SEQ ID NO: 650589 - DNA, 25 bp, Mus musculus
gagaacaccacggtagtgtctggac

SEQ ID NO: 650590 - DNA, 25 bp, Mus musculus
gagaacacgcccatgattgctggcc

SEQ ID NO: 650591 - DNA, 25 bp, Mus musculus
gagaacacgcccttgattgctggcc

SEQ ID NO: 650592 - DNA, 25 bp, Mus musculus
gagaacactctgaaccatgtgcaag

SEQ ID NO: 650593 - DNA, 25 bp, Mus musculus
gagaacactctgtaccatgtgcaag

SEQ ID NO: 650594 - DNA, 25 bp, Mus musculus
gagaacactgtccatcctgcactct

SEQ ID NO: 650595 - DNA, 25 bp, Mus musculus
gagaacactgtcgatcctgcactct

SEQ ID NO: 650596 - DNA, 25 bp, Mus musculus
gagaacagacaaactggtgtccagc

SEQ ID NO: 650597 - DNA, 25 bp, Mus musculus
gagaacagacaatctggtgtccagc

SEQ ID NO: 650598 - DNA, 25 bp, Mus musculus
gagaacagagccctaagggaagaaa

SEQ ID NO: 650599 - DNA, 25 bp, Mus musculus
gagaacagagccgtaagggaagaaa

SEQ ID NO: 650600 - DNA, 25 bp, Mus musculus
gagaacagaggtatttaaagcggcg

SEQ ID NO: 650601 - DNA, 25 bp, Mus musculus
gagaacagaggtttttaaagcggcg

SEQ ID NO: 650602 - DNA, 25 bp, Mus musculus
gagaacagcactcgctgtatttggg

SEQ ID NO: 650603 - DNA, 25 bp, Mus musculus
gagaacagcactggctgtatttggg

SEQ ID NO: 650604 - DNA, 25 bp, Mus musculus
gagaacagccgaacttcagggcttc

SEQ ID NO: 650605 - DNA, 25 bp, Mus musculus
gagaacagccgatcttcagggcttc

SEQ ID NO: 650606 - DNA, 25 bp, Mus musculus
gagaacagcctactttgatcaccat

SEQ ID NO: 650607 - DNA, 25 bp, Mus musculus
gagaacagcctagtttgatcaccat

SEQ ID NO: 650608 - DNA, 25 bp, Mus musculus
gagaacagcgttagattggtaggat

SEQ ID NO: 650609 - DNA, 25 bp, Mus musculus
gagaacagcgtttgattggtaggat

SEQ ID NO: 650610 - DNA, 25 bp, Mus musculus
gagaacagcttcatcttgaatgtta

SEQ ID NO: 650611 - DNA, 25 bp, Mus musculus
gagaacagcttcttcttgaatgtta

SEQ ID NO: 650612 - DNA, 25 bp, Mus musculus
gagaacaggtcaaagaccaccagca

SEQ ID NO: 650613 - DNA, 25 bp, Mus musculus
gagaacaggtcatagaccaccagca

SEQ ID NO: 650614 - DNA, 25 bp, Mus musculus
gagaacagtaaaccatccgacattg

SEQ ID NO: 650615 - DNA, 25 bp, Mus musculus
gagaacagtaaagcatccgacattg

SEQ ID NO: 650616 - DNA, 25 bp, Mus musculus
gagaacagtctcaagtccgggaagg

SEQ ID NO: 650617 - DNA, 25 bp, Mus musculus
gagaacagtctctagtccgggaagg

SEQ ID NO: 650618 - DNA, 25 bp, Mus musculus
gagaacagtgctcgctcctgaggac

SEQ ID NO: 650619 - DNA, 25 bp, Mus musculus
gagaacagtgctggctcctgaggac

SEQ ID NO: 650620 - DNA, 25 bp, Mus musculus
gagaacagtggcattgaaccaggag

SEQ ID NO: 650621 - DNA, 25 bp, Mus musculus
gagaacagtggctttgaaccaggag

SEQ ID NO: 650622 - DNA, 25 bp, Mus musculus
gagaacatcatgatgctggacaagc

SEQ ID NO: 650623 - DNA, 25 bp, Mus musculus
gagaacatcatgctcagcagccagg

SEQ ID NO: 650624 - DNA, 25 bp, Mus musculus
gagaacatcatggtcagcagccagg

SEQ ID NO: 650625 - DNA, 25 bp, Mus musculus
gagaacatcatgttgctggacaagc

SEQ ID NO: 650626 - DNA, 25 bp, Mus musculus
gagaacatcctaagtgagcacccca

SEQ ID NO: 650627 - DNA, 25 bp, Mus musculus
gagaacatcctatgtgagcacccca

SEQ ID NO: 650628 - DNA, 25 bp, Mus musculus
gagaacatcgcacacatgggaggcc

SEQ ID NO: 650629 - DNA, 25 bp, Mus musculus
gagaacatcgcagacatgggaggcc

SEQ ID NO: 650630 - DNA, 25 bp, Mus musculus
gagaacatcgcccacaacttccagg

SEQ ID NO: 650631 - DNA, 25 bp, Mus musculus
gagaacatcgccgacaacttccagg

SEQ ID NO: 650632 - DNA, 25 bp, Mus musculus
gagaacatcggtccaagaacacaga

SEQ ID NO: 650633 - DNA, 25 bp, Mus musculus
gagaacatcggtgcaagaacacaga

SEQ ID NO: 650634 - DNA, 25 bp, Mus musculus
gagaacatctagacagtagactata

SEQ ID NO: 650635 - DNA, 25 bp, Mus musculus
gagaacatctagtcagtagactata

SEQ ID NO: 650636 - DNA, 25 bp, Mus musculus
gagaacatcttgctgctgcgaaggc

SEQ ID NO: 650637 - DNA, 25 bp, Mus musculus
gagaacatcttggtgctgcgaaggc

SEQ ID NO: 650638 - DNA, 25 bp, Mus musculus
gagaacatgaccaggacacacttcc

SEQ ID NO: 650639 - DNA, 25 bp, Mus musculus
gagaacatgacctggacacacttcc

SEQ ID NO: 650640 - DNA, 25 bp, Mus musculus
gagaacatgcgcaatgacatctcca

SEQ ID NO: 650641 - DNA, 25 bp, Mus musculus
gagaacatgcgctatgacatctcca

SEQ ID NO: 650642 - DNA, 25 bp, Mus musculus
gagaacatggagacccaggacacta

SEQ ID NO: 650643 - DNA, 25 bp, Mus musculus
gagaacatggagtcccaggacacta

SEQ ID NO: 650644 - DNA, 25 bp, Mus musculus
gagaacattgaaagagcacgatacc

SEQ ID NO: 650645 - DNA, 25 bp, Mus musculus
gagaacattgaatgagcacgatacc

SEQ ID NO: 650646 - DNA, 25 bp, Mus musculus
gagaacattgcacgcttggcccgcc

SEQ ID NO: 650647 - DNA, 25 bp, Mus musculus
gagaacattgcaggcttggcccgcc

SEQ ID NO: 650648 - DNA, 25 bp, Mus musculus
gagaaccacattaccttgagagggc

SEQ ID NO: 650649 - DNA, 25 bp, Mus musculus
gagaaccacatttccttgagagggc

SEQ ID NO: 650650 - DNA, 25 bp, Mus musculus
gagaaccacgtgaccagtgattagg

SEQ ID NO: 650651 - DNA, 25 bp, Mus musculus
gagaaccacgtgtccagtgattagg

SEQ ID NO: 650652 - DNA, 25 bp, Mus musculus
gagaaccactgtccctagtttggag

SEQ ID NO: 650653 - DNA, 25 bp, Mus musculus
gagaaccactgtgcctagtttggag

SEQ ID NO: 650654 - DNA, 25 bp, Mus musculus
gagaaccagaacctagtcctgcaag

SEQ ID NO: 650655 - DNA, 25 bp, Mus musculus
gagaaccagaacgtagtcctgcaag

SEQ ID NO: 650656 - DNA, 25 bp, Mus musculus
gagaaccagatgaaaggcctggaga

SEQ ID NO: 650657 - DNA, 25 bp, Mus musculus
gagaaccagatgtaaggcctggaga

SEQ ID NO: 650658 - DNA, 25 bp, Mus musculus
gagaaccagcttctggcaccaacca

SEQ ID NO: 650659 - DNA, 25 bp, Mus musculus
gagaaccagcttgtggcaccaacca

SEQ ID NO: 650660 - DNA, 25 bp, Mus musculus
gagaaccaggatcacacaacggaga

SEQ ID NO: 650661 - DNA, 25 bp, Mus musculus
gagaaccaggatgacacaacggaga

SEQ ID NO: 650662 - DNA, 25 bp, Mus musculus
gagaaccaggtcatcggccggttcc

SEQ ID NO: 650663 - DNA, 25 bp, Mus musculus
gagaaccaggtcttcggccggttcc

SEQ ID NO: 650664 - DNA, 25 bp, Mus musculus
gagaaccagtgtagcgtataccatg

SEQ ID NO: 650665 - DNA, 25 bp, Mus musculus
gagaaccagtgttgcgtataccatg

SEQ ID NO: 650666 - DNA, 25 bp, Mus musculus
gagaaccagttccaacgctacctga

SEQ ID NO: 650667 - DNA, 25 bp, Mus musculus
gagaaccagttcgaacgctacctga

SEQ ID NO: 650668 - DNA, 25 bp, Mus musculus
gagaaccatgaactatggaacaacc

SEQ ID NO: 650669 - DNA, 25 bp, Mus musculus
gagaaccatgaagtatggaacaacc

SEQ ID NO: 650670 - DNA, 25 bp, Mus musculus
gagaaccatggaaatctactcgaag

SEQ ID NO: 650671 - DNA, 25 bp, Mus musculus
gagaaccatggatatctactcgaag

SEQ ID NO: 650672 - DNA, 25 bp, Mus musculus
gagaacccaagcagccatctggtgg

SEQ ID NO: 650673 - DNA, 25 bp, Mus musculus
gagaacccaagctgccatctggtgg

SEQ ID NO: 650674 - DNA, 25 bp, Mus musculus
gagaacccagctcatgctgatgggc

SEQ ID NO: 650675 - DNA, 25 bp, Mus musculus
gagaacccagctgatgctgatgggc

SEQ ID NO: 650676 - DNA, 25 bp, Mus musculus
gagaaccccaatacatcagccggaa

SEQ ID NO: 650677 - DNA, 25 bp, Mus musculus
gagaaccccaattcatcagccggaa

SEQ ID NO: 650678 - DNA, 25 bp, Mus musculus
gagaaccccagcatactgacacgtg

SEQ ID NO: 650679 - DNA, 25 bp, Mus musculus
gagaaccccagcttactgacacgtg

SEQ ID NO: 650680 - DNA, 25 bp, Mus musculus
gagaaccctgtacctagctcaagac

SEQ ID NO: 650681 - DNA, 25 bp, Mus musculus
gagaaccctgtagctagctcaagac

SEQ ID NO: 650682 - DNA, 25 bp, Mus musculus
gagaaccctttcaaccgctgtctat

SEQ ID NO: 650683 - DNA, 25 bp, Mus musculus
gagaaccctttctaccgctgtctat

SEQ ID NO: 650684 - DNA, 25 bp, Mus musculus
gagaaccggaagaaaactatggata

SEQ ID NO: 650685 - DNA, 25 bp, Mus musculus
gagaaccggaagtaaactatggata

SEQ ID NO: 650686 - DNA, 25 bp, Mus musculus
gagaaccggcctcagtccctaaaga

SEQ ID NO: 650687 - DNA, 25 bp, Mus musculus
gagaaccggcctgagtccctaaaga

SEQ ID NO: 650688 - DNA, 25 bp, Mus musculus
gagaaccgtgatatatttccaagca

SEQ ID NO: 650689 - DNA, 25 bp, Mus musculus
gagaaccgtgatttatttccaagca

SEQ ID NO: 650690 - DNA, 25 bp, Mus musculus
gagaacctagagacctaatcttacc

SEQ ID NO: 650691 - DNA, 25 bp, Mus musculus
gagaacctagagtcctaatcttacc

SEQ ID NO: 650692 - DNA, 25 bp, Mus musculus
gagaacctcaacactgacaagctga

SEQ ID NO: 650693 - DNA, 25 bp, Mus musculus
gagaacctcaactctgacaagctga

SEQ ID NO: 650694 - DNA, 25 bp, Mus musculus
gagaacctcatcctcttggagcaag

SEQ ID NO: 650695 - DNA, 25 bp, Mus musculus
gagaacctcatcgtcttggagcaag

SEQ ID NO: 650696 - DNA, 25 bp, Mus musculus
gagaacctcggtctgagctatgtga

SEQ ID NO: 650697 - DNA, 25 bp, Mus musculus
gagaacctcggtgtgagctatgtga

SEQ ID NO: 650698 - DNA, 25 bp, Mus musculus
gagaacctctctcagtcctctgagg

SEQ ID NO: 650699 - DNA, 25 bp, Mus musculus
gagaacctctctgagtcctctgagg

SEQ ID NO: 650700 - DNA, 25 bp, Mus musculus
gagaacctgaagcaccagccaggag

SEQ ID NO: 650701 - DNA, 25 bp, Mus musculus
gagaacctgaaggaccagccaggag

SEQ ID NO: 650702 - DNA, 25 bp, Mus musculus
gagaacctgagtatccgagaagtgg

SEQ ID NO: 650703 - DNA, 25 bp, Mus musculus
gagaacctgagtttccgagaagtgg

SEQ ID NO: 650704 - DNA, 25 bp, Mus musculus
gagaacctgattattaacacagacg

SEQ ID NO: 650705 - DNA, 25 bp, Mus musculus
gagaacctgatttttaacacagacg

SEQ ID NO: 650706 - DNA, 25 bp, Mus musculus
gagaacctgcagaatgtcgggtaga

SEQ ID NO: 650707 - DNA, 25 bp, Mus musculus
gagaacctgcagtatgtcgggtaga

SEQ ID NO: 650708 - DNA, 25 bp, Mus musculus
gagaacctgccgctcatcgtgtggc

SEQ ID NO: 650709 - DNA, 25 bp, Mus musculus
gagaacctgccggtcatcgtgtggc

SEQ ID NO: 650710 - DNA, 25 bp, Mus musculus
gagaacctgctacctgtgggcatct

SEQ ID NO: 650711 - DNA, 25 bp, Mus musculus
gagaacctgctagctgtgggcatct

SEQ ID NO: 650712 - DNA, 25 bp, Mus musculus
gagaacctgggcaaccctttgtggg

SEQ ID NO: 650713 - DNA, 25 bp, Mus musculus
gagaacctgggctaccctttgtggg

SEQ ID NO: 650714 - DNA, 25 bp, Mus musculus
gagaacctggtgaacctgggtctcg

SEQ ID NO: 650715 - DNA, 25 bp, Mus musculus
gagaacctggtgtacctgggtctcg

SEQ ID NO: 650716 - DNA, 25 bp, Mus musculus
gagaaccttcacctgaatagccacg

SEQ ID NO: 650717 - DNA, 25 bp, Mus musculus
gagaaccttcacgtgaatagccacg

SEQ ID NO: 650718 - DNA, 25 bp, Mus musculus
gagaaccttctcaagcgcttcctgg

SEQ ID NO: 650719 - DNA, 25 bp, Mus musculus
gagaaccttctctagcgcttcctgg

SEQ ID NO: 650720 - DNA, 25 bp, Mus musculus
gagaaccttgatctcattgtcaaca

SEQ ID NO: 650721 - DNA, 25 bp, Mus musculus
gagaaccttgatgtcattgtcaaca

SEQ ID NO: 650722 - DNA, 25 bp, Mus musculus
gagaacctttaacccacgaggaaag

SEQ ID NO: 650723 - DNA, 25 bp, Mus musculus
gagaacctttaagccacgaggaaag

SEQ ID NO: 650724 - DNA, 25 bp, Mus musculus
gagaacgacgtcacagagagaagga

SEQ ID NO: 650725 - DNA, 25 bp, Mus musculus
gagaacgacgtctcagagagaagga

SEQ ID NO: 650726 - DNA, 25 bp, Mus musculus
gagaacgacttcctcacctttgatg

SEQ ID NO: 650727 - DNA, 25 bp, Mus musculus
gagaacgacttcgtcacctttgatg

SEQ ID NO: 650728 - DNA, 25 bp, Mus musculus
gagaacgagggcctcaaggtccaaa

SEQ ID NO: 650729 - DNA, 25 bp, Mus musculus
gagaacgagggcgtcaaggtccaaa

SEQ ID NO: 650730 - DNA, 25 bp, Mus musculus
gagaacgatttccatcgcctggcaa

SEQ ID NO: 650731 - DNA, 25 bp, Mus musculus
gagaacgatttcgatcgcctggcaa

SEQ ID NO: 650732 - DNA, 25 bp, Mus musculus
gagaacgccaagaagctctccatgt

SEQ ID NO: 650733 - DNA, 25 bp, Mus musculus
gagaacgccaagtagctctccatgt

SEQ ID NO: 650734 - DNA, 25 bp, Mus musculus
gagaacgcctggagtcatgaccaag

SEQ ID NO: 650735 - DNA, 25 bp, Mus musculus
gagaacgcctggtgtcatgaccaag

SEQ ID NO: 650736 - DNA, 25 bp, Mus musculus
gagaacgcgggcactatttgagcgc

SEQ ID NO: 650737 - DNA, 25 bp, Mus musculus
gagaacgcgggctctatttgagcgc

SEQ ID NO: 650738 - DNA, 25 bp, Mus musculus
gagaacgctgaacatgatccagcct

SEQ ID NO: 650739 - DNA, 25 bp, Mus musculus
gagaacgctgaagatgatccagcct

SEQ ID NO: 650740 - DNA, 25 bp, Mus musculus
gagaacggcttacatgaccagctca

SEQ ID NO: 650741 - DNA, 25 bp, Mus musculus
gagaacggcttagatgaccagctca

SEQ ID NO: 650742 - DNA, 25 bp, Mus musculus
gagaacgggacaccacgctttgaat

SEQ ID NO: 650743 - DNA, 25 bp, Mus musculus
gagaacgggacagcacgctttgaat

SEQ ID NO: 650744 - DNA, 25 bp, Mus musculus
gagaacgggatccacatcatcctgg

SEQ ID NO: 650745 - DNA, 25 bp, Mus musculus
gagaacgggatcgacatcatcctgg

SEQ ID NO: 650746 - DNA, 25 bp, Mus musculus
gagaacggggacaacttctctgttg

SEQ ID NO: 650747 - DNA, 25 bp, Mus musculus
gagaacggggactacttctctgttg

SEQ ID NO: 650748 - DNA, 25 bp, Mus musculus
gagaacgtatcacccgcctggagga

SEQ ID NO: 650749 - DNA, 25 bp, Mus musculus
gagaacgtatcagccgcctggagga

SEQ ID NO: 650750 - DNA, 25 bp, Mus musculus
gagaacgtcagcagcctcaacacca

SEQ ID NO: 650751 - DNA, 25 bp, Mus musculus
gagaacgtcagctgcctcaacacca

SEQ ID NO: 650752 - DNA, 25 bp, Mus musculus
gagaacgtcttacttgactcagaag

SEQ ID NO: 650753 - DNA, 25 bp, Mus musculus
gagaacgtcttagttgactcagaag

SEQ ID NO: 650754 - DNA, 25 bp, Mus musculus
gagaacgtgaatacccctgaagaca

SEQ ID NO: 650755 - DNA, 25 bp, Mus musculus
gagaacgtgaattcccctgaagaca

SEQ ID NO: 650756 - DNA, 25 bp, Mus musculus
gagaacgtgttcacatccgacgtgg

SEQ ID NO: 650757 - DNA, 25 bp, Mus musculus
gagaacgtgttctcatccgacgtgg

SEQ ID NO: 650758 - DNA, 25 bp, Mus musculus
gagaacgtttacattagagtgccca

SEQ ID NO: 650759 - DNA, 25 bp, Mus musculus
gagaacgtttactttagagtgccca

SEQ ID NO: 650760 - DNA, 25 bp, Mus musculus
gagaactatgatctggacgagtcca

SEQ ID NO: 650761 - DNA, 25 bp, Mus musculus
gagaactatgatgtggacgagtcca

SEQ ID NO: 650762 - DNA, 25 bp, Mus musculus
gagaactatgctaatacgggccaag

SEQ ID NO: 650763 - DNA, 25 bp, Mus musculus
gagaactatgcttatacgggccaag

SEQ ID NO: 650764 - DNA, 25 bp, Mus musculus
gagaactattccaggcgctctttcg

SEQ ID NO: 650765 - DNA, 25 bp, Mus musculus
gagaactattcctggcgctctttcg

SEQ ID NO: 650766 - DNA, 25 bp, Mus musculus
gagaactcaaaaagactcaggagga

SEQ ID NO: 650767 - DNA, 25 bp, Mus musculus
gagaactcaaaatgactcaggagga

SEQ ID NO: 650768 - DNA, 25 bp, Mus musculus
gagaactcactacgaatgagtccta

SEQ ID NO: 650769 - DNA, 25 bp, Mus musculus
gagaactcactaggaatgagtccta

SEQ ID NO: 650770 - DNA, 25 bp, Mus musculus
gagaactccaagagcagttgagcca

SEQ ID NO: 650771 - DNA, 25 bp, Mus musculus
gagaactccaagtgcagttgagcca

SEQ ID NO: 650772 - DNA, 25 bp, Mus musculus
gagaactccagtagcttcaacccac

SEQ ID NO: 650773 - DNA, 25 bp, Mus musculus
gagaactccagttgcttcaacccac

SEQ ID NO: 650774 - DNA, 25 bp, Mus musculus
gagaactccatcatgagggatgcct

SEQ ID NO: 650775 - DNA, 25 bp, Mus musculus
gagaactccatcatttttatgcctg

SEQ ID NO: 650776 - DNA, 25 bp, Mus musculus
gagaactccatcttgagggatgcct

SEQ ID NO: 650777 - DNA, 25 bp, Mus musculus
gagaactccatcttttttatgcctg

SEQ ID NO: 650778 - DNA, 25 bp, Mus musculus
gagaactcctttcagggctcatcct

SEQ ID NO: 650779 - DNA, 25 bp, Mus musculus
gagaactcctttgagggctcatcct

SEQ ID NO: 650780 - DNA, 25 bp, Mus musculus
gagaactcggtcagcaggaacctga

SEQ ID NO: 650781 - DNA, 25 bp, Mus musculus
gagaactcggtctgcaggaacctga

SEQ ID NO: 650782 - DNA, 25 bp, Mus musculus
gagaactctcgactcattgtcatga

SEQ ID NO: 650783 - DNA, 25 bp, Mus musculus
gagaactctcgagtcattgtcatga

SEQ ID NO: 650784 - DNA, 25 bp, Mus musculus
gagaactctcttcgcctccgctgtt

SEQ ID NO: 650785 - DNA, 25 bp, Mus musculus
gagaactctcttggcctccgctgtt

SEQ ID NO: 650786 - DNA, 25 bp, Mus musculus
gagaactctgatatcaccaaagtgg

SEQ ID NO: 650787 - DNA, 25 bp, Mus musculus
gagaactctgatttcaccaaagtgg

SEQ ID NO: 650788 - DNA, 25 bp, Mus musculus
gagaactcttcgatgacccctccta

SEQ ID NO: 650789 - DNA, 25 bp, Mus musculus
gagaactcttcgttgacccctccta

SEQ ID NO: 650790 - DNA, 25 bp, Mus musculus
gagaactctttaattggcctgaccc

SEQ ID NO: 650791 - DNA, 25 bp, Mus musculus
gagaactctttatttggcctgaccc

SEQ ID NO: 650792 - DNA, 25 bp, Mus musculus
gagaactgagcgactggtcaccaac

SEQ ID NO: 650793 - DNA, 25 bp, Mus musculus
gagaactgagcgtctggtcaccaac

SEQ ID NO: 650794 - DNA, 25 bp, Mus musculus
gagaactgcctcaactctgacgtgg

SEQ ID NO: 650795 - DNA, 25 bp, Mus musculus
gagaactgcctctactctgacgtgg

SEQ ID NO: 650796 - DNA, 25 bp, Mus musculus
gagaactgcctgaccaagtctccca

SEQ ID NO: 650797 - DNA, 25 bp, Mus musculus
gagaactgcctgtccaagtctccca

SEQ ID NO: 650798 - DNA, 25 bp, Mus musculus
gagaactgcgagacttatgaggccc

SEQ ID NO: 650799 - DNA, 25 bp, Mus musculus
gagaactgcgagtcttatgaggccc

SEQ ID NO: 650800 - DNA, 25 bp, Mus musculus
gagaactgcttcaggatcaaagtaa

SEQ ID NO: 650801 - DNA, 25 bp, Mus musculus
gagaactgcttctggatcaaagtaa

SEQ ID NO: 650802 - DNA, 25 bp, Mus musculus
gagaactggatcaaaaccattggcg

SEQ ID NO: 650803 - DNA, 25 bp, Mus musculus
gagaactggatcagtttctacagca

SEQ ID NO: 650804 - DNA, 25 bp, Mus musculus
gagaactggatctaaaccattggcg

SEQ ID NO: 650805 - DNA, 25 bp, Mus musculus
gagaactggatctgtttctacagca

SEQ ID NO: 650806 - DNA, 25 bp, Mus musculus
gagaactggccaagctacgaagaca

SEQ ID NO: 650807 - DNA, 25 bp, Mus musculus
gagaactggccatgctacgaagaca

SEQ ID NO: 650808 - DNA, 25 bp, Mus musculus
gagaactggctacatcaagacttgg

SEQ ID NO: 650809 - DNA, 25 bp, Mus musculus
gagaactggctagatcaagacttgg

SEQ ID NO: 650810 - DNA, 25 bp, Mus musculus
gagaactgggtgaccagctacaacg

SEQ ID NO: 650811 - DNA, 25 bp, Mus musculus
gagaactgggtgtccagctacaacg

SEQ ID NO: 650812 - DNA, 25 bp, Mus musculus
gagaactggtctattagtggaccaa

SEQ ID NO: 650813 - DNA, 25 bp, Mus musculus
gagaactggtcttttagtggaccaa

SEQ ID NO: 650814 - DNA, 25 bp, Mus musculus
gagaactgtgggacgcctaggcttt

SEQ ID NO: 650815 - DNA, 25 bp, Mus musculus
gagaactgtgggtcgcctaggcttt

SEQ ID NO: 650816 - DNA, 25 bp, Mus musculus
gagaacttaacaagtctgacaggga

SEQ ID NO: 650817 - DNA, 25 bp, Mus musculus
gagaacttaacatgtctgacaggga

SEQ ID NO: 650818 - DNA, 25 bp, Mus musculus
gagaacttccacagtgtttttgcag

SEQ ID NO: 650819 - DNA, 25 bp, Mus musculus
gagaacttccactgtgtttttgcag

SEQ ID NO: 650820 - DNA, 25 bp, Mus musculus
gagaacttcctgagtaccatggaga

SEQ ID NO: 650821 - DNA, 25 bp, Mus musculus
gagaacttcctgtgtaccatggaga

SEQ ID NO: 650822 - DNA, 25 bp, Mus musculus
gagaacttcgcgctgctcaaggtgc

SEQ ID NO: 650823 - DNA, 25 bp, Mus musculus
gagaacttcgcggtgctcaaggtgc

SEQ ID NO: 650824 - DNA, 25 bp, Mus musculus
gagaacttcggcatccttctgggcg

SEQ ID NO: 650825 - DNA, 25 bp, Mus musculus
gagaacttcggcttccttctgggcg

SEQ ID NO: 650826 - DNA, 25 bp, Mus musculus
gagaacttgaggatggcgaatcccc

SEQ ID NO: 650827 - DNA, 25 bp, Mus musculus
gagaacttgaggttggcgaatcccc

SEQ ID NO: 650828 - DNA, 25 bp, Mus musculus
gagaacttgctcaacaggtcagtca

SEQ ID NO: 650829 - DNA, 25 bp, Mus musculus
gagaacttgctcattccctggccga

SEQ ID NO: 650830 - DNA, 25 bp, Mus musculus
gagaacttgctctacaggtcagtca

SEQ ID NO: 650831 - DNA, 25 bp, Mus musculus
gagaacttgctctttccctggccga

SEQ ID NO: 650832 - DNA, 25 bp, Mus musculus
gagaacttggcccagtaggccctat

SEQ ID NO: 650833 - DNA, 25 bp, Mus musculus
gagaacttggccgagtaggccctat

SEQ ID NO: 650834 - DNA, 25 bp, Mus musculus
gagaactttacacctaacatagctg

SEQ ID NO: 650835 - DNA, 25 bp, Mus musculus
gagaactttacagctaacatagctg

SEQ ID NO: 650836 - DNA, 25 bp, Mus musculus
gagaactttctcattgggacaagaa

SEQ ID NO: 650837 - DNA, 25 bp, Mus musculus
gagaactttctctttgggacaagaa

SEQ ID NO: 650838 - DNA, 25 bp, Mus musculus
gagaactttgatatggaggccttca

SEQ ID NO: 650839 - DNA, 25 bp, Mus musculus
gagaactttgatttggaggccttca

SEQ ID NO: 650840 - DNA, 25 bp, Mus musculus
gagaagaaacagatgtcgtgttatc

SEQ ID NO: 650841 - DNA, 25 bp, Mus musculus
gagaagaaacagttgtcgtgttatc

SEQ ID NO: 650842 - DNA, 25 bp, Mus musculus
gagaagaaataccacttgcaagaac

SEQ ID NO: 650843 - DNA, 25 bp, Mus musculus
gagaagaaatacgacttgcaagaac

SEQ ID NO: 650844 - DNA, 25 bp, Mus musculus
gagaagaaatccaggaagtaagaag

SEQ ID NO: 650845 - DNA, 25 bp, Mus musculus
gagaagaaatcccttctatgcctcc

SEQ ID NO: 650846 - DNA, 25 bp, Mus musculus
gagaagaaatccgttctatgcctcc

SEQ ID NO: 650847 - DNA, 25 bp, Mus musculus
gagaagaaatcctggaagtaagaag

SEQ ID NO: 650848 - DNA, 25 bp, Mus musculus
gagaagaacaatcagcagaagatgc

SEQ ID NO: 650849 - DNA, 25 bp, Mus musculus
gagaagaacaatgagcagaagatgc

SEQ ID NO: 650850 - DNA, 25 bp, Mus musculus
gagaagaacctcagcgatctgatcg

SEQ ID NO: 650851 - DNA, 25 bp, Mus musculus
gagaagaacctctgcgatctgatcg

SEQ ID NO: 650852 - DNA, 25 bp, Mus musculus
gagaagaactagatacggtggcttc

SEQ ID NO: 650853 - DNA, 25 bp, Mus musculus
gagaagaactagttacggtggcttc

SEQ ID NO: 650854 - DNA, 25 bp, Mus musculus
gagaagaactatcgcgtcctgcgtg

SEQ ID NO: 650855 - DNA, 25 bp, Mus musculus
gagaagaactatggcgtcctgcgtg

SEQ ID NO: 650856 - DNA, 25 bp, Mus musculus
gagaagaactctatggcaccagaaa

SEQ ID NO: 650857 - DNA, 25 bp, Mus musculus
gagaagaactctttggcaccagaaa

SEQ ID NO: 650858 - DNA, 25 bp, Mus musculus
gagaagaacttgaggactcagcagg

SEQ ID NO: 650859 - DNA, 25 bp, Mus musculus
gagaagaacttgtggactcagcagg

SEQ ID NO: 650860 - DNA, 25 bp, Mus musculus
gagaagaagcaaatggttgccaatg

SEQ ID NO: 650861 - DNA, 25 bp, Mus musculus
gagaagaagcaattggttgccaatg

SEQ ID NO: 650862 - DNA, 25 bp, Mus musculus
gagaagaaggccagcaattgcctgc

SEQ ID NO: 650863 - DNA, 25 bp, Mus musculus
gagaagaaggcctgcaattgcctgc

SEQ ID NO: 650864 - DNA, 25 bp, Mus musculus
gagaagaaggtgagcatctggccac

SEQ ID NO: 650865 - DNA, 25 bp, Mus musculus
gagaagaaggtgtgcatctggccac

SEQ ID NO: 650866 - DNA, 25 bp, Mus musculus
gagaagaagtggagctacgttagcc

SEQ ID NO: 650867 - DNA, 25 bp, Mus musculus
gagaagaagtggtgctacgttagcc

SEQ ID NO: 650868 - DNA, 25 bp, Mus musculus
gagaagaagtttacgatgatgtgga

SEQ ID NO: 650869 - DNA, 25 bp, Mus musculus
gagaagaagttttcgatgatgtgga

SEQ ID NO: 650870 - DNA, 25 bp, Mus musculus
gagaagaatgggaacgccaatatag

SEQ ID NO: 650871 - DNA, 25 bp, Mus musculus
gagaagaatgggtacgccaatatag

SEQ ID NO: 650872 - DNA, 25 bp, Mus musculus
gagaagacactgagcaccagctgtg

SEQ ID NO: 650873 - DNA, 25 bp, Mus musculus
gagaagacactgtgcaccagctgtg

SEQ ID NO: 650874 - DNA, 25 bp, Mus musculus
gagaagacagcacctgattacaaga

SEQ ID NO: 650875 - DNA, 25 bp, Mus musculus
gagaagacagcagctgattacaaga

SEQ ID NO: 650876 - DNA, 25 bp, Mus musculus
gagaagacaggccagcaacactcct

SEQ ID NO: 650877 - DNA, 25 bp, Mus musculus
gagaagacaggcgagcaacactcct

SEQ ID NO: 650878 - DNA, 25 bp, Mus musculus
gagaagacatcccaccagatccact

SEQ ID NO: 650879 - DNA, 25 bp, Mus musculus
gagaagacatccgaccagatccact

SEQ ID NO: 650880 - DNA, 25 bp, Mus musculus
gagaagacatggatataagtgagcc

SEQ ID NO: 650881 - DNA, 25 bp, Mus musculus
gagaagacatggttataagtgagcc

SEQ ID NO: 650882 - DNA, 25 bp, Mus musculus
gagaagaccagacaatgcagcagct

SEQ ID NO: 650883 - DNA, 25 bp, Mus musculus
gagaagaccagagaatgcagcagct

SEQ ID NO: 650884 - DNA, 25 bp, Mus musculus
gagaagaccagcaacatggcggtgc

SEQ ID NO: 650885 - DNA, 25 bp, Mus musculus
gagaagaccagctacatggcggtgc

SEQ ID NO: 650886 - DNA, 25 bp, Mus musculus
gagaagacctcaaacatgactttga

SEQ ID NO: 650887 - DNA, 25 bp, Mus musculus
gagaagacctcatacatgactttga

SEQ ID NO: 650888 - DNA, 25 bp, Mus musculus
gagaagacctttcacattgacctgt

SEQ ID NO: 650889 - DNA, 25 bp, Mus musculus
gagaagacctttgacattgacctgt

SEQ ID NO: 650890 - DNA, 25 bp, Mus musculus
gagaagacgccactgttccgaaacc

SEQ ID NO: 650891 - DNA, 25 bp, Mus musculus
gagaagacgccagtgttccgaaacc

SEQ ID NO: 650892 - DNA, 25 bp, Mus musculus
gagaagactcatcctccgtcagtgc

SEQ ID NO: 650893 - DNA, 25 bp, Mus musculus
gagaagactcatgctccgtcagtgc

SEQ ID NO: 650894 - DNA, 25 bp, Mus musculus
gagaagactcctaacaccttcaaaa

SEQ ID NO: 650895 - DNA, 25 bp, Mus musculus
gagaagactccttacaccttcaaaa

SEQ ID NO: 650896 - DNA, 25 bp, Mus musculus
gagaagactcttaaaagggcaaggg

SEQ ID NO: 650897 - DNA, 25 bp, Mus musculus
gagaagactctttaaagggcaaggg

SEQ ID NO: 650898 - DNA, 25 bp, Mus musculus
gagaagactgaaaatctcttacacc

SEQ ID NO: 650899 - DNA, 25 bp, Mus musculus
gagaagactgaatatctcttacacc

SEQ ID NO: 650900 - DNA, 25 bp, Mus musculus
gagaagactgtaataatggcgaacc

SEQ ID NO: 650901 - DNA, 25 bp, Mus musculus
gagaagactgtattaatggcgaacc

SEQ ID NO: 650902 - DNA, 25 bp, Mus musculus
gagaagagaacaatgaccaagttac

SEQ ID NO: 650903 - DNA, 25 bp, Mus musculus
gagaagagaacattgaccaagttac

SEQ ID NO: 650904 - DNA, 25 bp, Mus musculus
gagaagagacgaaaaacgacacgta

SEQ ID NO: 650905 - DNA, 25 bp, Mus musculus
gagaagagacgataaacgacacgta

SEQ ID NO: 650906 - DNA, 25 bp, Mus musculus
gagaagagagaaagctgcagttgaa

SEQ ID NO: 650907 - DNA, 25 bp, Mus musculus
gagaagagagaatgctgcagttgaa

SEQ ID NO: 650908 - DNA, 25 bp, Mus musculus
gagaagagatccagacgcctctcag

SEQ ID NO: 650909 - DNA, 25 bp, Mus musculus
gagaagagatcctgacgcctctcag

SEQ ID NO: 650910 - DNA, 25 bp, Mus musculus
gagaagagcatgacggcttccttaa

SEQ ID NO: 650911 - DNA, 25 bp, Mus musculus
gagaagagcatgtcggcttccttaa

SEQ ID NO: 650912 - DNA, 25 bp, Mus musculus
gagaagagccagaacgaacaagagg

SEQ ID NO: 650913 - DNA, 25 bp, Mus musculus
gagaagagccagtacgaacaagagg

SEQ ID NO: 650914 - DNA, 25 bp, Mus musculus
gagaagagcccgcaaaggaaaatct

SEQ ID NO: 650915 - DNA, 25 bp, Mus musculus
gagaagagcccggaaaggaaaatct

SEQ ID NO: 650916 - DNA, 25 bp, Mus musculus
gagaagaggcacatccatttcaaaa

SEQ ID NO: 650917 - DNA, 25 bp, Mus musculus
gagaagaggcacttccatttcaaaa

SEQ ID NO: 650918 - DNA, 25 bp, Mus musculus
gagaagaggctcagaatccccagcg

SEQ ID NO: 650919 - DNA, 25 bp, Mus musculus
gagaagaggctctgaatccccagcg

SEQ ID NO: 650920 - DNA, 25 bp, Mus musculus
gagaagatagctaaccacctgcaag

SEQ ID NO: 650921 - DNA, 25 bp, Mus musculus
gagaagatagcttaccacctgcaag

SEQ ID NO: 650922 - DNA, 25 bp, Mus musculus
gagaagatcaagaagtccccactca

SEQ ID NO: 650923 - DNA, 25 bp, Mus musculus
gagaagatcaagtagtccccactca

SEQ ID NO: 650924 - DNA, 25 bp, Mus musculus
gagaagatccatcagtctggagcca

SEQ ID NO: 650925 - DNA, 25 bp, Mus musculus
gagaagatccatgagtctggagcca

SEQ ID NO: 650926 - DNA, 25 bp, Mus musculus
gagaagatccctcctatcctgtgat

SEQ ID NO: 650927 - DNA, 25 bp, Mus musculus
gagaagatccctgctatcctgtgat

SEQ ID NO: 650928 - DNA, 25 bp, Mus musculus
gagaagatcgcgaacaaatcattgg

SEQ ID NO: 650929 - DNA, 25 bp, Mus musculus
gagaagatcgcgtacaaatcattgg

SEQ ID NO: 650930 - DNA, 25 bp, Mus musculus
gagaagatcttgaagcttactgctg

SEQ ID NO: 650931 - DNA, 25 bp, Mus musculus
gagaagatcttgtagcttactgctg

SEQ ID NO: 650932 - DNA, 25 bp, Mus musculus
gagaagatgaccaggacaggttcag

SEQ ID NO: 650933 - DNA, 25 bp, Mus musculus
gagaagatgacctggacaggttcag

SEQ ID NO: 650934 - DNA, 25 bp, Mus musculus
gagaagatgacgacatttttaacag

SEQ ID NO: 650935 - DNA, 25 bp, Mus musculus
gagaagatgacgtcatttttaacag

SEQ ID NO: 650936 - DNA, 25 bp, Mus musculus
gagaagatgcctcccaacaaggaag

SEQ ID NO: 650937 - DNA, 25 bp, Mus musculus
gagaagatgcctgccaacaaggaag

SEQ ID NO: 650938 - DNA, 25 bp, Mus musculus
gagaagatgtacctagacagaatca

SEQ ID NO: 650939 - DNA, 25 bp, Mus musculus
gagaagatgtacgtagacagaatca

SEQ ID NO: 650940 - DNA, 25 bp, Mus musculus
gagaagattaaacacgtccttaaag

SEQ ID NO: 650941 - DNA, 25 bp, Mus musculus
gagaagattaaagacgtccttaaag

SEQ ID NO: 650942 - DNA, 25 bp, Mus musculus
gagaagattaatccccagtccactg

SEQ ID NO: 650943 - DNA, 25 bp, Mus musculus
gagaagattaatgcccagtccactg

SEQ ID NO: 650944 - DNA, 25 bp, Mus musculus
gagaagattccaaataatacacagt

SEQ ID NO: 650945 - DNA, 25 bp, Mus musculus
gagaagattccatataatacacagt

SEQ ID NO: 650946 - DNA, 25 bp, Mus musculus
gagaagattgcgcatgccatccagg

SEQ ID NO: 650947 - DNA, 25 bp, Mus musculus
gagaagattgcggatgccatccagg

SEQ ID NO: 650948 - DNA, 25 bp, Mus musculus
gagaagattgtgagtccattaattg

SEQ ID NO: 650949 - DNA, 25 bp, Mus musculus
gagaagattgtgtgtccattaattg

SEQ ID NO: 650950 - DNA, 25 bp, Mus musculus
gagaagcaaacaccagcgaactgca

SEQ ID NO: 650951 - DNA, 25 bp, Mus musculus
gagaagcaaacagcagcgaactgca

SEQ ID NO: 650952 - DNA, 25 bp, Mus musculus
gagaagcaaaggaaggagtccactc

SEQ ID NO: 650953 - DNA, 25 bp, Mus musculus
gagaagcaaaggtaggagtccactc

SEQ ID NO: 650954 - DNA, 25 bp, Mus musculus
gagaagcaactcaagcgccgttttg

SEQ ID NO: 650955 - DNA, 25 bp, Mus musculus
gagaagcaactctagcgccgttttg

SEQ ID NO: 650956 - DNA, 25 bp, Mus musculus
gagaagcaaggcaggaccacgtgta

SEQ ID NO: 650957 - DNA, 25 bp, Mus musculus
gagaagcaaggctggaccacgtgta

SEQ ID NO: 650958 - DNA, 25 bp, Mus musculus
gagaagcacgtaaggttggctttac

SEQ ID NO: 650959 - DNA, 25 bp, Mus musculus
gagaagcacgtatggttggctttac

SEQ ID NO: 650960 - DNA, 25 bp, Mus musculus
gagaagcactctcgtgaccatggcc

SEQ ID NO: 650961 - DNA, 25 bp, Mus musculus
gagaagcactctggtgaccatggcc

SEQ ID NO: 650962 - DNA, 25 bp, Mus musculus
gagaagcagcacagtttatcgtgcc

SEQ ID NO: 650963 - DNA, 25 bp, Mus musculus
gagaagcagcactgtttatcgtgcc

SEQ ID NO: 650964 - DNA, 25 bp, Mus musculus
gagaagcagcccatgaatgcagcgg

SEQ ID NO: 650965 - DNA, 25 bp, Mus musculus
gagaagcagcccttgaatgcagcgg

SEQ ID NO: 650966 - DNA, 25 bp, Mus musculus
gagaagcaggcacataaatcggagt

SEQ ID NO: 650967 - DNA, 25 bp, Mus musculus
gagaagcaggcagataaatcggagt

SEQ ID NO: 650968 - DNA, 25 bp, Mus musculus
gagaagcagtatatccgaaccttcg

SEQ ID NO: 650969 - DNA, 25 bp, Mus musculus
gagaagcagtatcaggtgcaccccg

SEQ ID NO: 650970 - DNA, 25 bp, Mus musculus
gagaagcagtatgaggtgcaccccg

SEQ ID NO: 650971 - DNA, 25 bp, Mus musculus
gagaagcagtatttccgaaccttcg

SEQ ID NO: 650972 - DNA, 25 bp, Mus musculus
gagaagcagtccagctccttctgag

SEQ ID NO: 650973 - DNA, 25 bp, Mus musculus
gagaagcagtcctgctccttctgag

SEQ ID NO: 650974 - DNA, 25 bp, Mus musculus
gagaagcagtctctacggccggctt

SEQ ID NO: 650975 - DNA, 25 bp, Mus musculus
gagaagcagtctgtacggccggctt

SEQ ID NO: 650976 - DNA, 25 bp, Mus musculus
gagaagcatcctagacatgagccct

SEQ ID NO: 650977 - DNA, 25 bp, Mus musculus
gagaagcatccttgacatgagccct

SEQ ID NO: 650978 - DNA, 25 bp, Mus musculus
gagaagcatcttcagactccattga

SEQ ID NO: 650979 - DNA, 25 bp, Mus musculus
gagaagcatcttgagactccattga

SEQ ID NO: 650980 - DNA, 25 bp, Mus musculus
gagaagcattttatgttcaagagac

SEQ ID NO: 650981 - DNA, 25 bp, Mus musculus
gagaagcattttttgttcaagagac

SEQ ID NO: 650982 - DNA, 25 bp, Mus musculus
gagaagccaaaactcaagtcaatgg

SEQ ID NO: 650983 - DNA, 25 bp, Mus musculus
gagaagccaaaagtcaagtcaatgg

SEQ ID NO: 650984 - DNA, 25 bp, Mus musculus
gagaagccacacacctcacttggag

SEQ ID NO: 650985 - DNA, 25 bp, Mus musculus
gagaagccacactcctcacttggag

SEQ ID NO: 650986 - DNA, 25 bp, Mus musculus
gagaagccaccaagcagcctggaat

SEQ ID NO: 650987 - DNA, 25 bp, Mus musculus
gagaagccaccatgcagcctggaat

SEQ ID NO: 650988 - DNA, 25 bp, Mus musculus
gagaagccagacatccactgatgga

SEQ ID NO: 650989 - DNA, 25 bp, Mus musculus
gagaagccagacttccactgatgga

SEQ ID NO: 650990 - DNA, 25 bp, Mus musculus
gagaagccatgcctctatcctgaag

SEQ ID NO: 650991 - DNA, 25 bp, Mus musculus
gagaagccatgcgtctatcctgaag

SEQ ID NO: 650992 - DNA, 25 bp, Mus musculus
gagaagcccactctatattgtaacg

SEQ ID NO: 650993 - DNA, 25 bp, Mus musculus
gagaagcccactgtatattgtaacg

SEQ ID NO: 650994 - DNA, 25 bp, Mus musculus
gagaagccccgtcaggagctcttcc

SEQ ID NO: 650995 - DNA, 25 bp, Mus musculus
gagaagccccgtgaggagctcttcc

SEQ ID NO: 650996 - DNA, 25 bp, Mus musculus
gagaagcccctcatgatccaggagt

SEQ ID NO: 650997 - DNA, 25 bp, Mus musculus
gagaagcccctcttgatccaggagt

SEQ ID NO: 650998 - DNA, 25 bp, Mus musculus
gagaagcccgggacactgattttta

SEQ ID NO: 650999 - DNA, 25 bp, Mus musculus
gagaagcccgggtcactgattttta

SEQ ID NO: 651000 - DNA, 25 bp, Mus musculus
gagaagccctgcagaactggatgga

SEQ ID NO: 651001 - DNA, 25 bp, Mus musculus
gagaagccctgccaacatgggacaa

SEQ ID NO: 651002 - DNA, 25 bp, Mus musculus
gagaagccctgcgaacatgggacaa

SEQ ID NO: 651003 - DNA, 25 bp, Mus musculus
gagaagccctgctgaactggatgga

SEQ ID NO: 651004 - DNA, 25 bp, Mus musculus
gagaagcccttgcatatcgccagga

SEQ ID NO: 651005 - DNA, 25 bp, Mus musculus
gagaagcccttggatatcgccagga

SEQ ID NO: 651006 - DNA, 25 bp, Mus musculus
gagaagccgaatattgtcatcaagg

SEQ ID NO: 651007 - DNA, 25 bp, Mus musculus
gagaagccgaattttgtcatcaagg

SEQ ID NO: 651008 - DNA, 25 bp, Mus musculus
gagaagccgcaaagaccgagattaa

SEQ ID NO: 651009 - DNA, 25 bp, Mus musculus
gagaagccgcaatgaccgagattaa

SEQ ID NO: 651010 - DNA, 25 bp, Mus musculus
gagaagccgggtccataaaacggat

SEQ ID NO: 651011 - DNA, 25 bp, Mus musculus
gagaagccgggtgcataaaacggat

SEQ ID NO: 651012 - DNA, 25 bp, Mus musculus
gagaagcctaccaggtgtacacaga

SEQ ID NO: 651013 - DNA, 25 bp, Mus musculus
gagaagcctacctggtgtacacaga

SEQ ID NO: 651014 - DNA, 25 bp, Mus musculus
gagaagcctagtagaactcccagcc

SEQ ID NO: 651015 - DNA, 25 bp, Mus musculus
gagaagcctagtcctatggtgcctg

SEQ ID NO: 651016 - DNA, 25 bp, Mus musculus
gagaagcctagtgctatggtgcctg

SEQ ID NO: 651017 - DNA, 25 bp, Mus musculus
gagaagcctagttgaactcccagcc

SEQ ID NO: 651018 - DNA, 25 bp, Mus musculus
gagaagcctatgcagtcctccttgg

SEQ ID NO: 651019 - DNA, 25 bp, Mus musculus
gagaagcctatggagtcctccttgg

SEQ ID NO: 651020 - DNA, 25 bp, Mus musculus
gagaagcctccaagttcaggcaagc

SEQ ID NO: 651021 - DNA, 25 bp, Mus musculus
gagaagcctccatgttcaggcaagc

SEQ ID NO: 651022 - DNA, 25 bp, Mus musculus
gagaagcctctgatagaaaatgaat

SEQ ID NO: 651023 - DNA, 25 bp, Mus musculus
gagaagcctctgcaactcctgggca

SEQ ID NO: 651024 - DNA, 25 bp, Mus musculus
gagaagcctctggaactcctgggca

SEQ ID NO: 651025 - DNA, 25 bp, Mus musculus
gagaagcctctgttagaaaatgaat

SEQ ID NO: 651026 - DNA, 25 bp, Mus musculus
gagaagcctgctcgacatgagacag

SEQ ID NO: 651027 - DNA, 25 bp, Mus musculus
gagaagcctgctggacatgagacag

SEQ ID NO: 651028 - DNA, 25 bp, Mus musculus
gagaagcgacgacaagagagagaac

SEQ ID NO: 651029 - DNA, 25 bp, Mus musculus
gagaagcgacgagaagagagagaac

SEQ ID NO: 651030 - DNA, 25 bp, Mus musculus
gagaagcgcaggaggcgacaagaga

SEQ ID NO: 651031 - DNA, 25 bp, Mus musculus
gagaagcgcaggtggcgacaagaga

SEQ ID NO: 651032 - DNA, 25 bp, Mus musculus
gagaagcgccatcgcacacggtcca

SEQ ID NO: 651033 - DNA, 25 bp, Mus musculus
gagaagcgccatggcacacggtcca

SEQ ID NO: 651034 - DNA, 25 bp, Mus musculus
gagaagcgcctgcaatctctgcgcc

SEQ ID NO: 651035 - DNA, 25 bp, Mus musculus
gagaagcgcctggaatctctgcgcc

SEQ ID NO: 651036 - DNA, 25 bp, Mus musculus
gagaagcggccgaagcccaagatgc

SEQ ID NO: 651037 - DNA, 25 bp, Mus musculus
gagaagcggccgtagcccaagatgc

SEQ ID NO: 651038 - DNA, 25 bp, Mus musculus
gagaagcgtatgacggaatacatca

SEQ ID NO: 651039 - DNA, 25 bp, Mus musculus
gagaagcgtatgtcggaatacatca

SEQ ID NO: 651040 - DNA, 25 bp, Mus musculus
gagaagctaacccacgattatctga

SEQ ID NO: 651041 - DNA, 25 bp, Mus musculus
gagaagctaaccgacgattatctga

SEQ ID NO: 651042 - DNA, 25 bp, Mus musculus
gagaagctactcaggccataatagc

SEQ ID NO: 651043 - DNA, 25 bp, Mus musculus
gagaagctactctggccataatagc

SEQ ID NO: 651044 - DNA, 25 bp, Mus musculus
gagaagctattacacctgcttggca

SEQ ID NO: 651045 - DNA, 25 bp, Mus musculus
gagaagctattagacctgcttggca

SEQ ID NO: 651046 - DNA, 25 bp, Mus musculus
gagaagctcaagattatcaaaggca

SEQ ID NO: 651047 - DNA, 25 bp, Mus musculus
gagaagctcaagtttatcaaaggca

SEQ ID NO: 651048 - DNA, 25 bp, Mus musculus
gagaagctcaccatcaataacccca

SEQ ID NO: 651049 - DNA, 25 bp, Mus musculus
gagaagctcaccttcaataacccca

SEQ ID NO: 651050 - DNA, 25 bp, Mus musculus
gagaagctccgacacagtctgacgt

SEQ ID NO: 651051 - DNA, 25 bp, Mus musculus
gagaagctccgagacagtctgacgt

SEQ ID NO: 651052 - DNA, 25 bp, Mus musculus
gagaagctctcgcacacatatacct

SEQ ID NO: 651053 - DNA, 25 bp, Mus musculus
gagaagctctcggacacatatacct

SEQ ID NO: 651054 - DNA, 25 bp, Mus musculus
gagaagctctgtacaggatccctac

SEQ ID NO: 651055 - DNA, 25 bp, Mus musculus
gagaagctctgttcaggatccctac

SEQ ID NO: 651056 - DNA, 25 bp, Mus musculus
gagaagctgaaaaaccgctacatca

SEQ ID NO: 651057 - DNA, 25 bp, Mus musculus
gagaagctgaaataccgctacatca

SEQ ID NO: 651058 - DNA, 25 bp, Mus musculus
gagaagctgaacagcaggccgccct

SEQ ID NO: 651059 - DNA, 25 bp, Mus musculus
gagaagctgaactgcaggccgccct

SEQ ID NO: 651060 - DNA, 25 bp, Mus musculus
gagaagctgactctccaggctctat

SEQ ID NO: 651061 - DNA, 25 bp, Mus musculus
gagaagctgactgtccaggctctat

SEQ ID NO: 651062 - DNA, 25 bp, Mus musculus
gagaagctgagtcgtcataccgcca

SEQ ID NO: 651063 - DNA, 25 bp, Mus musculus
gagaagctgagtggtcataccgcca

SEQ ID NO: 651064 - DNA, 25 bp, Mus musculus
gagaagctgcagaatacattgccca

SEQ ID NO: 651065 - DNA, 25 bp, Mus musculus
gagaagctgcagtatacattgccca

SEQ ID NO: 651066 - DNA, 25 bp, Mus musculus
gagaagctgcccagttggatgaaac

SEQ ID NO: 651067 - DNA, 25 bp, Mus musculus
gagaagctgccctgttggatgaaac

SEQ ID NO: 651068 - DNA, 25 bp, Mus musculus
gagaagctgccgatcttaggactgg

SEQ ID NO: 651069 - DNA, 25 bp, Mus musculus
gagaagctgccgttcttaggactgg

SEQ ID NO: 651070 - DNA, 25 bp, Mus musculus
gagaagctgcctatcgaagcatgct

SEQ ID NO: 651071 - DNA, 25 bp, Mus musculus
gagaagctgcctttcgaagcatgct

SEQ ID NO: 651072 - DNA, 25 bp, Mus musculus
gagaagctgcgcagtctccgggcat

SEQ ID NO: 651073 - DNA, 25 bp, Mus musculus
gagaagctgcgctgtctccgggcat

SEQ ID NO: 651074 - DNA, 25 bp, Mus musculus
gagaagctggacaaggcactaggac

SEQ ID NO: 651075 - DNA, 25 bp, Mus musculus
gagaagctggactaggcactaggac

SEQ ID NO: 651076 - DNA, 25 bp, Mus musculus
gagaagctggagacgacccagcgcc

SEQ ID NO: 651077 - DNA, 25 bp, Mus musculus
gagaagctggagtcgacccagcgcc

SEQ ID NO: 651078 - DNA, 25 bp, Mus musculus
gagaagctggatcgaaaagctaaaa

SEQ ID NO: 651079 - DNA, 25 bp, Mus musculus
gagaagctggatggaaaagctaaaa

SEQ ID NO: 651080 - DNA, 25 bp, Mus musculus
gagaagctggccacggagaatgcca

SEQ ID NO: 651081 - DNA, 25 bp, Mus musculus
gagaagctggcctcggagaatgcca

SEQ ID NO: 651082 - DNA, 25 bp, Mus musculus
gagaagctgggacgccacttcttta

SEQ ID NO: 651083 - DNA, 25 bp, Mus musculus
gagaagctgggaggccacttcttta

SEQ ID NO: 651084 - DNA, 25 bp, Mus musculus
gagaagctggttatcctggtcgccc

SEQ ID NO: 651085 - DNA, 25 bp, Mus musculus
gagaagctggttttcctggtcgccc

SEQ ID NO: 651086 - DNA, 25 bp, Mus musculus
gagaagctgtcacctccttatagct

SEQ ID NO: 651087 - DNA, 25 bp, Mus musculus
gagaagctgtcagctccttatagct

SEQ ID NO: 651088 - DNA, 25 bp, Mus musculus
gagaagctgttgaggtgtagctccc

SEQ ID NO: 651089 - DNA, 25 bp, Mus musculus
gagaagctgttgtggtgtagctccc

SEQ ID NO: 651090 - DNA, 25 bp, Mus musculus
gagaagcttactccatggtttgtag

SEQ ID NO: 651091 - DNA, 25 bp, Mus musculus
gagaagcttactgcatggtttgtag

SEQ ID NO: 651092 - DNA, 25 bp, Mus musculus
gagaagcttcagcttcgaaaagaaa

SEQ ID NO: 651093 - DNA, 25 bp, Mus musculus
gagaagcttcaggttcgaaaagaaa

SEQ ID NO: 651094 - DNA, 25 bp, Mus musculus
gagaagcttcccactcactgcagag

SEQ ID NO: 651095 - DNA, 25 bp, Mus musculus
gagaagcttccctctcactgcagag

SEQ ID NO: 651096 - DNA, 25 bp, Mus musculus
gagaagcttcgcagctcagagcgcc

SEQ ID NO: 651097 - DNA, 25 bp, Mus musculus
gagaagcttcgctgctcagagcgcc

SEQ ID NO: 651098 - DNA, 25 bp, Mus musculus
gagaagcttgatcttcggagtcaga

SEQ ID NO: 651099 - DNA, 25 bp, Mus musculus
gagaagcttgatgttcggagtcaga

SEQ ID NO: 651100 - DNA, 25 bp, Mus musculus
gagaaggaaagcacccagtcttgta

SEQ ID NO: 651101 - DNA, 25 bp, Mus musculus
gagaaggaaagctcccagtcttgta

SEQ ID NO: 651102 - DNA, 25 bp, Mus musculus
gagaaggaacaactcggcttccgac

SEQ ID NO: 651103 - DNA, 25 bp, Mus musculus
gagaaggaacaagtcggcttccgac

SEQ ID NO: 651104 - DNA, 25 bp, Mus musculus
gagaaggaactccagcttttggtca

SEQ ID NO: 651105 - DNA, 25 bp, Mus musculus
gagaaggaactcgagcttttggtca

SEQ ID NO: 651106 - DNA, 25 bp, Mus musculus
gagaaggaactgaagtcctcacttg

SEQ ID NO: 651107 - DNA, 25 bp, Mus musculus
gagaaggaactgtagtcctcacttg

SEQ ID NO: 651108 - DNA, 25 bp, Mus musculus
gagaaggaagacaggatcaaatgca

SEQ ID NO: 651109 - DNA, 25 bp, Mus musculus
gagaaggaagactggatcaaatgca

SEQ ID NO: 651110 - DNA, 25 bp, Mus musculus
gagaaggaagctaaacacctcagct

SEQ ID NO: 651111 - DNA, 25 bp, Mus musculus
gagaaggaagcttaacacctcagct

SEQ ID NO: 651112 - DNA, 25 bp, Mus musculus
gagaaggaagtgcacctgagtgaca

SEQ ID NO: 651113 - DNA, 25 bp, Mus musculus
gagaaggaagtggacctgagtgaca

SEQ ID NO: 651114 - DNA, 25 bp, Mus musculus
gagaaggacaagatcctcacccctg

SEQ ID NO: 651115 - DNA, 25 bp, Mus musculus
gagaaggacaagttcctcacccctg

SEQ ID NO: 651116 - DNA, 25 bp, Mus musculus
gagaaggacaccatgaaccatcatt

SEQ ID NO: 651117 - DNA, 25 bp, Mus musculus
gagaaggacaccttgaaccatcatt

SEQ ID NO: 651118 - DNA, 25 bp, Mus musculus
gagaaggacccaaacaggagacatt

SEQ ID NO: 651119 - DNA, 25 bp, Mus musculus
gagaaggacccatacaggagacatt

SEQ ID NO: 651120 - DNA, 25 bp, Mus musculus
gagaaggacttgatcccaaagctgt

SEQ ID NO: 651121 - DNA, 25 bp, Mus musculus
gagaaggacttgttcccaaagctgt

SEQ ID NO: 651122 - DNA, 25 bp, Mus musculus
gagaaggagaatagtcacctggagc

SEQ ID NO: 651123 - DNA, 25 bp, Mus musculus
gagaaggagaattgtcacctggagc

SEQ ID NO: 651124 - DNA, 25 bp, Mus musculus
gagaaggagatcatcaacagagtga

SEQ ID NO: 651125 - DNA, 25 bp, Mus musculus
gagaaggagatcttcaacagagtga

SEQ ID NO: 651126 - DNA, 25 bp, Mus musculus
gagaaggagccgcagctcacctctg

SEQ ID NO: 651127 - DNA, 25 bp, Mus musculus
gagaaggagccggagctcacctctg

SEQ ID NO: 651128 - DNA, 25 bp, Mus musculus
gagaaggagtccaaagcctcagagt

SEQ ID NO: 651129 - DNA, 25 bp, Mus musculus
gagaaggagtcctaagcctcagagt

SEQ ID NO: 651130 - DNA, 25 bp, Mus musculus
gagaaggatggcatgtccttccaag

SEQ ID NO: 651131 - DNA, 25 bp, Mus musculus
gagaaggatggcttgtccttccaag

SEQ ID NO: 651132 - DNA, 25 bp, Mus musculus
gagaaggattctctgccccgctttg

SEQ ID NO: 651133 - DNA, 25 bp, Mus musculus
gagaaggattctgtgccccgctttg

SEQ ID NO: 651134 - DNA, 25 bp, Mus musculus
gagaaggcaaaacacgagtttcaga

SEQ ID NO: 651135 - DNA, 25 bp, Mus musculus
gagaaggcaaaagacgagtttcaga

SEQ ID NO: 651136 - DNA, 25 bp, Mus musculus
gagaaggcaaagcaaatttatgaag

SEQ ID NO: 651137 - DNA, 25 bp, Mus musculus
gagaaggcaaaggaaatttatgaag

SEQ ID NO: 651138 - DNA, 25 bp, Mus musculus
gagaaggcaacgatacaagacctac

SEQ ID NO: 651139 - DNA, 25 bp, Mus musculus
gagaaggcaacgttacaagacctac

SEQ ID NO: 651140 - DNA, 25 bp, Mus musculus
gagaaggcattgctatgggttttct

SEQ ID NO: 651141 - DNA, 25 bp, Mus musculus
gagaaggcattggtatgggttttct

SEQ ID NO: 651142 - DNA, 25 bp, Mus musculus
gagaaggcatttcgagtcctcagcg

SEQ ID NO: 651143 - DNA, 25 bp, Mus musculus
gagaaggcatttcgtccctccctag

SEQ ID NO: 651144 - DNA, 25 bp, Mus musculus
gagaaggcatttggagtcctcagcg

SEQ ID NO: 651145 - DNA, 25 bp, Mus musculus
gagaaggcatttggtccctccctag

SEQ ID NO: 651146 - DNA, 25 bp, Mus musculus
gagaaggccaccaccaagaaacgca

SEQ ID NO: 651147 - DNA, 25 bp, Mus musculus
gagaaggccacctccaagaaacgca

SEQ ID NO: 651148 - DNA, 25 bp, Mus musculus
gagaaggcccgtcggtgaacatctt

SEQ ID NO: 651149 - DNA, 25 bp, Mus musculus
gagaaggcccgtgggtgaacatctt

SEQ ID NO: 651150 - DNA, 25 bp, Mus musculus
gagaaggccgcaactcagagacgag

SEQ ID NO: 651151 - DNA, 25 bp, Mus musculus
gagaaggccgcatctcagagacgag

SEQ ID NO: 651152 - DNA, 25 bp, Mus musculus
gagaaggcgaaaagatgacaaaagt

SEQ ID NO: 651153 - DNA, 25 bp, Mus musculus
gagaaggcgaaatgatgacaaaagt

SEQ ID NO: 651154 - DNA, 25 bp, Mus musculus
gagaaggctcctaaagccagggtcc

SEQ ID NO: 651155 - DNA, 25 bp, Mus musculus
gagaaggctccttaagccagggtcc

SEQ ID NO: 651156 - DNA, 25 bp, Mus musculus
gagaaggctggaaagcccctaactc

SEQ ID NO: 651157 - DNA, 25 bp, Mus musculus
gagaaggctggatagcccctaactc

SEQ ID NO: 651158 - DNA, 25 bp, Mus musculus
gagaaggctggcatccacgatggtc

SEQ ID NO: 651159 - DNA, 25 bp, Mus musculus
gagaaggctggcttccacgatggtc

SEQ ID NO: 651160 - DNA, 25 bp, Mus musculus
gagaagggaaacactttatttgttg

SEQ ID NO: 651161 - DNA, 25 bp, Mus musculus
gagaagggaaactctttatttgttg

SEQ ID NO: 651162 - DNA, 25 bp, Mus musculus
gagaagggccagaattgcgacgcca

SEQ ID NO: 651163 - DNA, 25 bp, Mus musculus
gagaagggccagtattgcgacgcca

SEQ ID NO: 651164 - DNA, 25 bp, Mus musculus
gagaagggctttcgctacaaaggct

SEQ ID NO: 651165 - DNA, 25 bp, Mus musculus
gagaagggctttggctacaaaggct

SEQ ID NO: 651166 - DNA, 25 bp, Mus musculus
gagaaggtaaatagactcttttcat

SEQ ID NO: 651167 - DNA, 25 bp, Mus musculus
gagaaggtaaattgactcttttcat

SEQ ID NO: 651168 - DNA, 25 bp, Mus musculus
gagaaggtagcaaacttgctgcaaa

SEQ ID NO: 651169 - DNA, 25 bp, Mus musculus
gagaaggtagcatacttgctgcaaa

SEQ ID NO: 651170 - DNA, 25 bp, Mus musculus
gagaaggtatctccacagtgcctca

SEQ ID NO: 651171 - DNA, 25 bp, Mus musculus
gagaaggtatctgcacagtgcctca

SEQ ID NO: 651172 - DNA, 25 bp, Mus musculus
gagaaggtccggaggttacagcttc

SEQ ID NO: 651173 - DNA, 25 bp, Mus musculus
gagaaggtccggtggttacagcttc

SEQ ID NO: 651174 - DNA, 25 bp, Mus musculus
gagaaggtcctgatctggccaatgt

SEQ ID NO: 651175 - DNA, 25 bp, Mus musculus
gagaaggtcctgttctggccaatgt

SEQ ID NO: 651176 - DNA, 25 bp, Mus musculus
gagaaggtcgtgctgctcacgttcc

SEQ ID NO: 651177 - DNA, 25 bp, Mus musculus
gagaaggtcgtggtgctcacgttcc

SEQ ID NO: 651178 - DNA, 25 bp, Mus musculus
gagaaggtgcacatgacttggacca

SEQ ID NO: 651179 - DNA, 25 bp, Mus musculus
gagaaggtgcacttgacttggacca

SEQ ID NO: 651180 - DNA, 25 bp, Mus musculus
gagaaggtgcccaactcatcactgc

SEQ ID NO: 651181 - DNA, 25 bp, Mus musculus
gagaaggtgccctactcatcactgc

SEQ ID NO: 651182 - DNA, 25 bp, Mus musculus
gagaaggtgcgaagacaggcatcaa

SEQ ID NO: 651183 - DNA, 25 bp, Mus musculus
gagaaggtgcgatgacaggcatcaa

SEQ ID NO: 651184 - DNA, 25 bp, Mus musculus
gagaaggtgtatccgtcactagaag

SEQ ID NO: 651185 - DNA, 25 bp, Mus musculus
gagaaggtgtatgcgtcactagaag

SEQ ID NO: 651186 - DNA, 25 bp, Mus musculus
gagaaggttaatatgaatgcagcac

SEQ ID NO: 651187 - DNA, 25 bp, Mus musculus
gagaaggttaatttgaatgcagcac

SEQ ID NO: 651188 - DNA, 25 bp, Mus musculus
gagaaggttctgctgaccaccaacg

SEQ ID NO: 651189 - DNA, 25 bp, Mus musculus
gagaaggttctggtgaccaccaacg

SEQ ID NO: 651190 - DNA, 25 bp, Mus musculus
gagaagtaacctcaaaactcacctt

SEQ ID NO: 651191 - DNA, 25 bp, Mus musculus
gagaagtaacctgaaaactcacctt

SEQ ID NO: 651192 - DNA, 25 bp, Mus musculus
gagaagtaccaaagcgtctgccacc

SEQ ID NO: 651193 - DNA, 25 bp, Mus musculus
gagaagtaccaatgcgtctgccacc

SEQ ID NO: 651194 - DNA, 25 bp, Mus musculus
gagaagtacgccctggcctacgttg

SEQ ID NO: 651195 - DNA, 25 bp, Mus musculus
gagaagtacgccgtggcctacgttg

SEQ ID NO: 651196 - DNA, 25 bp, Mus musculus
gagaagtacggaccgctgaagcccc

SEQ ID NO: 651197 - DNA, 25 bp, Mus musculus
gagaagtacggagcgctgaagcccc

SEQ ID NO: 651198 - DNA, 25 bp, Mus musculus
gagaagtactgactctttataaaaa

SEQ ID NO: 651199 - DNA, 25 bp, Mus musculus
gagaagtactgagtctttataaaaa

SEQ ID NO: 651200 - DNA, 25 bp, Mus musculus
gagaagtagcttactgcagctgtgg

SEQ ID NO: 651201 - DNA, 25 bp, Mus musculus
gagaagtagctttctgcagctgtgg

SEQ ID NO: 651202 - DNA, 25 bp, Mus musculus
gagaagtagggtcattccaggaccc

SEQ ID NO: 651203 - DNA, 25 bp, Mus musculus
gagaagtagggtgattccaggaccc

SEQ ID NO: 651204 - DNA, 25 bp, Mus musculus
gagaagtataataacccagccatgc

SEQ ID NO: 651205 - DNA, 25 bp, Mus musculus
gagaagtataattacccagccatgc

SEQ ID NO: 651206 - DNA, 25 bp, Mus musculus
gagaagtcctctaaagtgatcacct

SEQ ID NO: 651207 - DNA, 25 bp, Mus musculus
gagaagtcctcttaagtgatcacct

SEQ ID NO: 651208 - DNA, 25 bp, Mus musculus
gagaagtctggtatcagcagcccct

SEQ ID NO: 651209 - DNA, 25 bp, Mus musculus
gagaagtctggtttcagcagcccct

SEQ ID NO: 651210 - DNA, 25 bp, Mus musculus
gagaagtcttctcaacatatctgtc

SEQ ID NO: 651211 - DNA, 25 bp, Mus musculus
gagaagtcttctgaacatatctgtc

SEQ ID NO: 651212 - DNA, 25 bp, Mus musculus
gagaagtcttgacaaatctatgctg

SEQ ID NO: 651213 - DNA, 25 bp, Mus musculus
gagaagtcttgagaaatctatgctg

SEQ ID NO: 651214 - DNA, 25 bp, Mus musculus
gagaagtgagtaacggtcagcaaaa

SEQ ID NO: 651215 - DNA, 25 bp, Mus musculus
gagaagtgagtatcggtcagcaaaa

SEQ ID NO: 651216 - DNA, 25 bp, Mus musculus
gagaagtggattaataatgattccg

SEQ ID NO: 651217 - DNA, 25 bp, Mus musculus
gagaagtggatttataatgattccg

SEQ ID NO: 651218 - DNA, 25 bp, Mus musculus
gagaagtggtccagcaagatcgact

SEQ ID NO: 651219 - DNA, 25 bp, Mus musculus
gagaagtggtcctgcaagatcgact

SEQ ID NO: 651220 - DNA, 25 bp, Mus musculus
gagaagtgtcaccaacactacacca

SEQ ID NO: 651221 - DNA, 25 bp, Mus musculus
gagaagtgtcacgaacactacacca

SEQ ID NO: 651222 - DNA, 25 bp, Mus musculus
gagaagttccagcagcgttttcaga

SEQ ID NO: 651223 - DNA, 25 bp, Mus musculus
gagaagttccaggagcgttttcaga

SEQ ID NO: 651224 - DNA, 25 bp, Mus musculus
gagaagttcgccaaccctttcccag

SEQ ID NO: 651225 - DNA, 25 bp, Mus musculus
gagaagttcgcctaccctttcccag

SEQ ID NO: 651226 - DNA, 25 bp, Mus musculus
gagaagttctggagccctactgtca

SEQ ID NO: 651227 - DNA, 25 bp, Mus musculus
gagaagttctggtgccctactgtca

SEQ ID NO: 651228 - DNA, 25 bp, Mus musculus
gagaagttgacacttgacccaggct

SEQ ID NO: 651229 - DNA, 25 bp, Mus musculus
gagaagttgacagttgacccaggct

SEQ ID NO: 651230 - DNA, 25 bp, Mus musculus
gagaagttgctgaacaactggcaga

SEQ ID NO: 651231 - DNA, 25 bp, Mus musculus
gagaagttgctgtacaactggcaga

SEQ ID NO: 651232 - DNA, 25 bp, Mus musculus
gagaagttggacaaaattggattga

SEQ ID NO: 651233 - DNA, 25 bp, Mus musculus
gagaagttggactaaattggattga

SEQ ID NO: 651234 - DNA, 25 bp, Mus musculus
gagaagttggcgatcaaggacctcc

SEQ ID NO: 651235 - DNA, 25 bp, Mus musculus
gagaagttggcgttcaaggacctcc

SEQ ID NO: 651236 - DNA, 25 bp, Mus musculus
gagaagttgttacgagtgagctccc

SEQ ID NO: 651237 - DNA, 25 bp, Mus musculus
gagaagttgttaggagtgagctccc

SEQ ID NO: 651238 - DNA, 25 bp, Mus musculus
gagaagtttgagatgcagcactcag

SEQ ID NO: 651239 - DNA, 25 bp, Mus musculus
gagaagtttgagttgcagcactcag

SEQ ID NO: 651240 - DNA, 25 bp, Mus musculus
gagaataaacgaagctgtgtccaca

SEQ ID NO: 651241 - DNA, 25 bp, Mus musculus
gagaataaacgatgctgtgtccaca

SEQ ID NO: 651242 - DNA, 25 bp, Mus musculus
gagaataagcgcattttgatggacc

SEQ ID NO: 651243 - DNA, 25 bp, Mus musculus
gagaataagcgctttttgatggacc

SEQ ID NO: 651244 - DNA, 25 bp, Mus musculus
gagaataatatcagcaggagaggtg

SEQ ID NO: 651245 - DNA, 25 bp, Mus musculus
gagaataatatctgcaggagaggtg

SEQ ID NO: 651246 - DNA, 25 bp, Mus musculus
gagaataatgttatttatggacacc

SEQ ID NO: 651247 - DNA, 25 bp, Mus musculus
gagaataatgttttttatggacacc

SEQ ID NO: 651248 - DNA, 25 bp, Mus musculus
gagaatacagcaatcttacccatgg

SEQ ID NO: 651249 - DNA, 25 bp, Mus musculus
gagaatacagcattcttacccatgg

SEQ ID NO: 651250 - DNA, 25 bp, Mus musculus
gagaatacagggagagctacagaat

SEQ ID NO: 651251 - DNA, 25 bp, Mus musculus
gagaatacagggtgagctacagaat

SEQ ID NO: 651252 - DNA, 25 bp, Mus musculus
gagaatacccacaggtcctacaacg

SEQ ID NO: 651253 - DNA, 25 bp, Mus musculus
gagaatacccactggtcctacaacg

SEQ ID NO: 651254 - DNA, 25 bp, Mus musculus
gagaataccctccaggaacgtcaac

SEQ ID NO: 651255 - DNA, 25 bp, Mus musculus
gagaataccctcgaggaacgtcaac

SEQ ID NO: 651256 - DNA, 25 bp, Mus musculus
gagaataccctgatgtccctgagga

SEQ ID NO: 651257 - DNA, 25 bp, Mus musculus
gagaataccctgttgtccctgagga

SEQ ID NO: 651258 - DNA, 25 bp, Mus musculus
gagaatacctgtaggctgccaggcg

SEQ ID NO: 651259 - DNA, 25 bp, Mus musculus
gagaatacctgttggctgccaggcg

SEQ ID NO: 651260 - DNA, 25 bp, Mus musculus
gagaatactataagcttcaggagca

SEQ ID NO: 651261 - DNA, 25 bp, Mus musculus
gagaatactatatgcttcaggagca

SEQ ID NO: 651262 - DNA, 25 bp, Mus musculus
gagaatatcactaacccaggctggc

SEQ ID NO: 651263 - DNA, 25 bp, Mus musculus
gagaatatcacttacccaggctggc

SEQ ID NO: 651264 - DNA, 25 bp, Mus musculus
gagaatatcggtctcaaatggagca

SEQ ID NO: 651265 - DNA, 25 bp, Mus musculus
gagaatatcggtgtcaaatggagca

SEQ ID NO: 651266 - DNA, 25 bp, Mus musculus
gagaatattggcagctcctccgagc

SEQ ID NO: 651267 - DNA, 25 bp, Mus musculus
gagaatattggctgctcctccgagc

SEQ ID NO: 651268 - DNA, 25 bp, Mus musculus
gagaatattttacatcagccgctac

SEQ ID NO: 651269 - DNA, 25 bp, Mus musculus
gagaatattttagatcagccgctac

SEQ ID NO: 651270 - DNA, 25 bp, Mus musculus
gagaatcaagatcctgcagttgaca

SEQ ID NO: 651271 - DNA, 25 bp, Mus musculus
gagaatcaagatgctgcagttgaca

SEQ ID NO: 651272 - DNA, 25 bp, Mus musculus
gagaatcaattgctatgaagccagc

SEQ ID NO: 651273 - DNA, 25 bp, Mus musculus
gagaatcaattggtatgaagccagc

SEQ ID NO: 651274 - DNA, 25 bp, Mus musculus
gagaatcacatcagttcgtcctgaa

SEQ ID NO: 651275 - DNA, 25 bp, Mus musculus
gagaatcacatctgttcgtcctgaa

SEQ ID NO: 651276 - DNA, 25 bp, Mus musculus
gagaatcaccacaggcgatctacaa

SEQ ID NO: 651277 - DNA, 25 bp, Mus musculus
gagaatcaccactggcgatctacaa

SEQ ID NO: 651278 - DNA, 25 bp, Mus musculus
gagaatcagaacatctgcgtgccct

SEQ ID NO: 651279 - DNA, 25 bp, Mus musculus
gagaatcagaacttctgcgtgccct

SEQ ID NO: 651280 - DNA, 25 bp, Mus musculus
gagaatcagaccataccagcattag

SEQ ID NO: 651281 - DNA, 25 bp, Mus musculus
gagaatcagaccttaccagcattag

SEQ ID NO: 651282 - DNA, 25 bp, Mus musculus
gagaatcagccacatgtaaatccca

SEQ ID NO: 651283 - DNA, 25 bp, Mus musculus
gagaatcagccagatgtaaatccca

SEQ ID NO: 651284 - DNA, 25 bp, Mus musculus
gagaatcagcctagctagagccttg

SEQ ID NO: 651285 - DNA, 25 bp, Mus musculus
gagaatcagccttgctagagccttg

SEQ ID NO: 651286 - DNA, 25 bp, Mus musculus
gagaatcagcttatggacaaccgca

SEQ ID NO: 651287 - DNA, 25 bp, Mus musculus
gagaatcagcttttggacaaccgca

SEQ ID NO: 651288 - DNA, 25 bp, Mus musculus
gagaatcaggaaaaagcaccattgt

SEQ ID NO: 651289 - DNA, 25 bp, Mus musculus
gagaatcaggaataagcaccattgt

SEQ ID NO: 651290 - DNA, 25 bp, Mus musculus
gagaatcagtttccctcccggagca

SEQ ID NO: 651291 - DNA, 25 bp, Mus musculus
gagaatcagtttgcctcccggagca

SEQ ID NO: 651292 - DNA, 25 bp, Mus musculus
gagaatcatctcagacaattttaag

SEQ ID NO: 651293 - DNA, 25 bp, Mus musculus
gagaatcatctctgacaattttaag

SEQ ID NO: 651294 - DNA, 25 bp, Mus musculus
gagaatccatttcaacagccggttt

SEQ ID NO: 651295 - DNA, 25 bp, Mus musculus
gagaatccatttgaacagccggttt

SEQ ID NO: 651296 - DNA, 25 bp, Mus musculus
gagaatccccataggatttggaggg

SEQ ID NO: 651297 - DNA, 25 bp, Mus musculus
gagaatccccattggatttggaggg

SEQ ID NO: 651298 - DNA, 25 bp, Mus musculus
gagaatccctgcagttgatcaagag

SEQ ID NO: 651299 - DNA, 25 bp, Mus musculus
gagaatccctgctgttgatcaagag

SEQ ID NO: 651300 - DNA, 25 bp, Mus musculus
gagaatccctgtcttcagacctgtg

SEQ ID NO: 651301 - DNA, 25 bp, Mus musculus
gagaatccctgtgttcagacctgtg

SEQ ID NO: 651302 - DNA, 25 bp, Mus musculus
gagaatccgcctctccgtggagaaa

SEQ ID NO: 651303 - DNA, 25 bp, Mus musculus
gagaatccgcctgtccgtggagaaa

SEQ ID NO: 651304 - DNA, 25 bp, Mus musculus
gagaatccggagcaatccagagtga

SEQ ID NO: 651305 - DNA, 25 bp, Mus musculus
gagaatccggaggaatccagagtga

SEQ ID NO: 651306 - DNA, 25 bp, Mus musculus
gagaatccgtgaaatgttccgtgca

SEQ ID NO: 651307 - DNA, 25 bp, Mus musculus
gagaatccgtgatatgttccgtgca

SEQ ID NO: 651308 - DNA, 25 bp, Mus musculus
gagaatcctcacataatcaccgcac

SEQ ID NO: 651309 - DNA, 25 bp, Mus musculus
gagaatcctcacttaatcaccgcac

SEQ ID NO: 651310 - DNA, 25 bp, Mus musculus
gagaatcgctcgctttgctgcacaa

SEQ ID NO: 651311 - DNA, 25 bp, Mus musculus
gagaatcgctcggtttgctgcacaa

SEQ ID NO: 651312 - DNA, 25 bp, Mus musculus
gagaatcggatcagccatatctgca

SEQ ID NO: 651313 - DNA, 25 bp, Mus musculus
gagaatcggatctgccatatctgca

SEQ ID NO: 651314 - DNA, 25 bp, Mus musculus
gagaatcgtactcagactcgctggg

SEQ ID NO: 651315 - DNA, 25 bp, Mus musculus
gagaatcgtactgagactcgctggg

SEQ ID NO: 651316 - DNA, 25 bp, Mus musculus
gagaatcgtgccaataagaagccaa

SEQ ID NO: 651317 - DNA, 25 bp, Mus musculus
gagaatcgtgcctataagaagccaa

SEQ ID NO: 651318 - DNA, 25 bp, Mus musculus
gagaatctatcaattcgtggaagga

SEQ ID NO: 651319 - DNA, 25 bp, Mus musculus
gagaatctatcatttcgtggaagga

SEQ ID NO: 651320 - DNA, 25 bp, Mus musculus
gagaatctctgtccaaagaaatatc

SEQ ID NO: 651321 - DNA, 25 bp, Mus musculus
gagaatctctgtgcaaagaaatatc

SEQ ID NO: 651322 - DNA, 25 bp, Mus musculus
gagaatctctttcacgccatccagt

SEQ ID NO: 651323 - DNA, 25 bp, Mus musculus
gagaatctctttgacgccatccagt

SEQ ID NO: 651324 - DNA, 25 bp, Mus musculus
gagaatctgcttcatgaccactatg

SEQ ID NO: 651325 - DNA, 25 bp, Mus musculus
gagaatctgcttgatgaccactatg

SEQ ID NO: 651326 - DNA, 25 bp, Mus musculus
gagaatctgtgcaaacagttgtatg

SEQ ID NO: 651327 - DNA, 25 bp, Mus musculus
gagaatctgtgctaacagttgtatg

SEQ ID NO: 651328 - DNA, 25 bp, Mus musculus
gagaatctgtttcccggatgcctgc

SEQ ID NO: 651329 - DNA, 25 bp, Mus musculus
gagaatctgtttgccggatgcctgc

SEQ ID NO: 651330 - DNA, 25 bp, Mus musculus
gagaatcttatacgagctttactga

SEQ ID NO: 651331 - DNA, 25 bp, Mus musculus
gagaatcttataggagctttactga

SEQ ID NO: 651332 - DNA, 25 bp, Mus musculus
gagaatcttctcatcgaccagcagg

SEQ ID NO: 651333 - DNA, 25 bp, Mus musculus
gagaatcttctcttcgaccagcagg

SEQ ID NO: 651334 - DNA, 25 bp, Mus musculus
gagaatcttgctcagaatgcagaca

SEQ ID NO: 651335 - DNA, 25 bp, Mus musculus
gagaatcttgctgagaatgcagaca

SEQ ID NO: 651336 - DNA, 25 bp, Mus musculus
gagaatgaaagcagaatggtaggta

SEQ ID NO: 651337 - DNA, 25 bp, Mus musculus
gagaatgaaagctgaatggtaggta

SEQ ID NO: 651338 - DNA, 25 bp, Mus musculus
gagaatgaacgtcgcacaacctctg

SEQ ID NO: 651339 - DNA, 25 bp, Mus musculus
gagaatgaacgtggcacaacctctg

SEQ ID NO: 651340 - DNA, 25 bp, Mus musculus
gagaatgagagtctcctgtgtcgca

SEQ ID NO: 651341 - DNA, 25 bp, Mus musculus
gagaatgagagtgtcctgtgtcgca

SEQ ID NO: 651342 - DNA, 25 bp, Mus musculus
gagaatgagatcaacctgacacaca

SEQ ID NO: 651343 - DNA, 25 bp, Mus musculus
gagaatgagatctacctgacacaca

SEQ ID NO: 651344 - DNA, 25 bp, Mus musculus
gagaatgagctgaccctgcgtcagg

SEQ ID NO: 651345 - DNA, 25 bp, Mus musculus
gagaatgagctgtccctgcgtcagg

SEQ ID NO: 651346 - DNA, 25 bp, Mus musculus
gagaatgagtatcggagcatcaacc

SEQ ID NO: 651347 - DNA, 25 bp, Mus musculus
gagaatgagtatgggagcatcaacc

SEQ ID NO: 651348 - DNA, 25 bp, Mus musculus
gagaatgatccacctacacaacggg

SEQ ID NO: 651349 - DNA, 25 bp, Mus musculus
gagaatgatccagctacacaacggg

SEQ ID NO: 651350 - DNA, 25 bp, Mus musculus
gagaatgatctcattggaccccatg

SEQ ID NO: 651351 - DNA, 25 bp, Mus musculus
gagaatgatctctttggaccccatg

SEQ ID NO: 651352 - DNA, 25 bp, Mus musculus
gagaatgcaagtattgtctgaatcc

SEQ ID NO: 651353 - DNA, 25 bp, Mus musculus
gagaatgcaagttttgtctgaatcc

SEQ ID NO: 651354 - DNA, 25 bp, Mus musculus
gagaatgcactgctgtaccagggcc

SEQ ID NO: 651355 - DNA, 25 bp, Mus musculus
gagaatgcactggtgtaccagggcc

SEQ ID NO: 651356 - DNA, 25 bp, Mus musculus
gagaatgcagttatagagcagttgc

SEQ ID NO: 651357 - DNA, 25 bp, Mus musculus
gagaatgcagttttagagcagttgc

SEQ ID NO: 651358 - DNA, 25 bp, Mus musculus
gagaatgccagtctgaaggtctcca

SEQ ID NO: 651359 - DNA, 25 bp, Mus musculus
gagaatgccagtgtgaaggtctcca

SEQ ID NO: 651360 - DNA, 25 bp, Mus musculus
gagaatgccggcatgcacacagatg

SEQ ID NO: 651361 - DNA, 25 bp, Mus musculus
gagaatgccggcttgcacacagatg

SEQ ID NO: 651362 - DNA, 25 bp, Mus musculus
gagaatgcgactctctaaaaccctt

SEQ ID NO: 651363 - DNA, 25 bp, Mus musculus
gagaatgcgactgtctaaaaccctt

SEQ ID NO: 651364 - DNA, 25 bp, Mus musculus
gagaatgctaccaggcctgagcatc

SEQ ID NO: 651365 - DNA, 25 bp, Mus musculus
gagaatgctacctggcctgagcatc

SEQ ID NO: 651366 - DNA, 25 bp, Mus musculus
gagaatgctctcctgaccttagcag

SEQ ID NO: 651367 - DNA, 25 bp, Mus musculus
gagaatgctctcgtgaccttagcag

SEQ ID NO: 651368 - DNA, 25 bp, Mus musculus
gagaatgctggaaactataagtccc

SEQ ID NO: 651369 - DNA, 25 bp, Mus musculus
gagaatgctggatactataagtccc

SEQ ID NO: 651370 - DNA, 25 bp, Mus musculus
gagaatgctggcaaccttagagcct

SEQ ID NO: 651371 - DNA, 25 bp, Mus musculus
gagaatgctggctaccttagagcct

SEQ ID NO: 651372 - DNA, 25 bp, Mus musculus
gagaatggagcaacacgtagaggca

SEQ ID NO: 651373 - DNA, 25 bp, Mus musculus
gagaatggagcatcacgtagaggca

SEQ ID NO: 651374 - DNA, 25 bp, Mus musculus
gagaatggattaaggagaacagacc

SEQ ID NO: 651375 - DNA, 25 bp, Mus musculus
gagaatggattatggagaacagacc

SEQ ID NO: 651376 - DNA, 25 bp, Mus musculus
gagaatgggctaataaaaaacacct

SEQ ID NO: 651377 - DNA, 25 bp, Mus musculus
gagaatgggctattaaaaaacacct

SEQ ID NO: 651378 - DNA, 25 bp, Mus musculus
gagaatggtgccagcgtgatcctcc

SEQ ID NO: 651379 - DNA, 25 bp, Mus musculus
gagaatggtgcctgcgtgatcctcc

SEQ ID NO: 651380 - DNA, 25 bp, Mus musculus
gagaatgtattgctcatctgtcacc

SEQ ID NO: 651381 - DNA, 25 bp, Mus musculus
gagaatgtattggtcatctgtcacc

SEQ ID NO: 651382 - DNA, 25 bp, Mus musculus
gagaatgtcaacatggtcctggtcc

SEQ ID NO: 651383 - DNA, 25 bp, Mus musculus
gagaatgtcaacttggtcctggtcc

SEQ ID NO: 651384 - DNA, 25 bp, Mus musculus
gagaatgtcaatcgtgtcaatgacc

SEQ ID NO: 651385 - DNA, 25 bp, Mus musculus
gagaatgtcaatggtgtcaatgacc

SEQ ID NO: 651386 - DNA, 25 bp, Mus musculus
gagaatgtcactagaggagaccaag

SEQ ID NO: 651387 - DNA, 25 bp, Mus musculus
gagaatgtcacttgaggagaccaag

SEQ ID NO: 651388 - DNA, 25 bp, Mus musculus
gagaatgtccaaaaccggcacgagt

SEQ ID NO: 651389 - DNA, 25 bp, Mus musculus
gagaatgtccaataccggcacgagt

SEQ ID NO: 651390 - DNA, 25 bp, Mus musculus
gagaatgtccacagtaaccctgtca

SEQ ID NO: 651391 - DNA, 25 bp, Mus musculus
gagaatgtccactgtaaccctgtca

SEQ ID NO: 651392 - DNA, 25 bp, Mus musculus
gagaatgtctccaagaagtccgcag

SEQ ID NO: 651393 - DNA, 25 bp, Mus musculus
gagaatgtctcctagaagtccgcag

SEQ ID NO: 651394 - DNA, 25 bp, Mus musculus
gagaatgtggcccttcacctgtcca

SEQ ID NO: 651395 - DNA, 25 bp, Mus musculus
gagaatgtggccgttcacctgtcca

SEQ ID NO: 651396 - DNA, 25 bp, Mus musculus
gagaatgtgtggaaactatcaacaa

SEQ ID NO: 651397 - DNA, 25 bp, Mus musculus
gagaatgtgtggtaactatcaacaa

SEQ ID NO: 651398 - DNA, 25 bp, Mus musculus
gagaattaaacgacatcacggaaac

SEQ ID NO: 651399 - DNA, 25 bp, Mus musculus
gagaattaaacgtcatcacggaaac

SEQ ID NO: 651400 - DNA, 25 bp, Mus musculus
gagaattaacaaagtctgggtccct

SEQ ID NO: 651401 - DNA, 25 bp, Mus musculus
gagaattaacaaccggatcctgcag

SEQ ID NO: 651402 - DNA, 25 bp, Mus musculus
gagaattaacaagcggatcctgcag

SEQ ID NO: 651403 - DNA, 25 bp, Mus musculus
gagaattaacaatgtctgggtccct

SEQ ID NO: 651404 - DNA, 25 bp, Mus musculus
gagaattaagatcacagccaccata

SEQ ID NO: 651405 - DNA, 25 bp, Mus musculus
gagaattaagatgacagccaccata

SEQ ID NO: 651406 - DNA, 25 bp, Mus musculus
gagaattcagaacaaccagagggtg

SEQ ID NO: 651407 - DNA, 25 bp, Mus musculus
gagaattcagaagaaccagagggtg

SEQ ID NO: 651408 - DNA, 25 bp, Mus musculus
gagaattcctgtagagtgtgaggcc

SEQ ID NO: 651409 - DNA, 25 bp, Mus musculus
gagaattcctgttgagtgtgaggcc

SEQ ID NO: 651410 - DNA, 25 bp, Mus musculus
gagaattctgcgacctgcccagttg

SEQ ID NO: 651411 - DNA, 25 bp, Mus musculus
gagaattctgcgtcctgcccagttg

SEQ ID NO: 651412 - DNA, 25 bp, Mus musculus
gagaattgatgtcctcagaaagcaa

SEQ ID NO: 651413 - DNA, 25 bp, Mus musculus
gagaattgatgtgctcagaaagcaa

SEQ ID NO: 651414 - DNA, 25 bp, Mus musculus
gagaattgcactctacccaaccaag

SEQ ID NO: 651415 - DNA, 25 bp, Mus musculus
gagaattgcactgtacccaaccaag

SEQ ID NO: 651416 - DNA, 25 bp, Mus musculus
gagaattggattccagataggaacc

SEQ ID NO: 651417 - DNA, 25 bp, Mus musculus
gagaattggattgcagataggaacc

SEQ ID NO: 651418 - DNA, 25 bp, Mus musculus
gagaattggcttctgatgatccaga

SEQ ID NO: 651419 - DNA, 25 bp, Mus musculus
gagaattggcttgtgatgatccaga

SEQ ID NO: 651420 - DNA, 25 bp, Mus musculus
gagaatttcagcaccctgactttct

SEQ ID NO: 651421 - DNA, 25 bp, Mus musculus
gagaatttcagctccctgactttct

SEQ ID NO: 651422 - DNA, 25 bp, Mus musculus
gagaatttgccacgacggaattaca

SEQ ID NO: 651423 - DNA, 25 bp, Mus musculus
gagaatttgccaggacggaattaca

SEQ ID NO: 651424 - DNA, 25 bp, Mus musculus
gagaatttggctcccaacttcctcc

SEQ ID NO: 651425 - DNA, 25 bp, Mus musculus
gagaatttggctgccaacttcctcc

SEQ ID NO: 651426 - DNA, 25 bp, Mus musculus
gagaatttgtcaagtcgatgcagct

SEQ ID NO: 651427 - DNA, 25 bp, Mus musculus
gagaatttgtcatgtcgatgcagct

SEQ ID NO: 651428 - DNA, 25 bp, Mus musculus
gagaatttgtccacaatcagtgccc

SEQ ID NO: 651429 - DNA, 25 bp, Mus musculus
gagaatttgtcctcaatcagtgccc

SEQ ID NO: 651430 - DNA, 25 bp, Mus musculus
gagaatttgtgaagatgagctgatc

SEQ ID NO: 651431 - DNA, 25 bp, Mus musculus
gagaatttgtgatgatgagctgatc

SEQ ID NO: 651432 - DNA, 25 bp, Mus musculus
gagaatttgtgtccacttctaagaa

SEQ ID NO: 651433 - DNA, 25 bp, Mus musculus
gagaatttgtgtgcacttctaagaa

SEQ ID NO: 651434 - DNA, 25 bp, Mus musculus
gagacaaaagaactggagccagaac

SEQ ID NO: 651435 - DNA, 25 bp, Mus musculus
gagacaaaagaagtggagccagaac

SEQ ID NO: 651436 - DNA, 25 bp, Mus musculus
gagacaaacacaagatccacgcgcg

SEQ ID NO: 651437 - DNA, 25 bp, Mus musculus
gagacaaacacatgatccacgcgcg

SEQ ID NO: 651438 - DNA, 25 bp, Mus musculus
gagacaaacattatcaccatttgga

SEQ ID NO: 651439 - DNA, 25 bp, Mus musculus
gagacaaacattttcaccatttgga

SEQ ID NO: 651440 - DNA, 25 bp, Mus musculus
gagacaaactctccccaattcacat

SEQ ID NO: 651441 - DNA, 25 bp, Mus musculus
gagacaaactctgcccaattcacat

SEQ ID NO: 651442 - DNA, 25 bp, Mus musculus
gagacaaagaagaccggtttgggag

SEQ ID NO: 651443 - DNA, 25 bp, Mus musculus
gagacaaagaagtccggtttgggag

SEQ ID NO: 651444 - DNA, 25 bp, Mus musculus
gagacaaagcataatctaactgtga

SEQ ID NO: 651445 - DNA, 25 bp, Mus musculus
gagacaaagcattatctaactgtga

SEQ ID NO: 651446 - DNA, 25 bp, Mus musculus
gagacaaagttcattgacgatgatc

SEQ ID NO: 651447 - DNA, 25 bp, Mus musculus
gagacaaagttctttgacgatgatc

SEQ ID NO: 651448 - DNA, 25 bp, Mus musculus
gagacaaattcccagctgacggaga

SEQ ID NO: 651449 - DNA, 25 bp, Mus musculus
gagacaaattccgagctgacggaga

SEQ ID NO: 651450 - DNA, 25 bp, Mus musculus
gagacaaattcgagctaacagctgc

SEQ ID NO: 651451 - DNA, 25 bp, Mus musculus
gagacaaattcgtgctaacagctgc

SEQ ID NO: 651452 - DNA, 25 bp, Mus musculus
gagacaacaactcctccattatttg

SEQ ID NO: 651453 - DNA, 25 bp, Mus musculus
gagacaacaactgctccattatttg

SEQ ID NO: 651454 - DNA, 25 bp, Mus musculus
gagacaacagctaccggcttctgtt

SEQ ID NO: 651455 - DNA, 25 bp, Mus musculus
gagacaacagcttccggcttctgtt

SEQ ID NO: 651456 - DNA, 25 bp, Mus musculus
gagacaacctgtcaataaaagctgc

SEQ ID NO: 651457 - DNA, 25 bp, Mus musculus
gagacaacctgtgaataaaagctgc

SEQ ID NO: 651458 - DNA, 25 bp, Mus musculus
gagacaacggagaagcattttttgt

SEQ ID NO: 651459 - DNA, 25 bp, Mus musculus
gagacaacggagtagcattttttgt

SEQ ID NO: 651460 - DNA, 25 bp, Mus musculus
gagacaacgtggagtacggctaccg

SEQ ID NO: 651461 - DNA, 25 bp, Mus musculus
gagacaacgtggtgtacggctaccg

SEQ ID NO: 651462 - DNA, 25 bp, Mus musculus
gagacaagacagacctgatgtggga

SEQ ID NO: 651463 - DNA, 25 bp, Mus musculus
gagacaagacagtcctgatgtggga

SEQ ID NO: 651464 - DNA, 25 bp, Mus musculus
gagacaagagagcagctgagaacca

SEQ ID NO: 651465 - DNA, 25 bp, Mus musculus
gagacaagagaggagctgagaacca

SEQ ID NO: 651466 - DNA, 25 bp, Mus musculus
gagacaagcaatatcagtcacccct

SEQ ID NO: 651467 - DNA, 25 bp, Mus musculus
gagacaagcaatttcagtcacccct

SEQ ID NO: 651468 - DNA, 25 bp, Mus musculus
gagacaagccggacaacaacttccg

SEQ ID NO: 651469 - DNA, 25 bp, Mus musculus
gagacaagccggtcaacaacttccg

SEQ ID NO: 651470 - DNA, 25 bp, Mus musculus
gagacaaggccactgtccacttccg

SEQ ID NO: 651471 - DNA, 25 bp, Mus musculus
gagacaaggccagtgtccacttccg

SEQ ID NO: 651472 - DNA, 25 bp, Mus musculus
gagacaaggctgaacacaatcagct

SEQ ID NO: 651473 - DNA, 25 bp, Mus musculus
gagacaaggctgctgtagggaaaga

SEQ ID NO: 651474 - DNA, 25 bp, Mus musculus
gagacaaggctggtgtagggaaaga

SEQ ID NO: 651475 - DNA, 25 bp, Mus musculus
gagacaaggctgtacacaatcagct

SEQ ID NO: 651476 - DNA, 25 bp, Mus musculus
gagacaaggcttctgtatctctagc

SEQ ID NO: 651477 - DNA, 25 bp, Mus musculus
gagacaaggcttgtgtatctctagc

SEQ ID NO: 651478 - DNA, 25 bp, Mus musculus
gagacaagtttcctaaaggctcgag

SEQ ID NO: 651479 - DNA, 25 bp, Mus musculus
gagacaagtttcgtaaaggctcgag

SEQ ID NO: 651480 - DNA, 25 bp, Mus musculus
gagacaatagcaacaagtgcctggg

SEQ ID NO: 651481 - DNA, 25 bp, Mus musculus
gagacaatagcatcaagtgcctggg

SEQ ID NO: 651482 - DNA, 25 bp, Mus musculus
gagacaatatccactgctttgcaga

SEQ ID NO: 651483 - DNA, 25 bp, Mus musculus
gagacaatatcctctgctttgcaga

SEQ ID NO: 651484 - DNA, 25 bp, Mus musculus
gagacaatcaggctcctttctcagc

SEQ ID NO: 651485 - DNA, 25 bp, Mus musculus
gagacaatcagggtcctttctcagc

SEQ ID NO: 651486 - DNA, 25 bp, Mus musculus
gagacaatcgtcaccaagaatgggc

SEQ ID NO: 651487 - DNA, 25 bp, Mus musculus
gagacaatcgtctccaagaatgggc

SEQ ID NO: 651488 - DNA, 25 bp, Mus musculus
gagacaatgactacttcacttgcat

SEQ ID NO: 651489 - DNA, 25 bp, Mus musculus
gagacaatgacttcttcacttgcat

SEQ ID NO: 651490 - DNA, 25 bp, Mus musculus
gagacaatgctcacaacgcagaggc

SEQ ID NO: 651491 - DNA, 25 bp, Mus musculus
gagacaatgctctcaacgcagaggc

SEQ ID NO: 651492 - DNA, 25 bp, Mus musculus
gagacaatggacaagaagttcggct

SEQ ID NO: 651493 - DNA, 25 bp, Mus musculus
gagacaatggactagaagttcggct

SEQ ID NO: 651494 - DNA, 25 bp, Mus musculus
gagacaattggccagtcctctaaat

SEQ ID NO: 651495 - DNA, 25 bp, Mus musculus
gagacaattggcgagtcctctaaat

SEQ ID NO: 651496 - DNA, 25 bp, Mus musculus
gagacacaacatcgttctgaagagg

SEQ ID NO: 651497 - DNA, 25 bp, Mus musculus
gagacacaacatggttctgaagagg

SEQ ID NO: 651498 - DNA, 25 bp, Mus musculus
gagacacaagccattctgagggaaa

SEQ ID NO: 651499 - DNA, 25 bp, Mus musculus
gagacacaagcctttctgagggaaa

SEQ ID NO: 651500 - DNA, 25 bp, Mus musculus
gagacacaaggtccacatctcaggg

SEQ ID NO: 651501 - DNA, 25 bp, Mus musculus
gagacacaaggtgcacatctcaggg

SEQ ID NO: 651502 - DNA, 25 bp, Mus musculus
gagacacagctcaaacctatgcttg

SEQ ID NO: 651503 - DNA, 25 bp, Mus musculus
gagacacagctctaacctatgcttg

SEQ ID NO: 651504 - DNA, 25 bp, Mus musculus
gagacacattcacagatgaccttct

SEQ ID NO: 651505 - DNA, 25 bp, Mus musculus
gagacacattcagagatgaccttct

SEQ ID NO: 651506 - DNA, 25 bp, Mus musculus
gagacacattctactttcagccgag

SEQ ID NO: 651507 - DNA, 25 bp, Mus musculus
gagacacattcttctttcagccgag

SEQ ID NO: 651508 - DNA, 25 bp, Mus musculus
gagacaccaactattctatctgtac

SEQ ID NO: 651509 - DNA, 25 bp, Mus musculus
gagacaccaacttttctatctgtac

SEQ ID NO: 651510 - DNA, 25 bp, Mus musculus
gagacaccaggcacttgtactccct

SEQ ID NO: 651511 - DNA, 25 bp, Mus musculus
gagacaccaggctcttgtactccct

SEQ ID NO: 651512 - DNA, 25 bp, Mus musculus
gagacaccatccagacagaactctg

SEQ ID NO: 651513 - DNA, 25 bp, Mus musculus
gagacaccatcctgacagaactctg

SEQ ID NO: 651514 - DNA, 25 bp, Mus musculus
gagacaccatgtacaatcgagctaa

SEQ ID NO: 651515 - DNA, 25 bp, Mus musculus
gagacaccatgttcaatcgagctaa

SEQ ID NO: 651516 - DNA, 25 bp, Mus musculus
gagacacccaacaggcagctagaat

SEQ ID NO: 651517 - DNA, 25 bp, Mus musculus
gagacacccaactggcagctagaat

SEQ ID NO: 651518 - DNA, 25 bp, Mus musculus
gagacaccgccaaacacacaaatat

SEQ ID NO: 651519 - DNA, 25 bp, Mus musculus
gagacaccgccatacacacaaatat

SEQ ID NO: 651520 - DNA, 25 bp, Mus musculus
gagacacctatgaggaagtgaagca

SEQ ID NO: 651521 - DNA, 25 bp, Mus musculus
gagacacctatgtggaagtgaagca

SEQ ID NO: 651522 - DNA, 25 bp, Mus musculus
gagacacctcatcaagcagagcagt

SEQ ID NO: 651523 - DNA, 25 bp, Mus musculus
gagacacctcatgaagcagagcagt

SEQ ID NO: 651524 - DNA, 25 bp, Mus musculus
gagacacctggacttcctcgacatt

SEQ ID NO: 651525 - DNA, 25 bp, Mus musculus
gagacacctggagttcctcgacatt

SEQ ID NO: 651526 - DNA, 25 bp, Mus musculus
gagacaccttctagggacgtaactg

SEQ ID NO: 651527 - DNA, 25 bp, Mus musculus
gagacaccttctcttactttgcggg

SEQ ID NO: 651528 - DNA, 25 bp, Mus musculus
gagacaccttctgttactttgcggg

SEQ ID NO: 651529 - DNA, 25 bp, Mus musculus
gagacaccttcttgggacgtaactg

SEQ ID NO: 651530 - DNA, 25 bp, Mus musculus
gagacaccttttctggatcgatgca

SEQ ID NO: 651531 - DNA, 25 bp, Mus musculus
gagacaccttttgtggatcgatgca

SEQ ID NO: 651532 - DNA, 25 bp, Mus musculus
gagacacgctgaagccagagatgca

SEQ ID NO: 651533 - DNA, 25 bp, Mus musculus
gagacacgctgatgccagagatgca

SEQ ID NO: 651534 - DNA, 25 bp, Mus musculus
gagacacggccacgcttcctatgat

SEQ ID NO: 651535 - DNA, 25 bp, Mus musculus
gagacacggccaggcttcctatgat

SEQ ID NO: 651536 - DNA, 25 bp, Mus musculus
gagacacggcctccaaaggcgttag

SEQ ID NO: 651537 - DNA, 25 bp, Mus musculus
gagacacggcctgcaaaggcgttag

SEQ ID NO: 651538 - DNA, 25 bp, Mus musculus
gagacacggctcagctttatgaggg

SEQ ID NO: 651539 - DNA, 25 bp, Mus musculus
gagacacggctctgctttatgaggg

SEQ ID NO: 651540 - DNA, 25 bp, Mus musculus
gagacactaaccagaagctacggct

SEQ ID NO: 651541 - DNA, 25 bp, Mus musculus
gagacactaacctgaagctacggct

SEQ ID NO: 651542 - DNA, 25 bp, Mus musculus
gagacactaagaccaaaaccaagag

SEQ ID NO: 651543 - DNA, 25 bp, Mus musculus
gagacactaagagcaaaaccaagag

SEQ ID NO: 651544 - DNA, 25 bp, Mus musculus
gagacactaaggatgtctgtagaca

SEQ ID NO: 651545 - DNA, 25 bp, Mus musculus
gagacactaaggttgtctgtagaca

SEQ ID NO: 651546 - DNA, 25 bp, Mus musculus
gagacactcatcaagaacttccata

SEQ ID NO: 651547 - DNA, 25 bp, Mus musculus
gagacactcatctagaacttccata

SEQ ID NO: 651548 - DNA, 25 bp, Mus musculus
gagacactgaacaaacgcttccgag

SEQ ID NO: 651549 - DNA, 25 bp, Mus musculus
gagacactgaactaacgcttccgag

SEQ ID NO: 651550 - DNA, 25 bp, Mus musculus
gagacactgcaccttcaggagcgct

SEQ ID NO: 651551 - DNA, 25 bp, Mus musculus
gagacactgcacgttcaggagcgct

SEQ ID NO: 651552 - DNA, 25 bp, Mus musculus
gagacactgcagaatcatggcatta

SEQ ID NO: 651553 - DNA, 25 bp, Mus musculus
gagacactgcagtatcatggcatta

SEQ ID NO: 651554 - DNA, 25 bp, Mus musculus
gagacactgctacgcagccttctgg

SEQ ID NO: 651555 - DNA, 25 bp, Mus musculus
gagacactgctaggcagccttctgg

SEQ ID NO: 651556 - DNA, 25 bp, Mus musculus
gagacactggagaaagatgcactta

SEQ ID NO: 651557 - DNA, 25 bp, Mus musculus
gagacactggagtaagatgcactta

SEQ ID NO: 651558 - DNA, 25 bp, Mus musculus
gagacactgtctccatcgacctggt

SEQ ID NO: 651559 - DNA, 25 bp, Mus musculus
gagacactgtctgcatcgacctggt

SEQ ID NO: 651560 - DNA, 25 bp, Mus musculus
gagacactgtttcagcgtctacaga

SEQ ID NO: 651561 - DNA, 25 bp, Mus musculus
gagacactgtttgagcgtctacaga

SEQ ID NO: 651562 - DNA, 25 bp, Mus musculus
gagacacttcgcagttcctcagaga

SEQ ID NO: 651563 - DNA, 25 bp, Mus musculus
gagacacttcgctgttcctcagaga

SEQ ID NO: 651564 - DNA, 25 bp, Mus musculus
gagacactttgccacatctgataca

SEQ ID NO: 651565 - DNA, 25 bp, Mus musculus
gagacactttgcgacatctgataca

SEQ ID NO: 651566 - DNA, 25 bp, Mus musculus
gagacagaaacgaaccaggagaagg

SEQ ID NO: 651567 - DNA, 25 bp, Mus musculus
gagacagaaacgtaccaggagaagg

SEQ ID NO: 651568 - DNA, 25 bp, Mus musculus
gagacagaacccaaacaagtacatc

SEQ ID NO: 651569 - DNA, 25 bp, Mus musculus
gagacagaaccctaacaagtacatc

SEQ ID NO: 651570 - DNA, 25 bp, Mus musculus
gagacagaagcacggttcacttccg

SEQ ID NO: 651571 - DNA, 25 bp, Mus musculus
gagacagaagcagggttcacttccg

SEQ ID NO: 651572 - DNA, 25 bp, Mus musculus
gagacagaagtcaggaccaggctga

SEQ ID NO: 651573 - DNA, 25 bp, Mus musculus
gagacagaagtctggaccaggctga

SEQ ID NO: 651574 - DNA, 25 bp, Mus musculus
gagacagacagaaggctttaagaat

SEQ ID NO: 651575 - DNA, 25 bp, Mus musculus
gagacagacagatggctttaagaat

SEQ ID NO: 651576 - DNA, 25 bp, Mus musculus
gagacagacatgatacaaggaggtg

SEQ ID NO: 651577 - DNA, 25 bp, Mus musculus
gagacagacatgttacaaggaggtg

SEQ ID NO: 651578 - DNA, 25 bp, Mus musculus
gagacagacctaattacaagaatcg

SEQ ID NO: 651579 - DNA, 25 bp, Mus musculus
gagacagacctatttacaagaatcg

SEQ ID NO: 651580 - DNA, 25 bp, Mus musculus
gagacagacgccagctcacagggca

SEQ ID NO: 651581 - DNA, 25 bp, Mus musculus
gagacagacgcctgctcacagggca

SEQ ID NO: 651582 - DNA, 25 bp, Mus musculus
gagacagactacaacggctttcctg

SEQ ID NO: 651583 - DNA, 25 bp, Mus musculus
gagacagactactacggctttcctg

SEQ ID NO: 651584 - DNA, 25 bp, Mus musculus
gagacagactggaagcttcggctcc

SEQ ID NO: 651585 - DNA, 25 bp, Mus musculus
gagacagactggtagcttcggctcc

SEQ ID NO: 651586 - DNA, 25 bp, Mus musculus
gagacagacttactgcagaactcag

SEQ ID NO: 651587 - DNA, 25 bp, Mus musculus
gagacagacttagtgcagaactcag

SEQ ID NO: 651588 - DNA, 25 bp, Mus musculus
gagacagagaacctctgactccatc

SEQ ID NO: 651589 - DNA, 25 bp, Mus musculus
gagacagagaacgtctgactccatc

SEQ ID NO: 651590 - DNA, 25 bp, Mus musculus
gagacagagatccagttctacagaa

SEQ ID NO: 651591 - DNA, 25 bp, Mus musculus
gagacagagatcgagttctacagaa

SEQ ID NO: 651592 - DNA, 25 bp, Mus musculus
gagacagagtaaaagctggagactc

SEQ ID NO: 651593 - DNA, 25 bp, Mus musculus
gagacagagtaatagctggagactc

SEQ ID NO: 651594 - DNA, 25 bp, Mus musculus
gagacagagtccaaaagttcacatc

SEQ ID NO: 651595 - DNA, 25 bp, Mus musculus
gagacagagtccctggacacctctg

SEQ ID NO: 651596 - DNA, 25 bp, Mus musculus
gagacagagtccgtggacacctctg

SEQ ID NO: 651597 - DNA, 25 bp, Mus musculus
gagacagagtcctaaagttcacatc

SEQ ID NO: 651598 - DNA, 25 bp, Mus musculus
gagacagataacagacctggaagtc

SEQ ID NO: 651599 - DNA, 25 bp, Mus musculus
gagacagataactgacctggaagtc

SEQ ID NO: 651600 - DNA, 25 bp, Mus musculus
gagacagatcccagcccttactgta

SEQ ID NO: 651601 - DNA, 25 bp, Mus musculus
gagacagatccctgcccttactgta

SEQ ID NO: 651602 - DNA, 25 bp, Mus musculus
gagacagcaattctgtgaccaggat

SEQ ID NO: 651603 - DNA, 25 bp, Mus musculus
gagacagcaattgtgtgaccaggat

SEQ ID NO: 651604 - DNA, 25 bp, Mus musculus
gagacagcagcgagaaaaaacaaga

SEQ ID NO: 651605 - DNA, 25 bp, Mus musculus
gagacagcagcgtgaaaaaacaaga

SEQ ID NO: 651606 - DNA, 25 bp, Mus musculus
gagacagcagttcaacattcatgga

SEQ ID NO: 651607 - DNA, 25 bp, Mus musculus
gagacagcagttgaacattcatgga

SEQ ID NO: 651608 - DNA, 25 bp, Mus musculus
gagacagcatagaagtgaaggatga

SEQ ID NO: 651609 - DNA, 25 bp, Mus musculus
gagacagcatagtagtgaaggatga

SEQ ID NO: 651610 - DNA, 25 bp, Mus musculus
gagacagccaagctcccagtgcttg

SEQ ID NO: 651611 - DNA, 25 bp, Mus musculus
gagacagccaaggtcccagtgcttg

SEQ ID NO: 651612 - DNA, 25 bp, Mus musculus
gagacagccaccctgtcagacatca

SEQ ID NO: 651613 - DNA, 25 bp, Mus musculus
gagacagccaccgtgtcagacatca

SEQ ID NO: 651614 - DNA, 25 bp, Mus musculus
gagacagccatgatcataaactatg

SEQ ID NO: 651615 - DNA, 25 bp, Mus musculus
gagacagccatgttcataaactatg

SEQ ID NO: 651616 - DNA, 25 bp, Mus musculus
gagacagctcaacaagttgtgagac

SEQ ID NO: 651617 - DNA, 25 bp, Mus musculus
gagacagctcaagaagttgtgagac

SEQ ID NO: 651618 - DNA, 25 bp, Mus musculus
gagacagctgtcatttatccgactg

SEQ ID NO: 651619 - DNA, 25 bp, Mus musculus
gagacagctgtcttttatccgactg

SEQ ID NO: 651620 - DNA, 25 bp, Mus musculus
gagacagctgtgacgacattgagga

SEQ ID NO: 651621 - DNA, 25 bp, Mus musculus
gagacagctgtgtcgacattgagga

SEQ ID NO: 651622 - DNA, 25 bp, Mus musculus
gagacaggacccacgggtgttgttt

SEQ ID NO: 651623 - DNA, 25 bp, Mus musculus
gagacaggaccctcgggtgttgttt

SEQ ID NO: 651624 - DNA, 25 bp, Mus musculus
gagacaggagaacacagccaattgg

SEQ ID NO: 651625 - DNA, 25 bp, Mus musculus
gagacaggagaagacagccaattgg

SEQ ID NO: 651626 - DNA, 25 bp, Mus musculus
gagacaggagttccccacacatggc

SEQ ID NO: 651627 - DNA, 25 bp, Mus musculus
gagacaggagttgcccacacatggc

SEQ ID NO: 651628 - DNA, 25 bp, Mus musculus
gagacaggcagcctaacagccttgg

SEQ ID NO: 651629 - DNA, 25 bp, Mus musculus
gagacaggcagcgtaacagccttgg

SEQ ID NO: 651630 - DNA, 25 bp, Mus musculus
gagacaggccatatgtatgtgcacc

SEQ ID NO: 651631 - DNA, 25 bp, Mus musculus
gagacaggccatttgtatgtgcacc

SEQ ID NO: 651632 - DNA, 25 bp, Mus musculus
gagacaggcgcacgatcagataaag

SEQ ID NO: 651633 - DNA, 25 bp, Mus musculus
gagacaggcgcaggatcagataaag

SEQ ID NO: 651634 - DNA, 25 bp, Mus musculus
gagacaggcgtcctacctcctttat

SEQ ID NO: 651635 - DNA, 25 bp, Mus musculus
gagacaggcgtcgtacctcctttat

SEQ ID NO: 651636 - DNA, 25 bp, Mus musculus
gagacagggcagctgcactccatgt

SEQ ID NO: 651637 - DNA, 25 bp, Mus musculus
gagacagggcaggtgcactccatgt

SEQ ID NO: 651638 - DNA, 25 bp, Mus musculus
gagacaggtccccattctgaggtga

SEQ ID NO: 651639 - DNA, 25 bp, Mus musculus
gagacaggtcccgattctgaggtga

SEQ ID NO: 651640 - DNA, 25 bp, Mus musculus
gagacaggtgctacctcagatgtcg

SEQ ID NO: 651641 - DNA, 25 bp, Mus musculus
gagacaggtgcttcctcagatgtcg

SEQ ID NO: 651642 - DNA, 25 bp, Mus musculus
gagacaggtggaaccctagagccta

SEQ ID NO: 651643 - DNA, 25 bp, Mus musculus
gagacaggtggatccctagagccta

SEQ ID NO: 651644 - DNA, 25 bp, Mus musculus
gagacagtatgtctaacaagcactg

SEQ ID NO: 651645 - DNA, 25 bp, Mus musculus
gagacagtatgtgtaacaagcactg

SEQ ID NO: 651646 - DNA, 25 bp, Mus musculus
gagacagtattacccatagactcca

SEQ ID NO: 651647 - DNA, 25 bp, Mus musculus
gagacagtattagccatagactcca

SEQ ID NO: 651648 - DNA, 25 bp, Mus musculus
gagacagtccagaactggattgagt

SEQ ID NO: 651649 - DNA, 25 bp, Mus musculus
gagacagtccagtactggattgagt

SEQ ID NO: 651650 - DNA, 25 bp, Mus musculus
gagacagtgatactttgctattata

SEQ ID NO: 651651 - DNA, 25 bp, Mus musculus
gagacagtgatagtttgctattata

SEQ ID NO: 651652 - DNA, 25 bp, Mus musculus
gagacagtgcacaacaagcatttcg

SEQ ID NO: 651653 - DNA, 25 bp, Mus musculus
gagacagtgcactacaagcatttcg

SEQ ID NO: 651654 - DNA, 25 bp, Mus musculus
gagacagtgtatcgaaataattgag

SEQ ID NO: 651655 - DNA, 25 bp, Mus musculus
gagacagtgtatggaaataattgag

SEQ ID NO: 651656 - DNA, 25 bp, Mus musculus
gagacagttcctctaaagacatcct

SEQ ID NO: 651657 - DNA, 25 bp, Mus musculus
gagacagttcctgtaaagacatcct

SEQ ID NO: 651658 - DNA, 25 bp, Mus musculus
gagacagttgatacccaagtctgct

SEQ ID NO: 651659 - DNA, 25 bp, Mus musculus
gagacagttgattcccaagtctgct

SEQ ID NO: 651660 - DNA, 25 bp, Mus musculus
gagacagtttaactacaaccaactt

SEQ ID NO: 651661 - DNA, 25 bp, Mus musculus
gagacagtttaagtacaaccaactt

SEQ ID NO: 651662 - DNA, 25 bp, Mus musculus
gagacagtttgtcctcacgctgagc

SEQ ID NO: 651663 - DNA, 25 bp, Mus musculus
gagacagtttgtgctcacgctgagc

SEQ ID NO: 651664 - DNA, 25 bp, Mus musculus
gagacatacacactgttttacacag

SEQ ID NO: 651665 - DNA, 25 bp, Mus musculus
gagacatacacagtgttttacacag

SEQ ID NO: 651666 - DNA, 25 bp, Mus musculus
gagacatactcgagggttcttccca

SEQ ID NO: 651667 - DNA, 25 bp, Mus musculus
gagacatactcgtgggttcttccca

SEQ ID NO: 651668 - DNA, 25 bp, Mus musculus
gagacatccccgagaatcccttgtg

SEQ ID NO: 651669 - DNA, 25 bp, Mus musculus
gagacatccccgtgaatcccttgtg

SEQ ID NO: 651670 - DNA, 25 bp, Mus musculus
gagacatccgtaaagcgctggatgt

SEQ ID NO: 651671 - DNA, 25 bp, Mus musculus
gagacatccgtatagcgctggatgt

SEQ ID NO: 651672 - DNA, 25 bp, Mus musculus
gagacatctgctctagattctacaa

SEQ ID NO: 651673 - DNA, 25 bp, Mus musculus
gagacatctgctgtagattctacaa

SEQ ID NO: 651674 - DNA, 25 bp, Mus musculus
gagacatgaatgcactcagccctac

SEQ ID NO: 651675 - DNA, 25 bp, Mus musculus
gagacatgaatggactcagccctac

SEQ ID NO: 651676 - DNA, 25 bp, Mus musculus
gagacatgactaacgggcagctaca

SEQ ID NO: 651677 - DNA, 25 bp, Mus musculus
gagacatgactatcgggcagctaca

SEQ ID NO: 651678 - DNA, 25 bp, Mus musculus
gagacatgatcaaacaccttccatc

SEQ ID NO: 651679 - DNA, 25 bp, Mus musculus
gagacatgatcatacaccttccatc

SEQ ID NO: 651680 - DNA, 25 bp, Mus musculus
gagacatgatcgcagcttgctggac

SEQ ID NO: 651681 - DNA, 25 bp, Mus musculus
gagacatgatcggagcttgctggac

SEQ ID NO: 651682 - DNA, 25 bp, Mus musculus
gagacatgcctcatagcagccgcta

SEQ ID NO: 651683 - DNA, 25 bp, Mus musculus
gagacatgcctcttagcagccgcta

SEQ ID NO: 651684 - DNA, 25 bp, Mus musculus
gagacatgggcgagctcgcacttga

SEQ ID NO: 651685 - DNA, 25 bp, Mus musculus
gagacatgggcgtgctcgcacttga

SEQ ID NO: 651686 - DNA, 25 bp, Mus musculus
gagacattagtgatctcacattgag

SEQ ID NO: 651687 - DNA, 25 bp, Mus musculus
gagacattagtgttctcacattgag

SEQ ID NO: 651688 - DNA, 25 bp, Mus musculus
gagacattcatcatatcgactacta

SEQ ID NO: 651689 - DNA, 25 bp, Mus musculus
gagacattcatcttatcgactacta

SEQ ID NO: 651690 - DNA, 25 bp, Mus musculus
gagacattcccaattgtagatgacc

SEQ ID NO: 651691 - DNA, 25 bp, Mus musculus
gagacattcccatttgtagatgacc

SEQ ID NO: 651692 - DNA, 25 bp, Mus musculus
gagacattccggaatgccaagatgg

SEQ ID NO: 651693 - DNA, 25 bp, Mus musculus
gagacattccggtatgccaagatgg

SEQ ID NO: 651694 - DNA, 25 bp, Mus musculus
gagacattcctacacagcttcatac

SEQ ID NO: 651695 - DNA, 25 bp, Mus musculus
gagacattcctagacagcttcatac

SEQ ID NO: 651696 - DNA, 25 bp, Mus musculus
gagacattgccaccggcatcagcag

SEQ ID NO: 651697 - DNA, 25 bp, Mus musculus
gagacattgccagcggcatcagcag

SEQ ID NO: 651698 - DNA, 25 bp, Mus musculus
gagacattggaacatccttggttca

SEQ ID NO: 651699 - DNA, 25 bp, Mus musculus
gagacattggaagatccttggttca

SEQ ID NO: 651700 - DNA, 25 bp, Mus musculus
gagacattgtacatagctcccgtgt

SEQ ID NO: 651701 - DNA, 25 bp, Mus musculus
gagacattgtacttagctcccgtgt

SEQ ID NO: 651702 - DNA, 25 bp, Mus musculus
gagacattgtcaccgtggtgtcacc

SEQ ID NO: 651703 - DNA, 25 bp, Mus musculus
gagacattgtcagcgtggtgtcacc

SEQ ID NO: 651704 - DNA, 25 bp, Mus musculus
gagacatttccgaaaacacactggg

SEQ ID NO: 651705 - DNA, 25 bp, Mus musculus
gagacatttccgtaaacacactggg

SEQ ID NO: 651706 - DNA, 25 bp, Mus musculus
gagaccaaacctcacaaggctgtat

SEQ ID NO: 651707 - DNA, 25 bp, Mus musculus
gagaccaaacctctgataacctgtc

SEQ ID NO: 651708 - DNA, 25 bp, Mus musculus
gagaccaaacctgacaaggctgtat

SEQ ID NO: 651709 - DNA, 25 bp, Mus musculus
gagaccaaacctgtgataacctgtc

SEQ ID NO: 651710 - DNA, 25 bp, Mus musculus
gagaccaaagaaccgttagtgcagg

SEQ ID NO: 651711 - DNA, 25 bp, Mus musculus
gagaccaaagaagcgttagtgcagg

SEQ ID NO: 651712 - DNA, 25 bp, Mus musculus
gagaccaacaggatcattgcctccc

SEQ ID NO: 651713 - DNA, 25 bp, Mus musculus
gagaccaacaggttcattgcctccc

SEQ ID NO: 651714 - DNA, 25 bp, Mus musculus
gagaccaaccggaacacagctctca

SEQ ID NO: 651715 - DNA, 25 bp, Mus musculus
gagaccaaccggtacacagctctca

SEQ ID NO: 651716 - DNA, 25 bp, Mus musculus
gagaccaactaacaagttagacttg

SEQ ID NO: 651717 - DNA, 25 bp, Mus musculus
gagaccaactaagaagttagacttg

SEQ ID NO: 651718 - DNA, 25 bp, Mus musculus
gagaccaactacctcttcatgggag

SEQ ID NO: 651719 - DNA, 25 bp, Mus musculus
gagaccaactacgtcttcatgggag

SEQ ID NO: 651720 - DNA, 25 bp, Mus musculus
gagaccaactatcgcataccacagc

SEQ ID NO: 651721 - DNA, 25 bp, Mus musculus
gagaccaactatggcataccacagc

SEQ ID NO: 651722 - DNA, 25 bp, Mus musculus
gagaccaacttaatgcagacctgaa

SEQ ID NO: 651723 - DNA, 25 bp, Mus musculus
gagaccaacttacaacagcttaggg

SEQ ID NO: 651724 - DNA, 25 bp, Mus musculus
gagaccaacttagaacagcttaggg

SEQ ID NO: 651725 - DNA, 25 bp, Mus musculus
gagaccaacttattgcagacctgaa

SEQ ID NO: 651726 - DNA, 25 bp, Mus musculus
gagaccaagacccacatccaggagt

SEQ ID NO: 651727 - DNA, 25 bp, Mus musculus
gagaccaagaccgacatccaggagt

SEQ ID NO: 651728 - DNA, 25 bp, Mus musculus
gagaccaagctaccccagctacaga

SEQ ID NO: 651729 - DNA, 25 bp, Mus musculus
gagaccaagctagcccagctacaga

SEQ ID NO: 651730 - DNA, 25 bp, Mus musculus
gagaccaaggttctacagattcgct

SEQ ID NO: 651731 - DNA, 25 bp, Mus musculus
gagaccaaggttgtacagattcgct

SEQ ID NO: 651732 - DNA, 25 bp, Mus musculus
gagaccaagtgcaacaattccaaac

SEQ ID NO: 651733 - DNA, 25 bp, Mus musculus
gagaccaagtgctacaattccaaac

SEQ ID NO: 651734 - DNA, 25 bp, Mus musculus
gagaccaatgtcatgggattcaggg

SEQ ID NO: 651735 - DNA, 25 bp, Mus musculus
gagaccaatgtcttgggattcaggg

SEQ ID NO: 651736 - DNA, 25 bp, Mus musculus
gagaccacacgaaaggagatagtca

SEQ ID NO: 651737 - DNA, 25 bp, Mus musculus
gagaccacacgataggagatagtca

SEQ ID NO: 651738 - DNA, 25 bp, Mus musculus
gagaccacagcccataggacagaag

SEQ ID NO: 651739 - DNA, 25 bp, Mus musculus
gagaccacagccgataggacagaag

SEQ ID NO: 651740 - DNA, 25 bp, Mus musculus
gagaccacagctcagcgactccgat

SEQ ID NO: 651741 - DNA, 25 bp, Mus musculus
gagaccacagctgagcgactccgat

SEQ ID NO: 651742 - DNA, 25 bp, Mus musculus
gagaccacagtgacccatcaagaag

SEQ ID NO: 651743 - DNA, 25 bp, Mus musculus
gagaccacagtgtcccatcaagaag

SEQ ID NO: 651744 - DNA, 25 bp, Mus musculus
gagaccaccatgagccgagccatct

SEQ ID NO: 651745 - DNA, 25 bp, Mus musculus
gagaccaccatgtgccgagccatct

SEQ ID NO: 651746 - DNA, 25 bp, Mus musculus
gagaccaccccgaggagctgttggc

SEQ ID NO: 651747 - DNA, 25 bp, Mus musculus
gagaccaccccgtggagctgttggc

SEQ ID NO: 651748 - DNA, 25 bp, Mus musculus
gagaccacccgtcttgtttgctatg

SEQ ID NO: 651749 - DNA, 25 bp, Mus musculus
gagaccacccgtgttgtttgctatg

SEQ ID NO: 651750 - DNA, 25 bp, Mus musculus
gagaccaccgagcagtcagtcaagg

SEQ ID NO: 651751 - DNA, 25 bp, Mus musculus
gagaccaccgaggagtcagtcaagg

SEQ ID NO: 651752 - DNA, 25 bp, Mus musculus
gagaccacctatctcttaatactag

SEQ ID NO: 651753 - DNA, 25 bp, Mus musculus
gagaccacctatgtcttaatactag

SEQ ID NO: 651754 - DNA, 25 bp, Mus musculus
gagaccacgttaagaaaccccagag

SEQ ID NO: 651755 - DNA, 25 bp, Mus musculus
gagaccacgttatgaaaccccagag

SEQ ID NO: 651756 - DNA, 25 bp, Mus musculus
gagaccactgcgaaatctatccctg

SEQ ID NO: 651757 - DNA, 25 bp, Mus musculus
gagaccactgcgtaatctatccctg

SEQ ID NO: 651758 - DNA, 25 bp, Mus musculus
gagaccactgttcaagtaccacaaa

SEQ ID NO: 651759 - DNA, 25 bp, Mus musculus
gagaccactgttgaagtaccacaaa

SEQ ID NO: 651760 - DNA, 25 bp, Mus musculus
gagaccactttactgtgattggcca

SEQ ID NO: 651761 - DNA, 25 bp, Mus musculus
gagaccactttagtgtgattggcca

SEQ ID NO: 651762 - DNA, 25 bp, Mus musculus
gagaccacttttcaggacagggaca

SEQ ID NO: 651763 - DNA, 25 bp, Mus musculus
gagaccacttttgaggacagggaca

SEQ ID NO: 651764 - DNA, 25 bp, Mus musculus
gagaccagcgctcggtccagctcag

SEQ ID NO: 651765 - DNA, 25 bp, Mus musculus
gagaccagcgctgggtccagctcag

SEQ ID NO: 651766 - DNA, 25 bp, Mus musculus
gagaccagctgccatatctattgaa

SEQ ID NO: 651767 - DNA, 25 bp, Mus musculus
gagaccagctgcgatatctattgaa

SEQ ID NO: 651768 - DNA, 25 bp, Mus musculus
gagaccagcttcctcacaggttcca

SEQ ID NO: 651769 - DNA, 25 bp, Mus musculus
gagaccagcttcgtcacaggttcca

SEQ ID NO: 651770 - DNA, 25 bp, Mus musculus
gagaccaggtcaaagctgcaggaga

SEQ ID NO: 651771 - DNA, 25 bp, Mus musculus
gagaccaggtcatagctgcaggaga

SEQ ID NO: 651772 - DNA, 25 bp, Mus musculus
gagaccatactgattcacttcatgt

SEQ ID NO: 651773 - DNA, 25 bp, Mus musculus
gagaccatactgtttcacttcatgt

SEQ ID NO: 651774 - DNA, 25 bp, Mus musculus
gagaccatcaagaagcggctggaga

SEQ ID NO: 651775 - DNA, 25 bp, Mus musculus
gagaccatcaagtagcggctggaga

SEQ ID NO: 651776 - DNA, 25 bp, Mus musculus
gagaccatcataagcgccttcaatg

SEQ ID NO: 651777 - DNA, 25 bp, Mus musculus
gagaccatcatatgcgccttcaatg

SEQ ID NO: 651778 - DNA, 25 bp, Mus musculus
gagaccatcgaccagctacatttgg

SEQ ID NO: 651779 - DNA, 25 bp, Mus musculus
gagaccatcgacgagctacatttgg

SEQ ID NO: 651780 - DNA, 25 bp, Mus musculus
gagaccatgaagaccgtaaacagat

SEQ ID NO: 651781 - DNA, 25 bp, Mus musculus
gagaccatgaagtccgtaaacagat

SEQ ID NO: 651782 - DNA, 25 bp, Mus musculus
gagaccatgacacctatgctaacac

SEQ ID NO: 651783 - DNA, 25 bp, Mus musculus
gagaccatgacagctatgctaacac

SEQ ID NO: 651784 - DNA, 25 bp, Mus musculus
gagaccatgacccacgtgttggcag

SEQ ID NO: 651785 - DNA, 25 bp, Mus musculus
gagaccatgaccgacgtgttggcag

SEQ ID NO: 651786 - DNA, 25 bp, Mus musculus
gagaccatgactctttaccaggtcc

SEQ ID NO: 651787 - DNA, 25 bp, Mus musculus
gagaccatgactgtttaccaggtcc

SEQ ID NO: 651788 - DNA, 25 bp, Mus musculus
gagaccatgatcagaatgaagaaaa

SEQ ID NO: 651789 - DNA, 25 bp, Mus musculus
gagaccatgatctgaatgaagaaaa

SEQ ID NO: 651790 - DNA, 25 bp, Mus musculus
gagaccatgggcaatgccacagcca

SEQ ID NO: 651791 - DNA, 25 bp, Mus musculus
gagaccatgggctatgccacagcca

SEQ ID NO: 651792 - DNA, 25 bp, Mus musculus
gagaccatgtttcaaaatagaatcc

SEQ ID NO: 651793 - DNA, 25 bp, Mus musculus
gagaccatgtttgaaaatagaatcc

SEQ ID NO: 651794 - DNA, 25 bp, Mus musculus
gagaccattaaacgattccagcaga

SEQ ID NO: 651795 - DNA, 25 bp, Mus musculus
gagaccattaaaggattccagcaga

SEQ ID NO: 651796 - DNA, 25 bp, Mus musculus
gagaccattgtcaagccagactatc

SEQ ID NO: 651797 - DNA, 25 bp, Mus musculus
gagaccattgtctagccagactatc

SEQ ID NO: 651798 - DNA, 25 bp, Mus musculus
gagaccattgtgaggaaggcattca

SEQ ID NO: 651799 - DNA, 25 bp, Mus musculus
gagaccattgtgtggaaggcattca

SEQ ID NO: 651800 - DNA, 25 bp, Mus musculus
gagacccaaaacactttgcaggctg

SEQ ID NO: 651801 - DNA, 25 bp, Mus musculus
gagacccaaaactctttgcaggctg

SEQ ID NO: 651802 - DNA, 25 bp, Mus musculus
gagacccaaaagagaatgtactagg

SEQ ID NO: 651803 - DNA, 25 bp, Mus musculus
gagacccaaaagtgaatgtactagg

SEQ ID NO: 651804 - DNA, 25 bp, Mus musculus
gagacccacaagactgatccaccaa

SEQ ID NO: 651805 - DNA, 25 bp, Mus musculus
gagacccacaagtctgatccaccaa

SEQ ID NO: 651806 - DNA, 25 bp, Mus musculus
gagacccacagcaactatgcagacg

SEQ ID NO: 651807 - DNA, 25 bp, Mus musculus
gagacccacagctactatgcagacg

SEQ ID NO: 651808 - DNA, 25 bp, Mus musculus
gagacccacattcaagcagttggtc

SEQ ID NO: 651809 - DNA, 25 bp, Mus musculus
gagacccacattgaagcagttggtc

SEQ ID NO: 651810 - DNA, 25 bp, Mus musculus
gagacccactgcactgccttatgag

SEQ ID NO: 651811 - DNA, 25 bp, Mus musculus
gagacccactgctctgccttatgag

SEQ ID NO: 651812 - DNA, 25 bp, Mus musculus
gagacccagcaactgacaaaaatgg

SEQ ID NO: 651813 - DNA, 25 bp, Mus musculus
gagacccagcaagtgacaaaaatgg

SEQ ID NO: 651814 - DNA, 25 bp, Mus musculus
gagacccagcggcagattctgtcac

SEQ ID NO: 651815 - DNA, 25 bp, Mus musculus
gagacccagcgggagattctgtcac

SEQ ID NO: 651816 - DNA, 25 bp, Mus musculus
gagacccaggcaagccaggagcacc

SEQ ID NO: 651817 - DNA, 25 bp, Mus musculus
gagacccaggcatgccaggagcacc

SEQ ID NO: 651818 - DNA, 25 bp, Mus musculus
gagacccaggtcagcatcttggaca

SEQ ID NO: 651819 - DNA, 25 bp, Mus musculus
gagacccaggtctgcatcttggaca

SEQ ID NO: 651820 - DNA, 25 bp, Mus musculus
gagacccagtttcattgggagaagc

SEQ ID NO: 651821 - DNA, 25 bp, Mus musculus
gagacccagtttgattgggagaagc

SEQ ID NO: 651822 - DNA, 25 bp, Mus musculus
gagacccatcacctggtggaagcca

SEQ ID NO: 651823 - DNA, 25 bp, Mus musculus
gagacccatcacgtggtggaagcca

SEQ ID NO: 651824 - DNA, 25 bp, Mus musculus
gagaccccaaagagcctcccatgaa

SEQ ID NO: 651825 - DNA, 25 bp, Mus musculus
gagaccccaaagtgcctcccatgaa

SEQ ID NO: 651826 - DNA, 25 bp, Mus musculus
gagaccccacaacagacatacaaga

SEQ ID NO: 651827 - DNA, 25 bp, Mus musculus
gagaccccacaagagacatacaaga

SEQ ID NO: 651828 - DNA, 25 bp, Mus musculus
gagaccccagataattaaggacgtc

SEQ ID NO: 651829 - DNA, 25 bp, Mus musculus
gagaccccagattattaaggacgtc

SEQ ID NO: 651830 - DNA, 25 bp, Mus musculus
gagaccccagccagtgtcgtgtcac

SEQ ID NO: 651831 - DNA, 25 bp, Mus musculus
gagaccccagcctgtgtcgtgtcac

SEQ ID NO: 651832 - DNA, 25 bp, Mus musculus
gagaccccaggacctccattttaga

SEQ ID NO: 651833 - DNA, 25 bp, Mus musculus
gagaccccaggagctccattttaga

SEQ ID NO: 651834 - DNA, 25 bp, Mus musculus
gagaccccagttactggcgacagca

SEQ ID NO: 651835 - DNA, 25 bp, Mus musculus
gagaccccagtttctggcgacagca

SEQ ID NO: 651836 - DNA, 25 bp, Mus musculus
gagaccccatagatcgggaccacct

SEQ ID NO: 651837 - DNA, 25 bp, Mus musculus
gagaccccatagttcgggaccacct

SEQ ID NO: 651838 - DNA, 25 bp, Mus musculus
gagaccccatcgaggcgcgatcatg

SEQ ID NO: 651839 - DNA, 25 bp, Mus musculus
gagaccccatcgtggcgcgatcatg

SEQ ID NO: 651840 - DNA, 25 bp, Mus musculus
gagaccccatggagacatcacctgt

SEQ ID NO: 651841 - DNA, 25 bp, Mus musculus
gagaccccatggtgacatcacctgt

SEQ ID NO: 651842 - DNA, 25 bp, Mus musculus
gagaccccgacacaccgattctgat

SEQ ID NO: 651843 - DNA, 25 bp, Mus musculus
gagaccccgacagaccgattctgat

SEQ ID NO: 651844 - DNA, 25 bp, Mus musculus
gagacccgaacacccattgtgcgag

SEQ ID NO: 651845 - DNA, 25 bp, Mus musculus
gagacccgaacagccattgtgcgag

SEQ ID NO: 651846 - DNA, 25 bp, Mus musculus
gagacccgcttgcatgtcactggta

SEQ ID NO: 651847 - DNA, 25 bp, Mus musculus
gagacccgcttggatgtcactggta

SEQ ID NO: 651848 - DNA, 25 bp, Mus musculus
gagacccggatcagtgaagtgcgtc

SEQ ID NO: 651849 - DNA, 25 bp, Mus musculus
gagacccggatctgtgaagtgcgtc

SEQ ID NO: 651850 - DNA, 25 bp, Mus musculus
gagacccggctgcagatggacaaat

SEQ ID NO: 651851 - DNA, 25 bp, Mus musculus
gagacccggctggagatggacaaat

SEQ ID NO: 651852 - DNA, 25 bp, Mus musculus
gagacccggcttaggtcttcaaaga

SEQ ID NO: 651853 - DNA, 25 bp, Mus musculus
gagacccggctttggtcttcaaaga

SEQ ID NO: 651854 - DNA, 25 bp, Mus musculus
gagaccctcagtacgctgcgctatg

SEQ ID NO: 651855 - DNA, 25 bp, Mus musculus
gagaccctcagttcgctgcgctatg

SEQ ID NO: 651856 - DNA, 25 bp, Mus musculus
gagaccctcatcaatgtgttccatg

SEQ ID NO: 651857 - DNA, 25 bp, Mus musculus
gagaccctcatctatgtgttccatg

SEQ ID NO: 651858 - DNA, 25 bp, Mus musculus
gagaccctcgagcaggctttccatt

SEQ ID NO: 651859 - DNA, 25 bp, Mus musculus
gagaccctcgaggaggctttccatt

SEQ ID NO: 651860 - DNA, 25 bp, Mus musculus
gagaccctgagcagaattggaaatt

SEQ ID NO: 651861 - DNA, 25 bp, Mus musculus
gagaccctgagctgaattggaaatt

SEQ ID NO: 651862 - DNA, 25 bp, Mus musculus
gagaccctggatcaaatcgccaaga

SEQ ID NO: 651863 - DNA, 25 bp, Mus musculus
gagaccctggatgaaatcgccaaga

SEQ ID NO: 651864 - DNA, 25 bp, Mus musculus
gagaccctgggactactatctgatg

SEQ ID NO: 651865 - DNA, 25 bp, Mus musculus
gagaccctgggagtactatctgatg

SEQ ID NO: 651866 - DNA, 25 bp, Mus musculus
gagaccctgttgaccatgaactggg

SEQ ID NO: 651867 - DNA, 25 bp, Mus musculus
gagaccctgttgtccatgaactggg

SEQ ID NO: 651868 - DNA, 25 bp, Mus musculus
gagaccgaggtcaacatctatgagc

SEQ ID NO: 651869 - DNA, 25 bp, Mus musculus
gagaccgaggtctacatctatgagc

SEQ ID NO: 651870 - DNA, 25 bp, Mus musculus
gagaccgctcagatactgtttacca

SEQ ID NO: 651871 - DNA, 25 bp, Mus musculus
gagaccgctcagttactgtttacca

SEQ ID NO: 651872 - DNA, 25 bp, Mus musculus
gagaccgctgtgaccttacgtaaaa

SEQ ID NO: 651873 - DNA, 25 bp, Mus musculus
gagaccgctgtgtccttacgtaaaa

SEQ ID NO: 651874 - DNA, 25 bp, Mus musculus
gagaccggatgcagggtgctgggcg

SEQ ID NO: 651875 - DNA, 25 bp, Mus musculus
gagaccggatgctgggtgctgggcg

SEQ ID NO: 651876 - DNA, 25 bp, Mus musculus
gagaccgggtcacagctttcttcct

SEQ ID NO: 651877 - DNA, 25 bp, Mus musculus
gagaccgggtcagagctttcttcct

SEQ ID NO: 651878 - DNA, 25 bp, Mus musculus
gagaccgtcaaccatggcgcagagt

SEQ ID NO: 651879 - DNA, 25 bp, Mus musculus
gagaccgtcaacgatggcgcagagt

SEQ ID NO: 651880 - DNA, 25 bp, Mus musculus
gagaccgtgcagactcatctttgta

SEQ ID NO: 651881 - DNA, 25 bp, Mus musculus
gagaccgtgcagtctcatctttgta

SEQ ID NO: 651882 - DNA, 25 bp, Mus musculus
gagaccgtggacaacaaaatgatgg

SEQ ID NO: 651883 - DNA, 25 bp, Mus musculus
gagaccgtggactacaaaatgatgg

SEQ ID NO: 651884 - DNA, 25 bp, Mus musculus
gagacctaagaaaggccgatggcgt

SEQ ID NO: 651885 - DNA, 25 bp, Mus musculus
gagacctaagaaccactctgagagc

SEQ ID NO: 651886 - DNA, 25 bp, Mus musculus
gagacctaagaagcactctgagagc

SEQ ID NO: 651887 - DNA, 25 bp, Mus musculus
gagacctaagaatggccgatggcgt

SEQ ID NO: 651888 - DNA, 25 bp, Mus musculus
gagacctaagtgcttcctgccacca

SEQ ID NO: 651889 - DNA, 25 bp, Mus musculus
gagacctaagtggttcctgccacca

SEQ ID NO: 651890 - DNA, 25 bp, Mus musculus
gagacctacgttcaagcagttggtg

SEQ ID NO: 651891 - DNA, 25 bp, Mus musculus
gagacctacgttgaagcagttggtg

SEQ ID NO: 651892 - DNA, 25 bp, Mus musculus
gagacctactgcagaagagacattg

SEQ ID NO: 651893 - DNA, 25 bp, Mus musculus
gagacctactgctgaagagacattg

SEQ ID NO: 651894 - DNA, 25 bp, Mus musculus
gagacctagatccaaagacggagaa

SEQ ID NO: 651895 - DNA, 25 bp, Mus musculus
gagacctagatcgaaagacggagaa

SEQ ID NO: 651896 - DNA, 25 bp, Mus musculus
gagacctcaccaacaggctgggagt

SEQ ID NO: 651897 - DNA, 25 bp, Mus musculus
gagacctcaccatcaggctgggagt

SEQ ID NO: 651898 - DNA, 25 bp, Mus musculus
gagacctcatcacgatgaaccagga

SEQ ID NO: 651899 - DNA, 25 bp, Mus musculus
gagacctcatcactcaagtttgaaa

SEQ ID NO: 651900 - DNA, 25 bp, Mus musculus
gagacctcatcaggatgaaccagga

SEQ ID NO: 651901 - DNA, 25 bp, Mus musculus
gagacctcatcagtcaagtttgaaa

SEQ ID NO: 651902 - DNA, 25 bp, Mus musculus
gagacctcatgtccttcctggtggc

SEQ ID NO: 651903 - DNA, 25 bp, Mus musculus
gagacctcatgtgcttcctggtggc

SEQ ID NO: 651904 - DNA, 25 bp, Mus musculus
gagacctcatttctcacagtggaca

SEQ ID NO: 651905 - DNA, 25 bp, Mus musculus
gagacctcatttgtcacagtggaca

SEQ ID NO: 651906 - DNA, 25 bp, Mus musculus
gagacctccatgctgcatgagctca

SEQ ID NO: 651907 - DNA, 25 bp, Mus musculus
gagacctccatggtgcatgagctca

SEQ ID NO: 651908 - DNA, 25 bp, Mus musculus
gagacctcggttatgcacaagccgg

SEQ ID NO: 651909 - DNA, 25 bp, Mus musculus
gagacctcggttttgcacaagccgg

SEQ ID NO: 651910 - DNA, 25 bp, Mus musculus
gagacctcgttgactggtggacgca

SEQ ID NO: 651911 - DNA, 25 bp, Mus musculus
gagacctcgttgtctggtggacgca

SEQ ID NO: 651912 - DNA, 25 bp, Mus musculus
gagacctctggaacaggcattggag

SEQ ID NO: 651913 - DNA, 25 bp, Mus musculus
gagacctctggatcaggcattggag

SEQ ID NO: 651914 - DNA, 25 bp, Mus musculus
gagacctgagccctcactttaatgg

SEQ ID NO: 651915 - DNA, 25 bp, Mus musculus
gagacctgagccgtcactttaatgg

SEQ ID NO: 651916 - DNA, 25 bp, Mus musculus
gagacctgaggacgccttattcttc

SEQ ID NO: 651917 - DNA, 25 bp, Mus musculus
gagacctgaggaggccttattcttc

SEQ ID NO: 651918 - DNA, 25 bp, Mus musculus
gagacctgatgacaccttagccaag

SEQ ID NO: 651919 - DNA, 25 bp, Mus musculus
gagacctgatgagaccttagccaag

SEQ ID NO: 651920 - DNA, 25 bp, Mus musculus
gagacctgcaatacagtcccctaag

SEQ ID NO: 651921 - DNA, 25 bp, Mus musculus
gagacctgcaattcagtcccctaag

SEQ ID NO: 651922 - DNA, 25 bp, Mus musculus
gagacctgcttcacctgtcagcgct

SEQ ID NO: 651923 - DNA, 25 bp, Mus musculus
gagacctgcttctcctgtcagcgct

SEQ ID NO: 651924 - DNA, 25 bp, Mus musculus
gagacctggccccacagatgctgcg

SEQ ID NO: 651925 - DNA, 25 bp, Mus musculus
gagacctggcccgacagatgctgcg

SEQ ID NO: 651926 - DNA, 25 bp, Mus musculus
gagacctggtctcgttatgccctca

SEQ ID NO: 651927 - DNA, 25 bp, Mus musculus
gagacctggtctggttatgccctca

SEQ ID NO: 651928 - DNA, 25 bp, Mus musculus
gagacctggtgaccctccgttggac

SEQ ID NO: 651929 - DNA, 25 bp, Mus musculus
gagacctggtgagcctccgttggac

SEQ ID NO: 651930 - DNA, 25 bp, Mus musculus
gagacctggtggaaaccacccacct

SEQ ID NO: 651931 - DNA, 25 bp, Mus musculus
gagacctggtggtaaccacccacct

SEQ ID NO: 651932 - DNA, 25 bp, Mus musculus
gagacctgtgaaactccagaaccca

SEQ ID NO: 651933 - DNA, 25 bp, Mus musculus
gagacctgtgaatctccagaaccca

SEQ ID NO: 651934 - DNA, 25 bp, Mus musculus
gagacctgtgttatcggttacacca

SEQ ID NO: 651935 - DNA, 25 bp, Mus musculus
gagacctgtgttttcggttacacca

SEQ ID NO: 651936 - DNA, 25 bp, Mus musculus
gagacctgttggagacaggttccaa

SEQ ID NO: 651937 - DNA, 25 bp, Mus musculus
gagacctgttggtgacaggttccaa

SEQ ID NO: 651938 - DNA, 25 bp, Mus musculus
gagaccttaaatcaaatgtcacata

SEQ ID NO: 651939 - DNA, 25 bp, Mus musculus
gagaccttaaatgaaatgtcacata

SEQ ID NO: 651940 - DNA, 25 bp, Mus musculus
gagaccttaccccaagctgtttgga

SEQ ID NO: 651941 - DNA, 25 bp, Mus musculus
gagaccttacccgaagctgtttgga

SEQ ID NO: 651942 - DNA, 25 bp, Mus musculus
gagaccttcagcctaggagtctgcc

SEQ ID NO: 651943 - DNA, 25 bp, Mus musculus
gagaccttcagcgtaggagtctgcc

SEQ ID NO: 651944 - DNA, 25 bp, Mus musculus
gagaccttcatgcagtgggaccagt

SEQ ID NO: 651945 - DNA, 25 bp, Mus musculus
gagaccttcatggagtgggaccagt

SEQ ID NO: 651946 - DNA, 25 bp, Mus musculus
gagaccttccggcattcatccttcg

SEQ ID NO: 651947 - DNA, 25 bp, Mus musculus
gagaccttccgggattcatccttcg

SEQ ID NO: 651948 - DNA, 25 bp, Mus musculus
gagaccttcctgaggttccgctcca

SEQ ID NO: 651949 - DNA, 25 bp, Mus musculus
gagaccttcctgcaaaagctgaacc

SEQ ID NO: 651950 - DNA, 25 bp, Mus musculus
gagaccttcctggaaaagctgaacc

SEQ ID NO: 651951 - DNA, 25 bp, Mus musculus
gagaccttcctgtggttccgctcca

SEQ ID NO: 651952 - DNA, 25 bp, Mus musculus
gagaccttcgctcgctatctgctca

SEQ ID NO: 651953 - DNA, 25 bp, Mus musculus
gagaccttcgctggctatctgctca

SEQ ID NO: 651954 - DNA, 25 bp, Mus musculus
gagaccttgcggaactgccctggat

SEQ ID NO: 651955 - DNA, 25 bp, Mus musculus
gagaccttgcggtactgccctggat

SEQ ID NO: 651956 - DNA, 25 bp, Mus musculus
gagacctttaaacccaattgcaggg

SEQ ID NO: 651957 - DNA, 25 bp, Mus musculus
gagacctttaaagccaattgcaggg

SEQ ID NO: 651958 - DNA, 25 bp, Mus musculus
gagacctttttgaccgagagggaca

SEQ ID NO: 651959 - DNA, 25 bp, Mus musculus
gagacctttttgtccgagagggaca

SEQ ID NO: 651960 - DNA, 25 bp, Mus musculus
gagacgaaggcaagcccattgtctg

SEQ ID NO: 651961 - DNA, 25 bp, Mus musculus
gagacgaaggcatgcccattgtctg

SEQ ID NO: 651962 - DNA, 25 bp, Mus musculus
gagacgaatgctatgaacaggccca

SEQ ID NO: 651963 - DNA, 25 bp, Mus musculus
gagacgaatgctttgaacaggccca

SEQ ID NO: 651964 - DNA, 25 bp, Mus musculus
gagacgacaaagcaaccttcttaaa

SEQ ID NO: 651965 - DNA, 25 bp, Mus musculus
gagacgacaaaggaaccttcttaaa

SEQ ID NO: 651966 - DNA, 25 bp, Mus musculus
gagacgaccggactacctggatccg

SEQ ID NO: 651967 - DNA, 25 bp, Mus musculus
gagacgaccggagtacctggatccg

SEQ ID NO: 651968 - DNA, 25 bp, Mus musculus
gagacgacgtcaaggtcactcgggt

SEQ ID NO: 651969 - DNA, 25 bp, Mus musculus
gagacgacgtcatggtcactcgggt

SEQ ID NO: 651970 - DNA, 25 bp, Mus musculus
gagacgaggacacccgaatcactga

SEQ ID NO: 651971 - DNA, 25 bp, Mus musculus
gagacgaggacagccgaatcactga

SEQ ID NO: 651972 - DNA, 25 bp, Mus musculus
gagacgaggcagattcccaaattca

SEQ ID NO: 651973 - DNA, 25 bp, Mus musculus
gagacgaggcagtttcccaaattca

SEQ ID NO: 651974 - DNA, 25 bp, Mus musculus
gagacgagtcagcaaggtccctaga

SEQ ID NO: 651975 - DNA, 25 bp, Mus musculus
gagacgagtcaggaaggtccctaga

SEQ ID NO: 651976 - DNA, 25 bp, Mus musculus
gagacgagtttacgagccagcacct

SEQ ID NO: 651977 - DNA, 25 bp, Mus musculus
gagacgagtttaggagccagcacct

SEQ ID NO: 651978 - DNA, 25 bp, Mus musculus
gagacgagtttcagggacggatcaa

SEQ ID NO: 651979 - DNA, 25 bp, Mus musculus
gagacgagtttctgggacggatcaa

SEQ ID NO: 651980 - DNA, 25 bp, Mus musculus
gagacgcaagctaatttcaatggga

SEQ ID NO: 651981 - DNA, 25 bp, Mus musculus
gagacgcaagcttatttcaatggga

SEQ ID NO: 651982 - DNA, 25 bp, Mus musculus
gagacgcaccccaacatagacactg

SEQ ID NO: 651983 - DNA, 25 bp, Mus musculus
gagacgcacccctacatagacactg

SEQ ID NO: 651984 - DNA, 25 bp, Mus musculus
gagacgcagccgactctgtaacaac

SEQ ID NO: 651985 - DNA, 25 bp, Mus musculus
gagacgcagccgtctctgtaacaac

SEQ ID NO: 651986 - DNA, 25 bp, Mus musculus
gagacgcatggcactagctggatca

SEQ ID NO: 651987 - DNA, 25 bp, Mus musculus
gagacgcatggctctagctggatca

SEQ ID NO: 651988 - DNA, 25 bp, Mus musculus
gagacgccaagcattcacctaacgg

SEQ ID NO: 651989 - DNA, 25 bp, Mus musculus
gagacgccaagctttcacctaacgg

SEQ ID NO: 651990 - DNA, 25 bp, Mus musculus
gagacgccattcaccctgggatgct

SEQ ID NO: 651991 - DNA, 25 bp, Mus musculus
gagacgccattctccctgggatgct

SEQ ID NO: 651992 - DNA, 25 bp, Mus musculus
gagacgccccagcacatctgagtgt

SEQ ID NO: 651993 - DNA, 25 bp, Mus musculus
gagacgccccaggacatctgagtgt

SEQ ID NO: 651994 - DNA, 25 bp, Mus musculus
gagacgcgcctgagtctcctctttc

SEQ ID NO: 651995 - DNA, 25 bp, Mus musculus
gagacgcgcctgtgtctcctctttc

SEQ ID NO: 651996 - DNA, 25 bp, Mus musculus
gagacgcgccttagccctggtctct

SEQ ID NO: 651997 - DNA, 25 bp, Mus musculus
gagacgcgcctttgccctggtctct

SEQ ID NO: 651998 - DNA, 25 bp, Mus musculus
gagacgctaccacgaaatggctaga

SEQ ID NO: 651999 - DNA, 25 bp, Mus musculus
gagacgctaccaggaaatggctaga

SEQ ID NO: 652000 - DNA, 25 bp, Mus musculus
gagacgctctaccatgtcctgcatg

SEQ ID NO: 652001 - DNA, 25 bp, Mus musculus
gagacgctctacgatgtcctgcatg

SEQ ID NO: 652002 - DNA, 25 bp, Mus musculus
gagacgctgaaacagtttgtccaac

SEQ ID NO: 652003 - DNA, 25 bp, Mus musculus
gagacgctgaaagagtttgtccaac

SEQ ID NO: 652004 - DNA, 25 bp, Mus musculus
gagacgctgaccatcaagaggcctg

SEQ ID NO: 652005 - DNA, 25 bp, Mus musculus
gagacgctgaccttcaagaggcctg

SEQ ID NO: 652006 - DNA, 25 bp, Mus musculus
gagacgctgtccctgtgtttgacct

SEQ ID NO: 652007 - DNA, 25 bp, Mus musculus
gagacgctgtccgtgtgtttgacct

SEQ ID NO: 652008 - DNA, 25 bp, Mus musculus
gagacgctttttacctctccgccag

SEQ ID NO: 652009 - DNA, 25 bp, Mus musculus
gagacgcttttttcctctccgccag

SEQ ID NO: 652010 - DNA, 25 bp, Mus musculus
gagacggaaagcagcccacgtcact

SEQ ID NO: 652011 - DNA, 25 bp, Mus musculus
gagacggaaagctgcccacgtcact

SEQ ID NO: 652012 - DNA, 25 bp, Mus musculus
gagacggaatggcacctgtgaatat

SEQ ID NO: 652013 - DNA, 25 bp, Mus musculus
gagacggaatgggacctgtgaatat

SEQ ID NO: 652014 - DNA, 25 bp, Mus musculus
gagacggacgtcaagaatggttcag

SEQ ID NO: 652015 - DNA, 25 bp, Mus musculus
gagacggacgtctagaatggttcag

SEQ ID NO: 652016 - DNA, 25 bp, Mus musculus
gagacggagtcgcatatctaccgag

SEQ ID NO: 652017 - DNA, 25 bp, Mus musculus
gagacggagtcggatatctaccgag

SEQ ID NO: 652018 - DNA, 25 bp, Mus musculus
gagacggcagatatgattggtgtaa

SEQ ID NO: 652019 - DNA, 25 bp, Mus musculus
gagacggcagatttgattggtgtaa

SEQ ID NO: 652020 - DNA, 25 bp, Mus musculus
gagacggctaaaccagtcacaggag

SEQ ID NO: 652021 - DNA, 25 bp, Mus musculus
gagacggctaaagcagtcacaggag

SEQ ID NO: 652022 - DNA, 25 bp, Mus musculus
gagacgggaggcaagaagtcacctc

SEQ ID NO: 652023 - DNA, 25 bp, Mus musculus
gagacgggaggctagaagtcacctc

SEQ ID NO: 652024 - DNA, 25 bp, Mus musculus
gagacggttttactatggcagacaa

SEQ ID NO: 652025 - DNA, 25 bp, Mus musculus
gagacggttttagtatggcagacaa

SEQ ID NO: 652026 - DNA, 25 bp, Mus musculus
gagacgtatgtcagggtgcccattg

SEQ ID NO: 652027 - DNA, 25 bp, Mus musculus
gagacgtatgtctgggtgcccattg

SEQ ID NO: 652028 - DNA, 25 bp, Mus musculus
gagacgtcgcttaagctgaggcccc

SEQ ID NO: 652029 - DNA, 25 bp, Mus musculus
gagacgtcgctttagctgaggcccc

SEQ ID NO: 652030 - DNA, 25 bp, Mus musculus
gagacgtcgtatcaagaagcccttg

SEQ ID NO: 652031 - DNA, 25 bp, Mus musculus
gagacgtcgtatgaagaagcccttg

SEQ ID NO: 652032 - DNA, 25 bp, Mus musculus
gagacgtctaatcaccattctccat

SEQ ID NO: 652033 - DNA, 25 bp, Mus musculus
gagacgtctaatgaccattctccat

SEQ ID NO: 652034 - DNA, 25 bp, Mus musculus
gagacgtgcagaagacgctcggact

SEQ ID NO: 652035 - DNA, 25 bp, Mus musculus
gagacgtgcagatgacgctcggact

SEQ ID NO: 652036 - DNA, 25 bp, Mus musculus
gagacgtgctccagagggctttgct

SEQ ID NO: 652037 - DNA, 25 bp, Mus musculus
gagacgtgctcctgagggctttgct

SEQ ID NO: 652038 - DNA, 25 bp, Mus musculus
gagacgtggcttcggcacacaacta

SEQ ID NO: 652039 - DNA, 25 bp, Mus musculus
gagacgtggcttgggcacacaacta

SEQ ID NO: 652040 - DNA, 25 bp, Mus musculus
gagacgtgggatagcaaattcagca

SEQ ID NO: 652041 - DNA, 25 bp, Mus musculus
gagacgtgggattgcaaattcagca

SEQ ID NO: 652042 - DNA, 25 bp, Mus musculus
gagacgtgtttcagaacggatggca

SEQ ID NO: 652043 - DNA, 25 bp, Mus musculus
gagacgtgtttctgaacggatggca

SEQ ID NO: 652044 - DNA, 25 bp, Mus musculus
gagacgttgcgaaacacagcgatgc

SEQ ID NO: 652045 - DNA, 25 bp, Mus musculus
gagacgttgcgatacacagcgatgc

SEQ ID NO: 652046 - DNA, 25 bp, Mus musculus
gagacgtttaatactcgttggaggg

SEQ ID NO: 652047 - DNA, 25 bp, Mus musculus
gagacgtttaattctcgttggaggg

SEQ ID NO: 652048 - DNA, 25 bp, Mus musculus
gagactaaaatacctttgatgggac

SEQ ID NO: 652049 - DNA, 25 bp, Mus musculus
gagactaaaatagctttgatgggac

SEQ ID NO: 652050 - DNA, 25 bp, Mus musculus
gagactaaaggactggctctcaacc

SEQ ID NO: 652051 - DNA, 25 bp, Mus musculus
gagactaaaggagtggctctcaacc

SEQ ID NO: 652052 - DNA, 25 bp, Mus musculus
gagactaacccaccaacaggaaaag

SEQ ID NO: 652053 - DNA, 25 bp, Mus musculus
gagactaacccagcaacaggaaaag

SEQ ID NO: 652054 - DNA, 25 bp, Mus musculus
gagactaccacaatgggatccctct

SEQ ID NO: 652055 - DNA, 25 bp, Mus musculus
gagactaccacattgggatccctct

SEQ ID NO: 652056 - DNA, 25 bp, Mus musculus
gagactacgctgcaaaatgggctaa

SEQ ID NO: 652057 - DNA, 25 bp, Mus musculus
gagactacgctggaaaatgggctaa

SEQ ID NO: 652058 - DNA, 25 bp, Mus musculus
gagactacgcttacttcaacattga

SEQ ID NO: 652059 - DNA, 25 bp, Mus musculus
gagactacgctttcttcaacattga

SEQ ID NO: 652060 - DNA, 25 bp, Mus musculus
gagactacggataaaacatcatcca

SEQ ID NO: 652061 - DNA, 25 bp, Mus musculus
gagactacggattaaacatcatcca

SEQ ID NO: 652062 - DNA, 25 bp, Mus musculus
gagactactatgagtgcactggaat

SEQ ID NO: 652063 - DNA, 25 bp, Mus musculus
gagactactatgtgtgcactggaat

SEQ ID NO: 652064 - DNA, 25 bp, Mus musculus
gagactactttacgtatctttctga

SEQ ID NO: 652065 - DNA, 25 bp, Mus musculus
gagactactttaggtatctttctga

SEQ ID NO: 652066 - DNA, 25 bp, Mus musculus
gagactagcaagcataaggtgccag

SEQ ID NO: 652067 - DNA, 25 bp, Mus musculus
gagactagcaaggataaggtgccag

SEQ ID NO: 652068 - DNA, 25 bp, Mus musculus
gagactataaaacgccagccaatct

SEQ ID NO: 652069 - DNA, 25 bp, Mus musculus
gagactataaaaggccagccaatct

SEQ ID NO: 652070 - DNA, 25 bp, Mus musculus
gagactataggcctgtgcacaagcc

SEQ ID NO: 652071 - DNA, 25 bp, Mus musculus
gagactataggcgtgtgcacaagcc

SEQ ID NO: 652072 - DNA, 25 bp, Mus musculus
gagactatcaacctgaaggaacttg

SEQ ID NO: 652073 - DNA, 25 bp, Mus musculus
gagactatcaacgtgaaggaacttg

SEQ ID NO: 652074 - DNA, 25 bp, Mus musculus
gagactatgcacctcaatgctgaag

SEQ ID NO: 652075 - DNA, 25 bp, Mus musculus
gagactatgcacgtcaatgctgaag

SEQ ID NO: 652076 - DNA, 25 bp, Mus musculus
gagactcaaggactacagctccatg

SEQ ID NO: 652077 - DNA, 25 bp, Mus musculus
gagactcaaggagtacagctccatg

SEQ ID NO: 652078 - DNA, 25 bp, Mus musculus
gagactcaatgcataagtacccaga

SEQ ID NO: 652079 - DNA, 25 bp, Mus musculus
gagactcaatgcttaagtacccaga

SEQ ID NO: 652080 - DNA, 25 bp, Mus musculus
gagactcaatggcttgccgattgaa

SEQ ID NO: 652081 - DNA, 25 bp, Mus musculus
gagactcaatgggttgccgattgaa

SEQ ID NO: 652082 - DNA, 25 bp, Mus musculus
gagactcaccataaccagttgaaag

SEQ ID NO: 652083 - DNA, 25 bp, Mus musculus
gagactcaccattaccagttgaaag

SEQ ID NO: 652084 - DNA, 25 bp, Mus musculus
gagactcacgggagccccggacttc

SEQ ID NO: 652085 - DNA, 25 bp, Mus musculus
gagactcacgggtgccccggacttc

SEQ ID NO: 652086 - DNA, 25 bp, Mus musculus
gagactcagaacaccgtgtgtaact

SEQ ID NO: 652087 - DNA, 25 bp, Mus musculus
gagactcagaactccgtgtgtaact

SEQ ID NO: 652088 - DNA, 25 bp, Mus musculus
gagactcagatcactcatctgctag

SEQ ID NO: 652089 - DNA, 25 bp, Mus musculus
gagactcagatctctcatctgctag

SEQ ID NO: 652090 - DNA, 25 bp, Mus musculus
gagactcagctgagtgagctccgct

SEQ ID NO: 652091 - DNA, 25 bp, Mus musculus
gagactcagctgtgtgagctccgct

SEQ ID NO: 652092 - DNA, 25 bp, Mus musculus
gagactcaggccaagattagaaagg

SEQ ID NO: 652093 - DNA, 25 bp, Mus musculus
gagactcaggcctagattagaaagg

SEQ ID NO: 652094 - DNA, 25 bp, Mus musculus
gagactcagtaacgtggtaaaagat

SEQ ID NO: 652095 - DNA, 25 bp, Mus musculus
gagactcagtaaggtggtaaaagat

SEQ ID NO: 652096 - DNA, 25 bp, Mus musculus
gagactcagttgcaccagccgatga

SEQ ID NO: 652097 - DNA, 25 bp, Mus musculus
gagactcagttggaccagccgatga

SEQ ID NO: 652098 - DNA, 25 bp, Mus musculus
gagactcagtttacaaacaaaatat

SEQ ID NO: 652099 - DNA, 25 bp, Mus musculus
gagactcagttttcaaacaaaatat

SEQ ID NO: 652100 - DNA, 25 bp, Mus musculus
gagactccagtccaaaaccattaag

SEQ ID NO: 652101 - DNA, 25 bp, Mus musculus
gagactccagtcgaaaaccattaag

SEQ ID NO: 652102 - DNA, 25 bp, Mus musculus
gagactcccaccaggttgctgttgg

SEQ ID NO: 652103 - DNA, 25 bp, Mus musculus
gagactcccacctggttgctgttgg

SEQ ID NO: 652104 - DNA, 25 bp, Mus musculus
gagactccctagcagggtttcatag

SEQ ID NO: 652105 - DNA, 25 bp, Mus musculus
gagactccctaggagggtttcatag

SEQ ID NO: 652106 - DNA, 25 bp, Mus musculus
gagactccctctctgaatgtaattc

SEQ ID NO: 652107 - DNA, 25 bp, Mus musculus
gagactccctctgtgaatgtaattc

SEQ ID NO: 652108 - DNA, 25 bp, Mus musculus
gagactccctgccacttggtgtcgt

SEQ ID NO: 652109 - DNA, 25 bp, Mus musculus
gagactccctgcgacttggtgtcgt

SEQ ID NO: 652110 - DNA, 25 bp, Mus musculus
gagactccgctaagcggtccctgct

SEQ ID NO: 652111 - DNA, 25 bp, Mus musculus
gagactccgctatgcggtccctgct

SEQ ID NO: 652112 - DNA, 25 bp, Mus musculus
gagactccggcacccctctagtgtg

SEQ ID NO: 652113 - DNA, 25 bp, Mus musculus
gagactccggcagccctctagtgtg

SEQ ID NO: 652114 - DNA, 25 bp, Mus musculus
gagactccggccactatgcttgtac

SEQ ID NO: 652115 - DNA, 25 bp, Mus musculus
gagactccggcctctatgcttgtac

SEQ ID NO: 652116 - DNA, 25 bp, Mus musculus
gagactcctcgtagccaaaccggag

SEQ ID NO: 652117 - DNA, 25 bp, Mus musculus
gagactcctcgttgccaaaccggag

SEQ ID NO: 652118 - DNA, 25 bp, Mus musculus
gagactcctctcatgagacacaggg

SEQ ID NO: 652119 - DNA, 25 bp, Mus musculus
gagactcctctcttgagacacaggg

SEQ ID NO: 652120 - DNA, 25 bp, Mus musculus
gagactcctgcacaatccgaaagtc

SEQ ID NO: 652121 - DNA, 25 bp, Mus musculus
gagactcctgcagaatccgaaagtc

SEQ ID NO: 652122 - DNA, 25 bp, Mus musculus
gagactcgaaatccggcctggagaa

SEQ ID NO: 652123 - DNA, 25 bp, Mus musculus
gagactcgaaatgcggcctggagaa

SEQ ID NO: 652124 - DNA, 25 bp, Mus musculus
gagactcgaatccacattctaccct

SEQ ID NO: 652125 - DNA, 25 bp, Mus musculus
gagactcgaatcgacattctaccct

SEQ ID NO: 652126 - DNA, 25 bp, Mus musculus
gagactcgacagagcagctcggcat

SEQ ID NO: 652127 - DNA, 25 bp, Mus musculus
gagactcgacagtgcagctcggcat

SEQ ID NO: 652128 - DNA, 25 bp, Mus musculus
gagactcgatttagtcttccgtaca

SEQ ID NO: 652129 - DNA, 25 bp, Mus musculus
gagactcgattttgtcttccgtaca

SEQ ID NO: 652130 - DNA, 25 bp, Mus musculus
gagactcgccaaccactaacctgag

SEQ ID NO: 652131 - DNA, 25 bp, Mus musculus
gagactcgccaagcactaacctgag

SEQ ID NO: 652132 - DNA, 25 bp, Mus musculus
gagactcggttgaaaaagctctgtc

SEQ ID NO: 652133 - DNA, 25 bp, Mus musculus
gagactcggttgtaaaagctctgtc

SEQ ID NO: 652134 - DNA, 25 bp, Mus musculus
gagactctactgcaggacaatccaa

SEQ ID NO: 652135 - DNA, 25 bp, Mus musculus
gagactctactggaggacaatccaa

SEQ ID NO: 652136 - DNA, 25 bp, Mus musculus
gagactctcactccctataatctgc

SEQ ID NO: 652137 - DNA, 25 bp, Mus musculus
gagactctcactgcctataatctgc

SEQ ID NO: 652138 - DNA, 25 bp, Mus musculus
gagactctctcgcaagtcttctatt

SEQ ID NO: 652139 - DNA, 25 bp, Mus musculus
gagactctctcggaagtcttctatt

SEQ ID NO: 652140 - DNA, 25 bp, Mus musculus
gagactctctctatgtcctcgctgg

SEQ ID NO: 652141 - DNA, 25 bp, Mus musculus
gagactctctctttgtcctcgctgg

SEQ ID NO: 652142 - DNA, 25 bp, Mus musculus
gagactctgaagcagccagtctagt

SEQ ID NO: 652143 - DNA, 25 bp, Mus musculus
gagactctgaaggagccagtctagt

SEQ ID NO: 652144 - DNA, 25 bp, Mus musculus
gagactctgagaacagctccgagga

SEQ ID NO: 652145 - DNA, 25 bp, Mus musculus
gagactctgagatcagctccgagga

SEQ ID NO: 652146 - DNA, 25 bp, Mus musculus
gagactctgagcatcatccctgggt

SEQ ID NO: 652147 - DNA, 25 bp, Mus musculus
gagactctgagcttcatccctgggt

SEQ ID NO: 652148 - DNA, 25 bp, Mus musculus
gagactctgatcctcatgccactgg

SEQ ID NO: 652149 - DNA, 25 bp, Mus musculus
gagactctgatcgtcatgccactgg

SEQ ID NO: 652150 - DNA, 25 bp, Mus musculus
gagactctgatgagtgaacttggca

SEQ ID NO: 652151 - DNA, 25 bp, Mus musculus
gagactctgatgtgtgaacttggca

SEQ ID NO: 652152 - DNA, 25 bp, Mus musculus
gagactctgcctaccacgtctggag

SEQ ID NO: 652153 - DNA, 25 bp, Mus musculus
gagactctgccttccacgtctggag

SEQ ID NO: 652154 - DNA, 25 bp, Mus musculus
gagactctgtgtatagctgcgtcac

SEQ ID NO: 652155 - DNA, 25 bp, Mus musculus
gagactctgtgtttagctgcgtcac

SEQ ID NO: 652156 - DNA, 25 bp, Mus musculus
gagactcttcggatatcagcagaga

SEQ ID NO: 652157 - DNA, 25 bp, Mus musculus
gagactcttcggttatcagcagaga

SEQ ID NO: 652158 - DNA, 25 bp, Mus musculus
gagactcttctcaggctacaacaag

SEQ ID NO: 652159 - DNA, 25 bp, Mus musculus
gagactcttctctggctacaacaag

SEQ ID NO: 652160 - DNA, 25 bp, Mus musculus
gagactcttgatatgataaaccctg

SEQ ID NO: 652161 - DNA, 25 bp, Mus musculus
gagactcttgatttgataaaccctg

SEQ ID NO: 652162 - DNA, 25 bp, Mus musculus
gagactctttcaaagtgagtgaggg

SEQ ID NO: 652163 - DNA, 25 bp, Mus musculus
gagactctttcaaggcgggaggctc

SEQ ID NO: 652164 - DNA, 25 bp, Mus musculus
gagactctttcatagtgagtgaggg

SEQ ID NO: 652165 - DNA, 25 bp, Mus musculus
gagactctttcatggcgggaggctc

SEQ ID NO: 652166 - DNA, 25 bp, Mus musculus
gagactgaacccagtttactctagg

SEQ ID NO: 652167 - DNA, 25 bp, Mus musculus
gagactgaaccctgtttactctagg

SEQ ID NO: 652168 - DNA, 25 bp, Mus musculus
gagactgaaggcaaagacacccaaa

SEQ ID NO: 652169 - DNA, 25 bp, Mus musculus
gagactgaaggctaagacacccaaa

SEQ ID NO: 652170 - DNA, 25 bp, Mus musculus
gagactgacaccaggtatttcgatg

SEQ ID NO: 652171 - DNA, 25 bp, Mus musculus
gagactgacacctggtatttcgatg

SEQ ID NO: 652172 - DNA, 25 bp, Mus musculus
gagactgactgccacgtgctcagca

SEQ ID NO: 652173 - DNA, 25 bp, Mus musculus
gagactgactgcgacgtgctcagca

SEQ ID NO: 652174 - DNA, 25 bp, Mus musculus
gagactgagagacgcctttccagga

SEQ ID NO: 652175 - DNA, 25 bp, Mus musculus
gagactgagagaggcctttccagga

SEQ ID NO: 652176 - DNA, 25 bp, Mus musculus
gagactgagcttcgagaagcttgat

SEQ ID NO: 652177 - DNA, 25 bp, Mus musculus
gagactgagcttggagaagcttgat

SEQ ID NO: 652178 - DNA, 25 bp, Mus musculus
gagactgaggtcagcaagagttgcc

SEQ ID NO: 652179 - DNA, 25 bp, Mus musculus
gagactgaggtctgcaagagttgcc

SEQ ID NO: 652180 - DNA, 25 bp, Mus musculus
gagactgatcgaatccaaagtcggc

SEQ ID NO: 652181 - DNA, 25 bp, Mus musculus
gagactgatcgattccaaagtcggc

SEQ ID NO: 652182 - DNA, 25 bp, Mus musculus
gagactgatgcacatgaccctttgc

SEQ ID NO: 652183 - DNA, 25 bp, Mus musculus
gagactgatgcagatgaccctttgc

SEQ ID NO: 652184 - DNA, 25 bp, Mus musculus
gagactgcaaccaagcttattgaca

SEQ ID NO: 652185 - DNA, 25 bp, Mus musculus
gagactgcaacctagcttattgaca

SEQ ID NO: 652186 - DNA, 25 bp, Mus musculus
gagactgcacgcatgctagcgcagc

SEQ ID NO: 652187 - DNA, 25 bp, Mus musculus
gagactgcacgcttgctagcgcagc

SEQ ID NO: 652188 - DNA, 25 bp, Mus musculus
gagactgcagcaagctgtccgtcct

SEQ ID NO: 652189 - DNA, 25 bp, Mus musculus
gagactgcagcatgctgtccgtcct

SEQ ID NO: 652190 - DNA, 25 bp, Mus musculus
gagactgcatgtaagctcgctcgtc

SEQ ID NO: 652191 - DNA, 25 bp, Mus musculus
gagactgcatgttagctcgctcgtc

SEQ ID NO: 652192 - DNA, 25 bp, Mus musculus
gagactgccatgacactaccaagtg

SEQ ID NO: 652193 - DNA, 25 bp, Mus musculus
gagactgccatgtcactaccaagtg

SEQ ID NO: 652194 - DNA, 25 bp, Mus musculus
gagactgccgagcatgacatcagcg

SEQ ID NO: 652195 - DNA, 25 bp, Mus musculus
gagactgccgaggatgacatcagcg

SEQ ID NO: 652196 - DNA, 25 bp, Mus musculus
gagactgcctcaagacctgcctctt

SEQ ID NO: 652197 - DNA, 25 bp, Mus musculus
gagactgcctcatgacctgcctctt

SEQ ID NO: 652198 - DNA, 25 bp, Mus musculus
gagactgcggataccttgagaggac

SEQ ID NO: 652199 - DNA, 25 bp, Mus musculus
gagactgcggattccttgagaggac

SEQ ID NO: 652200 - DNA, 25 bp, Mus musculus
gagactgctctcacgtgcctggtgg

SEQ ID NO: 652201 - DNA, 25 bp, Mus musculus
gagactgctctctcgtgcctggtgg

SEQ ID NO: 652202 - DNA, 25 bp, Mus musculus
gagactgctggcacagaataaacag

SEQ ID NO: 652203 - DNA, 25 bp, Mus musculus
gagactgctggctcagaataaacag

SEQ ID NO: 652204 - DNA, 25 bp, Mus musculus
gagactgcttagaattaatccggac

SEQ ID NO: 652205 - DNA, 25 bp, Mus musculus
gagactgcttagtattaatccggac

SEQ ID NO: 652206 - DNA, 25 bp, Mus musculus
gagactggacaaaatgcttttggca

SEQ ID NO: 652207 - DNA, 25 bp, Mus musculus
gagactggacaatatgcttttggca

SEQ ID NO: 652208 - DNA, 25 bp, Mus musculus
gagactggatgacaatatccggact

SEQ ID NO: 652209 - DNA, 25 bp, Mus musculus
gagactggatgagaatatccggact

SEQ ID NO: 652210 - DNA, 25 bp, Mus musculus
gagactggcagcaattaacattgca

SEQ ID NO: 652211 - DNA, 25 bp, Mus musculus
gagactggcagctattaacattgca

SEQ ID NO: 652212 - DNA, 25 bp, Mus musculus
gagactggccacatcaatgtcacca

SEQ ID NO: 652213 - DNA, 25 bp, Mus musculus
gagactggccacttcaatgtcacca

SEQ ID NO: 652214 - DNA, 25 bp, Mus musculus
gagactggccagattgttgcaatca

SEQ ID NO: 652215 - DNA, 25 bp, Mus musculus
gagactggccagtttgttgcaatca

SEQ ID NO: 652216 - DNA, 25 bp, Mus musculus
gagactgggccgcatgctggtggaa

SEQ ID NO: 652217 - DNA, 25 bp, Mus musculus
gagactgggccggatgctggtggaa

SEQ ID NO: 652218 - DNA, 25 bp, Mus musculus
gagactggtcccatcctgatctgca

SEQ ID NO: 652219 - DNA, 25 bp, Mus musculus
gagactggtcccttcctgatctgca

SEQ ID NO: 652220 - DNA, 25 bp, Mus musculus
gagactggtgttagctccctggctc

SEQ ID NO: 652221 - DNA, 25 bp, Mus musculus
gagactggtgtttgctccctggctc

SEQ ID NO: 652222 - DNA, 25 bp, Mus musculus
gagactgtacctatgtctacggtca

SEQ ID NO: 652223 - DNA, 25 bp, Mus musculus
gagactgtacctttgtctacggtca

SEQ ID NO: 652224 - DNA, 25 bp, Mus musculus
gagactgtcagtccaagaacggcca

SEQ ID NO: 652225 - DNA, 25 bp, Mus musculus
gagactgtcagtgcaagaacggcca

SEQ ID NO: 652226 - DNA, 25 bp, Mus musculus
gagactgtccctcaacatgggcagt

SEQ ID NO: 652227 - DNA, 25 bp, Mus musculus
gagactgtccctgaacatgggcagt

SEQ ID NO: 652228 - DNA, 25 bp, Mus musculus
gagactgtctgtactgattgcatct

SEQ ID NO: 652229 - DNA, 25 bp, Mus musculus
gagactgtctgttctgattgcatct

SEQ ID NO: 652230 - DNA, 25 bp, Mus musculus
gagactgtgcagatgtatatcaagc

SEQ ID NO: 652231 - DNA, 25 bp, Mus musculus
gagactgtgcagttgtatatcaagc

SEQ ID NO: 652232 - DNA, 25 bp, Mus musculus
gagactgtgctaccgtaagttgtcg

SEQ ID NO: 652233 - DNA, 25 bp, Mus musculus
gagactgtgctagcgtaagttgtcg

SEQ ID NO: 652234 - DNA, 25 bp, Mus musculus
gagacttaattaacgaagccatgga

SEQ ID NO: 652235 - DNA, 25 bp, Mus musculus
gagacttaattatcgaagccatgga

SEQ ID NO: 652236 - DNA, 25 bp, Mus musculus
gagacttacaaaaccttccatgtgg

SEQ ID NO: 652237 - DNA, 25 bp, Mus musculus
gagacttacaaatccttccatgtgg

SEQ ID NO: 652238 - DNA, 25 bp, Mus musculus
gagacttacacaagggtatccaggc

SEQ ID NO: 652239 - DNA, 25 bp, Mus musculus
gagacttacacatgggtatccaggc

SEQ ID NO: 652240 - DNA, 25 bp, Mus musculus
gagacttacatgcagcctccaacca

SEQ ID NO: 652241 - DNA, 25 bp, Mus musculus
gagacttacatggagcctccaacca

SEQ ID NO: 652242 - DNA, 25 bp, Mus musculus
gagacttacctgaagattgcaaggc

SEQ ID NO: 652243 - DNA, 25 bp, Mus musculus
gagacttacctgtagattgcaaggc

SEQ ID NO: 652244 - DNA, 25 bp, Mus musculus
gagacttagaccaacccagggtgag

SEQ ID NO: 652245 - DNA, 25 bp, Mus musculus
gagacttagacctacccagggtgag

SEQ ID NO: 652246 - DNA, 25 bp, Mus musculus
gagacttaggaaccttgtagcgccc

SEQ ID NO: 652247 - DNA, 25 bp, Mus musculus
gagacttaggaagcttgtagcgccc

SEQ ID NO: 652248 - DNA, 25 bp, Mus musculus
gagacttattccaggaaagagattc

SEQ ID NO: 652249 - DNA, 25 bp, Mus musculus
gagacttattcctggaaagagattc

SEQ ID NO: 652250 - DNA, 25 bp, Mus musculus
gagacttattctaggagagagactc

SEQ ID NO: 652251 - DNA, 25 bp, Mus musculus
gagacttattcttggagagagactc

SEQ ID NO: 652252 - DNA, 25 bp, Mus musculus
gagacttcacctacaaccaggacag

SEQ ID NO: 652253 - DNA, 25 bp, Mus musculus
gagacttcaccttcaaccaggacag

SEQ ID NO: 652254 - DNA, 25 bp, Mus musculus
gagacttcagccagtaccctggtgt

SEQ ID NO: 652255 - DNA, 25 bp, Mus musculus
gagacttcagcctgtaccctggtgt

SEQ ID NO: 652256 - DNA, 25 bp, Mus musculus
gagacttcatgcctgctgttgagaa

SEQ ID NO: 652257 - DNA, 25 bp, Mus musculus
gagacttcatgcgtgctgttgagaa

SEQ ID NO: 652258 - DNA, 25 bp, Mus musculus
gagacttcatttcccgtgacctagg

SEQ ID NO: 652259 - DNA, 25 bp, Mus musculus
gagacttcatttgccgtgacctagg

SEQ ID NO: 652260 - DNA, 25 bp, Mus musculus
gagacttccgcgctgatgacgctga

SEQ ID NO: 652261 - DNA, 25 bp, Mus musculus
gagacttccgcggtgatgacgctga

SEQ ID NO: 652262 - DNA, 25 bp, Mus musculus
gagacttccggacgcacttcagcat

SEQ ID NO: 652263 - DNA, 25 bp, Mus musculus
gagacttccggaggcacttcagcat

SEQ ID NO: 652264 - DNA, 25 bp, Mus musculus
gagacttcggctatgaaattaaatg

SEQ ID NO: 652265 - DNA, 25 bp, Mus musculus
gagacttcggctttgaaattaaatg

SEQ ID NO: 652266 - DNA, 25 bp, Mus musculus
gagacttcgggaatccgctgaggaa

SEQ ID NO: 652267 - DNA, 25 bp, Mus musculus
gagacttcgggattccgctgaggaa

SEQ ID NO: 652268 - DNA, 25 bp, Mus musculus
gagacttctccacagtttcagtgac

SEQ ID NO: 652269 - DNA, 25 bp, Mus musculus
gagacttctccagagtttcagtgac

SEQ ID NO: 652270 - DNA, 25 bp, Mus musculus
gagacttcttcacagggtccctgcg

SEQ ID NO: 652271 - DNA, 25 bp, Mus musculus
gagacttcttcagagggtccctgcg

SEQ ID NO: 652272 - DNA, 25 bp, Mus musculus
gagacttgagggacctccaagtgga

SEQ ID NO: 652273 - DNA, 25 bp, Mus musculus
gagacttgagggtcctccaagtgga

SEQ ID NO: 652274 - DNA, 25 bp, Mus musculus
gagacttgccagattcctgacccct

SEQ ID NO: 652275 - DNA, 25 bp, Mus musculus
gagacttgccagtttcctgacccct

SEQ ID NO: 652276 - DNA, 25 bp, Mus musculus
gagacttgctcactatctctgatgg

SEQ ID NO: 652277 - DNA, 25 bp, Mus musculus
gagacttgctcagtatctctgatgg

SEQ ID NO: 652278 - DNA, 25 bp, Mus musculus
gagacttggaatcaaccagaccacc

SEQ ID NO: 652279 - DNA, 25 bp, Mus musculus
gagacttggaatgaaccagaccacc

SEQ ID NO: 652280 - DNA, 25 bp, Mus musculus
gagacttggaccatgggccatcctt

SEQ ID NO: 652281 - DNA, 25 bp, Mus musculus
gagacttggaccttgggccatcctt

SEQ ID NO: 652282 - DNA, 25 bp, Mus musculus
gagacttgggcaattgctggacgct

SEQ ID NO: 652283 - DNA, 25 bp, Mus musculus
gagacttgggcatttgctggacgct

SEQ ID NO: 652284 - DNA, 25 bp, Mus musculus
gagacttgtacacacggaatccgtc

SEQ ID NO: 652285 - DNA, 25 bp, Mus musculus
gagacttgtacagacggaatccgtc

SEQ ID NO: 652286 - DNA, 25 bp, Mus musculus
gagacttgtccgctttgcccgagat

SEQ ID NO: 652287 - DNA, 25 bp, Mus musculus
gagacttgtccggtttgcccgagat

SEQ ID NO: 652288 - DNA, 25 bp, Mus musculus
gagactttattcagtgctctaacca

SEQ ID NO: 652289 - DNA, 25 bp, Mus musculus
gagactttattctgtgctctaacca

SEQ ID NO: 652290 - DNA, 25 bp, Mus musculus
gagactttatttcttccaggcacag

SEQ ID NO: 652291 - DNA, 25 bp, Mus musculus
gagactttatttgttccaggcacag

SEQ ID NO: 652292 - DNA, 25 bp, Mus musculus
gagactttcatgcactgtctggaag

SEQ ID NO: 652293 - DNA, 25 bp, Mus musculus
gagactttcatggactgtctggaag

SEQ ID NO: 652294 - DNA, 25 bp, Mus musculus
gagactttccttacttgactcctta

SEQ ID NO: 652295 - DNA, 25 bp, Mus musculus
gagactttcctttcttgactcctta

SEQ ID NO: 652296 - DNA, 25 bp, Mus musculus
gagactttctacacaatgagcagca

SEQ ID NO: 652297 - DNA, 25 bp, Mus musculus
gagactttctactcaatgagcagca

SEQ ID NO: 652298 - DNA, 25 bp, Mus musculus
gagactttctgaatctccctcacaa

SEQ ID NO: 652299 - DNA, 25 bp, Mus musculus
gagactttctgattctccctcacaa

SEQ ID NO: 652300 - DNA, 25 bp, Mus musculus
gagactttctggaacattggtgtta

SEQ ID NO: 652301 - DNA, 25 bp, Mus musculus
gagactttctggtacattggtgtta

SEQ ID NO: 652302 - DNA, 25 bp, Mus musculus
gagacttttcatagggcgtcctcgg

SEQ ID NO: 652303 - DNA, 25 bp, Mus musculus
gagacttttcattgggcgtcctcgg

SEQ ID NO: 652304 - DNA, 25 bp, Mus musculus
gagacttttcccatctctagtgtcc

SEQ ID NO: 652305 - DNA, 25 bp, Mus musculus
gagacttttcccttctctagtgtcc

SEQ ID NO: 652306 - DNA, 25 bp, Mus musculus
gagacttttctccattaaccgccct

SEQ ID NO: 652307 - DNA, 25 bp, Mus musculus
gagacttttctcgattaaccgccct

SEQ ID NO: 652308 - DNA, 25 bp, Mus musculus
gagacttttgacctcccagatagca

SEQ ID NO: 652309 - DNA, 25 bp, Mus musculus
gagacttttgacgtcccagatagca

SEQ ID NO: 652310 - DNA, 25 bp, Mus musculus
gagacttttgctcagcgccttccaa

SEQ ID NO: 652311 - DNA, 25 bp, Mus musculus
gagacttttgctgagcgccttccaa

SEQ ID NO: 652312 - DNA, 25 bp, Mus musculus
gagactttttcaagactctccggaa

SEQ ID NO: 652313 - DNA, 25 bp, Mus musculus
gagactttttcatgactctccggaa

SEQ ID NO: 652314 - DNA, 25 bp, Mus musculus
gagagaaaaagtcgcgctggatcaa

SEQ ID NO: 652315 - DNA, 25 bp, Mus musculus
gagagaaaaagtggcgctggatcaa

SEQ ID NO: 652316 - DNA, 25 bp, Mus musculus
gagagaaaagctagccacagtcaac

SEQ ID NO: 652317 - DNA, 25 bp, Mus musculus
gagagaaaagcttgccacagtcaac

SEQ ID NO: 652318 - DNA, 25 bp, Mus musculus
gagagaaacctgacatgagctgcca

SEQ ID NO: 652319 - DNA, 25 bp, Mus musculus
gagagaaacctgtcatgagctgcca

SEQ ID NO: 652320 - DNA, 25 bp, Mus musculus
gagagaaactgcctgtaatttctga

SEQ ID NO: 652321 - DNA, 25 bp, Mus musculus
gagagaaactgcgtgtaatttctga

SEQ ID NO: 652322 - DNA, 25 bp, Mus musculus
gagagaaagacaagcttataccagg

SEQ ID NO: 652323 - DNA, 25 bp, Mus musculus
gagagaaagacatgcttataccagg

SEQ ID NO: 652324 - DNA, 25 bp, Mus musculus
gagagaaagaccaggaattccgctc

SEQ ID NO: 652325 - DNA, 25 bp, Mus musculus
gagagaaagacctggaattccgctc

SEQ ID NO: 652326 - DNA, 25 bp, Mus musculus
gagagaaagatgcagatgcccttcc

SEQ ID NO: 652327 - DNA, 25 bp, Mus musculus
gagagaaagatggagatgcccttcc

SEQ ID NO: 652328 - DNA, 25 bp, Mus musculus
gagagaaagctaagctccggcaaac

SEQ ID NO: 652329 - DNA, 25 bp, Mus musculus
gagagaaagctatgctccggcaaac

SEQ ID NO: 652330 - DNA, 25 bp, Mus musculus
gagagaaatcccaggctataaagga

SEQ ID NO: 652331 - DNA, 25 bp, Mus musculus
gagagaaatccctggctataaagga

SEQ ID NO: 652332 - DNA, 25 bp, Mus musculus
gagagaaattatccgaatcacttca

SEQ ID NO: 652333 - DNA, 25 bp, Mus musculus
gagagaaattatgcgaatcacttca

SEQ ID NO: 652334 - DNA, 25 bp, Mus musculus
gagagaacaccccatgtgacacaga

SEQ ID NO: 652335 - DNA, 25 bp, Mus musculus
gagagaacacccgatgtgacacaga

SEQ ID NO: 652336 - DNA, 25 bp, Mus musculus
gagagaacacttacacaactatagg

SEQ ID NO: 652337 - DNA, 25 bp, Mus musculus
gagagaacactttcacaactatagg

SEQ ID NO: 652338 - DNA, 25 bp, Mus musculus
gagagaaccccaccatactgacacg

SEQ ID NO: 652339 - DNA, 25 bp, Mus musculus
gagagaaccccagcatactgacacg

SEQ ID NO: 652340 - DNA, 25 bp, Mus musculus
gagagaaccctgaacctagctcaag

SEQ ID NO: 652341 - DNA, 25 bp, Mus musculus
gagagaaccctgtacctagctcaag

SEQ ID NO: 652342 - DNA, 25 bp, Mus musculus
gagagaacctgcaggtgaaaattgg

SEQ ID NO: 652343 - DNA, 25 bp, Mus musculus
gagagaacctgctggtgaaaattgg

SEQ ID NO: 652344 - DNA, 25 bp, Mus musculus
gagagaacgatcaacaagaaaaagc

SEQ ID NO: 652345 - DNA, 25 bp, Mus musculus
gagagaacgatctacaagaaaaagc

SEQ ID NO: 652346 - DNA, 25 bp, Mus musculus
gagagaactgcaagctgtcacctct

SEQ ID NO: 652347 - DNA, 25 bp, Mus musculus
gagagaactgcatgctgtcacctct

SEQ ID NO: 652348 - DNA, 25 bp, Mus musculus
gagagaagagaaatccctgagactc

SEQ ID NO: 652349 - DNA, 25 bp, Mus musculus
gagagaagagaattccctgagactc

SEQ ID NO: 652350 - DNA, 25 bp, Mus musculus
gagagaagagcaagttccacaccag

SEQ ID NO: 652351 - DNA, 25 bp, Mus musculus
gagagaagagcatgttccacaccag

SEQ ID NO: 652352 - DNA, 25 bp, Mus musculus
gagagaagcactagatctacctgct

SEQ ID NO: 652353 - DNA, 25 bp, Mus musculus
gagagaagcacttgatctacctgct

SEQ ID NO: 652354 - DNA, 25 bp, Mus musculus
gagagaagctttagcaacccaagga

SEQ ID NO: 652355 - DNA, 25 bp, Mus musculus
gagagaagcttttgcaacccaagga

SEQ ID NO: 652356 - DNA, 25 bp, Mus musculus
gagagaaggagaacacggcttcccc

SEQ ID NO: 652357 - DNA, 25 bp, Mus musculus
gagagaaggagatcacggcttcccc

SEQ ID NO: 652358 - DNA, 25 bp, Mus musculus
gagagaaggcaacgttacaagacct

SEQ ID NO: 652359 - DNA, 25 bp, Mus musculus
gagagaaggcaaggttacaagacct

SEQ ID NO: 652360 - DNA, 25 bp, Mus musculus
gagagaagtcataagccctgggcac

SEQ ID NO: 652361 - DNA, 25 bp, Mus musculus
gagagaagtcattagccctgggcac

SEQ ID NO: 652362 - DNA, 25 bp, Mus musculus
gagagaagttatcagtgccccggaa

SEQ ID NO: 652363 - DNA, 25 bp, Mus musculus
gagagaagttatgagtgccccggaa

SEQ ID NO: 652364 - DNA, 25 bp, Mus musculus
gagagaagttttcactgctgtggct

SEQ ID NO: 652365 - DNA, 25 bp, Mus musculus
gagagaagttttgactgctgtggct

SEQ ID NO: 652366 - DNA, 25 bp, Mus musculus
gagagaatcaatccttacaagctgt

SEQ ID NO: 652367 - DNA, 25 bp, Mus musculus
gagagaatcaatgcttacaagctgt

SEQ ID NO: 652368 - DNA, 25 bp, Mus musculus
gagagaatccagactcagcagggcc

SEQ ID NO: 652369 - DNA, 25 bp, Mus musculus
gagagaatccagtctcagcagggcc

SEQ ID NO: 652370 - DNA, 25 bp, Mus musculus
gagagaatccggctcacttttgaaa

SEQ ID NO: 652371 - DNA, 25 bp, Mus musculus
gagagaatccgggtcacttttgaaa

SEQ ID NO: 652372 - DNA, 25 bp, Mus musculus
gagagaatcctaccagatcttgagg

SEQ ID NO: 652373 - DNA, 25 bp, Mus musculus
gagagaatcctagcagatcttgagg

SEQ ID NO: 652374 - DNA, 25 bp, Mus musculus
gagagaatctggaattagaccgcca

SEQ ID NO: 652375 - DNA, 25 bp, Mus musculus
gagagaatctggtattagaccgcca

SEQ ID NO: 652376 - DNA, 25 bp, Mus musculus
gagagaatctttcccaggcacatgc

SEQ ID NO: 652377 - DNA, 25 bp, Mus musculus
gagagaatctttgccaggcacatgc

SEQ ID NO: 652378 - DNA, 25 bp, Mus musculus
gagagaatgacgctcttcaggcagt

SEQ ID NO: 652379 - DNA, 25 bp, Mus musculus
gagagaatgacggtcttcaggcagt

SEQ ID NO: 652380 - DNA, 25 bp, Mus musculus
gagagaatgccaactccagactgct

SEQ ID NO: 652381 - DNA, 25 bp, Mus musculus
gagagaatgccatctccagactgct

SEQ ID NO: 652382 - DNA, 25 bp, Mus musculus
gagagaatggttaccctggtcagat

SEQ ID NO: 652383 - DNA, 25 bp, Mus musculus
gagagaatggttccatttaatccct

SEQ ID NO: 652384 - DNA, 25 bp, Mus musculus
gagagaatggttgcatttaatccct

SEQ ID NO: 652385 - DNA, 25 bp, Mus musculus
gagagaatggtttccctggtcagat

SEQ ID NO: 652386 - DNA, 25 bp, Mus musculus
gagagaatgtcactagaggagacca

SEQ ID NO: 652387 - DNA, 25 bp, Mus musculus
gagagaatgtcagtagaggagacca

SEQ ID NO: 652388 - DNA, 25 bp, Mus musculus
gagagacaaaaccagatcaaatgca

SEQ ID NO: 652389 - DNA, 25 bp, Mus musculus
gagagacaaaacgagatcaaatgca

SEQ ID NO: 652390 - DNA, 25 bp, Mus musculus
gagagacaaattccatgatgaagag

SEQ ID NO: 652391 - DNA, 25 bp, Mus musculus
gagagacaaattgcatgatgaagag

SEQ ID NO: 652392 - DNA, 25 bp, Mus musculus
gagagacaacttcacaccaaataac

SEQ ID NO: 652393 - DNA, 25 bp, Mus musculus
gagagacaacttgacaccaaataac

SEQ ID NO: 652394 - DNA, 25 bp, Mus musculus
gagagacagaccagggaaacacagt

SEQ ID NO: 652395 - DNA, 25 bp, Mus musculus
gagagacagacctgggaaacacagt

SEQ ID NO: 652396 - DNA, 25 bp, Mus musculus
gagagacagaggacactggatagac

SEQ ID NO: 652397 - DNA, 25 bp, Mus musculus
gagagacagaggtcactggatagac

SEQ ID NO: 652398 - DNA, 25 bp, Mus musculus
gagagacagctcctgtcctttggaa

SEQ ID NO: 652399 - DNA, 25 bp, Mus musculus
gagagacagctcgtgtcctttggaa

SEQ ID NO: 652400 - DNA, 25 bp, Mus musculus
gagagaccaactccctgaaccacat

SEQ ID NO: 652401 - DNA, 25 bp, Mus musculus
gagagaccaactgcctgaaccacat

SEQ ID NO: 652402 - DNA, 25 bp, Mus musculus
gagagaccacgacgctatacgtcca

SEQ ID NO: 652403 - DNA, 25 bp, Mus musculus
gagagaccacgaggctatacgtcca

SEQ ID NO: 652404 - DNA, 25 bp, Mus musculus
gagagaccatatatgtcattgggca

SEQ ID NO: 652405 - DNA, 25 bp, Mus musculus
gagagaccatatttgtcattgggca

SEQ ID NO: 652406 - DNA, 25 bp, Mus musculus
gagagacccactccctgtggatctg

SEQ ID NO: 652407 - DNA, 25 bp, Mus musculus
gagagacccactgcctgtggatctg

SEQ ID NO: 652408 - DNA, 25 bp, Mus musculus
gagagaccccgaaacatacggaact

SEQ ID NO: 652409 - DNA, 25 bp, Mus musculus
gagagaccccgatacatacggaact

SEQ ID NO: 652410 - DNA, 25 bp, Mus musculus
gagagaccgggtcacagctttcttc

SEQ ID NO: 652411 - DNA, 25 bp, Mus musculus
gagagaccgggtgacagctttcttc

SEQ ID NO: 652412 - DNA, 25 bp, Mus musculus
gagagaccgtgcagtcgctacagaa

SEQ ID NO: 652413 - DNA, 25 bp, Mus musculus
gagagaccgtgctgtcgctacagaa

SEQ ID NO: 652414 - DNA, 25 bp, Mus musculus
gagagacctagaaccaaagacggag

SEQ ID NO: 652415 - DNA, 25 bp, Mus musculus
gagagacctagatccaaagacggag

SEQ ID NO: 652416 - DNA, 25 bp, Mus musculus
gagagacctctgagacttaccgaga

SEQ ID NO: 652417 - DNA, 25 bp, Mus musculus
gagagacctctgtgacttaccgaga

SEQ ID NO: 652418 - DNA, 25 bp, Mus musculus
gagagacctggccatgacctacaaa

SEQ ID NO: 652419 - DNA, 25 bp, Mus musculus
gagagacctggcgatgacctacaaa

SEQ ID NO: 652420 - DNA, 25 bp, Mus musculus
gagagacgaaggcatgcccattgtc

SEQ ID NO: 652421 - DNA, 25 bp, Mus musculus
gagagacgaagggatgcccattgtc

SEQ ID NO: 652422 - DNA, 25 bp, Mus musculus
gagagacgaagtcccacccacctgg

SEQ ID NO: 652423 - DNA, 25 bp, Mus musculus
gagagacgaagtgccacccacctgg

SEQ ID NO: 652424 - DNA, 25 bp, Mus musculus
gagagacggagacggagtcggagac

SEQ ID NO: 652425 - DNA, 25 bp, Mus musculus
gagagacggagagggagtcggagac

SEQ ID NO: 652426 - DNA, 25 bp, Mus musculus
gagagacggcctacacgtacgcggt

SEQ ID NO: 652427 - DNA, 25 bp, Mus musculus
gagagacggccttcacgtacgcggt

SEQ ID NO: 652428 - DNA, 25 bp, Mus musculus
gagagacggtctcacgatatacctc

SEQ ID NO: 652429 - DNA, 25 bp, Mus musculus
gagagacggtctgacgatatacctc

SEQ ID NO: 652430 - DNA, 25 bp, Mus musculus
gagagactatgtccctcccactgct

SEQ ID NO: 652431 - DNA, 25 bp, Mus musculus
gagagactatgtgcctcccactgct

SEQ ID NO: 652432 - DNA, 25 bp, Mus musculus
gagagactcgagatattactgggaa

SEQ ID NO: 652433 - DNA, 25 bp, Mus musculus
gagagactcgagttattactgggaa

SEQ ID NO: 652434 - DNA, 25 bp, Mus musculus
gagagactctacatcaacccacgag

SEQ ID NO: 652435 - DNA, 25 bp, Mus musculus
gagagactctacttcaacccacgag

SEQ ID NO: 652436 - DNA, 25 bp, Mus musculus
gagagactctgtcggctgagctcaa

SEQ ID NO: 652437 - DNA, 25 bp, Mus musculus
gagagactctgtgggctgagctcaa

SEQ ID NO: 652438 - DNA, 25 bp, Mus musculus
gagagactgcatctaagctcgctcg

SEQ ID NO: 652439 - DNA, 25 bp, Mus musculus
gagagactgcatgtaagctcgctcg

SEQ ID NO: 652440 - DNA, 25 bp, Mus musculus
gagagactgccaaaagctgtaacgg

SEQ ID NO: 652441 - DNA, 25 bp, Mus musculus
gagagactgccataagctgtaacgg

SEQ ID NO: 652442 - DNA, 25 bp, Mus musculus
gagagactgctcagcgttcttgaca

SEQ ID NO: 652443 - DNA, 25 bp, Mus musculus
gagagactgctctgcgttcttgaca

SEQ ID NO: 652444 - DNA, 25 bp, Mus musculus
gagagactgtaaagcgaatccggga

SEQ ID NO: 652445 - DNA, 25 bp, Mus musculus
gagagactgtaatgcgaatccggga

SEQ ID NO: 652446 - DNA, 25 bp, Mus musculus
gagagactgtctctactgattgcat

SEQ ID NO: 652447 - DNA, 25 bp, Mus musculus
gagagactgtctgtactgattgcat

SEQ ID NO: 652448 - DNA, 25 bp, Mus musculus
gagagacttattcttggagagagac

SEQ ID NO: 652449 - DNA, 25 bp, Mus musculus
gagagacttattgttggagagagac

SEQ ID NO: 652450 - DNA, 25 bp, Mus musculus
gagagacttctactaccagggactg

SEQ ID NO: 652451 - DNA, 25 bp, Mus musculus
gagagacttctagtaccagggactg

SEQ ID NO: 652452 - DNA, 25 bp, Mus musculus
gagagacttctgaaacagctttgcg

SEQ ID NO: 652453 - DNA, 25 bp, Mus musculus
gagagacttctgatctcgactcctc

SEQ ID NO: 652454 - DNA, 25 bp, Mus musculus
gagagacttctgtaacagctttgcg

SEQ ID NO: 652455 - DNA, 25 bp, Mus musculus
gagagacttctgttctcgactcctc

SEQ ID NO: 652456 - DNA, 25 bp, Mus musculus
gagagacttgcaccttaacactgga

SEQ ID NO: 652457 - DNA, 25 bp, Mus musculus
gagagacttgcagcttaacactgga

SEQ ID NO: 652458 - DNA, 25 bp, Mus musculus
gagagagaaacaattagccagcttt

SEQ ID NO: 652459 - DNA, 25 bp, Mus musculus
gagagagaaacatttagccagcttt

SEQ ID NO: 652460 - DNA, 25 bp, Mus musculus
gagagagaaactcacagagttgatg

SEQ ID NO: 652461 - DNA, 25 bp, Mus musculus
gagagagaaactgacagagttgatg

SEQ ID NO: 652462 - DNA, 25 bp, Mus musculus
gagagagaagacagtaataatggcg

SEQ ID NO: 652463 - DNA, 25 bp, Mus musculus
gagagagaagactgtaataatggcg

SEQ ID NO: 652464 - DNA, 25 bp, Mus musculus
gagagagaagttatcagtgccccgg

SEQ ID NO: 652465 - DNA, 25 bp, Mus musculus
gagagagaagttttcagtgccccgg

SEQ ID NO: 652466 - DNA, 25 bp, Mus musculus
gagagagaatacacaacacttgtct

SEQ ID NO: 652467 - DNA, 25 bp, Mus musculus
gagagagaatactcaacacttgtct

SEQ ID NO: 652468 - DNA, 25 bp, Mus musculus
gagagagacatcaaagaccaaagac

SEQ ID NO: 652469 - DNA, 25 bp, Mus musculus
gagagagacatctaagaccaaagac

SEQ ID NO: 652470 - DNA, 25 bp, Mus musculus
gagagagaccaacttaatgcagacc

SEQ ID NO: 652471 - DNA, 25 bp, Mus musculus
gagagagaccaagttaatgcagacc

SEQ ID NO: 652472 - DNA, 25 bp, Mus musculus
gagagagaccagatacccttctctg

SEQ ID NO: 652473 - DNA, 25 bp, Mus musculus
gagagagaccagttacccttctctg

SEQ ID NO: 652474 - DNA, 25 bp, Mus musculus
gagagagacctgcaggtgtacctcc

SEQ ID NO: 652475 - DNA, 25 bp, Mus musculus
gagagagacctggaggtgtacctcc

SEQ ID NO: 652476 - DNA, 25 bp, Mus musculus
gagagagaggcacctgaattctgtt

SEQ ID NO: 652477 - DNA, 25 bp, Mus musculus
gagagagaggcagctgaattctgtt

SEQ ID NO: 652478 - DNA, 25 bp, Mus musculus
gagagagatggcaagaaatataagc

SEQ ID NO: 652479 - DNA, 25 bp, Mus musculus
gagagagatggctagaaatataagc

SEQ ID NO: 652480 - DNA, 25 bp, Mus musculus
gagagagcaaacaacctttccccta

SEQ ID NO: 652481 - DNA, 25 bp, Mus musculus
gagagagcaaactacctttccccta

SEQ ID NO: 652482 - DNA, 25 bp, Mus musculus
gagagagcagacctcctctcggctc

SEQ ID NO: 652483 - DNA, 25 bp, Mus musculus
gagagagcagacgtcctctcggctc

SEQ ID NO: 652484 - DNA, 25 bp, Mus musculus
gagagagccatcacaccaaacaaag

SEQ ID NO: 652485 - DNA, 25 bp, Mus musculus
gagagagccatctcaccaaacaaag

SEQ ID NO: 652486 - DNA, 25 bp, Mus musculus
gagagagccgtgaaggactacatct

SEQ ID NO: 652487 - DNA, 25 bp, Mus musculus
gagagagccgtgtaggactacatct

SEQ ID NO: 652488 - DNA, 25 bp, Mus musculus
gagagagcctagaggatttgatgaa

SEQ ID NO: 652489 - DNA, 25 bp, Mus musculus
gagagagcctagtggatttgatgaa

SEQ ID NO: 652490 - DNA, 25 bp, Mus musculus
gagagagcctgtcttccgaaggccc

SEQ ID NO: 652491 - DNA, 25 bp, Mus musculus
gagagagcctgtgttccgaaggccc

SEQ ID NO: 652492 - DNA, 25 bp, Mus musculus
gagagagcgtctctctccaggaacc

SEQ ID NO: 652493 - DNA, 25 bp, Mus musculus
gagagagcgtctgtctccaggaacc

SEQ ID NO: 652494 - DNA, 25 bp, Mus musculus
gagagagctcatacagagcttgctt

SEQ ID NO: 652495 - DNA, 25 bp, Mus musculus
gagagagctcattcagagcttgctt

SEQ ID NO: 652496 - DNA, 25 bp, Mus musculus
gagagagctccccacaagcaggccg

SEQ ID NO: 652497 - DNA, 25 bp, Mus musculus
gagagagctcccgacaagcaggccg

SEQ ID NO: 652498 - DNA, 25 bp, Mus musculus
gagagagctggtagtcatcttttac

SEQ ID NO: 652499 - DNA, 25 bp, Mus musculus
gagagagctggttgtcatcttttac

SEQ ID NO: 652500 - DNA, 25 bp, Mus musculus
gagagagcttgtcaacattccactg

SEQ ID NO: 652501 - DNA, 25 bp, Mus musculus
gagagagcttgtgaacattccactg

SEQ ID NO: 652502 - DNA, 25 bp, Mus musculus
gagagaggccttaccaggaagcaca

SEQ ID NO: 652503 - DNA, 25 bp, Mus musculus
gagagaggcctttccaggaagcaca

SEQ ID NO: 652504 - DNA, 25 bp, Mus musculus
gagagaggcttcaagcaggaagatc

SEQ ID NO: 652505 - DNA, 25 bp, Mus musculus
gagagaggcttccagcagattagct

SEQ ID NO: 652506 - DNA, 25 bp, Mus musculus
gagagaggcttcgagcagattagct

SEQ ID NO: 652507 - DNA, 25 bp, Mus musculus
gagagaggcttctagcaggaagatc

SEQ ID NO: 652508 - DNA, 25 bp, Mus musculus
gagagagggcaaaggccctgttacc

SEQ ID NO: 652509 - DNA, 25 bp, Mus musculus
gagagagggcaatggccctgttacc

SEQ ID NO: 652510 - DNA, 25 bp, Mus musculus
gagagaggtccccaggagaactaca

SEQ ID NO: 652511 - DNA, 25 bp, Mus musculus
gagagaggtcccgaggagaactaca

SEQ ID NO: 652512 - DNA, 25 bp, Mus musculus
gagagaggtcctatcaaaaccaaac

SEQ ID NO: 652513 - DNA, 25 bp, Mus musculus
gagagaggtcctttcaaaaccaaac

SEQ ID NO: 652514 - DNA, 25 bp, Mus musculus
gagagaggtgctagtctagccccaa

SEQ ID NO: 652515 - DNA, 25 bp, Mus musculus
gagagaggtgcttgtctagccccaa

SEQ ID NO: 652516 - DNA, 25 bp, Mus musculus
gagagagtcctacagacagaaggaa

SEQ ID NO: 652517 - DNA, 25 bp, Mus musculus
gagagagtcctagagacagaaggaa

SEQ ID NO: 652518 - DNA, 25 bp, Mus musculus
gagagagtgttaccatcgaggccca

SEQ ID NO: 652519 - DNA, 25 bp, Mus musculus
gagagagtgttagcatcgaggccca

SEQ ID NO: 652520 - DNA, 25 bp, Mus musculus
gagagagttgacaaaggcattgaga

SEQ ID NO: 652521 - DNA, 25 bp, Mus musculus
gagagagttgactaaggcattgaga

SEQ ID NO: 652522 - DNA, 25 bp, Mus musculus
gagagagtttttagagataatgccc

SEQ ID NO: 652523 - DNA, 25 bp, Mus musculus
gagagagttttttgagataatgccc

SEQ ID NO: 652524 - DNA, 25 bp, Mus musculus
gagagatacagacccatcacctctg

SEQ ID NO: 652525 - DNA, 25 bp, Mus musculus
gagagatacagagccatcacctctg

SEQ ID NO: 652526 - DNA, 25 bp, Mus musculus
gagagatacataccaaacagcaact

SEQ ID NO: 652527 - DNA, 25 bp, Mus musculus
gagagatacatagcaaacagcaact

SEQ ID NO: 652528 - DNA, 25 bp, Mus musculus
gagagatagctaccaaccggtgagt

SEQ ID NO: 652529 - DNA, 25 bp, Mus musculus
gagagatagctagcaaccggtgagt

SEQ ID NO: 652530 - DNA, 25 bp, Mus musculus
gagagatagttccattctgtaatgc

SEQ ID NO: 652531 - DNA, 25 bp, Mus musculus
gagagatagttcgattctgtaatgc

SEQ ID NO: 652532 - DNA, 25 bp, Mus musculus
gagagatcgggacttggaaaaccca

SEQ ID NO: 652533 - DNA, 25 bp, Mus musculus
gagagatcgggagttggaaaaccca

SEQ ID NO: 652534 - DNA, 25 bp, Mus musculus
gagagatctccgcatatccatgtag

SEQ ID NO: 652535 - DNA, 25 bp, Mus musculus
gagagatctccggatatccatgtag

SEQ ID NO: 652536 - DNA, 25 bp, Mus musculus
gagagatctgcacataaaacctggg

SEQ ID NO: 652537 - DNA, 25 bp, Mus musculus
gagagatctgcagataaaacctggg

SEQ ID NO: 652538 - DNA, 25 bp, Mus musculus
gagagatcttctcctgggacacaca

SEQ ID NO: 652539 - DNA, 25 bp, Mus musculus
gagagatcttctgctgggacacaca

SEQ ID NO: 652540 - DNA, 25 bp, Mus musculus
gagagatgacggaagtacaatgatg

SEQ ID NO: 652541 - DNA, 25 bp, Mus musculus
gagagatgacggtagtacaatgatg

SEQ ID NO: 652542 - DNA, 25 bp, Mus musculus
gagagatgactcagaaaccaagagc

SEQ ID NO: 652543 - DNA, 25 bp, Mus musculus
gagagatgactctgaaaccaagagc

SEQ ID NO: 652544 - DNA, 25 bp, Mus musculus
gagagatgaggtatcacctaccagc

SEQ ID NO: 652545 - DNA, 25 bp, Mus musculus
gagagatgaggtttcacctaccagc

SEQ ID NO: 652546 - DNA, 25 bp, Mus musculus
gagagatgatatacccaagattgct

SEQ ID NO: 652547 - DNA, 25 bp, Mus musculus
gagagatgatattcccaagattgct

SEQ ID NO: 652548 - DNA, 25 bp, Mus musculus
gagagatgcctgcttaaatgcccgc

SEQ ID NO: 652549 - DNA, 25 bp, Mus musculus
gagagatgcctggttaaatgcccgc

SEQ ID NO: 652550 - DNA, 25 bp, Mus musculus
gagagatgctctacctggctactcg

SEQ ID NO: 652551 - DNA, 25 bp, Mus musculus
gagagatgctcttcctggctactcg

SEQ ID NO: 652552 - DNA, 25 bp, Mus musculus
gagagatggccaagtccagttctgg

SEQ ID NO: 652553 - DNA, 25 bp, Mus musculus
gagagatggccatgtccagttctgg

SEQ ID NO: 652554 - DNA, 25 bp, Mus musculus
gagagatggtagaagagttaatcct

SEQ ID NO: 652555 - DNA, 25 bp, Mus musculus
gagagatggtagtagagttaatcct

SEQ ID NO: 652556 - DNA, 25 bp, Mus musculus
gagagatgtctgcagttcttacaga

SEQ ID NO: 652557 - DNA, 25 bp, Mus musculus
gagagatgtctggagttcttacaga

SEQ ID NO: 652558 - DNA, 25 bp, Mus musculus
gagagatgtcttcgatgaccttgta

SEQ ID NO: 652559 - DNA, 25 bp, Mus musculus
gagagatgtcttggatgaccttgta

SEQ ID NO: 652560 - DNA, 25 bp, Mus musculus
gagagatgttatcacctccaaagtt

SEQ ID NO: 652561 - DNA, 25 bp, Mus musculus
gagagatgttatgacctccaaagtt

SEQ ID NO: 652562 - DNA, 25 bp, Mus musculus
gagagattcaagaagtagccacggg

SEQ ID NO: 652563 - DNA, 25 bp, Mus musculus
gagagattcaagtagtagccacggg

SEQ ID NO: 652564 - DNA, 25 bp, Mus musculus
gagagattcagaagcgggaacgaaa

SEQ ID NO: 652565 - DNA, 25 bp, Mus musculus
gagagattcagatgcgggaacgaaa

SEQ ID NO: 652566 - DNA, 25 bp, Mus musculus
gagagattcctgaggagagacttat

SEQ ID NO: 652567 - DNA, 25 bp, Mus musculus
gagagattcctgtggagagacttat

SEQ ID NO: 652568 - DNA, 25 bp, Mus musculus
gagagatttagactccaagcggcag

SEQ ID NO: 652569 - DNA, 25 bp, Mus musculus
gagagatttagagtccaagcggcag

SEQ ID NO: 652570 - DNA, 25 bp, Mus musculus
gagagcaaacgaagcttcatgggaa

SEQ ID NO: 652571 - DNA, 25 bp, Mus musculus
gagagcaaacgatgcttcatgggaa

SEQ ID NO: 652572 - DNA, 25 bp, Mus musculus
gagagcaaactgcaataactcctac

SEQ ID NO: 652573 - DNA, 25 bp, Mus musculus
gagagcaaactggaataactcctac

SEQ ID NO: 652574 - DNA, 25 bp, Mus musculus
gagagcaaccttcgtaaagcctttg

SEQ ID NO: 652575 - DNA, 25 bp, Mus musculus
gagagcaaccttggtaaagcctttg

SEQ ID NO: 652576 - DNA, 25 bp, Mus musculus
gagagcaacgccacctacttggatc

SEQ ID NO: 652577 - DNA, 25 bp, Mus musculus
gagagcaacgcctcctacttggatc

SEQ ID NO: 652578 - DNA, 25 bp, Mus musculus
gagagcaactgcctcaacgagttag

SEQ ID NO: 652579 - DNA, 25 bp, Mus musculus
gagagcaactgcgtcaacgagttag

SEQ ID NO: 652580 - DNA, 25 bp, Mus musculus
gagagcaacttcaaggagccggtga

SEQ ID NO: 652581 - DNA, 25 bp, Mus musculus
gagagcaacttctaggagccggtga

SEQ ID NO: 652582 - DNA, 25 bp, Mus musculus
gagagcaagcatacagtcccaagag

SEQ ID NO: 652583 - DNA, 25 bp, Mus musculus
gagagcaagcattcagtcccaagag

SEQ ID NO: 652584 - DNA, 25 bp, Mus musculus
gagagcaaggaacaacatctgtcct

SEQ ID NO: 652585 - DNA, 25 bp, Mus musculus
gagagcaaggaagaacatctgtcct

SEQ ID NO: 652586 - DNA, 25 bp, Mus musculus
gagagcaatattacactaagtgcag

SEQ ID NO: 652587 - DNA, 25 bp, Mus musculus
gagagcaatatttcactaagtgcag

SEQ ID NO: 652588 - DNA, 25 bp, Mus musculus
gagagcaatgctctgcatcaccatg

SEQ ID NO: 652589 - DNA, 25 bp, Mus musculus
gagagcaatgctgtgcatcaccatg

SEQ ID NO: 652590 - DNA, 25 bp, Mus musculus
gagagcaatggtccaacagacagtt

SEQ ID NO: 652591 - DNA, 25 bp, Mus musculus
gagagcaatggtgcaacagacagtt

SEQ ID NO: 652592 - DNA, 25 bp, Mus musculus
gagagcaattctaccactcctgcaa

SEQ ID NO: 652593 - DNA, 25 bp, Mus musculus
gagagcaattcttccactcctgcaa

SEQ ID NO: 652594 - DNA, 25 bp, Mus musculus
gagagcaattgacatctatacagac

SEQ ID NO: 652595 - DNA, 25 bp, Mus musculus
gagagcaattgagatctatacagac

SEQ ID NO: 652596 - DNA, 25 bp, Mus musculus
gagagcacaggcactccgagggcca

SEQ ID NO: 652597 - DNA, 25 bp, Mus musculus
gagagcacaggctctccgagggcca

SEQ ID NO: 652598 - DNA, 25 bp, Mus musculus
gagagcacccataggcttccatcga

SEQ ID NO: 652599 - DNA, 25 bp, Mus musculus
gagagcacccattggcttccatcga

SEQ ID NO: 652600 - DNA, 25 bp, Mus musculus
gagagcacgggaacacgccactgca

SEQ ID NO: 652601 - DNA, 25 bp, Mus musculus
gagagcacgggatcacgccactgca

SEQ ID NO: 652602 - DNA, 25 bp, Mus musculus
gagagcacggtcagaactattgcta

SEQ ID NO: 652603 - DNA, 25 bp, Mus musculus
gagagcacggtctgaactattgcta

SEQ ID NO: 652604 - DNA, 25 bp, Mus musculus
gagagcactcagactcgactggaca

SEQ ID NO: 652605 - DNA, 25 bp, Mus musculus
gagagcactcagtctcgactggaca

SEQ ID NO: 652606 - DNA, 25 bp, Mus musculus
gagagcactctcaagtgactttcct

SEQ ID NO: 652607 - DNA, 25 bp, Mus musculus
gagagcactctctagtgactttcct

SEQ ID NO: 652608 - DNA, 25 bp, Mus musculus
gagagcactgttctacttgactgaa

SEQ ID NO: 652609 - DNA, 25 bp, Mus musculus
gagagcactgttgtacttgactgaa

SEQ ID NO: 652610 - DNA, 25 bp, Mus musculus
gagagcacttgaacattcaggaccc

SEQ ID NO: 652611 - DNA, 25 bp, Mus musculus
gagagcacttgatcattcaggaccc

SEQ ID NO: 652612 - DNA, 25 bp, Mus musculus
gagagcagagaacccctgcagaact

SEQ ID NO: 652613 - DNA, 25 bp, Mus musculus
gagagcagagaagccctgcagaact

SEQ ID NO: 652614 - DNA, 25 bp, Mus musculus
gagagcagaggacttatgttatacc

SEQ ID NO: 652615 - DNA, 25 bp, Mus musculus
gagagcagaggagttatgttatacc

SEQ ID NO: 652616 - DNA, 25 bp, Mus musculus
gagagcagaggcaaccctgaatctc

SEQ ID NO: 652617 - DNA, 25 bp, Mus musculus
gagagcagaggctaccctgaatctc

SEQ ID NO: 652618 - DNA, 25 bp, Mus musculus
gagagcagcaccaaggctcaggaca

SEQ ID NO: 652619 - DNA, 25 bp, Mus musculus
gagagcagcaccagcgaggacaact

SEQ ID NO: 652620 - DNA, 25 bp, Mus musculus
gagagcagcacctaggctcaggaca

SEQ ID NO: 652621 - DNA, 25 bp, Mus musculus
gagagcagcacctgcgaggacaact

SEQ ID NO: 652622 - DNA, 25 bp, Mus musculus
gagagcagcataaatctcattggag

SEQ ID NO: 652623 - DNA, 25 bp, Mus musculus
gagagcagcatatatctcattggag

SEQ ID NO: 652624 - DNA, 25 bp, Mus musculus
gagagcagccggaatcagttccgca

SEQ ID NO: 652625 - DNA, 25 bp, Mus musculus
gagagcagccggtatcagttccgca

SEQ ID NO: 652626 - DNA, 25 bp, Mus musculus
gagagcagcttgaatgtcagctgca

SEQ ID NO: 652627 - DNA, 25 bp, Mus musculus
gagagcagcttgtatgtcagctgca

SEQ ID NO: 652628 - DNA, 25 bp, Mus musculus
gagagcagctttagcagcatcaacg

SEQ ID NO: 652629 - DNA, 25 bp, Mus musculus
gagagcagcttttgcagcatcaacg

SEQ ID NO: 652630 - DNA, 25 bp, Mus musculus
gagagcaggatacaaagcagccata

SEQ ID NO: 652631 - DNA, 25 bp, Mus musculus
gagagcaggatagaaagcagccata

SEQ ID NO: 652632 - DNA, 25 bp, Mus musculus
gagagcaggccgaaaacatctgtgc

SEQ ID NO: 652633 - DNA, 25 bp, Mus musculus
gagagcaggccgtaaacatctgtgc

SEQ ID NO: 652634 - DNA, 25 bp, Mus musculus
gagagcagggcacacagctttactt

SEQ ID NO: 652635 - DNA, 25 bp, Mus musculus
gagagcagggcagacagctttactt

SEQ ID NO: 652636 - DNA, 25 bp, Mus musculus
gagagcatagaaatgctagggcccc

SEQ ID NO: 652637 - DNA, 25 bp, Mus musculus
gagagcatagaattgctagggcccc

SEQ ID NO: 652638 - DNA, 25 bp, Mus musculus
gagagcatcgacaccatcatcgaca

SEQ ID NO: 652639 - DNA, 25 bp, Mus musculus
gagagcatcgactccatcatcgaca

SEQ ID NO: 652640 - DNA, 25 bp, Mus musculus
gagagcatgaatatgaagccctcat

SEQ ID NO: 652641 - DNA, 25 bp, Mus musculus
gagagcatgaatttgaagccctcat

SEQ ID NO: 652642 - DNA, 25 bp, Mus musculus
gagagcatggctcttttggaaaagc

SEQ ID NO: 652643 - DNA, 25 bp, Mus musculus
gagagcatggctgttttggaaaagc

SEQ ID NO: 652644 - DNA, 25 bp, Mus musculus
gagagcattggactccccaggactg

SEQ ID NO: 652645 - DNA, 25 bp, Mus musculus
gagagcattggagtccccaggactg

SEQ ID NO: 652646 - DNA, 25 bp, Mus musculus
gagagccaaaaaagacaaccactta

SEQ ID NO: 652647 - DNA, 25 bp, Mus musculus
gagagccaaaaatgacaaccactta

SEQ ID NO: 652648 - DNA, 25 bp, Mus musculus
gagagccaaccacagctgcttttca

SEQ ID NO: 652649 - DNA, 25 bp, Mus musculus
gagagccaaccagagctgcttttca

SEQ ID NO: 652650 - DNA, 25 bp, Mus musculus
gagagccaagtacttcatttacacc

SEQ ID NO: 652651 - DNA, 25 bp, Mus musculus
gagagccaagtagttcatttacacc

SEQ ID NO: 652652 - DNA, 25 bp, Mus musculus
gagagccaccaactgtgacttctag

SEQ ID NO: 652653 - DNA, 25 bp, Mus musculus
gagagccaccaagtgtgacttctag

SEQ ID NO: 652654 - DNA, 25 bp, Mus musculus
gagagccaccttctgaagagcggaa

SEQ ID NO: 652655 - DNA, 25 bp, Mus musculus
gagagccaccttgtgaagagcggaa

SEQ ID NO: 652656 - DNA, 25 bp, Mus musculus
gagagccacggacaactgcgttgat

SEQ ID NO: 652657 - DNA, 25 bp, Mus musculus
gagagccacggagaactgcgttgat

SEQ ID NO: 652658 - DNA, 25 bp, Mus musculus
gagagccactgtcctggttccagag

SEQ ID NO: 652659 - DNA, 25 bp, Mus musculus
gagagccactgtgctggttccagag

SEQ ID NO: 652660 - DNA, 25 bp, Mus musculus
gagagccagaacaatccatcttgac

SEQ ID NO: 652661 - DNA, 25 bp, Mus musculus
gagagccagaactatccatcttgac

SEQ ID NO: 652662 - DNA, 25 bp, Mus musculus
gagagccagacgacttttgggtcca

SEQ ID NO: 652663 - DNA, 25 bp, Mus musculus
gagagccagacgtcttttgggtcca

SEQ ID NO: 652664 - DNA, 25 bp, Mus musculus
gagagccagaggaagctccgcacat

SEQ ID NO: 652665 - DNA, 25 bp, Mus musculus
gagagccagaggtagctccgcacat

SEQ ID NO: 652666 - DNA, 25 bp, Mus musculus
gagagccagctacaaacgaatgtga

SEQ ID NO: 652667 - DNA, 25 bp, Mus musculus
gagagccagctagaaacgaatgtga

SEQ ID NO: 652668 - DNA, 25 bp, Mus musculus
gagagccatctcaccaaacaaagtg

SEQ ID NO: 652669 - DNA, 25 bp, Mus musculus
gagagccatctctccaaacaaagtg

SEQ ID NO: 652670 - DNA, 25 bp, Mus musculus
gagagccatggactgtcaccctttg

SEQ ID NO: 652671 - DNA, 25 bp, Mus musculus
gagagccatggagtgtcaccctttg

SEQ ID NO: 652672 - DNA, 25 bp, Mus musculus
gagagccatggcactcaaggtccta

SEQ ID NO: 652673 - DNA, 25 bp, Mus musculus
gagagccatggctctcaaggtccta

SEQ ID NO: 652674 - DNA, 25 bp, Mus musculus
gagagccatgggaaacctggtgaat

SEQ ID NO: 652675 - DNA, 25 bp, Mus musculus
gagagccatgggtaacctggtgaat

SEQ ID NO: 652676 - DNA, 25 bp, Mus musculus
gagagccatgtgatcactgccctca

SEQ ID NO: 652677 - DNA, 25 bp, Mus musculus
gagagccatgtgttcactgccctca

SEQ ID NO: 652678 - DNA, 25 bp, Mus musculus
gagagccatttcaacttcggtgtgc

SEQ ID NO: 652679 - DNA, 25 bp, Mus musculus
gagagccatttctacttcggtgtgc

SEQ ID NO: 652680 - DNA, 25 bp, Mus musculus
gagagcccaattccctgctccaatg

SEQ ID NO: 652681 - DNA, 25 bp, Mus musculus
gagagcccaattgcctgctccaatg

SEQ ID NO: 652682 - DNA, 25 bp, Mus musculus
gagagcccatggctcccatgccatt

SEQ ID NO: 652683 - DNA, 25 bp, Mus musculus
gagagcccatgggtcccatgccatt

SEQ ID NO: 652684 - DNA, 25 bp, Mus musculus
gagagcccatttcattcctgcgtag

SEQ ID NO: 652685 - DNA, 25 bp, Mus musculus
gagagcccatttgattcctgcgtag

SEQ ID NO: 652686 - DNA, 25 bp, Mus musculus
gagagccccagaatattgccctgaa

SEQ ID NO: 652687 - DNA, 25 bp, Mus musculus
gagagccccagattattgccctgaa

SEQ ID NO: 652688 - DNA, 25 bp, Mus musculus
gagagcccgtggacacagattggca

SEQ ID NO: 652689 - DNA, 25 bp, Mus musculus
gagagcccgtggtcacagattggca

SEQ ID NO: 652690 - DNA, 25 bp, Mus musculus
gagagccctaaacccaaaccagatc

SEQ ID NO: 652691 - DNA, 25 bp, Mus musculus
gagagccctaaagccaaaccagatc

SEQ ID NO: 652692 - DNA, 25 bp, Mus musculus
gagagccctgctacctctcaaaggg

SEQ ID NO: 652693 - DNA, 25 bp, Mus musculus
gagagccctgcttcctctcaaaggg

SEQ ID NO: 652694 - DNA, 25 bp, Mus musculus
gagagccgcgaaaagcaactagtag

SEQ ID NO: 652695 - DNA, 25 bp, Mus musculus
gagagccgcgaatagcaactagtag

SEQ ID NO: 652696 - DNA, 25 bp, Mus musculus
gagagcctacgccagggagccttct

SEQ ID NO: 652697 - DNA, 25 bp, Mus musculus
gagagcctacgcgagggagccttct

SEQ ID NO: 652698 - DNA, 25 bp, Mus musculus
gagagcctacttcaggtacagcaca

SEQ ID NO: 652699 - DNA, 25 bp, Mus musculus
gagagcctacttgaggtacagcaca

SEQ ID NO: 652700 - DNA, 25 bp, Mus musculus
gagagcctatgaccatcacctctgt

SEQ ID NO: 652701 - DNA, 25 bp, Mus musculus
gagagcctatgagcatcacctctgt

SEQ ID NO: 652702 - DNA, 25 bp, Mus musculus
gagagcctatgtcgccccagagaac

SEQ ID NO: 652703 - DNA, 25 bp, Mus musculus
gagagcctatgtggccccagagaac

SEQ ID NO: 652704 - DNA, 25 bp, Mus musculus
gagagcctcaagaaccaactggcct

SEQ ID NO: 652705 - DNA, 25 bp, Mus musculus
gagagcctcaagtaccaactggcct

SEQ ID NO: 652706 - DNA, 25 bp, Mus musculus
gagagcctcagtctggctgagaaca

SEQ ID NO: 652707 - DNA, 25 bp, Mus musculus
gagagcctcagtgtggctgagaaca

SEQ ID NO: 652708 - DNA, 25 bp, Mus musculus
gagagcctcttgagtagtagcctgg

SEQ ID NO: 652709 - DNA, 25 bp, Mus musculus
gagagcctcttgtgtagtagcctgg

SEQ ID NO: 652710 - DNA, 25 bp, Mus musculus
gagagcctgcatcaggcaaaaggca

SEQ ID NO: 652711 - DNA, 25 bp, Mus musculus
gagagcctgcatgaggcaaaaggca

SEQ ID NO: 652712 - DNA, 25 bp, Mus musculus
gagagcctgcctccatagctgtgga

SEQ ID NO: 652713 - DNA, 25 bp, Mus musculus
gagagcctgcctgcatagctgtgga

SEQ ID NO: 652714 - DNA, 25 bp, Mus musculus
gagagcctgcgaatcctgcacgtga

SEQ ID NO: 652715 - DNA, 25 bp, Mus musculus
gagagcctgcgattcctgcacgtga

SEQ ID NO: 652716 - DNA, 25 bp, Mus musculus
gagagcctggaaagacgttgatgcc

SEQ ID NO: 652717 - DNA, 25 bp, Mus musculus
gagagcctggaatgacgttgatgcc

SEQ ID NO: 652718 - DNA, 25 bp, Mus musculus
gagagcctggacaagaaggtccccg

SEQ ID NO: 652719 - DNA, 25 bp, Mus musculus
gagagcctggactagaaggtccccg

SEQ ID NO: 652720 - DNA, 25 bp, Mus musculus
gagagcctggctcaacctcatgtga

SEQ ID NO: 652721 - DNA, 25 bp, Mus musculus
gagagcctggctgaacctcatgtga

SEQ ID NO: 652722 - DNA, 25 bp, Mus musculus
gagagccttctccagcgtttgcaaa

SEQ ID NO: 652723 - DNA, 25 bp, Mus musculus
gagagccttctcgagcgtttgcaaa

SEQ ID NO: 652724 - DNA, 25 bp, Mus musculus
gagagcgagcggactccacttatgc

SEQ ID NO: 652725 - DNA, 25 bp, Mus musculus
gagagcgagcggtctccacttatgc

SEQ ID NO: 652726 - DNA, 25 bp, Mus musculus
gagagcgatcgacctaggaatccac

SEQ ID NO: 652727 - DNA, 25 bp, Mus musculus
gagagcgatcgagctaggaatccac

SEQ ID NO: 652728 - DNA, 25 bp, Mus musculus
gagagcgctgagcaatacatcgagt

SEQ ID NO: 652729 - DNA, 25 bp, Mus musculus
gagagcgctgaggaatacatcgagt

SEQ ID NO: 652730 - DNA, 25 bp, Mus musculus
gagagcgctgtgctgtccgctccca

SEQ ID NO: 652731 - DNA, 25 bp, Mus musculus
gagagcgctgtggtgtccgctccca

SEQ ID NO: 652732 - DNA, 25 bp, Mus musculus
gagagcgctgttactcatccccaga

SEQ ID NO: 652733 - DNA, 25 bp, Mus musculus
gagagcgctgtttctcatccccaga

SEQ ID NO: 652734 - DNA, 25 bp, Mus musculus
gagagcgcttcactgtccacagaac

SEQ ID NO: 652735 - DNA, 25 bp, Mus musculus
gagagcgcttcagtgtccacagaac

SEQ ID NO: 652736 - DNA, 25 bp, Mus musculus
gagagcgcttctcttctgcagcaga

SEQ ID NO: 652737 - DNA, 25 bp, Mus musculus
gagagcgcttctgttctgcagcaga

SEQ ID NO: 652738 - DNA, 25 bp, Mus musculus
gagagcgctttgactctctgacaga

SEQ ID NO: 652739 - DNA, 25 bp, Mus musculus
gagagcgctttgtctctctgacaga

SEQ ID NO: 652740 - DNA, 25 bp, Mus musculus
gagagcggaggaatatctgatattg

SEQ ID NO: 652741 - DNA, 25 bp, Mus musculus
gagagcggaggattatctgatattg

SEQ ID NO: 652742 - DNA, 25 bp, Mus musculus
gagagcggccaacgtctgccattta

SEQ ID NO: 652743 - DNA, 25 bp, Mus musculus
gagagcggccaaggtctgccattta

SEQ ID NO: 652744 - DNA, 25 bp, Mus musculus
gagagcgtctgtctccaggaacctg

SEQ ID NO: 652745 - DNA, 25 bp, Mus musculus
gagagcgtctgtgtccaggaacctg

SEQ ID NO: 652746 - DNA, 25 bp, Mus musculus
gagagcgtgactcgcccgctccagt

SEQ ID NO: 652747 - DNA, 25 bp, Mus musculus
gagagcgtgactggcccgctccagt

SEQ ID NO: 652748 - DNA, 25 bp, Mus musculus
gagagcgtgcatctaaaatttaacc

SEQ ID NO: 652749 - DNA, 25 bp, Mus musculus
gagagcgtgcatgtaaaatttaacc

SEQ ID NO: 652750 - DNA, 25 bp, Mus musculus
gagagcgtggatcaaacctccccta

SEQ ID NO: 652751 - DNA, 25 bp, Mus musculus
gagagcgtggatgaaacctccccta

SEQ ID NO: 652752 - DNA, 25 bp, Mus musculus
gagagcgtggcaaacactttaggag

SEQ ID NO: 652753 - DNA, 25 bp, Mus musculus
gagagcgtggcatacactttaggag

SEQ ID NO: 652754 - DNA, 25 bp, Mus musculus
gagagctaccgtcacccctttggct

SEQ ID NO: 652755 - DNA, 25 bp, Mus musculus
gagagctaccgtgacccctttggct

SEQ ID NO: 652756 - DNA, 25 bp, Mus musculus
gagagctagggcctgtccagcccaa

SEQ ID NO: 652757 - DNA, 25 bp, Mus musculus
gagagctagggcgtgtccagcccaa

SEQ ID NO: 652758 - DNA, 25 bp, Mus musculus
gagagctcagcccattcgctggagc

SEQ ID NO: 652759 - DNA, 25 bp, Mus musculus
gagagctcagccgattcgctggagc

SEQ ID NO: 652760 - DNA, 25 bp, Mus musculus
gagagctcaggcatagtgaagcttg

SEQ ID NO: 652761 - DNA, 25 bp, Mus musculus
gagagctcaggcttagtgaagcttg

SEQ ID NO: 652762 - DNA, 25 bp, Mus musculus
gagagctcatacagagcttgcttct

SEQ ID NO: 652763 - DNA, 25 bp, Mus musculus
gagagctcatactgagcttgcttct

SEQ ID NO: 652764 - DNA, 25 bp, Mus musculus
gagagctccagcctgtactccataa

SEQ ID NO: 652765 - DNA, 25 bp, Mus musculus
gagagctccagcgtgtactccataa

SEQ ID NO: 652766 - DNA, 25 bp, Mus musculus
gagagctccgatctcagagaagaag

SEQ ID NO: 652767 - DNA, 25 bp, Mus musculus
gagagctccgatgtcagagaagaag

SEQ ID NO: 652768 - DNA, 25 bp, Mus musculus
gagagctcggagagagtatcctact

SEQ ID NO: 652769 - DNA, 25 bp, Mus musculus
gagagctcggagtgagtatcctact

SEQ ID NO: 652770 - DNA, 25 bp, Mus musculus
gagagctctagccttggcctcagtg

SEQ ID NO: 652771 - DNA, 25 bp, Mus musculus
gagagctctagcgttggcctcagtg

SEQ ID NO: 652772 - DNA, 25 bp, Mus musculus
gagagctctgccatccttggtagaa

SEQ ID NO: 652773 - DNA, 25 bp, Mus musculus
gagagctctgccttccttggtagaa

SEQ ID NO: 652774 - DNA, 25 bp, Mus musculus
gagagctgcatgaggtacctgcaca

SEQ ID NO: 652775 - DNA, 25 bp, Mus musculus
gagagctgcatgtggtacctgcaca

SEQ ID NO: 652776 - DNA, 25 bp, Mus musculus
gagagctggccaaccaggtcagaca

SEQ ID NO: 652777 - DNA, 25 bp, Mus musculus
gagagctggccatccaggtcagaca

SEQ ID NO: 652778 - DNA, 25 bp, Mus musculus
gagagctggcgcacaggtccagctc

SEQ ID NO: 652779 - DNA, 25 bp, Mus musculus
gagagctggcgctcaggtccagctc

SEQ ID NO: 652780 - DNA, 25 bp, Mus musculus
gagagctggttgacatcttttacat

SEQ ID NO: 652781 - DNA, 25 bp, Mus musculus
gagagctggttgtcatcttttacat

SEQ ID NO: 652782 - DNA, 25 bp, Mus musculus
gagagctgtatgatgccctggtgaa

SEQ ID NO: 652783 - DNA, 25 bp, Mus musculus
gagagctgtatgttgccctggtgaa

SEQ ID NO: 652784 - DNA, 25 bp, Mus musculus
gagagctgtcttaccaagcactcca

SEQ ID NO: 652785 - DNA, 25 bp, Mus musculus
gagagctgtctttccaagcactcca

SEQ ID NO: 652786 - DNA, 25 bp, Mus musculus
gagagctgtgctacgtgtcagagcc

SEQ ID NO: 652787 - DNA, 25 bp, Mus musculus
gagagctgtgcttcgtgtcagagcc

SEQ ID NO: 652788 - DNA, 25 bp, Mus musculus
gagagcttactacatctattctggg

SEQ ID NO: 652789 - DNA, 25 bp, Mus musculus
gagagcttactagatctattctggg

SEQ ID NO: 652790 - DNA, 25 bp, Mus musculus
gagagcttccgcctgggatcagaac

SEQ ID NO: 652791 - DNA, 25 bp, Mus musculus
gagagcttccgcgtgggatcagaac

SEQ ID NO: 652792 - DNA, 25 bp, Mus musculus
gagagcttgctccagaggttgaccc

SEQ ID NO: 652793 - DNA, 25 bp, Mus musculus
gagagcttgctcgagaggttgaccc

SEQ ID NO: 652794 - DNA, 25 bp, Mus musculus
gagagctttagacttccctatgatc

SEQ ID NO: 652795 - DNA, 25 bp, Mus musculus
gagagctttagagttccctatgatc

SEQ ID NO: 652796 - DNA, 25 bp, Mus musculus
gagagctttcttcgactgtccagtg

SEQ ID NO: 652797 - DNA, 25 bp, Mus musculus
gagagctttcttggactgtccagtg

SEQ ID NO: 652798 - DNA, 25 bp, Mus musculus
gagaggaaaaagcatactgagaaag

SEQ ID NO: 652799 - DNA, 25 bp, Mus musculus
gagaggaaaaaggatactgagaaag

SEQ ID NO: 652800 - DNA, 25 bp, Mus musculus
gagaggaaacagaccagagccagag

SEQ ID NO: 652801 - DNA, 25 bp, Mus musculus
gagaggaaacagactatactcccgt

SEQ ID NO: 652802 - DNA, 25 bp, Mus musculus
gagaggaaacagtccagagccagag

SEQ ID NO: 652803 - DNA, 25 bp, Mus musculus
gagaggaaacagtctatactcccgt

SEQ ID NO: 652804 - DNA, 25 bp, Mus musculus
gagaggaaagaaacctctggctgtt

SEQ ID NO: 652805 - DNA, 25 bp, Mus musculus
gagaggaaagaatcctctggctgtt

SEQ ID NO: 652806 - DNA, 25 bp, Mus musculus
gagaggaaattcagccctcaaaaag

SEQ ID NO: 652807 - DNA, 25 bp, Mus musculus
gagaggaaattctgccctcaaaaag

SEQ ID NO: 652808 - DNA, 25 bp, Mus musculus
gagaggaaatttccagttccaaagc

SEQ ID NO: 652809 - DNA, 25 bp, Mus musculus
gagaggaaatttgcagttccaaagc

SEQ ID NO: 652810 - DNA, 25 bp, Mus musculus
gagaggaacattctagaatctgtga

SEQ ID NO: 652811 - DNA, 25 bp, Mus musculus
gagaggaacattgtagaatctgtga

SEQ ID NO: 652812 - DNA, 25 bp, Mus musculus
gagaggaaccccaatgaaacactgc

SEQ ID NO: 652813 - DNA, 25 bp, Mus musculus
gagaggaacccctatgaaacactgc

SEQ ID NO: 652814 - DNA, 25 bp, Mus musculus
gagaggaactagaagccctccaggc

SEQ ID NO: 652815 - DNA, 25 bp, Mus musculus
gagaggaactagtagccctccaggc

SEQ ID NO: 652816 - DNA, 25 bp, Mus musculus
gagaggaactatagacagacacgag

SEQ ID NO: 652817 - DNA, 25 bp, Mus musculus
gagaggaactattgacagacacgag

SEQ ID NO: 652818 - DNA, 25 bp, Mus musculus
gagaggaagaaaagccacaatcaaa

SEQ ID NO: 652819 - DNA, 25 bp, Mus musculus
gagaggaagaaatgccacaatcaaa

SEQ ID NO: 652820 - DNA, 25 bp, Mus musculus
gagaggaagacgcagcttccacatt

SEQ ID NO: 652821 - DNA, 25 bp, Mus musculus
gagaggaagacggagcttccacatt

SEQ ID NO: 652822 - DNA, 25 bp, Mus musculus
gagaggaatgctcaagtcaattcac

SEQ ID NO: 652823 - DNA, 25 bp, Mus musculus
gagaggaatgctgaagtcaattcac

SEQ ID NO: 652824 - DNA, 25 bp, Mus musculus
gagaggaattttaccacggaacaag

SEQ ID NO: 652825 - DNA, 25 bp, Mus musculus
gagaggaatttttccacggaacaag

SEQ ID NO: 652826 - DNA, 25 bp, Mus musculus
gagaggacaatacgacccgtaaggc

SEQ ID NO: 652827 - DNA, 25 bp, Mus musculus
gagaggacaataggacccgtaaggc

SEQ ID NO: 652828 - DNA, 25 bp, Mus musculus
gagaggaccacgctggccaaaattc

SEQ ID NO: 652829 - DNA, 25 bp, Mus musculus
gagaggaccacggtggccaaaattc

SEQ ID NO: 652830 - DNA, 25 bp, Mus musculus
gagaggacccataatccagatgtgt

SEQ ID NO: 652831 - DNA, 25 bp, Mus musculus
gagaggacccattatccagatgtgt

SEQ ID NO: 652832 - DNA, 25 bp, Mus musculus
gagaggaccccacgcttttgatgcc

SEQ ID NO: 652833 - DNA, 25 bp, Mus musculus
gagaggaccccaggcttttgatgcc

SEQ ID NO: 652834 - DNA, 25 bp, Mus musculus
gagaggaccctaagaacacgtaaag

SEQ ID NO: 652835 - DNA, 25 bp, Mus musculus
gagaggaccctatgaacacgtaaag

SEQ ID NO: 652836 - DNA, 25 bp, Mus musculus
gagaggacgcctctactgaaaagag

SEQ ID NO: 652837 - DNA, 25 bp, Mus musculus
gagaggacgcctgtactgaaaagag

SEQ ID NO: 652838 - DNA, 25 bp, Mus musculus
gagaggactacaccagaggacacct

SEQ ID NO: 652839 - DNA, 25 bp, Mus musculus
gagaggactacagcagaggacacct

SEQ ID NO: 652840 - DNA, 25 bp, Mus musculus
gagaggactgtcatggatcaacagc

SEQ ID NO: 652841 - DNA, 25 bp, Mus musculus
gagaggactgtcttggatcaacagc

SEQ ID NO: 652842 - DNA, 25 bp, Mus musculus
gagaggacttcaaaaaagaagccat

SEQ ID NO: 652843 - DNA, 25 bp, Mus musculus
gagaggacttcataaaagaagccat

SEQ ID NO: 652844 - DNA, 25 bp, Mus musculus
gagaggacttccagttgcagcgaag

SEQ ID NO: 652845 - DNA, 25 bp, Mus musculus
gagaggacttcctgttgcagcgaag

SEQ ID NO: 652846 - DNA, 25 bp, Mus musculus
gagaggacttgccacagacagaata

SEQ ID NO: 652847 - DNA, 25 bp, Mus musculus
gagaggacttgcgacagacagaata

SEQ ID NO: 652848 - DNA, 25 bp, Mus musculus
gagaggagaccacaacagaacactg

SEQ ID NO: 652849 - DNA, 25 bp, Mus musculus
gagaggagaccagaacagaacactg

SEQ ID NO: 652850 - DNA, 25 bp, Mus musculus
gagaggagccctctgccacgcttcg

SEQ ID NO: 652851 - DNA, 25 bp, Mus musculus
gagaggagccctgtgccacgcttcg

SEQ ID NO: 652852 - DNA, 25 bp, Mus musculus
gagaggaggtccatcccgagaagtt

SEQ ID NO: 652853 - DNA, 25 bp, Mus musculus
gagaggaggtccttcccgagaagtt

SEQ ID NO: 652854 - DNA, 25 bp, Mus musculus
gagaggatcagcatccagccggcag

SEQ ID NO: 652855 - DNA, 25 bp, Mus musculus
gagaggatcagcttccagccggcag

SEQ ID NO: 652856 - DNA, 25 bp, Mus musculus
gagaggatctctatgtagtcagtaa

SEQ ID NO: 652857 - DNA, 25 bp, Mus musculus
gagaggatctctttgtagtcagtaa

SEQ ID NO: 652858 - DNA, 25 bp, Mus musculus
gagaggattagccttacagggcaca

SEQ ID NO: 652859 - DNA, 25 bp, Mus musculus
gagaggattagcgttacagggcaca

SEQ ID NO: 652860 - DNA, 25 bp, Mus musculus
gagaggcaaagaataatgagcttca

SEQ ID NO: 652861 - DNA, 25 bp, Mus musculus
gagaggcaaagattaatgagcttca

SEQ ID NO: 652862 - DNA, 25 bp, Mus musculus
gagaggcacagaatcggaaatatcc

SEQ ID NO: 652863 - DNA, 25 bp, Mus musculus
gagaggcacagattcggaaatatcc

SEQ ID NO: 652864 - DNA, 25 bp, Mus musculus
gagaggcactacattcgaaaccagc

SEQ ID NO: 652865 - DNA, 25 bp, Mus musculus
gagaggcactactttcgaaaccagc

SEQ ID NO: 652866 - DNA, 25 bp, Mus musculus
gagaggcactggagacatgtatgtc

SEQ ID NO: 652867 - DNA, 25 bp, Mus musculus
gagaggcactggtgacatgtatgtc

SEQ ID NO: 652868 - DNA, 25 bp, Mus musculus
gagaggcagtccaccacctagtggt

SEQ ID NO: 652869 - DNA, 25 bp, Mus musculus
gagaggcagtcctccacctagtggt

SEQ ID NO: 652870 - DNA, 25 bp, Mus musculus
gagaggcagtggctaaacaaagacc

SEQ ID NO: 652871 - DNA, 25 bp, Mus musculus
gagaggcagtgggtaaacaaagacc

SEQ ID NO: 652872 - DNA, 25 bp, Mus musculus
gagaggcatcggacgccacctcgct

SEQ ID NO: 652873 - DNA, 25 bp, Mus musculus
gagaggcatcggtcgccacctcgct

SEQ ID NO: 652874 - DNA, 25 bp, Mus musculus
gagaggcattctaccgccagaacct

SEQ ID NO: 652875 - DNA, 25 bp, Mus musculus
gagaggcattcttccgccagaacct

SEQ ID NO: 652876 - DNA, 25 bp, Mus musculus
gagaggccaccaaagattctctgga

SEQ ID NO: 652877 - DNA, 25 bp, Mus musculus
gagaggccaccatagattctctgga

SEQ ID NO: 652878 - DNA, 25 bp, Mus musculus
gagaggccacccaactcttatatgg

SEQ ID NO: 652879 - DNA, 25 bp, Mus musculus
gagaggccaccctactcttatatgg

SEQ ID NO: 652880 - DNA, 25 bp, Mus musculus
gagaggccagaaccttcaatggctc

SEQ ID NO: 652881 - DNA, 25 bp, Mus musculus
gagaggccagaagcttcaatggctc

SEQ ID NO: 652882 - DNA, 25 bp, Mus musculus
gagaggcccaacattcagaaacagt

SEQ ID NO: 652883 - DNA, 25 bp, Mus musculus
gagaggcccaactttcagaaacagt

SEQ ID NO: 652884 - DNA, 25 bp, Mus musculus
gagaggccctctctgcggagcatcc

SEQ ID NO: 652885 - DNA, 25 bp, Mus musculus
gagaggccctctgtgcggagcatcc

SEQ ID NO: 652886 - DNA, 25 bp, Mus musculus
gagaggcctcggctcctcagacttg

SEQ ID NO: 652887 - DNA, 25 bp, Mus musculus
gagaggcctcgggtcctcagacttg

SEQ ID NO: 652888 - DNA, 25 bp, Mus musculus
gagaggcctctgaggtagaccttaa

SEQ ID NO: 652889 - DNA, 25 bp, Mus musculus
gagaggcctctgtggtagaccttaa

SEQ ID NO: 652890 - DNA, 25 bp, Mus musculus
gagaggccttaaagcagcagctcaa

SEQ ID NO: 652891 - DNA, 25 bp, Mus musculus
gagaggccttaatgcagcagctcaa

SEQ ID NO: 652892 - DNA, 25 bp, Mus musculus
gagaggcctttccaggaagcacata

SEQ ID NO: 652893 - DNA, 25 bp, Mus musculus
gagaggcctttcgaggaagcacata

SEQ ID NO: 652894 - DNA, 25 bp, Mus musculus
gagaggcgaaggacccatgtgaccc

SEQ ID NO: 652895 - DNA, 25 bp, Mus musculus
gagaggcgaaggtcccatgtgaccc

SEQ ID NO: 652896 - DNA, 25 bp, Mus musculus
gagaggcgcatcactttctccacca

SEQ ID NO: 652897 - DNA, 25 bp, Mus musculus
gagaggcgcatctctttctccacca

SEQ ID NO: 652898 - DNA, 25 bp, Mus musculus
gagaggcggaggatatcaaatttgt

SEQ ID NO: 652899 - DNA, 25 bp, Mus musculus
gagaggcggaggttatcaaatttgt

SEQ ID NO: 652900 - DNA, 25 bp, Mus musculus
gagaggcggcaacacattgtcctga

SEQ ID NO: 652901 - DNA, 25 bp, Mus musculus
gagaggcggcaagacattgtcctga

SEQ ID NO: 652902 - DNA, 25 bp, Mus musculus
gagaggcggtcgcttccaagtgggt

SEQ ID NO: 652903 - DNA, 25 bp, Mus musculus
gagaggcggtcggttccaagtgggt

SEQ ID NO: 652904 - DNA, 25 bp, Mus musculus
gagaggctaagaagcagcttcagga

SEQ ID NO: 652905 - DNA, 25 bp, Mus musculus
gagaggctaagatgcagcttcagga

SEQ ID NO: 652906 - DNA, 25 bp, Mus musculus
gagaggctacgactctgaccctgtg

SEQ ID NO: 652907 - DNA, 25 bp, Mus musculus
gagaggctacgagtctgaccctgtg

SEQ ID NO: 652908 - DNA, 25 bp, Mus musculus
gagaggctaggcacctacatgggcc

SEQ ID NO: 652909 - DNA, 25 bp, Mus musculus
gagaggctaggctcctacatgggcc

SEQ ID NO: 652910 - DNA, 25 bp, Mus musculus
gagaggctcacacgcgtcagcatct

SEQ ID NO: 652911 - DNA, 25 bp, Mus musculus
gagaggctcacaggcgtcagcatct

SEQ ID NO: 652912 - DNA, 25 bp, Mus musculus
gagaggctcagacttccgcatgagt

SEQ ID NO: 652913 - DNA, 25 bp, Mus musculus
gagaggctcagagttccgcatgagt

SEQ ID NO: 652914 - DNA, 25 bp, Mus musculus
gagaggctctcacatgaatggcttg

SEQ ID NO: 652915 - DNA, 25 bp, Mus musculus
gagaggctctcagatgaatggcttg

SEQ ID NO: 652916 - DNA, 25 bp, Mus musculus
gagaggctgcccaagctgaaccggc

SEQ ID NO: 652917 - DNA, 25 bp, Mus musculus
gagaggctgccctagctgaaccggc

SEQ ID NO: 652918 - DNA, 25 bp, Mus musculus
gagaggcttacgctgccgccatgaa

SEQ ID NO: 652919 - DNA, 25 bp, Mus musculus
gagaggcttacggtgccgccatgaa

SEQ ID NO: 652920 - DNA, 25 bp, Mus musculus
gagaggcttcaaccaggaagatccc

SEQ ID NO: 652921 - DNA, 25 bp, Mus musculus
gagaggcttcaagcaggaagatccc

SEQ ID NO: 652922 - DNA, 25 bp, Mus musculus
gagaggcttccaaacacctgcaact

SEQ ID NO: 652923 - DNA, 25 bp, Mus musculus
gagaggcttccatacacctgcaact

SEQ ID NO: 652924 - DNA, 25 bp, Mus musculus
gagagggaaccaagggaatatttct

SEQ ID NO: 652925 - DNA, 25 bp, Mus musculus
gagagggaaccatgggaatatttct

SEQ ID NO: 652926 - DNA, 25 bp, Mus musculus
gagagggaagcacgacaatcccaga

SEQ ID NO: 652927 - DNA, 25 bp, Mus musculus
gagagggaagcaggacaatcccaga

SEQ ID NO: 652928 - DNA, 25 bp, Mus musculus
gagagggaccagacctcagaaaggt

SEQ ID NO: 652929 - DNA, 25 bp, Mus musculus
gagagggaccagatctcgcctgatg

SEQ ID NO: 652930 - DNA, 25 bp, Mus musculus
gagagggaccagtcctcagaaaggt

SEQ ID NO: 652931 - DNA, 25 bp, Mus musculus
gagagggaccagttctcgcctgatg

SEQ ID NO: 652932 - DNA, 25 bp, Mus musculus
gagagggacgctacagaagccgtct

SEQ ID NO: 652933 - DNA, 25 bp, Mus musculus
gagagggacgcttcagaagccgtct

SEQ ID NO: 652934 - DNA, 25 bp, Mus musculus
gagagggacttcctttgagacccag

SEQ ID NO: 652935 - DNA, 25 bp, Mus musculus
gagagggacttcgtttgagacccag

SEQ ID NO: 652936 - DNA, 25 bp, Mus musculus
gagagggatagcctttgccttcaat

SEQ ID NO: 652937 - DNA, 25 bp, Mus musculus
gagagggatagcgtttgccttcaat

SEQ ID NO: 652938 - DNA, 25 bp, Mus musculus
gagagggcacagactgagccttgcc

SEQ ID NO: 652939 - DNA, 25 bp, Mus musculus
gagagggcacagtctgagccttgcc

SEQ ID NO: 652940 - DNA, 25 bp, Mus musculus
gagagggccagtagctaagtcttaa

SEQ ID NO: 652941 - DNA, 25 bp, Mus musculus
gagagggccagttgctaagtcttaa

SEQ ID NO: 652942 - DNA, 25 bp, Mus musculus
gagagggccatcattacctgcccaa

SEQ ID NO: 652943 - DNA, 25 bp, Mus musculus
gagagggccatctttacctgcccaa

SEQ ID NO: 652944 - DNA, 25 bp, Mus musculus
gagagggccattcagacactcatca

SEQ ID NO: 652945 - DNA, 25 bp, Mus musculus
gagagggccattgagacactcatca

SEQ ID NO: 652946 - DNA, 25 bp, Mus musculus
gagagggccctgaactactttgctg

SEQ ID NO: 652947 - DNA, 25 bp, Mus musculus
gagagggccctgtactactttgctg

SEQ ID NO: 652948 - DNA, 25 bp, Mus musculus
gagagggcctgcctgtttctattcc

SEQ ID NO: 652949 - DNA, 25 bp, Mus musculus
gagagggcctgcgtgtttctattcc

SEQ ID NO: 652950 - DNA, 25 bp, Mus musculus
gagagggctagactccatgtccaga

SEQ ID NO: 652951 - DNA, 25 bp, Mus musculus
gagagggctagagtccatgtccaga

SEQ ID NO: 652952 - DNA, 25 bp, Mus musculus
gagagggtacttcctcacttttgtg

SEQ ID NO: 652953 - DNA, 25 bp, Mus musculus
gagagggtacttgctcacttttgtg

SEQ ID NO: 652954 - DNA, 25 bp, Mus musculus
gagagggtgaacataacaattgcca

SEQ ID NO: 652955 - DNA, 25 bp, Mus musculus
gagagggtgaacttaacaattgcca

SEQ ID NO: 652956 - DNA, 25 bp, Mus musculus
gagagggttatccatctgtgccacc

SEQ ID NO: 652957 - DNA, 25 bp, Mus musculus
gagagggttatcgatctgtgccacc

SEQ ID NO: 652958 - DNA, 25 bp, Mus musculus
gagagggttgagacaactgttgcaa

SEQ ID NO: 652959 - DNA, 25 bp, Mus musculus
gagagggttgagtcaactgttgcaa

SEQ ID NO: 652960 - DNA, 25 bp, Mus musculus
gagagggtttccctgtgccctttat

SEQ ID NO: 652961 - DNA, 25 bp, Mus musculus
gagagggtttccgtgtgccctttat

SEQ ID NO: 652962 - DNA, 25 bp, Mus musculus
gagaggtacaagatggtacaggcca

SEQ ID NO: 652963 - DNA, 25 bp, Mus musculus
gagaggtacaagttggtacaggcca

SEQ ID NO: 652964 - DNA, 25 bp, Mus musculus
gagaggtacccgaccatcatctata

SEQ ID NO: 652965 - DNA, 25 bp, Mus musculus
gagaggtacccgtccatcatctata

SEQ ID NO: 652966 - DNA, 25 bp, Mus musculus
gagaggtactacaagatcttccagt

SEQ ID NO: 652967 - DNA, 25 bp, Mus musculus
gagaggtactaccacatttgtgcca

SEQ ID NO: 652968 - DNA, 25 bp, Mus musculus
gagaggtactacgacatttgtgcca

SEQ ID NO: 652969 - DNA, 25 bp, Mus musculus
gagaggtactactagatcttccagt

SEQ ID NO: 652970 - DNA, 25 bp, Mus musculus
gagaggtaggcgacacccagtatct

SEQ ID NO: 652971 - DNA, 25 bp, Mus musculus
gagaggtaggcgtcacccagtatct

SEQ ID NO: 652972 - DNA, 25 bp, Mus musculus
gagaggtatctcaacctcgaggagc

SEQ ID NO: 652973 - DNA, 25 bp, Mus musculus
gagaggtatctctacctcgaggagc

SEQ ID NO: 652974 - DNA, 25 bp, Mus musculus
gagaggtcacagagtctacagagac

SEQ ID NO: 652975 - DNA, 25 bp, Mus musculus
gagaggtcacagtgtctacagagac

SEQ ID NO: 652976 - DNA, 25 bp, Mus musculus
gagaggtcatttcctcaatcagcta

SEQ ID NO: 652977 - DNA, 25 bp, Mus musculus
gagaggtcatttgctcaatcagcta

SEQ ID NO: 652978 - DNA, 25 bp, Mus musculus
gagaggtccgccagaagatcatgca

SEQ ID NO: 652979 - DNA, 25 bp, Mus musculus
gagaggtccgcctgaagatcatgca

SEQ ID NO: 652980 - DNA, 25 bp, Mus musculus
gagaggtcctccctaatctactcaa

SEQ ID NO: 652981 - DNA, 25 bp, Mus musculus
gagaggtcctccgtaatctactcaa

SEQ ID NO: 652982 - DNA, 25 bp, Mus musculus
gagaggtccttcacttgtcttggga

SEQ ID NO: 652983 - DNA, 25 bp, Mus musculus
gagaggtccttctcttgtcttggga

SEQ ID NO: 652984 - DNA, 25 bp, Mus musculus
gagaggtctacacaagcagtgctag

SEQ ID NO: 652985 - DNA, 25 bp, Mus musculus
gagaggtctacagaagcagtgctag

SEQ ID NO: 652986 - DNA, 25 bp, Mus musculus
gagaggtctcccaccttcgtgggat

SEQ ID NO: 652987 - DNA, 25 bp, Mus musculus
gagaggtctccctccttcgtgggat

SEQ ID NO: 652988 - DNA, 25 bp, Mus musculus
gagaggtctcggaacatctacggct

SEQ ID NO: 652989 - DNA, 25 bp, Mus musculus
gagaggtctcggtacatctacggct

SEQ ID NO: 652990 - DNA, 25 bp, Mus musculus
gagaggtggtccagtccgctgaaaa

SEQ ID NO: 652991 - DNA, 25 bp, Mus musculus
gagaggtggtcctgtccgctgaaaa

SEQ ID NO: 652992 - DNA, 25 bp, Mus musculus
gagaggtgtaaacccttggactgcc

SEQ ID NO: 652993 - DNA, 25 bp, Mus musculus
gagaggtgtaaagccttggactgcc

SEQ ID NO: 652994 - DNA, 25 bp, Mus musculus
gagaggtgtacccaccttccgtgga

SEQ ID NO: 652995 - DNA, 25 bp, Mus musculus
gagaggtgtaccgaccttccgtgga

SEQ ID NO: 652996 - DNA, 25 bp, Mus musculus
gagaggttcaacctgcctctaggaa

SEQ ID NO: 652997 - DNA, 25 bp, Mus musculus
gagaggttcaacgtgcctctaggaa

SEQ ID NO: 652998 - DNA, 25 bp, Mus musculus
gagagtaaagaacccgacctcctct

SEQ ID NO: 652999 - DNA, 25 bp, Mus musculus
gagagtaaagaagccgacctcctct

SEQ ID NO: 653000 - DNA, 25 bp, Mus musculus
gagagtaaagagagcaaggcctaga

SEQ ID NO: 653001 - DNA, 25 bp, Mus musculus
gagagtaaagagtgcaaggcctaga

SEQ ID NO: 653002 - DNA, 25 bp, Mus musculus
gagagtaactttcgccaggtgctgc

SEQ ID NO: 653003 - DNA, 25 bp, Mus musculus
gagagtaactttggccaggtgctgc

SEQ ID NO: 653004 - DNA, 25 bp, Mus musculus
gagagtacaacaaagccgtggagtg

SEQ ID NO: 653005 - DNA, 25 bp, Mus musculus
gagagtacaacatagccgtggagtg

SEQ ID NO: 653006 - DNA, 25 bp, Mus musculus
gagagtacccacagacagctatgac

SEQ ID NO: 653007 - DNA, 25 bp, Mus musculus
gagagtacccactgacagctatgac

SEQ ID NO: 653008 - DNA, 25 bp, Mus musculus
gagagtacccttcgcatggatgaag

SEQ ID NO: 653009 - DNA, 25 bp, Mus musculus
gagagtacccttggcatggatgaag

SEQ ID NO: 653010 - DNA, 25 bp, Mus musculus
gagagtactcttcaccccacgaaga

SEQ ID NO: 653011 - DNA, 25 bp, Mus musculus
gagagtactcttgaccccacgaaga

SEQ ID NO: 653012 - DNA, 25 bp, Mus musculus
gagagtactgtgaccttagtcacaa

SEQ ID NO: 653013 - DNA, 25 bp, Mus musculus
gagagtactgtgtccttagtcacaa

SEQ ID NO: 653014 - DNA, 25 bp, Mus musculus
gagagtagaagaagtcgtcgttagt

SEQ ID NO: 653015 - DNA, 25 bp, Mus musculus
gagagtagaagatgtcgtcgttagt

SEQ ID NO: 653016 - DNA, 25 bp, Mus musculus
gagagtatacctctctggcgggcaa

SEQ ID NO: 653017 - DNA, 25 bp, Mus musculus
gagagtatacctgtctggcgggcaa

SEQ ID NO: 653018 - DNA, 25 bp, Mus musculus
gagagtatcatgcagtgcgccacag

SEQ ID NO: 653019 - DNA, 25 bp, Mus musculus
gagagtatcatggagtgcgccacag

SEQ ID NO: 653020 - DNA, 25 bp, Mus musculus
gagagtatccacaacgcgctcatgg

SEQ ID NO: 653021 - DNA, 25 bp, Mus musculus
gagagtatccactacgcgctcatgg

SEQ ID NO: 653022 - DNA, 25 bp, Mus musculus
gagagtatctgtcccttctcaacag

SEQ ID NO: 653023 - DNA, 25 bp, Mus musculus
gagagtatctgtgccttctcaacag

SEQ ID NO: 653024 - DNA, 25 bp, Mus musculus
gagagtatcttaagtggctccttcc

SEQ ID NO: 653025 - DNA, 25 bp, Mus musculus
gagagtatcttatgtggctccttcc

SEQ ID NO: 653026 - DNA, 25 bp, Mus musculus
gagagtcaaacaccggatggtaccc

SEQ ID NO: 653027 - DNA, 25 bp, Mus musculus
gagagtcaaacagcggatggtaccc

SEQ ID NO: 653028 - DNA, 25 bp, Mus musculus
gagagtcaactcagcgacgtgattt

SEQ ID NO: 653029 - DNA, 25 bp, Mus musculus
gagagtcaactctgcgacgtgattt

SEQ ID NO: 653030 - DNA, 25 bp, Mus musculus
gagagtcaagctcggcagaatctct

SEQ ID NO: 653031 - DNA, 25 bp, Mus musculus
gagagtcaagctgggcagaatctct

SEQ ID NO: 653032 - DNA, 25 bp, Mus musculus
gagagtcacaggcactacaggctga

SEQ ID NO: 653033 - DNA, 25 bp, Mus musculus
gagagtcacagggactacaggctga

SEQ ID NO: 653034 - DNA, 25 bp, Mus musculus
gagagtcacttaatgggcctcacta

SEQ ID NO: 653035 - DNA, 25 bp, Mus musculus
gagagtcacttattgggcctcacta

SEQ ID NO: 653036 - DNA, 25 bp, Mus musculus
gagagtcacttgagctgctaccact

SEQ ID NO: 653037 - DNA, 25 bp, Mus musculus
gagagtcacttgtgctgctaccact

SEQ ID NO: 653038 - DNA, 25 bp, Mus musculus
gagagtcagcgaagccccaactgtg

SEQ ID NO: 653039 - DNA, 25 bp, Mus musculus
gagagtcagcgatgccccaactgtg

SEQ ID NO: 653040 - DNA, 25 bp, Mus musculus
gagagtcagcggagttctccttccc

SEQ ID NO: 653041 - DNA, 25 bp, Mus musculus
gagagtcagcggtgttctccttccc

SEQ ID NO: 653042 - DNA, 25 bp, Mus musculus
gagagtcagtggatcagctcagcct

SEQ ID NO: 653043 - DNA, 25 bp, Mus musculus
gagagtcagtggttcagctcagcct

SEQ ID NO: 653044 - DNA, 25 bp, Mus musculus
gagagtcatgctagtccctctacga

SEQ ID NO: 653045 - DNA, 25 bp, Mus musculus
gagagtcatgcttgtccctctacga

SEQ ID NO: 653046 - DNA, 25 bp, Mus musculus
gagagtcatgtgatcctgaaggcca

SEQ ID NO: 653047 - DNA, 25 bp, Mus musculus
gagagtcatgtgttcctgaaggcca

SEQ ID NO: 653048 - DNA, 25 bp, Mus musculus
gagagtccatcgaggttatttcagt

SEQ ID NO: 653049 - DNA, 25 bp, Mus musculus
gagagtccatcgtggttatttcagt

SEQ ID NO: 653050 - DNA, 25 bp, Mus musculus
gagagtccccggaaggatgatgcaa

SEQ ID NO: 653051 - DNA, 25 bp, Mus musculus
gagagtccccggtaggatgatgcaa

SEQ ID NO: 653052 - DNA, 25 bp, Mus musculus
gagagtccctttctccggcgcttca

SEQ ID NO: 653053 - DNA, 25 bp, Mus musculus
gagagtccctttgtccggcgcttca

SEQ ID NO: 653054 - DNA, 25 bp, Mus musculus
gagagtcctaccacagtgaaactca

SEQ ID NO: 653055 - DNA, 25 bp, Mus musculus
gagagtcctacctcagtgaaactca

SEQ ID NO: 653056 - DNA, 25 bp, Mus musculus
gagagtcctagacacagaaggaaga

SEQ ID NO: 653057 - DNA, 25 bp, Mus musculus
gagagtcctagagacagaaggaaga

SEQ ID NO: 653058 - DNA, 25 bp, Mus musculus
gagagtcctgagaattatccacacg

SEQ ID NO: 653059 - DNA, 25 bp, Mus musculus
gagagtcctgagtattatccacacg

SEQ ID NO: 653060 - DNA, 25 bp, Mus musculus
gagagtcctgctagtccgctaacgg

SEQ ID NO: 653061 - DNA, 25 bp, Mus musculus
gagagtcctgcttgtccgctaacgg

SEQ ID NO: 653062 - DNA, 25 bp, Mus musculus
gagagtcctgtcactcctttgggcc

SEQ ID NO: 653063 - DNA, 25 bp, Mus musculus
gagagtcctgtctctcctttgggcc

SEQ ID NO: 653064 - DNA, 25 bp, Mus musculus
gagagtcgagctactcgccaagaag

SEQ ID NO: 653065 - DNA, 25 bp, Mus musculus
gagagtcgagcttctcgccaagaag

SEQ ID NO: 653066 - DNA, 25 bp, Mus musculus
gagagtcgcagacagcattgacata

SEQ ID NO: 653067 - DNA, 25 bp, Mus musculus
gagagtcgcagagagcattgacata

SEQ ID NO: 653068 - DNA, 25 bp, Mus musculus
gagagtctacagcaaaattactggg

SEQ ID NO: 653069 - DNA, 25 bp, Mus musculus
gagagtctacaggaaaattactggg

SEQ ID NO: 653070 - DNA, 25 bp, Mus musculus
gagagtctcacacctctgttgaaaa

SEQ ID NO: 653071 - DNA, 25 bp, Mus musculus
gagagtctcacagctctgttgaaaa

SEQ ID NO: 653072 - DNA, 25 bp, Mus musculus
gagagtctcctgagtcgcacacggc

SEQ ID NO: 653073 - DNA, 25 bp, Mus musculus
gagagtctcctgtgtcgcacacggc

SEQ ID NO: 653074 - DNA, 25 bp, Mus musculus
gagagtctggatagaaacaatttga

SEQ ID NO: 653075 - DNA, 25 bp, Mus musculus
gagagtctggattgaaacaatttga

SEQ ID NO: 653076 - DNA, 25 bp, Mus musculus
gagagtcttactcagcaggtggcca

SEQ ID NO: 653077 - DNA, 25 bp, Mus musculus
gagagtcttactgagcaggtggcca

SEQ ID NO: 653078 - DNA, 25 bp, Mus musculus
gagagtgaaagcacagactctgagg

SEQ ID NO: 653079 - DNA, 25 bp, Mus musculus
gagagtgaaagctcagactctgagg

SEQ ID NO: 653080 - DNA, 25 bp, Mus musculus
gagagtgaaggaaccgctgttgccc

SEQ ID NO: 653081 - DNA, 25 bp, Mus musculus
gagagtgaaggatccgctgttgccc

SEQ ID NO: 653082 - DNA, 25 bp, Mus musculus
gagagtgacaacagcgcagactcct

SEQ ID NO: 653083 - DNA, 25 bp, Mus musculus
gagagtgacaactgcgcagactcct

SEQ ID NO: 653084 - DNA, 25 bp, Mus musculus
gagagtgaccttatgagagcccact

SEQ ID NO: 653085 - DNA, 25 bp, Mus musculus
gagagtgaccttccccaatgggaac

SEQ ID NO: 653086 - DNA, 25 bp, Mus musculus
gagagtgaccttgcccaatgggaac

SEQ ID NO: 653087 - DNA, 25 bp, Mus musculus
gagagtgaccttttgagagcccact

SEQ ID NO: 653088 - DNA, 25 bp, Mus musculus
gagagtgagataagcacccagggac

SEQ ID NO: 653089 - DNA, 25 bp, Mus musculus
gagagtgagatatgcacccagggac

SEQ ID NO: 653090 - DNA, 25 bp, Mus musculus
gagagtgagctcaaccgaattggtc

SEQ ID NO: 653091 - DNA, 25 bp, Mus musculus
gagagtgagctctaccgaattggtc

SEQ ID NO: 653092 - DNA, 25 bp, Mus musculus
gagagtgcacctcccaacttgtgtg

SEQ ID NO: 653093 - DNA, 25 bp, Mus musculus
gagagtgcacctgccaacttgtgtg

SEQ ID NO: 653094 - DNA, 25 bp, Mus musculus
gagagtgcattccaccatggagcag

SEQ ID NO: 653095 - DNA, 25 bp, Mus musculus
gagagtgcattcgaccatggagcag

SEQ ID NO: 653096 - DNA, 25 bp, Mus musculus
gagagtgcatttcaccccgactgaa

SEQ ID NO: 653097 - DNA, 25 bp, Mus musculus
gagagtgcatttgaccccgactgaa

SEQ ID NO: 653098 - DNA, 25 bp, Mus musculus
gagagtgcctacagctagaagctga

SEQ ID NO: 653099 - DNA, 25 bp, Mus musculus
gagagtgcctactgctagaagctga

SEQ ID NO: 653100 - DNA, 25 bp, Mus musculus
gagagtgcctcacctatgaccaata

SEQ ID NO: 653101 - DNA, 25 bp, Mus musculus
gagagtgcctcagctatgaccaata

SEQ ID NO: 653102 - DNA, 25 bp, Mus musculus
gagagtgcctcgcagcttgagccca

SEQ ID NO: 653103 - DNA, 25 bp, Mus musculus
gagagtgcctcggagcttgagccca

SEQ ID NO: 653104 - DNA, 25 bp, Mus musculus
gagagtgcggcccacgccattgtct

SEQ ID NO: 653105 - DNA, 25 bp, Mus musculus
gagagtgcggccgacgccattgtct

SEQ ID NO: 653106 - DNA, 25 bp, Mus musculus
gagagtgctctcatcttcccctttt

SEQ ID NO: 653107 - DNA, 25 bp, Mus musculus
gagagtgctctcttcttcccctttt

SEQ ID NO: 653108 - DNA, 25 bp, Mus musculus
gagagtggaacacgtgacaagaaaa

SEQ ID NO: 653109 - DNA, 25 bp, Mus musculus
gagagtggaacaggtgacaagaaaa

SEQ ID NO: 653110 - DNA, 25 bp, Mus musculus
gagagtggctaaaccttgtgtgaac

SEQ ID NO: 653111 - DNA, 25 bp, Mus musculus
gagagtggctaatccttgtgtgaac

SEQ ID NO: 653112 - DNA, 25 bp, Mus musculus
gagagtggctggaactgattgtttc

SEQ ID NO: 653113 - DNA, 25 bp, Mus musculus
gagagtggctggtactgattgtttc

SEQ ID NO: 653114 - DNA, 25 bp, Mus musculus
gagagtgggaaccaccagtgattca

SEQ ID NO: 653115 - DNA, 25 bp, Mus musculus
gagagtgggaaccactacgccatga

SEQ ID NO: 653116 - DNA, 25 bp, Mus musculus
gagagtgggaacgaccagtgattca

SEQ ID NO: 653117 - DNA, 25 bp, Mus musculus
gagagtgggaacgactacgccatga

SEQ ID NO: 653118 - DNA, 25 bp, Mus musculus
gagagtggtgtaaacaacaacactg

SEQ ID NO: 653119 - DNA, 25 bp, Mus musculus
gagagtggtgtatacaacaacactg

SEQ ID NO: 653120 - DNA, 25 bp, Mus musculus
gagagtgtaattctgactactggga

SEQ ID NO: 653121 - DNA, 25 bp, Mus musculus
gagagtgtaattgtgactactggga

SEQ ID NO: 653122 - DNA, 25 bp, Mus musculus
gagagtgtcccaaagctggtgtctg

SEQ ID NO: 653123 - DNA, 25 bp, Mus musculus
gagagtgtcccatagctggtgtctg

SEQ ID NO: 653124 - DNA, 25 bp, Mus musculus
gagagtgtgggcctctacctctgtc

SEQ ID NO: 653125 - DNA, 25 bp, Mus musculus
gagagtgtgggcgtctacctctgtc

SEQ ID NO: 653126 - DNA, 25 bp, Mus musculus
gagagtgtggtaacttcgtccggct

SEQ ID NO: 653127 - DNA, 25 bp, Mus musculus
gagagtgtggtatcttcgtccggct

SEQ ID NO: 653128 - DNA, 25 bp, Mus musculus
gagagtgtggtgctcgtcctttcca

SEQ ID NO: 653129 - DNA, 25 bp, Mus musculus
gagagtgtggtggtcgtcctttcca

SEQ ID NO: 653130 - DNA, 25 bp, Mus musculus
gagagttatcaacaggtccttggaa

SEQ ID NO: 653131 - DNA, 25 bp, Mus musculus
gagagttatcaagaggtccttggaa

SEQ ID NO: 653132 - DNA, 25 bp, Mus musculus
gagagttcattgcttcccagcgctg

SEQ ID NO: 653133 - DNA, 25 bp, Mus musculus
gagagttcattggttcccagcgctg

SEQ ID NO: 653134 - DNA, 25 bp, Mus musculus
gagagttccctccacagaatgtctg

SEQ ID NO: 653135 - DNA, 25 bp, Mus musculus
gagagttccctcgacagaatgtctg

SEQ ID NO: 653136 - DNA, 25 bp, Mus musculus
gagagttctagccatcctgggcctc

SEQ ID NO: 653137 - DNA, 25 bp, Mus musculus
gagagttctagcgatcctgggcctc

SEQ ID NO: 653138 - DNA, 25 bp, Mus musculus
gagagttctcacatctgcgacttca

SEQ ID NO: 653139 - DNA, 25 bp, Mus musculus
gagagttctcacttctgcgacttca

SEQ ID NO: 653140 - DNA, 25 bp, Mus musculus
gagagttctggcagcttcctaccgg

SEQ ID NO: 653141 - DNA, 25 bp, Mus musculus
gagagttctggctgcttcctaccgg

SEQ ID NO: 653142 - DNA, 25 bp, Mus musculus
gagagttgaggccatttaaacaata

SEQ ID NO: 653143 - DNA, 25 bp, Mus musculus
gagagttgaggcgatttaaacaata

SEQ ID NO: 653144 - DNA, 25 bp, Mus musculus
gagagttgcaacagcgcagaccaga

SEQ ID NO: 653145 - DNA, 25 bp, Mus musculus
gagagttgcaactgcgcagaccaga

SEQ ID NO: 653146 - DNA, 25 bp, Mus musculus
gagagttggacacccaatggtgtcc

SEQ ID NO: 653147 - DNA, 25 bp, Mus musculus
gagagttggacagccaatggtgtcc

SEQ ID NO: 653148 - DNA, 25 bp, Mus musculus
gagagttgttgtctctgcgctatga

SEQ ID NO: 653149 - DNA, 25 bp, Mus musculus
gagagttgttgtgtctgcgctatga

SEQ ID NO: 653150 - DNA, 25 bp, Mus musculus
gagagtttcaatcatgccaaggaga

SEQ ID NO: 653151 - DNA, 25 bp, Mus musculus
gagagtttcaatgatgccaaggaga

SEQ ID NO: 653152 - DNA, 25 bp, Mus musculus
gagagtttccaaagtggacacggga

SEQ ID NO: 653153 - DNA, 25 bp, Mus musculus
gagagtttccaatgtggacacggga

SEQ ID NO: 653154 - DNA, 25 bp, Mus musculus
gagagtttcggcaacaaaacctttg

SEQ ID NO: 653155 - DNA, 25 bp, Mus musculus
gagagtttcggctacaaaacctttg

SEQ ID NO: 653156 - DNA, 25 bp, Mus musculus
gagagtttgaaaccgccatcgtgga

SEQ ID NO: 653157 - DNA, 25 bp, Mus musculus
gagagtttgaaagcgccatcgtgga

SEQ ID NO: 653158 - DNA, 25 bp, Mus musculus
gagagtttgcatatctctacagcca

SEQ ID NO: 653159 - DNA, 25 bp, Mus musculus
gagagtttgcatttctctacagcca

SEQ ID NO: 653160 - DNA, 25 bp, Mus musculus
gagagtttgcctatgcttgttgtcg

SEQ ID NO: 653161 - DNA, 25 bp, Mus musculus
gagagtttgcctttgcttgttgtcg

SEQ ID NO: 653162 - DNA, 25 bp, Mus musculus
gagagtttgtctcatgtgctgagca

SEQ ID NO: 653163 - DNA, 25 bp, Mus musculus
gagagtttgtctgatgtgctgagca

SEQ ID NO: 653164 - DNA, 25 bp, Mus musculus
gagagtttgtgccttcccgagatga

SEQ ID NO: 653165 - DNA, 25 bp, Mus musculus
gagagtttgtgcgttcccgagatga

SEQ ID NO: 653166 - DNA, 25 bp, Mus musculus
gagataaatacgctccccctactcg

SEQ ID NO: 653167 - DNA, 25 bp, Mus musculus
gagataaatacggtccccctactcg

SEQ ID NO: 653168 - DNA, 25 bp, Mus musculus
gagataaccagtcatccctagtgaa

SEQ ID NO: 653169 - DNA, 25 bp, Mus musculus
gagataaccagtgatccctagtgaa

SEQ ID NO: 653170 - DNA, 25 bp, Mus musculus
gagataacccacatttagacaccgg

SEQ ID NO: 653171 - DNA, 25 bp, Mus musculus
gagataacccacttttagacaccgg

SEQ ID NO: 653172 - DNA, 25 bp, Mus musculus
gagataacccagactctccatggca

SEQ ID NO: 653173 - DNA, 25 bp, Mus musculus
gagataacccagtctctccatggca

SEQ ID NO: 653174 - DNA, 25 bp, Mus musculus
gagataagatgaatctcttctccct

SEQ ID NO: 653175 - DNA, 25 bp, Mus musculus
gagataagatgattctcttctccct

SEQ ID NO: 653176 - DNA, 25 bp, Mus musculus
gagataagatgcagaaggcagaacc

SEQ ID NO: 653177 - DNA, 25 bp, Mus musculus
gagataagatgctgaaggcagaacc

SEQ ID NO: 653178 - DNA, 25 bp, Mus musculus
gagataagctaacgatcctcccctg

SEQ ID NO: 653179 - DNA, 25 bp, Mus musculus
gagataagctaaggatcctcccctg

SEQ ID NO: 653180 - DNA, 25 bp, Mus musculus
gagataagctagcagatttgaagga

SEQ ID NO: 653181 - DNA, 25 bp, Mus musculus
gagataagctaggagatttgaagga

SEQ ID NO: 653182 - DNA, 25 bp, Mus musculus
gagataaggaaacctaacatcccaa

SEQ ID NO: 653183 - DNA, 25 bp, Mus musculus
gagataaggaaagctaacatcccaa

SEQ ID NO: 653184 - DNA, 25 bp, Mus musculus
gagataaggcgcatcaggactatcg

SEQ ID NO: 653185 - DNA, 25 bp, Mus musculus
gagataaggcgcttcaggactatcg

SEQ ID NO: 653186 - DNA, 25 bp, Mus musculus
gagataagtgctatcacgtttctca

SEQ ID NO: 653187 - DNA, 25 bp, Mus musculus
gagataagtgctttcacgtttctca

SEQ ID NO: 653188 - DNA, 25 bp, Mus musculus
gagataagtgggagtttacagccag

SEQ ID NO: 653189 - DNA, 25 bp, Mus musculus
gagataagtgggtgtttacagccag

SEQ ID NO: 653190 - DNA, 25 bp, Mus musculus
gagataatacaaacgctgtcgctct

SEQ ID NO: 653191 - DNA, 25 bp, Mus musculus
gagataatacaatcgctgtcgctct

SEQ ID NO: 653192 - DNA, 25 bp, Mus musculus
gagataatcggacattcacactgag

SEQ ID NO: 653193 - DNA, 25 bp, Mus musculus
gagataatcggagattcacactgag

SEQ ID NO: 653194 - DNA, 25 bp, Mus musculus
gagatacaacgtagctgactgcagc

SEQ ID NO: 653195 - DNA, 25 bp, Mus musculus
gagatacaacgttgctgactgcagc

SEQ ID NO: 653196 - DNA, 25 bp, Mus musculus
gagatacaggttcccgtgccaggat

SEQ ID NO: 653197 - DNA, 25 bp, Mus musculus
gagatacaggttgccgtgccaggat

SEQ ID NO: 653198 - DNA, 25 bp, Mus musculus
gagatacagtgaagggatgaagcac

SEQ ID NO: 653199 - DNA, 25 bp, Mus musculus
gagatacagtgatgggatgaagcac

SEQ ID NO: 653200 - DNA, 25 bp, Mus musculus
gagatacatagcaaacagcaactcc

SEQ ID NO: 653201 - DNA, 25 bp, Mus musculus
gagatacatagctaacagcaactcc

SEQ ID NO: 653202 - DNA, 25 bp, Mus musculus
gagataccaccacaaaccttcatgg

SEQ ID NO: 653203 - DNA, 25 bp, Mus musculus
gagataccaccagaaaccttcatgg

SEQ ID NO: 653204 - DNA, 25 bp, Mus musculus
gagatacctaagacccgaagggcca

SEQ ID NO: 653205 - DNA, 25 bp, Mus musculus
gagatacctaagtcccgaagggcca

SEQ ID NO: 653206 - DNA, 25 bp, Mus musculus
gagatacctaccctgaggagtacgc

SEQ ID NO: 653207 - DNA, 25 bp, Mus musculus
gagatacctaccgtgaggagtacgc

SEQ ID NO: 653208 - DNA, 25 bp, Mus musculus
gagatacctcagagcacagaagcct

SEQ ID NO: 653209 - DNA, 25 bp, Mus musculus
gagatacctcagtgcacagaagcct

SEQ ID NO: 653210 - DNA, 25 bp, Mus musculus
gagataccttaacccggaggtccat

SEQ ID NO: 653211 - DNA, 25 bp, Mus musculus
gagataccttaagccggaggtccat

SEQ ID NO: 653212 - DNA, 25 bp, Mus musculus
gagatacggctcaagagcttccttc

SEQ ID NO: 653213 - DNA, 25 bp, Mus musculus
gagatacggctctagagcttccttc

SEQ ID NO: 653214 - DNA, 25 bp, Mus musculus
gagatacttccacgcagagtctacc

SEQ ID NO: 653215 - DNA, 25 bp, Mus musculus
gagatacttccaggcagagtctacc

SEQ ID NO: 653216 - DNA, 25 bp, Mus musculus
gagatagaacccctgtggcctggta

SEQ ID NO: 653217 - DNA, 25 bp, Mus musculus
gagatagaacccgtgtggcctggta

SEQ ID NO: 653218 - DNA, 25 bp, Mus musculus
gagatagaatgcagtaacaccctgg

SEQ ID NO: 653219 - DNA, 25 bp, Mus musculus
gagatagaatgctgtaacaccctgg

SEQ ID NO: 653220 - DNA, 25 bp, Mus musculus
gagatagaccatcaaacagagaaat

SEQ ID NO: 653221 - DNA, 25 bp, Mus musculus
gagatagaccatgaaacagagaaat

SEQ ID NO: 653222 - DNA, 25 bp, Mus musculus
gagatagaccgtcattttcctggaa

SEQ ID NO: 653223 - DNA, 25 bp, Mus musculus
gagatagaccgtgattttcctggaa

SEQ ID NO: 653224 - DNA, 25 bp, Mus musculus
gagatagcaacaccagctacactga

SEQ ID NO: 653225 - DNA, 25 bp, Mus musculus
gagatagcaacagcagctacactga

SEQ ID NO: 653226 - DNA, 25 bp, Mus musculus
gagatagccatgcaagatagtccca

SEQ ID NO: 653227 - DNA, 25 bp, Mus musculus
gagatagccatggaagatagtccca

SEQ ID NO: 653228 - DNA, 25 bp, Mus musculus
gagatagctctcagtgcccgtctga

SEQ ID NO: 653229 - DNA, 25 bp, Mus musculus
gagatagctctctgtgcccgtctga

SEQ ID NO: 653230 - DNA, 25 bp, Mus musculus
gagatagtatggacttacagaggtt

SEQ ID NO: 653231 - DNA, 25 bp, Mus musculus
gagatagtatggtcttacagaggtt

SEQ ID NO: 653232 - DNA, 25 bp, Mus musculus
gagatagtcgtcctcatggaagaag

SEQ ID NO: 653233 - DNA, 25 bp, Mus musculus
gagatagtcgtcgtcatggaagaag

SEQ ID NO: 653234 - DNA, 25 bp, Mus musculus
gagatagtgagcacctgctgttccc

SEQ ID NO: 653235 - DNA, 25 bp, Mus musculus
gagatagtgagctcctgctgttccc

SEQ ID NO: 653236 - DNA, 25 bp, Mus musculus
gagatagttggtcgtgccacacgaa

SEQ ID NO: 653237 - DNA, 25 bp, Mus musculus
gagatagttggtggtgccacacgaa

SEQ ID NO: 653238 - DNA, 25 bp, Mus musculus
gagatagtttcccagctggccagct

SEQ ID NO: 653239 - DNA, 25 bp, Mus musculus
gagatagtttccgagctggccagct

SEQ ID NO: 653240 - DNA, 25 bp, Mus musculus
gagatatcaccactattaaacttct

SEQ ID NO: 653241 - DNA, 25 bp, Mus musculus
gagatatcaccagtattaaacttct

SEQ ID NO: 653242 - DNA, 25 bp, Mus musculus
gagatatcagttaagggtcacagct

SEQ ID NO: 653243 - DNA, 25 bp, Mus musculus
gagatatcagtttagggtcacagct

SEQ ID NO: 653244 - DNA, 25 bp, Mus musculus
gagatatcttagcaattaagaatgc

SEQ ID NO: 653245 - DNA, 25 bp, Mus musculus
gagatatcttaggaattaagaatgc

SEQ ID NO: 653246 - DNA, 25 bp, Mus musculus
gagatattcaataagcttaaccttg

SEQ ID NO: 653247 - DNA, 25 bp, Mus musculus
gagatattcaattagcttaaccttg

SEQ ID NO: 653248 - DNA, 25 bp, Mus musculus
gagatattcagacgatgctctaggg

SEQ ID NO: 653249 - DNA, 25 bp, Mus musculus
gagatattcagaggatgctctaggg

SEQ ID NO: 653250 - DNA, 25 bp, Mus musculus
gagatattgatgaaacggagcaaga

SEQ ID NO: 653251 - DNA, 25 bp, Mus musculus
gagatattgatgtaacggagcaaga

SEQ ID NO: 653252 - DNA, 25 bp, Mus musculus
gagatattggctacatgggtcccag

SEQ ID NO: 653253 - DNA, 25 bp, Mus musculus
gagatattggcttcatgggtcccag

SEQ ID NO: 653254 - DNA, 25 bp, Mus musculus
gagatattttcgactagctgtttcc

SEQ ID NO: 653255 - DNA, 25 bp, Mus musculus
gagatattttcgtctagctgtttcc

SEQ ID NO: 653256 - DNA, 25 bp, Mus musculus
gagatcaaccgacgcacggctgctg

SEQ ID NO: 653257 - DNA, 25 bp, Mus musculus
gagatcaaccgaggcacggctgctg

SEQ ID NO: 653258 - DNA, 25 bp, Mus musculus
gagatcaaccgcatcttcaaagaaa

SEQ ID NO: 653259 - DNA, 25 bp, Mus musculus
gagatcaaccgcttcttcaaagaaa

SEQ ID NO: 653260 - DNA, 25 bp, Mus musculus
gagatcaactctcaagtacggaggt

SEQ ID NO: 653261 - DNA, 25 bp, Mus musculus
gagatcaactctgaagtacggaggt

SEQ ID NO: 653262 - DNA, 25 bp, Mus musculus
gagatcaagaggctaaaggctatcc

SEQ ID NO: 653263 - DNA, 25 bp, Mus musculus
gagatcaagagggtaaaggctatcc

SEQ ID NO: 653264 - DNA, 25 bp, Mus musculus
gagatcaagatcaagttgggaattc

SEQ ID NO: 653265 - DNA, 25 bp, Mus musculus
gagatcaagatctagttgggaattc

SEQ ID NO: 653266 - DNA, 25 bp, Mus musculus
gagatcaagcagaagattgacagct

SEQ ID NO: 653267 - DNA, 25 bp, Mus musculus
gagatcaagcagtagattgacagct

SEQ ID NO: 653268 - DNA, 25 bp, Mus musculus
gagatcaagctaaagtacgctaccc

SEQ ID NO: 653269 - DNA, 25 bp, Mus musculus
gagatcaagctatagtacgctaccc

SEQ ID NO: 653270 - DNA, 25 bp, Mus musculus
gagatcaaggtgctgaacccaccca

SEQ ID NO: 653271 - DNA, 25 bp, Mus musculus
gagatcaaggtggtgaacccaccca

SEQ ID NO: 653272 - DNA, 25 bp, Mus musculus
gagatcaaggttctctctgacaagc

SEQ ID NO: 653273 - DNA, 25 bp, Mus musculus
gagatcaaggttgtctctgacaagc

SEQ ID NO: 653274 - DNA, 25 bp, Mus musculus
gagatcaatgggacccctgtccgta

SEQ ID NO: 653275 - DNA, 25 bp, Mus musculus
gagatcaatgggtcccctgtccgta

SEQ ID NO: 653276 - DNA, 25 bp, Mus musculus
gagatcaatttacagaagtgtccac

SEQ ID NO: 653277 - DNA, 25 bp, Mus musculus
gagatcaatttagagaagtgtccac

SEQ ID NO: 653278 - DNA, 25 bp, Mus musculus
gagatcacagacctgagacggaccc

SEQ ID NO: 653279 - DNA, 25 bp, Mus musculus
gagatcacagacgtgagacggaccc

SEQ ID NO: 653280 - DNA, 25 bp, Mus musculus
gagatcacagtcaggactccctgcc

SEQ ID NO: 653281 - DNA, 25 bp, Mus musculus
gagatcacagtctggactccctgcc

SEQ ID NO: 653282 - DNA, 25 bp, Mus musculus
gagatcaccaagctacaacagcgtt

SEQ ID NO: 653283 - DNA, 25 bp, Mus musculus
gagatcaccaaggtacaacagcgtt

SEQ ID NO: 653284 - DNA, 25 bp, Mus musculus
gagatcaccatcctggcagcagagc

SEQ ID NO: 653285 - DNA, 25 bp, Mus musculus
gagatcaccatcgtggcagcagagc

SEQ ID NO: 653286 - DNA, 25 bp, Mus musculus
gagatcacccgacatattaagcagt

SEQ ID NO: 653287 - DNA, 25 bp, Mus musculus
gagatcacccgagatattaagcagt

SEQ ID NO: 653288 - DNA, 25 bp, Mus musculus
gagatcacggacaacagaacccaag

SEQ ID NO: 653289 - DNA, 25 bp, Mus musculus
gagatcacggactacagaacccaag

SEQ ID NO: 653290 - DNA, 25 bp, Mus musculus
gagatcactatgatctgaatggcaa

SEQ ID NO: 653291 - DNA, 25 bp, Mus musculus
gagatcactatgttctgaatggcaa

SEQ ID NO: 653292 - DNA, 25 bp, Mus musculus
gagatcactggtataagatcacgca

SEQ ID NO: 653293 - DNA, 25 bp, Mus musculus
gagatcactggtttaagatcacgca

SEQ ID NO: 653294 - DNA, 25 bp, Mus musculus
gagatcactttgaggaagccatgcg

SEQ ID NO: 653295 - DNA, 25 bp, Mus musculus
gagatcactttgtggaagccatgcg

SEQ ID NO: 653296 - DNA, 25 bp, Mus musculus
gagatcagcagtctgtgacatttgg

SEQ ID NO: 653297 - DNA, 25 bp, Mus musculus
gagatcagcagtgtgtgacatttgg

SEQ ID NO: 653298 - DNA, 25 bp, Mus musculus
gagatcagcggtacctgaccaccta

SEQ ID NO: 653299 - DNA, 25 bp, Mus musculus
gagatcagcggttcctgaccaccta

SEQ ID NO: 653300 - DNA, 25 bp, Mus musculus
gagatcagtcttctcacaccagctc

SEQ ID NO: 653301 - DNA, 25 bp, Mus musculus
gagatcagtcttgtcacaccagctc

SEQ ID NO: 653302 - DNA, 25 bp, Mus musculus
gagatcagtggtcccctgacctcag

SEQ ID NO: 653303 - DNA, 25 bp, Mus musculus
gagatcagtggtgccctgacctcag

SEQ ID NO: 653304 - DNA, 25 bp, Mus musculus
gagatcatacagaacttcgtgcggg

SEQ ID NO: 653305 - DNA, 25 bp, Mus musculus
gagatcatacagtacttcgtgcggg

SEQ ID NO: 653306 - DNA, 25 bp, Mus musculus
gagatcatcaagactgagatcttgg

SEQ ID NO: 653307 - DNA, 25 bp, Mus musculus
gagatcatcaagtctgagatcttgg

SEQ ID NO: 653308 - DNA, 25 bp, Mus musculus
gagatcatctccattggaagcggat

SEQ ID NO: 653309 - DNA, 25 bp, Mus musculus
gagatcatctcctttggaagcggat

SEQ ID NO: 653310 - DNA, 25 bp, Mus musculus
gagatcatctggcagaaccggcagc

SEQ ID NO: 653311 - DNA, 25 bp, Mus musculus
gagatcatctgggagaaccggcagc

SEQ ID NO: 653312 - DNA, 25 bp, Mus musculus
gagatcatgaagatcacagggacgc

SEQ ID NO: 653313 - DNA, 25 bp, Mus musculus
gagatcatgaagcagacagggtacc

SEQ ID NO: 653314 - DNA, 25 bp, Mus musculus
gagatcatgaaggagacagggtacc

SEQ ID NO: 653315 - DNA, 25 bp, Mus musculus
gagatcatgaagttcacagggacgc

SEQ ID NO: 653316 - DNA, 25 bp, Mus musculus
gagatcatgctaccctttagccact

SEQ ID NO: 653317 - DNA, 25 bp, Mus musculus
gagatcatgctagcctttagccact

SEQ ID NO: 653318 - DNA, 25 bp, Mus musculus
gagatcattgctcgcatcctggcct

SEQ ID NO: 653319 - DNA, 25 bp, Mus musculus
gagatcattgctggcatcctggcct

SEQ ID NO: 653320 - DNA, 25 bp, Mus musculus
gagatccaaatgagagctgcacccc

SEQ ID NO: 653321 - DNA, 25 bp, Mus musculus
gagatccaaatgtgagctgcacccc

SEQ ID NO: 653322 - DNA, 25 bp, Mus musculus
gagatccaagatcgcagattcaatc

SEQ ID NO: 653323 - DNA, 25 bp, Mus musculus
gagatccaagatggcagattcaatc

SEQ ID NO: 653324 - DNA, 25 bp, Mus musculus
gagatccaagtaccaccacagagtc

SEQ ID NO: 653325 - DNA, 25 bp, Mus musculus
gagatccaagtagcaccacagagtc

SEQ ID NO: 653326 - DNA, 25 bp, Mus musculus
gagatccaatctacaagatcaaagg

SEQ ID NO: 653327 - DNA, 25 bp, Mus musculus
gagatccaatcttcaagatcaaagg

SEQ ID NO: 653328 - DNA, 25 bp, Mus musculus
gagatccacagacttgccaaagagg

SEQ ID NO: 653329 - DNA, 25 bp, Mus musculus
gagatccacagagttgccaaagagg

SEQ ID NO: 653330 - DNA, 25 bp, Mus musculus
gagatccacagcaagtgcgcatgtt

SEQ ID NO: 653331 - DNA, 25 bp, Mus musculus
gagatccacagctagtgcgcatgtt

SEQ ID NO: 653332 - DNA, 25 bp, Mus musculus
gagatccaccacaagaccgagatgg

SEQ ID NO: 653333 - DNA, 25 bp, Mus musculus
gagatccaccactagaccgagatgg

SEQ ID NO: 653334 - DNA, 25 bp, Mus musculus
gagatccacctccaattgttccctt

SEQ ID NO: 653335 - DNA, 25 bp, Mus musculus
gagatccacctcgaattgttccctt

SEQ ID NO: 653336 - DNA, 25 bp, Mus musculus
gagatccaccttaaaacctgaggaa

SEQ ID NO: 653337 - DNA, 25 bp, Mus musculus
gagatccacctttaaacctgaggaa

SEQ ID NO: 653338 - DNA, 25 bp, Mus musculus
gagatccactcacccgtggtttacc

SEQ ID NO: 653339 - DNA, 25 bp, Mus musculus
gagatccactcagccgtggtttacc

SEQ ID NO: 653340 - DNA, 25 bp, Mus musculus
gagatccagaagagacgagagcgcc

SEQ ID NO: 653341 - DNA, 25 bp, Mus musculus
gagatccagaagtgacgagagcgcc

SEQ ID NO: 653342 - DNA, 25 bp, Mus musculus
gagatccagaatcgagcctcgaatt

SEQ ID NO: 653343 - DNA, 25 bp, Mus musculus
gagatccagaatggagcctcgaatt

SEQ ID NO: 653344 - DNA, 25 bp, Mus musculus
gagatccagccacgtttcatccgct

SEQ ID NO: 653345 - DNA, 25 bp, Mus musculus
gagatccagccaggtttcatccgct

SEQ ID NO: 653346 - DNA, 25 bp, Mus musculus
gagatccagtctcacatgggacgcc

SEQ ID NO: 653347 - DNA, 25 bp, Mus musculus
gagatccagtctgacatgggacgcc

SEQ ID NO: 653348 - DNA, 25 bp, Mus musculus
gagatccagtttacccagaaaggtg

SEQ ID NO: 653349 - DNA, 25 bp, Mus musculus
gagatccagttttcccagaaaggtg

SEQ ID NO: 653350 - DNA, 25 bp, Mus musculus
gagatccatcacatcatggagatgt

SEQ ID NO: 653351 - DNA, 25 bp, Mus musculus
gagatccatcacttcatggagatgt

SEQ ID NO: 653352 - DNA, 25 bp, Mus musculus
gagatccatgatcctcaggggagaa

SEQ ID NO: 653353 - DNA, 25 bp, Mus musculus
gagatccatgatgctcaggggagaa

SEQ ID NO: 653354 - DNA, 25 bp, Mus musculus
gagatcccacaccaagagtcaagag

SEQ ID NO: 653355 - DNA, 25 bp, Mus musculus
gagatcccacacgaagagtcaagag

SEQ ID NO: 653356 - DNA, 25 bp, Mus musculus
gagatcccatgtaaagaacggtgag

SEQ ID NO: 653357 - DNA, 25 bp, Mus musculus
gagatcccatgttaagaacggtgag

SEQ ID NO: 653358 - DNA, 25 bp, Mus musculus
gagatcccctcgctgaagaagcaga

SEQ ID NO: 653359 - DNA, 25 bp, Mus musculus
gagatcccctcggtgaagaagcaga

SEQ ID NO: 653360 - DNA, 25 bp, Mus musculus
gagatccctggccagaagtacaaag

SEQ ID NO: 653361 - DNA, 25 bp, Mus musculus
gagatccctggcgagaagtacaaag

SEQ ID NO: 653362 - DNA, 25 bp, Mus musculus
gagatccgaaatcgcccataccgtc

SEQ ID NO: 653363 - DNA, 25 bp, Mus musculus
gagatccgaaatggcccataccgtc

SEQ ID NO: 653364 - DNA, 25 bp, Mus musculus
gagatccgagccacactacctggtg

SEQ ID NO: 653365 - DNA, 25 bp, Mus musculus
gagatccgagcctcactacctggtg

SEQ ID NO: 653366 - DNA, 25 bp, Mus musculus
gagatccgaggcaatgtacttgtat

SEQ ID NO: 653367 - DNA, 25 bp, Mus musculus
gagatccgaggctatgtacttgtat

SEQ ID NO: 653368 - DNA, 25 bp, Mus musculus
gagatccgatgtaatgtgcgtgaca

SEQ ID NO: 653369 - DNA, 25 bp, Mus musculus
gagatccgatgttatgtgcgtgaca

SEQ ID NO: 653370 - DNA, 25 bp, Mus musculus
gagatccgcctcaagtattttgata

SEQ ID NO: 653371 - DNA, 25 bp, Mus musculus
gagatccgcctctagtattttgata

SEQ ID NO: 653372 - DNA, 25 bp, Mus musculus
gagatccggactaggcacctctaat

SEQ ID NO: 653373 - DNA, 25 bp, Mus musculus
gagatccggacttggcacctctaat

SEQ ID NO: 653374 - DNA, 25 bp, Mus musculus
gagatccgtgcacagctaagtgagc

SEQ ID NO: 653375 - DNA, 25 bp, Mus musculus
gagatccgtgcagagctaagtgagc

SEQ ID NO: 653376 - DNA, 25 bp, Mus musculus
gagatccgttctctccgtgtgggca

SEQ ID NO: 653377 - DNA, 25 bp, Mus musculus
gagatccgttctgtccgtgtgggca

SEQ ID NO: 653378 - DNA, 25 bp, Mus musculus
gagatcctccgcctctttgcagatg

SEQ ID NO: 653379 - DNA, 25 bp, Mus musculus
gagatcctccgcgtctttgcagatg

SEQ ID NO: 653380 - DNA, 25 bp, Mus musculus
gagatcctctctcacctttgcaatc

SEQ ID NO: 653381 - DNA, 25 bp, Mus musculus
gagatcctctctgacctttgcaatc

SEQ ID NO: 653382 - DNA, 25 bp, Mus musculus
gagatcctgatacttggcatgttgg

SEQ ID NO: 653383 - DNA, 25 bp, Mus musculus
gagatcctgatagttggcatgttgg

SEQ ID NO: 653384 - DNA, 25 bp, Mus musculus
gagatcctgctcagctacctacgca

SEQ ID NO: 653385 - DNA, 25 bp, Mus musculus
gagatcctgctctgctacctacgca

SEQ ID NO: 653386 - DNA, 25 bp, Mus musculus
gagatcctgctgcaactctacaggg

SEQ ID NO: 653387 - DNA, 25 bp, Mus musculus
gagatcctgctggaactctacaggg

SEQ ID NO: 653388 - DNA, 25 bp, Mus musculus
gagatcctgtgtatctgctttcaat

SEQ ID NO: 653389 - DNA, 25 bp, Mus musculus
gagatcctgtgtttctgctttcaat

SEQ ID NO: 653390 - DNA, 25 bp, Mus musculus
gagatccttctcctgagtggtagag

SEQ ID NO: 653391 - DNA, 25 bp, Mus musculus
gagatccttctcgtgagtggtagag

SEQ ID NO: 653392 - DNA, 25 bp, Mus musculus
gagatccttggaatcgaagatgatg

SEQ ID NO: 653393 - DNA, 25 bp, Mus musculus
gagatccttggattcgaagatgatg

SEQ ID NO: 653394 - DNA, 25 bp, Mus musculus
gagatccttgttctcatgcattgca

SEQ ID NO: 653395 - DNA, 25 bp, Mus musculus
gagatccttgttgtcatgcattgca

SEQ ID NO: 653396 - DNA, 25 bp, Mus musculus
gagatcctttacagacacctcatgg

SEQ ID NO: 653397 - DNA, 25 bp, Mus musculus
gagatcctttactgacacctcatgg

SEQ ID NO: 653398 - DNA, 25 bp, Mus musculus
gagatcgaacacaagaaggaggagc

SEQ ID NO: 653399 - DNA, 25 bp, Mus musculus
gagatcgaacactagaaggaggagc

SEQ ID NO: 653400 - DNA, 25 bp, Mus musculus
gagatcgacagccatgactttgtgc

SEQ ID NO: 653401 - DNA, 25 bp, Mus musculus
gagatcgacagcgatgactttgtgc

SEQ ID NO: 653402 - DNA, 25 bp, Mus musculus
gagatcgagactcatccaaggactc

SEQ ID NO: 653403 - DNA, 25 bp, Mus musculus
gagatcgagactgatccaaggactc

SEQ ID NO: 653404 - DNA, 25 bp, Mus musculus
gagatcgagctgaggtttcagagca

SEQ ID NO: 653405 - DNA, 25 bp, Mus musculus
gagatcgagctgtggtttcagagca

SEQ ID NO: 653406 - DNA, 25 bp, Mus musculus
gagatcgagggtacacagataacct

SEQ ID NO: 653407 - DNA, 25 bp, Mus musculus
gagatcgagggttcacagataacct

SEQ ID NO: 653408 - DNA, 25 bp, Mus musculus
gagatcgagttcaacagaaatccca

SEQ ID NO: 653409 - DNA, 25 bp, Mus musculus
gagatcgagttctacagaaatccca

SEQ ID NO: 653410 - DNA, 25 bp, Mus musculus
gagatcgcattgaagagcctcagct

SEQ ID NO: 653411 - DNA, 25 bp, Mus musculus
gagatcgcattgtagagcctcagct

SEQ ID NO: 653412 - DNA, 25 bp, Mus musculus
gagatcgcgccgcttttctgggaaa

SEQ ID NO: 653413 - DNA, 25 bp, Mus musculus
gagatcgcgccggttttctgggaaa

SEQ ID NO: 653414 - DNA, 25 bp, Mus musculus
gagatcggccttccagtttgcaata

SEQ ID NO: 653415 - DNA, 25 bp, Mus musculus
gagatcggccttgcagtttgcaata

SEQ ID NO: 653416 - DNA, 25 bp, Mus musculus
gagatcggctccaatcgctgtgcct

SEQ ID NO: 653417 - DNA, 25 bp, Mus musculus
gagatcggctcctatcgctgtgcct

SEQ ID NO: 653418 - DNA, 25 bp, Mus musculus
gagatcgggcgcatctccattgaga

SEQ ID NO: 653419 - DNA, 25 bp, Mus musculus
gagatcgggcgcttctccattgaga

SEQ ID NO: 653420 - DNA, 25 bp, Mus musculus
gagatcgtctgcataatcctgaaag

SEQ ID NO: 653421 - DNA, 25 bp, Mus musculus
gagatcgtctgcttaatcctgaaag

SEQ ID NO: 653422 - DNA, 25 bp, Mus musculus
gagatcgtgcccatctgcttcacgg

SEQ ID NO: 653423 - DNA, 25 bp, Mus musculus
gagatcgtgcccttctgcttcacgg

SEQ ID NO: 653424 - DNA, 25 bp, Mus musculus
gagatctacaaccaagatgtccatg

SEQ ID NO: 653425 - DNA, 25 bp, Mus musculus
gagatctacaacgaagatgtccatg

SEQ ID NO: 653426 - DNA, 25 bp, Mus musculus
gagatctacaagctgactctggagg

SEQ ID NO: 653427 - DNA, 25 bp, Mus musculus
gagatctacaaggtgactctggagg

SEQ ID NO: 653428 - DNA, 25 bp, Mus musculus
gagatctacacgcacttcacgtgcg

SEQ ID NO: 653429 - DNA, 25 bp, Mus musculus
gagatctacacggacttcacgtgcg

SEQ ID NO: 653430 - DNA, 25 bp, Mus musculus
gagatctaggctcgccagcgcccag

SEQ ID NO: 653431 - DNA, 25 bp, Mus musculus
gagatctaggctggccagcgcccag

SEQ ID NO: 653432 - DNA, 25 bp, Mus musculus
gagatctatgccaatcgagaagagc

SEQ ID NO: 653433 - DNA, 25 bp, Mus musculus
gagatctatgcctatcgagaagagc

SEQ ID NO: 653434 - DNA, 25 bp, Mus musculus
gagatctcaggacccattcccatgg

SEQ ID NO: 653435 - DNA, 25 bp, Mus musculus
gagatctcaggagccattcccatgg

SEQ ID NO: 653436 - DNA, 25 bp, Mus musculus
gagatctcccctcaatacaaaacga

SEQ ID NO: 653437 - DNA, 25 bp, Mus musculus
gagatctcccctgaatacaaaacga

SEQ ID NO: 653438 - DNA, 25 bp, Mus musculus
gagatctcctggcatcatgggaaag

SEQ ID NO: 653439 - DNA, 25 bp, Mus musculus
gagatctcctgggatcatgggaaag

SEQ ID NO: 653440 - DNA, 25 bp, Mus musculus
gagatctcctgtatcaaccagtggc

SEQ ID NO: 653441 - DNA, 25 bp, Mus musculus
gagatctcctgtttcaaccagtggc

SEQ ID NO: 653442 - DNA, 25 bp, Mus musculus
gagatctcgaaacgcaattgtgagg

SEQ ID NO: 653443 - DNA, 25 bp, Mus musculus
gagatctcgaaaggcaattgtgagg

SEQ ID NO: 653444 - DNA, 25 bp, Mus musculus
gagatctcggataaattccttgtgc

SEQ ID NO: 653445 - DNA, 25 bp, Mus musculus
gagatctcggattaattccttgtgc

SEQ ID NO: 653446 - DNA, 25 bp, Mus musculus
gagatctcggtcagagagtgatgcc

SEQ ID NO: 653447 - DNA, 25 bp, Mus musculus
gagatctcggtctgagagtgatgcc

SEQ ID NO: 653448 - DNA, 25 bp, Mus musculus
gagatctcgtgcagccaagtgtcca

SEQ ID NO: 653449 - DNA, 25 bp, Mus musculus
gagatctcgtgctgccaagtgtcca

SEQ ID NO: 653450 - DNA, 25 bp, Mus musculus
gagatctctataactacttctcaag

SEQ ID NO: 653451 - DNA, 25 bp, Mus musculus
gagatctctatatctacttctcaag

SEQ ID NO: 653452 - DNA, 25 bp, Mus musculus
gagatctgaaagatgcccagaagtc

SEQ ID NO: 653453 - DNA, 25 bp, Mus musculus
gagatctgaaagttgcccagaagtc

SEQ ID NO: 653454 - DNA, 25 bp, Mus musculus
gagatctgatcaacctgaagccagt

SEQ ID NO: 653455 - DNA, 25 bp, Mus musculus
gagatctgatcatcctgaagccagt

SEQ ID NO: 653456 - DNA, 25 bp, Mus musculus
gagatctgccaacctgtgcgcctgg

SEQ ID NO: 653457 - DNA, 25 bp, Mus musculus
gagatctgccaagctgtgcgcctgg

SEQ ID NO: 653458 - DNA, 25 bp, Mus musculus
gagatctgcctcaatggcaccccag

SEQ ID NO: 653459 - DNA, 25 bp, Mus musculus
gagatctgcctctatggcaccccag

SEQ ID NO: 653460 - DNA, 25 bp, Mus musculus
gagatctgctccagggtctcccttt

SEQ ID NO: 653461 - DNA, 25 bp, Mus musculus
gagatctgctcctgggtctcccttt

SEQ ID NO: 653462 - DNA, 25 bp, Mus musculus
gagatctgttgtatatggtggatac

SEQ ID NO: 653463 - DNA, 25 bp, Mus musculus
gagatctgttgtttatggtggatac

SEQ ID NO: 653464 - DNA, 25 bp, Mus musculus
gagatcttcagcattggatgatccc

SEQ ID NO: 653465 - DNA, 25 bp, Mus musculus
gagatcttcagctttggatgatccc

SEQ ID NO: 653466 - DNA, 25 bp, Mus musculus
gagatcttccggcacttacagacaa

SEQ ID NO: 653467 - DNA, 25 bp, Mus musculus
gagatcttccgggacttacagacaa

SEQ ID NO: 653468 - DNA, 25 bp, Mus musculus
gagatcttcgatcacaatgccaagt

SEQ ID NO: 653469 - DNA, 25 bp, Mus musculus
gagatcttcgatgacaatgccaagt

SEQ ID NO: 653470 - DNA, 25 bp, Mus musculus
gagatcttctatactagaagtggac

SEQ ID NO: 653471 - DNA, 25 bp, Mus musculus
gagatcttctattctagaagtggac

SEQ ID NO: 653472 - DNA, 25 bp, Mus musculus
gagatcttggaaagtgtctgctcct

SEQ ID NO: 653473 - DNA, 25 bp, Mus musculus
gagatcttggaatgtgtctgctcct

SEQ ID NO: 653474 - DNA, 25 bp, Mus musculus
gagatcttgggcagcccactgccgg

SEQ ID NO: 653475 - DNA, 25 bp, Mus musculus
gagatcttgggctgcccactgccgg

SEQ ID NO: 653476 - DNA, 25 bp, Mus musculus
gagatcttggtcagttggactgtca

SEQ ID NO: 653477 - DNA, 25 bp, Mus musculus
gagatcttggtctgttggactgtca

SEQ ID NO: 653478 - DNA, 25 bp, Mus musculus
gagatctttaggaaggacggcccct

SEQ ID NO: 653479 - DNA, 25 bp, Mus musculus
gagatctttaggtaggacggcccct

SEQ ID NO: 653480 - DNA, 25 bp, Mus musculus
gagatctttgacaacctcagcctgt

SEQ ID NO: 653481 - DNA, 25 bp, Mus musculus
gagatctttgactacctcagcctgt

SEQ ID NO: 653482 - DNA, 25 bp, Mus musculus
gagatgaaaacccacctcttgattg

SEQ ID NO: 653483 - DNA, 25 bp, Mus musculus
gagatgaaaaccgacctcttgattg

SEQ ID NO: 653484 - DNA, 25 bp, Mus musculus
gagatgaaatggattcctggatgca

SEQ ID NO: 653485 - DNA, 25 bp, Mus musculus
gagatgaaatggtttcctggatgca

SEQ ID NO: 653486 - DNA, 25 bp, Mus musculus
gagatgaacaccaggctacaagtgg

SEQ ID NO: 653487 - DNA, 25 bp, Mus musculus
gagatgaacacctggctacaagtgg

SEQ ID NO: 653488 - DNA, 25 bp, Mus musculus
gagatgaacagcagctgaactcatg

SEQ ID NO: 653489 - DNA, 25 bp, Mus musculus
gagatgaacagctgctgaactcatg

SEQ ID NO: 653490 - DNA, 25 bp, Mus musculus
gagatgaagcctaatctaaatcagt

SEQ ID NO: 653491 - DNA, 25 bp, Mus musculus
gagatgaagccttatctaaatcagt

SEQ ID NO: 653492 - DNA, 25 bp, Mus musculus
gagatgaatggcacagaagatggca

SEQ ID NO: 653493 - DNA, 25 bp, Mus musculus
gagatgaatggctcagaagatggca

SEQ ID NO: 653494 - DNA, 25 bp, Mus musculus
gagatgaatggtattgtatacacag

SEQ ID NO: 653495 - DNA, 25 bp, Mus musculus
gagatgaatggttttgtatacacag

SEQ ID NO: 653496 - DNA, 25 bp, Mus musculus
gagatgaatgttcacccttccaaga

SEQ ID NO: 653497 - DNA, 25 bp, Mus musculus
gagatgaatgttgacccttccaaga

SEQ ID NO: 653498 - DNA, 25 bp, Mus musculus
gagatgaattccagttcacctggga

SEQ ID NO: 653499 - DNA, 25 bp, Mus musculus
gagatgaattcctgttcacctggga

SEQ ID NO: 653500 - DNA, 25 bp, Mus musculus
gagatgacagtcctatctttgaaga

SEQ ID NO: 653501 - DNA, 25 bp, Mus musculus
gagatgacagtcgtatctttgaaga

SEQ ID NO: 653502 - DNA, 25 bp, Mus musculus
gagatgacatcgaccttatcgtccg

SEQ ID NO: 653503 - DNA, 25 bp, Mus musculus
gagatgacatcgtccttatcgtccg

SEQ ID NO: 653504 - DNA, 25 bp, Mus musculus
gagatgaccaagaggaattccaatg

SEQ ID NO: 653505 - DNA, 25 bp, Mus musculus
gagatgaccaagtggaattccaatg

SEQ ID NO: 653506 - DNA, 25 bp, Mus musculus
gagatgaccaggatgagtgcctgat

SEQ ID NO: 653507 - DNA, 25 bp, Mus musculus
gagatgaccaggttgagtgcctgat

SEQ ID NO: 653508 - DNA, 25 bp, Mus musculus
gagatgaccttcacaacctgctcag

SEQ ID NO: 653509 - DNA, 25 bp, Mus musculus
gagatgaccttctcaacctgctcag

SEQ ID NO: 653510 - DNA, 25 bp, Mus musculus
gagatgacggctaggcagttgtaaa

SEQ ID NO: 653511 - DNA, 25 bp, Mus musculus
gagatgacggcttggcagttgtaaa

SEQ ID NO: 653512 - DNA, 25 bp, Mus musculus
gagatgactccaaccggtacccata

SEQ ID NO: 653513 - DNA, 25 bp, Mus musculus
gagatgactccatccggtacccata

SEQ ID NO: 653514 - DNA, 25 bp, Mus musculus
gagatgactctgacatgatagagtg

SEQ ID NO: 653515 - DNA, 25 bp, Mus musculus
gagatgactctgtcatgatagagtg

SEQ ID NO: 653516 - DNA, 25 bp, Mus musculus
gagatgactgcactctagcgttgga

SEQ ID NO: 653517 - DNA, 25 bp, Mus musculus
gagatgactgcagtctagcgttgga

SEQ ID NO: 653518 - DNA, 25 bp, Mus musculus
gagatgacttatcggctgtggtcat

SEQ ID NO: 653519 - DNA, 25 bp, Mus musculus
gagatgacttatgggctgtggtcat

SEQ ID NO: 653520 - DNA, 25 bp, Mus musculus
gagatgagaacaacccaccatcagt

SEQ ID NO: 653521 - DNA, 25 bp, Mus musculus
gagatgagaacatcccaccatcagt

SEQ ID NO: 653522 - DNA, 25 bp, Mus musculus
gagatgagacttacaagccccacct

SEQ ID NO: 653523 - DNA, 25 bp, Mus musculus
gagatgagactttcaagccccacct

SEQ ID NO: 653524 - DNA, 25 bp, Mus musculus
gagatgagatgcatgtggcacacag

SEQ ID NO: 653525 - DNA, 25 bp, Mus musculus
gagatgagatgcttgtggcacacag

SEQ ID NO: 653526 - DNA, 25 bp, Mus musculus
gagatgagcagcagctaaaagaaca

SEQ ID NO: 653527 - DNA, 25 bp, Mus musculus
gagatgagcagctgctaaaagaaca

SEQ ID NO: 653528 - DNA, 25 bp, Mus musculus
gagatgagccgcatcatcccgttcc

SEQ ID NO: 653529 - DNA, 25 bp, Mus musculus
gagatgagccgcttcatcccgttcc

SEQ ID NO: 653530 - DNA, 25 bp, Mus musculus
gagatgagccgtctgtccatccgca

SEQ ID NO: 653531 - DNA, 25 bp, Mus musculus
gagatgagccgtgtgtccatccgca

SEQ ID NO: 653532 - DNA, 25 bp, Mus musculus
gagatgagcgcactgtaaagagcac

SEQ ID NO: 653533 - DNA, 25 bp, Mus musculus
gagatgagcgcagtgtaaagagcac

SEQ ID NO: 653534 - DNA, 25 bp, Mus musculus
gagatgaggcacaagtcagaaacgg

SEQ ID NO: 653535 - DNA, 25 bp, Mus musculus
gagatgaggcactagtcagaaacgg

SEQ ID NO: 653536 - DNA, 25 bp, Mus musculus
gagatgaggcagatgtttgtccaga

SEQ ID NO: 653537 - DNA, 25 bp, Mus musculus
gagatgaggcagttgtttgtccaga

SEQ ID NO: 653538 - DNA, 25 bp, Mus musculus
gagatgagggcaacaacctcctcac

SEQ ID NO: 653539 - DNA, 25 bp, Mus musculus
gagatgagggcatcaacctcctcac

SEQ ID NO: 653540 - DNA, 25 bp, Mus musculus
gagatgagggtgatacgcttttgat

SEQ ID NO: 653541 - DNA, 25 bp, Mus musculus
gagatgagggtgttacgcttttgat

SEQ ID NO: 653542 - DNA, 25 bp, Mus musculus
gagatgaggtttcgagctacagccc

SEQ ID NO: 653543 - DNA, 25 bp, Mus musculus
gagatgaggtttggagctacagccc

SEQ ID NO: 653544 - DNA, 25 bp, Mus musculus
gagatgatataaagtccgtgaatcc

SEQ ID NO: 653545 - DNA, 25 bp, Mus musculus
gagatgatataatgtccgtgaatcc

SEQ ID NO: 653546 - DNA, 25 bp, Mus musculus
gagatgatattaaccggcgctacga

SEQ ID NO: 653547 - DNA, 25 bp, Mus musculus
gagatgatattatccggcgctacga

SEQ ID NO: 653548 - DNA, 25 bp, Mus musculus
gagatgatcaatccaaactacattg

SEQ ID NO: 653549 - DNA, 25 bp, Mus musculus
gagatgatcaatgcaaactacattg

SEQ ID NO: 653550 - DNA, 25 bp, Mus musculus
gagatgatccagaagtctgtgacct

SEQ ID NO: 653551 - DNA, 25 bp, Mus musculus
gagatgatccagtagtctgtgacct

SEQ ID NO: 653552 - DNA, 25 bp, Mus musculus
gagatgatcttccagattccatgga

SEQ ID NO: 653553 - DNA, 25 bp, Mus musculus
gagatgatcttcgagattccatgga

SEQ ID NO: 653554 - DNA, 25 bp, Mus musculus
gagatgatgagaacctgattcctgg

SEQ ID NO: 653555 - DNA, 25 bp, Mus musculus
gagatgatgagatcctgattcctgg

SEQ ID NO: 653556 - DNA, 25 bp, Mus musculus
gagatgatggatcccaaagccaggc

SEQ ID NO: 653557 - DNA, 25 bp, Mus musculus
gagatgatggatgccaaagccaggc

SEQ ID NO: 653558 - DNA, 25 bp, Mus musculus
gagatgattactcggaagatcctgt

SEQ ID NO: 653559 - DNA, 25 bp, Mus musculus
gagatgattactgggaagatcctgt

SEQ ID NO: 653560 - DNA, 25 bp, Mus musculus
gagatgattgaaccttatcggcttc

SEQ ID NO: 653561 - DNA, 25 bp, Mus musculus
gagatgattgaagcttatcggcttc

SEQ ID NO: 653562 - DNA, 25 bp, Mus musculus
gagatgatttccaacttcctgcgct

SEQ ID NO: 653563 - DNA, 25 bp, Mus musculus
gagatgatttcctacttcctgcgct

SEQ ID NO: 653564 - DNA, 25 bp, Mus musculus
gagatgcaaagactctccttcgccc

SEQ ID NO: 653565 - DNA, 25 bp, Mus musculus
gagatgcaaagagtctccttcgccc

SEQ ID NO: 653566 - DNA, 25 bp, Mus musculus
gagatgcacctgcaagactctgcta

SEQ ID NO: 653567 - DNA, 25 bp, Mus musculus
gagatgcacctggaagactctgcta

SEQ ID NO: 653568 - DNA, 25 bp, Mus musculus
gagatgcagatacaatcccttgctg

SEQ ID NO: 653569 - DNA, 25 bp, Mus musculus
gagatgcagatagaatcccttgctg

SEQ ID NO: 653570 - DNA, 25 bp, Mus musculus
gagatgcagctgatccctctcctgt

SEQ ID NO: 653571 - DNA, 25 bp, Mus musculus
gagatgcagctgttccctctcctgt

SEQ ID NO: 653572 - DNA, 25 bp, Mus musculus
gagatgcaggaaaatgacgcctcca

SEQ ID NO: 653573 - DNA, 25 bp, Mus musculus
gagatgcaggaatatgacgcctcca

SEQ ID NO: 653574 - DNA, 25 bp, Mus musculus
gagatgcatattatcacaacggtcc

SEQ ID NO: 653575 - DNA, 25 bp, Mus musculus
gagatgcatattttcacaacggtcc

SEQ ID NO: 653576 - DNA, 25 bp, Mus musculus
gagatgcatccaccaagatccaagg

SEQ ID NO: 653577 - DNA, 25 bp, Mus musculus
gagatgcatccagcaagatccaagg

SEQ ID NO: 653578 - DNA, 25 bp, Mus musculus
gagatgcattaacaaggctgtggcc

SEQ ID NO: 653579 - DNA, 25 bp, Mus musculus
gagatgcattaagaaggctgtggcc

SEQ ID NO: 653580 - DNA, 25 bp, Mus musculus
gagatgccagagacaactctccata

SEQ ID NO: 653581 - DNA, 25 bp, Mus musculus
gagatgccagagtcaactctccata

SEQ ID NO: 653582 - DNA, 25 bp, Mus musculus
gagatgccatacctgaaatgtccgc

SEQ ID NO: 653583 - DNA, 25 bp, Mus musculus
gagatgccatacgtgaaatgtccgc

SEQ ID NO: 653584 - DNA, 25 bp, Mus musculus
gagatgccatcacccaaaaagctgc

SEQ ID NO: 653585 - DNA, 25 bp, Mus musculus
gagatgccatcagccaaaaagctgc

SEQ ID NO: 653586 - DNA, 25 bp, Mus musculus
gagatgcccattacgacgacgacga

SEQ ID NO: 653587 - DNA, 25 bp, Mus musculus
gagatgcccatttcgacgacgacga

SEQ ID NO: 653588 - DNA, 25 bp, Mus musculus
gagatgccccaacatgtgtcctcta

SEQ ID NO: 653589 - DNA, 25 bp, Mus musculus
gagatgccccaagatgtgtcctcta

SEQ ID NO: 653590 - DNA, 25 bp, Mus musculus
gagatgccgcctctgggaccatcag

SEQ ID NO: 653591 - DNA, 25 bp, Mus musculus
gagatgccgcctgtgggaccatcag

SEQ ID NO: 653592 - DNA, 25 bp, Mus musculus
gagatgcctaatctacatgctcccc

SEQ ID NO: 653593 - DNA, 25 bp, Mus musculus
gagatgcctaatgtacatgctcccc

SEQ ID NO: 653594 - DNA, 25 bp, Mus musculus
gagatgcctgacaacctctacacct

SEQ ID NO: 653595 - DNA, 25 bp, Mus musculus
gagatgcctgactacctctacacct

SEQ ID NO: 653596 - DNA, 25 bp, Mus musculus
gagatgcctgggaaggtctcactac

SEQ ID NO: 653597 - DNA, 25 bp, Mus musculus
gagatgcctgggtaggtctcactac

SEQ ID NO: 653598 - DNA, 25 bp, Mus musculus
gagatgcgacctccattaattgaat

SEQ ID NO: 653599 - DNA, 25 bp, Mus musculus
gagatgcgacctgcattaattgaat

SEQ ID NO: 653600 - DNA, 25 bp, Mus musculus
gagatgcgccccatcaagacagagc

SEQ ID NO: 653601 - DNA, 25 bp, Mus musculus
gagatgcgccccttcaagacagagc

SEQ ID NO: 653602 - DNA, 25 bp, Mus musculus
gagatgcgctccatcattctgacag

SEQ ID NO: 653603 - DNA, 25 bp, Mus musculus
gagatgcgctccttcattctgacag

SEQ ID NO: 653604 - DNA, 25 bp, Mus musculus
gagatgcgctgtatgcctaggaagc

SEQ ID NO: 653605 - DNA, 25 bp, Mus musculus
gagatgcgctgtttgcctaggaagc

SEQ ID NO: 653606 - DNA, 25 bp, Mus musculus
gagatgcggaaacccctcacagact

SEQ ID NO: 653607 - DNA, 25 bp, Mus musculus
gagatgcggaaagccctcacagact

SEQ ID NO: 653608 - DNA, 25 bp, Mus musculus
gagatgcggcatctactgagactac

SEQ ID NO: 653609 - DNA, 25 bp, Mus musculus
gagatgcggcatgtactgagactac

SEQ ID NO: 653610 - DNA, 25 bp, Mus musculus
gagatgctaacaagggaggtcccct

SEQ ID NO: 653611 - DNA, 25 bp, Mus musculus
gagatgctaacacctccgtgtggcc

SEQ ID NO: 653612 - DNA, 25 bp, Mus musculus
gagatgctaacagctccgtgtggcc

SEQ ID NO: 653613 - DNA, 25 bp, Mus musculus
gagatgctaacatgggaggtcccct

SEQ ID NO: 653614 - DNA, 25 bp, Mus musculus
gagatgctccacagtaacggagata

SEQ ID NO: 653615 - DNA, 25 bp, Mus musculus
gagatgctccactgtaacggagata

SEQ ID NO: 653616 - DNA, 25 bp, Mus musculus
gagatgctcggcctgtacacagaga

SEQ ID NO: 653617 - DNA, 25 bp, Mus musculus
gagatgctcggcgtgtacacagaga

SEQ ID NO: 653618 - DNA, 25 bp, Mus musculus
gagatgctctacctggctactcgta

SEQ ID NO: 653619 - DNA, 25 bp, Mus musculus
gagatgctctacgtggctactcgta

SEQ ID NO: 653620 - DNA, 25 bp, Mus musculus
gagatgctgaaccccttcagcacca

SEQ ID NO: 653621 - DNA, 25 bp, Mus musculus
gagatgctgaacgccttcagcacca

SEQ ID NO: 653622 - DNA, 25 bp, Mus musculus
gagatgctgagaacaatgtggaatt

SEQ ID NO: 653623 - DNA, 25 bp, Mus musculus
gagatgctgagatcaatgtggaatt

SEQ ID NO: 653624 - DNA, 25 bp, Mus musculus
gagatgctggaaacagacaccttca

SEQ ID NO: 653625 - DNA, 25 bp, Mus musculus
gagatgctggaatcagacaccttca

SEQ ID NO: 653626 - DNA, 25 bp, Mus musculus
gagatgctggcgagtctggtccaac

SEQ ID NO: 653627 - DNA, 25 bp, Mus musculus
gagatgctggcgtgtctggtccaac

SEQ ID NO: 653628 - DNA, 25 bp, Mus musculus
gagatgcttcccatagcctgtgatg

SEQ ID NO: 653629 - DNA, 25 bp, Mus musculus
gagatgcttcccttagcctgtgatg

SEQ ID NO: 653630 - DNA, 25 bp, Mus musculus
gagatgctttgactgactctaagac

SEQ ID NO: 653631 - DNA, 25 bp, Mus musculus
gagatgctttgagtgactctaagac

SEQ ID NO: 653632 - DNA, 25 bp, Mus musculus
gagatggaattccagcgattcataa

SEQ ID NO: 653633 - DNA, 25 bp, Mus musculus
gagatggaattcgagcgattcataa

SEQ ID NO: 653634 - DNA, 25 bp, Mus musculus
gagatggagacaaagcacgatacct

SEQ ID NO: 653635 - DNA, 25 bp, Mus musculus
gagatggagacatagcacgatacct

SEQ ID NO: 653636 - DNA, 25 bp, Mus musculus
gagatggagagccaacagtctactg

SEQ ID NO: 653637 - DNA, 25 bp, Mus musculus
gagatggagagccactgaacttcta

SEQ ID NO: 653638 - DNA, 25 bp, Mus musculus
gagatggagagcgaacagtctactg

SEQ ID NO: 653639 - DNA, 25 bp, Mus musculus
gagatggagagcgactgaacttcta

SEQ ID NO: 653640 - DNA, 25 bp, Mus musculus
gagatggagcagacaatgaacatgt

SEQ ID NO: 653641 - DNA, 25 bp, Mus musculus
gagatggagcagtcaatgaacatgt

SEQ ID NO: 653642 - DNA, 25 bp, Mus musculus
gagatggagtccaaggcttctcgga

SEQ ID NO: 653643 - DNA, 25 bp, Mus musculus
gagatggagtcctaggcttctcgga

SEQ ID NO: 653644 - DNA, 25 bp, Mus musculus
gagatggagtttcatccaaattcaa

SEQ ID NO: 653645 - DNA, 25 bp, Mus musculus
gagatggagtttgatccaaattcaa

SEQ ID NO: 653646 - DNA, 25 bp, Mus musculus
gagatggatatcaacaagaacaaga

SEQ ID NO: 653647 - DNA, 25 bp, Mus musculus
gagatggatatctacaagaacaaga

SEQ ID NO: 653648 - DNA, 25 bp, Mus musculus
gagatggcaattcaccctgaccctg

SEQ ID NO: 653649 - DNA, 25 bp, Mus musculus
gagatggcaattgaccctgaccctg

SEQ ID NO: 653650 - DNA, 25 bp, Mus musculus
gagatggcaccaataccaccaagga

SEQ ID NO: 653651 - DNA, 25 bp, Mus musculus
gagatggcaccaatcccagaattac

SEQ ID NO: 653652 - DNA, 25 bp, Mus musculus
gagatggcaccattaccaccaagga

SEQ ID NO: 653653 - DNA, 25 bp, Mus musculus
gagatggcaccattcccagaattac

SEQ ID NO: 653654 - DNA, 25 bp, Mus musculus
gagatggcaggaaccagcctagaaa

SEQ ID NO: 653655 - DNA, 25 bp, Mus musculus
gagatggcaggatccagcctagaaa

SEQ ID NO: 653656 - DNA, 25 bp, Mus musculus
gagatggcatcgctgcatggtccac

SEQ ID NO: 653657 - DNA, 25 bp, Mus musculus
gagatggcatcggtgcatggtccac

SEQ ID NO: 653658 - DNA, 25 bp, Mus musculus
gagatggcatctcctactgagccac

SEQ ID NO: 653659 - DNA, 25 bp, Mus musculus
gagatggcatctgctactgagccac

SEQ ID NO: 653660 - DNA, 25 bp, Mus musculus
gagatggcattgagcagcccattct

SEQ ID NO: 653661 - DNA, 25 bp, Mus musculus
gagatggcattgtgcagcccattct

SEQ ID NO: 653662 - DNA, 25 bp, Mus musculus
gagatggcccagaatgccgttcgcc

SEQ ID NO: 653663 - DNA, 25 bp, Mus musculus
gagatggcccagtatgccgttcgcc

SEQ ID NO: 653664 - DNA, 25 bp, Mus musculus
gagatggcccatcgagggcttcccc

SEQ ID NO: 653665 - DNA, 25 bp, Mus musculus
gagatggcccatggagggcttcccc

SEQ ID NO: 653666 - DNA, 25 bp, Mus musculus
gagatggcctgaaggagcatcagat

SEQ ID NO: 653667 - DNA, 25 bp, Mus musculus
gagatggcctgatggagcatcagat

SEQ ID NO: 653668 - DNA, 25 bp, Mus musculus
gagatggcgcctacacgccgttcgg

SEQ ID NO: 653669 - DNA, 25 bp, Mus musculus
gagatggcgccttcacgccgttcgg

SEQ ID NO: 653670 - DNA, 25 bp, Mus musculus
gagatggcgctgattctgaacaacc

SEQ ID NO: 653671 - DNA, 25 bp, Mus musculus
gagatggcgctgtttctgaacaacc

SEQ ID NO: 653672 - DNA, 25 bp, Mus musculus
gagatggcgtgaaccgctgcattct

SEQ ID NO: 653673 - DNA, 25 bp, Mus musculus
gagatggcgtgatccgctgcattct

SEQ ID NO: 653674 - DNA, 25 bp, Mus musculus
gagatggctactctcaggcatcggc

SEQ ID NO: 653675 - DNA, 25 bp, Mus musculus
gagatggctactgtcaggcatcggc

SEQ ID NO: 653676 - DNA, 25 bp, Mus musculus
gagatggctcctccccagggtcaaa

SEQ ID NO: 653677 - DNA, 25 bp, Mus musculus
gagatggctcctgcccagggtcaaa

SEQ ID NO: 653678 - DNA, 25 bp, Mus musculus
gagatggctgacagtgtcaaaacct

SEQ ID NO: 653679 - DNA, 25 bp, Mus musculus
gagatggctgactgtgtcaaaacct

SEQ ID NO: 653680 - DNA, 25 bp, Mus musculus
gagatggctgagcaccctgattcaa

SEQ ID NO: 653681 - DNA, 25 bp, Mus musculus
gagatggctgaggaccctgattcaa

SEQ ID NO: 653682 - DNA, 25 bp, Mus musculus
gagatggcttccagctctaatagaa

SEQ ID NO: 653683 - DNA, 25 bp, Mus musculus
gagatggcttcctgctctaatagaa

SEQ ID NO: 653684 - DNA, 25 bp, Mus musculus
gagatgggaagacgcgcacccttac

SEQ ID NO: 653685 - DNA, 25 bp, Mus musculus
gagatgggaagaggcgcacccttac

SEQ ID NO: 653686 - DNA, 25 bp, Mus musculus
gagatgggtcccctgaactgcctct

SEQ ID NO: 653687 - DNA, 25 bp, Mus musculus
gagatgggtcccgtgaactgcctct

SEQ ID NO: 653688 - DNA, 25 bp, Mus musculus
gagatggtaacacctctagtgacga

SEQ ID NO: 653689 - DNA, 25 bp, Mus musculus
gagatggtaacagctctagtgacga

SEQ ID NO: 653690 - DNA, 25 bp, Mus musculus
gagatggtcggcatccagtacttca

SEQ ID NO: 653691 - DNA, 25 bp, Mus musculus
gagatggtcggcttccagtacttca

SEQ ID NO: 653692 - DNA, 25 bp, Mus musculus
gagatggtgcgcctcctgctgctct

SEQ ID NO: 653693 - DNA, 25 bp, Mus musculus
gagatggtgcgcgtcctgctgctct

SEQ ID NO: 653694 - DNA, 25 bp, Mus musculus
gagatggtggtgagaaaactgccca

SEQ ID NO: 653695 - DNA, 25 bp, Mus musculus
gagatggtggtgtgaaaactgccca

SEQ ID NO: 653696 - DNA, 25 bp, Mus musculus
gagatggtgtctaccagaaagggat

SEQ ID NO: 653697 - DNA, 25 bp, Mus musculus
gagatggtgtctacttcatgtatga

SEQ ID NO: 653698 - DNA, 25 bp, Mus musculus
gagatggtgtcttccagaaagggat

SEQ ID NO: 653699 - DNA, 25 bp, Mus musculus
gagatggtgtcttcttcatgtatga

SEQ ID NO: 653700 - DNA, 25 bp, Mus musculus
gagatggtgttcaagcggctgcacc

SEQ ID NO: 653701 - DNA, 25 bp, Mus musculus
gagatggtgttctagcggctgcacc

SEQ ID NO: 653702 - DNA, 25 bp, Mus musculus
gagatggttgcgaagagcagcccac

SEQ ID NO: 653703 - DNA, 25 bp, Mus musculus
gagatggttgcgtagagcagcccac

SEQ ID NO: 653704 - DNA, 25 bp, Mus musculus
gagatgtacattagcaccccaggga

SEQ ID NO: 653705 - DNA, 25 bp, Mus musculus
gagatgtacatttgcaccccaggga

SEQ ID NO: 653706 - DNA, 25 bp, Mus musculus
gagatgtattcactggaagaagctg

SEQ ID NO: 653707 - DNA, 25 bp, Mus musculus
gagatgtattcagtggaagaagctg

SEQ ID NO: 653708 - DNA, 25 bp, Mus musculus
gagatgtcatcacgccgagcttgtc

SEQ ID NO: 653709 - DNA, 25 bp, Mus musculus
gagatgtcatcaggccgagcttgtc

SEQ ID NO: 653710 - DNA, 25 bp, Mus musculus
gagatgtcctctcagtaccgggaat

SEQ ID NO: 653711 - DNA, 25 bp, Mus musculus
gagatgtcctctgagtaccgggaat

SEQ ID NO: 653712 - DNA, 25 bp, Mus musculus
gagatgtcgatgcaaattcaaccaa

SEQ ID NO: 653713 - DNA, 25 bp, Mus musculus
gagatgtcgatggaaattcaaccaa

SEQ ID NO: 653714 - DNA, 25 bp, Mus musculus
gagatgtctaacatacacctggtga

SEQ ID NO: 653715 - DNA, 25 bp, Mus musculus
gagatgtctaacttacacctggtga

SEQ ID NO: 653716 - DNA, 25 bp, Mus musculus
gagatgtctcctaaagattttaacc

SEQ ID NO: 653717 - DNA, 25 bp, Mus musculus
gagatgtctccttaagattttaacc

SEQ ID NO: 653718 - DNA, 25 bp, Mus musculus
gagatgtctgtcaccctgatgcggg

SEQ ID NO: 653719 - DNA, 25 bp, Mus musculus
gagatgtctgtctccctgatgcggg

SEQ ID NO: 653720 - DNA, 25 bp, Mus musculus
gagatgtgatggacaagaccaatgg

SEQ ID NO: 653721 - DNA, 25 bp, Mus musculus
gagatgtgatggtcaagaccaatgg

SEQ ID NO: 653722 - DNA, 25 bp, Mus musculus
gagatgtgcaatattttatcaatgg

SEQ ID NO: 653723 - DNA, 25 bp, Mus musculus
gagatgtgcaattttttatcaatgg

SEQ ID NO: 653724 - DNA, 25 bp, Mus musculus
gagatgtgcacaacctggactacta

SEQ ID NO: 653725 - DNA, 25 bp, Mus musculus
gagatgtgcacatcctggactacta

SEQ ID NO: 653726 - DNA, 25 bp, Mus musculus
gagatgtgcgcaagattcggctgac

SEQ ID NO: 653727 - DNA, 25 bp, Mus musculus
gagatgtgcgcatgattcggctgac

SEQ ID NO: 653728 - DNA, 25 bp, Mus musculus
gagatgtgctagagagaagccgcct

SEQ ID NO: 653729 - DNA, 25 bp, Mus musculus
gagatgtgctagtgagaagccgcct

SEQ ID NO: 653730 - DNA, 25 bp, Mus musculus
gagatgtggactcgtagccctatca

SEQ ID NO: 653731 - DNA, 25 bp, Mus musculus
gagatgtggactggtagccctatca

SEQ ID NO: 653732 - DNA, 25 bp, Mus musculus
gagatgtggattcaggttgccctca

SEQ ID NO: 653733 - DNA, 25 bp, Mus musculus
gagatgtggattgaggttgccctca

SEQ ID NO: 653734 - DNA, 25 bp, Mus musculus
gagatgtggccaaggttatgcctgc

SEQ ID NO: 653735 - DNA, 25 bp, Mus musculus
gagatgtggccaatttgcaggaaag

SEQ ID NO: 653736 - DNA, 25 bp, Mus musculus
gagatgtggccatggttatgcctgc

SEQ ID NO: 653737 - DNA, 25 bp, Mus musculus
gagatgtggccattttgcaggaaag

SEQ ID NO: 653738 - DNA, 25 bp, Mus musculus
gagatgtggcttctgctatccggaa

SEQ ID NO: 653739 - DNA, 25 bp, Mus musculus
gagatgtggcttgtgctatccggaa

SEQ ID NO: 653740 - DNA, 25 bp, Mus musculus
gagatgttcactcacctctaccagc

SEQ ID NO: 653741 - DNA, 25 bp, Mus musculus
gagatgttcactgacctctaccagc

SEQ ID NO: 653742 - DNA, 25 bp, Mus musculus
gagatgttctgaaggtgtttccaat

SEQ ID NO: 653743 - DNA, 25 bp, Mus musculus
gagatgttctgatggtgtttccaat

SEQ ID NO: 653744 - DNA, 25 bp, Mus musculus
gagatgttctgcatacagagttccc

SEQ ID NO: 653745 - DNA, 25 bp, Mus musculus
gagatgttctgcttacagagttccc

SEQ ID NO: 653746 - DNA, 25 bp, Mus musculus
gagatgttggtgctctagctcctag

SEQ ID NO: 653747 - DNA, 25 bp, Mus musculus
gagatgttggtggtctagctcctag

SEQ ID NO: 653748 - DNA, 25 bp, Mus musculus
gagatgtttcgaaatatgcagaacg

SEQ ID NO: 653749 - DNA, 25 bp, Mus musculus
gagatgtttcgatatatgcagaacg

SEQ ID NO: 653750 - DNA, 25 bp, Mus musculus
gagattaaaaagaggcaacaagaga

SEQ ID NO: 653751 - DNA, 25 bp, Mus musculus
gagattaaaaagtggcaacaagaga

SEQ ID NO: 653752 - DNA, 25 bp, Mus musculus
gagattaaagttcgcatctcctaca

SEQ ID NO: 653753 - DNA, 25 bp, Mus musculus
gagattaaagttggcatctcctaca

SEQ ID NO: 653754 - DNA, 25 bp, Mus musculus
gagattaacttgaacgacaggtgta

SEQ ID NO: 653755 - DNA, 25 bp, Mus musculus
gagattaacttgtacgacaggtgta

SEQ ID NO: 653756 - DNA, 25 bp, Mus musculus
gagattacactcagctccaagacca

SEQ ID NO: 653757 - DNA, 25 bp, Mus musculus
gagattacactctgctccaagacca

SEQ ID NO: 653758 - DNA, 25 bp, Mus musculus
gagattacctggagcaattgatgtc

SEQ ID NO: 653759 - DNA, 25 bp, Mus musculus
gagattacctggtgcaattgatgtc

SEQ ID NO: 653760 - DNA, 25 bp, Mus musculus
gagattactacgatacagttgtgga

SEQ ID NO: 653761 - DNA, 25 bp, Mus musculus
gagattactacgttacagttgtgga

SEQ ID NO: 653762 - DNA, 25 bp, Mus musculus
gagattactccgcaccgaagcatga

SEQ ID NO: 653763 - DNA, 25 bp, Mus musculus
gagattactccggaccgaagcatga

SEQ ID NO: 653764 - DNA, 25 bp, Mus musculus
gagattagcaaactgcagtcctgct

SEQ ID NO: 653765 - DNA, 25 bp, Mus musculus
gagattagcaaagtgcagtcctgct

SEQ ID NO: 653766 - DNA, 25 bp, Mus musculus
gagattagttgtcactgaaaccagc

SEQ ID NO: 653767 - DNA, 25 bp, Mus musculus
gagattagttgtgactgaaaccagc

SEQ ID NO: 653768 - DNA, 25 bp, Mus musculus
gagattataggcactcatcaccctg

SEQ ID NO: 653769 - DNA, 25 bp, Mus musculus
gagattataggctctcatcaccctg

SEQ ID NO: 653770 - DNA, 25 bp, Mus musculus
gagattatgtacaaactggaagtgc

SEQ ID NO: 653771 - DNA, 25 bp, Mus musculus
gagattatgtactaactggaagtgc

SEQ ID NO: 653772 - DNA, 25 bp, Mus musculus
gagattcagactcctgaggattcct

SEQ ID NO: 653773 - DNA, 25 bp, Mus musculus
gagattcagactgctgaggattcct

SEQ ID NO: 653774 - DNA, 25 bp, Mus musculus
gagattcagcaaccaaaagccaggg

SEQ ID NO: 653775 - DNA, 25 bp, Mus musculus
gagattcagcaagcaaaagccaggg

SEQ ID NO: 653776 - DNA, 25 bp, Mus musculus
gagattcatgagaatgcccagagag

SEQ ID NO: 653777 - DNA, 25 bp, Mus musculus
gagattcatgagtatgcccagagag

SEQ ID NO: 653778 - DNA, 25 bp, Mus musculus
gagattccaaaaccgtctgagaaga

SEQ ID NO: 653779 - DNA, 25 bp, Mus musculus
gagattccaaaagcgtctgagaaga

SEQ ID NO: 653780 - DNA, 25 bp, Mus musculus
gagattccaaagaagctccaggagc

SEQ ID NO: 653781 - DNA, 25 bp, Mus musculus
gagattccaaagtagctccaggagc

SEQ ID NO: 653782 - DNA, 25 bp, Mus musculus
gagattccagaaaccgagcttgcag

SEQ ID NO: 653783 - DNA, 25 bp, Mus musculus
gagattccagaatccgagcttgcag

SEQ ID NO: 653784 - DNA, 25 bp, Mus musculus
gagattcccggcagtactggtagga

SEQ ID NO: 653785 - DNA, 25 bp, Mus musculus
gagattcccggctgtactggtagga

SEQ ID NO: 653786 - DNA, 25 bp, Mus musculus
gagattccggaaacaaaaggaccct

SEQ ID NO: 653787 - DNA, 25 bp, Mus musculus
gagattccggaatcaaaaggaccct

SEQ ID NO: 653788 - DNA, 25 bp, Mus musculus
gagattcctgctcttactctgggca

SEQ ID NO: 653789 - DNA, 25 bp, Mus musculus
gagattcctgctgttactctgggca

SEQ ID NO: 653790 - DNA, 25 bp, Mus musculus
gagattcctggacccttttccaggt

SEQ ID NO: 653791 - DNA, 25 bp, Mus musculus
gagattcctggagccttttccaggt

SEQ ID NO: 653792 - DNA, 25 bp, Mus musculus
gagattcctgtgcagagacttattc

SEQ ID NO: 653793 - DNA, 25 bp, Mus musculus
gagattcctgtggagagacttattc

SEQ ID NO: 653794 - DNA, 25 bp, Mus musculus
gagattcgctttcgctagtcgacac

SEQ ID NO: 653795 - DNA, 25 bp, Mus musculus
gagattcgctttggctagtcgacac

SEQ ID NO: 653796 - DNA, 25 bp, Mus musculus
gagattcggaatcgcatggccgtca

SEQ ID NO: 653797 - DNA, 25 bp, Mus musculus
gagattcggaatggcatggccgtca

SEQ ID NO: 653798 - DNA, 25 bp, Mus musculus
gagattcggcagcataaattgcgga

SEQ ID NO: 653799 - DNA, 25 bp, Mus musculus
gagattcggcaggataaattgcgga

SEQ ID NO: 653800 - DNA, 25 bp, Mus musculus
gagattctaaacactcctgaaaagg

SEQ ID NO: 653801 - DNA, 25 bp, Mus musculus
gagattctaaactctcctgaaaagg

SEQ ID NO: 653802 - DNA, 25 bp, Mus musculus
gagattctagacctaccgcggagtg

SEQ ID NO: 653803 - DNA, 25 bp, Mus musculus
gagattctagacgtaccgcggagtg

SEQ ID NO: 653804 - DNA, 25 bp, Mus musculus
gagattctcccacgcttgtttcctg

SEQ ID NO: 653805 - DNA, 25 bp, Mus musculus
gagattctcccaggcttgtttcctg

SEQ ID NO: 653806 - DNA, 25 bp, Mus musculus
gagattctgaacaggtacatctatt

SEQ ID NO: 653807 - DNA, 25 bp, Mus musculus
gagattctgaactggtacatctatt

SEQ ID NO: 653808 - DNA, 25 bp, Mus musculus
gagattctgacactggactagaaag

SEQ ID NO: 653809 - DNA, 25 bp, Mus musculus
gagattctgacagtggactagaaag

SEQ ID NO: 653810 - DNA, 25 bp, Mus musculus
gagattctgcctaatggactaactt

SEQ ID NO: 653811 - DNA, 25 bp, Mus musculus
gagattctgccttatggactaactt

SEQ ID NO: 653812 - DNA, 25 bp, Mus musculus
gagattctgggtcgagccctagccc

SEQ ID NO: 653813 - DNA, 25 bp, Mus musculus
gagattctgggtggagccctagccc

SEQ ID NO: 653814 - DNA, 25 bp, Mus musculus
gagattcttcatatgatactacctc

SEQ ID NO: 653815 - DNA, 25 bp, Mus musculus
gagattcttcatttgatactacctc

SEQ ID NO: 653816 - DNA, 25 bp, Mus musculus
gagattgaagtaacagttcacggta

SEQ ID NO: 653817 - DNA, 25 bp, Mus musculus
gagattgaagtatcagttcacggta

SEQ ID NO: 653818 - DNA, 25 bp, Mus musculus
gagattgacctgctcaaccgcgacc

SEQ ID NO: 653819 - DNA, 25 bp, Mus musculus
gagattgacctggtcaaccgcgacc

SEQ ID NO: 653820 - DNA, 25 bp, Mus musculus
gagattgagagcaagcggagacaac

SEQ ID NO: 653821 - DNA, 25 bp, Mus musculus
gagattgagagctagcggagacaac

SEQ ID NO: 653822 - DNA, 25 bp, Mus musculus
gagattgagatacacatcgaaccca

SEQ ID NO: 653823 - DNA, 25 bp, Mus musculus
gagattgagatagacatcgaaccca

SEQ ID NO: 653824 - DNA, 25 bp, Mus musculus
gagattgagcggacgattgtccagc

SEQ ID NO: 653825 - DNA, 25 bp, Mus musculus
gagattgagcggtcgattgtccagc

SEQ ID NO: 653826 - DNA, 25 bp, Mus musculus
gagattgatcttcatcactaccggg

SEQ ID NO: 653827 - DNA, 25 bp, Mus musculus
gagattgatcttgatcactaccggg

SEQ ID NO: 653828 - DNA, 25 bp, Mus musculus
gagattgcagccagtcactctgccc

SEQ ID NO: 653829 - DNA, 25 bp, Mus musculus
gagattgcagcctgtcactctgccc

SEQ ID NO: 653830 - DNA, 25 bp, Mus musculus
gagattgccctccaaaacgaaaaag

SEQ ID NO: 653831 - DNA, 25 bp, Mus musculus
gagattgccctcgaaaacgaaaaag

SEQ ID NO: 653832 - DNA, 25 bp, Mus musculus
gagattgccgacctggccgacttct

SEQ ID NO: 653833 - DNA, 25 bp, Mus musculus
gagattgccgacgtggccgacttct

SEQ ID NO: 653834 - DNA, 25 bp, Mus musculus
gagattgcttctctacctacccctt

SEQ ID NO: 653835 - DNA, 25 bp, Mus musculus
gagattgcttctgtacctacccctt

SEQ ID NO: 653836 - DNA, 25 bp, Mus musculus
gagattggaaacctgcgcagcctca

SEQ ID NO: 653837 - DNA, 25 bp, Mus musculus
gagattggaaacgtgcgcagcctca

SEQ ID NO: 653838 - DNA, 25 bp, Mus musculus
gagattggagatactacattcacag

SEQ ID NO: 653839 - DNA, 25 bp, Mus musculus
gagattggagattctacattcacag

SEQ ID NO: 653840 - DNA, 25 bp, Mus musculus
gagattggcagtaacaccacgcaga

SEQ ID NO: 653841 - DNA, 25 bp, Mus musculus
gagattggcagttacaccacgcaga

SEQ ID NO: 653842 - DNA, 25 bp, Mus musculus
gagattggcgtgctcatagtcagaa

SEQ ID NO: 653843 - DNA, 25 bp, Mus musculus
gagattggcgtggtcatagtcagaa

SEQ ID NO: 653844 - DNA, 25 bp, Mus musculus
gagattggctggctcacctacccgc

SEQ ID NO: 653845 - DNA, 25 bp, Mus musculus
gagattggctgggtcacctacccgc

SEQ ID NO: 653846 - DNA, 25 bp, Mus musculus
gagattggtattatgacaacaaata

SEQ ID NO: 653847 - DNA, 25 bp, Mus musculus
gagattggtattttgacaacaaata

SEQ ID NO: 653848 - DNA, 25 bp, Mus musculus
gagattggttcactcaccataggac

SEQ ID NO: 653849 - DNA, 25 bp, Mus musculus
gagattggttcagtcaccataggac

SEQ ID NO: 653850 - DNA, 25 bp, Mus musculus
gagattgtggctcactctgacgtta

SEQ ID NO: 653851 - DNA, 25 bp, Mus musculus
gagattgtggctgactctgacgtta

SEQ ID NO: 653852 - DNA, 25 bp, Mus musculus
gagatttagactccaagcggcagtg

SEQ ID NO: 653853 - DNA, 25 bp, Mus musculus
gagatttagactgcaagcggcagtg

SEQ ID NO: 653854 - DNA, 25 bp, Mus musculus
gagatttataagaccaatggagacc

SEQ ID NO: 653855 - DNA, 25 bp, Mus musculus
gagatttataagtccaatggagacc

SEQ ID NO: 653856 - DNA, 25 bp, Mus musculus
gagatttcacagcattcaaaggtca

SEQ ID NO: 653857 - DNA, 25 bp, Mus musculus
gagatttcacaggattcaaaggtca

SEQ ID NO: 653858 - DNA, 25 bp, Mus musculus
gagatttcatctcctctccttcctg

SEQ ID NO: 653859 - DNA, 25 bp, Mus musculus
gagatttcatctgctctccttcctg

SEQ ID NO: 653860 - DNA, 25 bp, Mus musculus
gagatttccaatcctcatccgccag

SEQ ID NO: 653861 - DNA, 25 bp, Mus musculus
gagatttccaatgctcatccgccag

SEQ ID NO: 653862 - DNA, 25 bp, Mus musculus
gagatttccactccatgaggtcaac

SEQ ID NO: 653863 - DNA, 25 bp, Mus musculus
gagatttccactgcatgaggtcaac

SEQ ID NO: 653864 - DNA, 25 bp, Mus musculus
gagatttccatacagaagtgtcggg

SEQ ID NO: 653865 - DNA, 25 bp, Mus musculus
gagatttccatagagaagtgtcggg

SEQ ID NO: 653866 - DNA, 25 bp, Mus musculus
gagatttctaatagctctggtcgct

SEQ ID NO: 653867 - DNA, 25 bp, Mus musculus
gagatttctaattgctctggtcgct

SEQ ID NO: 653868 - DNA, 25 bp, Mus musculus
gagatttcttgaatcccgttgcctg

SEQ ID NO: 653869 - DNA, 25 bp, Mus musculus
gagatttcttgattcccgttgcctg

SEQ ID NO: 653870 - DNA, 25 bp, Mus musculus
gagatttcttggctctccttgttta

SEQ ID NO: 653871 - DNA, 25 bp, Mus musculus
gagatttcttggctggcctggcctt

SEQ ID NO: 653872 - DNA, 25 bp, Mus musculus
gagatttcttgggtctccttgttta

SEQ ID NO: 653873 - DNA, 25 bp, Mus musculus
gagatttcttgggtggcctggcctt

SEQ ID NO: 653874 - DNA, 25 bp, Mus musculus
gagatttgaagaagtagtaaaccag

SEQ ID NO: 653875 - DNA, 25 bp, Mus musculus
gagatttgaagatgtagtaaaccag

SEQ ID NO: 653876 - DNA, 25 bp, Mus musculus
gagatttgcagtagaggcccaggct

SEQ ID NO: 653877 - DNA, 25 bp, Mus musculus
gagatttgcagttgaggcccaggct

SEQ ID NO: 653878 - DNA, 25 bp, Mus musculus
gagatttgcctcctttgctttgtca

SEQ ID NO: 653879 - DNA, 25 bp, Mus musculus
gagatttgcctcgtttgctttgtca

SEQ ID NO: 653880 - DNA, 25 bp, Mus musculus
gagatttgtgcaataaattaaacag

SEQ ID NO: 653881 - DNA, 25 bp, Mus musculus
gagatttgtgcattaaattaaacag

SEQ ID NO: 653882 - DNA, 25 bp, Mus musculus
gagatttgtgccagaattatggaag

SEQ ID NO: 653883 - DNA, 25 bp, Mus musculus
gagatttgtgcctgaattatggaag

SEQ ID NO: 653884 - DNA, 25 bp, Mus musculus
gagattttatgacctgtacagaggg

SEQ ID NO: 653885 - DNA, 25 bp, Mus musculus
gagattttatgagctgtacagaggg

SEQ ID NO: 653886 - DNA, 25 bp, Mus musculus
gagattttctctaggacgaggccaa

SEQ ID NO: 653887 - DNA, 25 bp, Mus musculus
gagattttctcttggacgaggccaa

SEQ ID NO: 653888 - DNA, 25 bp, Mus musculus
gagattttgtcaagcaaggagccct

SEQ ID NO: 653889 - DNA, 25 bp, Mus musculus
gagattttgtcatgcaaggagccct

SEQ ID NO: 653890 - DNA, 25 bp, Mus musculus
gagcaaaacaccactggcaggagga

SEQ ID NO: 653891 - DNA, 25 bp, Mus musculus
gagcaaaacacctctggcaggagga

SEQ ID NO: 653892 - DNA, 25 bp, Mus musculus
gagcaaaacagacatggctcatggc

SEQ ID NO: 653893 - DNA, 25 bp, Mus musculus
gagcaaaacagagatggctcatggc

SEQ ID NO: 653894 - DNA, 25 bp, Mus musculus
gagcaaaaccgacaagacataaagt

SEQ ID NO: 653895 - DNA, 25 bp, Mus musculus
gagcaaaaccgagaagacataaagt

SEQ ID NO: 653896 - DNA, 25 bp, Mus musculus
gagcaaaacttcactacccggacgc

SEQ ID NO: 653897 - DNA, 25 bp, Mus musculus
gagcaaaacttctctacccggacgc

SEQ ID NO: 653898 - DNA, 25 bp, Mus musculus
gagcaaaatcaaagtccctgcagtg

SEQ ID NO: 653899 - DNA, 25 bp, Mus musculus
gagcaaaatcaatgtccctgcagtg

SEQ ID NO: 653900 - DNA, 25 bp, Mus musculus
gagcaaaatgagctcgtcagaagag

SEQ ID NO: 653901 - DNA, 25 bp, Mus musculus
gagcaaaatgaggtcgtcagaagag

SEQ ID NO: 653902 - DNA, 25 bp, Mus musculus
gagcaaacaaatcggaacatcctcg

SEQ ID NO: 653903 - DNA, 25 bp, Mus musculus
gagcaaacaaatgggaacatcctcg

SEQ ID NO: 653904 - DNA, 25 bp, Mus musculus
gagcaaacagatcaaagcattctgc

SEQ ID NO: 653905 - DNA, 25 bp, Mus musculus
gagcaaacagatgaaagcattctgc

SEQ ID NO: 653906 - DNA, 25 bp, Mus musculus
gagcaaacgaagcttcatgggaaac

SEQ ID NO: 653907 - DNA, 25 bp, Mus musculus
gagcaaacgaaggttcatgggaaac

SEQ ID NO: 653908 - DNA, 25 bp, Mus musculus
gagcaaactcacagtacagtccaca

SEQ ID NO: 653909 - DNA, 25 bp, Mus musculus
gagcaaactcactgtacagtccaca

SEQ ID NO: 653910 - DNA, 25 bp, Mus musculus
gagcaaactcgtagatgtggtgaaa

SEQ ID NO: 653911 - DNA, 25 bp, Mus musculus
gagcaaactcgttgatgtggtgaaa

SEQ ID NO: 653912 - DNA, 25 bp, Mus musculus
gagcaaactggaataactcctacca

SEQ ID NO: 653913 - DNA, 25 bp, Mus musculus
gagcaaactggattaactcctacca

SEQ ID NO: 653914 - DNA, 25 bp, Mus musculus
gagcaaacttgtcctgaaaacccca

SEQ ID NO: 653915 - DNA, 25 bp, Mus musculus
gagcaaacttgtgctgaaaacccca

SEQ ID NO: 653916 - DNA, 25 bp, Mus musculus
gagcaaacttttcgcaccgctgcag

SEQ ID NO: 653917 - DNA, 25 bp, Mus musculus
gagcaaacttttggcaccgctgcag

SEQ ID NO: 653918 - DNA, 25 bp, Mus musculus
gagcaaaggccaagagacacaacta

SEQ ID NO: 653919 - DNA, 25 bp, Mus musculus
gagcaaaggccatgagacacaacta

SEQ ID NO: 653920 - DNA, 25 bp, Mus musculus
gagcaaaggctcagaggcgcctctt

SEQ ID NO: 653921 - DNA, 25 bp, Mus musculus
gagcaaaggctctgaggcgcctctt

SEQ ID NO: 653922 - DNA, 25 bp, Mus musculus
gagcaaaggcttaagagaaatcacc

SEQ ID NO: 653923 - DNA, 25 bp, Mus musculus
gagcaaaggctttagagaaatcacc

SEQ ID NO: 653924 - DNA, 25 bp, Mus musculus
gagcaaagtagacaaaggatccgcc

SEQ ID NO: 653925 - DNA, 25 bp, Mus musculus
gagcaaagtagagaaaggatccgcc

SEQ ID NO: 653926 - DNA, 25 bp, Mus musculus
gagcaaagtcttcatttcataatga

SEQ ID NO: 653927 - DNA, 25 bp, Mus musculus
gagcaaagtcttgatttcataatga

SEQ ID NO: 653928 - DNA, 25 bp, Mus musculus
gagcaaataatgagccagcaccctg

SEQ ID NO: 653929 - DNA, 25 bp, Mus musculus
gagcaaataatgtgccagcaccctg

SEQ ID NO: 653930 - DNA, 25 bp, Mus musculus
gagcaaatatgcagctaaccctggg

SEQ ID NO: 653931 - DNA, 25 bp, Mus musculus
gagcaaatatgctgctaaccctggg

SEQ ID NO: 653932 - DNA, 25 bp, Mus musculus
gagcaaatcattcgcttctctcttc

SEQ ID NO: 653933 - DNA, 25 bp, Mus musculus
gagcaaatcattggcttctctcttc

SEQ ID NO: 653934 - DNA, 25 bp, Mus musculus
gagcaaatgaccaagagccatgtgg

SEQ ID NO: 653935 - DNA, 25 bp, Mus musculus
gagcaaatgacctagagccatgtgg

SEQ ID NO: 653936 - DNA, 25 bp, Mus musculus
gagcaaatgctgcaaagaaaatcta

SEQ ID NO: 653937 - DNA, 25 bp, Mus musculus
gagcaaatgctggaaagaaaatcta

SEQ ID NO: 653938 - DNA, 25 bp, Mus musculus
gagcaaatggaacagcaggcctctt

SEQ ID NO: 653939 - DNA, 25 bp, Mus musculus
gagcaaatggaagagcaggcctctt

SEQ ID NO: 653940 - DNA, 25 bp, Mus musculus
gagcaaatggctaggccaatcctcg

SEQ ID NO: 653941 - DNA, 25 bp, Mus musculus
gagcaaatggcttggccaatcctcg

SEQ ID NO: 653942 - DNA, 25 bp, Mus musculus
gagcaaatttcacttatgaggtaga

SEQ ID NO: 653943 - DNA, 25 bp, Mus musculus
gagcaaatttcagttatgaggtaga

SEQ ID NO: 653944 - DNA, 25 bp, Mus musculus
gagcaacaagttcctcattgtacga

SEQ ID NO: 653945 - DNA, 25 bp, Mus musculus
gagcaacaagttgctcattgtacga

SEQ ID NO: 653946 - DNA, 25 bp, Mus musculus
gagcaacacatcctgaaggtgtcca

SEQ ID NO: 653947 - DNA, 25 bp, Mus musculus
gagcaacacatcgtgaaggtgtcca

SEQ ID NO: 653948 - DNA, 25 bp, Mus musculus
gagcaacagacacagactgacaaag

SEQ ID NO: 653949 - DNA, 25 bp, Mus musculus
gagcaacagacagagactgacaaag

SEQ ID NO: 653950 - DNA, 25 bp, Mus musculus
gagcaacagactcattcatgccatg

SEQ ID NO: 653951 - DNA, 25 bp, Mus musculus
gagcaacagactgattcatgccatg

SEQ ID NO: 653952 - DNA, 25 bp, Mus musculus
gagcaacagcacctgatccagaggt

SEQ ID NO: 653953 - DNA, 25 bp, Mus musculus
gagcaacagcacgtgatccagaggt

SEQ ID NO: 653954 - DNA, 25 bp, Mus musculus
gagcaacaggctaaaacagcacacg

SEQ ID NO: 653955 - DNA, 25 bp, Mus musculus
gagcaacaggcttaaacagcacacg

SEQ ID NO: 653956 - DNA, 25 bp, Mus musculus
gagcaacagggcaccggattccctg

SEQ ID NO: 653957 - DNA, 25 bp, Mus musculus
gagcaacagggctccggattccctg

SEQ ID NO: 653958 - DNA, 25 bp, Mus musculus
gagcaacagttcatcaagcccttag

SEQ ID NO: 653959 - DNA, 25 bp, Mus musculus
gagcaacagttcttcaagcccttag

SEQ ID NO: 653960 - DNA, 25 bp, Mus musculus
gagcaacataaacaactaacataag

SEQ ID NO: 653961 - DNA, 25 bp, Mus musculus
gagcaacataaagaactaacataag

SEQ ID NO: 653962 - DNA, 25 bp, Mus musculus
gagcaacatcagacttcttggaatg

SEQ ID NO: 653963 - DNA, 25 bp, Mus musculus
gagcaacatcagtcttcttggaatg

SEQ ID NO: 653964 - DNA, 25 bp, Mus musculus
gagcaacatcccctttatcacggta

SEQ ID NO: 653965 - DNA, 25 bp, Mus musculus
gagcaacatcccgtttatcacggta

SEQ ID NO: 653966 - DNA, 25 bp, Mus musculus
gagcaaccagagaaagtaacctgcc

SEQ ID NO: 653967 - DNA, 25 bp, Mus musculus
gagcaaccagagtaagtaacctgcc

SEQ ID NO: 653968 - DNA, 25 bp, Mus musculus
gagcaaccagctaactcatttcact

SEQ ID NO: 653969 - DNA, 25 bp, Mus musculus
gagcaaccagcttactcatttcact

SEQ ID NO: 653970 - DNA, 25 bp, Mus musculus
gagcaaccagtgcttagctgcttag

SEQ ID NO: 653971 - DNA, 25 bp, Mus musculus
gagcaaccagtggttagctgcttag

SEQ ID NO: 653972 - DNA, 25 bp, Mus musculus
gagcaaccatccagatgacaccttc

SEQ ID NO: 653973 - DNA, 25 bp, Mus musculus
gagcaaccatcctgatgacaccttc

SEQ ID NO: 653974 - DNA, 25 bp, Mus musculus
gagcaacccatgatctccatctgtg

SEQ ID NO: 653975 - DNA, 25 bp, Mus musculus
gagcaacccatgttctccatctgtg

SEQ ID NO: 653976 - DNA, 25 bp, Mus musculus
gagcaacctagaaagtattcctggg

SEQ ID NO: 653977 - DNA, 25 bp, Mus musculus
gagcaacctagatagtattcctggg

SEQ ID NO: 653978 - DNA, 25 bp, Mus musculus
gagcaacctgaacacgattgaggag

SEQ ID NO: 653979 - DNA, 25 bp, Mus musculus
gagcaacctgaacagggtcacactg

SEQ ID NO: 653980 - DNA, 25 bp, Mus musculus
gagcaacctgaagacgattgaggag

SEQ ID NO: 653981 - DNA, 25 bp, Mus musculus
gagcaacctgaagagggtcacactg

SEQ ID NO: 653982 - DNA, 25 bp, Mus musculus
gagcaacctgagaacatcagtcatt

SEQ ID NO: 653983 - DNA, 25 bp, Mus musculus
gagcaacctgagtacatcagtcatt

SEQ ID NO: 653984 - DNA, 25 bp, Mus musculus
gagcaacgcctaatggttctctaaa

SEQ ID NO: 653985 - DNA, 25 bp, Mus musculus
gagcaacgcctattggttctctaaa

SEQ ID NO: 653986 - DNA, 25 bp, Mus musculus
gagcaacgtcttagtcaagttcacg

SEQ ID NO: 653987 - DNA, 25 bp, Mus musculus
gagcaacgtctttgtcaagttcacg

SEQ ID NO: 653988 - DNA, 25 bp, Mus musculus
gagcaactaaaaagtgtatggcctg

SEQ ID NO: 653989 - DNA, 25 bp, Mus musculus
gagcaactaaaatgtgtatggcctg

SEQ ID NO: 653990 - DNA, 25 bp, Mus musculus
gagcaactaaagcagcacgtggagc

SEQ ID NO: 653991 - DNA, 25 bp, Mus musculus
gagcaactaaaggagcacgtggagc

SEQ ID NO: 653992 - DNA, 25 bp, Mus musculus
gagcaactcacacaggaaaaccaga

SEQ ID NO: 653993 - DNA, 25 bp, Mus musculus
gagcaactcacagaggaaaaccaga

SEQ ID NO: 653994 - DNA, 25 bp, Mus musculus
gagcaactccctcgaatgatgaggc

SEQ ID NO: 653995 - DNA, 25 bp, Mus musculus
gagcaactccctggaatgatgaggc

SEQ ID NO: 653996 - DNA, 25 bp, Mus musculus
gagcaactccttaatgggaatcaca

SEQ ID NO: 653997 - DNA, 25 bp, Mus musculus
gagcaactcctttatgggaatcaca

SEQ ID NO: 653998 - DNA, 25 bp, Mus musculus
gagcaactctctcaaacacctgcaa

SEQ ID NO: 653999 - DNA, 25 bp, Mus musculus
gagcaactctctgaaacacctgcaa

SEQ ID NO: 654000 - DNA, 25 bp, Mus musculus
gagcaactgcaaagtaacattccaa

SEQ ID NO: 654001 - DNA, 25 bp, Mus musculus
gagcaactgcaatgtaacattccaa

SEQ ID NO: 654002 - DNA, 25 bp, Mus musculus
gagcaactgttcatgcagatggcag

SEQ ID NO: 654003 - DNA, 25 bp, Mus musculus
gagcaactgttcttgcagatggcag

SEQ ID NO: 654004 - DNA, 25 bp, Mus musculus
gagcaacttagacaccctacagaag

SEQ ID NO: 654005 - DNA, 25 bp, Mus musculus
gagcaacttagagaccctacagaag

SEQ ID NO: 654006 - DNA, 25 bp, Mus musculus
gagcaagaaaggcaatctccttgtg

SEQ ID NO: 654007 - DNA, 25 bp, Mus musculus
gagcaagaaagggaatctccttgtg

SEQ ID NO: 654008 - DNA, 25 bp, Mus musculus
gagcaagaaataagctactgcaccc

SEQ ID NO: 654009 - DNA, 25 bp, Mus musculus
gagcaagaaatatgctactgcaccc

SEQ ID NO: 654010 - DNA, 25 bp, Mus musculus
gagcaagaacaactggagcacaatc

SEQ ID NO: 654011 - DNA, 25 bp, Mus musculus
gagcaagaacaagtggagcacaatc

SEQ ID NO: 654012 - DNA, 25 bp, Mus musculus
gagcaagaactcacatccgcctcag

SEQ ID NO: 654013 - DNA, 25 bp, Mus musculus
gagcaagaactctcatccgcctcag

SEQ ID NO: 654014 - DNA, 25 bp, Mus musculus
gagcaagaccgtctttacgaggaac

SEQ ID NO: 654015 - DNA, 25 bp, Mus musculus
gagcaagaccgtgtttacgaggaac

SEQ ID NO: 654016 - DNA, 25 bp, Mus musculus
gagcaagaccttcccttctgcaaag

SEQ ID NO: 654017 - DNA, 25 bp, Mus musculus
gagcaagaccttgccttctgcaaag

SEQ ID NO: 654018 - DNA, 25 bp, Mus musculus
gagcaagagatgactattgtaaaag

SEQ ID NO: 654019 - DNA, 25 bp, Mus musculus
gagcaagagatgtctattgtaaaag

SEQ ID NO: 654020 - DNA, 25 bp, Mus musculus
gagcaagagcttctggtgaccatcc

SEQ ID NO: 654021 - DNA, 25 bp, Mus musculus
gagcaagagcttgtggtgaccatcc

SEQ ID NO: 654022 - DNA, 25 bp, Mus musculus
gagcaagaggctcgatattacccat

SEQ ID NO: 654023 - DNA, 25 bp, Mus musculus
gagcaagaggctggatattacccat

SEQ ID NO: 654024 - DNA, 25 bp, Mus musculus
gagcaagagtggagagctgcccatc

SEQ ID NO: 654025 - DNA, 25 bp, Mus musculus
gagcaagagtggtgagctgcccatc

SEQ ID NO: 654026 - DNA, 25 bp, Mus musculus
gagcaagctagcacaacaagcagct

SEQ ID NO: 654027 - DNA, 25 bp, Mus musculus
gagcaagctagctcaacaagcagct

SEQ ID NO: 654028 - DNA, 25 bp, Mus musculus
gagcaagctccactgtgattctgtt

SEQ ID NO: 654029 - DNA, 25 bp, Mus musculus
gagcaagctccagtgtgattctgtt

SEQ ID NO: 654030 - DNA, 25 bp, Mus musculus
gagcaagctcgtatttaagccggac

SEQ ID NO: 654031 - DNA, 25 bp, Mus musculus
gagcaagctcgtttttaagccggac

SEQ ID NO: 654032 - DNA, 25 bp, Mus musculus
gagcaaggcgatagagaaaaacctc

SEQ ID NO: 654033 - DNA, 25 bp, Mus musculus
gagcaaggcgattgagaaaaacctc

SEQ ID NO: 654034 - DNA, 25 bp, Mus musculus
gagcaaggcttcatcacagaccctg

SEQ ID NO: 654035 - DNA, 25 bp, Mus musculus
gagcaaggcttcttcacagaccctg

SEQ ID NO: 654036 - DNA, 25 bp, Mus musculus
gagcaaggctttacccagtccttca

SEQ ID NO: 654037 - DNA, 25 bp, Mus musculus
gagcaaggcttttcccagtccttca

SEQ ID NO: 654038 - DNA, 25 bp, Mus musculus
gagcaaggtcagcactgatgaccat

SEQ ID NO: 654039 - DNA, 25 bp, Mus musculus
gagcaaggtcaggactgatgaccat

SEQ ID NO: 654040 - DNA, 25 bp, Mus musculus
gagcaaggtcgccagcgcactgcca

SEQ ID NO: 654041 - DNA, 25 bp, Mus musculus
gagcaaggtcgcgagcgcactgcca

SEQ ID NO: 654042 - DNA, 25 bp, Mus musculus
gagcaagtaggcaccattaaggaga

SEQ ID NO: 654043 - DNA, 25 bp, Mus musculus
gagcaagtaggctccattaaggaga

SEQ ID NO: 654044 - DNA, 25 bp, Mus musculus
gagcaagtcttgaaatgtgtagagt

SEQ ID NO: 654045 - DNA, 25 bp, Mus musculus
gagcaagtcttgtaatgtgtagagt

SEQ ID NO: 654046 - DNA, 25 bp, Mus musculus
gagcaagtgaatagcctgcctgagg

SEQ ID NO: 654047 - DNA, 25 bp, Mus musculus
gagcaagtgaattgcctgcctgagg

SEQ ID NO: 654048 - DNA, 25 bp, Mus musculus
gagcaagtggctcatgatcttcagg

SEQ ID NO: 654049 - DNA, 25 bp, Mus musculus
gagcaagtggctgatgatcttcagg

SEQ ID NO: 654050 - DNA, 25 bp, Mus musculus
gagcaagttcacacagatctcacca

SEQ ID NO: 654051 - DNA, 25 bp, Mus musculus
gagcaagttcactcagatctcacca

SEQ ID NO: 654052 - DNA, 25 bp, Mus musculus
gagcaagttcgacaacgaggagttc

SEQ ID NO: 654053 - DNA, 25 bp, Mus musculus
gagcaagttcgagaacgaggagttc

SEQ ID NO: 654054 - DNA, 25 bp, Mus musculus
gagcaatacggccatttgactgtca

SEQ ID NO: 654055 - DNA, 25 bp, Mus musculus
gagcaatacggcgatttgactgtca

SEQ ID NO: 654056 - DNA, 25 bp, Mus musculus
gagcaatccagactgaccatcaaca

SEQ ID NO: 654057 - DNA, 25 bp, Mus musculus
gagcaatccagagtgaccatcaaca

SEQ ID NO: 654058 - DNA, 25 bp, Mus musculus
gagcaatcgacaagcaaaataagcc

SEQ ID NO: 654059 - DNA, 25 bp, Mus musculus
gagcaatcgacatgcaaaataagcc

SEQ ID NO: 654060 - DNA, 25 bp, Mus musculus
gagcaatcgatgcatttaatgctgc

SEQ ID NO: 654061 - DNA, 25 bp, Mus musculus
gagcaatcgatggatttaatgctgc

SEQ ID NO: 654062 - DNA, 25 bp, Mus musculus
gagcaatctgatacctaaggagcag

SEQ ID NO: 654063 - DNA, 25 bp, Mus musculus
gagcaatctgattcctaaggagcag

SEQ ID NO: 654064 - DNA, 25 bp, Mus musculus
gagcaatgacttcactgacggtgtc

SEQ ID NO: 654065 - DNA, 25 bp, Mus musculus
gagcaatgacttgactgacggtgtc

SEQ ID NO: 654066 - DNA, 25 bp, Mus musculus
gagcaatgcagaaatcaaggataga

SEQ ID NO: 654067 - DNA, 25 bp, Mus musculus
gagcaatgcagatatcaaggataga

SEQ ID NO: 654068 - DNA, 25 bp, Mus musculus
gagcaatgctacagctggccatcct

SEQ ID NO: 654069 - DNA, 25 bp, Mus musculus
gagcaatgctactgctggccatcct

SEQ ID NO: 654070 - DNA, 25 bp, Mus musculus
gagcaatggagtccagatctatcag

SEQ ID NO: 654071 - DNA, 25 bp, Mus musculus
gagcaatggagtgcagatctatcag

SEQ ID NO: 654072 - DNA, 25 bp, Mus musculus
gagcaatggctaccagtttcgagtg

SEQ ID NO: 654073 - DNA, 25 bp, Mus musculus
gagcaatggctagcagtttcgagtg

SEQ ID NO: 654074 - DNA, 25 bp, Mus musculus
gagcaatggttaataccactgtgag

SEQ ID NO: 654075 - DNA, 25 bp, Mus musculus
gagcaatggttattaccactgtgag

SEQ ID NO: 654076 - DNA, 25 bp, Mus musculus
gagcaattgagaactatacagacat

SEQ ID NO: 654077 - DNA, 25 bp, Mus musculus
gagcaattgagatctatacagacat

SEQ ID NO: 654078 - DNA, 25 bp, Mus musculus
gagcaatttattctcaaggcgggaa

SEQ ID NO: 654079 - DNA, 25 bp, Mus musculus
gagcaatttattgtcaaggcgggaa

SEQ ID NO: 654080 - DNA, 25 bp, Mus musculus
gagcaatttgcaagagtccaccaga

SEQ ID NO: 654081 - DNA, 25 bp, Mus musculus
gagcaatttgcatgagtccaccaga

SEQ ID NO: 654082 - DNA, 25 bp, Mus musculus
gagcacaaaatgcactcaggttgga

SEQ ID NO: 654083 - DNA, 25 bp, Mus musculus
gagcacaaaatggactcaggttgga

SEQ ID NO: 654084 - DNA, 25 bp, Mus musculus
gagcacaaaggtctacttagacctg

SEQ ID NO: 654085 - DNA, 25 bp, Mus musculus
gagcacaaaggtgtacttagacctg

SEQ ID NO: 654086 - DNA, 25 bp, Mus musculus
gagcacaaattgctgtaagaccgta

SEQ ID NO: 654087 - DNA, 25 bp, Mus musculus
gagcacaaattggtgtaagaccgta

SEQ ID NO: 654088 - DNA, 25 bp, Mus musculus
gagcacaacattctggcaccgtata

SEQ ID NO: 654089 - DNA, 25 bp, Mus musculus
gagcacaacattgtggcaccgtata

SEQ ID NO: 654090 - DNA, 25 bp, Mus musculus
gagcacaacttcaaagctgggagtt

SEQ ID NO: 654091 - DNA, 25 bp, Mus musculus
gagcacaacttctaagctgggagtt

SEQ ID NO: 654092 - DNA, 25 bp, Mus musculus
gagcacaaggaaaaaacgctaactg

SEQ ID NO: 654093 - DNA, 25 bp, Mus musculus
gagcacaaggaataaacgctaactg

SEQ ID NO: 654094 - DNA, 25 bp, Mus musculus
gagcacaaggagattgacggccgtc

SEQ ID NO: 654095 - DNA, 25 bp, Mus musculus
gagcacaaggagtttgacggccgtc

SEQ ID NO: 654096 - DNA, 25 bp, Mus musculus
gagcacaatgccaagcagcctctgc

SEQ ID NO: 654097 - DNA, 25 bp, Mus musculus
gagcacaatgcctagcagcctctgc

SEQ ID NO: 654098 - DNA, 25 bp, Mus musculus
gagcacacaatacaggagtggaaag

SEQ ID NO: 654099 - DNA, 25 bp, Mus musculus
gagcacacaatagaggagtggaaag

SEQ ID NO: 654100 - DNA, 25 bp, Mus musculus
gagcacacagctcgactgagccgtc

SEQ ID NO: 654101 - DNA, 25 bp, Mus musculus
gagcacacagctggactgagccgtc

SEQ ID NO: 654102 - DNA, 25 bp, Mus musculus
gagcacaccatccaagaatggaaag

SEQ ID NO: 654103 - DNA, 25 bp, Mus musculus
gagcacaccatcgaagaatggaaag

SEQ ID NO: 654104 - DNA, 25 bp, Mus musculus
gagcacaccgagaagccggaacctg

SEQ ID NO: 654105 - DNA, 25 bp, Mus musculus
gagcacaccgagtagccggaacctg

SEQ ID NO: 654106 - DNA, 25 bp, Mus musculus
gagcacacgtgccatacatcttgga

SEQ ID NO: 654107 - DNA, 25 bp, Mus musculus
gagcacacgtgcgatacatcttgga

SEQ ID NO: 654108 - DNA, 25 bp, Mus musculus
gagcacactgaaccgcatgctcagg

SEQ ID NO: 654109 - DNA, 25 bp, Mus musculus
gagcacactgaagcgcatgctcagg

SEQ ID NO: 654110 - DNA, 25 bp, Mus musculus
gagcacactgctaacctcatcaagg

SEQ ID NO: 654111 - DNA, 25 bp, Mus musculus
gagcacactgcttacctcatcaagg

SEQ ID NO: 654112 - DNA, 25 bp, Mus musculus
gagcacactgttcgctttggagagc

SEQ ID NO: 654113 - DNA, 25 bp, Mus musculus
gagcacactgttggctttggagagc

SEQ ID NO: 654114 - DNA, 25 bp, Mus musculus
gagcacacttcgcagagacttttcc

SEQ ID NO: 654115 - DNA, 25 bp, Mus musculus
gagcacacttcggagagacttttcc

SEQ ID NO: 654116 - DNA, 25 bp, Mus musculus
gagcacactttactcgggacccatc

SEQ ID NO: 654117 - DNA, 25 bp, Mus musculus
gagcacactttagtcgggacccatc

SEQ ID NO: 654118 - DNA, 25 bp, Mus musculus
gagcacagatatcggaagttctttc

SEQ ID NO: 654119 - DNA, 25 bp, Mus musculus
gagcacagatatgggaagttctttc

SEQ ID NO: 654120 - DNA, 25 bp, Mus musculus
gagcacagatcacctgaagctcttc

SEQ ID NO: 654121 - DNA, 25 bp, Mus musculus
gagcacagatcagctgaagctcttc

SEQ ID NO: 654122 - DNA, 25 bp, Mus musculus
gagcacagcagcatcttcggcttca

SEQ ID NO: 654123 - DNA, 25 bp, Mus musculus
gagcacagcagcttcttcggcttca

SEQ ID NO: 654124 - DNA, 25 bp, Mus musculus
gagcacagccccaggtaagcagctc

SEQ ID NO: 654125 - DNA, 25 bp, Mus musculus
gagcacagcccctggtaagcagctc

SEQ ID NO: 654126 - DNA, 25 bp, Mus musculus
gagcacagctatcacggcctataag

SEQ ID NO: 654127 - DNA, 25 bp, Mus musculus
gagcacagctatgacggcctataag

SEQ ID NO: 654128 - DNA, 25 bp, Mus musculus
gagcacagttctccgtctgtccctg

SEQ ID NO: 654129 - DNA, 25 bp, Mus musculus
gagcacagttctgcgtctgtccctg

SEQ ID NO: 654130 - DNA, 25 bp, Mus musculus
gagcacatacggcatcttaacatag

SEQ ID NO: 654131 - DNA, 25 bp, Mus musculus
gagcacatacgggatcttaacatag

SEQ ID NO: 654132 - DNA, 25 bp, Mus musculus
gagcacatcataatctagcaagcga

SEQ ID NO: 654133 - DNA, 25 bp, Mus musculus
gagcacatcatattctagcaagcga

SEQ ID NO: 654134 - DNA, 25 bp, Mus musculus
gagcacatgcacacccgacgtgtga

SEQ ID NO: 654135 - DNA, 25 bp, Mus musculus
gagcacatgcactcccgacgtgtga

SEQ ID NO: 654136 - DNA, 25 bp, Mus musculus
gagcacatgcctaagtgctaggccc

SEQ ID NO: 654137 - DNA, 25 bp, Mus musculus
gagcacatgccttagtgctaggccc

SEQ ID NO: 654138 - DNA, 25 bp, Mus musculus
gagcacattcgaaatgcaacagata

SEQ ID NO: 654139 - DNA, 25 bp, Mus musculus
gagcacattcgatatgcaacagata

SEQ ID NO: 654140 - DNA, 25 bp, Mus musculus
gagcaccaaccaagaaagatccaag

SEQ ID NO: 654141 - DNA, 25 bp, Mus musculus
gagcaccaaccatgaaagatccaag

SEQ ID NO: 654142 - DNA, 25 bp, Mus musculus
gagcaccaagaaaaggacaacaccc

SEQ ID NO: 654143 - DNA, 25 bp, Mus musculus
gagcaccaagaataggacaacaccc

SEQ ID NO: 654144 - DNA, 25 bp, Mus musculus
gagcaccacgtgactgttcttggag

SEQ ID NO: 654145 - DNA, 25 bp, Mus musculus
gagcaccacgtgtctgttcttggag

SEQ ID NO: 654146 - DNA, 25 bp, Mus musculus
gagcacccaagccagtgtacaactg

SEQ ID NO: 654147 - DNA, 25 bp, Mus musculus
gagcacccaagcgagtgtacaactg

SEQ ID NO: 654148 - DNA, 25 bp, Mus musculus
gagcacccgccgcaaaatccagtta

SEQ ID NO: 654149 - DNA, 25 bp, Mus musculus
gagcacccgccggaaaatccagtta

SEQ ID NO: 654150 - DNA, 25 bp, Mus musculus
gagcaccctcgccagatacagctgt

SEQ ID NO: 654151 - DNA, 25 bp, Mus musculus
gagcaccctcgcgagatacagctgt

SEQ ID NO: 654152 - DNA, 25 bp, Mus musculus
gagcaccctgtgagtgaacaagaac

SEQ ID NO: 654153 - DNA, 25 bp, Mus musculus
gagcaccctgtgtgtgaacaagaac

SEQ ID NO: 654154 - DNA, 25 bp, Mus musculus
gagcaccgagctactgtcgccatct

SEQ ID NO: 654155 - DNA, 25 bp, Mus musculus
gagcaccgagcttctgtcgccatct

SEQ ID NO: 654156 - DNA, 25 bp, Mus musculus
gagcaccgaggactggattagccat

SEQ ID NO: 654157 - DNA, 25 bp, Mus musculus
gagcaccgaggagtggattagccat

SEQ ID NO: 654158 - DNA, 25 bp, Mus musculus
gagcaccgaggtaaaaactttgtag

SEQ ID NO: 654159 - DNA, 25 bp, Mus musculus
gagcaccgaggttaaaactttgtag

SEQ ID NO: 654160 - DNA, 25 bp, Mus musculus
gagcaccgatgaaaatgggctcctg

SEQ ID NO: 654161 - DNA, 25 bp, Mus musculus
gagcaccgatgataatgggctcctg

SEQ ID NO: 654162 - DNA, 25 bp, Mus musculus
gagcaccgtctccattcgataggaa

SEQ ID NO: 654163 - DNA, 25 bp, Mus musculus
gagcaccgtctcgattcgataggaa

SEQ ID NO: 654164 - DNA, 25 bp, Mus musculus
gagcacctcatcatgccaccatgag

SEQ ID NO: 654165 - DNA, 25 bp, Mus musculus
gagcacctcatcttgccaccatgag

SEQ ID NO: 654166 - DNA, 25 bp, Mus musculus
gagcacctcggacaacatgttcctg

SEQ ID NO: 654167 - DNA, 25 bp, Mus musculus
gagcacctcggagaacatgttcctg

SEQ ID NO: 654168 - DNA, 25 bp, Mus musculus
gagcacctgatgcaagactatgaac

SEQ ID NO: 654169 - DNA, 25 bp, Mus musculus
gagcacctgatggaagactatgaac

SEQ ID NO: 654170 - DNA, 25 bp, Mus musculus
gagcacctggcgactgaccctttct

SEQ ID NO: 654171 - DNA, 25 bp, Mus musculus
gagcacctggcgtctgaccctttct

SEQ ID NO: 654172 - DNA, 25 bp, Mus musculus
gagcacctggtgcaaaatcaaatgg

SEQ ID NO: 654173 - DNA, 25 bp, Mus musculus
gagcacctggtggaaaatcaaatgg

SEQ ID NO: 654174 - DNA, 25 bp, Mus musculus
gagcacctgtgacagacctcttgga

SEQ ID NO: 654175 - DNA, 25 bp, Mus musculus
gagcacctgtgagagacctcttgga

SEQ ID NO: 654176 - DNA, 25 bp, Mus musculus
gagcaccttccactgaaataaatgg

SEQ ID NO: 654177 - DNA, 25 bp, Mus musculus
gagcaccttccagtgaaataaatgg

SEQ ID NO: 654178 - DNA, 25 bp, Mus musculus
gagcaccttgaaagtccttgtgacg

SEQ ID NO: 654179 - DNA, 25 bp, Mus musculus
gagcaccttgaatgtccttgtgacg

SEQ ID NO: 654180 - DNA, 25 bp, Mus musculus
gagcacgaaatcaggcctatgacac

SEQ ID NO: 654181 - DNA, 25 bp, Mus musculus
gagcacgaaatctggcctatgacac

SEQ ID NO: 654182 - DNA, 25 bp, Mus musculus
gagcacgactgcagtgtcctccgtg

SEQ ID NO: 654183 - DNA, 25 bp, Mus musculus
gagcacgactgctgtgtcctccgtg

SEQ ID NO: 654184 - DNA, 25 bp, Mus musculus
gagcacgagaggaccttcctagtag

SEQ ID NO: 654185 - DNA, 25 bp, Mus musculus
gagcacgagaggtccttcctagtag

SEQ ID NO: 654186 - DNA, 25 bp, Mus musculus
gagcacgagtagatctggttgacca

SEQ ID NO: 654187 - DNA, 25 bp, Mus musculus
gagcacgagtagttctggttgacca

SEQ ID NO: 654188 - DNA, 25 bp, Mus musculus
gagcacgccattaaatagcagtagg

SEQ ID NO: 654189 - DNA, 25 bp, Mus musculus
gagcacgccatttaatagcagtagg

SEQ ID NO: 654190 - DNA, 25 bp, Mus musculus
gagcacgcgaagctactcatcaagc

SEQ ID NO: 654191 - DNA, 25 bp, Mus musculus
gagcacgcgaaggtactcatcaagc

SEQ ID NO: 654192 - DNA, 25 bp, Mus musculus
gagcacggaatcacccgggcttggt

SEQ ID NO: 654193 - DNA, 25 bp, Mus musculus
gagcacggaatctcccgggcttggt

SEQ ID NO: 654194 - DNA, 25 bp, Mus musculus
gagcacggcccacaaaacattgtga

SEQ ID NO: 654195 - DNA, 25 bp, Mus musculus
gagcacggcccagaaaacattgtga

SEQ ID NO: 654196 - DNA, 25 bp, Mus musculus
gagcacgggtctcgctaagagaaaa

SEQ ID NO: 654197 - DNA, 25 bp, Mus musculus
gagcacgggtctggctaagagaaaa

SEQ ID NO: 654198 - DNA, 25 bp, Mus musculus
gagcacgtacgtatagcccatttat

SEQ ID NO: 654199 - DNA, 25 bp, Mus musculus
gagcacgtacgtttagcccatttat

SEQ ID NO: 654200 - DNA, 25 bp, Mus musculus
gagcactacaaacgcaacgagacag

SEQ ID NO: 654201 - DNA, 25 bp, Mus musculus
gagcactacaaaggcaacgagacag

SEQ ID NO: 654202 - DNA, 25 bp, Mus musculus
gagcactagccccatgcagaatatg

SEQ ID NO: 654203 - DNA, 25 bp, Mus musculus
gagcactagcccgatgcagaatatg

SEQ ID NO: 654204 - DNA, 25 bp, Mus musculus
gagcactagcggctcttctagaaga

SEQ ID NO: 654205 - DNA, 25 bp, Mus musculus
gagcactagcgggtcttctagaaga

SEQ ID NO: 654206 - DNA, 25 bp, Mus musculus
gagcactagttccacaagtcgcatt

SEQ ID NO: 654207 - DNA, 25 bp, Mus musculus
gagcactagttcgacaagtcgcatt

SEQ ID NO: 654208 - DNA, 25 bp, Mus musculus
gagcactattgaccctcggagactg

SEQ ID NO: 654209 - DNA, 25 bp, Mus musculus
gagcactattgagcctcggagactg

SEQ ID NO: 654210 - DNA, 25 bp, Mus musculus
gagcactcagagagcctatgagcat

SEQ ID NO: 654211 - DNA, 25 bp, Mus musculus
gagcactcagagtgcctatgagcat

SEQ ID NO: 654212 - DNA, 25 bp, Mus musculus
gagcactcatatcgcttggaaggtg

SEQ ID NO: 654213 - DNA, 25 bp, Mus musculus
gagcactcatatggcttggaaggtg

SEQ ID NO: 654214 - DNA, 25 bp, Mus musculus
gagcactccagtcaagcagtcaggt

SEQ ID NO: 654215 - DNA, 25 bp, Mus musculus
gagcactccagtgaagcagtcaggt

SEQ ID NO: 654216 - DNA, 25 bp, Mus musculus
gagcactcctccagcaacagctaat

SEQ ID NO: 654217 - DNA, 25 bp, Mus musculus
gagcactcctcctgcaacagctaat

SEQ ID NO: 654218 - DNA, 25 bp, Mus musculus
gagcactcgaacctggacaggccgc

SEQ ID NO: 654219 - DNA, 25 bp, Mus musculus
gagcactcgaacgtggacaggccgc

SEQ ID NO: 654220 - DNA, 25 bp, Mus musculus
gagcactctaggagacccagttgga

SEQ ID NO: 654221 - DNA, 25 bp, Mus musculus
gagcactctaggtgacccagttgga

SEQ ID NO: 654222 - DNA, 25 bp, Mus musculus
gagcactctctactgactttcctct

SEQ ID NO: 654223 - DNA, 25 bp, Mus musculus
gagcactctctagtgactttcctct

SEQ ID NO: 654224 - DNA, 25 bp, Mus musculus
gagcactctgctcaagaagctgttc

SEQ ID NO: 654225 - DNA, 25 bp, Mus musculus
gagcactctgctgaagaagctgttc

SEQ ID NO: 654226 - DNA, 25 bp, Mus musculus
gagcactgcctactagccaatcacg

SEQ ID NO: 654227 - DNA, 25 bp, Mus musculus
gagcactgcctagtagccaatcacg

SEQ ID NO: 654228 - DNA, 25 bp, Mus musculus
gagcactgcgcgagccgagacccag

SEQ ID NO: 654229 - DNA, 25 bp, Mus musculus
gagcactgcgcgtgccgagacccag

SEQ ID NO: 654230 - DNA, 25 bp, Mus musculus
gagcactgctgtaagaggcccagaa

SEQ ID NO: 654231 - DNA, 25 bp, Mus musculus
gagcactgctgttagaggcccagaa

SEQ ID NO: 654232 - DNA, 25 bp, Mus musculus
gagcactggacaagatcttctcagc

SEQ ID NO: 654233 - DNA, 25 bp, Mus musculus
gagcactggacatgatcttctcagc

SEQ ID NO: 654234 - DNA, 25 bp, Mus musculus
gagcactgtagcaccaaagtaccta

SEQ ID NO: 654235 - DNA, 25 bp, Mus musculus
gagcactgtagctccaaagtaccta

SEQ ID NO: 654236 - DNA, 25 bp, Mus musculus
gagcacttaggcacctgtcccggga

SEQ ID NO: 654237 - DNA, 25 bp, Mus musculus
gagcacttaggctcctgtcccggga

SEQ ID NO: 654238 - DNA, 25 bp, Mus musculus
gagcacttattgatcctccggagga

SEQ ID NO: 654239 - DNA, 25 bp, Mus musculus
gagcacttattgttcctccggagga

SEQ ID NO: 654240 - DNA, 25 bp, Mus musculus
gagcacttcattccctgccaaattg

SEQ ID NO: 654241 - DNA, 25 bp, Mus musculus
gagcacttcattgcctgccaaattg

SEQ ID NO: 654242 - DNA, 25 bp, Mus musculus
gagcacttccggatctgagatcgta

SEQ ID NO: 654243 - DNA, 25 bp, Mus musculus
gagcacttccggttctgagatcgta

SEQ ID NO: 654244 - DNA, 25 bp, Mus musculus
gagcacttctgacagaacagaacga

SEQ ID NO: 654245 - DNA, 25 bp, Mus musculus
gagcacttctgagagaacagaacga

SEQ ID NO: 654246 - DNA, 25 bp, Mus musculus
gagcacttgaacattcaggaccctg

SEQ ID NO: 654247 - DNA, 25 bp, Mus musculus
gagcacttgaactttcaggaccctg

SEQ ID NO: 654248 - DNA, 25 bp, Mus musculus
gagcacttgccgaaaaacagccaga

SEQ ID NO: 654249 - DNA, 25 bp, Mus musculus
gagcacttgccgtaaaacagccaga

SEQ ID NO: 654250 - DNA, 25 bp, Mus musculus
gagcactttcacaaatacatgggaa

SEQ ID NO: 654251 - DNA, 25 bp, Mus musculus
gagcactttcactaatacatgggaa

SEQ ID NO: 654252 - DNA, 25 bp, Mus musculus
gagcactttgccatgcttcagcggg

SEQ ID NO: 654253 - DNA, 25 bp, Mus musculus
gagcactttgccttgcttcagcggg

SEQ ID NO: 654254 - DNA, 25 bp, Mus musculus
gagcactttgttccggccatcgtgg

SEQ ID NO: 654255 - DNA, 25 bp, Mus musculus
gagcactttgttgcggccatcgtgg

SEQ ID NO: 654256 - DNA, 25 bp, Mus musculus
gagcacttttgtacttccaggagtt

SEQ ID NO: 654257 - DNA, 25 bp, Mus musculus
gagcacttttgtcaaccgcatgaag

SEQ ID NO: 654258 - DNA, 25 bp, Mus musculus
gagcacttttgtcctacagtataga

SEQ ID NO: 654259 - DNA, 25 bp, Mus musculus
gagcacttttgtgaaccgcatgaag

SEQ ID NO: 654260 - DNA, 25 bp, Mus musculus
gagcacttttgtgctacagtataga

SEQ ID NO: 654261 - DNA, 25 bp, Mus musculus
gagcacttttgttcttccaggagtt

SEQ ID NO: 654262 - DNA, 25 bp, Mus musculus
gagcagaaagcaagctcttgctgct

SEQ ID NO: 654263 - DNA, 25 bp, Mus musculus
gagcagaaagcatgctcttgctgct

SEQ ID NO: 654264 - DNA, 25 bp, Mus musculus
gagcagaaagtccttacggacccgg

SEQ ID NO: 654265 - DNA, 25 bp, Mus musculus
gagcagaaagtcgttacggacccgg

SEQ ID NO: 654266 - DNA, 25 bp, Mus musculus
gagcagaaccggctttcagaatgcg

SEQ ID NO: 654267 - DNA, 25 bp, Mus musculus
gagcagaaccgggtttcagaatgcg

SEQ ID NO: 654268 - DNA, 25 bp, Mus musculus
gagcagaacgacaactccctggtct

SEQ ID NO: 654269 - DNA, 25 bp, Mus musculus
gagcagaacgactactccctggtct

SEQ ID NO: 654270 - DNA, 25 bp, Mus musculus
gagcagaacttactacagcatgtga

SEQ ID NO: 654271 - DNA, 25 bp, Mus musculus
gagcagaacttagtacagcatgtga

SEQ ID NO: 654272 - DNA, 25 bp, Mus musculus
gagcagaagcaaacgtgacaacaat

SEQ ID NO: 654273 - DNA, 25 bp, Mus musculus
gagcagaagcaatcgtgacaacaat

SEQ ID NO: 654274 - DNA, 25 bp, Mus musculus
gagcagaagctccaacactgggtct

SEQ ID NO: 654275 - DNA, 25 bp, Mus musculus
gagcagaagctcgaacactgggtct

SEQ ID NO: 654276 - DNA, 25 bp, Mus musculus
gagcagaaggcaaaataagtgaatt

SEQ ID NO: 654277 - DNA, 25 bp, Mus musculus
gagcagaaggcataataagtgaatt

SEQ ID NO: 654278 - DNA, 25 bp, Mus musculus
gagcagaaggcgcaggaaatccttc

SEQ ID NO: 654279 - DNA, 25 bp, Mus musculus
gagcagaaggcggaggaaatccttc

SEQ ID NO: 654280 - DNA, 25 bp, Mus musculus
gagcagaagtgactgaaccacgtgt

SEQ ID NO: 654281 - DNA, 25 bp, Mus musculus
gagcagaagtgagtgaaccacgtgt

SEQ ID NO: 654282 - DNA, 25 bp, Mus musculus
gagcagaagttaagatgcgtacctg

SEQ ID NO: 654283 - DNA, 25 bp, Mus musculus
gagcagaagttatgatgcgtacctg

SEQ ID NO: 654284 - DNA, 25 bp, Mus musculus
gagcagacacatatgtcaacggcaa

SEQ ID NO: 654285 - DNA, 25 bp, Mus musculus
gagcagacacatttgtcaacggcaa

SEQ ID NO: 654286 - DNA, 25 bp, Mus musculus
gagcagaccatgagcagagccttct

SEQ ID NO: 654287 - DNA, 25 bp, Mus musculus
gagcagaccatgtgcagagccttct

SEQ ID NO: 654288 - DNA, 25 bp, Mus musculus
gagcagacccttatctcagagctat

SEQ ID NO: 654289 - DNA, 25 bp, Mus musculus
gagcagacccttttctcagagctat

SEQ ID NO: 654290 - DNA, 25 bp, Mus musculus
gagcagaccttacccatcttagaag

SEQ ID NO: 654291 - DNA, 25 bp, Mus musculus
gagcagaccttagccatcttagaag

SEQ ID NO: 654292 - DNA, 25 bp, Mus musculus
gagcagacgacaagttctacagcaa

SEQ ID NO: 654293 - DNA, 25 bp, Mus musculus
gagcagacgacatgttctacagcaa

SEQ ID NO: 654294 - DNA, 25 bp, Mus musculus
gagcagactttcaatttcactcaca

SEQ ID NO: 654295 - DNA, 25 bp, Mus musculus
gagcagactttctatttcactcaca

SEQ ID NO: 654296 - DNA, 25 bp, Mus musculus
gagcagagaaaacagctctttagaa

SEQ ID NO: 654297 - DNA, 25 bp, Mus musculus
gagcagagaaaagagctctttagaa

SEQ ID NO: 654298 - DNA, 25 bp, Mus musculus
gagcagagcaagcagcaatccaatg

SEQ ID NO: 654299 - DNA, 25 bp, Mus musculus
gagcagagcaaggagcaatccaatg

SEQ ID NO: 654300 - DNA, 25 bp, Mus musculus
gagcagagcagtagattggcaaaat

SEQ ID NO: 654301 - DNA, 25 bp, Mus musculus
gagcagagcagttgattggcaaaat

SEQ ID NO: 654302 - DNA, 25 bp, Mus musculus
gagcagagcctaagggctacagtgc

SEQ ID NO: 654303 - DNA, 25 bp, Mus musculus
gagcagagcctatgggctacagtgc

SEQ ID NO: 654304 - DNA, 25 bp, Mus musculus
gagcagagcggtagctgcttccttg

SEQ ID NO: 654305 - DNA, 25 bp, Mus musculus
gagcagagcggttgctgcttccttg

SEQ ID NO: 654306 - DNA, 25 bp, Mus musculus
gagcagagctctccggataaagaga

SEQ ID NO: 654307 - DNA, 25 bp, Mus musculus
gagcagagctctgcggataaagaga

SEQ ID NO: 654308 - DNA, 25 bp, Mus musculus
gagcagaggacacgtttctgttttg

SEQ ID NO: 654309 - DNA, 25 bp, Mus musculus
gagcagaggacaggtttctgttttg

SEQ ID NO: 654310 - DNA, 25 bp, Mus musculus
gagcagaggaccagccatagccctt

SEQ ID NO: 654311 - DNA, 25 bp, Mus musculus
gagcagaggacctgccatagccctt

SEQ ID NO: 654312 - DNA, 25 bp, Mus musculus
gagcagaggagtaatgttatacctc

SEQ ID NO: 654313 - DNA, 25 bp, Mus musculus
gagcagaggagttatgttatacctc

SEQ ID NO: 654314 - DNA, 25 bp, Mus musculus
gagcagaggctcctccatatagaac

SEQ ID NO: 654315 - DNA, 25 bp, Mus musculus
gagcagaggctcgtccatatagaac

SEQ ID NO: 654316 - DNA, 25 bp, Mus musculus
gagcagagggccatgttcctcttga

SEQ ID NO: 654317 - DNA, 25 bp, Mus musculus
gagcagagggccttgttcctcttga

SEQ ID NO: 654318 - DNA, 25 bp, Mus musculus
gagcagaggtcacagatgctgaaac

SEQ ID NO: 654319 - DNA, 25 bp, Mus musculus
gagcagaggtcagagatgctgaaac

SEQ ID NO: 654320 - DNA, 25 bp, Mus musculus
gagcagagtgacaggttctatgaga

SEQ ID NO: 654321 - DNA, 25 bp, Mus musculus
gagcagagtgactggttctatgaga

SEQ ID NO: 654322 - DNA, 25 bp, Mus musculus
gagcagagtgctacgctgtgaaccc

SEQ ID NO: 654323 - DNA, 25 bp, Mus musculus
gagcagagtgcttcgctgtgaaccc

SEQ ID NO: 654324 - DNA, 25 bp, Mus musculus
gagcagatcaataggcgaacgcgga

SEQ ID NO: 654325 - DNA, 25 bp, Mus musculus
gagcagatcaattggcgaacgcgga

SEQ ID NO: 654326 - DNA, 25 bp, Mus musculus
gagcagatctcgcagtcctattacc

SEQ ID NO: 654327 - DNA, 25 bp, Mus musculus
gagcagatctcggagtcctattacc

SEQ ID NO: 654328 - DNA, 25 bp, Mus musculus
gagcagatctctaaaacaattcgaa

SEQ ID NO: 654329 - DNA, 25 bp, Mus musculus
gagcagatctcttaaacaattcgaa

SEQ ID NO: 654330 - DNA, 25 bp, Mus musculus
gagcagatctggacagcgctgttct

SEQ ID NO: 654331 - DNA, 25 bp, Mus musculus
gagcagatctggtcagcgctgttct

SEQ ID NO: 654332 - DNA, 25 bp, Mus musculus
gagcagatgaagaactgcctccggg

SEQ ID NO: 654333 - DNA, 25 bp, Mus musculus
gagcagatgaagcaagataggatca

SEQ ID NO: 654334 - DNA, 25 bp, Mus musculus
gagcagatgaaggaagataggatca

SEQ ID NO: 654335 - DNA, 25 bp, Mus musculus
gagcagatgaagtactgcctccggg

SEQ ID NO: 654336 - DNA, 25 bp, Mus musculus
gagcagatgcatacccatagtatca

SEQ ID NO: 654337 - DNA, 25 bp, Mus musculus
gagcagatgcattcccatagtatca

SEQ ID NO: 654338 - DNA, 25 bp, Mus musculus
gagcagatgctcattctggaatgtg

SEQ ID NO: 654339 - DNA, 25 bp, Mus musculus
gagcagatgctctttctggaatgtg

SEQ ID NO: 654340 - DNA, 25 bp, Mus musculus
gagcagatgctgagaacggccctgt

SEQ ID NO: 654341 - DNA, 25 bp, Mus musculus
gagcagatgctgtgaacggccctgt

SEQ ID NO: 654342 - DNA, 25 bp, Mus musculus
gagcagatgtggacgttcaacccta

SEQ ID NO: 654343 - DNA, 25 bp, Mus musculus
gagcagatgtggtcgttcaacccta

SEQ ID NO: 654344 - DNA, 25 bp, Mus musculus
gagcagattcagaggcctttctgaa

SEQ ID NO: 654345 - DNA, 25 bp, Mus musculus
gagcagattcagtggcctttctgaa

SEQ ID NO: 654346 - DNA, 25 bp, Mus musculus
gagcagattctgagtggcagacaca

SEQ ID NO: 654347 - DNA, 25 bp, Mus musculus
gagcagattctgtgtggcagacaca

SEQ ID NO: 654348 - DNA, 25 bp, Mus musculus
gagcagattgggagcagtgtaactc

SEQ ID NO: 654349 - DNA, 25 bp, Mus musculus
gagcagattgggtgcagtgtaactc

SEQ ID NO: 654350 - DNA, 25 bp, Mus musculus
gagcagatttacaagcggaacccga

SEQ ID NO: 654351 - DNA, 25 bp, Mus musculus
gagcagatttactagcggaacccga

SEQ ID NO: 654352 - DNA, 25 bp, Mus musculus
gagcagcaagacaagatgacccaac

SEQ ID NO: 654353 - DNA, 25 bp, Mus musculus
gagcagcaagactagatgacccaac

SEQ ID NO: 654354 - DNA, 25 bp, Mus musculus
gagcagcacggtcgcacgatcatta

SEQ ID NO: 654355 - DNA, 25 bp, Mus musculus
gagcagcacggtggcacgatcatta

SEQ ID NO: 654356 - DNA, 25 bp, Mus musculus
gagcagcagcataggcattcctatt

SEQ ID NO: 654357 - DNA, 25 bp, Mus musculus
gagcagcagcatcttgaaatgagta

SEQ ID NO: 654358 - DNA, 25 bp, Mus musculus
gagcagcagcatgttgaaatgagta

SEQ ID NO: 654359 - DNA, 25 bp, Mus musculus
gagcagcagcattggcattcctatt

SEQ ID NO: 654360 - DNA, 25 bp, Mus musculus
gagcagcagccacacgtcagacgac

SEQ ID NO: 654361 - DNA, 25 bp, Mus musculus
gagcagcagccagacgtcagacgac

SEQ ID NO: 654362 - DNA, 25 bp, Mus musculus
gagcagcaggatcaagtgcagccac

SEQ ID NO: 654363 - DNA, 25 bp, Mus musculus
gagcagcaggatgaagtgcagccac

SEQ ID NO: 654364 - DNA, 25 bp, Mus musculus
gagcagcagtacctggacaagctga

SEQ ID NO: 654365 - DNA, 25 bp, Mus musculus
gagcagcagtacgtggacaagctga

SEQ ID NO: 654366 - DNA, 25 bp, Mus musculus
gagcagcagtgcagtgccaccacca

SEQ ID NO: 654367 - DNA, 25 bp, Mus musculus
gagcagcagtgcatcccgaggacct

SEQ ID NO: 654368 - DNA, 25 bp, Mus musculus
gagcagcagtgctgtgccaccacca

SEQ ID NO: 654369 - DNA, 25 bp, Mus musculus
gagcagcagtgcttcccgaggacct

SEQ ID NO: 654370 - DNA, 25 bp, Mus musculus
gagcagcatgccatgaagcactaca

SEQ ID NO: 654371 - DNA, 25 bp, Mus musculus
gagcagcatgccttgaagcactaca

SEQ ID NO: 654372 - DNA, 25 bp, Mus musculus
gagcagcatgctcgaacttttgcgg

SEQ ID NO: 654373 - DNA, 25 bp, Mus musculus
gagcagcatgctggaacttttgcgg

SEQ ID NO: 654374 - DNA, 25 bp, Mus musculus
gagcagccaagaagcagcattgata

SEQ ID NO: 654375 - DNA, 25 bp, Mus musculus
gagcagccaagatgcagcattgata

SEQ ID NO: 654376 - DNA, 25 bp, Mus musculus
gagcagccaccgcaatggaggttca

SEQ ID NO: 654377 - DNA, 25 bp, Mus musculus
gagcagccaccggaatggaggttca

SEQ ID NO: 654378 - DNA, 25 bp, Mus musculus
gagcagccatgacatctgaggccac

SEQ ID NO: 654379 - DNA, 25 bp, Mus musculus
gagcagccatgagatctgaggccac

SEQ ID NO: 654380 - DNA, 25 bp, Mus musculus
gagcagccattcatatgatgatagc

SEQ ID NO: 654381 - DNA, 25 bp, Mus musculus
gagcagccattcttatgatgatagc

SEQ ID NO: 654382 - DNA, 25 bp, Mus musculus
gagcagccggaactagaagtacagt

SEQ ID NO: 654383 - DNA, 25 bp, Mus musculus
gagcagccggaagtagaagtacagt

SEQ ID NO: 654384 - DNA, 25 bp, Mus musculus
gagcagccggacaactctaatcaga

SEQ ID NO: 654385 - DNA, 25 bp, Mus musculus
gagcagccggactactctaatcaga

SEQ ID NO: 654386 - DNA, 25 bp, Mus musculus
gagcagcctcagcagatttcccaga

SEQ ID NO: 654387 - DNA, 25 bp, Mus musculus
gagcagcctcaggagatttcccaga

SEQ ID NO: 654388 - DNA, 25 bp, Mus musculus
gagcagcctgcaataatacctagga

SEQ ID NO: 654389 - DNA, 25 bp, Mus musculus
gagcagcctgcattaatacctagga

SEQ ID NO: 654390 - DNA, 25 bp, Mus musculus
gagcagcgcctgacctatgagtgtg

SEQ ID NO: 654391 - DNA, 25 bp, Mus musculus
gagcagcgcctgtcctatgagtgtg

SEQ ID NO: 654392 - DNA, 25 bp, Mus musculus
gagcagcgctgtaccttgcaggctg

SEQ ID NO: 654393 - DNA, 25 bp, Mus musculus
gagcagcgctgttccttgcaggctg

SEQ ID NO: 654394 - DNA, 25 bp, Mus musculus
gagcagcggaaaccacagaatgtct

SEQ ID NO: 654395 - DNA, 25 bp, Mus musculus
gagcagcggaaagcacagaatgtct

SEQ ID NO: 654396 - DNA, 25 bp, Mus musculus
gagcagcggaggaaagctctctacg

SEQ ID NO: 654397 - DNA, 25 bp, Mus musculus
gagcagcggaggtaagctctctacg

SEQ ID NO: 654398 - DNA, 25 bp, Mus musculus
gagcagcggctcatctctatccaga

SEQ ID NO: 654399 - DNA, 25 bp, Mus musculus
gagcagcggctcttctctatccaga

SEQ ID NO: 654400 - DNA, 25 bp, Mus musculus
gagcagcgtccaacttccttacctg

SEQ ID NO: 654401 - DNA, 25 bp, Mus musculus
gagcagcgtccatcttccttacctg

SEQ ID NO: 654402 - DNA, 25 bp, Mus musculus
gagcagcgtcctaggtacgtgagca

SEQ ID NO: 654403 - DNA, 25 bp, Mus musculus
gagcagcgtccttggtacgtgagca

SEQ ID NO: 654404 - DNA, 25 bp, Mus musculus
gagcagctaggaactccgtgtccag

SEQ ID NO: 654405 - DNA, 25 bp, Mus musculus
gagcagctaggatctccgtgtccag

SEQ ID NO: 654406 - DNA, 25 bp, Mus musculus
gagcagctcacacatctggtgctga

SEQ ID NO: 654407 - DNA, 25 bp, Mus musculus
gagcagctcacagatctggtgctga

SEQ ID NO: 654408 - DNA, 25 bp, Mus musculus
gagcagctcactatctcttggaggt

SEQ ID NO: 654409 - DNA, 25 bp, Mus musculus
gagcagctcactttctcttggaggt

SEQ ID NO: 654410 - DNA, 25 bp, Mus musculus
gagcagctccggagtcatgtcctag

SEQ ID NO: 654411 - DNA, 25 bp, Mus musculus
gagcagctccggtgtcatgtcctag

SEQ ID NO: 654412 - DNA, 25 bp, Mus musculus
gagcagctcggcattaaactagtcc

SEQ ID NO: 654413 - DNA, 25 bp, Mus musculus
gagcagctcggctttaaactagtcc

SEQ ID NO: 654414 - DNA, 25 bp, Mus musculus
gagcagctcttaccaggagttttgg

SEQ ID NO: 654415 - DNA, 25 bp, Mus musculus
gagcagctcttagcaggagttttgg

SEQ ID NO: 654416 - DNA, 25 bp, Mus musculus
gagcagctgcccatgaggcaggcat

SEQ ID NO: 654417 - DNA, 25 bp, Mus musculus
gagcagctgcccttgaggcaggcat

SEQ ID NO: 654418 - DNA, 25 bp, Mus musculus
gagcagctgctgcatgatgctccac

SEQ ID NO: 654419 - DNA, 25 bp, Mus musculus
gagcagctgctggatgatgctccac

SEQ ID NO: 654420 - DNA, 25 bp, Mus musculus
gagcagctggagcttctgcaccctg

SEQ ID NO: 654421 - DNA, 25 bp, Mus musculus
gagcagctggaggttctgcaccctg

SEQ ID NO: 654422 - DNA, 25 bp, Mus musculus
gagcagctggcacgtgactttcgca

SEQ ID NO: 654423 - DNA, 25 bp, Mus musculus
gagcagctggcaggtgactttcgca

SEQ ID NO: 654424 - DNA, 25 bp, Mus musculus
gagcagctgggtaactcctgtgtga

SEQ ID NO: 654425 - DNA, 25 bp, Mus musculus
gagcagctgggttactcctgtgtga

SEQ ID NO: 654426 - DNA, 25 bp, Mus musculus
gagcagctgtagacaatgcatttta

SEQ ID NO: 654427 - DNA, 25 bp, Mus musculus
gagcagctgtagtcaatgcatttta

SEQ ID NO: 654428 - DNA, 25 bp, Mus musculus
gagcagctgtccctatatcttcaac

SEQ ID NO: 654429 - DNA, 25 bp, Mus musculus
gagcagctgtccgtatatcttcaac

SEQ ID NO: 654430 - DNA, 25 bp, Mus musculus
gagcagcttcagctaaaggttgccc

SEQ ID NO: 654431 - DNA, 25 bp, Mus musculus
gagcagcttcaggtaaaggttgccc

SEQ ID NO: 654432 - DNA, 25 bp, Mus musculus
gagcagcttctaccctgggtcacga

SEQ ID NO: 654433 - DNA, 25 bp, Mus musculus
gagcagcttctagcctgggtcacga

SEQ ID NO: 654434 - DNA, 25 bp, Mus musculus
gagcagcttgaaagtcagctgcaga

SEQ ID NO: 654435 - DNA, 25 bp, Mus musculus
gagcagcttgaatgtcagctgcaga

SEQ ID NO: 654436 - DNA, 25 bp, Mus musculus
gagcagcttggactggatcccagaa

SEQ ID NO: 654437 - DNA, 25 bp, Mus musculus
gagcagcttggagtggatcccagaa

SEQ ID NO: 654438 - DNA, 25 bp, Mus musculus
gagcagcttggcacctgccaggaca

SEQ ID NO: 654439 - DNA, 25 bp, Mus musculus
gagcagcttggctcctgccaggaca

SEQ ID NO: 654440 - DNA, 25 bp, Mus musculus
gagcagctttgactacacacatgac

SEQ ID NO: 654441 - DNA, 25 bp, Mus musculus
gagcagctttgagtacacacatgac

SEQ ID NO: 654442 - DNA, 25 bp, Mus musculus
gagcaggaaccgacctggatacggc

SEQ ID NO: 654443 - DNA, 25 bp, Mus musculus
gagcaggaaccgtcctggatacggc

SEQ ID NO: 654444 - DNA, 25 bp, Mus musculus
gagcaggaactcatgctgacagcca

SEQ ID NO: 654445 - DNA, 25 bp, Mus musculus
gagcaggaactcttgctgacagcca

SEQ ID NO: 654446 - DNA, 25 bp, Mus musculus
gagcaggaagccctttcaaggacca

SEQ ID NO: 654447 - DNA, 25 bp, Mus musculus
gagcaggaagccgtttcaaggacca

SEQ ID NO: 654448 - DNA, 25 bp, Mus musculus
gagcaggaagctcaccgaatcaact

SEQ ID NO: 654449 - DNA, 25 bp, Mus musculus
gagcaggaagctgaccgaatcaact

SEQ ID NO: 654450 - DNA, 25 bp, Mus musculus
gagcaggacaccctctatgaggaac

SEQ ID NO: 654451 - DNA, 25 bp, Mus musculus
gagcaggacaccgtctatgaggaac

SEQ ID NO: 654452 - DNA, 25 bp, Mus musculus
gagcaggacatacacctgcgtatct

SEQ ID NO: 654453 - DNA, 25 bp, Mus musculus
gagcaggacatagacctgcgtatct

SEQ ID NO: 654454 - DNA, 25 bp, Mus musculus
gagcaggaccacatcctgatcagcc

SEQ ID NO: 654455 - DNA, 25 bp, Mus musculus
gagcaggaccacttcctgatcagcc

SEQ ID NO: 654456 - DNA, 25 bp, Mus musculus
gagcaggagaatacataaaaaggag

SEQ ID NO: 654457 - DNA, 25 bp, Mus musculus
gagcaggagaattcataaaaaggag

SEQ ID NO: 654458 - DNA, 25 bp, Mus musculus
gagcaggagcatacattcagaagac

SEQ ID NO: 654459 - DNA, 25 bp, Mus musculus
gagcaggagcattcattcagaagac

SEQ ID NO: 654460 - DNA, 25 bp, Mus musculus
gagcaggagcctacattctcagcag

SEQ ID NO: 654461 - DNA, 25 bp, Mus musculus
gagcaggagccttcattctcagcag

SEQ ID NO: 654462 - DNA, 25 bp, Mus musculus
gagcaggatagtccccgaaaggaca

SEQ ID NO: 654463 - DNA, 25 bp, Mus musculus
gagcaggatagtgcccgaaaggaca

SEQ ID NO: 654464 - DNA, 25 bp, Mus musculus
gagcaggcactactcagccaggaac

SEQ ID NO: 654465 - DNA, 25 bp, Mus musculus
gagcaggcactagtcagccaggaac

SEQ ID NO: 654466 - DNA, 25 bp, Mus musculus
gagcaggcagtaagaagcatcagtt

SEQ ID NO: 654467 - DNA, 25 bp, Mus musculus
gagcaggcagtatgaagcatcagtt

SEQ ID NO: 654468 - DNA, 25 bp, Mus musculus
gagcaggcagttacttcagttcttc

SEQ ID NO: 654469 - DNA, 25 bp, Mus musculus
gagcaggcagtttcttcagttcttc

SEQ ID NO: 654470 - DNA, 25 bp, Mus musculus
gagcaggcatatagctacaccgtag

SEQ ID NO: 654471 - DNA, 25 bp, Mus musculus
gagcaggcatattgctacaccgtag

SEQ ID NO: 654472 - DNA, 25 bp, Mus musculus
gagcaggcgctgagcatcctcacca

SEQ ID NO: 654473 - DNA, 25 bp, Mus musculus
gagcaggcgctgtgcatcctcacca

SEQ ID NO: 654474 - DNA, 25 bp, Mus musculus
gagcaggctccgctgatttaatgat

SEQ ID NO: 654475 - DNA, 25 bp, Mus musculus
gagcaggctccggtgatttaatgat

SEQ ID NO: 654476 - DNA, 25 bp, Mus musculus
gagcaggctcggagttctgtgacat

SEQ ID NO: 654477 - DNA, 25 bp, Mus musculus
gagcaggctcggtgttctgtgacat

SEQ ID NO: 654478 - DNA, 25 bp, Mus musculus
gagcaggctgctctcttttccttgg

SEQ ID NO: 654479 - DNA, 25 bp, Mus musculus
gagcaggctgctgtcttttccttgg

SEQ ID NO: 654480 - DNA, 25 bp, Mus musculus
gagcaggctgttcctacgtcccgag

SEQ ID NO: 654481 - DNA, 25 bp, Mus musculus
gagcaggctgttgctacgtcccgag

SEQ ID NO: 654482 - DNA, 25 bp, Mus musculus
gagcaggcttacagagctggctgat

SEQ ID NO: 654483 - DNA, 25 bp, Mus musculus
gagcaggcttactgagctggctgat

SEQ ID NO: 654484 - DNA, 25 bp, Mus musculus
gagcagggacaccaactctccaatg

SEQ ID NO: 654485 - DNA, 25 bp, Mus musculus
gagcagggacacgaactctccaatg

SEQ ID NO: 654486 - DNA, 25 bp, Mus musculus
gagcagggagcgatcccattgaagt

SEQ ID NO: 654487 - DNA, 25 bp, Mus musculus
gagcagggagcgttcccattgaagt

SEQ ID NO: 654488 - DNA, 25 bp, Mus musculus
gagcagggccatcctggatagaaca

SEQ ID NO: 654489 - DNA, 25 bp, Mus musculus
gagcagggccatgctggatagaaca

SEQ ID NO: 654490 - DNA, 25 bp, Mus musculus
gagcagggccttagagaccacgcag

SEQ ID NO: 654491 - DNA, 25 bp, Mus musculus
gagcagggcctttgagaccacgcag

SEQ ID NO: 654492 - DNA, 25 bp, Mus musculus
gagcagggctccacacggatgtttt

SEQ ID NO: 654493 - DNA, 25 bp, Mus musculus
gagcagggctcctcacggatgtttt

SEQ ID NO: 654494 - DNA, 25 bp, Mus musculus
gagcagggtcccatctggacgtttc

SEQ ID NO: 654495 - DNA, 25 bp, Mus musculus
gagcagggtcccttctggacgtttc

SEQ ID NO: 654496 - DNA, 25 bp, Mus musculus
gagcaggtcacaccagtcagaacta

SEQ ID NO: 654497 - DNA, 25 bp, Mus musculus
gagcaggtcacagcagtcagaacta

SEQ ID NO: 654498 - DNA, 25 bp, Mus musculus
gagcaggtgatcagaaagtacaccg

SEQ ID NO: 654499 - DNA, 25 bp, Mus musculus
gagcaggtgatctgaaagtacaccg

SEQ ID NO: 654500 - DNA, 25 bp, Mus musculus
gagcagtaaccgagaccagattcag

SEQ ID NO: 654501 - DNA, 25 bp, Mus musculus
gagcagtaaccgtgaccagattcag

SEQ ID NO: 654502 - DNA, 25 bp, Mus musculus
gagcagtacaacattcctgccttct

SEQ ID NO: 654503 - DNA, 25 bp, Mus musculus
gagcagtacaactttcctgccttct

SEQ ID NO: 654504 - DNA, 25 bp, Mus musculus
gagcagtagattcgcaaaatatagg

SEQ ID NO: 654505 - DNA, 25 bp, Mus musculus
gagcagtagattggcaaaatatagg

SEQ ID NO: 654506 - DNA, 25 bp, Mus musculus
gagcagtaggccaggaagtagcata

SEQ ID NO: 654507 - DNA, 25 bp, Mus musculus
gagcagtaggcctggaagtagcata

SEQ ID NO: 654508 - DNA, 25 bp, Mus musculus
gagcagtatctaaggtcgcccggga

SEQ ID NO: 654509 - DNA, 25 bp, Mus musculus
gagcagtatctatggtcgcccggga

SEQ ID NO: 654510 - DNA, 25 bp, Mus musculus
gagcagtcaaaaagatgcatttcgt

SEQ ID NO: 654511 - DNA, 25 bp, Mus musculus
gagcagtcaaaatgatgcatttcgt

SEQ ID NO: 654512 - DNA, 25 bp, Mus musculus
gagcagtcagccaacctcctgaaat

SEQ ID NO: 654513 - DNA, 25 bp, Mus musculus
gagcagtcagcctacctcctgaaat

SEQ ID NO: 654514 - DNA, 25 bp, Mus musculus
gagcagtcagctcaaagaatctcag

SEQ ID NO: 654515 - DNA, 25 bp, Mus musculus
gagcagtcagctgaaagaatctcag

SEQ ID NO: 654516 - DNA, 25 bp, Mus musculus
gagcagtcatgtcaagcctataagc

SEQ ID NO: 654517 - DNA, 25 bp, Mus musculus
gagcagtcatgtgaagcctataagc

SEQ ID NO: 654518 - DNA, 25 bp, Mus musculus
gagcagtccagaacagaaggcagag

SEQ ID NO: 654519 - DNA, 25 bp, Mus musculus
gagcagtccagatcagaaggcagag

SEQ ID NO: 654520 - DNA, 25 bp, Mus musculus
gagcagtccctgcttgcagccttgg

SEQ ID NO: 654521 - DNA, 25 bp, Mus musculus
gagcagtccctggttgcagccttgg

SEQ ID NO: 654522 - DNA, 25 bp, Mus musculus
gagcagtcctcgcatgctacctgca

SEQ ID NO: 654523 - DNA, 25 bp, Mus musculus
gagcagtcctcggatgctacctgca

SEQ ID NO: 654524 - DNA, 25 bp, Mus musculus
gagcagtcgcttattcccgcgcgag

SEQ ID NO: 654525 - DNA, 25 bp, Mus musculus
gagcagtcgctttttcccgcgcgag

SEQ ID NO: 654526 - DNA, 25 bp, Mus musculus
gagcagtgagctagaatctagcagc

SEQ ID NO: 654527 - DNA, 25 bp, Mus musculus
gagcagtgagcttgaatctagcagc

SEQ ID NO: 654528 - DNA, 25 bp, Mus musculus
gagcagtgaggcaattgctaccctg

SEQ ID NO: 654529 - DNA, 25 bp, Mus musculus
gagcagtgaggcagtcactccagaa

SEQ ID NO: 654530 - DNA, 25 bp, Mus musculus
gagcagtgaggctattgctaccctg

SEQ ID NO: 654531 - DNA, 25 bp, Mus musculus
gagcagtgaggctgtcactccagaa

SEQ ID NO: 654532 - DNA, 25 bp, Mus musculus
gagcagtgccagcatagccccacat

SEQ ID NO: 654533 - DNA, 25 bp, Mus musculus
gagcagtgccaggatagccccacat

SEQ ID NO: 654534 - DNA, 25 bp, Mus musculus
gagcagtgccctctgcagctgaata

SEQ ID NO: 654535 - DNA, 25 bp, Mus musculus
gagcagtgccctgtgcagctgaata

SEQ ID NO: 654536 - DNA, 25 bp, Mus musculus
gagcagtggaaaagcctggccgctt

SEQ ID NO: 654537 - DNA, 25 bp, Mus musculus
gagcagtggaaatgcctggccgctt

SEQ ID NO: 654538 - DNA, 25 bp, Mus musculus
gagcagtgtctgacctacatctggc

SEQ ID NO: 654539 - DNA, 25 bp, Mus musculus
gagcagtgtctgtcctacatctggc

SEQ ID NO: 654540 - DNA, 25 bp, Mus musculus
gagcagtgtgccctgagagcccagg

SEQ ID NO: 654541 - DNA, 25 bp, Mus musculus
gagcagtgtgccgtgagagcccagg

SEQ ID NO: 654542 - DNA, 25 bp, Mus musculus
gagcagttaatacgcaggctctgag

SEQ ID NO: 654543 - DNA, 25 bp, Mus musculus
gagcagttaataggcaggctctgag

SEQ ID NO: 654544 - DNA, 25 bp, Mus musculus
gagcagttcatcctctcccaggtgg

SEQ ID NO: 654545 - DNA, 25 bp, Mus musculus
gagcagttcatcgtctcccaggtgg

SEQ ID NO: 654546 - DNA, 25 bp, Mus musculus
gagcagttcgtcacggcgacctgga

SEQ ID NO: 654547 - DNA, 25 bp, Mus musculus
gagcagttcgtctcggcgacctgga

SEQ ID NO: 654548 - DNA, 25 bp, Mus musculus
gagcagttctggaagttttacagcc

SEQ ID NO: 654549 - DNA, 25 bp, Mus musculus
gagcagttctggtagttttacagcc

SEQ ID NO: 654550 - DNA, 25 bp, Mus musculus
gagcagttgaccatccgcgacgtgg

SEQ ID NO: 654551 - DNA, 25 bp, Mus musculus
gagcagttgaccttccgcgacgtgg

SEQ ID NO: 654552 - DNA, 25 bp, Mus musculus
gagcagttgctgcaatcaccttgtt

SEQ ID NO: 654553 - DNA, 25 bp, Mus musculus
gagcagttgctggaatcaccttgtt

SEQ ID NO: 654554 - DNA, 25 bp, Mus musculus
gagcagttgtgcagccaagccaagg

SEQ ID NO: 654555 - DNA, 25 bp, Mus musculus
gagcagttgtgctgccaagccaagg

SEQ ID NO: 654556 - DNA, 25 bp, Mus musculus
gagcagtttaacacagatatacaaa

SEQ ID NO: 654557 - DNA, 25 bp, Mus musculus
gagcagtttaactcagatatacaaa

SEQ ID NO: 654558 - DNA, 25 bp, Mus musculus
gagcagtttcatcgccttgcacaag

SEQ ID NO: 654559 - DNA, 25 bp, Mus musculus
gagcagtttcatggccttgcacaag

SEQ ID NO: 654560 - DNA, 25 bp, Mus musculus
gagcagtttgaacacttactagtta

SEQ ID NO: 654561 - DNA, 25 bp, Mus musculus
gagcagtttgaagacttactagtta

SEQ ID NO: 654562 - DNA, 25 bp, Mus musculus
gagcagttttctcagggcaacattg

SEQ ID NO: 654563 - DNA, 25 bp, Mus musculus
gagcagttttctgagggcaacattg

SEQ ID NO: 654564 - DNA, 25 bp, Mus musculus
gagcatacattaattcctctaggcc

SEQ ID NO: 654565 - DNA, 25 bp, Mus musculus
gagcatacattatttcctctaggcc

SEQ ID NO: 654566 - DNA, 25 bp, Mus musculus
gagcatacccaaagtgctgcaaggt

SEQ ID NO: 654567 - DNA, 25 bp, Mus musculus
gagcatacccaatgtgctgcaaggt

SEQ ID NO: 654568 - DNA, 25 bp, Mus musculus
gagcatacctgaccctctctgtagg

SEQ ID NO: 654569 - DNA, 25 bp, Mus musculus
gagcatacctgagcctctctgtagg

SEQ ID NO: 654570 - DNA, 25 bp, Mus musculus
gagcatagagacatcttgccatggc

SEQ ID NO: 654571 - DNA, 25 bp, Mus musculus
gagcatagagacttcttgccatggc

SEQ ID NO: 654572 - DNA, 25 bp, Mus musculus
gagcataggcatccaatgaatgaac

SEQ ID NO: 654573 - DNA, 25 bp, Mus musculus
gagcataggcatgcaatgaatgaac

SEQ ID NO: 654574 - DNA, 25 bp, Mus musculus
gagcataggctgcatcatctttgag

SEQ ID NO: 654575 - DNA, 25 bp, Mus musculus
gagcataggctggatcatctttgag

SEQ ID NO: 654576 - DNA, 25 bp, Mus musculus
gagcatagtctgacagctgtaccag

SEQ ID NO: 654577 - DNA, 25 bp, Mus musculus
gagcatagtctgtcagctgtaccag

SEQ ID NO: 654578 - DNA, 25 bp, Mus musculus
gagcatatgataacgctggctccac

SEQ ID NO: 654579 - DNA, 25 bp, Mus musculus
gagcatatgatatcgctggctccac

SEQ ID NO: 654580 - DNA, 25 bp, Mus musculus
gagcatcacctcagtgtgctcccaa

SEQ ID NO: 654581 - DNA, 25 bp, Mus musculus
gagcatcacctctgtgtgctcccaa

SEQ ID NO: 654582 - DNA, 25 bp, Mus musculus
gagcatcactcgagctgtgcgctcc

SEQ ID NO: 654583 - DNA, 25 bp, Mus musculus
gagcatcactcgtgctgtgcgctcc

SEQ ID NO: 654584 - DNA, 25 bp, Mus musculus
gagcatcagacaagcgcgagaaaag

SEQ ID NO: 654585 - DNA, 25 bp, Mus musculus
gagcatcagacatgcgcgagaaaag

SEQ ID NO: 654586 - DNA, 25 bp, Mus musculus
gagcatcagatcagtcctgctgtgt

SEQ ID NO: 654587 - DNA, 25 bp, Mus musculus
gagcatcagatctgtcctgctgtgt

SEQ ID NO: 654588 - DNA, 25 bp, Mus musculus
gagcatcatcccagggttacccctg

SEQ ID NO: 654589 - DNA, 25 bp, Mus musculus
gagcatcatccctgggttacccctg

SEQ ID NO: 654590 - DNA, 25 bp, Mus musculus
gagcatcatctgagcgaggtgcaga

SEQ ID NO: 654591 - DNA, 25 bp, Mus musculus
gagcatcatctgtgcgaggtgcaga

SEQ ID NO: 654592 - DNA, 25 bp, Mus musculus
gagcatcatgtacaggaaattcacc

SEQ ID NO: 654593 - DNA, 25 bp, Mus musculus
gagcatcatgtagaggaaattcacc

SEQ ID NO: 654594 - DNA, 25 bp, Mus musculus
gagcatccagcgcaacatgtctgct

SEQ ID NO: 654595 - DNA, 25 bp, Mus musculus
gagcatccagcggaacatgtctgct

SEQ ID NO: 654596 - DNA, 25 bp, Mus musculus
gagcatccaggaatattcacaaggg

SEQ ID NO: 654597 - DNA, 25 bp, Mus musculus
gagcatccaggattattcacaaggg

SEQ ID NO: 654598 - DNA, 25 bp, Mus musculus
gagcatccattgcacattgtcccaa

SEQ ID NO: 654599 - DNA, 25 bp, Mus musculus
gagcatccattggacattgtcccaa

SEQ ID NO: 654600 - DNA, 25 bp, Mus musculus
gagcatcccgtgacattgcacagct

SEQ ID NO: 654601 - DNA, 25 bp, Mus musculus
gagcatcccgtgtcattgcacagct

SEQ ID NO: 654602 - DNA, 25 bp, Mus musculus
gagcatcctaggacactggcttttg

SEQ ID NO: 654603 - DNA, 25 bp, Mus musculus
gagcatcctaggtcactggcttttg

SEQ ID NO: 654604 - DNA, 25 bp, Mus musculus
gagcatcctccaaaggacacccttg

SEQ ID NO: 654605 - DNA, 25 bp, Mus musculus
gagcatcctccataggacacccttg

SEQ ID NO: 654606 - DNA, 25 bp, Mus musculus
gagcatcctcggaggccagcctgca

SEQ ID NO: 654607 - DNA, 25 bp, Mus musculus
gagcatcctcggtggccagcctgca

SEQ ID NO: 654608 - DNA, 25 bp, Mus musculus
gagcatcctgccaatagaccaggca

SEQ ID NO: 654609 - DNA, 25 bp, Mus musculus
gagcatcctgccatgataaacttgg

SEQ ID NO: 654610 - DNA, 25 bp, Mus musculus
gagcatcctgcctatagaccaggca

SEQ ID NO: 654611 - DNA, 25 bp, Mus musculus
gagcatcctgccttgataaacttgg

SEQ ID NO: 654612 - DNA, 25 bp, Mus musculus
gagcatcctgtacaatacctgtgtc

SEQ ID NO: 654613 - DNA, 25 bp, Mus musculus
gagcatcctgtagaatacctgtgtc

SEQ ID NO: 654614 - DNA, 25 bp, Mus musculus
gagcatcgcagaagttttgcacatg

SEQ ID NO: 654615 - DNA, 25 bp, Mus musculus
gagcatcgcagatgttttgcacatg

SEQ ID NO: 654616 - DNA, 25 bp, Mus musculus
gagcatcgtcagctctgcagatgaa

SEQ ID NO: 654617 - DNA, 25 bp, Mus musculus
gagcatcgtcaggtctgcagatgaa

SEQ ID NO: 654618 - DNA, 25 bp, Mus musculus
gagcatctaccgcagcaaagggctg

SEQ ID NO: 654619 - DNA, 25 bp, Mus musculus
gagcatctaccggagcaaagggctg

SEQ ID NO: 654620 - DNA, 25 bp, Mus musculus
gagcatctatctcaacggtctgaca

SEQ ID NO: 654621 - DNA, 25 bp, Mus musculus
gagcatctatctgaacggtctgaca

SEQ ID NO: 654622 - DNA, 25 bp, Mus musculus
gagcatctgcatctgcatttgtctc

SEQ ID NO: 654623 - DNA, 25 bp, Mus musculus
gagcatctgcatgtgcatttgtctc

SEQ ID NO: 654624 - DNA, 25 bp, Mus musculus
gagcatctgccaaggagcttcggag

SEQ ID NO: 654625 - DNA, 25 bp, Mus musculus
gagcatctgccatggagcttcggag

SEQ ID NO: 654626 - DNA, 25 bp, Mus musculus
gagcatctggtcaattctaatgaac

SEQ ID NO: 654627 - DNA, 25 bp, Mus musculus
gagcatctggtctattctaatgaac

SEQ ID NO: 654628 - DNA, 25 bp, Mus musculus
gagcatctgtctccctatctgagaa

SEQ ID NO: 654629 - DNA, 25 bp, Mus musculus
gagcatctgtctgcctatctgagaa

SEQ ID NO: 654630 - DNA, 25 bp, Mus musculus
gagcatcttatgctaattagccctg

SEQ ID NO: 654631 - DNA, 25 bp, Mus musculus
gagcatcttatggtaattagccctg

SEQ ID NO: 654632 - DNA, 25 bp, Mus musculus
gagcatcttctcatatcactgtcaa

SEQ ID NO: 654633 - DNA, 25 bp, Mus musculus
gagcatcttctcttatcactgtcaa

SEQ ID NO: 654634 - DNA, 25 bp, Mus musculus
gagcatcttgcaaactctgtgccag

SEQ ID NO: 654635 - DNA, 25 bp, Mus musculus
gagcatcttgcaagtggttactctg

SEQ ID NO: 654636 - DNA, 25 bp, Mus musculus
gagcatcttgcatactctgtgccag

SEQ ID NO: 654637 - DNA, 25 bp, Mus musculus
gagcatcttgcatgtggttactctg

SEQ ID NO: 654638 - DNA, 25 bp, Mus musculus
gagcatcttttcatctgcctggtgg

SEQ ID NO: 654639 - DNA, 25 bp, Mus musculus
gagcatcttttcttctgcctggtgg

SEQ ID NO: 654640 - DNA, 25 bp, Mus musculus
gagcatgaatggagacagagacccc

SEQ ID NO: 654641 - DNA, 25 bp, Mus musculus
gagcatgaatggtgacagagacccc

SEQ ID NO: 654642 - DNA, 25 bp, Mus musculus
gagcatgactggaaccatggtgcca

SEQ ID NO: 654643 - DNA, 25 bp, Mus musculus
gagcatgactggtaccatggtgcca

SEQ ID NO: 654644 - DNA, 25 bp, Mus musculus
gagcatgagaatcggatcagccata

SEQ ID NO: 654645 - DNA, 25 bp, Mus musculus
gagcatgagaatgggatcagccata

SEQ ID NO: 654646 - DNA, 25 bp, Mus musculus
gagcatgagacaatccggaatgcca

SEQ ID NO: 654647 - DNA, 25 bp, Mus musculus
gagcatgagacattccggaatgcca

SEQ ID NO: 654648 - DNA, 25 bp, Mus musculus
gagcatgagcgccagtacctgctgt

SEQ ID NO: 654649 - DNA, 25 bp, Mus musculus
gagcatgagcgcgagtacctgctgt

SEQ ID NO: 654650 - DNA, 25 bp, Mus musculus
gagcatgagggcctttggaaaaaac

SEQ ID NO: 654651 - DNA, 25 bp, Mus musculus
gagcatgagggcgtttggaaaaaac

SEQ ID NO: 654652 - DNA, 25 bp, Mus musculus
gagcatgatagaaaggacacctgat

SEQ ID NO: 654653 - DNA, 25 bp, Mus musculus
gagcatgatagataggacacctgat

SEQ ID NO: 654654 - DNA, 25 bp, Mus musculus
gagcatgatcgtcgacaagctgctg

SEQ ID NO: 654655 - DNA, 25 bp, Mus musculus
gagcatgatcgtggacaagctgctg

SEQ ID NO: 654656 - DNA, 25 bp, Mus musculus
gagcatgccaagaccaacatcagct

SEQ ID NO: 654657 - DNA, 25 bp, Mus musculus
gagcatgccaagtccaacatcagct

SEQ ID NO: 654658 - DNA, 25 bp, Mus musculus
gagcatgcccatcgtctctggagca

SEQ ID NO: 654659 - DNA, 25 bp, Mus musculus
gagcatgcccatggtctctggagca

SEQ ID NO: 654660 - DNA, 25 bp, Mus musculus
gagcatgcggtcctacacactaatc

SEQ ID NO: 654661 - DNA, 25 bp, Mus musculus
gagcatgcggtcgtacacactaatc

SEQ ID NO: 654662 - DNA, 25 bp, Mus musculus
gagcatgctctcaaatcctgacctg

SEQ ID NO: 654663 - DNA, 25 bp, Mus musculus
gagcatgctctctaatcctgacctg

SEQ ID NO: 654664 - DNA, 25 bp, Mus musculus
gagcatgctgggaaaatcgggtatc

SEQ ID NO: 654665 - DNA, 25 bp, Mus musculus
gagcatgctgggtaaatcgggtatc

SEQ ID NO: 654666 - DNA, 25 bp, Mus musculus
gagcatggccatctagggaacaaca

SEQ ID NO: 654667 - DNA, 25 bp, Mus musculus
gagcatggccatgtagggaacaaca

SEQ ID NO: 654668 - DNA, 25 bp, Mus musculus
gagcatggtcctacagaaaaggcaa

SEQ ID NO: 654669 - DNA, 25 bp, Mus musculus
gagcatggtccttcagaaaaggcaa

SEQ ID NO: 654670 - DNA, 25 bp, Mus musculus
gagcatgtacccactttgtagacaa

SEQ ID NO: 654671 - DNA, 25 bp, Mus musculus
gagcatgtaccctctttgtagacaa

SEQ ID NO: 654672 - DNA, 25 bp, Mus musculus
gagcatgtagctcagagttccagcc

SEQ ID NO: 654673 - DNA, 25 bp, Mus musculus
gagcatgtagctgagagttccagcc

SEQ ID NO: 654674 - DNA, 25 bp, Mus musculus
gagcatgtcacccaggttgtgaaac

SEQ ID NO: 654675 - DNA, 25 bp, Mus musculus
gagcatgtcaccgaggttgtgaaac

SEQ ID NO: 654676 - DNA, 25 bp, Mus musculus
gagcatgtcatcctggcctgctgca

SEQ ID NO: 654677 - DNA, 25 bp, Mus musculus
gagcatgtcatcgtggcctgctgca

SEQ ID NO: 654678 - DNA, 25 bp, Mus musculus
gagcatgtgccaaccacgtcagcac

SEQ ID NO: 654679 - DNA, 25 bp, Mus musculus
gagcatgtgccatccacgtcagcac

SEQ ID NO: 654680 - DNA, 25 bp, Mus musculus
gagcatgttatacgaattggcagca

SEQ ID NO: 654681 - DNA, 25 bp, Mus musculus
gagcatgttataggaattggcagca

SEQ ID NO: 654682 - DNA, 25 bp, Mus musculus
gagcatgttccacaccagggtcttc

SEQ ID NO: 654683 - DNA, 25 bp, Mus musculus
gagcatgttccagaccagggtcttc

SEQ ID NO: 654684 - DNA, 25 bp, Mus musculus
gagcatgttctcaatcgtttcggaa

SEQ ID NO: 654685 - DNA, 25 bp, Mus musculus
gagcatgttctctatcgtttcggaa

SEQ ID NO: 654686 - DNA, 25 bp, Mus musculus
gagcattaagtcagagacatctgga

SEQ ID NO: 654687 - DNA, 25 bp, Mus musculus
gagcattaagtctgagacatctgga

SEQ ID NO: 654688 - DNA, 25 bp, Mus musculus
gagcattacaagaagaaccccatgg

SEQ ID NO: 654689 - DNA, 25 bp, Mus musculus
gagcattacaagtagaaccccatgg

SEQ ID NO: 654690 - DNA, 25 bp, Mus musculus
gagcattacctgcacctgctggcaa

SEQ ID NO: 654691 - DNA, 25 bp, Mus musculus
gagcattacctggacctgctggcaa

SEQ ID NO: 654692 - DNA, 25 bp, Mus musculus
gagcattcctggctaccttaagagg

SEQ ID NO: 654693 - DNA, 25 bp, Mus musculus
gagcattcctgggtaccttaagagg

SEQ ID NO: 654694 - DNA, 25 bp, Mus musculus
gagcattcggtgcatttactaaaac

SEQ ID NO: 654695 - DNA, 25 bp, Mus musculus
gagcattcggtggatttactaaaac

SEQ ID NO: 654696 - DNA, 25 bp, Mus musculus
gagcattctccaattgccctccaga

SEQ ID NO: 654697 - DNA, 25 bp, Mus musculus
gagcattctccatttgccctccaga

SEQ ID NO: 654698 - DNA, 25 bp, Mus musculus
gagcattctggaagagttttccgcc

SEQ ID NO: 654699 - DNA, 25 bp, Mus musculus
gagcattctggatgagttttccgcc

SEQ ID NO: 654700 - DNA, 25 bp, Mus musculus
gagcattctgtacttgacccggtaa

SEQ ID NO: 654701 - DNA, 25 bp, Mus musculus
gagcattctgtagttgacccggtaa

SEQ ID NO: 654702 - DNA, 25 bp, Mus musculus
gagcattgaagccattcaagaagtg

SEQ ID NO: 654703 - DNA, 25 bp, Mus musculus
gagcattgaagcgattcaagaagtg

SEQ ID NO: 654704 - DNA, 25 bp, Mus musculus
gagcattgactccaagtgccggaca

SEQ ID NO: 654705 - DNA, 25 bp, Mus musculus
gagcattgactcgaagtgccggaca

SEQ ID NO: 654706 - DNA, 25 bp, Mus musculus
gagcattgcattccgcaggctctcc

SEQ ID NO: 654707 - DNA, 25 bp, Mus musculus
gagcattgcattgcgcaggctctcc

SEQ ID NO: 654708 - DNA, 25 bp, Mus musculus
gagcattgccgtcggctgtgccaca

SEQ ID NO: 654709 - DNA, 25 bp, Mus musculus
gagcattgccgtgggctgtgccaca

SEQ ID NO: 654710 - DNA, 25 bp, Mus musculus
gagcattgcctgcacatggtgcgca

SEQ ID NO: 654711 - DNA, 25 bp, Mus musculus
gagcattgcctggacatggtgcgca

SEQ ID NO: 654712 - DNA, 25 bp, Mus musculus
gagcattggactccccaggactgga

SEQ ID NO: 654713 - DNA, 25 bp, Mus musculus
gagcattggactgcccaggactgga

SEQ ID NO: 654714 - DNA, 25 bp, Mus musculus
gagcattggccaagccttaggctgc

SEQ ID NO: 654715 - DNA, 25 bp, Mus musculus
gagcattggccatgccttaggctgc

SEQ ID NO: 654716 - DNA, 25 bp, Mus musculus
gagcattggcggagtgctcctcgat

SEQ ID NO: 654717 - DNA, 25 bp, Mus musculus
gagcattggcggtgtgctcctcgat

SEQ ID NO: 654718 - DNA, 25 bp, Mus musculus
gagcattggctaaagagaggcagaa

SEQ ID NO: 654719 - DNA, 25 bp, Mus musculus
gagcattggctatagagaggcagaa

SEQ ID NO: 654720 - DNA, 25 bp, Mus musculus
gagcattggcttaacccagtccgtg

SEQ ID NO: 654721 - DNA, 25 bp, Mus musculus
gagcattggctttacccagtccgtg

SEQ ID NO: 654722 - DNA, 25 bp, Mus musculus
gagcattgtgctcctcacggcgagt

SEQ ID NO: 654723 - DNA, 25 bp, Mus musculus
gagcattgtgctgctcacggcgagt

SEQ ID NO: 654724 - DNA, 25 bp, Mus musculus
gagcatttagcaaagggccggacaa

SEQ ID NO: 654725 - DNA, 25 bp, Mus musculus
gagcatttagcatagggccggacaa

SEQ ID NO: 654726 - DNA, 25 bp, Mus musculus
gagccaaaagatcaggtagctacct

SEQ ID NO: 654727 - DNA, 25 bp, Mus musculus
gagccaaaagatgaggtagctacct

SEQ ID NO: 654728 - DNA, 25 bp, Mus musculus
gagccaaaccgactccaagtccgga

SEQ ID NO: 654729 - DNA, 25 bp, Mus musculus
gagccaaaccgagtccaagtccgga

SEQ ID NO: 654730 - DNA, 25 bp, Mus musculus
gagccaaactacacatcccacagag

SEQ ID NO: 654731 - DNA, 25 bp, Mus musculus
gagccaaactactcatcccacagag

SEQ ID NO: 654732 - DNA, 25 bp, Mus musculus
gagccaaaggtgaccgaggactgcc

SEQ ID NO: 654733 - DNA, 25 bp, Mus musculus
gagccaaaggtgtccgaggactgcc

SEQ ID NO: 654734 - DNA, 25 bp, Mus musculus
gagccaaagtacaaaccgcttggaa

SEQ ID NO: 654735 - DNA, 25 bp, Mus musculus
gagccaaagtacaacccggtggaag

SEQ ID NO: 654736 - DNA, 25 bp, Mus musculus
gagccaaagtactaaccgcttggaa

SEQ ID NO: 654737 - DNA, 25 bp, Mus musculus
gagccaaagtactacccggtggaag

SEQ ID NO: 654738 - DNA, 25 bp, Mus musculus
gagccaacaatgcactcctacatgc

SEQ ID NO: 654739 - DNA, 25 bp, Mus musculus
gagccaacaatggactcctacatgc

SEQ ID NO: 654740 - DNA, 25 bp, Mus musculus
gagccaacagtgactgaatctggac

SEQ ID NO: 654741 - DNA, 25 bp, Mus musculus
gagccaacagtgtctgaatctggac

SEQ ID NO: 654742 - DNA, 25 bp, Mus musculus
gagccaacccacagatgattacgtt

SEQ ID NO: 654743 - DNA, 25 bp, Mus musculus
gagccaacccactgatgattacgtt

SEQ ID NO: 654744 - DNA, 25 bp, Mus musculus
gagccaacgtcaagcatctgaaaat

SEQ ID NO: 654745 - DNA, 25 bp, Mus musculus
gagccaacgtcatgcatctgaaaat

SEQ ID NO: 654746 - DNA, 25 bp, Mus musculus
gagccaactacgctggagacaaaga

SEQ ID NO: 654747 - DNA, 25 bp, Mus musculus
gagccaactacggtggagacaaaga

SEQ ID NO: 654748 - DNA, 25 bp, Mus musculus
gagccaactgaacgatcatctgcgg

SEQ ID NO: 654749 - DNA, 25 bp, Mus musculus
gagccaactgaaggatcatctgcgg

SEQ ID NO: 654750 - DNA, 25 bp, Mus musculus
gagccaacttgacgcgttacaatga

SEQ ID NO: 654751 - DNA, 25 bp, Mus musculus
gagccaacttgaggcgttacaatga

SEQ ID NO: 654752 - DNA, 25 bp, Mus musculus
gagccaagaagacatgttcgccaag

SEQ ID NO: 654753 - DNA, 25 bp, Mus musculus
gagccaagaagagatgttcgccaag

SEQ ID NO: 654754 - DNA, 25 bp, Mus musculus
gagccaagacccataatcaggcccg

SEQ ID NO: 654755 - DNA, 25 bp, Mus musculus
gagccaagacccttaatcaggcccg

SEQ ID NO: 654756 - DNA, 25 bp, Mus musculus
gagccaagatgtacggcaagcactg

SEQ ID NO: 654757 - DNA, 25 bp, Mus musculus
gagccaagatgttcggcaagcactg

SEQ ID NO: 654758 - DNA, 25 bp, Mus musculus
gagccaagcagaagtttggaccaca

SEQ ID NO: 654759 - DNA, 25 bp, Mus musculus
gagccaagcagatgtttggaccaca

SEQ ID NO: 654760 - DNA, 25 bp, Mus musculus
gagccaagcaggacacggctcctga

SEQ ID NO: 654761 - DNA, 25 bp, Mus musculus
gagccaagcaggtcacggctcctga

SEQ ID NO: 654762 - DNA, 25 bp, Mus musculus
gagccaagcattcacagcttctcaa

SEQ ID NO: 654763 - DNA, 25 bp, Mus musculus
gagccaagcattgacagcttctcaa

SEQ ID NO: 654764 - DNA, 25 bp, Mus musculus
gagccaagccctctgggttcaagac

SEQ ID NO: 654765 - DNA, 25 bp, Mus musculus
gagccaagccctgtgggttcaagac

SEQ ID NO: 654766 - DNA, 25 bp, Mus musculus
gagccaagccggaaatgcaagacaa

SEQ ID NO: 654767 - DNA, 25 bp, Mus musculus
gagccaagccggtaatgcaagacaa

SEQ ID NO: 654768 - DNA, 25 bp, Mus musculus
gagccaagcgctagagctgtcactg

SEQ ID NO: 654769 - DNA, 25 bp, Mus musculus
gagccaagcgcttgagctgtcactg

SEQ ID NO: 654770 - DNA, 25 bp, Mus musculus
gagccaaggagcctgtctgtgggca

SEQ ID NO: 654771 - DNA, 25 bp, Mus musculus
gagccaaggagcgtgtctgtgggca

SEQ ID NO: 654772 - DNA, 25 bp, Mus musculus
gagccaagggctcagccaactcaga

SEQ ID NO: 654773 - DNA, 25 bp, Mus musculus
gagccaagggctgagccaactcaga

SEQ ID NO: 654774 - DNA, 25 bp, Mus musculus
gagccaagggttcctccctgttatg

SEQ ID NO: 654775 - DNA, 25 bp, Mus musculus
gagccaagggttgctccctgttatg

SEQ ID NO: 654776 - DNA, 25 bp, Mus musculus
gagccaaggtctattgttaccttag

SEQ ID NO: 654777 - DNA, 25 bp, Mus musculus
gagccaaggtcttttgttaccttag

SEQ ID NO: 654778 - DNA, 25 bp, Mus musculus
gagccaagtaccacatttgaaggga

SEQ ID NO: 654779 - DNA, 25 bp, Mus musculus
gagccaagtacctcatttgaaggga

SEQ ID NO: 654780 - DNA, 25 bp, Mus musculus
gagccaagtactacatttacaccac

SEQ ID NO: 654781 - DNA, 25 bp, Mus musculus
gagccaagtacttcatttacaccac

SEQ ID NO: 654782 - DNA, 25 bp, Mus musculus
gagccaagtagccaatccttgcgag

SEQ ID NO: 654783 - DNA, 25 bp, Mus musculus
gagccaagtagcgaatccttgcgag

SEQ ID NO: 654784 - DNA, 25 bp, Mus musculus
gagccaagtgaacgccgtagctgcc

SEQ ID NO: 654785 - DNA, 25 bp, Mus musculus
gagccaagtgaaggccgtagctgcc

SEQ ID NO: 654786 - DNA, 25 bp, Mus musculus
gagccaatcagtaatcctgttgctg

SEQ ID NO: 654787 - DNA, 25 bp, Mus musculus
gagccaatcagttatcctgttgctg

SEQ ID NO: 654788 - DNA, 25 bp, Mus musculus
gagccaatgggcaacagttcttctt

SEQ ID NO: 654789 - DNA, 25 bp, Mus musculus
gagccaatgggctacagttcttctt

SEQ ID NO: 654790 - DNA, 25 bp, Mus musculus
gagccaatgtgcagctttggaattg

SEQ ID NO: 654791 - DNA, 25 bp, Mus musculus
gagccaatgtgctgctttggaattg

SEQ ID NO: 654792 - DNA, 25 bp, Mus musculus
gagccacacccaaaagttattgaac

SEQ ID NO: 654793 - DNA, 25 bp, Mus musculus
gagccacacccataagttattgaac

SEQ ID NO: 654794 - DNA, 25 bp, Mus musculus
gagccacagaacatattaaagttaa

SEQ ID NO: 654795 - DNA, 25 bp, Mus musculus
gagccacagaacttattaaagttaa

SEQ ID NO: 654796 - DNA, 25 bp, Mus musculus
gagccacagcacagatacagccaag

SEQ ID NO: 654797 - DNA, 25 bp, Mus musculus
gagccacagcactgatacagccaag

SEQ ID NO: 654798 - DNA, 25 bp, Mus musculus
gagccacagcccaagagcctgggtt

SEQ ID NO: 654799 - DNA, 25 bp, Mus musculus
gagccacagccctagagcctgggtt

SEQ ID NO: 654800 - DNA, 25 bp, Mus musculus
gagccacagcttcgcctgggatctc

SEQ ID NO: 654801 - DNA, 25 bp, Mus musculus
gagccacagcttggcctgggatctc

SEQ ID NO: 654802 - DNA, 25 bp, Mus musculus
gagccacagtccagctagctacagt

SEQ ID NO: 654803 - DNA, 25 bp, Mus musculus
gagccacagtcctgctagctacagt

SEQ ID NO: 654804 - DNA, 25 bp, Mus musculus
gagccacagtgtcagcgctggaaat

SEQ ID NO: 654805 - DNA, 25 bp, Mus musculus
gagccacagtgtgagcgctggaaat

SEQ ID NO: 654806 - DNA, 25 bp, Mus musculus
gagccacatcagcaatgaagaaagc

SEQ ID NO: 654807 - DNA, 25 bp, Mus musculus
gagccacatcaggaatgaagaaagc

SEQ ID NO: 654808 - DNA, 25 bp, Mus musculus
gagccacatccactgggagcagtaa

SEQ ID NO: 654809 - DNA, 25 bp, Mus musculus
gagccacatccagtgggagcagtaa

SEQ ID NO: 654810 - DNA, 25 bp, Mus musculus
gagccacatcccaagatatacacaa

SEQ ID NO: 654811 - DNA, 25 bp, Mus musculus
gagccacatccctagatatacacaa

SEQ ID NO: 654812 - DNA, 25 bp, Mus musculus
gagccaccaccgagccataacagga

SEQ ID NO: 654813 - DNA, 25 bp, Mus musculus
gagccaccaccgtgccataacagga

SEQ ID NO: 654814 - DNA, 25 bp, Mus musculus
gagccaccagagctattcccgaaag

SEQ ID NO: 654815 - DNA, 25 bp, Mus musculus
gagccaccagaggtattcccgaaag

SEQ ID NO: 654816 - DNA, 25 bp, Mus musculus
gagccaccttcactagacggaacct

SEQ ID NO: 654817 - DNA, 25 bp, Mus musculus
gagccaccttcagtagacggaacct

SEQ ID NO: 654818 - DNA, 25 bp, Mus musculus
gagccacgagtgcaagaagccgata

SEQ ID NO: 654819 - DNA, 25 bp, Mus musculus
gagccacgagtggaagaagccgata

SEQ ID NO: 654820 - DNA, 25 bp, Mus musculus
gagccacggcgaagggaccacatct

SEQ ID NO: 654821 - DNA, 25 bp, Mus musculus
gagccacggcgatgggaccacatct

SEQ ID NO: 654822 - DNA, 25 bp, Mus musculus
gagccacgtaaaaggaaccttgacc

SEQ ID NO: 654823 - DNA, 25 bp, Mus musculus
gagccacgtaaatggaaccttgacc

SEQ ID NO: 654824 - DNA, 25 bp, Mus musculus
gagccactaataactgggaccctca

SEQ ID NO: 654825 - DNA, 25 bp, Mus musculus
gagccactaatatctgggaccctca

SEQ ID NO: 654826 - DNA, 25 bp, Mus musculus
gagccactcgagaccttgagtggat

SEQ ID NO: 654827 - DNA, 25 bp, Mus musculus
gagccactcgagtccttgagtggat

SEQ ID NO: 654828 - DNA, 25 bp, Mus musculus
gagccactgactaactgactaacga

SEQ ID NO: 654829 - DNA, 25 bp, Mus musculus
gagccactgacttactgactaacga

SEQ ID NO: 654830 - DNA, 25 bp, Mus musculus
gagccactgagcctgccaaagggta

SEQ ID NO: 654831 - DNA, 25 bp, Mus musculus
gagccactgagcgtgccaaagggta

SEQ ID NO: 654832 - DNA, 25 bp, Mus musculus
gagccactggccattcggaagaaga

SEQ ID NO: 654833 - DNA, 25 bp, Mus musculus
gagccactggcctttcggaagaaga

SEQ ID NO: 654834 - DNA, 25 bp, Mus musculus
gagccactgggtcaagacaagaaga

SEQ ID NO: 654835 - DNA, 25 bp, Mus musculus
gagccactgggtgaagacaagaaga

SEQ ID NO: 654836 - DNA, 25 bp, Mus musculus
gagccacttgatacaggtgtccttc

SEQ ID NO: 654837 - DNA, 25 bp, Mus musculus
gagccacttgattcaggtgtccttc

SEQ ID NO: 654838 - DNA, 25 bp, Mus musculus
gagccactttgtcagggccttggat

SEQ ID NO: 654839 - DNA, 25 bp, Mus musculus
gagccactttgtgagggccttggat

SEQ ID NO: 654840 - DNA, 25 bp, Mus musculus
gagccagaaagcagatgagtacctg

SEQ ID NO: 654841 - DNA, 25 bp, Mus musculus
gagccagaaagctgatgagtacctg

SEQ ID NO: 654842 - DNA, 25 bp, Mus musculus
gagccagaacttaaagcacgtaggg

SEQ ID NO: 654843 - DNA, 25 bp, Mus musculus
gagccagaactttaagcacgtaggg

SEQ ID NO: 654844 - DNA, 25 bp, Mus musculus
gagccagaagctatcaacatgagga

SEQ ID NO: 654845 - DNA, 25 bp, Mus musculus
gagccagaagctttcaacatgagga

SEQ ID NO: 654846 - DNA, 25 bp, Mus musculus
gagccagaattcagtgtcacagacc

SEQ ID NO: 654847 - DNA, 25 bp, Mus musculus
gagccagaattctgtgtcacagacc

SEQ ID NO: 654848 - DNA, 25 bp, Mus musculus
gagccagacaaaatgctaccctacc

SEQ ID NO: 654849 - DNA, 25 bp, Mus musculus
gagccagacaaattgctaccctacc

SEQ ID NO: 654850 - DNA, 25 bp, Mus musculus
gagccagacagcatggatatggaaa

SEQ ID NO: 654851 - DNA, 25 bp, Mus musculus
gagccagacagcttggatatggaaa

SEQ ID NO: 654852 - DNA, 25 bp, Mus musculus
gagccagacctacattgttggccgt

SEQ ID NO: 654853 - DNA, 25 bp, Mus musculus
gagccagacctagattgttggccgt

SEQ ID NO: 654854 - DNA, 25 bp, Mus musculus
gagccagaccttcactttgctgaca

SEQ ID NO: 654855 - DNA, 25 bp, Mus musculus
gagccagaccttgactttgctgaca

SEQ ID NO: 654856 - DNA, 25 bp, Mus musculus
gagccagacgtcatttgggtccatg

SEQ ID NO: 654857 - DNA, 25 bp, Mus musculus
gagccagacgtcttttgggtccatg

SEQ ID NO: 654858 - DNA, 25 bp, Mus musculus
gagccagactggaagtgcgtgtaca

SEQ ID NO: 654859 - DNA, 25 bp, Mus musculus
gagccagactggtagtgcgtgtaca

SEQ ID NO: 654860 - DNA, 25 bp, Mus musculus
gagccagagcgcatgctcactgcct

SEQ ID NO: 654861 - DNA, 25 bp, Mus musculus
gagccagagcgcttgctcactgcct

SEQ ID NO: 654862 - DNA, 25 bp, Mus musculus
gagccagataacaagaatgtatata

SEQ ID NO: 654863 - DNA, 25 bp, Mus musculus
gagccagataactagaatgtatata

SEQ ID NO: 654864 - DNA, 25 bp, Mus musculus
gagccagcacagcagtacgacatgt

SEQ ID NO: 654865 - DNA, 25 bp, Mus musculus
gagccagcacaggagtacgacatgt

SEQ ID NO: 654866 - DNA, 25 bp, Mus musculus
gagccagccatacaagagctgttca

SEQ ID NO: 654867 - DNA, 25 bp, Mus musculus
gagccagccatagaagagctgttca

SEQ ID NO: 654868 - DNA, 25 bp, Mus musculus
gagccagccattcttaagttctttt

SEQ ID NO: 654869 - DNA, 25 bp, Mus musculus
gagccagccattgttaagttctttt

SEQ ID NO: 654870 - DNA, 25 bp, Mus musculus
gagccagcccacctgatcttgttac

SEQ ID NO: 654871 - DNA, 25 bp, Mus musculus
gagccagcccacgtgatcttgttac

SEQ ID NO: 654872 - DNA, 25 bp, Mus musculus
gagccagcccatagtgttcgaggtc

SEQ ID NO: 654873 - DNA, 25 bp, Mus musculus
gagccagcccattgtgttcgaggtc

SEQ ID NO: 654874 - DNA, 25 bp, Mus musculus
gagccagccgcaatcttaaggatct

SEQ ID NO: 654875 - DNA, 25 bp, Mus musculus
gagccagccgcattcttaaggatct

SEQ ID NO: 654876 - DNA, 25 bp, Mus musculus
gagccagccgttcgcattgcacatc

SEQ ID NO: 654877 - DNA, 25 bp, Mus musculus
gagccagccgttggcattgcacatc

SEQ ID NO: 654878 - DNA, 25 bp, Mus musculus
gagccagcgcacctgtacagacttc

SEQ ID NO: 654879 - DNA, 25 bp, Mus musculus
gagccagcgcacgtgtacagacttc

SEQ ID NO: 654880 - DNA, 25 bp, Mus musculus
gagccagcgcctagcactctgtctt

SEQ ID NO: 654881 - DNA, 25 bp, Mus musculus
gagccagcgccttgcactctgtctt

SEQ ID NO: 654882 - DNA, 25 bp, Mus musculus
gagccagcggccagttttcctgaat

SEQ ID NO: 654883 - DNA, 25 bp, Mus musculus
gagccagcggcctgttttcctgaat

SEQ ID NO: 654884 - DNA, 25 bp, Mus musculus
gagccagctacccatactaatttat

SEQ ID NO: 654885 - DNA, 25 bp, Mus musculus
gagccagctaccgatactaatttat

SEQ ID NO: 654886 - DNA, 25 bp, Mus musculus
gagccagcttatcaacccacagcag

SEQ ID NO: 654887 - DNA, 25 bp, Mus musculus
gagccagcttatgaacccacagcag

SEQ ID NO: 654888 - DNA, 25 bp, Mus musculus
gagccagcttgtcaattgcctcacg

SEQ ID NO: 654889 - DNA, 25 bp, Mus musculus
gagccagcttgtgaattgcctcacg

SEQ ID NO: 654890 - DNA, 25 bp, Mus musculus
gagccaggacataatcaaatacaac

SEQ ID NO: 654891 - DNA, 25 bp, Mus musculus
gagccaggacattatcaaatacaac

SEQ ID NO: 654892 - DNA, 25 bp, Mus musculus
gagccaggagccaacgactggtcct

SEQ ID NO: 654893 - DNA, 25 bp, Mus musculus
gagccaggagcctacgactggtcct

SEQ ID NO: 654894 - DNA, 25 bp, Mus musculus
gagccaggatcaacttctttgggtc

SEQ ID NO: 654895 - DNA, 25 bp, Mus musculus
gagccaggatcatcttctttgggtc

SEQ ID NO: 654896 - DNA, 25 bp, Mus musculus
gagccaggcgagaaaagctctctag

SEQ ID NO: 654897 - DNA, 25 bp, Mus musculus
gagccaggcgagtaaagctctctag

SEQ ID NO: 654898 - DNA, 25 bp, Mus musculus
gagccaggctatctcctcacagatg

SEQ ID NO: 654899 - DNA, 25 bp, Mus musculus
gagccaggctatgtcctcacagatg

SEQ ID NO: 654900 - DNA, 25 bp, Mus musculus
gagccagggcaaaggagttcaccaa

SEQ ID NO: 654901 - DNA, 25 bp, Mus musculus
gagccagggcaatggagttcaccaa

SEQ ID NO: 654902 - DNA, 25 bp, Mus musculus
gagccagggctcaaagcattctcac

SEQ ID NO: 654903 - DNA, 25 bp, Mus musculus
gagccagggctctaagcattctcac

SEQ ID NO: 654904 - DNA, 25 bp, Mus musculus
gagccagggcttattagaggaatgc

SEQ ID NO: 654905 - DNA, 25 bp, Mus musculus
gagccagggctttttagaggaatgc

SEQ ID NO: 654906 - DNA, 25 bp, Mus musculus
gagccaggtcccagtttgatggcag

SEQ ID NO: 654907 - DNA, 25 bp, Mus musculus
gagccaggtccctgtttgatggcag

SEQ ID NO: 654908 - DNA, 25 bp, Mus musculus
gagccaggtgacaaaggctcagctg

SEQ ID NO: 654909 - DNA, 25 bp, Mus musculus
gagccaggtgactaaggctcagctg

SEQ ID NO: 654910 - DNA, 25 bp, Mus musculus
gagccagtagttctccctgacctga

SEQ ID NO: 654911 - DNA, 25 bp, Mus musculus
gagccagtagttgtccctgacctga

SEQ ID NO: 654912 - DNA, 25 bp, Mus musculus
gagccagtattcctcagtttcaaag

SEQ ID NO: 654913 - DNA, 25 bp, Mus musculus
gagccagtattcgtcagtttcaaag

SEQ ID NO: 654914 - DNA, 25 bp, Mus musculus
gagccagtcaacaccaaagcgaatt

SEQ ID NO: 654915 - DNA, 25 bp, Mus musculus
gagccagtcaactccaaagcgaatt

SEQ ID NO: 654916 - DNA, 25 bp, Mus musculus
gagccagtccaaaaccttccgacag

SEQ ID NO: 654917 - DNA, 25 bp, Mus musculus
gagccagtccaataccttccgacag

SEQ ID NO: 654918 - DNA, 25 bp, Mus musculus
gagccagtcccgaagctgctggagt

SEQ ID NO: 654919 - DNA, 25 bp, Mus musculus
gagccagtcccgtagctgctggagt

SEQ ID NO: 654920 - DNA, 25 bp, Mus musculus
gagccagtccggagccagtcccgaa

SEQ ID NO: 654921 - DNA, 25 bp, Mus musculus
gagccagtccggtgccagtcccgaa

SEQ ID NO: 654922 - DNA, 25 bp, Mus musculus
gagccagtcctgattgcaacaacca

SEQ ID NO: 654923 - DNA, 25 bp, Mus musculus
gagccagtcctgcttgaagaaccag

SEQ ID NO: 654924 - DNA, 25 bp, Mus musculus
gagccagtcctggttgaagaaccag

SEQ ID NO: 654925 - DNA, 25 bp, Mus musculus
gagccagtcctgtttgcaacaacca

SEQ ID NO: 654926 - DNA, 25 bp, Mus musculus
gagccagtggatatcggatcagctg

SEQ ID NO: 654927 - DNA, 25 bp, Mus musculus
gagccagtggatttcggatcagctg

SEQ ID NO: 654928 - DNA, 25 bp, Mus musculus
gagccagtgtcacagttactcaaaa

SEQ ID NO: 654929 - DNA, 25 bp, Mus musculus
gagccagtgtcagagttactcaaaa

SEQ ID NO: 654930 - DNA, 25 bp, Mus musculus
gagccagtgtctaaactaagcccat

SEQ ID NO: 654931 - DNA, 25 bp, Mus musculus
gagccagtgtcttaactaagcccat

SEQ ID NO: 654932 - DNA, 25 bp, Mus musculus
gagccagttatcagctgatgggtca

SEQ ID NO: 654933 - DNA, 25 bp, Mus musculus
gagccagttatctgctgatgggtca

SEQ ID NO: 654934 - DNA, 25 bp, Mus musculus
gagccagttcttcgaagagcagttg

SEQ ID NO: 654935 - DNA, 25 bp, Mus musculus
gagccagttcttggaagagcagttg

SEQ ID NO: 654936 - DNA, 25 bp, Mus musculus
gagccagttgctcagccagaaacat

SEQ ID NO: 654937 - DNA, 25 bp, Mus musculus
gagccagttgctgagccagaaacat

SEQ ID NO: 654938 - DNA, 25 bp, Mus musculus
gagccagtttctcagcctttctctg

SEQ ID NO: 654939 - DNA, 25 bp, Mus musculus
gagccagtttctgagcctttctctg

SEQ ID NO: 654940 - DNA, 25 bp, Mus musculus
gagccataagcaccatctagccagg

SEQ ID NO: 654941 - DNA, 25 bp, Mus musculus
gagccataagcagcatctagccagg

SEQ ID NO: 654942 - DNA, 25 bp, Mus musculus
gagccatacatactccagacctctg

SEQ ID NO: 654943 - DNA, 25 bp, Mus musculus
gagccatacatagtccagacctctg

SEQ ID NO: 654944 - DNA, 25 bp, Mus musculus
gagccatagacgcaatcatcaatat

SEQ ID NO: 654945 - DNA, 25 bp, Mus musculus
gagccatagacggaatcatcaatat

SEQ ID NO: 654946 - DNA, 25 bp, Mus musculus
gagccatatatgagccctagctgtg

SEQ ID NO: 654947 - DNA, 25 bp, Mus musculus
gagccatatatgtgccctagctgtg

SEQ ID NO: 654948 - DNA, 25 bp, Mus musculus
gagccatatgctaacacatcatctt

SEQ ID NO: 654949 - DNA, 25 bp, Mus musculus
gagccatatgcttacacatcatctt

SEQ ID NO: 654950 - DNA, 25 bp, Mus musculus
gagccatcactgcaggctgcccttg

SEQ ID NO: 654951 - DNA, 25 bp, Mus musculus
gagccatcactggaggctgcccttg

SEQ ID NO: 654952 - DNA, 25 bp, Mus musculus
gagccatcagagctgatcagaattt

SEQ ID NO: 654953 - DNA, 25 bp, Mus musculus
gagccatcagaggtgatcagaattt

SEQ ID NO: 654954 - DNA, 25 bp, Mus musculus
gagccatcagttagagatctgatag

SEQ ID NO: 654955 - DNA, 25 bp, Mus musculus
gagccatcagtttgagatctgatag

SEQ ID NO: 654956 - DNA, 25 bp, Mus musculus
gagccatcatggcagggatcctggg

SEQ ID NO: 654957 - DNA, 25 bp, Mus musculus
gagccatcatgggagggatcctggg

SEQ ID NO: 654958 - DNA, 25 bp, Mus musculus
gagccatcccttaaaagccaacagg

SEQ ID NO: 654959 - DNA, 25 bp, Mus musculus
gagccatccctttaaagccaacagg

SEQ ID NO: 654960 - DNA, 25 bp, Mus musculus
gagccatccgtgagctcagctataa

SEQ ID NO: 654961 - DNA, 25 bp, Mus musculus
gagccatccgtgtgctcagctataa

SEQ ID NO: 654962 - DNA, 25 bp, Mus musculus
gagccatctgtaatgaagaaattgg

SEQ ID NO: 654963 - DNA, 25 bp, Mus musculus
gagccatctgtattgaagaaattgg

SEQ ID NO: 654964 - DNA, 25 bp, Mus musculus
gagccatgaagacgaagctgtgttc

SEQ ID NO: 654965 - DNA, 25 bp, Mus musculus
gagccatgaagaggaagctgtgttc

SEQ ID NO: 654966 - DNA, 25 bp, Mus musculus
gagccatgacaaattgggatttcaa

SEQ ID NO: 654967 - DNA, 25 bp, Mus musculus
gagccatgacaatttgggatttcaa

SEQ ID NO: 654968 - DNA, 25 bp, Mus musculus
gagccatgagccaaagcagggattt

SEQ ID NO: 654969 - DNA, 25 bp, Mus musculus
gagccatgagcctaagcagggattt

SEQ ID NO: 654970 - DNA, 25 bp, Mus musculus
gagccatgccaacctccgagcggat

SEQ ID NO: 654971 - DNA, 25 bp, Mus musculus
gagccatgccaagctccgagcggat

SEQ ID NO: 654972 - DNA, 25 bp, Mus musculus
gagccatgcccacgaactttacggt

SEQ ID NO: 654973 - DNA, 25 bp, Mus musculus
gagccatgcccaggaactttacggt

SEQ ID NO: 654974 - DNA, 25 bp, Mus musculus
gagccatggacaagattatctcgtt

SEQ ID NO: 654975 - DNA, 25 bp, Mus musculus
gagccatggacatgattatctcgtt

SEQ ID NO: 654976 - DNA, 25 bp, Mus musculus
gagccatggactctcaccctttggg

SEQ ID NO: 654977 - DNA, 25 bp, Mus musculus
gagccatggactgtcaccctttggg

SEQ ID NO: 654978 - DNA, 25 bp, Mus musculus
gagccatggccccaaagatccgaat

SEQ ID NO: 654979 - DNA, 25 bp, Mus musculus
gagccatggcccgaaagatccgaat

SEQ ID NO: 654980 - DNA, 25 bp, Mus musculus
gagccatggcttctatgtgctgcat

SEQ ID NO: 654981 - DNA, 25 bp, Mus musculus
gagccatggcttgtatgtgctgcat

SEQ ID NO: 654982 - DNA, 25 bp, Mus musculus
gagccatgtacccacaactcagact

SEQ ID NO: 654983 - DNA, 25 bp, Mus musculus
gagccatgtaccgacaactcagact

SEQ ID NO: 654984 - DNA, 25 bp, Mus musculus
gagccatgtccacactaggcattga

SEQ ID NO: 654985 - DNA, 25 bp, Mus musculus
gagccatgtccagactaggcattga

SEQ ID NO: 654986 - DNA, 25 bp, Mus musculus
gagccatgtctacagcttgaccctg

SEQ ID NO: 654987 - DNA, 25 bp, Mus musculus
gagccatgtctagagcttgaccctg

SEQ ID NO: 654988 - DNA, 25 bp, Mus musculus
gagccatgtgatcactgccctcaga

SEQ ID NO: 654989 - DNA, 25 bp, Mus musculus
gagccatgtgatgactgccctcaga

SEQ ID NO: 654990 - DNA, 25 bp, Mus musculus
gagccattaaacagctgcttcgtgg

SEQ ID NO: 654991 - DNA, 25 bp, Mus musculus
gagccattaaactgctgcttcgtgg

SEQ ID NO: 654992 - DNA, 25 bp, Mus musculus
gagccattccgcctgtccttgcatt

SEQ ID NO: 654993 - DNA, 25 bp, Mus musculus
gagccattccgcgtgtccttgcatt

SEQ ID NO: 654994 - DNA, 25 bp, Mus musculus
gagccattccgtagtgccattcgga

SEQ ID NO: 654995 - DNA, 25 bp, Mus musculus
gagccattccgttgtgccattcgga

SEQ ID NO: 654996 - DNA, 25 bp, Mus musculus
gagccattcttgatcaatgtgacag

SEQ ID NO: 654997 - DNA, 25 bp, Mus musculus
gagccattcttgttcaatgtgacag

SEQ ID NO: 654998 - DNA, 25 bp, Mus musculus
gagccattgattcttcagaactttc

SEQ ID NO: 654999 - DNA, 25 bp, Mus musculus
gagccattgattgttcagaactttc

SEQ ID NO: 655000 - DNA, 25 bp, Mus musculus
gagccatttattcaaactcgccagg

SEQ ID NO: 655001 - DNA, 25 bp, Mus musculus
gagccatttattgaaactcgccagg

SEQ ID NO: 655002 - DNA, 25 bp, Mus musculus
gagccatttctacttcggtgtgcct

SEQ ID NO: 655003 - DNA, 25 bp, Mus musculus
gagccatttctagttcggtgtgcct

SEQ ID NO: 655004 - DNA, 25 bp, Mus musculus
gagccatttgtcatatatttccctg

SEQ ID NO: 655005 - DNA, 25 bp, Mus musculus
gagccatttgtcttatatttccctg

SEQ ID NO: 655006 - DNA, 25 bp, Mus musculus
gagcccaaagaaccgtctccagaaa

SEQ ID NO: 655007 - DNA, 25 bp, Mus musculus
gagcccaaagaagcgtctccagaaa

SEQ ID NO: 655008 - DNA, 25 bp, Mus musculus
gagcccaactacctctgtttactgg

SEQ ID NO: 655009 - DNA, 25 bp, Mus musculus
gagcccaactacgtctgtttactgg

SEQ ID NO: 655010 - DNA, 25 bp, Mus musculus
gagcccaagagccttgtgcaacaat

SEQ ID NO: 655011 - DNA, 25 bp, Mus musculus
gagcccaagagcgttgtgcaacaat

SEQ ID NO: 655012 - DNA, 25 bp, Mus musculus
gagcccaattaactctgaggtgagg

SEQ ID NO: 655013 - DNA, 25 bp, Mus musculus
gagcccaattaagtctgaggtgagg

SEQ ID NO: 655014 - DNA, 25 bp, Mus musculus
gagcccactcgtcgcagaacagaga

SEQ ID NO: 655015 - DNA, 25 bp, Mus musculus
gagcccactcgtggcagaacagaga

SEQ ID NO: 655016 - DNA, 25 bp, Mus musculus
gagcccagaacacaggattcttcag

SEQ ID NO: 655017 - DNA, 25 bp, Mus musculus
gagcccagaacagaggattcttcag

SEQ ID NO: 655018 - DNA, 25 bp, Mus musculus
gagcccagaagaaatacaggatgtc

SEQ ID NO: 655019 - DNA, 25 bp, Mus musculus
gagcccagaagatatacaggatgtc

SEQ ID NO: 655020 - DNA, 25 bp, Mus musculus
gagcccagagctcagtaactaaacg

SEQ ID NO: 655021 - DNA, 25 bp, Mus musculus
gagcccagagctgagtaactaaacg

SEQ ID NO: 655022 - DNA, 25 bp, Mus musculus
gagcccagaggtccaaagtggcctt

SEQ ID NO: 655023 - DNA, 25 bp, Mus musculus
gagcccagaggtgcaaagtggcctt

SEQ ID NO: 655024 - DNA, 25 bp, Mus musculus
gagcccagcatcagtcttccctagg

SEQ ID NO: 655025 - DNA, 25 bp, Mus musculus
gagcccagcatctgtcttccctagg

SEQ ID NO: 655026 - DNA, 25 bp, Mus musculus
gagcccaggcagacacatggcccag

SEQ ID NO: 655027 - DNA, 25 bp, Mus musculus
gagcccaggcagtcacatggcccag

SEQ ID NO: 655028 - DNA, 25 bp, Mus musculus
gagcccaggcatctgcttcaggata

SEQ ID NO: 655029 - DNA, 25 bp, Mus musculus
gagcccaggcatgtgcttcaggata

SEQ ID NO: 655030 - DNA, 25 bp, Mus musculus
gagcccaggctgagcataaacaact

SEQ ID NO: 655031 - DNA, 25 bp, Mus musculus
gagcccaggctgtgcataaacaact

SEQ ID NO: 655032 - DNA, 25 bp, Mus musculus
gagcccagtaagagaatcccgtcgt

SEQ ID NO: 655033 - DNA, 25 bp, Mus musculus
gagcccagtaagtgaatcccgtcgt

SEQ ID NO: 655034 - DNA, 25 bp, Mus musculus
gagcccagtccacaagttggtgatg

SEQ ID NO: 655035 - DNA, 25 bp, Mus musculus
gagcccagtccagaagttggtgatg

SEQ ID NO: 655036 - DNA, 25 bp, Mus musculus
gagcccagtcgcagcttcagctgct

SEQ ID NO: 655037 - DNA, 25 bp, Mus musculus
gagcccagtcgctgcttcagctgct

SEQ ID NO: 655038 - DNA, 25 bp, Mus musculus
gagcccagtgaactctaagccatcc

SEQ ID NO: 655039 - DNA, 25 bp, Mus musculus
gagcccagtgaagtctaagccatcc

SEQ ID NO: 655040 - DNA, 25 bp, Mus musculus
gagcccataaccaggaaaggagaac

SEQ ID NO: 655041 - DNA, 25 bp, Mus musculus
gagcccataacctggaaaggagaac

SEQ ID NO: 655042 - DNA, 25 bp, Mus musculus
gagcccatcacgacctcatcgggta

SEQ ID NO: 655043 - DNA, 25 bp, Mus musculus
gagcccatcacgtcctcatcgggta

SEQ ID NO: 655044 - DNA, 25 bp, Mus musculus
gagcccatctagcaactggtggcag

SEQ ID NO: 655045 - DNA, 25 bp, Mus musculus
gagcccatctaggaactggtggcag

SEQ ID NO: 655046 - DNA, 25 bp, Mus musculus
gagcccatgccgcagtctgtacttc

SEQ ID NO: 655047 - DNA, 25 bp, Mus musculus
gagcccatgccggagtctgtacttc

SEQ ID NO: 655048 - DNA, 25 bp, Mus musculus
gagcccatgcggcagccacttgtct

SEQ ID NO: 655049 - DNA, 25 bp, Mus musculus
gagcccatgcgggagccacttgtct

SEQ ID NO: 655050 - DNA, 25 bp, Mus musculus
gagcccatggcaacatagttgtgta

SEQ ID NO: 655051 - DNA, 25 bp, Mus musculus
gagcccatggcatcatagttgtgta

SEQ ID NO: 655052 - DNA, 25 bp, Mus musculus
gagcccatgtggaattgactgccag

SEQ ID NO: 655053 - DNA, 25 bp, Mus musculus
gagcccatgtggtattgactgccag

SEQ ID NO: 655054 - DNA, 25 bp, Mus musculus
gagcccattacgagactgtcccgag

SEQ ID NO: 655055 - DNA, 25 bp, Mus musculus
gagcccattacgtgactgtcccgag

SEQ ID NO: 655056 - DNA, 25 bp, Mus musculus
gagccccagaaaatccgggtccgct

SEQ ID NO: 655057 - DNA, 25 bp, Mus musculus
gagccccagaaattccgggtccgct

SEQ ID NO: 655058 - DNA, 25 bp, Mus musculus
gagccccagatcagggttgtggatt

SEQ ID NO: 655059 - DNA, 25 bp, Mus musculus
gagccccagatctgggttgtggatt

SEQ ID NO: 655060 - DNA, 25 bp, Mus musculus
gagccccagcagaccttattactgg

SEQ ID NO: 655061 - DNA, 25 bp, Mus musculus
gagccccagcagtccttattactgg

SEQ ID NO: 655062 - DNA, 25 bp, Mus musculus
gagccccagtgaaggtgcttctccc

SEQ ID NO: 655063 - DNA, 25 bp, Mus musculus
gagccccagtgatggtgcttctccc

SEQ ID NO: 655064 - DNA, 25 bp, Mus musculus
gagccccataacatactgccgctgg

SEQ ID NO: 655065 - DNA, 25 bp, Mus musculus
gagccccataacttactgccgctgg

SEQ ID NO: 655066 - DNA, 25 bp, Mus musculus
gagccccatcatatgaagtcttgtg

SEQ ID NO: 655067 - DNA, 25 bp, Mus musculus
gagccccatcatttgaagtcttgtg

SEQ ID NO: 655068 - DNA, 25 bp, Mus musculus
gagccccgagataagaagactcagc

SEQ ID NO: 655069 - DNA, 25 bp, Mus musculus
gagccccgagattagaagactcagc

SEQ ID NO: 655070 - DNA, 25 bp, Mus musculus
gagccccgagtaaccatcaagaagc

SEQ ID NO: 655071 - DNA, 25 bp, Mus musculus
gagccccgagtatccatcaagaagc

SEQ ID NO: 655072 - DNA, 25 bp, Mus musculus
gagccccgtggcatgggcaagctta

SEQ ID NO: 655073 - DNA, 25 bp, Mus musculus
gagccccgtggcttgggcaagctta

SEQ ID NO: 655074 - DNA, 25 bp, Mus musculus
gagcccctataccaacaaacgaaca

SEQ ID NO: 655075 - DNA, 25 bp, Mus musculus
gagcccctatacgaacaaacgaaca

SEQ ID NO: 655076 - DNA, 25 bp, Mus musculus
gagcccctcgacctaaagctgagca

SEQ ID NO: 655077 - DNA, 25 bp, Mus musculus
gagcccctcgacgtaaagctgagca

SEQ ID NO: 655078 - DNA, 25 bp, Mus musculus
gagcccctgaagataaaacctaaag

SEQ ID NO: 655079 - DNA, 25 bp, Mus musculus
gagcccctgaagttaaaacctaaag

SEQ ID NO: 655080 - DNA, 25 bp, Mus musculus
gagcccctgagacggtacttcctca

SEQ ID NO: 655081 - DNA, 25 bp, Mus musculus
gagcccctgagagggtacttcctca

SEQ ID NO: 655082 - DNA, 25 bp, Mus musculus
gagcccctgcacatcaaggactgcg

SEQ ID NO: 655083 - DNA, 25 bp, Mus musculus
gagcccctgcacttcaaggactgcg

SEQ ID NO: 655084 - DNA, 25 bp, Mus musculus
gagcccctgcgacgcatgatcaaca

SEQ ID NO: 655085 - DNA, 25 bp, Mus musculus
gagcccctgcgaggcatgatcaaca

SEQ ID NO: 655086 - DNA, 25 bp, Mus musculus
gagcccctggagatgaagaaataaa

SEQ ID NO: 655087 - DNA, 25 bp, Mus musculus
gagcccctggagttgaagaaataaa

SEQ ID NO: 655088 - DNA, 25 bp, Mus musculus
gagccccttctaaggagataagatg

SEQ ID NO: 655089 - DNA, 25 bp, Mus musculus
gagccccttctatggagataagatg

SEQ ID NO: 655090 - DNA, 25 bp, Mus musculus
gagcccctttctctctggcaggtgc

SEQ ID NO: 655091 - DNA, 25 bp, Mus musculus
gagcccctttctgtctggcaggtgc

SEQ ID NO: 655092 - DNA, 25 bp, Mus musculus
gagcccgaataaataggcttgtgaa

SEQ ID NO: 655093 - DNA, 25 bp, Mus musculus
gagcccgaataattaggcttgtgaa

SEQ ID NO: 655094 - DNA, 25 bp, Mus musculus
gagcccgagtacagtctacctggac

SEQ ID NO: 655095 - DNA, 25 bp, Mus musculus
gagcccgagtactgtctacctggac

SEQ ID NO: 655096 - DNA, 25 bp, Mus musculus
gagcccgagttccactacatcgcag

SEQ ID NO: 655097 - DNA, 25 bp, Mus musculus
gagcccgagttcgactacatcgcag

SEQ ID NO: 655098 - DNA, 25 bp, Mus musculus
gagcccgctactatggtgacacaga

SEQ ID NO: 655099 - DNA, 25 bp, Mus musculus
gagcccgctactttggtgacacaga

SEQ ID NO: 655100 - DNA, 25 bp, Mus musculus
gagcccgctcctacctaatgaatga

SEQ ID NO: 655101 - DNA, 25 bp, Mus musculus
gagcccgctccttcctaatgaatga

SEQ ID NO: 655102 - DNA, 25 bp, Mus musculus
gagcccggacgtatggctgcccgca

SEQ ID NO: 655103 - DNA, 25 bp, Mus musculus
gagcccggacgtttggctgcccgca

SEQ ID NO: 655104 - DNA, 25 bp, Mus musculus
gagcccggcaacacccgggacatga

SEQ ID NO: 655105 - DNA, 25 bp, Mus musculus
gagcccggcaactcccgggacatga

SEQ ID NO: 655106 - DNA, 25 bp, Mus musculus
gagcccggccccaaggaggaaaatg

SEQ ID NO: 655107 - DNA, 25 bp, Mus musculus
gagcccggcccctaggaggaaaatg

SEQ ID NO: 655108 - DNA, 25 bp, Mus musculus
gagcccgggctgacatctcactatg

SEQ ID NO: 655109 - DNA, 25 bp, Mus musculus
gagcccgggctgtcatctcactatg

SEQ ID NO: 655110 - DNA, 25 bp, Mus musculus
gagcccgtggttcactatgatatct

SEQ ID NO: 655111 - DNA, 25 bp, Mus musculus
gagcccgtggttgactatgatatct

SEQ ID NO: 655112 - DNA, 25 bp, Mus musculus
gagccctaaactcaggatcctagat

SEQ ID NO: 655113 - DNA, 25 bp, Mus musculus
gagccctaaactgaggatcctagat

SEQ ID NO: 655114 - DNA, 25 bp, Mus musculus
gagccctacagaaacagtggcgtaa

SEQ ID NO: 655115 - DNA, 25 bp, Mus musculus
gagccctacagatacagtggcgtaa

SEQ ID NO: 655116 - DNA, 25 bp, Mus musculus
gagccctatcgcatcggtcggataa

SEQ ID NO: 655117 - DNA, 25 bp, Mus musculus
gagccctatcgcttcggtcggataa

SEQ ID NO: 655118 - DNA, 25 bp, Mus musculus
gagccctcacatctaagtacagcta

SEQ ID NO: 655119 - DNA, 25 bp, Mus musculus
gagccctcacatgtaagtacagcta

SEQ ID NO: 655120 - DNA, 25 bp, Mus musculus
gagccctccaaaagtaatagtaaat

SEQ ID NO: 655121 - DNA, 25 bp, Mus musculus
gagccctccaaatgtaatagtaaat

SEQ ID NO: 655122 - DNA, 25 bp, Mus musculus
gagccctccaggacatgatgaccaa

SEQ ID NO: 655123 - DNA, 25 bp, Mus musculus
gagccctccaggtcatgatgaccaa

SEQ ID NO: 655124 - DNA, 25 bp, Mus musculus
gagccctccagtcgctttggtcaga

SEQ ID NO: 655125 - DNA, 25 bp, Mus musculus
gagccctccagtggctttggtcaga

SEQ ID NO: 655126 - DNA, 25 bp, Mus musculus
gagccctctaggaggatttcaagga

SEQ ID NO: 655127 - DNA, 25 bp, Mus musculus
gagccctctaggtggatttcaagga

SEQ ID NO: 655128 - DNA, 25 bp, Mus musculus
gagccctctggtctcaccagtgaag

SEQ ID NO: 655129 - DNA, 25 bp, Mus musculus
gagccctctggtgtcaccagtgaag

SEQ ID NO: 655130 - DNA, 25 bp, Mus musculus
gagccctctgtacgtattctttacc

SEQ ID NO: 655131 - DNA, 25 bp, Mus musculus
gagccctctgtaggtattctttacc

SEQ ID NO: 655132 - DNA, 25 bp, Mus musculus
gagccctctgtgctggagcgaccac

SEQ ID NO: 655133 - DNA, 25 bp, Mus musculus
gagccctctgtggtggagcgaccac

SEQ ID NO: 655134 - DNA, 25 bp, Mus musculus
gagccctgacccagaacacagcagg

SEQ ID NO: 655135 - DNA, 25 bp, Mus musculus
gagccctgaccctgaacacagcagg

SEQ ID NO: 655136 - DNA, 25 bp, Mus musculus
gagccctgcagcaagcccgaaaaga

SEQ ID NO: 655137 - DNA, 25 bp, Mus musculus
gagccctgcagctagcccgaaaaga

SEQ ID NO: 655138 - DNA, 25 bp, Mus musculus
gagccctgccttctctcaaagagaa

SEQ ID NO: 655139 - DNA, 25 bp, Mus musculus
gagccctgccttgtctcaaagagaa

SEQ ID NO: 655140 - DNA, 25 bp, Mus musculus
gagccctgcggacatcaactatgat

SEQ ID NO: 655141 - DNA, 25 bp, Mus musculus
gagccctgcggagatcaactatgat

SEQ ID NO: 655142 - DNA, 25 bp, Mus musculus
gagccctggagtactacgacaaagc

SEQ ID NO: 655143 - DNA, 25 bp, Mus musculus
gagccctggagttctacgacaaagc

SEQ ID NO: 655144 - DNA, 25 bp, Mus musculus
gagccctggatactaccatcgactg

SEQ ID NO: 655145 - DNA, 25 bp, Mus musculus
gagccctggatagtaccatcgactg

SEQ ID NO: 655146 - DNA, 25 bp, Mus musculus
gagccctgtccgcaatgagtaatca

SEQ ID NO: 655147 - DNA, 25 bp, Mus musculus
gagccctgtccggaatgagtaatca

SEQ ID NO: 655148 - DNA, 25 bp, Mus musculus
gagccctgtcctctgttggcctgca

SEQ ID NO: 655149 - DNA, 25 bp, Mus musculus
gagccctgtcctgtgttggcctgca

SEQ ID NO: 655150 - DNA, 25 bp, Mus musculus
gagccctgtgccacgcttcgtgcag

SEQ ID NO: 655151 - DNA, 25 bp, Mus musculus
gagccctgtgcctcgcttcgtgcag

SEQ ID NO: 655152 - DNA, 25 bp, Mus musculus
gagcccttaagtaagcagtttacct

SEQ ID NO: 655153 - DNA, 25 bp, Mus musculus
gagcccttaagttagcagtttacct

SEQ ID NO: 655154 - DNA, 25 bp, Mus musculus
gagcccttagccatccatattggta

SEQ ID NO: 655155 - DNA, 25 bp, Mus musculus
gagcccttagccttccatattggta

SEQ ID NO: 655156 - DNA, 25 bp, Mus musculus
gagcccttatgtcacttctgttatt

SEQ ID NO: 655157 - DNA, 25 bp, Mus musculus
gagcccttatgtgacttctgttatt

SEQ ID NO: 655158 - DNA, 25 bp, Mus musculus
gagcccttcccaagactgactgtac

SEQ ID NO: 655159 - DNA, 25 bp, Mus musculus
gagcccttcccatgactgactgtac

SEQ ID NO: 655160 - DNA, 25 bp, Mus musculus
gagcccttcgagaggcattctaccg

SEQ ID NO: 655161 - DNA, 25 bp, Mus musculus
gagcccttcgagtggcattctaccg

SEQ ID NO: 655162 - DNA, 25 bp, Mus musculus
gagcccttgactacaatacccggac

SEQ ID NO: 655163 - DNA, 25 bp, Mus musculus
gagcccttgacttcaatacccggac

SEQ ID NO: 655164 - DNA, 25 bp, Mus musculus
gagcccttgctcattaacttcagca

SEQ ID NO: 655165 - DNA, 25 bp, Mus musculus
gagcccttgctctttaacttcagca

SEQ ID NO: 655166 - DNA, 25 bp, Mus musculus
gagcccttggagaagtatactgcat

SEQ ID NO: 655167 - DNA, 25 bp, Mus musculus
gagcccttggagtagtatactgcat

SEQ ID NO: 655168 - DNA, 25 bp, Mus musculus
gagcccttggtgattagctgtgtca

SEQ ID NO: 655169 - DNA, 25 bp, Mus musculus
gagcccttggtgtttagctgtgtca

SEQ ID NO: 655170 - DNA, 25 bp, Mus musculus
gagccgaaactcaactgaatgcaca

SEQ ID NO: 655171 - DNA, 25 bp, Mus musculus
gagccgaaactctactgaatgcaca

SEQ ID NO: 655172 - DNA, 25 bp, Mus musculus
gagccgaaatcgaatcgctgaaaac

SEQ ID NO: 655173 - DNA, 25 bp, Mus musculus
gagccgaaatcgtatcgctgaaaac

SEQ ID NO: 655174 - DNA, 25 bp, Mus musculus
gagccgaacagcctaaggctcctga

SEQ ID NO: 655175 - DNA, 25 bp, Mus musculus
gagccgaacagcgtaaggctcctga

SEQ ID NO: 655176 - DNA, 25 bp, Mus musculus
gagccgaagcagcaagaatgaccca

SEQ ID NO: 655177 - DNA, 25 bp, Mus musculus
gagccgaagcaggaagaatgaccca

SEQ ID NO: 655178 - DNA, 25 bp, Mus musculus
gagccgaagttaacgcccaggatga

SEQ ID NO: 655179 - DNA, 25 bp, Mus musculus
gagccgaagttatcgcccaggatga

SEQ ID NO: 655180 - DNA, 25 bp, Mus musculus
gagccgacaagtatcactccgtgtg

SEQ ID NO: 655181 - DNA, 25 bp, Mus musculus
gagccgacaagtttcactccgtgtg

SEQ ID NO: 655182 - DNA, 25 bp, Mus musculus
gagccgacacctaggagctgatggt

SEQ ID NO: 655183 - DNA, 25 bp, Mus musculus
gagccgacaccttggagctgatggt

SEQ ID NO: 655184 - DNA, 25 bp, Mus musculus
gagccgacatcgctcctcgacttag

SEQ ID NO: 655185 - DNA, 25 bp, Mus musculus
gagccgacatcggtcctcgacttag

SEQ ID NO: 655186 - DNA, 25 bp, Mus musculus
gagccgactagtcagcagtgcagca

SEQ ID NO: 655187 - DNA, 25 bp, Mus musculus
gagccgactagtgagcagtgcagca

SEQ ID NO: 655188 - DNA, 25 bp, Mus musculus
gagccgagaattcccaggacacacg

SEQ ID NO: 655189 - DNA, 25 bp, Mus musculus
gagccgagaattgccaggacacacg

SEQ ID NO: 655190 - DNA, 25 bp, Mus musculus
gagccgagactccaagtgcatcatt

SEQ ID NO: 655191 - DNA, 25 bp, Mus musculus
gagccgagactcgaagtgcatcatt

SEQ ID NO: 655192 - DNA, 25 bp, Mus musculus
gagccgagacttccagaggttacct

SEQ ID NO: 655193 - DNA, 25 bp, Mus musculus
gagccgagacttgcagaggttacct

SEQ ID NO: 655194 - DNA, 25 bp, Mus musculus
gagccgatccagcactgtttcgtgc

SEQ ID NO: 655195 - DNA, 25 bp, Mus musculus
gagccgatccaggactgtttcgtgc

SEQ ID NO: 655196 - DNA, 25 bp, Mus musculus
gagccgcaaagaagaagaattagac

SEQ ID NO: 655197 - DNA, 25 bp, Mus musculus
gagccgcaaagatgaagaattagac

SEQ ID NO: 655198 - DNA, 25 bp, Mus musculus
gagccgcagggtcttcttctacaac

SEQ ID NO: 655199 - DNA, 25 bp, Mus musculus
gagccgcagggtgttcttctacaac

SEQ ID NO: 655200 - DNA, 25 bp, Mus musculus
gagccgccacttcgaagcgtcttgg

SEQ ID NO: 655201 - DNA, 25 bp, Mus musculus
gagccgccacttggaagcgtcttgg

SEQ ID NO: 655202 - DNA, 25 bp, Mus musculus
gagccgccatctagggctcggtgtt

SEQ ID NO: 655203 - DNA, 25 bp, Mus musculus
gagccgccatcttgggctcggtgtt

SEQ ID NO: 655204 - DNA, 25 bp, Mus musculus
gagccgccgcatagagcagccacag

SEQ ID NO: 655205 - DNA, 25 bp, Mus musculus
gagccgccgcattgagcagccacag

SEQ ID NO: 655206 - DNA, 25 bp, Mus musculus
gagccgccggtaccttctttggctt

SEQ ID NO: 655207 - DNA, 25 bp, Mus musculus
gagccgccggtagcttctttggctt

SEQ ID NO: 655208 - DNA, 25 bp, Mus musculus
gagccgcctaccagacagcagggtg

SEQ ID NO: 655209 - DNA, 25 bp, Mus musculus
gagccgcctacctgacagcagggtg

SEQ ID NO: 655210 - DNA, 25 bp, Mus musculus
gagccgcctagaaggcttgtagcat

SEQ ID NO: 655211 - DNA, 25 bp, Mus musculus
gagccgcctagatggcttgtagcat

SEQ ID NO: 655212 - DNA, 25 bp, Mus musculus
gagccgcgaaaaccaactagtagcg

SEQ ID NO: 655213 - DNA, 25 bp, Mus musculus
gagccgcgaaaagcaactagtagcg

SEQ ID NO: 655214 - DNA, 25 bp, Mus musculus
gagccgcgggacattgccctagatg

SEQ ID NO: 655215 - DNA, 25 bp, Mus musculus
gagccgcgggactttgccctagatg

SEQ ID NO: 655216 - DNA, 25 bp, Mus musculus
gagccgctagatcaagatctctaca

SEQ ID NO: 655217 - DNA, 25 bp, Mus musculus
gagccgctagatgaagatctctaca

SEQ ID NO: 655218 - DNA, 25 bp, Mus musculus
gagccgctgcctcaagatcgtctta

SEQ ID NO: 655219 - DNA, 25 bp, Mus musculus
gagccgctgcctgaagatcgtctta

SEQ ID NO: 655220 - DNA, 25 bp, Mus musculus
gagccggaagaacacgaaaaccatc

SEQ ID NO: 655221 - DNA, 25 bp, Mus musculus
gagccggaagaagacgaaaaccatc

SEQ ID NO: 655222 - DNA, 25 bp, Mus musculus
gagccggagcctacattctgtcgcg

SEQ ID NO: 655223 - DNA, 25 bp, Mus musculus
gagccggagccttcattctgtcgcg

SEQ ID NO: 655224 - DNA, 25 bp, Mus musculus
gagccggatcctcttcagtacctgg

SEQ ID NO: 655225 - DNA, 25 bp, Mus musculus
gagccggatcctgttcagtacctgg

SEQ ID NO: 655226 - DNA, 25 bp, Mus musculus
gagccggcgatacccttcatcagga

SEQ ID NO: 655227 - DNA, 25 bp, Mus musculus
gagccggcgatagccttcatcagga

SEQ ID NO: 655228 - DNA, 25 bp, Mus musculus
gagccgggcgttatcattcttgacc

SEQ ID NO: 655229 - DNA, 25 bp, Mus musculus
gagccgggcgttttcattcttgacc

SEQ ID NO: 655230 - DNA, 25 bp, Mus musculus
gagccggtgaagaggccaattttgc

SEQ ID NO: 655231 - DNA, 25 bp, Mus musculus
gagccggtgaagtggccaattttgc

SEQ ID NO: 655232 - DNA, 25 bp, Mus musculus
gagccggtggtgacatcacgagccc

SEQ ID NO: 655233 - DNA, 25 bp, Mus musculus
gagccggtggtgtcatcacgagccc

SEQ ID NO: 655234 - DNA, 25 bp, Mus musculus
gagccgtagtctccagctgcatttc

SEQ ID NO: 655235 - DNA, 25 bp, Mus musculus
gagccgtagtctgcagctgcatttc

SEQ ID NO: 655236 - DNA, 25 bp, Mus musculus
gagccgtattccattacactttgga

SEQ ID NO: 655237 - DNA, 25 bp, Mus musculus
gagccgtattcctttacactttgga

SEQ ID NO: 655238 - DNA, 25 bp, Mus musculus
gagccgtcaaaaatatgctgaggaa

SEQ ID NO: 655239 - DNA, 25 bp, Mus musculus
gagccgtcaaaattatgctgaggaa

SEQ ID NO: 655240 - DNA, 25 bp, Mus musculus
gagccgtcctgaaggacccaaacga

SEQ ID NO: 655241 - DNA, 25 bp, Mus musculus
gagccgtcctgatggacccaaacga

SEQ ID NO: 655242 - DNA, 25 bp, Mus musculus
gagccgtctcagaaccacagccaag

SEQ ID NO: 655243 - DNA, 25 bp, Mus musculus
gagccgtctcagtaccacagccaag

SEQ ID NO: 655244 - DNA, 25 bp, Mus musculus
gagccgtgaatcagccaaactccat

SEQ ID NO: 655245 - DNA, 25 bp, Mus musculus
gagccgtgaatctgccaaactccat

SEQ ID NO: 655246 - DNA, 25 bp, Mus musculus
gagccgtgcagaactcctgtgataa

SEQ ID NO: 655247 - DNA, 25 bp, Mus musculus
gagccgtgcagatctcctgtgataa

SEQ ID NO: 655248 - DNA, 25 bp, Mus musculus
gagccgtggagacttgtggtgccct

SEQ ID NO: 655249 - DNA, 25 bp, Mus musculus
gagccgtggagagttgtggtgccct

SEQ ID NO: 655250 - DNA, 25 bp, Mus musculus
gagccgttcagtccaatgcattgat

SEQ ID NO: 655251 - DNA, 25 bp, Mus musculus
gagccgttcagtgcaatgcattgat

SEQ ID NO: 655252 - DNA, 25 bp, Mus musculus
gagcctaaaggaagactgactccct

SEQ ID NO: 655253 - DNA, 25 bp, Mus musculus
gagcctaaaggatgactgactccct

SEQ ID NO: 655254 - DNA, 25 bp, Mus musculus
gagcctaaaggtcacggtctggaac

SEQ ID NO: 655255 - DNA, 25 bp, Mus musculus
gagcctaaaggtgacggtctggaac

SEQ ID NO: 655256 - DNA, 25 bp, Mus musculus
gagcctacattcacagcagatttgc

SEQ ID NO: 655257 - DNA, 25 bp, Mus musculus
gagcctacattcagtcgcgatatgc

SEQ ID NO: 655258 - DNA, 25 bp, Mus musculus
gagcctacattctcagcagatttgc

SEQ ID NO: 655259 - DNA, 25 bp, Mus musculus
gagcctacattctgtcgcgatatgc

SEQ ID NO: 655260 - DNA, 25 bp, Mus musculus
gagcctacctgaacacagctccaga

SEQ ID NO: 655261 - DNA, 25 bp, Mus musculus
gagcctacctgatcacagctccaga

SEQ ID NO: 655262 - DNA, 25 bp, Mus musculus
gagcctactaccagatttcccggag

SEQ ID NO: 655263 - DNA, 25 bp, Mus musculus
gagcctactacctgatttcccggag

SEQ ID NO: 655264 - DNA, 25 bp, Mus musculus
gagcctacttgacgtacagcacaat

SEQ ID NO: 655265 - DNA, 25 bp, Mus musculus
gagcctacttgaggtacagcacaat

SEQ ID NO: 655266 - DNA, 25 bp, Mus musculus
gagcctacttgccacagtatacaca

SEQ ID NO: 655267 - DNA, 25 bp, Mus musculus
gagcctacttgcgacagtatacaca

SEQ ID NO: 655268 - DNA, 25 bp, Mus musculus
gagcctaggcttacaaagtctctta

SEQ ID NO: 655269 - DNA, 25 bp, Mus musculus
gagcctaggctttcaaagtctctta

SEQ ID NO: 655270 - DNA, 25 bp, Mus musculus
gagcctaggttcattgaggccccag

SEQ ID NO: 655271 - DNA, 25 bp, Mus musculus
gagcctaggttctttgaggccccag

SEQ ID NO: 655272 - DNA, 25 bp, Mus musculus
gagcctataaaacccggacggtgcg

SEQ ID NO: 655273 - DNA, 25 bp, Mus musculus
gagcctataaaagccggacggtgcg

SEQ ID NO: 655274 - DNA, 25 bp, Mus musculus
gagcctatcacgcatgcagtcccta

SEQ ID NO: 655275 - DNA, 25 bp, Mus musculus
gagcctatcacggatgcagtcccta

SEQ ID NO: 655276 - DNA, 25 bp, Mus musculus
gagcctatccggaggctcttggctg

SEQ ID NO: 655277 - DNA, 25 bp, Mus musculus
gagcctatccggtggctcttggctg

SEQ ID NO: 655278 - DNA, 25 bp, Mus musculus
gagcctatcgctatactctgagtgc

SEQ ID NO: 655279 - DNA, 25 bp, Mus musculus
gagcctatcgctttactctgagtgc

SEQ ID NO: 655280 - DNA, 25 bp, Mus musculus
gagcctatctacaggaattcctcga

SEQ ID NO: 655281 - DNA, 25 bp, Mus musculus
gagcctatctactggaattcctcga

SEQ ID NO: 655282 - DNA, 25 bp, Mus musculus
gagcctatgagcatcacctctgtgt

SEQ ID NO: 655283 - DNA, 25 bp, Mus musculus
gagcctatgagcttcacctctgtgt

SEQ ID NO: 655284 - DNA, 25 bp, Mus musculus
gagcctatggagctggcagaacatc

SEQ ID NO: 655285 - DNA, 25 bp, Mus musculus
gagcctatggaggtggcagaacatc

SEQ ID NO: 655286 - DNA, 25 bp, Mus musculus
gagcctcaaataagctaggcaagca

SEQ ID NO: 655287 - DNA, 25 bp, Mus musculus
gagcctcaaatatgctaggcaagca

SEQ ID NO: 655288 - DNA, 25 bp, Mus musculus
gagcctcaactgcagaagccccatt

SEQ ID NO: 655289 - DNA, 25 bp, Mus musculus
gagcctcaactggagaagccccatt

SEQ ID NO: 655290 - DNA, 25 bp, Mus musculus
gagcctcacaggagcgcctcggctg

SEQ ID NO: 655291 - DNA, 25 bp, Mus musculus
gagcctcacaggtgcgcctcggctg

SEQ ID NO: 655292 - DNA, 25 bp, Mus musculus
gagcctcactctcagagcaaggaga

SEQ ID NO: 655293 - DNA, 25 bp, Mus musculus
gagcctcactctgagagcaaggaga

SEQ ID NO: 655294 - DNA, 25 bp, Mus musculus
gagcctcagacacaggcggtagctc

SEQ ID NO: 655295 - DNA, 25 bp, Mus musculus
gagcctcagacagaggcggtagctc

SEQ ID NO: 655296 - DNA, 25 bp, Mus musculus
gagcctcagatcaggacacactggc

SEQ ID NO: 655297 - DNA, 25 bp, Mus musculus
gagcctcagatctggacacactggc

SEQ ID NO: 655298 - DNA, 25 bp, Mus musculus
gagcctcagcttctaatatctttac

SEQ ID NO: 655299 - DNA, 25 bp, Mus musculus
gagcctcagcttgtaatatctttac

SEQ ID NO: 655300 - DNA, 25 bp, Mus musculus
gagcctcatctcaacgtgtacattg

SEQ ID NO: 655301 - DNA, 25 bp, Mus musculus
gagcctcatctctacgtgtacattg

SEQ ID NO: 655302 - DNA, 25 bp, Mus musculus
gagcctcatgacagtaccttctact

SEQ ID NO: 655303 - DNA, 25 bp, Mus musculus
gagcctcatgactgtaccttctact

SEQ ID NO: 655304 - DNA, 25 bp, Mus musculus
gagcctccaccgatcagggagatcc

SEQ ID NO: 655305 - DNA, 25 bp, Mus musculus
gagcctccaccgttcagggagatcc

SEQ ID NO: 655306 - DNA, 25 bp, Mus musculus
gagcctccagatcagagaatccagg

SEQ ID NO: 655307 - DNA, 25 bp, Mus musculus
gagcctccagatgagagaatccagg

SEQ ID NO: 655308 - DNA, 25 bp, Mus musculus
gagcctccatttcttatactactgc

SEQ ID NO: 655309 - DNA, 25 bp, Mus musculus
gagcctccatttgttatactactgc

SEQ ID NO: 655310 - DNA, 25 bp, Mus musculus
gagcctcccaagagcactcctttag

SEQ ID NO: 655311 - DNA, 25 bp, Mus musculus
gagcctcccaagtgcactcctttag

SEQ ID NO: 655312 - DNA, 25 bp, Mus musculus
gagcctcccatgaaatcagaacaga

SEQ ID NO: 655313 - DNA, 25 bp, Mus musculus
gagcctcccatgtaatcagaacaga

SEQ ID NO: 655314 - DNA, 25 bp, Mus musculus
gagcctccctgacttgtcaggagcc

SEQ ID NO: 655315 - DNA, 25 bp, Mus musculus
gagcctccctgagttgtcaggagcc

SEQ ID NO: 655316 - DNA, 25 bp, Mus musculus
gagcctccggctcgagtacctgcag

SEQ ID NO: 655317 - DNA, 25 bp, Mus musculus
gagcctccggctggagtacctgcag

SEQ ID NO: 655318 - DNA, 25 bp, Mus musculus
gagcctcctcaacttctgctctgga

SEQ ID NO: 655319 - DNA, 25 bp, Mus musculus
gagcctcctcaagttctgctctgga

SEQ ID NO: 655320 - DNA, 25 bp, Mus musculus
gagcctcctcggaacctgactttag

SEQ ID NO: 655321 - DNA, 25 bp, Mus musculus
gagcctcctcggtacctgactttag

SEQ ID NO: 655322 - DNA, 25 bp, Mus musculus
gagcctcgaatgatcgtgcgttgca

SEQ ID NO: 655323 - DNA, 25 bp, Mus musculus
gagcctcgaatgttcgtgcgttgca

SEQ ID NO: 655324 - DNA, 25 bp, Mus musculus
gagcctcgaggaattgggcacccct

SEQ ID NO: 655325 - DNA, 25 bp, Mus musculus
gagcctcgaggatttgggcacccct

SEQ ID NO: 655326 - DNA, 25 bp, Mus musculus
gagcctcgatttagtcttctgcaag

SEQ ID NO: 655327 - DNA, 25 bp, Mus musculus
gagcctcgattttgtcttctgcaag

SEQ ID NO: 655328 - DNA, 25 bp, Mus musculus
gagcctcgctcgagaacttcctgtg

SEQ ID NO: 655329 - DNA, 25 bp, Mus musculus
gagcctcgctcgtgaacttcctgtg

SEQ ID NO: 655330 - DNA, 25 bp, Mus musculus
gagcctcgtactcgctcttcagggc

SEQ ID NO: 655331 - DNA, 25 bp, Mus musculus
gagcctcgtactggctcttcagggc

SEQ ID NO: 655332 - DNA, 25 bp, Mus musculus
gagcctcgtcggcagtgcgtctcct

SEQ ID NO: 655333 - DNA, 25 bp, Mus musculus
gagcctcgtcgggagtgcgtctcct

SEQ ID NO: 655334 - DNA, 25 bp, Mus musculus
gagcctctaaagagcttgaggcctc

SEQ ID NO: 655335 - DNA, 25 bp, Mus musculus
gagcctctaaagtgcttgaggcctc

SEQ ID NO: 655336 - DNA, 25 bp, Mus musculus
gagcctctcactcagtcctgacttg

SEQ ID NO: 655337 - DNA, 25 bp, Mus musculus
gagcctctcactgagtcctgacttg

SEQ ID NO: 655338 - DNA, 25 bp, Mus musculus
gagcctctcctcaaataccactggg

SEQ ID NO: 655339 - DNA, 25 bp, Mus musculus
gagcctctcctctaataccactggg

SEQ ID NO: 655340 - DNA, 25 bp, Mus musculus
gagcctctgctcaaccaaggaagtg

SEQ ID NO: 655341 - DNA, 25 bp, Mus musculus
gagcctctgctcagattgtttggga

SEQ ID NO: 655342 - DNA, 25 bp, Mus musculus
gagcctctgctctaccaaggaagtg

SEQ ID NO: 655343 - DNA, 25 bp, Mus musculus
gagcctctgctctgattgtttggga

SEQ ID NO: 655344 - DNA, 25 bp, Mus musculus
gagcctctgggactcgtactgatta

SEQ ID NO: 655345 - DNA, 25 bp, Mus musculus
gagcctctgggagtcgtactgatta

SEQ ID NO: 655346 - DNA, 25 bp, Mus musculus
gagcctctgttgctttcctggatcc

SEQ ID NO: 655347 - DNA, 25 bp, Mus musculus
gagcctctgttggtttcctggatcc

SEQ ID NO: 655348 - DNA, 25 bp, Mus musculus
gagcctgaacatcgttctgtccagg

SEQ ID NO: 655349 - DNA, 25 bp, Mus musculus
gagcctgaacatggttctgtccagg

SEQ ID NO: 655350 - DNA, 25 bp, Mus musculus
gagcctgaagatcacctttctgggt

SEQ ID NO: 655351 - DNA, 25 bp, Mus musculus
gagcctgaagatgacctttctgggt

SEQ ID NO: 655352 - DNA, 25 bp, Mus musculus
gagcctgaagctaccgtggactctg

SEQ ID NO: 655353 - DNA, 25 bp, Mus musculus
gagcctgaagcttccgtggactctg

SEQ ID NO: 655354 - DNA, 25 bp, Mus musculus
gagcctgaattcaaccttcaggatg

SEQ ID NO: 655355 - DNA, 25 bp, Mus musculus
gagcctgaattctaccttcaggatg

SEQ ID NO: 655356 - DNA, 25 bp, Mus musculus
gagcctgacacgaactgccgatatg

SEQ ID NO: 655357 - DNA, 25 bp, Mus musculus
gagcctgacacgtactgccgatatg

SEQ ID NO: 655358 - DNA, 25 bp, Mus musculus
gagcctgacagaagtcgcgcagcag

SEQ ID NO: 655359 - DNA, 25 bp, Mus musculus
gagcctgacagatgtcgcgcagcag

SEQ ID NO: 655360 - DNA, 25 bp, Mus musculus
gagcctgacatgatcaccatcttca

SEQ ID NO: 655361 - DNA, 25 bp, Mus musculus
gagcctgacatgttcaccatcttca

SEQ ID NO: 655362 - DNA, 25 bp, Mus musculus
gagcctgaccaacctagtcctcaag

SEQ ID NO: 655363 - DNA, 25 bp, Mus musculus
gagcctgaccaagctagtcctcaag

SEQ ID NO: 655364 - DNA, 25 bp, Mus musculus
gagcctgaccatcaaccccgtaggg

SEQ ID NO: 655365 - DNA, 25 bp, Mus musculus
gagcctgaccatgaaccccgtaggg

SEQ ID NO: 655366 - DNA, 25 bp, Mus musculus
gagcctgaccttcgctttgttgtgc

SEQ ID NO: 655367 - DNA, 25 bp, Mus musculus
gagcctgaccttggctttgttgtgc

SEQ ID NO: 655368 - DNA, 25 bp, Mus musculus
gagcctgacggtcgatccagttgtc

SEQ ID NO: 655369 - DNA, 25 bp, Mus musculus
gagcctgacggtggatccagttgtc

SEQ ID NO: 655370 - DNA, 25 bp, Mus musculus
gagcctgactatcaagccatacaga

SEQ ID NO: 655371 - DNA, 25 bp, Mus musculus
gagcctgactatgaagccatacaga

SEQ ID NO: 655372 - DNA, 25 bp, Mus musculus
gagcctgactgaacgaattaatctc

SEQ ID NO: 655373 - DNA, 25 bp, Mus musculus
gagcctgactgatcgaattaatctc

SEQ ID NO: 655374 - DNA, 25 bp, Mus musculus
gagcctgactttctgatgactgact

SEQ ID NO: 655375 - DNA, 25 bp, Mus musculus
gagcctgactttgtgatgactgact

SEQ ID NO: 655376 - DNA, 25 bp, Mus musculus
gagcctgagaatccccggatgcata

SEQ ID NO: 655377 - DNA, 25 bp, Mus musculus
gagcctgagaatgcccggatgcata

SEQ ID NO: 655378 - DNA, 25 bp, Mus musculus
gagcctgagcagcagaagttcacca

SEQ ID NO: 655379 - DNA, 25 bp, Mus musculus
gagcctgagcaggagaagttcacca

SEQ ID NO: 655380 - DNA, 25 bp, Mus musculus
gagcctgaggtcagaaaaacaatct

SEQ ID NO: 655381 - DNA, 25 bp, Mus musculus
gagcctgaggtctgaaaaacaatct

SEQ ID NO: 655382 - DNA, 25 bp, Mus musculus
gagcctgatgaactgcaaatgctga

SEQ ID NO: 655383 - DNA, 25 bp, Mus musculus
gagcctgatgaagtgcaaatgctga

SEQ ID NO: 655384 - DNA, 25 bp, Mus musculus
gagcctgatgtaaacctgagagtgg

SEQ ID NO: 655385 - DNA, 25 bp, Mus musculus
gagcctgatgtatacctgagagtgg

SEQ ID NO: 655386 - DNA, 25 bp, Mus musculus
gagcctgcaattacatcacagaata

SEQ ID NO: 655387 - DNA, 25 bp, Mus musculus
gagcctgcaatttcatcacagaata

SEQ ID NO: 655388 - DNA, 25 bp, Mus musculus
gagcctgcacacctcatgagcttgt

SEQ ID NO: 655389 - DNA, 25 bp, Mus musculus
gagcctgcacacgtcatgagcttgt

SEQ ID NO: 655390 - DNA, 25 bp, Mus musculus
gagcctgcccgcaacttggtggcta

SEQ ID NO: 655391 - DNA, 25 bp, Mus musculus
gagcctgcccgctacttggtggcta

SEQ ID NO: 655392 - DNA, 25 bp, Mus musculus
gagcctgccgctcgtaaagagacag

SEQ ID NO: 655393 - DNA, 25 bp, Mus musculus
gagcctgccgctggtaaagagacag

SEQ ID NO: 655394 - DNA, 25 bp, Mus musculus
gagcctgccttcacaaagtcataat

SEQ ID NO: 655395 - DNA, 25 bp, Mus musculus
gagcctgccttctcaaagtcataat

SEQ ID NO: 655396 - DNA, 25 bp, Mus musculus
gagcctgcggccctactatcaaggg

SEQ ID NO: 655397 - DNA, 25 bp, Mus musculus
gagcctgcggccgtactatcaaggg

SEQ ID NO: 655398 - DNA, 25 bp, Mus musculus
gagcctgctctgactccttggaatc

SEQ ID NO: 655399 - DNA, 25 bp, Mus musculus
gagcctgctctgtctccttggaatc

SEQ ID NO: 655400 - DNA, 25 bp, Mus musculus
gagcctgcttacatagacatcttgg

SEQ ID NO: 655401 - DNA, 25 bp, Mus musculus
gagcctgcttacttagacatcttgg

SEQ ID NO: 655402 - DNA, 25 bp, Mus musculus
gagcctgcttggaaatcaccagcct

SEQ ID NO: 655403 - DNA, 25 bp, Mus musculus
gagcctgcttggtaatcaccagcct

SEQ ID NO: 655404 - DNA, 25 bp, Mus musculus
gagcctggacaacaaggtccccgag

SEQ ID NO: 655405 - DNA, 25 bp, Mus musculus
gagcctggacaagaaggtccccgag

SEQ ID NO: 655406 - DNA, 25 bp, Mus musculus
gagcctggagtcaacaaatgtcact

SEQ ID NO: 655407 - DNA, 25 bp, Mus musculus
gagcctggagtctacaaatgtcact

SEQ ID NO: 655408 - DNA, 25 bp, Mus musculus
gagcctggctgacagcttacccttg

SEQ ID NO: 655409 - DNA, 25 bp, Mus musculus
gagcctggctgagagcttacccttg

SEQ ID NO: 655410 - DNA, 25 bp, Mus musculus
gagcctgggagcagctctgagcacc

SEQ ID NO: 655411 - DNA, 25 bp, Mus musculus
gagcctgggagctgctctgagcacc

SEQ ID NO: 655412 - DNA, 25 bp, Mus musculus
gagcctgggcgaaccggctgcttcc

SEQ ID NO: 655413 - DNA, 25 bp, Mus musculus
gagcctgggcgatccggctgcttcc

SEQ ID NO: 655414 - DNA, 25 bp, Mus musculus
gagcctgggcgtactgggcatcaca

SEQ ID NO: 655415 - DNA, 25 bp, Mus musculus
gagcctgggcgtcatccttttcatg

SEQ ID NO: 655416 - DNA, 25 bp, Mus musculus
gagcctgggcgtgatccttttcatg

SEQ ID NO: 655417 - DNA, 25 bp, Mus musculus
gagcctgggcgttctgggcatcaca

SEQ ID NO: 655418 - DNA, 25 bp, Mus musculus
gagcctgggctgctaaagtcatcag

SEQ ID NO: 655419 - DNA, 25 bp, Mus musculus
gagcctgggctggtaaagtcatcag

SEQ ID NO: 655420 - DNA, 25 bp, Mus musculus
gagcctgggtccagcgagtttagcc

SEQ ID NO: 655421 - DNA, 25 bp, Mus musculus
gagcctgggtcctgcgagtttagcc

SEQ ID NO: 655422 - DNA, 25 bp, Mus musculus
gagcctggtcgacctggttccccag

SEQ ID NO: 655423 - DNA, 25 bp, Mus musculus
gagcctggtcgagctggttccccag

SEQ ID NO: 655424 - DNA, 25 bp, Mus musculus
gagcctgtatgtcgcagaataccac

SEQ ID NO: 655425 - DNA, 25 bp, Mus musculus
gagcctgtatgtggcagaataccac

SEQ ID NO: 655426 - DNA, 25 bp, Mus musculus
gagcctgtccatccaagatgttcct

SEQ ID NO: 655427 - DNA, 25 bp, Mus musculus
gagcctgtccatgcaagatgttcct

SEQ ID NO: 655428 - DNA, 25 bp, Mus musculus
gagcctgtctacaggctggtggaca

SEQ ID NO: 655429 - DNA, 25 bp, Mus musculus
gagcctgtctactggctggtggaca

SEQ ID NO: 655430 - DNA, 25 bp, Mus musculus
gagcctgtgaaaagacggtctacca

SEQ ID NO: 655431 - DNA, 25 bp, Mus musculus
gagcctgtgaaatgacggtctacca

SEQ ID NO: 655432 - DNA, 25 bp, Mus musculus
gagcctgtgcaaagaatcccgcggt

SEQ ID NO: 655433 - DNA, 25 bp, Mus musculus
gagcctgtgcaatgaatcccgcggt

SEQ ID NO: 655434 - DNA, 25 bp, Mus musculus
gagcctgtgctcaagtggagaaatg

SEQ ID NO: 655435 - DNA, 25 bp, Mus musculus
gagcctgtgctccatgtagaagcag

SEQ ID NO: 655436 - DNA, 25 bp, Mus musculus
gagcctgtgctcgatgtagaagcag

SEQ ID NO: 655437 - DNA, 25 bp, Mus musculus
gagcctgtgctctagtggagaaatg

SEQ ID NO: 655438 - DNA, 25 bp, Mus musculus
gagcctgtggagaacaagtccttgc

SEQ ID NO: 655439 - DNA, 25 bp, Mus musculus
gagcctgtggagtacaagtccttgc

SEQ ID NO: 655440 - DNA, 25 bp, Mus musculus
gagcctgtggccagcgcactcggac

SEQ ID NO: 655441 - DNA, 25 bp, Mus musculus
gagcctgtggcctgcgcactcggac

SEQ ID NO: 655442 - DNA, 25 bp, Mus musculus
gagcctgtgggtcggccttctattc

SEQ ID NO: 655443 - DNA, 25 bp, Mus musculus
gagcctgtgggtgggccttctattc

SEQ ID NO: 655444 - DNA, 25 bp, Mus musculus
gagcctgtgtttccgccttgtgagc

SEQ ID NO: 655445 - DNA, 25 bp, Mus musculus
gagcctgtgtttgcgccttgtgagc

SEQ ID NO: 655446 - DNA, 25 bp, Mus musculus
gagcctgttatcagctccgtgcaca

SEQ ID NO: 655447 - DNA, 25 bp, Mus musculus
gagcctgttatctgctccgtgcaca

SEQ ID NO: 655448 - DNA, 25 bp, Mus musculus
gagcctgtttctcattacattaatg

SEQ ID NO: 655449 - DNA, 25 bp, Mus musculus
gagcctgtttctgattacattaatg

SEQ ID NO: 655450 - DNA, 25 bp, Mus musculus
gagcctgtttggcacagccatgacc

SEQ ID NO: 655451 - DNA, 25 bp, Mus musculus
gagcctgtttgggacagccatgacc

SEQ ID NO: 655452 - DNA, 25 bp, Mus musculus
gagccttaaaccagcacagtcagaa

SEQ ID NO: 655453 - DNA, 25 bp, Mus musculus
gagccttaaacctgcacagtcagaa

SEQ ID NO: 655454 - DNA, 25 bp, Mus musculus
gagccttacgatcgagcagtggact

SEQ ID NO: 655455 - DNA, 25 bp, Mus musculus
gagccttacgatggagcagtggact

SEQ ID NO: 655456 - DNA, 25 bp, Mus musculus
gagccttagaggaccagcatttgaa

SEQ ID NO: 655457 - DNA, 25 bp, Mus musculus
gagccttagaggtccagcatttgaa

SEQ ID NO: 655458 - DNA, 25 bp, Mus musculus
gagccttatataattcagacaccag

SEQ ID NO: 655459 - DNA, 25 bp, Mus musculus
gagccttatatatttcagacaccag

SEQ ID NO: 655460 - DNA, 25 bp, Mus musculus
gagccttatggcagacgggaagatc

SEQ ID NO: 655461 - DNA, 25 bp, Mus musculus
gagccttatggctgacgggaagatc

SEQ ID NO: 655462 - DNA, 25 bp, Mus musculus
gagccttcaagtaagtggaacattg

SEQ ID NO: 655463 - DNA, 25 bp, Mus musculus
gagccttcaagttagtggaacattg

SEQ ID NO: 655464 - DNA, 25 bp, Mus musculus
gagccttcagccaaggccgctgatg

SEQ ID NO: 655465 - DNA, 25 bp, Mus musculus
gagccttcagcctaggccgctgatg

SEQ ID NO: 655466 - DNA, 25 bp, Mus musculus
gagccttcaggaaaggagtcccagg

SEQ ID NO: 655467 - DNA, 25 bp, Mus musculus
gagccttcaggataggagtcccagg

SEQ ID NO: 655468 - DNA, 25 bp, Mus musculus
gagccttccatccagagctgacttt

SEQ ID NO: 655469 - DNA, 25 bp, Mus musculus
gagccttccatcgagagctgacttt

SEQ ID NO: 655470 - DNA, 25 bp, Mus musculus
gagccttcccttcagttccgaagga

SEQ ID NO: 655471 - DNA, 25 bp, Mus musculus
gagccttcccttgagttccgaagga

SEQ ID NO: 655472 - DNA, 25 bp, Mus musculus
gagccttctccaccgtttgcaaaac

SEQ ID NO: 655473 - DNA, 25 bp, Mus musculus
gagccttctccagcgtttgcaaaac

SEQ ID NO: 655474 - DNA, 25 bp, Mus musculus
gagccttctgtaagcactgacctgg

SEQ ID NO: 655475 - DNA, 25 bp, Mus musculus
gagccttctgtatgcactgacctgg

SEQ ID NO: 655476 - DNA, 25 bp, Mus musculus
gagccttctgtcaaagacctggccg

SEQ ID NO: 655477 - DNA, 25 bp, Mus musculus
gagccttctgtctaagacctggccg

SEQ ID NO: 655478 - DNA, 25 bp, Mus musculus
gagccttgcggcctcagcctcgttt

SEQ ID NO: 655479 - DNA, 25 bp, Mus musculus
gagccttgcggcgtcagcctcgttt

SEQ ID NO: 655480 - DNA, 25 bp, Mus musculus
gagccttggaacatccttcgcagtg

SEQ ID NO: 655481 - DNA, 25 bp, Mus musculus
gagccttggaacttccttcgcagtg

SEQ ID NO: 655482 - DNA, 25 bp, Mus musculus
gagccttggccaagagtgaacccaa

SEQ ID NO: 655483 - DNA, 25 bp, Mus musculus
gagccttggccatgagtgaacccaa

SEQ ID NO: 655484 - DNA, 25 bp, Mus musculus
gagccttgggacctaattatcctgc

SEQ ID NO: 655485 - DNA, 25 bp, Mus musculus
gagccttgggacgtaattatcctgc

SEQ ID NO: 655486 - DNA, 25 bp, Mus musculus
gagccttgggtccactctcatgtga

SEQ ID NO: 655487 - DNA, 25 bp, Mus musculus
gagccttgggtcgactctcatgtga

SEQ ID NO: 655488 - DNA, 25 bp, Mus musculus
gagccttgtgtcagttccttcatga

SEQ ID NO: 655489 - DNA, 25 bp, Mus musculus
gagccttgtgtctgttccttcatga

SEQ ID NO: 655490 - DNA, 25 bp, Mus musculus
gagccttgttaccaacctctaaccg

SEQ ID NO: 655491 - DNA, 25 bp, Mus musculus
gagccttgttacgaacctctaaccg

SEQ ID NO: 655492 - DNA, 25 bp, Mus musculus
gagcctttgagcatcaaaagtcagc

SEQ ID NO: 655493 - DNA, 25 bp, Mus musculus
gagcctttgagcttcaaaagtcagc

SEQ ID NO: 655494 - DNA, 25 bp, Mus musculus
gagcctttggcgagggaagcaacct

SEQ ID NO: 655495 - DNA, 25 bp, Mus musculus
gagcctttggcgtgggaagcaacct

SEQ ID NO: 655496 - DNA, 25 bp, Mus musculus
gagcctttggtcagtgcatcagaga

SEQ ID NO: 655497 - DNA, 25 bp, Mus musculus
gagcctttggtctgtgcatcagaga

SEQ ID NO: 655498 - DNA, 25 bp, Mus musculus
gagccttttcaactgcaggatcttc

SEQ ID NO: 655499 - DNA, 25 bp, Mus musculus
gagccttttcaagtgcaggatcttc

SEQ ID NO: 655500 - DNA, 25 bp, Mus musculus
gagcctttttgtacggagtctcagc

SEQ ID NO: 655501 - DNA, 25 bp, Mus musculus
gagcctttttgttcggagtctcagc

SEQ ID NO: 655502 - DNA, 25 bp, Mus musculus
gagccttttttcacttcaatcttag

SEQ ID NO: 655503 - DNA, 25 bp, Mus musculus
gagccttttttctcttcaatcttag

SEQ ID NO: 655504 - DNA, 25 bp, Mus musculus
gagcgaaagcgtaagcgcctgcgtc

SEQ ID NO: 655505 - DNA, 25 bp, Mus musculus
gagcgaaagcgttagcgcctgcgtc

SEQ ID NO: 655506 - DNA, 25 bp, Mus musculus
gagcgaactgagctcctgcataaga

SEQ ID NO: 655507 - DNA, 25 bp, Mus musculus
gagcgaactgaggtcctgcataaga

SEQ ID NO: 655508 - DNA, 25 bp, Mus musculus
gagcgaagaggcaggaagaccaact

SEQ ID NO: 655509 - DNA, 25 bp, Mus musculus
gagcgaagaggctggaagaccaact

SEQ ID NO: 655510 - DNA, 25 bp, Mus musculus
gagcgaagccctctgtatgcgacag

SEQ ID NO: 655511 - DNA, 25 bp, Mus musculus
gagcgaagccctgtgtatgcgacag

SEQ ID NO: 655512 - DNA, 25 bp, Mus musculus
gagcgaatccacataattcgaaaag

SEQ ID NO: 655513 - DNA, 25 bp, Mus musculus
gagcgaatccacttaattcgaaaag

SEQ ID NO: 655514 - DNA, 25 bp, Mus musculus
gagcgaatcctgaaccccttgctgg

SEQ ID NO: 655515 - DNA, 25 bp, Mus musculus
gagcgaatcctgtaccccttgctgg

SEQ ID NO: 655516 - DNA, 25 bp, Mus musculus
gagcgacacctgaagatccacaccg

SEQ ID NO: 655517 - DNA, 25 bp, Mus musculus
gagcgacacctgtagatccacaccg

SEQ ID NO: 655518 - DNA, 25 bp, Mus musculus
gagcgacacgttacttggcccactc

SEQ ID NO: 655519 - DNA, 25 bp, Mus musculus
gagcgacacgtttcttggcccactc

SEQ ID NO: 655520 - DNA, 25 bp, Mus musculus
gagcgacactggagtctccgtggca

SEQ ID NO: 655521 - DNA, 25 bp, Mus musculus
gagcgacactggtgtctccgtggca

SEQ ID NO: 655522 - DNA, 25 bp, Mus musculus
gagcgacagcctccatgttagccag

SEQ ID NO: 655523 - DNA, 25 bp, Mus musculus
gagcgacagcctgcatgttagccag

SEQ ID NO: 655524 - DNA, 25 bp, Mus musculus
gagcgacagttcctttctggtgaat

SEQ ID NO: 655525 - DNA, 25 bp, Mus musculus
gagcgacagttcgtttctggtgaat

SEQ ID NO: 655526 - DNA, 25 bp, Mus musculus
gagcgacagtttagagaatccagtc

SEQ ID NO: 655527 - DNA, 25 bp, Mus musculus
gagcgacagttttgagaatccagtc

SEQ ID NO: 655528 - DNA, 25 bp, Mus musculus
gagcgacatggactggaccatcaaa

SEQ ID NO: 655529 - DNA, 25 bp, Mus musculus
gagcgacatggagtggaccatcaaa

SEQ ID NO: 655530 - DNA, 25 bp, Mus musculus
gagcgaccgtatagtcacttgtggg

SEQ ID NO: 655531 - DNA, 25 bp, Mus musculus
gagcgaccgtattgtcacttgtggg

SEQ ID NO: 655532 - DNA, 25 bp, Mus musculus
gagcgactcaagactcgcatcgcgg

SEQ ID NO: 655533 - DNA, 25 bp, Mus musculus
gagcgactcaagtctcgcatcgcgg

SEQ ID NO: 655534 - DNA, 25 bp, Mus musculus
gagcgactcggcctggttctcctcg

SEQ ID NO: 655535 - DNA, 25 bp, Mus musculus
gagcgactcggcgtggttctcctcg

SEQ ID NO: 655536 - DNA, 25 bp, Mus musculus
gagcgacttgaacgccagcaagaga

SEQ ID NO: 655537 - DNA, 25 bp, Mus musculus
gagcgacttgaaggccagcaagaga

SEQ ID NO: 655538 - DNA, 25 bp, Mus musculus
gagcgagaagtgagcaaactacagg

SEQ ID NO: 655539 - DNA, 25 bp, Mus musculus
gagcgagaagtgtgcaaactacagg

SEQ ID NO: 655540 - DNA, 25 bp, Mus musculus
gagcgagacttcagtttgttccacc

SEQ ID NO: 655541 - DNA, 25 bp, Mus musculus
gagcgagacttctgtttgttccacc

SEQ ID NO: 655542 - DNA, 25 bp, Mus musculus
gagcgagatatactctgtgttcaga

SEQ ID NO: 655543 - DNA, 25 bp, Mus musculus
gagcgagatatagtctgtgttcaga

SEQ ID NO: 655544 - DNA, 25 bp, Mus musculus
gagcgagatctcagctttaaagagc

SEQ ID NO: 655545 - DNA, 25 bp, Mus musculus
gagcgagatctctgctttaaagagc

SEQ ID NO: 655546 - DNA, 25 bp, Mus musculus
gagcgagcaaaaactaaagaaaaga

SEQ ID NO: 655547 - DNA, 25 bp, Mus musculus
gagcgagcaaaatctaaagaaaaga

SEQ ID NO: 655548 - DNA, 25 bp, Mus musculus
gagcgagcactcacccgcttcatgg

SEQ ID NO: 655549 - DNA, 25 bp, Mus musculus
gagcgagcactctcccgcttcatgg

SEQ ID NO: 655550 - DNA, 25 bp, Mus musculus
gagcgagcgagaacccgaacgctcc

SEQ ID NO: 655551 - DNA, 25 bp, Mus musculus
gagcgagcgagatcccgaacgctcc

SEQ ID NO: 655552 - DNA, 25 bp, Mus musculus
gagcgagcgcgtccttgcttcaaag

SEQ ID NO: 655553 - DNA, 25 bp, Mus musculus
gagcgagcgcgtgcttgcttcaaag

SEQ ID NO: 655554 - DNA, 25 bp, Mus musculus
gagcgaggtgcacaatatggcttct

SEQ ID NO: 655555 - DNA, 25 bp, Mus musculus
gagcgaggtgcagaatatggcttct

SEQ ID NO: 655556 - DNA, 25 bp, Mus musculus
gagcgagtggacagcaccaccttac

SEQ ID NO: 655557 - DNA, 25 bp, Mus musculus
gagcgagtggactgcaccaccttac

SEQ ID NO: 655558 - DNA, 25 bp, Mus musculus
gagcgataagctctaccagcggaaa

SEQ ID NO: 655559 - DNA, 25 bp, Mus musculus
gagcgataagctgtaccagcggaaa

SEQ ID NO: 655560 - DNA, 25 bp, Mus musculus
gagcgatctacaagagctgcccagg

SEQ ID NO: 655561 - DNA, 25 bp, Mus musculus
gagcgatctacatgagctgcccagg

SEQ ID NO: 655562 - DNA, 25 bp, Mus musculus
gagcgatgtcctacaggctggctgt

SEQ ID NO: 655563 - DNA, 25 bp, Mus musculus
gagcgatgtccttcaggctggctgt

SEQ ID NO: 655564 - DNA, 25 bp, Mus musculus
gagcgatttcttcttagcagacagg

SEQ ID NO: 655565 - DNA, 25 bp, Mus musculus
gagcgatttcttgttagcagacagg

SEQ ID NO: 655566 - DNA, 25 bp, Mus musculus
gagcgcaaagccaatgataaggatg

SEQ ID NO: 655567 - DNA, 25 bp, Mus musculus
gagcgcaaagcctatgataaggatg

SEQ ID NO: 655568 - DNA, 25 bp, Mus musculus
gagcgcaagctgatcagagctgcca

SEQ ID NO: 655569 - DNA, 25 bp, Mus musculus
gagcgcaagctgttcagagctgcca

SEQ ID NO: 655570 - DNA, 25 bp, Mus musculus
gagcgcaatgaccataaactctact

SEQ ID NO: 655571 - DNA, 25 bp, Mus musculus
gagcgcaatgacgataaactctact

SEQ ID NO: 655572 - DNA, 25 bp, Mus musculus
gagcgcacagacatcgcctacgact

SEQ ID NO: 655573 - DNA, 25 bp, Mus musculus
gagcgcacagacttcgcctacgact

SEQ ID NO: 655574 - DNA, 25 bp, Mus musculus
gagcgcacgcatcctcatgaactta

SEQ ID NO: 655575 - DNA, 25 bp, Mus musculus
gagcgcacgcatgctcatgaactta

SEQ ID NO: 655576 - DNA, 25 bp, Mus musculus
gagcgcagcaaaaacttgggtgtta

SEQ ID NO: 655577 - DNA, 25 bp, Mus musculus
gagcgcagcaaatacttgggtgtta

SEQ ID NO: 655578 - DNA, 25 bp, Mus musculus
gagcgcatcaacagtctcgagggaa

SEQ ID NO: 655579 - DNA, 25 bp, Mus musculus
gagcgcatcaactgtctcgagggaa

SEQ ID NO: 655580 - DNA, 25 bp, Mus musculus
gagcgcatcagacccatggttcgag

SEQ ID NO: 655581 - DNA, 25 bp, Mus musculus
gagcgcatcagagccatggttcgag

SEQ ID NO: 655582 - DNA, 25 bp, Mus musculus
gagcgcatccacactggttatgaag

SEQ ID NO: 655583 - DNA, 25 bp, Mus musculus
gagcgcatccactctggttatgaag

SEQ ID NO: 655584 - DNA, 25 bp, Mus musculus
gagcgcatcctcactcagaacagag

SEQ ID NO: 655585 - DNA, 25 bp, Mus musculus
gagcgcatcctctctcagaacagag

SEQ ID NO: 655586 - DNA, 25 bp, Mus musculus
gagcgcatcttgattgctccaggca

SEQ ID NO: 655587 - DNA, 25 bp, Mus musculus
gagcgcatcttgtttgctccaggca

SEQ ID NO: 655588 - DNA, 25 bp, Mus musculus
gagcgcatgaataatatccacagag

SEQ ID NO: 655589 - DNA, 25 bp, Mus musculus
gagcgcatgaattatatccacagag

SEQ ID NO: 655590 - DNA, 25 bp, Mus musculus
gagcgccaagtcaggactcctggag

SEQ ID NO: 655591 - DNA, 25 bp, Mus musculus
gagcgccaagtctggactcctggag

SEQ ID NO: 655592 - DNA, 25 bp, Mus musculus
gagcgccacgttatggccatcgaca

SEQ ID NO: 655593 - DNA, 25 bp, Mus musculus
gagcgccacgttttggccatcgaca

SEQ ID NO: 655594 - DNA, 25 bp, Mus musculus
gagcgccagacacgcttccagaacg

SEQ ID NO: 655595 - DNA, 25 bp, Mus musculus
gagcgccagacaggcttccagaacg

SEQ ID NO: 655596 - DNA, 25 bp, Mus musculus
gagcgccatcatcggactcttcttc

SEQ ID NO: 655597 - DNA, 25 bp, Mus musculus
gagcgccatcatgggactcttcttc

SEQ ID NO: 655598 - DNA, 25 bp, Mus musculus
gagcgccatcgccactaacggagtg

SEQ ID NO: 655599 - DNA, 25 bp, Mus musculus
gagcgccatcgcgactaacggagtg

SEQ ID NO: 655600 - DNA, 25 bp, Mus musculus
gagcgccatgagctgatccagttca

SEQ ID NO: 655601 - DNA, 25 bp, Mus musculus
gagcgccatgaggtgatccagttca

SEQ ID NO: 655602 - DNA, 25 bp, Mus musculus
gagcgccattggataccttcactct

SEQ ID NO: 655603 - DNA, 25 bp, Mus musculus
gagcgccattggttaccttcactct

SEQ ID NO: 655604 - DNA, 25 bp, Mus musculus
gagcgccggtcgagtcagcgccaaa

SEQ ID NO: 655605 - DNA, 25 bp, Mus musculus
gagcgccggtcgtgtcagcgccaaa

SEQ ID NO: 655606 - DNA, 25 bp, Mus musculus
gagcgcctagccagggagcatgatc

SEQ ID NO: 655607 - DNA, 25 bp, Mus musculus
gagcgcctagcctgggagcatgatc

SEQ ID NO: 655608 - DNA, 25 bp, Mus musculus
gagcgcctgcaccagtcattcttct

SEQ ID NO: 655609 - DNA, 25 bp, Mus musculus
gagcgcctgcacgagtcattcttct

SEQ ID NO: 655610 - DNA, 25 bp, Mus musculus
gagcgcctgcccaatatgggcagtg

SEQ ID NO: 655611 - DNA, 25 bp, Mus musculus
gagcgcctgccctatatgggcagtg

SEQ ID NO: 655612 - DNA, 25 bp, Mus musculus
gagcgcctggagattttgtcaagca

SEQ ID NO: 655613 - DNA, 25 bp, Mus musculus
gagcgcctggagtttttgtcaagca

SEQ ID NO: 655614 - DNA, 25 bp, Mus musculus
gagcgcctggcaaagtttatgaaga

SEQ ID NO: 655615 - DNA, 25 bp, Mus musculus
gagcgcctggcatagtttatgaaga

SEQ ID NO: 655616 - DNA, 25 bp, Mus musculus
gagcgcctggccctggactatattg

SEQ ID NO: 655617 - DNA, 25 bp, Mus musculus
gagcgcctggccgtggactatattg

SEQ ID NO: 655618 - DNA, 25 bp, Mus musculus
gagcgcctggtgcacatcatctgtg

SEQ ID NO: 655619 - DNA, 25 bp, Mus musculus
gagcgcctggtggacatcatctgtg

SEQ ID NO: 655620 - DNA, 25 bp, Mus musculus
gagcgcctgttcagcatctgccaaa

SEQ ID NO: 655621 - DNA, 25 bp, Mus musculus
gagcgcctgttctgcatctgccaaa

SEQ ID NO: 655622 - DNA, 25 bp, Mus musculus
gagcgccttgacatgcggtgccgac

SEQ ID NO: 655623 - DNA, 25 bp, Mus musculus
gagcgccttgacttgcggtgccgac

SEQ ID NO: 655624 - DNA, 25 bp, Mus musculus
gagcgcgatgtgcagcgcttcttta

SEQ ID NO: 655625 - DNA, 25 bp, Mus musculus
gagcgcgatgtggagcgcttcttta

SEQ ID NO: 655626 - DNA, 25 bp, Mus musculus
gagcgcgccgagctcacctgtgtgc

SEQ ID NO: 655627 - DNA, 25 bp, Mus musculus
gagcgcgccgaggtcacctgtgtgc

SEQ ID NO: 655628 - DNA, 25 bp, Mus musculus
gagcgcgccggcagcgcgatctcta

SEQ ID NO: 655629 - DNA, 25 bp, Mus musculus
gagcgcgccggctgcgcgatctcta

SEQ ID NO: 655630 - DNA, 25 bp, Mus musculus
gagcgcgcggccatctacggcgtca

SEQ ID NO: 655631 - DNA, 25 bp, Mus musculus
gagcgcgcggccttctacggcgtca

SEQ ID NO: 655632 - DNA, 25 bp, Mus musculus
gagcgcgcttatcacatatactcga

SEQ ID NO: 655633 - DNA, 25 bp, Mus musculus
gagcgcgcttatgacatatactcga

SEQ ID NO: 655634 - DNA, 25 bp, Mus musculus
gagcgcgcttggagcccagatcttc

SEQ ID NO: 655635 - DNA, 25 bp, Mus musculus
gagcgcgcttggtgcccagatcttc

SEQ ID NO: 655636 - DNA, 25 bp, Mus musculus
gagcgcgggcgcaagttgcctcctt

SEQ ID NO: 655637 - DNA, 25 bp, Mus musculus
gagcgcgggcgctagttgcctcctt

SEQ ID NO: 655638 - DNA, 25 bp, Mus musculus
gagcgcgtacctatcgatgctgcta

SEQ ID NO: 655639 - DNA, 25 bp, Mus musculus
gagcgcgtacctttcgatgctgcta

SEQ ID NO: 655640 - DNA, 25 bp, Mus musculus
gagcgctaactcaaaaggaattcac

SEQ ID NO: 655641 - DNA, 25 bp, Mus musculus
gagcgctaactctaaaggaattcac

SEQ ID NO: 655642 - DNA, 25 bp, Mus musculus
gagcgctaattaaaacacacctgta

SEQ ID NO: 655643 - DNA, 25 bp, Mus musculus
gagcgctaattataacacacctgta

SEQ ID NO: 655644 - DNA, 25 bp, Mus musculus
gagcgctaccctctttttctggaga

SEQ ID NO: 655645 - DNA, 25 bp, Mus musculus
gagcgctaccctgtttttctggaga

SEQ ID NO: 655646 - DNA, 25 bp, Mus musculus
gagcgctacgaacccatgagcagaa

SEQ ID NO: 655647 - DNA, 25 bp, Mus musculus
gagcgctacgaagccatgagcagaa

SEQ ID NO: 655648 - DNA, 25 bp, Mus musculus
gagcgctcatagcagagagctgccc

SEQ ID NO: 655649 - DNA, 25 bp, Mus musculus
gagcgctcataggagagagctgccc

SEQ ID NO: 655650 - DNA, 25 bp, Mus musculus
gagcgctcatatcataaagttagtt

SEQ ID NO: 655651 - DNA, 25 bp, Mus musculus
gagcgctcatatgataaagttagtt

SEQ ID NO: 655652 - DNA, 25 bp, Mus musculus
gagcgctccatcaacagtgactttg

SEQ ID NO: 655653 - DNA, 25 bp, Mus musculus
gagcgctccatctacagtgactttg

SEQ ID NO: 655654 - DNA, 25 bp, Mus musculus
gagcgctctaaaatgatcgacaaga

SEQ ID NO: 655655 - DNA, 25 bp, Mus musculus
gagcgctctaaattgatcgacaaga

SEQ ID NO: 655656 - DNA, 25 bp, Mus musculus
gagcgctctcgtatgtccttgcaag

SEQ ID NO: 655657 - DNA, 25 bp, Mus musculus
gagcgctctcgtttgtccttgcaag

SEQ ID NO: 655658 - DNA, 25 bp, Mus musculus
gagcgctctgcgcagtgctgaccct

SEQ ID NO: 655659 - DNA, 25 bp, Mus musculus
gagcgctctgcggagtgctgaccct

SEQ ID NO: 655660 - DNA, 25 bp, Mus musculus
gagcgcttcaaacaaccccgtttat

SEQ ID NO: 655661 - DNA, 25 bp, Mus musculus
gagcgcttcaaagaaccccgtttat

SEQ ID NO: 655662 - DNA, 25 bp, Mus musculus
gagcgcttccagagtgacagcagct

SEQ ID NO: 655663 - DNA, 25 bp, Mus musculus
gagcgcttccagtgtgacagcagct

SEQ ID NO: 655664 - DNA, 25 bp, Mus musculus
gagcgctttatcctaaaatcataca

SEQ ID NO: 655665 - DNA, 25 bp, Mus musculus
gagcgctttatcgtaaaatcataca

SEQ ID NO: 655666 - DNA, 25 bp, Mus musculus
gagcgctttgacactctgacagacc

SEQ ID NO: 655667 - DNA, 25 bp, Mus musculus
gagcgctttgactctctgacagacc

SEQ ID NO: 655668 - DNA, 25 bp, Mus musculus
gagcgctttgataatgaggactgcc

SEQ ID NO: 655669 - DNA, 25 bp, Mus musculus
gagcgctttgattatgaggactgcc

SEQ ID NO: 655670 - DNA, 25 bp, Mus musculus
gagcggaagacaagggcgttcattc

SEQ ID NO: 655671 - DNA, 25 bp, Mus musculus
gagcggaagacatgggcgttcattc

SEQ ID NO: 655672 - DNA, 25 bp, Mus musculus
gagcggaagctcatggcacgttttg

SEQ ID NO: 655673 - DNA, 25 bp, Mus musculus
gagcggaagctcttggcacgttttg

SEQ ID NO: 655674 - DNA, 25 bp, Mus musculus
gagcggaaggctcccctcaaaacag

SEQ ID NO: 655675 - DNA, 25 bp, Mus musculus
gagcggaaggctgccctcaaaacag

SEQ ID NO: 655676 - DNA, 25 bp, Mus musculus
gagcggaccttcaccttctgtggca

SEQ ID NO: 655677 - DNA, 25 bp, Mus musculus
gagcggaccttcaggaattggatga

SEQ ID NO: 655678 - DNA, 25 bp, Mus musculus
gagcggaccttctccttctgtggca

SEQ ID NO: 655679 - DNA, 25 bp, Mus musculus
gagcggaccttctggaattggatga

SEQ ID NO: 655680 - DNA, 25 bp, Mus musculus
gagcggacgctgaggagcagaaggc

SEQ ID NO: 655681 - DNA, 25 bp, Mus musculus
gagcggacgctgtggagcagaaggc

SEQ ID NO: 655682 - DNA, 25 bp, Mus musculus
gagcggactctcagtgtgctggcct

SEQ ID NO: 655683 - DNA, 25 bp, Mus musculus
gagcggactctctgtgtgctggcct

SEQ ID NO: 655684 - DNA, 25 bp, Mus musculus
gagcggagcagcattaagaagtcca

SEQ ID NO: 655685 - DNA, 25 bp, Mus musculus
gagcggagcagctttaagaagtcca

SEQ ID NO: 655686 - DNA, 25 bp, Mus musculus
gagcggaggtgtaaaaccagtacca

SEQ ID NO: 655687 - DNA, 25 bp, Mus musculus
gagcggaggtgttaaaccagtacca

SEQ ID NO: 655688 - DNA, 25 bp, Mus musculus
gagcggagtcgcaccccggtcgact

SEQ ID NO: 655689 - DNA, 25 bp, Mus musculus
gagcggagtcgctccccggtcgact

SEQ ID NO: 655690 - DNA, 25 bp, Mus musculus
gagcggagtctcactcgcaccctgg

SEQ ID NO: 655691 - DNA, 25 bp, Mus musculus
gagcggagtctctctcgcaccctgg

SEQ ID NO: 655692 - DNA, 25 bp, Mus musculus
gagcggagttgactaccgaccttgc

SEQ ID NO: 655693 - DNA, 25 bp, Mus musculus
gagcggagttgagtaccgaccttgc

SEQ ID NO: 655694 - DNA, 25 bp, Mus musculus
gagcggatcccgacctttgagcgca

SEQ ID NO: 655695 - DNA, 25 bp, Mus musculus
gagcggatcccgtcctttgagcgca

SEQ ID NO: 655696 - DNA, 25 bp, Mus musculus
gagcggattgacaagatctggccaa

SEQ ID NO: 655697 - DNA, 25 bp, Mus musculus
gagcggattgactagatctggccaa

SEQ ID NO: 655698 - DNA, 25 bp, Mus musculus
gagcggcaccacacggtcctcatgt

SEQ ID NO: 655699 - DNA, 25 bp, Mus musculus
gagcggcaccactcggtcctcatgt

SEQ ID NO: 655700 - DNA, 25 bp, Mus musculus
gagcggcacgtgcttcaagccatca

SEQ ID NO: 655701 - DNA, 25 bp, Mus musculus
gagcggcacgtggttcaagccatca

SEQ ID NO: 655702 - DNA, 25 bp, Mus musculus
gagcggcagcgtacattgctctcca

SEQ ID NO: 655703 - DNA, 25 bp, Mus musculus
gagcggcagcgttcattgctctcca

SEQ ID NO: 655704 - DNA, 25 bp, Mus musculus
gagcggcagctgactctcatcagtg

SEQ ID NO: 655705 - DNA, 25 bp, Mus musculus
gagcggcagctgtctctcatcagtg

SEQ ID NO: 655706 - DNA, 25 bp, Mus musculus
gagcggcagggcatcttcaagccag

SEQ ID NO: 655707 - DNA, 25 bp, Mus musculus
gagcggcagggcttcttcaagccag

SEQ ID NO: 655708 - DNA, 25 bp, Mus musculus
gagcggcatcgaagattatttccac

SEQ ID NO: 655709 - DNA, 25 bp, Mus musculus
gagcggcatcgatgattatttccac

SEQ ID NO: 655710 - DNA, 25 bp, Mus musculus
gagcggccaacgactgccatttacc

SEQ ID NO: 655711 - DNA, 25 bp, Mus musculus
gagcggccaacgtctgccatttacc

SEQ ID NO: 655712 - DNA, 25 bp, Mus musculus
gagcggccccagatctggtcgaaga

SEQ ID NO: 655713 - DNA, 25 bp, Mus musculus
gagcggccccagttctggtcgaaga

SEQ ID NO: 655714 - DNA, 25 bp, Mus musculus
gagcggccccgactcatagtctcgt

SEQ ID NO: 655715 - DNA, 25 bp, Mus musculus
gagcggccccgagtcatagtctcgt

SEQ ID NO: 655716 - DNA, 25 bp, Mus musculus
gagcggcccctgcttatcttcggca

SEQ ID NO: 655717 - DNA, 25 bp, Mus musculus
gagcggcccctggttatcttcggca

SEQ ID NO: 655718 - DNA, 25 bp, Mus musculus
gagcggcgagaaagtcatggcctcc

SEQ ID NO: 655719 - DNA, 25 bp, Mus musculus
gagcggcgagaatgtcatggcctcc

SEQ ID NO: 655720 - DNA, 25 bp, Mus musculus
gagcggcgccgactttccatcgcag

SEQ ID NO: 655721 - DNA, 25 bp, Mus musculus
gagcggcgccgagtttccatcgcag

SEQ ID NO: 655722 - DNA, 25 bp, Mus musculus
gagcggctactgcactacagcagaa

SEQ ID NO: 655723 - DNA, 25 bp, Mus musculus
gagcggctactggactacagcagaa

SEQ ID NO: 655724 - DNA, 25 bp, Mus musculus
gagcggctcatgaagctcttgccct

SEQ ID NO: 655725 - DNA, 25 bp, Mus musculus
gagcggctcatgtagctcttgccct

SEQ ID NO: 655726 - DNA, 25 bp, Mus musculus
gagcggctgcggacgatttacaacc

SEQ ID NO: 655727 - DNA, 25 bp, Mus musculus
gagcggctgcggtcgatttacaacc

SEQ ID NO: 655728 - DNA, 25 bp, Mus musculus
gagcggctggagctctctgctccaa

SEQ ID NO: 655729 - DNA, 25 bp, Mus musculus
gagcggctggaggtctctgctccaa

SEQ ID NO: 655730 - DNA, 25 bp, Mus musculus
gagcggctggctcagtttgtccaac

SEQ ID NO: 655731 - DNA, 25 bp, Mus musculus
gagcggctggctgagtttgtccaac

SEQ ID NO: 655732 - DNA, 25 bp, Mus musculus
gagcggcttttcacctctcagggct

SEQ ID NO: 655733 - DNA, 25 bp, Mus musculus
gagcggcttttctcctctcagggct

SEQ ID NO: 655734 - DNA, 25 bp, Mus musculus
gagcgggagacccagaccctgatct

SEQ ID NO: 655735 - DNA, 25 bp, Mus musculus
gagcgggagaccgagaccctgatct

SEQ ID NO: 655736 - DNA, 25 bp, Mus musculus
gagcgggagcttcgccgtggccaga

SEQ ID NO: 655737 - DNA, 25 bp, Mus musculus
gagcgggagcttggccgtggccaga

SEQ ID NO: 655738 - DNA, 25 bp, Mus musculus
gagcgggagtcacccctacttcctg

SEQ ID NO: 655739 - DNA, 25 bp, Mus musculus
gagcgggagtcagccctacttcctg

SEQ ID NO: 655740 - DNA, 25 bp, Mus musculus
gagcgggcatgcactgagagtccca

SEQ ID NO: 655741 - DNA, 25 bp, Mus musculus
gagcgggcatgctctgagagtccca

SEQ ID NO: 655742 - DNA, 25 bp, Mus musculus
gagcgggccgaactcgcgttctcct

SEQ ID NO: 655743 - DNA, 25 bp, Mus musculus
gagcgggccgaagtcgcgttctcct

SEQ ID NO: 655744 - DNA, 25 bp, Mus musculus
gagcgggctcacctggcaacacaga

SEQ ID NO: 655745 - DNA, 25 bp, Mus musculus
gagcgggctcacgtggcaacacaga

SEQ ID NO: 655746 - DNA, 25 bp, Mus musculus
gagcgggtatcaagcactccatggg

SEQ ID NO: 655747 - DNA, 25 bp, Mus musculus
gagcgggtatcatgcactccatggg

SEQ ID NO: 655748 - DNA, 25 bp, Mus musculus
gagcgggtcattagtgcactgttca

SEQ ID NO: 655749 - DNA, 25 bp, Mus musculus
gagcgggtcattcggcaggcgctgc

SEQ ID NO: 655750 - DNA, 25 bp, Mus musculus
gagcgggtcattgggcaggcgctgc

SEQ ID NO: 655751 - DNA, 25 bp, Mus musculus
gagcgggtcatttgtgcactgttca

SEQ ID NO: 655752 - DNA, 25 bp, Mus musculus
gagcgggtgtgcacacctacatcat

SEQ ID NO: 655753 - DNA, 25 bp, Mus musculus
gagcgggtgtgctcacctacatcat

SEQ ID NO: 655754 - DNA, 25 bp, Mus musculus
gagcggtcaggaagctaatccaatc

SEQ ID NO: 655755 - DNA, 25 bp, Mus musculus
gagcggtcaggatgctaatccaatc

SEQ ID NO: 655756 - DNA, 25 bp, Mus musculus
gagcggtccatcacgcagatcaagt

SEQ ID NO: 655757 - DNA, 25 bp, Mus musculus
gagcggtccatctcgcagatcaagt

SEQ ID NO: 655758 - DNA, 25 bp, Mus musculus
gagcggtcggatccctctgctcctg

SEQ ID NO: 655759 - DNA, 25 bp, Mus musculus
gagcggtcggatgcctctgctcctg

SEQ ID NO: 655760 - DNA, 25 bp, Mus musculus
gagcggtctgatcctcttggacaga

SEQ ID NO: 655761 - DNA, 25 bp, Mus musculus
gagcggtctgatgctcttggacaga

SEQ ID NO: 655762 - DNA, 25 bp, Mus musculus
gagcggtgctatccacatctgggac

SEQ ID NO: 655763 - DNA, 25 bp, Mus musculus
gagcggtgctatgcacatctgggac

SEQ ID NO: 655764 - DNA, 25 bp, Mus musculus
gagcggtggtgacatgttcactcac

SEQ ID NO: 655765 - DNA, 25 bp, Mus musculus
gagcggtggtgagatgttcactcac

SEQ ID NO: 655766 - DNA, 25 bp, Mus musculus
gagcggttagaacacctaccaagtg

SEQ ID NO: 655767 - DNA, 25 bp, Mus musculus
gagcggttagaagacctaccaagtg

SEQ ID NO: 655768 - DNA, 25 bp, Mus musculus
gagcggttcacaaacctcctgagga

SEQ ID NO: 655769 - DNA, 25 bp, Mus musculus
gagcggttcacatacctcctgagga

SEQ ID NO: 655770 - DNA, 25 bp, Mus musculus
gagcggtttgccaggtaatgtacta

SEQ ID NO: 655771 - DNA, 25 bp, Mus musculus
gagcggtttgcctggtaatgtacta

SEQ ID NO: 655772 - DNA, 25 bp, Mus musculus
gagcgtaatcaacacctggtccaga

SEQ ID NO: 655773 - DNA, 25 bp, Mus musculus
gagcgtaatcaagacctggtccaga

SEQ ID NO: 655774 - DNA, 25 bp, Mus musculus
gagcgtacaggtcaattatcaaaga

SEQ ID NO: 655775 - DNA, 25 bp, Mus musculus
gagcgtacaggtgaattatcaaaga

SEQ ID NO: 655776 - DNA, 25 bp, Mus musculus
gagcgtactctcaaagtgtgtcagt

SEQ ID NO: 655777 - DNA, 25 bp, Mus musculus
gagcgtactctctaagtgtgtcagt

SEQ ID NO: 655778 - DNA, 25 bp, Mus musculus
gagcgtagttgtcacaacactcaca

SEQ ID NO: 655779 - DNA, 25 bp, Mus musculus
gagcgtagttgtgacaacactcaca

SEQ ID NO: 655780 - DNA, 25 bp, Mus musculus
gagcgtatggagagcacacttcaca

SEQ ID NO: 655781 - DNA, 25 bp, Mus musculus
gagcgtatggagtgcacacttcaca

SEQ ID NO: 655782 - DNA, 25 bp, Mus musculus
gagcgtattcataatccctggaagt

SEQ ID NO: 655783 - DNA, 25 bp, Mus musculus
gagcgtattcattatccctggaagt

SEQ ID NO: 655784 - DNA, 25 bp, Mus musculus
gagcgtcaacgccagatccagctgg

SEQ ID NO: 655785 - DNA, 25 bp, Mus musculus
gagcgtcaacgcgagatccagctgg

SEQ ID NO: 655786 - DNA, 25 bp, Mus musculus
gagcgtcagactaaacaggaagctt

SEQ ID NO: 655787 - DNA, 25 bp, Mus musculus
gagcgtcagacttaacaggaagctt

SEQ ID NO: 655788 - DNA, 25 bp, Mus musculus
gagcgtccaatgaccttgctccagc

SEQ ID NO: 655789 - DNA, 25 bp, Mus musculus
gagcgtccaatgtccttgctccagc

SEQ ID NO: 655790 - DNA, 25 bp, Mus musculus
gagcgtccaggaccagctaccgctg

SEQ ID NO: 655791 - DNA, 25 bp, Mus musculus
gagcgtccaggagcagctaccgctg

SEQ ID NO: 655792 - DNA, 25 bp, Mus musculus
gagcgtccatgtaaataattaaagc

SEQ ID NO: 655793 - DNA, 25 bp, Mus musculus
gagcgtccatgttaataattaaagc

SEQ ID NO: 655794 - DNA, 25 bp, Mus musculus
gagcgtcgacggaagactctccaga

SEQ ID NO: 655795 - DNA, 25 bp, Mus musculus
gagcgtcgacggtagactctccaga

SEQ ID NO: 655796 - DNA, 25 bp, Mus musculus
gagcgtctctccacgtggaatttgt

SEQ ID NO: 655797 - DNA, 25 bp, Mus musculus
gagcgtctctcctcgtggaatttgt

SEQ ID NO: 655798 - DNA, 25 bp, Mus musculus
gagcgtctggtgactccaggatatg

SEQ ID NO: 655799 - DNA, 25 bp, Mus musculus
gagcgtctggtgtctccaggatatg

SEQ ID NO: 655800 - DNA, 25 bp, Mus musculus
gagcgtcttcagcatgcttatcaag

SEQ ID NO: 655801 - DNA, 25 bp, Mus musculus
gagcgtcttcaggatgcttatcaag

SEQ ID NO: 655802 - DNA, 25 bp, Mus musculus
gagcgtctttgaacttttccgaggc

SEQ ID NO: 655803 - DNA, 25 bp, Mus musculus
gagcgtctttgatcttttccgaggc

SEQ ID NO: 655804 - DNA, 25 bp, Mus musculus
gagcgtgaccaccttgagtttcagc

SEQ ID NO: 655805 - DNA, 25 bp, Mus musculus
gagcgtgaccacgttgagtttcagc

SEQ ID NO: 655806 - DNA, 25 bp, Mus musculus
gagcgtgcaaccattggaaataact

SEQ ID NO: 655807 - DNA, 25 bp, Mus musculus
gagcgtgcaacctttggaaataact

SEQ ID NO: 655808 - DNA, 25 bp, Mus musculus
gagcgtgccaacctgcaaacgaaag

SEQ ID NO: 655809 - DNA, 25 bp, Mus musculus
gagcgtgccaacgtgcaaacgaaag

SEQ ID NO: 655810 - DNA, 25 bp, Mus musculus
gagcgtgctggtcccttatgagcca

SEQ ID NO: 655811 - DNA, 25 bp, Mus musculus
gagcgtgctggtgccttatgagcca

SEQ ID NO: 655812 - DNA, 25 bp, Mus musculus
gagcgtgtcatcaacgaagagtata

SEQ ID NO: 655813 - DNA, 25 bp, Mus musculus
gagcgtgtcatctacgaagagtata

SEQ ID NO: 655814 - DNA, 25 bp, Mus musculus
gagcgtgtctttcccgcacttcaga

SEQ ID NO: 655815 - DNA, 25 bp, Mus musculus
gagcgtgtctttgccgcacttcaga

SEQ ID NO: 655816 - DNA, 25 bp, Mus musculus
gagcgtgtggccaagtctaaccgct

SEQ ID NO: 655817 - DNA, 25 bp, Mus musculus
gagcgtgtggcctagtctaaccgct

SEQ ID NO: 655818 - DNA, 25 bp, Mus musculus
gagcgtgtggctaccacttctgctg

SEQ ID NO: 655819 - DNA, 25 bp, Mus musculus
gagcgtgtggcttccacttctgctg

SEQ ID NO: 655820 - DNA, 25 bp, Mus musculus
gagcgttaccagcaggcccttccta

SEQ ID NO: 655821 - DNA, 25 bp, Mus musculus
gagcgttaccaggaggcccttccta

SEQ ID NO: 655822 - DNA, 25 bp, Mus musculus
gagcgttatcatccacctcttatca

SEQ ID NO: 655823 - DNA, 25 bp, Mus musculus
gagcgttatcatgcacctcttatca

SEQ ID NO: 655824 - DNA, 25 bp, Mus musculus
gagcgttcagttaccgaacagttga

SEQ ID NO: 655825 - DNA, 25 bp, Mus musculus
gagcgttcagtttccgaacagttga

SEQ ID NO: 655826 - DNA, 25 bp, Mus musculus
gagcgttcgtgcacccacggaggct

SEQ ID NO: 655827 - DNA, 25 bp, Mus musculus
gagcgttcgtgctcccacggaggct

SEQ ID NO: 655828 - DNA, 25 bp, Mus musculus
gagcgttgcatgagtcttgaagaga

SEQ ID NO: 655829 - DNA, 25 bp, Mus musculus
gagcgttgcatgtgtcttgaagaga

SEQ ID NO: 655830 - DNA, 25 bp, Mus musculus
gagcgtttcagaacaacacctttaa

SEQ ID NO: 655831 - DNA, 25 bp, Mus musculus
gagcgtttcagatcaacacctttaa

SEQ ID NO: 655832 - DNA, 25 bp, Mus musculus
gagcgtttctgaccactttccagct

SEQ ID NO: 655833 - DNA, 25 bp, Mus musculus
gagcgtttctgagcactttccagct

SEQ ID NO: 655834 - DNA, 25 bp, Mus musculus
gagcgtttctgtccagctactaccg

SEQ ID NO: 655835 - DNA, 25 bp, Mus musculus
gagcgtttctgtgcagctactaccg

SEQ ID NO: 655836 - DNA, 25 bp, Mus musculus
gagcgtttgctgcaaactgctggca

SEQ ID NO: 655837 - DNA, 25 bp, Mus musculus
gagcgtttgctggaaactgctggca

SEQ ID NO: 655838 - DNA, 25 bp, Mus musculus
gagcgtttgtctatgatgtactaca

SEQ ID NO: 655839 - DNA, 25 bp, Mus musculus
gagcgtttgtctttgatgtactaca

SEQ ID NO: 655840 - DNA, 25 bp, Mus musculus
gagctaaaaatgaccttggacttgg

SEQ ID NO: 655841 - DNA, 25 bp, Mus musculus
gagctaaaaatgtccttggacttgg

SEQ ID NO: 655842 - DNA, 25 bp, Mus musculus
gagctaaactcacgctctacttgga

SEQ ID NO: 655843 - DNA, 25 bp, Mus musculus
gagctaaactcaggctctacttgga

SEQ ID NO: 655844 - DNA, 25 bp, Mus musculus
gagctaaagaagaggcactacaaaa

SEQ ID NO: 655845 - DNA, 25 bp, Mus musculus
gagctaaagaagtggcactacaaaa

SEQ ID NO: 655846 - DNA, 25 bp, Mus musculus
gagctaactgaactgaatgtgggca

SEQ ID NO: 655847 - DNA, 25 bp, Mus musculus
gagctaactgaagtgaatgtgggca

SEQ ID NO: 655848 - DNA, 25 bp, Mus musculus
gagctaactgttctctctttctcct

SEQ ID NO: 655849 - DNA, 25 bp, Mus musculus
gagctaactgttgtctctttctcct

SEQ ID NO: 655850 - DNA, 25 bp, Mus musculus
gagctaaggcctataagctgtttta

SEQ ID NO: 655851 - DNA, 25 bp, Mus musculus
gagctaaggcctctgcgggtttttt

SEQ ID NO: 655852 - DNA, 25 bp, Mus musculus
gagctaaggcctgtgcgggtttttt

SEQ ID NO: 655853 - DNA, 25 bp, Mus musculus
gagctaaggcctttaagctgtttta

SEQ ID NO: 655854 - DNA, 25 bp, Mus musculus
gagctaagggctccctggttcaaag

SEQ ID NO: 655855 - DNA, 25 bp, Mus musculus
gagctaagggctgcctggttcaaag

SEQ ID NO: 655856 - DNA, 25 bp, Mus musculus
gagctaagtcttcagtcccaccctg

SEQ ID NO: 655857 - DNA, 25 bp, Mus musculus
gagctaagtcttgagtcccaccctg

SEQ ID NO: 655858 - DNA, 25 bp, Mus musculus
gagctaagttcccagtcaagtggtg

SEQ ID NO: 655859 - DNA, 25 bp, Mus musculus
gagctaagttccgagtcaagtggtg

SEQ ID NO: 655860 - DNA, 25 bp, Mus musculus
gagctaatagcaacggctccaccag

SEQ ID NO: 655861 - DNA, 25 bp, Mus musculus
gagctaatagcatcggctccaccag

SEQ ID NO: 655862 - DNA, 25 bp, Mus musculus
gagctaatcaacaatgtcgccaaag

SEQ ID NO: 655863 - DNA, 25 bp, Mus musculus
gagctaatcaactatgtcgccaaag

SEQ ID NO: 655864 - DNA, 25 bp, Mus musculus
gagctaatccaacgaggtttccttt

SEQ ID NO: 655865 - DNA, 25 bp, Mus musculus
gagctaatccaaggaggtttccttt

SEQ ID NO: 655866 - DNA, 25 bp, Mus musculus
gagctaatgagcaaggagggcttcc

SEQ ID NO: 655867 - DNA, 25 bp, Mus musculus
gagctaatgagctaggagggcttcc

SEQ ID NO: 655868 - DNA, 25 bp, Mus musculus
gagctaatggagctgcaacatttcc

SEQ ID NO: 655869 - DNA, 25 bp, Mus musculus
gagctaatggaggtgcaacatttcc

SEQ ID NO: 655870 - DNA, 25 bp, Mus musculus
gagctaattacaccattttgaaggg

SEQ ID NO: 655871 - DNA, 25 bp, Mus musculus
gagctaattacagcattttgaaggg

SEQ ID NO: 655872 - DNA, 25 bp, Mus musculus
gagctaattcccatctgttcacgga

SEQ ID NO: 655873 - DNA, 25 bp, Mus musculus
gagctaattcccttctgttcacgga

SEQ ID NO: 655874 - DNA, 25 bp, Mus musculus
gagctaattggaaagtgtaactgta

SEQ ID NO: 655875 - DNA, 25 bp, Mus musculus
gagctaattggatagtgtaactgta

SEQ ID NO: 655876 - DNA, 25 bp, Mus musculus
gagctacacatgacttccagtccaa

SEQ ID NO: 655877 - DNA, 25 bp, Mus musculus
gagctacacatgtcttccagtccaa

SEQ ID NO: 655878 - DNA, 25 bp, Mus musculus
gagctacacgggaacaaagccctgg

SEQ ID NO: 655879 - DNA, 25 bp, Mus musculus
gagctacacgggtacaaagccctgg

SEQ ID NO: 655880 - DNA, 25 bp, Mus musculus
gagctacagacacggtttcggcaac

SEQ ID NO: 655881 - DNA, 25 bp, Mus musculus
gagctacagacagggtttcggcaac

SEQ ID NO: 655882 - DNA, 25 bp, Mus musculus
gagctacagtgaccgccaggaagat

SEQ ID NO: 655883 - DNA, 25 bp, Mus musculus
gagctacagtgagcgccaggaagat

SEQ ID NO: 655884 - DNA, 25 bp, Mus musculus
gagctacccaagaccgcagtgcagc

SEQ ID NO: 655885 - DNA, 25 bp, Mus musculus
gagctacccaagtccgcagtgcagc

SEQ ID NO: 655886 - DNA, 25 bp, Mus musculus
gagctaccgaaaatgaattggctaa

SEQ ID NO: 655887 - DNA, 25 bp, Mus musculus
gagctaccgaaattgaattggctaa

SEQ ID NO: 655888 - DNA, 25 bp, Mus musculus
gagctacctggcagttgcctccact

SEQ ID NO: 655889 - DNA, 25 bp, Mus musculus
gagctacctggctgttgcctccact

SEQ ID NO: 655890 - DNA, 25 bp, Mus musculus
gagctacggtatctgagcagcccaa

SEQ ID NO: 655891 - DNA, 25 bp, Mus musculus
gagctacggtatgtgagcagcccaa

SEQ ID NO: 655892 - DNA, 25 bp, Mus musculus
gagctacgtggaaaacttgatgtgc

SEQ ID NO: 655893 - DNA, 25 bp, Mus musculus
gagctacgtggataacttgatgtgc

SEQ ID NO: 655894 - DNA, 25 bp, Mus musculus
gagctacgtgtcagagatccagcag

SEQ ID NO: 655895 - DNA, 25 bp, Mus musculus
gagctacgtgtctgagatccagcag

SEQ ID NO: 655896 - DNA, 25 bp, Mus musculus
gagctactatacacgcattctgccc

SEQ ID NO: 655897 - DNA, 25 bp, Mus musculus
gagctactatactcgcattctgccc

SEQ ID NO: 655898 - DNA, 25 bp, Mus musculus
gagctacttccaaattctacatctt

SEQ ID NO: 655899 - DNA, 25 bp, Mus musculus
gagctacttccatattctacatctt

SEQ ID NO: 655900 - DNA, 25 bp, Mus musculus
gagctacttgggactgcagaaacac

SEQ ID NO: 655901 - DNA, 25 bp, Mus musculus
gagctacttgggtctgcagaaacac

SEQ ID NO: 655902 - DNA, 25 bp, Mus musculus
gagctagaaagacggccaagagtcc

SEQ ID NO: 655903 - DNA, 25 bp, Mus musculus
gagctagaaagagggccaagagtcc

SEQ ID NO: 655904 - DNA, 25 bp, Mus musculus
gagctagaagcgatcaaagctcgag

SEQ ID NO: 655905 - DNA, 25 bp, Mus musculus
gagctagaagcgttcaaagctcgag

SEQ ID NO: 655906 - DNA, 25 bp, Mus musculus
gagctagaagctcgtacaaatggga

SEQ ID NO: 655907 - DNA, 25 bp, Mus musculus
gagctagaagctggtacaaatggga

SEQ ID NO: 655908 - DNA, 25 bp, Mus musculus
gagctagagctcaggcacgagaatt

SEQ ID NO: 655909 - DNA, 25 bp, Mus musculus
gagctagagctctggcacgagaatt

SEQ ID NO: 655910 - DNA, 25 bp, Mus musculus
gagctagaggttctgtccttgcaca

SEQ ID NO: 655911 - DNA, 25 bp, Mus musculus
gagctagaggttgtgtccttgcaca

SEQ ID NO: 655912 - DNA, 25 bp, Mus musculus
gagctagatcccagaaaccaggaca

SEQ ID NO: 655913 - DNA, 25 bp, Mus musculus
gagctagatccctgaaaccaggaca

SEQ ID NO: 655914 - DNA, 25 bp, Mus musculus
gagctagcaagaagagccagtcagt

SEQ ID NO: 655915 - DNA, 25 bp, Mus musculus
gagctagcaagatgagccagtcagt

SEQ ID NO: 655916 - DNA, 25 bp, Mus musculus
gagctagcagcaacaccttatgttt

SEQ ID NO: 655917 - DNA, 25 bp, Mus musculus
gagctagcagcatcaccttatgttt

SEQ ID NO: 655918 - DNA, 25 bp, Mus musculus
gagctagccaccaagtacgcaaact

SEQ ID NO: 655919 - DNA, 25 bp, Mus musculus
gagctagccacctagtacgcaaact

SEQ ID NO: 655920 - DNA, 25 bp, Mus musculus
gagctagcctatcttgttcccacga

SEQ ID NO: 655921 - DNA, 25 bp, Mus musculus
gagctagcctatgttgttcccacga

SEQ ID NO: 655922 - DNA, 25 bp, Mus musculus
gagctagcgggcacacctgcatcaa

SEQ ID NO: 655923 - DNA, 25 bp, Mus musculus
gagctagcgggctcacctgcatcaa

SEQ ID NO: 655924 - DNA, 25 bp, Mus musculus
gagctagctaccctcaaaggcaaca

SEQ ID NO: 655925 - DNA, 25 bp, Mus musculus
gagctagctaccgtcaaaggcaaca

SEQ ID NO: 655926 - DNA, 25 bp, Mus musculus
gagctagctactcacctgattgaca

SEQ ID NO: 655927 - DNA, 25 bp, Mus musculus
gagctagctactgacctgattgaca

SEQ ID NO: 655928 - DNA, 25 bp, Mus musculus
gagctagctcaccagctggccactg

SEQ ID NO: 655929 - DNA, 25 bp, Mus musculus
gagctagctcacgagctggccactg

SEQ ID NO: 655930 - DNA, 25 bp, Mus musculus
gagctagctgagatgctgcctcctg

SEQ ID NO: 655931 - DNA, 25 bp, Mus musculus
gagctagctgagttgctgcctcctg

SEQ ID NO: 655932 - DNA, 25 bp, Mus musculus
gagctaggaatccacatctgtcgcc

SEQ ID NO: 655933 - DNA, 25 bp, Mus musculus
gagctaggaatccattctatgcgtg

SEQ ID NO: 655934 - DNA, 25 bp, Mus musculus
gagctaggaatcgacatctgtcgcc

SEQ ID NO: 655935 - DNA, 25 bp, Mus musculus
gagctaggaatcgattctatgcgtg

SEQ ID NO: 655936 - DNA, 25 bp, Mus musculus
gagctaggcagcacctttccggaga

SEQ ID NO: 655937 - DNA, 25 bp, Mus musculus
gagctaggcagctcctttccggaga

SEQ ID NO: 655938 - DNA, 25 bp, Mus musculus
gagctaggctcgcaactacaattcc

SEQ ID NO: 655939 - DNA, 25 bp, Mus musculus
gagctaggctcggaactacaattcc

SEQ ID NO: 655940 - DNA, 25 bp, Mus musculus
gagctaggtactagggctgcccaga

SEQ ID NO: 655941 - DNA, 25 bp, Mus musculus
gagctaggtacttgggctgcccaga

SEQ ID NO: 655942 - DNA, 25 bp, Mus musculus
gagctagtcaaaagtggcatccaga

SEQ ID NO: 655943 - DNA, 25 bp, Mus musculus
gagctagtcaaatgtggcatccaga

SEQ ID NO: 655944 - DNA, 25 bp, Mus musculus
gagctagtgactattgccaaataca

SEQ ID NO: 655945 - DNA, 25 bp, Mus musculus
gagctagtgacttttgccaaataca

SEQ ID NO: 655946 - DNA, 25 bp, Mus musculus
gagctagtggcacatgaacctgctg

SEQ ID NO: 655947 - DNA, 25 bp, Mus musculus
gagctagtggcagatgaacctgctg

SEQ ID NO: 655948 - DNA, 25 bp, Mus musculus
gagctagttctcaccgacctttcag

SEQ ID NO: 655949 - DNA, 25 bp, Mus musculus
gagctagttctctccgacctttcag

SEQ ID NO: 655950 - DNA, 25 bp, Mus musculus
gagctagttggtatgtggccattgc

SEQ ID NO: 655951 - DNA, 25 bp, Mus musculus
gagctagttggtttgtggccattgc

SEQ ID NO: 655952 - DNA, 25 bp, Mus musculus
gagctatagtgccaaatttgcctcc

SEQ ID NO: 655953 - DNA, 25 bp, Mus musculus
gagctatagtgcgaaatttgcctcc

SEQ ID NO: 655954 - DNA, 25 bp, Mus musculus
gagctatcaaatccaattacattaa

SEQ ID NO: 655955 - DNA, 25 bp, Mus musculus
gagctatcaaatgcaattacattaa

SEQ ID NO: 655956 - DNA, 25 bp, Mus musculus
gagctatccagcagtcacggtcctg

SEQ ID NO: 655957 - DNA, 25 bp, Mus musculus
gagctatccagctgtcacggtcctg

SEQ ID NO: 655958 - DNA, 25 bp, Mus musculus
gagctatccggtcccatccttgtcg

SEQ ID NO: 655959 - DNA, 25 bp, Mus musculus
gagctatccggtgccatccttgtcg

SEQ ID NO: 655960 - DNA, 25 bp, Mus musculus
gagctatcgcttcagcccaagattg

SEQ ID NO: 655961 - DNA, 25 bp, Mus musculus
gagctatcgcttgagcccaagattg

SEQ ID NO: 655962 - DNA, 25 bp, Mus musculus
gagctatcggttctctgcggccgta

SEQ ID NO: 655963 - DNA, 25 bp, Mus musculus
gagctatcggttgtctgcggccgta

SEQ ID NO: 655964 - DNA, 25 bp, Mus musculus
gagctatctggacggaagtcttctg

SEQ ID NO: 655965 - DNA, 25 bp, Mus musculus
gagctatctggagggaagtcttctg

SEQ ID NO: 655966 - DNA, 25 bp, Mus musculus
gagctatgaagtaccggaatttgtg

SEQ ID NO: 655967 - DNA, 25 bp, Mus musculus
gagctatgaagttccggaatttgtg

SEQ ID NO: 655968 - DNA, 25 bp, Mus musculus
gagctatgagcacaacatcaagcag

SEQ ID NO: 655969 - DNA, 25 bp, Mus musculus
gagctatgagcagaacatcaagcag

SEQ ID NO: 655970 - DNA, 25 bp, Mus musculus
gagctatgcactacacgggtgctgg

SEQ ID NO: 655971 - DNA, 25 bp, Mus musculus
gagctatgcacttcacgggtgctgg

SEQ ID NO: 655972 - DNA, 25 bp, Mus musculus
gagctatgctgacttgtgcagtaca

SEQ ID NO: 655973 - DNA, 25 bp, Mus musculus
gagctatgctgagttgtgcagtaca

SEQ ID NO: 655974 - DNA, 25 bp, Mus musculus
gagctatggatcagctctctcccca

SEQ ID NO: 655975 - DNA, 25 bp, Mus musculus
gagctatggatctgctctctcccca

SEQ ID NO: 655976 - DNA, 25 bp, Mus musculus
gagctatgtaggcattcatcaacag

SEQ ID NO: 655977 - DNA, 25 bp, Mus musculus
gagctatgtagggattcatcaacag

SEQ ID NO: 655978 - DNA, 25 bp, Mus musculus
gagctatgtgaaaggaaccgaacaa

SEQ ID NO: 655979 - DNA, 25 bp, Mus musculus
gagctatgtgaatggaaccgaacaa

SEQ ID NO: 655980 - DNA, 25 bp, Mus musculus
gagctatgtgagcttgaccctgctt

SEQ ID NO: 655981 - DNA, 25 bp, Mus musculus
gagctatgtgaggttgaccctgctt

SEQ ID NO: 655982 - DNA, 25 bp, Mus musculus
gagctattcatgcaatttgcacaca

SEQ ID NO: 655983 - DNA, 25 bp, Mus musculus
gagctattcatggaatttgcacaca

SEQ ID NO: 655984 - DNA, 25 bp, Mus musculus
gagctcaacaggctgcctagtccgg

SEQ ID NO: 655985 - DNA, 25 bp, Mus musculus
gagctcaacagggtgcctagtccgg

SEQ ID NO: 655986 - DNA, 25 bp, Mus musculus
gagctcaactaaccagtctggcctt

SEQ ID NO: 655987 - DNA, 25 bp, Mus musculus
gagctcaactaagcagtctggcctt

SEQ ID NO: 655988 - DNA, 25 bp, Mus musculus
gagctcaagatgatgtaatcaaccc

SEQ ID NO: 655989 - DNA, 25 bp, Mus musculus
gagctcaagatgttgtaatcaaccc

SEQ ID NO: 655990 - DNA, 25 bp, Mus musculus
gagctcaagtttaaagtaccctggg

SEQ ID NO: 655991 - DNA, 25 bp, Mus musculus
gagctcaagttttaagtaccctggg

SEQ ID NO: 655992 - DNA, 25 bp, Mus musculus
gagctcacagatcagccccgagtgg

SEQ ID NO: 655993 - DNA, 25 bp, Mus musculus
gagctcacagatgagccccgagtgg

SEQ ID NO: 655994 - DNA, 25 bp, Mus musculus
gagctcacagcccagattgcaggca

SEQ ID NO: 655995 - DNA, 25 bp, Mus musculus
gagctcacagccgagattgcaggca

SEQ ID NO: 655996 - DNA, 25 bp, Mus musculus
gagctcaccactcctcaatgacaaa

SEQ ID NO: 655997 - DNA, 25 bp, Mus musculus
gagctcaccactgctcaatgacaaa

SEQ ID NO: 655998 - DNA, 25 bp, Mus musculus
gagctcaccgttcttggtttgctgg

SEQ ID NO: 655999 - DNA, 25 bp, Mus musculus
gagctcaccgttgttggtttgctgg

SEQ ID NO: 656000 - DNA, 25 bp, Mus musculus
gagctcactcagcaccaaagccatg

SEQ ID NO: 656001 - DNA, 25 bp, Mus musculus
gagctcactcaggaccaaagccatg

SEQ ID NO: 656002 - DNA, 25 bp, Mus musculus
gagctcagaagtccaagatacactg

SEQ ID NO: 656003 - DNA, 25 bp, Mus musculus
gagctcagaagtgcaagatacactg

SEQ ID NO: 656004 - DNA, 25 bp, Mus musculus
gagctcagctgccattaagtcccca

SEQ ID NO: 656005 - DNA, 25 bp, Mus musculus
gagctcagctgcgattaagtcccca

SEQ ID NO: 656006 - DNA, 25 bp, Mus musculus
gagctcagctttagggagcctttgt

SEQ ID NO: 656007 - DNA, 25 bp, Mus musculus
gagctcagcttttgggagcctttgt

SEQ ID NO: 656008 - DNA, 25 bp, Mus musculus
gagctcaggagcaaggagccacaga

SEQ ID NO: 656009 - DNA, 25 bp, Mus musculus
gagctcaggagctaggagccacaga

SEQ ID NO: 656010 - DNA, 25 bp, Mus musculus
gagctcaggcaacgttgacctctat

SEQ ID NO: 656011 - DNA, 25 bp, Mus musculus
gagctcaggcaaggttgacctctat

SEQ ID NO: 656012 - DNA, 25 bp, Mus musculus
gagctcaggtttcgcactcggatct

SEQ ID NO: 656013 - DNA, 25 bp, Mus musculus
gagctcaggtttggcactcggatct

SEQ ID NO: 656014 - DNA, 25 bp, Mus musculus
gagctcagtcgaattggaaggtcca

SEQ ID NO: 656015 - DNA, 25 bp, Mus musculus
gagctcagtcgatttggaaggtcca

SEQ ID NO: 656016 - DNA, 25 bp, Mus musculus
gagctcatacagagcttgcttctct

SEQ ID NO: 656017 - DNA, 25 bp, Mus musculus
gagctcatacagtgcttgcttctct

SEQ ID NO: 656018 - DNA, 25 bp, Mus musculus
gagctcatagaccagcttgagtgca

SEQ ID NO: 656019 - DNA, 25 bp, Mus musculus
gagctcatagacgagcttgagtgca

SEQ ID NO: 656020 - DNA, 25 bp, Mus musculus
gagctcatagagaccaaccagcaac

SEQ ID NO: 656021 - DNA, 25 bp, Mus musculus
gagctcatagagtccaaccagcaac

SEQ ID NO: 656022 - DNA, 25 bp, Mus musculus
gagctcatcaggctagccggatcta

SEQ ID NO: 656023 - DNA, 25 bp, Mus musculus
gagctcatcagggtagccggatcta

SEQ ID NO: 656024 - DNA, 25 bp, Mus musculus
gagctcatcttacccggcaaggatg

SEQ ID NO: 656025 - DNA, 25 bp, Mus musculus
gagctcatcttagccggcaaggatg

SEQ ID NO: 656026 - DNA, 25 bp, Mus musculus
gagctcatgaggatgctagctgaag

SEQ ID NO: 656027 - DNA, 25 bp, Mus musculus
gagctcatgaggttgctagctgaag

SEQ ID NO: 656028 - DNA, 25 bp, Mus musculus
gagctcatgcaactgaaggctgaag

SEQ ID NO: 656029 - DNA, 25 bp, Mus musculus
gagctcatgcaagtgaaggctgaag

SEQ ID NO: 656030 - DNA, 25 bp, Mus musculus
gagctcatgcatcctgtcaaggaag

SEQ ID NO: 656031 - DNA, 25 bp, Mus musculus
gagctcatgcatgctgtcaaggaag

SEQ ID NO: 656032 - DNA, 25 bp, Mus musculus
gagctcatggacagagatggcgcct

SEQ ID NO: 656033 - DNA, 25 bp, Mus musculus
gagctcatggactgagatggcgcct

SEQ ID NO: 656034 - DNA, 25 bp, Mus musculus
gagctcatggtcactgatggctggc

SEQ ID NO: 656035 - DNA, 25 bp, Mus musculus
gagctcatggtctctgatggctggc

SEQ ID NO: 656036 - DNA, 25 bp, Mus musculus
gagctcattgtgaggattaccagtc

SEQ ID NO: 656037 - DNA, 25 bp, Mus musculus
gagctcattgtgtggattaccagtc

SEQ ID NO: 656038 - DNA, 25 bp, Mus musculus
gagctccaaacaccttcttggtgac

SEQ ID NO: 656039 - DNA, 25 bp, Mus musculus
gagctccaaacagcttcttggtgac

SEQ ID NO: 656040 - DNA, 25 bp, Mus musculus
gagctccaaagaatgaagatgtatc

SEQ ID NO: 656041 - DNA, 25 bp, Mus musculus
gagctccaaagattgaagatgtatc

SEQ ID NO: 656042 - DNA, 25 bp, Mus musculus
gagctccaccctcggacagaggaaa

SEQ ID NO: 656043 - DNA, 25 bp, Mus musculus
gagctccaccctgggacagaggaaa

SEQ ID NO: 656044 - DNA, 25 bp, Mus musculus
gagctccagactaaccgctaccatg

SEQ ID NO: 656045 - DNA, 25 bp, Mus musculus
gagctccagacttaccgctaccatg

SEQ ID NO: 656046 - DNA, 25 bp, Mus musculus
gagctccaggacaccagtttgacag

SEQ ID NO: 656047 - DNA, 25 bp, Mus musculus
gagctccaggactccagtttgacag

SEQ ID NO: 656048 - DNA, 25 bp, Mus musculus
gagctccaggccatgaactttgaag

SEQ ID NO: 656049 - DNA, 25 bp, Mus musculus
gagctccaggccttgaactttgaag

SEQ ID NO: 656050 - DNA, 25 bp, Mus musculus
gagctcccagcgagcctggatgagt

SEQ ID NO: 656051 - DNA, 25 bp, Mus musculus
gagctcccagcgtgcctggatgagt

SEQ ID NO: 656052 - DNA, 25 bp, Mus musculus
gagctccccagtatccaggagagtg

SEQ ID NO: 656053 - DNA, 25 bp, Mus musculus
gagctccccagtttccaggagagtg

SEQ ID NO: 656054 - DNA, 25 bp, Mus musculus
gagctcccgggcactagtgtcctgg

SEQ ID NO: 656055 - DNA, 25 bp, Mus musculus
gagctcccgggctctagtgtcctgg

SEQ ID NO: 656056 - DNA, 25 bp, Mus musculus
gagctccctcagcacacaaggctgt

SEQ ID NO: 656057 - DNA, 25 bp, Mus musculus
gagctccctcaggacacaaggctgt

SEQ ID NO: 656058 - DNA, 25 bp, Mus musculus
gagctccctccaaagatacaagcgg

SEQ ID NO: 656059 - DNA, 25 bp, Mus musculus
gagctccctccatagatacaagcgg

SEQ ID NO: 656060 - DNA, 25 bp, Mus musculus
gagctccctgatccgagcagcaaat

SEQ ID NO: 656061 - DNA, 25 bp, Mus musculus
gagctccctgatgcgagcagcaaat

SEQ ID NO: 656062 - DNA, 25 bp, Mus musculus
gagctccgagcccatcgcaaggact

SEQ ID NO: 656063 - DNA, 25 bp, Mus musculus
gagctccgagccctgaaacagagaa

SEQ ID NO: 656064 - DNA, 25 bp, Mus musculus
gagctccgagccgatcgcaaggact

SEQ ID NO: 656065 - DNA, 25 bp, Mus musculus
gagctccgagccgtgaaacagagaa

SEQ ID NO: 656066 - DNA, 25 bp, Mus musculus
gagctccgccataccgatcatcatg

SEQ ID NO: 656067 - DNA, 25 bp, Mus musculus
gagctccgccattccgatcatcatg

SEQ ID NO: 656068 - DNA, 25 bp, Mus musculus
gagctccggcaccttggctctgcag

SEQ ID NO: 656069 - DNA, 25 bp, Mus musculus
gagctccggcacgttggctctgcag

SEQ ID NO: 656070 - DNA, 25 bp, Mus musculus
gagctccgggaacaaattgacaacc

SEQ ID NO: 656071 - DNA, 25 bp, Mus musculus
gagctccgggaagaaattgacaacc

SEQ ID NO: 656072 - DNA, 25 bp, Mus musculus
gagctccgtgcaaccggcaactcgg

SEQ ID NO: 656073 - DNA, 25 bp, Mus musculus
gagctccgtgcatccggcaactcgg

SEQ ID NO: 656074 - DNA, 25 bp, Mus musculus
gagctcctagatcgagcaggtgcca

SEQ ID NO: 656075 - DNA, 25 bp, Mus musculus
gagctcctagatggagcaggtgcca

SEQ ID NO: 656076 - DNA, 25 bp, Mus musculus
gagctcctaggtactggtaacacca

SEQ ID NO: 656077 - DNA, 25 bp, Mus musculus
gagctcctaggttctggtaacacca

SEQ ID NO: 656078 - DNA, 25 bp, Mus musculus
gagctcctcacaaattgttcttgtc

SEQ ID NO: 656079 - DNA, 25 bp, Mus musculus
gagctcctcacatattgttcttgtc

SEQ ID NO: 656080 - DNA, 25 bp, Mus musculus
gagctcctctcaagcgaaaggagga

SEQ ID NO: 656081 - DNA, 25 bp, Mus musculus
gagctcctctcatgcgaaaggagga

SEQ ID NO: 656082 - DNA, 25 bp, Mus musculus
gagctcctgaagatcgtgaaccgga

SEQ ID NO: 656083 - DNA, 25 bp, Mus musculus
gagctcctgaagttcgtgaaccgga

SEQ ID NO: 656084 - DNA, 25 bp, Mus musculus
gagctcctgagcatagtctgtcagc

SEQ ID NO: 656085 - DNA, 25 bp, Mus musculus
gagctcctgagcttagtctgtcagc

SEQ ID NO: 656086 - DNA, 25 bp, Mus musculus
gagctcctgcaccaagttcagatgg

SEQ ID NO: 656087 - DNA, 25 bp, Mus musculus
gagctcctgcacgaagttcagatgg

SEQ ID NO: 656088 - DNA, 25 bp, Mus musculus
gagctcctggaaagactgggcccaa

SEQ ID NO: 656089 - DNA, 25 bp, Mus musculus
gagctcctggaatgactgggcccaa

SEQ ID NO: 656090 - DNA, 25 bp, Mus musculus
gagctcctggatcccacgggactct

SEQ ID NO: 656091 - DNA, 25 bp, Mus musculus
gagctcctggatgccacgggactct

SEQ ID NO: 656092 - DNA, 25 bp, Mus musculus
gagctcctggtaagcattagattaa

SEQ ID NO: 656093 - DNA, 25 bp, Mus musculus
gagctcctggtatgcattagattaa

SEQ ID NO: 656094 - DNA, 25 bp, Mus musculus
gagctcctgtttatccggaacactt

SEQ ID NO: 656095 - DNA, 25 bp, Mus musculus
gagctcctgtttttccggaacactt

SEQ ID NO: 656096 - DNA, 25 bp, Mus musculus
gagctccttgtgcatagaacttccc

SEQ ID NO: 656097 - DNA, 25 bp, Mus musculus
gagctccttgtggatagaacttccc

SEQ ID NO: 656098 - DNA, 25 bp, Mus musculus
gagctcgactacctaaccatcaggg

SEQ ID NO: 656099 - DNA, 25 bp, Mus musculus
gagctcgactacgtaaccatcaggg

SEQ ID NO: 656100 - DNA, 25 bp, Mus musculus
gagctcgagtcacaatcaggcccga

SEQ ID NO: 656101 - DNA, 25 bp, Mus musculus
gagctcgagtcagaatcaggcccga

SEQ ID NO: 656102 - DNA, 25 bp, Mus musculus
gagctcgcacttcaaagcacacaga

SEQ ID NO: 656103 - DNA, 25 bp, Mus musculus
gagctcgcacttgaaagcacacaga

SEQ ID NO: 656104 - DNA, 25 bp, Mus musculus
gagctcgcagttccaggttttggtt

SEQ ID NO: 656105 - DNA, 25 bp, Mus musculus
gagctcgcagttgcaggttttggtt

SEQ ID NO: 656106 - DNA, 25 bp, Mus musculus
gagctcgcctaccttggattcctaa

SEQ ID NO: 656107 - DNA, 25 bp, Mus musculus
gagctcgcctacgttggattcctaa

SEQ ID NO: 656108 - DNA, 25 bp, Mus musculus
gagctcgggcccaccagcgaggaaa

SEQ ID NO: 656109 - DNA, 25 bp, Mus musculus
gagctcgggccctccagcgaggaaa

SEQ ID NO: 656110 - DNA, 25 bp, Mus musculus
gagctcggtggcagcgcgcttccca

SEQ ID NO: 656111 - DNA, 25 bp, Mus musculus
gagctcggtggctgcgcgcttccca

SEQ ID NO: 656112 - DNA, 25 bp, Mus musculus
gagctcggtgtacaaactcaatagc

SEQ ID NO: 656113 - DNA, 25 bp, Mus musculus
gagctcggtgtagaaactcaatagc

SEQ ID NO: 656114 - DNA, 25 bp, Mus musculus
gagctcgtgcgcaactgctcggcgc

SEQ ID NO: 656115 - DNA, 25 bp, Mus musculus
gagctcgtgcgctactgctcggcgc

SEQ ID NO: 656116 - DNA, 25 bp, Mus musculus
gagctcgtttcacaagggccggttc

SEQ ID NO: 656117 - DNA, 25 bp, Mus musculus
gagctcgtttcagaagggccggttc

SEQ ID NO: 656118 - DNA, 25 bp, Mus musculus
gagctctaaagactgacctcgaagg

SEQ ID NO: 656119 - DNA, 25 bp, Mus musculus
gagctctaaagagtgacctcgaagg

SEQ ID NO: 656120 - DNA, 25 bp, Mus musculus
gagctctacaaacgcagaagagaga

SEQ ID NO: 656121 - DNA, 25 bp, Mus musculus
gagctctacaaaggcagaagagaga

SEQ ID NO: 656122 - DNA, 25 bp, Mus musculus
gagctctacaagctagttcaagggc

SEQ ID NO: 656123 - DNA, 25 bp, Mus musculus
gagctctacaaggtagttcaagggc

SEQ ID NO: 656124 - DNA, 25 bp, Mus musculus
gagctctacatcaataggatgaagg

SEQ ID NO: 656125 - DNA, 25 bp, Mus musculus
gagctctacatctataggatgaagg

SEQ ID NO: 656126 - DNA, 25 bp, Mus musculus
gagctctacccaaccttcagtgata

SEQ ID NO: 656127 - DNA, 25 bp, Mus musculus
gagctctacccatccttcagtgata

SEQ ID NO: 656128 - DNA, 25 bp, Mus musculus
gagctctagagacaagtgaaattac

SEQ ID NO: 656129 - DNA, 25 bp, Mus musculus
gagctctagagagaagtgaaattac

SEQ ID NO: 656130 - DNA, 25 bp, Mus musculus
gagctctcaaaacagggccaccagg

SEQ ID NO: 656131 - DNA, 25 bp, Mus musculus
gagctctcaaaagagggccaccagg

SEQ ID NO: 656132 - DNA, 25 bp, Mus musculus
gagctctcaagaactgttgaaagac

SEQ ID NO: 656133 - DNA, 25 bp, Mus musculus
gagctctcaagatctgttgaaagac

SEQ ID NO: 656134 - DNA, 25 bp, Mus musculus
gagctctcgcttattgaaggtcaac

SEQ ID NO: 656135 - DNA, 25 bp, Mus musculus
gagctctcgctttttgaaggtcaac

SEQ ID NO: 656136 - DNA, 25 bp, Mus musculus
gagctctctcaaaacatgggactgt

SEQ ID NO: 656137 - DNA, 25 bp, Mus musculus
gagctctctcaatacatgggactgt

SEQ ID NO: 656138 - DNA, 25 bp, Mus musculus
gagctctctgcacataggcacagtc

SEQ ID NO: 656139 - DNA, 25 bp, Mus musculus
gagctctctgcagataggcacagtc

SEQ ID NO: 656140 - DNA, 25 bp, Mus musculus
gagctctctgctcgaaatgttgttg

SEQ ID NO: 656141 - DNA, 25 bp, Mus musculus
gagctctctgctggaaatgttgttg

SEQ ID NO: 656142 - DNA, 25 bp, Mus musculus
gagctctctgttatcttcgtatggg

SEQ ID NO: 656143 - DNA, 25 bp, Mus musculus
gagctctctgttttcttcgtatggg

SEQ ID NO: 656144 - DNA, 25 bp, Mus musculus
gagctctcttacaagacaatagtcc

SEQ ID NO: 656145 - DNA, 25 bp, Mus musculus
gagctctcttactagacaatagtcc

SEQ ID NO: 656146 - DNA, 25 bp, Mus musculus
gagctctgaacaacacctaggggtg

SEQ ID NO: 656147 - DNA, 25 bp, Mus musculus
gagctctgaacatcacctaggggtg

SEQ ID NO: 656148 - DNA, 25 bp, Mus musculus
gagctctgaagtagccaaaccttgt

SEQ ID NO: 656149 - DNA, 25 bp, Mus musculus
gagctctgaagttgccaaaccttgt

SEQ ID NO: 656150 - DNA, 25 bp, Mus musculus
gagctctgagttctacgccacccag

SEQ ID NO: 656151 - DNA, 25 bp, Mus musculus
gagctctgagttgtacgccacccag

SEQ ID NO: 656152 - DNA, 25 bp, Mus musculus
gagctctgatttctgctttgaaaaa

SEQ ID NO: 656153 - DNA, 25 bp, Mus musculus
gagctctgatttgtgctttgaaaaa

SEQ ID NO: 656154 - DNA, 25 bp, Mus musculus
gagctctgcggaaaaagagagactt

SEQ ID NO: 656155 - DNA, 25 bp, Mus musculus
gagctctgcggataaagagagactt

SEQ ID NO: 656156 - DNA, 25 bp, Mus musculus
gagctctgcgtaagaacaagactct

SEQ ID NO: 656157 - DNA, 25 bp, Mus musculus
gagctctgcgtatgaacaagactct

SEQ ID NO: 656158 - DNA, 25 bp, Mus musculus
gagctctgctttagacaacctgatt

SEQ ID NO: 656159 - DNA, 25 bp, Mus musculus
gagctctgcttttgacaacctgatt

SEQ ID NO: 656160 - DNA, 25 bp, Mus musculus
gagctctggaagctttggttttgca

SEQ ID NO: 656161 - DNA, 25 bp, Mus musculus
gagctctggaaggtttggttttgca

SEQ ID NO: 656162 - DNA, 25 bp, Mus musculus
gagctctgtccaccttctttctgtt

SEQ ID NO: 656163 - DNA, 25 bp, Mus musculus
gagctctgtccagcttctttctgtt

SEQ ID NO: 656164 - DNA, 25 bp, Mus musculus
gagctcttaactcggacgtgttctt

SEQ ID NO: 656165 - DNA, 25 bp, Mus musculus
gagctcttaactgggacgtgttctt

SEQ ID NO: 656166 - DNA, 25 bp, Mus musculus
gagctcttacagcaacactccagag

SEQ ID NO: 656167 - DNA, 25 bp, Mus musculus
gagctcttacaggaacactccagag

SEQ ID NO: 656168 - DNA, 25 bp, Mus musculus
gagctcttagggaagaatattgtag

SEQ ID NO: 656169 - DNA, 25 bp, Mus musculus
gagctcttagggtagaatattgtag

SEQ ID NO: 656170 - DNA, 25 bp, Mus musculus
gagctcttcagaaactgccttctcc

SEQ ID NO: 656171 - DNA, 25 bp, Mus musculus
gagctcttcagatactgccttctcc

SEQ ID NO: 656172 - DNA, 25 bp, Mus musculus
gagctcttcaggacacccaactacg

SEQ ID NO: 656173 - DNA, 25 bp, Mus musculus
gagctcttcaggtcacccaactacg

SEQ ID NO: 656174 - DNA, 25 bp, Mus musculus
gagctcttcttcactgtggttctca

SEQ ID NO: 656175 - DNA, 25 bp, Mus musculus
gagctcttcttctctgtggttctca

SEQ ID NO: 656176 - DNA, 25 bp, Mus musculus
gagctcttgcgccagactggattca

SEQ ID NO: 656177 - DNA, 25 bp, Mus musculus
gagctcttgcgcgagactggattca

SEQ ID NO: 656178 - DNA, 25 bp, Mus musculus
gagctcttggagatttcagggaaac

SEQ ID NO: 656179 - DNA, 25 bp, Mus musculus
gagctcttggagttttcagggaaac

SEQ ID NO: 656180 - DNA, 25 bp, Mus musculus
gagctctttgccctggtgaagacga

SEQ ID NO: 656181 - DNA, 25 bp, Mus musculus
gagctctttgccgtggtgaagacga

SEQ ID NO: 656182 - DNA, 25 bp, Mus musculus
gagctcttttctcaggtctgtaaaa

SEQ ID NO: 656183 - DNA, 25 bp, Mus musculus
gagctcttttctgaggtctgtaaaa

SEQ ID NO: 656184 - DNA, 25 bp, Mus musculus
gagctgaaaagcaagtatgaggacc

SEQ ID NO: 656185 - DNA, 25 bp, Mus musculus
gagctgaaaagctagtatgaggacc

SEQ ID NO: 656186 - DNA, 25 bp, Mus musculus
gagctgaaattaacaatcatctggc

SEQ ID NO: 656187 - DNA, 25 bp, Mus musculus
gagctgaaattatcaatcatctggc

SEQ ID NO: 656188 - DNA, 25 bp, Mus musculus
gagctgaacaccatctacctgaagt

SEQ ID NO: 656189 - DNA, 25 bp, Mus musculus
gagctgaacaccttctacctgaagt

SEQ ID NO: 656190 - DNA, 25 bp, Mus musculus
gagctgaaccagacagtgcaggaac

SEQ ID NO: 656191 - DNA, 25 bp, Mus musculus
gagctgaaccagtcagtgcaggaac

SEQ ID NO: 656192 - DNA, 25 bp, Mus musculus
gagctgaaccctaaagatgctactt

SEQ ID NO: 656193 - DNA, 25 bp, Mus musculus
gagctgaacccttaagatgctactt

SEQ ID NO: 656194 - DNA, 25 bp, Mus musculus
gagctgaagatgacccagatccaag

SEQ ID NO: 656195 - DNA, 25 bp, Mus musculus
gagctgaagatgtcccagatccaag

SEQ ID NO: 656196 - DNA, 25 bp, Mus musculus
gagctgaagcccagtcggtcacatg

SEQ ID NO: 656197 - DNA, 25 bp, Mus musculus
gagctgaagccctgtcggtcacatg

SEQ ID NO: 656198 - DNA, 25 bp, Mus musculus
gagctgaagcctccccgagtgtatg

SEQ ID NO: 656199 - DNA, 25 bp, Mus musculus
gagctgaagcctgcccgagtgtatg

SEQ ID NO: 656200 - DNA, 25 bp, Mus musculus
gagctgaagcttaaacaggctgtca

SEQ ID NO: 656201 - DNA, 25 bp, Mus musculus
gagctgaagctttaacaggctgtca

SEQ ID NO: 656202 - DNA, 25 bp, Mus musculus
gagctgaaggataccgatctgggct

SEQ ID NO: 656203 - DNA, 25 bp, Mus musculus
gagctgaaggattccgatctgggct

SEQ ID NO: 656204 - DNA, 25 bp, Mus musculus
gagctgaaggcccattttcgtaagg

SEQ ID NO: 656205 - DNA, 25 bp, Mus musculus
gagctgaaggccgattttcgtaagg

SEQ ID NO: 656206 - DNA, 25 bp, Mus musculus
gagctgaaggctctgttagaccaag

SEQ ID NO: 656207 - DNA, 25 bp, Mus musculus
gagctgaaggctgtgttagaccaag

SEQ ID NO: 656208 - DNA, 25 bp, Mus musculus
gagctgaagttcaacttgcagaagg

SEQ ID NO: 656209 - DNA, 25 bp, Mus musculus
gagctgaagttctacttgcagaagg

SEQ ID NO: 656210 - DNA, 25 bp, Mus musculus
gagctgaataaccataccctcatgg

SEQ ID NO: 656211 - DNA, 25 bp, Mus musculus
gagctgaataacgataccctcatgg

SEQ ID NO: 656212 - DNA, 25 bp, Mus musculus
gagctgaatctcagcggtaatagtg

SEQ ID NO: 656213 - DNA, 25 bp, Mus musculus
gagctgaatctctgcggtaatagtg

SEQ ID NO: 656214 - DNA, 25 bp, Mus musculus
gagctgaatgaaattctcactcggg

SEQ ID NO: 656215 - DNA, 25 bp, Mus musculus
gagctgaatgaatttctcactcggg

SEQ ID NO: 656216 - DNA, 25 bp, Mus musculus
gagctgaatgccatccgtaggaagc

SEQ ID NO: 656217 - DNA, 25 bp, Mus musculus
gagctgaatgccttccgtaggaagc

SEQ ID NO: 656218 - DNA, 25 bp, Mus musculus
gagctgacaatcatgccatccccat

SEQ ID NO: 656219 - DNA, 25 bp, Mus musculus
gagctgacaatcttgccatccccat

SEQ ID NO: 656220 - DNA, 25 bp, Mus musculus
gagctgacacacaatgtcgcacgtc

SEQ ID NO: 656221 - DNA, 25 bp, Mus musculus
gagctgacacactatgtcgcacgtc

SEQ ID NO: 656222 - DNA, 25 bp, Mus musculus
gagctgacagacatcgaaagacagt

SEQ ID NO: 656223 - DNA, 25 bp, Mus musculus
gagctgacagacttcgaaagacagt

SEQ ID NO: 656224 - DNA, 25 bp, Mus musculus
gagctgacagagagcagcgtgaacc

SEQ ID NO: 656225 - DNA, 25 bp, Mus musculus
gagctgacagagtgcagcgtgaacc

SEQ ID NO: 656226 - DNA, 25 bp, Mus musculus
gagctgacatacagaaggaattagg

SEQ ID NO: 656227 - DNA, 25 bp, Mus musculus
gagctgacatactgaaggaattagg

SEQ ID NO: 656228 - DNA, 25 bp, Mus musculus
gagctgacatcaagcagcactctag

SEQ ID NO: 656229 - DNA, 25 bp, Mus musculus
gagctgacatcacacatgggtggca

SEQ ID NO: 656230 - DNA, 25 bp, Mus musculus
gagctgacatcagacatgggtggca

SEQ ID NO: 656231 - DNA, 25 bp, Mus musculus
gagctgacatcatgcagcactctag

SEQ ID NO: 656232 - DNA, 25 bp, Mus musculus
gagctgacatgcacatggtgaagcc

SEQ ID NO: 656233 - DNA, 25 bp, Mus musculus
gagctgacatgctcatggtgaagcc

SEQ ID NO: 656234 - DNA, 25 bp, Mus musculus
gagctgacatgtcctattgagtcac

SEQ ID NO: 656235 - DNA, 25 bp, Mus musculus
gagctgacatgtgctattgagtcac

SEQ ID NO: 656236 - DNA, 25 bp, Mus musculus
gagctgacccaacaagtggagtttg

SEQ ID NO: 656237 - DNA, 25 bp, Mus musculus
gagctgacccaagaagtggagtttg

SEQ ID NO: 656238 - DNA, 25 bp, Mus musculus
gagctgacccagagcagctgcgtcg

SEQ ID NO: 656239 - DNA, 25 bp, Mus musculus
gagctgacccagtgcagctgcgtcg

SEQ ID NO: 656240 - DNA, 25 bp, Mus musculus
gagctgaccgatcctgagttcccac

SEQ ID NO: 656241 - DNA, 25 bp, Mus musculus
gagctgaccgatgctgagttcccac

SEQ ID NO: 656242 - DNA, 25 bp, Mus musculus
gagctgacttacatgccccttaacg

SEQ ID NO: 656243 - DNA, 25 bp, Mus musculus
gagctgacttacttgccccttaacg

SEQ ID NO: 656244 - DNA, 25 bp, Mus musculus
gagctgagaatcagcttcatgacca

SEQ ID NO: 656245 - DNA, 25 bp, Mus musculus
gagctgagaatctgcttcatgacca

SEQ ID NO: 656246 - DNA, 25 bp, Mus musculus
gagctgagacagatgattcccaagt

SEQ ID NO: 656247 - DNA, 25 bp, Mus musculus
gagctgagacagttgattcccaagt

SEQ ID NO: 656248 - DNA, 25 bp, Mus musculus
gagctgagagctactgccttgtccg

SEQ ID NO: 656249 - DNA, 25 bp, Mus musculus
gagctgagagcttctgccttgtccg

SEQ ID NO: 656250 - DNA, 25 bp, Mus musculus
gagctgagcagcaactttgagcagg

SEQ ID NO: 656251 - DNA, 25 bp, Mus musculus
gagctgagcagctactttgagcagg

SEQ ID NO: 656252 - DNA, 25 bp, Mus musculus
gagctgaggcacctcctgtggtcat

SEQ ID NO: 656253 - DNA, 25 bp, Mus musculus
gagctgaggcacgtcctgtggtcat

SEQ ID NO: 656254 - DNA, 25 bp, Mus musculus
gagctgaggcggaagcggaccggct

SEQ ID NO: 656255 - DNA, 25 bp, Mus musculus
gagctgaggcggtagcggaccggct

SEQ ID NO: 656256 - DNA, 25 bp, Mus musculus
gagctgagtaagacaaagcacgtcc

SEQ ID NO: 656257 - DNA, 25 bp, Mus musculus
gagctgagtaagtcaaagcacgtcc

SEQ ID NO: 656258 - DNA, 25 bp, Mus musculus
gagctgagtactcggaaaagcgccc

SEQ ID NO: 656259 - DNA, 25 bp, Mus musculus
gagctgagtactgggaaaagcgccc

SEQ ID NO: 656260 - DNA, 25 bp, Mus musculus
gagctgagtgacaagagcaccaaga

SEQ ID NO: 656261 - DNA, 25 bp, Mus musculus
gagctgagtgactagagcaccaaga

SEQ ID NO: 656262 - DNA, 25 bp, Mus musculus
gagctgagtgagcactccagcaatg

SEQ ID NO: 656263 - DNA, 25 bp, Mus musculus
gagctgagtgaggactccagcaatg

SEQ ID NO: 656264 - DNA, 25 bp, Mus musculus
gagctgatatttagcccaatgaatg

SEQ ID NO: 656265 - DNA, 25 bp, Mus musculus
gagctgatattttgcccaatgaatg

SEQ ID NO: 656266 - DNA, 25 bp, Mus musculus
gagctgatccgtcaggacatccaag

SEQ ID NO: 656267 - DNA, 25 bp, Mus musculus
gagctgatccgtgaggacatccaag

SEQ ID NO: 656268 - DNA, 25 bp, Mus musculus
gagctgatgaagatcaacgtcgatg

SEQ ID NO: 656269 - DNA, 25 bp, Mus musculus
gagctgatgaagttcaacgtcgatg

SEQ ID NO: 656270 - DNA, 25 bp, Mus musculus
gagctgatgcggcaaccctgcatta

SEQ ID NO: 656271 - DNA, 25 bp, Mus musculus
gagctgatgcgggaaccctgcatta

SEQ ID NO: 656272 - DNA, 25 bp, Mus musculus
gagctgatgctgaacactcaatgcc

SEQ ID NO: 656273 - DNA, 25 bp, Mus musculus
gagctgatgctgtacactcaatgcc

SEQ ID NO: 656274 - DNA, 25 bp, Mus musculus
gagctgatggcaaagctgacggccc

SEQ ID NO: 656275 - DNA, 25 bp, Mus musculus
gagctgatggcatagctgacggccc

SEQ ID NO: 656276 - DNA, 25 bp, Mus musculus
gagctgatggtgattatctggacga

SEQ ID NO: 656277 - DNA, 25 bp, Mus musculus
gagctgatggtgtttatctggacga

SEQ ID NO: 656278 - DNA, 25 bp, Mus musculus
gagctgatgtgacttatgcggccct

SEQ ID NO: 656279 - DNA, 25 bp, Mus musculus
gagctgatgtgagttatgcggccct

SEQ ID NO: 656280 - DNA, 25 bp, Mus musculus
gagctgatgttccagcagtacaaca

SEQ ID NO: 656281 - DNA, 25 bp, Mus musculus
gagctgatgttcgagcagtacaaca

SEQ ID NO: 656282 - DNA, 25 bp, Mus musculus
gagctgcacagcatgtggacagcag

SEQ ID NO: 656283 - DNA, 25 bp, Mus musculus
gagctgcacagcttgtggacagcag

SEQ ID NO: 656284 - DNA, 25 bp, Mus musculus
gagctgcaccgacaacagcacagcg

SEQ ID NO: 656285 - DNA, 25 bp, Mus musculus
gagctgcaccgagaacagcacagcg

SEQ ID NO: 656286 - DNA, 25 bp, Mus musculus
gagctgcaccgccatatagaggaag

SEQ ID NO: 656287 - DNA, 25 bp, Mus musculus
gagctgcaccgcgatatagaggaag

SEQ ID NO: 656288 - DNA, 25 bp, Mus musculus
gagctgcaccggagactgatggctc

SEQ ID NO: 656289 - DNA, 25 bp, Mus musculus
gagctgcaccggtgactgatggctc

SEQ ID NO: 656290 - DNA, 25 bp, Mus musculus
gagctgcacctgctgatgacggccc

SEQ ID NO: 656291 - DNA, 25 bp, Mus musculus
gagctgcacctggtgatgacggccc

SEQ ID NO: 656292 - DNA, 25 bp, Mus musculus
gagctgcacggcacagtctgaccag

SEQ ID NO: 656293 - DNA, 25 bp, Mus musculus
gagctgcacggctcagtctgaccag

SEQ ID NO: 656294 - DNA, 25 bp, Mus musculus
gagctgcagaacctcaggaagcaca

SEQ ID NO: 656295 - DNA, 25 bp, Mus musculus
gagctgcagaacgtcaggaagcaca

SEQ ID NO: 656296 - DNA, 25 bp, Mus musculus
gagctgcagaggaaactagatcatg

SEQ ID NO: 656297 - DNA, 25 bp, Mus musculus
gagctgcagaggtaactagatcatg

SEQ ID NO: 656298 - DNA, 25 bp, Mus musculus
gagctgcagagtaccagctcaatga

SEQ ID NO: 656299 - DNA, 25 bp, Mus musculus
gagctgcagagttccagctcaatga

SEQ ID NO: 656300 - DNA, 25 bp, Mus musculus
gagctgcagccaaatgatagaaacc

SEQ ID NO: 656301 - DNA, 25 bp, Mus musculus
gagctgcagccatatgatagaaacc

SEQ ID NO: 656302 - DNA, 25 bp, Mus musculus
gagctgcaggcaattgagaatattg

SEQ ID NO: 656303 - DNA, 25 bp, Mus musculus
gagctgcaggcatttgagaatattg

SEQ ID NO: 656304 - DNA, 25 bp, Mus musculus
gagctgcatgagctacctgcacagg

SEQ ID NO: 656305 - DNA, 25 bp, Mus musculus
gagctgcatgaggtacctgcacagg

SEQ ID NO: 656306 - DNA, 25 bp, Mus musculus
gagctgcattcaaatctcaccaggc

SEQ ID NO: 656307 - DNA, 25 bp, Mus musculus
gagctgcattcatatctcaccaggc

SEQ ID NO: 656308 - DNA, 25 bp, Mus musculus
gagctgccaaagacagtaagaattt

SEQ ID NO: 656309 - DNA, 25 bp, Mus musculus
gagctgccaaagtcagtaagaattt

SEQ ID NO: 656310 - DNA, 25 bp, Mus musculus
gagctgccacagaatgaggaaacct

SEQ ID NO: 656311 - DNA, 25 bp, Mus musculus
gagctgccacagtatgaggaaacct

SEQ ID NO: 656312 - DNA, 25 bp, Mus musculus
gagctgccagaaatccagcttaacc

SEQ ID NO: 656313 - DNA, 25 bp, Mus musculus
gagctgccagaattccagcttaacc

SEQ ID NO: 656314 - DNA, 25 bp, Mus musculus
gagctgccatctatcggagtgacga

SEQ ID NO: 656315 - DNA, 25 bp, Mus musculus
gagctgccatctcctctggatcctg

SEQ ID NO: 656316 - DNA, 25 bp, Mus musculus
gagctgccatctgctctggatcctg

SEQ ID NO: 656317 - DNA, 25 bp, Mus musculus
gagctgccatctttcggagtgacga

SEQ ID NO: 656318 - DNA, 25 bp, Mus musculus
gagctgccatgtcttccgacttcga

SEQ ID NO: 656319 - DNA, 25 bp, Mus musculus
gagctgccatgtgttccgacttcga

SEQ ID NO: 656320 - DNA, 25 bp, Mus musculus
gagctgcccatgaacgaccagttct

SEQ ID NO: 656321 - DNA, 25 bp, Mus musculus
gagctgcccatgtacgaccagttct

SEQ ID NO: 656322 - DNA, 25 bp, Mus musculus
gagctgcctgctctcatggactgaa

SEQ ID NO: 656323 - DNA, 25 bp, Mus musculus
gagctgcctgctgtcatggactgaa

SEQ ID NO: 656324 - DNA, 25 bp, Mus musculus
gagctgcctgttcagcagcccgagc

SEQ ID NO: 656325 - DNA, 25 bp, Mus musculus
gagctgcctgttgagcagcccgagc

SEQ ID NO: 656326 - DNA, 25 bp, Mus musculus
gagctgcggtccatgttcacgcgag

SEQ ID NO: 656327 - DNA, 25 bp, Mus musculus
gagctgcggtccttgttcacgcgag

SEQ ID NO: 656328 - DNA, 25 bp, Mus musculus
gagctgcgtcccattcaggatccag

SEQ ID NO: 656329 - DNA, 25 bp, Mus musculus
gagctgcgtccctttcaggatccag

SEQ ID NO: 656330 - DNA, 25 bp, Mus musculus
gagctgcgtctcattgtgttgccac

SEQ ID NO: 656331 - DNA, 25 bp, Mus musculus
gagctgcgtctctttgtgttgccac

SEQ ID NO: 656332 - DNA, 25 bp, Mus musculus
gagctgcgtgagatcgcatcggaac

SEQ ID NO: 656333 - DNA, 25 bp, Mus musculus
gagctgcgtgagttcgcatcggaac

SEQ ID NO: 656334 - DNA, 25 bp, Mus musculus
gagctgcgtgtcatgacctgcacct

SEQ ID NO: 656335 - DNA, 25 bp, Mus musculus
gagctgcgtgtcttgacctgcacct

SEQ ID NO: 656336 - DNA, 25 bp, Mus musculus
gagctgctaaagacagccatccagg

SEQ ID NO: 656337 - DNA, 25 bp, Mus musculus
gagctgctaaagtcagccatccagg

SEQ ID NO: 656338 - DNA, 25 bp, Mus musculus
gagctgctaagcagccaaacggaga

SEQ ID NO: 656339 - DNA, 25 bp, Mus musculus
gagctgctaagctgccaaacggaga

SEQ ID NO: 656340 - DNA, 25 bp, Mus musculus
gagctgctatatacacagggatctg

SEQ ID NO: 656341 - DNA, 25 bp, Mus musculus
gagctgctatattcacagggatctg

SEQ ID NO: 656342 - DNA, 25 bp, Mus musculus
gagctgctcaatcgagaccctaagg

SEQ ID NO: 656343 - DNA, 25 bp, Mus musculus
gagctgctcaatggagaccctaagg

SEQ ID NO: 656344 - DNA, 25 bp, Mus musculus
gagctgctcagaaaaacatcgatcg

SEQ ID NO: 656345 - DNA, 25 bp, Mus musculus
gagctgctcagataaacatcgatcg

SEQ ID NO: 656346 - DNA, 25 bp, Mus musculus
gagctgctcagcatagtcaatctga

SEQ ID NO: 656347 - DNA, 25 bp, Mus musculus
gagctgctcagcttagtcaatctga

SEQ ID NO: 656348 - DNA, 25 bp, Mus musculus
gagctgctccctagtgcttctactt

SEQ ID NO: 656349 - DNA, 25 bp, Mus musculus
gagctgctcccttgtgcttctactt

SEQ ID NO: 656350 - DNA, 25 bp, Mus musculus
gagctgctccgcatgaacatcgtcc

SEQ ID NO: 656351 - DNA, 25 bp, Mus musculus
gagctgctccgcttgaacatcgtcc

SEQ ID NO: 656352 - DNA, 25 bp, Mus musculus
gagctgctctatcccatgatggcat

SEQ ID NO: 656353 - DNA, 25 bp, Mus musculus
gagctgctctatgccatgatggcat

SEQ ID NO: 656354 - DNA, 25 bp, Mus musculus
gagctgctctgtactccgcttttta

SEQ ID NO: 656355 - DNA, 25 bp, Mus musculus
gagctgctctgttctccgcttttta

SEQ ID NO: 656356 - DNA, 25 bp, Mus musculus
gagctgctctttcggaccctgcctg

SEQ ID NO: 656357 - DNA, 25 bp, Mus musculus
gagctgctctttgggaccctgcctg

SEQ ID NO: 656358 - DNA, 25 bp, Mus musculus
gagctgctgactacgtcgtgggatc

SEQ ID NO: 656359 - DNA, 25 bp, Mus musculus
gagctgctgacttcgtcgtgggatc

SEQ ID NO: 656360 - DNA, 25 bp, Mus musculus
gagctgctgcggactttgaataccc

SEQ ID NO: 656361 - DNA, 25 bp, Mus musculus
gagctgctgcggtctttgaataccc

SEQ ID NO: 656362 - DNA, 25 bp, Mus musculus
gagctgctgggtaaaaccaaagaca

SEQ ID NO: 656363 - DNA, 25 bp, Mus musculus
gagctgctgggttaaaccaaagaca

SEQ ID NO: 656364 - DNA, 25 bp, Mus musculus
gagctgctggtacaccagtacttcc

SEQ ID NO: 656365 - DNA, 25 bp, Mus musculus
gagctgctggtagaccagtacttcc

SEQ ID NO: 656366 - DNA, 25 bp, Mus musculus
gagctgcttgcgaaataaacacgaa

SEQ ID NO: 656367 - DNA, 25 bp, Mus musculus
gagctgcttgcgtaataaacacgaa

SEQ ID NO: 656368 - DNA, 25 bp, Mus musculus
gagctgcttgttagggacctccttg

SEQ ID NO: 656369 - DNA, 25 bp, Mus musculus
gagctgcttgtttgggacctccttg

SEQ ID NO: 656370 - DNA, 25 bp, Mus musculus
gagctggaacggaacaaactacttg

SEQ ID NO: 656371 - DNA, 25 bp, Mus musculus
gagctggaacggtacaaactacttg

SEQ ID NO: 656372 - DNA, 25 bp, Mus musculus
gagctggaagcccattttcatggct

SEQ ID NO: 656373 - DNA, 25 bp, Mus musculus
gagctggaagccgattttcatggct

SEQ ID NO: 656374 - DNA, 25 bp, Mus musculus
gagctggacacccaatgaaacctca

SEQ ID NO: 656375 - DNA, 25 bp, Mus musculus
gagctggacaccgaatgaaacctca

SEQ ID NO: 656376 - DNA, 25 bp, Mus musculus
gagctggacattatcgaagtccaca

SEQ ID NO: 656377 - DNA, 25 bp, Mus musculus
gagctggacattttcgaagtccaca

SEQ ID NO: 656378 - DNA, 25 bp, Mus musculus
gagctggaccaccagcggatgtctt

SEQ ID NO: 656379 - DNA, 25 bp, Mus musculus
gagctggaccacgagcggatgtctt

SEQ ID NO: 656380 - DNA, 25 bp, Mus musculus
gagctggactagcttgctttcctga

SEQ ID NO: 656381 - DNA, 25 bp, Mus musculus
gagctggactaggttgctttcctga

SEQ ID NO: 656382 - DNA, 25 bp, Mus musculus
gagctggagagcccctcactgacat

SEQ ID NO: 656383 - DNA, 25 bp, Mus musculus
gagctggagagcgcctcactgacat

SEQ ID NO: 656384 - DNA, 25 bp, Mus musculus
gagctggagatcattgcaataatct

SEQ ID NO: 656385 - DNA, 25 bp, Mus musculus
gagctggagatctttgcaataatct

SEQ ID NO: 656386 - DNA, 25 bp, Mus musculus
gagctggagcgtcactacggcctac

SEQ ID NO: 656387 - DNA, 25 bp, Mus musculus
gagctggagcgtgactacggcctac

SEQ ID NO: 656388 - DNA, 25 bp, Mus musculus
gagctggcaggtctacagctctgcc

SEQ ID NO: 656389 - DNA, 25 bp, Mus musculus
gagctggcaggtgtacagctctgcc

SEQ ID NO: 656390 - DNA, 25 bp, Mus musculus
gagctggcattacaaactggaaaag

SEQ ID NO: 656391 - DNA, 25 bp, Mus musculus
gagctggcattagaaactggaaaag

SEQ ID NO: 656392 - DNA, 25 bp, Mus musculus
gagctggcccatagtcctctgcctg

SEQ ID NO: 656393 - DNA, 25 bp, Mus musculus
gagctggcccattgtcctctgcctg

SEQ ID NO: 656394 - DNA, 25 bp, Mus musculus
gagctggcctcacagttttctccta

SEQ ID NO: 656395 - DNA, 25 bp, Mus musculus
gagctggcctcagagttttctccta

SEQ ID NO: 656396 - DNA, 25 bp, Mus musculus
gagctggcgcaaagagcggatcctt

SEQ ID NO: 656397 - DNA, 25 bp, Mus musculus
gagctggcgcaatgagcggatcctt

SEQ ID NO: 656398 - DNA, 25 bp, Mus musculus
gagctggcggacatctctgatgtag

SEQ ID NO: 656399 - DNA, 25 bp, Mus musculus
gagctggcggacttctctgatgtag

SEQ ID NO: 656400 - DNA, 25 bp, Mus musculus
gagctggctcggagcactgatgact

SEQ ID NO: 656401 - DNA, 25 bp, Mus musculus
gagctggctcggtgcactgatgact

SEQ ID NO: 656402 - DNA, 25 bp, Mus musculus
gagctggctctgatgagggacctac

SEQ ID NO: 656403 - DNA, 25 bp, Mus musculus
gagctggctctgttgagggacctac

SEQ ID NO: 656404 - DNA, 25 bp, Mus musculus
gagctggctgctcccaataatgtct

SEQ ID NO: 656405 - DNA, 25 bp, Mus musculus
gagctggctgctgccaataatgtct

SEQ ID NO: 656406 - DNA, 25 bp, Mus musculus
gagctgggaaaacggaaagcaccaa

SEQ ID NO: 656407 - DNA, 25 bp, Mus musculus
gagctgggaaaagggaaagcaccaa

SEQ ID NO: 656408 - DNA, 25 bp, Mus musculus
gagctgggaaatctggcctgtatcc

SEQ ID NO: 656409 - DNA, 25 bp, Mus musculus
gagctgggaaatgtggcctgtatcc

SEQ ID NO: 656410 - DNA, 25 bp, Mus musculus
gagctgggaccaatcagatacctgg

SEQ ID NO: 656411 - DNA, 25 bp, Mus musculus
gagctgggaccattcagatacctgg

SEQ ID NO: 656412 - DNA, 25 bp, Mus musculus
gagctgggcaataccgggcatttta

SEQ ID NO: 656413 - DNA, 25 bp, Mus musculus
gagctgggcaattccgggcatttta

SEQ ID NO: 656414 - DNA, 25 bp, Mus musculus
gagctgggtatcctctgcagaaaaa

SEQ ID NO: 656415 - DNA, 25 bp, Mus musculus
gagctgggtatcgtctgcagaaaaa

SEQ ID NO: 656416 - DNA, 25 bp, Mus musculus
gagctgggtcctctctataccaaca

SEQ ID NO: 656417 - DNA, 25 bp, Mus musculus
gagctgggtcctgtctataccaaca

SEQ ID NO: 656418 - DNA, 25 bp, Mus musculus
gagctgggtgtactccgaaagttcc

SEQ ID NO: 656419 - DNA, 25 bp, Mus musculus
gagctgggtgtagtccgaaagttcc

SEQ ID NO: 656420 - DNA, 25 bp, Mus musculus
gagctggtgaagattgctgattttg

SEQ ID NO: 656421 - DNA, 25 bp, Mus musculus
gagctggtgaagtttgctgattttg

SEQ ID NO: 656422 - DNA, 25 bp, Mus musculus
gagctggtgaatcgtttccaatacc

SEQ ID NO: 656423 - DNA, 25 bp, Mus musculus
gagctggtgaatggtttccaatacc

SEQ ID NO: 656424 - DNA, 25 bp, Mus musculus
gagctggtgactaaagatcaggaga

SEQ ID NO: 656425 - DNA, 25 bp, Mus musculus
gagctggtgacttaagatcaggaga

SEQ ID NO: 656426 - DNA, 25 bp, Mus musculus
gagctggtgctgattgacaagccca

SEQ ID NO: 656427 - DNA, 25 bp, Mus musculus
gagctggtgctgtttgacaagccca

SEQ ID NO: 656428 - DNA, 25 bp, Mus musculus
gagctggtgtctaagatgcgtgaca

SEQ ID NO: 656429 - DNA, 25 bp, Mus musculus
gagctggtgtcttagatgcgtgaca

SEQ ID NO: 656430 - DNA, 25 bp, Mus musculus
gagctggtgtgaaagcttcctgcct

SEQ ID NO: 656431 - DNA, 25 bp, Mus musculus
gagctggtgtgatagcttcctgcct

SEQ ID NO: 656432 - DNA, 25 bp, Mus musculus
gagctggttcgcatccttttggaca

SEQ ID NO: 656433 - DNA, 25 bp, Mus musculus
gagctggttcgcttccttttggaca

SEQ ID NO: 656434 - DNA, 25 bp, Mus musculus
gagctggttcggaccttctcttcca

SEQ ID NO: 656435 - DNA, 25 bp, Mus musculus
gagctggttcggtccttctcttcca

SEQ ID NO: 656436 - DNA, 25 bp, Mus musculus
gagctgtacaagatcacactaccgg

SEQ ID NO: 656437 - DNA, 25 bp, Mus musculus
gagctgtacaagttcacactaccgg

SEQ ID NO: 656438 - DNA, 25 bp, Mus musculus
gagctgtaccagctctcactgcagc

SEQ ID NO: 656439 - DNA, 25 bp, Mus musculus
gagctgtaccaggtctcactgcagc

SEQ ID NO: 656440 - DNA, 25 bp, Mus musculus
gagctgtacctaacagaaccttggg

SEQ ID NO: 656441 - DNA, 25 bp, Mus musculus
gagctgtacctatcagaaccttggg

SEQ ID NO: 656442 - DNA, 25 bp, Mus musculus
gagctgtactgtagcaccatgggaa

SEQ ID NO: 656443 - DNA, 25 bp, Mus musculus
gagctgtactgttgcaccatgggaa

SEQ ID NO: 656444 - DNA, 25 bp, Mus musculus
gagctgtcactgagggaacggttct

SEQ ID NO: 656445 - DNA, 25 bp, Mus musculus
gagctgtcactgtgggaacggttct

SEQ ID NO: 656446 - DNA, 25 bp, Mus musculus
gagctgtcccacagaatgctaacac

SEQ ID NO: 656447 - DNA, 25 bp, Mus musculus
gagctgtcccactgaatgctaacac

SEQ ID NO: 656448 - DNA, 25 bp, Mus musculus
gagctgtccccacaaagctacctag

SEQ ID NO: 656449 - DNA, 25 bp, Mus musculus
gagctgtccccagaaagctacctag

SEQ ID NO: 656450 - DNA, 25 bp, Mus musculus
gagctgtccccgagtgagaatcctg

SEQ ID NO: 656451 - DNA, 25 bp, Mus musculus
gagctgtccccgtgtgagaatcctg

SEQ ID NO: 656452 - DNA, 25 bp, Mus musculus
gagctgtcctacaacagcagctgct

SEQ ID NO: 656453 - DNA, 25 bp, Mus musculus
gagctgtcctactacagcagctgct

SEQ ID NO: 656454 - DNA, 25 bp, Mus musculus
gagctgtcgagcctgttggacccta

SEQ ID NO: 656455 - DNA, 25 bp, Mus musculus
gagctgtcgagcgtgttggacccta

SEQ ID NO: 656456 - DNA, 25 bp, Mus musculus
gagctgtcggctaggatccaaagac

SEQ ID NO: 656457 - DNA, 25 bp, Mus musculus
gagctgtcggcttggatccaaagac

SEQ ID NO: 656458 - DNA, 25 bp, Mus musculus
gagctgtctcacacctcttctggac

SEQ ID NO: 656459 - DNA, 25 bp, Mus musculus
gagctgtctcactcctcttctggac

SEQ ID NO: 656460 - DNA, 25 bp, Mus musculus
gagctgtctcagcagatcaacatga

SEQ ID NO: 656461 - DNA, 25 bp, Mus musculus
gagctgtctcaggagatcaacatga

SEQ ID NO: 656462 - DNA, 25 bp, Mus musculus
gagctgtctgaacccgaaaaccagt

SEQ ID NO: 656463 - DNA, 25 bp, Mus musculus
gagctgtctgaagccgaaaaccagt

SEQ ID NO: 656464 - DNA, 25 bp, Mus musculus
gagctgtgaatccaactgtaaagtt

SEQ ID NO: 656465 - DNA, 25 bp, Mus musculus
gagctgtgaatcgaactgtaaagtt

SEQ ID NO: 656466 - DNA, 25 bp, Mus musculus
gagctgtgactaagacacaagtctc

SEQ ID NO: 656467 - DNA, 25 bp, Mus musculus
gagctgtgactatgacacaagtctc

SEQ ID NO: 656468 - DNA, 25 bp, Mus musculus
gagctgtgaggaccaatcagtttgt

SEQ ID NO: 656469 - DNA, 25 bp, Mus musculus
gagctgtgaggagcaatcagtttgt

SEQ ID NO: 656470 - DNA, 25 bp, Mus musculus
gagctgtgcccaaccccgtgatcaa

SEQ ID NO: 656471 - DNA, 25 bp, Mus musculus
gagctgtgcccatccccgtgatcaa

SEQ ID NO: 656472 - DNA, 25 bp, Mus musculus
gagctgtgcttcacactacgctacg

SEQ ID NO: 656473 - DNA, 25 bp, Mus musculus
gagctgtgcttctcactacgctacg

SEQ ID NO: 656474 - DNA, 25 bp, Mus musculus
gagctgtgggagagactccctgcca

SEQ ID NO: 656475 - DNA, 25 bp, Mus musculus
gagctgtgggagtgactccctgcca

SEQ ID NO: 656476 - DNA, 25 bp, Mus musculus
gagctgtggtcacacaacttcatgg

SEQ ID NO: 656477 - DNA, 25 bp, Mus musculus
gagctgtggtcagacaacttcatgg

SEQ ID NO: 656478 - DNA, 25 bp, Mus musculus
gagctgtggtgtaccaggtctccag

SEQ ID NO: 656479 - DNA, 25 bp, Mus musculus
gagctgtggtgttccaggtctccag

SEQ ID NO: 656480 - DNA, 25 bp, Mus musculus
gagctgtgtacacaggtttgccgct

SEQ ID NO: 656481 - DNA, 25 bp, Mus musculus
gagctgtgtacagaggtttgccgct

SEQ ID NO: 656482 - DNA, 25 bp, Mus musculus
gagctgtgtccaaccagacgggcta

SEQ ID NO: 656483 - DNA, 25 bp, Mus musculus
gagctgtgtccatccagacgggcta

SEQ ID NO: 656484 - DNA, 25 bp, Mus musculus
gagctgtgtgcaacccctggaggaa

SEQ ID NO: 656485 - DNA, 25 bp, Mus musculus
gagctgtgtgcatcccctggaggaa

SEQ ID NO: 656486 - DNA, 25 bp, Mus musculus
gagctgtgtgtcaaccagacagtgg

SEQ ID NO: 656487 - DNA, 25 bp, Mus musculus
gagctgtgtgtctaccagacagtgg

SEQ ID NO: 656488 - DNA, 25 bp, Mus musculus
gagctgttctttctttaaggactga

SEQ ID NO: 656489 - DNA, 25 bp, Mus musculus
gagctgttctttgtttaaggactga

SEQ ID NO: 656490 - DNA, 25 bp, Mus musculus
gagctgttgcacattctgtttggac

SEQ ID NO: 656491 - DNA, 25 bp, Mus musculus
gagctgttgcactttctgtttggac

SEQ ID NO: 656492 - DNA, 25 bp, Mus musculus
gagctgttgccacccagctggactg

SEQ ID NO: 656493 - DNA, 25 bp, Mus musculus
gagctgttgccagccagctggactg

SEQ ID NO: 656494 - DNA, 25 bp, Mus musculus
gagctgttgctcagaccttggagga

SEQ ID NO: 656495 - DNA, 25 bp, Mus musculus
gagctgttgctctgaccttggagga

SEQ ID NO: 656496 - DNA, 25 bp, Mus musculus
gagctgttgtacagagggctattaa

SEQ ID NO: 656497 - DNA, 25 bp, Mus musculus
gagctgttgtactgagggctattaa

SEQ ID NO: 656498 - DNA, 25 bp, Mus musculus
gagctgtttcccatccacacggagc

SEQ ID NO: 656499 - DNA, 25 bp, Mus musculus
gagctgtttcccttccacacggagc

SEQ ID NO: 656500 - DNA, 25 bp, Mus musculus
gagcttaacaacaagagccactcgg

SEQ ID NO: 656501 - DNA, 25 bp, Mus musculus
gagcttaacaactagagccactcgg

SEQ ID NO: 656502 - DNA, 25 bp, Mus musculus
gagcttaacactcagtgggatcaca

SEQ ID NO: 656503 - DNA, 25 bp, Mus musculus
gagcttaacactgagtgggatcaca

SEQ ID NO: 656504 - DNA, 25 bp, Mus musculus
gagcttaacctactgtcaacacatt

SEQ ID NO: 656505 - DNA, 25 bp, Mus musculus
gagcttaacctagtgtcaacacatt

SEQ ID NO: 656506 - DNA, 25 bp, Mus musculus
gagcttaactgcagaggtgccggct

SEQ ID NO: 656507 - DNA, 25 bp, Mus musculus
gagcttaactgctgaggtgccggct

SEQ ID NO: 656508 - DNA, 25 bp, Mus musculus
gagcttaagaatattcccatgaccc

SEQ ID NO: 656509 - DNA, 25 bp, Mus musculus
gagcttaagaattttcccatgaccc

SEQ ID NO: 656510 - DNA, 25 bp, Mus musculus
gagcttaagccaattgttgaaccag

SEQ ID NO: 656511 - DNA, 25 bp, Mus musculus
gagcttaagccatttgttgaaccag

SEQ ID NO: 656512 - DNA, 25 bp, Mus musculus
gagcttaccaacacaagatcagcaa

SEQ ID NO: 656513 - DNA, 25 bp, Mus musculus
gagcttaccaactcaagatcagcaa

SEQ ID NO: 656514 - DNA, 25 bp, Mus musculus
gagcttaccacaagaacccctgatg

SEQ ID NO: 656515 - DNA, 25 bp, Mus musculus
gagcttaccacatgaacccctgatg

SEQ ID NO: 656516 - DNA, 25 bp, Mus musculus
gagcttaccagcacaggatccctga

SEQ ID NO: 656517 - DNA, 25 bp, Mus musculus
gagcttaccagctcaggatccctga

SEQ ID NO: 656518 - DNA, 25 bp, Mus musculus
gagcttacctctcttgctcgggcca

SEQ ID NO: 656519 - DNA, 25 bp, Mus musculus
gagcttacctctgttgctcgggcca

SEQ ID NO: 656520 - DNA, 25 bp, Mus musculus
gagcttacggctcggtgttccactt

SEQ ID NO: 656521 - DNA, 25 bp, Mus musculus
gagcttacggctgggtgttccactt

SEQ ID NO: 656522 - DNA, 25 bp, Mus musculus
gagcttacgtttcttagcaggcgta

SEQ ID NO: 656523 - DNA, 25 bp, Mus musculus
gagcttacgtttgttagcaggcgta

SEQ ID NO: 656524 - DNA, 25 bp, Mus musculus
gagcttactagcaggcagaggagca

SEQ ID NO: 656525 - DNA, 25 bp, Mus musculus
gagcttactagctggcagaggagca

SEQ ID NO: 656526 - DNA, 25 bp, Mus musculus
gagcttactgtgaaacctgttggga

SEQ ID NO: 656527 - DNA, 25 bp, Mus musculus
gagcttactgtgtaacctgttggga

SEQ ID NO: 656528 - DNA, 25 bp, Mus musculus
gagcttataggtacgtgcaaggcaa

SEQ ID NO: 656529 - DNA, 25 bp, Mus musculus
gagcttataggttcgtgcaaggcaa

SEQ ID NO: 656530 - DNA, 25 bp, Mus musculus
gagcttatcccacgcatctccaatg

SEQ ID NO: 656531 - DNA, 25 bp, Mus musculus
gagcttatcccaggcatctccaatg

SEQ ID NO: 656532 - DNA, 25 bp, Mus musculus
gagcttatgtaccaggtcaccctta

SEQ ID NO: 656533 - DNA, 25 bp, Mus musculus
gagcttatgtacgaggtcaccctta

SEQ ID NO: 656534 - DNA, 25 bp, Mus musculus
gagcttcaaaagacagccttcagcg

SEQ ID NO: 656535 - DNA, 25 bp, Mus musculus
gagcttcaaaagtcagccttcagcg

SEQ ID NO: 656536 - DNA, 25 bp, Mus musculus
gagcttcaagtcaacttagtccgtt

SEQ ID NO: 656537 - DNA, 25 bp, Mus musculus
gagcttcaagtctacttagtccgtt

SEQ ID NO: 656538 - DNA, 25 bp, Mus musculus
gagcttcagattctttacagaggat

SEQ ID NO: 656539 - DNA, 25 bp, Mus musculus
gagcttcagattgtttacagaggat

SEQ ID NO: 656540 - DNA, 25 bp, Mus musculus
gagcttcagcaaccattatccaatg

SEQ ID NO: 656541 - DNA, 25 bp, Mus musculus
gagcttcagcaagcattatccaatg

SEQ ID NO: 656542 - DNA, 25 bp, Mus musculus
gagcttcagctcagatccttatatt

SEQ ID NO: 656543 - DNA, 25 bp, Mus musculus
gagcttcagctctgatccttatatt

SEQ ID NO: 656544 - DNA, 25 bp, Mus musculus
gagcttcagttaagagatagagatc

SEQ ID NO: 656545 - DNA, 25 bp, Mus musculus
gagcttcagttatgagatagagatc

SEQ ID NO: 656546 - DNA, 25 bp, Mus musculus
gagcttcattagaagcacgttaaga

SEQ ID NO: 656547 - DNA, 25 bp, Mus musculus
gagcttcattagtagcacgttaaga

SEQ ID NO: 656548 - DNA, 25 bp, Mus musculus
gagcttcattctctctgcggagccg

SEQ ID NO: 656549 - DNA, 25 bp, Mus musculus
gagcttcattctgtctgcggagccg

SEQ ID NO: 656550 - DNA, 25 bp, Mus musculus
gagcttccagcaagaaaggctttct

SEQ ID NO: 656551 - DNA, 25 bp, Mus musculus
gagcttccagcatgaaaggctttct

SEQ ID NO: 656552 - DNA, 25 bp, Mus musculus
gagcttccagcgcaatgtccgatcg

SEQ ID NO: 656553 - DNA, 25 bp, Mus musculus
gagcttccagcggaatgtccgatcg

SEQ ID NO: 656554 - DNA, 25 bp, Mus musculus
gagcttccagctctgtcgccttgag

SEQ ID NO: 656555 - DNA, 25 bp, Mus musculus
gagcttccagctgtgtcgccttgag

SEQ ID NO: 656556 - DNA, 25 bp, Mus musculus
gagcttccatgactcgttctcctgc

SEQ ID NO: 656557 - DNA, 25 bp, Mus musculus
gagcttccatgagtcgttctcctgc

SEQ ID NO: 656558 - DNA, 25 bp, Mus musculus
gagcttccctcacgactctagagaa

SEQ ID NO: 656559 - DNA, 25 bp, Mus musculus
gagcttccctcaggactctagagaa

SEQ ID NO: 656560 - DNA, 25 bp, Mus musculus
gagcttccctgtctgacctctcaag

SEQ ID NO: 656561 - DNA, 25 bp, Mus musculus
gagcttccctgtgtgacctctcaag

SEQ ID NO: 656562 - DNA, 25 bp, Mus musculus
gagcttcctactctgccaagatctg

SEQ ID NO: 656563 - DNA, 25 bp, Mus musculus
gagcttcctactgtgccaagatctg

SEQ ID NO: 656564 - DNA, 25 bp, Mus musculus
gagcttcctgtgcaacgtcttccag

SEQ ID NO: 656565 - DNA, 25 bp, Mus musculus
gagcttcctgtggaacgtcttccag

SEQ ID NO: 656566 - DNA, 25 bp, Mus musculus
gagcttcctttacgagatagtgtct

SEQ ID NO: 656567 - DNA, 25 bp, Mus musculus
gagcttcctttaggagatagtgtct

SEQ ID NO: 656568 - DNA, 25 bp, Mus musculus
gagcttcgaaatctggttccattgc

SEQ ID NO: 656569 - DNA, 25 bp, Mus musculus
gagcttcgaaatgtggttccattgc

SEQ ID NO: 656570 - DNA, 25 bp, Mus musculus
gagcttcggtggctcactctttgcc

SEQ ID NO: 656571 - DNA, 25 bp, Mus musculus
gagcttcggtgggtcactctttgcc

SEQ ID NO: 656572 - DNA, 25 bp, Mus musculus
gagcttctagaacttcgaaccagtt

SEQ ID NO: 656573 - DNA, 25 bp, Mus musculus
gagcttctagaagttcgaaccagtt

SEQ ID NO: 656574 - DNA, 25 bp, Mus musculus
gagcttctggatccagcaagagcag

SEQ ID NO: 656575 - DNA, 25 bp, Mus musculus
gagcttctggatgcagcaagagcag

SEQ ID NO: 656576 - DNA, 25 bp, Mus musculus
gagcttctgggccttagcaccttcg

SEQ ID NO: 656577 - DNA, 25 bp, Mus musculus
gagcttctgggcgttagcaccttcg

SEQ ID NO: 656578 - DNA, 25 bp, Mus musculus
gagcttcttggaaactgaggagaag

SEQ ID NO: 656579 - DNA, 25 bp, Mus musculus
gagcttcttggatactgaggagaag

SEQ ID NO: 656580 - DNA, 25 bp, Mus musculus
gagcttgaagggaacatcacacaga

SEQ ID NO: 656581 - DNA, 25 bp, Mus musculus
gagcttgaagggtacatcacacaga

SEQ ID NO: 656582 - DNA, 25 bp, Mus musculus
gagcttgaataaaatgtgctcaaac

SEQ ID NO: 656583 - DNA, 25 bp, Mus musculus
gagcttgaataatatgtgctcaaac

SEQ ID NO: 656584 - DNA, 25 bp, Mus musculus
gagcttgacattctcaaagactggt

SEQ ID NO: 656585 - DNA, 25 bp, Mus musculus
gagcttgacattgtcaaagactggt

SEQ ID NO: 656586 - DNA, 25 bp, Mus musculus
gagcttgagagtcccttacaacagg

SEQ ID NO: 656587 - DNA, 25 bp, Mus musculus
gagcttgagagtgccttacaacagg

SEQ ID NO: 656588 - DNA, 25 bp, Mus musculus
gagcttgagatgaaagacatccatg

SEQ ID NO: 656589 - DNA, 25 bp, Mus musculus
gagcttgagatgtaagacatccatg

SEQ ID NO: 656590 - DNA, 25 bp, Mus musculus
gagcttgaggagatcctggtcccca

SEQ ID NO: 656591 - DNA, 25 bp, Mus musculus
gagcttgaggagttcctggtcccca

SEQ ID NO: 656592 - DNA, 25 bp, Mus musculus
gagcttgaggccacgcaaggtcagc

SEQ ID NO: 656593 - DNA, 25 bp, Mus musculus
gagcttgaggcctcgcaaggtcagc

SEQ ID NO: 656594 - DNA, 25 bp, Mus musculus
gagcttgaggctctgttcaaacggc

SEQ ID NO: 656595 - DNA, 25 bp, Mus musculus
gagcttgaggctgtgttcaaacggc

SEQ ID NO: 656596 - DNA, 25 bp, Mus musculus
gagcttgatgtcagctatgtgcttg

SEQ ID NO: 656597 - DNA, 25 bp, Mus musculus
gagcttgatgtctgctatgtgcttg

SEQ ID NO: 656598 - DNA, 25 bp, Mus musculus
gagcttgccactaactcttttcacc

SEQ ID NO: 656599 - DNA, 25 bp, Mus musculus
gagcttgccacttactcttttcacc

SEQ ID NO: 656600 - DNA, 25 bp, Mus musculus
gagcttgctcctcctactgtgggct

SEQ ID NO: 656601 - DNA, 25 bp, Mus musculus
gagcttgctcctgctactgtgggct

SEQ ID NO: 656602 - DNA, 25 bp, Mus musculus
gagcttgctcttcaaacaggaaaag

SEQ ID NO: 656603 - DNA, 25 bp, Mus musculus
gagcttgctcttgaaacaggaaaag

SEQ ID NO: 656604 - DNA, 25 bp, Mus musculus
gagcttgctgggattattaagaaag

SEQ ID NO: 656605 - DNA, 25 bp, Mus musculus
gagcttgctgggtttattaagaaag

SEQ ID NO: 656606 - DNA, 25 bp, Mus musculus
gagcttgctgtgcagtgtacagtca

SEQ ID NO: 656607 - DNA, 25 bp, Mus musculus
gagcttgctgtgctccgccatcctg

SEQ ID NO: 656608 - DNA, 25 bp, Mus musculus
gagcttgctgtggagtgtacagtca

SEQ ID NO: 656609 - DNA, 25 bp, Mus musculus
gagcttgctgtggtccgccatcctg

SEQ ID NO: 656610 - DNA, 25 bp, Mus musculus
gagcttggcctgacggacatggact

SEQ ID NO: 656611 - DNA, 25 bp, Mus musculus
gagcttggcctgtcggacatggact

SEQ ID NO: 656612 - DNA, 25 bp, Mus musculus
gagcttggcgacaaggaccttgtgc

SEQ ID NO: 656613 - DNA, 25 bp, Mus musculus
gagcttggcgactaggaccttgtgc

SEQ ID NO: 656614 - DNA, 25 bp, Mus musculus
gagcttggtccacattcagacactg

SEQ ID NO: 656615 - DNA, 25 bp, Mus musculus
gagcttggtccagattcagacactg

SEQ ID NO: 656616 - DNA, 25 bp, Mus musculus
gagcttgtaactcgagaccccgtcc

SEQ ID NO: 656617 - DNA, 25 bp, Mus musculus
gagcttgtaactggagaccccgtcc

SEQ ID NO: 656618 - DNA, 25 bp, Mus musculus
gagcttgtatcacagcatgcacaca

SEQ ID NO: 656619 - DNA, 25 bp, Mus musculus
gagcttgtatcagagcatgcacaca

SEQ ID NO: 656620 - DNA, 25 bp, Mus musculus
gagcttgtctgaccgagagtccatg

SEQ ID NO: 656621 - DNA, 25 bp, Mus musculus
gagcttgtctgagcgagagtccatg

SEQ ID NO: 656622 - DNA, 25 bp, Mus musculus
gagcttgtgaaaagccggctgcaga

SEQ ID NO: 656623 - DNA, 25 bp, Mus musculus
gagcttgtgaaatgccggctgcaga

SEQ ID NO: 656624 - DNA, 25 bp, Mus musculus
gagcttgtgagccttccctctggct

SEQ ID NO: 656625 - DNA, 25 bp, Mus musculus
gagcttgtgagcgttccctctggct

SEQ ID NO: 656626 - DNA, 25 bp, Mus musculus
gagcttgtgcccctctgggagcaac

SEQ ID NO: 656627 - DNA, 25 bp, Mus musculus
gagcttgtgcccgtctgggagcaac

SEQ ID NO: 656628 - DNA, 25 bp, Mus musculus
gagcttgtgctgaattacaccaaaa

SEQ ID NO: 656629 - DNA, 25 bp, Mus musculus
gagcttgtgctgtattacaccaaaa

SEQ ID NO: 656630 - DNA, 25 bp, Mus musculus
gagcttgtggatacaagtcaccggg

SEQ ID NO: 656631 - DNA, 25 bp, Mus musculus
gagcttgtggattcaagtcaccggg

SEQ ID NO: 656632 - DNA, 25 bp, Mus musculus
gagcttgtggtgaccatccctaaaa

SEQ ID NO: 656633 - DNA, 25 bp, Mus musculus
gagcttgtggtgtccatccctaaaa

SEQ ID NO: 656634 - DNA, 25 bp, Mus musculus
gagcttgtgtttatctccctggaag

SEQ ID NO: 656635 - DNA, 25 bp, Mus musculus
gagcttgtgtttttctccctggaag

SEQ ID NO: 656636 - DNA, 25 bp, Mus musculus
gagcttgttaccattctcggaggat

SEQ ID NO: 656637 - DNA, 25 bp, Mus musculus
gagcttgttacctttctcggaggat

SEQ ID NO: 656638 - DNA, 25 bp, Mus musculus
gagcttgttagtaccgggtccttga

SEQ ID NO: 656639 - DNA, 25 bp, Mus musculus
gagcttgttagttccgggtccttga

SEQ ID NO: 656640 - DNA, 25 bp, Mus musculus
gagctttaacagacacaatctgaag

SEQ ID NO: 656641 - DNA, 25 bp, Mus musculus
gagctttaacagtcacaatctgaag

SEQ ID NO: 656642 - DNA, 25 bp, Mus musculus
gagctttatagtacacacaaaacag

SEQ ID NO: 656643 - DNA, 25 bp, Mus musculus
gagctttatagttcacacaaaacag

SEQ ID NO: 656644 - DNA, 25 bp, Mus musculus
gagctttcatgcaccagagcccaag

SEQ ID NO: 656645 - DNA, 25 bp, Mus musculus
gagctttcatgctccagagcccaag

SEQ ID NO: 656646 - DNA, 25 bp, Mus musculus
gagctttccagactcagtttaccga

SEQ ID NO: 656647 - DNA, 25 bp, Mus musculus
gagctttccagagtcagtttaccga

SEQ ID NO: 656648 - DNA, 25 bp, Mus musculus
gagctttcctgaaaagaaaagagta

SEQ ID NO: 656649 - DNA, 25 bp, Mus musculus
gagctttcctgataagaaaagagta

SEQ ID NO: 656650 - DNA, 25 bp, Mus musculus
gagctttcgacaatgatgttgatgc

SEQ ID NO: 656651 - DNA, 25 bp, Mus musculus
gagctttcgacattgatgttgatgc

SEQ ID NO: 656652 - DNA, 25 bp, Mus musculus
gagctttctaagcagatgaaacttg

SEQ ID NO: 656653 - DNA, 25 bp, Mus musculus
gagctttctaaggagatgaaacttg

SEQ ID NO: 656654 - DNA, 25 bp, Mus musculus
gagctttctggaaattctgaattga

SEQ ID NO: 656655 - DNA, 25 bp, Mus musculus
gagctttctggatattctgaattga

SEQ ID NO: 656656 - DNA, 25 bp, Mus musculus
gagctttgacatcttctgtgacgtg

SEQ ID NO: 656657 - DNA, 25 bp, Mus musculus
gagctttgacatgttctgtgacgtg

SEQ ID NO: 656658 - DNA, 25 bp, Mus musculus
gagctttgccgtatagtgatggaga

SEQ ID NO: 656659 - DNA, 25 bp, Mus musculus
gagctttgccgtttagtgatggaga

SEQ ID NO: 656660 - DNA, 25 bp, Mus musculus
gagctttgcttcagcccagcgctgc

SEQ ID NO: 656661 - DNA, 25 bp, Mus musculus
gagctttgcttctgcccagcgctgc

SEQ ID NO: 656662 - DNA, 25 bp, Mus musculus
gagctttggcctctgtggtctccct

SEQ ID NO: 656663 - DNA, 25 bp, Mus musculus
gagctttggcctgtgtggtctccct

SEQ ID NO: 656664 - DNA, 25 bp, Mus musculus
gagctttgtgaaatcctcagttgaa

SEQ ID NO: 656665 - DNA, 25 bp, Mus musculus
gagctttgtgaattcctcagttgaa

SEQ ID NO: 656666 - DNA, 25 bp, Mus musculus
gagctttgtgagactcaatggaaaa

SEQ ID NO: 656667 - DNA, 25 bp, Mus musculus
gagctttgtgagtctcaatggaaaa

SEQ ID NO: 656668 - DNA, 25 bp, Mus musculus
gagctttgtgcaccctgggaagccc

SEQ ID NO: 656669 - DNA, 25 bp, Mus musculus
gagctttgtgcagcctgggaagccc

SEQ ID NO: 656670 - DNA, 25 bp, Mus musculus
gagctttgttgcaagctggctcaga

SEQ ID NO: 656671 - DNA, 25 bp, Mus musculus
gagctttgttgctagctggctcaga

SEQ ID NO: 656672 - DNA, 25 bp, Mus musculus
gagcttttactgcaaggcttgggtc

SEQ ID NO: 656673 - DNA, 25 bp, Mus musculus
gagcttttactggaaggcttgggtc

SEQ ID NO: 656674 - DNA, 25 bp, Mus musculus
gagcttttcgacatcctggccgaga

SEQ ID NO: 656675 - DNA, 25 bp, Mus musculus
gagcttttcgacttcctggccgaga

SEQ ID NO: 656676 - DNA, 25 bp, Mus musculus
gagcttttgaatatgtcgcgccagc

SEQ ID NO: 656677 - DNA, 25 bp, Mus musculus
gagcttttgaatttgtcgcgccagc

SEQ ID NO: 656678 - DNA, 25 bp, Mus musculus
gagcttttgcccagcatgtgtaaga

SEQ ID NO: 656679 - DNA, 25 bp, Mus musculus
gagcttttgccctgcatgtgtaaga

SEQ ID NO: 656680 - DNA, 25 bp, Mus musculus
gaggaaaacaccagtccacggtggg

SEQ ID NO: 656681 - DNA, 25 bp, Mus musculus
gaggaaaacacctgtccacggtggg

SEQ ID NO: 656682 - DNA, 25 bp, Mus musculus
gaggaaaagacgcaagccttgactt

SEQ ID NO: 656683 - DNA, 25 bp, Mus musculus
gaggaaaagacggaagccttgactt

SEQ ID NO: 656684 - DNA, 25 bp, Mus musculus
gaggaaaaggcacttaccaccactt

SEQ ID NO: 656685 - DNA, 25 bp, Mus musculus
gaggaaaaggcacttcatagaggtc

SEQ ID NO: 656686 - DNA, 25 bp, Mus musculus
gaggaaaaggcagttaccaccactt

SEQ ID NO: 656687 - DNA, 25 bp, Mus musculus
gaggaaaaggcagttcatagaggtc

SEQ ID NO: 656688 - DNA, 25 bp, Mus musculus
gaggaaacaatcctgtactcagaca

SEQ ID NO: 656689 - DNA, 25 bp, Mus musculus
gaggaaacaatcgtgtactcagaca

SEQ ID NO: 656690 - DNA, 25 bp, Mus musculus
gaggaaacacccagccaagtagact

SEQ ID NO: 656691 - DNA, 25 bp, Mus musculus
gaggaaacaccctgccaagtagact

SEQ ID NO: 656692 - DNA, 25 bp, Mus musculus
gaggaaaccctgagtatcagtagag

SEQ ID NO: 656693 - DNA, 25 bp, Mus musculus
gaggaaaccctgtgtatcagtagag

SEQ ID NO: 656694 - DNA, 25 bp, Mus musculus
gaggaaacctagcagctcaggctgc

SEQ ID NO: 656695 - DNA, 25 bp, Mus musculus
gaggaaacctaggagctcaggctgc

SEQ ID NO: 656696 - DNA, 25 bp, Mus musculus
gaggaaacctcgagagactttcatg

SEQ ID NO: 656697 - DNA, 25 bp, Mus musculus
gaggaaacctcgtgagactttcatg

SEQ ID NO: 656698 - DNA, 25 bp, Mus musculus
gaggaaaccttcagcagacactggt

SEQ ID NO: 656699 - DNA, 25 bp, Mus musculus
gaggaaaccttctgcagacactggt

SEQ ID NO: 656700 - DNA, 25 bp, Mus musculus
gaggaaacgcccagtagctctggaa

SEQ ID NO: 656701 - DNA, 25 bp, Mus musculus
gaggaaacgccctgtagctctggaa

SEQ ID NO: 656702 - DNA, 25 bp, Mus musculus
gaggaaacgtgtacttctccacgac

SEQ ID NO: 656703 - DNA, 25 bp, Mus musculus
gaggaaacgtgttcttctccacgac

SEQ ID NO: 656704 - DNA, 25 bp, Mus musculus
gaggaaactcctagggagcgccctg

SEQ ID NO: 656705 - DNA, 25 bp, Mus musculus
gaggaaactccttgggagcgccctg

SEQ ID NO: 656706 - DNA, 25 bp, Mus musculus
gaggaaactgaaccctgagagtatg

SEQ ID NO: 656707 - DNA, 25 bp, Mus musculus
gaggaaactgaagcctgagagtatg

SEQ ID NO: 656708 - DNA, 25 bp, Mus musculus
gaggaaactgcacaatagtacagta

SEQ ID NO: 656709 - DNA, 25 bp, Mus musculus
gaggaaactgcagaatagtacagta

SEQ ID NO: 656710 - DNA, 25 bp, Mus musculus
gaggaaactgtaaaagctatgctgg

SEQ ID NO: 656711 - DNA, 25 bp, Mus musculus
gaggaaactgtataagctatgctgg

SEQ ID NO: 656712 - DNA, 25 bp, Mus musculus
gaggaaacttccatggtgaataccc

SEQ ID NO: 656713 - DNA, 25 bp, Mus musculus
gaggaaacttccttggtgaataccc

SEQ ID NO: 656714 - DNA, 25 bp, Mus musculus
gaggaaactttactttcatggagta

SEQ ID NO: 656715 - DNA, 25 bp, Mus musculus
gaggaaactttagtttcatggagta

SEQ ID NO: 656716 - DNA, 25 bp, Mus musculus
gaggaaagagttcctggatgacctt

SEQ ID NO: 656717 - DNA, 25 bp, Mus musculus
gaggaaagagttgctggatgacctt

SEQ ID NO: 656718 - DNA, 25 bp, Mus musculus
gaggaaagcaacatcgggaagcatc

SEQ ID NO: 656719 - DNA, 25 bp, Mus musculus
gaggaaagcaacttcgggaagcatc

SEQ ID NO: 656720 - DNA, 25 bp, Mus musculus
gaggaaagcttcagagtaatgatga

SEQ ID NO: 656721 - DNA, 25 bp, Mus musculus
gaggaaagcttctgagtaatgatga

SEQ ID NO: 656722 - DNA, 25 bp, Mus musculus
gaggaaaggaaacttcttggtgctt

SEQ ID NO: 656723 - DNA, 25 bp, Mus musculus
gaggaaaggaaagttcttggtgctt

SEQ ID NO: 656724 - DNA, 25 bp, Mus musculus
gaggaaagggcactgtcttcaagac

SEQ ID NO: 656725 - DNA, 25 bp, Mus musculus
gaggaaagggcagtgtcttcaagac

SEQ ID NO: 656726 - DNA, 25 bp, Mus musculus
gaggaaagggccaagcatgaccagc

SEQ ID NO: 656727 - DNA, 25 bp, Mus musculus
gaggaaagggcctagcatgaccagc

SEQ ID NO: 656728 - DNA, 25 bp, Mus musculus
gaggaaaggtctaagccctgagtca

SEQ ID NO: 656729 - DNA, 25 bp, Mus musculus
gaggaaaggtcttagccctgagtca

SEQ ID NO: 656730 - DNA, 25 bp, Mus musculus
gaggaaataaatacttggccaagcc

SEQ ID NO: 656731 - DNA, 25 bp, Mus musculus
gaggaaataaattcttggccaagcc

SEQ ID NO: 656732 - DNA, 25 bp, Mus musculus
gaggaaataccaacgccgagaatca

SEQ ID NO: 656733 - DNA, 25 bp, Mus musculus
gaggaaataccatcgccgagaatca

SEQ ID NO: 656734 - DNA, 25 bp, Mus musculus
gaggaaatataacaaaacgtcccag

SEQ ID NO: 656735 - DNA, 25 bp, Mus musculus
gaggaaatataagaaaacgtcccag

SEQ ID NO: 656736 - DNA, 25 bp, Mus musculus
gaggaaatccgacgcaaagcaattg

SEQ ID NO: 656737 - DNA, 25 bp, Mus musculus
gaggaaatccgaggcaaagcaattg

SEQ ID NO: 656738 - DNA, 25 bp, Mus musculus
gaggaaatcgttaggcttggccaac

SEQ ID NO: 656739 - DNA, 25 bp, Mus musculus
gaggaaatcgtttggcttggccaac

SEQ ID NO: 656740 - DNA, 25 bp, Mus musculus
gaggaaatctcacaaatcaaagagg

SEQ ID NO: 656741 - DNA, 25 bp, Mus musculus
gaggaaatctcagaaatcaaagagg

SEQ ID NO: 656742 - DNA, 25 bp, Mus musculus
gaggaaatctctccccatttggcag

SEQ ID NO: 656743 - DNA, 25 bp, Mus musculus
gaggaaatctctgcccatttggcag

SEQ ID NO: 656744 - DNA, 25 bp, Mus musculus
gaggaaatgccccagccatgatgaa

SEQ ID NO: 656745 - DNA, 25 bp, Mus musculus
gaggaaatgcccgagccatgatgaa

SEQ ID NO: 656746 - DNA, 25 bp, Mus musculus
gaggaaatgctgaaagttcttcttc

SEQ ID NO: 656747 - DNA, 25 bp, Mus musculus
gaggaaatgctgtaagttcttcttc

SEQ ID NO: 656748 - DNA, 25 bp, Mus musculus
gaggaaatggccctgctgcagtctt

SEQ ID NO: 656749 - DNA, 25 bp, Mus musculus
gaggaaatggccgtgctgcagtctt

SEQ ID NO: 656750 - DNA, 25 bp, Mus musculus
gaggaaatggtcctcacagattcca

SEQ ID NO: 656751 - DNA, 25 bp, Mus musculus
gaggaaatggtcgtcacagattcca

SEQ ID NO: 656752 - DNA, 25 bp, Mus musculus
gaggaaattccccagaaggaattag

SEQ ID NO: 656753 - DNA, 25 bp, Mus musculus
gaggaaattcccgagaaggaattag

SEQ ID NO: 656754 - DNA, 25 bp, Mus musculus
gaggaaattgtgatcactctgccaa

SEQ ID NO: 656755 - DNA, 25 bp, Mus musculus
gaggaaattgtgttcactctgccaa

SEQ ID NO: 656756 - DNA, 25 bp, Mus musculus
gaggaacaaacacgtagccatgggc

SEQ ID NO: 656757 - DNA, 25 bp, Mus musculus
gaggaacaaacaggtagccatgggc

SEQ ID NO: 656758 - DNA, 25 bp, Mus musculus
gaggaacaaactcctcttcattgag

SEQ ID NO: 656759 - DNA, 25 bp, Mus musculus
gaggaacaaactgctcttcattgag

SEQ ID NO: 656760 - DNA, 25 bp, Mus musculus
gaggaacaaatcacctgctgttcaa

SEQ ID NO: 656761 - DNA, 25 bp, Mus musculus
gaggaacaaatctcctgctgttcaa

SEQ ID NO: 656762 - DNA, 25 bp, Mus musculus
gaggaacaacagaaactatgtttag

SEQ ID NO: 656763 - DNA, 25 bp, Mus musculus
gaggaacaacagtaactatgtttag

SEQ ID NO: 656764 - DNA, 25 bp, Mus musculus
gaggaacaattgctgcagcgcctaa

SEQ ID NO: 656765 - DNA, 25 bp, Mus musculus
gaggaacaattggtgcagcgcctaa

SEQ ID NO: 656766 - DNA, 25 bp, Mus musculus
gaggaacaccacagctctacgctgt

SEQ ID NO: 656767 - DNA, 25 bp, Mus musculus
gaggaacaccactgctctacgctgt

SEQ ID NO: 656768 - DNA, 25 bp, Mus musculus
gaggaacaccgacgaagaagactta

SEQ ID NO: 656769 - DNA, 25 bp, Mus musculus
gaggaacaccgaggaagaagactta

SEQ ID NO: 656770 - DNA, 25 bp, Mus musculus
gaggaacacctcagtggatgagaac

SEQ ID NO: 656771 - DNA, 25 bp, Mus musculus
gaggaacacctctgtggatgagaac

SEQ ID NO: 656772 - DNA, 25 bp, Mus musculus
gaggaacagaggaggaaagtattca

SEQ ID NO: 656773 - DNA, 25 bp, Mus musculus
gaggaacagaggtggaaagtattca

SEQ ID NO: 656774 - DNA, 25 bp, Mus musculus
gaggaacagtcgataccagctaaag

SEQ ID NO: 656775 - DNA, 25 bp, Mus musculus
gaggaacagtcgttaccagctaaag

SEQ ID NO: 656776 - DNA, 25 bp, Mus musculus
gaggaacatgctaaaaggccaacat

SEQ ID NO: 656777 - DNA, 25 bp, Mus musculus
gaggaacatgcttaaaggccaacat

SEQ ID NO: 656778 - DNA, 25 bp, Mus musculus
gaggaaccaactattcaagccaatg

SEQ ID NO: 656779 - DNA, 25 bp, Mus musculus
gaggaaccaacttttcaagccaatg

SEQ ID NO: 656780 - DNA, 25 bp, Mus musculus
gaggaaccaagcctacaggtacaga

SEQ ID NO: 656781 - DNA, 25 bp, Mus musculus
gaggaaccaagcgtacaggtacaga

SEQ ID NO: 656782 - DNA, 25 bp, Mus musculus
gaggaacccacacagcggcttccgg

SEQ ID NO: 656783 - DNA, 25 bp, Mus musculus
gaggaacccacagagcggcttccgg

SEQ ID NO: 656784 - DNA, 25 bp, Mus musculus
gaggaacccagcagtggatcgcctg

SEQ ID NO: 656785 - DNA, 25 bp, Mus musculus
gaggaacccagctgtggatcgcctg

SEQ ID NO: 656786 - DNA, 25 bp, Mus musculus
gaggaaccctatccagcatggcagg

SEQ ID NO: 656787 - DNA, 25 bp, Mus musculus
gaggaaccctatgcagcatggcagg

SEQ ID NO: 656788 - DNA, 25 bp, Mus musculus
gaggaaccctgccatgtgtagtgaa

SEQ ID NO: 656789 - DNA, 25 bp, Mus musculus
gaggaaccctgcgatgtgtagtgaa

SEQ ID NO: 656790 - DNA, 25 bp, Mus musculus
gaggaaccgcccaacatggcatcag

SEQ ID NO: 656791 - DNA, 25 bp, Mus musculus
gaggaaccgccctacatggcatcag

SEQ ID NO: 656792 - DNA, 25 bp, Mus musculus
gaggaaccgtgaaagctgcttcagg

SEQ ID NO: 656793 - DNA, 25 bp, Mus musculus
gaggaaccgtgatagctgcttcagg

SEQ ID NO: 656794 - DNA, 25 bp, Mus musculus
gaggaacctccccgagacaccaaga

SEQ ID NO: 656795 - DNA, 25 bp, Mus musculus
gaggaacctcccggagacaccaaga

SEQ ID NO: 656796 - DNA, 25 bp, Mus musculus
gaggaacgacctatggctatgaagt

SEQ ID NO: 656797 - DNA, 25 bp, Mus musculus
gaggaacgacctttggctatgaagt

SEQ ID NO: 656798 - DNA, 25 bp, Mus musculus
gaggaacgccgcactgtggtagaca

SEQ ID NO: 656799 - DNA, 25 bp, Mus musculus
gaggaacgccgctctgtggtagaca

SEQ ID NO: 656800 - DNA, 25 bp, Mus musculus
gaggaacgggcaagtttaaggaact

SEQ ID NO: 656801 - DNA, 25 bp, Mus musculus
gaggaacgggcatgtttaaggaact

SEQ ID NO: 656802 - DNA, 25 bp, Mus musculus
gaggaactactcacttcattaattt

SEQ ID NO: 656803 - DNA, 25 bp, Mus musculus
gaggaactactctcttcattaattt

SEQ ID NO: 656804 - DNA, 25 bp, Mus musculus
gaggaactcagccagccctttggag

SEQ ID NO: 656805 - DNA, 25 bp, Mus musculus
gaggaactcagcgagccctttggag

SEQ ID NO: 656806 - DNA, 25 bp, Mus musculus
gaggaactctccagggatcttgtaa

SEQ ID NO: 656807 - DNA, 25 bp, Mus musculus
gaggaactctcctgggatcttgtaa

SEQ ID NO: 656808 - DNA, 25 bp, Mus musculus
gaggaactgatgaatatttcatccg

SEQ ID NO: 656809 - DNA, 25 bp, Mus musculus
gaggaactgatgagtaacttctact

SEQ ID NO: 656810 - DNA, 25 bp, Mus musculus
gaggaactgatgtatatttcatccg

SEQ ID NO: 656811 - DNA, 25 bp, Mus musculus
gaggaactgatgtgtaacttctact

SEQ ID NO: 656812 - DNA, 25 bp, Mus musculus
gaggaactggctagccccttaaggg

SEQ ID NO: 656813 - DNA, 25 bp, Mus musculus
gaggaactggcttgccccttaaggg

SEQ ID NO: 656814 - DNA, 25 bp, Mus musculus
gaggaacttcagagcataataaaaa

SEQ ID NO: 656815 - DNA, 25 bp, Mus musculus
gaggaacttcagtgcataataaaaa

SEQ ID NO: 656816 - DNA, 25 bp, Mus musculus
gaggaactttgacagtacctttatg

SEQ ID NO: 656817 - DNA, 25 bp, Mus musculus
gaggaactttgagagtacctttatg

SEQ ID NO: 656818 - DNA, 25 bp, Mus musculus
gaggaagaaaagctccaacaatttg

SEQ ID NO: 656819 - DNA, 25 bp, Mus musculus
gaggaagaaaaggtccaacaatttg

SEQ ID NO: 656820 - DNA, 25 bp, Mus musculus
gaggaagaaagcaggcccatgagtt

SEQ ID NO: 656821 - DNA, 25 bp, Mus musculus
gaggaagaaagctggcccatgagtt

SEQ ID NO: 656822 - DNA, 25 bp, Mus musculus
gaggaagaaagtcatctctaccagc

SEQ ID NO: 656823 - DNA, 25 bp, Mus musculus
gaggaagaaagtgatctctaccagc

SEQ ID NO: 656824 - DNA, 25 bp, Mus musculus
gaggaagaacccataatcgtcgaga

SEQ ID NO: 656825 - DNA, 25 bp, Mus musculus
gaggaagaacccttaatcgtcgaga

SEQ ID NO: 656826 - DNA, 25 bp, Mus musculus
gaggaagaagttaccatttttattg

SEQ ID NO: 656827 - DNA, 25 bp, Mus musculus
gaggaagaagttatggagatcacaa

SEQ ID NO: 656828 - DNA, 25 bp, Mus musculus
gaggaagaagtttccatttttattg

SEQ ID NO: 656829 - DNA, 25 bp, Mus musculus
gaggaagaagttttggagatcacaa

SEQ ID NO: 656830 - DNA, 25 bp, Mus musculus
gaggaagaatccacttcaactctat

SEQ ID NO: 656831 - DNA, 25 bp, Mus musculus
gaggaagaatcctcttcaactctat

SEQ ID NO: 656832 - DNA, 25 bp, Mus musculus
gaggaagaatggaactcagcgccca

SEQ ID NO: 656833 - DNA, 25 bp, Mus musculus
gaggaagaatggtactcagcgccca

SEQ ID NO: 656834 - DNA, 25 bp, Mus musculus
gaggaagaattcattgatgcccatg

SEQ ID NO: 656835 - DNA, 25 bp, Mus musculus
gaggaagaattctttgatgcccatg

SEQ ID NO: 656836 - DNA, 25 bp, Mus musculus
gaggaagaccagcactacagctttc

SEQ ID NO: 656837 - DNA, 25 bp, Mus musculus
gaggaagaccaggactacagctttc

SEQ ID NO: 656838 - DNA, 25 bp, Mus musculus
gaggaagacgcaccttccacattag

SEQ ID NO: 656839 - DNA, 25 bp, Mus musculus
gaggaagacgcagcttccacattag

SEQ ID NO: 656840 - DNA, 25 bp, Mus musculus
gaggaagagaaccaccacctgcgag

SEQ ID NO: 656841 - DNA, 25 bp, Mus musculus
gaggaagagaacgaccacctgcgag

SEQ ID NO: 656842 - DNA, 25 bp, Mus musculus
gaggaagagcccattggacctgatc

SEQ ID NO: 656843 - DNA, 25 bp, Mus musculus
gaggaagagccctttggacctgatc

SEQ ID NO: 656844 - DNA, 25 bp, Mus musculus
gaggaagagcggaccactgcctagc

SEQ ID NO: 656845 - DNA, 25 bp, Mus musculus
gaggaagagcggtccactgcctagc

SEQ ID NO: 656846 - DNA, 25 bp, Mus musculus
gaggaagagctgatacagtctgaga

SEQ ID NO: 656847 - DNA, 25 bp, Mus musculus
gaggaagagctgttacagtctgaga

SEQ ID NO: 656848 - DNA, 25 bp, Mus musculus
gaggaagatgctagccgctgtatcc

SEQ ID NO: 656849 - DNA, 25 bp, Mus musculus
gaggaagatgcttgccgctgtatcc

SEQ ID NO: 656850 - DNA, 25 bp, Mus musculus
gaggaagcacggaagagccccacac

SEQ ID NO: 656851 - DNA, 25 bp, Mus musculus
gaggaagcacggtagagccccacac

SEQ ID NO: 656852 - DNA, 25 bp, Mus musculus
gaggaagcagaaagggaaagcatca

SEQ ID NO: 656853 - DNA, 25 bp, Mus musculus
gaggaagcagaatgggaaagcatca

SEQ ID NO: 656854 - DNA, 25 bp, Mus musculus
gaggaagcagtcattgtacgtgaaa

SEQ ID NO: 656855 - DNA, 25 bp, Mus musculus
gaggaagcagtctttgtacgtgaaa

SEQ ID NO: 656856 - DNA, 25 bp, Mus musculus
gaggaagcattcagcatctgccctt

SEQ ID NO: 656857 - DNA, 25 bp, Mus musculus
gaggaagcattctgcatctgccctt

SEQ ID NO: 656858 - DNA, 25 bp, Mus musculus
gaggaagccaataaagtacctggag

SEQ ID NO: 656859 - DNA, 25 bp, Mus musculus
gaggaagccaattaagtacctggag

SEQ ID NO: 656860 - DNA, 25 bp, Mus musculus
gaggaagccactctcctcactggga

SEQ ID NO: 656861 - DNA, 25 bp, Mus musculus
gaggaagccactgtcctcactggga

SEQ ID NO: 656862 - DNA, 25 bp, Mus musculus
gaggaagccagccagaagaactaga

SEQ ID NO: 656863 - DNA, 25 bp, Mus musculus
gaggaagccagcgagaagaactaga

SEQ ID NO: 656864 - DNA, 25 bp, Mus musculus
gaggaagccattctacccagctctt

SEQ ID NO: 656865 - DNA, 25 bp, Mus musculus
gaggaagccattgtacccagctctt

SEQ ID NO: 656866 - DNA, 25 bp, Mus musculus
gaggaagcccataacagggcccctt

SEQ ID NO: 656867 - DNA, 25 bp, Mus musculus
gaggaagcccattacagggcccctt

SEQ ID NO: 656868 - DNA, 25 bp, Mus musculus
gaggaagccgctcccagcaggaatt

SEQ ID NO: 656869 - DNA, 25 bp, Mus musculus
gaggaagccgctgccagcaggaatt

SEQ ID NO: 656870 - DNA, 25 bp, Mus musculus
gaggaagccttgcaaactctacaaa

SEQ ID NO: 656871 - DNA, 25 bp, Mus musculus
gaggaagccttggaaactctacaaa

SEQ ID NO: 656872 - DNA, 25 bp, Mus musculus
gaggaagcgagaagaccattctgct

SEQ ID NO: 656873 - DNA, 25 bp, Mus musculus
gaggaagcgagatgaccattctgct

SEQ ID NO: 656874 - DNA, 25 bp, Mus musculus
gaggaagcggcaagtagagactccc

SEQ ID NO: 656875 - DNA, 25 bp, Mus musculus
gaggaagcggcatgtagagactccc

SEQ ID NO: 656876 - DNA, 25 bp, Mus musculus
gaggaagcgtataccacagaacact

SEQ ID NO: 656877 - DNA, 25 bp, Mus musculus
gaggaagcgtattccacagaacact

SEQ ID NO: 656878 - DNA, 25 bp, Mus musculus
gaggaagctacgctcaatgagatgt

SEQ ID NO: 656879 - DNA, 25 bp, Mus musculus
gaggaagctacggtcaatgagatgt

SEQ ID NO: 656880 - DNA, 25 bp, Mus musculus
gaggaagctattcccaatatcactg

SEQ ID NO: 656881 - DNA, 25 bp, Mus musculus
gaggaagctattgccaatatcactg

SEQ ID NO: 656882 - DNA, 25 bp, Mus musculus
gaggaagctcatcagtggaaccaga

SEQ ID NO: 656883 - DNA, 25 bp, Mus musculus
gaggaagctcatgagtggaaccaga

SEQ ID NO: 656884 - DNA, 25 bp, Mus musculus
gaggaagctcctagctgaagcaggt

SEQ ID NO: 656885 - DNA, 25 bp, Mus musculus
gaggaagctccttgctgaagcaggt

SEQ ID NO: 656886 - DNA, 25 bp, Mus musculus
gaggaagctcggcaatatctcaaca

SEQ ID NO: 656887 - DNA, 25 bp, Mus musculus
gaggaagctcgggaatatctcaaca

SEQ ID NO: 656888 - DNA, 25 bp, Mus musculus
gaggaagctcttctgtcccgtgccc

SEQ ID NO: 656889 - DNA, 25 bp, Mus musculus
gaggaagctcttgtgtcccgtgccc

SEQ ID NO: 656890 - DNA, 25 bp, Mus musculus
gaggaagctgttaccttccagcggg

SEQ ID NO: 656891 - DNA, 25 bp, Mus musculus
gaggaagctgtttccttccagcggg

SEQ ID NO: 656892 - DNA, 25 bp, Mus musculus
gaggaaggaactacaggccgaagcc

SEQ ID NO: 656893 - DNA, 25 bp, Mus musculus
gaggaaggaacttcaggccgaagcc

SEQ ID NO: 656894 - DNA, 25 bp, Mus musculus
gaggaaggaatgagccactgttgct

SEQ ID NO: 656895 - DNA, 25 bp, Mus musculus
gaggaaggaatgtgccactgttgct

SEQ ID NO: 656896 - DNA, 25 bp, Mus musculus
gaggaaggacctcctcacactaaaa

SEQ ID NO: 656897 - DNA, 25 bp, Mus musculus
gaggaaggacctgctcacactaaaa

SEQ ID NO: 656898 - DNA, 25 bp, Mus musculus
gaggaaggagacataagatccacac

SEQ ID NO: 656899 - DNA, 25 bp, Mus musculus
gaggaaggagacttaagatccacac

SEQ ID NO: 656900 - DNA, 25 bp, Mus musculus
gaggaaggatacagagctctgaatt

SEQ ID NO: 656901 - DNA, 25 bp, Mus musculus
gaggaaggatactgagctctgaatt

SEQ ID NO: 656902 - DNA, 25 bp, Mus musculus
gaggaaggatttatggtggccaaca

SEQ ID NO: 656903 - DNA, 25 bp, Mus musculus
gaggaaggatttttggtggccaaca

SEQ ID NO: 656904 - DNA, 25 bp, Mus musculus
gaggaaggcgtgacacccaagaagc

SEQ ID NO: 656905 - DNA, 25 bp, Mus musculus
gaggaaggcgtgtcacccaagaagc

SEQ ID NO: 656906 - DNA, 25 bp, Mus musculus
gaggaagggcctccatcctactatg

SEQ ID NO: 656907 - DNA, 25 bp, Mus musculus
gaggaagggcctgcatcctactatg

SEQ ID NO: 656908 - DNA, 25 bp, Mus musculus
gaggaagggtccaccctcagcgtgc

SEQ ID NO: 656909 - DNA, 25 bp, Mus musculus
gaggaagggtcctccctcagcgtgc

SEQ ID NO: 656910 - DNA, 25 bp, Mus musculus
gaggaaggtatcagtcagaggacac

SEQ ID NO: 656911 - DNA, 25 bp, Mus musculus
gaggaaggtatctgtcagaggacac

SEQ ID NO: 656912 - DNA, 25 bp, Mus musculus
gaggaaggtggaaagactccattga

SEQ ID NO: 656913 - DNA, 25 bp, Mus musculus
gaggaaggtggatagactccattga

SEQ ID NO: 656914 - DNA, 25 bp, Mus musculus
gaggaagtacctagtgccctccgac

SEQ ID NO: 656915 - DNA, 25 bp, Mus musculus
gaggaagtaccttgtgccctccgac

SEQ ID NO: 656916 - DNA, 25 bp, Mus musculus
gaggaagtatctagcagtggtcctc

SEQ ID NO: 656917 - DNA, 25 bp, Mus musculus
gaggaagtatcttgcagtggtcctc

SEQ ID NO: 656918 - DNA, 25 bp, Mus musculus
gaggaagtattaccaaggtcctcat

SEQ ID NO: 656919 - DNA, 25 bp, Mus musculus
gaggaagtattagcaaggtcctcat

SEQ ID NO: 656920 - DNA, 25 bp, Mus musculus
gaggaagtcgttcctaccgcccctg

SEQ ID NO: 656921 - DNA, 25 bp, Mus musculus
gaggaagtcgttgctaccgcccctg

SEQ ID NO: 656922 - DNA, 25 bp, Mus musculus
gaggaagtctggaatcacttccctg

SEQ ID NO: 656923 - DNA, 25 bp, Mus musculus
gaggaagtctggtatcacttccctg

SEQ ID NO: 656924 - DNA, 25 bp, Mus musculus
gaggaagtgaacatccctagccggc

SEQ ID NO: 656925 - DNA, 25 bp, Mus musculus
gaggaagtgaacttccctagccggc

SEQ ID NO: 656926 - DNA, 25 bp, Mus musculus
gaggaagtgcgtctggttttcaccc

SEQ ID NO: 656927 - DNA, 25 bp, Mus musculus
gaggaagtgcgtgtggttttcaccc

SEQ ID NO: 656928 - DNA, 25 bp, Mus musculus
gaggaagtggatagaaaagcagaac

SEQ ID NO: 656929 - DNA, 25 bp, Mus musculus
gaggaagtggattgaaaagcagaac

SEQ ID NO: 656930 - DNA, 25 bp, Mus musculus
gaggaagtggttaccgcagaatctg

SEQ ID NO: 656931 - DNA, 25 bp, Mus musculus
gaggaagtggtttccgcagaatctg

SEQ ID NO: 656932 - DNA, 25 bp, Mus musculus
gaggaatacagtaatagggaccccg

SEQ ID NO: 656933 - DNA, 25 bp, Mus musculus
gaggaatacagttatagggaccccg

SEQ ID NO: 656934 - DNA, 25 bp, Mus musculus
gaggaatcagcccttgcattatcat

SEQ ID NO: 656935 - DNA, 25 bp, Mus musculus
gaggaatcagccgttgcattatcat

SEQ ID NO: 656936 - DNA, 25 bp, Mus musculus
gaggaatcatggctatcgagatcta

SEQ ID NO: 656937 - DNA, 25 bp, Mus musculus
gaggaatcatgggtatcgagatcta

SEQ ID NO: 656938 - DNA, 25 bp, Mus musculus
gaggaatccaacatccccttcatca

SEQ ID NO: 656939 - DNA, 25 bp, Mus musculus
gaggaatccaacttccccttcatca

SEQ ID NO: 656940 - DNA, 25 bp, Mus musculus
gaggaatcctttatagccgcggtgc

SEQ ID NO: 656941 - DNA, 25 bp, Mus musculus
gaggaatcctttttagccgcggtgc

SEQ ID NO: 656942 - DNA, 25 bp, Mus musculus
gaggaatgacaactcatctagattc

SEQ ID NO: 656943 - DNA, 25 bp, Mus musculus
gaggaatgacaagtcatctagattc

SEQ ID NO: 656944 - DNA, 25 bp, Mus musculus
gaggaatgatgcagtagaggctcaa

SEQ ID NO: 656945 - DNA, 25 bp, Mus musculus
gaggaatgatgctgtagaggctcaa

SEQ ID NO: 656946 - DNA, 25 bp, Mus musculus
gaggaatgcctccagttcattgcca

SEQ ID NO: 656947 - DNA, 25 bp, Mus musculus
gaggaatgcctcgagttcattgcca

SEQ ID NO: 656948 - DNA, 25 bp, Mus musculus
gaggaatgcgatacagcgtcgatgt

SEQ ID NO: 656949 - DNA, 25 bp, Mus musculus
gaggaatgcgattcagcgtcgatgt

SEQ ID NO: 656950 - DNA, 25 bp, Mus musculus
gaggaatgctcaagtcaattcacag

SEQ ID NO: 656951 - DNA, 25 bp, Mus musculus
gaggaatgctcatgtcaattcacag

SEQ ID NO: 656952 - DNA, 25 bp, Mus musculus
gaggaatggagtagctcactctgcc

SEQ ID NO: 656953 - DNA, 25 bp, Mus musculus
gaggaatggagttgctcactctgcc

SEQ ID NO: 656954 - DNA, 25 bp, Mus musculus
gaggaatggcatcgacgtagacaaa

SEQ ID NO: 656955 - DNA, 25 bp, Mus musculus
gaggaatggcatggacgtagacaaa

SEQ ID NO: 656956 - DNA, 25 bp, Mus musculus
gaggaatggcttacccagggagaca

SEQ ID NO: 656957 - DNA, 25 bp, Mus musculus
gaggaatggctttcccagggagaca

SEQ ID NO: 656958 - DNA, 25 bp, Mus musculus
gaggaatgggctactccacacaagc

SEQ ID NO: 656959 - DNA, 25 bp, Mus musculus
gaggaatgggcttctccacacaagc

SEQ ID NO: 656960 - DNA, 25 bp, Mus musculus
gaggaattatcacatattctatgca

SEQ ID NO: 656961 - DNA, 25 bp, Mus musculus
gaggaattatcagatattctatgca

SEQ ID NO: 656962 - DNA, 25 bp, Mus musculus
gaggaattcttgctctgcacagaga

SEQ ID NO: 656963 - DNA, 25 bp, Mus musculus
gaggaattcttggtctgcacagaga

SEQ ID NO: 656964 - DNA, 25 bp, Mus musculus
gaggaattgccacaccgccagtgta

SEQ ID NO: 656965 - DNA, 25 bp, Mus musculus
gaggaattgccagaccgccagtgta

SEQ ID NO: 656966 - DNA, 25 bp, Mus musculus
gaggaattgctaaaggaggcaaagc

SEQ ID NO: 656967 - DNA, 25 bp, Mus musculus
gaggaattgctataggaggcaaagc

SEQ ID NO: 656968 - DNA, 25 bp, Mus musculus
gaggaattggcaactcctggctgtc

SEQ ID NO: 656969 - DNA, 25 bp, Mus musculus
gaggaattggcatctcctggctgtc

SEQ ID NO: 656970 - DNA, 25 bp, Mus musculus
gaggaattggctccttattttgacc

SEQ ID NO: 656971 - DNA, 25 bp, Mus musculus
gaggaattggctgcttattttgacc

SEQ ID NO: 656972 - DNA, 25 bp, Mus musculus
gaggaattggttacattcatcacaa

SEQ ID NO: 656973 - DNA, 25 bp, Mus musculus
gaggaattggtttcattcatcacaa

SEQ ID NO: 656974 - DNA, 25 bp, Mus musculus
gaggaattgtgcagtattggcatca

SEQ ID NO: 656975 - DNA, 25 bp, Mus musculus
gaggaattgtgctgtattggcatca

SEQ ID NO: 656976 - DNA, 25 bp, Mus musculus
gaggaatttagacccgacttgatag

SEQ ID NO: 656977 - DNA, 25 bp, Mus musculus
gaggaatttagagccgacttgatag

SEQ ID NO: 656978 - DNA, 25 bp, Mus musculus
gaggaatttcgtcgcctggctgccc

SEQ ID NO: 656979 - DNA, 25 bp, Mus musculus
gaggaatttcgtggcctggctgccc

SEQ ID NO: 656980 - DNA, 25 bp, Mus musculus
gaggaatttggaagttccctaagaa

SEQ ID NO: 656981 - DNA, 25 bp, Mus musculus
gaggaatttggatgttccctaagaa

SEQ ID NO: 656982 - DNA, 25 bp, Mus musculus
gaggaatttgtcatggcgagcagat

SEQ ID NO: 656983 - DNA, 25 bp, Mus musculus
gaggaatttgtcttggcgagcagat

SEQ ID NO: 656984 - DNA, 25 bp, Mus musculus
gaggacaaagcaccctgaccgtgcc

SEQ ID NO: 656985 - DNA, 25 bp, Mus musculus
gaggacaaagcagcctgaccgtgcc

SEQ ID NO: 656986 - DNA, 25 bp, Mus musculus
gaggacaagaccaacatccgtaagg

SEQ ID NO: 656987 - DNA, 25 bp, Mus musculus
gaggacaagacctacatccgtaagg

SEQ ID NO: 656988 - DNA, 25 bp, Mus musculus
gaggacaagcaaaccagacgatgca

SEQ ID NO: 656989 - DNA, 25 bp, Mus musculus
gaggacaagcaatccagacgatgca

SEQ ID NO: 656990 - DNA, 25 bp, Mus musculus
gaggacaagcttctcctgagacacc

SEQ ID NO: 656991 - DNA, 25 bp, Mus musculus
gaggacaagcttgtcctgagacacc

SEQ ID NO: 656992 - DNA, 25 bp, Mus musculus
gaggacacacgtcacggaatggaat

SEQ ID NO: 656993 - DNA, 25 bp, Mus musculus
gaggacacacgtgacggaatggaat

SEQ ID NO: 656994 - DNA, 25 bp, Mus musculus
gaggacacactcagattaaaaatta

SEQ ID NO: 656995 - DNA, 25 bp, Mus musculus
gaggacacactctgattaaaaatta

SEQ ID NO: 656996 - DNA, 25 bp, Mus musculus
gaggacacagccatttcacctgtga

SEQ ID NO: 656997 - DNA, 25 bp, Mus musculus
gaggacacagccttttcacctgtga

SEQ ID NO: 656998 - DNA, 25 bp, Mus musculus
gaggacacatgtagactagataggt

SEQ ID NO: 656999 - DNA, 25 bp, Mus musculus
gaggacacatgttgactagataggt

SEQ ID NO: 657000 - DNA, 25 bp, Mus musculus
gaggacaccagcctctcgcagaagt

SEQ ID NO: 657001 - DNA, 25 bp, Mus musculus
gaggacaccagcgtctcgcagaagt

SEQ ID NO: 657002 - DNA, 25 bp, Mus musculus
gaggacaccttccacggaagacaga

SEQ ID NO: 657003 - DNA, 25 bp, Mus musculus
gaggacaccttcgacggaagacaga

SEQ ID NO: 657004 - DNA, 25 bp, Mus musculus
gaggacaccttgagggccttcgctt

SEQ ID NO: 657005 - DNA, 25 bp, Mus musculus
gaggacaccttgtgggccttcgctt

SEQ ID NO: 657006 - DNA, 25 bp, Mus musculus
gaggacacggacacagaggagtaca

SEQ ID NO: 657007 - DNA, 25 bp, Mus musculus
gaggacacggacacgggccccatgt

SEQ ID NO: 657008 - DNA, 25 bp, Mus musculus
gaggacacggactcagaggagtaca

SEQ ID NO: 657009 - DNA, 25 bp, Mus musculus
gaggacacggactcgggccccatgt

SEQ ID NO: 657010 - DNA, 25 bp, Mus musculus
gaggacactaagaacaccaccctga

SEQ ID NO: 657011 - DNA, 25 bp, Mus musculus
gaggacactaagtacaccaccctga

SEQ ID NO: 657012 - DNA, 25 bp, Mus musculus
gaggacactcggctcagtgcttctg

SEQ ID NO: 657013 - DNA, 25 bp, Mus musculus
gaggacactcgggtcagtgcttctg

SEQ ID NO: 657014 - DNA, 25 bp, Mus musculus
gaggacactgctccgaaatctccac

SEQ ID NO: 657015 - DNA, 25 bp, Mus musculus
gaggacactgctgcgaaatctccac

SEQ ID NO: 657016 - DNA, 25 bp, Mus musculus
gaggacactggaaagacttcgaaca

SEQ ID NO: 657017 - DNA, 25 bp, Mus musculus
gaggacactggatagacttcgaaca

SEQ ID NO: 657018 - DNA, 25 bp, Mus musculus
gaggacactgtacaacattgactta

SEQ ID NO: 657019 - DNA, 25 bp, Mus musculus
gaggacactgtagaacattgactta

SEQ ID NO: 657020 - DNA, 25 bp, Mus musculus
gaggacacttgcaaatctggaccca

SEQ ID NO: 657021 - DNA, 25 bp, Mus musculus
gaggacacttgctaatctggaccca

SEQ ID NO: 657022 - DNA, 25 bp, Mus musculus
gaggacagacccacatcctcaatag

SEQ ID NO: 657023 - DNA, 25 bp, Mus musculus
gaggacagaccctcatcctcaatag

SEQ ID NO: 657024 - DNA, 25 bp, Mus musculus
gaggacagactaaacgcctttcagt

SEQ ID NO: 657025 - DNA, 25 bp, Mus musculus
gaggacagactatacgcctttcagt

SEQ ID NO: 657026 - DNA, 25 bp, Mus musculus
gaggacagccctactttgtctgtga

SEQ ID NO: 657027 - DNA, 25 bp, Mus musculus
gaggacagcccttctttgtctgtga

SEQ ID NO: 657028 - DNA, 25 bp, Mus musculus
gaggacagcctgagctaactagggc

SEQ ID NO: 657029 - DNA, 25 bp, Mus musculus
gaggacagcctgtgctaactagggc

SEQ ID NO: 657030 - DNA, 25 bp, Mus musculus
gaggacagcgcacatggcatctgta

SEQ ID NO: 657031 - DNA, 25 bp, Mus musculus
gaggacagcgcagatggcatctgta

SEQ ID NO: 657032 - DNA, 25 bp, Mus musculus
gaggacagcttccatctccttccaa

SEQ ID NO: 657033 - DNA, 25 bp, Mus musculus
gaggacagcttcgatctccttccaa

SEQ ID NO: 657034 - DNA, 25 bp, Mus musculus
gaggacaggctcattgaatcctcca

SEQ ID NO: 657035 - DNA, 25 bp, Mus musculus
gaggacaggctctttgaatcctcca

SEQ ID NO: 657036 - DNA, 25 bp, Mus musculus
gaggacagggctagaatgtgacccc

SEQ ID NO: 657037 - DNA, 25 bp, Mus musculus
gaggacagggcttgaatgtgacccc

SEQ ID NO: 657038 - DNA, 25 bp, Mus musculus
gaggacagtaaccattaaatcatct

SEQ ID NO: 657039 - DNA, 25 bp, Mus musculus
gaggacagtaacgattaaatcatct

SEQ ID NO: 657040 - DNA, 25 bp, Mus musculus
gaggacagtacaaacacttcactcc

SEQ ID NO: 657041 - DNA, 25 bp, Mus musculus
gaggacagtacatacacttcactcc

SEQ ID NO: 657042 - DNA, 25 bp, Mus musculus
gaggacagtattccagacagaagga

SEQ ID NO: 657043 - DNA, 25 bp, Mus musculus
gaggacagtattgcagacagaagga

SEQ ID NO: 657044 - DNA, 25 bp, Mus musculus
gaggacatagacagcgatcctcccc

SEQ ID NO: 657045 - DNA, 25 bp, Mus musculus
gaggacatagactgcgatcctcccc

SEQ ID NO: 657046 - DNA, 25 bp, Mus musculus
gaggacatagggaatacctgtcacc

SEQ ID NO: 657047 - DNA, 25 bp, Mus musculus
gaggacatagggtatacctgtcacc

SEQ ID NO: 657048 - DNA, 25 bp, Mus musculus
gaggacatcaaaccaaagaaagaca

SEQ ID NO: 657049 - DNA, 25 bp, Mus musculus
gaggacatcaaagcaaagaaagaca

SEQ ID NO: 657050 - DNA, 25 bp, Mus musculus
gaggacatcaatccttgcacgctga

SEQ ID NO: 657051 - DNA, 25 bp, Mus musculus
gaggacatcaatgcttgcacgctga

SEQ ID NO: 657052 - DNA, 25 bp, Mus musculus
gaggacatcatcatatctgtaccag

SEQ ID NO: 657053 - DNA, 25 bp, Mus musculus
gaggacatcatcttatctgtaccag

SEQ ID NO: 657054 - DNA, 25 bp, Mus musculus
gaggacatcctcacaagaggcccag

SEQ ID NO: 657055 - DNA, 25 bp, Mus musculus
gaggacatcctctcaagaggcccag

SEQ ID NO: 657056 - DNA, 25 bp, Mus musculus
gaggacatcgcaccgaaagagaagc

SEQ ID NO: 657057 - DNA, 25 bp, Mus musculus
gaggacatcgcagcgaaagagaagc

SEQ ID NO: 657058 - DNA, 25 bp, Mus musculus
gaggacatgaacctcttcaaaacca

SEQ ID NO: 657059 - DNA, 25 bp, Mus musculus
gaggacatgaacgtcttcaaaacca

SEQ ID NO: 657060 - DNA, 25 bp, Mus musculus
gaggacattattactatatggaata

SEQ ID NO: 657061 - DNA, 25 bp, Mus musculus
gaggacattatttctatatggaata

SEQ ID NO: 657062 - DNA, 25 bp, Mus musculus
gaggacattggtaaaaatcgagcgg

SEQ ID NO: 657063 - DNA, 25 bp, Mus musculus
gaggacattggttaaaatcgagcgg

SEQ ID NO: 657064 - DNA, 25 bp, Mus musculus
gaggacatttaacctcgactacagc

SEQ ID NO: 657065 - DNA, 25 bp, Mus musculus
gaggacatttaagctcgactacagc

SEQ ID NO: 657066 - DNA, 25 bp, Mus musculus
gaggacatttctagaccctggctga

SEQ ID NO: 657067 - DNA, 25 bp, Mus musculus
gaggacatttcttgaccctggctga

SEQ ID NO: 657068 - DNA, 25 bp, Mus musculus
gaggaccaaaccagtgggcgtgcct

SEQ ID NO: 657069 - DNA, 25 bp, Mus musculus
gaggaccaaacctgtgggcgtgcct

SEQ ID NO: 657070 - DNA, 25 bp, Mus musculus
gaggaccaataaatcctgatatatc

SEQ ID NO: 657071 - DNA, 25 bp, Mus musculus
gaggaccaataattcctgatatatc

SEQ ID NO: 657072 - DNA, 25 bp, Mus musculus
gaggaccaccccatcgagtatcgga

SEQ ID NO: 657073 - DNA, 25 bp, Mus musculus
gaggaccaccccttcgagtatcgga

SEQ ID NO: 657074 - DNA, 25 bp, Mus musculus
gaggaccacctcagccgtttcgtgt

SEQ ID NO: 657075 - DNA, 25 bp, Mus musculus
gaggaccacctctgccgtttcgtgt

SEQ ID NO: 657076 - DNA, 25 bp, Mus musculus
gaggaccacggtcgccaaaattctt

SEQ ID NO: 657077 - DNA, 25 bp, Mus musculus
gaggaccacggtggccaaaattctt

SEQ ID NO: 657078 - DNA, 25 bp, Mus musculus
gaggaccagaaaaaccaacgtgatc

SEQ ID NO: 657079 - DNA, 25 bp, Mus musculus
gaggaccagaaataccaacgtgatc

SEQ ID NO: 657080 - DNA, 25 bp, Mus musculus
gaggaccagaggataatttattctg

SEQ ID NO: 657081 - DNA, 25 bp, Mus musculus
gaggaccagaggttaatttattctg

SEQ ID NO: 657082 - DNA, 25 bp, Mus musculus
gaggaccaggagcatcagcataaga

SEQ ID NO: 657083 - DNA, 25 bp, Mus musculus
gaggaccaggaggatcagcataaga

SEQ ID NO: 657084 - DNA, 25 bp, Mus musculus
gaggaccaggctcgcatatgaatag

SEQ ID NO: 657085 - DNA, 25 bp, Mus musculus
gaggaccaggctggcatatgaatag

SEQ ID NO: 657086 - DNA, 25 bp, Mus musculus
gaggaccagtatcaacacttggatg

SEQ ID NO: 657087 - DNA, 25 bp, Mus musculus
gaggaccagtatgaacacttggatg

SEQ ID NO: 657088 - DNA, 25 bp, Mus musculus
gaggaccagttaaagtggcagcaag

SEQ ID NO: 657089 - DNA, 25 bp, Mus musculus
gaggaccagttaacctcactgggaa

SEQ ID NO: 657090 - DNA, 25 bp, Mus musculus
gaggaccagttatagtggcagcaag

SEQ ID NO: 657091 - DNA, 25 bp, Mus musculus
gaggaccagttatcctcactgggaa

SEQ ID NO: 657092 - DNA, 25 bp, Mus musculus
gaggaccagttccacatcagtgtca

SEQ ID NO: 657093 - DNA, 25 bp, Mus musculus
gaggaccagttcgacatcagtgtca

SEQ ID NO: 657094 - DNA, 25 bp, Mus musculus
gaggaccatgctcgagctactgaac

SEQ ID NO: 657095 - DNA, 25 bp, Mus musculus
gaggaccatgctggagctactgaac

SEQ ID NO: 657096 - DNA, 25 bp, Mus musculus
gaggacccagagaggtttggctacc

SEQ ID NO: 657097 - DNA, 25 bp, Mus musculus
gaggacccagagtggtttggctacc

SEQ ID NO: 657098 - DNA, 25 bp, Mus musculus
gaggacccagcaatgtcctgagaga

SEQ ID NO: 657099 - DNA, 25 bp, Mus musculus
gaggacccagcattgtcctgagaga

SEQ ID NO: 657100 - DNA, 25 bp, Mus musculus
gaggacccagttaccaactttggat

SEQ ID NO: 657101 - DNA, 25 bp, Mus musculus
gaggacccagtttccaactttggat

SEQ ID NO: 657102 - DNA, 25 bp, Mus musculus
gaggacccattaacagctcatgatg

SEQ ID NO: 657103 - DNA, 25 bp, Mus musculus
gaggacccattatcagctcatgatg

SEQ ID NO: 657104 - DNA, 25 bp, Mus musculus
gaggaccccgagagatcaatattca

SEQ ID NO: 657105 - DNA, 25 bp, Mus musculus
gaggaccccgagtgatcaatattca

SEQ ID NO: 657106 - DNA, 25 bp, Mus musculus
gaggacccctatagccgttcgattc

SEQ ID NO: 657107 - DNA, 25 bp, Mus musculus
gaggacccctattgccgttcgattc

SEQ ID NO: 657108 - DNA, 25 bp, Mus musculus
gaggaccccttcattgtagtgaagg

SEQ ID NO: 657109 - DNA, 25 bp, Mus musculus
gaggaccccttctttgtagtgaagg

SEQ ID NO: 657110 - DNA, 25 bp, Mus musculus
gaggacccgaagctcaaaggcgtct

SEQ ID NO: 657111 - DNA, 25 bp, Mus musculus
gaggacccgaaggtcaaaggcgtct

SEQ ID NO: 657112 - DNA, 25 bp, Mus musculus
gaggacccgaggaggcttctccagt

SEQ ID NO: 657113 - DNA, 25 bp, Mus musculus
gaggacccgaggtggcttctccagt

SEQ ID NO: 657114 - DNA, 25 bp, Mus musculus
gaggacccgtgacggcaatgattta

SEQ ID NO: 657115 - DNA, 25 bp, Mus musculus
gaggacccgtgagggcaatgattta

SEQ ID NO: 657116 - DNA, 25 bp, Mus musculus
gaggaccctaccatccaggccttag

SEQ ID NO: 657117 - DNA, 25 bp, Mus musculus
gaggaccctaccttccaggccttag

SEQ ID NO: 657118 - DNA, 25 bp, Mus musculus
gaggaccctcagaatggaacatact

SEQ ID NO: 657119 - DNA, 25 bp, Mus musculus
gaggaccctcagtatggaacatact

SEQ ID NO: 657120 - DNA, 25 bp, Mus musculus
gaggaccctgtccacatctcagaag

SEQ ID NO: 657121 - DNA, 25 bp, Mus musculus
gaggaccctgtcgacatctcagaag

SEQ ID NO: 657122 - DNA, 25 bp, Mus musculus
gaggaccgtgatcttcacacaaggg

SEQ ID NO: 657123 - DNA, 25 bp, Mus musculus
gaggaccgtgatgttcacacaaggg

SEQ ID NO: 657124 - DNA, 25 bp, Mus musculus
gaggaccgttggaattgtcggcaac

SEQ ID NO: 657125 - DNA, 25 bp, Mus musculus
gaggaccgttggtattgtcggcaac

SEQ ID NO: 657126 - DNA, 25 bp, Mus musculus
gaggaccgtttcaacctggtgtttg

SEQ ID NO: 657127 - DNA, 25 bp, Mus musculus
gaggaccgtttctacctggtgtttg

SEQ ID NO: 657128 - DNA, 25 bp, Mus musculus
gaggacctacttcgatactccaagc

SEQ ID NO: 657129 - DNA, 25 bp, Mus musculus
gaggacctacttggatactccaagc

SEQ ID NO: 657130 - DNA, 25 bp, Mus musculus
gaggacctcatcaactcacatgctg

SEQ ID NO: 657131 - DNA, 25 bp, Mus musculus
gaggacctcatctactcacatgctg

SEQ ID NO: 657132 - DNA, 25 bp, Mus musculus
gaggacctcggcaggaactgtgcaa

SEQ ID NO: 657133 - DNA, 25 bp, Mus musculus
gaggacctcggctggaactgtgcaa

SEQ ID NO: 657134 - DNA, 25 bp, Mus musculus
gaggacctctaaagggagacggaga

SEQ ID NO: 657135 - DNA, 25 bp, Mus musculus
gaggacctctaatgggagacggaga

SEQ ID NO: 657136 - DNA, 25 bp, Mus musculus
gaggacctctctaaactcttcaagc

SEQ ID NO: 657137 - DNA, 25 bp, Mus musculus
gaggacctctctcacaagactttga

SEQ ID NO: 657138 - DNA, 25 bp, Mus musculus
gaggacctctctgacaagactttga

SEQ ID NO: 657139 - DNA, 25 bp, Mus musculus
gaggacctctcttaactcttcaagc

SEQ ID NO: 657140 - DNA, 25 bp, Mus musculus
gaggacctggaaataattgttgacc

SEQ ID NO: 657141 - DNA, 25 bp, Mus musculus
gaggacctggaattaattgttgacc

SEQ ID NO: 657142 - DNA, 25 bp, Mus musculus
gaggacctggacaacataggcatgg

SEQ ID NO: 657143 - DNA, 25 bp, Mus musculus
gaggacctggactacataggcatgg

SEQ ID NO: 657144 - DNA, 25 bp, Mus musculus
gaggacctggtgactcattattctg

SEQ ID NO: 657145 - DNA, 25 bp, Mus musculus
gaggacctggtgtctcattattctg

SEQ ID NO: 657146 - DNA, 25 bp, Mus musculus
gaggacctgtatccgcccactgcag

SEQ ID NO: 657147 - DNA, 25 bp, Mus musculus
gaggacctgtatgcgcccactgcag

SEQ ID NO: 657148 - DNA, 25 bp, Mus musculus
gaggacctgttgatattggcccaga

SEQ ID NO: 657149 - DNA, 25 bp, Mus musculus
gaggacctgttgatgccatcttggg

SEQ ID NO: 657150 - DNA, 25 bp, Mus musculus
gaggacctgttgttattggcccaga

SEQ ID NO: 657151 - DNA, 25 bp, Mus musculus
gaggacctgttgttgccatcttggg

SEQ ID NO: 657152 - DNA, 25 bp, Mus musculus
gaggaccttccaccaagatttggtt

SEQ ID NO: 657153 - DNA, 25 bp, Mus musculus
gaggaccttccagcaagatttggtt

SEQ ID NO: 657154 - DNA, 25 bp, Mus musculus
gaggaccttgatcgtctgatccaac

SEQ ID NO: 657155 - DNA, 25 bp, Mus musculus
gaggaccttgatggtctgatccaac

SEQ ID NO: 657156 - DNA, 25 bp, Mus musculus
gaggacgaaagaatgatagaggtta

SEQ ID NO: 657157 - DNA, 25 bp, Mus musculus
gaggacgaaagattgatagaggtta

SEQ ID NO: 657158 - DNA, 25 bp, Mus musculus
gaggacgaaaggctcatcccaagca

SEQ ID NO: 657159 - DNA, 25 bp, Mus musculus
gaggacgaaagggtcatcccaagca

SEQ ID NO: 657160 - DNA, 25 bp, Mus musculus
gaggacgaactcatctccttcgact

SEQ ID NO: 657161 - DNA, 25 bp, Mus musculus
gaggacgaactcttctccttcgact

SEQ ID NO: 657162 - DNA, 25 bp, Mus musculus
gaggacgacagcaccttcacaatca

SEQ ID NO: 657163 - DNA, 25 bp, Mus musculus
gaggacgacagctccttcacaatca

SEQ ID NO: 657164 - DNA, 25 bp, Mus musculus
gaggacgacttacgagcctcccact

SEQ ID NO: 657165 - DNA, 25 bp, Mus musculus
gaggacgacttaggagcctcccact

SEQ ID NO: 657166 - DNA, 25 bp, Mus musculus
gaggacgaggacctcatccgctgct

SEQ ID NO: 657167 - DNA, 25 bp, Mus musculus
gaggacgaggacgtcatccgctgct

SEQ ID NO: 657168 - DNA, 25 bp, Mus musculus
gaggacgagtccagcttcgaaggca

SEQ ID NO: 657169 - DNA, 25 bp, Mus musculus
gaggacgagtcctgcttcgaaggca

SEQ ID NO: 657170 - DNA, 25 bp, Mus musculus
gaggacgatgatcactacgttgatg

SEQ ID NO: 657171 - DNA, 25 bp, Mus musculus
gaggacgatgatgactacgttgatg

SEQ ID NO: 657172 - DNA, 25 bp, Mus musculus
gaggacgcagagcacttttgaccca

SEQ ID NO: 657173 - DNA, 25 bp, Mus musculus
gaggacgcagaggacttttgaccca

SEQ ID NO: 657174 - DNA, 25 bp, Mus musculus
gaggacgcccctcctgcgtttgtac

SEQ ID NO: 657175 - DNA, 25 bp, Mus musculus
gaggacgcccctgctgcgtttgtac

SEQ ID NO: 657176 - DNA, 25 bp, Mus musculus
gaggacgccgcccatgtctcagcaa

SEQ ID NO: 657177 - DNA, 25 bp, Mus musculus
gaggacgccgccgatgtctcagcaa

SEQ ID NO: 657178 - DNA, 25 bp, Mus musculus
gaggacgccttaatcttctttgtca

SEQ ID NO: 657179 - DNA, 25 bp, Mus musculus
gaggacgccttattcttctttgtca

SEQ ID NO: 657180 - DNA, 25 bp, Mus musculus
gaggacgctcgcacagatgctgtgg

SEQ ID NO: 657181 - DNA, 25 bp, Mus musculus
gaggacgctcgctcagatgctgtgg

SEQ ID NO: 657182 - DNA, 25 bp, Mus musculus
gaggacggacacatggtcactgccc

SEQ ID NO: 657183 - DNA, 25 bp, Mus musculus
gaggacggacacttggtcactgccc

SEQ ID NO: 657184 - DNA, 25 bp, Mus musculus
gaggacggacgccattatcgcagct

SEQ ID NO: 657185 - DNA, 25 bp, Mus musculus
gaggacggacgcgattatcgcagct

SEQ ID NO: 657186 - DNA, 25 bp, Mus musculus
gaggacggagagcacctgttcacca

SEQ ID NO: 657187 - DNA, 25 bp, Mus musculus
gaggacggagaggacctgttcacca

SEQ ID NO: 657188 - DNA, 25 bp, Mus musculus
gaggacggagtgattgacatccact

SEQ ID NO: 657189 - DNA, 25 bp, Mus musculus
gaggacggagtgtttgacatccact

SEQ ID NO: 657190 - DNA, 25 bp, Mus musculus
gaggacggcgcaaccatgacgtttt

SEQ ID NO: 657191 - DNA, 25 bp, Mus musculus
gaggacggcgcatccatgacgtttt

SEQ ID NO: 657192 - DNA, 25 bp, Mus musculus
gaggacgggcgcactcgatccacgt

SEQ ID NO: 657193 - DNA, 25 bp, Mus musculus
gaggacgggcgctctcgatccacgt

SEQ ID NO: 657194 - DNA, 25 bp, Mus musculus
gaggacgggctcagccagtacaagt

SEQ ID NO: 657195 - DNA, 25 bp, Mus musculus
gaggacgggctctgccagtacaagt

SEQ ID NO: 657196 - DNA, 25 bp, Mus musculus
gaggacggtagaagctgtgcaacaa

SEQ ID NO: 657197 - DNA, 25 bp, Mus musculus
gaggacggtagatgctgtgcaacaa

SEQ ID NO: 657198 - DNA, 25 bp, Mus musculus
gaggacgtaagacagccagccttga

SEQ ID NO: 657199 - DNA, 25 bp, Mus musculus
gaggacgtaagagagccagccttga

SEQ ID NO: 657200 - DNA, 25 bp, Mus musculus
gaggacgtcagtaccttcagtaccg

SEQ ID NO: 657201 - DNA, 25 bp, Mus musculus
gaggacgtcagttccttcagtaccg

SEQ ID NO: 657202 - DNA, 25 bp, Mus musculus
gaggacgtcccaattgcacacatta

SEQ ID NO: 657203 - DNA, 25 bp, Mus musculus
gaggacgtcccatttgcacacatta

SEQ ID NO: 657204 - DNA, 25 bp, Mus musculus
gaggacgtcctacaggtgaagccct

SEQ ID NO: 657205 - DNA, 25 bp, Mus musculus
gaggacgtcctagaggtgaagccct

SEQ ID NO: 657206 - DNA, 25 bp, Mus musculus
gaggacgtcctcatccttggataac

SEQ ID NO: 657207 - DNA, 25 bp, Mus musculus
gaggacgtcctcttccttggataac

SEQ ID NO: 657208 - DNA, 25 bp, Mus musculus
gaggacgtgaggaatctgaacgcca

SEQ ID NO: 657209 - DNA, 25 bp, Mus musculus
gaggacgtgaggtatctgaacgcca

SEQ ID NO: 657210 - DNA, 25 bp, Mus musculus
gaggacgttcacatcaggaatctac

SEQ ID NO: 657211 - DNA, 25 bp, Mus musculus
gaggacgttcacttcaggaatctac

SEQ ID NO: 657212 - DNA, 25 bp, Mus musculus
gaggacgttcgtaagttgtgcccac

SEQ ID NO: 657213 - DNA, 25 bp, Mus musculus
gaggacgttcgttagttgtgcccac

SEQ ID NO: 657214 - DNA, 25 bp, Mus musculus
gaggactaccagagccgtcactttg

SEQ ID NO: 657215 - DNA, 25 bp, Mus musculus
gaggactaccagtgccgtcactttg

SEQ ID NO: 657216 - DNA, 25 bp, Mus musculus
gaggactacgtaatttccctgctca

SEQ ID NO: 657217 - DNA, 25 bp, Mus musculus
gaggactacgtattttccctgctca

SEQ ID NO: 657218 - DNA, 25 bp, Mus musculus
gaggactatcccagctcgcttgtgg

SEQ ID NO: 657219 - DNA, 25 bp, Mus musculus
gaggactatccctgctcgcttgtgg

SEQ ID NO: 657220 - DNA, 25 bp, Mus musculus
gaggactattttagatacgccagat

SEQ ID NO: 657221 - DNA, 25 bp, Mus musculus
gaggactatttttgatacgccagat

SEQ ID NO: 657222 - DNA, 25 bp, Mus musculus
gaggactcaaaccacacatgcttct

SEQ ID NO: 657223 - DNA, 25 bp, Mus musculus
gaggactcaaacgacacatgcttct

SEQ ID NO: 657224 - DNA, 25 bp, Mus musculus
gaggactcaccaagggacctaacca

SEQ ID NO: 657225 - DNA, 25 bp, Mus musculus
gaggactcaccatgggacctaacca

SEQ ID NO: 657226 - DNA, 25 bp, Mus musculus
gaggactccccaactattgaggctg

SEQ ID NO: 657227 - DNA, 25 bp, Mus musculus
gaggactccccaccaattattcatt

SEQ ID NO: 657228 - DNA, 25 bp, Mus musculus
gaggactccccagcaattattcatt

SEQ ID NO: 657229 - DNA, 25 bp, Mus musculus
gaggactccccatctattgaggctg

SEQ ID NO: 657230 - DNA, 25 bp, Mus musculus
gaggactccgacattcccatccaaa

SEQ ID NO: 657231 - DNA, 25 bp, Mus musculus
gaggactccgactttcccatccaaa

SEQ ID NO: 657232 - DNA, 25 bp, Mus musculus
gaggactccggtatctatcagtgtg

SEQ ID NO: 657233 - DNA, 25 bp, Mus musculus
gaggactccggtttctatcagtgtg

SEQ ID NO: 657234 - DNA, 25 bp, Mus musculus
gaggactcctacatagtgcctgagc

SEQ ID NO: 657235 - DNA, 25 bp, Mus musculus
gaggactcctacttagtgcctgagc

SEQ ID NO: 657236 - DNA, 25 bp, Mus musculus
gaggactcggagacacttcagtttc

SEQ ID NO: 657237 - DNA, 25 bp, Mus musculus
gaggactcggagtcacttcagtttc

SEQ ID NO: 657238 - DNA, 25 bp, Mus musculus
gaggactcgggaaagacctttgaat

SEQ ID NO: 657239 - DNA, 25 bp, Mus musculus
gaggactcgggatagacctttgaat

SEQ ID NO: 657240 - DNA, 25 bp, Mus musculus
gaggactctcatctccacatacaga

SEQ ID NO: 657241 - DNA, 25 bp, Mus musculus
gaggactctcatgtccacatacaga

SEQ ID NO: 657242 - DNA, 25 bp, Mus musculus
gaggactctggcagtgccacgctga

SEQ ID NO: 657243 - DNA, 25 bp, Mus musculus
gaggactctggctgtgccacgctga

SEQ ID NO: 657244 - DNA, 25 bp, Mus musculus
gaggactctggtcatatcagtgata

SEQ ID NO: 657245 - DNA, 25 bp, Mus musculus
gaggactctggtgatatcagtgata

SEQ ID NO: 657246 - DNA, 25 bp, Mus musculus
gaggactctgtcatctctcatgagc

SEQ ID NO: 657247 - DNA, 25 bp, Mus musculus
gaggactctgtcttctctcatgagc

SEQ ID NO: 657248 - DNA, 25 bp, Mus musculus
gaggactggatcagctgtgcctgcc

SEQ ID NO: 657249 - DNA, 25 bp, Mus musculus
gaggactggatctgctgtgcctgcc

SEQ ID NO: 657250 - DNA, 25 bp, Mus musculus
gaggactggctcaacatgggctgca

SEQ ID NO: 657251 - DNA, 25 bp, Mus musculus
gaggactggctctacatgggctgca

SEQ ID NO: 657252 - DNA, 25 bp, Mus musculus
gaggactgggccctcaacatggaaa

SEQ ID NO: 657253 - DNA, 25 bp, Mus musculus
gaggactgggccgtcaacatggaaa

SEQ ID NO: 657254 - DNA, 25 bp, Mus musculus
gaggactgtcttacatccaccagcg

SEQ ID NO: 657255 - DNA, 25 bp, Mus musculus
gaggactgtcttcgatcaacagccc

SEQ ID NO: 657256 - DNA, 25 bp, Mus musculus
gaggactgtcttggatcaacagccc

SEQ ID NO: 657257 - DNA, 25 bp, Mus musculus
gaggactgtctttcatccaccagcg

SEQ ID NO: 657258 - DNA, 25 bp, Mus musculus
gaggacttacccatcaaacgcggag

SEQ ID NO: 657259 - DNA, 25 bp, Mus musculus
gaggacttacccttcaaacgcggag

SEQ ID NO: 657260 - DNA, 25 bp, Mus musculus
gaggacttagaacatctaacctctc

SEQ ID NO: 657261 - DNA, 25 bp, Mus musculus
gaggacttagaagatctaacctctc

SEQ ID NO: 657262 - DNA, 25 bp, Mus musculus
gaggacttattcagcccctcacagc

SEQ ID NO: 657263 - DNA, 25 bp, Mus musculus
gaggacttattctgcccctcacagc

SEQ ID NO: 657264 - DNA, 25 bp, Mus musculus
gaggacttcactattaatggcatta

SEQ ID NO: 657265 - DNA, 25 bp, Mus musculus
gaggacttcacttttaatggcatta

SEQ ID NO: 657266 - DNA, 25 bp, Mus musculus
gaggacttcaggcatgggctcaaac

SEQ ID NO: 657267 - DNA, 25 bp, Mus musculus
gaggacttcagggatgggctcaaac

SEQ ID NO: 657268 - DNA, 25 bp, Mus musculus
gaggacttcataaaagaagccatgc

SEQ ID NO: 657269 - DNA, 25 bp, Mus musculus
gaggacttcatataagaagccatgc

SEQ ID NO: 657270 - DNA, 25 bp, Mus musculus
gaggacttccacaccatagactggc

SEQ ID NO: 657271 - DNA, 25 bp, Mus musculus
gaggacttccactccatagactggc

SEQ ID NO: 657272 - DNA, 25 bp, Mus musculus
gaggacttccggctcaagacctgcg

SEQ ID NO: 657273 - DNA, 25 bp, Mus musculus
gaggacttccgggtcaagacctgcg

SEQ ID NO: 657274 - DNA, 25 bp, Mus musculus
gaggacttcgaaaggaatagctttg

SEQ ID NO: 657275 - DNA, 25 bp, Mus musculus
gaggacttcgaatggaatagctttg

SEQ ID NO: 657276 - DNA, 25 bp, Mus musculus
gaggacttcgacaccaggtttgata

SEQ ID NO: 657277 - DNA, 25 bp, Mus musculus
gaggacttcgactccaggtttgata

SEQ ID NO: 657278 - DNA, 25 bp, Mus musculus
gaggacttcgcccacgtcataagct

SEQ ID NO: 657279 - DNA, 25 bp, Mus musculus
gaggacttcgccgacgtcataagct

SEQ ID NO: 657280 - DNA, 25 bp, Mus musculus
gaggacttgcatcacaagtttgtga

SEQ ID NO: 657281 - DNA, 25 bp, Mus musculus
gaggacttgcatgacaagtttgtga

SEQ ID NO: 657282 - DNA, 25 bp, Mus musculus
gaggactttcagaccaccgaactta

SEQ ID NO: 657283 - DNA, 25 bp, Mus musculus
gaggactttcagtccaccgaactta

SEQ ID NO: 657284 - DNA, 25 bp, Mus musculus
gaggactttcttatgcttatttcac

SEQ ID NO: 657285 - DNA, 25 bp, Mus musculus
gaggactttcttttgcttatttcac

SEQ ID NO: 657286 - DNA, 25 bp, Mus musculus
gaggactttgcgaatagccctgccc

SEQ ID NO: 657287 - DNA, 25 bp, Mus musculus
gaggactttgcgtatagccctgccc

SEQ ID NO: 657288 - DNA, 25 bp, Mus musculus
gaggagaaagagacggacaacacca

SEQ ID NO: 657289 - DNA, 25 bp, Mus musculus
gaggagaaagagtcggacaacacca

SEQ ID NO: 657290 - DNA, 25 bp, Mus musculus
gaggagaaatagcaggacctccaga

SEQ ID NO: 657291 - DNA, 25 bp, Mus musculus
gaggagaaataggaggacctccaga

SEQ ID NO: 657292 - DNA, 25 bp, Mus musculus
gaggagaacccaaatcagattcgtc

SEQ ID NO: 657293 - DNA, 25 bp, Mus musculus
gaggagaacccatatcagattcgtc

SEQ ID NO: 657294 - DNA, 25 bp, Mus musculus
gaggagaactaaagcttggtggcac

SEQ ID NO: 657295 - DNA, 25 bp, Mus musculus
gaggagaactaatgcttggtggcac

SEQ ID NO: 657296 - DNA, 25 bp, Mus musculus
gaggagaagagacgaaaaacgacac

SEQ ID NO: 657297 - DNA, 25 bp, Mus musculus
gaggagaagagaggaaaaacgacac

SEQ ID NO: 657298 - DNA, 25 bp, Mus musculus
gaggagaagatacaccagttacatc

SEQ ID NO: 657299 - DNA, 25 bp, Mus musculus
gaggagaagatagaccagttacatc

SEQ ID NO: 657300 - DNA, 25 bp, Mus musculus
gaggagaatgcaatatcaactgctc

SEQ ID NO: 657301 - DNA, 25 bp, Mus musculus
gaggagaatgcattatcaactgctc

SEQ ID NO: 657302 - DNA, 25 bp, Mus musculus
gaggagacactacagcgaattgagc

SEQ ID NO: 657303 - DNA, 25 bp, Mus musculus
gaggagacactagagcgaattgagc

SEQ ID NO: 657304 - DNA, 25 bp, Mus musculus
gaggagacactgctaggcagccttc

SEQ ID NO: 657305 - DNA, 25 bp, Mus musculus
gaggagacactggtaggcagccttc

SEQ ID NO: 657306 - DNA, 25 bp, Mus musculus
gaggagacaggtccttcctcagatg

SEQ ID NO: 657307 - DNA, 25 bp, Mus musculus
gaggagacaggtgcttcctcagatg

SEQ ID NO: 657308 - DNA, 25 bp, Mus musculus
gaggagacagtaatcccttgagaga

SEQ ID NO: 657309 - DNA, 25 bp, Mus musculus
gaggagacagtattcccttgagaga

SEQ ID NO: 657310 - DNA, 25 bp, Mus musculus
gaggagaccacaacagaacactgga

SEQ ID NO: 657311 - DNA, 25 bp, Mus musculus
gaggagaccacatcagaacactgga

SEQ ID NO: 657312 - DNA, 25 bp, Mus musculus
gaggagaccataaagcttctgaaag

SEQ ID NO: 657313 - DNA, 25 bp, Mus musculus
gaggagaccatatagcttctgaaag

SEQ ID NO: 657314 - DNA, 25 bp, Mus musculus
gaggagacccaaaactctttgcagg

SEQ ID NO: 657315 - DNA, 25 bp, Mus musculus
gaggagacccaatactctttgcagg

SEQ ID NO: 657316 - DNA, 25 bp, Mus musculus
gaggagaccccactcctggagtagc

SEQ ID NO: 657317 - DNA, 25 bp, Mus musculus
gaggagaccccagtcctggagtagc

SEQ ID NO: 657318 - DNA, 25 bp, Mus musculus
gaggagacccttagaaagggcccat

SEQ ID NO: 657319 - DNA, 25 bp, Mus musculus
gaggagaccctttgaaagggcccat

SEQ ID NO: 657320 - DNA, 25 bp, Mus musculus
gaggagacgccactgcgctacagca

SEQ ID NO: 657321 - DNA, 25 bp, Mus musculus
gaggagacgccagtgcgctacagca

SEQ ID NO: 657322 - DNA, 25 bp, Mus musculus
gaggagacgcgcagataccgaccta

SEQ ID NO: 657323 - DNA, 25 bp, Mus musculus
gaggagacgcgctgataccgaccta

SEQ ID NO: 657324 - DNA, 25 bp, Mus musculus
gaggagacggctaaagcagtcacag

SEQ ID NO: 657325 - DNA, 25 bp, Mus musculus
gaggagacggcttaagcagtcacag

SEQ ID NO: 657326 - DNA, 25 bp, Mus musculus
gaggagacgttcatcgacaacctga

SEQ ID NO: 657327 - DNA, 25 bp, Mus musculus
gaggagacgttccagctgcagctca

SEQ ID NO: 657328 - DNA, 25 bp, Mus musculus
gaggagacgttcgagctgcagctca

SEQ ID NO: 657329 - DNA, 25 bp, Mus musculus
gaggagacgttcttcgacaacctga

SEQ ID NO: 657330 - DNA, 25 bp, Mus musculus
gaggagactcagatttatatagcag

SEQ ID NO: 657331 - DNA, 25 bp, Mus musculus
gaggagactcagttttatatagcag

SEQ ID NO: 657332 - DNA, 25 bp, Mus musculus
gaggagactcggcaaacgccctctg

SEQ ID NO: 657333 - DNA, 25 bp, Mus musculus
gaggagactcgggaaacgccctctg

SEQ ID NO: 657334 - DNA, 25 bp, Mus musculus
gaggagactctgcacaccatcaaac

SEQ ID NO: 657335 - DNA, 25 bp, Mus musculus
gaggagactctggacaccatcaaac

SEQ ID NO: 657336 - DNA, 25 bp, Mus musculus
gaggagacttgccagctactgacag

SEQ ID NO: 657337 - DNA, 25 bp, Mus musculus
gaggagacttgcgagctactgacag

SEQ ID NO: 657338 - DNA, 25 bp, Mus musculus
gaggagagcaccctacaggatctgc

SEQ ID NO: 657339 - DNA, 25 bp, Mus musculus
gaggagagcaccgtacaggatctgc

SEQ ID NO: 657340 - DNA, 25 bp, Mus musculus
gaggagagcattcccattgctttat

SEQ ID NO: 657341 - DNA, 25 bp, Mus musculus
gaggagagcattgccattgctttat

SEQ ID NO: 657342 - DNA, 25 bp, Mus musculus
gaggagagcggcacagacctcgcta

SEQ ID NO: 657343 - DNA, 25 bp, Mus musculus
gaggagagcggctcagacctcgcta

SEQ ID NO: 657344 - DNA, 25 bp, Mus musculus
gaggagagtcttacccagacgttct

SEQ ID NO: 657345 - DNA, 25 bp, Mus musculus
gaggagagtctttcccagacgttct

SEQ ID NO: 657346 - DNA, 25 bp, Mus musculus
gaggagatacggcacagagtcacta

SEQ ID NO: 657347 - DNA, 25 bp, Mus musculus
gaggagatacgggacagagtcacta

SEQ ID NO: 657348 - DNA, 25 bp, Mus musculus
gaggagatatttctactggtatacc

SEQ ID NO: 657349 - DNA, 25 bp, Mus musculus
gaggagatatttgtactggtatacc

SEQ ID NO: 657350 - DNA, 25 bp, Mus musculus
gaggagatcagacatacctaccctg

SEQ ID NO: 657351 - DNA, 25 bp, Mus musculus
gaggagatcagagatacctaccctg

SEQ ID NO: 657352 - DNA, 25 bp, Mus musculus
gaggagatccgtcgaatcaaccaga

SEQ ID NO: 657353 - DNA, 25 bp, Mus musculus
gaggagatccgtggaatcaaccaga

SEQ ID NO: 657354 - DNA, 25 bp, Mus musculus
gaggagatcgcccaggtacacagca

SEQ ID NO: 657355 - DNA, 25 bp, Mus musculus
gaggagatcgccgaggtacacagca

SEQ ID NO: 657356 - DNA, 25 bp, Mus musculus
gaggagatctccctatgtggctaga

SEQ ID NO: 657357 - DNA, 25 bp, Mus musculus
gaggagatctccgtatgtggctaga

SEQ ID NO: 657358 - DNA, 25 bp, Mus musculus
gaggagatgaaacaattagatgctc

SEQ ID NO: 657359 - DNA, 25 bp, Mus musculus
gaggagatgaaagaattagatgctc

SEQ ID NO: 657360 - DNA, 25 bp, Mus musculus
gaggagatgaccctcaagcagttcc

SEQ ID NO: 657361 - DNA, 25 bp, Mus musculus
gaggagatgaccgtcaagcagttcc

SEQ ID NO: 657362 - DNA, 25 bp, Mus musculus
gaggagatgcccctccatgtgaagt

SEQ ID NO: 657363 - DNA, 25 bp, Mus musculus
gaggagatgcccgtccatgtgaagt

SEQ ID NO: 657364 - DNA, 25 bp, Mus musculus
gaggagatggacatccctcagctga

SEQ ID NO: 657365 - DNA, 25 bp, Mus musculus
gaggagatggacttccctcagctga

SEQ ID NO: 657366 - DNA, 25 bp, Mus musculus
gaggagattgtaaggctaatgatca

SEQ ID NO: 657367 - DNA, 25 bp, Mus musculus
gaggagattgtatggctaatgatca

SEQ ID NO: 657368 - DNA, 25 bp, Mus musculus
gaggagattttaatcctggactcag

SEQ ID NO: 657369 - DNA, 25 bp, Mus musculus
gaggagattttattcctggactcag

SEQ ID NO: 657370 - DNA, 25 bp, Mus musculus
gaggagcaaaagacagaaaccttgg

SEQ ID NO: 657371 - DNA, 25 bp, Mus musculus
gaggagcaaaagtcagaaaccttgg

SEQ ID NO: 657372 - DNA, 25 bp, Mus musculus
gaggagcaaacacatacagagaaca

SEQ ID NO: 657373 - DNA, 25 bp, Mus musculus
gaggagcaaacagatacagagaaca

SEQ ID NO: 657374 - DNA, 25 bp, Mus musculus
gaggagcaaaccaacaccagtgctc

SEQ ID NO: 657375 - DNA, 25 bp, Mus musculus
gaggagcaaacctacaccagtgctc

SEQ ID NO: 657376 - DNA, 25 bp, Mus musculus
gaggagcaaactcgcactgagcaag

SEQ ID NO: 657377 - DNA, 25 bp, Mus musculus
gaggagcaaactggcactgagcaag

SEQ ID NO: 657378 - DNA, 25 bp, Mus musculus
gaggagcaacatcctttggccacag

SEQ ID NO: 657379 - DNA, 25 bp, Mus musculus
gaggagcaacatgctttggccacag

SEQ ID NO: 657380 - DNA, 25 bp, Mus musculus
gaggagcacctgaaagccatccagg

SEQ ID NO: 657381 - DNA, 25 bp, Mus musculus
gaggagcacctgtaagccatccagg

SEQ ID NO: 657382 - DNA, 25 bp, Mus musculus
gaggagcacgccacacaaggatgcc

SEQ ID NO: 657383 - DNA, 25 bp, Mus musculus
gaggagcacgcctcacaaggatgcc

SEQ ID NO: 657384 - DNA, 25 bp, Mus musculus
gaggagcagaacatactacagcatg

SEQ ID NO: 657385 - DNA, 25 bp, Mus musculus
gaggagcagaacttactacagcatg

SEQ ID NO: 657386 - DNA, 25 bp, Mus musculus
gaggagcatgtccattttcacatcc

SEQ ID NO: 657387 - DNA, 25 bp, Mus musculus
gaggagcatgtcgattttcacatcc

SEQ ID NO: 657388 - DNA, 25 bp, Mus musculus
gaggagcattataggaaaagttctc

SEQ ID NO: 657389 - DNA, 25 bp, Mus musculus
gaggagcattattggaaaagttctc

SEQ ID NO: 657390 - DNA, 25 bp, Mus musculus
gaggagccagcccttggcattgcac

SEQ ID NO: 657391 - DNA, 25 bp, Mus musculus
gaggagccagccgttggcattgcac

SEQ ID NO: 657392 - DNA, 25 bp, Mus musculus
gaggagccagtcaacatccctcagc

SEQ ID NO: 657393 - DNA, 25 bp, Mus musculus
gaggagccagtctacatccctcagc

SEQ ID NO: 657394 - DNA, 25 bp, Mus musculus
gaggagcccgtaaggatttcacaca

SEQ ID NO: 657395 - DNA, 25 bp, Mus musculus
gaggagcccgtatggatttcacaca

SEQ ID NO: 657396 - DNA, 25 bp, Mus musculus
gaggagcccgtcactcaagattaca

SEQ ID NO: 657397 - DNA, 25 bp, Mus musculus
gaggagcccgtctctcaagattaca

SEQ ID NO: 657398 - DNA, 25 bp, Mus musculus
gaggagccctctcgtgtcaccagtg

SEQ ID NO: 657399 - DNA, 25 bp, Mus musculus
gaggagccctctggtgtcaccagtg

SEQ ID NO: 657400 - DNA, 25 bp, Mus musculus
gaggagccctgcaaagttctgagaa

SEQ ID NO: 657401 - DNA, 25 bp, Mus musculus
gaggagccctgctaagttctgagaa

SEQ ID NO: 657402 - DNA, 25 bp, Mus musculus
gaggagcctcggacagctgcctctg

SEQ ID NO: 657403 - DNA, 25 bp, Mus musculus
gaggagcctcggtcagctgcctctg

SEQ ID NO: 657404 - DNA, 25 bp, Mus musculus
gaggagcctgctcagttccagatag

SEQ ID NO: 657405 - DNA, 25 bp, Mus musculus
gaggagcctgctgagttccagatag

SEQ ID NO: 657406 - DNA, 25 bp, Mus musculus
gaggagcgacctccgggacttcctc

SEQ ID NO: 657407 - DNA, 25 bp, Mus musculus
gaggagcgacctgcgggacttcctc

SEQ ID NO: 657408 - DNA, 25 bp, Mus musculus
gaggagcgatctccacagcccaggc

SEQ ID NO: 657409 - DNA, 25 bp, Mus musculus
gaggagcgatctgcacagcccaggc

SEQ ID NO: 657410 - DNA, 25 bp, Mus musculus
gaggagcgcaagaagaggctaggcc

SEQ ID NO: 657411 - DNA, 25 bp, Mus musculus
gaggagcgcaagtagaggctaggcc

SEQ ID NO: 657412 - DNA, 25 bp, Mus musculus
gaggagcgccagacacgcttccaga

SEQ ID NO: 657413 - DNA, 25 bp, Mus musculus
gaggagcgccagtcacgcttccaga

SEQ ID NO: 657414 - DNA, 25 bp, Mus musculus
gaggagcgcctgcaatttcagctga

SEQ ID NO: 657415 - DNA, 25 bp, Mus musculus
gaggagcgcctggaatttcagctga

SEQ ID NO: 657416 - DNA, 25 bp, Mus musculus
gaggagcgctacatggataacaact

SEQ ID NO: 657417 - DNA, 25 bp, Mus musculus
gaggagcgctacttggataacaact

SEQ ID NO: 657418 - DNA, 25 bp, Mus musculus
gaggagcgctccaacatcgtggaca

SEQ ID NO: 657419 - DNA, 25 bp, Mus musculus
gaggagcgctcctacatcgtggaca

SEQ ID NO: 657420 - DNA, 25 bp, Mus musculus
gaggagcggatcctggaagaaggca

SEQ ID NO: 657421 - DNA, 25 bp, Mus musculus
gaggagcggatcgtggaagaaggca

SEQ ID NO: 657422 - DNA, 25 bp, Mus musculus
gaggagcggcctccgcatgctccat

SEQ ID NO: 657423 - DNA, 25 bp, Mus musculus
gaggagcggcctgcgcatgctccat

SEQ ID NO: 657424 - DNA, 25 bp, Mus musculus
gaggagcggcttctactctgccagc

SEQ ID NO: 657425 - DNA, 25 bp, Mus musculus
gaggagcggcttgtactctgccagc

SEQ ID NO: 657426 - DNA, 25 bp, Mus musculus
gaggagcgtgcaatgctgccaatgt

SEQ ID NO: 657427 - DNA, 25 bp, Mus musculus
gaggagcgtgcattgctgccaatgt

SEQ ID NO: 657428 - DNA, 25 bp, Mus musculus
gaggagcgtgtcatcaacgaagagt

SEQ ID NO: 657429 - DNA, 25 bp, Mus musculus
gaggagcgtgtcttcaacgaagagt

SEQ ID NO: 657430 - DNA, 25 bp, Mus musculus
gaggagctcccgacagtagcctcaa

SEQ ID NO: 657431 - DNA, 25 bp, Mus musculus
gaggagctcccgtcagtagcctcaa

SEQ ID NO: 657432 - DNA, 25 bp, Mus musculus
gaggagctccgaacatctctgagga

SEQ ID NO: 657433 - DNA, 25 bp, Mus musculus
gaggagctccgatcatctctgagga

SEQ ID NO: 657434 - DNA, 25 bp, Mus musculus
gaggagctcttcagtttcctgtgca

SEQ ID NO: 657435 - DNA, 25 bp, Mus musculus
gaggagctcttctgtttcctgtgca

SEQ ID NO: 657436 - DNA, 25 bp, Mus musculus
gaggagctgaaacttccaaaattac

SEQ ID NO: 657437 - DNA, 25 bp, Mus musculus
gaggagctgaaagttccaaaattac

SEQ ID NO: 657438 - DNA, 25 bp, Mus musculus
gaggagctgaccaacatgtatgcag

SEQ ID NO: 657439 - DNA, 25 bp, Mus musculus
gaggagctgacctacatgtatgcag

SEQ ID NO: 657440 - DNA, 25 bp, Mus musculus
gaggagctggatcatcagaacattc

SEQ ID NO: 657441 - DNA, 25 bp, Mus musculus
gaggagctggatgatcagaacattc

SEQ ID NO: 657442 - DNA, 25 bp, Mus musculus
gaggagctggctcgaaataacaacc

SEQ ID NO: 657443 - DNA, 25 bp, Mus musculus
gaggagctggctggaaataacaacc

SEQ ID NO: 657444 - DNA, 25 bp, Mus musculus
gaggagctgtcacatctctgttctt

SEQ ID NO: 657445 - DNA, 25 bp, Mus musculus
gaggagctgtcagatctctgttctt

SEQ ID NO: 657446 - DNA, 25 bp, Mus musculus
gaggagctgtgaacaagtcagacca

SEQ ID NO: 657447 - DNA, 25 bp, Mus musculus
gaggagctgtgatcaagtcagacca

SEQ ID NO: 657448 - DNA, 25 bp, Mus musculus
gaggagctgtttctgacatccaagc

SEQ ID NO: 657449 - DNA, 25 bp, Mus musculus
gaggagctgtttgtgacatccaagc

SEQ ID NO: 657450 - DNA, 25 bp, Mus musculus
gaggaggaagctaagccagaaccag

SEQ ID NO: 657451 - DNA, 25 bp, Mus musculus
gaggaggaagcttagccagaaccag

SEQ ID NO: 657452 - DNA, 25 bp, Mus musculus
gaggaggaatataggaacagctcca

SEQ ID NO: 657453 - DNA, 25 bp, Mus musculus
gaggaggaatattggaacagctcca

SEQ ID NO: 657454 - DNA, 25 bp, Mus musculus
gaggaggaatttctgcgcacctatg

SEQ ID NO: 657455 - DNA, 25 bp, Mus musculus
gaggaggaatttgtgcgcacctatg

SEQ ID NO: 657456 - DNA, 25 bp, Mus musculus
gaggaggacactcctccgaaatctc

SEQ ID NO: 657457 - DNA, 25 bp, Mus musculus
gaggaggacactgctccgaaatctc

SEQ ID NO: 657458 - DNA, 25 bp, Mus musculus
gaggaggacaggctcattgaatcct

SEQ ID NO: 657459 - DNA, 25 bp, Mus musculus
gaggaggacagggtcattgaatcct

SEQ ID NO: 657460 - DNA, 25 bp, Mus musculus
gaggaggaccctaacatgaactaca

SEQ ID NO: 657461 - DNA, 25 bp, Mus musculus
gaggaggacccttacatgaactaca

SEQ ID NO: 657462 - DNA, 25 bp, Mus musculus
gaggaggacctcactaaactcttca

SEQ ID NO: 657463 - DNA, 25 bp, Mus musculus
gaggaggacctctctaaactcttca

SEQ ID NO: 657464 - DNA, 25 bp, Mus musculus
gaggaggagagcagccagatatcct

SEQ ID NO: 657465 - DNA, 25 bp, Mus musculus
gaggaggagagctgccagatatcct

SEQ ID NO: 657466 - DNA, 25 bp, Mus musculus
gaggaggagattaaggcccagaccc

SEQ ID NO: 657467 - DNA, 25 bp, Mus musculus
gaggaggagatttaggcccagaccc

SEQ ID NO: 657468 - DNA, 25 bp, Mus musculus
gaggaggatggtcccaacattgacc

SEQ ID NO: 657469 - DNA, 25 bp, Mus musculus
gaggaggatggtgccaacattgacc

SEQ ID NO: 657470 - DNA, 25 bp, Mus musculus
gaggaggcagctctactggaaaaac

SEQ ID NO: 657471 - DNA, 25 bp, Mus musculus
gaggaggcagctgtactggaaaaac

SEQ ID NO: 657472 - DNA, 25 bp, Mus musculus
gaggaggccacaaaccttctggagc

SEQ ID NO: 657473 - DNA, 25 bp, Mus musculus
gaggaggccacacttttcaccaagg

SEQ ID NO: 657474 - DNA, 25 bp, Mus musculus
gaggaggccacagttttcaccaagg

SEQ ID NO: 657475 - DNA, 25 bp, Mus musculus
gaggaggccacataccttctggagc

SEQ ID NO: 657476 - DNA, 25 bp, Mus musculus
gaggaggcggaacccctcagaatct

SEQ ID NO: 657477 - DNA, 25 bp, Mus musculus
gaggaggcggaagccctcagaatct

SEQ ID NO: 657478 - DNA, 25 bp, Mus musculus
gaggagggaactatccgcagctcca

SEQ ID NO: 657479 - DNA, 25 bp, Mus musculus
gaggagggaactttccgcagctcca

SEQ ID NO: 657480 - DNA, 25 bp, Mus musculus
gaggagggcctgctgtcaaccatct

SEQ ID NO: 657481 - DNA, 25 bp, Mus musculus
gaggagggcctggtgtcaaccatct

SEQ ID NO: 657482 - DNA, 25 bp, Mus musculus
gaggagggtacaatcctgagccaga

SEQ ID NO: 657483 - DNA, 25 bp, Mus musculus
gaggagggtacattcctgagccaga

SEQ ID NO: 657484 - DNA, 25 bp, Mus musculus
gaggaggtaaaactttgtgctacca

SEQ ID NO: 657485 - DNA, 25 bp, Mus musculus
gaggaggtaaaagtttgtgctacca

SEQ ID NO: 657486 - DNA, 25 bp, Mus musculus
gaggaggtctttcgaagctacgttt

SEQ ID NO: 657487 - DNA, 25 bp, Mus musculus
gaggaggtctttggaagctacgttt

SEQ ID NO: 657488 - DNA, 25 bp, Mus musculus
gaggaggtgggcctctcatacttaa

SEQ ID NO: 657489 - DNA, 25 bp, Mus musculus
gaggaggtgggcgtctcatacttaa

SEQ ID NO: 657490 - DNA, 25 bp, Mus musculus
gaggaggttcccactttaagaagtg

SEQ ID NO: 657491 - DNA, 25 bp, Mus musculus
gaggaggttccctctttaagaagtg

SEQ ID NO: 657492 - DNA, 25 bp, Mus musculus
gaggaggtttttctctgcaatataa

SEQ ID NO: 657493 - DNA, 25 bp, Mus musculus
gaggaggtttttgtctgcaatataa

SEQ ID NO: 657494 - DNA, 25 bp, Mus musculus
gaggagtaacctcaagtttgctgga

SEQ ID NO: 657495 - DNA, 25 bp, Mus musculus
gaggagtaacctgaagtttgctgga

SEQ ID NO: 657496 - DNA, 25 bp, Mus musculus
gaggagtaactaccataactagtca

SEQ ID NO: 657497 - DNA, 25 bp, Mus musculus
gaggagtaactagcataactagtca

SEQ ID NO: 657498 - DNA, 25 bp, Mus musculus
gaggagtacatcaccaagcttttca

SEQ ID NO: 657499 - DNA, 25 bp, Mus musculus
gaggagtacatctccaagcttttca

SEQ ID NO: 657500 - DNA, 25 bp, Mus musculus
gaggagtacgctctgctcacagcga

SEQ ID NO: 657501 - DNA, 25 bp, Mus musculus
gaggagtacgctgtgctcacagcga

SEQ ID NO: 657502 - DNA, 25 bp, Mus musculus
gaggagtagaaacctttgcccacct

SEQ ID NO: 657503 - DNA, 25 bp, Mus musculus
gaggagtagaaagctttgcccacct

SEQ ID NO: 657504 - DNA, 25 bp, Mus musculus
gaggagtatataatgtgacagagtg

SEQ ID NO: 657505 - DNA, 25 bp, Mus musculus
gaggagtatatattgtgacagagtg

SEQ ID NO: 657506 - DNA, 25 bp, Mus musculus
gaggagtcaaccaccacaacatctc

SEQ ID NO: 657507 - DNA, 25 bp, Mus musculus
gaggagtcaacctccacaacatctc

SEQ ID NO: 657508 - DNA, 25 bp, Mus musculus
gaggagtcacagaaaagttctatga

SEQ ID NO: 657509 - DNA, 25 bp, Mus musculus
gaggagtcacagtaaagttctatga

SEQ ID NO: 657510 - DNA, 25 bp, Mus musculus
gaggagtcaccgagcactatgggat

SEQ ID NO: 657511 - DNA, 25 bp, Mus musculus
gaggagtcaccgtgcactatgggat

SEQ ID NO: 657512 - DNA, 25 bp, Mus musculus
gaggagtcagaccagcactgcagat

SEQ ID NO: 657513 - DNA, 25 bp, Mus musculus
gaggagtcagacgagcactgcagat

SEQ ID NO: 657514 - DNA, 25 bp, Mus musculus
gaggagtctcatccctacttccacg

SEQ ID NO: 657515 - DNA, 25 bp, Mus musculus
gaggagtctcatgcctacttccacg

SEQ ID NO: 657516 - DNA, 25 bp, Mus musculus
gaggagtgatttccaacgcaatgga

SEQ ID NO: 657517 - DNA, 25 bp, Mus musculus
gaggagtgatttgcaacgcaatgga

SEQ ID NO: 657518 - DNA, 25 bp, Mus musculus
gaggagtgctgtccttccggcaaca

SEQ ID NO: 657519 - DNA, 25 bp, Mus musculus
gaggagtgctgtgcttccggcaaca

SEQ ID NO: 657520 - DNA, 25 bp, Mus musculus
gaggagtggattagccatcccttcc

SEQ ID NO: 657521 - DNA, 25 bp, Mus musculus
gaggagtggatttgccatcccttcc

SEQ ID NO: 657522 - DNA, 25 bp, Mus musculus
gaggagtggccgagctcaagtacac

SEQ ID NO: 657523 - DNA, 25 bp, Mus musculus
gaggagtggccgtgctcaagtacac

SEQ ID NO: 657524 - DNA, 25 bp, Mus musculus
gaggagtgtatgaagttgtgcctac

SEQ ID NO: 657525 - DNA, 25 bp, Mus musculus
gaggagtgtatgtagttgtgcctac

SEQ ID NO: 657526 - DNA, 25 bp, Mus musculus
gaggagtgtcagaaatatggaccag

SEQ ID NO: 657527 - DNA, 25 bp, Mus musculus
gaggagtgtcagtaatatggaccag

SEQ ID NO: 657528 - DNA, 25 bp, Mus musculus
gaggagttccagacagtggtctatg

SEQ ID NO: 657529 - DNA, 25 bp, Mus musculus
gaggagttccagtcagtggtctatg

SEQ ID NO: 657530 - DNA, 25 bp, Mus musculus
gaggagttcctgaagcgggagtttg

SEQ ID NO: 657531 - DNA, 25 bp, Mus musculus
gaggagttcctgtagcgggagtttg

SEQ ID NO: 657532 - DNA, 25 bp, Mus musculus
gaggagttctatcatgcactgtcag

SEQ ID NO: 657533 - DNA, 25 bp, Mus musculus
gaggagttctatgatgcactgtcag

SEQ ID NO: 657534 - DNA, 25 bp, Mus musculus
gaggagttcttcaggaagctgagcc

SEQ ID NO: 657535 - DNA, 25 bp, Mus musculus
gaggagttcttcctgttcagtcagc

SEQ ID NO: 657536 - DNA, 25 bp, Mus musculus
gaggagttcttcgtgttcagtcagc

SEQ ID NO: 657537 - DNA, 25 bp, Mus musculus
gaggagttcttctggaagctgagcc

SEQ ID NO: 657538 - DNA, 25 bp, Mus musculus
gaggagttggcacctctcttcgcgc

SEQ ID NO: 657539 - DNA, 25 bp, Mus musculus
gaggagttggcagctctcttcgcgc

SEQ ID NO: 657540 - DNA, 25 bp, Mus musculus
gaggagttgggaagctggccctgcc

SEQ ID NO: 657541 - DNA, 25 bp, Mus musculus
gaggagttgggatgctggccctgcc

SEQ ID NO: 657542 - DNA, 25 bp, Mus musculus
gaggagtttcatcgcctggtgaaca

SEQ ID NO: 657543 - DNA, 25 bp, Mus musculus
gaggagtttcatggcctggtgaaca

SEQ ID NO: 657544 - DNA, 25 bp, Mus musculus
gaggagtttgatcaacacgaacacg

SEQ ID NO: 657545 - DNA, 25 bp, Mus musculus
gaggagtttgatgaacacgaacacg

SEQ ID NO: 657546 - DNA, 25 bp, Mus musculus
gaggagtttgttaatttcgcagcca

SEQ ID NO: 657547 - DNA, 25 bp, Mus musculus
gaggagtttgtttatttcgcagcca

SEQ ID NO: 657548 - DNA, 25 bp, Mus musculus
gaggataatcttaaagagtttgacc

SEQ ID NO: 657549 - DNA, 25 bp, Mus musculus
gaggataatctttaagagtttgacc

SEQ ID NO: 657550 - DNA, 25 bp, Mus musculus
gaggataccaccagctataaagtct

SEQ ID NO: 657551 - DNA, 25 bp, Mus musculus
gaggataccacctgctataaagtct

SEQ ID NO: 657552 - DNA, 25 bp, Mus musculus
gaggataccactatagaaccagaag

SEQ ID NO: 657553 - DNA, 25 bp, Mus musculus
gaggataccactttagaaccagaag

SEQ ID NO: 657554 - DNA, 25 bp, Mus musculus
gaggatactcctcaggaccctctat

SEQ ID NO: 657555 - DNA, 25 bp, Mus musculus
gaggatactcctgaggaccctctat

SEQ ID NO: 657556 - DNA, 25 bp, Mus musculus
gaggatagctcacttcttcgcaaga

SEQ ID NO: 657557 - DNA, 25 bp, Mus musculus
gaggatagctcagttcttcgcaaga

SEQ ID NO: 657558 - DNA, 25 bp, Mus musculus
gaggatatgattacccaggatccaa

SEQ ID NO: 657559 - DNA, 25 bp, Mus musculus
gaggatatgatttcccaggatccaa

SEQ ID NO: 657560 - DNA, 25 bp, Mus musculus
gaggatattcaaatgggtgcctgtg

SEQ ID NO: 657561 - DNA, 25 bp, Mus musculus
gaggatattcaattgggtgcctgtg

SEQ ID NO: 657562 - DNA, 25 bp, Mus musculus
gaggatcaacgtcttagccaaaggt

SEQ ID NO: 657563 - DNA, 25 bp, Mus musculus
gaggatcaacgtgttagccaaaggt

SEQ ID NO: 657564 - DNA, 25 bp, Mus musculus
gaggatcaagtgactggaatcacag

SEQ ID NO: 657565 - DNA, 25 bp, Mus musculus
gaggatcaagtgtctggaatcacag

SEQ ID NO: 657566 - DNA, 25 bp, Mus musculus
gaggatcacctgaaatcaacgctgg

SEQ ID NO: 657567 - DNA, 25 bp, Mus musculus
gaggatcacctgtaatcaacgctgg

SEQ ID NO: 657568 - DNA, 25 bp, Mus musculus
gaggatcagatcatgcatgcgccat

SEQ ID NO: 657569 - DNA, 25 bp, Mus musculus
gaggatcagatcttgcatgcgccat

SEQ ID NO: 657570 - DNA, 25 bp, Mus musculus
gaggatcagcataagaccatctgta

SEQ ID NO: 657571 - DNA, 25 bp, Mus musculus
gaggatcagcattagaccatctgta

SEQ ID NO: 657572 - DNA, 25 bp, Mus musculus
gaggatcatgcacactgaaggcttc

SEQ ID NO: 657573 - DNA, 25 bp, Mus musculus
gaggatcatgcagactgaaggcttc

SEQ ID NO: 657574 - DNA, 25 bp, Mus musculus
gaggatcatggacttgcataagaca

SEQ ID NO: 657575 - DNA, 25 bp, Mus musculus
gaggatcatggagttgcataagaca

SEQ ID NO: 657576 - DNA, 25 bp, Mus musculus
gaggatccaattcgcacctttaggt

SEQ ID NO: 657577 - DNA, 25 bp, Mus musculus
gaggatccaattggcacctttaggt

SEQ ID NO: 657578 - DNA, 25 bp, Mus musculus
gaggatccagcaaatgatacagtgg

SEQ ID NO: 657579 - DNA, 25 bp, Mus musculus
gaggatccagcatatgatacagtgg

SEQ ID NO: 657580 - DNA, 25 bp, Mus musculus
gaggatccagtccatcaaggaagag

SEQ ID NO: 657581 - DNA, 25 bp, Mus musculus
gaggatccagtcgatcaaggaagag

SEQ ID NO: 657582 - DNA, 25 bp, Mus musculus
gaggatcccacacttttctgagctg

SEQ ID NO: 657583 - DNA, 25 bp, Mus musculus
gaggatcccacagttttctgagctg

SEQ ID NO: 657584 - DNA, 25 bp, Mus musculus
gaggatcccgatcctctgttggaga

SEQ ID NO: 657585 - DNA, 25 bp, Mus musculus
gaggatcccgatgctctgttggaga

SEQ ID NO: 657586 - DNA, 25 bp, Mus musculus
gaggatccgattctggaacgttctt

SEQ ID NO: 657587 - DNA, 25 bp, Mus musculus
gaggatccgattgtggaacgttctt

SEQ ID NO: 657588 - DNA, 25 bp, Mus musculus
gaggatccgcagaccaagagggttt

SEQ ID NO: 657589 - DNA, 25 bp, Mus musculus
gaggatccgcagtccaagagggttt

SEQ ID NO: 657590 - DNA, 25 bp, Mus musculus
gaggatccggaacgagttccccaag

SEQ ID NO: 657591 - DNA, 25 bp, Mus musculus
gaggatccggaactctactgtccct

SEQ ID NO: 657592 - DNA, 25 bp, Mus musculus
gaggatccggaaggagttccccaag

SEQ ID NO: 657593 - DNA, 25 bp, Mus musculus
gaggatccggaagtctactgtccct

SEQ ID NO: 657594 - DNA, 25 bp, Mus musculus
gaggatccgtgtcctgtcttttaaa

SEQ ID NO: 657595 - DNA, 25 bp, Mus musculus
gaggatccgtgtgctgtcttttaaa

SEQ ID NO: 657596 - DNA, 25 bp, Mus musculus
gaggatccgttccatcgaagccctt

SEQ ID NO: 657597 - DNA, 25 bp, Mus musculus
gaggatccgttcgatcgaagccctt

SEQ ID NO: 657598 - DNA, 25 bp, Mus musculus
gaggatcctcatcaaaggcaactca

SEQ ID NO: 657599 - DNA, 25 bp, Mus musculus
gaggatcctcatgaaaggcaactca

SEQ ID NO: 657600 - DNA, 25 bp, Mus musculus
gaggatcctgtgactgtaagacaag

SEQ ID NO: 657601 - DNA, 25 bp, Mus musculus
gaggatcctgtgtctgtaagacaag

SEQ ID NO: 657602 - DNA, 25 bp, Mus musculus
gaggatcgacctcaacttggatatc

SEQ ID NO: 657603 - DNA, 25 bp, Mus musculus
gaggatcgacctgaacttggatatc

SEQ ID NO: 657604 - DNA, 25 bp, Mus musculus
gaggatcgttctcggaggaacaaca

SEQ ID NO: 657605 - DNA, 25 bp, Mus musculus
gaggatcgttctgggaggaacaaca

SEQ ID NO: 657606 - DNA, 25 bp, Mus musculus
gaggatctcagccaaaactcatcat

SEQ ID NO: 657607 - DNA, 25 bp, Mus musculus
gaggatctcagcgaaaactcatcat

SEQ ID NO: 657608 - DNA, 25 bp, Mus musculus
gaggatctcagtagagttttgccac

SEQ ID NO: 657609 - DNA, 25 bp, Mus musculus
gaggatctcagttgagttttgccac

SEQ ID NO: 657610 - DNA, 25 bp, Mus musculus
gaggatctctgtaccatacgctggc

SEQ ID NO: 657611 - DNA, 25 bp, Mus musculus
gaggatctctgttccatacgctggc

SEQ ID NO: 657612 - DNA, 25 bp, Mus musculus
gaggatctgaccatgaaatactacc

SEQ ID NO: 657613 - DNA, 25 bp, Mus musculus
gaggatctgaccttgaaatactacc

SEQ ID NO: 657614 - DNA, 25 bp, Mus musculus
gaggatctgcagaagcgcctagctg

SEQ ID NO: 657615 - DNA, 25 bp, Mus musculus
gaggatctgcagtagcgcctagctg

SEQ ID NO: 657616 - DNA, 25 bp, Mus musculus
gaggatctgcccaaccactactatg

SEQ ID NO: 657617 - DNA, 25 bp, Mus musculus
gaggatctgccctaccactactatg

SEQ ID NO: 657618 - DNA, 25 bp, Mus musculus
gaggatctgccgaccaaacttgaag

SEQ ID NO: 657619 - DNA, 25 bp, Mus musculus
gaggatctgccgtccaaacttgaag

SEQ ID NO: 657620 - DNA, 25 bp, Mus musculus
gaggatctgctgcagccgtcatcgt

SEQ ID NO: 657621 - DNA, 25 bp, Mus musculus
gaggatctgctggagccgtcatcgt

SEQ ID NO: 657622 - DNA, 25 bp, Mus musculus
gaggatctggatcagttacactacc

SEQ ID NO: 657623 - DNA, 25 bp, Mus musculus
gaggatctggatgagttacactacc

SEQ ID NO: 657624 - DNA, 25 bp, Mus musculus
gaggatctggtgctttcatcaagaa

SEQ ID NO: 657625 - DNA, 25 bp, Mus musculus
gaggatctggtggtttcatcaagaa

SEQ ID NO: 657626 - DNA, 25 bp, Mus musculus
gaggatctttttctatgacgcagag

SEQ ID NO: 657627 - DNA, 25 bp, Mus musculus
gaggatctttttgtatgacgcagag

SEQ ID NO: 657628 - DNA, 25 bp, Mus musculus
gaggatgaagatatcctcccattag

SEQ ID NO: 657629 - DNA, 25 bp, Mus musculus
gaggatgaagatttcctcccattag

SEQ ID NO: 657630 - DNA, 25 bp, Mus musculus
gaggatgacaaactgggcaccgact

SEQ ID NO: 657631 - DNA, 25 bp, Mus musculus
gaggatgacaaagtgggcaccgact

SEQ ID NO: 657632 - DNA, 25 bp, Mus musculus
gaggatgagaagatgccgccctatg

SEQ ID NO: 657633 - DNA, 25 bp, Mus musculus
gaggatgagaagttgccgccctatg

SEQ ID NO: 657634 - DNA, 25 bp, Mus musculus
gaggatgagctgaaccagctctcac

SEQ ID NO: 657635 - DNA, 25 bp, Mus musculus
gaggatgagctgtaccagctctcac

SEQ ID NO: 657636 - DNA, 25 bp, Mus musculus
gaggatgcaataaagcagacaagcc

SEQ ID NO: 657637 - DNA, 25 bp, Mus musculus
gaggatgcaatatagcagacaagcc

SEQ ID NO: 657638 - DNA, 25 bp, Mus musculus
gaggatgcatacagctgtgaagctc

SEQ ID NO: 657639 - DNA, 25 bp, Mus musculus
gaggatgcatactgctgtgaagctc

SEQ ID NO: 657640 - DNA, 25 bp, Mus musculus
gaggatgccaagcagatcatgcagc

SEQ ID NO: 657641 - DNA, 25 bp, Mus musculus
gaggatgccaaggagatcatgcagc

SEQ ID NO: 657642 - DNA, 25 bp, Mus musculus
gaggatgcccccctgggagaatatc

SEQ ID NO: 657643 - DNA, 25 bp, Mus musculus
gaggatgcccccgtgggagaatatc

SEQ ID NO: 657644 - DNA, 25 bp, Mus musculus
gaggatgccttgcagacaagtctga

SEQ ID NO: 657645 - DNA, 25 bp, Mus musculus
gaggatgccttggagacaagtctga

SEQ ID NO: 657646 - DNA, 25 bp, Mus musculus
gaggatgctgggaaactgtataata

SEQ ID NO: 657647 - DNA, 25 bp, Mus musculus
gaggatgctgggtaactgtataata

SEQ ID NO: 657648 - DNA, 25 bp, Mus musculus
gaggatgcttcacctactaagtgtc

SEQ ID NO: 657649 - DNA, 25 bp, Mus musculus
gaggatgcttcagctactaagtgtc

SEQ ID NO: 657650 - DNA, 25 bp, Mus musculus
gaggatggacacatctcacactaca

SEQ ID NO: 657651 - DNA, 25 bp, Mus musculus
gaggatggacacttctcacactaca

SEQ ID NO: 657652 - DNA, 25 bp, Mus musculus
gaggatggagaacagctcctccatc

SEQ ID NO: 657653 - DNA, 25 bp, Mus musculus
gaggatggagaagagctcctccatc

SEQ ID NO: 657654 - DNA, 25 bp, Mus musculus
gaggatggagcccacctcaggcttt

SEQ ID NO: 657655 - DNA, 25 bp, Mus musculus
gaggatggagccgacctcaggcttt

SEQ ID NO: 657656 - DNA, 25 bp, Mus musculus
gaggatggcagcactaagagccctg

SEQ ID NO: 657657 - DNA, 25 bp, Mus musculus
gaggatggcagctctaagagccctg

SEQ ID NO: 657658 - DNA, 25 bp, Mus musculus
gaggatggccatcagaacaatctgg

SEQ ID NO: 657659 - DNA, 25 bp, Mus musculus
gaggatggccatgagaacaatctgg

SEQ ID NO: 657660 - DNA, 25 bp, Mus musculus
gaggatggcccaaggcaatggctcc

SEQ ID NO: 657661 - DNA, 25 bp, Mus musculus
gaggatggcccatggcaatggctcc

SEQ ID NO: 657662 - DNA, 25 bp, Mus musculus
gaggatggctggcagcccatcctat

SEQ ID NO: 657663 - DNA, 25 bp, Mus musculus
gaggatggctgggagcccatcctat

SEQ ID NO: 657664 - DNA, 25 bp, Mus musculus
gaggatgggctcaagtactacagga

SEQ ID NO: 657665 - DNA, 25 bp, Mus musculus
gaggatgggctctagtactacagga

SEQ ID NO: 657666 - DNA, 25 bp, Mus musculus
gaggatggtgccaacattgacctgg

SEQ ID NO: 657667 - DNA, 25 bp, Mus musculus
gaggatggtgcctacattgacctgg

SEQ ID NO: 657668 - DNA, 25 bp, Mus musculus
gaggatggttcaaatacttacgtca

SEQ ID NO: 657669 - DNA, 25 bp, Mus musculus
gaggatggttcatatacttacgtca

SEQ ID NO: 657670 - DNA, 25 bp, Mus musculus
gaggatgtcacaccttggatcccgg

SEQ ID NO: 657671 - DNA, 25 bp, Mus musculus
gaggatgtcacagcttggatcccgg

SEQ ID NO: 657672 - DNA, 25 bp, Mus musculus
gaggatgtccccctcacctaatctt

SEQ ID NO: 657673 - DNA, 25 bp, Mus musculus
gaggatgtccccgtcacctaatctt

SEQ ID NO: 657674 - DNA, 25 bp, Mus musculus
gaggatgtgaggaaaaacttacagc

SEQ ID NO: 657675 - DNA, 25 bp, Mus musculus
gaggatgtgaggtaaaacttacagc

SEQ ID NO: 657676 - DNA, 25 bp, Mus musculus
gaggatgtgcgcctctcacaaacca

SEQ ID NO: 657677 - DNA, 25 bp, Mus musculus
gaggatgtgcgcgtctcacaaacca

SEQ ID NO: 657678 - DNA, 25 bp, Mus musculus
gaggatgtggttcaaccctttggtt

SEQ ID NO: 657679 - DNA, 25 bp, Mus musculus
gaggatgtggttgaaccctttggtt

SEQ ID NO: 657680 - DNA, 25 bp, Mus musculus
gaggatgtgtacacgctcttccctg

SEQ ID NO: 657681 - DNA, 25 bp, Mus musculus
gaggatgtgtactcgctcttccctg

SEQ ID NO: 657682 - DNA, 25 bp, Mus musculus
gaggatgtgtctcgtctcgtttccc

SEQ ID NO: 657683 - DNA, 25 bp, Mus musculus
gaggatgtgtctggtctcgtttccc

SEQ ID NO: 657684 - DNA, 25 bp, Mus musculus
gaggatgttcctagcttcacagaga

SEQ ID NO: 657685 - DNA, 25 bp, Mus musculus
gaggatgttccttgcttcacagaga

SEQ ID NO: 657686 - DNA, 25 bp, Mus musculus
gaggatgttgagcaccattatgaga

SEQ ID NO: 657687 - DNA, 25 bp, Mus musculus
gaggatgttgaggaccattatgaga

SEQ ID NO: 657688 - DNA, 25 bp, Mus musculus
gaggatgtttctactgtgggcagca

SEQ ID NO: 657689 - DNA, 25 bp, Mus musculus
gaggatgtttcttctgtgggcagca

SEQ ID NO: 657690 - DNA, 25 bp, Mus musculus
gaggattacgtcagtgtggctgctt

SEQ ID NO: 657691 - DNA, 25 bp, Mus musculus
gaggattacgtctgtgtggctgctt

SEQ ID NO: 657692 - DNA, 25 bp, Mus musculus
gaggattagcctaacagggcacaga

SEQ ID NO: 657693 - DNA, 25 bp, Mus musculus
gaggattagccttacagggcacaga

SEQ ID NO: 657694 - DNA, 25 bp, Mus musculus
gaggattatgcaagttacattatga

SEQ ID NO: 657695 - DNA, 25 bp, Mus musculus
gaggattatgcatgttacattatga

SEQ ID NO: 657696 - DNA, 25 bp, Mus musculus
gaggattcaggccaataccactgtg

SEQ ID NO: 657697 - DNA, 25 bp, Mus musculus
gaggattcaggcgaataccactgtg

SEQ ID NO: 657698 - DNA, 25 bp, Mus musculus
gaggattcttgcatttcgagaagga

SEQ ID NO: 657699 - DNA, 25 bp, Mus musculus
gaggattcttgcttttcgagaagga

SEQ ID NO: 657700 - DNA, 25 bp, Mus musculus
gaggattgaaacaggagtccggcaa

SEQ ID NO: 657701 - DNA, 25 bp, Mus musculus
gaggattgaaactggagtccggcaa

SEQ ID NO: 657702 - DNA, 25 bp, Mus musculus
gaggattgataaagagcctgcttac

SEQ ID NO: 657703 - DNA, 25 bp, Mus musculus
gaggattgataatgagcctgcttac

SEQ ID NO: 657704 - DNA, 25 bp, Mus musculus
gaggattgctgacatcctcctgtgg

SEQ ID NO: 657705 - DNA, 25 bp, Mus musculus
gaggattgctgagatcctcctgtgg

SEQ ID NO: 657706 - DNA, 25 bp, Mus musculus
gaggattggcctctcagtatcagag

SEQ ID NO: 657707 - DNA, 25 bp, Mus musculus
gaggattggcctgtcagtatcagag

SEQ ID NO: 657708 - DNA, 25 bp, Mus musculus
gaggatttcacaccatacggtggtg

SEQ ID NO: 657709 - DNA, 25 bp, Mus musculus
gaggatttcacagcatacggtggtg

SEQ ID NO: 657710 - DNA, 25 bp, Mus musculus
gaggatttcattccacagccggctc

SEQ ID NO: 657711 - DNA, 25 bp, Mus musculus
gaggatttcattgcacagccggctc

SEQ ID NO: 657712 - DNA, 25 bp, Mus musculus
gaggatttcgatctggaccactttg

SEQ ID NO: 657713 - DNA, 25 bp, Mus musculus
gaggatttcgatgtggaccactttg

SEQ ID NO: 657714 - DNA, 25 bp, Mus musculus
gaggatttttgaactgcagcttcca

SEQ ID NO: 657715 - DNA, 25 bp, Mus musculus
gaggatttttgatctgcagcttcca

SEQ ID NO: 657716 - DNA, 25 bp, Mus musculus
gaggcaaaaatgatggttgctaaca

SEQ ID NO: 657717 - DNA, 25 bp, Mus musculus
gaggcaaaaatgttggttgctaaca

SEQ ID NO: 657718 - DNA, 25 bp, Mus musculus
gaggcaaaaggtctggcttccgcaa

SEQ ID NO: 657719 - DNA, 25 bp, Mus musculus
gaggcaaaaggtgtggcttccgcaa

SEQ ID NO: 657720 - DNA, 25 bp, Mus musculus
gaggcaaacgacatctgcatcagac

SEQ ID NO: 657721 - DNA, 25 bp, Mus musculus
gaggcaaacgacttctgcatcagac

SEQ ID NO: 657722 - DNA, 25 bp, Mus musculus
gaggcaaagattaatgagcttcaag

SEQ ID NO: 657723 - DNA, 25 bp, Mus musculus
gaggcaaagatttatgagcttcaag

SEQ ID NO: 657724 - DNA, 25 bp, Mus musculus
gaggcaaaggctcataaaccctgca

SEQ ID NO: 657725 - DNA, 25 bp, Mus musculus
gaggcaaaggctgataaaccctgca

SEQ ID NO: 657726 - DNA, 25 bp, Mus musculus
gaggcaaagtttccaaccatgaacc

SEQ ID NO: 657727 - DNA, 25 bp, Mus musculus
gaggcaaagtttgcaaccatgaacc

SEQ ID NO: 657728 - DNA, 25 bp, Mus musculus
gaggcaaatgaacgccccagcggaa

SEQ ID NO: 657729 - DNA, 25 bp, Mus musculus
gaggcaaatgaaggccccagcggaa

SEQ ID NO: 657730 - DNA, 25 bp, Mus musculus
gaggcaacaaagattgcggctgcct

SEQ ID NO: 657731 - DNA, 25 bp, Mus musculus
gaggcaacaaagtttgcggctgcct

SEQ ID NO: 657732 - DNA, 25 bp, Mus musculus
gaggcaacacatctcagtctgctga

SEQ ID NO: 657733 - DNA, 25 bp, Mus musculus
gaggcaacacatgtcagtctgctga

SEQ ID NO: 657734 - DNA, 25 bp, Mus musculus
gaggcaaccaccagcctgtccagtt

SEQ ID NO: 657735 - DNA, 25 bp, Mus musculus
gaggcaaccacctgcctgtccagtt

SEQ ID NO: 657736 - DNA, 25 bp, Mus musculus
gaggcaaccagcctgtgtcatggcc

SEQ ID NO: 657737 - DNA, 25 bp, Mus musculus
gaggcaaccagcgtgtgtcatggcc

SEQ ID NO: 657738 - DNA, 25 bp, Mus musculus
gaggcaacctgcagcgagttcccac

SEQ ID NO: 657739 - DNA, 25 bp, Mus musculus
gaggcaacctgctgcgagttcccac

SEQ ID NO: 657740 - DNA, 25 bp, Mus musculus
gaggcaacctggacgatgccctgaa

SEQ ID NO: 657741 - DNA, 25 bp, Mus musculus
gaggcaacctggtcgatgccctgaa

SEQ ID NO: 657742 - DNA, 25 bp, Mus musculus
gaggcaacggcaacgttggagctca

SEQ ID NO: 657743 - DNA, 25 bp, Mus musculus
gaggcaacggcatcgttggagctca

SEQ ID NO: 657744 - DNA, 25 bp, Mus musculus
gaggcaagacataaggaatggcgac

SEQ ID NO: 657745 - DNA, 25 bp, Mus musculus
gaggcaagacattaggaatggcgac

SEQ ID NO: 657746 - DNA, 25 bp, Mus musculus
gaggcaagagcaaccttacagaact

SEQ ID NO: 657747 - DNA, 25 bp, Mus musculus
gaggcaagagcatccttacagaact

SEQ ID NO: 657748 - DNA, 25 bp, Mus musculus
gaggcaagccttcccaagatcaagg

SEQ ID NO: 657749 - DNA, 25 bp, Mus musculus
gaggcaagccttgccaagatcaagg

SEQ ID NO: 657750 - DNA, 25 bp, Mus musculus
gaggcaagctgaaaagctcgaagaa

SEQ ID NO: 657751 - DNA, 25 bp, Mus musculus
gaggcaagctgataagctcgaagaa

SEQ ID NO: 657752 - DNA, 25 bp, Mus musculus
gaggcaagttcaatccagggcatct

SEQ ID NO: 657753 - DNA, 25 bp, Mus musculus
gaggcaagttcattccagggcatct

SEQ ID NO: 657754 - DNA, 25 bp, Mus musculus
gaggcaatactcaggcgtgcacacg

SEQ ID NO: 657755 - DNA, 25 bp, Mus musculus
gaggcaatactctggcgtgcacacg

SEQ ID NO: 657756 - DNA, 25 bp, Mus musculus
gaggcaatgagtcgagcatctactt

SEQ ID NO: 657757 - DNA, 25 bp, Mus musculus
gaggcaatgagtggagcatctactt

SEQ ID NO: 657758 - DNA, 25 bp, Mus musculus
gaggcaatgtacaaccagggctata

SEQ ID NO: 657759 - DNA, 25 bp, Mus musculus
gaggcaatgtactaccagggctata

SEQ ID NO: 657760 - DNA, 25 bp, Mus musculus
gaggcaatgtccagctggcagctca

SEQ ID NO: 657761 - DNA, 25 bp, Mus musculus
gaggcaatgtcctgctggcagctca

SEQ ID NO: 657762 - DNA, 25 bp, Mus musculus
gaggcaattaggattgcccaggagt

SEQ ID NO: 657763 - DNA, 25 bp, Mus musculus
gaggcaattaggtttgcccaggagt

SEQ ID NO: 657764 - DNA, 25 bp, Mus musculus
gaggcaattctgcagaccactggaa

SEQ ID NO: 657765 - DNA, 25 bp, Mus musculus
gaggcaattctggagaccactggaa

SEQ ID NO: 657766 - DNA, 25 bp, Mus musculus
gaggcacaaagaaatctggtccaag

SEQ ID NO: 657767 - DNA, 25 bp, Mus musculus
gaggcacaaagatatctggtccaag

SEQ ID NO: 657768 - DNA, 25 bp, Mus musculus
gaggcacaatctcaacgaactaaag

SEQ ID NO: 657769 - DNA, 25 bp, Mus musculus
gaggcacaatctgaacgaactaaag

SEQ ID NO: 657770 - DNA, 25 bp, Mus musculus
gaggcacacaaaactctgcgtttgg

SEQ ID NO: 657771 - DNA, 25 bp, Mus musculus
gaggcacacaaatctctgcgtttgg

SEQ ID NO: 657772 - DNA, 25 bp, Mus musculus
gaggcacacaccatatggtaaccaa

SEQ ID NO: 657773 - DNA, 25 bp, Mus musculus
gaggcacacaccttatggtaaccaa

SEQ ID NO: 657774 - DNA, 25 bp, Mus musculus
gaggcacagaggatctcagcttcac

SEQ ID NO: 657775 - DNA, 25 bp, Mus musculus
gaggcacagaggttctcagcttcac

SEQ ID NO: 657776 - DNA, 25 bp, Mus musculus
gaggcacagattcggaaatatccgg

SEQ ID NO: 657777 - DNA, 25 bp, Mus musculus
gaggcacagattgggaaatatccgg

SEQ ID NO: 657778 - DNA, 25 bp, Mus musculus
gaggcacagctcagtaaaagagagc

SEQ ID NO: 657779 - DNA, 25 bp, Mus musculus
gaggcacagctctgtaaaagagagc

SEQ ID NO: 657780 - DNA, 25 bp, Mus musculus
gaggcacagttgctggctacttcct

SEQ ID NO: 657781 - DNA, 25 bp, Mus musculus
gaggcacagttggtggctacttcct

SEQ ID NO: 657782 - DNA, 25 bp, Mus musculus
gaggcacatcatagcccaagccttg

SEQ ID NO: 657783 - DNA, 25 bp, Mus musculus
gaggcacatcattgcccaagccttg

SEQ ID NO: 657784 - DNA, 25 bp, Mus musculus
gaggcacatcttactcttttactca

SEQ ID NO: 657785 - DNA, 25 bp, Mus musculus
gaggcacatctttctcttttactca

SEQ ID NO: 657786 - DNA, 25 bp, Mus musculus
gaggcaccaggtaaagcagtacctt

SEQ ID NO: 657787 - DNA, 25 bp, Mus musculus
gaggcaccaggttaagcagtacctt

SEQ ID NO: 657788 - DNA, 25 bp, Mus musculus
gaggcaccatgtaccaaatcccagg

SEQ ID NO: 657789 - DNA, 25 bp, Mus musculus
gaggcaccatgttccaaatcccagg

SEQ ID NO: 657790 - DNA, 25 bp, Mus musculus
gaggcacccaatatccaggcttcag

SEQ ID NO: 657791 - DNA, 25 bp, Mus musculus
gaggcacccaatttccaggcttcag

SEQ ID NO: 657792 - DNA, 25 bp, Mus musculus
gaggcaccgctcacctgtctgcggt

SEQ ID NO: 657793 - DNA, 25 bp, Mus musculus
gaggcaccgctctcctgtctgcggt

SEQ ID NO: 657794 - DNA, 25 bp, Mus musculus
gaggcacctgaaatctgttatcttc

SEQ ID NO: 657795 - DNA, 25 bp, Mus musculus
gaggcacctgaattctgttatcttc

SEQ ID NO: 657796 - DNA, 25 bp, Mus musculus
gaggcacctgccagaggctatctcg

SEQ ID NO: 657797 - DNA, 25 bp, Mus musculus
gaggcacctgcctgaggctatctcg

SEQ ID NO: 657798 - DNA, 25 bp, Mus musculus
gaggcactatcacaggagaggtcac

SEQ ID NO: 657799 - DNA, 25 bp, Mus musculus
gaggcactatcagaggagaggtcac

SEQ ID NO: 657800 - DNA, 25 bp, Mus musculus
gaggcactccgtctctaccagcatg

SEQ ID NO: 657801 - DNA, 25 bp, Mus musculus
gaggcactccgtgtctaccagcatg

SEQ ID NO: 657802 - DNA, 25 bp, Mus musculus
gaggcactgttgagatgaagtcatg

SEQ ID NO: 657803 - DNA, 25 bp, Mus musculus
gaggcactgttgtgatgaagtcatg

SEQ ID NO: 657804 - DNA, 25 bp, Mus musculus
gaggcactttccataaagtgaaggc

SEQ ID NO: 657805 - DNA, 25 bp, Mus musculus
gaggcactttccttaaagtgaaggc

SEQ ID NO: 657806 - DNA, 25 bp, Mus musculus
gaggcagaactcacctgcagggagt

SEQ ID NO: 657807 - DNA, 25 bp, Mus musculus
gaggcagaactctcctgcagggagt

SEQ ID NO: 657808 - DNA, 25 bp, Mus musculus
gaggcagaagaacacgttaagcaga

SEQ ID NO: 657809 - DNA, 25 bp, Mus musculus
gaggcagaagaacgtcaagttgttt

SEQ ID NO: 657810 - DNA, 25 bp, Mus musculus
gaggcagaagaagacgttaagcaga

SEQ ID NO: 657811 - DNA, 25 bp, Mus musculus
gaggcagaagaaggtcaagttgttt

SEQ ID NO: 657812 - DNA, 25 bp, Mus musculus
gaggcagaagcccaaaagtagccac

SEQ ID NO: 657813 - DNA, 25 bp, Mus musculus
gaggcagaagccgaaaagtagccac

SEQ ID NO: 657814 - DNA, 25 bp, Mus musculus
gaggcagaagtactcacagggtcct

SEQ ID NO: 657815 - DNA, 25 bp, Mus musculus
gaggcagaagtagtcacagggtcct

SEQ ID NO: 657816 - DNA, 25 bp, Mus musculus
gaggcagacaggaggatctttacaa

SEQ ID NO: 657817 - DNA, 25 bp, Mus musculus
gaggcagacaggtggatctttacaa

SEQ ID NO: 657818 - DNA, 25 bp, Mus musculus
gaggcagacctgctcaaaactctcc

SEQ ID NO: 657819 - DNA, 25 bp, Mus musculus
gaggcagacctggtcaaaactctcc

SEQ ID NO: 657820 - DNA, 25 bp, Mus musculus
gaggcagagaacatcactgaaggga

SEQ ID NO: 657821 - DNA, 25 bp, Mus musculus
gaggcagagaacttcactgaaggga

SEQ ID NO: 657822 - DNA, 25 bp, Mus musculus
gaggcagagagactcggcctacaca

SEQ ID NO: 657823 - DNA, 25 bp, Mus musculus
gaggcagagagagtcggcctacaca

SEQ ID NO: 657824 - DNA, 25 bp, Mus musculus
gaggcagagatccacttcctggaga

SEQ ID NO: 657825 - DNA, 25 bp, Mus musculus
gaggcagagatcgacttcctggaga

SEQ ID NO: 657826 - DNA, 25 bp, Mus musculus
gaggcagagctgcaaacaactccca

SEQ ID NO: 657827 - DNA, 25 bp, Mus musculus
gaggcagagctggaaacaactccca

SEQ ID NO: 657828 - DNA, 25 bp, Mus musculus
gaggcagaggaccattttgactcag

SEQ ID NO: 657829 - DNA, 25 bp, Mus musculus
gaggcagaggacgattttgactcag

SEQ ID NO: 657830 - DNA, 25 bp, Mus musculus
gaggcagatcctacgagcatccgtg

SEQ ID NO: 657831 - DNA, 25 bp, Mus musculus
gaggcagatccttcgagcatccgtg

SEQ ID NO: 657832 - DNA, 25 bp, Mus musculus
gaggcagatgttagtccagagagtc

SEQ ID NO: 657833 - DNA, 25 bp, Mus musculus
gaggcagatgtttgtccagagagtc

SEQ ID NO: 657834 - DNA, 25 bp, Mus musculus
gaggcagcacacaggttgcttcttg

SEQ ID NO: 657835 - DNA, 25 bp, Mus musculus
gaggcagcacactggttgcttcttg

SEQ ID NO: 657836 - DNA, 25 bp, Mus musculus
gaggcagccaggaactttcccctgc

SEQ ID NO: 657837 - DNA, 25 bp, Mus musculus
gaggcagccaggtactttcccctgc

SEQ ID NO: 657838 - DNA, 25 bp, Mus musculus
gaggcagcccatccagttctcgtgg

SEQ ID NO: 657839 - DNA, 25 bp, Mus musculus
gaggcagcccatgcagttctcgtgg

SEQ ID NO: 657840 - DNA, 25 bp, Mus musculus
gaggcagcgcctaccagaaacagtt

SEQ ID NO: 657841 - DNA, 25 bp, Mus musculus
gaggcagcgccttccagaaacagtt

SEQ ID NO: 657842 - DNA, 25 bp, Mus musculus
gaggcagcgttccacaaacttgaga

SEQ ID NO: 657843 - DNA, 25 bp, Mus musculus
gaggcagcgttcctaaccatcgtct

SEQ ID NO: 657844 - DNA, 25 bp, Mus musculus
gaggcagcgttcgacaaacttgaga

SEQ ID NO: 657845 - DNA, 25 bp, Mus musculus
gaggcagcgttcgtaaccatcgtct

SEQ ID NO: 657846 - DNA, 25 bp, Mus musculus
gaggcagctaagaacgttcatggca

SEQ ID NO: 657847 - DNA, 25 bp, Mus musculus
gaggcagctaagtacgttcatggca

SEQ ID NO: 657848 - DNA, 25 bp, Mus musculus
gaggcagctatacaagaaacggaga

SEQ ID NO: 657849 - DNA, 25 bp, Mus musculus
gaggcagctatagaagaaacggaga

SEQ ID NO: 657850 - DNA, 25 bp, Mus musculus
gaggcaggaagcaaacgttttccag

SEQ ID NO: 657851 - DNA, 25 bp, Mus musculus
gaggcaggaagctaacgttttccag

SEQ ID NO: 657852 - DNA, 25 bp, Mus musculus
gaggcaggactgctcacggttacat

SEQ ID NO: 657853 - DNA, 25 bp, Mus musculus
gaggcaggactggtcacggttacat

SEQ ID NO: 657854 - DNA, 25 bp, Mus musculus
gaggcaggattgaccacggacatca

SEQ ID NO: 657855 - DNA, 25 bp, Mus musculus
gaggcaggattgtccacggacatca

SEQ ID NO: 657856 - DNA, 25 bp, Mus musculus
gaggcaggcaaacatgcctctcaca

SEQ ID NO: 657857 - DNA, 25 bp, Mus musculus
gaggcaggcaaagatgcctctcaca

SEQ ID NO: 657858 - DNA, 25 bp, Mus musculus
gaggcaggcagcacacacattggac

SEQ ID NO: 657859 - DNA, 25 bp, Mus musculus
gaggcaggcagctcacacattggac

SEQ ID NO: 657860 - DNA, 25 bp, Mus musculus
gaggcaggcatgcagttctcttcac

SEQ ID NO: 657861 - DNA, 25 bp, Mus musculus
gaggcaggcatggagttctcttcac

SEQ ID NO: 657862 - DNA, 25 bp, Mus musculus
gaggcaggctacacaggtctagcta

SEQ ID NO: 657863 - DNA, 25 bp, Mus musculus
gaggcaggctactcaggtctagcta

SEQ ID NO: 657864 - DNA, 25 bp, Mus musculus
gaggcagtatgaagacccctacagc

SEQ ID NO: 657865 - DNA, 25 bp, Mus musculus
gaggcagtatgatgacccctacagc

SEQ ID NO: 657866 - DNA, 25 bp, Mus musculus
gaggcagtgctcctaaggttaacac

SEQ ID NO: 657867 - DNA, 25 bp, Mus musculus
gaggcagtgctcgtaaggttaacac

SEQ ID NO: 657868 - DNA, 25 bp, Mus musculus
gaggcagtggctacacaagagctat

SEQ ID NO: 657869 - DNA, 25 bp, Mus musculus
gaggcagtggcttcacaagagctat

SEQ ID NO: 657870 - DNA, 25 bp, Mus musculus
gaggcagtgggtaaacaaagaccaa

SEQ ID NO: 657871 - DNA, 25 bp, Mus musculus
gaggcagtgggttaacaaagaccaa

SEQ ID NO: 657872 - DNA, 25 bp, Mus musculus
gaggcagtgtgtccttctccatcca

SEQ ID NO: 657873 - DNA, 25 bp, Mus musculus
gaggcagtgtgtgcttctccatcca

SEQ ID NO: 657874 - DNA, 25 bp, Mus musculus
gaggcagttctgctttcaaggcaat

SEQ ID NO: 657875 - DNA, 25 bp, Mus musculus
gaggcagttctggtttcaaggcaat

SEQ ID NO: 657876 - DNA, 25 bp, Mus musculus
gaggcatacttccagtccattaaag

SEQ ID NO: 657877 - DNA, 25 bp, Mus musculus
gaggcatacttcgagtccattaaag

SEQ ID NO: 657878 - DNA, 25 bp, Mus musculus
gaggcatcaacgacggaggagacct

SEQ ID NO: 657879 - DNA, 25 bp, Mus musculus
gaggcatcaacgtcggaggagacct

SEQ ID NO: 657880 - DNA, 25 bp, Mus musculus
gaggcatcatagagcgatggtgtaa

SEQ ID NO: 657881 - DNA, 25 bp, Mus musculus
gaggcatcatagtgcgatggtgtaa

SEQ ID NO: 657882 - DNA, 25 bp, Mus musculus
gaggcatcccagagttcataaagac

SEQ ID NO: 657883 - DNA, 25 bp, Mus musculus
gaggcatcccagtgttcataaagac

SEQ ID NO: 657884 - DNA, 25 bp, Mus musculus
gaggcatccggcagccgaggaaatt

SEQ ID NO: 657885 - DNA, 25 bp, Mus musculus
gaggcatccggctgccgaggaaatt

SEQ ID NO: 657886 - DNA, 25 bp, Mus musculus
gaggcatcctacacccgatcttgtg

SEQ ID NO: 657887 - DNA, 25 bp, Mus musculus
gaggcatcctactcccgatcttgtg

SEQ ID NO: 657888 - DNA, 25 bp, Mus musculus
gaggcatcctctagctgcaaaggca

SEQ ID NO: 657889 - DNA, 25 bp, Mus musculus
gaggcatcctcttgctgcaaaggca

SEQ ID NO: 657890 - DNA, 25 bp, Mus musculus
gaggcatcctgtctgttatcttctt

SEQ ID NO: 657891 - DNA, 25 bp, Mus musculus
gaggcatcctgtgtgttatcttctt

SEQ ID NO: 657892 - DNA, 25 bp, Mus musculus
gaggcatcggtcaccttaccaacct

SEQ ID NO: 657893 - DNA, 25 bp, Mus musculus
gaggcatcggtctccttaccaacct

SEQ ID NO: 657894 - DNA, 25 bp, Mus musculus
gaggcatcgtcactcaggtcaaagt

SEQ ID NO: 657895 - DNA, 25 bp, Mus musculus
gaggcatcgtcagtcaggtcaaagt

SEQ ID NO: 657896 - DNA, 25 bp, Mus musculus
gaggcatctagcagacagactgagg

SEQ ID NO: 657897 - DNA, 25 bp, Mus musculus
gaggcatctagctgacagactgagg

SEQ ID NO: 657898 - DNA, 25 bp, Mus musculus
gaggcatctctgctgactggtgact

SEQ ID NO: 657899 - DNA, 25 bp, Mus musculus
gaggcatctctggtgactggtgact

SEQ ID NO: 657900 - DNA, 25 bp, Mus musculus
gaggcatctgcactattcatgtcta

SEQ ID NO: 657901 - DNA, 25 bp, Mus musculus
gaggcatctgcagtattcatgtcta

SEQ ID NO: 657902 - DNA, 25 bp, Mus musculus
gaggcatctgtaaatgaccctggga

SEQ ID NO: 657903 - DNA, 25 bp, Mus musculus
gaggcatctgtatatgaccctggga

SEQ ID NO: 657904 - DNA, 25 bp, Mus musculus
gaggcatcttctatcagattgacag

SEQ ID NO: 657905 - DNA, 25 bp, Mus musculus
gaggcatcttctttcagattgacag

SEQ ID NO: 657906 - DNA, 25 bp, Mus musculus
gaggcatgaataccttaatcacttg

SEQ ID NO: 657907 - DNA, 25 bp, Mus musculus
gaggcatgaatagcttaatcacttg

SEQ ID NO: 657908 - DNA, 25 bp, Mus musculus
gaggcatggctccatctctgtgacc

SEQ ID NO: 657909 - DNA, 25 bp, Mus musculus
gaggcatggctcgatctctgtgacc

SEQ ID NO: 657910 - DNA, 25 bp, Mus musculus
gaggcatggctgattgctccgtttt

SEQ ID NO: 657911 - DNA, 25 bp, Mus musculus
gaggcatggctgtttgctccgtttt

SEQ ID NO: 657912 - DNA, 25 bp, Mus musculus
gaggcatgttgtcttctacccaact

SEQ ID NO: 657913 - DNA, 25 bp, Mus musculus
gaggcatgttgtgttctacccaact

SEQ ID NO: 657914 - DNA, 25 bp, Mus musculus
gaggcattacgacagtcccaaggga

SEQ ID NO: 657915 - DNA, 25 bp, Mus musculus
gaggcattacgagagtcccaaggga

SEQ ID NO: 657916 - DNA, 25 bp, Mus musculus
gaggcattagatcccctgaaatgga

SEQ ID NO: 657917 - DNA, 25 bp, Mus musculus
gaggcattagatgccctgaaatgga

SEQ ID NO: 657918 - DNA, 25 bp, Mus musculus
gaggcattatgacaccaccaaagag

SEQ ID NO: 657919 - DNA, 25 bp, Mus musculus
gaggcattatgagaccaccaaagag

SEQ ID NO: 657920 - DNA, 25 bp, Mus musculus
gaggcattctggctcttctctgtcc

SEQ ID NO: 657921 - DNA, 25 bp, Mus musculus
gaggcattctgggtcttctctgtcc

SEQ ID NO: 657922 - DNA, 25 bp, Mus musculus
gaggcattgttccaccgcgtgtaca

SEQ ID NO: 657923 - DNA, 25 bp, Mus musculus
gaggcattgttcgaccgcgtgtaca

SEQ ID NO: 657924 - DNA, 25 bp, Mus musculus
gaggccaaacatccacttgaacgtg

SEQ ID NO: 657925 - DNA, 25 bp, Mus musculus
gaggccaaacatgcacttgaacgtg

SEQ ID NO: 657926 - DNA, 25 bp, Mus musculus
gaggccaaagatattcccaccgaat

SEQ ID NO: 657927 - DNA, 25 bp, Mus musculus
gaggccaaagattttcccaccgaat

SEQ ID NO: 657928 - DNA, 25 bp, Mus musculus
gaggccaacgccatcagtgtggagc

SEQ ID NO: 657929 - DNA, 25 bp, Mus musculus
gaggccaacgccttcagtgtggagc

SEQ ID NO: 657930 - DNA, 25 bp, Mus musculus
gaggccaactcgcatacccctatgt

SEQ ID NO: 657931 - DNA, 25 bp, Mus musculus
gaggccaactcggatacccctatgt

SEQ ID NO: 657932 - DNA, 25 bp, Mus musculus
gaggccaagaagaatgcttcccgtg

SEQ ID NO: 657933 - DNA, 25 bp, Mus musculus
gaggccaagaagtatgcttcccgtg

SEQ ID NO: 657934 - DNA, 25 bp, Mus musculus
gaggccaaggcaaaggaaatgcacc

SEQ ID NO: 657935 - DNA, 25 bp, Mus musculus
gaggccaaggcataggaaatgcacc

SEQ ID NO: 657936 - DNA, 25 bp, Mus musculus
gaggccaagggacaaactcccaagg

SEQ ID NO: 657937 - DNA, 25 bp, Mus musculus
gaggccaagggagaaactcccaagg

SEQ ID NO: 657938 - DNA, 25 bp, Mus musculus
gaggccaataatctgtttcgtcaga

SEQ ID NO: 657939 - DNA, 25 bp, Mus musculus
gaggccaataatgtgtttcgtcaga

SEQ ID NO: 657940 - DNA, 25 bp, Mus musculus
gaggccaatctcaatgctgcaaaaa

SEQ ID NO: 657941 - DNA, 25 bp, Mus musculus
gaggccaatctctatgctgcaaaaa

SEQ ID NO: 657942 - DNA, 25 bp, Mus musculus
gaggccacaactcaactctaccagt

SEQ ID NO: 657943 - DNA, 25 bp, Mus musculus
gaggccacaactgaactctaccagt

SEQ ID NO: 657944 - DNA, 25 bp, Mus musculus
gaggccacacagctatcagttactg

SEQ ID NO: 657945 - DNA, 25 bp, Mus musculus
gaggccacacaggtatcagttactg

SEQ ID NO: 657946 - DNA, 25 bp, Mus musculus
gaggccacaggacttccactacctt

SEQ ID NO: 657947 - DNA, 25 bp, Mus musculus
gaggccacaggagttccactacctt

SEQ ID NO: 657948 - DNA, 25 bp, Mus musculus
gaggccacataccttctggagcagc

SEQ ID NO: 657949 - DNA, 25 bp, Mus musculus
gaggccacatacgttctggagcagc

SEQ ID NO: 657950 - DNA, 25 bp, Mus musculus
gaggccaccaaacattctctggatg

SEQ ID NO: 657951 - DNA, 25 bp, Mus musculus
gaggccaccaaagattctctggatg

SEQ ID NO: 657952 - DNA, 25 bp, Mus musculus
gaggccaccacacctaccatttatg

SEQ ID NO: 657953 - DNA, 25 bp, Mus musculus
gaggccaccacagctaccatttatg

SEQ ID NO: 657954 - DNA, 25 bp, Mus musculus
gaggccacgttcatatgttcccagg

SEQ ID NO: 657955 - DNA, 25 bp, Mus musculus
gaggccacgttcttatgttcccagg

SEQ ID NO: 657956 - DNA, 25 bp, Mus musculus
gaggccactactatctcttcgactg

SEQ ID NO: 657957 - DNA, 25 bp, Mus musculus
gaggccactactttctcttcgactg

SEQ ID NO: 657958 - DNA, 25 bp, Mus musculus
gaggccactcgcatattattagaga

SEQ ID NO: 657959 - DNA, 25 bp, Mus musculus
gaggccactcgcttattattagaga

SEQ ID NO: 657960 - DNA, 25 bp, Mus musculus
gaggccactggcagcgaatcgcctt

SEQ ID NO: 657961 - DNA, 25 bp, Mus musculus
gaggccactggctgcgaatcgcctt

SEQ ID NO: 657962 - DNA, 25 bp, Mus musculus
gaggccacttgcaaatctctggaag

SEQ ID NO: 657963 - DNA, 25 bp, Mus musculus
gaggccacttgctaatctctggaag

SEQ ID NO: 657964 - DNA, 25 bp, Mus musculus
gaggccactttacctttatagcagc

SEQ ID NO: 657965 - DNA, 25 bp, Mus musculus
gaggccactttagctttatagcagc

SEQ ID NO: 657966 - DNA, 25 bp, Mus musculus
gaggccagaaccatcaatggctcca

SEQ ID NO: 657967 - DNA, 25 bp, Mus musculus
gaggccagaaccttcaatggctcca

SEQ ID NO: 657968 - DNA, 25 bp, Mus musculus
gaggccagacctcggtgcgtaccca

SEQ ID NO: 657969 - DNA, 25 bp, Mus musculus
gaggccagacctgggtgcgtaccca

SEQ ID NO: 657970 - DNA, 25 bp, Mus musculus
gaggccagagctacggaactatttc

SEQ ID NO: 657971 - DNA, 25 bp, Mus musculus
gaggccagagcttcggaactatttc

SEQ ID NO: 657972 - DNA, 25 bp, Mus musculus
gaggccagatctcccctcaggcttt

SEQ ID NO: 657973 - DNA, 25 bp, Mus musculus
gaggccagatctgccctcaggcttt

SEQ ID NO: 657974 - DNA, 25 bp, Mus musculus
gaggccagcatcaacgacaagcgct

SEQ ID NO: 657975 - DNA, 25 bp, Mus musculus
gaggccagcatctacgacaagcgct

SEQ ID NO: 657976 - DNA, 25 bp, Mus musculus
gaggccagccttcgttatagagcaa

SEQ ID NO: 657977 - DNA, 25 bp, Mus musculus
gaggccagccttggttatagagcaa

SEQ ID NO: 657978 - DNA, 25 bp, Mus musculus
gaggccaggatccagaagctactcg

SEQ ID NO: 657979 - DNA, 25 bp, Mus musculus
gaggccaggatcgagaagctactcg

SEQ ID NO: 657980 - DNA, 25 bp, Mus musculus
gaggccaggcggcatgctgctaaag

SEQ ID NO: 657981 - DNA, 25 bp, Mus musculus
gaggccaggcgggatgctgctaaag

SEQ ID NO: 657982 - DNA, 25 bp, Mus musculus
gaggccagggctatagctcaggacc

SEQ ID NO: 657983 - DNA, 25 bp, Mus musculus
gaggccagggctttagctcaggacc

SEQ ID NO: 657984 - DNA, 25 bp, Mus musculus
gaggccaggtcacgcgattttcctg

SEQ ID NO: 657985 - DNA, 25 bp, Mus musculus
gaggccaggtcaggcgattttcctg

SEQ ID NO: 657986 - DNA, 25 bp, Mus musculus
gaggccagtcccatcaccatggttg

SEQ ID NO: 657987 - DNA, 25 bp, Mus musculus
gaggccagtcccttcaccatggttg

SEQ ID NO: 657988 - DNA, 25 bp, Mus musculus
gaggccagtgacaccgtgtctaact

SEQ ID NO: 657989 - DNA, 25 bp, Mus musculus
gaggccagtgactccgtgtctaact

SEQ ID NO: 657990 - DNA, 25 bp, Mus musculus
gaggccagttacaccaccattgcgc

SEQ ID NO: 657991 - DNA, 25 bp, Mus musculus
gaggccagttactccaccattgcgc

SEQ ID NO: 657992 - DNA, 25 bp, Mus musculus
gaggccagtttgcactttagcttcc

SEQ ID NO: 657993 - DNA, 25 bp, Mus musculus
gaggccagtttggactttagcttcc

SEQ ID NO: 657994 - DNA, 25 bp, Mus musculus
gaggccatcatccagaagatcaagc

SEQ ID NO: 657995 - DNA, 25 bp, Mus musculus
gaggccatcatcgagaagatcaagc

SEQ ID NO: 657996 - DNA, 25 bp, Mus musculus
gaggccatcatgaagcctcttgatc

SEQ ID NO: 657997 - DNA, 25 bp, Mus musculus
gaggccatcatgtagcctcttgatc

SEQ ID NO: 657998 - DNA, 25 bp, Mus musculus
gaggccatccctaatccaagatcac

SEQ ID NO: 657999 - DNA, 25 bp, Mus musculus
gaggccatcccttatccaagatcac

SEQ ID NO: 658000 - DNA, 25 bp, Mus musculus
gaggccatcgacagcgtcagttcga

SEQ ID NO: 658001 - DNA, 25 bp, Mus musculus
gaggccatcgactgcgtcagttcga

SEQ ID NO: 658002 - DNA, 25 bp, Mus musculus
gaggccatcgcgaatcttcctgccg

SEQ ID NO: 658003 - DNA, 25 bp, Mus musculus
gaggccatcgcgtatcttcctgccg

SEQ ID NO: 658004 - DNA, 25 bp, Mus musculus
gaggccatctatcgccctggtagtg

SEQ ID NO: 658005 - DNA, 25 bp, Mus musculus
gaggccatctatggccctggtagtg

SEQ ID NO: 658006 - DNA, 25 bp, Mus musculus
gaggccatctcaccactcaagaatg

SEQ ID NO: 658007 - DNA, 25 bp, Mus musculus
gaggccatctcagcactcaagaatg

SEQ ID NO: 658008 - DNA, 25 bp, Mus musculus
gaggccatgacaccgttttctccct

SEQ ID NO: 658009 - DNA, 25 bp, Mus musculus
gaggccatgacagcgttttctccct

SEQ ID NO: 658010 - DNA, 25 bp, Mus musculus
gaggccatgcatatcttaaggaatg

SEQ ID NO: 658011 - DNA, 25 bp, Mus musculus
gaggccatgcatttcttaaggaatg

SEQ ID NO: 658012 - DNA, 25 bp, Mus musculus
gaggccatgctgaagcaacgggact

SEQ ID NO: 658013 - DNA, 25 bp, Mus musculus
gaggccatgctgtagcaacgggact

SEQ ID NO: 658014 - DNA, 25 bp, Mus musculus
gaggccatggcacctacaatccctt

SEQ ID NO: 658015 - DNA, 25 bp, Mus musculus
gaggccatggcagctacaatccctt

SEQ ID NO: 658016 - DNA, 25 bp, Mus musculus
gaggccatgtatccaaatatttgag

SEQ ID NO: 658017 - DNA, 25 bp, Mus musculus
gaggccatgtatgcaaatatttgag

SEQ ID NO: 658018 - DNA, 25 bp, Mus musculus
gaggccatgtttacacagtacagca

SEQ ID NO: 658019 - DNA, 25 bp, Mus musculus
gaggccatgttttcacagtacagca

SEQ ID NO: 658020 - DNA, 25 bp, Mus musculus
gaggccattagtcaggaacttccct

SEQ ID NO: 658021 - DNA, 25 bp, Mus musculus
gaggccattagtgaggaacttccct

SEQ ID NO: 658022 - DNA, 25 bp, Mus musculus
gaggccattgcaaagccagtgacat

SEQ ID NO: 658023 - DNA, 25 bp, Mus musculus
gaggccattgcatagccagtgacat

SEQ ID NO: 658024 - DNA, 25 bp, Mus musculus
gaggcccaagtccaagcactagcat

SEQ ID NO: 658025 - DNA, 25 bp, Mus musculus
gaggcccaagtcgaagcactagcat

SEQ ID NO: 658026 - DNA, 25 bp, Mus musculus
gaggcccaccaacagagggcatacc

SEQ ID NO: 658027 - DNA, 25 bp, Mus musculus
gaggcccaccaagagagggcatacc

SEQ ID NO: 658028 - DNA, 25 bp, Mus musculus
gaggcccacgcgcttggctaagtac

SEQ ID NO: 658029 - DNA, 25 bp, Mus musculus
gaggcccacgcggttggctaagtac

SEQ ID NO: 658030 - DNA, 25 bp, Mus musculus
gaggcccagaaacccattcagcaac

SEQ ID NO: 658031 - DNA, 25 bp, Mus musculus
gaggcccagaaagccattcagcaac

SEQ ID NO: 658032 - DNA, 25 bp, Mus musculus
gaggcccagaccaaggagaccctgc

SEQ ID NO: 658033 - DNA, 25 bp, Mus musculus
gaggcccagaccctgatttgctcag

SEQ ID NO: 658034 - DNA, 25 bp, Mus musculus
gaggcccagaccgtgatttgctcag

SEQ ID NO: 658035 - DNA, 25 bp, Mus musculus
gaggcccagacctaggagaccctgc

SEQ ID NO: 658036 - DNA, 25 bp, Mus musculus
gaggcccagcggcttattgagattc

SEQ ID NO: 658037 - DNA, 25 bp, Mus musculus
gaggcccagcgggttattgagattc

SEQ ID NO: 658038 - DNA, 25 bp, Mus musculus
gaggcccaggagaggtggctccgga

SEQ ID NO: 658039 - DNA, 25 bp, Mus musculus
gaggcccaggagtggtggctccgga

SEQ ID NO: 658040 - DNA, 25 bp, Mus musculus
gaggcccagtacagtaatccttatt

SEQ ID NO: 658041 - DNA, 25 bp, Mus musculus
gaggcccagtactgtaatccttatt

SEQ ID NO: 658042 - DNA, 25 bp, Mus musculus
gaggccccaagacgcagcgttgcct

SEQ ID NO: 658043 - DNA, 25 bp, Mus musculus
gaggccccaagaggcagcgttgcct

SEQ ID NO: 658044 - DNA, 25 bp, Mus musculus
gaggccccaaggacacgtgttagga

SEQ ID NO: 658045 - DNA, 25 bp, Mus musculus
gaggccccaaggtcacgtgttagga

SEQ ID NO: 658046 - DNA, 25 bp, Mus musculus
gaggccccatttccattgtttaaca

SEQ ID NO: 658047 - DNA, 25 bp, Mus musculus
gaggccccatttgcattgtttaaca

SEQ ID NO: 658048 - DNA, 25 bp, Mus musculus
gaggcccctcccaatacagatctgg

SEQ ID NO: 658049 - DNA, 25 bp, Mus musculus
gaggcccctccctatacagatctgg

SEQ ID NO: 658050 - DNA, 25 bp, Mus musculus
gaggcccctgaacacttggaagatt

SEQ ID NO: 658051 - DNA, 25 bp, Mus musculus
gaggcccctgaagacttggaagatt

SEQ ID NO: 658052 - DNA, 25 bp, Mus musculus
gaggcccgagaaagccaatcacagg

SEQ ID NO: 658053 - DNA, 25 bp, Mus musculus
gaggcccgagaatgccaatcacagg

SEQ ID NO: 658054 - DNA, 25 bp, Mus musculus
gaggcccgagtacacctgggacata

SEQ ID NO: 658055 - DNA, 25 bp, Mus musculus
gaggcccgagtagacctgggacata

SEQ ID NO: 658056 - DNA, 25 bp, Mus musculus
gaggccctacagaaacagatggact

SEQ ID NO: 658057 - DNA, 25 bp, Mus musculus
gaggccctacagtaacagatggact

SEQ ID NO: 658058 - DNA, 25 bp, Mus musculus
gaggccctcactcaggtgttctctg

SEQ ID NO: 658059 - DNA, 25 bp, Mus musculus
gaggccctcactgaggtgttctctg

SEQ ID NO: 658060 - DNA, 25 bp, Mus musculus
gaggccctcgaactgggttacagca

SEQ ID NO: 658061 - DNA, 25 bp, Mus musculus
gaggccctcgaagtgggttacagca

SEQ ID NO: 658062 - DNA, 25 bp, Mus musculus
gaggccctcgctattcttcaccatg

SEQ ID NO: 658063 - DNA, 25 bp, Mus musculus
gaggccctcgcttttcttcaccatg

SEQ ID NO: 658064 - DNA, 25 bp, Mus musculus
gaggccctcgtcagcaaaggcctgg

SEQ ID NO: 658065 - DNA, 25 bp, Mus musculus
gaggccctcgtctgcaaaggcctgg

SEQ ID NO: 658066 - DNA, 25 bp, Mus musculus
gaggccctgaggatttccttggagc

SEQ ID NO: 658067 - DNA, 25 bp, Mus musculus
gaggccctgaggttttccttggagc

SEQ ID NO: 658068 - DNA, 25 bp, Mus musculus
gaggccctgatgaggaacatcttgg

SEQ ID NO: 658069 - DNA, 25 bp, Mus musculus
gaggccctgatgtggaacatcttgg

SEQ ID NO: 658070 - DNA, 25 bp, Mus musculus
gaggccctgcttcgaaaattcatgg

SEQ ID NO: 658071 - DNA, 25 bp, Mus musculus
gaggccctgcttctgtttaatccca

SEQ ID NO: 658072 - DNA, 25 bp, Mus musculus
gaggccctgcttggaaaattcatgg

SEQ ID NO: 658073 - DNA, 25 bp, Mus musculus
gaggccctgcttgtgtttaatccca

SEQ ID NO: 658074 - DNA, 25 bp, Mus musculus
gaggccctggatcaactcgcttcac

SEQ ID NO: 658075 - DNA, 25 bp, Mus musculus
gaggccctggatgaactcgcttcac

SEQ ID NO: 658076 - DNA, 25 bp, Mus musculus
gaggccctttttcaccgagtctaca

SEQ ID NO: 658077 - DNA, 25 bp, Mus musculus
gaggccctttttgaccgagtctaca

SEQ ID NO: 658078 - DNA, 25 bp, Mus musculus
gaggccgacaggattcgttggctac

SEQ ID NO: 658079 - DNA, 25 bp, Mus musculus
gaggccgacaggtttcgttggctac

SEQ ID NO: 658080 - DNA, 25 bp, Mus musculus
gaggccgaccggaattccatgcatg

SEQ ID NO: 658081 - DNA, 25 bp, Mus musculus
gaggccgaccggtattccatgcatg

SEQ ID NO: 658082 - DNA, 25 bp, Mus musculus
gaggccgaccttcctggccatggac

SEQ ID NO: 658083 - DNA, 25 bp, Mus musculus
gaggccgaccttgctggccatggac

SEQ ID NO: 658084 - DNA, 25 bp, Mus musculus
gaggccgaggcccagttctatgaac

SEQ ID NO: 658085 - DNA, 25 bp, Mus musculus
gaggccgaggccgagttctatgaac

SEQ ID NO: 658086 - DNA, 25 bp, Mus musculus
gaggccgaggtgatcgacaaactaa

SEQ ID NO: 658087 - DNA, 25 bp, Mus musculus
gaggccgaggtgttcgacaaactaa

SEQ ID NO: 658088 - DNA, 25 bp, Mus musculus
gaggccgagtgtatgtcctaccctg

SEQ ID NO: 658089 - DNA, 25 bp, Mus musculus
gaggccgagtgtttgtcctaccctg

SEQ ID NO: 658090 - DNA, 25 bp, Mus musculus
gaggccgatgctcactctttcttcc

SEQ ID NO: 658091 - DNA, 25 bp, Mus musculus
gaggccgatgctgactctttcttcc

SEQ ID NO: 658092 - DNA, 25 bp, Mus musculus
gaggccgcctctagccggagcgttt

SEQ ID NO: 658093 - DNA, 25 bp, Mus musculus
gaggccgcctcttgccggagcgttt

SEQ ID NO: 658094 - DNA, 25 bp, Mus musculus
gaggccgcctggagatcgccagctt

SEQ ID NO: 658095 - DNA, 25 bp, Mus musculus
gaggccgcctggtgatcgccagctt

SEQ ID NO: 658096 - DNA, 25 bp, Mus musculus
gaggccggatgaatcttctagttgt

SEQ ID NO: 658097 - DNA, 25 bp, Mus musculus
gaggccggatgattcttctagttgt

SEQ ID NO: 658098 - DNA, 25 bp, Mus musculus
gaggccggtatcaccctgaggaatg

SEQ ID NO: 658099 - DNA, 25 bp, Mus musculus
gaggccggtatctccctgaggaatg

SEQ ID NO: 658100 - DNA, 25 bp, Mus musculus
gaggccgtgagtcggacagctcgga

SEQ ID NO: 658101 - DNA, 25 bp, Mus musculus
gaggccgtgagtgggacagctcgga

SEQ ID NO: 658102 - DNA, 25 bp, Mus musculus
gaggccgtgtcacccgatgcattcc

SEQ ID NO: 658103 - DNA, 25 bp, Mus musculus
gaggccgtgtcagccgatgcattcc

SEQ ID NO: 658104 - DNA, 25 bp, Mus musculus
gaggcctatccaagctgagccacag

SEQ ID NO: 658105 - DNA, 25 bp, Mus musculus
gaggcctatccatgctgagccacag

SEQ ID NO: 658106 - DNA, 25 bp, Mus musculus
gaggcctatgaactactatctgaca

SEQ ID NO: 658107 - DNA, 25 bp, Mus musculus
gaggcctatgaagtactatctgaca

SEQ ID NO: 658108 - DNA, 25 bp, Mus musculus
gaggcctccagtattacaggagtga

SEQ ID NO: 658109 - DNA, 25 bp, Mus musculus
gaggcctccagttttacaggagtga

SEQ ID NO: 658110 - DNA, 25 bp, Mus musculus
gaggcctccatcatcaatctcctag

SEQ ID NO: 658111 - DNA, 25 bp, Mus musculus
gaggcctccatcttcaatctcctag

SEQ ID NO: 658112 - DNA, 25 bp, Mus musculus
gaggcctcgaagatgcagttcatct

SEQ ID NO: 658113 - DNA, 25 bp, Mus musculus
gaggcctcgaagttgcagttcatct

SEQ ID NO: 658114 - DNA, 25 bp, Mus musculus
gaggcctcgattccgctattatcac

SEQ ID NO: 658115 - DNA, 25 bp, Mus musculus
gaggcctcgattgcgctattatcac

SEQ ID NO: 658116 - DNA, 25 bp, Mus musculus
gaggcctctcgccaagagttgtctt

SEQ ID NO: 658117 - DNA, 25 bp, Mus musculus
gaggcctctcgcgaagagttgtctt

SEQ ID NO: 658118 - DNA, 25 bp, Mus musculus
gaggcctctgtcaacttttacacca

SEQ ID NO: 658119 - DNA, 25 bp, Mus musculus
gaggcctctgtctacttttacacca

SEQ ID NO: 658120 - DNA, 25 bp, Mus musculus
gaggcctcttgccacagcatacaag

SEQ ID NO: 658121 - DNA, 25 bp, Mus musculus
gaggcctcttgcgacagcatacaag

SEQ ID NO: 658122 - DNA, 25 bp, Mus musculus
gaggcctgactcctatcacctgctg

SEQ ID NO: 658123 - DNA, 25 bp, Mus musculus
gaggcctgactcgtatcacctgctg

SEQ ID NO: 658124 - DNA, 25 bp, Mus musculus
gaggcctgagccctgtctgtcttgt

SEQ ID NO: 658125 - DNA, 25 bp, Mus musculus
gaggcctgagccgtgtctgtcttgt

SEQ ID NO: 658126 - DNA, 25 bp, Mus musculus
gaggcctgcacccagtgtctgagca

SEQ ID NO: 658127 - DNA, 25 bp, Mus musculus
gaggcctgcaccgagtgtctgagca

SEQ ID NO: 658128 - DNA, 25 bp, Mus musculus
gaggcctgcataagggatttacaac

SEQ ID NO: 658129 - DNA, 25 bp, Mus musculus
gaggcctgcatatgggatttacaac

SEQ ID NO: 658130 - DNA, 25 bp, Mus musculus
gaggcctggtgaagaagcccagcct

SEQ ID NO: 658131 - DNA, 25 bp, Mus musculus
gaggcctggtgatgaagcccagcct

SEQ ID NO: 658132 - DNA, 25 bp, Mus musculus
gaggcctgtcagaacagattcggga

SEQ ID NO: 658133 - DNA, 25 bp, Mus musculus
gaggcctgtcagtacagattcggga

SEQ ID NO: 658134 - DNA, 25 bp, Mus musculus
gaggcctgtgtcacggctctgctca

SEQ ID NO: 658135 - DNA, 25 bp, Mus musculus
gaggcctgtgtctcggctctgctca

SEQ ID NO: 658136 - DNA, 25 bp, Mus musculus
gaggccttcaaccagaccatcaaga

SEQ ID NO: 658137 - DNA, 25 bp, Mus musculus
gaggccttcaacgagaccatcaaga

SEQ ID NO: 658138 - DNA, 25 bp, Mus musculus
gaggccttcctcctcacagagggct

SEQ ID NO: 658139 - DNA, 25 bp, Mus musculus
gaggccttcctcgtcacagagggct

SEQ ID NO: 658140 - DNA, 25 bp, Mus musculus
gaggccttcgccatggttacagctg

SEQ ID NO: 658141 - DNA, 25 bp, Mus musculus
gaggccttcgccttggttacagctg

SEQ ID NO: 658142 - DNA, 25 bp, Mus musculus
gaggccttctatcccctgtacttgg

SEQ ID NO: 658143 - DNA, 25 bp, Mus musculus
gaggccttctatgccctgtacttgg

SEQ ID NO: 658144 - DNA, 25 bp, Mus musculus
gaggccttgaagcactatgattaca

SEQ ID NO: 658145 - DNA, 25 bp, Mus musculus
gaggccttgaaggactatgattaca

SEQ ID NO: 658146 - DNA, 25 bp, Mus musculus
gaggccttgagaaatcaagagtcca

SEQ ID NO: 658147 - DNA, 25 bp, Mus musculus
gaggccttgagatatcaagagtcca

SEQ ID NO: 658148 - DNA, 25 bp, Mus musculus
gaggccttgaggctattcatgccaa

SEQ ID NO: 658149 - DNA, 25 bp, Mus musculus
gaggccttgagggtattcatgccaa

SEQ ID NO: 658150 - DNA, 25 bp, Mus musculus
gaggccttgcaacggaacctggtca

SEQ ID NO: 658151 - DNA, 25 bp, Mus musculus
gaggccttgcaagggaacctggtca

SEQ ID NO: 658152 - DNA, 25 bp, Mus musculus
gaggccttggacaggatcgtccatc

SEQ ID NO: 658153 - DNA, 25 bp, Mus musculus
gaggccttggactggatcgtccatc

SEQ ID NO: 658154 - DNA, 25 bp, Mus musculus
gaggccttgtagcaagcattgcagc

SEQ ID NO: 658155 - DNA, 25 bp, Mus musculus
gaggccttgtaggaagcattgcagc

SEQ ID NO: 658156 - DNA, 25 bp, Mus musculus
gaggcctttccacgaagcacataat

SEQ ID NO: 658157 - DNA, 25 bp, Mus musculus
gaggcctttccaggaagcacataat

SEQ ID NO: 658158 - DNA, 25 bp, Mus musculus
gaggcctttgctataggtgcccgcg

SEQ ID NO: 658159 - DNA, 25 bp, Mus musculus
gaggcctttgctttaggtgcccgcg

SEQ ID NO: 658160 - DNA, 25 bp, Mus musculus
gaggcgaaatcaccaagaggaaagc

SEQ ID NO: 658161 - DNA, 25 bp, Mus musculus
gaggcgaaatcagcaagaggaaagc

SEQ ID NO: 658162 - DNA, 25 bp, Mus musculus
gaggcgaaggccctccgaatcagca

SEQ ID NO: 658163 - DNA, 25 bp, Mus musculus
gaggcgaaggccgtccgaatcagca

SEQ ID NO: 658164 - DNA, 25 bp, Mus musculus
gaggcgaataaacccagggtcgaac

SEQ ID NO: 658165 - DNA, 25 bp, Mus musculus
gaggcgaataaagccagggtcgaac

SEQ ID NO: 658166 - DNA, 25 bp, Mus musculus
gaggcgacatcacaagatcattgag

SEQ ID NO: 658167 - DNA, 25 bp, Mus musculus
gaggcgacatcagaagatcattgag

SEQ ID NO: 658168 - DNA, 25 bp, Mus musculus
gaggcgagaccaaccatatgtccga

SEQ ID NO: 658169 - DNA, 25 bp, Mus musculus
gaggcgagaccatccatatgtccga

SEQ ID NO: 658170 - DNA, 25 bp, Mus musculus
gaggcgagccatctttgatgagatc

SEQ ID NO: 658171 - DNA, 25 bp, Mus musculus
gaggcgagccatgtttgatgagatc

SEQ ID NO: 658172 - DNA, 25 bp, Mus musculus
gaggcgagcgcgcttatgacatata

SEQ ID NO: 658173 - DNA, 25 bp, Mus musculus
gaggcgagcgcggttatgacatata

SEQ ID NO: 658174 - DNA, 25 bp, Mus musculus
gaggcgatccgcagagtcagcatga

SEQ ID NO: 658175 - DNA, 25 bp, Mus musculus
gaggcgatccgctgagtcagcatga

SEQ ID NO: 658176 - DNA, 25 bp, Mus musculus
gaggcgattgctcagttggacaccc

SEQ ID NO: 658177 - DNA, 25 bp, Mus musculus
gaggcgattgctgagttggacaccc

SEQ ID NO: 658178 - DNA, 25 bp, Mus musculus
gaggcgcaaagcaccgaagaaatgt

SEQ ID NO: 658179 - DNA, 25 bp, Mus musculus
gaggcgcaaagctccgaagaaatgt

SEQ ID NO: 658180 - DNA, 25 bp, Mus musculus
gaggcgcaggctctgaggagaacct

SEQ ID NO: 658181 - DNA, 25 bp, Mus musculus
gaggcgcaggctgtgaggagaacct

SEQ ID NO: 658182 - DNA, 25 bp, Mus musculus
gaggcgcatctcattctccaccagt

SEQ ID NO: 658183 - DNA, 25 bp, Mus musculus
gaggcgcatctctttctccaccagt

SEQ ID NO: 658184 - DNA, 25 bp, Mus musculus
gaggcgcctggtcaatacttcttct

SEQ ID NO: 658185 - DNA, 25 bp, Mus musculus
gaggcgcctggtgaatacttcttct

SEQ ID NO: 658186 - DNA, 25 bp, Mus musculus
gaggcgccttggagcttcacatctc

SEQ ID NO: 658187 - DNA, 25 bp, Mus musculus
gaggcgccttggtgcttcacatctc

SEQ ID NO: 658188 - DNA, 25 bp, Mus musculus
gaggcgcgaggaaataccaacgccg

SEQ ID NO: 658189 - DNA, 25 bp, Mus musculus
gaggcgcgaggatataccaacgccg

SEQ ID NO: 658190 - DNA, 25 bp, Mus musculus
gaggcgcgtgatatcccgcgtcttg

SEQ ID NO: 658191 - DNA, 25 bp, Mus musculus
gaggcgcgtgatttcccgcgtcttg

SEQ ID NO: 658192 - DNA, 25 bp, Mus musculus
gaggcgcgtgcacttccacaatgct

SEQ ID NO: 658193 - DNA, 25 bp, Mus musculus
gaggcgcgtgcagttccacaatgct

SEQ ID NO: 658194 - DNA, 25 bp, Mus musculus
gaggcgctagcacagcttttcctag

SEQ ID NO: 658195 - DNA, 25 bp, Mus musculus
gaggcgctagcagagcttttcctag

SEQ ID NO: 658196 - DNA, 25 bp, Mus musculus
gaggcgctcacaaacatctctgagg

SEQ ID NO: 658197 - DNA, 25 bp, Mus musculus
gaggcgctcacatacatctctgagg

SEQ ID NO: 658198 - DNA, 25 bp, Mus musculus
gaggcgctgagacgtaaccgacttc

SEQ ID NO: 658199 - DNA, 25 bp, Mus musculus
gaggcgctgagaggtaaccgacttc

SEQ ID NO: 658200 - DNA, 25 bp, Mus musculus
gaggcgctggccacggtagacctca

SEQ ID NO: 658201 - DNA, 25 bp, Mus musculus
gaggcgctggcctcggtagacctca

SEQ ID NO: 658202 - DNA, 25 bp, Mus musculus
gaggcgcttagaattgagatgctca

SEQ ID NO: 658203 - DNA, 25 bp, Mus musculus
gaggcgcttagatttgagatgctca

SEQ ID NO: 658204 - DNA, 25 bp, Mus musculus
gaggcggaaatcaaaggaggatcca

SEQ ID NO: 658205 - DNA, 25 bp, Mus musculus
gaggcggaaatctaaggaggatcca

SEQ ID NO: 658206 - DNA, 25 bp, Mus musculus
gaggcggaacccctcagaatctggc

SEQ ID NO: 658207 - DNA, 25 bp, Mus musculus
gaggcggaacccgtcagaatctggc

SEQ ID NO: 658208 - DNA, 25 bp, Mus musculus
gaggcggacttgacctcgcttgcgt

SEQ ID NO: 658209 - DNA, 25 bp, Mus musculus
gaggcggacttgtcctcgcttgcgt

SEQ ID NO: 658210 - DNA, 25 bp, Mus musculus
gaggcggagagcaattggaacacat

SEQ ID NO: 658211 - DNA, 25 bp, Mus musculus
gaggcggagagctattggaacacat

SEQ ID NO: 658212 - DNA, 25 bp, Mus musculus
gaggcggagattccccacattgccc

SEQ ID NO: 658213 - DNA, 25 bp, Mus musculus
gaggcggagattgcccacattgccc

SEQ ID NO: 658214 - DNA, 25 bp, Mus musculus
gaggcggatcagcaaatctctccaa

SEQ ID NO: 658215 - DNA, 25 bp, Mus musculus
gaggcggatcaggaaatctctccaa

SEQ ID NO: 658216 - DNA, 25 bp, Mus musculus
gaggcggatgtgctacctcaccatc

SEQ ID NO: 658217 - DNA, 25 bp, Mus musculus
gaggcggatgtggtacctcaccatc

SEQ ID NO: 658218 - DNA, 25 bp, Mus musculus
gaggcggcatttctcccgtcctgag

SEQ ID NO: 658219 - DNA, 25 bp, Mus musculus
gaggcggcatttgtcccgtcctgag

SEQ ID NO: 658220 - DNA, 25 bp, Mus musculus
gaggcgggttgcaggaaaacatccc

SEQ ID NO: 658221 - DNA, 25 bp, Mus musculus
gaggcgggttgctggaaaacatccc

SEQ ID NO: 658222 - DNA, 25 bp, Mus musculus
gaggcggtacccaacgcacactatg

SEQ ID NO: 658223 - DNA, 25 bp, Mus musculus
gaggcggtaccctacgcacactatg

SEQ ID NO: 658224 - DNA, 25 bp, Mus musculus
gaggcggtctgcacctccttgtgag

SEQ ID NO: 658225 - DNA, 25 bp, Mus musculus
gaggcggtctgctcctccttgtgag

SEQ ID NO: 658226 - DNA, 25 bp, Mus musculus
gaggcgtaagaccaccaggctgggc

SEQ ID NO: 658227 - DNA, 25 bp, Mus musculus
gaggcgtaagacgaccaggctgggc

SEQ ID NO: 658228 - DNA, 25 bp, Mus musculus
gaggcgtccaccaaaaatatttttg

SEQ ID NO: 658229 - DNA, 25 bp, Mus musculus
gaggcgtccacctaaaatatttttg

SEQ ID NO: 658230 - DNA, 25 bp, Mus musculus
gaggcgtctgctaaacccggcttct

SEQ ID NO: 658231 - DNA, 25 bp, Mus musculus
gaggcgtctgcttaacccggcttct

SEQ ID NO: 658232 - DNA, 25 bp, Mus musculus
gaggcgtgatccaaggtgtagctct

SEQ ID NO: 658233 - DNA, 25 bp, Mus musculus
gaggcgtgatcctaggtgtagctct

SEQ ID NO: 658234 - DNA, 25 bp, Mus musculus
gaggcgttaacccatccatactttg

SEQ ID NO: 658235 - DNA, 25 bp, Mus musculus
gaggcgttaaccgatccatactttg

SEQ ID NO: 658236 - DNA, 25 bp, Mus musculus
gaggcgttctgtctccccatggtta

SEQ ID NO: 658237 - DNA, 25 bp, Mus musculus
gaggcgttctgtgtccccatggtta

SEQ ID NO: 658238 - DNA, 25 bp, Mus musculus
gaggcgtttctcactcatgacgctg

SEQ ID NO: 658239 - DNA, 25 bp, Mus musculus
gaggcgtttctctctcatgacgctg

SEQ ID NO: 658240 - DNA, 25 bp, Mus musculus
gaggcgttttgaagctggaaaaagc

SEQ ID NO: 658241 - DNA, 25 bp, Mus musculus
gaggcgttttgatgctggaaaaagc

SEQ ID NO: 658242 - DNA, 25 bp, Mus musculus
gaggctaatgagaaggtcccagaca

SEQ ID NO: 658243 - DNA, 25 bp, Mus musculus
gaggctaatgagtaggtcccagaca

SEQ ID NO: 658244 - DNA, 25 bp, Mus musculus
gaggctacagcgaatccgtgccaag

SEQ ID NO: 658245 - DNA, 25 bp, Mus musculus
gaggctacagcgtatccgtgccaag

SEQ ID NO: 658246 - DNA, 25 bp, Mus musculus
gaggctaccacacttactatgaaac

SEQ ID NO: 658247 - DNA, 25 bp, Mus musculus
gaggctaccacagttactatgaaac

SEQ ID NO: 658248 - DNA, 25 bp, Mus musculus
gaggctaccctgaatctcctaagca

SEQ ID NO: 658249 - DNA, 25 bp, Mus musculus
gaggctaccctgtatctcctaagca

SEQ ID NO: 658250 - DNA, 25 bp, Mus musculus
gaggctaccgccaccacgtgggtgc

SEQ ID NO: 658251 - DNA, 25 bp, Mus musculus
gaggctaccgcctccacgtgggtgc

SEQ ID NO: 658252 - DNA, 25 bp, Mus musculus
gaggctaccttcagcaacagtctgc

SEQ ID NO: 658253 - DNA, 25 bp, Mus musculus
gaggctaccttctgcaacagtctgc

SEQ ID NO: 658254 - DNA, 25 bp, Mus musculus
gaggctacgactcgtccactcatga

SEQ ID NO: 658255 - DNA, 25 bp, Mus musculus
gaggctacgactctgaccctgtgaa

SEQ ID NO: 658256 - DNA, 25 bp, Mus musculus
gaggctacgactggtccactcatga

SEQ ID NO: 658257 - DNA, 25 bp, Mus musculus
gaggctacgactgtgaccctgtgaa

SEQ ID NO: 658258 - DNA, 25 bp, Mus musculus
gaggctagcactcttgtgtacatgg

SEQ ID NO: 658259 - DNA, 25 bp, Mus musculus
gaggctagcactgttgtgtacatgg

SEQ ID NO: 658260 - DNA, 25 bp, Mus musculus
gaggctaggacccactggctgtcat

SEQ ID NO: 658261 - DNA, 25 bp, Mus musculus
gaggctaggaccgactggctgtcat

SEQ ID NO: 658262 - DNA, 25 bp, Mus musculus
gaggctaggcacctacatgggccac

SEQ ID NO: 658263 - DNA, 25 bp, Mus musculus
gaggctaggcacgtacatgggccac

SEQ ID NO: 658264 - DNA, 25 bp, Mus musculus
gaggctatacacaggagctgggccc

SEQ ID NO: 658265 - DNA, 25 bp, Mus musculus
gaggctatacactggagctgggccc

SEQ ID NO: 658266 - DNA, 25 bp, Mus musculus
gaggctatacgtccaagattgcagg

SEQ ID NO: 658267 - DNA, 25 bp, Mus musculus
gaggctatacgtgcaagattgcagg

SEQ ID NO: 658268 - DNA, 25 bp, Mus musculus
gaggctatcttcctgtgatcgacaa

SEQ ID NO: 658269 - DNA, 25 bp, Mus musculus
gaggctatcttcgtgtgatcgacaa

SEQ ID NO: 658270 - DNA, 25 bp, Mus musculus
gaggctatgacaccagttccgggac

SEQ ID NO: 658271 - DNA, 25 bp, Mus musculus
gaggctatgacagcagttccgggac

SEQ ID NO: 658272 - DNA, 25 bp, Mus musculus
gaggctatgaggagtgctgataaac

SEQ ID NO: 658273 - DNA, 25 bp, Mus musculus
gaggctatgaggtgtgctgataaac

SEQ ID NO: 658274 - DNA, 25 bp, Mus musculus
gaggctcaacaaacagtttgctttg

SEQ ID NO: 658275 - DNA, 25 bp, Mus musculus
gaggctcaacaatcagtttgctttg

SEQ ID NO: 658276 - DNA, 25 bp, Mus musculus
gaggctcaaggacacacggaagcct

SEQ ID NO: 658277 - DNA, 25 bp, Mus musculus
gaggctcaaggagacacggaagcct

SEQ ID NO: 658278 - DNA, 25 bp, Mus musculus
gaggctcaccatcacagcatcatga

SEQ ID NO: 658279 - DNA, 25 bp, Mus musculus
gaggctcaccatgacagcatcatga

SEQ ID NO: 658280 - DNA, 25 bp, Mus musculus
gaggctcacgcaccatgtggctttg

SEQ ID NO: 658281 - DNA, 25 bp, Mus musculus
gaggctcacgcagcatgtggctttg

SEQ ID NO: 658282 - DNA, 25 bp, Mus musculus
gaggctcactttatgtcgtgtatga

SEQ ID NO: 658283 - DNA, 25 bp, Mus musculus
gaggctcactttttgtcgtgtatga

SEQ ID NO: 658284 - DNA, 25 bp, Mus musculus
gaggctcagaagcatcccggtctta

SEQ ID NO: 658285 - DNA, 25 bp, Mus musculus
gaggctcagaaggatcccggtctta

SEQ ID NO: 658286 - DNA, 25 bp, Mus musculus
gaggctcagagcctacctaagtgaa

SEQ ID NO: 658287 - DNA, 25 bp, Mus musculus
gaggctcagagcgtacctaagtgaa

SEQ ID NO: 658288 - DNA, 25 bp, Mus musculus
gaggctcagatgctgataccagtaa

SEQ ID NO: 658289 - DNA, 25 bp, Mus musculus
gaggctcagatggtgataccagtaa

SEQ ID NO: 658290 - DNA, 25 bp, Mus musculus
gaggctcagcatcctatctacacgc

SEQ ID NO: 658291 - DNA, 25 bp, Mus musculus
gaggctcagcatgctatctacacgc

SEQ ID NO: 658292 - DNA, 25 bp, Mus musculus
gaggctcagccgcagttgcagctcc

SEQ ID NO: 658293 - DNA, 25 bp, Mus musculus
gaggctcagccggagttgcagctcc

SEQ ID NO: 658294 - DNA, 25 bp, Mus musculus
gaggctcatctcctgaccatcttgt

SEQ ID NO: 658295 - DNA, 25 bp, Mus musculus
gaggctcatctcgtgaccatcttgt

SEQ ID NO: 658296 - DNA, 25 bp, Mus musculus
gaggctccaaggatctaccaaggtg

SEQ ID NO: 658297 - DNA, 25 bp, Mus musculus
gaggctccaaggttctaccaaggtg

SEQ ID NO: 658298 - DNA, 25 bp, Mus musculus
gaggctccaataaagtgccttctgg

SEQ ID NO: 658299 - DNA, 25 bp, Mus musculus
gaggctccaatatagtgccttctgg

SEQ ID NO: 658300 - DNA, 25 bp, Mus musculus
gaggctccaggaattcctgttgtcc

SEQ ID NO: 658301 - DNA, 25 bp, Mus musculus
gaggctccaggatttcctgttgtcc

SEQ ID NO: 658302 - DNA, 25 bp, Mus musculus
gaggctccatagcactcaggccaga

SEQ ID NO: 658303 - DNA, 25 bp, Mus musculus
gaggctccataggactcaggccaga

SEQ ID NO: 658304 - DNA, 25 bp, Mus musculus
gaggctccatgtatgtgttctcacc

SEQ ID NO: 658305 - DNA, 25 bp, Mus musculus
gaggctccatgtttgtgttctcacc

SEQ ID NO: 658306 - DNA, 25 bp, Mus musculus
gaggctccctcgctgcgctaaactt

SEQ ID NO: 658307 - DNA, 25 bp, Mus musculus
gaggctccctcggtgcgctaaactt

SEQ ID NO: 658308 - DNA, 25 bp, Mus musculus
gaggctccctttcgatgccagtgtg

SEQ ID NO: 658309 - DNA, 25 bp, Mus musculus
gaggctccctttggatgccagtgtg

SEQ ID NO: 658310 - DNA, 25 bp, Mus musculus
gaggctccggagatagaagctccca

SEQ ID NO: 658311 - DNA, 25 bp, Mus musculus
gaggctccggagttagaagctccca

SEQ ID NO: 658312 - DNA, 25 bp, Mus musculus
gaggctccgtgcaacgcatctgtga

SEQ ID NO: 658313 - DNA, 25 bp, Mus musculus
gaggctccgtgctacgcatctgtga

SEQ ID NO: 658314 - DNA, 25 bp, Mus musculus
gaggctccgttcctgcattatcttt

SEQ ID NO: 658315 - DNA, 25 bp, Mus musculus
gaggctccgttcgtgcattatcttt

SEQ ID NO: 658316 - DNA, 25 bp, Mus musculus
gaggctcctcagagagaagaagacc

SEQ ID NO: 658317 - DNA, 25 bp, Mus musculus
gaggctcctcagtgagaagaagacc

SEQ ID NO: 658318 - DNA, 25 bp, Mus musculus
gaggctcctgtcaggctcctgtcct

SEQ ID NO: 658319 - DNA, 25 bp, Mus musculus
gaggctcctgtctggctcctgtcct

SEQ ID NO: 658320 - DNA, 25 bp, Mus musculus
gaggctccttaaagatatgttcaaa

SEQ ID NO: 658321 - DNA, 25 bp, Mus musculus
gaggctccttaatgatatgttcaaa

SEQ ID NO: 658322 - DNA, 25 bp, Mus musculus
gaggctccttagaaagccagatcga

SEQ ID NO: 658323 - DNA, 25 bp, Mus musculus
gaggctccttagtaagccagatcga

SEQ ID NO: 658324 - DNA, 25 bp, Mus musculus
gaggctcgagtcacactgtccacac

SEQ ID NO: 658325 - DNA, 25 bp, Mus musculus
gaggctcgagtctcactgtccacac

SEQ ID NO: 658326 - DNA, 25 bp, Mus musculus
gaggctcggcacagcttaggtgtcc

SEQ ID NO: 658327 - DNA, 25 bp, Mus musculus
gaggctcggcactgcttaggtgtcc

SEQ ID NO: 658328 - DNA, 25 bp, Mus musculus
gaggctcgtatgagtcatgacttga

SEQ ID NO: 658329 - DNA, 25 bp, Mus musculus
gaggctcgtatgtgtcatgacttga

SEQ ID NO: 658330 - DNA, 25 bp, Mus musculus
gaggctctacggcaagtctttgtac

SEQ ID NO: 658331 - DNA, 25 bp, Mus musculus
gaggctctacgggaagtctttgtac

SEQ ID NO: 658332 - DNA, 25 bp, Mus musculus
gaggctctatagcactgccaatgaa

SEQ ID NO: 658333 - DNA, 25 bp, Mus musculus
gaggctctataggactgccaatgaa

SEQ ID NO: 658334 - DNA, 25 bp, Mus musculus
gaggctctcagaagaatggcttgga

SEQ ID NO: 658335 - DNA, 25 bp, Mus musculus
gaggctctcagatgaatggcttgga

SEQ ID NO: 658336 - DNA, 25 bp, Mus musculus
gaggctctcagcagggctgccccaa

SEQ ID NO: 658337 - DNA, 25 bp, Mus musculus
gaggctctcagctgggctgccccaa

SEQ ID NO: 658338 - DNA, 25 bp, Mus musculus
gaggctctcggcagaacatcatcat

SEQ ID NO: 658339 - DNA, 25 bp, Mus musculus
gaggctctcggctgaacatcatcat

SEQ ID NO: 658340 - DNA, 25 bp, Mus musculus
gaggctctgacactctataacctga

SEQ ID NO: 658341 - DNA, 25 bp, Mus musculus
gaggctctgacagtctataacctga

SEQ ID NO: 658342 - DNA, 25 bp, Mus musculus
gaggctctgatcagtaaccatcagg

SEQ ID NO: 658343 - DNA, 25 bp, Mus musculus
gaggctctgatccttgatatcaaat

SEQ ID NO: 658344 - DNA, 25 bp, Mus musculus
gaggctctgatcgttgatatcaaat

SEQ ID NO: 658345 - DNA, 25 bp, Mus musculus
gaggctctgatctgtaaccatcagg

SEQ ID NO: 658346 - DNA, 25 bp, Mus musculus
gaggctctgcaactgcgagcacagt

SEQ ID NO: 658347 - DNA, 25 bp, Mus musculus
gaggctctgcaagtgcgagcacagt

SEQ ID NO: 658348 - DNA, 25 bp, Mus musculus
gaggctctgccactctcaggaccag

SEQ ID NO: 658349 - DNA, 25 bp, Mus musculus
gaggctctgccagtctcaggaccag

SEQ ID NO: 658350 - DNA, 25 bp, Mus musculus
gaggctctgcgtcgccaggtatccc

SEQ ID NO: 658351 - DNA, 25 bp, Mus musculus
gaggctctgcgtggccaggtatccc

SEQ ID NO: 658352 - DNA, 25 bp, Mus musculus
gaggctctgttcaaacggcatttca

SEQ ID NO: 658353 - DNA, 25 bp, Mus musculus
gaggctctgttctaacggcatttca

SEQ ID NO: 658354 - DNA, 25 bp, Mus musculus
gaggctcttctcaactccaaggaag

SEQ ID NO: 658355 - DNA, 25 bp, Mus musculus
gaggctcttctctactccaaggaag

SEQ ID NO: 658356 - DNA, 25 bp, Mus musculus
gaggctcttgccagtaataacccac

SEQ ID NO: 658357 - DNA, 25 bp, Mus musculus
gaggctcttgcctgtaataacccac

SEQ ID NO: 658358 - DNA, 25 bp, Mus musculus
gaggctcttgttctgaagaagctac

SEQ ID NO: 658359 - DNA, 25 bp, Mus musculus
gaggctcttgttgtgaagaagctac

SEQ ID NO: 658360 - DNA, 25 bp, Mus musculus
gaggctgaaataactctgaaagagt

SEQ ID NO: 658361 - DNA, 25 bp, Mus musculus
gaggctgaaatatctctgaaagagt

SEQ ID NO: 658362 - DNA, 25 bp, Mus musculus
gaggctgaacttcaggccaataatg

SEQ ID NO: 658363 - DNA, 25 bp, Mus musculus
gaggctgaacttgaggccaataatg

SEQ ID NO: 658364 - DNA, 25 bp, Mus musculus
gaggctgaagctagagctcgagcat

SEQ ID NO: 658365 - DNA, 25 bp, Mus musculus
gaggctgaagcttgagctcgagcat

SEQ ID NO: 658366 - DNA, 25 bp, Mus musculus
gaggctgaataacgacaccttaggg

SEQ ID NO: 658367 - DNA, 25 bp, Mus musculus
gaggctgaataaggacaccttaggg

SEQ ID NO: 658368 - DNA, 25 bp, Mus musculus
gaggctgacatacaagccacaccta

SEQ ID NO: 658369 - DNA, 25 bp, Mus musculus
gaggctgacatagaagccacaccta

SEQ ID NO: 658370 - DNA, 25 bp, Mus musculus
gaggctgacgcgaacctgcagatct

SEQ ID NO: 658371 - DNA, 25 bp, Mus musculus
gaggctgacgcgtacctgcagatct

SEQ ID NO: 658372 - DNA, 25 bp, Mus musculus
gaggctgacggcactagaagtcccc

SEQ ID NO: 658373 - DNA, 25 bp, Mus musculus
gaggctgacggctctagaagtcccc

SEQ ID NO: 658374 - DNA, 25 bp, Mus musculus
gaggctgactacactcaggacctgt

SEQ ID NO: 658375 - DNA, 25 bp, Mus musculus
gaggctgactactctcaggacctgt

SEQ ID NO: 658376 - DNA, 25 bp, Mus musculus
gaggctgaggaaaatgtccgtaaaa

SEQ ID NO: 658377 - DNA, 25 bp, Mus musculus
gaggctgaggaatatgtccgtaaaa

SEQ ID NO: 658378 - DNA, 25 bp, Mus musculus
gaggctgagtatccttattattgga

SEQ ID NO: 658379 - DNA, 25 bp, Mus musculus
gaggctgagtatgcttattattgga

SEQ ID NO: 658380 - DNA, 25 bp, Mus musculus
gaggctgagtcacgaagacttaaaa

SEQ ID NO: 658381 - DNA, 25 bp, Mus musculus
gaggctgagtcaggaagacttaaaa

SEQ ID NO: 658382 - DNA, 25 bp, Mus musculus
gaggctgatcgacttagagctgcca

SEQ ID NO: 658383 - DNA, 25 bp, Mus musculus
gaggctgatcgagttagagctgcca

SEQ ID NO: 658384 - DNA, 25 bp, Mus musculus
gaggctgcaatcaccatccttcgga

SEQ ID NO: 658385 - DNA, 25 bp, Mus musculus
gaggctgcaatctccatccttcgga

SEQ ID NO: 658386 - DNA, 25 bp, Mus musculus
gaggctgcagaacctagaacaacag

SEQ ID NO: 658387 - DNA, 25 bp, Mus musculus
gaggctgcagaagctagaacaacag

SEQ ID NO: 658388 - DNA, 25 bp, Mus musculus
gaggctgcagccctagaatttagag

SEQ ID NO: 658389 - DNA, 25 bp, Mus musculus
gaggctgcagccgtagaatttagag

SEQ ID NO: 658390 - DNA, 25 bp, Mus musculus
gaggctgcagtactgactcactgtg

SEQ ID NO: 658391 - DNA, 25 bp, Mus musculus
gaggctgcagtagtgactcactgtg

SEQ ID NO: 658392 - DNA, 25 bp, Mus musculus
gaggctgccaagatcaaggagctta

SEQ ID NO: 658393 - DNA, 25 bp, Mus musculus
gaggctgccaagttcaaggagctta

SEQ ID NO: 658394 - DNA, 25 bp, Mus musculus
gaggctgccatgctaaggtctcccg

SEQ ID NO: 658395 - DNA, 25 bp, Mus musculus
gaggctgccatggtaaggtctcccg

SEQ ID NO: 658396 - DNA, 25 bp, Mus musculus
gaggctgccattagctgccttcatt

SEQ ID NO: 658397 - DNA, 25 bp, Mus musculus
gaggctgccatttgctgccttcatt

SEQ ID NO: 658398 - DNA, 25 bp, Mus musculus
gaggctgccgatacactcgtgtgca

SEQ ID NO: 658399 - DNA, 25 bp, Mus musculus
gaggctgccgattcactcgtgtgca

SEQ ID NO: 658400 - DNA, 25 bp, Mus musculus
gaggctgccttgatctgggaggagt

SEQ ID NO: 658401 - DNA, 25 bp, Mus musculus
gaggctgccttgttctgggaggagt

SEQ ID NO: 658402 - DNA, 25 bp, Mus musculus
gaggctgcgaccacttctgccgaaa

SEQ ID NO: 658403 - DNA, 25 bp, Mus musculus
gaggctgcgacctcttctgccgaaa

SEQ ID NO: 658404 - DNA, 25 bp, Mus musculus
gaggctgcggctagcgcttctcctg

SEQ ID NO: 658405 - DNA, 25 bp, Mus musculus
gaggctgcggcttgcgcttctcctg

SEQ ID NO: 658406 - DNA, 25 bp, Mus musculus
gaggctgctacactgacgtcatacc

SEQ ID NO: 658407 - DNA, 25 bp, Mus musculus
gaggctgctacagtgacgtcatacc

SEQ ID NO: 658408 - DNA, 25 bp, Mus musculus
gaggctgctagcagccgctctgctg

SEQ ID NO: 658409 - DNA, 25 bp, Mus musculus
gaggctgctagctgccgctctgctg

SEQ ID NO: 658410 - DNA, 25 bp, Mus musculus
gaggctgctaggagtcgttctcgac

SEQ ID NO: 658411 - DNA, 25 bp, Mus musculus
gaggctgctaggtgtcgttctcgac

SEQ ID NO: 658412 - DNA, 25 bp, Mus musculus
gaggctgctatgctgctgagttccc

SEQ ID NO: 658413 - DNA, 25 bp, Mus musculus
gaggctgctatggtgctgagttccc

SEQ ID NO: 658414 - DNA, 25 bp, Mus musculus
gaggctgctcggagagtctgaactc

SEQ ID NO: 658415 - DNA, 25 bp, Mus musculus
gaggctgctcggtgagtctgaactc

SEQ ID NO: 658416 - DNA, 25 bp, Mus musculus
gaggctgctcttcaagcagaggatt

SEQ ID NO: 658417 - DNA, 25 bp, Mus musculus
gaggctgctcttgaagcagaggatt

SEQ ID NO: 658418 - DNA, 25 bp, Mus musculus
gaggctgctggacagaccctgtaca

SEQ ID NO: 658419 - DNA, 25 bp, Mus musculus
gaggctgctggacccactactgcag

SEQ ID NO: 658420 - DNA, 25 bp, Mus musculus
gaggctgctggagagaccctgtaca

SEQ ID NO: 658421 - DNA, 25 bp, Mus musculus
gaggctgctggagccactactgcag

SEQ ID NO: 658422 - DNA, 25 bp, Mus musculus
gaggctgcttctacccggatgaccc

SEQ ID NO: 658423 - DNA, 25 bp, Mus musculus
gaggctgcttcttcccggatgaccc

SEQ ID NO: 658424 - DNA, 25 bp, Mus musculus
gaggctggacctcgacgcagattct

SEQ ID NO: 658425 - DNA, 25 bp, Mus musculus
gaggctggacctggacgcagattct

SEQ ID NO: 658426 - DNA, 25 bp, Mus musculus
gaggctggaggacctatacaacacc

SEQ ID NO: 658427 - DNA, 25 bp, Mus musculus
gaggctggaggagctatacaacacc

SEQ ID NO: 658428 - DNA, 25 bp, Mus musculus
gaggctgggtgaagggcgtcgctct

SEQ ID NO: 658429 - DNA, 25 bp, Mus musculus
gaggctgggtgatgggcgtcgctct

SEQ ID NO: 658430 - DNA, 25 bp, Mus musculus
gaggctggtgaaagatgtcttcatt

SEQ ID NO: 658431 - DNA, 25 bp, Mus musculus
gaggctggtgaatgatgtcttcatt

SEQ ID NO: 658432 - DNA, 25 bp, Mus musculus
gaggctgtaagaaccaccctgggtc

SEQ ID NO: 658433 - DNA, 25 bp, Mus musculus
gaggctgtaagatccaccctgggtc

SEQ ID NO: 658434 - DNA, 25 bp, Mus musculus
gaggctgtatatcaagctctgaaga

SEQ ID NO: 658435 - DNA, 25 bp, Mus musculus
gaggctgtatatgaagctctgaaga

SEQ ID NO: 658436 - DNA, 25 bp, Mus musculus
gaggctgtcaaccaaatcctggagg

SEQ ID NO: 658437 - DNA, 25 bp, Mus musculus
gaggctgtcaacgaaatcctggagg

SEQ ID NO: 658438 - DNA, 25 bp, Mus musculus
gaggctgtcgcgcacagacttgact

SEQ ID NO: 658439 - DNA, 25 bp, Mus musculus
gaggctgtcgcggacagacttgact

SEQ ID NO: 658440 - DNA, 25 bp, Mus musculus
gaggctgtctaccagctgacgcgca

SEQ ID NO: 658441 - DNA, 25 bp, Mus musculus
gaggctgtctacgagctgacgcgca

SEQ ID NO: 658442 - DNA, 25 bp, Mus musculus
gaggctgtgaacaaggacattaccg

SEQ ID NO: 658443 - DNA, 25 bp, Mus musculus
gaggctgtgaactaggacattaccg

SEQ ID NO: 658444 - DNA, 25 bp, Mus musculus
gaggctgtgggcctgatctatccac

SEQ ID NO: 658445 - DNA, 25 bp, Mus musculus
gaggctgtgggcgtgatctatccac

SEQ ID NO: 658446 - DNA, 25 bp, Mus musculus
gaggctgttcgacaaggttctccag

SEQ ID NO: 658447 - DNA, 25 bp, Mus musculus
gaggctgttcgagaaggttctccag

SEQ ID NO: 658448 - DNA, 25 bp, Mus musculus
gaggctgttgtacaccttcagaggt

SEQ ID NO: 658449 - DNA, 25 bp, Mus musculus
gaggctgttgtagaccttcagaggt

SEQ ID NO: 658450 - DNA, 25 bp, Mus musculus
gaggcttacataaaccgagcgtcct

SEQ ID NO: 658451 - DNA, 25 bp, Mus musculus
gaggcttacatataccgagcgtcct

SEQ ID NO: 658452 - DNA, 25 bp, Mus musculus
gaggcttatgagagccctgctaacg

SEQ ID NO: 658453 - DNA, 25 bp, Mus musculus
gaggcttatgagtgccctgctaacg

SEQ ID NO: 658454 - DNA, 25 bp, Mus musculus
gaggcttatgcgctgcaagatcagc

SEQ ID NO: 658455 - DNA, 25 bp, Mus musculus
gaggcttatgcggtgcaagatcagc

SEQ ID NO: 658456 - DNA, 25 bp, Mus musculus
gaggcttcaagcaggaagatcccga

SEQ ID NO: 658457 - DNA, 25 bp, Mus musculus
gaggcttcaagctggaagatcccga

SEQ ID NO: 658458 - DNA, 25 bp, Mus musculus
gaggcttcagctcgagccatggctc

SEQ ID NO: 658459 - DNA, 25 bp, Mus musculus
gaggcttcagctggagccatggctc

SEQ ID NO: 658460 - DNA, 25 bp, Mus musculus
gaggcttcaggacatcctcagccca

SEQ ID NO: 658461 - DNA, 25 bp, Mus musculus
gaggcttcaggagatcctcagccca

SEQ ID NO: 658462 - DNA, 25 bp, Mus musculus
gaggcttcattcacaaaaacatcat

SEQ ID NO: 658463 - DNA, 25 bp, Mus musculus
gaggcttcattctcaaaaacatcat

SEQ ID NO: 658464 - DNA, 25 bp, Mus musculus
gaggcttccagactatataggcaac

SEQ ID NO: 658465 - DNA, 25 bp, Mus musculus
gaggcttccagagtatataggcaac

SEQ ID NO: 658466 - DNA, 25 bp, Mus musculus
gaggcttcccttccctactctgtgt

SEQ ID NO: 658467 - DNA, 25 bp, Mus musculus
gaggcttcccttgcctactctgtgt

SEQ ID NO: 658468 - DNA, 25 bp, Mus musculus
gaggcttcctggatcgagacaaatt

SEQ ID NO: 658469 - DNA, 25 bp, Mus musculus
gaggcttcctggttcgagacaaatt

SEQ ID NO: 658470 - DNA, 25 bp, Mus musculus
gaggcttcctttcgaccatgttggg

SEQ ID NO: 658471 - DNA, 25 bp, Mus musculus
gaggcttcctttcgctgcagccagc

SEQ ID NO: 658472 - DNA, 25 bp, Mus musculus
gaggcttcctttggaccatgttggg

SEQ ID NO: 658473 - DNA, 25 bp, Mus musculus
gaggcttcctttggctgcagccagc

SEQ ID NO: 658474 - DNA, 25 bp, Mus musculus
gaggcttcggctcagcccgaaaaca

SEQ ID NO: 658475 - DNA, 25 bp, Mus musculus
gaggcttcggctgagcccgaaaaca

SEQ ID NO: 658476 - DNA, 25 bp, Mus musculus
gaggcttctccaacactaagagagc

SEQ ID NO: 658477 - DNA, 25 bp, Mus musculus
gaggcttctccatcactaagagagc

SEQ ID NO: 658478 - DNA, 25 bp, Mus musculus
gaggcttgaggtctctcttgaccag

SEQ ID NO: 658479 - DNA, 25 bp, Mus musculus
gaggcttgaggtgtctcttgaccag

SEQ ID NO: 658480 - DNA, 25 bp, Mus musculus
gaggcttgccaccaaaaacagtagc

SEQ ID NO: 658481 - DNA, 25 bp, Mus musculus
gaggcttgccacgaaaaacagtagc

SEQ ID NO: 658482 - DNA, 25 bp, Mus musculus
gaggcttggaaaaatctgtctcctg

SEQ ID NO: 658483 - DNA, 25 bp, Mus musculus
gaggcttggaaatatctgtctcctg

SEQ ID NO: 658484 - DNA, 25 bp, Mus musculus
gaggcttggcaaacagcatttctgg

SEQ ID NO: 658485 - DNA, 25 bp, Mus musculus
gaggcttggcaatcagcatttctgg

SEQ ID NO: 658486 - DNA, 25 bp, Mus musculus
gaggcttggtatccccatttgcaac

SEQ ID NO: 658487 - DNA, 25 bp, Mus musculus
gaggcttggtatgcccatttgcaac

SEQ ID NO: 658488 - DNA, 25 bp, Mus musculus
gaggcttgtcataagctctggcgcc

SEQ ID NO: 658489 - DNA, 25 bp, Mus musculus
gaggcttgtcattagctctggcgcc

SEQ ID NO: 658490 - DNA, 25 bp, Mus musculus
gaggcttgtttaagaaggccggcaa

SEQ ID NO: 658491 - DNA, 25 bp, Mus musculus
gaggcttgtttatgaaggccggcaa

SEQ ID NO: 658492 - DNA, 25 bp, Mus musculus
gaggctttaattcctgtccagttac

SEQ ID NO: 658493 - DNA, 25 bp, Mus musculus
gaggctttaattgctgtccagttac

SEQ ID NO: 658494 - DNA, 25 bp, Mus musculus
gaggctttcagcaggacgcctcccg

SEQ ID NO: 658495 - DNA, 25 bp, Mus musculus
gaggctttcagctggacgcctcccg

SEQ ID NO: 658496 - DNA, 25 bp, Mus musculus
gaggctttccataacatctttaatg

SEQ ID NO: 658497 - DNA, 25 bp, Mus musculus
gaggctttccattacatctttaatg

SEQ ID NO: 658498 - DNA, 25 bp, Mus musculus
gaggctttcctgctcttctgagtgt

SEQ ID NO: 658499 - DNA, 25 bp, Mus musculus
gaggctttcctggtcttctgagtgt

SEQ ID NO: 658500 - DNA, 25 bp, Mus musculus
gaggctttccttcgcgttccctgaa

SEQ ID NO: 658501 - DNA, 25 bp, Mus musculus
gaggctttccttggcgttccctgaa

SEQ ID NO: 658502 - DNA, 25 bp, Mus musculus
gaggctttgagactggtgtatacaa

SEQ ID NO: 658503 - DNA, 25 bp, Mus musculus
gaggctttgagagtggtgtatacaa

SEQ ID NO: 658504 - DNA, 25 bp, Mus musculus
gaggctttgatgagacccggttcct

SEQ ID NO: 658505 - DNA, 25 bp, Mus musculus
gaggctttgatgtgacccggttcct

SEQ ID NO: 658506 - DNA, 25 bp, Mus musculus
gaggctttgcgtccctcgcagttca

SEQ ID NO: 658507 - DNA, 25 bp, Mus musculus
gaggctttgcgtgcctcgcagttca

SEQ ID NO: 658508 - DNA, 25 bp, Mus musculus
gaggctttgctacaacgctgacttt

SEQ ID NO: 658509 - DNA, 25 bp, Mus musculus
gaggctttgctagaacgctgacttt

SEQ ID NO: 658510 - DNA, 25 bp, Mus musculus
gaggcttttaagcatcgtggagaaa

SEQ ID NO: 658511 - DNA, 25 bp, Mus musculus
gaggcttttaaggatcgtggagaaa

SEQ ID NO: 658512 - DNA, 25 bp, Mus musculus
gaggcttttggaagtgtaagttgtc

SEQ ID NO: 658513 - DNA, 25 bp, Mus musculus
gaggcttttggatgtgtaagttgtc

SEQ ID NO: 658514 - DNA, 25 bp, Mus musculus
gagggaaaacgaactggctctctcc

SEQ ID NO: 658515 - DNA, 25 bp, Mus musculus
gagggaaaacgatctggctctctcc

SEQ ID NO: 658516 - DNA, 25 bp, Mus musculus
gagggaaacctgaacacctataagc

SEQ ID NO: 658517 - DNA, 25 bp, Mus musculus
gagggaaacctgtacacctataagc

SEQ ID NO: 658518 - DNA, 25 bp, Mus musculus
gagggaaagaaacttggcaccttct

SEQ ID NO: 658519 - DNA, 25 bp, Mus musculus
gagggaaagaaagttggcaccttct

SEQ ID NO: 658520 - DNA, 25 bp, Mus musculus
gagggaaagatacacgtggactact

SEQ ID NO: 658521 - DNA, 25 bp, Mus musculus
gagggaaagatagacgtggactact

SEQ ID NO: 658522 - DNA, 25 bp, Mus musculus
gagggaaagggtagctaaatgccat

SEQ ID NO: 658523 - DNA, 25 bp, Mus musculus
gagggaaagggttgctaaatgccat

SEQ ID NO: 658524 - DNA, 25 bp, Mus musculus
gagggaacaaacaagaaggaacgcg

SEQ ID NO: 658525 - DNA, 25 bp, Mus musculus
gagggaacaaactagaaggaacgcg

SEQ ID NO: 658526 - DNA, 25 bp, Mus musculus
gagggaacatcacctgacagagaga

SEQ ID NO: 658527 - DNA, 25 bp, Mus musculus
gagggaacatcactagcctgaggcc

SEQ ID NO: 658528 - DNA, 25 bp, Mus musculus
gagggaacatcagctgacagagaga

SEQ ID NO: 658529 - DNA, 25 bp, Mus musculus
gagggaacatcagtagcctgaggcc

SEQ ID NO: 658530 - DNA, 25 bp, Mus musculus
gagggaaccagcatcaagaatttgc

SEQ ID NO: 658531 - DNA, 25 bp, Mus musculus
gagggaaccagcttcaagaatttgc

SEQ ID NO: 658532 - DNA, 25 bp, Mus musculus
gagggaaccatcacacgcaatgtgg

SEQ ID NO: 658533 - DNA, 25 bp, Mus musculus
gagggaaccatctcacgcaatgtgg

SEQ ID NO: 658534 - DNA, 25 bp, Mus musculus
gagggaacccagagttacctagaag

SEQ ID NO: 658535 - DNA, 25 bp, Mus musculus
gagggaacccagtgttacctagaag

SEQ ID NO: 658536 - DNA, 25 bp, Mus musculus
gagggaaccctaattctgttcagtt

SEQ ID NO: 658537 - DNA, 25 bp, Mus musculus
gagggaaccctatttctgttcagtt

SEQ ID NO: 658538 - DNA, 25 bp, Mus musculus
gagggaacctcaaaccaaggcaaga

SEQ ID NO: 658539 - DNA, 25 bp, Mus musculus
gagggaacctcataccaaggcaaga

SEQ ID NO: 658540 - DNA, 25 bp, Mus musculus
gagggaacgcatataattgtgactg

SEQ ID NO: 658541 - DNA, 25 bp, Mus musculus
gagggaacgcatttaattgtgactg

SEQ ID NO: 658542 - DNA, 25 bp, Mus musculus
gagggaactcatcggcatgttgtct

SEQ ID NO: 658543 - DNA, 25 bp, Mus musculus
gagggaactcatgggcatgttgtct

SEQ ID NO: 658544 - DNA, 25 bp, Mus musculus
gagggaagcctcacctttaatgcca

SEQ ID NO: 658545 - DNA, 25 bp, Mus musculus
gagggaagcctctcctttaatgcca

SEQ ID NO: 658546 - DNA, 25 bp, Mus musculus
gagggaagctgacaatgaaaagcta

SEQ ID NO: 658547 - DNA, 25 bp, Mus musculus
gagggaagctgagaatgaaaagcta

SEQ ID NO: 658548 - DNA, 25 bp, Mus musculus
gagggaaggctgagaatacagcccc

SEQ ID NO: 658549 - DNA, 25 bp, Mus musculus
gagggaaggctgtgaatacagcccc

SEQ ID NO: 658550 - DNA, 25 bp, Mus musculus
gagggaagttttctttcagcaccca

SEQ ID NO: 658551 - DNA, 25 bp, Mus musculus
gagggaagttttgtttcagcaccca

SEQ ID NO: 658552 - DNA, 25 bp, Mus musculus
gagggaatccccactaactagtagt

SEQ ID NO: 658553 - DNA, 25 bp, Mus musculus
gagggaatcccctctaactagtagt

SEQ ID NO: 658554 - DNA, 25 bp, Mus musculus
gagggaatcttgacttcctcaagcc

SEQ ID NO: 658555 - DNA, 25 bp, Mus musculus
gagggaatcttgtcttcctcaagcc

SEQ ID NO: 658556 - DNA, 25 bp, Mus musculus
gagggaatgcccacttcgtgtgccc

SEQ ID NO: 658557 - DNA, 25 bp, Mus musculus
gagggaatgccctcttcgtgtgccc

SEQ ID NO: 658558 - DNA, 25 bp, Mus musculus
gagggaattctcacttcgacgtggt

SEQ ID NO: 658559 - DNA, 25 bp, Mus musculus
gagggaattctctcttcgacgtggt

SEQ ID NO: 658560 - DNA, 25 bp, Mus musculus
gagggaatttccacgccagttcaca

SEQ ID NO: 658561 - DNA, 25 bp, Mus musculus
gagggaatttcctcgccagttcaca

SEQ ID NO: 658562 - DNA, 25 bp, Mus musculus
gagggacacacgctatacctcgtgc

SEQ ID NO: 658563 - DNA, 25 bp, Mus musculus
gagggacacacggtatacctcgtgc

SEQ ID NO: 658564 - DNA, 25 bp, Mus musculus
gagggaccaccgacttgacttctgt

SEQ ID NO: 658565 - DNA, 25 bp, Mus musculus
gagggaccaccgtcttgacttctgt

SEQ ID NO: 658566 - DNA, 25 bp, Mus musculus
gagggaccataacaggaagtacctg

SEQ ID NO: 658567 - DNA, 25 bp, Mus musculus
gagggaccataagaggaagtacctg

SEQ ID NO: 658568 - DNA, 25 bp, Mus musculus
gagggaccctctctctaggtatatg

SEQ ID NO: 658569 - DNA, 25 bp, Mus musculus
gagggaccctctgtctaggtatatg

SEQ ID NO: 658570 - DNA, 25 bp, Mus musculus
gagggacctcgtctagcttcaccta

SEQ ID NO: 658571 - DNA, 25 bp, Mus musculus
gagggacctcgtgtagcttcaccta

SEQ ID NO: 658572 - DNA, 25 bp, Mus musculus
gagggacctcttatataaatgtgca

SEQ ID NO: 658573 - DNA, 25 bp, Mus musculus
gagggacctcttttataaatgtgca

SEQ ID NO: 658574 - DNA, 25 bp, Mus musculus
gagggacctggaagcaacacccgca

SEQ ID NO: 658575 - DNA, 25 bp, Mus musculus
gagggacctggatgcaacacccgca

SEQ ID NO: 658576 - DNA, 25 bp, Mus musculus
gagggacgaacacgtctggctctca

SEQ ID NO: 658577 - DNA, 25 bp, Mus musculus
gagggacgaacaggtctggctctca

SEQ ID NO: 658578 - DNA, 25 bp, Mus musculus
gagggacgagttctccaccaagtgt

SEQ ID NO: 658579 - DNA, 25 bp, Mus musculus
gagggacgagttgtccaccaagtgt

SEQ ID NO: 658580 - DNA, 25 bp, Mus musculus
gagggacgccgtattcctgaaggac

SEQ ID NO: 658581 - DNA, 25 bp, Mus musculus
gagggacgccgttttcctgaaggac

SEQ ID NO: 658582 - DNA, 25 bp, Mus musculus
gagggacggtgacagtatccactac

SEQ ID NO: 658583 - DNA, 25 bp, Mus musculus
gagggacggtgagagtatccactac

SEQ ID NO: 658584 - DNA, 25 bp, Mus musculus
gagggactcactctacaaagagaac

SEQ ID NO: 658585 - DNA, 25 bp, Mus musculus
gagggactcactgtacaaagagaac

SEQ ID NO: 658586 - DNA, 25 bp, Mus musculus
gagggacttcaaagtacgccatgga

SEQ ID NO: 658587 - DNA, 25 bp, Mus musculus
gagggacttcaatgtacgccatgga

SEQ ID NO: 658588 - DNA, 25 bp, Mus musculus
gagggagaaaatcctcgataagatt

SEQ ID NO: 658589 - DNA, 25 bp, Mus musculus
gagggagaaaatgctcgataagatt

SEQ ID NO: 658590 - DNA, 25 bp, Mus musculus
gagggagaaattaaacttactgcat

SEQ ID NO: 658591 - DNA, 25 bp, Mus musculus
gagggagaaatttaacttactgcat

SEQ ID NO: 658592 - DNA, 25 bp, Mus musculus
gagggagaagcaagcctatttaaga

SEQ ID NO: 658593 - DNA, 25 bp, Mus musculus
gagggagaagcatgcctatttaaga

SEQ ID NO: 658594 - DNA, 25 bp, Mus musculus
gagggagagctcagccatgacccca

SEQ ID NO: 658595 - DNA, 25 bp, Mus musculus
gagggagagctctgccatgacccca

SEQ ID NO: 658596 - DNA, 25 bp, Mus musculus
gagggagaggccaccaaagattctc

SEQ ID NO: 658597 - DNA, 25 bp, Mus musculus
gagggagaggcctccaaagattctc

SEQ ID NO: 658598 - DNA, 25 bp, Mus musculus
gagggagcaaatctaatttataagc

SEQ ID NO: 658599 - DNA, 25 bp, Mus musculus
gagggagcaaatgtaatttataagc

SEQ ID NO: 658600 - DNA, 25 bp, Mus musculus
gagggagccagccatcgattgcccc

SEQ ID NO: 658601 - DNA, 25 bp, Mus musculus
gagggagccagcgatcgattgcccc

SEQ ID NO: 658602 - DNA, 25 bp, Mus musculus
gagggagctgctatggcaactttca

SEQ ID NO: 658603 - DNA, 25 bp, Mus musculus
gagggagctgctttggcaactttca

SEQ ID NO: 658604 - DNA, 25 bp, Mus musculus
gagggaggcacactcaaagacttcc

SEQ ID NO: 658605 - DNA, 25 bp, Mus musculus
gagggaggcacagtcaaagacttcc

SEQ ID NO: 658606 - DNA, 25 bp, Mus musculus
gagggaggccatcacttgaccgcca

SEQ ID NO: 658607 - DNA, 25 bp, Mus musculus
gagggaggccatgacttgaccgcca

SEQ ID NO: 658608 - DNA, 25 bp, Mus musculus
gagggaggcctaaaccacatgacga

SEQ ID NO: 658609 - DNA, 25 bp, Mus musculus
gagggaggcctataccacatgacga

SEQ ID NO: 658610 - DNA, 25 bp, Mus musculus
gagggaggcgaacaagtctttcaat

SEQ ID NO: 658611 - DNA, 25 bp, Mus musculus
gagggaggcgaagaagtctttcaat

SEQ ID NO: 658612 - DNA, 25 bp, Mus musculus
gagggaggctgtcctatgacaccac

SEQ ID NO: 658613 - DNA, 25 bp, Mus musculus
gagggaggctgtgctatgacaccac

SEQ ID NO: 658614 - DNA, 25 bp, Mus musculus
gagggaggtccacatgaacccatca

SEQ ID NO: 658615 - DNA, 25 bp, Mus musculus
gagggaggtccagatgaacccatca

SEQ ID NO: 658616 - DNA, 25 bp, Mus musculus
gagggagtcgtcattcagatcctgc

SEQ ID NO: 658617 - DNA, 25 bp, Mus musculus
gagggagtcgtctttcagatcctgc

SEQ ID NO: 658618 - DNA, 25 bp, Mus musculus
gagggataaatccacgggagaccac

SEQ ID NO: 658619 - DNA, 25 bp, Mus musculus
gagggataaatcgacgggagaccac

SEQ ID NO: 658620 - DNA, 25 bp, Mus musculus
gagggataaatgaccacagtggaaa

SEQ ID NO: 658621 - DNA, 25 bp, Mus musculus
gagggataaatgtccacagtggaaa

SEQ ID NO: 658622 - DNA, 25 bp, Mus musculus
gagggatactcaaacccaaacgaag

SEQ ID NO: 658623 - DNA, 25 bp, Mus musculus
gagggatactcatacccaaacgaag

SEQ ID NO: 658624 - DNA, 25 bp, Mus musculus
gagggatccgaacaagctcagaatg

SEQ ID NO: 658625 - DNA, 25 bp, Mus musculus
gagggatccgaagaagctcagaatg

SEQ ID NO: 658626 - DNA, 25 bp, Mus musculus
gagggatcctagacccggcagccac

SEQ ID NO: 658627 - DNA, 25 bp, Mus musculus
gagggatcctagtcccggcagccac

SEQ ID NO: 658628 - DNA, 25 bp, Mus musculus
gagggatcttcacagtgttcagaac

SEQ ID NO: 658629 - DNA, 25 bp, Mus musculus
gagggatcttcagagtgttcagaac

SEQ ID NO: 658630 - DNA, 25 bp, Mus musculus
gagggatggtacagaatttcgccgc

SEQ ID NO: 658631 - DNA, 25 bp, Mus musculus
gagggatggtactgaatttcgccgc

SEQ ID NO: 658632 - DNA, 25 bp, Mus musculus
gagggatgttgtaacttgacggcca

SEQ ID NO: 658633 - DNA, 25 bp, Mus musculus
gagggatgttgttacttgacggcca

SEQ ID NO: 658634 - DNA, 25 bp, Mus musculus
gagggattatggaagtcactccgac

SEQ ID NO: 658635 - DNA, 25 bp, Mus musculus
gagggattatggtagtcactccgac

SEQ ID NO: 658636 - DNA, 25 bp, Mus musculus
gagggattcggcactaaaactgaac

SEQ ID NO: 658637 - DNA, 25 bp, Mus musculus
gagggattcggctctaaaactgaac

SEQ ID NO: 658638 - DNA, 25 bp, Mus musculus
gagggattggccacattatcaggaa

SEQ ID NO: 658639 - DNA, 25 bp, Mus musculus
gagggattggcctcattatcaggaa

SEQ ID NO: 658640 - DNA, 25 bp, Mus musculus
gagggattttgcagtgactcttgag

SEQ ID NO: 658641 - DNA, 25 bp, Mus musculus
gagggattttgctgtgactcttgag

SEQ ID NO: 658642 - DNA, 25 bp, Mus musculus
gagggcaaccataagttcccacaga

SEQ ID NO: 658643 - DNA, 25 bp, Mus musculus
gagggcaaccattagttcccacaga

SEQ ID NO: 658644 - DNA, 25 bp, Mus musculus
gagggcaacggcaacactgtatcca

SEQ ID NO: 658645 - DNA, 25 bp, Mus musculus
gagggcaacggctacactgtatcca

SEQ ID NO: 658646 - DNA, 25 bp, Mus musculus
gagggcaagcctaacctggtcctgg

SEQ ID NO: 658647 - DNA, 25 bp, Mus musculus
gagggcaagccttacctggtcctgg

SEQ ID NO: 658648 - DNA, 25 bp, Mus musculus
gagggcaataagctagtgaacagac

SEQ ID NO: 658649 - DNA, 25 bp, Mus musculus
gagggcaataaggtagtgaacagac

SEQ ID NO: 658650 - DNA, 25 bp, Mus musculus
gagggcaatcatcgcccacatgact

SEQ ID NO: 658651 - DNA, 25 bp, Mus musculus
gagggcaatcatggcccacatgact

SEQ ID NO: 658652 - DNA, 25 bp, Mus musculus
gagggcaatctcagcattaggagcg

SEQ ID NO: 658653 - DNA, 25 bp, Mus musculus
gagggcaatctctgcattaggagcg

SEQ ID NO: 658654 - DNA, 25 bp, Mus musculus
gagggcaatgacaagccccaggagt

SEQ ID NO: 658655 - DNA, 25 bp, Mus musculus
gagggcaatgactagccccaggagt

SEQ ID NO: 658656 - DNA, 25 bp, Mus musculus
gagggcaatgagaggagcatcccaa

SEQ ID NO: 658657 - DNA, 25 bp, Mus musculus
gagggcaatgagtggagcatcccaa

SEQ ID NO: 658658 - DNA, 25 bp, Mus musculus
gagggcacacctatcacagccatca

SEQ ID NO: 658659 - DNA, 25 bp, Mus musculus
gagggcacacctttcacagccatca

SEQ ID NO: 658660 - DNA, 25 bp, Mus musculus
gagggcaccagtaacaatggagaga

SEQ ID NO: 658661 - DNA, 25 bp, Mus musculus
gagggcaccagtaactgtctgcaga

SEQ ID NO: 658662 - DNA, 25 bp, Mus musculus
gagggcaccagttacaatggagaga

SEQ ID NO: 658663 - DNA, 25 bp, Mus musculus
gagggcaccagttactgtctgcaga

SEQ ID NO: 658664 - DNA, 25 bp, Mus musculus
gagggcacccggaggaaagctcaac

SEQ ID NO: 658665 - DNA, 25 bp, Mus musculus
gagggcacccggtggaaagctcaac

SEQ ID NO: 658666 - DNA, 25 bp, Mus musculus
gagggcacctttccaactaccagta

SEQ ID NO: 658667 - DNA, 25 bp, Mus musculus
gagggcacctttgcaactaccagta

SEQ ID NO: 658668 - DNA, 25 bp, Mus musculus
gagggcactctgcagctagctaacc

SEQ ID NO: 658669 - DNA, 25 bp, Mus musculus
gagggcactctggagctagctaacc

SEQ ID NO: 658670 - DNA, 25 bp, Mus musculus
gagggcagacaaccagtctgtgcac

SEQ ID NO: 658671 - DNA, 25 bp, Mus musculus
gagggcagacaagcagtctgtgcac

SEQ ID NO: 658672 - DNA, 25 bp, Mus musculus
gagggcagacgtcttatctgttctt

SEQ ID NO: 658673 - DNA, 25 bp, Mus musculus
gagggcagacgtgttatctgttctt

SEQ ID NO: 658674 - DNA, 25 bp, Mus musculus
gagggcagcctaccaagctgcttta

SEQ ID NO: 658675 - DNA, 25 bp, Mus musculus
gagggcagcctagcaagctgcttta

SEQ ID NO: 658676 - DNA, 25 bp, Mus musculus
gagggcaggtcaacgattcaagcat

SEQ ID NO: 658677 - DNA, 25 bp, Mus musculus
gagggcaggtcatcgattcaagcat

SEQ ID NO: 658678 - DNA, 25 bp, Mus musculus
gagggcagtcctctgaacctgacct

SEQ ID NO: 658679 - DNA, 25 bp, Mus musculus
gagggcagtcctgtgaacctgacct

SEQ ID NO: 658680 - DNA, 25 bp, Mus musculus
gagggcagtcgcatccactatggct

SEQ ID NO: 658681 - DNA, 25 bp, Mus musculus
gagggcagtcgcttccactatggct

SEQ ID NO: 658682 - DNA, 25 bp, Mus musculus
gagggcatctcgaggcacaacattg

SEQ ID NO: 658683 - DNA, 25 bp, Mus musculus
gagggcatctcgtggcacaacattg

SEQ ID NO: 658684 - DNA, 25 bp, Mus musculus
gagggcatctgcaaccgcaacatag

SEQ ID NO: 658685 - DNA, 25 bp, Mus musculus
gagggcatctgctaccgcaacatag

SEQ ID NO: 658686 - DNA, 25 bp, Mus musculus
gagggcatgaccagctattacctga

SEQ ID NO: 658687 - DNA, 25 bp, Mus musculus
gagggcatgacctgctattacctga

SEQ ID NO: 658688 - DNA, 25 bp, Mus musculus
gagggcatggccactttgctgcctt

SEQ ID NO: 658689 - DNA, 25 bp, Mus musculus
gagggcatggcctctttgctgcctt

SEQ ID NO: 658690 - DNA, 25 bp, Mus musculus
gagggccacgccatttggtgaagcc

SEQ ID NO: 658691 - DNA, 25 bp, Mus musculus
gagggccacgccttttggtgaagcc

SEQ ID NO: 658692 - DNA, 25 bp, Mus musculus
gagggccacgtgcatcttgttctcc

SEQ ID NO: 658693 - DNA, 25 bp, Mus musculus
gagggccacgtggatcttgttctcc

SEQ ID NO: 658694 - DNA, 25 bp, Mus musculus
gagggccagagacatcatccttaga

SEQ ID NO: 658695 - DNA, 25 bp, Mus musculus
gagggccagagagatcatccttaga

SEQ ID NO: 658696 - DNA, 25 bp, Mus musculus
gagggccagcagatccggtcattag

SEQ ID NO: 658697 - DNA, 25 bp, Mus musculus
gagggccagcagttccggtcattag

SEQ ID NO: 658698 - DNA, 25 bp, Mus musculus
gagggccagcctatcaagagcagag

SEQ ID NO: 658699 - DNA, 25 bp, Mus musculus
gagggccagcctttcaagagcagag

SEQ ID NO: 658700 - DNA, 25 bp, Mus musculus
gagggccagtaaccagaaagtcacc

SEQ ID NO: 658701 - DNA, 25 bp, Mus musculus
gagggccagtaagcagaaagtcacc

SEQ ID NO: 658702 - DNA, 25 bp, Mus musculus
gagggccagttcagtagcctgcagc

SEQ ID NO: 658703 - DNA, 25 bp, Mus musculus
gagggccagttctgtagcctgcagc

SEQ ID NO: 658704 - DNA, 25 bp, Mus musculus
gagggccattctcttgtttaaccgg

SEQ ID NO: 658705 - DNA, 25 bp, Mus musculus
gagggccattctgttgtttaaccgg

SEQ ID NO: 658706 - DNA, 25 bp, Mus musculus
gagggccattgacacactcatcaag

SEQ ID NO: 658707 - DNA, 25 bp, Mus musculus
gagggccattgagacactcatcaag

SEQ ID NO: 658708 - DNA, 25 bp, Mus musculus
gagggcccagagactgaccttgaag

SEQ ID NO: 658709 - DNA, 25 bp, Mus musculus
gagggcccagagtctgaccttgaag

SEQ ID NO: 658710 - DNA, 25 bp, Mus musculus
gagggcccctccacgttcaggatgt

SEQ ID NO: 658711 - DNA, 25 bp, Mus musculus
gagggcccctcctcgttcaggatgt

SEQ ID NO: 658712 - DNA, 25 bp, Mus musculus
gagggccctccaatcaagttcaagt

SEQ ID NO: 658713 - DNA, 25 bp, Mus musculus
gagggccctccattcaagttcaagt

SEQ ID NO: 658714 - DNA, 25 bp, Mus musculus
gagggccctgttctcaagatctctt

SEQ ID NO: 658715 - DNA, 25 bp, Mus musculus
gagggccctgttgtcaagatctctt

SEQ ID NO: 658716 - DNA, 25 bp, Mus musculus
gagggccgaccgagttatgcactcc

SEQ ID NO: 658717 - DNA, 25 bp, Mus musculus
gagggccgaccgtgttatgcactcc

SEQ ID NO: 658718 - DNA, 25 bp, Mus musculus
gagggccgcacacctctgcactttg

SEQ ID NO: 658719 - DNA, 25 bp, Mus musculus
gagggccgcacagctctgcactttg

SEQ ID NO: 658720 - DNA, 25 bp, Mus musculus
gagggccgccagacagtcagccagt

SEQ ID NO: 658721 - DNA, 25 bp, Mus musculus
gagggccgccagtcagtcagccagt

SEQ ID NO: 658722 - DNA, 25 bp, Mus musculus
gagggccgctccctagtgctcacgt

SEQ ID NO: 658723 - DNA, 25 bp, Mus musculus
gagggccgctccgtagtgctcacgt

SEQ ID NO: 658724 - DNA, 25 bp, Mus musculus
gagggccgctggatactttgaagaa

SEQ ID NO: 658725 - DNA, 25 bp, Mus musculus
gagggccgctggttactttgaagaa

SEQ ID NO: 658726 - DNA, 25 bp, Mus musculus
gagggcctactgctcctgaacatgg

SEQ ID NO: 658727 - DNA, 25 bp, Mus musculus
gagggcctactggtcctgaacatgg

SEQ ID NO: 658728 - DNA, 25 bp, Mus musculus
gagggcctcctcagtgttccacaag

SEQ ID NO: 658729 - DNA, 25 bp, Mus musculus
gagggcctcctctgtgttccacaag

SEQ ID NO: 658730 - DNA, 25 bp, Mus musculus
gagggcctctctcagtgtcctgctg

SEQ ID NO: 658731 - DNA, 25 bp, Mus musculus
gagggcctctctgagtgtcctgctg

SEQ ID NO: 658732 - DNA, 25 bp, Mus musculus
gagggcctctgcatcccgtgccagc

SEQ ID NO: 658733 - DNA, 25 bp, Mus musculus
gagggcctctgcttcccgtgccagc

SEQ ID NO: 658734 - DNA, 25 bp, Mus musculus
gagggcctgagtatgtgcactgtct

SEQ ID NO: 658735 - DNA, 25 bp, Mus musculus
gagggcctgagtttgtgcactgtct

SEQ ID NO: 658736 - DNA, 25 bp, Mus musculus
gagggcctttgactgcagcctgtta

SEQ ID NO: 658737 - DNA, 25 bp, Mus musculus
gagggcctttgagtgcagcctgtta

SEQ ID NO: 658738 - DNA, 25 bp, Mus musculus
gagggcgaccccatctacgaggtgc

SEQ ID NO: 658739 - DNA, 25 bp, Mus musculus
gagggcgaccccttctacgaggtgc

SEQ ID NO: 658740 - DNA, 25 bp, Mus musculus
gagggcgcagagctcctcttctact

SEQ ID NO: 658741 - DNA, 25 bp, Mus musculus
gagggcgcagaggtcctcttctact

SEQ ID NO: 658742 - DNA, 25 bp, Mus musculus
gagggcgcggatactccgatcctaa

SEQ ID NO: 658743 - DNA, 25 bp, Mus musculus
gagggcgcggattctccgatcctaa

SEQ ID NO: 658744 - DNA, 25 bp, Mus musculus
gagggcgtgaccagaaaggaattcc

SEQ ID NO: 658745 - DNA, 25 bp, Mus musculus
gagggcgtgacctgaaaggaattcc

SEQ ID NO: 658746 - DNA, 25 bp, Mus musculus
gagggctaccccaggtgacatgtgc

SEQ ID NO: 658747 - DNA, 25 bp, Mus musculus
gagggctacccctggtgacatgtgc

SEQ ID NO: 658748 - DNA, 25 bp, Mus musculus
gagggctagccacccatcccaggat

SEQ ID NO: 658749 - DNA, 25 bp, Mus musculus
gagggctagccagccatcccaggat

SEQ ID NO: 658750 - DNA, 25 bp, Mus musculus
gagggctatgtaccctataatatcc

SEQ ID NO: 658751 - DNA, 25 bp, Mus musculus
gagggctatgtagcctataatatcc

SEQ ID NO: 658752 - DNA, 25 bp, Mus musculus
gagggctcagtgctacttctaggac

SEQ ID NO: 658753 - DNA, 25 bp, Mus musculus
gagggctcagtggtacttctaggac

SEQ ID NO: 658754 - DNA, 25 bp, Mus musculus
gagggctccaaaatcatattccggg

SEQ ID NO: 658755 - DNA, 25 bp, Mus musculus
gagggctccaaattcatattccggg

SEQ ID NO: 658756 - DNA, 25 bp, Mus musculus
gagggctccaacagtgacaccaacc

SEQ ID NO: 658757 - DNA, 25 bp, Mus musculus
gagggctccaactgtgacaccaacc

SEQ ID NO: 658758 - DNA, 25 bp, Mus musculus
gagggctcctgtcgcaaatacccgg

SEQ ID NO: 658759 - DNA, 25 bp, Mus musculus
gagggctcctgtggcaaatacccgg

SEQ ID NO: 658760 - DNA, 25 bp, Mus musculus
gagggctcggctatggactcctgca

SEQ ID NO: 658761 - DNA, 25 bp, Mus musculus
gagggctcggctttggactcctgca

SEQ ID NO: 658762 - DNA, 25 bp, Mus musculus
gagggctctactactgacactcaag

SEQ ID NO: 658763 - DNA, 25 bp, Mus musculus
gagggctctacttctgacactcaag

SEQ ID NO: 658764 - DNA, 25 bp, Mus musculus
gagggctcttaaattttgtctgaaa

SEQ ID NO: 658765 - DNA, 25 bp, Mus musculus
gagggctcttaatttttgtctgaaa

SEQ ID NO: 658766 - DNA, 25 bp, Mus musculus
gagggctgagctcgcccatagtcct

SEQ ID NO: 658767 - DNA, 25 bp, Mus musculus
gagggctgagctggcccatagtcct

SEQ ID NO: 658768 - DNA, 25 bp, Mus musculus
gagggctgaggaaatctccagcttt

SEQ ID NO: 658769 - DNA, 25 bp, Mus musculus
gagggctgaggatatctccagcttt

SEQ ID NO: 658770 - DNA, 25 bp, Mus musculus
gagggctgcttcactagtcccgaaa

SEQ ID NO: 658771 - DNA, 25 bp, Mus musculus
gagggctgcttctctagtcccgaaa

SEQ ID NO: 658772 - DNA, 25 bp, Mus musculus
gagggctgggatatcgtaccagaaa

SEQ ID NO: 658773 - DNA, 25 bp, Mus musculus
gagggctgggatttcgtaccagaaa

SEQ ID NO: 658774 - DNA, 25 bp, Mus musculus
gagggctgtgaccagtacagcctca

SEQ ID NO: 658775 - DNA, 25 bp, Mus musculus
gagggctgtgacgagtacagcctca

SEQ ID NO: 658776 - DNA, 25 bp, Mus musculus
gagggctgttggatcttgactgaca

SEQ ID NO: 658777 - DNA, 25 bp, Mus musculus
gagggctgttggttcttgactgaca

SEQ ID NO: 658778 - DNA, 25 bp, Mus musculus
gagggcttcaggctcactcatgcag

SEQ ID NO: 658779 - DNA, 25 bp, Mus musculus
gagggcttcagggtcactcatgcag

SEQ ID NO: 658780 - DNA, 25 bp, Mus musculus
gagggcttccctctgaataaagacg

SEQ ID NO: 658781 - DNA, 25 bp, Mus musculus
gagggcttccctgtgaataaagacg

SEQ ID NO: 658782 - DNA, 25 bp, Mus musculus
gagggcttcggtcatgccgcactca

SEQ ID NO: 658783 - DNA, 25 bp, Mus musculus
gagggcttcggtgatgccgcactca

SEQ ID NO: 658784 - DNA, 25 bp, Mus musculus
gagggcttcgttactatgccaacaa

SEQ ID NO: 658785 - DNA, 25 bp, Mus musculus
gagggcttcgtttctatgccaacaa

SEQ ID NO: 658786 - DNA, 25 bp, Mus musculus
gagggcttggagctctcaaaagacc

SEQ ID NO: 658787 - DNA, 25 bp, Mus musculus
gagggcttggaggtctcaaaagacc

SEQ ID NO: 658788 - DNA, 25 bp, Mus musculus
gagggcttgtacatgaacactggaa

SEQ ID NO: 658789 - DNA, 25 bp, Mus musculus
gagggcttgtacttgaacactggaa

SEQ ID NO: 658790 - DNA, 25 bp, Mus musculus
gagggcttttttcacctcatcgcca

SEQ ID NO: 658791 - DNA, 25 bp, Mus musculus
gagggcttttttgacctcatcgcca

SEQ ID NO: 658792 - DNA, 25 bp, Mus musculus
gaggggccaaagagatggcaaccac

SEQ ID NO: 658793 - DNA, 25 bp, Mus musculus
gaggggccaaagtgatggcaaccac

SEQ ID NO: 658794 - DNA, 25 bp, Mus musculus
gaggggtttccacgtatacaagcag

SEQ ID NO: 658795 - DNA, 25 bp, Mus musculus
gaggggtttccaggtatacaagcag

SEQ ID NO: 658796 - DNA, 25 bp, Mus musculus
gagggtaaccttaccttgcgcgcag

SEQ ID NO: 658797 - DNA, 25 bp, Mus musculus
gagggtaacctttccttgcgcgcag

SEQ ID NO: 658798 - DNA, 25 bp, Mus musculus
gagggtaccaggagctaatggctac

SEQ ID NO: 658799 - DNA, 25 bp, Mus musculus
gagggtaccaggtgctaatggctac

SEQ ID NO: 658800 - DNA, 25 bp, Mus musculus
gagggtagtgatcgctcaaaataac

SEQ ID NO: 658801 - DNA, 25 bp, Mus musculus
gagggtagtgatggctcaaaataac

SEQ ID NO: 658802 - DNA, 25 bp, Mus musculus
gagggtatcacaagggcaaaacaga

SEQ ID NO: 658803 - DNA, 25 bp, Mus musculus
gagggtatcacatgggcaaaacaga

SEQ ID NO: 658804 - DNA, 25 bp, Mus musculus
gagggtatgtaacctcaatggtcct

SEQ ID NO: 658805 - DNA, 25 bp, Mus musculus
gagggtatgtaagctcaatggtcct

SEQ ID NO: 658806 - DNA, 25 bp, Mus musculus
gagggtcaatttcagtcatgcaggt

SEQ ID NO: 658807 - DNA, 25 bp, Mus musculus
gagggtcaatttgagtcatgcaggt

SEQ ID NO: 658808 - DNA, 25 bp, Mus musculus
gagggtcagcacctgcacaagatga

SEQ ID NO: 658809 - DNA, 25 bp, Mus musculus
gagggtcagcacgtgcacaagatga

SEQ ID NO: 658810 - DNA, 25 bp, Mus musculus
gagggtcaggacacctttatgggtt

SEQ ID NO: 658811 - DNA, 25 bp, Mus musculus
gagggtcaggactcctttatgggtt

SEQ ID NO: 658812 - DNA, 25 bp, Mus musculus
gagggtcaggcccataactaaccag

SEQ ID NO: 658813 - DNA, 25 bp, Mus musculus
gagggtcaggccgataactaaccag

SEQ ID NO: 658814 - DNA, 25 bp, Mus musculus
gagggtccattcatgggacaaaacg

SEQ ID NO: 658815 - DNA, 25 bp, Mus musculus
gagggtccattcttgggacaaaacg

SEQ ID NO: 658816 - DNA, 25 bp, Mus musculus
gagggtcccagcacgctacgtaggt

SEQ ID NO: 658817 - DNA, 25 bp, Mus musculus
gagggtcccagctcgctacgtaggt

SEQ ID NO: 658818 - DNA, 25 bp, Mus musculus
gagggtccgacacagtgccgacttt

SEQ ID NO: 658819 - DNA, 25 bp, Mus musculus
gagggtccgacagagtgccgacttt

SEQ ID NO: 658820 - DNA, 25 bp, Mus musculus
gagggtcctcctccacaacatgcag

SEQ ID NO: 658821 - DNA, 25 bp, Mus musculus
gagggtcctcctgcacaacatgcag

SEQ ID NO: 658822 - DNA, 25 bp, Mus musculus
gagggtcctgaaaccaagcctgtgt

SEQ ID NO: 658823 - DNA, 25 bp, Mus musculus
gagggtcctgaatccaagcctgtgt

SEQ ID NO: 658824 - DNA, 25 bp, Mus musculus
gagggtcctttcaacattgagtccg

SEQ ID NO: 658825 - DNA, 25 bp, Mus musculus
gagggtcctttctacattgagtccg

SEQ ID NO: 658826 - DNA, 25 bp, Mus musculus
gagggtcctttgactgcttgctcaa

SEQ ID NO: 658827 - DNA, 25 bp, Mus musculus
gagggtcctttgtctgcttgctcaa

SEQ ID NO: 658828 - DNA, 25 bp, Mus musculus
gagggtctaaacactgggagtccca

SEQ ID NO: 658829 - DNA, 25 bp, Mus musculus
gagggtctaaactctgggagtccca

SEQ ID NO: 658830 - DNA, 25 bp, Mus musculus
gagggtctacgaccagcactaccag

SEQ ID NO: 658831 - DNA, 25 bp, Mus musculus
gagggtctacgagcagcactaccag

SEQ ID NO: 658832 - DNA, 25 bp, Mus musculus
gagggtctcactagatcaagttggt

SEQ ID NO: 658833 - DNA, 25 bp, Mus musculus
gagggtctcacttgatcaagttggt

SEQ ID NO: 658834 - DNA, 25 bp, Mus musculus
gagggtctgcacaatcaccttacga

SEQ ID NO: 658835 - DNA, 25 bp, Mus musculus
gagggtctgcactatcaccttacga

SEQ ID NO: 658836 - DNA, 25 bp, Mus musculus
gagggtctgctacgaatgaagtcca

SEQ ID NO: 658837 - DNA, 25 bp, Mus musculus
gagggtctgctaggaatgaagtcca

SEQ ID NO: 658838 - DNA, 25 bp, Mus musculus
gagggtcttagtacctctttagact

SEQ ID NO: 658839 - DNA, 25 bp, Mus musculus
gagggtcttagttcctctttagact

SEQ ID NO: 658840 - DNA, 25 bp, Mus musculus
gagggtcttatgactgtttctgttc

SEQ ID NO: 658841 - DNA, 25 bp, Mus musculus
gagggtcttatgtctgtttctgttc

SEQ ID NO: 658842 - DNA, 25 bp, Mus musculus
gagggtctttccctaattgcctgat

SEQ ID NO: 658843 - DNA, 25 bp, Mus musculus
gagggtctttccgtaattgcctgat

SEQ ID NO: 658844 - DNA, 25 bp, Mus musculus
gagggtgaacttaacaattgccaga

SEQ ID NO: 658845 - DNA, 25 bp, Mus musculus
gagggtgaactttacaattgccaga

SEQ ID NO: 658846 - DNA, 25 bp, Mus musculus
gagggtgaagatactctacaaaaag

SEQ ID NO: 658847 - DNA, 25 bp, Mus musculus
gagggtgaagattctctacaaaaag

SEQ ID NO: 658848 - DNA, 25 bp, Mus musculus
gagggtgaattcaggctctcagtcc

SEQ ID NO: 658849 - DNA, 25 bp, Mus musculus
gagggtgaattctggctctcagtcc

SEQ ID NO: 658850 - DNA, 25 bp, Mus musculus
gagggtgacacccactttgaccaac

SEQ ID NO: 658851 - DNA, 25 bp, Mus musculus
gagggtgacaccgactttgaccaac

SEQ ID NO: 658852 - DNA, 25 bp, Mus musculus
gagggtgaccctaacgcttcctgtg

SEQ ID NO: 658853 - DNA, 25 bp, Mus musculus
gagggtgacccttacgcttcctgtg

SEQ ID NO: 658854 - DNA, 25 bp, Mus musculus
gagggtgatgtaagtttatggaaac

SEQ ID NO: 658855 - DNA, 25 bp, Mus musculus
gagggtgatgtatgtttatggaaac

SEQ ID NO: 658856 - DNA, 25 bp, Mus musculus
gagggtgccagcaactccaagctat

SEQ ID NO: 658857 - DNA, 25 bp, Mus musculus
gagggtgccagctactccaagctat

SEQ ID NO: 658858 - DNA, 25 bp, Mus musculus
gagggtgccatcaccgacaatacca

SEQ ID NO: 658859 - DNA, 25 bp, Mus musculus
gagggtgccatctccgacaatacca

SEQ ID NO: 658860 - DNA, 25 bp, Mus musculus
gagggtggcccaacttcccctgaag

SEQ ID NO: 658861 - DNA, 25 bp, Mus musculus
gagggtggcccatcttcccctgaag

SEQ ID NO: 658862 - DNA, 25 bp, Mus musculus
gagggtgggactaagctaataacgc

SEQ ID NO: 658863 - DNA, 25 bp, Mus musculus
gagggtgggacttagctaataacgc

SEQ ID NO: 658864 - DNA, 25 bp, Mus musculus
gagggtggtatcactgtatcttcag

SEQ ID NO: 658865 - DNA, 25 bp, Mus musculus
gagggtggtatctctgtatcttcag

SEQ ID NO: 658866 - DNA, 25 bp, Mus musculus
gagggtgtcttgcttcccaatctaa

SEQ ID NO: 658867 - DNA, 25 bp, Mus musculus
gagggtgtcttggttcccaatctaa

SEQ ID NO: 658868 - DNA, 25 bp, Mus musculus
gagggtgtgacgagcatcattttca

SEQ ID NO: 658869 - DNA, 25 bp, Mus musculus
gagggtgtgacgtgcatcattttca

SEQ ID NO: 658870 - DNA, 25 bp, Mus musculus
gagggtgtgcatactgcagaagact

SEQ ID NO: 658871 - DNA, 25 bp, Mus musculus
gagggtgtgcattctgcagaagact

SEQ ID NO: 658872 - DNA, 25 bp, Mus musculus
gagggttaaggcacagggtcataca

SEQ ID NO: 658873 - DNA, 25 bp, Mus musculus
gagggttaaggctcagggtcataca

SEQ ID NO: 658874 - DNA, 25 bp, Mus musculus
gagggttatcggaaggattccacca

SEQ ID NO: 658875 - DNA, 25 bp, Mus musculus
gagggttatcggtaggattccacca

SEQ ID NO: 658876 - DNA, 25 bp, Mus musculus
gagggttatgacagctattattttc

SEQ ID NO: 658877 - DNA, 25 bp, Mus musculus
gagggttatgactgctattattttc

SEQ ID NO: 658878 - DNA, 25 bp, Mus musculus
gagggttcacatccccattctgtac

SEQ ID NO: 658879 - DNA, 25 bp, Mus musculus
gagggttcacatgcccattctgtac

SEQ ID NO: 658880 - DNA, 25 bp, Mus musculus
gagggttgacctctacaggatcctg

SEQ ID NO: 658881 - DNA, 25 bp, Mus musculus
gagggttgacctgtacaggatcctg

SEQ ID NO: 658882 - DNA, 25 bp, Mus musculus
gagggttgagacaactgttgcaagc

SEQ ID NO: 658883 - DNA, 25 bp, Mus musculus
gagggttgagactactgttgcaagc

SEQ ID NO: 658884 - DNA, 25 bp, Mus musculus
gagggttgctaaagtctgttttctc

SEQ ID NO: 658885 - DNA, 25 bp, Mus musculus
gagggttgctaatgtctgttttctc

SEQ ID NO: 658886 - DNA, 25 bp, Mus musculus
gagggttggcagctcttcctcacag

SEQ ID NO: 658887 - DNA, 25 bp, Mus musculus
gagggttggcaggtcttcctcacag

SEQ ID NO: 658888 - DNA, 25 bp, Mus musculus
gagggttgtccaactcccaaagaca

SEQ ID NO: 658889 - DNA, 25 bp, Mus musculus
gagggttgtccatctcccaaagaca

SEQ ID NO: 658890 - DNA, 25 bp, Mus musculus
gagggtttaggaacagtgtttctgc

SEQ ID NO: 658891 - DNA, 25 bp, Mus musculus
gagggtttaggatcagtgtttctgc

SEQ ID NO: 658892 - DNA, 25 bp, Mus musculus
gaggtaaaaagcaagtgtgaagagc

SEQ ID NO: 658893 - DNA, 25 bp, Mus musculus
gaggtaaaaagctagtgtgaagagc

SEQ ID NO: 658894 - DNA, 25 bp, Mus musculus
gaggtaaatgccatccgcttcggag

SEQ ID NO: 658895 - DNA, 25 bp, Mus musculus
gaggtaaatgccttccgcttcggag

SEQ ID NO: 658896 - DNA, 25 bp, Mus musculus
gaggtaactcagagcctgccatggt

SEQ ID NO: 658897 - DNA, 25 bp, Mus musculus
gaggtaactcagtgcctgccatggt

SEQ ID NO: 658898 - DNA, 25 bp, Mus musculus
gaggtaagagcaatggccaagcctt

SEQ ID NO: 658899 - DNA, 25 bp, Mus musculus
gaggtaagagcattggccaagcctt

SEQ ID NO: 658900 - DNA, 25 bp, Mus musculus
gaggtaagaggaagcgcacgacttt

SEQ ID NO: 658901 - DNA, 25 bp, Mus musculus
gaggtaagaggatgcgcacgacttt

SEQ ID NO: 658902 - DNA, 25 bp, Mus musculus
gaggtaagcttgcagcctcgactct

SEQ ID NO: 658903 - DNA, 25 bp, Mus musculus
gaggtaagcttggagcctcgactct

SEQ ID NO: 658904 - DNA, 25 bp, Mus musculus
gaggtaaggctgaccactctgtcct

SEQ ID NO: 658905 - DNA, 25 bp, Mus musculus
gaggtaaggctgtccactctgtcct

SEQ ID NO: 658906 - DNA, 25 bp, Mus musculus
gaggtaagtcttagctggagttagt

SEQ ID NO: 658907 - DNA, 25 bp, Mus musculus
gaggtaagtctttgctggagttagt

SEQ ID NO: 658908 - DNA, 25 bp, Mus musculus
gaggtaatccgacttacagcaccac

SEQ ID NO: 658909 - DNA, 25 bp, Mus musculus
gaggtaatccgagttacagcaccac

SEQ ID NO: 658910 - DNA, 25 bp, Mus musculus
gaggtacaacatccgtcagcagacg

SEQ ID NO: 658911 - DNA, 25 bp, Mus musculus
gaggtacaacatgcgtcagcagacg

SEQ ID NO: 658912 - DNA, 25 bp, Mus musculus
gaggtacaagcactcctggaaagca

SEQ ID NO: 658913 - DNA, 25 bp, Mus musculus
gaggtacaagcagtcctggaaagca

SEQ ID NO: 658914 - DNA, 25 bp, Mus musculus
gaggtacaatgacctctcttacaag

SEQ ID NO: 658915 - DNA, 25 bp, Mus musculus
gaggtacaatgagctctcttacaag

SEQ ID NO: 658916 - DNA, 25 bp, Mus musculus
gaggtaccatgcacttgccagtaaa

SEQ ID NO: 658917 - DNA, 25 bp, Mus musculus
gaggtaccatgctcttgccagtaaa

SEQ ID NO: 658918 - DNA, 25 bp, Mus musculus
gaggtacccacaaaagacgccaagt

SEQ ID NO: 658919 - DNA, 25 bp, Mus musculus
gaggtacccacataagacgccaagt

SEQ ID NO: 658920 - DNA, 25 bp, Mus musculus
gaggtaccccatcatggacccatgt

SEQ ID NO: 658921 - DNA, 25 bp, Mus musculus
gaggtaccccatgatggacccatgt

SEQ ID NO: 658922 - DNA, 25 bp, Mus musculus
gaggtactactacatcttccagtag

SEQ ID NO: 658923 - DNA, 25 bp, Mus musculus
gaggtactactagatcttccagtag

SEQ ID NO: 658924 - DNA, 25 bp, Mus musculus
gaggtactgcctacatcagtacaac

SEQ ID NO: 658925 - DNA, 25 bp, Mus musculus
gaggtactgccttcatcagtacaac

SEQ ID NO: 658926 - DNA, 25 bp, Mus musculus
gaggtactggctatgcaggcaagcc

SEQ ID NO: 658927 - DNA, 25 bp, Mus musculus
gaggtactggctttgcaggcaagcc

SEQ ID NO: 658928 - DNA, 25 bp, Mus musculus
gaggtagaacatcccgcagccaaag

SEQ ID NO: 658929 - DNA, 25 bp, Mus musculus
gaggtagaacatgccgcagccaaag

SEQ ID NO: 658930 - DNA, 25 bp, Mus musculus
gaggtagaagaacaagggatacaca

SEQ ID NO: 658931 - DNA, 25 bp, Mus musculus
gaggtagaagaagaagggatacaca

SEQ ID NO: 658932 - DNA, 25 bp, Mus musculus
gaggtagacagtcaagtagagctac

SEQ ID NO: 658933 - DNA, 25 bp, Mus musculus
gaggtagacagtgaagtagagctac

SEQ ID NO: 658934 - DNA, 25 bp, Mus musculus
gaggtagactctcactttgacattg

SEQ ID NO: 658935 - DNA, 25 bp, Mus musculus
gaggtagactctgactttgacattg

SEQ ID NO: 658936 - DNA, 25 bp, Mus musculus
gaggtagagagcctcaagtaccaac

SEQ ID NO: 658937 - DNA, 25 bp, Mus musculus
gaggtagagagcgtcaagtaccaac

SEQ ID NO: 658938 - DNA, 25 bp, Mus musculus
gaggtagaggccaacaatgccttcg

SEQ ID NO: 658939 - DNA, 25 bp, Mus musculus
gaggtagaggcctacaatgccttcg

SEQ ID NO: 658940 - DNA, 25 bp, Mus musculus
gaggtagcccttcggcactcggctc

SEQ ID NO: 658941 - DNA, 25 bp, Mus musculus
gaggtagcccttgggcactcggctc

SEQ ID NO: 658942 - DNA, 25 bp, Mus musculus
gaggtagcctgcactagcagttcag

SEQ ID NO: 658943 - DNA, 25 bp, Mus musculus
gaggtagcctgctctagcagttcag

SEQ ID NO: 658944 - DNA, 25 bp, Mus musculus
gaggtagctcccaggttggccaata

SEQ ID NO: 658945 - DNA, 25 bp, Mus musculus
gaggtagctccctggttggccaata

SEQ ID NO: 658946 - DNA, 25 bp, Mus musculus
gaggtaggacgtcctttcacagtct

SEQ ID NO: 658947 - DNA, 25 bp, Mus musculus
gaggtaggacgtgctttcacagtct

SEQ ID NO: 658948 - DNA, 25 bp, Mus musculus
gaggtagggtggacacactcagaaa

SEQ ID NO: 658949 - DNA, 25 bp, Mus musculus
gaggtagggtggtcacactcagaaa

SEQ ID NO: 658950 - DNA, 25 bp, Mus musculus
gaggtaggttacacaggctctcctg

SEQ ID NO: 658951 - DNA, 25 bp, Mus musculus
gaggtaggttactcaggctctcctg

SEQ ID NO: 658952 - DNA, 25 bp, Mus musculus
gaggtatacatcaccacagccttgg

SEQ ID NO: 658953 - DNA, 25 bp, Mus musculus
gaggtatacatctccacagccttgg

SEQ ID NO: 658954 - DNA, 25 bp, Mus musculus
gaggtatactacctaattcgttcta

SEQ ID NO: 658955 - DNA, 25 bp, Mus musculus
gaggtatactacgtaattcgttcta

SEQ ID NO: 658956 - DNA, 25 bp, Mus musculus
gaggtatactggcacttaagaggta

SEQ ID NO: 658957 - DNA, 25 bp, Mus musculus
gaggtatactgggacttaagaggta

SEQ ID NO: 658958 - DNA, 25 bp, Mus musculus
gaggtatatggtcctgacatcagcc

SEQ ID NO: 658959 - DNA, 25 bp, Mus musculus
gaggtatatggtgctgacatcagcc

SEQ ID NO: 658960 - DNA, 25 bp, Mus musculus
gaggtatcaggtaccaacgactatg

SEQ ID NO: 658961 - DNA, 25 bp, Mus musculus
gaggtatcaggttccaacgactatg

SEQ ID NO: 658962 - DNA, 25 bp, Mus musculus
gaggtatcatcactacaaaagtaat

SEQ ID NO: 658963 - DNA, 25 bp, Mus musculus
gaggtatcatcagtacaaaagtaat

SEQ ID NO: 658964 - DNA, 25 bp, Mus musculus
gaggtatgtcgcagtgtgccatgct

SEQ ID NO: 658965 - DNA, 25 bp, Mus musculus
gaggtatgtcgctgtgtgccatgct

SEQ ID NO: 658966 - DNA, 25 bp, Mus musculus
gaggtattcgaacgcgagtccgcac

SEQ ID NO: 658967 - DNA, 25 bp, Mus musculus
gaggtattcgaaggcgagtccgcac

SEQ ID NO: 658968 - DNA, 25 bp, Mus musculus
gaggtattgataaacaagctgtgaa

SEQ ID NO: 658969 - DNA, 25 bp, Mus musculus
gaggtattgatatacaagctgtgaa

SEQ ID NO: 658970 - DNA, 25 bp, Mus musculus
gaggtattgcctatattcagcagaa

SEQ ID NO: 658971 - DNA, 25 bp, Mus musculus
gaggtattgcctttattcagcagaa

SEQ ID NO: 658972 - DNA, 25 bp, Mus musculus
gaggtcaacgtccactcccaatgtc

SEQ ID NO: 658973 - DNA, 25 bp, Mus musculus
gaggtcaacgtcgactcccaatgtc

SEQ ID NO: 658974 - DNA, 25 bp, Mus musculus
gaggtcaactgcctctcattcaatc

SEQ ID NO: 658975 - DNA, 25 bp, Mus musculus
gaggtcaactgcgtctcattcaatc

SEQ ID NO: 658976 - DNA, 25 bp, Mus musculus
gaggtcaagagcattggcagcctgc

SEQ ID NO: 658977 - DNA, 25 bp, Mus musculus
gaggtcaagagctttggcagcctgc

SEQ ID NO: 658978 - DNA, 25 bp, Mus musculus
gaggtcaagaggctcagctcccatc

SEQ ID NO: 658979 - DNA, 25 bp, Mus musculus
gaggtcaagagggtcagctcccatc

SEQ ID NO: 658980 - DNA, 25 bp, Mus musculus
gaggtcaccctcaccgacttcaggg

SEQ ID NO: 658981 - DNA, 25 bp, Mus musculus
gaggtcaccctctccgacttcaggg

SEQ ID NO: 658982 - DNA, 25 bp, Mus musculus
gaggtcaccctgatgtggctaccat

SEQ ID NO: 658983 - DNA, 25 bp, Mus musculus
gaggtcaccctgttgtggctaccat

SEQ ID NO: 658984 - DNA, 25 bp, Mus musculus
gaggtcaccgtaaccatctgtctgt

SEQ ID NO: 658985 - DNA, 25 bp, Mus musculus
gaggtcaccgtatccatctgtctgt

SEQ ID NO: 658986 - DNA, 25 bp, Mus musculus
gaggtcagagacacccacctggttg

SEQ ID NO: 658987 - DNA, 25 bp, Mus musculus
gaggtcagagactcccacctggttg

SEQ ID NO: 658988 - DNA, 25 bp, Mus musculus
gaggtcagagtgagttagataccaa

SEQ ID NO: 658989 - DNA, 25 bp, Mus musculus
gaggtcagagtgtgttagataccaa

SEQ ID NO: 658990 - DNA, 25 bp, Mus musculus
gaggtcagatagcagtcagcctatg

SEQ ID NO: 658991 - DNA, 25 bp, Mus musculus
gaggtcagataggagtcagcctatg

SEQ ID NO: 658992 - DNA, 25 bp, Mus musculus
gaggtcagccccaacagtgacgaag

SEQ ID NO: 658993 - DNA, 25 bp, Mus musculus
gaggtcagcccctacagtgacgaag

SEQ ID NO: 658994 - DNA, 25 bp, Mus musculus
gaggtcagctaccaaagcctttcgc

SEQ ID NO: 658995 - DNA, 25 bp, Mus musculus
gaggtcagctacgaaagcctttcgc

SEQ ID NO: 658996 - DNA, 25 bp, Mus musculus
gaggtcagtggtaggaactccagcc

SEQ ID NO: 658997 - DNA, 25 bp, Mus musculus
gaggtcagtggttggaactccagcc

SEQ ID NO: 658998 - DNA, 25 bp, Mus musculus
gaggtcagttttaagttcaccctgg

SEQ ID NO: 658999 - DNA, 25 bp, Mus musculus
gaggtcagtttttagttcaccctgg

SEQ ID NO: 659000 - DNA, 25 bp, Mus musculus
gaggtcatataaaccaatgattcaa

SEQ ID NO: 659001 - DNA, 25 bp, Mus musculus
gaggtcatataatccaatgattcaa

SEQ ID NO: 659002 - DNA, 25 bp, Mus musculus
gaggtcatcagcatgtaaccagggt

SEQ ID NO: 659003 - DNA, 25 bp, Mus musculus
gaggtcatcagcttgtaaccagggt

SEQ ID NO: 659004 - DNA, 25 bp, Mus musculus
gaggtcatccaactccatcgcaaat

SEQ ID NO: 659005 - DNA, 25 bp, Mus musculus
gaggtcatccaagtccatcgcaaat

SEQ ID NO: 659006 - DNA, 25 bp, Mus musculus
gaggtcatccctattggtgcagcca

SEQ ID NO: 659007 - DNA, 25 bp, Mus musculus
gaggtcatcccttttggtgcagcca

SEQ ID NO: 659008 - DNA, 25 bp, Mus musculus
gaggtcatcgcaccccaaaaaacac

SEQ ID NO: 659009 - DNA, 25 bp, Mus musculus
gaggtcatcgcagcccaaaaaacac

SEQ ID NO: 659010 - DNA, 25 bp, Mus musculus
gaggtcatcttcaccctgaggagac

SEQ ID NO: 659011 - DNA, 25 bp, Mus musculus
gaggtcatcttctccctgaggagac

SEQ ID NO: 659012 - DNA, 25 bp, Mus musculus
gaggtccaggatcgccctaatgatg

SEQ ID NO: 659013 - DNA, 25 bp, Mus musculus
gaggtccaggatggccctaatgatg

SEQ ID NO: 659014 - DNA, 25 bp, Mus musculus
gaggtccatctacggaagccgcttt

SEQ ID NO: 659015 - DNA, 25 bp, Mus musculus
gaggtccatctagggaagccgcttt

SEQ ID NO: 659016 - DNA, 25 bp, Mus musculus
gaggtcccaggtatctgtgaagctg

SEQ ID NO: 659017 - DNA, 25 bp, Mus musculus
gaggtcccaggtttctgtgaagctg

SEQ ID NO: 659018 - DNA, 25 bp, Mus musculus
gaggtcccgaggagaactacagcag

SEQ ID NO: 659019 - DNA, 25 bp, Mus musculus
gaggtcccgaggtgaactacagcag

SEQ ID NO: 659020 - DNA, 25 bp, Mus musculus
gaggtccctggtcctacacaacaaa

SEQ ID NO: 659021 - DNA, 25 bp, Mus musculus
gaggtccctggtgctacacaacaaa

SEQ ID NO: 659022 - DNA, 25 bp, Mus musculus
gaggtccgtgtgcttctcacctgaa

SEQ ID NO: 659023 - DNA, 25 bp, Mus musculus
gaggtccgtgtggttctcacctgaa

SEQ ID NO: 659024 - DNA, 25 bp, Mus musculus
gaggtcctcaccaaagtcctacagg

SEQ ID NO: 659025 - DNA, 25 bp, Mus musculus
gaggtcctcacctaagtcctacagg

SEQ ID NO: 659026 - DNA, 25 bp, Mus musculus
gaggtcctccctaatctactcaaag

SEQ ID NO: 659027 - DNA, 25 bp, Mus musculus
gaggtcctcccttatctactcaaag

SEQ ID NO: 659028 - DNA, 25 bp, Mus musculus
gaggtcctcggaccttctgtttccg

SEQ ID NO: 659029 - DNA, 25 bp, Mus musculus
gaggtcctcggagcttctgtttccg

SEQ ID NO: 659030 - DNA, 25 bp, Mus musculus
gaggtcctcggcctccattgtctct

SEQ ID NO: 659031 - DNA, 25 bp, Mus musculus
gaggtcctcggcgtccattgtctct

SEQ ID NO: 659032 - DNA, 25 bp, Mus musculus
gaggtcctgagcacttcttcgtggt

SEQ ID NO: 659033 - DNA, 25 bp, Mus musculus
gaggtcctgagctcttcttcgtggt

SEQ ID NO: 659034 - DNA, 25 bp, Mus musculus
gaggtcctgaggaagttgacctgag

SEQ ID NO: 659035 - DNA, 25 bp, Mus musculus
gaggtcctgaggtagttgacctgag

SEQ ID NO: 659036 - DNA, 25 bp, Mus musculus
gaggtcctgcataagaagtttgaag

SEQ ID NO: 659037 - DNA, 25 bp, Mus musculus
gaggtcctgcattagaagtttgaag

SEQ ID NO: 659038 - DNA, 25 bp, Mus musculus
gaggtcctgggaacacactcagagg

SEQ ID NO: 659039 - DNA, 25 bp, Mus musculus
gaggtcctgggatcacactcagagg

SEQ ID NO: 659040 - DNA, 25 bp, Mus musculus
gaggtcctgtcaaaacagcatttta

SEQ ID NO: 659041 - DNA, 25 bp, Mus musculus
gaggtcctgtcataacagcatttta

SEQ ID NO: 659042 - DNA, 25 bp, Mus musculus
gaggtcgacacgcattttccgccac

SEQ ID NO: 659043 - DNA, 25 bp, Mus musculus
gaggtcgacacggattttccgccac

SEQ ID NO: 659044 - DNA, 25 bp, Mus musculus
gaggtcgcagtcctccctgcacagg

SEQ ID NO: 659045 - DNA, 25 bp, Mus musculus
gaggtcgcagtcgtccctgcacagg

SEQ ID NO: 659046 - DNA, 25 bp, Mus musculus
gaggtcgggcacagctatccaagct

SEQ ID NO: 659047 - DNA, 25 bp, Mus musculus
gaggtcgggcactgctatccaagct

SEQ ID NO: 659048 - DNA, 25 bp, Mus musculus
gaggtcgtggtcacagacatggaca

SEQ ID NO: 659049 - DNA, 25 bp, Mus musculus
gaggtcgtggtctcagacatggaca

SEQ ID NO: 659050 - DNA, 25 bp, Mus musculus
gaggtcgttcctcaccacttgagaa

SEQ ID NO: 659051 - DNA, 25 bp, Mus musculus
gaggtcgttcctgaccacttgagaa

SEQ ID NO: 659052 - DNA, 25 bp, Mus musculus
gaggtctaaaccctgaagccacaga

SEQ ID NO: 659053 - DNA, 25 bp, Mus musculus
gaggtctaaaccgtgaagccacaga

SEQ ID NO: 659054 - DNA, 25 bp, Mus musculus
gaggtctatcccaaaataaattgtt

SEQ ID NO: 659055 - DNA, 25 bp, Mus musculus
gaggtctatccctaaataaattgtt

SEQ ID NO: 659056 - DNA, 25 bp, Mus musculus
gaggtctcactaccctttgaggaag

SEQ ID NO: 659057 - DNA, 25 bp, Mus musculus
gaggtctcactagcctttgaggaag

SEQ ID NO: 659058 - DNA, 25 bp, Mus musculus
gaggtctcccgcctactcaaagact

SEQ ID NO: 659059 - DNA, 25 bp, Mus musculus
gaggtctcccgcgtactcaaagact

SEQ ID NO: 659060 - DNA, 25 bp, Mus musculus
gaggtctcggaacatctacggctca

SEQ ID NO: 659061 - DNA, 25 bp, Mus musculus
gaggtctcggaagatctacggctca

SEQ ID NO: 659062 - DNA, 25 bp, Mus musculus
gaggtctctacaaggaagactcgaa

SEQ ID NO: 659063 - DNA, 25 bp, Mus musculus
gaggtctctacatggaagactcgaa

SEQ ID NO: 659064 - DNA, 25 bp, Mus musculus
gaggtctctccacggttccacaaaa

SEQ ID NO: 659065 - DNA, 25 bp, Mus musculus
gaggtctctccagggttccacaaaa

SEQ ID NO: 659066 - DNA, 25 bp, Mus musculus
gaggtctctgccagtggttacacaa

SEQ ID NO: 659067 - DNA, 25 bp, Mus musculus
gaggtctctgcctgtggttacacaa

SEQ ID NO: 659068 - DNA, 25 bp, Mus musculus
gaggtctgatttccatagccccgcc

SEQ ID NO: 659069 - DNA, 25 bp, Mus musculus
gaggtctgatttgcatagccccgcc

SEQ ID NO: 659070 - DNA, 25 bp, Mus musculus
gaggtctggataatcctaaagttca

SEQ ID NO: 659071 - DNA, 25 bp, Mus musculus
gaggtctggatattcctaaagttca

SEQ ID NO: 659072 - DNA, 25 bp, Mus musculus
gaggtctgtaagctagcctgtgtta

SEQ ID NO: 659073 - DNA, 25 bp, Mus musculus
gaggtctgtaaggtagcctgtgtta

SEQ ID NO: 659074 - DNA, 25 bp, Mus musculus
gaggtctgtggacaggatatcacca

SEQ ID NO: 659075 - DNA, 25 bp, Mus musculus
gaggtctgtggagaggatatcacca

SEQ ID NO: 659076 - DNA, 25 bp, Mus musculus
gaggtctgtttgacattatacggcg

SEQ ID NO: 659077 - DNA, 25 bp, Mus musculus
gaggtctgtttgtcattatacggcg

SEQ ID NO: 659078 - DNA, 25 bp, Mus musculus
gaggtcttacagacaatgcgagccc

SEQ ID NO: 659079 - DNA, 25 bp, Mus musculus
gaggtcttacagtcaatgcgagccc

SEQ ID NO: 659080 - DNA, 25 bp, Mus musculus
gaggtcttcacactacgatgagctg

SEQ ID NO: 659081 - DNA, 25 bp, Mus musculus
gaggtcttcacagtacgatgagctg

SEQ ID NO: 659082 - DNA, 25 bp, Mus musculus
gaggtcttccctacctgctctatgg

SEQ ID NO: 659083 - DNA, 25 bp, Mus musculus
gaggtcttcccttcctgctctatgg

SEQ ID NO: 659084 - DNA, 25 bp, Mus musculus
gaggtcttctatcgcagccctggac

SEQ ID NO: 659085 - DNA, 25 bp, Mus musculus
gaggtcttctatggcagccctggac

SEQ ID NO: 659086 - DNA, 25 bp, Mus musculus
gaggtgaaatccacacttctggaca

SEQ ID NO: 659087 - DNA, 25 bp, Mus musculus
gaggtgaaatcctcacttctggaca

SEQ ID NO: 659088 - DNA, 25 bp, Mus musculus
gaggtgaacatacacatagcttccc

SEQ ID NO: 659089 - DNA, 25 bp, Mus musculus
gaggtgaacatagacatagcttccc

SEQ ID NO: 659090 - DNA, 25 bp, Mus musculus
gaggtgaagaacaacctggcatcta

SEQ ID NO: 659091 - DNA, 25 bp, Mus musculus
gaggtgaagaacctcctgtacctgt

SEQ ID NO: 659092 - DNA, 25 bp, Mus musculus
gaggtgaagaacgtcctgtacctgt

SEQ ID NO: 659093 - DNA, 25 bp, Mus musculus
gaggtgaagaactacctggcatcta

SEQ ID NO: 659094 - DNA, 25 bp, Mus musculus
gaggtgaagcaaacagaaaattgtg

SEQ ID NO: 659095 - DNA, 25 bp, Mus musculus
gaggtgaagcaatcagaaaattgtg

SEQ ID NO: 659096 - DNA, 25 bp, Mus musculus
gaggtgaagcacctacatcggatgc

SEQ ID NO: 659097 - DNA, 25 bp, Mus musculus
gaggtgaagcacgtacatcggatgc

SEQ ID NO: 659098 - DNA, 25 bp, Mus musculus
gaggtgaagctcaggccgctctttg

SEQ ID NO: 659099 - DNA, 25 bp, Mus musculus
gaggtgaagctcctagctttcaaca

SEQ ID NO: 659100 - DNA, 25 bp, Mus musculus
gaggtgaagctcgtagctttcaaca

SEQ ID NO: 659101 - DNA, 25 bp, Mus musculus
gaggtgaagctctggccgctctttg

SEQ ID NO: 659102 - DNA, 25 bp, Mus musculus
gaggtgacacctattaccaagagcg

SEQ ID NO: 659103 - DNA, 25 bp, Mus musculus
gaggtgacaccttttaccaagagcg

SEQ ID NO: 659104 - DNA, 25 bp, Mus musculus
gaggtgacacttcgaggttccctga

SEQ ID NO: 659105 - DNA, 25 bp, Mus musculus
gaggtgacacttggaggttccctga

SEQ ID NO: 659106 - DNA, 25 bp, Mus musculus
gaggtgacagctagtcactcagggc

SEQ ID NO: 659107 - DNA, 25 bp, Mus musculus
gaggtgacagcttgtcactcagggc

SEQ ID NO: 659108 - DNA, 25 bp, Mus musculus
gaggtgacagtcctaactcacacaa

SEQ ID NO: 659109 - DNA, 25 bp, Mus musculus
gaggtgacagtcgtaactcacacaa

SEQ ID NO: 659110 - DNA, 25 bp, Mus musculus
gaggtgacagtgcaaactcctgcgt

SEQ ID NO: 659111 - DNA, 25 bp, Mus musculus
gaggtgacagtggaaactcctgcgt

SEQ ID NO: 659112 - DNA, 25 bp, Mus musculus
gaggtgaccaaacttatctactgct

SEQ ID NO: 659113 - DNA, 25 bp, Mus musculus
gaggtgaccaaagttatctactgct

SEQ ID NO: 659114 - DNA, 25 bp, Mus musculus
gaggtgaccaacactctgggccaaa

SEQ ID NO: 659115 - DNA, 25 bp, Mus musculus
gaggtgaccaactctctgggccaaa

SEQ ID NO: 659116 - DNA, 25 bp, Mus musculus
gaggtgaccgtgagcgccctatttg

SEQ ID NO: 659117 - DNA, 25 bp, Mus musculus
gaggtgaccgtgtgcgccctatttg

SEQ ID NO: 659118 - DNA, 25 bp, Mus musculus
gaggtgacgcagaggatctatgaca

SEQ ID NO: 659119 - DNA, 25 bp, Mus musculus
gaggtgacgcagtggatctatgaca

SEQ ID NO: 659120 - DNA, 25 bp, Mus musculus
gaggtgacgcctccaaagacgactt

SEQ ID NO: 659121 - DNA, 25 bp, Mus musculus
gaggtgacgcctgcaaagacgactt

SEQ ID NO: 659122 - DNA, 25 bp, Mus musculus
gaggtgactgctaatagccccttgg

SEQ ID NO: 659123 - DNA, 25 bp, Mus musculus
gaggtgactgcttatagccccttgg

SEQ ID NO: 659124 - DNA, 25 bp, Mus musculus
gaggtgataaagacccttctctgaa

SEQ ID NO: 659125 - DNA, 25 bp, Mus musculus
gaggtgataaagtcccttctctgaa

SEQ ID NO: 659126 - DNA, 25 bp, Mus musculus
gaggtgataagacgacaagcaaacc

SEQ ID NO: 659127 - DNA, 25 bp, Mus musculus
gaggtgataagaggacaagcaaacc

SEQ ID NO: 659128 - DNA, 25 bp, Mus musculus
gaggtgatcaagagagcgaatagca

SEQ ID NO: 659129 - DNA, 25 bp, Mus musculus
gaggtgatcaagtgagcgaatagca

SEQ ID NO: 659130 - DNA, 25 bp, Mus musculus
gaggtgatgaaccagaaccctgagt

SEQ ID NO: 659131 - DNA, 25 bp, Mus musculus
gaggtgatgaacgagaaccctgagt

SEQ ID NO: 659132 - DNA, 25 bp, Mus musculus
gaggtgatgctgactactcggatcg

SEQ ID NO: 659133 - DNA, 25 bp, Mus musculus
gaggtgatgctgtctactcggatcg

SEQ ID NO: 659134 - DNA, 25 bp, Mus musculus
gaggtgattcccaacctgatccgaa

SEQ ID NO: 659135 - DNA, 25 bp, Mus musculus
gaggtgattccctacctgatccgaa

SEQ ID NO: 659136 - DNA, 25 bp, Mus musculus
gaggtgcaacacaaacctgaatttg

SEQ ID NO: 659137 - DNA, 25 bp, Mus musculus
gaggtgcaacactaacctgaatttg

SEQ ID NO: 659138 - DNA, 25 bp, Mus musculus
gaggtgcaacatatccgaaccatct

SEQ ID NO: 659139 - DNA, 25 bp, Mus musculus
gaggtgcaacatttccgaaccatct

SEQ ID NO: 659140 - DNA, 25 bp, Mus musculus
gaggtgcacacacctcagacgaaac

SEQ ID NO: 659141 - DNA, 25 bp, Mus musculus
gaggtgcacacagctcagacgaaac

SEQ ID NO: 659142 - DNA, 25 bp, Mus musculus
gaggtgcacctaaggctctttcttt

SEQ ID NO: 659143 - DNA, 25 bp, Mus musculus
gaggtgcacctatggctctttcttt

SEQ ID NO: 659144 - DNA, 25 bp, Mus musculus
gaggtgcagttacacccacactgta

SEQ ID NO: 659145 - DNA, 25 bp, Mus musculus
gaggtgcagttagacccacactgta

SEQ ID NO: 659146 - DNA, 25 bp, Mus musculus
gaggtgcccacactgcagtctctac

SEQ ID NO: 659147 - DNA, 25 bp, Mus musculus
gaggtgcccacagtgcagtctctac

SEQ ID NO: 659148 - DNA, 25 bp, Mus musculus
gaggtgcccaccatctacaggcaaa

SEQ ID NO: 659149 - DNA, 25 bp, Mus musculus
gaggtgcccaccttctacaggcaaa

SEQ ID NO: 659150 - DNA, 25 bp, Mus musculus
gaggtgcccatccaccgagttgcag

SEQ ID NO: 659151 - DNA, 25 bp, Mus musculus
gaggtgcccatcgaccgagttgcag

SEQ ID NO: 659152 - DNA, 25 bp, Mus musculus
gaggtgcccctcctgaaaaagtagg

SEQ ID NO: 659153 - DNA, 25 bp, Mus musculus
gaggtgcccctcgtgaaaaagtagg

SEQ ID NO: 659154 - DNA, 25 bp, Mus musculus
gaggtgcctggcaaactgaccgcac

SEQ ID NO: 659155 - DNA, 25 bp, Mus musculus
gaggtgcctggctaactgaccgcac

SEQ ID NO: 659156 - DNA, 25 bp, Mus musculus
gaggtgcgggcgacatgacgtcacg

SEQ ID NO: 659157 - DNA, 25 bp, Mus musculus
gaggtgcgggcgtcatgacgtcacg

SEQ ID NO: 659158 - DNA, 25 bp, Mus musculus
gaggtgctagccagataaccactgc

SEQ ID NO: 659159 - DNA, 25 bp, Mus musculus
gaggtgctagcctgataaccactgc

SEQ ID NO: 659160 - DNA, 25 bp, Mus musculus
gaggtgctcagcagcacaccctgct

SEQ ID NO: 659161 - DNA, 25 bp, Mus musculus
gaggtgctcagctgcacaccctgct

SEQ ID NO: 659162 - DNA, 25 bp, Mus musculus
gaggtgctcatgcagtttctctaca

SEQ ID NO: 659163 - DNA, 25 bp, Mus musculus
gaggtgctcatggagtttctctaca

SEQ ID NO: 659164 - DNA, 25 bp, Mus musculus
gaggtgctccatctcaggtcaccac

SEQ ID NO: 659165 - DNA, 25 bp, Mus musculus
gaggtgctccatgtcaggtcaccac

SEQ ID NO: 659166 - DNA, 25 bp, Mus musculus
gaggtgctccctacaaaggctcaga

SEQ ID NO: 659167 - DNA, 25 bp, Mus musculus
gaggtgctcccttcaaaggctcaga

SEQ ID NO: 659168 - DNA, 25 bp, Mus musculus
gaggtgctctctacccaatttggaa

SEQ ID NO: 659169 - DNA, 25 bp, Mus musculus
gaggtgctctcttcccaatttggaa

SEQ ID NO: 659170 - DNA, 25 bp, Mus musculus
gaggtgctgaccctgttcaatgtga

SEQ ID NO: 659171 - DNA, 25 bp, Mus musculus
gaggtgctgaccgtgttcaatgtga

SEQ ID NO: 659172 - DNA, 25 bp, Mus musculus
gaggtgctgcagcacaagccgctca

SEQ ID NO: 659173 - DNA, 25 bp, Mus musculus
gaggtgctgcaggacaagccgctca

SEQ ID NO: 659174 - DNA, 25 bp, Mus musculus
gaggtgctgggcaatgaacctgaac

SEQ ID NO: 659175 - DNA, 25 bp, Mus musculus
gaggtgctgggctatgaacctgaac

SEQ ID NO: 659176 - DNA, 25 bp, Mus musculus
gaggtgctggtgatccgactcctga

SEQ ID NO: 659177 - DNA, 25 bp, Mus musculus
gaggtgctggtgttccgactcctga

SEQ ID NO: 659178 - DNA, 25 bp, Mus musculus
gaggtgctgtagaagctgccctgtc

SEQ ID NO: 659179 - DNA, 25 bp, Mus musculus
gaggtgctgtagtagctgccctgtc

SEQ ID NO: 659180 - DNA, 25 bp, Mus musculus
gaggtgcttcatctacggaatgtct

SEQ ID NO: 659181 - DNA, 25 bp, Mus musculus
gaggtgcttcatgtacggaatgtct

SEQ ID NO: 659182 - DNA, 25 bp, Mus musculus
gaggtgcttcgcacctgttcaagcc

SEQ ID NO: 659183 - DNA, 25 bp, Mus musculus
gaggtgcttcgctcctgttcaagcc

SEQ ID NO: 659184 - DNA, 25 bp, Mus musculus
gaggtggaaattatgtgctctcaac

SEQ ID NO: 659185 - DNA, 25 bp, Mus musculus
gaggtggaaattttgtgctctcaac

SEQ ID NO: 659186 - DNA, 25 bp, Mus musculus
gaggtggaagcccaagtatctctgc

SEQ ID NO: 659187 - DNA, 25 bp, Mus musculus
gaggtggaagccgaagtatctctgc

SEQ ID NO: 659188 - DNA, 25 bp, Mus musculus
gaggtggaatccagcatcgcaggca

SEQ ID NO: 659189 - DNA, 25 bp, Mus musculus
gaggtggaatcctgcatcgcaggca

SEQ ID NO: 659190 - DNA, 25 bp, Mus musculus
gaggtggacaccattgaacaggaga

SEQ ID NO: 659191 - DNA, 25 bp, Mus musculus
gaggtggacacctttgaacaggaga

SEQ ID NO: 659192 - DNA, 25 bp, Mus musculus
gaggtggacgtactttttaacatcg

SEQ ID NO: 659193 - DNA, 25 bp, Mus musculus
gaggtggacgtagtttttaacatcg

SEQ ID NO: 659194 - DNA, 25 bp, Mus musculus
gaggtggagctaccgaaattgaatt

SEQ ID NO: 659195 - DNA, 25 bp, Mus musculus
gaggtggagctagcgaaattgaatt

SEQ ID NO: 659196 - DNA, 25 bp, Mus musculus
gaggtggatccaatggtttataaca

SEQ ID NO: 659197 - DNA, 25 bp, Mus musculus
gaggtggatccattggtttataaca

SEQ ID NO: 659198 - DNA, 25 bp, Mus musculus
gaggtggcaagcacccaaggtgaca

SEQ ID NO: 659199 - DNA, 25 bp, Mus musculus
gaggtggcaagctcccaaggtgaca

SEQ ID NO: 659200 - DNA, 25 bp, Mus musculus
gaggtggcatgtccttgccgtcaca

SEQ ID NO: 659201 - DNA, 25 bp, Mus musculus
gaggtggcatgtgcttgccgtcaca

SEQ ID NO: 659202 - DNA, 25 bp, Mus musculus
gaggtggccaaacataaagcaggac

SEQ ID NO: 659203 - DNA, 25 bp, Mus musculus
gaggtggccaaagataaagcaggac

SEQ ID NO: 659204 - DNA, 25 bp, Mus musculus
gaggtggccagcattaggaaagacc

SEQ ID NO: 659205 - DNA, 25 bp, Mus musculus
gaggtggccagctttaggaaagacc

SEQ ID NO: 659206 - DNA, 25 bp, Mus musculus
gaggtggcccagatcgacctgtaca

SEQ ID NO: 659207 - DNA, 25 bp, Mus musculus
gaggtggcccagttcgacctgtaca

SEQ ID NO: 659208 - DNA, 25 bp, Mus musculus
gaggtggccgccagagtacgctccc

SEQ ID NO: 659209 - DNA, 25 bp, Mus musculus
gaggtggccgcctgagtacgctccc

SEQ ID NO: 659210 - DNA, 25 bp, Mus musculus
gaggtggcgttcatcaataactttc

SEQ ID NO: 659211 - DNA, 25 bp, Mus musculus
gaggtggcgttcttcaataactttc

SEQ ID NO: 659212 - DNA, 25 bp, Mus musculus
gaggtggctgctacaatttcttgaa

SEQ ID NO: 659213 - DNA, 25 bp, Mus musculus
gaggtggctgcttcaatttcttgaa

SEQ ID NO: 659214 - DNA, 25 bp, Mus musculus
gaggtgggaccacctcacactgtcc

SEQ ID NO: 659215 - DNA, 25 bp, Mus musculus
gaggtgggaccagctcacactgtcc

SEQ ID NO: 659216 - DNA, 25 bp, Mus musculus
gaggtgggcctcacatacttaatga

SEQ ID NO: 659217 - DNA, 25 bp, Mus musculus
gaggtgggcctctcatacttaatga

SEQ ID NO: 659218 - DNA, 25 bp, Mus musculus
gaggtggtaactatgacagaagcta

SEQ ID NO: 659219 - DNA, 25 bp, Mus musculus
gaggtggtaactttgacagaagcta

SEQ ID NO: 659220 - DNA, 25 bp, Mus musculus
gaggtggtagttctaagtttgtaca

SEQ ID NO: 659221 - DNA, 25 bp, Mus musculus
gaggtggtagttgtaagtttgtaca

SEQ ID NO: 659222 - DNA, 25 bp, Mus musculus
gaggtggtccagaacctcactggcc

SEQ ID NO: 659223 - DNA, 25 bp, Mus musculus
gaggtggtccagtacctcactggcc

SEQ ID NO: 659224 - DNA, 25 bp, Mus musculus
gaggtggtccttctttgccggcctc

SEQ ID NO: 659225 - DNA, 25 bp, Mus musculus
gaggtggtccttgtttgccggcctc

SEQ ID NO: 659226 - DNA, 25 bp, Mus musculus
gaggtggtctacaagctctccctaa

SEQ ID NO: 659227 - DNA, 25 bp, Mus musculus
gaggtggtctactagctctccctaa

SEQ ID NO: 659228 - DNA, 25 bp, Mus musculus
gaggtggtggctacactgtccgaaa

SEQ ID NO: 659229 - DNA, 25 bp, Mus musculus
gaggtggtggcttcactgtccgaaa

SEQ ID NO: 659230 - DNA, 25 bp, Mus musculus
gaggtggtttgcacttccgttgccc

SEQ ID NO: 659231 - DNA, 25 bp, Mus musculus
gaggtggtttgctcttccgttgccc

SEQ ID NO: 659232 - DNA, 25 bp, Mus musculus
gaggtgtacagtactgaggcctgta

SEQ ID NO: 659233 - DNA, 25 bp, Mus musculus
gaggtgtacagttctgaggcctgta

SEQ ID NO: 659234 - DNA, 25 bp, Mus musculus
gaggtgtacctccagacgctcctca

SEQ ID NO: 659235 - DNA, 25 bp, Mus musculus
gaggtgtacctcgagacgctcctca

SEQ ID NO: 659236 - DNA, 25 bp, Mus musculus
gaggtgtaccttcccacttgcctga

SEQ ID NO: 659237 - DNA, 25 bp, Mus musculus
gaggtgtaccttgccacttgcctga

SEQ ID NO: 659238 - DNA, 25 bp, Mus musculus
gaggtgtattccctacttaaggagc

SEQ ID NO: 659239 - DNA, 25 bp, Mus musculus
gaggtgtattccgtacttaaggagc

SEQ ID NO: 659240 - DNA, 25 bp, Mus musculus
gaggtgtcccacatcacagcagagt

SEQ ID NO: 659241 - DNA, 25 bp, Mus musculus
gaggtgtcccacttcacagcagagt

SEQ ID NO: 659242 - DNA, 25 bp, Mus musculus
gaggtgtccgtacaaaagtccacca

SEQ ID NO: 659243 - DNA, 25 bp, Mus musculus
gaggtgtccgtagaaaagtccacca

SEQ ID NO: 659244 - DNA, 25 bp, Mus musculus
gaggtgtccgtcactcctccagcgg

SEQ ID NO: 659245 - DNA, 25 bp, Mus musculus
gaggtgtccgtctctcctccagcgg

SEQ ID NO: 659246 - DNA, 25 bp, Mus musculus
gaggtgtcgaatcatccggcattca

SEQ ID NO: 659247 - DNA, 25 bp, Mus musculus
gaggtgtcgaatgatccggcattca

SEQ ID NO: 659248 - DNA, 25 bp, Mus musculus
gaggtgtctcgtccaatagaccacg

SEQ ID NO: 659249 - DNA, 25 bp, Mus musculus
gaggtgtctcgtgcaatagaccacg

SEQ ID NO: 659250 - DNA, 25 bp, Mus musculus
gaggtgtgcggcactactacatcgg

SEQ ID NO: 659251 - DNA, 25 bp, Mus musculus
gaggtgtgcggctctactacatcgg

SEQ ID NO: 659252 - DNA, 25 bp, Mus musculus
gaggtgtgctctacagtctagagga

SEQ ID NO: 659253 - DNA, 25 bp, Mus musculus
gaggtgtgctcttcagtctagagga

SEQ ID NO: 659254 - DNA, 25 bp, Mus musculus
gaggtgtggaccacggctatcagca

SEQ ID NO: 659255 - DNA, 25 bp, Mus musculus
gaggtgtggacctcggctatcagca

SEQ ID NO: 659256 - DNA, 25 bp, Mus musculus
gaggtgtgggtcacaaaaggattta

SEQ ID NO: 659257 - DNA, 25 bp, Mus musculus
gaggtgtgggtctcaaaaggattta

SEQ ID NO: 659258 - DNA, 25 bp, Mus musculus
gaggtgtgtcatcaccttaacgctg

SEQ ID NO: 659259 - DNA, 25 bp, Mus musculus
gaggtgtgtcatgaccttaacgctg

SEQ ID NO: 659260 - DNA, 25 bp, Mus musculus
gaggtgtgtgagacagctgatgaca

SEQ ID NO: 659261 - DNA, 25 bp, Mus musculus
gaggtgtgtgagtcagctgatgaca

SEQ ID NO: 659262 - DNA, 25 bp, Mus musculus
gaggtgttacttaccgggagcagcc

SEQ ID NO: 659263 - DNA, 25 bp, Mus musculus
gaggtgttactttccgggagcagcc

SEQ ID NO: 659264 - DNA, 25 bp, Mus musculus
gaggtgttcaggatccaaatgtccc

SEQ ID NO: 659265 - DNA, 25 bp, Mus musculus
gaggtgttcaggttccaaatgtccc

SEQ ID NO: 659266 - DNA, 25 bp, Mus musculus
gaggttaaccttcaactacagagcg

SEQ ID NO: 659267 - DNA, 25 bp, Mus musculus
gaggttaaccttgaactacagagcg

SEQ ID NO: 659268 - DNA, 25 bp, Mus musculus
gaggttacaactagcagtgtcagaa

SEQ ID NO: 659269 - DNA, 25 bp, Mus musculus
gaggttacaacttgcagtgtcagaa

SEQ ID NO: 659270 - DNA, 25 bp, Mus musculus
gaggttacagccactacacaggagg

SEQ ID NO: 659271 - DNA, 25 bp, Mus musculus
gaggttacagcctctacacaggagg

SEQ ID NO: 659272 - DNA, 25 bp, Mus musculus
gaggttacagctaacatccatgtgg

SEQ ID NO: 659273 - DNA, 25 bp, Mus musculus
gaggttacagcttacatccatgtgg

SEQ ID NO: 659274 - DNA, 25 bp, Mus musculus
gaggttacctcaactgaagtgtcag

SEQ ID NO: 659275 - DNA, 25 bp, Mus musculus
gaggttacctcatctgaagtgtcag

SEQ ID NO: 659276 - DNA, 25 bp, Mus musculus
gaggttacgctgagctctgaacaag

SEQ ID NO: 659277 - DNA, 25 bp, Mus musculus
gaggttacgctgtgctctgaacaag

SEQ ID NO: 659278 - DNA, 25 bp, Mus musculus
gaggttagcatacccagccactaga

SEQ ID NO: 659279 - DNA, 25 bp, Mus musculus
gaggttagcatagccagccactaga

SEQ ID NO: 659280 - DNA, 25 bp, Mus musculus
gaggttagtctgaaatcagtggcca

SEQ ID NO: 659281 - DNA, 25 bp, Mus musculus
gaggttagtctgtaatcagtggcca

SEQ ID NO: 659282 - DNA, 25 bp, Mus musculus
gaggttagtttcacagcagcacagg

SEQ ID NO: 659283 - DNA, 25 bp, Mus musculus
gaggttagtttctcagcagcacagg

SEQ ID NO: 659284 - DNA, 25 bp, Mus musculus
gaggttataccaacctttgacatgg

SEQ ID NO: 659285 - DNA, 25 bp, Mus musculus
gaggttataccatcctttgacatgg

SEQ ID NO: 659286 - DNA, 25 bp, Mus musculus
gaggttatcaagcagtcggcctatg

SEQ ID NO: 659287 - DNA, 25 bp, Mus musculus
gaggttatcaaggagtcggcctatg

SEQ ID NO: 659288 - DNA, 25 bp, Mus musculus
gaggttatgaccatcctgtgtcgct

SEQ ID NO: 659289 - DNA, 25 bp, Mus musculus
gaggttatgaccttcctgtgtcgct

SEQ ID NO: 659290 - DNA, 25 bp, Mus musculus
gaggttattgcgctgacagccgtca

SEQ ID NO: 659291 - DNA, 25 bp, Mus musculus
gaggttattgcggtgacagccgtca

SEQ ID NO: 659292 - DNA, 25 bp, Mus musculus
gaggttatttctctgtagtgtggac

SEQ ID NO: 659293 - DNA, 25 bp, Mus musculus
gaggttatttctgtgtagtgtggac

SEQ ID NO: 659294 - DNA, 25 bp, Mus musculus
gaggttatttggaattgctgataag

SEQ ID NO: 659295 - DNA, 25 bp, Mus musculus
gaggttatttggtattgctgataag

SEQ ID NO: 659296 - DNA, 25 bp, Mus musculus
gaggttcaaacaatcttccactgac

SEQ ID NO: 659297 - DNA, 25 bp, Mus musculus
gaggttcaaacattcttccactgac

SEQ ID NO: 659298 - DNA, 25 bp, Mus musculus
gaggttcacaaaacgagtgtagtag

SEQ ID NO: 659299 - DNA, 25 bp, Mus musculus
gaggttcacaaatcgagtgtagtag

SEQ ID NO: 659300 - DNA, 25 bp, Mus musculus
gaggttcacagaaattccacgtcta

SEQ ID NO: 659301 - DNA, 25 bp, Mus musculus
gaggttcacagatattccacgtcta

SEQ ID NO: 659302 - DNA, 25 bp, Mus musculus
gaggttcagggaaagacactctcca

SEQ ID NO: 659303 - DNA, 25 bp, Mus musculus
gaggttcagggatagacactctcca

SEQ ID NO: 659304 - DNA, 25 bp, Mus musculus
gaggttcatggaccaagcctcccag

SEQ ID NO: 659305 - DNA, 25 bp, Mus musculus
gaggttcatggagcaagcctcccag

SEQ ID NO: 659306 - DNA, 25 bp, Mus musculus
gaggttccacttaccttagctctgc

SEQ ID NO: 659307 - DNA, 25 bp, Mus musculus
gaggttccactttccttagctctgc

SEQ ID NO: 659308 - DNA, 25 bp, Mus musculus
gaggttcgccttcgcagtttgatcg

SEQ ID NO: 659309 - DNA, 25 bp, Mus musculus
gaggttcgccttggcagtttgatcg

SEQ ID NO: 659310 - DNA, 25 bp, Mus musculus
gaggttcgggcactcgcctgtctaa

SEQ ID NO: 659311 - DNA, 25 bp, Mus musculus
gaggttcgggcagtcgcctgtctaa

SEQ ID NO: 659312 - DNA, 25 bp, Mus musculus
gaggttctagtaaaattgcccacgg

SEQ ID NO: 659313 - DNA, 25 bp, Mus musculus
gaggttctagtataattgcccacgg

SEQ ID NO: 659314 - DNA, 25 bp, Mus musculus
gaggttctcagaccccaggtccagg

SEQ ID NO: 659315 - DNA, 25 bp, Mus musculus
gaggttctcagagcccaggtccagg

SEQ ID NO: 659316 - DNA, 25 bp, Mus musculus
gaggttctctatattcggaatgtaa

SEQ ID NO: 659317 - DNA, 25 bp, Mus musculus
gaggttctctattttcggaatgtaa

SEQ ID NO: 659318 - DNA, 25 bp, Mus musculus
gaggttcttcaccaagctggaccag

SEQ ID NO: 659319 - DNA, 25 bp, Mus musculus
gaggttcttcacgaagctggaccag

SEQ ID NO: 659320 - DNA, 25 bp, Mus musculus
gaggttgaactactacagctccaga

SEQ ID NO: 659321 - DNA, 25 bp, Mus musculus
gaggttgaactagtacagctccaga

SEQ ID NO: 659322 - DNA, 25 bp, Mus musculus
gaggttgaccctacatatatcaaga

SEQ ID NO: 659323 - DNA, 25 bp, Mus musculus
gaggttgacccttcatatatcaaga

SEQ ID NO: 659324 - DNA, 25 bp, Mus musculus
gaggttgacgtaagtctgcagagaa

SEQ ID NO: 659325 - DNA, 25 bp, Mus musculus
gaggttgacgtatgtctgcagagaa

SEQ ID NO: 659326 - DNA, 25 bp, Mus musculus
gaggttgactatactgaaaagctca

SEQ ID NO: 659327 - DNA, 25 bp, Mus musculus
gaggttgactattctgaaaagctca

SEQ ID NO: 659328 - DNA, 25 bp, Mus musculus
gaggttgagcttagacgattccaga

SEQ ID NO: 659329 - DNA, 25 bp, Mus musculus
gaggttgagctttgacgattccaga

SEQ ID NO: 659330 - DNA, 25 bp, Mus musculus
gaggttgaggtcagtttttagttca

SEQ ID NO: 659331 - DNA, 25 bp, Mus musculus
gaggttgaggtctgtttttagttca

SEQ ID NO: 659332 - DNA, 25 bp, Mus musculus
gaggttgcatccagactcttcagat

SEQ ID NO: 659333 - DNA, 25 bp, Mus musculus
gaggttgcatcctgactcttcagat

SEQ ID NO: 659334 - DNA, 25 bp, Mus musculus
gaggttgccagtcactcttcaaagc

SEQ ID NO: 659335 - DNA, 25 bp, Mus musculus
gaggttgccagtgactcttcaaagc

SEQ ID NO: 659336 - DNA, 25 bp, Mus musculus
gaggttgcccacacgcttactgaga

SEQ ID NO: 659337 - DNA, 25 bp, Mus musculus
gaggttgcccactcgcttactgaga

SEQ ID NO: 659338 - DNA, 25 bp, Mus musculus
gaggttgccgatatctgcgctacaa

SEQ ID NO: 659339 - DNA, 25 bp, Mus musculus
gaggttgccgatttctgcgctacaa

SEQ ID NO: 659340 - DNA, 25 bp, Mus musculus
gaggttgctcctcactccatgatcc

SEQ ID NO: 659341 - DNA, 25 bp, Mus musculus
gaggttgctcctgactccatgatcc

SEQ ID NO: 659342 - DNA, 25 bp, Mus musculus
gaggttgctgctactgccatcctga

SEQ ID NO: 659343 - DNA, 25 bp, Mus musculus
gaggttgctgcttctgccatcctga

SEQ ID NO: 659344 - DNA, 25 bp, Mus musculus
gaggttggatccacagcagggctcc

SEQ ID NO: 659345 - DNA, 25 bp, Mus musculus
gaggttggatcctcagcagggctcc

SEQ ID NO: 659346 - DNA, 25 bp, Mus musculus
gaggttggcgaaaccccattcattc

SEQ ID NO: 659347 - DNA, 25 bp, Mus musculus
gaggttggcgaatccccattcattc

SEQ ID NO: 659348 - DNA, 25 bp, Mus musculus
gaggttggcgagagtcatgtattac

SEQ ID NO: 659349 - DNA, 25 bp, Mus musculus
gaggttggcgagtgtcatgtattac

SEQ ID NO: 659350 - DNA, 25 bp, Mus musculus
gaggttggcttgactcagtatttgg

SEQ ID NO: 659351 - DNA, 25 bp, Mus musculus
gaggttggcttgtctcagtatttgg

SEQ ID NO: 659352 - DNA, 25 bp, Mus musculus
gaggttgtagaaagctctgcaggtt

SEQ ID NO: 659353 - DNA, 25 bp, Mus musculus
gaggttgtagaatgctctgcaggtt

SEQ ID NO: 659354 - DNA, 25 bp, Mus musculus
gaggttgtagcactttccataatgg

SEQ ID NO: 659355 - DNA, 25 bp, Mus musculus
gaggttgtagcagtttccataatgg

SEQ ID NO: 659356 - DNA, 25 bp, Mus musculus
gaggttgtcgccagaatcaaggcac

SEQ ID NO: 659357 - DNA, 25 bp, Mus musculus
gaggttgtcgcctgaatcaaggcac

SEQ ID NO: 659358 - DNA, 25 bp, Mus musculus
gaggttgtgacgctacccatcccca

SEQ ID NO: 659359 - DNA, 25 bp, Mus musculus
gaggttgtgacggtacccatcccca

SEQ ID NO: 659360 - DNA, 25 bp, Mus musculus
gaggttgtgagtcagtctagtccca

SEQ ID NO: 659361 - DNA, 25 bp, Mus musculus
gaggttgtgagtgagtctagtccca

SEQ ID NO: 659362 - DNA, 25 bp, Mus musculus
gaggttgttgtgactctcttaccag

SEQ ID NO: 659363 - DNA, 25 bp, Mus musculus
gaggttgttgtgtctctcttaccag

SEQ ID NO: 659364 - DNA, 25 bp, Mus musculus
gaggttgtttgaccaacagctctcc

SEQ ID NO: 659365 - DNA, 25 bp, Mus musculus
gaggttgtttgagcaacagctctcc

SEQ ID NO: 659366 - DNA, 25 bp, Mus musculus
gaggttttcataccgattgcccgat

SEQ ID NO: 659367 - DNA, 25 bp, Mus musculus
gaggttttcatagcgattgcccgat

SEQ ID NO: 659368 - DNA, 25 bp, Mus musculus
gaggttttctgaagcttgctactta

SEQ ID NO: 659369 - DNA, 25 bp, Mus musculus
gaggttttctgatgcttgctactta

SEQ ID NO: 659370 - DNA, 25 bp, Mus musculus
gaggttttgtttcctgtaggtcaga

SEQ ID NO: 659371 - DNA, 25 bp, Mus musculus
gaggttttgtttgctgtaggtcaga

SEQ ID NO: 659372 - DNA, 25 bp, Mus musculus
gaggtttttcgactttttgacaatg

SEQ ID NO: 659373 - DNA, 25 bp, Mus musculus
gaggtttttcgagtttttgacaatg

SEQ ID NO: 659374 - DNA, 25 bp, Mus musculus
gagtaaaacaggaaagcccagagcc

SEQ ID NO: 659375 - DNA, 25 bp, Mus musculus
gagtaaaacaggtaagcccagagcc

SEQ ID NO: 659376 - DNA, 25 bp, Mus musculus
gagtaaaagctgcagactctctgat

SEQ ID NO: 659377 - DNA, 25 bp, Mus musculus
gagtaaaagctggagactctctgat

SEQ ID NO: 659378 - DNA, 25 bp, Mus musculus
gagtaaaaggctcgacctggtaaag

SEQ ID NO: 659379 - DNA, 25 bp, Mus musculus
gagtaaaaggctggacctggtaaag

SEQ ID NO: 659380 - DNA, 25 bp, Mus musculus
gagtaaacgcataccgatctacgag

SEQ ID NO: 659381 - DNA, 25 bp, Mus musculus
gagtaaacgcattccgatctacgag

SEQ ID NO: 659382 - DNA, 25 bp, Mus musculus
gagtaaagaaggagacaacgtggac

SEQ ID NO: 659383 - DNA, 25 bp, Mus musculus
gagtaaagaaggtgacaacgtggac

SEQ ID NO: 659384 - DNA, 25 bp, Mus musculus
gagtaaagcaaccaattgcagaaat

SEQ ID NO: 659385 - DNA, 25 bp, Mus musculus
gagtaaagcaacgaattgcagaaat

SEQ ID NO: 659386 - DNA, 25 bp, Mus musculus
gagtaaagccctacgctcgaatgga

SEQ ID NO: 659387 - DNA, 25 bp, Mus musculus
gagtaaagcccttcgctcgaatgga

SEQ ID NO: 659388 - DNA, 25 bp, Mus musculus
gagtaaaggccgcatgtgccaccac

SEQ ID NO: 659389 - DNA, 25 bp, Mus musculus
gagtaaaggccggatgtgccaccac

SEQ ID NO: 659390 - DNA, 25 bp, Mus musculus
gagtaaatgctcaagctgctgcgta

SEQ ID NO: 659391 - DNA, 25 bp, Mus musculus
gagtaaatgctctagctgctgcgta

SEQ ID NO: 659392 - DNA, 25 bp, Mus musculus
gagtaaatgttacccaaaagattca

SEQ ID NO: 659393 - DNA, 25 bp, Mus musculus
gagtaaatgttagccaaaagattca

SEQ ID NO: 659394 - DNA, 25 bp, Mus musculus
gagtaaattctaaaacgagtctgcc

SEQ ID NO: 659395 - DNA, 25 bp, Mus musculus
gagtaaattctataacgagtctgcc

SEQ ID NO: 659396 - DNA, 25 bp, Mus musculus
gagtaacaacctaatcatcattgag

SEQ ID NO: 659397 - DNA, 25 bp, Mus musculus
gagtaacaaccttatcatcattgag

SEQ ID NO: 659398 - DNA, 25 bp, Mus musculus
gagtaacaagtaagaccctcctttg

SEQ ID NO: 659399 - DNA, 25 bp, Mus musculus
gagtaacaagtatgaccctcctttg

SEQ ID NO: 659400 - DNA, 25 bp, Mus musculus
gagtaacatttgacagccaacagag

SEQ ID NO: 659401 - DNA, 25 bp, Mus musculus
gagtaacatttgtcagccaacagag

SEQ ID NO: 659402 - DNA, 25 bp, Mus musculus
gagtaaccacgtctacctggaaggg

SEQ ID NO: 659403 - DNA, 25 bp, Mus musculus
gagtaaccacgtgtacctggaaggg

SEQ ID NO: 659404 - DNA, 25 bp, Mus musculus
gagtaaccagacatccaaaccactg

SEQ ID NO: 659405 - DNA, 25 bp, Mus musculus
gagtaaccagacttccaaaccactg

SEQ ID NO: 659406 - DNA, 25 bp, Mus musculus
gagtaaccagtcactggaccatcgc

SEQ ID NO: 659407 - DNA, 25 bp, Mus musculus
gagtaaccagtctctggaccatcgc

SEQ ID NO: 659408 - DNA, 25 bp, Mus musculus
gagtaaccccagcataatagtctta

SEQ ID NO: 659409 - DNA, 25 bp, Mus musculus
gagtaaccccaggataatagtctta

SEQ ID NO: 659410 - DNA, 25 bp, Mus musculus
gagtaaccctcaagaacggcgcact

SEQ ID NO: 659411 - DNA, 25 bp, Mus musculus
gagtaaccctcatgaacggcgcact

SEQ ID NO: 659412 - DNA, 25 bp, Mus musculus
gagtaaccgcttcctaaaccatttg

SEQ ID NO: 659413 - DNA, 25 bp, Mus musculus
gagtaaccgcttgctaaaccatttg

SEQ ID NO: 659414 - DNA, 25 bp, Mus musculus
gagtaactaaggactgcaccttgct

SEQ ID NO: 659415 - DNA, 25 bp, Mus musculus
gagtaactaaggtctgcaccttgct

SEQ ID NO: 659416 - DNA, 25 bp, Mus musculus
gagtaactaccaaaactagtcaagt

SEQ ID NO: 659417 - DNA, 25 bp, Mus musculus
gagtaactaccataactagtcaagt

SEQ ID NO: 659418 - DNA, 25 bp, Mus musculus
gagtaactcgtcctcatccactggg

SEQ ID NO: 659419 - DNA, 25 bp, Mus musculus
gagtaactcgtcgtcatccactggg

SEQ ID NO: 659420 - DNA, 25 bp, Mus musculus
gagtaactggttacacatagtgact

SEQ ID NO: 659421 - DNA, 25 bp, Mus musculus
gagtaactggtttcacatagtgact

SEQ ID NO: 659422 - DNA, 25 bp, Mus musculus
gagtaactgtgacgtgcctcggccc

SEQ ID NO: 659423 - DNA, 25 bp, Mus musculus
gagtaactgtgaggtgcctcggccc

SEQ ID NO: 659424 - DNA, 25 bp, Mus musculus
gagtaactgttgcaccatcgtcaca

SEQ ID NO: 659425 - DNA, 25 bp, Mus musculus
gagtaactgttggaccatcgtcaca

SEQ ID NO: 659426 - DNA, 25 bp, Mus musculus
gagtaacttctacgcacaatacaaa

SEQ ID NO: 659427 - DNA, 25 bp, Mus musculus
gagtaacttctaggcacaatacaaa

SEQ ID NO: 659428 - DNA, 25 bp, Mus musculus
gagtaagaccccagtctccgcagga

SEQ ID NO: 659429 - DNA, 25 bp, Mus musculus
gagtaagacccctgtctccgcagga

SEQ ID NO: 659430 - DNA, 25 bp, Mus musculus
gagtaagaggcactgctctccgcag

SEQ ID NO: 659431 - DNA, 25 bp, Mus musculus
gagtaagaggcagtgctctccgcag

SEQ ID NO: 659432 - DNA, 25 bp, Mus musculus
gagtaagcaccgctcagaaaatgaa

SEQ ID NO: 659433 - DNA, 25 bp, Mus musculus
gagtaagcaccggtcagaaaatgaa

SEQ ID NO: 659434 - DNA, 25 bp, Mus musculus
gagtaagcaggcatgcctcaagagg

SEQ ID NO: 659435 - DNA, 25 bp, Mus musculus
gagtaagcaggcttgcctcaagagg

SEQ ID NO: 659436 - DNA, 25 bp, Mus musculus
gagtaagctggacgccctacagaaa

SEQ ID NO: 659437 - DNA, 25 bp, Mus musculus
gagtaagctggaggccctacagaaa

SEQ ID NO: 659438 - DNA, 25 bp, Mus musculus
gagtaaggaaagaccctttgctgtt

SEQ ID NO: 659439 - DNA, 25 bp, Mus musculus
gagtaaggaaagtccctttgctgtt

SEQ ID NO: 659440 - DNA, 25 bp, Mus musculus
gagtaaggcagaacttcgcgccgaa

SEQ ID NO: 659441 - DNA, 25 bp, Mus musculus
gagtaaggcagatcttcgcgccgaa

SEQ ID NO: 659442 - DNA, 25 bp, Mus musculus
gagtaaggcattattctggtgtact

SEQ ID NO: 659443 - DNA, 25 bp, Mus musculus
gagtaaggcatttttctggtgtact

SEQ ID NO: 659444 - DNA, 25 bp, Mus musculus
gagtaaggtgagcagtactcaccag

SEQ ID NO: 659445 - DNA, 25 bp, Mus musculus
gagtaaggtgaggagtactcaccag

SEQ ID NO: 659446 - DNA, 25 bp, Mus musculus
gagtaagtaaccagcctccgaaggt

SEQ ID NO: 659447 - DNA, 25 bp, Mus musculus
gagtaagtaacctgcctccgaaggt

SEQ ID NO: 659448 - DNA, 25 bp, Mus musculus
gagtaagtcaaaagcaattctgtct

SEQ ID NO: 659449 - DNA, 25 bp, Mus musculus
gagtaagtcaaatgcaattctgtct

SEQ ID NO: 659450 - DNA, 25 bp, Mus musculus
gagtaatatcgccaagctgcagcta

SEQ ID NO: 659451 - DNA, 25 bp, Mus musculus
gagtaatatcgcgaagctgcagcta

SEQ ID NO: 659452 - DNA, 25 bp, Mus musculus
gagtaatccttaccaataatattgc

SEQ ID NO: 659453 - DNA, 25 bp, Mus musculus
gagtaatccttagcaataatattgc

SEQ ID NO: 659454 - DNA, 25 bp, Mus musculus
gagtaatcctttcccagaatgtgta

SEQ ID NO: 659455 - DNA, 25 bp, Mus musculus
gagtaatcctttgccagaatgtgta

SEQ ID NO: 659456 - DNA, 25 bp, Mus musculus
gagtaatcttttcaggaatcggaag

SEQ ID NO: 659457 - DNA, 25 bp, Mus musculus
gagtaatcttttgaggaatcggaag

SEQ ID NO: 659458 - DNA, 25 bp, Mus musculus
gagtaatgagccacggctaaaggac

SEQ ID NO: 659459 - DNA, 25 bp, Mus musculus
gagtaatgagcctcggctaaaggac

SEQ ID NO: 659460 - DNA, 25 bp, Mus musculus
gagtaatgccctagacatgccgagg

SEQ ID NO: 659461 - DNA, 25 bp, Mus musculus
gagtaatgcccttgacatgccgagg

SEQ ID NO: 659462 - DNA, 25 bp, Mus musculus
gagtaatgcggaccagcacgcagat

SEQ ID NO: 659463 - DNA, 25 bp, Mus musculus
gagtaatgcggagcagcacgcagat

SEQ ID NO: 659464 - DNA, 25 bp, Mus musculus
gagtaattatttaccaaagggtgag

SEQ ID NO: 659465 - DNA, 25 bp, Mus musculus
gagtaattattttccaaagggtgag

SEQ ID NO: 659466 - DNA, 25 bp, Mus musculus
gagtacaaaaacatcagcttcacag

SEQ ID NO: 659467 - DNA, 25 bp, Mus musculus
gagtacaaaaacttcagcttcacag

SEQ ID NO: 659468 - DNA, 25 bp, Mus musculus
gagtacaaccccaatgcttggaacc

SEQ ID NO: 659469 - DNA, 25 bp, Mus musculus
gagtacaacccctatgcttggaacc

SEQ ID NO: 659470 - DNA, 25 bp, Mus musculus
gagtacaatggcctgttggtaaaaa

SEQ ID NO: 659471 - DNA, 25 bp, Mus musculus
gagtacaatggcgtgttggtaaaaa

SEQ ID NO: 659472 - DNA, 25 bp, Mus musculus
gagtacacacaacgccaggtgggca

SEQ ID NO: 659473 - DNA, 25 bp, Mus musculus
gagtacacacaaggccaggtgggca

SEQ ID NO: 659474 - DNA, 25 bp, Mus musculus
gagtacacacacaacgacgagaaga

SEQ ID NO: 659475 - DNA, 25 bp, Mus musculus
gagtacacacactacgacgagaaga

SEQ ID NO: 659476 - DNA, 25 bp, Mus musculus
gagtacacagccctgtccaggcaac

SEQ ID NO: 659477 - DNA, 25 bp, Mus musculus
gagtacacagccgtgtccaggcaac

SEQ ID NO: 659478 - DNA, 25 bp, Mus musculus
gagtacaccgtcatggaccagaaag

SEQ ID NO: 659479 - DNA, 25 bp, Mus musculus
gagtacaccgtcttggaccagaaag

SEQ ID NO: 659480 - DNA, 25 bp, Mus musculus
gagtacacctgcctggcgggcaatt

SEQ ID NO: 659481 - DNA, 25 bp, Mus musculus
gagtacacctgcgtggcgggcaatt

SEQ ID NO: 659482 - DNA, 25 bp, Mus musculus
gagtacacctggcacataaagctgg

SEQ ID NO: 659483 - DNA, 25 bp, Mus musculus
gagtacacctgggacataaagctgg

SEQ ID NO: 659484 - DNA, 25 bp, Mus musculus
gagtacacggtgctggacgaatcct

SEQ ID NO: 659485 - DNA, 25 bp, Mus musculus
gagtacacggtggtggacgaatcct

SEQ ID NO: 659486 - DNA, 25 bp, Mus musculus
gagtacactgatagccctggaccat

SEQ ID NO: 659487 - DNA, 25 bp, Mus musculus
gagtacactgattgccctggaccat

SEQ ID NO: 659488 - DNA, 25 bp, Mus musculus
gagtacagagatctgtacacctgcc

SEQ ID NO: 659489 - DNA, 25 bp, Mus musculus
gagtacagagatgtgtacacctgcc

SEQ ID NO: 659490 - DNA, 25 bp, Mus musculus
gagtacagcaccatcaacttctgga

SEQ ID NO: 659491 - DNA, 25 bp, Mus musculus
gagtacagcaccttcaacttctgga

SEQ ID NO: 659492 - DNA, 25 bp, Mus musculus
gagtacaggaacaactccttaaact

SEQ ID NO: 659493 - DNA, 25 bp, Mus musculus
gagtacaggaactactccttaaact

SEQ ID NO: 659494 - DNA, 25 bp, Mus musculus
gagtacaggcagcactcgggcaaaa

SEQ ID NO: 659495 - DNA, 25 bp, Mus musculus
gagtacaggcaggactcgggcaaaa

SEQ ID NO: 659496 - DNA, 25 bp, Mus musculus
gagtacatagcaccagaaaagattg

SEQ ID NO: 659497 - DNA, 25 bp, Mus musculus
gagtacatagcagcagaaaagattg

SEQ ID NO: 659498 - DNA, 25 bp, Mus musculus
gagtacatcagtcattgctgtcacc

SEQ ID NO: 659499 - DNA, 25 bp, Mus musculus
gagtacatcagtgattgctgtcacc

SEQ ID NO: 659500 - DNA, 25 bp, Mus musculus
gagtacatcataaacaggaataaga

SEQ ID NO: 659501 - DNA, 25 bp, Mus musculus
gagtacatcatatacaggaataaga

SEQ ID NO: 659502 - DNA, 25 bp, Mus musculus
gagtacatccataagacaggccagt

SEQ ID NO: 659503 - DNA, 25 bp, Mus musculus
gagtacatccattagacaggccagt

SEQ ID NO: 659504 - DNA, 25 bp, Mus musculus
gagtacatgcttaacgccatcccca

SEQ ID NO: 659505 - DNA, 25 bp, Mus musculus
gagtacatgctttacgccatcccca

SEQ ID NO: 659506 - DNA, 25 bp, Mus musculus
gagtacatgggtatgaccaagagga

SEQ ID NO: 659507 - DNA, 25 bp, Mus musculus
gagtacatgggtttgaccaagagga

SEQ ID NO: 659508 - DNA, 25 bp, Mus musculus
gagtacattgatcgcattgccatac

SEQ ID NO: 659509 - DNA, 25 bp, Mus musculus
gagtacattgatggcattgccatac

SEQ ID NO: 659510 - DNA, 25 bp, Mus musculus
gagtaccaaactagcagggcccata

SEQ ID NO: 659511 - DNA, 25 bp, Mus musculus
gagtaccaaacttgcagggcccata

SEQ ID NO: 659512 - DNA, 25 bp, Mus musculus
gagtaccactgtcgagaccctcagt

SEQ ID NO: 659513 - DNA, 25 bp, Mus musculus
gagtaccactgtggagaccctcagt

SEQ ID NO: 659514 - DNA, 25 bp, Mus musculus
gagtaccagacaaacaagcaagaag

SEQ ID NO: 659515 - DNA, 25 bp, Mus musculus
gagtaccagacatacaagcaagaag

SEQ ID NO: 659516 - DNA, 25 bp, Mus musculus
gagtaccagactatcccacttaata

SEQ ID NO: 659517 - DNA, 25 bp, Mus musculus
gagtaccagactttcccacttaata

SEQ ID NO: 659518 - DNA, 25 bp, Mus musculus
gagtaccagatgcacttccacccat

SEQ ID NO: 659519 - DNA, 25 bp, Mus musculus
gagtaccagatggacttccacccat

SEQ ID NO: 659520 - DNA, 25 bp, Mus musculus
gagtaccagcctatcgctgggaaga

SEQ ID NO: 659521 - DNA, 25 bp, Mus musculus
gagtaccagcctttcgctgggaaga

SEQ ID NO: 659522 - DNA, 25 bp, Mus musculus
gagtacccactgacagctatgaccc

SEQ ID NO: 659523 - DNA, 25 bp, Mus musculus
gagtacccactgtcagctatgaccc

SEQ ID NO: 659524 - DNA, 25 bp, Mus musculus
gagtacccatacacacacttgccat

SEQ ID NO: 659525 - DNA, 25 bp, Mus musculus
gagtacccatactcacacttgccat

SEQ ID NO: 659526 - DNA, 25 bp, Mus musculus
gagtacccatatctaatctccctgg

SEQ ID NO: 659527 - DNA, 25 bp, Mus musculus
gagtacccatatgtaatctccctgg

SEQ ID NO: 659528 - DNA, 25 bp, Mus musculus
gagtacccgggtacagcaccgcctt

SEQ ID NO: 659529 - DNA, 25 bp, Mus musculus
gagtacccgggttcagcaccgcctt

SEQ ID NO: 659530 - DNA, 25 bp, Mus musculus
gagtaccgctggcacatcaacttca

SEQ ID NO: 659531 - DNA, 25 bp, Mus musculus
gagtaccgctgggacatcaacttca

SEQ ID NO: 659532 - DNA, 25 bp, Mus musculus
gagtaccgctttaacaagcagctca

SEQ ID NO: 659533 - DNA, 25 bp, Mus musculus
gagtaccgcttttacaagcagctca

SEQ ID NO: 659534 - DNA, 25 bp, Mus musculus
gagtaccggtttcttcctgatcaga

SEQ ID NO: 659535 - DNA, 25 bp, Mus musculus
gagtaccggtttgttcctgatcaga

SEQ ID NO: 659536 - DNA, 25 bp, Mus musculus
gagtaccgtttcactgtacgcacca

SEQ ID NO: 659537 - DNA, 25 bp, Mus musculus
gagtaccgtttctctgtacgcacca

SEQ ID NO: 659538 - DNA, 25 bp, Mus musculus
gagtacctacacctggcgctgtgac

SEQ ID NO: 659539 - DNA, 25 bp, Mus musculus
gagtacctacacgtggcgctgtgac

SEQ ID NO: 659540 - DNA, 25 bp, Mus musculus
gagtacctccttattcatggaacgg

SEQ ID NO: 659541 - DNA, 25 bp, Mus musculus
gagtacctcctttttcatggaacgg

SEQ ID NO: 659542 - DNA, 25 bp, Mus musculus
gagtacctcgcccttttttgagaca

SEQ ID NO: 659543 - DNA, 25 bp, Mus musculus
gagtacctcgccgttttttgagaca

SEQ ID NO: 659544 - DNA, 25 bp, Mus musculus
gagtacctctccctgatgcatgctg

SEQ ID NO: 659545 - DNA, 25 bp, Mus musculus
gagtacctctccgtgatgcatgctg

SEQ ID NO: 659546 - DNA, 25 bp, Mus musculus
gagtacctctgtcgagccaccaatt

SEQ ID NO: 659547 - DNA, 25 bp, Mus musculus
gagtacctctgtggagccaccaatt

SEQ ID NO: 659548 - DNA, 25 bp, Mus musculus
gagtacctgacgctcaactttggac

SEQ ID NO: 659549 - DNA, 25 bp, Mus musculus
gagtacctgacggtcaactttggac

SEQ ID NO: 659550 - DNA, 25 bp, Mus musculus
gagtacctgccaagacctaacgcgt

SEQ ID NO: 659551 - DNA, 25 bp, Mus musculus
gagtacctgccatgacctaacgcgt

SEQ ID NO: 659552 - DNA, 25 bp, Mus musculus
gagtacctgctgcagaggttccatg

SEQ ID NO: 659553 - DNA, 25 bp, Mus musculus
gagtacctgctggagaggttccatg

SEQ ID NO: 659554 - DNA, 25 bp, Mus musculus
gagtacctggccagtctactttgga

SEQ ID NO: 659555 - DNA, 25 bp, Mus musculus
gagtacctggcctgtctactttgga

SEQ ID NO: 659556 - DNA, 25 bp, Mus musculus
gagtacctgttcctcgccatcaacg

SEQ ID NO: 659557 - DNA, 25 bp, Mus musculus
gagtacctgttcgtcgccatcaacg

SEQ ID NO: 659558 - DNA, 25 bp, Mus musculus
gagtaccttgaaactcttataacca

SEQ ID NO: 659559 - DNA, 25 bp, Mus musculus
gagtaccttgaatctcttataacca

SEQ ID NO: 659560 - DNA, 25 bp, Mus musculus
gagtacgaactcattgaattccggc

SEQ ID NO: 659561 - DNA, 25 bp, Mus musculus
gagtacgaactctttgaattccggc

SEQ ID NO: 659562 - DNA, 25 bp, Mus musculus
gagtacgaagtacgatatcaaatct

SEQ ID NO: 659563 - DNA, 25 bp, Mus musculus
gagtacgaagtaggatatcaaatct

SEQ ID NO: 659564 - DNA, 25 bp, Mus musculus
gagtacgaggccatcaatctcaggg

SEQ ID NO: 659565 - DNA, 25 bp, Mus musculus
gagtacgaggccttcaatctcaggg

SEQ ID NO: 659566 - DNA, 25 bp, Mus musculus
gagtacgcaaggattgaatccccac

SEQ ID NO: 659567 - DNA, 25 bp, Mus musculus
gagtacgcaaggtttgaatccccac

SEQ ID NO: 659568 - DNA, 25 bp, Mus musculus
gagtacgctgaaaccataggtgcca

SEQ ID NO: 659569 - DNA, 25 bp, Mus musculus
gagtacgctgaatccataggtgcca

SEQ ID NO: 659570 - DNA, 25 bp, Mus musculus
gagtacggactcatccagatcagtg

SEQ ID NO: 659571 - DNA, 25 bp, Mus musculus
gagtacggactcttccagatcagtg

SEQ ID NO: 659572 - DNA, 25 bp, Mus musculus
gagtacggcgcgacctggcatccgt

SEQ ID NO: 659573 - DNA, 25 bp, Mus musculus
gagtacggcgcgtcctggcatccgt

SEQ ID NO: 659574 - DNA, 25 bp, Mus musculus
gagtacgtggagcatctccgcacca

SEQ ID NO: 659575 - DNA, 25 bp, Mus musculus
gagtacgtggaggatctccgcacca

SEQ ID NO: 659576 - DNA, 25 bp, Mus musculus
gagtacgtggatctggtttttgcca

SEQ ID NO: 659577 - DNA, 25 bp, Mus musculus
gagtacgtggatgtggtttttgcca

SEQ ID NO: 659578 - DNA, 25 bp, Mus musculus
gagtacgttaggagccagtacccca

SEQ ID NO: 659579 - DNA, 25 bp, Mus musculus
gagtacgttaggtgccagtacccca

SEQ ID NO: 659580 - DNA, 25 bp, Mus musculus
gagtactacactccttggcaggtga

SEQ ID NO: 659581 - DNA, 25 bp, Mus musculus
gagtactacactgcttggcaggtga

SEQ ID NO: 659582 - DNA, 25 bp, Mus musculus
gagtactacagcagttgttaccacc

SEQ ID NO: 659583 - DNA, 25 bp, Mus musculus
gagtactacagctgttgttaccacc

SEQ ID NO: 659584 - DNA, 25 bp, Mus musculus
gagtactactccatccatgaatcgg

SEQ ID NO: 659585 - DNA, 25 bp, Mus musculus
gagtactactccttccatgaatcgg

SEQ ID NO: 659586 - DNA, 25 bp, Mus musculus
gagtactccacactaactacacgca

SEQ ID NO: 659587 - DNA, 25 bp, Mus musculus
gagtactccacagtaactacacgca

SEQ ID NO: 659588 - DNA, 25 bp, Mus musculus
gagtactcctatcacattaaccgtg

SEQ ID NO: 659589 - DNA, 25 bp, Mus musculus
gagtactcctatgacattaaccgtg

SEQ ID NO: 659590 - DNA, 25 bp, Mus musculus
gagtactctgtgaacctggccatcc

SEQ ID NO: 659591 - DNA, 25 bp, Mus musculus
gagtactctgtgtacctggccatcc

SEQ ID NO: 659592 - DNA, 25 bp, Mus musculus
gagtactgctcgagactattacaca

SEQ ID NO: 659593 - DNA, 25 bp, Mus musculus
gagtactgctcgtgactattacaca

SEQ ID NO: 659594 - DNA, 25 bp, Mus musculus
gagtactggaaacttactggatgat

SEQ ID NO: 659595 - DNA, 25 bp, Mus musculus
gagtactggaaagttactggatgat

SEQ ID NO: 659596 - DNA, 25 bp, Mus musculus
gagtactggctcaatgacctctaaa

SEQ ID NO: 659597 - DNA, 25 bp, Mus musculus
gagtactggctctatgacctctaaa

SEQ ID NO: 659598 - DNA, 25 bp, Mus musculus
gagtactgggaaaagcgccctcaac

SEQ ID NO: 659599 - DNA, 25 bp, Mus musculus
gagtactgggaatagcgccctcaac

SEQ ID NO: 659600 - DNA, 25 bp, Mus musculus
gagtactttccgctgttcctcgcca

SEQ ID NO: 659601 - DNA, 25 bp, Mus musculus
gagtactttccggtgttcctcgcca

SEQ ID NO: 659602 - DNA, 25 bp, Mus musculus
gagtactttgacaacgagtccagaa

SEQ ID NO: 659603 - DNA, 25 bp, Mus musculus
gagtactttgactacgagtccagaa

SEQ ID NO: 659604 - DNA, 25 bp, Mus musculus
gagtactttgctactcccaaggcca

SEQ ID NO: 659605 - DNA, 25 bp, Mus musculus
gagtactttgcttctcccaaggcca

SEQ ID NO: 659606 - DNA, 25 bp, Mus musculus
gagtagaaaaggatccagaacttgg

SEQ ID NO: 659607 - DNA, 25 bp, Mus musculus
gagtagaaaaggttccagaacttgg

SEQ ID NO: 659608 - DNA, 25 bp, Mus musculus
gagtagaaacctatgcccaccttat

SEQ ID NO: 659609 - DNA, 25 bp, Mus musculus
gagtagaaacctttgcccaccttat

SEQ ID NO: 659610 - DNA, 25 bp, Mus musculus
gagtagaacgcgacccatttccccg

SEQ ID NO: 659611 - DNA, 25 bp, Mus musculus
gagtagaacgcgtcccatttccccg

SEQ ID NO: 659612 - DNA, 25 bp, Mus musculus
gagtagaactttcattgtccccaac

SEQ ID NO: 659613 - DNA, 25 bp, Mus musculus
gagtagaactttgattgtccccaac

SEQ ID NO: 659614 - DNA, 25 bp, Mus musculus
gagtagaagatgacgtcgttagtga

SEQ ID NO: 659615 - DNA, 25 bp, Mus musculus
gagtagaagatgtcgtcgttagtga

SEQ ID NO: 659616 - DNA, 25 bp, Mus musculus
gagtagaaggatagctgtcacccga

SEQ ID NO: 659617 - DNA, 25 bp, Mus musculus
gagtagaaggattgctgtcacccga

SEQ ID NO: 659618 - DNA, 25 bp, Mus musculus
gagtagaagttcaccagcatcacag

SEQ ID NO: 659619 - DNA, 25 bp, Mus musculus
gagtagaagttctccagcatcacag

SEQ ID NO: 659620 - DNA, 25 bp, Mus musculus
gagtagacctgactcttagctcagg

SEQ ID NO: 659621 - DNA, 25 bp, Mus musculus
gagtagacctgagtcttagctcagg

SEQ ID NO: 659622 - DNA, 25 bp, Mus musculus
gagtagacgcttcgcggcggacgga

SEQ ID NO: 659623 - DNA, 25 bp, Mus musculus
gagtagacgcttggcggcggacgga

SEQ ID NO: 659624 - DNA, 25 bp, Mus musculus
gagtagagattgaacacccctgaag

SEQ ID NO: 659625 - DNA, 25 bp, Mus musculus
gagtagagattgtacacccctgaag

SEQ ID NO: 659626 - DNA, 25 bp, Mus musculus
gagtagagcccgagtggccttcagc

SEQ ID NO: 659627 - DNA, 25 bp, Mus musculus
gagtagagcccgtgtggccttcagc

SEQ ID NO: 659628 - DNA, 25 bp, Mus musculus
gagtagcagctacagctatggccca

SEQ ID NO: 659629 - DNA, 25 bp, Mus musculus
gagtagcagctagagctatggccca

SEQ ID NO: 659630 - DNA, 25 bp, Mus musculus
gagtagcagtgcatcaccacacagg

SEQ ID NO: 659631 - DNA, 25 bp, Mus musculus
gagtagcagtgcttcaccacacagg

SEQ ID NO: 659632 - DNA, 25 bp, Mus musculus
gagtagcatcagcacgtggatccag

SEQ ID NO: 659633 - DNA, 25 bp, Mus musculus
gagtagcatcaggacgtggatccag

SEQ ID NO: 659634 - DNA, 25 bp, Mus musculus
gagtagccagagaccatttcctgag

SEQ ID NO: 659635 - DNA, 25 bp, Mus musculus
gagtagccagagtccatttcctgag

SEQ ID NO: 659636 - DNA, 25 bp, Mus musculus
gagtagcccgccaccattctgttct

SEQ ID NO: 659637 - DNA, 25 bp, Mus musculus
gagtagcccgcctccattctgttct

SEQ ID NO: 659638 - DNA, 25 bp, Mus musculus
gagtagcgacttcaccaatcggagg

SEQ ID NO: 659639 - DNA, 25 bp, Mus musculus
gagtagcgacttgaccaatcggagg

SEQ ID NO: 659640 - DNA, 25 bp, Mus musculus
gagtagctgccgagttcctctttgt

SEQ ID NO: 659641 - DNA, 25 bp, Mus musculus
gagtagctgccgtgttcctctttgt

SEQ ID NO: 659642 - DNA, 25 bp, Mus musculus
gagtagctgcctctttccctagcca

SEQ ID NO: 659643 - DNA, 25 bp, Mus musculus
gagtagctgcctgtttccctagcca

SEQ ID NO: 659644 - DNA, 25 bp, Mus musculus
gagtagctgcttctcttcctattga

SEQ ID NO: 659645 - DNA, 25 bp, Mus musculus
gagtagctgcttgtcttcctattga

SEQ ID NO: 659646 - DNA, 25 bp, Mus musculus
gagtaggatatcaagcaaagaatgc

SEQ ID NO: 659647 - DNA, 25 bp, Mus musculus
gagtaggatatctagcaaagaatgc

SEQ ID NO: 659648 - DNA, 25 bp, Mus musculus
gagtagggcaaaaagtcaaggagaa

SEQ ID NO: 659649 - DNA, 25 bp, Mus musculus
gagtagggcaaatagtcaaggagaa

SEQ ID NO: 659650 - DNA, 25 bp, Mus musculus
gagtagggtcttagggcccaccaag

SEQ ID NO: 659651 - DNA, 25 bp, Mus musculus
gagtagggtctttgggcccaccaag

SEQ ID NO: 659652 - DNA, 25 bp, Mus musculus
gagtaggtaatgatggccttcagtg

SEQ ID NO: 659653 - DNA, 25 bp, Mus musculus
gagtaggtaatgttggccttcagtg

SEQ ID NO: 659654 - DNA, 25 bp, Mus musculus
gagtaggtcctacatcttgccgtgg

SEQ ID NO: 659655 - DNA, 25 bp, Mus musculus
gagtaggtcctagatcttgccgtgg

SEQ ID NO: 659656 - DNA, 25 bp, Mus musculus
gagtaggtgccaagacctggtcccc

SEQ ID NO: 659657 - DNA, 25 bp, Mus musculus
gagtaggtgccatgacctggtcccc

SEQ ID NO: 659658 - DNA, 25 bp, Mus musculus
gagtagtgttacaccaagagggcca

SEQ ID NO: 659659 - DNA, 25 bp, Mus musculus
gagtagtgttacacggcatagaaca

SEQ ID NO: 659660 - DNA, 25 bp, Mus musculus
gagtagtgttactccaagagggcca

SEQ ID NO: 659661 - DNA, 25 bp, Mus musculus
gagtagtgttactcggcatagaaca

SEQ ID NO: 659662 - DNA, 25 bp, Mus musculus
gagtagttctggactgtattcactg

SEQ ID NO: 659663 - DNA, 25 bp, Mus musculus
gagtagttctggtctgtattcactg

SEQ ID NO: 659664 - DNA, 25 bp, Mus musculus
gagtataactcaaaaggcccatctc

SEQ ID NO: 659665 - DNA, 25 bp, Mus musculus
gagtataactcataaggcccatctc

SEQ ID NO: 659666 - DNA, 25 bp, Mus musculus
gagtataagagcaagggcatctttg

SEQ ID NO: 659667 - DNA, 25 bp, Mus musculus
gagtataagagctagggcatctttg

SEQ ID NO: 659668 - DNA, 25 bp, Mus musculus
gagtataagggtcaactagcctcct

SEQ ID NO: 659669 - DNA, 25 bp, Mus musculus
gagtataagggtgaactagcctcct

SEQ ID NO: 659670 - DNA, 25 bp, Mus musculus
gagtataatcccctaggctccaagg

SEQ ID NO: 659671 - DNA, 25 bp, Mus musculus
gagtataatcccgtaggctccaagg

SEQ ID NO: 659672 - DNA, 25 bp, Mus musculus
gagtataatgaccagctcaccaggg

SEQ ID NO: 659673 - DNA, 25 bp, Mus musculus
gagtataatgacgagctcaccaggg

SEQ ID NO: 659674 - DNA, 25 bp, Mus musculus
gagtatacatgacccaaagaggaga

SEQ ID NO: 659675 - DNA, 25 bp, Mus musculus
gagtatacatgagccaaagaggaga

SEQ ID NO: 659676 - DNA, 25 bp, Mus musculus
gagtatacatttcttagcgggagcg

SEQ ID NO: 659677 - DNA, 25 bp, Mus musculus
gagtatacatttgttagcgggagcg

SEQ ID NO: 659678 - DNA, 25 bp, Mus musculus
gagtatagattgctcgttcccaaag

SEQ ID NO: 659679 - DNA, 25 bp, Mus musculus
gagtatagattggtcgttcccaaag

SEQ ID NO: 659680 - DNA, 25 bp, Mus musculus
gagtatagtgagattaaaaggcagc

SEQ ID NO: 659681 - DNA, 25 bp, Mus musculus
gagtatagtgagtttaaaaggcagc

SEQ ID NO: 659682 - DNA, 25 bp, Mus musculus
gagtatatcttcagcttcgtcctgg

SEQ ID NO: 659683 - DNA, 25 bp, Mus musculus
gagtatatcttctgcttcgtcctgg

SEQ ID NO: 659684 - DNA, 25 bp, Mus musculus
gagtatcactaaagtgagtccgtgc

SEQ ID NO: 659685 - DNA, 25 bp, Mus musculus
gagtatcactaatgtgagtccgtgc

SEQ ID NO: 659686 - DNA, 25 bp, Mus musculus
gagtatcactccagcatgattgcag

SEQ ID NO: 659687 - DNA, 25 bp, Mus musculus
gagtatcactcctgcatgattgcag

SEQ ID NO: 659688 - DNA, 25 bp, Mus musculus
gagtatcacttacgaaggaagagag

SEQ ID NO: 659689 - DNA, 25 bp, Mus musculus
gagtatcacttaggaaggaagagag

SEQ ID NO: 659690 - DNA, 25 bp, Mus musculus
gagtatcagcaacatctggacagag

SEQ ID NO: 659691 - DNA, 25 bp, Mus musculus
gagtatcagcaagatctggacagag

SEQ ID NO: 659692 - DNA, 25 bp, Mus musculus
gagtatccacgaagctctaagaaga

SEQ ID NO: 659693 - DNA, 25 bp, Mus musculus
gagtatccacgatgctctaagaaga

SEQ ID NO: 659694 - DNA, 25 bp, Mus musculus
gagtatccactacgcgctcatgggt

SEQ ID NO: 659695 - DNA, 25 bp, Mus musculus
gagtatccactaggcgctcatgggt

SEQ ID NO: 659696 - DNA, 25 bp, Mus musculus
gagtatccatgacacgctatttcta

SEQ ID NO: 659697 - DNA, 25 bp, Mus musculus
gagtatccatgagacgctatttcta

SEQ ID NO: 659698 - DNA, 25 bp, Mus musculus
gagtatcccaacaggaggcccagct

SEQ ID NO: 659699 - DNA, 25 bp, Mus musculus
gagtatcccaactggaggcccagct

SEQ ID NO: 659700 - DNA, 25 bp, Mus musculus
gagtatcccggcaatcgcagttttt

SEQ ID NO: 659701 - DNA, 25 bp, Mus musculus
gagtatcccggctatcgcagttttt

SEQ ID NO: 659702 - DNA, 25 bp, Mus musculus
gagtatccgagaagtggaggactcc

SEQ ID NO: 659703 - DNA, 25 bp, Mus musculus
gagtatccgagatgtggaggactcc

SEQ ID NO: 659704 - DNA, 25 bp, Mus musculus
gagtatccggaaaactttctggaaa

SEQ ID NO: 659705 - DNA, 25 bp, Mus musculus
gagtatccggaatactttctggaaa

SEQ ID NO: 659706 - DNA, 25 bp, Mus musculus
gagtatcctggaagacattctcttg

SEQ ID NO: 659707 - DNA, 25 bp, Mus musculus
gagtatcctggatgacattctcttg

SEQ ID NO: 659708 - DNA, 25 bp, Mus musculus
gagtatccttctcctgtcctgcaac

SEQ ID NO: 659709 - DNA, 25 bp, Mus musculus
gagtatccttctgctgtcctgcaac

SEQ ID NO: 659710 - DNA, 25 bp, Mus musculus
gagtatcgagaacaggtccactgga

SEQ ID NO: 659711 - DNA, 25 bp, Mus musculus
gagtatcgagaagaggtccactgga

SEQ ID NO: 659712 - DNA, 25 bp, Mus musculus
gagtatctactgaaccccaaagtgg

SEQ ID NO: 659713 - DNA, 25 bp, Mus musculus
gagtatctactgtaccccaaagtgg

SEQ ID NO: 659714 - DNA, 25 bp, Mus musculus
gagtatctagctcctcagaagccct

SEQ ID NO: 659715 - DNA, 25 bp, Mus musculus
gagtatctagctgctcagaagccct

SEQ ID NO: 659716 - DNA, 25 bp, Mus musculus
gagtatctagtactttttcaagaaa

SEQ ID NO: 659717 - DNA, 25 bp, Mus musculus
gagtatctagtagtttttcaagaaa

SEQ ID NO: 659718 - DNA, 25 bp, Mus musculus
gagtatctcaaaaccagtgaccggc

SEQ ID NO: 659719 - DNA, 25 bp, Mus musculus
gagtatctcaaatccagtgaccggc

SEQ ID NO: 659720 - DNA, 25 bp, Mus musculus
gagtatctcatgagctctctgaagc

SEQ ID NO: 659721 - DNA, 25 bp, Mus musculus
gagtatctcatgtgctctctgaagc

SEQ ID NO: 659722 - DNA, 25 bp, Mus musculus
gagtatctctgcaccagtcatcttt

SEQ ID NO: 659723 - DNA, 25 bp, Mus musculus
gagtatctctgctccagtcatcttt

SEQ ID NO: 659724 - DNA, 25 bp, Mus musculus
gagtatctgcggcaccagttccaga

SEQ ID NO: 659725 - DNA, 25 bp, Mus musculus
gagtatctgcgggaccagttccaga

SEQ ID NO: 659726 - DNA, 25 bp, Mus musculus
gagtatcttgaccacctggcaccat

SEQ ID NO: 659727 - DNA, 25 bp, Mus musculus
gagtatcttgacgacctggcaccat

SEQ ID NO: 659728 - DNA, 25 bp, Mus musculus
gagtatctttcccttgtggcccgac

SEQ ID NO: 659729 - DNA, 25 bp, Mus musculus
gagtatctttccgttgtggcccgac

SEQ ID NO: 659730 - DNA, 25 bp, Mus musculus
gagtatgactttcacctgctcccca

SEQ ID NO: 659731 - DNA, 25 bp, Mus musculus
gagtatgactttgacctgctcccca

SEQ ID NO: 659732 - DNA, 25 bp, Mus musculus
gagtatgagaagctgccctactcat

SEQ ID NO: 659733 - DNA, 25 bp, Mus musculus
gagtatgagaaggtgccctactcat

SEQ ID NO: 659734 - DNA, 25 bp, Mus musculus
gagtatgagccaatatttgggctga

SEQ ID NO: 659735 - DNA, 25 bp, Mus musculus
gagtatgagccattatttgggctga

SEQ ID NO: 659736 - DNA, 25 bp, Mus musculus
gagtatgaggccaaagtcaaggccc

SEQ ID NO: 659737 - DNA, 25 bp, Mus musculus
gagtatgaggcctaagtcaaggccc

SEQ ID NO: 659738 - DNA, 25 bp, Mus musculus
gagtatgagtagagttactcggcat

SEQ ID NO: 659739 - DNA, 25 bp, Mus musculus
gagtatgagtagtgttactcggcat

SEQ ID NO: 659740 - DNA, 25 bp, Mus musculus
gagtatgagttcaccgtgttgccca

SEQ ID NO: 659741 - DNA, 25 bp, Mus musculus
gagtatgagttctccgtgttgccca

SEQ ID NO: 659742 - DNA, 25 bp, Mus musculus
gagtatgagtttatcacctatctgg

SEQ ID NO: 659743 - DNA, 25 bp, Mus musculus
gagtatgagtttttcacctatctgg

SEQ ID NO: 659744 - DNA, 25 bp, Mus musculus
gagtatgatgacctctactgcaagt

SEQ ID NO: 659745 - DNA, 25 bp, Mus musculus
gagtatgatgacgtctactgcaagt

SEQ ID NO: 659746 - DNA, 25 bp, Mus musculus
gagtatgcaggcactcccagcccag

SEQ ID NO: 659747 - DNA, 25 bp, Mus musculus
gagtatgcaggctctcccagcccag

SEQ ID NO: 659748 - DNA, 25 bp, Mus musculus
gagtatgcagtcaattctattaaaa

SEQ ID NO: 659749 - DNA, 25 bp, Mus musculus
gagtatgcagtctattctattaaaa

SEQ ID NO: 659750 - DNA, 25 bp, Mus musculus
gagtatgcctacagtgacaacagcc

SEQ ID NO: 659751 - DNA, 25 bp, Mus musculus
gagtatgcctactgtgacaacagcc

SEQ ID NO: 659752 - DNA, 25 bp, Mus musculus
gagtatgcctcaacctggccctgag

SEQ ID NO: 659753 - DNA, 25 bp, Mus musculus
gagtatgcctcatcctggccctgag

SEQ ID NO: 659754 - DNA, 25 bp, Mus musculus
gagtatgctgagatctaaggcttgt

SEQ ID NO: 659755 - DNA, 25 bp, Mus musculus
gagtatgctgagttctaaggcttgt

SEQ ID NO: 659756 - DNA, 25 bp, Mus musculus
gagtatggaacaaatacttgattct

SEQ ID NO: 659757 - DNA, 25 bp, Mus musculus
gagtatggaacatatacttgattct

SEQ ID NO: 659758 - DNA, 25 bp, Mus musculus
gagtatggaatacccctgccctgcc

SEQ ID NO: 659759 - DNA, 25 bp, Mus musculus
gagtatggaatagccctgccctgcc

SEQ ID NO: 659760 - DNA, 25 bp, Mus musculus
gagtatggctagaaacccaggtcca

SEQ ID NO: 659761 - DNA, 25 bp, Mus musculus
gagtatggctagtaacccaggtcca

SEQ ID NO: 659762 - DNA, 25 bp, Mus musculus
gagtatgggagcatcaaccacacct

SEQ ID NO: 659763 - DNA, 25 bp, Mus musculus
gagtatgggagcttcaaccacacct

SEQ ID NO: 659764 - DNA, 25 bp, Mus musculus
gagtatggtctacacacagtcagag

SEQ ID NO: 659765 - DNA, 25 bp, Mus musculus
gagtatggtctagacacagtcagag

SEQ ID NO: 659766 - DNA, 25 bp, Mus musculus
gagtatgtcaccatctggctgctta

SEQ ID NO: 659767 - DNA, 25 bp, Mus musculus
gagtatgtcaccttctggctgctta

SEQ ID NO: 659768 - DNA, 25 bp, Mus musculus
gagtatgtccccacctgtggcttgg

SEQ ID NO: 659769 - DNA, 25 bp, Mus musculus
gagtatgtcccctcctgtggcttgg

SEQ ID NO: 659770 - DNA, 25 bp, Mus musculus
gagtatgtggacctcttgccttgaa

SEQ ID NO: 659771 - DNA, 25 bp, Mus musculus
gagtatgtggacgtcttgccttgaa

SEQ ID NO: 659772 - DNA, 25 bp, Mus musculus
gagtattacgaaagcctcagcgagc

SEQ ID NO: 659773 - DNA, 25 bp, Mus musculus
gagtattacgaatgcctcagcgagc

SEQ ID NO: 659774 - DNA, 25 bp, Mus musculus
gagtattcccttcgttcctgtacct

SEQ ID NO: 659775 - DNA, 25 bp, Mus musculus
gagtattcccttggttcctgtacct

SEQ ID NO: 659776 - DNA, 25 bp, Mus musculus
gagtattgccgcctgacagcctgtg

SEQ ID NO: 659777 - DNA, 25 bp, Mus musculus
gagtattgccgcgtgacagcctgtg

SEQ ID NO: 659778 - DNA, 25 bp, Mus musculus
gagtattgtccccaggtcttcagga

SEQ ID NO: 659779 - DNA, 25 bp, Mus musculus
gagtattgtcccgaggtcttcagga

SEQ ID NO: 659780 - DNA, 25 bp, Mus musculus
gagtatttcaacattgcagtgataa

SEQ ID NO: 659781 - DNA, 25 bp, Mus musculus
gagtatttcaactttgcagtgataa

SEQ ID NO: 659782 - DNA, 25 bp, Mus musculus
gagtatttcagccatctgcctccac

SEQ ID NO: 659783 - DNA, 25 bp, Mus musculus
gagtatttcagcgatctgcctccac

SEQ ID NO: 659784 - DNA, 25 bp, Mus musculus
gagtatttcaggatgtatgccaaag

SEQ ID NO: 659785 - DNA, 25 bp, Mus musculus
gagtatttcaggttgtatgccaaag

SEQ ID NO: 659786 - DNA, 25 bp, Mus musculus
gagtattttgagctgggcgaccact

SEQ ID NO: 659787 - DNA, 25 bp, Mus musculus
gagtattttgaggtgggcgaccact

SEQ ID NO: 659788 - DNA, 25 bp, Mus musculus
gagtcaaaaactaagatactaaggc

SEQ ID NO: 659789 - DNA, 25 bp, Mus musculus
gagtcaaaaacttagatactaaggc

SEQ ID NO: 659790 - DNA, 25 bp, Mus musculus
gagtcaaaacaactggcatcgtaga

SEQ ID NO: 659791 - DNA, 25 bp, Mus musculus
gagtcaaaacaagtggcatcgtaga

SEQ ID NO: 659792 - DNA, 25 bp, Mus musculus
gagtcaaaaggaatgatgaatgacg

SEQ ID NO: 659793 - DNA, 25 bp, Mus musculus
gagtcaaaaggattgatgaatgacg

SEQ ID NO: 659794 - DNA, 25 bp, Mus musculus
gagtcaaagatacgttccctggaag

SEQ ID NO: 659795 - DNA, 25 bp, Mus musculus
gagtcaaagataggttccctggaag

SEQ ID NO: 659796 - DNA, 25 bp, Mus musculus
gagtcaaaggaaagctaggcagact

SEQ ID NO: 659797 - DNA, 25 bp, Mus musculus
gagtcaaaggaatgctaggcagact

SEQ ID NO: 659798 - DNA, 25 bp, Mus musculus
gagtcaaccttacaacccggcgagt

SEQ ID NO: 659799 - DNA, 25 bp, Mus musculus
gagtcaaccttagaacccggcgagt

SEQ ID NO: 659800 - DNA, 25 bp, Mus musculus
gagtcaagaactcaactggctcctt

SEQ ID NO: 659801 - DNA, 25 bp, Mus musculus
gagtcaagaactgaactggctcctt

SEQ ID NO: 659802 - DNA, 25 bp, Mus musculus
gagtcaagacaacaggcatcatcga

SEQ ID NO: 659803 - DNA, 25 bp, Mus musculus
gagtcaagacaagaggcatcatcga

SEQ ID NO: 659804 - DNA, 25 bp, Mus musculus
gagtcaagcatcactgctactacca

SEQ ID NO: 659805 - DNA, 25 bp, Mus musculus
gagtcaagcatctctgctactacca

SEQ ID NO: 659806 - DNA, 25 bp, Mus musculus
gagtcaaggctcacttcgccatctc

SEQ ID NO: 659807 - DNA, 25 bp, Mus musculus
gagtcaaggctctcttcgccatctc

SEQ ID NO: 659808 - DNA, 25 bp, Mus musculus
gagtcaagggtcattctccagggaa

SEQ ID NO: 659809 - DNA, 25 bp, Mus musculus
gagtcaagggtctttctccagggaa

SEQ ID NO: 659810 - DNA, 25 bp, Mus musculus
gagtcaagtcaaacttcattgcaga

SEQ ID NO: 659811 - DNA, 25 bp, Mus musculus
gagtcaagtcaatcttcattgcaga

SEQ ID NO: 659812 - DNA, 25 bp, Mus musculus
gagtcaataccacgatcgacgacct

SEQ ID NO: 659813 - DNA, 25 bp, Mus musculus
gagtcaataccaggatcgacgacct

SEQ ID NO: 659814 - DNA, 25 bp, Mus musculus
gagtcaatatccatgccatagccac

SEQ ID NO: 659815 - DNA, 25 bp, Mus musculus
gagtcaatatccttgccatagccac

SEQ ID NO: 659816 - DNA, 25 bp, Mus musculus
gagtcaatgaagatttcctccaaac

SEQ ID NO: 659817 - DNA, 25 bp, Mus musculus
gagtcaatgaagttttcctccaaac

SEQ ID NO: 659818 - DNA, 25 bp, Mus musculus
gagtcaatgcctacctctgggcctc

SEQ ID NO: 659819 - DNA, 25 bp, Mus musculus
gagtcaatgccttcctctgggcctc

SEQ ID NO: 659820 - DNA, 25 bp, Mus musculus
gagtcacaagagcatcatgctgttc

SEQ ID NO: 659821 - DNA, 25 bp, Mus musculus
gagtcacaagaggatcatgctgttc

SEQ ID NO: 659822 - DNA, 25 bp, Mus musculus
gagtcacacaagctaaagacgggcc

SEQ ID NO: 659823 - DNA, 25 bp, Mus musculus
gagtcacacaaggtaaagacgggcc

SEQ ID NO: 659824 - DNA, 25 bp, Mus musculus
gagtcacaccggctattccagggtc

SEQ ID NO: 659825 - DNA, 25 bp, Mus musculus
gagtcacaccgggtattccagggtc

SEQ ID NO: 659826 - DNA, 25 bp, Mus musculus
gagtcacacctgaattgctttgcct

SEQ ID NO: 659827 - DNA, 25 bp, Mus musculus
gagtcacacctgtattgctttgcct

SEQ ID NO: 659828 - DNA, 25 bp, Mus musculus
gagtcacagaaaagttctatgatga

SEQ ID NO: 659829 - DNA, 25 bp, Mus musculus
gagtcacagaaatgttctatgatga

SEQ ID NO: 659830 - DNA, 25 bp, Mus musculus
gagtcacatactcctgtggtctaca

SEQ ID NO: 659831 - DNA, 25 bp, Mus musculus
gagtcacatactgctgtggtctaca

SEQ ID NO: 659832 - DNA, 25 bp, Mus musculus
gagtcaccagagagccgtggctgca

SEQ ID NO: 659833 - DNA, 25 bp, Mus musculus
gagtcaccagagtgccgtggctgca

SEQ ID NO: 659834 - DNA, 25 bp, Mus musculus
gagtcaccatcacctcctggaagaa

SEQ ID NO: 659835 - DNA, 25 bp, Mus musculus
gagtcaccatcagctcctggaagaa

SEQ ID NO: 659836 - DNA, 25 bp, Mus musculus
gagtcaccattccagcatttgatga

SEQ ID NO: 659837 - DNA, 25 bp, Mus musculus
gagtcaccattcgagcatttgatga

SEQ ID NO: 659838 - DNA, 25 bp, Mus musculus
gagtcaccccttcctgctgggaaaa

SEQ ID NO: 659839 - DNA, 25 bp, Mus musculus
gagtcaccccttgctgctgggaaaa

SEQ ID NO: 659840 - DNA, 25 bp, Mus musculus
gagtcaccctttcaaacacctgaag

SEQ ID NO: 659841 - DNA, 25 bp, Mus musculus
gagtcaccctttgaaacacctgaag

SEQ ID NO: 659842 - DNA, 25 bp, Mus musculus
gagtcaccgaagcattctccttttc

SEQ ID NO: 659843 - DNA, 25 bp, Mus musculus
gagtcaccgaaggattctccttttc

SEQ ID NO: 659844 - DNA, 25 bp, Mus musculus
gagtcaccgagcactatgggatcag

SEQ ID NO: 659845 - DNA, 25 bp, Mus musculus
gagtcaccgagctctatgggatcag

SEQ ID NO: 659846 - DNA, 25 bp, Mus musculus
gagtcactaaatcctcacgggatca

SEQ ID NO: 659847 - DNA, 25 bp, Mus musculus
gagtcactaaatgctcacgggatca

SEQ ID NO: 659848 - DNA, 25 bp, Mus musculus
gagtcactaagcacttaggctaaga

SEQ ID NO: 659849 - DNA, 25 bp, Mus musculus
gagtcactaagctcttaggctaaga

SEQ ID NO: 659850 - DNA, 25 bp, Mus musculus
gagtcactacgtagccctgactgaa

SEQ ID NO: 659851 - DNA, 25 bp, Mus musculus
gagtcactacgttgccctgactgaa

SEQ ID NO: 659852 - DNA, 25 bp, Mus musculus
gagtcactactcatctccaggctat

SEQ ID NO: 659853 - DNA, 25 bp, Mus musculus
gagtcactactcttctccaggctat

SEQ ID NO: 659854 - DNA, 25 bp, Mus musculus
gagtcactaggtagagctgtcctct

SEQ ID NO: 659855 - DNA, 25 bp, Mus musculus
gagtcactaggttgagctgtcctct

SEQ ID NO: 659856 - DNA, 25 bp, Mus musculus
gagtcactcatcaaacacatgaaag

SEQ ID NO: 659857 - DNA, 25 bp, Mus musculus
gagtcactcatctaacacatgaaag

SEQ ID NO: 659858 - DNA, 25 bp, Mus musculus
gagtcactcggcacctttgctggta

SEQ ID NO: 659859 - DNA, 25 bp, Mus musculus
gagtcactcggctcctttgctggta

SEQ ID NO: 659860 - DNA, 25 bp, Mus musculus
gagtcactgaaacaccctttaattg

SEQ ID NO: 659861 - DNA, 25 bp, Mus musculus
gagtcactgaaagaccctttaattg

SEQ ID NO: 659862 - DNA, 25 bp, Mus musculus
gagtcactgagtagatggagatgcc

SEQ ID NO: 659863 - DNA, 25 bp, Mus musculus
gagtcactgagttgatggagatgcc

SEQ ID NO: 659864 - DNA, 25 bp, Mus musculus
gagtcactgcacacccgagtatcgt

SEQ ID NO: 659865 - DNA, 25 bp, Mus musculus
gagtcactgcactcccgagtatcgt

SEQ ID NO: 659866 - DNA, 25 bp, Mus musculus
gagtcactgctgaggccgccgccat

SEQ ID NO: 659867 - DNA, 25 bp, Mus musculus
gagtcactgctgtggccgccgccat

SEQ ID NO: 659868 - DNA, 25 bp, Mus musculus
gagtcactggtcaccatggtcgtcc

SEQ ID NO: 659869 - DNA, 25 bp, Mus musculus
gagtcactggtctccatggtcgtcc

SEQ ID NO: 659870 - DNA, 25 bp, Mus musculus
gagtcactggttcctcttgctgctg

SEQ ID NO: 659871 - DNA, 25 bp, Mus musculus
gagtcactggttgctcttgctgctg

SEQ ID NO: 659872 - DNA, 25 bp, Mus musculus
gagtcactttttccagaagtggcta

SEQ ID NO: 659873 - DNA, 25 bp, Mus musculus
gagtcactttttgcagaagtggcta

SEQ ID NO: 659874 - DNA, 25 bp, Mus musculus
gagtcagaaaagcaatccagcccaa

SEQ ID NO: 659875 - DNA, 25 bp, Mus musculus
gagtcagaaaaggaatccagcccaa

SEQ ID NO: 659876 - DNA, 25 bp, Mus musculus
gagtcagaaagaaggcatctggaag

SEQ ID NO: 659877 - DNA, 25 bp, Mus musculus
gagtcagaaagatggcatctggaag

SEQ ID NO: 659878 - DNA, 25 bp, Mus musculus
gagtcagaagtacaaatgtctcacc

SEQ ID NO: 659879 - DNA, 25 bp, Mus musculus
gagtcagaagtagaaatgtctcacc

SEQ ID NO: 659880 - DNA, 25 bp, Mus musculus
gagtcagacctcaatggcctgcgca

SEQ ID NO: 659881 - DNA, 25 bp, Mus musculus
gagtcagacctctatggcctgcgca

SEQ ID NO: 659882 - DNA, 25 bp, Mus musculus
gagtcagactgcaattccagcagca

SEQ ID NO: 659883 - DNA, 25 bp, Mus musculus
gagtcagactgctattccagcagca

SEQ ID NO: 659884 - DNA, 25 bp, Mus musculus
gagtcagagaggaagcttcttgatg

SEQ ID NO: 659885 - DNA, 25 bp, Mus musculus
gagtcagagaggtagcttcttgatg

SEQ ID NO: 659886 - DNA, 25 bp, Mus musculus
gagtcagaggacagaaagctcttct

SEQ ID NO: 659887 - DNA, 25 bp, Mus musculus
gagtcagaggactgaaagctcttct

SEQ ID NO: 659888 - DNA, 25 bp, Mus musculus
gagtcagagggaacaggccttaaag

SEQ ID NO: 659889 - DNA, 25 bp, Mus musculus
gagtcagagggatcaggccttaaag

SEQ ID NO: 659890 - DNA, 25 bp, Mus musculus
gagtcagagttgcaatcagggctac

SEQ ID NO: 659891 - DNA, 25 bp, Mus musculus
gagtcagagttggaatcagggctac

SEQ ID NO: 659892 - DNA, 25 bp, Mus musculus
gagtcagatactctcaaacgcaggc

SEQ ID NO: 659893 - DNA, 25 bp, Mus musculus
gagtcagatactgtcaaacgcaggc

SEQ ID NO: 659894 - DNA, 25 bp, Mus musculus
gagtcagatgacattactattaaga

SEQ ID NO: 659895 - DNA, 25 bp, Mus musculus
gagtcagatgactttactattaaga

SEQ ID NO: 659896 - DNA, 25 bp, Mus musculus
gagtcagcatctcctttgaatctca

SEQ ID NO: 659897 - DNA, 25 bp, Mus musculus
gagtcagcatctgctttgaatctca

SEQ ID NO: 659898 - DNA, 25 bp, Mus musculus
gagtcagcgaccctctgggctcact

SEQ ID NO: 659899 - DNA, 25 bp, Mus musculus
gagtcagcgaccgtctgggctcact

SEQ ID NO: 659900 - DNA, 25 bp, Mus musculus
gagtcagcgccgaatcttgtggaca

SEQ ID NO: 659901 - DNA, 25 bp, Mus musculus
gagtcagcgccgtatcttgtggaca

SEQ ID NO: 659902 - DNA, 25 bp, Mus musculus
gagtcagctatgagaagtcctccaa

SEQ ID NO: 659903 - DNA, 25 bp, Mus musculus
gagtcagctatgtgaagtcctccaa

SEQ ID NO: 659904 - DNA, 25 bp, Mus musculus
gagtcaggacataagaatttctcac

SEQ ID NO: 659905 - DNA, 25 bp, Mus musculus
gagtcaggacattagaatttctcac

SEQ ID NO: 659906 - DNA, 25 bp, Mus musculus
gagtcaggagttagcgaagaagtca

SEQ ID NO: 659907 - DNA, 25 bp, Mus musculus
gagtcaggagtttgcgaagaagtca

SEQ ID NO: 659908 - DNA, 25 bp, Mus musculus
gagtcaggccctcattccaattcag

SEQ ID NO: 659909 - DNA, 25 bp, Mus musculus
gagtcaggccctgattccaattcag

SEQ ID NO: 659910 - DNA, 25 bp, Mus musculus
gagtcagggctcagacctggctctc

SEQ ID NO: 659911 - DNA, 25 bp, Mus musculus
gagtcagggctctgacctggctctc

SEQ ID NO: 659912 - DNA, 25 bp, Mus musculus
gagtcaggtgcaccctagtctatct

SEQ ID NO: 659913 - DNA, 25 bp, Mus musculus
gagtcaggtgcagcctagtctatct

SEQ ID NO: 659914 - DNA, 25 bp, Mus musculus
gagtcaggtgcccacagattcacag

SEQ ID NO: 659915 - DNA, 25 bp, Mus musculus
gagtcaggtgccgacagattcacag

SEQ ID NO: 659916 - DNA, 25 bp, Mus musculus
gagtcagtacataaaggaccacccc

SEQ ID NO: 659917 - DNA, 25 bp, Mus musculus
gagtcagtacattaaggaccacccc

SEQ ID NO: 659918 - DNA, 25 bp, Mus musculus
gagtcagtattgacatatcagctac

SEQ ID NO: 659919 - DNA, 25 bp, Mus musculus
gagtcagtattgtcatatcagctac

SEQ ID NO: 659920 - DNA, 25 bp, Mus musculus
gagtcagtcacgatgtcacaaccag

SEQ ID NO: 659921 - DNA, 25 bp, Mus musculus
gagtcagtcacgttgtcacaaccag

SEQ ID NO: 659922 - DNA, 25 bp, Mus musculus
gagtcagtccttcccaaatgtcttc

SEQ ID NO: 659923 - DNA, 25 bp, Mus musculus
gagtcagtccttgccaaatgtcttc

SEQ ID NO: 659924 - DNA, 25 bp, Mus musculus
gagtcagtcgaacctctcctcagcg

SEQ ID NO: 659925 - DNA, 25 bp, Mus musculus
gagtcagtcgaagctctcctcagcg

SEQ ID NO: 659926 - DNA, 25 bp, Mus musculus
gagtcagtctagacccaacaactgc

SEQ ID NO: 659927 - DNA, 25 bp, Mus musculus
gagtcagtctagtcccaacaactgc

SEQ ID NO: 659928 - DNA, 25 bp, Mus musculus
gagtcagtctataccaaaagccagc

SEQ ID NO: 659929 - DNA, 25 bp, Mus musculus
gagtcagtctattccaaaagccagc

SEQ ID NO: 659930 - DNA, 25 bp, Mus musculus
gagtcagtctgtattccatgagaag

SEQ ID NO: 659931 - DNA, 25 bp, Mus musculus
gagtcagtctgttttccatgagaag

SEQ ID NO: 659932 - DNA, 25 bp, Mus musculus
gagtcagtggaaaagaccacgaaca

SEQ ID NO: 659933 - DNA, 25 bp, Mus musculus
gagtcagtggaatagaccacgaaca

SEQ ID NO: 659934 - DNA, 25 bp, Mus musculus
gagtcatacaaaagaaatgaaagac

SEQ ID NO: 659935 - DNA, 25 bp, Mus musculus
gagtcatacaaatgaaatgaaagac

SEQ ID NO: 659936 - DNA, 25 bp, Mus musculus
gagtcatactacagcttctggacaa

SEQ ID NO: 659937 - DNA, 25 bp, Mus musculus
gagtcatactactgcttctggacaa

SEQ ID NO: 659938 - DNA, 25 bp, Mus musculus
gagtcatactctaggtcagaaataa

SEQ ID NO: 659939 - DNA, 25 bp, Mus musculus
gagtcatactcttggtcagaaataa

SEQ ID NO: 659940 - DNA, 25 bp, Mus musculus
gagtcatagccaatgagagtgcacc

SEQ ID NO: 659941 - DNA, 25 bp, Mus musculus
gagtcatagccattgagagtgcacc

SEQ ID NO: 659942 - DNA, 25 bp, Mus musculus
gagtcatatcctctcgatgccatcg

SEQ ID NO: 659943 - DNA, 25 bp, Mus musculus
gagtcatatcctgtcgatgccatcg

SEQ ID NO: 659944 - DNA, 25 bp, Mus musculus
gagtcatcatgaagagctctcccga

SEQ ID NO: 659945 - DNA, 25 bp, Mus musculus
gagtcatcatgatgagctctcccga

SEQ ID NO: 659946 - DNA, 25 bp, Mus musculus
gagtcatcattcagatacttcagtc

SEQ ID NO: 659947 - DNA, 25 bp, Mus musculus
gagtcatcattctgatacttcagtc

SEQ ID NO: 659948 - DNA, 25 bp, Mus musculus
gagtcatcattgagttcctctgtga

SEQ ID NO: 659949 - DNA, 25 bp, Mus musculus
gagtcatcattgtgttcctctgtga

SEQ ID NO: 659950 - DNA, 25 bp, Mus musculus
gagtcatccccacgcactgagtggg

SEQ ID NO: 659951 - DNA, 25 bp, Mus musculus
gagtcatccccaggcactgagtggg

SEQ ID NO: 659952 - DNA, 25 bp, Mus musculus
gagtcatcccgaatccgcaaactgg

SEQ ID NO: 659953 - DNA, 25 bp, Mus musculus
gagtcatcccgattccgcaaactgg

SEQ ID NO: 659954 - DNA, 25 bp, Mus musculus
gagtcatcctctccttagtctatgg

SEQ ID NO: 659955 - DNA, 25 bp, Mus musculus
gagtcatcctctgcttagtctatgg

SEQ ID NO: 659956 - DNA, 25 bp, Mus musculus
gagtcatctgacacagacactggtg

SEQ ID NO: 659957 - DNA, 25 bp, Mus musculus
gagtcatctgactcagacactggtg

SEQ ID NO: 659958 - DNA, 25 bp, Mus musculus
gagtcatctgcacgcataatgggaa

SEQ ID NO: 659959 - DNA, 25 bp, Mus musculus
gagtcatctgcaggcataatgggaa

SEQ ID NO: 659960 - DNA, 25 bp, Mus musculus
gagtcatgaaacagtaaccattgaa

SEQ ID NO: 659961 - DNA, 25 bp, Mus musculus
gagtcatgaaactgtaaccattgaa

SEQ ID NO: 659962 - DNA, 25 bp, Mus musculus
gagtcatgacaaaactgattccaag

SEQ ID NO: 659963 - DNA, 25 bp, Mus musculus
gagtcatgacaatactgattccaag

SEQ ID NO: 659964 - DNA, 25 bp, Mus musculus
gagtcatgacttcactgatatccag

SEQ ID NO: 659965 - DNA, 25 bp, Mus musculus
gagtcatgacttgactgatatccag

SEQ ID NO: 659966 - DNA, 25 bp, Mus musculus
gagtcatgatctcctcaggatcctc

SEQ ID NO: 659967 - DNA, 25 bp, Mus musculus
gagtcatgatctctactccctgtca

SEQ ID NO: 659968 - DNA, 25 bp, Mus musculus
gagtcatgatctgctcaggatcctc

SEQ ID NO: 659969 - DNA, 25 bp, Mus musculus
gagtcatgatctgtactccctgtca

SEQ ID NO: 659970 - DNA, 25 bp, Mus musculus
gagtcatgcactaccagcggcagaa

SEQ ID NO: 659971 - DNA, 25 bp, Mus musculus
gagtcatgcacttccagcggcagaa

SEQ ID NO: 659972 - DNA, 25 bp, Mus musculus
gagtcatgctctacattcgcctctc

SEQ ID NO: 659973 - DNA, 25 bp, Mus musculus
gagtcatgctcttcattcgcctctc

SEQ ID NO: 659974 - DNA, 25 bp, Mus musculus
gagtcatgtatacttggaaatagaa

SEQ ID NO: 659975 - DNA, 25 bp, Mus musculus
gagtcatgtatagttggaaatagaa

SEQ ID NO: 659976 - DNA, 25 bp, Mus musculus
gagtcatgtcctcgagcttctacaa

SEQ ID NO: 659977 - DNA, 25 bp, Mus musculus
gagtcatgtcctggagcttctacaa

SEQ ID NO: 659978 - DNA, 25 bp, Mus musculus
gagtcatgtgccacaatcagtagga

SEQ ID NO: 659979 - DNA, 25 bp, Mus musculus
gagtcatgtgcctcaatcagtagga

SEQ ID NO: 659980 - DNA, 25 bp, Mus musculus
gagtcatgtggcaggaactcatcct

SEQ ID NO: 659981 - DNA, 25 bp, Mus musculus
gagtcatgtggctggaactcatcct

SEQ ID NO: 659982 - DNA, 25 bp, Mus musculus
gagtcattcaagacacctggcataa

SEQ ID NO: 659983 - DNA, 25 bp, Mus musculus
gagtcattcaagtcacctggcataa

SEQ ID NO: 659984 - DNA, 25 bp, Mus musculus
gagtcattcattctcatgacacgag

SEQ ID NO: 659985 - DNA, 25 bp, Mus musculus
gagtcattcattgtcatgacacgag

SEQ ID NO: 659986 - DNA, 25 bp, Mus musculus
gagtcattgagaagggttcttgaga

SEQ ID NO: 659987 - DNA, 25 bp, Mus musculus
gagtcattgagatgggttcttgaga

SEQ ID NO: 659988 - DNA, 25 bp, Mus musculus
gagtcattgagtaatgctcttcaac

SEQ ID NO: 659989 - DNA, 25 bp, Mus musculus
gagtcattgagttatgctcttcaac

SEQ ID NO: 659990 - DNA, 25 bp, Mus musculus
gagtcattgctgagggagtcttcct

SEQ ID NO: 659991 - DNA, 25 bp, Mus musculus
gagtcattgctgtgggagtcttcct

SEQ ID NO: 659992 - DNA, 25 bp, Mus musculus
gagtcattgtcaagaccacaaagga

SEQ ID NO: 659993 - DNA, 25 bp, Mus musculus
gagtcattgtcaagtctgatccagg

SEQ ID NO: 659994 - DNA, 25 bp, Mus musculus
gagtcattgtcatgaccacaaagga

SEQ ID NO: 659995 - DNA, 25 bp, Mus musculus
gagtcattgtcatgtctgatccagg

SEQ ID NO: 659996 - DNA, 25 bp, Mus musculus
gagtcattgtggatccctgcctgtg

SEQ ID NO: 659997 - DNA, 25 bp, Mus musculus
gagtcattgtggttccctgcctgtg

SEQ ID NO: 659998 - DNA, 25 bp, Mus musculus
gagtccaaaatccacctccttgatc

SEQ ID NO: 659999 - DNA, 25 bp, Mus musculus
gagtccaaaatcgacctccttgatc

SEQ ID NO: 660000 - DNA, 25 bp, Mus musculus
gagtccaaacctacttcactgaaat

SEQ ID NO: 660001 - DNA, 25 bp, Mus musculus
gagtccaaaccttcttcactgaaat

SEQ ID NO: 660002 - DNA, 25 bp, Mus musculus
gagtccaaaggcagtgaagtcacag

SEQ ID NO: 660003 - DNA, 25 bp, Mus musculus
gagtccaaaggctgtgaagtcacag

SEQ ID NO: 660004 - DNA, 25 bp, Mus musculus
gagtccaagactatggctccaagct

SEQ ID NO: 660005 - DNA, 25 bp, Mus musculus
gagtccaagactttggctccaagct

SEQ ID NO: 660006 - DNA, 25 bp, Mus musculus
gagtccaaggctactcggatgccag

SEQ ID NO: 660007 - DNA, 25 bp, Mus musculus
gagtccaaggcttctcggatgccag

SEQ ID NO: 660008 - DNA, 25 bp, Mus musculus
gagtccacagccatgtgagtacccc

SEQ ID NO: 660009 - DNA, 25 bp, Mus musculus
gagtccacagccttgtgagtacccc

SEQ ID NO: 660010 - DNA, 25 bp, Mus musculus
gagtccacagtgctctaatccaggg

SEQ ID NO: 660011 - DNA, 25 bp, Mus musculus
gagtccacagtggtctaatccaggg

SEQ ID NO: 660012 - DNA, 25 bp, Mus musculus
gagtccacgagtatactgagtgctt

SEQ ID NO: 660013 - DNA, 25 bp, Mus musculus
gagtccacgagtttactgagtgctt

SEQ ID NO: 660014 - DNA, 25 bp, Mus musculus
gagtccacgcgcagcagtgatgtaa

SEQ ID NO: 660015 - DNA, 25 bp, Mus musculus
gagtccacgcgctgcagtgatgtaa

SEQ ID NO: 660016 - DNA, 25 bp, Mus musculus
gagtccactgtacagaatgccgagg

SEQ ID NO: 660017 - DNA, 25 bp, Mus musculus
gagtccactgtagagaatgccgagg

SEQ ID NO: 660018 - DNA, 25 bp, Mus musculus
gagtccagactaaagctccccaaga

SEQ ID NO: 660019 - DNA, 25 bp, Mus musculus
gagtccagactatagctccccaaga

SEQ ID NO: 660020 - DNA, 25 bp, Mus musculus
gagtccagactgaccagcgggtcct

SEQ ID NO: 660021 - DNA, 25 bp, Mus musculus
gagtccagactgtccagcgggtcct

SEQ ID NO: 660022 - DNA, 25 bp, Mus musculus
gagtccagcctgaaatgctctgtgc

SEQ ID NO: 660023 - DNA, 25 bp, Mus musculus
gagtccagcctgtaatgctctgtgc

SEQ ID NO: 660024 - DNA, 25 bp, Mus musculus
gagtccagctctagcaaatttccag

SEQ ID NO: 660025 - DNA, 25 bp, Mus musculus
gagtccagctcttgcaaatttccag

SEQ ID NO: 660026 - DNA, 25 bp, Mus musculus
gagtccaggactcctgaaggctcct

SEQ ID NO: 660027 - DNA, 25 bp, Mus musculus
gagtccaggactgctgaaggctcct

SEQ ID NO: 660028 - DNA, 25 bp, Mus musculus
gagtccaggcccagtacttctctgc

SEQ ID NO: 660029 - DNA, 25 bp, Mus musculus
gagtccaggccctgtacttctctgc

SEQ ID NO: 660030 - DNA, 25 bp, Mus musculus
gagtccagtaagaagtttgctaaag

SEQ ID NO: 660031 - DNA, 25 bp, Mus musculus
gagtccagtaagtagtttgctaaag

SEQ ID NO: 660032 - DNA, 25 bp, Mus musculus
gagtccagtccactgtttgtgtctc

SEQ ID NO: 660033 - DNA, 25 bp, Mus musculus
gagtccagtccagtgtttgtgtctc

SEQ ID NO: 660034 - DNA, 25 bp, Mus musculus
gagtccagttctcaggattctgaca

SEQ ID NO: 660035 - DNA, 25 bp, Mus musculus
gagtccagttctgaggattctgaca

SEQ ID NO: 660036 - DNA, 25 bp, Mus musculus
gagtccagtttaactatcccacccg

SEQ ID NO: 660037 - DNA, 25 bp, Mus musculus
gagtccagtttatctatcccacccg

SEQ ID NO: 660038 - DNA, 25 bp, Mus musculus
gagtccatatgtctcaatgaccggc

SEQ ID NO: 660039 - DNA, 25 bp, Mus musculus
gagtccatatgtgtcaatgaccggc

SEQ ID NO: 660040 - DNA, 25 bp, Mus musculus
gagtccatcgaccaaggccatgtca

SEQ ID NO: 660041 - DNA, 25 bp, Mus musculus
gagtccatcgacgaaggccatgtca

SEQ ID NO: 660042 - DNA, 25 bp, Mus musculus
gagtccatcgtgcttatttcagtgg

SEQ ID NO: 660043 - DNA, 25 bp, Mus musculus
gagtccatcgtggttatttcagtgg

SEQ ID NO: 660044 - DNA, 25 bp, Mus musculus
gagtccatctgacaaggcatacttc

SEQ ID NO: 660045 - DNA, 25 bp, Mus musculus
gagtccatctgagaaggcatacttc

SEQ ID NO: 660046 - DNA, 25 bp, Mus musculus
gagtccatctgtcttggtaaagccc

SEQ ID NO: 660047 - DNA, 25 bp, Mus musculus
gagtccatctgtgttggtaaagccc

SEQ ID NO: 660048 - DNA, 25 bp, Mus musculus
gagtccatgatccagcttttttaga

SEQ ID NO: 660049 - DNA, 25 bp, Mus musculus
gagtccatgatcgagcttttttaga

SEQ ID NO: 660050 - DNA, 25 bp, Mus musculus
gagtccatgctacgctacatctact

SEQ ID NO: 660051 - DNA, 25 bp, Mus musculus
gagtccatgctaggctacatctact

SEQ ID NO: 660052 - DNA, 25 bp, Mus musculus
gagtccattcatcagggtgctatca

SEQ ID NO: 660053 - DNA, 25 bp, Mus musculus
gagtccattcatgagggtgctatca

SEQ ID NO: 660054 - DNA, 25 bp, Mus musculus
gagtccatttctcgatccacagagc

SEQ ID NO: 660055 - DNA, 25 bp, Mus musculus
gagtccatttctggatccacagagc

SEQ ID NO: 660056 - DNA, 25 bp, Mus musculus
gagtccatttggcagactgaatctc

SEQ ID NO: 660057 - DNA, 25 bp, Mus musculus
gagtccatttgggagactgaatctc

SEQ ID NO: 660058 - DNA, 25 bp, Mus musculus
gagtcccaaattaggaaaagctgac

SEQ ID NO: 660059 - DNA, 25 bp, Mus musculus
gagtcccaaatttggaaaagctgac

SEQ ID NO: 660060 - DNA, 25 bp, Mus musculus
gagtcccacgcacgacatcttggca

SEQ ID NO: 660061 - DNA, 25 bp, Mus musculus
gagtcccacgcaggacatcttggca

SEQ ID NO: 660062 - DNA, 25 bp, Mus musculus
gagtcccagggaagctgagctcatt

SEQ ID NO: 660063 - DNA, 25 bp, Mus musculus
gagtcccagggatgctgagctcatt

SEQ ID NO: 660064 - DNA, 25 bp, Mus musculus
gagtcccattgccagagagggacta

SEQ ID NO: 660065 - DNA, 25 bp, Mus musculus
gagtcccattgcgagagagggacta

SEQ ID NO: 660066 - DNA, 25 bp, Mus musculus
gagtcccatttgagacttcttgccc

SEQ ID NO: 660067 - DNA, 25 bp, Mus musculus
gagtcccatttgtgacttcttgccc

SEQ ID NO: 660068 - DNA, 25 bp, Mus musculus
gagtccccaaggactagtggagtcc

SEQ ID NO: 660069 - DNA, 25 bp, Mus musculus
gagtccccaaggtctagtggagtcc

SEQ ID NO: 660070 - DNA, 25 bp, Mus musculus
gagtccccagagaactcagacactg

SEQ ID NO: 660071 - DNA, 25 bp, Mus musculus
gagtccccagagtactcagacactg

SEQ ID NO: 660072 - DNA, 25 bp, Mus musculus
gagtccccgtacacacactggaagc

SEQ ID NO: 660073 - DNA, 25 bp, Mus musculus
gagtccccgtactcacactggaagc

SEQ ID NO: 660074 - DNA, 25 bp, Mus musculus
gagtcccctgccaaagtgcatgtct

SEQ ID NO: 660075 - DNA, 25 bp, Mus musculus
gagtcccctgcctaagtgcatgtct

SEQ ID NO: 660076 - DNA, 25 bp, Mus musculus
gagtccccttacacagttgagccgg

SEQ ID NO: 660077 - DNA, 25 bp, Mus musculus
gagtccccttactcagttgagccgg

SEQ ID NO: 660078 - DNA, 25 bp, Mus musculus
gagtcccgggatcagctcacagaaa

SEQ ID NO: 660079 - DNA, 25 bp, Mus musculus
gagtcccgggatgagctcacagaaa

SEQ ID NO: 660080 - DNA, 25 bp, Mus musculus
gagtccctatgtagtggcctcacgt

SEQ ID NO: 660081 - DNA, 25 bp, Mus musculus
gagtccctatgttgtggcctcacgt

SEQ ID NO: 660082 - DNA, 25 bp, Mus musculus
gagtccctccacatacacagtcagg

SEQ ID NO: 660083 - DNA, 25 bp, Mus musculus
gagtccctccacttacacagtcagg

SEQ ID NO: 660084 - DNA, 25 bp, Mus musculus
gagtccctcgagaatctgcagttca

SEQ ID NO: 660085 - DNA, 25 bp, Mus musculus
gagtccctcgagtatctgcagttca

SEQ ID NO: 660086 - DNA, 25 bp, Mus musculus
gagtccctgaaccaatctcttccgg

SEQ ID NO: 660087 - DNA, 25 bp, Mus musculus
gagtccctgaacgaatctcttccgg

SEQ ID NO: 660088 - DNA, 25 bp, Mus musculus
gagtccctggacagggattcagcca

SEQ ID NO: 660089 - DNA, 25 bp, Mus musculus
gagtccctggactgggattcagcca

SEQ ID NO: 660090 - DNA, 25 bp, Mus musculus
gagtccctggtgcttactgtaccct

SEQ ID NO: 660091 - DNA, 25 bp, Mus musculus
gagtccctggtggttactgtaccct

SEQ ID NO: 660092 - DNA, 25 bp, Mus musculus
gagtccctgttcaattccatgattc

SEQ ID NO: 660093 - DNA, 25 bp, Mus musculus
gagtccctgttctattccatgattc

SEQ ID NO: 660094 - DNA, 25 bp, Mus musculus
gagtcccttggacacttctgtgcaa

SEQ ID NO: 660095 - DNA, 25 bp, Mus musculus
gagtcccttggagacttctgtgcaa

SEQ ID NO: 660096 - DNA, 25 bp, Mus musculus
gagtccgaagaacaccctattctag

SEQ ID NO: 660097 - DNA, 25 bp, Mus musculus
gagtccgaagaagaccctattctag

SEQ ID NO: 660098 - DNA, 25 bp, Mus musculus
gagtccgagtggaccttggaccgct

SEQ ID NO: 660099 - DNA, 25 bp, Mus musculus
gagtccgagtggtccttggaccgct

SEQ ID NO: 660100 - DNA, 25 bp, Mus musculus
gagtccgatggcagcagaggacaac

SEQ ID NO: 660101 - DNA, 25 bp, Mus musculus
gagtccgatggctgcagaggacaac

SEQ ID NO: 660102 - DNA, 25 bp, Mus musculus
gagtccgcgaatcgtccgctccgga

SEQ ID NO: 660103 - DNA, 25 bp, Mus musculus
gagtccgcgaatggtccgctccgga

SEQ ID NO: 660104 - DNA, 25 bp, Mus musculus
gagtccgcgtgtactccgcggtgct

SEQ ID NO: 660105 - DNA, 25 bp, Mus musculus
gagtccgcgtgttctccgcggtgct

SEQ ID NO: 660106 - DNA, 25 bp, Mus musculus
gagtccgctcttagctatcttctcc

SEQ ID NO: 660107 - DNA, 25 bp, Mus musculus
gagtccgctctttgctatcttctcc

SEQ ID NO: 660108 - DNA, 25 bp, Mus musculus
gagtccgctgaaatggctgtgttgt

SEQ ID NO: 660109 - DNA, 25 bp, Mus musculus
gagtccgctgaattggctgtgttgt

SEQ ID NO: 660110 - DNA, 25 bp, Mus musculus
gagtccgcttgcaacttgactgaga

SEQ ID NO: 660111 - DNA, 25 bp, Mus musculus
gagtccgcttgctacttgactgaga

SEQ ID NO: 660112 - DNA, 25 bp, Mus musculus
gagtccggaggacatgtacattcaa

SEQ ID NO: 660113 - DNA, 25 bp, Mus musculus
gagtccggaggagatgtacattcaa

SEQ ID NO: 660114 - DNA, 25 bp, Mus musculus
gagtccggcacaagctccgtaaatt

SEQ ID NO: 660115 - DNA, 25 bp, Mus musculus
gagtccggcacatgctccgtaaatt

SEQ ID NO: 660116 - DNA, 25 bp, Mus musculus
gagtccggtacaccagagactgccc

SEQ ID NO: 660117 - DNA, 25 bp, Mus musculus
gagtccggtacagcagagactgccc

SEQ ID NO: 660118 - DNA, 25 bp, Mus musculus
gagtccgtgcaactgaatcatatga

SEQ ID NO: 660119 - DNA, 25 bp, Mus musculus
gagtccgtgcaagtgaatcatatga

SEQ ID NO: 660120 - DNA, 25 bp, Mus musculus
gagtccgttatgcatcccatcgatg

SEQ ID NO: 660121 - DNA, 25 bp, Mus musculus
gagtccgttatggatcccatcgatg

SEQ ID NO: 660122 - DNA, 25 bp, Mus musculus
gagtcctacaagacggtcctcgata

SEQ ID NO: 660123 - DNA, 25 bp, Mus musculus
gagtcctacaagcagtcctacaaag

SEQ ID NO: 660124 - DNA, 25 bp, Mus musculus
gagtcctacaaggagtcctacaaag

SEQ ID NO: 660125 - DNA, 25 bp, Mus musculus
gagtcctacaagtcggtcctcgata

SEQ ID NO: 660126 - DNA, 25 bp, Mus musculus
gagtcctactacaaaactgagggcg

SEQ ID NO: 660127 - DNA, 25 bp, Mus musculus
gagtcctactactaaactgagggcg

SEQ ID NO: 660128 - DNA, 25 bp, Mus musculus
gagtcctagagtataatgacaacca

SEQ ID NO: 660129 - DNA, 25 bp, Mus musculus
gagtcctagagtttaatgacaacca

SEQ ID NO: 660130 - DNA, 25 bp, Mus musculus
gagtcctagtgactgcttctccaag

SEQ ID NO: 660131 - DNA, 25 bp, Mus musculus
gagtcctagtgagtgcttctccaag

SEQ ID NO: 660132 - DNA, 25 bp, Mus musculus
gagtcctatcagagcctgttctcag

SEQ ID NO: 660133 - DNA, 25 bp, Mus musculus
gagtcctatcagtgcctgttctcag

SEQ ID NO: 660134 - DNA, 25 bp, Mus musculus
gagtcctcagcgagaccttgtatga

SEQ ID NO: 660135 - DNA, 25 bp, Mus musculus
gagtcctcagcgtgaccttgtatga

SEQ ID NO: 660136 - DNA, 25 bp, Mus musculus
gagtcctcatcactcttggagccaa

SEQ ID NO: 660137 - DNA, 25 bp, Mus musculus
gagtcctcatcagtcttggagccaa

SEQ ID NO: 660138 - DNA, 25 bp, Mus musculus
gagtcctccaagagggtgcccagtt

SEQ ID NO: 660139 - DNA, 25 bp, Mus musculus
gagtcctccaagtgggtgcccagtt

SEQ ID NO: 660140 - DNA, 25 bp, Mus musculus
gagtcctccagcagaggagtcaccc

SEQ ID NO: 660141 - DNA, 25 bp, Mus musculus
gagtcctccagctgaggagtcaccc

SEQ ID NO: 660142 - DNA, 25 bp, Mus musculus
gagtcctccccaaaaggctatgcag

SEQ ID NO: 660143 - DNA, 25 bp, Mus musculus
gagtcctccccataaggctatgcag

SEQ ID NO: 660144 - DNA, 25 bp, Mus musculus
gagtcctcttgtaggagctacaact

SEQ ID NO: 660145 - DNA, 25 bp, Mus musculus
gagtcctcttgttggagctacaact

SEQ ID NO: 660146 - DNA, 25 bp, Mus musculus
gagtcctgaagacaactgtgcctca

SEQ ID NO: 660147 - DNA, 25 bp, Mus musculus
gagtcctgaagagaactgtgcctca

SEQ ID NO: 660148 - DNA, 25 bp, Mus musculus
gagtcctgacagcatcatggagatg

SEQ ID NO: 660149 - DNA, 25 bp, Mus musculus
gagtcctgacaggatcatggagatg

SEQ ID NO: 660150 - DNA, 25 bp, Mus musculus
gagtcctgagtcagcaccatctgcc

SEQ ID NO: 660151 - DNA, 25 bp, Mus musculus
gagtcctgagtcatgaagcctctga

SEQ ID NO: 660152 - DNA, 25 bp, Mus musculus
gagtcctgagtctgcaccatctgcc

SEQ ID NO: 660153 - DNA, 25 bp, Mus musculus
gagtcctgagtcttgaagcctctga

SEQ ID NO: 660154 - DNA, 25 bp, Mus musculus
gagtcctgcaacactcaatgctagg

SEQ ID NO: 660155 - DNA, 25 bp, Mus musculus
gagtcctgcaacctggcggcctatc

SEQ ID NO: 660156 - DNA, 25 bp, Mus musculus
gagtcctgcaacgtggcggcctatc

SEQ ID NO: 660157 - DNA, 25 bp, Mus musculus
gagtcctgcaactctcaatgctagg

SEQ ID NO: 660158 - DNA, 25 bp, Mus musculus
gagtcctgcaagactgggtcattga

SEQ ID NO: 660159 - DNA, 25 bp, Mus musculus
gagtcctgcaagtctgggtcattga

SEQ ID NO: 660160 - DNA, 25 bp, Mus musculus
gagtcctgcagactacagactagcc

SEQ ID NO: 660161 - DNA, 25 bp, Mus musculus
gagtcctgcagagtacagactagcc

SEQ ID NO: 660162 - DNA, 25 bp, Mus musculus
gagtcctgccaacatgtctattggt

SEQ ID NO: 660163 - DNA, 25 bp, Mus musculus
gagtcctgccaagatgtctattggt

SEQ ID NO: 660164 - DNA, 25 bp, Mus musculus
gagtcctgcggcaagcgtgccattg

SEQ ID NO: 660165 - DNA, 25 bp, Mus musculus
gagtcctgcggctagcgtgccattg

SEQ ID NO: 660166 - DNA, 25 bp, Mus musculus
gagtcctggaagcatctcttgtgct

SEQ ID NO: 660167 - DNA, 25 bp, Mus musculus
gagtcctggaaggatctcttgtgct

SEQ ID NO: 660168 - DNA, 25 bp, Mus musculus
gagtcctggatgatatgacacctat

SEQ ID NO: 660169 - DNA, 25 bp, Mus musculus
gagtcctggatgttatgacacctat

SEQ ID NO: 660170 - DNA, 25 bp, Mus musculus
gagtcctggccacctacgattcaag

SEQ ID NO: 660171 - DNA, 25 bp, Mus musculus
gagtcctggccagctacgattcaag

SEQ ID NO: 660172 - DNA, 25 bp, Mus musculus
gagtcctgggcgatctttccagtga

SEQ ID NO: 660173 - DNA, 25 bp, Mus musculus
gagtcctgggcgttctttccagtga

SEQ ID NO: 660174 - DNA, 25 bp, Mus musculus
gagtcctggtgtccacgggtcatca

SEQ ID NO: 660175 - DNA, 25 bp, Mus musculus
gagtcctggtgtgcacgggtcatca

SEQ ID NO: 660176 - DNA, 25 bp, Mus musculus
gagtcctggttcatgtatagtggaa

SEQ ID NO: 660177 - DNA, 25 bp, Mus musculus
gagtcctggttcttgtatagtggaa

SEQ ID NO: 660178 - DNA, 25 bp, Mus musculus
gagtcctgttgaagttgccagtaaa

SEQ ID NO: 660179 - DNA, 25 bp, Mus musculus
gagtcctgttgatgttgccagtaaa

SEQ ID NO: 660180 - DNA, 25 bp, Mus musculus
gagtccttcaataacgttaaacagt

SEQ ID NO: 660181 - DNA, 25 bp, Mus musculus
gagtccttcaattacgttaaacagt

SEQ ID NO: 660182 - DNA, 25 bp, Mus musculus
gagtccttcagcatcgagatcccct

SEQ ID NO: 660183 - DNA, 25 bp, Mus musculus
gagtccttcagcttcgagatcccct

SEQ ID NO: 660184 - DNA, 25 bp, Mus musculus
gagtccttcatccatgtctatgcta

SEQ ID NO: 660185 - DNA, 25 bp, Mus musculus
gagtccttcatcgatgtctatgcta

SEQ ID NO: 660186 - DNA, 25 bp, Mus musculus
gagtccttccgtcggtcaaagtaag

SEQ ID NO: 660187 - DNA, 25 bp, Mus musculus
gagtccttccgtgggtcaaagtaag

SEQ ID NO: 660188 - DNA, 25 bp, Mus musculus
gagtccttctgccaacatccctgag

SEQ ID NO: 660189 - DNA, 25 bp, Mus musculus
gagtccttctgcgaacatccctgag

SEQ ID NO: 660190 - DNA, 25 bp, Mus musculus
gagtccttgcccaatgagatcgcgt

SEQ ID NO: 660191 - DNA, 25 bp, Mus musculus
gagtccttgccctatgagatcgcgt

SEQ ID NO: 660192 - DNA, 25 bp, Mus musculus
gagtccttggctccatgtgccagaa

SEQ ID NO: 660193 - DNA, 25 bp, Mus musculus
gagtccttggctcgctacgcggaca

SEQ ID NO: 660194 - DNA, 25 bp, Mus musculus
gagtccttggctgcatgtgccagaa

SEQ ID NO: 660195 - DNA, 25 bp, Mus musculus
gagtccttggctggctacgcggaca

SEQ ID NO: 660196 - DNA, 25 bp, Mus musculus
gagtccttgtttcgatctgttgctg

SEQ ID NO: 660197 - DNA, 25 bp, Mus musculus
gagtccttgtttggatctgttgctg

SEQ ID NO: 660198 - DNA, 25 bp, Mus musculus
gagtcctttcctcgtataggaagca

SEQ ID NO: 660199 - DNA, 25 bp, Mus musculus
gagtcctttcctggtataggaagca

SEQ ID NO: 660200 - DNA, 25 bp, Mus musculus
gagtcctttctcagggccgttgtct

SEQ ID NO: 660201 - DNA, 25 bp, Mus musculus
gagtcctttctctgggccgttgtct

SEQ ID NO: 660202 - DNA, 25 bp, Mus musculus
gagtcgaagcacacctgtacgggac

SEQ ID NO: 660203 - DNA, 25 bp, Mus musculus
gagtcgaagcactcctgtacgggac

SEQ ID NO: 660204 - DNA, 25 bp, Mus musculus
gagtcgaagctccagaaagtactgg

SEQ ID NO: 660205 - DNA, 25 bp, Mus musculus
gagtcgaagctcgagaaagtactgg

SEQ ID NO: 660206 - DNA, 25 bp, Mus musculus
gagtcgaagtcaaagcaggagtcgt

SEQ ID NO: 660207 - DNA, 25 bp, Mus musculus
gagtcgaagtcatagcaggagtcgt

SEQ ID NO: 660208 - DNA, 25 bp, Mus musculus
gagtcgaatgatcctggccttcctg

SEQ ID NO: 660209 - DNA, 25 bp, Mus musculus
gagtcgaatgatgctggccttcctg

SEQ ID NO: 660210 - DNA, 25 bp, Mus musculus
gagtcgacccatccggacaccattg

SEQ ID NO: 660211 - DNA, 25 bp, Mus musculus
gagtcgacccatgcggacaccattg

SEQ ID NO: 660212 - DNA, 25 bp, Mus musculus
gagtcgaccgccagcatcttggcct

SEQ ID NO: 660213 - DNA, 25 bp, Mus musculus
gagtcgaccgcctgcatcttggcct

SEQ ID NO: 660214 - DNA, 25 bp, Mus musculus
gagtcgagctacacgccaagaagat

SEQ ID NO: 660215 - DNA, 25 bp, Mus musculus
gagtcgagctactcgccaagaagat

SEQ ID NO: 660216 - DNA, 25 bp, Mus musculus
gagtcgaggtgcaaatagggatacc

SEQ ID NO: 660217 - DNA, 25 bp, Mus musculus
gagtcgaggtgctaatagggatacc

SEQ ID NO: 660218 - DNA, 25 bp, Mus musculus
gagtcgatggaaactcctccaccta

SEQ ID NO: 660219 - DNA, 25 bp, Mus musculus
gagtcgatggaatctcctccaccta

SEQ ID NO: 660220 - DNA, 25 bp, Mus musculus
gagtcgcaagtgcaccacagcacca

SEQ ID NO: 660221 - DNA, 25 bp, Mus musculus
gagtcgcaagtggaccacagcacca

SEQ ID NO: 660222 - DNA, 25 bp, Mus musculus
gagtcgcagagaccattgacatagg

SEQ ID NO: 660223 - DNA, 25 bp, Mus musculus
gagtcgcagagagcattgacatagg

SEQ ID NO: 660224 - DNA, 25 bp, Mus musculus
gagtcgcgctccaggtcaaaatcgg

SEQ ID NO: 660225 - DNA, 25 bp, Mus musculus
gagtcgcgctcctggtcaaaatcgg

SEQ ID NO: 660226 - DNA, 25 bp, Mus musculus
gagtcgctctgccacaattgtcttg

SEQ ID NO: 660227 - DNA, 25 bp, Mus musculus
gagtcgctctgcgacaattgtcttg

SEQ ID NO: 660228 - DNA, 25 bp, Mus musculus
gagtcgctcttgcacgagttggcca

SEQ ID NO: 660229 - DNA, 25 bp, Mus musculus
gagtcgctcttggacgagttggcca

SEQ ID NO: 660230 - DNA, 25 bp, Mus musculus
gagtcgctgaccctctctgagcctt

SEQ ID NO: 660231 - DNA, 25 bp, Mus musculus
gagtcgctgaccgtctctgagcctt

SEQ ID NO: 660232 - DNA, 25 bp, Mus musculus
gagtcgcttgacaactgatgtgcaa

SEQ ID NO: 660233 - DNA, 25 bp, Mus musculus
gagtcgcttgactactgatgtgcaa

SEQ ID NO: 660234 - DNA, 25 bp, Mus musculus
gagtcggaagatcctaattacaacg

SEQ ID NO: 660235 - DNA, 25 bp, Mus musculus
gagtcggaagatgctaattacaacg

SEQ ID NO: 660236 - DNA, 25 bp, Mus musculus
gagtcggaataacaagcggactgca

SEQ ID NO: 660237 - DNA, 25 bp, Mus musculus
gagtcggaataagaagcggactgca

SEQ ID NO: 660238 - DNA, 25 bp, Mus musculus
gagtcggagcggatccggctcttcc

SEQ ID NO: 660239 - DNA, 25 bp, Mus musculus
gagtcggagcggttccggctcttcc

SEQ ID NO: 660240 - DNA, 25 bp, Mus musculus
gagtcggatgctcagtatcttctac

SEQ ID NO: 660241 - DNA, 25 bp, Mus musculus
gagtcggatgctgagtatcttctac

SEQ ID NO: 660242 - DNA, 25 bp, Mus musculus
gagtcggattgtaacaataagtcac

SEQ ID NO: 660243 - DNA, 25 bp, Mus musculus
gagtcggattgttacaataagtcac

SEQ ID NO: 660244 - DNA, 25 bp, Mus musculus
gagtcggcaaggataacttctgggc

SEQ ID NO: 660245 - DNA, 25 bp, Mus musculus
gagtcggcaaggttaacttctgggc

SEQ ID NO: 660246 - DNA, 25 bp, Mus musculus
gagtcggcagaacaagaccaataaa

SEQ ID NO: 660247 - DNA, 25 bp, Mus musculus
gagtcggcagaagaagaccaataaa

SEQ ID NO: 660248 - DNA, 25 bp, Mus musculus
gagtcggcctacacaaagtcttcaa

SEQ ID NO: 660249 - DNA, 25 bp, Mus musculus
gagtcggcctactcaaagtcttcaa

SEQ ID NO: 660250 - DNA, 25 bp, Mus musculus
gagtcggctcagaccgccgaggaag

SEQ ID NO: 660251 - DNA, 25 bp, Mus musculus
gagtcggctcagtccgccgaggaag

SEQ ID NO: 660252 - DNA, 25 bp, Mus musculus
gagtcggctctaaactcttctttga

SEQ ID NO: 660253 - DNA, 25 bp, Mus musculus
gagtcggctctatactcttctttga

SEQ ID NO: 660254 - DNA, 25 bp, Mus musculus
gagtcggcttcccagttggaacttg

SEQ ID NO: 660255 - DNA, 25 bp, Mus musculus
gagtcggcttccgagttggaacttg

SEQ ID NO: 660256 - DNA, 25 bp, Mus musculus
gagtcgggctatccaggcttcatca

SEQ ID NO: 660257 - DNA, 25 bp, Mus musculus
gagtcgggctatgcaggcttcatca

SEQ ID NO: 660258 - DNA, 25 bp, Mus musculus
gagtcgggctcgatgctggtgtccg

SEQ ID NO: 660259 - DNA, 25 bp, Mus musculus
gagtcgggctcgttgctggtgtccg

SEQ ID NO: 660260 - DNA, 25 bp, Mus musculus
gagtcgggttggaccgggacggctg

SEQ ID NO: 660261 - DNA, 25 bp, Mus musculus
gagtcgggttggtccgggacggctg

SEQ ID NO: 660262 - DNA, 25 bp, Mus musculus
gagtcggtacctactggccatggag

SEQ ID NO: 660263 - DNA, 25 bp, Mus musculus
gagtcggtaccttctggccatggag

SEQ ID NO: 660264 - DNA, 25 bp, Mus musculus
gagtcggtctgtcacgaccctactg

SEQ ID NO: 660265 - DNA, 25 bp, Mus musculus
gagtcggtctgtgacgaccctactg

SEQ ID NO: 660266 - DNA, 25 bp, Mus musculus
gagtcggtgacaatcaaagatgtgg

SEQ ID NO: 660267 - DNA, 25 bp, Mus musculus
gagtcggtgacattcaaagatgtgg

SEQ ID NO: 660268 - DNA, 25 bp, Mus musculus
gagtcggtgcagaatgaccacccca

SEQ ID NO: 660269 - DNA, 25 bp, Mus musculus
gagtcggtgcagtatgaccacccca

SEQ ID NO: 660270 - DNA, 25 bp, Mus musculus
gagtcgtacaaacacagcacgctaa

SEQ ID NO: 660271 - DNA, 25 bp, Mus musculus
gagtcgtacaaagacagcacgctaa

SEQ ID NO: 660272 - DNA, 25 bp, Mus musculus
gagtcgtatgaaccacctgaaggag

SEQ ID NO: 660273 - DNA, 25 bp, Mus musculus
gagtcgtatgaagcacctgaaggag

SEQ ID NO: 660274 - DNA, 25 bp, Mus musculus
gagtcgtatttaaattcccgggagg

SEQ ID NO: 660275 - DNA, 25 bp, Mus musculus
gagtcgtatttatattcccgggagg

SEQ ID NO: 660276 - DNA, 25 bp, Mus musculus
gagtcgtgagacatctgtgttgcag

SEQ ID NO: 660277 - DNA, 25 bp, Mus musculus
gagtcgtgagacttctgtgttgcag

SEQ ID NO: 660278 - DNA, 25 bp, Mus musculus
gagtcgttctccagctaggaccaga

SEQ ID NO: 660279 - DNA, 25 bp, Mus musculus
gagtcgttctcctgctaggaccaga

SEQ ID NO: 660280 - DNA, 25 bp, Mus musculus
gagtcgttgagtcttcttttgttca

SEQ ID NO: 660281 - DNA, 25 bp, Mus musculus
gagtcgttgagtgttcttttgttca

SEQ ID NO: 660282 - DNA, 25 bp, Mus musculus
gagtcgtttgaacacctgactgagg

SEQ ID NO: 660283 - DNA, 25 bp, Mus musculus
gagtcgtttgaagacctgactgagg

SEQ ID NO: 660284 - DNA, 25 bp, Mus musculus
gagtctaactgcaggaacggagtgt

SEQ ID NO: 660285 - DNA, 25 bp, Mus musculus
gagtctaactgctggaacggagtgt

SEQ ID NO: 660286 - DNA, 25 bp, Mus musculus
gagtctaatagacagctgcacctag

SEQ ID NO: 660287 - DNA, 25 bp, Mus musculus
gagtctaatagagagctgcacctag

SEQ ID NO: 660288 - DNA, 25 bp, Mus musculus
gagtctacaaatctcactgacaagg

SEQ ID NO: 660289 - DNA, 25 bp, Mus musculus
gagtctacaaatgtcactgacaagg

SEQ ID NO: 660290 - DNA, 25 bp, Mus musculus
gagtctacaggaatctggaacctgg

SEQ ID NO: 660291 - DNA, 25 bp, Mus musculus
gagtctacaggattctggaacctgg

SEQ ID NO: 660292 - DNA, 25 bp, Mus musculus
gagtctaccaagaatcccattgtct

SEQ ID NO: 660293 - DNA, 25 bp, Mus musculus
gagtctaccaagtatcccattgtct

SEQ ID NO: 660294 - DNA, 25 bp, Mus musculus
gagtctaccattacgatttccctgt

SEQ ID NO: 660295 - DNA, 25 bp, Mus musculus
gagtctaccatttcgatttccctgt

SEQ ID NO: 660296 - DNA, 25 bp, Mus musculus
gagtctaccgcgacgaatatcagcg

SEQ ID NO: 660297 - DNA, 25 bp, Mus musculus
gagtctaccgcgtcgaatatcagcg

SEQ ID NO: 660298 - DNA, 25 bp, Mus musculus
gagtctacgccaagggcttcaatcg

SEQ ID NO: 660299 - DNA, 25 bp, Mus musculus
gagtctacgccactctgttaagagg

SEQ ID NO: 660300 - DNA, 25 bp, Mus musculus
gagtctacgccagtctgttaagagg

SEQ ID NO: 660301 - DNA, 25 bp, Mus musculus
gagtctacgccatgggcttcaatcg

SEQ ID NO: 660302 - DNA, 25 bp, Mus musculus
gagtctactcagagtccatctctca

SEQ ID NO: 660303 - DNA, 25 bp, Mus musculus
gagtctactcagtgtccatctctca

SEQ ID NO: 660304 - DNA, 25 bp, Mus musculus
gagtctagcatgatcttttgtaaag

SEQ ID NO: 660305 - DNA, 25 bp, Mus musculus
gagtctagcatgttcttttgtaaag

SEQ ID NO: 660306 - DNA, 25 bp, Mus musculus
gagtctagtgagagtgcaccctggt

SEQ ID NO: 660307 - DNA, 25 bp, Mus musculus
gagtctagtgagtgtgcaccctggt

SEQ ID NO: 660308 - DNA, 25 bp, Mus musculus
gagtctataagtctgtcattcaagc

SEQ ID NO: 660309 - DNA, 25 bp, Mus musculus
gagtctataagtgtgtcattcaagc

SEQ ID NO: 660310 - DNA, 25 bp, Mus musculus
gagtctatagatccagcctgctact

SEQ ID NO: 660311 - DNA, 25 bp, Mus musculus
gagtctatagatgcagcctgctact

SEQ ID NO: 660312 - DNA, 25 bp, Mus musculus
gagtctatcagacagaagttggcac

SEQ ID NO: 660313 - DNA, 25 bp, Mus musculus
gagtctatcagagagaagttggcac

SEQ ID NO: 660314 - DNA, 25 bp, Mus musculus
gagtctatcttcagaggagaccaaa

SEQ ID NO: 660315 - DNA, 25 bp, Mus musculus
gagtctatcttctgaggagaccaaa

SEQ ID NO: 660316 - DNA, 25 bp, Mus musculus
gagtctatggcacctgcctccaggg

SEQ ID NO: 660317 - DNA, 25 bp, Mus musculus
gagtctatggcagctgcctccaggg

SEQ ID NO: 660318 - DNA, 25 bp, Mus musculus
gagtctatggccatgggcacgaatg

SEQ ID NO: 660319 - DNA, 25 bp, Mus musculus
gagtctatggccttgggcacgaatg

SEQ ID NO: 660320 - DNA, 25 bp, Mus musculus
gagtctatggctccctgcacccatt

SEQ ID NO: 660321 - DNA, 25 bp, Mus musculus
gagtctatggctgcctgcacccatt

SEQ ID NO: 660322 - DNA, 25 bp, Mus musculus
gagtctatttatctggtgacagcaa

SEQ ID NO: 660323 - DNA, 25 bp, Mus musculus
gagtctatttatgtggtgacagcaa

SEQ ID NO: 660324 - DNA, 25 bp, Mus musculus
gagtctatttctaccgagttccaca

SEQ ID NO: 660325 - DNA, 25 bp, Mus musculus
gagtctatttcttccgagttccaca

SEQ ID NO: 660326 - DNA, 25 bp, Mus musculus
gagtctcaaactagtttcttgataa

SEQ ID NO: 660327 - DNA, 25 bp, Mus musculus
gagtctcaaacttgtttcttgataa

SEQ ID NO: 660328 - DNA, 25 bp, Mus musculus
gagtctcagccaaagtcacagtgaa

SEQ ID NO: 660329 - DNA, 25 bp, Mus musculus
gagtctcagccatagtcacagtgaa

SEQ ID NO: 660330 - DNA, 25 bp, Mus musculus
gagtctcagccccatgtctcagagg

SEQ ID NO: 660331 - DNA, 25 bp, Mus musculus
gagtctcagcccgatgtctcagagg

SEQ ID NO: 660332 - DNA, 25 bp, Mus musculus
gagtctcagcgtcgtatgggctaca

SEQ ID NO: 660333 - DNA, 25 bp, Mus musculus
gagtctcagcgtggtatgggctaca

SEQ ID NO: 660334 - DNA, 25 bp, Mus musculus
gagtctcagtgacgtccagtactga

SEQ ID NO: 660335 - DNA, 25 bp, Mus musculus
gagtctcagtgaggtccagtactga

SEQ ID NO: 660336 - DNA, 25 bp, Mus musculus
gagtctcatccacagtgggtccgct

SEQ ID NO: 660337 - DNA, 25 bp, Mus musculus
gagtctcatccagagtgggtccgct

SEQ ID NO: 660338 - DNA, 25 bp, Mus musculus
gagtctccaaatcctttctgataaa

SEQ ID NO: 660339 - DNA, 25 bp, Mus musculus
gagtctccaaatgctttctgataaa

SEQ ID NO: 660340 - DNA, 25 bp, Mus musculus
gagtctccaactaaagtctctgcag

SEQ ID NO: 660341 - DNA, 25 bp, Mus musculus
gagtctccaacttaagtctctgcag

SEQ ID NO: 660342 - DNA, 25 bp, Mus musculus
gagtctccaagcctggcagctgcga

SEQ ID NO: 660343 - DNA, 25 bp, Mus musculus
gagtctccaagcgtggcagctgcga

SEQ ID NO: 660344 - DNA, 25 bp, Mus musculus
gagtctccaatgaaatgtacacaga

SEQ ID NO: 660345 - DNA, 25 bp, Mus musculus
gagtctccaatgtaatgtacacaga

SEQ ID NO: 660346 - DNA, 25 bp, Mus musculus
gagtctccacctcaggaagattggg

SEQ ID NO: 660347 - DNA, 25 bp, Mus musculus
gagtctccacctgaggaagattggg

SEQ ID NO: 660348 - DNA, 25 bp, Mus musculus
gagtctcccaagatgctgcggaagg

SEQ ID NO: 660349 - DNA, 25 bp, Mus musculus
gagtctcccaagttgctgcggaagg

SEQ ID NO: 660350 - DNA, 25 bp, Mus musculus
gagtctccctgtcttttttaggatg

SEQ ID NO: 660351 - DNA, 25 bp, Mus musculus
gagtctccctgtgttttttaggatg

SEQ ID NO: 660352 - DNA, 25 bp, Mus musculus
gagtctccgaatatgagctccctga

SEQ ID NO: 660353 - DNA, 25 bp, Mus musculus
gagtctccgaatttgagctccctga

SEQ ID NO: 660354 - DNA, 25 bp, Mus musculus
gagtctccgtcaagattttatttct

SEQ ID NO: 660355 - DNA, 25 bp, Mus musculus
gagtctccgtcatgattttatttct

SEQ ID NO: 660356 - DNA, 25 bp, Mus musculus
gagtctccgtgaatctggaattcac

SEQ ID NO: 660357 - DNA, 25 bp, Mus musculus
gagtctccgtgattctggaattcac

SEQ ID NO: 660358 - DNA, 25 bp, Mus musculus
gagtctcctctacactgcagggcgg

SEQ ID NO: 660359 - DNA, 25 bp, Mus musculus
gagtctcctctagactgcagggcgg

SEQ ID NO: 660360 - DNA, 25 bp, Mus musculus
gagtctcctcttactgaagtcacca

SEQ ID NO: 660361 - DNA, 25 bp, Mus musculus
gagtctcctctttctgaagtcacca

SEQ ID NO: 660362 - DNA, 25 bp, Mus musculus
gagtctcctgtgacgcacacggctc

SEQ ID NO: 660363 - DNA, 25 bp, Mus musculus
gagtctcctgtgtcgcacacggctc

SEQ ID NO: 660364 - DNA, 25 bp, Mus musculus
gagtctccttacctctggtccctta

SEQ ID NO: 660365 - DNA, 25 bp, Mus musculus
gagtctccttacgtctggtccctta

SEQ ID NO: 660366 - DNA, 25 bp, Mus musculus
gagtctccttgtccttgatgtcaaa

SEQ ID NO: 660367 - DNA, 25 bp, Mus musculus
gagtctccttgtgcttgatgtcaaa

SEQ ID NO: 660368 - DNA, 25 bp, Mus musculus
gagtctcgcgctcttcgttcgctta

SEQ ID NO: 660369 - DNA, 25 bp, Mus musculus
gagtctcgcgctgttcgttcgctta

SEQ ID NO: 660370 - DNA, 25 bp, Mus musculus
gagtctctagcaaagtccacgcagg

SEQ ID NO: 660371 - DNA, 25 bp, Mus musculus
gagtctctagcatagtccacgcagg

SEQ ID NO: 660372 - DNA, 25 bp, Mus musculus
gagtctctcgctctggtttcccctg

SEQ ID NO: 660373 - DNA, 25 bp, Mus musculus
gagtctctcgctgtggtttcccctg

SEQ ID NO: 660374 - DNA, 25 bp, Mus musculus
gagtctctgaatacctccatgtcca

SEQ ID NO: 660375 - DNA, 25 bp, Mus musculus
gagtctctgaattcctccatgtcca

SEQ ID NO: 660376 - DNA, 25 bp, Mus musculus
gagtctctgcagaatcgggcttcag

SEQ ID NO: 660377 - DNA, 25 bp, Mus musculus
gagtctctgcagtatcgggcttcag

SEQ ID NO: 660378 - DNA, 25 bp, Mus musculus
gagtctctgctccataagtgcctct

SEQ ID NO: 660379 - DNA, 25 bp, Mus musculus
gagtctctgctcgataagtgcctct

SEQ ID NO: 660380 - DNA, 25 bp, Mus musculus
gagtctctgctgaccggaattctct

SEQ ID NO: 660381 - DNA, 25 bp, Mus musculus
gagtctctgctgtccggaattctct

SEQ ID NO: 660382 - DNA, 25 bp, Mus musculus
gagtctctggcccaactttgttcca

SEQ ID NO: 660383 - DNA, 25 bp, Mus musculus
gagtctctggccgaactttgttcca

SEQ ID NO: 660384 - DNA, 25 bp, Mus musculus
gagtctcttaaacctccaggtactg

SEQ ID NO: 660385 - DNA, 25 bp, Mus musculus
gagtctcttaaagctccaggtactg

SEQ ID NO: 660386 - DNA, 25 bp, Mus musculus
gagtctcttcagaccctcgagcaga

SEQ ID NO: 660387 - DNA, 25 bp, Mus musculus
gagtctcttcagtccctcgagcaga

SEQ ID NO: 660388 - DNA, 25 bp, Mus musculus
gagtctcttcgtcgatttccgtaaa

SEQ ID NO: 660389 - DNA, 25 bp, Mus musculus
gagtctcttcgtggatttccgtaaa

SEQ ID NO: 660390 - DNA, 25 bp, Mus musculus
gagtctgaaaagaagaaaccacaac

SEQ ID NO: 660391 - DNA, 25 bp, Mus musculus
gagtctgaaaagtagaaaccacaac

SEQ ID NO: 660392 - DNA, 25 bp, Mus musculus
gagtctgaaagcaagtacagtccca

SEQ ID NO: 660393 - DNA, 25 bp, Mus musculus
gagtctgaaagctagtacagtccca

SEQ ID NO: 660394 - DNA, 25 bp, Mus musculus
gagtctgaaaggcagtattccacta

SEQ ID NO: 660395 - DNA, 25 bp, Mus musculus
gagtctgaaagggagtattccacta

SEQ ID NO: 660396 - DNA, 25 bp, Mus musculus
gagtctgaagcaagagcattggcta

SEQ ID NO: 660397 - DNA, 25 bp, Mus musculus
gagtctgaagcatgagcattggcta

SEQ ID NO: 660398 - DNA, 25 bp, Mus musculus
gagtctgaatgaagcccataaattc

SEQ ID NO: 660399 - DNA, 25 bp, Mus musculus
gagtctgaatgatgcccataaattc

SEQ ID NO: 660400 - DNA, 25 bp, Mus musculus
gagtctgacaaaagagaatcgcagt

SEQ ID NO: 660401 - DNA, 25 bp, Mus musculus
gagtctgacaaatgagaatcgcagt

SEQ ID NO: 660402 - DNA, 25 bp, Mus musculus
gagtctgacaccataactggcacaa

SEQ ID NO: 660403 - DNA, 25 bp, Mus musculus
gagtctgacaccttaactggcacaa

SEQ ID NO: 660404 - DNA, 25 bp, Mus musculus
gagtctgagaaacaaacccaagatt

SEQ ID NO: 660405 - DNA, 25 bp, Mus musculus
gagtctgagaaagaaacccaagatt

SEQ ID NO: 660406 - DNA, 25 bp, Mus musculus
gagtctgagagcaaccttcgtaaag

SEQ ID NO: 660407 - DNA, 25 bp, Mus musculus
gagtctgagagctaccttcgtaaag

SEQ ID NO: 660408 - DNA, 25 bp, Mus musculus
gagtctgagcatcgctctgaaccag

SEQ ID NO: 660409 - DNA, 25 bp, Mus musculus
gagtctgagcatggctctgaaccag

SEQ ID NO: 660410 - DNA, 25 bp, Mus musculus
gagtctgagctgctgacagaaaaag

SEQ ID NO: 660411 - DNA, 25 bp, Mus musculus
gagtctgagctggtgacagaaaaag

SEQ ID NO: 660412 - DNA, 25 bp, Mus musculus
gagtctgaggaaacttagcagtcac

SEQ ID NO: 660413 - DNA, 25 bp, Mus musculus
gagtctgaggaatcttagcagtcac

SEQ ID NO: 660414 - DNA, 25 bp, Mus musculus
gagtctgatattcttaagcccacag

SEQ ID NO: 660415 - DNA, 25 bp, Mus musculus
gagtctgatattgttaagcccacag

SEQ ID NO: 660416 - DNA, 25 bp, Mus musculus
gagtctgcaaaaccttcccgatggc

SEQ ID NO: 660417 - DNA, 25 bp, Mus musculus
gagtctgcaaaagcttcccgatggc

SEQ ID NO: 660418 - DNA, 25 bp, Mus musculus
gagtctgcaccgaggtctgagtctg

SEQ ID NO: 660419 - DNA, 25 bp, Mus musculus
gagtctgcaccgtggtctgagtctg

SEQ ID NO: 660420 - DNA, 25 bp, Mus musculus
gagtctgcctctcaagagaagccaa

SEQ ID NO: 660421 - DNA, 25 bp, Mus musculus
gagtctgcctctgaagagaagccaa

SEQ ID NO: 660422 - DNA, 25 bp, Mus musculus
gagtctgcctgacctgctacacatt

SEQ ID NO: 660423 - DNA, 25 bp, Mus musculus
gagtctgcctgagctgctacacatt

SEQ ID NO: 660424 - DNA, 25 bp, Mus musculus
gagtctgccttcaactccatcgtgg

SEQ ID NO: 660425 - DNA, 25 bp, Mus musculus
gagtctgccttctactccatcgtgg

SEQ ID NO: 660426 - DNA, 25 bp, Mus musculus
gagtctgcgaaccactggacaccgt

SEQ ID NO: 660427 - DNA, 25 bp, Mus musculus
gagtctgcgaacgactggacaccgt

SEQ ID NO: 660428 - DNA, 25 bp, Mus musculus
gagtctgcttcgagtctcctcctga

SEQ ID NO: 660429 - DNA, 25 bp, Mus musculus
gagtctgcttcgtgtctcctcctga

SEQ ID NO: 660430 - DNA, 25 bp, Mus musculus
gagtctgctttcctccaccatttca

SEQ ID NO: 660431 - DNA, 25 bp, Mus musculus
gagtctgctttcgtccaccatttca

SEQ ID NO: 660432 - DNA, 25 bp, Mus musculus
gagtctggacctcgaaactaccatc

SEQ ID NO: 660433 - DNA, 25 bp, Mus musculus
gagtctggacctggaaactaccatc

SEQ ID NO: 660434 - DNA, 25 bp, Mus musculus
gagtctggagcccacgatttcatct

SEQ ID NO: 660435 - DNA, 25 bp, Mus musculus
gagtctggagccgacgatttcatct

SEQ ID NO: 660436 - DNA, 25 bp, Mus musculus
gagtctggcacaagggaacccctgc

SEQ ID NO: 660437 - DNA, 25 bp, Mus musculus
gagtctggcacatgggaacccctgc

SEQ ID NO: 660438 - DNA, 25 bp, Mus musculus
gagtctgggccaagaccttcttgca

SEQ ID NO: 660439 - DNA, 25 bp, Mus musculus
gagtctgggccatgaccttcttgca

SEQ ID NO: 660440 - DNA, 25 bp, Mus musculus
gagtctgggctcaaaagagcaaagc

SEQ ID NO: 660441 - DNA, 25 bp, Mus musculus
gagtctgggctctaaagagcaaagc

SEQ ID NO: 660442 - DNA, 25 bp, Mus musculus
gagtctggtaatccaatgctgtact

SEQ ID NO: 660443 - DNA, 25 bp, Mus musculus
gagtctggtaatgcaatgctgtact

SEQ ID NO: 660444 - DNA, 25 bp, Mus musculus
gagtctggtgtgaaaatgacaaaga

SEQ ID NO: 660445 - DNA, 25 bp, Mus musculus
gagtctggtgtgattgccgatcccc

SEQ ID NO: 660446 - DNA, 25 bp, Mus musculus
gagtctggtgtgtaaatgacaaaga

SEQ ID NO: 660447 - DNA, 25 bp, Mus musculus
gagtctggtgtgtttgccgatcccc

SEQ ID NO: 660448 - DNA, 25 bp, Mus musculus
gagtctggttctcgaaagccgacag

SEQ ID NO: 660449 - DNA, 25 bp, Mus musculus
gagtctggttctggaaagccgacag

SEQ ID NO: 660450 - DNA, 25 bp, Mus musculus
gagtctggttttcttatcccttcag

SEQ ID NO: 660451 - DNA, 25 bp, Mus musculus
gagtctggttttgttatcccttcag

SEQ ID NO: 660452 - DNA, 25 bp, Mus musculus
gagtctgtcagtaccggtgtcgata

SEQ ID NO: 660453 - DNA, 25 bp, Mus musculus
gagtctgtcagttccggtgtcgata

SEQ ID NO: 660454 - DNA, 25 bp, Mus musculus
gagtctgtcatgattgccaacccta

SEQ ID NO: 660455 - DNA, 25 bp, Mus musculus
gagtctgtcatgtttgccaacccta

SEQ ID NO: 660456 - DNA, 25 bp, Mus musculus
gagtctgtcccgacagatatcaaca

SEQ ID NO: 660457 - DNA, 25 bp, Mus musculus
gagtctgtcccgtcagatatcaaca

SEQ ID NO: 660458 - DNA, 25 bp, Mus musculus
gagtctgtcctacccttggtggcct

SEQ ID NO: 660459 - DNA, 25 bp, Mus musculus
gagtctgtcctagccttggtggcct

SEQ ID NO: 660460 - DNA, 25 bp, Mus musculus
gagtctgtcggaatataccagggat

SEQ ID NO: 660461 - DNA, 25 bp, Mus musculus
gagtctgtcggattataccagggat

SEQ ID NO: 660462 - DNA, 25 bp, Mus musculus
gagtctgtgaatcgcatcctcacca

SEQ ID NO: 660463 - DNA, 25 bp, Mus musculus
gagtctgtgaatggcatcctcacca

SEQ ID NO: 660464 - DNA, 25 bp, Mus musculus
gagtctgtgcatagacttacccggg

SEQ ID NO: 660465 - DNA, 25 bp, Mus musculus
gagtctgtgcattgacttacccggg

SEQ ID NO: 660466 - DNA, 25 bp, Mus musculus
gagtctgtggctagcaaacacgcca

SEQ ID NO: 660467 - DNA, 25 bp, Mus musculus
gagtctgtggcttgcaaacacgcca

SEQ ID NO: 660468 - DNA, 25 bp, Mus musculus
gagtctgtgggcatgtccaagagct

SEQ ID NO: 660469 - DNA, 25 bp, Mus musculus
gagtctgtgggcttgtccaagagct

SEQ ID NO: 660470 - DNA, 25 bp, Mus musculus
gagtctgttgctacccatttcgcac

SEQ ID NO: 660471 - DNA, 25 bp, Mus musculus
gagtctgttgcttcccatttcgcac

SEQ ID NO: 660472 - DNA, 25 bp, Mus musculus
gagtctgttgggattcgctttctga

SEQ ID NO: 660473 - DNA, 25 bp, Mus musculus
gagtctgttgggtttcgctttctga

SEQ ID NO: 660474 - DNA, 25 bp, Mus musculus
gagtctgtttccatcctgtttcgaa

SEQ ID NO: 660475 - DNA, 25 bp, Mus musculus
gagtctgtttccttcctgtttcgaa

SEQ ID NO: 660476 - DNA, 25 bp, Mus musculus
gagtcttaccagctctataaacgct

SEQ ID NO: 660477 - DNA, 25 bp, Mus musculus
gagtcttaccaggtctataaacgct

SEQ ID NO: 660478 - DNA, 25 bp, Mus musculus
gagtcttatgcaccctcacggctgt

SEQ ID NO: 660479 - DNA, 25 bp, Mus musculus
gagtcttatgcagcctcacggctgt

SEQ ID NO: 660480 - DNA, 25 bp, Mus musculus
gagtcttcagccaggtacctctctc

SEQ ID NO: 660481 - DNA, 25 bp, Mus musculus
gagtcttcagcctggtacctctctc

SEQ ID NO: 660482 - DNA, 25 bp, Mus musculus
gagtcttcaggccatgaggatcccg

SEQ ID NO: 660483 - DNA, 25 bp, Mus musculus
gagtcttcaggcgatgaggatcccg

SEQ ID NO: 660484 - DNA, 25 bp, Mus musculus
gagtcttcagtgaccgtcgtgcaaa

SEQ ID NO: 660485 - DNA, 25 bp, Mus musculus
gagtcttcagtgtccgtcgtgcaaa

SEQ ID NO: 660486 - DNA, 25 bp, Mus musculus
gagtcttcatacatctgtcgctgcc

SEQ ID NO: 660487 - DNA, 25 bp, Mus musculus
gagtcttcatacttctgtcgctgcc

SEQ ID NO: 660488 - DNA, 25 bp, Mus musculus
gagtcttcatctactgttgggcccc

SEQ ID NO: 660489 - DNA, 25 bp, Mus musculus
gagtcttcatcttctgttgggcccc

SEQ ID NO: 660490 - DNA, 25 bp, Mus musculus
gagtcttccatcacgtctgctcaca

SEQ ID NO: 660491 - DNA, 25 bp, Mus musculus
gagtcttccatctcgtctgctcaca

SEQ ID NO: 660492 - DNA, 25 bp, Mus musculus
gagtcttcccagatggcaaatgtca

SEQ ID NO: 660493 - DNA, 25 bp, Mus musculus
gagtcttcccagttggcaaatgtca

SEQ ID NO: 660494 - DNA, 25 bp, Mus musculus
gagtcttccgagagccggagcagct

SEQ ID NO: 660495 - DNA, 25 bp, Mus musculus
gagtcttccgagtgccggagcagct

SEQ ID NO: 660496 - DNA, 25 bp, Mus musculus
gagtcttcgaatacatggccctgag

SEQ ID NO: 660497 - DNA, 25 bp, Mus musculus
gagtcttcgaattcatggccctgag

SEQ ID NO: 660498 - DNA, 25 bp, Mus musculus
gagtcttcgacgacacaccagagag

SEQ ID NO: 660499 - DNA, 25 bp, Mus musculus
gagtcttcgacgtcacaccagagag

SEQ ID NO: 660500 - DNA, 25 bp, Mus musculus
gagtcttcgataaggagctccaccc

SEQ ID NO: 660501 - DNA, 25 bp, Mus musculus
gagtcttcgatatggagctccaccc

SEQ ID NO: 660502 - DNA, 25 bp, Mus musculus
gagtcttcgcttacgtccagtcctg

SEQ ID NO: 660503 - DNA, 25 bp, Mus musculus
gagtcttcgctttcgtccagtcctg

SEQ ID NO: 660504 - DNA, 25 bp, Mus musculus
gagtcttctgaacagtaactggata

SEQ ID NO: 660505 - DNA, 25 bp, Mus musculus
gagtcttctgaagagtaactggata

SEQ ID NO: 660506 - DNA, 25 bp, Mus musculus
gagtcttctgtcacctggtatggga

SEQ ID NO: 660507 - DNA, 25 bp, Mus musculus
gagtcttctgtctcctggtatggga

SEQ ID NO: 660508 - DNA, 25 bp, Mus musculus
gagtcttgaagtctgatacgctgta

SEQ ID NO: 660509 - DNA, 25 bp, Mus musculus
gagtcttgaagtgtgatacgctgta

SEQ ID NO: 660510 - DNA, 25 bp, Mus musculus
gagtcttgacttagccctcaaccca

SEQ ID NO: 660511 - DNA, 25 bp, Mus musculus
gagtcttgactttgccctcaaccca

SEQ ID NO: 660512 - DNA, 25 bp, Mus musculus
gagtcttgaggaaacacaggatccg

SEQ ID NO: 660513 - DNA, 25 bp, Mus musculus
gagtcttgaggatacacaggatccg

SEQ ID NO: 660514 - DNA, 25 bp, Mus musculus
gagtcttgcaaacaacaatctccag

SEQ ID NO: 660515 - DNA, 25 bp, Mus musculus
gagtcttgcaaagaacaatctccag

SEQ ID NO: 660516 - DNA, 25 bp, Mus musculus
gagtcttgtcatctccatctctagc

SEQ ID NO: 660517 - DNA, 25 bp, Mus musculus
gagtcttgtcatgtccatctctagc

SEQ ID NO: 660518 - DNA, 25 bp, Mus musculus
gagtcttgtctacctctggttcctg

SEQ ID NO: 660519 - DNA, 25 bp, Mus musculus
gagtcttgtctagctctggttcctg

SEQ ID NO: 660520 - DNA, 25 bp, Mus musculus
gagtctttacacctgcgtttctcag

SEQ ID NO: 660521 - DNA, 25 bp, Mus musculus
gagtctttacacgtgcgtttctcag

SEQ ID NO: 660522 - DNA, 25 bp, Mus musculus
gagtctttacccagacgccttgcca

SEQ ID NO: 660523 - DNA, 25 bp, Mus musculus
gagtctttaccctgacgccttgcca

SEQ ID NO: 660524 - DNA, 25 bp, Mus musculus
gagtctttcagcaatcttctaaaca

SEQ ID NO: 660525 - DNA, 25 bp, Mus musculus
gagtctttcagctatcttctaaaca

SEQ ID NO: 660526 - DNA, 25 bp, Mus musculus
gagtctttcctgaaaatggccccta

SEQ ID NO: 660527 - DNA, 25 bp, Mus musculus
gagtctttcctgtaaatggccccta

SEQ ID NO: 660528 - DNA, 25 bp, Mus musculus
gagtctttgcatctgttcaacagca

SEQ ID NO: 660529 - DNA, 25 bp, Mus musculus
gagtctttgcatgtgttcaacagca

SEQ ID NO: 660530 - DNA, 25 bp, Mus musculus
gagtctttgctgagccaaagccctg

SEQ ID NO: 660531 - DNA, 25 bp, Mus musculus
gagtctttgctgtgccaaagccctg

SEQ ID NO: 660532 - DNA, 25 bp, Mus musculus
gagtcttttatgatcccagaggacg

SEQ ID NO: 660533 - DNA, 25 bp, Mus musculus
gagtcttttatgttcccagaggacg

SEQ ID NO: 660534 - DNA, 25 bp, Mus musculus
gagtcttttcataccttctctacac

SEQ ID NO: 660535 - DNA, 25 bp, Mus musculus
gagtcttttcattccttctctacac

SEQ ID NO: 660536 - DNA, 25 bp, Mus musculus
gagtctttttctcccttaggcctct

SEQ ID NO: 660537 - DNA, 25 bp, Mus musculus
gagtctttttctgccttaggcctct

SEQ ID NO: 660538 - DNA, 25 bp, Mus musculus
gagtgaaagagtccagagccaagtt

SEQ ID NO: 660539 - DNA, 25 bp, Mus musculus
gagtgaaagagtgcagagccaagtt

SEQ ID NO: 660540 - DNA, 25 bp, Mus musculus
gagtgaacatgcagcatttcctcac

SEQ ID NO: 660541 - DNA, 25 bp, Mus musculus
gagtgaacatgctgcatttcctcac

SEQ ID NO: 660542 - DNA, 25 bp, Mus musculus
gagtgaacccatctgtgaacggaca

SEQ ID NO: 660543 - DNA, 25 bp, Mus musculus
gagtgaacccatgtgtgaacggaca

SEQ ID NO: 660544 - DNA, 25 bp, Mus musculus
gagtgaacccgtctctcaaacccaa

SEQ ID NO: 660545 - DNA, 25 bp, Mus musculus
gagtgaacccgtgtctcaaacccaa

SEQ ID NO: 660546 - DNA, 25 bp, Mus musculus
gagtgaacgagaaggactataaccc

SEQ ID NO: 660547 - DNA, 25 bp, Mus musculus
gagtgaacgagatggactataaccc

SEQ ID NO: 660548 - DNA, 25 bp, Mus musculus
gagtgaactcaccttgttcatccag

SEQ ID NO: 660549 - DNA, 25 bp, Mus musculus
gagtgaactcacgttgttcatccag

SEQ ID NO: 660550 - DNA, 25 bp, Mus musculus
gagtgaactgctaagcacctggact

SEQ ID NO: 660551 - DNA, 25 bp, Mus musculus
gagtgaactgcttagcacctggact

SEQ ID NO: 660552 - DNA, 25 bp, Mus musculus
gagtgaacttgcaggttggtacaga

SEQ ID NO: 660553 - DNA, 25 bp, Mus musculus
gagtgaacttgctggttggtacaga

SEQ ID NO: 660554 - DNA, 25 bp, Mus musculus
gagtgaactttaccttgtctactaa

SEQ ID NO: 660555 - DNA, 25 bp, Mus musculus
gagtgaactttagcttgtctactaa

SEQ ID NO: 660556 - DNA, 25 bp, Mus musculus
gagtgaagaatcaccagcagatgat

SEQ ID NO: 660557 - DNA, 25 bp, Mus musculus
gagtgaagaatctccagcagatgat

SEQ ID NO: 660558 - DNA, 25 bp, Mus musculus
gagtgaagagatcgacatggaacac

SEQ ID NO: 660559 - DNA, 25 bp, Mus musculus
gagtgaagagatggacatggaacac

SEQ ID NO: 660560 - DNA, 25 bp, Mus musculus
gagtgaagccgcacgtaggatcaaa

SEQ ID NO: 660561 - DNA, 25 bp, Mus musculus
gagtgaagccgctcgtaggatcaaa

SEQ ID NO: 660562 - DNA, 25 bp, Mus musculus
gagtgaagcgtgaccccgagcacac

SEQ ID NO: 660563 - DNA, 25 bp, Mus musculus
gagtgaagcgtgtccccgagcacac

SEQ ID NO: 660564 - DNA, 25 bp, Mus musculus
gagtgaaggaagacacgcccagata

SEQ ID NO: 660565 - DNA, 25 bp, Mus musculus
gagtgaaggaagtcacgcccagata

SEQ ID NO: 660566 - DNA, 25 bp, Mus musculus
gagtgaaggcttatccagatcatcc

SEQ ID NO: 660567 - DNA, 25 bp, Mus musculus
gagtgaaggcttttccagatcatcc

SEQ ID NO: 660568 - DNA, 25 bp, Mus musculus
gagtgaaggttcagatccacagcca

SEQ ID NO: 660569 - DNA, 25 bp, Mus musculus
gagtgaaggttctgatccacagcca

SEQ ID NO: 660570 - DNA, 25 bp, Mus musculus
gagtgaagtattccgagtcacccat

SEQ ID NO: 660571 - DNA, 25 bp, Mus musculus
gagtgaagtattgcgagtcacccat

SEQ ID NO: 660572 - DNA, 25 bp, Mus musculus
gagtgaagtcagagattccccaggt

SEQ ID NO: 660573 - DNA, 25 bp, Mus musculus
gagtgaagtcagtgattccccaggt

SEQ ID NO: 660574 - DNA, 25 bp, Mus musculus
gagtgaagtcttcaagctttttgag

SEQ ID NO: 660575 - DNA, 25 bp, Mus musculus
gagtgaagtcttgaagctttttgag

SEQ ID NO: 660576 - DNA, 25 bp, Mus musculus
gagtgaagtgagcatcctagagaaa

SEQ ID NO: 660577 - DNA, 25 bp, Mus musculus
gagtgaagtgaggatcctagagaaa

SEQ ID NO: 660578 - DNA, 25 bp, Mus musculus
gagtgaatgaaacgaccttgaaccc

SEQ ID NO: 660579 - DNA, 25 bp, Mus musculus
gagtgaatgaaaggaccttgaaccc

SEQ ID NO: 660580 - DNA, 25 bp, Mus musculus
gagtgaatgaatccaggacgcctcc

SEQ ID NO: 660581 - DNA, 25 bp, Mus musculus
gagtgaatgaatgcaggacgcctcc

SEQ ID NO: 660582 - DNA, 25 bp, Mus musculus
gagtgaatgcagagcctgcggcttt

SEQ ID NO: 660583 - DNA, 25 bp, Mus musculus
gagtgaatgcagtgcctgcggcttt

SEQ ID NO: 660584 - DNA, 25 bp, Mus musculus
gagtgaatgtggcaatggctcacca

SEQ ID NO: 660585 - DNA, 25 bp, Mus musculus
gagtgaatgtgggaatggctcacca

SEQ ID NO: 660586 - DNA, 25 bp, Mus musculus
gagtgacaacagcttcttagtcaag

SEQ ID NO: 660587 - DNA, 25 bp, Mus musculus
gagtgacaacaggttcttagtcaag

SEQ ID NO: 660588 - DNA, 25 bp, Mus musculus
gagtgacaactccaaatgactgttt

SEQ ID NO: 660589 - DNA, 25 bp, Mus musculus
gagtgacaactcgaaatgactgttt

SEQ ID NO: 660590 - DNA, 25 bp, Mus musculus
gagtgacaactgctgcccatctagc

SEQ ID NO: 660591 - DNA, 25 bp, Mus musculus
gagtgacaactggtgcccatctagc

SEQ ID NO: 660592 - DNA, 25 bp, Mus musculus
gagtgacaatgactacatcatcccc

SEQ ID NO: 660593 - DNA, 25 bp, Mus musculus
gagtgacaatgagtacatcatcccc

SEQ ID NO: 660594 - DNA, 25 bp, Mus musculus
gagtgacactcactgtttgtggacg

SEQ ID NO: 660595 - DNA, 25 bp, Mus musculus
gagtgacactcagtgtttgtggacg

SEQ ID NO: 660596 - DNA, 25 bp, Mus musculus
gagtgacactcgctatttcttcaag

SEQ ID NO: 660597 - DNA, 25 bp, Mus musculus
gagtgacactcggtatttcttcaag

SEQ ID NO: 660598 - DNA, 25 bp, Mus musculus
gagtgacactgtatgtggcgcttta

SEQ ID NO: 660599 - DNA, 25 bp, Mus musculus
gagtgacactgtttgtggcgcttta

SEQ ID NO: 660600 - DNA, 25 bp, Mus musculus
gagtgacatcatcaacacccctctg

SEQ ID NO: 660601 - DNA, 25 bp, Mus musculus
gagtgacatcatgaacacccctctg

SEQ ID NO: 660602 - DNA, 25 bp, Mus musculus
gagtgacatcgaagactgccgcccc

SEQ ID NO: 660603 - DNA, 25 bp, Mus musculus
gagtgacatcgatgactgccgcccc

SEQ ID NO: 660604 - DNA, 25 bp, Mus musculus
gagtgaccatcaacaactgggtagc

SEQ ID NO: 660605 - DNA, 25 bp, Mus musculus
gagtgaccatcatcaactgggtagc

SEQ ID NO: 660606 - DNA, 25 bp, Mus musculus
gagtgacccacaacagagtcgtagt

SEQ ID NO: 660607 - DNA, 25 bp, Mus musculus
gagtgacccacatcagagtcgtagt

SEQ ID NO: 660608 - DNA, 25 bp, Mus musculus
gagtgacccggaagcagaagtgttc

SEQ ID NO: 660609 - DNA, 25 bp, Mus musculus
gagtgacccggatgcagaagtgttc

SEQ ID NO: 660610 - DNA, 25 bp, Mus musculus
gagtgaccgaagactgcctggaaca

SEQ ID NO: 660611 - DNA, 25 bp, Mus musculus
gagtgaccgaagtctgcctggaaca

SEQ ID NO: 660612 - DNA, 25 bp, Mus musculus
gagtgacctcgcacctatatccata

SEQ ID NO: 660613 - DNA, 25 bp, Mus musculus
gagtgacctcgctcctatatccata

SEQ ID NO: 660614 - DNA, 25 bp, Mus musculus
gagtgacctggcatctcctgggacc

SEQ ID NO: 660615 - DNA, 25 bp, Mus musculus
gagtgacctggcttctcctgggacc

SEQ ID NO: 660616 - DNA, 25 bp, Mus musculus
gagtgaccttaacgatacctctaag

SEQ ID NO: 660617 - DNA, 25 bp, Mus musculus
gagtgaccttaaggatacctctaag

SEQ ID NO: 660618 - DNA, 25 bp, Mus musculus
gagtgaccttatcagagcccactcc

SEQ ID NO: 660619 - DNA, 25 bp, Mus musculus
gagtgaccttatgagagcccactcc

SEQ ID NO: 660620 - DNA, 25 bp, Mus musculus
gagtgacgagggatattccagtgcc

SEQ ID NO: 660621 - DNA, 25 bp, Mus musculus
gagtgacgagggttattccagtgcc

SEQ ID NO: 660622 - DNA, 25 bp, Mus musculus
gagtgacgatgaagctgcctgtagc

SEQ ID NO: 660623 - DNA, 25 bp, Mus musculus
gagtgacgatgatgctgcctgtagc

SEQ ID NO: 660624 - DNA, 25 bp, Mus musculus
gagtgacgatgtacccatcaaggaa

SEQ ID NO: 660625 - DNA, 25 bp, Mus musculus
gagtgacgatgttcccatcaaggaa

SEQ ID NO: 660626 - DNA, 25 bp, Mus musculus
gagtgactacatccctacacagcag

SEQ ID NO: 660627 - DNA, 25 bp, Mus musculus
gagtgactacatgcctacacagcag

SEQ ID NO: 660628 - DNA, 25 bp, Mus musculus
gagtgactagcacggtcagggcggg

SEQ ID NO: 660629 - DNA, 25 bp, Mus musculus
gagtgactagcagggtcagggcggg

SEQ ID NO: 660630 - DNA, 25 bp, Mus musculus
gagtgactatggattttgctcacag

SEQ ID NO: 660631 - DNA, 25 bp, Mus musculus
gagtgactatggtttttgctcacag

SEQ ID NO: 660632 - DNA, 25 bp, Mus musculus
gagtgactcaaaagattccatctcc

SEQ ID NO: 660633 - DNA, 25 bp, Mus musculus
gagtgactcaaatgattccatctcc

SEQ ID NO: 660634 - DNA, 25 bp, Mus musculus
gagtgactcagacatctcctctaca

SEQ ID NO: 660635 - DNA, 25 bp, Mus musculus
gagtgactcagagatctcctctaca

SEQ ID NO: 660636 - DNA, 25 bp, Mus musculus
gagtgactgctactcctccatctgg

SEQ ID NO: 660637 - DNA, 25 bp, Mus musculus
gagtgactgctagtcctccatctgg

SEQ ID NO: 660638 - DNA, 25 bp, Mus musculus
gagtgactgcttactgcatatcatg

SEQ ID NO: 660639 - DNA, 25 bp, Mus musculus
gagtgactgctttctgcatatcatg

SEQ ID NO: 660640 - DNA, 25 bp, Mus musculus
gagtgactggaacactggtcctagc

SEQ ID NO: 660641 - DNA, 25 bp, Mus musculus
gagtgactggaagactggtcctagc

SEQ ID NO: 660642 - DNA, 25 bp, Mus musculus
gagtgactgggtcacatcctataaa

SEQ ID NO: 660643 - DNA, 25 bp, Mus musculus
gagtgactgggtgacatcctataaa

SEQ ID NO: 660644 - DNA, 25 bp, Mus musculus
gagtgactgtgcagggtcatgtaca

SEQ ID NO: 660645 - DNA, 25 bp, Mus musculus
gagtgactgtgctgggtcatgtaca

SEQ ID NO: 660646 - DNA, 25 bp, Mus musculus
gagtgacttactccagcgcctgcca

SEQ ID NO: 660647 - DNA, 25 bp, Mus musculus
gagtgacttactgcagcgcctgcca

SEQ ID NO: 660648 - DNA, 25 bp, Mus musculus
gagtgacttggaaagtccctggagc

SEQ ID NO: 660649 - DNA, 25 bp, Mus musculus
gagtgacttggatagtccctggagc

SEQ ID NO: 660650 - DNA, 25 bp, Mus musculus
gagtgacttttgacctgtacctgct

SEQ ID NO: 660651 - DNA, 25 bp, Mus musculus
gagtgacttttgtcctgtacctgct

SEQ ID NO: 660652 - DNA, 25 bp, Mus musculus
gagtgagaacccagatgacgataaa

SEQ ID NO: 660653 - DNA, 25 bp, Mus musculus
gagtgagaaccctgatgacgataaa

SEQ ID NO: 660654 - DNA, 25 bp, Mus musculus
gagtgagagcaaatcattctgggac

SEQ ID NO: 660655 - DNA, 25 bp, Mus musculus
gagtgagagcaattcattctgggac

SEQ ID NO: 660656 - DNA, 25 bp, Mus musculus
gagtgagatcgacgccctctacgat

SEQ ID NO: 660657 - DNA, 25 bp, Mus musculus
gagtgagatcgaggccctctacgat

SEQ ID NO: 660658 - DNA, 25 bp, Mus musculus
gagtgagatgacaggcaatacagca

SEQ ID NO: 660659 - DNA, 25 bp, Mus musculus
gagtgagatgactggcaatacagca

SEQ ID NO: 660660 - DNA, 25 bp, Mus musculus
gagtgagcaaggagcaggaccactt

SEQ ID NO: 660661 - DNA, 25 bp, Mus musculus
gagtgagcaaggtgcaggaccactt

SEQ ID NO: 660662 - DNA, 25 bp, Mus musculus
gagtgagcacctattatttggataa

SEQ ID NO: 660663 - DNA, 25 bp, Mus musculus
gagtgagcaccttttatttggataa

SEQ ID NO: 660664 - DNA, 25 bp, Mus musculus
gagtgagccatacatagtccagacc

SEQ ID NO: 660665 - DNA, 25 bp, Mus musculus
gagtgagccatagatagtccagacc

SEQ ID NO: 660666 - DNA, 25 bp, Mus musculus
gagtgagcctgtacccgacttccct

SEQ ID NO: 660667 - DNA, 25 bp, Mus musculus
gagtgagcctgttcccgacttccct

SEQ ID NO: 660668 - DNA, 25 bp, Mus musculus
gagtgagccttacaatcatgtccac

SEQ ID NO: 660669 - DNA, 25 bp, Mus musculus
gagtgagccttagaatcatgtccac

SEQ ID NO: 660670 - DNA, 25 bp, Mus musculus
gagtgagctactatatgtccaaggg

SEQ ID NO: 660671 - DNA, 25 bp, Mus musculus
gagtgagctactttatgtccaaggg

SEQ ID NO: 660672 - DNA, 25 bp, Mus musculus
gagtgagcttatcctggacatgttt

SEQ ID NO: 660673 - DNA, 25 bp, Mus musculus
gagtgagcttatgctggacatgttt

SEQ ID NO: 660674 - DNA, 25 bp, Mus musculus
gagtgagcttttccccattttacca

SEQ ID NO: 660675 - DNA, 25 bp, Mus musculus
gagtgagcttttgcccattttacca

SEQ ID NO: 660676 - DNA, 25 bp, Mus musculus
gagtgaggcaaaaatgggaccagaa

SEQ ID NO: 660677 - DNA, 25 bp, Mus musculus
gagtgaggcaaatatgggaccagaa

SEQ ID NO: 660678 - DNA, 25 bp, Mus musculus
gagtgaggcatccacaaagcgtgca

SEQ ID NO: 660679 - DNA, 25 bp, Mus musculus
gagtgaggcatcgacaaagcgtgca

SEQ ID NO: 660680 - DNA, 25 bp, Mus musculus
gagtgaggttggagcctgtgtcccg

SEQ ID NO: 660681 - DNA, 25 bp, Mus musculus
gagtgaggttggtgcctgtgtcccg

SEQ ID NO: 660682 - DNA, 25 bp, Mus musculus
gagtgagtaaagcaattcttaaagc

SEQ ID NO: 660683 - DNA, 25 bp, Mus musculus
gagtgagtaaaggaattcttaaagc

SEQ ID NO: 660684 - DNA, 25 bp, Mus musculus
gagtgagtgatcagactttgtgtac

SEQ ID NO: 660685 - DNA, 25 bp, Mus musculus
gagtgagtgatctgactttgtgtac

SEQ ID NO: 660686 - DNA, 25 bp, Mus musculus
gagtgagtgcccaggtatgaacacg

SEQ ID NO: 660687 - DNA, 25 bp, Mus musculus
gagtgagtgccctggtatgaacacg

SEQ ID NO: 660688 - DNA, 25 bp, Mus musculus
gagtgagtggtaacttccagactct

SEQ ID NO: 660689 - DNA, 25 bp, Mus musculus
gagtgagtggtatcttccagactct

SEQ ID NO: 660690 - DNA, 25 bp, Mus musculus
gagtgataacaaaacagctctcttg

SEQ ID NO: 660691 - DNA, 25 bp, Mus musculus
gagtgataacaatacagctctcttg

SEQ ID NO: 660692 - DNA, 25 bp, Mus musculus
gagtgatagctccaaggaagagaat

SEQ ID NO: 660693 - DNA, 25 bp, Mus musculus
gagtgatagctcgaaggaagagaat

SEQ ID NO: 660694 - DNA, 25 bp, Mus musculus
gagtgatatcaaactcctttcggac

SEQ ID NO: 660695 - DNA, 25 bp, Mus musculus
gagtgatatcaatctcctttcggac

SEQ ID NO: 660696 - DNA, 25 bp, Mus musculus
gagtgatccaccaatcccagcttga

SEQ ID NO: 660697 - DNA, 25 bp, Mus musculus
gagtgatccacctatcccagcttga

SEQ ID NO: 660698 - DNA, 25 bp, Mus musculus
gagtgatccagtctctcccgtggtg

SEQ ID NO: 660699 - DNA, 25 bp, Mus musculus
gagtgatccagtgtctcccgtggtg

SEQ ID NO: 660700 - DNA, 25 bp, Mus musculus
gagtgatcctcaaaaagaaagctgg

SEQ ID NO: 660701 - DNA, 25 bp, Mus musculus
gagtgatcctcataaagaaagctgg

SEQ ID NO: 660702 - DNA, 25 bp, Mus musculus
gagtgatcctctacctgcgtcttac

SEQ ID NO: 660703 - DNA, 25 bp, Mus musculus
gagtgatcctcttcctgcgtcttac

SEQ ID NO: 660704 - DNA, 25 bp, Mus musculus
gagtgatcgctcacgtgaacgcaag

SEQ ID NO: 660705 - DNA, 25 bp, Mus musculus
gagtgatcgctctcgtgaacgcaag

SEQ ID NO: 660706 - DNA, 25 bp, Mus musculus
gagtgatctctaaggtgacaacaga

SEQ ID NO: 660707 - DNA, 25 bp, Mus musculus
gagtgatctctatggtgacaacaga

SEQ ID NO: 660708 - DNA, 25 bp, Mus musculus
gagtgatctgacacctaggtgttgg

SEQ ID NO: 660709 - DNA, 25 bp, Mus musculus
gagtgatctgactcctaggtgttgg

SEQ ID NO: 660710 - DNA, 25 bp, Mus musculus
gagtgatgcctacccgatgacagaa

SEQ ID NO: 660711 - DNA, 25 bp, Mus musculus
gagtgatgcctagccgatgacagaa

SEQ ID NO: 660712 - DNA, 25 bp, Mus musculus
gagtgatgctcaagagccagccgag

SEQ ID NO: 660713 - DNA, 25 bp, Mus musculus
gagtgatgctcatgagccagccgag

SEQ ID NO: 660714 - DNA, 25 bp, Mus musculus
gagtgatggatgaccttaaagacaa

SEQ ID NO: 660715 - DNA, 25 bp, Mus musculus
gagtgatggatgtccttaaagacaa

SEQ ID NO: 660716 - DNA, 25 bp, Mus musculus
gagtgatggctcaagttactctgcc

SEQ ID NO: 660717 - DNA, 25 bp, Mus musculus
gagtgatggctctagttactctgcc

SEQ ID NO: 660718 - DNA, 25 bp, Mus musculus
gagtgatgggccctggtcccatctc

SEQ ID NO: 660719 - DNA, 25 bp, Mus musculus
gagtgatgggccgtggtcccatctc

SEQ ID NO: 660720 - DNA, 25 bp, Mus musculus
gagtgatgtcctagtcggcctcctg

SEQ ID NO: 660721 - DNA, 25 bp, Mus musculus
gagtgatgtccttgtcggcctcctg

SEQ ID NO: 660722 - DNA, 25 bp, Mus musculus
gagtgattacagaggtacagttgac

SEQ ID NO: 660723 - DNA, 25 bp, Mus musculus
gagtgattacagtggtacagttgac

SEQ ID NO: 660724 - DNA, 25 bp, Mus musculus
gagtgatttacgacatctcagggca

SEQ ID NO: 660725 - DNA, 25 bp, Mus musculus
gagtgatttacgtcatctcagggca

SEQ ID NO: 660726 - DNA, 25 bp, Mus musculus
gagtgatttatgaagcagtactgct

SEQ ID NO: 660727 - DNA, 25 bp, Mus musculus
gagtgatttatgtagcagtactgct

SEQ ID NO: 660728 - DNA, 25 bp, Mus musculus
gagtgatttgcaacgcaatggagcg

SEQ ID NO: 660729 - DNA, 25 bp, Mus musculus
gagtgatttgcatcgcaatggagcg

SEQ ID NO: 660730 - DNA, 25 bp, Mus musculus
gagtgatttggtatgctgtttgcaa

SEQ ID NO: 660731 - DNA, 25 bp, Mus musculus
gagtgatttggtttgctgtttgcaa

SEQ ID NO: 660732 - DNA, 25 bp, Mus musculus
gagtgcaaacgcacccagggtgtgt

SEQ ID NO: 660733 - DNA, 25 bp, Mus musculus
gagtgcaaacgctcccagggtgtgt

SEQ ID NO: 660734 - DNA, 25 bp, Mus musculus
gagtgcaaacgtctcccaagctatg

SEQ ID NO: 660735 - DNA, 25 bp, Mus musculus
gagtgcaaacgtgtcccaagctatg

SEQ ID NO: 660736 - DNA, 25 bp, Mus musculus
gagtgcaaagtcctcacagtgttgt

SEQ ID NO: 660737 - DNA, 25 bp, Mus musculus
gagtgcaaagtcgtcacagtgttgt

SEQ ID NO: 660738 - DNA, 25 bp, Mus musculus
gagtgcaacagcacgcaggattgca

SEQ ID NO: 660739 - DNA, 25 bp, Mus musculus
gagtgcaacagcagtgtcagttcct

SEQ ID NO: 660740 - DNA, 25 bp, Mus musculus
gagtgcaacagctcgcaggattgca

SEQ ID NO: 660741 - DNA, 25 bp, Mus musculus
gagtgcaacagctgtgtcagttcct

SEQ ID NO: 660742 - DNA, 25 bp, Mus musculus
gagtgcacaagaacaacaatgtaaa

SEQ ID NO: 660743 - DNA, 25 bp, Mus musculus
gagtgcacaagatcaacaatgtaaa

SEQ ID NO: 660744 - DNA, 25 bp, Mus musculus
gagtgcacccctccggagcaggcat

SEQ ID NO: 660745 - DNA, 25 bp, Mus musculus
gagtgcacccctgcggagcaggcat

SEQ ID NO: 660746 - DNA, 25 bp, Mus musculus
gagtgcaccgtgcagcccatggaaa

SEQ ID NO: 660747 - DNA, 25 bp, Mus musculus
gagtgcaccgtggagcccatggaaa

SEQ ID NO: 660748 - DNA, 25 bp, Mus musculus
gagtgcacggccatcgacgggctct

SEQ ID NO: 660749 - DNA, 25 bp, Mus musculus
gagtgcacggccttcgacgggctct

SEQ ID NO: 660750 - DNA, 25 bp, Mus musculus
gagtgcactaataccgctcctggtt

SEQ ID NO: 660751 - DNA, 25 bp, Mus musculus
gagtgcactaattccgctcctggtt

SEQ ID NO: 660752 - DNA, 25 bp, Mus musculus
gagtgcactctcatcaccgaccagg

SEQ ID NO: 660753 - DNA, 25 bp, Mus musculus
gagtgcactctcttcaccgaccagg

SEQ ID NO: 660754 - DNA, 25 bp, Mus musculus
gagtgcagaataagccccgcagggt

SEQ ID NO: 660755 - DNA, 25 bp, Mus musculus
gagtgcagaatatgccccgcagggt

SEQ ID NO: 660756 - DNA, 25 bp, Mus musculus
gagtgcagagctcaattcgggccac

SEQ ID NO: 660757 - DNA, 25 bp, Mus musculus
gagtgcagagctgaattcgggccac

SEQ ID NO: 660758 - DNA, 25 bp, Mus musculus
gagtgcagcctaccgccttctgcag

SEQ ID NO: 660759 - DNA, 25 bp, Mus musculus
gagtgcagcctagcgccttctgcag

SEQ ID NO: 660760 - DNA, 25 bp, Mus musculus
gagtgcagtgtcaacaatggaggct

SEQ ID NO: 660761 - DNA, 25 bp, Mus musculus
gagtgcagtgtctacaatggaggct

SEQ ID NO: 660762 - DNA, 25 bp, Mus musculus
gagtgcatactgacaggcaaggatg

SEQ ID NO: 660763 - DNA, 25 bp, Mus musculus
gagtgcatactgtcaggcaaggatg

SEQ ID NO: 660764 - DNA, 25 bp, Mus musculus
gagtgcataggcaccgggctgatcc

SEQ ID NO: 660765 - DNA, 25 bp, Mus musculus
gagtgcataggctccgggctgatcc

SEQ ID NO: 660766 - DNA, 25 bp, Mus musculus
gagtgcatcagcacttagtttcttt

SEQ ID NO: 660767 - DNA, 25 bp, Mus musculus
gagtgcatcagcatggacaaggtgt

SEQ ID NO: 660768 - DNA, 25 bp, Mus musculus
gagtgcatcagctcttagtttcttt

SEQ ID NO: 660769 - DNA, 25 bp, Mus musculus
gagtgcatcagcttggacaaggtgt

SEQ ID NO: 660770 - DNA, 25 bp, Mus musculus
gagtgcatcgttcgcctctatgaca

SEQ ID NO: 660771 - DNA, 25 bp, Mus musculus
gagtgcatcgttggcctctatgaca

SEQ ID NO: 660772 - DNA, 25 bp, Mus musculus
gagtgcatgaacatcgtgaagctgc

SEQ ID NO: 660773 - DNA, 25 bp, Mus musculus
gagtgcatgaacttcgtgaagctgc

SEQ ID NO: 660774 - DNA, 25 bp, Mus musculus
gagtgcattccaagctctggcagaa

SEQ ID NO: 660775 - DNA, 25 bp, Mus musculus
gagtgcattccatgctctggcagaa

SEQ ID NO: 660776 - DNA, 25 bp, Mus musculus
gagtgccaaatacgtctttactact

SEQ ID NO: 660777 - DNA, 25 bp, Mus musculus
gagtgccaaataggtctttactact

SEQ ID NO: 660778 - DNA, 25 bp, Mus musculus
gagtgccacccaaagttctgaaaca

SEQ ID NO: 660779 - DNA, 25 bp, Mus musculus
gagtgccacccatagttctgaaaca

SEQ ID NO: 660780 - DNA, 25 bp, Mus musculus
gagtgccaccgaagtggctgccttc

SEQ ID NO: 660781 - DNA, 25 bp, Mus musculus
gagtgccaccgatgtggctgccttc

SEQ ID NO: 660782 - DNA, 25 bp, Mus musculus
gagtgccactacatcatctgtgacg

SEQ ID NO: 660783 - DNA, 25 bp, Mus musculus
gagtgccactacttcatctgtgacg

SEQ ID NO: 660784 - DNA, 25 bp, Mus musculus
gagtgccacttcacgtaaacggaaa

SEQ ID NO: 660785 - DNA, 25 bp, Mus musculus
gagtgccacttctcgtaaacggaaa

SEQ ID NO: 660786 - DNA, 25 bp, Mus musculus
gagtgccagatcacacaggaatact

SEQ ID NO: 660787 - DNA, 25 bp, Mus musculus
gagtgccagatctcacaggaatact

SEQ ID NO: 660788 - DNA, 25 bp, Mus musculus
gagtgccagtcccagatcacagaga

SEQ ID NO: 660789 - DNA, 25 bp, Mus musculus
gagtgccagtccgagatcacagaga

SEQ ID NO: 660790 - DNA, 25 bp, Mus musculus
gagtgccatcgccaccgtcggtgct

SEQ ID NO: 660791 - DNA, 25 bp, Mus musculus
gagtgccatcgcgaccgtcggtgct

SEQ ID NO: 660792 - DNA, 25 bp, Mus musculus
gagtgccatggacaccctcatcaat

SEQ ID NO: 660793 - DNA, 25 bp, Mus musculus
gagtgccatggagaccctcatcaat

SEQ ID NO: 660794 - DNA, 25 bp, Mus musculus
gagtgccattgtccgcgtcatgcag

SEQ ID NO: 660795 - DNA, 25 bp, Mus musculus
gagtgccattgtgcgcgtcatgcag

SEQ ID NO: 660796 - DNA, 25 bp, Mus musculus
gagtgcccagaacgagaatccgtga

SEQ ID NO: 660797 - DNA, 25 bp, Mus musculus
gagtgcccagaaggagaatccgtga

SEQ ID NO: 660798 - DNA, 25 bp, Mus musculus
gagtgcccaggcagtgttcccagct

SEQ ID NO: 660799 - DNA, 25 bp, Mus musculus
gagtgcccaggctgtgttcccagct

SEQ ID NO: 660800 - DNA, 25 bp, Mus musculus
gagtgcccataacacagaacccctg

SEQ ID NO: 660801 - DNA, 25 bp, Mus musculus
gagtgcccataagacagaacccctg

SEQ ID NO: 660802 - DNA, 25 bp, Mus musculus
gagtgccctactctgtggatgagaa

SEQ ID NO: 660803 - DNA, 25 bp, Mus musculus
gagtgccctactgtgtggatgagaa

SEQ ID NO: 660804 - DNA, 25 bp, Mus musculus
gagtgccgaagacaccgcatggcta

SEQ ID NO: 660805 - DNA, 25 bp, Mus musculus
gagtgccgaagagaccgcatggcta

SEQ ID NO: 660806 - DNA, 25 bp, Mus musculus
gagtgccgaattagtttaacatgag

SEQ ID NO: 660807 - DNA, 25 bp, Mus musculus
gagtgccgaatttgtttaacatgag

SEQ ID NO: 660808 - DNA, 25 bp, Mus musculus
gagtgccgcctgctgaaagagaccc

SEQ ID NO: 660809 - DNA, 25 bp, Mus musculus
gagtgccgcctgcttgcctacatat

SEQ ID NO: 660810 - DNA, 25 bp, Mus musculus
gagtgccgcctggtgaaagagaccc

SEQ ID NO: 660811 - DNA, 25 bp, Mus musculus
gagtgccgcctggttgcctacatat

SEQ ID NO: 660812 - DNA, 25 bp, Mus musculus
gagtgccggcgtatcaccacagatg

SEQ ID NO: 660813 - DNA, 25 bp, Mus musculus
gagtgccggcgtttcaccacagatg

SEQ ID NO: 660814 - DNA, 25 bp, Mus musculus
gagtgccgtgtgatatcagagtttg

SEQ ID NO: 660815 - DNA, 25 bp, Mus musculus
gagtgccgtgtgttatcagagtttg

SEQ ID NO: 660816 - DNA, 25 bp, Mus musculus
gagtgcctaaagcaataggagttca

SEQ ID NO: 660817 - DNA, 25 bp, Mus musculus
gagtgcctaaaggaataggagttca

SEQ ID NO: 660818 - DNA, 25 bp, Mus musculus
gagtgcctacatcaggatgaagtac

SEQ ID NO: 660819 - DNA, 25 bp, Mus musculus
gagtgcctacatgaggatgaagtac

SEQ ID NO: 660820 - DNA, 25 bp, Mus musculus
gagtgcctactacaacaaccccgag

SEQ ID NO: 660821 - DNA, 25 bp, Mus musculus
gagtgcctactagaacaaccccgag

SEQ ID NO: 660822 - DNA, 25 bp, Mus musculus
gagtgcctcaacagcctgggctcct

SEQ ID NO: 660823 - DNA, 25 bp, Mus musculus
gagtgcctcaactgcctgggctcct

SEQ ID NO: 660824 - DNA, 25 bp, Mus musculus
gagtgcctgaagatcgtcactcgca

SEQ ID NO: 660825 - DNA, 25 bp, Mus musculus
gagtgcctgaagttcgtcactcgca

SEQ ID NO: 660826 - DNA, 25 bp, Mus musculus
gagtgccttatgcaacctgtctgca

SEQ ID NO: 660827 - DNA, 25 bp, Mus musculus
gagtgccttatggaacctgtctgca

SEQ ID NO: 660828 - DNA, 25 bp, Mus musculus
gagtgcgaaactcagaatccctgtg

SEQ ID NO: 660829 - DNA, 25 bp, Mus musculus
gagtgcgaaactgagaatccctgtg

SEQ ID NO: 660830 - DNA, 25 bp, Mus musculus
gagtgcgaaccacttatggctacca

SEQ ID NO: 660831 - DNA, 25 bp, Mus musculus
gagtgcgaaccagttatggctacca

SEQ ID NO: 660832 - DNA, 25 bp, Mus musculus
gagtgcgaccatcgctgtagtgaaa

SEQ ID NO: 660833 - DNA, 25 bp, Mus musculus
gagtgcgaccatggctgtagtgaaa

SEQ ID NO: 660834 - DNA, 25 bp, Mus musculus
gagtgcgaccgcagtaggatctatc

SEQ ID NO: 660835 - DNA, 25 bp, Mus musculus
gagtgcgaccgctgtaggatctatc

SEQ ID NO: 660836 - DNA, 25 bp, Mus musculus
gagtgcgctgtaactaatcaattgg

SEQ ID NO: 660837 - DNA, 25 bp, Mus musculus
gagtgcgctgtatctaatcaattgg

SEQ ID NO: 660838 - DNA, 25 bp, Mus musculus
gagtgctacacacagttatgttttc

SEQ ID NO: 660839 - DNA, 25 bp, Mus musculus
gagtgctacacagagttatgttttc

SEQ ID NO: 660840 - DNA, 25 bp, Mus musculus
gagtgctacattcccgagcaaaaca

SEQ ID NO: 660841 - DNA, 25 bp, Mus musculus
gagtgctacattgccgagcaaaaca

SEQ ID NO: 660842 - DNA, 25 bp, Mus musculus
gagtgctaccagcacaacttctcca

SEQ ID NO: 660843 - DNA, 25 bp, Mus musculus
gagtgctaccaggacaacttctcca

SEQ ID NO: 660844 - DNA, 25 bp, Mus musculus
gagtgctacccaagctctccggttc

SEQ ID NO: 660845 - DNA, 25 bp, Mus musculus
gagtgctacccatgctctccggttc

SEQ ID NO: 660846 - DNA, 25 bp, Mus musculus
gagtgctcacggcaacttctacgag

SEQ ID NO: 660847 - DNA, 25 bp, Mus musculus
gagtgctcacgggaacttctacgag

SEQ ID NO: 660848 - DNA, 25 bp, Mus musculus
gagtgctcagccaccaatgtcctgg

SEQ ID NO: 660849 - DNA, 25 bp, Mus musculus
gagtgctcagcctccaatgtcctgg

SEQ ID NO: 660850 - DNA, 25 bp, Mus musculus
gagtgctccccactgtgagtatgca

SEQ ID NO: 660851 - DNA, 25 bp, Mus musculus
gagtgctccccagtgtgagtatgca

SEQ ID NO: 660852 - DNA, 25 bp, Mus musculus
gagtgctccgtgacactgatgtcgg

SEQ ID NO: 660853 - DNA, 25 bp, Mus musculus
gagtgctccgtgtcactgatgtcgg

SEQ ID NO: 660854 - DNA, 25 bp, Mus musculus
gagtgctctatcaccttaggaagaa

SEQ ID NO: 660855 - DNA, 25 bp, Mus musculus
gagtgctctatctccttaggaagaa

SEQ ID NO: 660856 - DNA, 25 bp, Mus musculus
gagtgctcttgtcttctccgttgtg

SEQ ID NO: 660857 - DNA, 25 bp, Mus musculus
gagtgctcttgtgttctccgttgtg

SEQ ID NO: 660858 - DNA, 25 bp, Mus musculus
gagtgctgaaagcattcaaaggaga

SEQ ID NO: 660859 - DNA, 25 bp, Mus musculus
gagtgctgaaaggattcaaaggaga

SEQ ID NO: 660860 - DNA, 25 bp, Mus musculus
gagtgctgacacctttgagttgaag

SEQ ID NO: 660861 - DNA, 25 bp, Mus musculus
gagtgctgacacgtttgagttgaag

SEQ ID NO: 660862 - DNA, 25 bp, Mus musculus
gagtgctgccatcctaggtaattct

SEQ ID NO: 660863 - DNA, 25 bp, Mus musculus
gagtgctgccatgctaggtaattct

SEQ ID NO: 660864 - DNA, 25 bp, Mus musculus
gagtgctgggctcgttttttgtacc

SEQ ID NO: 660865 - DNA, 25 bp, Mus musculus
gagtgctgggctggttttttgtacc

SEQ ID NO: 660866 - DNA, 25 bp, Mus musculus
gagtgctggttgcttcccgtaattt

SEQ ID NO: 660867 - DNA, 25 bp, Mus musculus
gagtgctggttggttcccgtaattt

SEQ ID NO: 660868 - DNA, 25 bp, Mus musculus
gagtgctgtgaaaacgaagtggaaa

SEQ ID NO: 660869 - DNA, 25 bp, Mus musculus
gagtgctgtgaatacgaagtggaaa

SEQ ID NO: 660870 - DNA, 25 bp, Mus musculus
gagtgctgtgcaactgtcccggtta

SEQ ID NO: 660871 - DNA, 25 bp, Mus musculus
gagtgctgtgcatctgtcccggtta

SEQ ID NO: 660872 - DNA, 25 bp, Mus musculus
gagtgcttacggaaatatggttcag

SEQ ID NO: 660873 - DNA, 25 bp, Mus musculus
gagtgcttacggtaatatggttcag

SEQ ID NO: 660874 - DNA, 25 bp, Mus musculus
gagtgcttcaatactccatatggaa

SEQ ID NO: 660875 - DNA, 25 bp, Mus musculus
gagtgcttcaattctccatatggaa

SEQ ID NO: 660876 - DNA, 25 bp, Mus musculus
gagtgcttggccctttgaggtctca

SEQ ID NO: 660877 - DNA, 25 bp, Mus musculus
gagtgcttggccgtttgaggtctca

SEQ ID NO: 660878 - DNA, 25 bp, Mus musculus
gagtgcttgggcagtcactgatgct

SEQ ID NO: 660879 - DNA, 25 bp, Mus musculus
gagtgcttgggctgtcactgatgct

SEQ ID NO: 660880 - DNA, 25 bp, Mus musculus
gagtgctttagacaacgctctggaa

SEQ ID NO: 660881 - DNA, 25 bp, Mus musculus
gagtgctttagagaacgctctggaa

SEQ ID NO: 660882 - DNA, 25 bp, Mus musculus
gagtggaaaatgagtatacacagca

SEQ ID NO: 660883 - DNA, 25 bp, Mus musculus
gagtggaaaatgtgtatacacagca

SEQ ID NO: 660884 - DNA, 25 bp, Mus musculus
gagtggaaaccacgtcaaattgaca

SEQ ID NO: 660885 - DNA, 25 bp, Mus musculus
gagtggaaaccaggtcaaattgaca

SEQ ID NO: 660886 - DNA, 25 bp, Mus musculus
gagtggaaacctccaaatcactgga

SEQ ID NO: 660887 - DNA, 25 bp, Mus musculus
gagtggaaacctgcaaatcactgga

SEQ ID NO: 660888 - DNA, 25 bp, Mus musculus
gagtggaacaggagacaagaaaaat

SEQ ID NO: 660889 - DNA, 25 bp, Mus musculus
gagtggaacaggtgacaagaaaaat

SEQ ID NO: 660890 - DNA, 25 bp, Mus musculus
gagtggaaccctaacatccatcaac

SEQ ID NO: 660891 - DNA, 25 bp, Mus musculus
gagtggaacccttacatccatcaac

SEQ ID NO: 660892 - DNA, 25 bp, Mus musculus
gagtggaagacaacgttcgacgccc

SEQ ID NO: 660893 - DNA, 25 bp, Mus musculus
gagtggaagacatcgttcgacgccc

SEQ ID NO: 660894 - DNA, 25 bp, Mus musculus
gagtggaagttcctttaggcccttg

SEQ ID NO: 660895 - DNA, 25 bp, Mus musculus
gagtggaagttcgtttaggcccttg

SEQ ID NO: 660896 - DNA, 25 bp, Mus musculus
gagtggacaatgaggagtaccagtt

SEQ ID NO: 660897 - DNA, 25 bp, Mus musculus
gagtggacaatgtggagtaccagtt

SEQ ID NO: 660898 - DNA, 25 bp, Mus musculus
gagtggacacttcatcaaagaggag

SEQ ID NO: 660899 - DNA, 25 bp, Mus musculus
gagtggacacttgatcaaagaggag

SEQ ID NO: 660900 - DNA, 25 bp, Mus musculus
gagtggaccgacaacaggttaagct

SEQ ID NO: 660901 - DNA, 25 bp, Mus musculus
gagtggaccgactacaggttaagct

SEQ ID NO: 660902 - DNA, 25 bp, Mus musculus
gagtggacgatcaaacaccgttaca

SEQ ID NO: 660903 - DNA, 25 bp, Mus musculus
gagtggacgatctaacaccgttaca

SEQ ID NO: 660904 - DNA, 25 bp, Mus musculus
gagtggacgcctcctgatgtaacaa

SEQ ID NO: 660905 - DNA, 25 bp, Mus musculus
gagtggacgcctgctgatgtaacaa

SEQ ID NO: 660906 - DNA, 25 bp, Mus musculus
gagtggactcctacgtgatccgcga

SEQ ID NO: 660907 - DNA, 25 bp, Mus musculus
gagtggactccttcgtgatccgcga

SEQ ID NO: 660908 - DNA, 25 bp, Mus musculus
gagtggactgcgatcccgcctgctt

SEQ ID NO: 660909 - DNA, 25 bp, Mus musculus
gagtggactgcgttcccgcctgctt

SEQ ID NO: 660910 - DNA, 25 bp, Mus musculus
gagtggagaggcatccaaacacctg

SEQ ID NO: 660911 - DNA, 25 bp, Mus musculus
gagtggagaggcctcgtctccctca

SEQ ID NO: 660912 - DNA, 25 bp, Mus musculus
gagtggagaggcgtcgtctccctca

SEQ ID NO: 660913 - DNA, 25 bp, Mus musculus
gagtggagaggcttccaaacacctg

SEQ ID NO: 660914 - DNA, 25 bp, Mus musculus
gagtggagctccacctgtgagaagt

SEQ ID NO: 660915 - DNA, 25 bp, Mus musculus
gagtggagctcctcctgtgagaagt

SEQ ID NO: 660916 - DNA, 25 bp, Mus musculus
gagtggaggccaccgccttcagtcc

SEQ ID NO: 660917 - DNA, 25 bp, Mus musculus
gagtggaggccagcgccttcagtcc

SEQ ID NO: 660918 - DNA, 25 bp, Mus musculus
gagtggaggcctacagtacctaccc

SEQ ID NO: 660919 - DNA, 25 bp, Mus musculus
gagtggaggccttcagtacctaccc

SEQ ID NO: 660920 - DNA, 25 bp, Mus musculus
gagtggaggctgacattgccttgct

SEQ ID NO: 660921 - DNA, 25 bp, Mus musculus
gagtggaggctgtcattgccttgct

SEQ ID NO: 660922 - DNA, 25 bp, Mus musculus
gagtggatcaagaccctaaaggaac

SEQ ID NO: 660923 - DNA, 25 bp, Mus musculus
gagtggatcaagtccctaaaggaac

SEQ ID NO: 660924 - DNA, 25 bp, Mus musculus
gagtggatctcacggcccaatgtgc

SEQ ID NO: 660925 - DNA, 25 bp, Mus musculus
gagtggatctcagggcccaatgtgc

SEQ ID NO: 660926 - DNA, 25 bp, Mus musculus
gagtggatgtcgaagacctgggcgt

SEQ ID NO: 660927 - DNA, 25 bp, Mus musculus
gagtggatgtcgtagacctgggcgt

SEQ ID NO: 660928 - DNA, 25 bp, Mus musculus
gagtggattgaacccttagcaggac

SEQ ID NO: 660929 - DNA, 25 bp, Mus musculus
gagtggattgaagccttagcaggac

SEQ ID NO: 660930 - DNA, 25 bp, Mus musculus
gagtggattgccacgtggctccgta

SEQ ID NO: 660931 - DNA, 25 bp, Mus musculus
gagtggattgcctcgtggctccgta

SEQ ID NO: 660932 - DNA, 25 bp, Mus musculus
gagtggattttcatgcctatattga

SEQ ID NO: 660933 - DNA, 25 bp, Mus musculus
gagtggattttcttgcctatattga

SEQ ID NO: 660934 - DNA, 25 bp, Mus musculus
gagtggcaaagcaaccaaccctggg

SEQ ID NO: 660935 - DNA, 25 bp, Mus musculus
gagtggcaaagcacagacagaggat

SEQ ID NO: 660936 - DNA, 25 bp, Mus musculus
gagtggcaaagctaccaaccctggg

SEQ ID NO: 660937 - DNA, 25 bp, Mus musculus
gagtggcaaagctcagacagaggat

SEQ ID NO: 660938 - DNA, 25 bp, Mus musculus
gagtggcaacatcacggcatttgca

SEQ ID NO: 660939 - DNA, 25 bp, Mus musculus
gagtggcaacatgacggcatttgca

SEQ ID NO: 660940 - DNA, 25 bp, Mus musculus
gagtggcaaccacatacccatgtgt

SEQ ID NO: 660941 - DNA, 25 bp, Mus musculus
gagtggcaaccagatacccatgtgt

SEQ ID NO: 660942 - DNA, 25 bp, Mus musculus
gagtggcacatcaatcaggactggc

SEQ ID NO: 660943 - DNA, 25 bp, Mus musculus
gagtggcacatctatcaggactggc

SEQ ID NO: 660944 - DNA, 25 bp, Mus musculus
gagtggcaccagctattctgatatc

SEQ ID NO: 660945 - DNA, 25 bp, Mus musculus
gagtggcaccaggtattctgatatc

SEQ ID NO: 660946 - DNA, 25 bp, Mus musculus
gagtggcagcacacattgggcttca

SEQ ID NO: 660947 - DNA, 25 bp, Mus musculus
gagtggcagcactcattgggcttca

SEQ ID NO: 660948 - DNA, 25 bp, Mus musculus
gagtggcaggaactctccacctgag

SEQ ID NO: 660949 - DNA, 25 bp, Mus musculus
gagtggcaggaagtctccacctgag

SEQ ID NO: 660950 - DNA, 25 bp, Mus musculus
gagtggcaggttacctctgaggatt

SEQ ID NO: 660951 - DNA, 25 bp, Mus musculus
gagtggcaggtttcctctgaggatt

SEQ ID NO: 660952 - DNA, 25 bp, Mus musculus
gagtggcatccgcatagcacagagc

SEQ ID NO: 660953 - DNA, 25 bp, Mus musculus
gagtggcatccggatagcacagagc

SEQ ID NO: 660954 - DNA, 25 bp, Mus musculus
gagtggcatctgcacctctctcttc

SEQ ID NO: 660955 - DNA, 25 bp, Mus musculus
gagtggcatctggacctctctcttc

SEQ ID NO: 660956 - DNA, 25 bp, Mus musculus
gagtggcatgacaacaaactgcgct

SEQ ID NO: 660957 - DNA, 25 bp, Mus musculus
gagtggcatgactacaaactgcgct

SEQ ID NO: 660958 - DNA, 25 bp, Mus musculus
gagtggcatgtgactctattttcta

SEQ ID NO: 660959 - DNA, 25 bp, Mus musculus
gagtggcatgtgtctctattttcta

SEQ ID NO: 660960 - DNA, 25 bp, Mus musculus
gagtggccaccaaggacctcttcga

SEQ ID NO: 660961 - DNA, 25 bp, Mus musculus
gagtggccaccatggacctcttcga

SEQ ID NO: 660962 - DNA, 25 bp, Mus musculus
gagtggccacgcagctagacagtat

SEQ ID NO: 660963 - DNA, 25 bp, Mus musculus
gagtggccacgctgctagacagtat

SEQ ID NO: 660964 - DNA, 25 bp, Mus musculus
gagtggccaggtactacaggtcaag

SEQ ID NO: 660965 - DNA, 25 bp, Mus musculus
gagtggccaggttctacaggtcaag

SEQ ID NO: 660966 - DNA, 25 bp, Mus musculus
gagtggcccagtaagccctgttaga

SEQ ID NO: 660967 - DNA, 25 bp, Mus musculus
gagtggcccagtcagttttccagtg

SEQ ID NO: 660968 - DNA, 25 bp, Mus musculus
gagtggcccagtgagttttccagtg

SEQ ID NO: 660969 - DNA, 25 bp, Mus musculus
gagtggcccagttagccctgttaga

SEQ ID NO: 660970 - DNA, 25 bp, Mus musculus
gagtggcccgcaacaacgggaaaca

SEQ ID NO: 660971 - DNA, 25 bp, Mus musculus
gagtggcccgcatcaacgggaaaca

SEQ ID NO: 660972 - DNA, 25 bp, Mus musculus
gagtggccctcaaatcgtccttgcg

SEQ ID NO: 660973 - DNA, 25 bp, Mus musculus
gagtggccctcatatcgtccttgcg

SEQ ID NO: 660974 - DNA, 25 bp, Mus musculus
gagtggccgcacagccctgcacttg

SEQ ID NO: 660975 - DNA, 25 bp, Mus musculus
gagtggccgcactgccctgcacttg

SEQ ID NO: 660976 - DNA, 25 bp, Mus musculus
gagtggccgcccagcaaggcatccg

SEQ ID NO: 660977 - DNA, 25 bp, Mus musculus
gagtggccgccctgcaaggcatccg

SEQ ID NO: 660978 - DNA, 25 bp, Mus musculus
gagtggccgtgcacaagtacacgtg

SEQ ID NO: 660979 - DNA, 25 bp, Mus musculus
gagtggccgtgctcaagtacacgtg

SEQ ID NO: 660980 - DNA, 25 bp, Mus musculus
gagtggcctatgctgtcacatcaaa

SEQ ID NO: 660981 - DNA, 25 bp, Mus musculus
gagtggcctatggtgtcacatcaaa

SEQ ID NO: 660982 - DNA, 25 bp, Mus musculus
gagtggcctctcaggctgacagtgc

SEQ ID NO: 660983 - DNA, 25 bp, Mus musculus
gagtggcctctctggctgacagtgc

SEQ ID NO: 660984 - DNA, 25 bp, Mus musculus
gagtggcgagctaccttttcctgga

SEQ ID NO: 660985 - DNA, 25 bp, Mus musculus
gagtggcgagcttccttttcctgga

SEQ ID NO: 660986 - DNA, 25 bp, Mus musculus
gagtggcgatccagttcctaaagga

SEQ ID NO: 660987 - DNA, 25 bp, Mus musculus
gagtggcgatcctgttcctaaagga

SEQ ID NO: 660988 - DNA, 25 bp, Mus musculus
gagtggcgtattcgtgctgtctttc

SEQ ID NO: 660989 - DNA, 25 bp, Mus musculus
gagtggcgtattggtgctgtctttc

SEQ ID NO: 660990 - DNA, 25 bp, Mus musculus
gagtggctactgatcccaaagcagc

SEQ ID NO: 660991 - DNA, 25 bp, Mus musculus
gagtggctactgttcccaaagcagc

SEQ ID NO: 660992 - DNA, 25 bp, Mus musculus
gagtggctacttacacatccaggcc

SEQ ID NO: 660993 - DNA, 25 bp, Mus musculus
gagtggctactttcacatccaggcc

SEQ ID NO: 660994 - DNA, 25 bp, Mus musculus
gagtggctgacacaaggctatccgc

SEQ ID NO: 660995 - DNA, 25 bp, Mus musculus
gagtggctgacagaaggctatccgc

SEQ ID NO: 660996 - DNA, 25 bp, Mus musculus
gagtggctgcgcattggattcctgc

SEQ ID NO: 660997 - DNA, 25 bp, Mus musculus
gagtggctgcgctttggattcctgc

SEQ ID NO: 660998 - DNA, 25 bp, Mus musculus
gagtggctgggcagatgctaaatat

SEQ ID NO: 660999 - DNA, 25 bp, Mus musculus
gagtggctgggctgatgctaaatat

SEQ ID NO: 661000 - DNA, 25 bp, Mus musculus
gagtggctggttagataaccttctc

SEQ ID NO: 661001 - DNA, 25 bp, Mus musculus
gagtggctggtttgataaccttctc

SEQ ID NO: 661002 - DNA, 25 bp, Mus musculus
gagtggctgtctagatatctggaac

SEQ ID NO: 661003 - DNA, 25 bp, Mus musculus
gagtggctgtcttgatatctggaac

SEQ ID NO: 661004 - DNA, 25 bp, Mus musculus
gagtggcttcctaccttcgggagcc

SEQ ID NO: 661005 - DNA, 25 bp, Mus musculus
gagtggcttccttccttcgggagcc

SEQ ID NO: 661006 - DNA, 25 bp, Mus musculus
gagtggctttcacgaacgtcaagcc

SEQ ID NO: 661007 - DNA, 25 bp, Mus musculus
gagtggctttcaggaacgtcaagcc

SEQ ID NO: 661008 - DNA, 25 bp, Mus musculus
gagtggcttttgaccctcatccttg

SEQ ID NO: 661009 - DNA, 25 bp, Mus musculus
gagtggcttttgtccctcatccttg

SEQ ID NO: 661010 - DNA, 25 bp, Mus musculus
gagtgggaaccaccagtgattcaaa

SEQ ID NO: 661011 - DNA, 25 bp, Mus musculus
gagtgggaaccactacgccatgaag

SEQ ID NO: 661012 - DNA, 25 bp, Mus musculus
gagtgggaaccagcagtgattcaaa

SEQ ID NO: 661013 - DNA, 25 bp, Mus musculus
gagtgggaaccagtacgccatgaag

SEQ ID NO: 661014 - DNA, 25 bp, Mus musculus
gagtgggaaggaaataaccaccgta

SEQ ID NO: 661015 - DNA, 25 bp, Mus musculus
gagtgggaaggatataaccaccgta

SEQ ID NO: 661016 - DNA, 25 bp, Mus musculus
gagtgggagaaaacttgactgaccc

SEQ ID NO: 661017 - DNA, 25 bp, Mus musculus
gagtgggagaaatcttgactgaccc

SEQ ID NO: 661018 - DNA, 25 bp, Mus musculus
gagtgggaggctctaaaccatttac

SEQ ID NO: 661019 - DNA, 25 bp, Mus musculus
gagtgggaggctgtaaaccatttac

SEQ ID NO: 661020 - DNA, 25 bp, Mus musculus
gagtgggagtccaactacaaaactg

SEQ ID NO: 661021 - DNA, 25 bp, Mus musculus
gagtgggagtcctactacaaaactg

SEQ ID NO: 661022 - DNA, 25 bp, Mus musculus
gagtgggcaggtactagccaagcaa

SEQ ID NO: 661023 - DNA, 25 bp, Mus musculus
gagtgggcaggttctagccaagcaa

SEQ ID NO: 661024 - DNA, 25 bp, Mus musculus
gagtgggccaagaacatcccggcct

SEQ ID NO: 661025 - DNA, 25 bp, Mus musculus
gagtgggccaagtacatcccggcct

SEQ ID NO: 661026 - DNA, 25 bp, Mus musculus
gagtgggcccaacgcaccttcaaat

SEQ ID NO: 661027 - DNA, 25 bp, Mus musculus
gagtgggcccaaggcaccttcaaat

SEQ ID NO: 661028 - DNA, 25 bp, Mus musculus
gagtgggcgcctatgcagttttagc

SEQ ID NO: 661029 - DNA, 25 bp, Mus musculus
gagtgggcgcctttgcagttttagc

SEQ ID NO: 661030 - DNA, 25 bp, Mus musculus
gagtgggctaggaacctacaacaac

SEQ ID NO: 661031 - DNA, 25 bp, Mus musculus
gagtgggctaggtacctacaacaac

SEQ ID NO: 661032 - DNA, 25 bp, Mus musculus
gagtgggcttctcccagaaatttta

SEQ ID NO: 661033 - DNA, 25 bp, Mus musculus
gagtgggcttctgccagaaatttta

SEQ ID NO: 661034 - DNA, 25 bp, Mus musculus
gagtggggggtcatgctttctctac

SEQ ID NO: 661035 - DNA, 25 bp, Mus musculus
gagtggggggtcttgctttctctac

SEQ ID NO: 661036 - DNA, 25 bp, Mus musculus
gagtggtagccaagatgaatctgat

SEQ ID NO: 661037 - DNA, 25 bp, Mus musculus
gagtggtagccatgatgaatctgat

SEQ ID NO: 661038 - DNA, 25 bp, Mus musculus
gagtggtatcgaattcccagtagct

SEQ ID NO: 661039 - DNA, 25 bp, Mus musculus
gagtggtatcgatttcccagtagct

SEQ ID NO: 661040 - DNA, 25 bp, Mus musculus
gagtggtcacatcagagcaacagca

SEQ ID NO: 661041 - DNA, 25 bp, Mus musculus
gagtggtcacatgagagcaacagca

SEQ ID NO: 661042 - DNA, 25 bp, Mus musculus
gagtggtcatgtctacccacagcaa

SEQ ID NO: 661043 - DNA, 25 bp, Mus musculus
gagtggtcatgtgtacccacagcaa

SEQ ID NO: 661044 - DNA, 25 bp, Mus musculus
gagtggtcctttccagccattcctc

SEQ ID NO: 661045 - DNA, 25 bp, Mus musculus
gagtggtcctttgcagccattcctc

SEQ ID NO: 661046 - DNA, 25 bp, Mus musculus
gagtggtcggacatgtacactgtga

SEQ ID NO: 661047 - DNA, 25 bp, Mus musculus
gagtggtcggacttgtacactgtga

SEQ ID NO: 661048 - DNA, 25 bp, Mus musculus
gagtggtctcatcgcatgcacctca

SEQ ID NO: 661049 - DNA, 25 bp, Mus musculus
gagtggtctcatggcatgcacctca

SEQ ID NO: 661050 - DNA, 25 bp, Mus musculus
gagtggtctgtgaatccttggaaga

SEQ ID NO: 661051 - DNA, 25 bp, Mus musculus
gagtggtctgtgtatccttggaaga

SEQ ID NO: 661052 - DNA, 25 bp, Mus musculus
gagtggtgcattctgggaaactcct

SEQ ID NO: 661053 - DNA, 25 bp, Mus musculus
gagtggtgcattgtgggaaactcct

SEQ ID NO: 661054 - DNA, 25 bp, Mus musculus
gagtggtgctaccaaaggaccccaa

SEQ ID NO: 661055 - DNA, 25 bp, Mus musculus
gagtggtgctacgaaaggaccccaa

SEQ ID NO: 661056 - DNA, 25 bp, Mus musculus
gagtggtgcttcaaaccatgtgaga

SEQ ID NO: 661057 - DNA, 25 bp, Mus musculus
gagtggtgcttctaaccatgtgaga

SEQ ID NO: 661058 - DNA, 25 bp, Mus musculus
gagtggtggaaaagcgccttctcct

SEQ ID NO: 661059 - DNA, 25 bp, Mus musculus
gagtggtggaaatgcgccttctcct

SEQ ID NO: 661060 - DNA, 25 bp, Mus musculus
gagtggtggacgagtggctgtggag

SEQ ID NO: 661061 - DNA, 25 bp, Mus musculus
gagtggtggacgtgtggctgtggag

SEQ ID NO: 661062 - DNA, 25 bp, Mus musculus
gagtggtggcctcaagccgccattt

SEQ ID NO: 661063 - DNA, 25 bp, Mus musculus
gagtggtggcctgaagccgccattt

SEQ ID NO: 661064 - DNA, 25 bp, Mus musculus
gagtggtgtccgagtcccacatcct

SEQ ID NO: 661065 - DNA, 25 bp, Mus musculus
gagtggtgtccgtgtcccacatcct

SEQ ID NO: 661066 - DNA, 25 bp, Mus musculus
gagtggtgtggtcataaatacaaac

SEQ ID NO: 661067 - DNA, 25 bp, Mus musculus
gagtggtgtggtgataaatacaaac

SEQ ID NO: 661068 - DNA, 25 bp, Mus musculus
gagtggttaatgcagaaggcttctc

SEQ ID NO: 661069 - DNA, 25 bp, Mus musculus
gagtggttaatggagaaggcttctc

SEQ ID NO: 661070 - DNA, 25 bp, Mus musculus
gagtggttccacagatggaaatgcc

SEQ ID NO: 661071 - DNA, 25 bp, Mus musculus
gagtggttccactgatggaaatgcc

SEQ ID NO: 661072 - DNA, 25 bp, Mus musculus
gagtggtttgtgcattcgctcaacc

SEQ ID NO: 661073 - DNA, 25 bp, Mus musculus
gagtggtttgtggattcgctcaacc

SEQ ID NO: 661074 - DNA, 25 bp, Mus musculus
gagtgtaacaacatgaccctcatca

SEQ ID NO: 661075 - DNA, 25 bp, Mus musculus
gagtgtaacaacttgaccctcatca

SEQ ID NO: 661076 - DNA, 25 bp, Mus musculus
gagtgtaacaccatctgcacgcggc

SEQ ID NO: 661077 - DNA, 25 bp, Mus musculus
gagtgtaacaccttctgcacgcggc

SEQ ID NO: 661078 - DNA, 25 bp, Mus musculus
gagtgtaacactcacaacacgtaca

SEQ ID NO: 661079 - DNA, 25 bp, Mus musculus
gagtgtaacactgacaacacgtaca

SEQ ID NO: 661080 - DNA, 25 bp, Mus musculus
gagtgtaagtcaatatcctccacgc

SEQ ID NO: 661081 - DNA, 25 bp, Mus musculus
gagtgtaagtcattatcctccacgc

SEQ ID NO: 661082 - DNA, 25 bp, Mus musculus
gagtgtaatcgccaacaagctgggc

SEQ ID NO: 661083 - DNA, 25 bp, Mus musculus
gagtgtaatcgcgaacaagctgggc

SEQ ID NO: 661084 - DNA, 25 bp, Mus musculus
gagtgtacaacaccctgaaccaagg

SEQ ID NO: 661085 - DNA, 25 bp, Mus musculus
gagtgtacaacagcctgaaccaagg

SEQ ID NO: 661086 - DNA, 25 bp, Mus musculus
gagtgtacactgacatgggcaggat

SEQ ID NO: 661087 - DNA, 25 bp, Mus musculus
gagtgtacactgtcatgggcaggat

SEQ ID NO: 661088 - DNA, 25 bp, Mus musculus
gagtgtacagccactttatgtcaac

SEQ ID NO: 661089 - DNA, 25 bp, Mus musculus
gagtgtacagcctctttatgtcaac

SEQ ID NO: 661090 - DNA, 25 bp, Mus musculus
gagtgtacaggcacaggccctagag

SEQ ID NO: 661091 - DNA, 25 bp, Mus musculus
gagtgtacaggcctctatctgtcca

SEQ ID NO: 661092 - DNA, 25 bp, Mus musculus
gagtgtacaggcgtctatctgtcca

SEQ ID NO: 661093 - DNA, 25 bp, Mus musculus
gagtgtacaggctcaggccctagag

SEQ ID NO: 661094 - DNA, 25 bp, Mus musculus
gagtgtacggtacaggactctccga

SEQ ID NO: 661095 - DNA, 25 bp, Mus musculus
gagtgtacggtagaggactctccga

SEQ ID NO: 661096 - DNA, 25 bp, Mus musculus
gagtgtactgaccaccaagaaaccc

SEQ ID NO: 661097 - DNA, 25 bp, Mus musculus
gagtgtactgacgaccaagaaaccc

SEQ ID NO: 661098 - DNA, 25 bp, Mus musculus
gagtgtagagaaagcgcctctggcc

SEQ ID NO: 661099 - DNA, 25 bp, Mus musculus
gagtgtagagaatgcgcctctggcc

SEQ ID NO: 661100 - DNA, 25 bp, Mus musculus
gagtgtagccatcgcacctccggga

SEQ ID NO: 661101 - DNA, 25 bp, Mus musculus
gagtgtagccatggcacctccggga

SEQ ID NO: 661102 - DNA, 25 bp, Mus musculus
gagtgtagtgtccagagctaatagc

SEQ ID NO: 661103 - DNA, 25 bp, Mus musculus
gagtgtagtgtcgagagctaatagc

SEQ ID NO: 661104 - DNA, 25 bp, Mus musculus
gagtgtatgaacatgcgagaagtta

SEQ ID NO: 661105 - DNA, 25 bp, Mus musculus
gagtgtatgaacttgcgagaagtta

SEQ ID NO: 661106 - DNA, 25 bp, Mus musculus
gagtgtattcccatactgtgggaag

SEQ ID NO: 661107 - DNA, 25 bp, Mus musculus
gagtgtattcccttactgtgggaag

SEQ ID NO: 661108 - DNA, 25 bp, Mus musculus
gagtgtattttgaggtgcatacccc

SEQ ID NO: 661109 - DNA, 25 bp, Mus musculus
gagtgtattttgtggtgcatacccc

SEQ ID NO: 661110 - DNA, 25 bp, Mus musculus
gagtgtcaacaaagaaatggagcct

SEQ ID NO: 661111 - DNA, 25 bp, Mus musculus
gagtgtcaacaatgaaatggagcct

SEQ ID NO: 661112 - DNA, 25 bp, Mus musculus
gagtgtcaagacaacaacggcggct

SEQ ID NO: 661113 - DNA, 25 bp, Mus musculus
gagtgtcaagactacaacggcggct

SEQ ID NO: 661114 - DNA, 25 bp, Mus musculus
gagtgtcaccctcgaccactttggg

SEQ ID NO: 661115 - DNA, 25 bp, Mus musculus
gagtgtcaccctggaccactttggg

SEQ ID NO: 661116 - DNA, 25 bp, Mus musculus
gagtgtcagaaaaatggaccagtgg

SEQ ID NO: 661117 - DNA, 25 bp, Mus musculus
gagtgtcagaaatatggaccagtgg

SEQ ID NO: 661118 - DNA, 25 bp, Mus musculus
gagtgtcagaataatgccaaggagg

SEQ ID NO: 661119 - DNA, 25 bp, Mus musculus
gagtgtcagaattatgccaaggagg

SEQ ID NO: 661120 - DNA, 25 bp, Mus musculus
gagtgtcagttcacacgagacatgg

SEQ ID NO: 661121 - DNA, 25 bp, Mus musculus
gagtgtcagttctcacgagacatgg

SEQ ID NO: 661122 - DNA, 25 bp, Mus musculus
gagtgtcatctgaatcccatcatcc

SEQ ID NO: 661123 - DNA, 25 bp, Mus musculus
gagtgtcatctgtatcccatcatcc

SEQ ID NO: 661124 - DNA, 25 bp, Mus musculus
gagtgtccagcaactggccagagca

SEQ ID NO: 661125 - DNA, 25 bp, Mus musculus
gagtgtccagcatctggccagagca

SEQ ID NO: 661126 - DNA, 25 bp, Mus musculus
gagtgtccatccagcgccgtgtgac

SEQ ID NO: 661127 - DNA, 25 bp, Mus musculus
gagtgtccatcctgcgccgtgtgac

SEQ ID NO: 661128 - DNA, 25 bp, Mus musculus
gagtgtcccctgactatgtttccct

SEQ ID NO: 661129 - DNA, 25 bp, Mus musculus
gagtgtcccctgtctatgtttccct

SEQ ID NO: 661130 - DNA, 25 bp, Mus musculus
gagtgtccccttcgaccccatggaa

SEQ ID NO: 661131 - DNA, 25 bp, Mus musculus
gagtgtccccttggaccccatggaa

SEQ ID NO: 661132 - DNA, 25 bp, Mus musculus
gagtgtccctcacacattgcttgaa

SEQ ID NO: 661133 - DNA, 25 bp, Mus musculus
gagtgtccctcagacattgcttgaa

SEQ ID NO: 661134 - DNA, 25 bp, Mus musculus
gagtgtccctctaagctgctgcaga

SEQ ID NO: 661135 - DNA, 25 bp, Mus musculus
gagtgtccctcttagctgctgcaga

SEQ ID NO: 661136 - DNA, 25 bp, Mus musculus
gagtgtcctagcatggcttctaatc

SEQ ID NO: 661137 - DNA, 25 bp, Mus musculus
gagtgtcctagcttggcttctaatc

SEQ ID NO: 661138 - DNA, 25 bp, Mus musculus
gagtgtcctctcagctcttacaggc

SEQ ID NO: 661139 - DNA, 25 bp, Mus musculus
gagtgtcctctctgctcttacaggc

SEQ ID NO: 661140 - DNA, 25 bp, Mus musculus
gagtgtcgaagcactaggtttggat

SEQ ID NO: 661141 - DNA, 25 bp, Mus musculus
gagtgtcgaagctctaggtttggat

SEQ ID NO: 661142 - DNA, 25 bp, Mus musculus
gagtgtcgacatcgcagctttcaac

SEQ ID NO: 661143 - DNA, 25 bp, Mus musculus
gagtgtcgacatggcagctttcaac

SEQ ID NO: 661144 - DNA, 25 bp, Mus musculus
gagtgtcggcccatcacattgtggt

SEQ ID NO: 661145 - DNA, 25 bp, Mus musculus
gagtgtcggcccttcacattgtggt

SEQ ID NO: 661146 - DNA, 25 bp, Mus musculus
gagtgtctaaaacctgtgctgaatg

SEQ ID NO: 661147 - DNA, 25 bp, Mus musculus
gagtgtctaaaagctgtgctgaatg

SEQ ID NO: 661148 - DNA, 25 bp, Mus musculus
gagtgtctcactaaagcttctctca

SEQ ID NO: 661149 - DNA, 25 bp, Mus musculus
gagtgtctcacttaagcttctctca

SEQ ID NO: 661150 - DNA, 25 bp, Mus musculus
gagtgtctcatgaagccactcaggc

SEQ ID NO: 661151 - DNA, 25 bp, Mus musculus
gagtgtctcatgtagccactcaggc

SEQ ID NO: 661152 - DNA, 25 bp, Mus musculus
gagtgtgaaggaattgatccgatac

SEQ ID NO: 661153 - DNA, 25 bp, Mus musculus
gagtgtgaaggatttgatccgatac

SEQ ID NO: 661154 - DNA, 25 bp, Mus musculus
gagtgtgagaatcactactacaacg

SEQ ID NO: 661155 - DNA, 25 bp, Mus musculus
gagtgtgagaatgactactacaacg

SEQ ID NO: 661156 - DNA, 25 bp, Mus musculus
gagtgtgagcagctctcctcctcta

SEQ ID NO: 661157 - DNA, 25 bp, Mus musculus
gagtgtgagcaggtctcctcctcta

SEQ ID NO: 661158 - DNA, 25 bp, Mus musculus
gagtgtgagtccaacccttgtgtca

SEQ ID NO: 661159 - DNA, 25 bp, Mus musculus
gagtgtgagtcctacccttgtgtca

SEQ ID NO: 661160 - DNA, 25 bp, Mus musculus
gagtgtgagtgcattgaaggattcc

SEQ ID NO: 661161 - DNA, 25 bp, Mus musculus
gagtgtgagtgctttgaaggattcc

SEQ ID NO: 661162 - DNA, 25 bp, Mus musculus
gagtgtgatcatcctgggtcttgcc

SEQ ID NO: 661163 - DNA, 25 bp, Mus musculus
gagtgtgatcatgctgggtcttgcc

SEQ ID NO: 661164 - DNA, 25 bp, Mus musculus
gagtgtgattcacggccctgtctgc

SEQ ID NO: 661165 - DNA, 25 bp, Mus musculus
gagtgtgattcagggccctgtctgc

SEQ ID NO: 661166 - DNA, 25 bp, Mus musculus
gagtgtgattcccaagactgactgc

SEQ ID NO: 661167 - DNA, 25 bp, Mus musculus
gagtgtgattccgaagactgactgc

SEQ ID NO: 661168 - DNA, 25 bp, Mus musculus
gagtgtgcactgagcgacacggccc

SEQ ID NO: 661169 - DNA, 25 bp, Mus musculus
gagtgtgcactgtgcgacacggccc

SEQ ID NO: 661170 - DNA, 25 bp, Mus musculus
gagtgtgcagatcctgctcatggcc

SEQ ID NO: 661171 - DNA, 25 bp, Mus musculus
gagtgtgcagatgctgctcatggcc

SEQ ID NO: 661172 - DNA, 25 bp, Mus musculus
gagtgtgcatggagtcacctaccag

SEQ ID NO: 661173 - DNA, 25 bp, Mus musculus
gagtgtgcatggtgtcacctaccag

SEQ ID NO: 661174 - DNA, 25 bp, Mus musculus
gagtgtgccccacataactgcgtct

SEQ ID NO: 661175 - DNA, 25 bp, Mus musculus
gagtgtgccccagataactgcgtct

SEQ ID NO: 661176 - DNA, 25 bp, Mus musculus
gagtgtgcctccagagtccaacaca

SEQ ID NO: 661177 - DNA, 25 bp, Mus musculus
gagtgtgcctcctgagtccaacaca

SEQ ID NO: 661178 - DNA, 25 bp, Mus musculus
gagtgtgccttgatgtttctggtcc

SEQ ID NO: 661179 - DNA, 25 bp, Mus musculus
gagtgtgccttgttgtttctggtcc

SEQ ID NO: 661180 - DNA, 25 bp, Mus musculus
gagtgtgcgacgaccgcatttgacg

SEQ ID NO: 661181 - DNA, 25 bp, Mus musculus
gagtgtgcgacgtccgcatttgacg

SEQ ID NO: 661182 - DNA, 25 bp, Mus musculus
gagtgtgcgatccagacatgtccag

SEQ ID NO: 661183 - DNA, 25 bp, Mus musculus
gagtgtgcgatcgagacatgtccag

SEQ ID NO: 661184 - DNA, 25 bp, Mus musculus
gagtgtggaattagaacccgtaagg

SEQ ID NO: 661185 - DNA, 25 bp, Mus musculus
gagtgtggaatttgaacccgtaagg

SEQ ID NO: 661186 - DNA, 25 bp, Mus musculus
gagtgtggacttatccgctgatggc

SEQ ID NO: 661187 - DNA, 25 bp, Mus musculus
gagtgtggacttttccgctgatggc

SEQ ID NO: 661188 - DNA, 25 bp, Mus musculus
gagtgtggagttcgccaagaagagg

SEQ ID NO: 661189 - DNA, 25 bp, Mus musculus
gagtgtggagttggccaagaagagg

SEQ ID NO: 661190 - DNA, 25 bp, Mus musculus
gagtgtggatgtcaccaataccact

SEQ ID NO: 661191 - DNA, 25 bp, Mus musculus
gagtgtggatgtgaccaataccact

SEQ ID NO: 661192 - DNA, 25 bp, Mus musculus
gagtgtggcaagctagaatcacccc

SEQ ID NO: 661193 - DNA, 25 bp, Mus musculus
gagtgtggcaaggtagaatcacccc

SEQ ID NO: 661194 - DNA, 25 bp, Mus musculus
gagtgtggcactcatgccctacgct

SEQ ID NO: 661195 - DNA, 25 bp, Mus musculus
gagtgtggcactgatgccctacgct

SEQ ID NO: 661196 - DNA, 25 bp, Mus musculus
gagtgtggccagcacctagacgacc

SEQ ID NO: 661197 - DNA, 25 bp, Mus musculus
gagtgtggccaggacctagacgacc

SEQ ID NO: 661198 - DNA, 25 bp, Mus musculus
gagtgtggctacaagttcacgcggc

SEQ ID NO: 661199 - DNA, 25 bp, Mus musculus
gagtgtggctactagttcacgcggc

SEQ ID NO: 661200 - DNA, 25 bp, Mus musculus
gagtgtgggaatcagctagatcatc

SEQ ID NO: 661201 - DNA, 25 bp, Mus musculus
gagtgtgggaatgagctagatcatc

SEQ ID NO: 661202 - DNA, 25 bp, Mus musculus
gagtgtgggtctacaggcacatgca

SEQ ID NO: 661203 - DNA, 25 bp, Mus musculus
gagtgtgggtcttcaggcacatgca

SEQ ID NO: 661204 - DNA, 25 bp, Mus musculus
gagtgtggtacgatcattctgataa

SEQ ID NO: 661205 - DNA, 25 bp, Mus musculus
gagtgtggtacgttcattctgataa

SEQ ID NO: 661206 - DNA, 25 bp, Mus musculus
gagtgtgtaccgaaactacagcatc

SEQ ID NO: 661207 - DNA, 25 bp, Mus musculus
gagtgtgtaccgtaactacagcatc

SEQ ID NO: 661208 - DNA, 25 bp, Mus musculus
gagtgtgtatgtcaccagcactagt

SEQ ID NO: 661209 - DNA, 25 bp, Mus musculus
gagtgtgtatgtgaccagcactagt

SEQ ID NO: 661210 - DNA, 25 bp, Mus musculus
gagtgtgtcaacattgcctccttta

SEQ ID NO: 661211 - DNA, 25 bp, Mus musculus
gagtgtgtcaactttgcctccttta

SEQ ID NO: 661212 - DNA, 25 bp, Mus musculus
gagtgtgtcagcatccatgctatgg

SEQ ID NO: 661213 - DNA, 25 bp, Mus musculus
gagtgtgtcagcttccatgctatgg

SEQ ID NO: 661214 - DNA, 25 bp, Mus musculus
gagtgtgtctgcctgtttacaccca

SEQ ID NO: 661215 - DNA, 25 bp, Mus musculus
gagtgtgtctgcgtgtttacaccca

SEQ ID NO: 661216 - DNA, 25 bp, Mus musculus
gagtgtgtgaacacagaaggctcct

SEQ ID NO: 661217 - DNA, 25 bp, Mus musculus
gagtgtgtgaactcagaaggctcct

SEQ ID NO: 661218 - DNA, 25 bp, Mus musculus
gagtgtgtttggcatcagaacagac

SEQ ID NO: 661219 - DNA, 25 bp, Mus musculus
gagtgtgtttgggatcagaacagac

SEQ ID NO: 661220 - DNA, 25 bp, Mus musculus
gagtgttaccagagctatggagtcc

SEQ ID NO: 661221 - DNA, 25 bp, Mus musculus
gagtgttaccagtgctatggagtcc

SEQ ID NO: 661222 - DNA, 25 bp, Mus musculus
gagtgttacgaaagtcaccctaagc

SEQ ID NO: 661223 - DNA, 25 bp, Mus musculus
gagtgttacgaatgtcaccctaagc

SEQ ID NO: 661224 - DNA, 25 bp, Mus musculus
gagtgttactggcagccatgatgtt

SEQ ID NO: 661225 - DNA, 25 bp, Mus musculus
gagtgttactgggagccatgatgtt

SEQ ID NO: 661226 - DNA, 25 bp, Mus musculus
gagtgttagattctcagcaacctca

SEQ ID NO: 661227 - DNA, 25 bp, Mus musculus
gagtgttagattgtcagcaacctca

SEQ ID NO: 661228 - DNA, 25 bp, Mus musculus
gagtgttatctgagaattccctaca

SEQ ID NO: 661229 - DNA, 25 bp, Mus musculus
gagtgttatctgtgaattccctaca

SEQ ID NO: 661230 - DNA, 25 bp, Mus musculus
gagtgttcaccaacagccgtgagcg

SEQ ID NO: 661231 - DNA, 25 bp, Mus musculus
gagtgttcaccatcagccgtgagcg

SEQ ID NO: 661232 - DNA, 25 bp, Mus musculus
gagtgttcactactcgccagcaaag

SEQ ID NO: 661233 - DNA, 25 bp, Mus musculus
gagtgttcactagtcgccagcaaag

SEQ ID NO: 661234 - DNA, 25 bp, Mus musculus
gagtgttccgatccctctgtcgaag

SEQ ID NO: 661235 - DNA, 25 bp, Mus musculus
gagtgttccgatgcctctgtcgaag

SEQ ID NO: 661236 - DNA, 25 bp, Mus musculus
gagtgttcctttcagcggacctgtg

SEQ ID NO: 661237 - DNA, 25 bp, Mus musculus
gagtgttcctttgagcggacctgtg

SEQ ID NO: 661238 - DNA, 25 bp, Mus musculus
gagtgttcgtacagggctatgagaa

SEQ ID NO: 661239 - DNA, 25 bp, Mus musculus
gagtgttcgtactgggctatgagaa

SEQ ID NO: 661240 - DNA, 25 bp, Mus musculus
gagtgttcgtgcagctgatgcccat

SEQ ID NO: 661241 - DNA, 25 bp, Mus musculus
gagtgttcgtgctgctgatgcccat

SEQ ID NO: 661242 - DNA, 25 bp, Mus musculus
gagtgttgccaacatgatagattca

SEQ ID NO: 661243 - DNA, 25 bp, Mus musculus
gagtgttgccaagatgatagattca

SEQ ID NO: 661244 - DNA, 25 bp, Mus musculus
gagtgttgccatcgaaccgatcagt

SEQ ID NO: 661245 - DNA, 25 bp, Mus musculus
gagtgttgccatggaaccgatcagt

SEQ ID NO: 661246 - DNA, 25 bp, Mus musculus
gagtgttgccttatgccttccagaa

SEQ ID NO: 661247 - DNA, 25 bp, Mus musculus
gagtgttgccttttgccttccagaa

SEQ ID NO: 661248 - DNA, 25 bp, Mus musculus
gagtgttggcggaaacgtgctcatc

SEQ ID NO: 661249 - DNA, 25 bp, Mus musculus
gagtgttggcggtaacgtgctcatc

SEQ ID NO: 661250 - DNA, 25 bp, Mus musculus
gagtgtttgacaaccacttataaaa

SEQ ID NO: 661251 - DNA, 25 bp, Mus musculus
gagtgtttgacatccacttataaaa

SEQ ID NO: 661252 - DNA, 25 bp, Mus musculus
gagtgtttgctgatggtcttggcca

SEQ ID NO: 661253 - DNA, 25 bp, Mus musculus
gagtgtttgctgttggtcttggcca

SEQ ID NO: 661254 - DNA, 25 bp, Mus musculus
gagtgtttggacaacaatggtggct

SEQ ID NO: 661255 - DNA, 25 bp, Mus musculus
gagtgtttggactacaatggtggct

SEQ ID NO: 661256 - DNA, 25 bp, Mus musculus
gagtgtttggatcccccacaactgt

SEQ ID NO: 661257 - DNA, 25 bp, Mus musculus
gagtgtttggatgccccacaactgt

SEQ ID NO: 661258 - DNA, 25 bp, Mus musculus
gagtgtttgtccaaccctgcattca

SEQ ID NO: 661259 - DNA, 25 bp, Mus musculus
gagtgtttgtccctttcaggactcc

SEQ ID NO: 661260 - DNA, 25 bp, Mus musculus
gagtgtttgtccgtttcaggactcc

SEQ ID NO: 661261 - DNA, 25 bp, Mus musculus
gagtgtttgtcctaccctgcattca

SEQ ID NO: 661262 - DNA, 25 bp, Mus musculus
gagtgttttgcaccttcagatggaa

SEQ ID NO: 661263 - DNA, 25 bp, Mus musculus
gagtgttttgcagcttcagatggaa

SEQ ID NO: 661264 - DNA, 25 bp, Mus musculus
gagtgttttgctccttttgcccttg

SEQ ID NO: 661265 - DNA, 25 bp, Mus musculus
gagtgttttgctgcttttgcccttg

SEQ ID NO: 661266 - DNA, 25 bp, Mus musculus
gagttaaacgttcaggcacccagat

SEQ ID NO: 661267 - DNA, 25 bp, Mus musculus
gagttaaacgttgaggcacccagat

SEQ ID NO: 661268 - DNA, 25 bp, Mus musculus
gagttaacatggatgtgatcagtgc

SEQ ID NO: 661269 - DNA, 25 bp, Mus musculus
gagttaacatggttgtgatcagtgc

SEQ ID NO: 661270 - DNA, 25 bp, Mus musculus
gagttaaccattcaaagctaatgca

SEQ ID NO: 661271 - DNA, 25 bp, Mus musculus
gagttaaccattgaaagctaatgca

SEQ ID NO: 661272 - DNA, 25 bp, Mus musculus
gagttaaccggactgccttttgcag

SEQ ID NO: 661273 - DNA, 25 bp, Mus musculus
gagttaaccggagtgccttttgcag

SEQ ID NO: 661274 - DNA, 25 bp, Mus musculus
gagttaactaagagaagccccgtca

SEQ ID NO: 661275 - DNA, 25 bp, Mus musculus
gagttaactaagtgaagccccgtca

SEQ ID NO: 661276 - DNA, 25 bp, Mus musculus
gagttaactgtgcagctgcacacag

SEQ ID NO: 661277 - DNA, 25 bp, Mus musculus
gagttaactgtggagctgcacacag

SEQ ID NO: 661278 - DNA, 25 bp, Mus musculus
gagttaagaacactcactgctcctg

SEQ ID NO: 661279 - DNA, 25 bp, Mus musculus
gagttaagaacagtcactgctcctg

SEQ ID NO: 661280 - DNA, 25 bp, Mus musculus
gagttaagctctactacaagctcaa

SEQ ID NO: 661281 - DNA, 25 bp, Mus musculus
gagttaagctcttctacaagctcaa

SEQ ID NO: 661282 - DNA, 25 bp, Mus musculus
gagttaaggaacctgttacacacag

SEQ ID NO: 661283 - DNA, 25 bp, Mus musculus
gagttaaggaacgtgttacacacag

SEQ ID NO: 661284 - DNA, 25 bp, Mus musculus
gagttaaggacaaagtctcagagca

SEQ ID NO: 661285 - DNA, 25 bp, Mus musculus
gagttaaggacatagtctcagagca

SEQ ID NO: 661286 - DNA, 25 bp, Mus musculus
gagttaaggtctactttatcggcag

SEQ ID NO: 661287 - DNA, 25 bp, Mus musculus
gagttaaggtcttctttatcggcag

SEQ ID NO: 661288 - DNA, 25 bp, Mus musculus
gagttaagtattcggagaaacagga

SEQ ID NO: 661289 - DNA, 25 bp, Mus musculus
gagttaagtattgggagaaacagga

SEQ ID NO: 661290 - DNA, 25 bp, Mus musculus
gagttaagtcccagctcaatgcccc

SEQ ID NO: 661291 - DNA, 25 bp, Mus musculus
gagttaagtccctgctcaatgcccc

SEQ ID NO: 661292 - DNA, 25 bp, Mus musculus
gagttaataacactcgacgggtcaa

SEQ ID NO: 661293 - DNA, 25 bp, Mus musculus
gagttaataacagtcgacgggtcaa

SEQ ID NO: 661294 - DNA, 25 bp, Mus musculus
gagttaataggaaaccgcaagaaat

SEQ ID NO: 661295 - DNA, 25 bp, Mus musculus
gagttaataggataccgcaagaaat

SEQ ID NO: 661296 - DNA, 25 bp, Mus musculus
gagttaatccacctgttcaacaaac

SEQ ID NO: 661297 - DNA, 25 bp, Mus musculus
gagttaatccacgtgttcaacaaac

SEQ ID NO: 661298 - DNA, 25 bp, Mus musculus
gagttaatccttccacatatgggtg

SEQ ID NO: 661299 - DNA, 25 bp, Mus musculus
gagttaatccttgcacatatgggtg

SEQ ID NO: 661300 - DNA, 25 bp, Mus musculus
gagttacaatgacactgccccaagg

SEQ ID NO: 661301 - DNA, 25 bp, Mus musculus
gagttacaatgagactgccccaagg

SEQ ID NO: 661302 - DNA, 25 bp, Mus musculus
gagttacagcaccacttttgctacg

SEQ ID NO: 661303 - DNA, 25 bp, Mus musculus
gagttacagcacgacttttgctacg

SEQ ID NO: 661304 - DNA, 25 bp, Mus musculus
gagttacagttacaagaattcccca

SEQ ID NO: 661305 - DNA, 25 bp, Mus musculus
gagttacagttagaagaattcccca

SEQ ID NO: 661306 - DNA, 25 bp, Mus musculus
gagttaccgctgacactgaacaggg

SEQ ID NO: 661307 - DNA, 25 bp, Mus musculus
gagttaccgctgtcactgaacaggg

SEQ ID NO: 661308 - DNA, 25 bp, Mus musculus
gagttaccggcactaccgaagatcc

SEQ ID NO: 661309 - DNA, 25 bp, Mus musculus
gagttaccggcagtaccgaagatcc

SEQ ID NO: 661310 - DNA, 25 bp, Mus musculus
gagttacctcttaccttagcggcag

SEQ ID NO: 661311 - DNA, 25 bp, Mus musculus
gagttacctctttccttagcggcag

SEQ ID NO: 661312 - DNA, 25 bp, Mus musculus
gagttacgacgaagccaaggacgat

SEQ ID NO: 661313 - DNA, 25 bp, Mus musculus
gagttacgacgatgccaaggacgat

SEQ ID NO: 661314 - DNA, 25 bp, Mus musculus
gagttacgcctacgaatgttagtgc

SEQ ID NO: 661315 - DNA, 25 bp, Mus musculus
gagttacgcctaggaatgttagtgc

SEQ ID NO: 661316 - DNA, 25 bp, Mus musculus
gagttacggcaactgtcacagatgc

SEQ ID NO: 661317 - DNA, 25 bp, Mus musculus
gagttacggcaagtgtcacagatgc

SEQ ID NO: 661318 - DNA, 25 bp, Mus musculus
gagttactacttacaagaaatgcgg

SEQ ID NO: 661319 - DNA, 25 bp, Mus musculus
gagttactactttcaagaaatgcgg

SEQ ID NO: 661320 - DNA, 25 bp, Mus musculus
gagttactccacaccaggaatgaag

SEQ ID NO: 661321 - DNA, 25 bp, Mus musculus
gagttactccactccaggaatgaag

SEQ ID NO: 661322 - DNA, 25 bp, Mus musculus
gagttactgccgaccccgaatttcg

SEQ ID NO: 661323 - DNA, 25 bp, Mus musculus
gagttactgccgtccccgaatttcg

SEQ ID NO: 661324 - DNA, 25 bp, Mus musculus
gagttactggtacttgacttacaag

SEQ ID NO: 661325 - DNA, 25 bp, Mus musculus
gagttactggtagttgacttacaag

SEQ ID NO: 661326 - DNA, 25 bp, Mus musculus
gagttacttaagcatccactgtaca

SEQ ID NO: 661327 - DNA, 25 bp, Mus musculus
gagttacttaaggatccactgtaca

SEQ ID NO: 661328 - DNA, 25 bp, Mus musculus
gagttacttcgacagacttggccac

SEQ ID NO: 661329 - DNA, 25 bp, Mus musculus
gagttacttcgagagacttggccac

SEQ ID NO: 661330 - DNA, 25 bp, Mus musculus
gagttacttgtcagtcccggcttac

SEQ ID NO: 661331 - DNA, 25 bp, Mus musculus
gagttacttgtctgtcccggcttac

SEQ ID NO: 661332 - DNA, 25 bp, Mus musculus
gagttagaagttctcaggcctccca

SEQ ID NO: 661333 - DNA, 25 bp, Mus musculus
gagttagaagttgtcaggcctccca

SEQ ID NO: 661334 - DNA, 25 bp, Mus musculus
gagttagactgcctctaatcttggt

SEQ ID NO: 661335 - DNA, 25 bp, Mus musculus
gagttagactgcgtctaatcttggt

SEQ ID NO: 661336 - DNA, 25 bp, Mus musculus
gagttagatatgactcccgtgcacc

SEQ ID NO: 661337 - DNA, 25 bp, Mus musculus
gagttagatatgtctcccgtgcacc

SEQ ID NO: 661338 - DNA, 25 bp, Mus musculus
gagttagattcacttccacttagta

SEQ ID NO: 661339 - DNA, 25 bp, Mus musculus
gagttagattcagttccacttagta

SEQ ID NO: 661340 - DNA, 25 bp, Mus musculus
gagttagcacacctgttgtcttggg

SEQ ID NO: 661341 - DNA, 25 bp, Mus musculus
gagttagcacacgtgttgtcttggg

SEQ ID NO: 661342 - DNA, 25 bp, Mus musculus
gagttagccaccatctgtgctctgt

SEQ ID NO: 661343 - DNA, 25 bp, Mus musculus
gagttagccaccttctgtgctctgt

SEQ ID NO: 661344 - DNA, 25 bp, Mus musculus
gagttagccttcatccctcgggacg

SEQ ID NO: 661345 - DNA, 25 bp, Mus musculus
gagttagccttcttccctcgggacg

SEQ ID NO: 661346 - DNA, 25 bp, Mus musculus
gagttaggacagcaaatcctggctg

SEQ ID NO: 661347 - DNA, 25 bp, Mus musculus
gagttaggacaggaaatcctggctg

SEQ ID NO: 661348 - DNA, 25 bp, Mus musculus
gagttaggcctaatgggcctccaga

SEQ ID NO: 661349 - DNA, 25 bp, Mus musculus
gagttaggcctattgggcctccaga

SEQ ID NO: 661350 - DNA, 25 bp, Mus musculus
gagttaggcctgcaccctcatgtca

SEQ ID NO: 661351 - DNA, 25 bp, Mus musculus
gagttaggcctggaccctcatgtca

SEQ ID NO: 661352 - DNA, 25 bp, Mus musculus
gagttaggcgcgatgctttccactg

SEQ ID NO: 661353 - DNA, 25 bp, Mus musculus
gagttaggcgcgttgctttccactg

SEQ ID NO: 661354 - DNA, 25 bp, Mus musculus
gagttagtcccaagtcgtcggactc

SEQ ID NO: 661355 - DNA, 25 bp, Mus musculus
gagttagtcccatgtcgtcggactc

SEQ ID NO: 661356 - DNA, 25 bp, Mus musculus
gagttagtggaccacaatgctcctt

SEQ ID NO: 661357 - DNA, 25 bp, Mus musculus
gagttagtggacgacaatgctcctt

SEQ ID NO: 661358 - DNA, 25 bp, Mus musculus
gagttagttagcaaagagcagaggc

SEQ ID NO: 661359 - DNA, 25 bp, Mus musculus
gagttagttagctaagagcagaggc

SEQ ID NO: 661360 - DNA, 25 bp, Mus musculus
gagttagttttgactactcgcaaca

SEQ ID NO: 661361 - DNA, 25 bp, Mus musculus
gagttagttttgtctactcgcaaca

SEQ ID NO: 661362 - DNA, 25 bp, Mus musculus
gagttatacacacataaggacacag

SEQ ID NO: 661363 - DNA, 25 bp, Mus musculus
gagttatacacagataaggacacag

SEQ ID NO: 661364 - DNA, 25 bp, Mus musculus
gagttatccaaaacccaccgtgtca

SEQ ID NO: 661365 - DNA, 25 bp, Mus musculus
gagttatccaaatcccaccgtgtca

SEQ ID NO: 661366 - DNA, 25 bp, Mus musculus
gagttatgatacctacacccctccg

SEQ ID NO: 661367 - DNA, 25 bp, Mus musculus
gagttatgatacgtacacccctccg

SEQ ID NO: 661368 - DNA, 25 bp, Mus musculus
gagttatggaacagcaccagtaaat

SEQ ID NO: 661369 - DNA, 25 bp, Mus musculus
gagttatggaactgcaccagtaaat

SEQ ID NO: 661370 - DNA, 25 bp, Mus musculus
gagttattcctcaatatctatgtga

SEQ ID NO: 661371 - DNA, 25 bp, Mus musculus
gagttattcctctatatctatgtga

SEQ ID NO: 661372 - DNA, 25 bp, Mus musculus
gagttcaaccggatcatgagtgtgg

SEQ ID NO: 661373 - DNA, 25 bp, Mus musculus
gagttcaaccggttcatgagtgtgg

SEQ ID NO: 661374 - DNA, 25 bp, Mus musculus
gagttcaactctaccacaacaggca

SEQ ID NO: 661375 - DNA, 25 bp, Mus musculus
gagttcaactcttccacaacaggca

SEQ ID NO: 661376 - DNA, 25 bp, Mus musculus
gagttcaactgcaacatccgggctc

SEQ ID NO: 661377 - DNA, 25 bp, Mus musculus
gagttcaactgctacatccgggctc

SEQ ID NO: 661378 - DNA, 25 bp, Mus musculus
gagttcaagcatctcaacccaagga

SEQ ID NO: 661379 - DNA, 25 bp, Mus musculus
gagttcaagcatgtcaacccaagga

SEQ ID NO: 661380 - DNA, 25 bp, Mus musculus
gagttcaagctcaggaaccccgtct

SEQ ID NO: 661381 - DNA, 25 bp, Mus musculus
gagttcaagctctggaaccccgtct

SEQ ID NO: 661382 - DNA, 25 bp, Mus musculus
gagttcaagtctctcatctatggga

SEQ ID NO: 661383 - DNA, 25 bp, Mus musculus
gagttcaagtctgtcatctatggga

SEQ ID NO: 661384 - DNA, 25 bp, Mus musculus
gagttcaatcctcaacattttctgg

SEQ ID NO: 661385 - DNA, 25 bp, Mus musculus
gagttcaatcctgaacattttctgg

SEQ ID NO: 661386 - DNA, 25 bp, Mus musculus
gagttcacaatcatggtgaccctga

SEQ ID NO: 661387 - DNA, 25 bp, Mus musculus
gagttcacaatcttggtgaccctga

SEQ ID NO: 661388 - DNA, 25 bp, Mus musculus
gagttcacccatcgatgaagtgtta

SEQ ID NO: 661389 - DNA, 25 bp, Mus musculus
gagttcacccatggatgaagtgtta

SEQ ID NO: 661390 - DNA, 25 bp, Mus musculus
gagttcacccttcaatacctggaag

SEQ ID NO: 661391 - DNA, 25 bp, Mus musculus
gagttcacccttgaatacctggaag

SEQ ID NO: 661392 - DNA, 25 bp, Mus musculus
gagttcacctaccaactgagcccga

SEQ ID NO: 661393 - DNA, 25 bp, Mus musculus
gagttcacctacgaactgagcccga

SEQ ID NO: 661394 - DNA, 25 bp, Mus musculus
gagttcaccttgcatggccgggcta

SEQ ID NO: 661395 - DNA, 25 bp, Mus musculus
gagttcaccttggatggccgggcta

SEQ ID NO: 661396 - DNA, 25 bp, Mus musculus
gagttcacggatagggtggtctcca

SEQ ID NO: 661397 - DNA, 25 bp, Mus musculus
gagttcacggattgggtggtctcca

SEQ ID NO: 661398 - DNA, 25 bp, Mus musculus
gagttcactctgcagttttcacggg

SEQ ID NO: 661399 - DNA, 25 bp, Mus musculus
gagttcactctggagttttcacggg

SEQ ID NO: 661400 - DNA, 25 bp, Mus musculus
gagttcactgcccaaaacttaggca

SEQ ID NO: 661401 - DNA, 25 bp, Mus musculus
gagttcactgccgaaaacttaggca

SEQ ID NO: 661402 - DNA, 25 bp, Mus musculus
gagttcacttgcacatggattcaca

SEQ ID NO: 661403 - DNA, 25 bp, Mus musculus
gagttcacttgctcatggattcaca

SEQ ID NO: 661404 - DNA, 25 bp, Mus musculus
gagttcagactgctttgaggaatga

SEQ ID NO: 661405 - DNA, 25 bp, Mus musculus
gagttcagactggtttgaggaatga

SEQ ID NO: 661406 - DNA, 25 bp, Mus musculus
gagttcagaggtcttgctgccagct

SEQ ID NO: 661407 - DNA, 25 bp, Mus musculus
gagttcagaggtgttgctgccagct

SEQ ID NO: 661408 - DNA, 25 bp, Mus musculus
gagttcagattcatgcagactgatc

SEQ ID NO: 661409 - DNA, 25 bp, Mus musculus
gagttcagattcttgcagactgatc

SEQ ID NO: 661410 - DNA, 25 bp, Mus musculus
gagttcagcaacagcacaagatcct

SEQ ID NO: 661411 - DNA, 25 bp, Mus musculus
gagttcagcaactgcacaagatcct

SEQ ID NO: 661412 - DNA, 25 bp, Mus musculus
gagttcagccctcgtgattcagtcg

SEQ ID NO: 661413 - DNA, 25 bp, Mus musculus
gagttcagccctggtgattcagtcg

SEQ ID NO: 661414 - DNA, 25 bp, Mus musculus
gagttcagcctcaggattcaggagt

SEQ ID NO: 661415 - DNA, 25 bp, Mus musculus
gagttcagcctctggattcaggagt

SEQ ID NO: 661416 - DNA, 25 bp, Mus musculus
gagttcaggtgaataggcttggcca

SEQ ID NO: 661417 - DNA, 25 bp, Mus musculus
gagttcaggtgattaggcttggcca

SEQ ID NO: 661418 - DNA, 25 bp, Mus musculus
gagttcagtccccaaattgcatgtg

SEQ ID NO: 661419 - DNA, 25 bp, Mus musculus
gagttcagtcccgaaattgcatgtg

SEQ ID NO: 661420 - DNA, 25 bp, Mus musculus
gagttcagtgcaagctgtcaggaca

SEQ ID NO: 661421 - DNA, 25 bp, Mus musculus
gagttcagtgcatgctgtcaggaca

SEQ ID NO: 661422 - DNA, 25 bp, Mus musculus
gagttcagtgccatgcgggaacaat

SEQ ID NO: 661423 - DNA, 25 bp, Mus musculus
gagttcagtgccttgcgggaacaat

SEQ ID NO: 661424 - DNA, 25 bp, Mus musculus
gagttcatacctacgattttccaca

SEQ ID NO: 661425 - DNA, 25 bp, Mus musculus
gagttcataccttcgattttccaca

SEQ ID NO: 661426 - DNA, 25 bp, Mus musculus
gagttcatagagatgagtgttgagc

SEQ ID NO: 661427 - DNA, 25 bp, Mus musculus
gagttcatagagttgagtgttgagc

SEQ ID NO: 661428 - DNA, 25 bp, Mus musculus
gagttcatatccagtcatcacagat

SEQ ID NO: 661429 - DNA, 25 bp, Mus musculus
gagttcatatcctgtcatcacagat

SEQ ID NO: 661430 - DNA, 25 bp, Mus musculus
gagttcatccctatccggtttgcct

SEQ ID NO: 661431 - DNA, 25 bp, Mus musculus
gagttcatccctttccggtttgcct

SEQ ID NO: 661432 - DNA, 25 bp, Mus musculus
gagttcatgtttactacacctcgga

SEQ ID NO: 661433 - DNA, 25 bp, Mus musculus
gagttcatgttttctacacctcgga

SEQ ID NO: 661434 - DNA, 25 bp, Mus musculus
gagttcattgaacttgtccggcaga

SEQ ID NO: 661435 - DNA, 25 bp, Mus musculus
gagttcattgaagttgtccggcaga

SEQ ID NO: 661436 - DNA, 25 bp, Mus musculus
gagttcattgccatcatctacggca

SEQ ID NO: 661437 - DNA, 25 bp, Mus musculus
gagttcattgccttcatctacggca

SEQ ID NO: 661438 - DNA, 25 bp, Mus musculus
gagttccaacaccagtcagcgtgga

SEQ ID NO: 661439 - DNA, 25 bp, Mus musculus
gagttccaacacgagtcagcgtgga

SEQ ID NO: 661440 - DNA, 25 bp, Mus musculus
gagttccaatgtcagtgccccaaag

SEQ ID NO: 661441 - DNA, 25 bp, Mus musculus
gagttccaatgtgagtgccccaaag

SEQ ID NO: 661442 - DNA, 25 bp, Mus musculus
gagttccacaagacgcacacaactg

SEQ ID NO: 661443 - DNA, 25 bp, Mus musculus
gagttccacaagtcgcacacaactg

SEQ ID NO: 661444 - DNA, 25 bp, Mus musculus
gagttccacactagtcacagcacag

SEQ ID NO: 661445 - DNA, 25 bp, Mus musculus
gagttccacacttgtcacagcacag

SEQ ID NO: 661446 - DNA, 25 bp, Mus musculus
gagttccacgtgatcttcgactgca

SEQ ID NO: 661447 - DNA, 25 bp, Mus musculus
gagttccacgtgttcttcgactgca

SEQ ID NO: 661448 - DNA, 25 bp, Mus musculus
gagttccacttcacccttggatgga

SEQ ID NO: 661449 - DNA, 25 bp, Mus musculus
gagttccacttctcccttggatgga

SEQ ID NO: 661450 - DNA, 25 bp, Mus musculus
gagttccagagcacaccaggtgaca

SEQ ID NO: 661451 - DNA, 25 bp, Mus musculus
gagttccagagctcaccaggtgaca

SEQ ID NO: 661452 - DNA, 25 bp, Mus musculus
gagttccagcaactgttcattccag

SEQ ID NO: 661453 - DNA, 25 bp, Mus musculus
gagttccagcaagtgttcattccag

SEQ ID NO: 661454 - DNA, 25 bp, Mus musculus
gagttccagcatctcatctcgcgct

SEQ ID NO: 661455 - DNA, 25 bp, Mus musculus
gagttccagcatgtcatctcgcgct

SEQ ID NO: 661456 - DNA, 25 bp, Mus musculus
gagttccagtacagcctctccaaga

SEQ ID NO: 661457 - DNA, 25 bp, Mus musculus
gagttccagtactgcctctccaaga

SEQ ID NO: 661458 - DNA, 25 bp, Mus musculus
gagttccataggcaggacgctccat

SEQ ID NO: 661459 - DNA, 25 bp, Mus musculus
gagttccatagggaggacgctccat

SEQ ID NO: 661460 - DNA, 25 bp, Mus musculus
gagttcccaagcactgcaggttctg

SEQ ID NO: 661461 - DNA, 25 bp, Mus musculus
gagttcccaagctctgcaggttctg

SEQ ID NO: 661462 - DNA, 25 bp, Mus musculus
gagttcccacaaactggcagtacac

SEQ ID NO: 661463 - DNA, 25 bp, Mus musculus
gagttcccacaatctggcagtacac

SEQ ID NO: 661464 - DNA, 25 bp, Mus musculus
gagttcccacgcaggtagtgtggca

SEQ ID NO: 661465 - DNA, 25 bp, Mus musculus
gagttcccacgctggtagtgtggca

SEQ ID NO: 661466 - DNA, 25 bp, Mus musculus
gagttcccctccatgctggcgttgg

SEQ ID NO: 661467 - DNA, 25 bp, Mus musculus
gagttcccctccttgctggcgttgg

SEQ ID NO: 661468 - DNA, 25 bp, Mus musculus
gagttcccctctcagaatgatataa

SEQ ID NO: 661469 - DNA, 25 bp, Mus musculus
gagttcccctctgagaatgatataa

SEQ ID NO: 661470 - DNA, 25 bp, Mus musculus
gagttcccgcacagtgactcatgga

SEQ ID NO: 661471 - DNA, 25 bp, Mus musculus
gagttcccgcactgtgactcatgga

SEQ ID NO: 661472 - DNA, 25 bp, Mus musculus
gagttccctagtaaagcggtggctg

SEQ ID NO: 661473 - DNA, 25 bp, Mus musculus
gagttccctagttaagcggtggctg

SEQ ID NO: 661474 - DNA, 25 bp, Mus musculus
gagttccctatgactatacccagag

SEQ ID NO: 661475 - DNA, 25 bp, Mus musculus
gagttccctatgatcctggactaaa

SEQ ID NO: 661476 - DNA, 25 bp, Mus musculus
gagttccctatgtctatacccagag

SEQ ID NO: 661477 - DNA, 25 bp, Mus musculus
gagttccctatgttcctggactaaa

SEQ ID NO: 661478 - DNA, 25 bp, Mus musculus
gagttccctgacaaggactggtccc

SEQ ID NO: 661479 - DNA, 25 bp, Mus musculus
gagttccctgactaggactggtccc

SEQ ID NO: 661480 - DNA, 25 bp, Mus musculus
gagttccctgagcaccctttccagg

SEQ ID NO: 661481 - DNA, 25 bp, Mus musculus
gagttccctgaggaccctttccagg

SEQ ID NO: 661482 - DNA, 25 bp, Mus musculus
gagttccgggcaaagatggcattga

SEQ ID NO: 661483 - DNA, 25 bp, Mus musculus
gagttccgggcatagatggcattga

SEQ ID NO: 661484 - DNA, 25 bp, Mus musculus
gagttccgggctctgcagttctcgc

SEQ ID NO: 661485 - DNA, 25 bp, Mus musculus
gagttccgggctgtgcagttctcgc

SEQ ID NO: 661486 - DNA, 25 bp, Mus musculus
gagttcctagtgcttggtaacaaga

SEQ ID NO: 661487 - DNA, 25 bp, Mus musculus
gagttcctagtggttggtaacaaga

SEQ ID NO: 661488 - DNA, 25 bp, Mus musculus
gagttcctatacaacctgtactcct

SEQ ID NO: 661489 - DNA, 25 bp, Mus musculus
gagttcctatactacctgtactcct

SEQ ID NO: 661490 - DNA, 25 bp, Mus musculus
gagttcctcggaccgaatcgtgcag

SEQ ID NO: 661491 - DNA, 25 bp, Mus musculus
gagttcctcggagcgaatcgtgcag

SEQ ID NO: 661492 - DNA, 25 bp, Mus musculus
gagttcctcgtccttcctactgcta

SEQ ID NO: 661493 - DNA, 25 bp, Mus musculus
gagttcctcgtcgttcctactgcta

SEQ ID NO: 661494 - DNA, 25 bp, Mus musculus
gagttcctctgtcaacacgagtgtg

SEQ ID NO: 661495 - DNA, 25 bp, Mus musculus
gagttcctctgtgaacacgagtgtg

SEQ ID NO: 661496 - DNA, 25 bp, Mus musculus
gagttcctgaggagtgaccatcctg

SEQ ID NO: 661497 - DNA, 25 bp, Mus musculus
gagttcctgaggatcttcgtactag

SEQ ID NO: 661498 - DNA, 25 bp, Mus musculus
gagttcctgaggtgtgaccatcctg

SEQ ID NO: 661499 - DNA, 25 bp, Mus musculus
gagttcctgaggttcttcgtactag

SEQ ID NO: 661500 - DNA, 25 bp, Mus musculus
gagttcctgcaaaacaatcctgatg

SEQ ID NO: 661501 - DNA, 25 bp, Mus musculus
gagttcctgcaatacaatcctgatg

SEQ ID NO: 661502 - DNA, 25 bp, Mus musculus
gagttcctgcccatccatacagctg

SEQ ID NO: 661503 - DNA, 25 bp, Mus musculus
gagttcctgcccttccatacagctg

SEQ ID NO: 661504 - DNA, 25 bp, Mus musculus
gagttcctggatcctatcaccctgg

SEQ ID NO: 661505 - DNA, 25 bp, Mus musculus
gagttcctggatgctatcaccctgg

SEQ ID NO: 661506 - DNA, 25 bp, Mus musculus
gagttcctggctagaatcgtaccca

SEQ ID NO: 661507 - DNA, 25 bp, Mus musculus
gagttcctggcttgaatcgtaccca

SEQ ID NO: 661508 - DNA, 25 bp, Mus musculus
gagttcctgtcacccagcgtctggt

SEQ ID NO: 661509 - DNA, 25 bp, Mus musculus
gagttcctgtcagccagcgtctggt

SEQ ID NO: 661510 - DNA, 25 bp, Mus musculus
gagttccttcctcctaggagttaca

SEQ ID NO: 661511 - DNA, 25 bp, Mus musculus
gagttccttcctgctaggagttaca

SEQ ID NO: 661512 - DNA, 25 bp, Mus musculus
gagttcgaggacacacaggacccaa

SEQ ID NO: 661513 - DNA, 25 bp, Mus musculus
gagttcgaggactcacaggacccaa

SEQ ID NO: 661514 - DNA, 25 bp, Mus musculus
gagttcgagttcctgatgcgacagc

SEQ ID NO: 661515 - DNA, 25 bp, Mus musculus
gagttcgagttcgtgatgcgacagc

SEQ ID NO: 661516 - DNA, 25 bp, Mus musculus
gagttcgattccagcctcgcacaca

SEQ ID NO: 661517 - DNA, 25 bp, Mus musculus
gagttcgattcctgcctcgcacaca

SEQ ID NO: 661518 - DNA, 25 bp, Mus musculus
gagttcgccaacaccagatacgttc

SEQ ID NO: 661519 - DNA, 25 bp, Mus musculus
gagttcgccaactccagatacgttc

SEQ ID NO: 661520 - DNA, 25 bp, Mus musculus
gagttcgcctagcagatgtcatcag

SEQ ID NO: 661521 - DNA, 25 bp, Mus musculus
gagttcgcctaggagatgtcatcag

SEQ ID NO: 661522 - DNA, 25 bp, Mus musculus
gagttcggcggtcttcctgtataca

SEQ ID NO: 661523 - DNA, 25 bp, Mus musculus
gagttcggcggtgttcctgtataca

SEQ ID NO: 661524 - DNA, 25 bp, Mus musculus
gagttcgggaacactgcaccaggca

SEQ ID NO: 661525 - DNA, 25 bp, Mus musculus
gagttcgggaactctgcaccaggca

SEQ ID NO: 661526 - DNA, 25 bp, Mus musculus
gagttcggttagctcgactgacagc

SEQ ID NO: 661527 - DNA, 25 bp, Mus musculus
gagttcggttaggtcgactgacagc

SEQ ID NO: 661528 - DNA, 25 bp, Mus musculus
gagttctaatccagttgcatgtagg

SEQ ID NO: 661529 - DNA, 25 bp, Mus musculus
gagttctaatcctgttgcatgtagg

SEQ ID NO: 661530 - DNA, 25 bp, Mus musculus
gagttctacagtagttccaacgtta

SEQ ID NO: 661531 - DNA, 25 bp, Mus musculus
gagttctacagttgttccaacgtta

SEQ ID NO: 661532 - DNA, 25 bp, Mus musculus
gagttctaccgcagtctggtccaga

SEQ ID NO: 661533 - DNA, 25 bp, Mus musculus
gagttctaccgctgtctggtccaga

SEQ ID NO: 661534 - DNA, 25 bp, Mus musculus
gagttctagcggcacgcactctgct

SEQ ID NO: 661535 - DNA, 25 bp, Mus musculus
gagttctagcgggacgcactctgct

SEQ ID NO: 661536 - DNA, 25 bp, Mus musculus
gagttctatactcgctggctagacc

SEQ ID NO: 661537 - DNA, 25 bp, Mus musculus
gagttctatactggctggctagacc

SEQ ID NO: 661538 - DNA, 25 bp, Mus musculus
gagttctatgatcctgatgaattcc

SEQ ID NO: 661539 - DNA, 25 bp, Mus musculus
gagttctatgatgctgatgaattcc

SEQ ID NO: 661540 - DNA, 25 bp, Mus musculus
gagttctcacctcacgtcgtcctag

SEQ ID NO: 661541 - DNA, 25 bp, Mus musculus
gagttctcacctgacgtcgtcctag

SEQ ID NO: 661542 - DNA, 25 bp, Mus musculus
gagttctcagtgcttcgccagcacg

SEQ ID NO: 661543 - DNA, 25 bp, Mus musculus
gagttctcagtggttcgccagcacg

SEQ ID NO: 661544 - DNA, 25 bp, Mus musculus
gagttctccaccaagtgtaaccaga

SEQ ID NO: 661545 - DNA, 25 bp, Mus musculus
gagttctccacctagtgtaaccaga

SEQ ID NO: 661546 - DNA, 25 bp, Mus musculus
gagttctccttgataaaggagcaga

SEQ ID NO: 661547 - DNA, 25 bp, Mus musculus
gagttctccttgttaaaggagcaga

SEQ ID NO: 661548 - DNA, 25 bp, Mus musculus
gagttctcggacaaagagtcagtga

SEQ ID NO: 661549 - DNA, 25 bp, Mus musculus
gagttctcggactaagagtcagtga

SEQ ID NO: 661550 - DNA, 25 bp, Mus musculus
gagttctctactaacctgcttataa

SEQ ID NO: 661551 - DNA, 25 bp, Mus musculus
gagttctctacttacctgcttataa

SEQ ID NO: 661552 - DNA, 25 bp, Mus musculus
gagttctcttacactagcagtgaag

SEQ ID NO: 661553 - DNA, 25 bp, Mus musculus
gagttctcttactctagcagtgaag

SEQ ID NO: 661554 - DNA, 25 bp, Mus musculus
gagttctgaaccaaggtgaccacaa

SEQ ID NO: 661555 - DNA, 25 bp, Mus musculus
gagttctgaacctaggtgaccacaa

SEQ ID NO: 661556 - DNA, 25 bp, Mus musculus
gagttctgaattagcagtctatcga

SEQ ID NO: 661557 - DNA, 25 bp, Mus musculus
gagttctgaatttgcagtctatcga

SEQ ID NO: 661558 - DNA, 25 bp, Mus musculus
gagttctgagcaaggagatttaacc

SEQ ID NO: 661559 - DNA, 25 bp, Mus musculus
gagttctgagcatggagatttaacc

SEQ ID NO: 661560 - DNA, 25 bp, Mus musculus
gagttctgagttcctgcgcttcaaa

SEQ ID NO: 661561 - DNA, 25 bp, Mus musculus
gagttctgagttgctgcgcttcaaa

SEQ ID NO: 661562 - DNA, 25 bp, Mus musculus
gagttctgcattcccaaatttgtag

SEQ ID NO: 661563 - DNA, 25 bp, Mus musculus
gagttctgcattgccaaatttgtag

SEQ ID NO: 661564 - DNA, 25 bp, Mus musculus
gagttctgcctgcttcgcgagaaca

SEQ ID NO: 661565 - DNA, 25 bp, Mus musculus
gagttctgcctggttcgcgagaaca

SEQ ID NO: 661566 - DNA, 25 bp, Mus musculus
gagttctggcccacttcctgcattt

SEQ ID NO: 661567 - DNA, 25 bp, Mus musculus
gagttctggccctcttcctgcattt

SEQ ID NO: 661568 - DNA, 25 bp, Mus musculus
gagttctgtcatagccgtggtatca

SEQ ID NO: 661569 - DNA, 25 bp, Mus musculus
gagttctgtcattgccgtggtatca

SEQ ID NO: 661570 - DNA, 25 bp, Mus musculus
gagttctgtttgctgaccgagagca

SEQ ID NO: 661571 - DNA, 25 bp, Mus musculus
gagttctgtttggtgaccgagagca

SEQ ID NO: 661572 - DNA, 25 bp, Mus musculus
gagttcttagtacagtgctcttgtg

SEQ ID NO: 661573 - DNA, 25 bp, Mus musculus
gagttcttagtagagtgctcttgtg

SEQ ID NO: 661574 - DNA, 25 bp, Mus musculus
gagttcttcgggagcggagaccctt

SEQ ID NO: 661575 - DNA, 25 bp, Mus musculus
gagttcttcgggtgcggagaccctt

SEQ ID NO: 661576 - DNA, 25 bp, Mus musculus
gagttcttctccaatacaacagacg

SEQ ID NO: 661577 - DNA, 25 bp, Mus musculus
gagttcttctcctatacaacagacg

SEQ ID NO: 661578 - DNA, 25 bp, Mus musculus
gagttcttctttcgctcgggcagct

SEQ ID NO: 661579 - DNA, 25 bp, Mus musculus
gagttcttctttggctcgggcagct

SEQ ID NO: 661580 - DNA, 25 bp, Mus musculus
gagttcttgaagaccaagactaagt

SEQ ID NO: 661581 - DNA, 25 bp, Mus musculus
gagttcttgaagtccaagactaagt

SEQ ID NO: 661582 - DNA, 25 bp, Mus musculus
gagttcttgagcatcgccgagaggt

SEQ ID NO: 661583 - DNA, 25 bp, Mus musculus
gagttcttgagcttcgccgagaggt

SEQ ID NO: 661584 - DNA, 25 bp, Mus musculus
gagttctttctgaggaagcctgttg

SEQ ID NO: 661585 - DNA, 25 bp, Mus musculus
gagttctttctgtggaagcctgttg

SEQ ID NO: 661586 - DNA, 25 bp, Mus musculus
gagttctttgaacatgacgccatgc

SEQ ID NO: 661587 - DNA, 25 bp, Mus musculus
gagttctttgaagatgacgccatgc

SEQ ID NO: 661588 - DNA, 25 bp, Mus musculus
gagttcttttacagcggtgagtcct

SEQ ID NO: 661589 - DNA, 25 bp, Mus musculus
gagttcttttactgcggtgagtcct

SEQ ID NO: 661590 - DNA, 25 bp, Mus musculus
gagttcttttatcatatcaaacaca

SEQ ID NO: 661591 - DNA, 25 bp, Mus musculus
gagttcttttatgatatcaaacaca

SEQ ID NO: 661592 - DNA, 25 bp, Mus musculus
gagttcttttcaaccctctgcacgc

SEQ ID NO: 661593 - DNA, 25 bp, Mus musculus
gagttcttttcatccctctgcacgc

SEQ ID NO: 661594 - DNA, 25 bp, Mus musculus
gagttgaaactcagaaaatgcgggc

SEQ ID NO: 661595 - DNA, 25 bp, Mus musculus
gagttgaaactctgaaaatgcgggc

SEQ ID NO: 661596 - DNA, 25 bp, Mus musculus
gagttgaacagcatgcagccggtca

SEQ ID NO: 661597 - DNA, 25 bp, Mus musculus
gagttgaacagcttgcagccggtca

SEQ ID NO: 661598 - DNA, 25 bp, Mus musculus
gagttgaaccttcccacaagtctaa

SEQ ID NO: 661599 - DNA, 25 bp, Mus musculus
gagttgaaccttgccacaagtctaa

SEQ ID NO: 661600 - DNA, 25 bp, Mus musculus
gagttgaagtcccagttacaccaac

SEQ ID NO: 661601 - DNA, 25 bp, Mus musculus
gagttgaagtccgagttacaccaac

SEQ ID NO: 661602 - DNA, 25 bp, Mus musculus
gagttgaagtggatctactcctcag

SEQ ID NO: 661603 - DNA, 25 bp, Mus musculus
gagttgaagtggttctactcctcag

SEQ ID NO: 661604 - DNA, 25 bp, Mus musculus
gagttgacaaccataaccaccacaa

SEQ ID NO: 661605 - DNA, 25 bp, Mus musculus
gagttgacaaccttaaccaccacaa

SEQ ID NO: 661606 - DNA, 25 bp, Mus musculus
gagttgacaagactaataaacttcg

SEQ ID NO: 661607 - DNA, 25 bp, Mus musculus
gagttgacaagagtaataaacttcg

SEQ ID NO: 661608 - DNA, 25 bp, Mus musculus
gagttgaccagcatcgatcaggtgg

SEQ ID NO: 661609 - DNA, 25 bp, Mus musculus
gagttgaccagcttcgatcaggtgg

SEQ ID NO: 661610 - DNA, 25 bp, Mus musculus
gagttgacccaacaagagaagcttc

SEQ ID NO: 661611 - DNA, 25 bp, Mus musculus
gagttgacccaagaagagaagcttc

SEQ ID NO: 661612 - DNA, 25 bp, Mus musculus
gagttgactacccaccttgcgcgac

SEQ ID NO: 661613 - DNA, 25 bp, Mus musculus
gagttgactaccgaccttgcgcgac

SEQ ID NO: 661614 - DNA, 25 bp, Mus musculus
gagttgactgaaatgtcagagtcct

SEQ ID NO: 661615 - DNA, 25 bp, Mus musculus
gagttgactgaattgtcagagtcct

SEQ ID NO: 661616 - DNA, 25 bp, Mus musculus
gagttgagcatcagtttgcctgaag

SEQ ID NO: 661617 - DNA, 25 bp, Mus musculus
gagttgagcatctgtttgcctgaag

SEQ ID NO: 661618 - DNA, 25 bp, Mus musculus
gagttgagcgctacaaacaaccccg

SEQ ID NO: 661619 - DNA, 25 bp, Mus musculus
gagttgagcgcttcaaacaaccccg

SEQ ID NO: 661620 - DNA, 25 bp, Mus musculus
gagttgaggccaacaaggctgccct

SEQ ID NO: 661621 - DNA, 25 bp, Mus musculus
gagttgaggccatcaaggctgccct

SEQ ID NO: 661622 - DNA, 25 bp, Mus musculus
gagttgagtgacaagtctccagggt

SEQ ID NO: 661623 - DNA, 25 bp, Mus musculus
gagttgagtgactagtctccagggt

SEQ ID NO: 661624 - DNA, 25 bp, Mus musculus
gagttgagttccatggcccggcttc

SEQ ID NO: 661625 - DNA, 25 bp, Mus musculus
gagttgagttccttggcccggcttc

SEQ ID NO: 661626 - DNA, 25 bp, Mus musculus
gagttgataatgcacagatgagctg

SEQ ID NO: 661627 - DNA, 25 bp, Mus musculus
gagttgataatggacagatgagctg

SEQ ID NO: 661628 - DNA, 25 bp, Mus musculus
gagttgatccaacgatgtctcgttg

SEQ ID NO: 661629 - DNA, 25 bp, Mus musculus
gagttgatccaaggatgtctcgttg

SEQ ID NO: 661630 - DNA, 25 bp, Mus musculus
gagttgatccgcagtgatgaggaaa

SEQ ID NO: 661631 - DNA, 25 bp, Mus musculus
gagttgatccgctgtgatgaggaaa

SEQ ID NO: 661632 - DNA, 25 bp, Mus musculus
gagttgatggtcagtctgctgcaga

SEQ ID NO: 661633 - DNA, 25 bp, Mus musculus
gagttgatggtctgtctgctgcaga

SEQ ID NO: 661634 - DNA, 25 bp, Mus musculus
gagttgcaaggaaccaattcgagaa

SEQ ID NO: 661635 - DNA, 25 bp, Mus musculus
gagttgcaaggatccaattcgagaa

SEQ ID NO: 661636 - DNA, 25 bp, Mus musculus
gagttgcaaggtcatcattgaggat

SEQ ID NO: 661637 - DNA, 25 bp, Mus musculus
gagttgcaaggtgatcattgaggat

SEQ ID NO: 661638 - DNA, 25 bp, Mus musculus
gagttgcaatttaagcccctttaat

SEQ ID NO: 661639 - DNA, 25 bp, Mus musculus
gagttgcaattttagcccctttaat

SEQ ID NO: 661640 - DNA, 25 bp, Mus musculus
gagttgcagagcacattttgcccga

SEQ ID NO: 661641 - DNA, 25 bp, Mus musculus
gagttgcagagctcattttgcccga

SEQ ID NO: 661642 - DNA, 25 bp, Mus musculus
gagttgcagagtcccaatgcctctg

SEQ ID NO: 661643 - DNA, 25 bp, Mus musculus
gagttgcagagtgccaatgcctctg

SEQ ID NO: 661644 - DNA, 25 bp, Mus musculus
gagttgcagataaaaccttcagacc

SEQ ID NO: 661645 - DNA, 25 bp, Mus musculus
gagttgcagatataaccttcagacc

SEQ ID NO: 661646 - DNA, 25 bp, Mus musculus
gagttgcatctcatgttttgaagcc

SEQ ID NO: 661647 - DNA, 25 bp, Mus musculus
gagttgcatctcttgttttgaagcc

SEQ ID NO: 661648 - DNA, 25 bp, Mus musculus
gagttgcatgaaatcgtctttgcca

SEQ ID NO: 661649 - DNA, 25 bp, Mus musculus
gagttgcatgaattcgtctttgcca

SEQ ID NO: 661650 - DNA, 25 bp, Mus musculus
gagttgcatggactctgtcaaggac

SEQ ID NO: 661651 - DNA, 25 bp, Mus musculus
gagttgcatggagtctgtcaaggac

SEQ ID NO: 661652 - DNA, 25 bp, Mus musculus
gagttgcccaataccagggtgccgg

SEQ ID NO: 661653 - DNA, 25 bp, Mus musculus
gagttgcccaattccagggtgccgg

SEQ ID NO: 661654 - DNA, 25 bp, Mus musculus
gagttgcccagtagcctgtctttcg

SEQ ID NO: 661655 - DNA, 25 bp, Mus musculus
gagttgcccagttgcctgtctttcg

SEQ ID NO: 661656 - DNA, 25 bp, Mus musculus
gagttgccgtatagctttctgagaa

SEQ ID NO: 661657 - DNA, 25 bp, Mus musculus
gagttgccgtattgctttctgagaa

SEQ ID NO: 661658 - DNA, 25 bp, Mus musculus
gagttgccgttaaactgttctgggg

SEQ ID NO: 661659 - DNA, 25 bp, Mus musculus
gagttgccgttatactgttctgggg

SEQ ID NO: 661660 - DNA, 25 bp, Mus musculus
gagttgcctggactaatcctttccc

SEQ ID NO: 661661 - DNA, 25 bp, Mus musculus
gagttgcctggagtaatcctttccc

SEQ ID NO: 661662 - DNA, 25 bp, Mus musculus
gagttgccttgcctcacatggaacg

SEQ ID NO: 661663 - DNA, 25 bp, Mus musculus
gagttgccttgcgtcacatggaacg

SEQ ID NO: 661664 - DNA, 25 bp, Mus musculus
gagttgcgacgactgatcttccttt

SEQ ID NO: 661665 - DNA, 25 bp, Mus musculus
gagttgcgacgagtgatcttccttt

SEQ ID NO: 661666 - DNA, 25 bp, Mus musculus
gagttgctcactctgccacgtgctc

SEQ ID NO: 661667 - DNA, 25 bp, Mus musculus
gagttgctcactgtgccacgtgctc

SEQ ID NO: 661668 - DNA, 25 bp, Mus musculus
gagttgctctacctcgggatctttg

SEQ ID NO: 661669 - DNA, 25 bp, Mus musculus
gagttgctctacgtcgggatctttg

SEQ ID NO: 661670 - DNA, 25 bp, Mus musculus
gagttgctcttgatccatggatgta

SEQ ID NO: 661671 - DNA, 25 bp, Mus musculus
gagttgctcttgttccatggatgta

SEQ ID NO: 661672 - DNA, 25 bp, Mus musculus
gagttgctgagaagacgcttgtacc

SEQ ID NO: 661673 - DNA, 25 bp, Mus musculus
gagttgctgagatgacgcttgtacc

SEQ ID NO: 661674 - DNA, 25 bp, Mus musculus
gagttgctgcaaatggtggtgcttt

SEQ ID NO: 661675 - DNA, 25 bp, Mus musculus
gagttgctgcaattggtggtgcttt

SEQ ID NO: 661676 - DNA, 25 bp, Mus musculus
gagttgctgcagatccaacaggaca

SEQ ID NO: 661677 - DNA, 25 bp, Mus musculus
gagttgctgcagttccaacaggaca

SEQ ID NO: 661678 - DNA, 25 bp, Mus musculus
gagttgctgcgtatccaggaatgaa

SEQ ID NO: 661679 - DNA, 25 bp, Mus musculus
gagttgctgcgtttccaggaatgaa

SEQ ID NO: 661680 - DNA, 25 bp, Mus musculus
gagttgctgttgaaactgcccctcc

SEQ ID NO: 661681 - DNA, 25 bp, Mus musculus
gagttgctgttgtaactgcccctcc

SEQ ID NO: 661682 - DNA, 25 bp, Mus musculus
gagttgctttggatatgaccacact

SEQ ID NO: 661683 - DNA, 25 bp, Mus musculus
gagttgctttggttatgaccacact

SEQ ID NO: 661684 - DNA, 25 bp, Mus musculus
gagttggaaaacaccaagtccttgg

SEQ ID NO: 661685 - DNA, 25 bp, Mus musculus
gagttggaaaactccaagtccttgg

SEQ ID NO: 661686 - DNA, 25 bp, Mus musculus
gagttggaagctagtgagctgacct

SEQ ID NO: 661687 - DNA, 25 bp, Mus musculus
gagttggaagcttgtgagctgacct

SEQ ID NO: 661688 - DNA, 25 bp, Mus musculus
gagttggaatccagctctttttaaa

SEQ ID NO: 661689 - DNA, 25 bp, Mus musculus
gagttggaatcctgctctttttaaa

SEQ ID NO: 661690 - DNA, 25 bp, Mus musculus
gagttggaattactagcttcgccca

SEQ ID NO: 661691 - DNA, 25 bp, Mus musculus
gagttggaattagtagcttcgccca

SEQ ID NO: 661692 - DNA, 25 bp, Mus musculus
gagttggacaccctgaatgaagagt

SEQ ID NO: 661693 - DNA, 25 bp, Mus musculus
gagttggacaccgtgaatgaagagt

SEQ ID NO: 661694 - DNA, 25 bp, Mus musculus
gagttggactgccttatcttataaa

SEQ ID NO: 661695 - DNA, 25 bp, Mus musculus
gagttggactgcgttatcttataaa

SEQ ID NO: 661696 - DNA, 25 bp, Mus musculus
gagttggagacaaggtcctacctcc

SEQ ID NO: 661697 - DNA, 25 bp, Mus musculus
gagttggagacatggtcctacctcc

SEQ ID NO: 661698 - DNA, 25 bp, Mus musculus
gagttggagatcacagctctaccta

SEQ ID NO: 661699 - DNA, 25 bp, Mus musculus
gagttggagatctcagctctaccta

SEQ ID NO: 661700 - DNA, 25 bp, Mus musculus
gagttggagccaatcagtaatcctg

SEQ ID NO: 661701 - DNA, 25 bp, Mus musculus
gagttggagccattcagtaatcctg

SEQ ID NO: 661702 - DNA, 25 bp, Mus musculus
gagttggatgcactcacactggcaa

SEQ ID NO: 661703 - DNA, 25 bp, Mus musculus
gagttggatgcagtcacactggcaa

SEQ ID NO: 661704 - DNA, 25 bp, Mus musculus
gagttggattgacaaaatgggaaaa

SEQ ID NO: 661705 - DNA, 25 bp, Mus musculus
gagttggattgagaaaatgggaaaa

SEQ ID NO: 661706 - DNA, 25 bp, Mus musculus
gagttggccaacctgagccagtccc

SEQ ID NO: 661707 - DNA, 25 bp, Mus musculus
gagttggccaacgtgagccagtccc

SEQ ID NO: 661708 - DNA, 25 bp, Mus musculus
gagttggcccagaaccgccactggg

SEQ ID NO: 661709 - DNA, 25 bp, Mus musculus
gagttggcccagtaccgccactggg

SEQ ID NO: 661710 - DNA, 25 bp, Mus musculus
gagttggccccgaagaacattcgag

SEQ ID NO: 661711 - DNA, 25 bp, Mus musculus
gagttggccccgtagaacattcgag

SEQ ID NO: 661712 - DNA, 25 bp, Mus musculus
gagttggccgccactgggtccctat

SEQ ID NO: 661713 - DNA, 25 bp, Mus musculus
gagttggccgcctctgggtccctat

SEQ ID NO: 661714 - DNA, 25 bp, Mus musculus
gagttggccggcagttaaattgaag

SEQ ID NO: 661715 - DNA, 25 bp, Mus musculus
gagttggccggctgttaaattgaag

SEQ ID NO: 661716 - DNA, 25 bp, Mus musculus
gagttggccttcaccttagacctcg

SEQ ID NO: 661717 - DNA, 25 bp, Mus musculus
gagttggccttctccttagacctcg

SEQ ID NO: 661718 - DNA, 25 bp, Mus musculus
gagttggcctttctggcaattgcca

SEQ ID NO: 661719 - DNA, 25 bp, Mus musculus
gagttggcctttgtggcaattgcca

SEQ ID NO: 661720 - DNA, 25 bp, Mus musculus
gagttggcgtccaacatctgctaat

SEQ ID NO: 661721 - DNA, 25 bp, Mus musculus
gagttggcgtcctacatctgctaat

SEQ ID NO: 661722 - DNA, 25 bp, Mus musculus
gagttggctctgacaacctgaggcc

SEQ ID NO: 661723 - DNA, 25 bp, Mus musculus
gagttggctctgtcaacctgaggcc

SEQ ID NO: 661724 - DNA, 25 bp, Mus musculus
gagttgggactgatgtaccctgtcc

SEQ ID NO: 661725 - DNA, 25 bp, Mus musculus
gagttgggactgttgtaccctgtcc

SEQ ID NO: 661726 - DNA, 25 bp, Mus musculus
gagttgggagatacaaagtcctccg

SEQ ID NO: 661727 - DNA, 25 bp, Mus musculus
gagttgggagattcaaagtcctccg

SEQ ID NO: 661728 - DNA, 25 bp, Mus musculus
gagttgggagcccagtccatcacct

SEQ ID NO: 661729 - DNA, 25 bp, Mus musculus
gagttgggagccgagtccatcacct

SEQ ID NO: 661730 - DNA, 25 bp, Mus musculus
gagttgggcttgactcaataaggga

SEQ ID NO: 661731 - DNA, 25 bp, Mus musculus
gagttgggcttgtctcaataaggga

SEQ ID NO: 661732 - DNA, 25 bp, Mus musculus
gagttgggttgactacttatcctta

SEQ ID NO: 661733 - DNA, 25 bp, Mus musculus
gagttgggttgagtacttatcctta

SEQ ID NO: 661734 - DNA, 25 bp, Mus musculus
gagttggtaactatgcctgcagcga

SEQ ID NO: 661735 - DNA, 25 bp, Mus musculus
gagttggtaactttgcctgcagcga

SEQ ID NO: 661736 - DNA, 25 bp, Mus musculus
gagttggtacgcagcattcgatttg

SEQ ID NO: 661737 - DNA, 25 bp, Mus musculus
gagttggtacgctgcattcgatttg

SEQ ID NO: 661738 - DNA, 25 bp, Mus musculus
gagttggtactaatgtccatgagaa

SEQ ID NO: 661739 - DNA, 25 bp, Mus musculus
gagttggtactattgtccatgagaa

SEQ ID NO: 661740 - DNA, 25 bp, Mus musculus
gagttggtcactctcattaaacaag

SEQ ID NO: 661741 - DNA, 25 bp, Mus musculus
gagttggtcactgtcattaaacaag

SEQ ID NO: 661742 - DNA, 25 bp, Mus musculus
gagttggtcgacacaatttgcgaga

SEQ ID NO: 661743 - DNA, 25 bp, Mus musculus
gagttggtcgactcaatttgcgaga

SEQ ID NO: 661744 - DNA, 25 bp, Mus musculus
gagttggtgaaaacagaagactaaa

SEQ ID NO: 661745 - DNA, 25 bp, Mus musculus
gagttggtgaaatcagaagactaaa

SEQ ID NO: 661746 - DNA, 25 bp, Mus musculus
gagttgtatatgacaagtcatttcc

SEQ ID NO: 661747 - DNA, 25 bp, Mus musculus
gagttgtatatgtcaagtcatttcc

SEQ ID NO: 661748 - DNA, 25 bp, Mus musculus
gagttgtcaggacccctggaagacc

SEQ ID NO: 661749 - DNA, 25 bp, Mus musculus
gagttgtcaggagccctggaagacc

SEQ ID NO: 661750 - DNA, 25 bp, Mus musculus
gagttgtccaaacaagatcccaagt

SEQ ID NO: 661751 - DNA, 25 bp, Mus musculus
gagttgtccaaagaagatcccaagt

SEQ ID NO: 661752 - DNA, 25 bp, Mus musculus
gagttgtcccggacgcgcgcgcttc

SEQ ID NO: 661753 - DNA, 25 bp, Mus musculus
gagttgtcccggtcgcgcgcgcttc

SEQ ID NO: 661754 - DNA, 25 bp, Mus musculus
gagttgtctactccatattagatag

SEQ ID NO: 661755 - DNA, 25 bp, Mus musculus
gagttgtctactgcatattagatag

SEQ ID NO: 661756 - DNA, 25 bp, Mus musculus
gagttgtggtctctcttcacagcaa

SEQ ID NO: 661757 - DNA, 25 bp, Mus musculus
gagttgtggtctgtcttcacagcaa

SEQ ID NO: 661758 - DNA, 25 bp, Mus musculus
gagttgtgtccaaaaggtgccccaa

SEQ ID NO: 661759 - DNA, 25 bp, Mus musculus
gagttgtgtccataaggtgccccaa

SEQ ID NO: 661760 - DNA, 25 bp, Mus musculus
gagttgtgtgccaaagcagacaagc

SEQ ID NO: 661761 - DNA, 25 bp, Mus musculus
gagttgtgtgcctaagcagacaagc

SEQ ID NO: 661762 - DNA, 25 bp, Mus musculus
gagttgttcccgcttcccgctgtgc

SEQ ID NO: 661763 - DNA, 25 bp, Mus musculus
gagttgttcccggttcccgctgtgc

SEQ ID NO: 661764 - DNA, 25 bp, Mus musculus
gagttgttgcccatcctcctgcagt

SEQ ID NO: 661765 - DNA, 25 bp, Mus musculus
gagttgttgcccttcctcctgcagt

SEQ ID NO: 661766 - DNA, 25 bp, Mus musculus
gagttgttgtctctgcgctatgacc

SEQ ID NO: 661767 - DNA, 25 bp, Mus musculus
gagttgttgtctgtgcgctatgacc

SEQ ID NO: 661768 - DNA, 25 bp, Mus musculus
gagttgtttactatctgagcaagca

SEQ ID NO: 661769 - DNA, 25 bp, Mus musculus
gagttgtttactttctgagcaagca

SEQ ID NO: 661770 - DNA, 25 bp, Mus musculus
gagtttaagtgtcctgatcccacag

SEQ ID NO: 661771 - DNA, 25 bp, Mus musculus
gagtttaagtgtgctgatcccacag

SEQ ID NO: 661772 - DNA, 25 bp, Mus musculus
gagtttaagttcatccttggccaca

SEQ ID NO: 661773 - DNA, 25 bp, Mus musculus
gagtttaagttcttccttggccaca

SEQ ID NO: 661774 - DNA, 25 bp, Mus musculus
gagtttacaaggagataccaaaaat

SEQ ID NO: 661775 - DNA, 25 bp, Mus musculus
gagtttacaaggtgataccaaaaat

SEQ ID NO: 661776 - DNA, 25 bp, Mus musculus
gagtttacactcatcagagcgatgt

SEQ ID NO: 661777 - DNA, 25 bp, Mus musculus
gagtttacactcttcagagcgatgt

SEQ ID NO: 661778 - DNA, 25 bp, Mus musculus
gagtttacatataagaccatttcta

SEQ ID NO: 661779 - DNA, 25 bp, Mus musculus
gagtttacatattagaccatttcta

SEQ ID NO: 661780 - DNA, 25 bp, Mus musculus
gagtttagccatcgcgctcagcttt

SEQ ID NO: 661781 - DNA, 25 bp, Mus musculus
gagtttagccatggcgctcagcttt

SEQ ID NO: 661782 - DNA, 25 bp, Mus musculus
gagtttatctagacaggatttggag

SEQ ID NO: 661783 - DNA, 25 bp, Mus musculus
gagtttatctagtcaggatttggag

SEQ ID NO: 661784 - DNA, 25 bp, Mus musculus
gagtttcaacatctttctccgaggg

SEQ ID NO: 661785 - DNA, 25 bp, Mus musculus
gagtttcaacatgtttctccgaggg

SEQ ID NO: 661786 - DNA, 25 bp, Mus musculus
gagtttcaacgcattctttagcttc

SEQ ID NO: 661787 - DNA, 25 bp, Mus musculus
gagtttcaacgctttctttagcttc

SEQ ID NO: 661788 - DNA, 25 bp, Mus musculus
gagtttcaactcacacaatcctaag

SEQ ID NO: 661789 - DNA, 25 bp, Mus musculus
gagtttcaactctcacaatcctaag

SEQ ID NO: 661790 - DNA, 25 bp, Mus musculus
gagtttcaaggtcaatcactctttt

SEQ ID NO: 661791 - DNA, 25 bp, Mus musculus
gagtttcaaggtgaatcactctttt

SEQ ID NO: 661792 - DNA, 25 bp, Mus musculus
gagtttcaatatccctctcctggta

SEQ ID NO: 661793 - DNA, 25 bp, Mus musculus
gagtttcaatatgcctctcctggta

SEQ ID NO: 661794 - DNA, 25 bp, Mus musculus
gagtttcagaaccacattgtagtat

SEQ ID NO: 661795 - DNA, 25 bp, Mus musculus
gagtttcagaacgacattgtagtat

SEQ ID NO: 661796 - DNA, 25 bp, Mus musculus
gagtttcagaatatcgagaggcagt

SEQ ID NO: 661797 - DNA, 25 bp, Mus musculus
gagtttcagaatttcgagaggcagt

SEQ ID NO: 661798 - DNA, 25 bp, Mus musculus
gagtttcatcctcaacaaggctgag

SEQ ID NO: 661799 - DNA, 25 bp, Mus musculus
gagtttcatcctgaacaaggctgag

SEQ ID NO: 661800 - DNA, 25 bp, Mus musculus
gagtttccacaacacctgtttccac

SEQ ID NO: 661801 - DNA, 25 bp, Mus musculus
gagtttccacaagacctgtttccac

SEQ ID NO: 661802 - DNA, 25 bp, Mus musculus
gagtttccagttcacctcagcacta

SEQ ID NO: 661803 - DNA, 25 bp, Mus musculus
gagtttccagttgacctcagcacta

SEQ ID NO: 661804 - DNA, 25 bp, Mus musculus
gagtttccatgcatagtctgagggc

SEQ ID NO: 661805 - DNA, 25 bp, Mus musculus
gagtttccatgcttagtctgagggc

SEQ ID NO: 661806 - DNA, 25 bp, Mus musculus
gagtttcggaatccttctctgggaa

SEQ ID NO: 661807 - DNA, 25 bp, Mus musculus
gagtttcggaatgcttctctgggaa

SEQ ID NO: 661808 - DNA, 25 bp, Mus musculus
gagtttcggtatcgcccaagcttcg

SEQ ID NO: 661809 - DNA, 25 bp, Mus musculus
gagtttcggtatggcccaagcttcg

SEQ ID NO: 661810 - DNA, 25 bp, Mus musculus
gagtttcgtgtcagagtcccgtaag

SEQ ID NO: 661811 - DNA, 25 bp, Mus musculus
gagtttcgtgtctgagtcccgtaag

SEQ ID NO: 661812 - DNA, 25 bp, Mus musculus
gagtttcgttctcagcataccacag

SEQ ID NO: 661813 - DNA, 25 bp, Mus musculus
gagtttcgttctgagcataccacag

SEQ ID NO: 661814 - DNA, 25 bp, Mus musculus
gagtttctacgtctatgcaggcatc

SEQ ID NO: 661815 - DNA, 25 bp, Mus musculus
gagtttctacgtgtatgcaggcatc

SEQ ID NO: 661816 - DNA, 25 bp, Mus musculus
gagtttctcatccaatgcagcccag

SEQ ID NO: 661817 - DNA, 25 bp, Mus musculus
gagtttctcatcgaatgcagcccag

SEQ ID NO: 661818 - DNA, 25 bp, Mus musculus
gagtttctgatgactacagtgagcc

SEQ ID NO: 661819 - DNA, 25 bp, Mus musculus
gagtttctgatgtctacagtgagcc

SEQ ID NO: 661820 - DNA, 25 bp, Mus musculus
gagtttctgcgccaatgtccgacag

SEQ ID NO: 661821 - DNA, 25 bp, Mus musculus
gagtttctgcgcgaatgtccgacag

SEQ ID NO: 661822 - DNA, 25 bp, Mus musculus
gagtttctgctaaccatctgctgcc

SEQ ID NO: 661823 - DNA, 25 bp, Mus musculus
gagtttctgctatccatctgctgcc

SEQ ID NO: 661824 - DNA, 25 bp, Mus musculus
gagtttcttattcacaccatcgctg

SEQ ID NO: 661825 - DNA, 25 bp, Mus musculus
gagtttcttattgacaccatcgctg

SEQ ID NO: 661826 - DNA, 25 bp, Mus musculus
gagtttgacacaaaacaggcacccg

SEQ ID NO: 661827 - DNA, 25 bp, Mus musculus
gagtttgacacataacaggcacccg

SEQ ID NO: 661828 - DNA, 25 bp, Mus musculus
gagtttgaccaactggaccaggaaa

SEQ ID NO: 661829 - DNA, 25 bp, Mus musculus
gagtttgaccaagtggaccaggaaa

SEQ ID NO: 661830 - DNA, 25 bp, Mus musculus
gagtttgacccaatgatccctgatg

SEQ ID NO: 661831 - DNA, 25 bp, Mus musculus
gagtttgacccactatgaatctgga

SEQ ID NO: 661832 - DNA, 25 bp, Mus musculus
gagtttgacccagtatgaatctgga

SEQ ID NO: 661833 - DNA, 25 bp, Mus musculus
gagtttgacccattgatccctgatg

SEQ ID NO: 661834 - DNA, 25 bp, Mus musculus
gagtttgacctcagcagatatggct

SEQ ID NO: 661835 - DNA, 25 bp, Mus musculus
gagtttgacctcatgccttggcagg

SEQ ID NO: 661836 - DNA, 25 bp, Mus musculus
gagtttgacctctgcagatatggct

SEQ ID NO: 661837 - DNA, 25 bp, Mus musculus
gagtttgacctcttgccttggcagg

SEQ ID NO: 661838 - DNA, 25 bp, Mus musculus
gagtttgacgtcatcaccaggctct

SEQ ID NO: 661839 - DNA, 25 bp, Mus musculus
gagtttgacgtcttcaccaggctct

SEQ ID NO: 661840 - DNA, 25 bp, Mus musculus
gagtttgagaccatgaggcagttcc

SEQ ID NO: 661841 - DNA, 25 bp, Mus musculus
gagtttgagaccttgaggcagttcc

SEQ ID NO: 661842 - DNA, 25 bp, Mus musculus
gagtttgagcctactgctgacaaca

SEQ ID NO: 661843 - DNA, 25 bp, Mus musculus
gagtttgagccttctgctgacaaca

SEQ ID NO: 661844 - DNA, 25 bp, Mus musculus
gagtttgaggctcagatccttgtcc

SEQ ID NO: 661845 - DNA, 25 bp, Mus musculus
gagtttgaggctgagatccttgtcc

SEQ ID NO: 661846 - DNA, 25 bp, Mus musculus
gagtttgagttcatggatgatgcca

SEQ ID NO: 661847 - DNA, 25 bp, Mus musculus
gagtttgagttcttggatgatgcca

SEQ ID NO: 661848 - DNA, 25 bp, Mus musculus
gagtttgatcctacccacagctgaa

SEQ ID NO: 661849 - DNA, 25 bp, Mus musculus
gagtttgatccttcccacagctgaa

SEQ ID NO: 661850 - DNA, 25 bp, Mus musculus
gagtttgatctgaatggaaatggag

SEQ ID NO: 661851 - DNA, 25 bp, Mus musculus
gagtttgatctgtatggaaatggag

SEQ ID NO: 661852 - DNA, 25 bp, Mus musculus
gagtttgatcttctcttcacatcca

SEQ ID NO: 661853 - DNA, 25 bp, Mus musculus
gagtttgatcttgtcttcacatcca

SEQ ID NO: 661854 - DNA, 25 bp, Mus musculus
gagtttgcaaagacctcagcagtca

SEQ ID NO: 661855 - DNA, 25 bp, Mus musculus
gagtttgcaaagtcctcagcagtca

SEQ ID NO: 661856 - DNA, 25 bp, Mus musculus
gagtttgcagagagatcagtaacca

SEQ ID NO: 661857 - DNA, 25 bp, Mus musculus
gagtttgcagagtgatcagtaacca

SEQ ID NO: 661858 - DNA, 25 bp, Mus musculus
gagtttgccacgctcagaacctggc

SEQ ID NO: 661859 - DNA, 25 bp, Mus musculus
gagtttgccacggtcagaacctggc

SEQ ID NO: 661860 - DNA, 25 bp, Mus musculus
gagtttgctagccagaatcctgact

SEQ ID NO: 661861 - DNA, 25 bp, Mus musculus
gagtttgctagcgagaatcctgact

SEQ ID NO: 661862 - DNA, 25 bp, Mus musculus
gagtttgctcaacatgtgggccgca

SEQ ID NO: 661863 - DNA, 25 bp, Mus musculus
gagtttgctcaagatgtgggccgca

SEQ ID NO: 661864 - DNA, 25 bp, Mus musculus
gagtttgctggaccaaaattcaaag

SEQ ID NO: 661865 - DNA, 25 bp, Mus musculus
gagtttgctggagcaaaattcaaag

SEQ ID NO: 661866 - DNA, 25 bp, Mus musculus
gagtttgctgtcaagatcctcagcc

SEQ ID NO: 661867 - DNA, 25 bp, Mus musculus
gagtttgctgtctagatcctcagcc

SEQ ID NO: 661868 - DNA, 25 bp, Mus musculus
gagtttggaacaagagatctccttt

SEQ ID NO: 661869 - DNA, 25 bp, Mus musculus
gagtttggaacatgagatctccttt

SEQ ID NO: 661870 - DNA, 25 bp, Mus musculus
gagtttggaaccagaaagacgaatt

SEQ ID NO: 661871 - DNA, 25 bp, Mus musculus
gagtttggaacctgaaagacgaatt

SEQ ID NO: 661872 - DNA, 25 bp, Mus musculus
gagtttggacctagtatctccaaga

SEQ ID NO: 661873 - DNA, 25 bp, Mus musculus
gagtttggaccttgtatctccaaga

SEQ ID NO: 661874 - DNA, 25 bp, Mus musculus
gagtttggccagaaccattgcatct

SEQ ID NO: 661875 - DNA, 25 bp, Mus musculus
gagtttggccagtaccattgcatct

SEQ ID NO: 661876 - DNA, 25 bp, Mus musculus
gagtttgggcctaccctgggctaat

SEQ ID NO: 661877 - DNA, 25 bp, Mus musculus
gagtttgggccttccctgggctaat

SEQ ID NO: 661878 - DNA, 25 bp, Mus musculus
gagtttgtaatacctgccactgact

SEQ ID NO: 661879 - DNA, 25 bp, Mus musculus
gagtttgtaatagctgccactgact

SEQ ID NO: 661880 - DNA, 25 bp, Mus musculus
gagtttgtccaacttgtctgtcctg

SEQ ID NO: 661881 - DNA, 25 bp, Mus musculus
gagtttgtccaagttgtctgtcctg

SEQ ID NO: 661882 - DNA, 25 bp, Mus musculus
gagtttgtccagcagacatttccgc

SEQ ID NO: 661883 - DNA, 25 bp, Mus musculus
gagtttgtccaggagacatttccgc

SEQ ID NO: 661884 - DNA, 25 bp, Mus musculus
gagtttgtgacaaactaggtgacac

SEQ ID NO: 661885 - DNA, 25 bp, Mus musculus
gagtttgtgacatactaggtgacac

SEQ ID NO: 661886 - DNA, 25 bp, Mus musculus
gagtttgtgcacatgtataatgccc

SEQ ID NO: 661887 - DNA, 25 bp, Mus musculus
gagtttgtgcacttgtataatgccc

SEQ ID NO: 661888 - DNA, 25 bp, Mus musculus
gagtttgtgccaccttttgggatca

SEQ ID NO: 661889 - DNA, 25 bp, Mus musculus
gagtttgtgccagcttttgggatca

SEQ ID NO: 661890 - DNA, 25 bp, Mus musculus
gagtttgtgcgcaagcatatcttca

SEQ ID NO: 661891 - DNA, 25 bp, Mus musculus
gagtttgtgcgctagcatatcttca

SEQ ID NO: 661892 - DNA, 25 bp, Mus musculus
gagtttgtggttcgccaactgcctt

SEQ ID NO: 661893 - DNA, 25 bp, Mus musculus
gagtttgtggttggccaactgcctt

SEQ ID NO: 661894 - DNA, 25 bp, Mus musculus
gagtttgttccaaagaatgaggatg

SEQ ID NO: 661895 - DNA, 25 bp, Mus musculus
gagtttgttccatagaatgaggatg

SEQ ID NO: 661896 - DNA, 25 bp, Mus musculus
gagtttgttgtaatcatgtggcggc

SEQ ID NO: 661897 - DNA, 25 bp, Mus musculus
gagtttgttgtattcatgtggcggc

SEQ ID NO: 661898 - DNA, 25 bp, Mus musculus
gagttttaaaaccagacctgaagca

SEQ ID NO: 661899 - DNA, 25 bp, Mus musculus
gagttttaaaacgagacctgaagca

SEQ ID NO: 661900 - DNA, 25 bp, Mus musculus
gagttttaaagccacttggactgag

SEQ ID NO: 661901 - DNA, 25 bp, Mus musculus
gagttttaaagcgacttggactgag

SEQ ID NO: 661902 - DNA, 25 bp, Mus musculus
gagttttaaatcctgagatgcgcag

SEQ ID NO: 661903 - DNA, 25 bp, Mus musculus
gagttttaaatcgtgagatgcgcag

SEQ ID NO: 661904 - DNA, 25 bp, Mus musculus
gagttttaacctatgggctaaacag

SEQ ID NO: 661905 - DNA, 25 bp, Mus musculus
gagttttaacctttgggctaaacag

SEQ ID NO: 661906 - DNA, 25 bp, Mus musculus
gagttttaatgaccatgtctagccc

SEQ ID NO: 661907 - DNA, 25 bp, Mus musculus
gagttttaatgagcatgtctagccc

SEQ ID NO: 661908 - DNA, 25 bp, Mus musculus
gagttttagagaatttcccagggca

SEQ ID NO: 661909 - DNA, 25 bp, Mus musculus
gagttttagagattttcccagggca

SEQ ID NO: 661910 - DNA, 25 bp, Mus musculus
gagttttatcagcttgtaagtaccg

SEQ ID NO: 661911 - DNA, 25 bp, Mus musculus
gagttttatcaggttgtaagtaccg

SEQ ID NO: 661912 - DNA, 25 bp, Mus musculus
gagttttcagatcgcatttgtccaa

SEQ ID NO: 661913 - DNA, 25 bp, Mus musculus
gagttttcagatggcatttgtccaa

SEQ ID NO: 661914 - DNA, 25 bp, Mus musculus
gagttttcagcaacaaatttttagc

SEQ ID NO: 661915 - DNA, 25 bp, Mus musculus
gagttttcagcatcaaatttttagc

SEQ ID NO: 661916 - DNA, 25 bp, Mus musculus
gagttttcataactctcagacccta

SEQ ID NO: 661917 - DNA, 25 bp, Mus musculus
gagttttcataagtctcagacccta

SEQ ID NO: 661918 - DNA, 25 bp, Mus musculus
gagttttcatggctccaagcaggga

SEQ ID NO: 661919 - DNA, 25 bp, Mus musculus
gagttttcatgggtccaagcaggga

SEQ ID NO: 661920 - DNA, 25 bp, Mus musculus
gagttttccgaactctggctcatga

SEQ ID NO: 661921 - DNA, 25 bp, Mus musculus
gagttttccgaagtctggctcatga

SEQ ID NO: 661922 - DNA, 25 bp, Mus musculus
gagttttccgccaccagtttgatga

SEQ ID NO: 661923 - DNA, 25 bp, Mus musculus
gagttttccgcctccagtttgatga

SEQ ID NO: 661924 - DNA, 25 bp, Mus musculus
gagttttcctcccagatcatcgcct

SEQ ID NO: 661925 - DNA, 25 bp, Mus musculus
gagttttcctccgagatcatcgcct

SEQ ID NO: 661926 - DNA, 25 bp, Mus musculus
gagttttcgtatcctgtgttccgag

SEQ ID NO: 661927 - DNA, 25 bp, Mus musculus
gagttttcgtatgctgtgttccgag

SEQ ID NO: 661928 - DNA, 25 bp, Mus musculus
gagttttcgtctcccatgcctctag

SEQ ID NO: 661929 - DNA, 25 bp, Mus musculus
gagttttcgtctgccatgcctctag

SEQ ID NO: 661930 - DNA, 25 bp, Mus musculus
gagttttctaacataggaagccaca

SEQ ID NO: 661931 - DNA, 25 bp, Mus musculus
gagttttctaacttaggaagccaca

SEQ ID NO: 661932 - DNA, 25 bp, Mus musculus
gagttttctgccaaccctgagggaa

SEQ ID NO: 661933 - DNA, 25 bp, Mus musculus
gagttttctgcctaccctgagggaa

SEQ ID NO: 661934 - DNA, 25 bp, Mus musculus
gagttttctgctcagcgccttcttc

SEQ ID NO: 661935 - DNA, 25 bp, Mus musculus
gagttttctgctgagcgccttcttc

SEQ ID NO: 661936 - DNA, 25 bp, Mus musculus
gagttttgagacctcccttcgtgga

SEQ ID NO: 661937 - DNA, 25 bp, Mus musculus
gagttttgagacgtcccttcgtgga

SEQ ID NO: 661938 - DNA, 25 bp, Mus musculus
gagttttggatgcatggcaatagac

SEQ ID NO: 661939 - DNA, 25 bp, Mus musculus
gagttttggatggatggcaatagac

SEQ ID NO: 661940 - DNA, 25 bp, Mus musculus
gagtttttacggaggtgatcgagac

SEQ ID NO: 661941 - DNA, 25 bp, Mus musculus
gagtttttacggtggtgatcgagac

SEQ ID NO: 661942 - DNA, 25 bp, Mus musculus
gagtttttcaccaatctggataagc

SEQ ID NO: 661943 - DNA, 25 bp, Mus musculus
gagtttttcacctatctggataagc

SEQ ID NO: 661944 - DNA, 25 bp, Mus musculus
gagttttttgaaaccagcgccaagg

SEQ ID NO: 661945 - DNA, 25 bp, Mus musculus
gagttttttgaatccagcgccaagg

SEQ ID NO: 661946 - DNA, 25 bp, Mus musculus
gagttttttgacctcccgagtctca

SEQ ID NO: 661947 - DNA, 25 bp, Mus musculus
gagttttttgacgtcccgagtctca

SEQ ID NO: 661948 - DNA, 25 bp, Mus musculus
gataaaaaagcgagttccttctcca

SEQ ID NO: 661949 - DNA, 25 bp, Mus musculus
gataaaaaagcgtgttccttctcca

SEQ ID NO: 661950 - DNA, 25 bp, Mus musculus
gataaaaaggcaccattgcgggaaa

SEQ ID NO: 661951 - DNA, 25 bp, Mus musculus
gataaaaaggcagcattgcgggaaa

SEQ ID NO: 661952 - DNA, 25 bp, Mus musculus
gataaaaaggctatccaggcatcca

SEQ ID NO: 661953 - DNA, 25 bp, Mus musculus
gataaaaaggctttccaggcatcca

SEQ ID NO: 661954 - DNA, 25 bp, Mus musculus
gataaaaatctgctctttggcaaca

SEQ ID NO: 661955 - DNA, 25 bp, Mus musculus
gataaaaatctggtctttggcaaca

SEQ ID NO: 661956 - DNA, 25 bp, Mus musculus
gataaaacatcaaccagaaacttcc

SEQ ID NO: 661957 - DNA, 25 bp, Mus musculus
gataaaacatcatccagaaacttcc

SEQ ID NO: 661958 - DNA, 25 bp, Mus musculus
gataaaactatcagatcttccctcc

SEQ ID NO: 661959 - DNA, 25 bp, Mus musculus
gataaaactatctgatcttccctcc

SEQ ID NO: 661960 - DNA, 25 bp, Mus musculus
gataaaagatcgcttcatggccccg

SEQ ID NO: 661961 - DNA, 25 bp, Mus musculus
gataaaagatcggttcatggccccg

SEQ ID NO: 661962 - DNA, 25 bp, Mus musculus
gataaaagctttcctaacgccacaa

SEQ ID NO: 661963 - DNA, 25 bp, Mus musculus
gataaaagctttgctaacgccacaa

SEQ ID NO: 661964 - DNA, 25 bp, Mus musculus
gataaaataaccaatggttctcgaa

SEQ ID NO: 661965 - DNA, 25 bp, Mus musculus
gataaaataacctatggttctcgaa

SEQ ID NO: 661966 - DNA, 25 bp, Mus musculus
gataaaatgtcacccaggtagcctc

SEQ ID NO: 661967 - DNA, 25 bp, Mus musculus
gataaaatgtcagccaggtagcctc

SEQ ID NO: 661968 - DNA, 25 bp, Mus musculus
gataaaattcttctctttcgccacg

SEQ ID NO: 661969 - DNA, 25 bp, Mus musculus
gataaaattcttgtctttcgccacg

SEQ ID NO: 661970 - DNA, 25 bp, Mus musculus
gataaacaagcaaccttgattcctg

SEQ ID NO: 661971 - DNA, 25 bp, Mus musculus
gataaacaagcatccttgattcctg

SEQ ID NO: 661972 - DNA, 25 bp, Mus musculus
gataaacaatagctaggacaccatt

SEQ ID NO: 661973 - DNA, 25 bp, Mus musculus
gataaacaataggtaggacaccatt

SEQ ID NO: 661974 - DNA, 25 bp, Mus musculus
gataaacaatggctccagccaggca

SEQ ID NO: 661975 - DNA, 25 bp, Mus musculus
gataaacaatgggtccagccaggca

SEQ ID NO: 661976 - DNA, 25 bp, Mus musculus
gataaacacctgcaagaaggccggc

SEQ ID NO: 661977 - DNA, 25 bp, Mus musculus
gataaacacctggaagaaggccggc

SEQ ID NO: 661978 - DNA, 25 bp, Mus musculus
gataaacacgtgcatgtgtcatcta

SEQ ID NO: 661979 - DNA, 25 bp, Mus musculus
gataaacacgtggatgtgtcatcta

SEQ ID NO: 661980 - DNA, 25 bp, Mus musculus
gataaacagaataagcacaccagct

SEQ ID NO: 661981 - DNA, 25 bp, Mus musculus
gataaacagaattagcacaccagct

SEQ ID NO: 661982 - DNA, 25 bp, Mus musculus
gataaacagtaaaggcggaggctgc

SEQ ID NO: 661983 - DNA, 25 bp, Mus musculus
gataaacagtaatggcggaggctgc

SEQ ID NO: 661984 - DNA, 25 bp, Mus musculus
gataaacattacagccactgccagg

SEQ ID NO: 661985 - DNA, 25 bp, Mus musculus
gataaacattactgccactgccagg

SEQ ID NO: 661986 - DNA, 25 bp, Mus musculus
gataaaccaagactctgagatccag

SEQ ID NO: 661987 - DNA, 25 bp, Mus musculus
gataaaccaagagtctgagatccag

SEQ ID NO: 661988 - DNA, 25 bp, Mus musculus
gataaaccattaagcccgtgcaggc

SEQ ID NO: 661989 - DNA, 25 bp, Mus musculus
gataaaccattatgcccgtgcaggc

SEQ ID NO: 661990 - DNA, 25 bp, Mus musculus
gataaaccgaatagagcgagccact

SEQ ID NO: 661991 - DNA, 25 bp, Mus musculus
gataaaccgaattgagcgagccact

SEQ ID NO: 661992 - DNA, 25 bp, Mus musculus
gataaacctgcaaactatcctacta

SEQ ID NO: 661993 - DNA, 25 bp, Mus musculus
gataaacctgcatactatcctacta

SEQ ID NO: 661994 - DNA, 25 bp, Mus musculus
gataaacgttggagcctggcattct

SEQ ID NO: 661995 - DNA, 25 bp, Mus musculus
gataaacgttggtgcctggcattct

SEQ ID NO: 661996 - DNA, 25 bp, Mus musculus
gataaactaaagacgctaaatgtga

SEQ ID NO: 661997 - DNA, 25 bp, Mus musculus
gataaactaaagtcgctaaatgtga

SEQ ID NO: 661998 - DNA, 25 bp, Mus musculus
gataaactgtagcaagtctgacctt

SEQ ID NO: 661999 - DNA, 25 bp, Mus musculus
gataaactgtaggaagtctgacctt

SEQ ID NO: 662000 - DNA, 25 bp, Mus musculus
gataaacttggtcaccaaatggcca

SEQ ID NO: 662001 - DNA, 25 bp, Mus musculus
gataaacttggtgaccaaatggcca

SEQ ID NO: 662002 - DNA, 25 bp, Mus musculus
gataaagaaaaccatgaaacacagc

SEQ ID NO: 662003 - DNA, 25 bp, Mus musculus
gataaagaaaacgatgaaacacagc

SEQ ID NO: 662004 - DNA, 25 bp, Mus musculus
gataaagaacaaaccggccagtcct

SEQ ID NO: 662005 - DNA, 25 bp, Mus musculus
gataaagaacaatccggccagtcct

SEQ ID NO: 662006 - DNA, 25 bp, Mus musculus
gataaagaataccttgcccaagtct

SEQ ID NO: 662007 - DNA, 25 bp, Mus musculus
gataaagaatacgttgcccaagtct

SEQ ID NO: 662008 - DNA, 25 bp, Mus musculus
gataaagacagaaagggcaaaagag

SEQ ID NO: 662009 - DNA, 25 bp, Mus musculus
gataaagacagatagggcaaaagag

SEQ ID NO: 662010 - DNA, 25 bp, Mus musculus
gataaagactccagatactgccctt

SEQ ID NO: 662011 - DNA, 25 bp, Mus musculus
gataaagactcctgatactgccctt

SEQ ID NO: 662012 - DNA, 25 bp, Mus musculus
gataaagagggaacccaagccgtga

SEQ ID NO: 662013 - DNA, 25 bp, Mus musculus
gataaagagggatcccaagccgtga

SEQ ID NO: 662014 - DNA, 25 bp, Mus musculus
gataaagagtgaagctgaacttgag

SEQ ID NO: 662015 - DNA, 25 bp, Mus musculus
gataaagagtgactacagcttctca

SEQ ID NO: 662016 - DNA, 25 bp, Mus musculus
gataaagagtgagtacagcttctca

SEQ ID NO: 662017 - DNA, 25 bp, Mus musculus
gataaagagtgatgctgaacttgag

SEQ ID NO: 662018 - DNA, 25 bp, Mus musculus
gataaagagttcagccctggtgatt

SEQ ID NO: 662019 - DNA, 25 bp, Mus musculus
gataaagagttctgccctggtgatt

SEQ ID NO: 662020 - DNA, 25 bp, Mus musculus
gataaagatgtgaccaggtcttcac

SEQ ID NO: 662021 - DNA, 25 bp, Mus musculus
gataaagatgtgtccaggtcttcac

SEQ ID NO: 662022 - DNA, 25 bp, Mus musculus
gataaagccaagaactacgaggagg

SEQ ID NO: 662023 - DNA, 25 bp, Mus musculus
gataaagccaagtactacgaggagg

SEQ ID NO: 662024 - DNA, 25 bp, Mus musculus
gataaagccaataacctgtcccaag

SEQ ID NO: 662025 - DNA, 25 bp, Mus musculus
gataaagccaattacctgtcccaag

SEQ ID NO: 662026 - DNA, 25 bp, Mus musculus
gataaagccataaggattgctggta

SEQ ID NO: 662027 - DNA, 25 bp, Mus musculus
gataaagccatatggattgctggta

SEQ ID NO: 662028 - DNA, 25 bp, Mus musculus
gataaagcctatccaaccctgaagc

SEQ ID NO: 662029 - DNA, 25 bp, Mus musculus
gataaagcctatgcaaccctgaagc

SEQ ID NO: 662030 - DNA, 25 bp, Mus musculus
gataaagctgaccacgcccgggact

SEQ ID NO: 662031 - DNA, 25 bp, Mus musculus
gataaagctgacgacgcccgggact

SEQ ID NO: 662032 - DNA, 25 bp, Mus musculus
gataaaggacccagatgctgccaag

SEQ ID NO: 662033 - DNA, 25 bp, Mus musculus
gataaaggaccctgatgctgccaag

SEQ ID NO: 662034 - DNA, 25 bp, Mus musculus
gataaaggagaacgaagctaaacac

SEQ ID NO: 662035 - DNA, 25 bp, Mus musculus
gataaaggagaaggaagctaaacac

SEQ ID NO: 662036 - DNA, 25 bp, Mus musculus
gataaaggatttaggtgccagggcc

SEQ ID NO: 662037 - DNA, 25 bp, Mus musculus
gataaaggattttggtgccagggcc

SEQ ID NO: 662038 - DNA, 25 bp, Mus musculus
gataaaggcaaaacaggatgaagtc

SEQ ID NO: 662039 - DNA, 25 bp, Mus musculus
gataaaggcaaatcaggatgaagtc

SEQ ID NO: 662040 - DNA, 25 bp, Mus musculus
gataaaggctataccctggcactcc

SEQ ID NO: 662041 - DNA, 25 bp, Mus musculus
gataaaggctattccctggcactcc

SEQ ID NO: 662042 - DNA, 25 bp, Mus musculus
gataaaggctccattcagaagtttg

SEQ ID NO: 662043 - DNA, 25 bp, Mus musculus
gataaaggctcctttcagaagtttg

SEQ ID NO: 662044 - DNA, 25 bp, Mus musculus
gataaaggtgatcactaacatgaca

SEQ ID NO: 662045 - DNA, 25 bp, Mus musculus
gataaaggtgatgactaacatgaca

SEQ ID NO: 662046 - DNA, 25 bp, Mus musculus
gataaagtatccagtgtagccagct

SEQ ID NO: 662047 - DNA, 25 bp, Mus musculus
gataaagtatcctgtgtagccagct

SEQ ID NO: 662048 - DNA, 25 bp, Mus musculus
gataaagtccagagtttcttgaagg

SEQ ID NO: 662049 - DNA, 25 bp, Mus musculus
gataaagtccagtgtttcttgaagg

SEQ ID NO: 662050 - DNA, 25 bp, Mus musculus
gataaagtctgccttctcggctgtg

SEQ ID NO: 662051 - DNA, 25 bp, Mus musculus
gataaagtctgcgttctcggctgtg

SEQ ID NO: 662052 - DNA, 25 bp, Mus musculus
gataaagtggagagaagagagcccc

SEQ ID NO: 662053 - DNA, 25 bp, Mus musculus
gataaagtggagtgaagagagcccc

SEQ ID NO: 662054 - DNA, 25 bp, Mus musculus
gataaagttaccatcttcagtctta

SEQ ID NO: 662055 - DNA, 25 bp, Mus musculus
gataaagttaccttcttcagtctta

SEQ ID NO: 662056 - DNA, 25 bp, Mus musculus
gataaagtttgaaagtatgttgcca

SEQ ID NO: 662057 - DNA, 25 bp, Mus musculus
gataaagtttgatagtatgttgcca

SEQ ID NO: 662058 - DNA, 25 bp, Mus musculus
gataaataacccaacactggcctca

SEQ ID NO: 662059 - DNA, 25 bp, Mus musculus
gataaataaccctacactggcctca

SEQ ID NO: 662060 - DNA, 25 bp, Mus musculus
gataaatgacaccatggagcttcga

SEQ ID NO: 662061 - DNA, 25 bp, Mus musculus
gataaatgacacgatggagcttcga

SEQ ID NO: 662062 - DNA, 25 bp, Mus musculus
gataaatgactgaggactagtgagc

SEQ ID NO: 662063 - DNA, 25 bp, Mus musculus
gataaatgactgtggactagtgagc

SEQ ID NO: 662064 - DNA, 25 bp, Mus musculus
gataaatgtatgataagctcctgga

SEQ ID NO: 662065 - DNA, 25 bp, Mus musculus
gataaatgtatgttaagctcctgga

SEQ ID NO: 662066 - DNA, 25 bp, Mus musculus
gataaattccttctgcggcggagag

SEQ ID NO: 662067 - DNA, 25 bp, Mus musculus
gataaattccttgtgcggcggagag

SEQ ID NO: 662068 - DNA, 25 bp, Mus musculus
gataaattcgttcattagctctcac

SEQ ID NO: 662069 - DNA, 25 bp, Mus musculus
gataaattcgttgattagctctcac

SEQ ID NO: 662070 - DNA, 25 bp, Mus musculus
gataaattgaatagggatcttcaca

SEQ ID NO: 662071 - DNA, 25 bp, Mus musculus
gataaattgaattgggatcttcaca

SEQ ID NO: 662072 - DNA, 25 bp, Mus musculus
gataaattgtggcttccccggtgtc

SEQ ID NO: 662073 - DNA, 25 bp, Mus musculus
gataaattgtgggttccccggtgtc

SEQ ID NO: 662074 - DNA, 25 bp, Mus musculus
gataaatttccaaggtaaaaagctg

SEQ ID NO: 662075 - DNA, 25 bp, Mus musculus
gataaatttccatggtaaaaagctg

SEQ ID NO: 662076 - DNA, 25 bp, Mus musculus
gataacaacgcgactgtcctcaaca

SEQ ID NO: 662077 - DNA, 25 bp, Mus musculus
gataacaacgcgtctgtcctcaaca

SEQ ID NO: 662078 - DNA, 25 bp, Mus musculus
gataacaactctcgcttgtggcaga

SEQ ID NO: 662079 - DNA, 25 bp, Mus musculus
gataacaactctggcttgtggcaga

SEQ ID NO: 662080 - DNA, 25 bp, Mus musculus
gataacaagtaaacgggtgtctcca

SEQ ID NO: 662081 - DNA, 25 bp, Mus musculus
gataacaagtaatcgggtgtctcca

SEQ ID NO: 662082 - DNA, 25 bp, Mus musculus
gataacaagttgacacatacggacc

SEQ ID NO: 662083 - DNA, 25 bp, Mus musculus
gataacaagttgtcacatacggacc

SEQ ID NO: 662084 - DNA, 25 bp, Mus musculus
gataacaatacacctctcttgctct

SEQ ID NO: 662085 - DNA, 25 bp, Mus musculus
gataacaatacagctctcttgctct

SEQ ID NO: 662086 - DNA, 25 bp, Mus musculus
gataacagcaagattccccaggtgc

SEQ ID NO: 662087 - DNA, 25 bp, Mus musculus
gataacagcaagtttccccaggtgc

SEQ ID NO: 662088 - DNA, 25 bp, Mus musculus
gataacagcaggaataatgaatata

SEQ ID NO: 662089 - DNA, 25 bp, Mus musculus
gataacagcaggtataatgaatata

SEQ ID NO: 662090 - DNA, 25 bp, Mus musculus
gataacagcttccagcagtttatta

SEQ ID NO: 662091 - DNA, 25 bp, Mus musculus
gataacagcttcgagcagtttatta

SEQ ID NO: 662092 - DNA, 25 bp, Mus musculus
gataacatcaaacaagaattagcca

SEQ ID NO: 662093 - DNA, 25 bp, Mus musculus
gataacatcaaagaagaattagcca

SEQ ID NO: 662094 - DNA, 25 bp, Mus musculus
gataacatgcatcagaggcttggag

SEQ ID NO: 662095 - DNA, 25 bp, Mus musculus
gataacatgcatgagaggcttggag

SEQ ID NO: 662096 - DNA, 25 bp, Mus musculus
gataacatggagatggtcaaagccc

SEQ ID NO: 662097 - DNA, 25 bp, Mus musculus
gataacatggagttggtcaaagccc

SEQ ID NO: 662098 - DNA, 25 bp, Mus musculus
gataacatgggcattgcctgcgctc

SEQ ID NO: 662099 - DNA, 25 bp, Mus musculus
gataacatgggctttgcctgcgctc

SEQ ID NO: 662100 - DNA, 25 bp, Mus musculus
gataacattccacggtgaaggagac

SEQ ID NO: 662101 - DNA, 25 bp, Mus musculus
gataacattccagggtgaaggagac

SEQ ID NO: 662102 - DNA, 25 bp, Mus musculus
gataacattgctattactccacttg

SEQ ID NO: 662103 - DNA, 25 bp, Mus musculus
gataacattgcttttactccacttg

SEQ ID NO: 662104 - DNA, 25 bp, Mus musculus
gataaccaaatgagccgtgatgtat

SEQ ID NO: 662105 - DNA, 25 bp, Mus musculus
gataaccaaatgtgccgtgatgtat

SEQ ID NO: 662106 - DNA, 25 bp, Mus musculus
gataaccacgaaatgactaatcagg

SEQ ID NO: 662107 - DNA, 25 bp, Mus musculus
gataaccacgaattgactaatcagg

SEQ ID NO: 662108 - DNA, 25 bp, Mus musculus
gataaccagcctagttacagaggaa

SEQ ID NO: 662109 - DNA, 25 bp, Mus musculus
gataaccagccttgttacagaggaa

SEQ ID NO: 662110 - DNA, 25 bp, Mus musculus
gataaccagtagctttcaggtaggg

SEQ ID NO: 662111 - DNA, 25 bp, Mus musculus
gataaccagtaggtttcaggtaggg

SEQ ID NO: 662112 - DNA, 25 bp, Mus musculus
gataacccactgcattggacaatat

SEQ ID NO: 662113 - DNA, 25 bp, Mus musculus
gataacccactggattggacaatat

SEQ ID NO: 662114 - DNA, 25 bp, Mus musculus
gataaccctagacgacattaatgac

SEQ ID NO: 662115 - DNA, 25 bp, Mus musculus
gataaccctagaggacattaatgac

SEQ ID NO: 662116 - DNA, 25 bp, Mus musculus
gataaccctcgtcggaagaactcca

SEQ ID NO: 662117 - DNA, 25 bp, Mus musculus
gataaccctcgtgggaagaactcca

SEQ ID NO: 662118 - DNA, 25 bp, Mus musculus
gataaccggaagagagagtccaatt

SEQ ID NO: 662119 - DNA, 25 bp, Mus musculus
gataaccggaagtgagagtccaatt

SEQ ID NO: 662120 - DNA, 25 bp, Mus musculus
gataacctcatcaatagacaaccag

SEQ ID NO: 662121 - DNA, 25 bp, Mus musculus
gataacctcatctatagacaaccag

SEQ ID NO: 662122 - DNA, 25 bp, Mus musculus
gataacctgatgctcactccagccg

SEQ ID NO: 662123 - DNA, 25 bp, Mus musculus
gataacctgatggtcactccagccg

SEQ ID NO: 662124 - DNA, 25 bp, Mus musculus
gataacctgctgcaggtgtctgccc

SEQ ID NO: 662125 - DNA, 25 bp, Mus musculus
gataacctgctggaggtgtctgccc

SEQ ID NO: 662126 - DNA, 25 bp, Mus musculus
gataacctgggcactctgacacaca

SEQ ID NO: 662127 - DNA, 25 bp, Mus musculus
gataacctgggctctctgacacaca

SEQ ID NO: 662128 - DNA, 25 bp, Mus musculus
gataaccttctgctttaaggaacag

SEQ ID NO: 662129 - DNA, 25 bp, Mus musculus
gataaccttctggtttaaggaacag

SEQ ID NO: 662130 - DNA, 25 bp, Mus musculus
gataaccttgatactcggctgccca

SEQ ID NO: 662131 - DNA, 25 bp, Mus musculus
gataaccttgattctcggctgccca

SEQ ID NO: 662132 - DNA, 25 bp, Mus musculus
gataacgactgcagtctctccgagt

SEQ ID NO: 662133 - DNA, 25 bp, Mus musculus
gataacgactgctgtctctccgagt

SEQ ID NO: 662134 - DNA, 25 bp, Mus musculus
gataacgcctgactcctgaattgct

SEQ ID NO: 662135 - DNA, 25 bp, Mus musculus
gataacgcctgagtcctgaattgct

SEQ ID NO: 662136 - DNA, 25 bp, Mus musculus
gataacgctaacagcaacaatactt

SEQ ID NO: 662137 - DNA, 25 bp, Mus musculus
gataacgctaactgcaacaatactt

SEQ ID NO: 662138 - DNA, 25 bp, Mus musculus
gataacgtaatgaagatcgcagact

SEQ ID NO: 662139 - DNA, 25 bp, Mus musculus
gataacgtaatgtagatcgcagact

SEQ ID NO: 662140 - DNA, 25 bp, Mus musculus
gataacgtcaccattcccgtgttga

SEQ ID NO: 662141 - DNA, 25 bp, Mus musculus
gataacgtcacctttcccgtgttga

SEQ ID NO: 662142 - DNA, 25 bp, Mus musculus
gataactaccagaacacctcaactg

SEQ ID NO: 662143 - DNA, 25 bp, Mus musculus
gataactaccagtacacctcaactg

SEQ ID NO: 662144 - DNA, 25 bp, Mus musculus
gataactaccatctggcccggagga

SEQ ID NO: 662145 - DNA, 25 bp, Mus musculus
gataactaccatgtggcccggagga

SEQ ID NO: 662146 - DNA, 25 bp, Mus musculus
gataactactccaatgaactctcga

SEQ ID NO: 662147 - DNA, 25 bp, Mus musculus
gataactactcctatgaactctcga

SEQ ID NO: 662148 - DNA, 25 bp, Mus musculus
gataactcaaatcatgggacccatc

SEQ ID NO: 662149 - DNA, 25 bp, Mus musculus
gataactcaaatgatgggacccatc

SEQ ID NO: 662150 - DNA, 25 bp, Mus musculus
gataactgcaaacacggaaaacggg

SEQ ID NO: 662151 - DNA, 25 bp, Mus musculus
gataactgcaaagacggaaaacggg

SEQ ID NO: 662152 - DNA, 25 bp, Mus musculus
gataactgccttaaacgatggcctg

SEQ ID NO: 662153 - DNA, 25 bp, Mus musculus
gataactgcctttaacgatggcctg

SEQ ID NO: 662154 - DNA, 25 bp, Mus musculus
gataactgcggtctctgctcaacag

SEQ ID NO: 662155 - DNA, 25 bp, Mus musculus
gataactgcggtgtctgctcaacag

SEQ ID NO: 662156 - DNA, 25 bp, Mus musculus
gataacttcatacctgcctgcacag

SEQ ID NO: 662157 - DNA, 25 bp, Mus musculus
gataacttcatagctgcctgcacag

SEQ ID NO: 662158 - DNA, 25 bp, Mus musculus
gataacttccacaaccaacacagtt

SEQ ID NO: 662159 - DNA, 25 bp, Mus musculus
gataacttccactaccaacacagtt

SEQ ID NO: 662160 - DNA, 25 bp, Mus musculus
gataactttaacagagttgtcaggt

SEQ ID NO: 662161 - DNA, 25 bp, Mus musculus
gataactttaactgagttgtcaggt

SEQ ID NO: 662162 - DNA, 25 bp, Mus musculus
gataagaaaccaccaatttgtaaaa

SEQ ID NO: 662163 - DNA, 25 bp, Mus musculus
gataagaaaccagcaatttgtaaaa

SEQ ID NO: 662164 - DNA, 25 bp, Mus musculus
gataagaaacgcagagttgtagaca

SEQ ID NO: 662165 - DNA, 25 bp, Mus musculus
gataagaaacgctgagttgtagaca

SEQ ID NO: 662166 - DNA, 25 bp, Mus musculus
gataagaaacttaccgaggctgacg

SEQ ID NO: 662167 - DNA, 25 bp, Mus musculus
gataagaaactttccgaggctgacg

SEQ ID NO: 662168 - DNA, 25 bp, Mus musculus
gataagaaagaactattccggcctc

SEQ ID NO: 662169 - DNA, 25 bp, Mus musculus
gataagaaagaagtattccggcctc

SEQ ID NO: 662170 - DNA, 25 bp, Mus musculus
gataagaaatggcttctcaatcatg

SEQ ID NO: 662171 - DNA, 25 bp, Mus musculus
gataagaaatgggttctcaatcatg

SEQ ID NO: 662172 - DNA, 25 bp, Mus musculus
gataagaacatgcttgccctccgtg

SEQ ID NO: 662173 - DNA, 25 bp, Mus musculus
gataagaacatggttgccctccgtg

SEQ ID NO: 662174 - DNA, 25 bp, Mus musculus
gataagacatatcaacccacaaaca

SEQ ID NO: 662175 - DNA, 25 bp, Mus musculus
gataagacatatgaacccacaaaca

SEQ ID NO: 662176 - DNA, 25 bp, Mus musculus
gataagaccatcaggtgggctactg

SEQ ID NO: 662177 - DNA, 25 bp, Mus musculus
gataagaccatctggtgggctactg

SEQ ID NO: 662178 - DNA, 25 bp, Mus musculus
gataagaccgttattatgcaaatgt

SEQ ID NO: 662179 - DNA, 25 bp, Mus musculus
gataagaccgtttttatgcaaatgt

SEQ ID NO: 662180 - DNA, 25 bp, Mus musculus
gataagactcatcgaaatgcttaga

SEQ ID NO: 662181 - DNA, 25 bp, Mus musculus
gataagactcatggaaatgcttaga

SEQ ID NO: 662182 - DNA, 25 bp, Mus musculus
gataagaggaagaaccttgtgccct

SEQ ID NO: 662183 - DNA, 25 bp, Mus musculus
gataagaggaagtaccttgtgccct

SEQ ID NO: 662184 - DNA, 25 bp, Mus musculus
gataagagtgaaatgtgtctgacag

SEQ ID NO: 662185 - DNA, 25 bp, Mus musculus
gataagagtgaattgtgtctgacag

SEQ ID NO: 662186 - DNA, 25 bp, Mus musculus
gataagagttccatggtcccaaggt

SEQ ID NO: 662187 - DNA, 25 bp, Mus musculus
gataagagttccttggtcccaaggt

SEQ ID NO: 662188 - DNA, 25 bp, Mus musculus
gataagatcatacaagaaggcagag

SEQ ID NO: 662189 - DNA, 25 bp, Mus musculus
gataagatcatagaagaaggcagag

SEQ ID NO: 662190 - DNA, 25 bp, Mus musculus
gataagatctggcttaaagagggac

SEQ ID NO: 662191 - DNA, 25 bp, Mus musculus
gataagatctgggttaaagagggac

SEQ ID NO: 662192 - DNA, 25 bp, Mus musculus
gataagatgcagcaaaccccagaca

SEQ ID NO: 662193 - DNA, 25 bp, Mus musculus
gataagatgcaggaaaccccagaca

SEQ ID NO: 662194 - DNA, 25 bp, Mus musculus
gataagatgcccaaaaagggaggaa

SEQ ID NO: 662195 - DNA, 25 bp, Mus musculus
gataagatgccctaaaagggaggaa

SEQ ID NO: 662196 - DNA, 25 bp, Mus musculus
gataagattatcagctgtttcaaac

SEQ ID NO: 662197 - DNA, 25 bp, Mus musculus
gataagattatctgctgtttcaaac

SEQ ID NO: 662198 - DNA, 25 bp, Mus musculus
gataagatttccaccaagatccaag

SEQ ID NO: 662199 - DNA, 25 bp, Mus musculus
gataagatttcctccaagatccaag

SEQ ID NO: 662200 - DNA, 25 bp, Mus musculus
gataagcacgaaatgctcagtcttg

SEQ ID NO: 662201 - DNA, 25 bp, Mus musculus
gataagcacgaattgctcagtcttg

SEQ ID NO: 662202 - DNA, 25 bp, Mus musculus
gataagcatgacagccgagttctac

SEQ ID NO: 662203 - DNA, 25 bp, Mus musculus
gataagcatgactgccgagttctac

SEQ ID NO: 662204 - DNA, 25 bp, Mus musculus
gataagccagtgaagtgccatcagt

SEQ ID NO: 662205 - DNA, 25 bp, Mus musculus
gataagccagtgtagtgccatcagt

SEQ ID NO: 662206 - DNA, 25 bp, Mus musculus
gataagcctcgactccttcctggcg

SEQ ID NO: 662207 - DNA, 25 bp, Mus musculus
gataagcctcgagtccttcctggcg

SEQ ID NO: 662208 - DNA, 25 bp, Mus musculus
gataagcctgagaagaggatcccct

SEQ ID NO: 662209 - DNA, 25 bp, Mus musculus
gataagcctgagtagaggatcccct

SEQ ID NO: 662210 - DNA, 25 bp, Mus musculus
gataagcgaataagaatagggaaag

SEQ ID NO: 662211 - DNA, 25 bp, Mus musculus
gataagcgaatatgaatagggaaag

SEQ ID NO: 662212 - DNA, 25 bp, Mus musculus
gataagcgtcttctacctggaggtg

SEQ ID NO: 662213 - DNA, 25 bp, Mus musculus
gataagcgtcttgtacctggaggtg

SEQ ID NO: 662214 - DNA, 25 bp, Mus musculus
gataagctaaggatcctcccctgct

SEQ ID NO: 662215 - DNA, 25 bp, Mus musculus
gataagctaaggttcctcccctgct

SEQ ID NO: 662216 - DNA, 25 bp, Mus musculus
gataagctctatctctcgtgggtgg

SEQ ID NO: 662217 - DNA, 25 bp, Mus musculus
gataagctctatgtctcgtgggtgg

SEQ ID NO: 662218 - DNA, 25 bp, Mus musculus
gataagctctggatctttgctggtt

SEQ ID NO: 662219 - DNA, 25 bp, Mus musculus
gataagctctggttctttgctggtt

SEQ ID NO: 662220 - DNA, 25 bp, Mus musculus
gataagctctttcgattactggtga

SEQ ID NO: 662221 - DNA, 25 bp, Mus musculus
gataagctctttggattactggtga

SEQ ID NO: 662222 - DNA, 25 bp, Mus musculus
gataagctgtaccagcggaaagagc

SEQ ID NO: 662223 - DNA, 25 bp, Mus musculus
gataagctgtacgagcggaaagagc

SEQ ID NO: 662224 - DNA, 25 bp, Mus musculus
gataagcttatcagcgtggaggacc

SEQ ID NO: 662225 - DNA, 25 bp, Mus musculus
gataagcttatctgcgtggaggacc

SEQ ID NO: 662226 - DNA, 25 bp, Mus musculus
gataaggaatgcaaaaaatacttct

SEQ ID NO: 662227 - DNA, 25 bp, Mus musculus
gataaggaatgctaaaaatacttct

SEQ ID NO: 662228 - DNA, 25 bp, Mus musculus
gataaggaattgaatgtccgctatc

SEQ ID NO: 662229 - DNA, 25 bp, Mus musculus
gataaggaattgtatgtccgctatc

SEQ ID NO: 662230 - DNA, 25 bp, Mus musculus
gataaggacacacgatgaaagacgt

SEQ ID NO: 662231 - DNA, 25 bp, Mus musculus
gataaggacacaggatgaaagacgt

SEQ ID NO: 662232 - DNA, 25 bp, Mus musculus
gataaggatcagagcattgcaccca

SEQ ID NO: 662233 - DNA, 25 bp, Mus musculus
gataaggatcagtgcattgcaccca

SEQ ID NO: 662234 - DNA, 25 bp, Mus musculus
gataaggattcaacagattggacca

SEQ ID NO: 662235 - DNA, 25 bp, Mus musculus
gataaggattcatcagattggacca

SEQ ID NO: 662236 - DNA, 25 bp, Mus musculus
gataaggcgcttcaggactatcgca

SEQ ID NO: 662237 - DNA, 25 bp, Mus musculus
gataaggcgcttgaggactatcgca

SEQ ID NO: 662238 - DNA, 25 bp, Mus musculus
gataaggctggtacatggacacctg

SEQ ID NO: 662239 - DNA, 25 bp, Mus musculus
gataaggctggttcatggacacctg

SEQ ID NO: 662240 - DNA, 25 bp, Mus musculus
gataagggctatccaaatcatctac

SEQ ID NO: 662241 - DNA, 25 bp, Mus musculus
gataagggctatgcaaatcatctac

SEQ ID NO: 662242 - DNA, 25 bp, Mus musculus
gataagggtgcacatgagagtaccc

SEQ ID NO: 662243 - DNA, 25 bp, Mus musculus
gataagggtgcagatgagagtaccc

SEQ ID NO: 662244 - DNA, 25 bp, Mus musculus
gataaggttatcagtcccagtagcc

SEQ ID NO: 662245 - DNA, 25 bp, Mus musculus
gataaggttatctgtcccagtagcc

SEQ ID NO: 662246 - DNA, 25 bp, Mus musculus
gataagtcagcgaatgtgtcagagg

SEQ ID NO: 662247 - DNA, 25 bp, Mus musculus
gataagtcagcgtatgtgtcagagg

SEQ ID NO: 662248 - DNA, 25 bp, Mus musculus
gataagtcctaaagaccactgaaaa

SEQ ID NO: 662249 - DNA, 25 bp, Mus musculus
gataagtcctaatgaccactgaaaa

SEQ ID NO: 662250 - DNA, 25 bp, Mus musculus
gataagtctcttcttcaccgtgatt

SEQ ID NO: 662251 - DNA, 25 bp, Mus musculus
gataagtctcttgttcaccgtgatt

SEQ ID NO: 662252 - DNA, 25 bp, Mus musculus
gataagtgaacaaagacttaggtta

SEQ ID NO: 662253 - DNA, 25 bp, Mus musculus
gataagtgaacatagacttaggtta

SEQ ID NO: 662254 - DNA, 25 bp, Mus musculus
gataagtgatggagtgcgctagccc

SEQ ID NO: 662255 - DNA, 25 bp, Mus musculus
gataagtgatggtgtgcgctagccc

SEQ ID NO: 662256 - DNA, 25 bp, Mus musculus
gataagtgcttgatctgctcgtggc

SEQ ID NO: 662257 - DNA, 25 bp, Mus musculus
gataagtgcttgttctgctcgtggc

SEQ ID NO: 662258 - DNA, 25 bp, Mus musculus
gataagtgctttcacgtttctcaag

SEQ ID NO: 662259 - DNA, 25 bp, Mus musculus
gataagtgctttgacgtttctcaag

SEQ ID NO: 662260 - DNA, 25 bp, Mus musculus
gataagtgttctcccttcacatagg

SEQ ID NO: 662261 - DNA, 25 bp, Mus musculus
gataagtgttctgccttcacatagg

SEQ ID NO: 662262 - DNA, 25 bp, Mus musculus
gataataagaaaatggtgactcggc

SEQ ID NO: 662263 - DNA, 25 bp, Mus musculus
gataataagaaattggtgactcggc

SEQ ID NO: 662264 - DNA, 25 bp, Mus musculus
gataataccagacaagaattcactt

SEQ ID NO: 662265 - DNA, 25 bp, Mus musculus
gataataccagagaagaattcactt

SEQ ID NO: 662266 - DNA, 25 bp, Mus musculus
gataatacggagcatgagtcaagtc

SEQ ID NO: 662267 - DNA, 25 bp, Mus musculus
gataatacggaggatgagtcaagtc

SEQ ID NO: 662268 - DNA, 25 bp, Mus musculus
gataatactctccagctgtgccctg

SEQ ID NO: 662269 - DNA, 25 bp, Mus musculus
gataatactctcgagctgtgccctg

SEQ ID NO: 662270 - DNA, 25 bp, Mus musculus
gataatatcaaacacgtcccgggtg

SEQ ID NO: 662271 - DNA, 25 bp, Mus musculus
gataatatcaaagacgtcccgggtg

SEQ ID NO: 662272 - DNA, 25 bp, Mus musculus
gataatatcacccacgtccctggag

SEQ ID NO: 662273 - DNA, 25 bp, Mus musculus
gataatatcaccgacgtccctggag

SEQ ID NO: 662274 - DNA, 25 bp, Mus musculus
gataatatctcactgaacctgtttg

SEQ ID NO: 662275 - DNA, 25 bp, Mus musculus
gataatatctcagtgaacctgtttg

SEQ ID NO: 662276 - DNA, 25 bp, Mus musculus
gataatatgcaacatgcatactggg

SEQ ID NO: 662277 - DNA, 25 bp, Mus musculus
gataatatgcaagatgcatactggg

SEQ ID NO: 662278 - DNA, 25 bp, Mus musculus
gataatattccacgagggaaggcca

SEQ ID NO: 662279 - DNA, 25 bp, Mus musculus
gataatattccaggagggaaggcca

SEQ ID NO: 662280 - DNA, 25 bp, Mus musculus
gataatattgttcagctcatcaaag

SEQ ID NO: 662281 - DNA, 25 bp, Mus musculus
gataatattgttgagctcatcaaag

SEQ ID NO: 662282 - DNA, 25 bp, Mus musculus
gataatcaacgtccagctctgaagg

SEQ ID NO: 662283 - DNA, 25 bp, Mus musculus
gataatcaacgtgcagctctgaagg

SEQ ID NO: 662284 - DNA, 25 bp, Mus musculus
gataatcactgaacgaactggtgtg

SEQ ID NO: 662285 - DNA, 25 bp, Mus musculus
gataatcactgatcgaactggtgtg

SEQ ID NO: 662286 - DNA, 25 bp, Mus musculus
gataatcagactcgttttctctaaa

SEQ ID NO: 662287 - DNA, 25 bp, Mus musculus
gataatcagactggttttctctaaa

SEQ ID NO: 662288 - DNA, 25 bp, Mus musculus
gataatcagtttagatggctcaaag

SEQ ID NO: 662289 - DNA, 25 bp, Mus musculus
gataatcagttttgatggctcaaag

SEQ ID NO: 662290 - DNA, 25 bp, Mus musculus
gataatcatctgcacgacattcgga

SEQ ID NO: 662291 - DNA, 25 bp, Mus musculus
gataatcatctggacgacattcgga

SEQ ID NO: 662292 - DNA, 25 bp, Mus musculus
gataatcatgaacgcaactctcatc

SEQ ID NO: 662293 - DNA, 25 bp, Mus musculus
gataatcatgaaggcaactctcatc

SEQ ID NO: 662294 - DNA, 25 bp, Mus musculus
gataatccacagctttgtagaaact

SEQ ID NO: 662295 - DNA, 25 bp, Mus musculus
gataatccacaggtttgtagaaact

SEQ ID NO: 662296 - DNA, 25 bp, Mus musculus
gataatccaggcagaccaccgtgga

SEQ ID NO: 662297 - DNA, 25 bp, Mus musculus
gataatccaggctgaccaccgtgga

SEQ ID NO: 662298 - DNA, 25 bp, Mus musculus
gataatccagtcaccgtggcggagg

SEQ ID NO: 662299 - DNA, 25 bp, Mus musculus
gataatccagtctccgtggcggagg

SEQ ID NO: 662300 - DNA, 25 bp, Mus musculus
gataatcccgttagctttcttcgtg

SEQ ID NO: 662301 - DNA, 25 bp, Mus musculus
gataatcccgtttgctttcttcgtg

SEQ ID NO: 662302 - DNA, 25 bp, Mus musculus
gataatcctaacaatcttggccctg

SEQ ID NO: 662303 - DNA, 25 bp, Mus musculus
gataatcctaactatcttggccctg

SEQ ID NO: 662304 - DNA, 25 bp, Mus musculus
gataatcgacgccttggaactggag

SEQ ID NO: 662305 - DNA, 25 bp, Mus musculus
gataatcgacgcgttggaactggag

SEQ ID NO: 662306 - DNA, 25 bp, Mus musculus
gataatcgcaagctcagctttcaca

SEQ ID NO: 662307 - DNA, 25 bp, Mus musculus
gataatcgcaaggtcagctttcaca

SEQ ID NO: 662308 - DNA, 25 bp, Mus musculus
gataatcggacaatcacactgagag

SEQ ID NO: 662309 - DNA, 25 bp, Mus musculus
gataatcggacattcacactgagag

SEQ ID NO: 662310 - DNA, 25 bp, Mus musculus
gataatcggttcagcaacaaacaga

SEQ ID NO: 662311 - DNA, 25 bp, Mus musculus
gataatcggttctgcaacaaacaga

SEQ ID NO: 662312 - DNA, 25 bp, Mus musculus
gataatctccctacggactttgatg

SEQ ID NO: 662313 - DNA, 25 bp, Mus musculus
gataatctcccttcggactttgatg

SEQ ID NO: 662314 - DNA, 25 bp, Mus musculus
gataatgaaaaaatgactgctttgg

SEQ ID NO: 662315 - DNA, 25 bp, Mus musculus
gataatgaaaaattgactgctttgg

SEQ ID NO: 662316 - DNA, 25 bp, Mus musculus
gataatgacacacgtccatggtgct

SEQ ID NO: 662317 - DNA, 25 bp, Mus musculus
gataatgacacaggtccatggtgct

SEQ ID NO: 662318 - DNA, 25 bp, Mus musculus
gataatgagcctccttacttagaca

SEQ ID NO: 662319 - DNA, 25 bp, Mus musculus
gataatgagcctgcttacttagaca

SEQ ID NO: 662320 - DNA, 25 bp, Mus musculus
gataatgatagcctggctgcccggc

SEQ ID NO: 662321 - DNA, 25 bp, Mus musculus
gataatgatagcgtggctgcccggc

SEQ ID NO: 662322 - DNA, 25 bp, Mus musculus
gataatgcagacaccttagcactag

SEQ ID NO: 662323 - DNA, 25 bp, Mus musculus
gataatgcagactccttagcactag

SEQ ID NO: 662324 - DNA, 25 bp, Mus musculus
gataatgcatgcacatgggagacac

SEQ ID NO: 662325 - DNA, 25 bp, Mus musculus
gataatgcatgctcatgggagacac

SEQ ID NO: 662326 - DNA, 25 bp, Mus musculus
gataatgccagacaactccaagaac

SEQ ID NO: 662327 - DNA, 25 bp, Mus musculus
gataatgccagagaactccaagaac

SEQ ID NO: 662328 - DNA, 25 bp, Mus musculus
gataatgcctcaaatctctgctccc

SEQ ID NO: 662329 - DNA, 25 bp, Mus musculus
gataatgcctcatatctctgctccc

SEQ ID NO: 662330 - DNA, 25 bp, Mus musculus
gataatggagggaatgcggctctct

SEQ ID NO: 662331 - DNA, 25 bp, Mus musculus
gataatggagggtatgcggctctct

SEQ ID NO: 662332 - DNA, 25 bp, Mus musculus
gataatggaggtattggccaagcat

SEQ ID NO: 662333 - DNA, 25 bp, Mus musculus
gataatggaggttttggccaagcat

SEQ ID NO: 662334 - DNA, 25 bp, Mus musculus
gataatggcctgcatgattgtgaac

SEQ ID NO: 662335 - DNA, 25 bp, Mus musculus
gataatggcctggatgattgtgaac

SEQ ID NO: 662336 - DNA, 25 bp, Mus musculus
gataatggcgccagtatattttatc

SEQ ID NO: 662337 - DNA, 25 bp, Mus musculus
gataatggcgcctgtatattttatc

SEQ ID NO: 662338 - DNA, 25 bp, Mus musculus
gataatggcttcctgcaaacgtccg

SEQ ID NO: 662339 - DNA, 25 bp, Mus musculus
gataatggcttcgtgcaaacgtccg

SEQ ID NO: 662340 - DNA, 25 bp, Mus musculus
gataatggtgccatgctctgtcagc

SEQ ID NO: 662341 - DNA, 25 bp, Mus musculus
gataatggtgccttgctctgtcagc

SEQ ID NO: 662342 - DNA, 25 bp, Mus musculus
gataatgtacccatggagactagca

SEQ ID NO: 662343 - DNA, 25 bp, Mus musculus
gataatgtacccttggagactagca

SEQ ID NO: 662344 - DNA, 25 bp, Mus musculus
gataattaagtcaccaaagtcggta

SEQ ID NO: 662345 - DNA, 25 bp, Mus musculus
gataattaagtctccaaagtcggta

SEQ ID NO: 662346 - DNA, 25 bp, Mus musculus
gataattacccgatctttacacaga

SEQ ID NO: 662347 - DNA, 25 bp, Mus musculus
gataattacccgttctttacacaga

SEQ ID NO: 662348 - DNA, 25 bp, Mus musculus
gataattagcccaatcccatgtgca

SEQ ID NO: 662349 - DNA, 25 bp, Mus musculus
gataattagccctatcccatgtgca

SEQ ID NO: 662350 - DNA, 25 bp, Mus musculus
gataattagctcacaacatggaaaa

SEQ ID NO: 662351 - DNA, 25 bp, Mus musculus
gataattagctctcaacatggaaaa

SEQ ID NO: 662352 - DNA, 25 bp, Mus musculus
gataattaggacattcttctgctgt

SEQ ID NO: 662353 - DNA, 25 bp, Mus musculus
gataattaggactttcttctgctgt

SEQ ID NO: 662354 - DNA, 25 bp, Mus musculus
gataattattctacccaggaactcg

SEQ ID NO: 662355 - DNA, 25 bp, Mus musculus
gataattattcttcccaggaactcg

SEQ ID NO: 662356 - DNA, 25 bp, Mus musculus
gataattccagtagcggttgcattc

SEQ ID NO: 662357 - DNA, 25 bp, Mus musculus
gataattccagttgcggttgcattc

SEQ ID NO: 662358 - DNA, 25 bp, Mus musculus
gataattcccatagtgaacgggcag

SEQ ID NO: 662359 - DNA, 25 bp, Mus musculus
gataattcccattgtgaacgggcag

SEQ ID NO: 662360 - DNA, 25 bp, Mus musculus
gataattgccggatctgccccggct

SEQ ID NO: 662361 - DNA, 25 bp, Mus musculus
gataattgccggttctgccccggct

SEQ ID NO: 662362 - DNA, 25 bp, Mus musculus
gataattgggacagtgagaaccagg

SEQ ID NO: 662363 - DNA, 25 bp, Mus musculus
gataattgggactgtgagaaccagg

SEQ ID NO: 662364 - DNA, 25 bp, Mus musculus
gataattggttcaccttttaagtga

SEQ ID NO: 662365 - DNA, 25 bp, Mus musculus
gataattggttctccttttaagtga

SEQ ID NO: 662366 - DNA, 25 bp, Mus musculus
gataattgtatgcaaagcacagact

SEQ ID NO: 662367 - DNA, 25 bp, Mus musculus
gataattgtatggaaagcacagact

SEQ ID NO: 662368 - DNA, 25 bp, Mus musculus
gataatttaatgaggattccttcca

SEQ ID NO: 662369 - DNA, 25 bp, Mus musculus
gataatttaatgtggattccttcca

SEQ ID NO: 662370 - DNA, 25 bp, Mus musculus
gataatttggccctcagctttggag

SEQ ID NO: 662371 - DNA, 25 bp, Mus musculus
gataatttggccgtcagctttggag

SEQ ID NO: 662372 - DNA, 25 bp, Mus musculus
gataatttgggaagaaggaggtaca

SEQ ID NO: 662373 - DNA, 25 bp, Mus musculus
gataatttgggatgaaggaggtaca

SEQ ID NO: 662374 - DNA, 25 bp, Mus musculus
gataatttggtcaacggtggacaga

SEQ ID NO: 662375 - DNA, 25 bp, Mus musculus
gataatttggtctacggtggacaga

SEQ ID NO: 662376 - DNA, 25 bp, Mus musculus
gataattttccaagcactttggagg

SEQ ID NO: 662377 - DNA, 25 bp, Mus musculus
gataattttccatgcactttggagg

SEQ ID NO: 662378 - DNA, 25 bp, Mus musculus
gatacaaaactgattccgaaatgca

SEQ ID NO: 662379 - DNA, 25 bp, Mus musculus
gatacaaaactgtttccgaaatgca

SEQ ID NO: 662380 - DNA, 25 bp, Mus musculus
gatacaaaagatccaaagcctttgc

SEQ ID NO: 662381 - DNA, 25 bp, Mus musculus
gatacaaaagatgcaaagcctttgc

SEQ ID NO: 662382 - DNA, 25 bp, Mus musculus
gatacaaaatagagtcctgggaagt

SEQ ID NO: 662383 - DNA, 25 bp, Mus musculus
gatacaaaatagtgtcctgggaagt

SEQ ID NO: 662384 - DNA, 25 bp, Mus musculus
gatacaaacgaactggctctggccc

SEQ ID NO: 662385 - DNA, 25 bp, Mus musculus
gatacaaacgaagtggctctggccc

SEQ ID NO: 662386 - DNA, 25 bp, Mus musculus
gatacaaactctactggagagaggt

SEQ ID NO: 662387 - DNA, 25 bp, Mus musculus
gatacaaactcttctggagagaggt

SEQ ID NO: 662388 - DNA, 25 bp, Mus musculus
gatacaaactttccaccgattggtg

SEQ ID NO: 662389 - DNA, 25 bp, Mus musculus
gatacaaactttgcaccgattggtg

SEQ ID NO: 662390 - DNA, 25 bp, Mus musculus
gatacaaagaaccagaaagaccagt

SEQ ID NO: 662391 - DNA, 25 bp, Mus musculus
gatacaaagaacgagaaagaccagt

SEQ ID NO: 662392 - DNA, 25 bp, Mus musculus
gatacaacttctctccgaagagcgt

SEQ ID NO: 662393 - DNA, 25 bp, Mus musculus
gatacaacttctgtccgaagagcgt

SEQ ID NO: 662394 - DNA, 25 bp, Mus musculus
gatacaagcccgctggttccacatc

SEQ ID NO: 662395 - DNA, 25 bp, Mus musculus
gatacaagcccggtggttccacatc

SEQ ID NO: 662396 - DNA, 25 bp, Mus musculus
gatacaatgccaccagggacgttgt

SEQ ID NO: 662397 - DNA, 25 bp, Mus musculus
gatacaatgccagcagggacgttgt

SEQ ID NO: 662398 - DNA, 25 bp, Mus musculus
gatacaattcaaagctcatatctgg

SEQ ID NO: 662399 - DNA, 25 bp, Mus musculus
gatacaattcaatgctcatatctgg

SEQ ID NO: 662400 - DNA, 25 bp, Mus musculus
gatacaattcatagaaccatccaaa

SEQ ID NO: 662401 - DNA, 25 bp, Mus musculus
gatacaattcattgaaccatccaaa

SEQ ID NO: 662402 - DNA, 25 bp, Mus musculus
gatacacaagtgcttgtttttaagc

SEQ ID NO: 662403 - DNA, 25 bp, Mus musculus
gatacacaagtggttgtttttaagc

SEQ ID NO: 662404 - DNA, 25 bp, Mus musculus
gatacacagataacatcctgtatgt

SEQ ID NO: 662405 - DNA, 25 bp, Mus musculus
gatacacagatatcatcctgtatgt

SEQ ID NO: 662406 - DNA, 25 bp, Mus musculus
gatacacagcgaagctggccctctg

SEQ ID NO: 662407 - DNA, 25 bp, Mus musculus
gatacacagcgatgctggccctctg

SEQ ID NO: 662408 - DNA, 25 bp, Mus musculus
gatacaccaagaagacctcctttct

SEQ ID NO: 662409 - DNA, 25 bp, Mus musculus
gatacaccaagatgacctcctttct

SEQ ID NO: 662410 - DNA, 25 bp, Mus musculus
gatacaccaggacggttgtcaccag

SEQ ID NO: 662411 - DNA, 25 bp, Mus musculus
gatacaccaggagggttgtcaccag

SEQ ID NO: 662412 - DNA, 25 bp, Mus musculus
gatacaccatggaactcactgttgg

SEQ ID NO: 662413 - DNA, 25 bp, Mus musculus
gatacaccatggtactcactgttgg

SEQ ID NO: 662414 - DNA, 25 bp, Mus musculus
gatacaccgatgaggaaagcttcga

SEQ ID NO: 662415 - DNA, 25 bp, Mus musculus
gatacaccgatgtggaaagcttcga

SEQ ID NO: 662416 - DNA, 25 bp, Mus musculus
gatacaccgcatctgccagctctat

SEQ ID NO: 662417 - DNA, 25 bp, Mus musculus
gatacaccgcatgtgccagctctat

SEQ ID NO: 662418 - DNA, 25 bp, Mus musculus
gatacacgattcacattcaacggga

SEQ ID NO: 662419 - DNA, 25 bp, Mus musculus
gatacacgattctcattcaacggga

SEQ ID NO: 662420 - DNA, 25 bp, Mus musculus
gatacactacttctggatgttgaac

SEQ ID NO: 662421 - DNA, 25 bp, Mus musculus
gatacactacttgtggatgttgaac

SEQ ID NO: 662422 - DNA, 25 bp, Mus musculus
gatacactcacaagaaagtggcgga

SEQ ID NO: 662423 - DNA, 25 bp, Mus musculus
gatacactcacatgaaagtggcgga

SEQ ID NO: 662424 - DNA, 25 bp, Mus musculus
gatacactgaagctttgtccacgtg

SEQ ID NO: 662425 - DNA, 25 bp, Mus musculus
gatacactgaaggtttgtccacgtg

SEQ ID NO: 662426 - DNA, 25 bp, Mus musculus
gatacactggaacaagagatttcaa

SEQ ID NO: 662427 - DNA, 25 bp, Mus musculus
gatacactggaagaagagatttcaa

SEQ ID NO: 662428 - DNA, 25 bp, Mus musculus
gatacactggacactttcttggaca

SEQ ID NO: 662429 - DNA, 25 bp, Mus musculus
gatacactggactctttcttggaca

SEQ ID NO: 662430 - DNA, 25 bp, Mus musculus
gatacactggatcctgctttgctgc

SEQ ID NO: 662431 - DNA, 25 bp, Mus musculus
gatacactggatgctgctttgctgc

SEQ ID NO: 662432 - DNA, 25 bp, Mus musculus
gatacactgtgtcaataattacacc

SEQ ID NO: 662433 - DNA, 25 bp, Mus musculus
gatacactgtgtgaataattacacc

SEQ ID NO: 662434 - DNA, 25 bp, Mus musculus
gatacagaaagaatgtacttgtgcc

SEQ ID NO: 662435 - DNA, 25 bp, Mus musculus
gatacagaaagattgtacttgtgcc

SEQ ID NO: 662436 - DNA, 25 bp, Mus musculus
gatacagaaatcacagataaccgag

SEQ ID NO: 662437 - DNA, 25 bp, Mus musculus
gatacagaaatctcagataaccgag

SEQ ID NO: 662438 - DNA, 25 bp, Mus musculus
gatacagaagcacatcactcaggag

SEQ ID NO: 662439 - DNA, 25 bp, Mus musculus
gatacagaagcagatcactcaggag

SEQ ID NO: 662440 - DNA, 25 bp, Mus musculus
gatacagaatgtacctcagctgttg

SEQ ID NO: 662441 - DNA, 25 bp, Mus musculus
gatacagaatgttcctcagctgttg

SEQ ID NO: 662442 - DNA, 25 bp, Mus musculus
gatacagacggaacctcagaaaccc

SEQ ID NO: 662443 - DNA, 25 bp, Mus musculus
gatacagacggatcctcagaaaccc

SEQ ID NO: 662444 - DNA, 25 bp, Mus musculus
gatacagactccagttatgcacgga

SEQ ID NO: 662445 - DNA, 25 bp, Mus musculus
gatacagactcctgttatgcacgga

SEQ ID NO: 662446 - DNA, 25 bp, Mus musculus
gatacagagaaacaggacagatccc

SEQ ID NO: 662447 - DNA, 25 bp, Mus musculus
gatacagagaaagaggacagatccc

SEQ ID NO: 662448 - DNA, 25 bp, Mus musculus
gatacagagcggagccatcatctgc

SEQ ID NO: 662449 - DNA, 25 bp, Mus musculus
gatacagagcggtgccatcatctgc

SEQ ID NO: 662450 - DNA, 25 bp, Mus musculus
gatacagagttcagggataagatgc

SEQ ID NO: 662451 - DNA, 25 bp, Mus musculus
gatacagagttctgggataagatgc

SEQ ID NO: 662452 - DNA, 25 bp, Mus musculus
gatacagcatcactttcattggcaa

SEQ ID NO: 662453 - DNA, 25 bp, Mus musculus
gatacagcatcagtttcattggcaa

SEQ ID NO: 662454 - DNA, 25 bp, Mus musculus
gatacagccaacatgctatcttgga

SEQ ID NO: 662455 - DNA, 25 bp, Mus musculus
gatacagccaacttgctatcttgga

SEQ ID NO: 662456 - DNA, 25 bp, Mus musculus
gatacagccatgagtaagctgtggt

SEQ ID NO: 662457 - DNA, 25 bp, Mus musculus
gatacagccatgtgtaagctgtggt

SEQ ID NO: 662458 - DNA, 25 bp, Mus musculus
gatacagccccaacctctcgagatt

SEQ ID NO: 662459 - DNA, 25 bp, Mus musculus
gatacagccccatcctctcgagatt

SEQ ID NO: 662460 - DNA, 25 bp, Mus musculus
gatacagctccgacattgcgggaca

SEQ ID NO: 662461 - DNA, 25 bp, Mus musculus
gatacagctccgtcattgcgggaca

SEQ ID NO: 662462 - DNA, 25 bp, Mus musculus
gatacaggccatcggcaatggcaat

SEQ ID NO: 662463 - DNA, 25 bp, Mus musculus
gatacaggccatgggcaatggcaat

SEQ ID NO: 662464 - DNA, 25 bp, Mus musculus
gatacaggcctcagtggctaccaac

SEQ ID NO: 662465 - DNA, 25 bp, Mus musculus
gatacaggcctctgtggctaccaac

SEQ ID NO: 662466 - DNA, 25 bp, Mus musculus
gatacaggcttgcatttagatcacc

SEQ ID NO: 662467 - DNA, 25 bp, Mus musculus
gatacaggcttggatttagatcacc

SEQ ID NO: 662468 - DNA, 25 bp, Mus musculus
gatacagtctgacaactcagcttcc

SEQ ID NO: 662469 - DNA, 25 bp, Mus musculus
gatacagtctgagaactcagcttcc

SEQ ID NO: 662470 - DNA, 25 bp, Mus musculus
gatacagtgcaacgcctccgccggg

SEQ ID NO: 662471 - DNA, 25 bp, Mus musculus
gatacagtgcaaggcctccgccggg

SEQ ID NO: 662472 - DNA, 25 bp, Mus musculus
gatacagtgctcaacctctgacgtg

SEQ ID NO: 662473 - DNA, 25 bp, Mus musculus
gatacagtgctctacctctgacgtg

SEQ ID NO: 662474 - DNA, 25 bp, Mus musculus
gatacagtgttgacaaatctctcag

SEQ ID NO: 662475 - DNA, 25 bp, Mus musculus
gatacagtgttgtcaaatctctcag

SEQ ID NO: 662476 - DNA, 25 bp, Mus musculus
gatacagttgataaatctcagccct

SEQ ID NO: 662477 - DNA, 25 bp, Mus musculus
gatacagttgattaatctcagccct

SEQ ID NO: 662478 - DNA, 25 bp, Mus musculus
gatacagttgctaatcagggcacaa

SEQ ID NO: 662479 - DNA, 25 bp, Mus musculus
gatacagttgcttatcagggcacaa

SEQ ID NO: 662480 - DNA, 25 bp, Mus musculus
gatacatagcaacacatgccctgcc

SEQ ID NO: 662481 - DNA, 25 bp, Mus musculus
gatacatagcaagacatgccctgcc

SEQ ID NO: 662482 - DNA, 25 bp, Mus musculus
gatacataggaccaccagggacctg

SEQ ID NO: 662483 - DNA, 25 bp, Mus musculus
gatacataggacgaccagggacctg

SEQ ID NO: 662484 - DNA, 25 bp, Mus musculus
gatacatcatgtagaagaccctgca

SEQ ID NO: 662485 - DNA, 25 bp, Mus musculus
gatacatcatgtcaccggcatgtgg

SEQ ID NO: 662486 - DNA, 25 bp, Mus musculus
gatacatcatgtgaccggcatgtgg

SEQ ID NO: 662487 - DNA, 25 bp, Mus musculus
gatacatcatgttgaagaccctgca

SEQ ID NO: 662488 - DNA, 25 bp, Mus musculus
gatacatcccggaaccagcactgtt

SEQ ID NO: 662489 - DNA, 25 bp, Mus musculus
gatacatcccggtaccagcactgtt

SEQ ID NO: 662490 - DNA, 25 bp, Mus musculus
gatacatccgctctgctcttcgtca

SEQ ID NO: 662491 - DNA, 25 bp, Mus musculus
gatacatccgctgtgctcttcgtca

SEQ ID NO: 662492 - DNA, 25 bp, Mus musculus
gatacatcctcgaatgtgaagggag

SEQ ID NO: 662493 - DNA, 25 bp, Mus musculus
gatacatcctcgtatgtgaagggag

SEQ ID NO: 662494 - DNA, 25 bp, Mus musculus
gatacatgatgacacagcaggtgga

SEQ ID NO: 662495 - DNA, 25 bp, Mus musculus
gatacatgatgagacagcaggtgga

SEQ ID NO: 662496 - DNA, 25 bp, Mus musculus
gatacatgcaacagcacaatatccc

SEQ ID NO: 662497 - DNA, 25 bp, Mus musculus
gatacatgcaactgcacaatatccc

SEQ ID NO: 662498 - DNA, 25 bp, Mus musculus
gatacatgctgcagccagacgggtc

SEQ ID NO: 662499 - DNA, 25 bp, Mus musculus
gatacatgctgctgccagacgggtc

SEQ ID NO: 662500 - DNA, 25 bp, Mus musculus
gatacatggcatcggagacaccttc

SEQ ID NO: 662501 - DNA, 25 bp, Mus musculus
gatacatggcatgggagacaccttc

SEQ ID NO: 662502 - DNA, 25 bp, Mus musculus
gatacatggcctctgagtccccatt

SEQ ID NO: 662503 - DNA, 25 bp, Mus musculus
gatacatggcctgtgagtccccatt

SEQ ID NO: 662504 - DNA, 25 bp, Mus musculus
gatacattaagtcaagagtcgtaca

SEQ ID NO: 662505 - DNA, 25 bp, Mus musculus
gatacattaagtgaagagtcgtaca

SEQ ID NO: 662506 - DNA, 25 bp, Mus musculus
gatacattgaaaacacttacagccc

SEQ ID NO: 662507 - DNA, 25 bp, Mus musculus
gatacattgaaatcacttacagccc

SEQ ID NO: 662508 - DNA, 25 bp, Mus musculus
gataccaaagatcaatcggaggaga

SEQ ID NO: 662509 - DNA, 25 bp, Mus musculus
gataccaaagatgaatcggaggaga

SEQ ID NO: 662510 - DNA, 25 bp, Mus musculus
gataccaacattctctacctctgtg

SEQ ID NO: 662511 - DNA, 25 bp, Mus musculus
gataccaacattgtctacctctgtg

SEQ ID NO: 662512 - DNA, 25 bp, Mus musculus
gataccaagagcatagtcccaccag

SEQ ID NO: 662513 - DNA, 25 bp, Mus musculus
gataccaagagcttagtcccaccag

SEQ ID NO: 662514 - DNA, 25 bp, Mus musculus
gataccacacttccagcatggtaac

SEQ ID NO: 662515 - DNA, 25 bp, Mus musculus
gataccacacttgcagcatggtaac

SEQ ID NO: 662516 - DNA, 25 bp, Mus musculus
gataccacatagaaagcatgcagcc

SEQ ID NO: 662517 - DNA, 25 bp, Mus musculus
gataccacatagtaagcatgcagcc

SEQ ID NO: 662518 - DNA, 25 bp, Mus musculus
gataccacctacatctccgtcaatg

SEQ ID NO: 662519 - DNA, 25 bp, Mus musculus
gataccacctacttctccgtcaatg

SEQ ID NO: 662520 - DNA, 25 bp, Mus musculus
gataccacgctacttccgaagcatt

SEQ ID NO: 662521 - DNA, 25 bp, Mus musculus
gataccacgctagttccgaagcatt

SEQ ID NO: 662522 - DNA, 25 bp, Mus musculus
gataccactataagtgtaagcatgg

SEQ ID NO: 662523 - DNA, 25 bp, Mus musculus
gataccactatatgtgtaagcatgg

SEQ ID NO: 662524 - DNA, 25 bp, Mus musculus
gataccactgtgatttgcatgctca

SEQ ID NO: 662525 - DNA, 25 bp, Mus musculus
gataccactgtgttttgcatgctca

SEQ ID NO: 662526 - DNA, 25 bp, Mus musculus
gataccagaaatatgggaaggccac

SEQ ID NO: 662527 - DNA, 25 bp, Mus musculus
gataccagaaatttgggaaggccac

SEQ ID NO: 662528 - DNA, 25 bp, Mus musculus
gataccagaattaaaagcctatagg

SEQ ID NO: 662529 - DNA, 25 bp, Mus musculus
gataccagaatttaaagcctatagg

SEQ ID NO: 662530 - DNA, 25 bp, Mus musculus
gataccagctgaagcgtgttctgag

SEQ ID NO: 662531 - DNA, 25 bp, Mus musculus
gataccagctgatgcgtgttctgag

SEQ ID NO: 662532 - DNA, 25 bp, Mus musculus
gataccagcttgcatcctccatgaa

SEQ ID NO: 662533 - DNA, 25 bp, Mus musculus
gataccagcttggatcctccatgaa

SEQ ID NO: 662534 - DNA, 25 bp, Mus musculus
gataccaggattctaagcttcagga

SEQ ID NO: 662535 - DNA, 25 bp, Mus musculus
gataccaggattgtaagcttcagga

SEQ ID NO: 662536 - DNA, 25 bp, Mus musculus
gataccaggctgctctggcagcttt

SEQ ID NO: 662537 - DNA, 25 bp, Mus musculus
gataccaggctggtctggcagcttt

SEQ ID NO: 662538 - DNA, 25 bp, Mus musculus
gataccagtagcatcaacactctca

SEQ ID NO: 662539 - DNA, 25 bp, Mus musculus
gataccagtagcttcaacactctca

SEQ ID NO: 662540 - DNA, 25 bp, Mus musculus
gataccagtcagaacatgcccacac

SEQ ID NO: 662541 - DNA, 25 bp, Mus musculus
gataccagtcagtacatgcccacac

SEQ ID NO: 662542 - DNA, 25 bp, Mus musculus
gataccagtgttctctgtgaccgac

SEQ ID NO: 662543 - DNA, 25 bp, Mus musculus
gataccagtgttgtctgtgaccgac

SEQ ID NO: 662544 - DNA, 25 bp, Mus musculus
gataccatatgccacccaggaggta

SEQ ID NO: 662545 - DNA, 25 bp, Mus musculus
gataccatatgcgacccaggaggta

SEQ ID NO: 662546 - DNA, 25 bp, Mus musculus
gataccatcaaaaaggttctgggaa

SEQ ID NO: 662547 - DNA, 25 bp, Mus musculus
gataccatcaaataggttctgggaa

SEQ ID NO: 662548 - DNA, 25 bp, Mus musculus
gataccatcactatgaagccccggc

SEQ ID NO: 662549 - DNA, 25 bp, Mus musculus
gataccatcactttgaagccccggc

SEQ ID NO: 662550 - DNA, 25 bp, Mus musculus
gataccatcccaacactagtcaggg

SEQ ID NO: 662551 - DNA, 25 bp, Mus musculus
gataccatcccatcactagtcaggg

SEQ ID NO: 662552 - DNA, 25 bp, Mus musculus
gataccatcttccagaatcctatgg

SEQ ID NO: 662553 - DNA, 25 bp, Mus musculus
gataccatcttcgagaatcctatgg

SEQ ID NO: 662554 - DNA, 25 bp, Mus musculus
gataccatgaaccacgtagccattg

SEQ ID NO: 662555 - DNA, 25 bp, Mus musculus
gataccatgaacgacgtagccattg

SEQ ID NO: 662556 - DNA, 25 bp, Mus musculus
gataccatggagatagttgctacgg

SEQ ID NO: 662557 - DNA, 25 bp, Mus musculus
gataccatggagttagttgctacgg

SEQ ID NO: 662558 - DNA, 25 bp, Mus musculus
gataccatttttctttaccaccttg

SEQ ID NO: 662559 - DNA, 25 bp, Mus musculus
gataccatttttgtttaccaccttg

SEQ ID NO: 662560 - DNA, 25 bp, Mus musculus
gatacccaaatgagtaacaacagcc

SEQ ID NO: 662561 - DNA, 25 bp, Mus musculus
gatacccaaatgtgtaacaacagcc

SEQ ID NO: 662562 - DNA, 25 bp, Mus musculus
gatacccagcatcattaactcagga

SEQ ID NO: 662563 - DNA, 25 bp, Mus musculus
gatacccagcatgattaactcagga

SEQ ID NO: 662564 - DNA, 25 bp, Mus musculus
gatacccaggctatatgcgagtggc

SEQ ID NO: 662565 - DNA, 25 bp, Mus musculus
gatacccaggctttatgcgagtggc

SEQ ID NO: 662566 - DNA, 25 bp, Mus musculus
gataccccatatcaggcagtccaca

SEQ ID NO: 662567 - DNA, 25 bp, Mus musculus
gataccccatatgaggcagtccaca

SEQ ID NO: 662568 - DNA, 25 bp, Mus musculus
gataccccgcttctactgggaggac

SEQ ID NO: 662569 - DNA, 25 bp, Mus musculus
gataccccgcttgtactgggaggac

SEQ ID NO: 662570 - DNA, 25 bp, Mus musculus
gataccccttgcacttgctgcatcg

SEQ ID NO: 662571 - DNA, 25 bp, Mus musculus
gataccccttgctcttgctgcatcg

SEQ ID NO: 662572 - DNA, 25 bp, Mus musculus
gatacccgcgagatctggagttaga

SEQ ID NO: 662573 - DNA, 25 bp, Mus musculus
gatacccgcgagttctggagttaga

SEQ ID NO: 662574 - DNA, 25 bp, Mus musculus
gatacccgctcaagcctttgccaaa

SEQ ID NO: 662575 - DNA, 25 bp, Mus musculus
gatacccgctcatgcctttgccaaa

SEQ ID NO: 662576 - DNA, 25 bp, Mus musculus
gataccctagccatcatgtctctgc

SEQ ID NO: 662577 - DNA, 25 bp, Mus musculus
gataccctagccttcatgtctctgc

SEQ ID NO: 662578 - DNA, 25 bp, Mus musculus
gataccctcagaaacagatgcggct

SEQ ID NO: 662579 - DNA, 25 bp, Mus musculus
gataccctcagatacagatgcggct

SEQ ID NO: 662580 - DNA, 25 bp, Mus musculus
gataccctcaggaaaatccaagtgg

SEQ ID NO: 662581 - DNA, 25 bp, Mus musculus
gataccctcaggtaaatccaagtgg

SEQ ID NO: 662582 - DNA, 25 bp, Mus musculus
gataccctccacagagctcttgtag

SEQ ID NO: 662583 - DNA, 25 bp, Mus musculus
gataccctccactgagctcttgtag

SEQ ID NO: 662584 - DNA, 25 bp, Mus musculus
gataccctccccacaagtcttggga

SEQ ID NO: 662585 - DNA, 25 bp, Mus musculus
gataccctcccctcaagtcttggga

SEQ ID NO: 662586 - DNA, 25 bp, Mus musculus
gataccctgaggcatccccttttag

SEQ ID NO: 662587 - DNA, 25 bp, Mus musculus
gataccctgagggatccccttttag

SEQ ID NO: 662588 - DNA, 25 bp, Mus musculus
gataccctgcgtctggtcatcgacc

SEQ ID NO: 662589 - DNA, 25 bp, Mus musculus
gataccctgcgtgtggtcatcgacc

SEQ ID NO: 662590 - DNA, 25 bp, Mus musculus
gataccctggaacatgaactgagaa

SEQ ID NO: 662591 - DNA, 25 bp, Mus musculus
gataccctggaagatgaactgagaa

SEQ ID NO: 662592 - DNA, 25 bp, Mus musculus
gataccctggtcatgctgacactgc

SEQ ID NO: 662593 - DNA, 25 bp, Mus musculus
gataccctggtcttgctgacactgc

SEQ ID NO: 662594 - DNA, 25 bp, Mus musculus
gatacccttggtcgacgctccatga

SEQ ID NO: 662595 - DNA, 25 bp, Mus musculus
gatacccttggtggacgctccatga

SEQ ID NO: 662596 - DNA, 25 bp, Mus musculus
gataccgccattcctggagacaaag

SEQ ID NO: 662597 - DNA, 25 bp, Mus musculus
gataccgccattgctggagacaaag

SEQ ID NO: 662598 - DNA, 25 bp, Mus musculus
gataccgctattctgcatccagtcc

SEQ ID NO: 662599 - DNA, 25 bp, Mus musculus
gataccgctattgtgcatccagtcc

SEQ ID NO: 662600 - DNA, 25 bp, Mus musculus
gataccgggaaaatctccctctggt

SEQ ID NO: 662601 - DNA, 25 bp, Mus musculus
gataccgggaaattctccctctggt

SEQ ID NO: 662602 - DNA, 25 bp, Mus musculus
gataccgtgtcaaggctggaggagg

SEQ ID NO: 662603 - DNA, 25 bp, Mus musculus
gataccgtgtcatggctggaggagg

SEQ ID NO: 662604 - DNA, 25 bp, Mus musculus
gatacctacggcagggaaatgagac

SEQ ID NO: 662605 - DNA, 25 bp, Mus musculus
gatacctacggctgggaaatgagac

SEQ ID NO: 662606 - DNA, 25 bp, Mus musculus
gatacctactgtaggcttcacaaag

SEQ ID NO: 662607 - DNA, 25 bp, Mus musculus
gatacctactgttggcttcacaaag

SEQ ID NO: 662608 - DNA, 25 bp, Mus musculus
gatacctatgagaaaggccagttga

SEQ ID NO: 662609 - DNA, 25 bp, Mus musculus
gatacctatgagtaaggccagttga

SEQ ID NO: 662610 - DNA, 25 bp, Mus musculus
gatacctgaaacattctgatccaga

SEQ ID NO: 662611 - DNA, 25 bp, Mus musculus
gatacctgaaactttctgatccaga

SEQ ID NO: 662612 - DNA, 25 bp, Mus musculus
gatacctgacagcagttcgggaact

SEQ ID NO: 662613 - DNA, 25 bp, Mus musculus
gatacctgacaggagttcgggaact

SEQ ID NO: 662614 - DNA, 25 bp, Mus musculus
gatacctgatatctgactcctctga

SEQ ID NO: 662615 - DNA, 25 bp, Mus musculus
gatacctgatatgtgactcctctga

SEQ ID NO: 662616 - DNA, 25 bp, Mus musculus
gatacctggaggaccaagtccagcg

SEQ ID NO: 662617 - DNA, 25 bp, Mus musculus
gatacctggaggtccaagtccagcg

SEQ ID NO: 662618 - DNA, 25 bp, Mus musculus
gatacctggctcaccatctggcaag

SEQ ID NO: 662619 - DNA, 25 bp, Mus musculus
gatacctggctctccatctggcaag

SEQ ID NO: 662620 - DNA, 25 bp, Mus musculus
gatacctttagaaggataagaaggc

SEQ ID NO: 662621 - DNA, 25 bp, Mus musculus
gatacctttagatggataagaaggc

SEQ ID NO: 662622 - DNA, 25 bp, Mus musculus
gatacctttattcagctcgctcttc

SEQ ID NO: 662623 - DNA, 25 bp, Mus musculus
gatacctttattgagctcgctcttc

SEQ ID NO: 662624 - DNA, 25 bp, Mus musculus
gatacctttgacattgatccaaggg

SEQ ID NO: 662625 - DNA, 25 bp, Mus musculus
gatacctttgactttgatccaaggg

SEQ ID NO: 662626 - DNA, 25 bp, Mus musculus
gatacgaaatcaatgcggaccccag

SEQ ID NO: 662627 - DNA, 25 bp, Mus musculus
gatacgaaatcattgcggaccccag

SEQ ID NO: 662628 - DNA, 25 bp, Mus musculus
gatacgaacagccaaaaagatgggt

SEQ ID NO: 662629 - DNA, 25 bp, Mus musculus
gatacgaacagcgaaaaagatgggt

SEQ ID NO: 662630 - DNA, 25 bp, Mus musculus
gatacgacccgtaaccaagtgctgc

SEQ ID NO: 662631 - DNA, 25 bp, Mus musculus
gatacgacccgttaccaagtgctgc

SEQ ID NO: 662632 - DNA, 25 bp, Mus musculus
gatacgagggtgaggtcattgccat

SEQ ID NO: 662633 - DNA, 25 bp, Mus musculus
gatacgagggtgtggtcattgccat

SEQ ID NO: 662634 - DNA, 25 bp, Mus musculus
gatacgaggtatcgttgggtacaat

SEQ ID NO: 662635 - DNA, 25 bp, Mus musculus
gatacgaggtatggttgggtacaat

SEQ ID NO: 662636 - DNA, 25 bp, Mus musculus
gatacgcaagttagtttaaggagaa

SEQ ID NO: 662637 - DNA, 25 bp, Mus musculus
gatacgcaagtttgtttaaggagaa

SEQ ID NO: 662638 - DNA, 25 bp, Mus musculus
gatacgcgcgctcagcgcaactcag

SEQ ID NO: 662639 - DNA, 25 bp, Mus musculus
gatacgcgcgctgagcgcaactcag

SEQ ID NO: 662640 - DNA, 25 bp, Mus musculus
gatacgcttgaacattgtaggcacg

SEQ ID NO: 662641 - DNA, 25 bp, Mus musculus
gatacgcttgaagattgtaggcacg

SEQ ID NO: 662642 - DNA, 25 bp, Mus musculus
gatacgcttttgatcagaatatact

SEQ ID NO: 662643 - DNA, 25 bp, Mus musculus
gatacgcttttgttcagaatatact

SEQ ID NO: 662644 - DNA, 25 bp, Mus musculus
gatacggaagaacacgtgggcctcc

SEQ ID NO: 662645 - DNA, 25 bp, Mus musculus
gatacggaagaagacgtgggcctcc

SEQ ID NO: 662646 - DNA, 25 bp, Mus musculus
gatacggcaccgcttacttccagta

SEQ ID NO: 662647 - DNA, 25 bp, Mus musculus
gatacggcaccggttacttccagta

SEQ ID NO: 662648 - DNA, 25 bp, Mus musculus
gatacggcagaaagcctgagagaca

SEQ ID NO: 662649 - DNA, 25 bp, Mus musculus
gatacggcagaatgcctgagagaca

SEQ ID NO: 662650 - DNA, 25 bp, Mus musculus
gatacgggttcacgtgtcaaagcct

SEQ ID NO: 662651 - DNA, 25 bp, Mus musculus
gatacgggttcaggtgtcaaagcct

SEQ ID NO: 662652 - DNA, 25 bp, Mus musculus
gatacgtagaatcttttcggaggtt

SEQ ID NO: 662653 - DNA, 25 bp, Mus musculus
gatacgtagaatgttttcggaggtt

SEQ ID NO: 662654 - DNA, 25 bp, Mus musculus
gatacgtatacgcaaagctacatca

SEQ ID NO: 662655 - DNA, 25 bp, Mus musculus
gatacgtatacggaaagctacatca

SEQ ID NO: 662656 - DNA, 25 bp, Mus musculus
gatacgtgagctccgatggaagcat

SEQ ID NO: 662657 - DNA, 25 bp, Mus musculus
gatacgtgagctgcgatggaagcat

SEQ ID NO: 662658 - DNA, 25 bp, Mus musculus
gatacgtgcacgaccgcttcttggt

SEQ ID NO: 662659 - DNA, 25 bp, Mus musculus
gatacgtgcacgtccgcttcttggt

SEQ ID NO: 662660 - DNA, 25 bp, Mus musculus
gatacgtgcatgacaaacattttca

SEQ ID NO: 662661 - DNA, 25 bp, Mus musculus
gatacgtgcatgtcaaacattttca

SEQ ID NO: 662662 - DNA, 25 bp, Mus musculus
gatacgtgggccacaaggatgttgt

SEQ ID NO: 662663 - DNA, 25 bp, Mus musculus
gatacgtgggcctcaaggatgttgt

SEQ ID NO: 662664 - DNA, 25 bp, Mus musculus
gatacgttgtagcttgtcgtcgtca

SEQ ID NO: 662665 - DNA, 25 bp, Mus musculus
gatacgttgtaggttgtcgtcgtca

SEQ ID NO: 662666 - DNA, 25 bp, Mus musculus
gatacgttttctccgtttggtaaca

SEQ ID NO: 662667 - DNA, 25 bp, Mus musculus
gatacgttttctgcgtttggtaaca

SEQ ID NO: 662668 - DNA, 25 bp, Mus musculus
gatactaaggcaccgaactctctgc

SEQ ID NO: 662669 - DNA, 25 bp, Mus musculus
gatactaaggcagcgaactctctgc

SEQ ID NO: 662670 - DNA, 25 bp, Mus musculus
gatactaagtcacctctgcccagag

SEQ ID NO: 662671 - DNA, 25 bp, Mus musculus
gatactaagtcagctctgcccagag

SEQ ID NO: 662672 - DNA, 25 bp, Mus musculus
gatactaatgctcctccctcttggg

SEQ ID NO: 662673 - DNA, 25 bp, Mus musculus
gatactaatgctgctccctcttggg

SEQ ID NO: 662674 - DNA, 25 bp, Mus musculus
gatactacactgagctccatgcacg

SEQ ID NO: 662675 - DNA, 25 bp, Mus musculus
gatactacactgtgctccatgcacg

SEQ ID NO: 662676 - DNA, 25 bp, Mus musculus
gatactacctctcaggctctctgta

SEQ ID NO: 662677 - DNA, 25 bp, Mus musculus
gatactacctctgaggctctctgta

SEQ ID NO: 662678 - DNA, 25 bp, Mus musculus
gatactacctttccacgttaggcgg

SEQ ID NO: 662679 - DNA, 25 bp, Mus musculus
gatactacctttgcacgttaggcgg

SEQ ID NO: 662680 - DNA, 25 bp, Mus musculus
gatactacggcgcatctcagcctca

SEQ ID NO: 662681 - DNA, 25 bp, Mus musculus
gatactacggcggatctcagcctca

SEQ ID NO: 662682 - DNA, 25 bp, Mus musculus
gatactagagcccatgcaggaactt

SEQ ID NO: 662683 - DNA, 25 bp, Mus musculus
gatactagagccgatgcaggaactt

SEQ ID NO: 662684 - DNA, 25 bp, Mus musculus
gatactatgactagagtacaggcaa

SEQ ID NO: 662685 - DNA, 25 bp, Mus musculus
gatactatgacttgagtacaggcaa

SEQ ID NO: 662686 - DNA, 25 bp, Mus musculus
gatactcacataaccactcactctg

SEQ ID NO: 662687 - DNA, 25 bp, Mus musculus
gatactcacatatccactcactctg

SEQ ID NO: 662688 - DNA, 25 bp, Mus musculus
gatactcactgtaaccatcttggca

SEQ ID NO: 662689 - DNA, 25 bp, Mus musculus
gatactcactgttaccatcttggca

SEQ ID NO: 662690 - DNA, 25 bp, Mus musculus
gatactcagcaactgtgtttcactc

SEQ ID NO: 662691 - DNA, 25 bp, Mus musculus
gatactcagcaagtgtgtttcactc

SEQ ID NO: 662692 - DNA, 25 bp, Mus musculus
gatactcagtcaagaagtccgggta

SEQ ID NO: 662693 - DNA, 25 bp, Mus musculus
gatactcagtcatgaagtccgggta

SEQ ID NO: 662694 - DNA, 25 bp, Mus musculus
gatactcatgaccagctcacccggt

SEQ ID NO: 662695 - DNA, 25 bp, Mus musculus
gatactcatgacgagctcacccggt

SEQ ID NO: 662696 - DNA, 25 bp, Mus musculus
gatactcattcacgcattgaacatt

SEQ ID NO: 662697 - DNA, 25 bp, Mus musculus
gatactcattcaggcattgaacatt

SEQ ID NO: 662698 - DNA, 25 bp, Mus musculus
gatactcattctaggacggttcctc

SEQ ID NO: 662699 - DNA, 25 bp, Mus musculus
gatactcattcttggacggttcctc

SEQ ID NO: 662700 - DNA, 25 bp, Mus musculus
gatactccacgtacttccactgtgt

SEQ ID NO: 662701 - DNA, 25 bp, Mus musculus
gatactccacgttcttccactgtgt

SEQ ID NO: 662702 - DNA, 25 bp, Mus musculus
gatactccgttcagggctgggatca

SEQ ID NO: 662703 - DNA, 25 bp, Mus musculus
gatactccgttctgggctgggatca

SEQ ID NO: 662704 - DNA, 25 bp, Mus musculus
gatactcctctgatagcagctcgag

SEQ ID NO: 662705 - DNA, 25 bp, Mus musculus
gatactcctctgttagcagctcgag

SEQ ID NO: 662706 - DNA, 25 bp, Mus musculus
gatactcctgaaaacactctgaaac

SEQ ID NO: 662707 - DNA, 25 bp, Mus musculus
gatactcctgaatacactctgaaac

SEQ ID NO: 662708 - DNA, 25 bp, Mus musculus
gatactccttcgaggctccgtccat

SEQ ID NO: 662709 - DNA, 25 bp, Mus musculus
gatactccttcgcagttccgaaaga

SEQ ID NO: 662710 - DNA, 25 bp, Mus musculus
gatactccttcggagttccgaaaga

SEQ ID NO: 662711 - DNA, 25 bp, Mus musculus
gatactccttcgtggctccgtccat

SEQ ID NO: 662712 - DNA, 25 bp, Mus musculus
gatactcgtcttagatgcctccttg

SEQ ID NO: 662713 - DNA, 25 bp, Mus musculus
gatactcgtctttgatgcctccttg

SEQ ID NO: 662714 - DNA, 25 bp, Mus musculus
gatactctcacactcctgtttgaag

SEQ ID NO: 662715 - DNA, 25 bp, Mus musculus
gatactctcacagtcctgtttgaag

SEQ ID NO: 662716 - DNA, 25 bp, Mus musculus
gatactctcagtcccagccaaatta

SEQ ID NO: 662717 - DNA, 25 bp, Mus musculus
gatactctcagtgccagccaaatta

SEQ ID NO: 662718 - DNA, 25 bp, Mus musculus
gatactctccagcaattatgtagaa

SEQ ID NO: 662719 - DNA, 25 bp, Mus musculus
gatactctccaggaattatgtagaa

SEQ ID NO: 662720 - DNA, 25 bp, Mus musculus
gatactctgaatatgctggtcaagg

SEQ ID NO: 662721 - DNA, 25 bp, Mus musculus
gatactctgaatttgctggtcaagg

SEQ ID NO: 662722 - DNA, 25 bp, Mus musculus
gatactctgtggagttaaaggaaaa

SEQ ID NO: 662723 - DNA, 25 bp, Mus musculus
gatactctgtggtgttaaaggaaaa

SEQ ID NO: 662724 - DNA, 25 bp, Mus musculus
gatactcttggtcacattttgccca

SEQ ID NO: 662725 - DNA, 25 bp, Mus musculus
gatactcttggtgacattttgccca

SEQ ID NO: 662726 - DNA, 25 bp, Mus musculus
gatactgacgtcaactgtgtcccct

SEQ ID NO: 662727 - DNA, 25 bp, Mus musculus
gatactgacgtctactgtgtcccct

SEQ ID NO: 662728 - DNA, 25 bp, Mus musculus
gatactgagcccacgatctgtggca

SEQ ID NO: 662729 - DNA, 25 bp, Mus musculus
gatactgagccctcgatctgtggca

SEQ ID NO: 662730 - DNA, 25 bp, Mus musculus
gatactgatcaccaacttcctagtc

SEQ ID NO: 662731 - DNA, 25 bp, Mus musculus
gatactgatcacgaacttcctagtc

SEQ ID NO: 662732 - DNA, 25 bp, Mus musculus
gatactgatgatcaggtacgggacc

SEQ ID NO: 662733 - DNA, 25 bp, Mus musculus
gatactgatgatgaggtacgggacc

SEQ ID NO: 662734 - DNA, 25 bp, Mus musculus
gatactgatgctcaggttttagaac

SEQ ID NO: 662735 - DNA, 25 bp, Mus musculus
gatactgatgctgaggttttagaac

SEQ ID NO: 662736 - DNA, 25 bp, Mus musculus
gatactgcaagtcctttgaatccat

SEQ ID NO: 662737 - DNA, 25 bp, Mus musculus
gatactgcaagtgctttgaatccat

SEQ ID NO: 662738 - DNA, 25 bp, Mus musculus
gatactgccctgaatgtgattgtcg

SEQ ID NO: 662739 - DNA, 25 bp, Mus musculus
gatactgccctgtatgtgattgtcg

SEQ ID NO: 662740 - DNA, 25 bp, Mus musculus
gatactgcccttacaggcaaccata

SEQ ID NO: 662741 - DNA, 25 bp, Mus musculus
gatactgccctttcaggcaaccata

SEQ ID NO: 662742 - DNA, 25 bp, Mus musculus
gatactgctgctacagtgaccccag

SEQ ID NO: 662743 - DNA, 25 bp, Mus musculus
gatactgctgcttcagtgaccccag

SEQ ID NO: 662744 - DNA, 25 bp, Mus musculus
gatactgctgtgactagtgaggcct

SEQ ID NO: 662745 - DNA, 25 bp, Mus musculus
gatactgctgtgtctagtgaggcct

SEQ ID NO: 662746 - DNA, 25 bp, Mus musculus
gatactggaaacctgtattgcactg

SEQ ID NO: 662747 - DNA, 25 bp, Mus musculus
gatactggaaacgtgtattgcactg

SEQ ID NO: 662748 - DNA, 25 bp, Mus musculus
gatactggaactatcgagaagctcg

SEQ ID NO: 662749 - DNA, 25 bp, Mus musculus
gatactggaactttcgagaagctcg

SEQ ID NO: 662750 - DNA, 25 bp, Mus musculus
gatactggccctactgaaagtcctg

SEQ ID NO: 662751 - DNA, 25 bp, Mus musculus
gatactggcccttctgaaagtcctg

SEQ ID NO: 662752 - DNA, 25 bp, Mus musculus
gatactggcgatattctcgacctga

SEQ ID NO: 662753 - DNA, 25 bp, Mus musculus
gatactggcgattttctcgacctga

SEQ ID NO: 662754 - DNA, 25 bp, Mus musculus
gatactggctgactttgcaatagca

SEQ ID NO: 662755 - DNA, 25 bp, Mus musculus
gatactggctgagtttgcaatagca

SEQ ID NO: 662756 - DNA, 25 bp, Mus musculus
gatactgggctgacttcattgaccc

SEQ ID NO: 662757 - DNA, 25 bp, Mus musculus
gatactgggctgtcttcattgaccc

SEQ ID NO: 662758 - DNA, 25 bp, Mus musculus
gatactgtaaatatgagctttgtca

SEQ ID NO: 662759 - DNA, 25 bp, Mus musculus
gatactgtaaatttgagctttgtca

SEQ ID NO: 662760 - DNA, 25 bp, Mus musculus
gatactgtaacaaaacggctgaagc

SEQ ID NO: 662761 - DNA, 25 bp, Mus musculus
gatactgtaacataacggctgaagc

SEQ ID NO: 662762 - DNA, 25 bp, Mus musculus
gatactgtcaaacgccagagccagt

SEQ ID NO: 662763 - DNA, 25 bp, Mus musculus
gatactgtcaaaggccagagccagt

SEQ ID NO: 662764 - DNA, 25 bp, Mus musculus
gatactgtcattcgaaagattgcaa

SEQ ID NO: 662765 - DNA, 25 bp, Mus musculus
gatactgtcattggaaagattgcaa

SEQ ID NO: 662766 - DNA, 25 bp, Mus musculus
gatactgtctcactaacaaaccact

SEQ ID NO: 662767 - DNA, 25 bp, Mus musculus
gatactgtctcagtaacaaaccact

SEQ ID NO: 662768 - DNA, 25 bp, Mus musculus
gatactgttcttcttgggctggaca

SEQ ID NO: 662769 - DNA, 25 bp, Mus musculus
gatactgttcttgttgggctggaca

SEQ ID NO: 662770 - DNA, 25 bp, Mus musculus
gatactgttttcatccaccctctgc

SEQ ID NO: 662771 - DNA, 25 bp, Mus musculus
gatactgttttcttccaccctctgc

SEQ ID NO: 662772 - DNA, 25 bp, Mus musculus
gatacttatctgcaagtctgtttac

SEQ ID NO: 662773 - DNA, 25 bp, Mus musculus
gatacttatctggaagtctgtttac

SEQ ID NO: 662774 - DNA, 25 bp, Mus musculus
gatacttcacgcatctatgtggccc

SEQ ID NO: 662775 - DNA, 25 bp, Mus musculus
gatacttcacgcttctatgtggccc

SEQ ID NO: 662776 - DNA, 25 bp, Mus musculus
gatacttccaagatgaaccatgcct

SEQ ID NO: 662777 - DNA, 25 bp, Mus musculus
gatacttccaagttgaaccatgcct

SEQ ID NO: 662778 - DNA, 25 bp, Mus musculus
gatacttccctaatagaagaaaatg

SEQ ID NO: 662779 - DNA, 25 bp, Mus musculus
gatacttccctattagaagaaaatg

SEQ ID NO: 662780 - DNA, 25 bp, Mus musculus
gatacttcggtccaaacttgctcaa

SEQ ID NO: 662781 - DNA, 25 bp, Mus musculus
gatacttcggtcgaaacttgctcaa

SEQ ID NO: 662782 - DNA, 25 bp, Mus musculus
gatacttcgtggcatatcccaggtg

SEQ ID NO: 662783 - DNA, 25 bp, Mus musculus
gatacttcgtgggatatcccaggtg

SEQ ID NO: 662784 - DNA, 25 bp, Mus musculus
gatacttctgtaagccctacccaca

SEQ ID NO: 662785 - DNA, 25 bp, Mus musculus
gatacttctgtatgccctacccaca

SEQ ID NO: 662786 - DNA, 25 bp, Mus musculus
gatacttcttcaacttctacttcct

SEQ ID NO: 662787 - DNA, 25 bp, Mus musculus
gatacttcttcatcttctacttcct

SEQ ID NO: 662788 - DNA, 25 bp, Mus musculus
gatacttggaccagcgagtgcccta

SEQ ID NO: 662789 - DNA, 25 bp, Mus musculus
gatacttggacctgcgagtgcccta

SEQ ID NO: 662790 - DNA, 25 bp, Mus musculus
gatacttgtttcacacagaacagag

SEQ ID NO: 662791 - DNA, 25 bp, Mus musculus
gatacttgtttctcacagaacagag

SEQ ID NO: 662792 - DNA, 25 bp, Mus musculus
gatactttacagattatcatggaaa

SEQ ID NO: 662793 - DNA, 25 bp, Mus musculus
gatactttacagtttatcatggaaa

SEQ ID NO: 662794 - DNA, 25 bp, Mus musculus
gatactttatacaaacatgccatgg

SEQ ID NO: 662795 - DNA, 25 bp, Mus musculus
gatactttatactaacatgccatgg

SEQ ID NO: 662796 - DNA, 25 bp, Mus musculus
gatactttgaataccgcggttcacc

SEQ ID NO: 662797 - DNA, 25 bp, Mus musculus
gatactttgaattccgcggttcacc

SEQ ID NO: 662798 - DNA, 25 bp, Mus musculus
gatactttgacaatactaacaccta

SEQ ID NO: 662799 - DNA, 25 bp, Mus musculus
gatactttgacattactaacaccta

SEQ ID NO: 662800 - DNA, 25 bp, Mus musculus
gatactttgaggacacccacgatat

SEQ ID NO: 662801 - DNA, 25 bp, Mus musculus
gatactttgaggtcacccacgatat

SEQ ID NO: 662802 - DNA, 25 bp, Mus musculus
gatactttgttgaaacagctggcaa

SEQ ID NO: 662803 - DNA, 25 bp, Mus musculus
gatactttgttgtaacagctggcaa

SEQ ID NO: 662804 - DNA, 25 bp, Mus musculus
gatacttttaccacggccgaacaga

SEQ ID NO: 662805 - DNA, 25 bp, Mus musculus
gatacttttacctcggccgaacaga

SEQ ID NO: 662806 - DNA, 25 bp, Mus musculus
gatacttttagtcaccagtcgccaa

SEQ ID NO: 662807 - DNA, 25 bp, Mus musculus
gatacttttagtgaccagtcgccaa

SEQ ID NO: 662808 - DNA, 25 bp, Mus musculus
gatacttttgtgaatcagacactgg

SEQ ID NO: 662809 - DNA, 25 bp, Mus musculus
gatacttttgtgtatcagacactgg

SEQ ID NO: 662810 - DNA, 25 bp, Mus musculus
gatagaaaacaacactccccaggga

SEQ ID NO: 662811 - DNA, 25 bp, Mus musculus
gatagaaaacaagactccccaggga

SEQ ID NO: 662812 - DNA, 25 bp, Mus musculus
gatagaaaacctagtctgtgcattc

SEQ ID NO: 662813 - DNA, 25 bp, Mus musculus
gatagaaaaccttgtctgtgcattc

SEQ ID NO: 662814 - DNA, 25 bp, Mus musculus
gatagaaactaacggctagcaagca

SEQ ID NO: 662815 - DNA, 25 bp, Mus musculus
gatagaaactaagggctagcaagca

SEQ ID NO: 662816 - DNA, 25 bp, Mus musculus
gatagaaattgacatcgacgggact

SEQ ID NO: 662817 - DNA, 25 bp, Mus musculus
gatagaaattgagatcgacgggact

SEQ ID NO: 662818 - DNA, 25 bp, Mus musculus
gatagaacaatcacccgcaggatgg

SEQ ID NO: 662819 - DNA, 25 bp, Mus musculus
gatagaacaatctcccgcaggatgg

SEQ ID NO: 662820 - DNA, 25 bp, Mus musculus
gatagaacacagctacagaacgagt

SEQ ID NO: 662821 - DNA, 25 bp, Mus musculus
gatagaacacaggtacagaacgagt

SEQ ID NO: 662822 - DNA, 25 bp, Mus musculus
gatagaaccaatcaaaatgattctg

SEQ ID NO: 662823 - DNA, 25 bp, Mus musculus
gatagaaccaatgaaaatgattctg

SEQ ID NO: 662824 - DNA, 25 bp, Mus musculus
gatagaaccatgctcctttttcgtt

SEQ ID NO: 662825 - DNA, 25 bp, Mus musculus
gatagaaccatggtcctttttcgtt

SEQ ID NO: 662826 - DNA, 25 bp, Mus musculus
gatagaactcagaacagcttgccca

SEQ ID NO: 662827 - DNA, 25 bp, Mus musculus
gatagaactcagcagctcacaagag

SEQ ID NO: 662828 - DNA, 25 bp, Mus musculus
gatagaactcaggagctcacaagag

SEQ ID NO: 662829 - DNA, 25 bp, Mus musculus
gatagaactcagtacagcttgccca

SEQ ID NO: 662830 - DNA, 25 bp, Mus musculus
gatagaagaggtcgacaatgacccc

SEQ ID NO: 662831 - DNA, 25 bp, Mus musculus
gatagaagaggtggacaatgacccc

SEQ ID NO: 662832 - DNA, 25 bp, Mus musculus
gatagaagagtacacggtggccacc

SEQ ID NO: 662833 - DNA, 25 bp, Mus musculus
gatagaagagtagacggtggccacc

SEQ ID NO: 662834 - DNA, 25 bp, Mus musculus
gatagaatatggagcagtagaggac

SEQ ID NO: 662835 - DNA, 25 bp, Mus musculus
gatagaatatggtgcagtagaggac

SEQ ID NO: 662836 - DNA, 25 bp, Mus musculus
gatagaatgctgcaggatgtccaga

SEQ ID NO: 662837 - DNA, 25 bp, Mus musculus
gatagaatgctggaggatgtccaga

SEQ ID NO: 662838 - DNA, 25 bp, Mus musculus
gatagaatggcactaaaatgcaatc

SEQ ID NO: 662839 - DNA, 25 bp, Mus musculus
gatagaatggcagtaaaatgcaatc

SEQ ID NO: 662840 - DNA, 25 bp, Mus musculus
gatagacaaatgactgacagcccaa

SEQ ID NO: 662841 - DNA, 25 bp, Mus musculus
gatagacaaatgagaaactccccag

SEQ ID NO: 662842 - DNA, 25 bp, Mus musculus
gatagacaaatgtctgacagcccaa

SEQ ID NO: 662843 - DNA, 25 bp, Mus musculus
gatagacaaatgtgaaactccccag

SEQ ID NO: 662844 - DNA, 25 bp, Mus musculus
gatagacaccgccatcaagtcgggc

SEQ ID NO: 662845 - DNA, 25 bp, Mus musculus
gatagacaccgcgatcaagtcgggc

SEQ ID NO: 662846 - DNA, 25 bp, Mus musculus
gatagacagaaaatctcagagcagg

SEQ ID NO: 662847 - DNA, 25 bp, Mus musculus
gatagacagaaattctcagagcagg

SEQ ID NO: 662848 - DNA, 25 bp, Mus musculus
gatagacagtttaggcttcctgaac

SEQ ID NO: 662849 - DNA, 25 bp, Mus musculus
gatagacagttttggcttcctgaac

SEQ ID NO: 662850 - DNA, 25 bp, Mus musculus
gatagacatcgaacccacagacaag

SEQ ID NO: 662851 - DNA, 25 bp, Mus musculus
gatagacatcgatcccacagacaag

SEQ ID NO: 662852 - DNA, 25 bp, Mus musculus
gatagaccacgcagagcgggagctt

SEQ ID NO: 662853 - DNA, 25 bp, Mus musculus
gatagaccacgctgagcgggagctt

SEQ ID NO: 662854 - DNA, 25 bp, Mus musculus
gatagacccagcatcaaggtccagg

SEQ ID NO: 662855 - DNA, 25 bp, Mus musculus
gatagacccagcttcaaggtccagg

SEQ ID NO: 662856 - DNA, 25 bp, Mus musculus
gatagaccctgtaacgaatcagaaa

SEQ ID NO: 662857 - DNA, 25 bp, Mus musculus
gatagaccctgttacgaatcagaaa

SEQ ID NO: 662858 - DNA, 25 bp, Mus musculus
gatagaccgcctctggcatacaagt

SEQ ID NO: 662859 - DNA, 25 bp, Mus musculus
gatagaccgcctgtggcatacaagt

SEQ ID NO: 662860 - DNA, 25 bp, Mus musculus
gatagaccggttagtggcagatttc

SEQ ID NO: 662861 - DNA, 25 bp, Mus musculus
gatagaccggtttgtggcagatttc

SEQ ID NO: 662862 - DNA, 25 bp, Mus musculus
gatagacgcggtagggagtcctaca

SEQ ID NO: 662863 - DNA, 25 bp, Mus musculus
gatagacgcggttgggagtcctaca

SEQ ID NO: 662864 - DNA, 25 bp, Mus musculus
gatagacgctctccagaaagcaccc

SEQ ID NO: 662865 - DNA, 25 bp, Mus musculus
gatagacgctctgcagaaagcaccc

SEQ ID NO: 662866 - DNA, 25 bp, Mus musculus
gatagactattgaccaactgcagtt

SEQ ID NO: 662867 - DNA, 25 bp, Mus musculus
gatagactattgtccaactgcagtt

SEQ ID NO: 662868 - DNA, 25 bp, Mus musculus
gatagactcatgaggcatctcagac

SEQ ID NO: 662869 - DNA, 25 bp, Mus musculus
gatagactcatgtggcatctcagac

SEQ ID NO: 662870 - DNA, 25 bp, Mus musculus
gatagactctcaaggtttatgatcc

SEQ ID NO: 662871 - DNA, 25 bp, Mus musculus
gatagactctcatggtttatgatcc

SEQ ID NO: 662872 - DNA, 25 bp, Mus musculus
gatagacttaaacgcacattggtgg

SEQ ID NO: 662873 - DNA, 25 bp, Mus musculus
gatagacttaaaggcacattggtgg

SEQ ID NO: 662874 - DNA, 25 bp, Mus musculus
gatagagaagacattttgcaaaagg

SEQ ID NO: 662875 - DNA, 25 bp, Mus musculus
gatagagaagactttttgcaaaagg

SEQ ID NO: 662876 - DNA, 25 bp, Mus musculus
gatagagaagtccatatgacggctc

SEQ ID NO: 662877 - DNA, 25 bp, Mus musculus
gatagagaagtcgatatgacggctc

SEQ ID NO: 662878 - DNA, 25 bp, Mus musculus
gatagagaatatccttcaagaacaa

SEQ ID NO: 662879 - DNA, 25 bp, Mus musculus
gatagagaatatgcttcaagaacaa

SEQ ID NO: 662880 - DNA, 25 bp, Mus musculus
gatagagacctactacttgcctgat

SEQ ID NO: 662881 - DNA, 25 bp, Mus musculus
gatagagacctagtacttgcctgat

SEQ ID NO: 662882 - DNA, 25 bp, Mus musculus
gatagagactctacatgcaatggga

SEQ ID NO: 662883 - DNA, 25 bp, Mus musculus
gatagagactcttcatgcaatggga

SEQ ID NO: 662884 - DNA, 25 bp, Mus musculus
gatagagccaatcctggaaacccct

SEQ ID NO: 662885 - DNA, 25 bp, Mus musculus
gatagagccaatgctggaaacccct

SEQ ID NO: 662886 - DNA, 25 bp, Mus musculus
gatagagctgctacctcattccaaa

SEQ ID NO: 662887 - DNA, 25 bp, Mus musculus
gatagagctgcttcctcattccaaa

SEQ ID NO: 662888 - DNA, 25 bp, Mus musculus
gatagagctttaactcaccgttggc

SEQ ID NO: 662889 - DNA, 25 bp, Mus musculus
gatagagctttatctcaccgttggc

SEQ ID NO: 662890 - DNA, 25 bp, Mus musculus
gatagagtcctgcaacatcaccgtg

SEQ ID NO: 662891 - DNA, 25 bp, Mus musculus
gatagagtcctggaacatcaccgtg

SEQ ID NO: 662892 - DNA, 25 bp, Mus musculus
gatagagtgcagaaaataatagacc

SEQ ID NO: 662893 - DNA, 25 bp, Mus musculus
gatagagtgcagtaaataatagacc

SEQ ID NO: 662894 - DNA, 25 bp, Mus musculus
gatagagtgcatcacccagggaaga

SEQ ID NO: 662895 - DNA, 25 bp, Mus musculus
gatagagtgcatgacccagggaaga

SEQ ID NO: 662896 - DNA, 25 bp, Mus musculus
gatagagtgctactgctcctcagag

SEQ ID NO: 662897 - DNA, 25 bp, Mus musculus
gatagagtgctagtgctcctcagag

SEQ ID NO: 662898 - DNA, 25 bp, Mus musculus
gatagagtttacactcatcagagcg

SEQ ID NO: 662899 - DNA, 25 bp, Mus musculus
gatagagtttactctcatcagagcg

SEQ ID NO: 662900 - DNA, 25 bp, Mus musculus
gatagatcattaactaggacttgca

SEQ ID NO: 662901 - DNA, 25 bp, Mus musculus
gatagatcattatctaggacttgca

SEQ ID NO: 662902 - DNA, 25 bp, Mus musculus
gatagatctctgctccatgctgaag

SEQ ID NO: 662903 - DNA, 25 bp, Mus musculus
gatagatctctggtccatgctgaag

SEQ ID NO: 662904 - DNA, 25 bp, Mus musculus
gatagatgacacctactctgtccct

SEQ ID NO: 662905 - DNA, 25 bp, Mus musculus
gatagatgacacgtactctgtccct

SEQ ID NO: 662906 - DNA, 25 bp, Mus musculus
gatagatgcgctagttcattgggaa

SEQ ID NO: 662907 - DNA, 25 bp, Mus musculus
gatagatgcgcttgttcattgggaa

SEQ ID NO: 662908 - DNA, 25 bp, Mus musculus
gatagatgctaaatgcccaggccca

SEQ ID NO: 662909 - DNA, 25 bp, Mus musculus
gatagatgctaattgcccaggccca

SEQ ID NO: 662910 - DNA, 25 bp, Mus musculus
gatagcaaattcagcaccattgcct

SEQ ID NO: 662911 - DNA, 25 bp, Mus musculus
gatagcaaattctgcaccattgcct

SEQ ID NO: 662912 - DNA, 25 bp, Mus musculus
gatagcaacagcagtgagtcgacct

SEQ ID NO: 662913 - DNA, 25 bp, Mus musculus
gatagcaacagctgtgagtcgacct

SEQ ID NO: 662914 - DNA, 25 bp, Mus musculus
gatagcaaccccacgtctggttctg

SEQ ID NO: 662915 - DNA, 25 bp, Mus musculus
gatagcaacccctcgtctggttctg

SEQ ID NO: 662916 - DNA, 25 bp, Mus musculus
gatagcaagcgacttgcaatttggg

SEQ ID NO: 662917 - DNA, 25 bp, Mus musculus
gatagcaagcgagttgcaatttggg

SEQ ID NO: 662918 - DNA, 25 bp, Mus musculus
gatagcaccactcatctgtataacc

SEQ ID NO: 662919 - DNA, 25 bp, Mus musculus
gatagcaccactgatctgtataacc

SEQ ID NO: 662920 - DNA, 25 bp, Mus musculus
gatagcacccggcatcccaagagct

SEQ ID NO: 662921 - DNA, 25 bp, Mus musculus
gatagcacccgggatcccaagagct

SEQ ID NO: 662922 - DNA, 25 bp, Mus musculus
gatagcactcttccctgttcctgga

SEQ ID NO: 662923 - DNA, 25 bp, Mus musculus
gatagcactcttgcctgttcctgga

SEQ ID NO: 662924 - DNA, 25 bp, Mus musculus
gatagcagaaggctcaactcttctg

SEQ ID NO: 662925 - DNA, 25 bp, Mus musculus
gatagcagaagggtcaactcttctg

SEQ ID NO: 662926 - DNA, 25 bp, Mus musculus
gatagcagctgtcctaggattggcc

SEQ ID NO: 662927 - DNA, 25 bp, Mus musculus
gatagcagctgtgctaggattggcc

SEQ ID NO: 662928 - DNA, 25 bp, Mus musculus
gatagcagttctcatcgtcattgtg

SEQ ID NO: 662929 - DNA, 25 bp, Mus musculus
gatagcagttctgatcgtcattgtg

SEQ ID NO: 662930 - DNA, 25 bp, Mus musculus
gatagcattgttctctacaagaacc

SEQ ID NO: 662931 - DNA, 25 bp, Mus musculus
gatagcattgttgtctacaagaacc

SEQ ID NO: 662932 - DNA, 25 bp, Mus musculus
gatagccacaggatctgctgatgct

SEQ ID NO: 662933 - DNA, 25 bp, Mus musculus
gatagccacaggttctgctgatgct

SEQ ID NO: 662934 - DNA, 25 bp, Mus musculus
gatagccagacgatcagtaaggata

SEQ ID NO: 662935 - DNA, 25 bp, Mus musculus
gatagccagacgttcagtaaggata

SEQ ID NO: 662936 - DNA, 25 bp, Mus musculus
gatagccagagtagagccctgactg

SEQ ID NO: 662937 - DNA, 25 bp, Mus musculus
gatagccagagttgagccctgactg

SEQ ID NO: 662938 - DNA, 25 bp, Mus musculus
gatagccaggaaccccatcagaaat

SEQ ID NO: 662939 - DNA, 25 bp, Mus musculus
gatagccaggaagcccatcagaaat

SEQ ID NO: 662940 - DNA, 25 bp, Mus musculus
gatagccagttcaccattgtgttgg

SEQ ID NO: 662941 - DNA, 25 bp, Mus musculus
gatagccagttctccattgtgttgg

SEQ ID NO: 662942 - DNA, 25 bp, Mus musculus
gatagccagtttatacaccctcctg

SEQ ID NO: 662943 - DNA, 25 bp, Mus musculus
gatagccagtttttacaccctcctg

SEQ ID NO: 662944 - DNA, 25 bp, Mus musculus
gatagccatggaaagtcacgggcca

SEQ ID NO: 662945 - DNA, 25 bp, Mus musculus
gatagccatggatagtcacgggcca

SEQ ID NO: 662946 - DNA, 25 bp, Mus musculus
gatagccattgactacaagtctgcc

SEQ ID NO: 662947 - DNA, 25 bp, Mus musculus
gatagccattgagtacaagtctgcc

SEQ ID NO: 662948 - DNA, 25 bp, Mus musculus
gatagccccattattgtcgacatcc

SEQ ID NO: 662949 - DNA, 25 bp, Mus musculus
gatagccccatttttgtcgacatcc

SEQ ID NO: 662950 - DNA, 25 bp, Mus musculus
gatagccgagcccttggacttcctt

SEQ ID NO: 662951 - DNA, 25 bp, Mus musculus
gatagccgagccgttggacttcctt

SEQ ID NO: 662952 - DNA, 25 bp, Mus musculus
gatagccgagttcaccgtcagcatc

SEQ ID NO: 662953 - DNA, 25 bp, Mus musculus
gatagccgagttgaccgtcagcatc

SEQ ID NO: 662954 - DNA, 25 bp, Mus musculus
gatagccggagcatctgcctcggca

SEQ ID NO: 662955 - DNA, 25 bp, Mus musculus
gatagccggagcttctgcctcggca

SEQ ID NO: 662956 - DNA, 25 bp, Mus musculus
gatagcctggatctgattacaaaag

SEQ ID NO: 662957 - DNA, 25 bp, Mus musculus
gatagcctggatgtgattacaaaag

SEQ ID NO: 662958 - DNA, 25 bp, Mus musculus
gatagccttcaccggctccacagag

SEQ ID NO: 662959 - DNA, 25 bp, Mus musculus
gatagccttcacgggctccacagag

SEQ ID NO: 662960 - DNA, 25 bp, Mus musculus
gatagcctttgccttcaatgccaag

SEQ ID NO: 662961 - DNA, 25 bp, Mus musculus
gatagcctttgcgttcaatgccaag

SEQ ID NO: 662962 - DNA, 25 bp, Mus musculus
gatagcgagattcgaaactttgaag

SEQ ID NO: 662963 - DNA, 25 bp, Mus musculus
gatagcgagattggaaactttgaag

SEQ ID NO: 662964 - DNA, 25 bp, Mus musculus
gatagcgcggtacacataattctca

SEQ ID NO: 662965 - DNA, 25 bp, Mus musculus
gatagcgcggtagacataattctca

SEQ ID NO: 662966 - DNA, 25 bp, Mus musculus
gatagctaaaatacttcctggtcac

SEQ ID NO: 662967 - DNA, 25 bp, Mus musculus
gatagctaaaattcttcctggtcac

SEQ ID NO: 662968 - DNA, 25 bp, Mus musculus
gatagctaaccacctgcaagaattg

SEQ ID NO: 662969 - DNA, 25 bp, Mus musculus
gatagctaaccagctgcaagaattg

SEQ ID NO: 662970 - DNA, 25 bp, Mus musculus
gatagctacgtcagtgaccccagca

SEQ ID NO: 662971 - DNA, 25 bp, Mus musculus
gatagctacgtctgtgaccccagca

SEQ ID NO: 662972 - DNA, 25 bp, Mus musculus
gatagctcaataacaagtattctgc

SEQ ID NO: 662973 - DNA, 25 bp, Mus musculus
gatagctcaatatcaagtattctgc

SEQ ID NO: 662974 - DNA, 25 bp, Mus musculus
gatagctcagcgctataccacttgc

SEQ ID NO: 662975 - DNA, 25 bp, Mus musculus
gatagctcagcggtataccacttgc

SEQ ID NO: 662976 - DNA, 25 bp, Mus musculus
gatagctcagggactacatttcact

SEQ ID NO: 662977 - DNA, 25 bp, Mus musculus
gatagctcagggtctacatttcact

SEQ ID NO: 662978 - DNA, 25 bp, Mus musculus
gatagctcagttcttcgcaagaacg

SEQ ID NO: 662979 - DNA, 25 bp, Mus musculus
gatagctcagttgttcgcaagaacg

SEQ ID NO: 662980 - DNA, 25 bp, Mus musculus
gatagctcccagattcagtgcacaa

SEQ ID NO: 662981 - DNA, 25 bp, Mus musculus
gatagctcccagtttcagtgcacaa

SEQ ID NO: 662982 - DNA, 25 bp, Mus musculus
gatagctctatcaaaagaaccccaa

SEQ ID NO: 662983 - DNA, 25 bp, Mus musculus
gatagctctatctaaagaaccccaa

SEQ ID NO: 662984 - DNA, 25 bp, Mus musculus
gatagctctgctaacacttaacgtg

SEQ ID NO: 662985 - DNA, 25 bp, Mus musculus
gatagctctgcttacacttaacgtg

SEQ ID NO: 662986 - DNA, 25 bp, Mus musculus
gatagctgagctactcaggaggaac

SEQ ID NO: 662987 - DNA, 25 bp, Mus musculus
gatagctgagcttctcaggaggaac

SEQ ID NO: 662988 - DNA, 25 bp, Mus musculus
gatagctgtcacctccagagtagaa

SEQ ID NO: 662989 - DNA, 25 bp, Mus musculus
gatagctgtcacgtccagagtagaa

SEQ ID NO: 662990 - DNA, 25 bp, Mus musculus
gatagctgtgctctacttcacctgg

SEQ ID NO: 662991 - DNA, 25 bp, Mus musculus
gatagctgtgctgtacttcacctgg

SEQ ID NO: 662992 - DNA, 25 bp, Mus musculus
gatagctgtgggatacatgaacctg

SEQ ID NO: 662993 - DNA, 25 bp, Mus musculus
gatagctgtgggttacatgaacctg

SEQ ID NO: 662994 - DNA, 25 bp, Mus musculus
gatagcttccagaaaggcctgtagc

SEQ ID NO: 662995 - DNA, 25 bp, Mus musculus
gatagcttccagtaaggcctgtagc

SEQ ID NO: 662996 - DNA, 25 bp, Mus musculus
gatagctttggacacctatcctctg

SEQ ID NO: 662997 - DNA, 25 bp, Mus musculus
gatagctttggagacctatcctctg

SEQ ID NO: 662998 - DNA, 25 bp, Mus musculus
gataggaaaaaacaagcgacagaag

SEQ ID NO: 662999 - DNA, 25 bp, Mus musculus
gataggaaaaaagaagcgacagaag

SEQ ID NO: 663000 - DNA, 25 bp, Mus musculus
gataggaaagtaaaagcaacaattg

SEQ ID NO: 663001 - DNA, 25 bp, Mus musculus
gataggaaagtataagcaacaattg

SEQ ID NO: 663002 - DNA, 25 bp, Mus musculus
gataggaacaaaataactgaacatt

SEQ ID NO: 663003 - DNA, 25 bp, Mus musculus
gataggaacaaattaactgaacatt

SEQ ID NO: 663004 - DNA, 25 bp, Mus musculus
gataggaaccagactcttatctcag

SEQ ID NO: 663005 - DNA, 25 bp, Mus musculus
gataggaaccagtctcttatctcag

SEQ ID NO: 663006 - DNA, 25 bp, Mus musculus
gataggaaccatcacacaggaacga

SEQ ID NO: 663007 - DNA, 25 bp, Mus musculus
gataggaaccatgacacaggaacga

SEQ ID NO: 663008 - DNA, 25 bp, Mus musculus
gataggaatgccatatgaggccctg

SEQ ID NO: 663009 - DNA, 25 bp, Mus musculus
gataggaatgccttatgaggccctg

SEQ ID NO: 663010 - DNA, 25 bp, Mus musculus
gataggacatctccccacgtcagtg

SEQ ID NO: 663011 - DNA, 25 bp, Mus musculus
gataggacatctgcccacgtcagtg

SEQ ID NO: 663012 - DNA, 25 bp, Mus musculus
gataggagcgatagctcaggtgcac

SEQ ID NO: 663013 - DNA, 25 bp, Mus musculus
gataggagcgattgctcaggtgcac

SEQ ID NO: 663014 - DNA, 25 bp, Mus musculus
gataggaggtgtcctcttcagtcta

SEQ ID NO: 663015 - DNA, 25 bp, Mus musculus
gataggaggtgtgctcttcagtcta

SEQ ID NO: 663016 - DNA, 25 bp, Mus musculus
gataggatggttacaaagatccagg

SEQ ID NO: 663017 - DNA, 25 bp, Mus musculus
gataggatggtttcaaagatccagg

SEQ ID NO: 663018 - DNA, 25 bp, Mus musculus
gataggattcgaagtcgtcaccctg

SEQ ID NO: 663019 - DNA, 25 bp, Mus musculus
gataggattcgatgtcgtcaccctg

SEQ ID NO: 663020 - DNA, 25 bp, Mus musculus
gataggattttaaagcgaggatagt

SEQ ID NO: 663021 - DNA, 25 bp, Mus musculus
gataggattttatagcgaggatagt

SEQ ID NO: 663022 - DNA, 25 bp, Mus musculus
gataggattttcctcctgtgttttc

SEQ ID NO: 663023 - DNA, 25 bp, Mus musculus
gataggattttcgtcctgtgttttc

SEQ ID NO: 663024 - DNA, 25 bp, Mus musculus
gataggccacccctatctgcagaca

SEQ ID NO: 663025 - DNA, 25 bp, Mus musculus
gataggccacccgtatctgcagaca

SEQ ID NO: 663026 - DNA, 25 bp, Mus musculus
gataggccaggaccaaaacaagccc

SEQ ID NO: 663027 - DNA, 25 bp, Mus musculus
gataggccaggagcaaaacaagccc

SEQ ID NO: 663028 - DNA, 25 bp, Mus musculus
gataggccggccatctacagtgcac

SEQ ID NO: 663029 - DNA, 25 bp, Mus musculus
gataggccggccttctacagtgcac

SEQ ID NO: 663030 - DNA, 25 bp, Mus musculus
gataggcgtgtgcacacaaagacag

SEQ ID NO: 663031 - DNA, 25 bp, Mus musculus
gataggcgtgtggacacaaagacag

SEQ ID NO: 663032 - DNA, 25 bp, Mus musculus
gataggcgttctcttgagccacaaa

SEQ ID NO: 663033 - DNA, 25 bp, Mus musculus
gataggcgttctgttgagccacaaa

SEQ ID NO: 663034 - DNA, 25 bp, Mus musculus
gataggctgaaccaagcttcctggc

SEQ ID NO: 663035 - DNA, 25 bp, Mus musculus
gataggctgaacgaagcttcctggc

SEQ ID NO: 663036 - DNA, 25 bp, Mus musculus
gatagggagcagaaacccaagggct

SEQ ID NO: 663037 - DNA, 25 bp, Mus musculus
gatagggagcagtaacccaagggct

SEQ ID NO: 663038 - DNA, 25 bp, Mus musculus
gatagggatcccaactagccagcct

SEQ ID NO: 663039 - DNA, 25 bp, Mus musculus
gatagggatccctactagccagcct

SEQ ID NO: 663040 - DNA, 25 bp, Mus musculus
gatagggctcagattctctagacaa

SEQ ID NO: 663041 - DNA, 25 bp, Mus musculus
gatagggctcagtttctctagacaa

SEQ ID NO: 663042 - DNA, 25 bp, Mus musculus
gatagggtgaccctgacaaaacgtt

SEQ ID NO: 663043 - DNA, 25 bp, Mus musculus
gatagggtgaccgtgacaaaacgtt

SEQ ID NO: 663044 - DNA, 25 bp, Mus musculus
gatagggtgagcagcatgtgccacc

SEQ ID NO: 663045 - DNA, 25 bp, Mus musculus
gatagggtgagctgcatgtgccacc

SEQ ID NO: 663046 - DNA, 25 bp, Mus musculus
gataggtcacagaagcgagtcactc

SEQ ID NO: 663047 - DNA, 25 bp, Mus musculus
gataggtcacagtagcgagtcactc

SEQ ID NO: 663048 - DNA, 25 bp, Mus musculus
gataggtctggtcgaactacttcac

SEQ ID NO: 663049 - DNA, 25 bp, Mus musculus
gataggtctggtggaactacttcac

SEQ ID NO: 663050 - DNA, 25 bp, Mus musculus
gataggtgtcaacagttcaacgaac

SEQ ID NO: 663051 - DNA, 25 bp, Mus musculus
gataggtgtcaagagttcaacgaac

SEQ ID NO: 663052 - DNA, 25 bp, Mus musculus
gataggttgggcaagcttccattat

SEQ ID NO: 663053 - DNA, 25 bp, Mus musculus
gataggttgggctagcttccattat

SEQ ID NO: 663054 - DNA, 25 bp, Mus musculus
gatagtaaagaacccagaaaaccga

SEQ ID NO: 663055 - DNA, 25 bp, Mus musculus
gatagtaaagaagccagaaaaccga

SEQ ID NO: 663056 - DNA, 25 bp, Mus musculus
gatagtaaggttcctggctacacac

SEQ ID NO: 663057 - DNA, 25 bp, Mus musculus
gatagtaaggttgctggctacacac

SEQ ID NO: 663058 - DNA, 25 bp, Mus musculus
gatagtaattccatggagatcacag

SEQ ID NO: 663059 - DNA, 25 bp, Mus musculus
gatagtaattccttggagatcacag

SEQ ID NO: 663060 - DNA, 25 bp, Mus musculus
gatagtacttcgcaaaaaactcaag

SEQ ID NO: 663061 - DNA, 25 bp, Mus musculus
gatagtacttcggaaaaaactcaag

SEQ ID NO: 663062 - DNA, 25 bp, Mus musculus
gatagtatggacatacagaggttta

SEQ ID NO: 663063 - DNA, 25 bp, Mus musculus
gatagtatggacttacagaggttta

SEQ ID NO: 663064 - DNA, 25 bp, Mus musculus
gatagtattcacatagccgcaaggc

SEQ ID NO: 663065 - DNA, 25 bp, Mus musculus
gatagtattcacttagccgcaaggc

SEQ ID NO: 663066 - DNA, 25 bp, Mus musculus
gatagtattgctccataccccgtgc

SEQ ID NO: 663067 - DNA, 25 bp, Mus musculus
gatagtattgctgcataccccgtgc

SEQ ID NO: 663068 - DNA, 25 bp, Mus musculus
gatagtcaaacgcaaaccctctgcc

SEQ ID NO: 663069 - DNA, 25 bp, Mus musculus
gatagtcaaacggaaaccctctgcc

SEQ ID NO: 663070 - DNA, 25 bp, Mus musculus
gatagtcaaactcggaaaccatgga

SEQ ID NO: 663071 - DNA, 25 bp, Mus musculus
gatagtcaaactgggaaaccatgga

SEQ ID NO: 663072 - DNA, 25 bp, Mus musculus
gatagtcagtggagcctgcttcagt

SEQ ID NO: 663073 - DNA, 25 bp, Mus musculus
gatagtcagtggtgcctgcttcagt

SEQ ID NO: 663074 - DNA, 25 bp, Mus musculus
gatagtccacacaggacggagccca

SEQ ID NO: 663075 - DNA, 25 bp, Mus musculus
gatagtccacactggacggagccca

SEQ ID NO: 663076 - DNA, 25 bp, Mus musculus
gatagtcccctgaaaatcccagtgc

SEQ ID NO: 663077 - DNA, 25 bp, Mus musculus
gatagtcccctgtaaatcccagtgc

SEQ ID NO: 663078 - DNA, 25 bp, Mus musculus
gatagtcctgctcgtcgtctctctc

SEQ ID NO: 663079 - DNA, 25 bp, Mus musculus
gatagtcctgctggtcgtctctctc

SEQ ID NO: 663080 - DNA, 25 bp, Mus musculus
gatagtccttaacccttctgagagc

SEQ ID NO: 663081 - DNA, 25 bp, Mus musculus
gatagtccttaagccttctgagagc

SEQ ID NO: 663082 - DNA, 25 bp, Mus musculus
gatagtcggagtctcctttggaaga

SEQ ID NO: 663083 - DNA, 25 bp, Mus musculus
gatagtcggagtgtcctttggaaga

SEQ ID NO: 663084 - DNA, 25 bp, Mus musculus
gatagtctggccagttacagaagtg

SEQ ID NO: 663085 - DNA, 25 bp, Mus musculus
gatagtctggcctgttacagaagtg

SEQ ID NO: 663086 - DNA, 25 bp, Mus musculus
gatagtgaactgcttcctgtctgtg

SEQ ID NO: 663087 - DNA, 25 bp, Mus musculus
gatagtgaactggttcctgtctgtg

SEQ ID NO: 663088 - DNA, 25 bp, Mus musculus
gatagtgaagctaagaaactactgg

SEQ ID NO: 663089 - DNA, 25 bp, Mus musculus
gatagtgaagcttagaaactactgg

SEQ ID NO: 663090 - DNA, 25 bp, Mus musculus
gatagtgacacccttatcccagcac

SEQ ID NO: 663091 - DNA, 25 bp, Mus musculus
gatagtgacaccgttatcccagcac

SEQ ID NO: 663092 - DNA, 25 bp, Mus musculus
gatagtgatgcacctgttgaacaag

SEQ ID NO: 663093 - DNA, 25 bp, Mus musculus
gatagtgatgcagctgttgaacaag

SEQ ID NO: 663094 - DNA, 25 bp, Mus musculus
gatagtgcaatacctcagaacccgc

SEQ ID NO: 663095 - DNA, 25 bp, Mus musculus
gatagtgcaatagctcagaacccgc

SEQ ID NO: 663096 - DNA, 25 bp, Mus musculus
gatagtgcccgaaaggacatccatg

SEQ ID NO: 663097 - DNA, 25 bp, Mus musculus
gatagtgcccgataggacatccatg

SEQ ID NO: 663098 - DNA, 25 bp, Mus musculus
gatagtgcccttagcggatgttaca

SEQ ID NO: 663099 - DNA, 25 bp, Mus musculus
gatagtgccctttgcggatgttaca

SEQ ID NO: 663100 - DNA, 25 bp, Mus musculus
gatagtgctcgtcaaatcctgcgaa

SEQ ID NO: 663101 - DNA, 25 bp, Mus musculus
gatagtgctcgtgaaatcctgcgaa

SEQ ID NO: 663102 - DNA, 25 bp, Mus musculus
gatagtggcagtaaggcctcttctg

SEQ ID NO: 663103 - DNA, 25 bp, Mus musculus
gatagtggcagttaggcctcttctg

SEQ ID NO: 663104 - DNA, 25 bp, Mus musculus
gatagtggcgagagcttgccactta

SEQ ID NO: 663105 - DNA, 25 bp, Mus musculus
gatagtggcgagtgcttgccactta

SEQ ID NO: 663106 - DNA, 25 bp, Mus musculus
gatagtgggaggactattatgctgc

SEQ ID NO: 663107 - DNA, 25 bp, Mus musculus
gatagtgggaggtctattatgctgc

SEQ ID NO: 663108 - DNA, 25 bp, Mus musculus
gatagtgggcagagctgaaaatgcc

SEQ ID NO: 663109 - DNA, 25 bp, Mus musculus
gatagtgggcagtgctgaaaatgcc

SEQ ID NO: 663110 - DNA, 25 bp, Mus musculus
gatagtgtaacaagggttcctccag

SEQ ID NO: 663111 - DNA, 25 bp, Mus musculus
gatagtgtaacatgggttcctccag

SEQ ID NO: 663112 - DNA, 25 bp, Mus musculus
gatagtgttcccaatcatgccaggg

SEQ ID NO: 663113 - DNA, 25 bp, Mus musculus
gatagtgttccctatcatgccaggg

SEQ ID NO: 663114 - DNA, 25 bp, Mus musculus
gatagtgtttgcacagcgcgcgaca

SEQ ID NO: 663115 - DNA, 25 bp, Mus musculus
gatagtgtttgctcagcgcgcgaca

SEQ ID NO: 663116 - DNA, 25 bp, Mus musculus
gatagttaatctaccagtgtgagct

SEQ ID NO: 663117 - DNA, 25 bp, Mus musculus
gatagttaatcttccagtgtgagct

SEQ ID NO: 663118 - DNA, 25 bp, Mus musculus
gatagttacagactctcagctgctg

SEQ ID NO: 663119 - DNA, 25 bp, Mus musculus
gatagttacagagtctcagctgctg

SEQ ID NO: 663120 - DNA, 25 bp, Mus musculus
gatagttaccaaactgctttagaag

SEQ ID NO: 663121 - DNA, 25 bp, Mus musculus
gatagttaccaatctgctttagaag

SEQ ID NO: 663122 - DNA, 25 bp, Mus musculus
gatagttaccagatctggagacacc

SEQ ID NO: 663123 - DNA, 25 bp, Mus musculus
gatagttaccagttctggagacacc

SEQ ID NO: 663124 - DNA, 25 bp, Mus musculus
gatagttcgtcgcaagcagcagccg

SEQ ID NO: 663125 - DNA, 25 bp, Mus musculus
gatagttcgtcggaagcagcagccg

SEQ ID NO: 663126 - DNA, 25 bp, Mus musculus
gatagttctgacctttcctttgcaa

SEQ ID NO: 663127 - DNA, 25 bp, Mus musculus
gatagttctgacgtttcctttgcaa

SEQ ID NO: 663128 - DNA, 25 bp, Mus musculus
gatagttctgccaatcaagctccct

SEQ ID NO: 663129 - DNA, 25 bp, Mus musculus
gatagttctgcctatcaagctccct

SEQ ID NO: 663130 - DNA, 25 bp, Mus musculus
gatagttgggagcacagtgttctcc

SEQ ID NO: 663131 - DNA, 25 bp, Mus musculus
gatagttgggaggacagtgttctcc

SEQ ID NO: 663132 - DNA, 25 bp, Mus musculus
gatagtttaaccaagcagcccgagg

SEQ ID NO: 663133 - DNA, 25 bp, Mus musculus
gatagtttaacctagcagcccgagg

SEQ ID NO: 663134 - DNA, 25 bp, Mus musculus
gatagtttctccacatttgatacgc

SEQ ID NO: 663135 - DNA, 25 bp, Mus musculus
gatagtttctcctcatttgatacgc

SEQ ID NO: 663136 - DNA, 25 bp, Mus musculus
gatagtttgcgaaagggaatgcccc

SEQ ID NO: 663137 - DNA, 25 bp, Mus musculus
gatagtttgcgatagggaatgcccc

SEQ ID NO: 663138 - DNA, 25 bp, Mus musculus
gatagttttagaccctatctactgg

SEQ ID NO: 663139 - DNA, 25 bp, Mus musculus
gatagttttagagcctatctactgg

SEQ ID NO: 663140 - DNA, 25 bp, Mus musculus
gatagttttgctctactgggcctag

SEQ ID NO: 663141 - DNA, 25 bp, Mus musculus
gatagttttgctgtactgggcctag

SEQ ID NO: 663142 - DNA, 25 bp, Mus musculus
gatataaaagaaaggctagacgata

SEQ ID NO: 663143 - DNA, 25 bp, Mus musculus
gatataaaagaatggctagacgata

SEQ ID NO: 663144 - DNA, 25 bp, Mus musculus
gatataaaatcccactccatgtgga

SEQ ID NO: 663145 - DNA, 25 bp, Mus musculus
gatataaaatccgactccatgtgga

SEQ ID NO: 663146 - DNA, 25 bp, Mus musculus
gatataaactgccaagtcttcaaca

SEQ ID NO: 663147 - DNA, 25 bp, Mus musculus
gatataaactgcgaagtcttcaaca

SEQ ID NO: 663148 - DNA, 25 bp, Mus musculus
gatataaagtatctctcaccactgt

SEQ ID NO: 663149 - DNA, 25 bp, Mus musculus
gatataaagtatgtctcaccactgt

SEQ ID NO: 663150 - DNA, 25 bp, Mus musculus
gatataaatgtgctcacctgtgcag

SEQ ID NO: 663151 - DNA, 25 bp, Mus musculus
gatataaatgtggtcacctgtgcag

SEQ ID NO: 663152 - DNA, 25 bp, Mus musculus
gatataaccggaatcaacatgggca

SEQ ID NO: 663153 - DNA, 25 bp, Mus musculus
gatataaccggattcaacatgggca

SEQ ID NO: 663154 - DNA, 25 bp, Mus musculus
gatataagacataatcagaagacat

SEQ ID NO: 663155 - DNA, 25 bp, Mus musculus
gatataagacattatcagaagacat

SEQ ID NO: 663156 - DNA, 25 bp, Mus musculus
gatataagctccattctggtgcaga

SEQ ID NO: 663157 - DNA, 25 bp, Mus musculus
gatataagctcctttctggtgcaga

SEQ ID NO: 663158 - DNA, 25 bp, Mus musculus
gatataagctggatcgatgaccata

SEQ ID NO: 663159 - DNA, 25 bp, Mus musculus
gatataagctggttcgatgaccata

SEQ ID NO: 663160 - DNA, 25 bp, Mus musculus
gatataatcaacctgttccctgcca

SEQ ID NO: 663161 - DNA, 25 bp, Mus musculus
gatataatcaacgtgttccctgcca

SEQ ID NO: 663162 - DNA, 25 bp, Mus musculus
gatataatgtccctgaatcctacct

SEQ ID NO: 663163 - DNA, 25 bp, Mus musculus
gatataatgtccgtgaatcctacct

SEQ ID NO: 663164 - DNA, 25 bp, Mus musculus
gatatacaccatccatgctgaagga

SEQ ID NO: 663165 - DNA, 25 bp, Mus musculus
gatatacaccatgcatgctgaagga

SEQ ID NO: 663166 - DNA, 25 bp, Mus musculus
gatatacacctgcacaaattgtgtg

SEQ ID NO: 663167 - DNA, 25 bp, Mus musculus
gatatacacctggacaaattgtgtg

SEQ ID NO: 663168 - DNA, 25 bp, Mus musculus
gatatacactttctctcacaggctg

SEQ ID NO: 663169 - DNA, 25 bp, Mus musculus
gatatacactttgtctcacaggctg

SEQ ID NO: 663170 - DNA, 25 bp, Mus musculus
gatataccaagtcccctgaatctat

SEQ ID NO: 663171 - DNA, 25 bp, Mus musculus
gatataccaagtgccctgaatctat

SEQ ID NO: 663172 - DNA, 25 bp, Mus musculus
gatataccgcatagtttctcagaag

SEQ ID NO: 663173 - DNA, 25 bp, Mus musculus
gatataccgcattgtttctcagaag

SEQ ID NO: 663174 - DNA, 25 bp, Mus musculus
gatataccgcgcatgtttgcctgta

SEQ ID NO: 663175 - DNA, 25 bp, Mus musculus
gatataccgcgcttgtttgcctgta

SEQ ID NO: 663176 - DNA, 25 bp, Mus musculus
gatatacctctgacctgcaattcgc

SEQ ID NO: 663177 - DNA, 25 bp, Mus musculus
gatatacctctgtcctgcaattcgc

SEQ ID NO: 663178 - DNA, 25 bp, Mus musculus
gatatactgagaaaaaccgccacac

SEQ ID NO: 663179 - DNA, 25 bp, Mus musculus
gatatactgagataaaccgccacac

SEQ ID NO: 663180 - DNA, 25 bp, Mus musculus
gatatactgaggcaggtgaaactga

SEQ ID NO: 663181 - DNA, 25 bp, Mus musculus
gatatactgagggaggtgaaactga

SEQ ID NO: 663182 - DNA, 25 bp, Mus musculus
gatatacttcctagcgggctggctt

SEQ ID NO: 663183 - DNA, 25 bp, Mus musculus
gatatacttccttgcgggctggctt

SEQ ID NO: 663184 - DNA, 25 bp, Mus musculus
gatatactttcaagggagtcatttc

SEQ ID NO: 663185 - DNA, 25 bp, Mus musculus
gatatactttcatgggagtcatttc

SEQ ID NO: 663186 - DNA, 25 bp, Mus musculus
gatatagacctcaccacactcaaca

SEQ ID NO: 663187 - DNA, 25 bp, Mus musculus
gatatagacctctccacactcaaca

SEQ ID NO: 663188 - DNA, 25 bp, Mus musculus
gatatagatgaaagtgaagcccggg

SEQ ID NO: 663189 - DNA, 25 bp, Mus musculus
gatatagatgaatgtgaagcccggg

SEQ ID NO: 663190 - DNA, 25 bp, Mus musculus
gatatagcaatgaggtggccccagc

SEQ ID NO: 663191 - DNA, 25 bp, Mus musculus
gatatagcaatgtggtggccccagc

SEQ ID NO: 663192 - DNA, 25 bp, Mus musculus
gatatagcagctacttcccatgaaa

SEQ ID NO: 663193 - DNA, 25 bp, Mus musculus
gatatagcagcttcttcccatgaaa

SEQ ID NO: 663194 - DNA, 25 bp, Mus musculus
gatatagcaggtatagatgacgtca

SEQ ID NO: 663195 - DNA, 25 bp, Mus musculus
gatatagcaggtttagatgacgtca

SEQ ID NO: 663196 - DNA, 25 bp, Mus musculus
gatatagctctaagccgggtcctgg

SEQ ID NO: 663197 - DNA, 25 bp, Mus musculus
gatatagctctatgccgggtcctgg

SEQ ID NO: 663198 - DNA, 25 bp, Mus musculus
gatatagctgtgcaattcacctggc

SEQ ID NO: 663199 - DNA, 25 bp, Mus musculus
gatatagctgtggaattcacctggc

SEQ ID NO: 663200 - DNA, 25 bp, Mus musculus
gatataggccgtaccaaatctcgct

SEQ ID NO: 663201 - DNA, 25 bp, Mus musculus
gatataggccgttccaaatctcgct

SEQ ID NO: 663202 - DNA, 25 bp, Mus musculus
gatatagttacacgctgagtccctc

SEQ ID NO: 663203 - DNA, 25 bp, Mus musculus
gatatagttacaggctgagtccctc

SEQ ID NO: 663204 - DNA, 25 bp, Mus musculus
gatatagtttttcatccatactgga

SEQ ID NO: 663205 - DNA, 25 bp, Mus musculus
gatatagtttttgatccatactgga

SEQ ID NO: 663206 - DNA, 25 bp, Mus musculus
gatatataagtaataaccgttccct

SEQ ID NO: 663207 - DNA, 25 bp, Mus musculus
gatatataagtattaaccgttccct

SEQ ID NO: 663208 - DNA, 25 bp, Mus musculus
gatatataccacagctactgctttg

SEQ ID NO: 663209 - DNA, 25 bp, Mus musculus
gatatataccactgctactgctttg

SEQ ID NO: 663210 - DNA, 25 bp, Mus musculus
gatatatgataaccagctggatgaa

SEQ ID NO: 663211 - DNA, 25 bp, Mus musculus
gatatatgataagcagctggatgaa

SEQ ID NO: 663212 - DNA, 25 bp, Mus musculus
gatatatgccaccatgacccgtttt

SEQ ID NO: 663213 - DNA, 25 bp, Mus musculus
gatatatgccacgatgacccgtttt

SEQ ID NO: 663214 - DNA, 25 bp, Mus musculus
gatatatgccagaggaattttccag

SEQ ID NO: 663215 - DNA, 25 bp, Mus musculus
gatatatgccagtggaattttccag

SEQ ID NO: 663216 - DNA, 25 bp, Mus musculus
gatatatggacaacagggaggcaat

SEQ ID NO: 663217 - DNA, 25 bp, Mus musculus
gatatatggacatcagggaggcaat

SEQ ID NO: 663218 - DNA, 25 bp, Mus musculus
gatatattctatccgggagatcagc

SEQ ID NO: 663219 - DNA, 25 bp, Mus musculus
gatatattctatgcgggagatcagc

SEQ ID NO: 663220 - DNA, 25 bp, Mus musculus
gatatattgaaaatccacgcaggac

SEQ ID NO: 663221 - DNA, 25 bp, Mus musculus
gatatattgaaattccacgcaggac

SEQ ID NO: 663222 - DNA, 25 bp, Mus musculus
gatatatttactcggcttattgggc

SEQ ID NO: 663223 - DNA, 25 bp, Mus musculus
gatatatttactgggcttattgggc

SEQ ID NO: 663224 - DNA, 25 bp, Mus musculus
gatatatttcccaatcagcctggtg

SEQ ID NO: 663225 - DNA, 25 bp, Mus musculus
gatatatttccctatcagcctggtg

SEQ ID NO: 663226 - DNA, 25 bp, Mus musculus
gatatcaaacacagcgacctggcta

SEQ ID NO: 663227 - DNA, 25 bp, Mus musculus
gatatcaaacactgcgacctggcta

SEQ ID NO: 663228 - DNA, 25 bp, Mus musculus
gatatcaagtacatcttgggccagc

SEQ ID NO: 663229 - DNA, 25 bp, Mus musculus
gatatcaagtacttcttgggccagc

SEQ ID NO: 663230 - DNA, 25 bp, Mus musculus
gatatcaataaacctatcctggacg

SEQ ID NO: 663231 - DNA, 25 bp, Mus musculus
gatatcaataaagctatcctggacg

SEQ ID NO: 663232 - DNA, 25 bp, Mus musculus
gatatcacaaccagcggccgacgat

SEQ ID NO: 663233 - DNA, 25 bp, Mus musculus
gatatcacaacctgcggccgacgat

SEQ ID NO: 663234 - DNA, 25 bp, Mus musculus
gatatcaccaaactggtatcaaccc

SEQ ID NO: 663235 - DNA, 25 bp, Mus musculus
gatatcaccaaagtggtatcaaccc

SEQ ID NO: 663236 - DNA, 25 bp, Mus musculus
gatatcaccactattaaacttctca

SEQ ID NO: 663237 - DNA, 25 bp, Mus musculus
gatatcaccactcaggtggcactgg

SEQ ID NO: 663238 - DNA, 25 bp, Mus musculus
gatatcaccactgaggtggcactgg

SEQ ID NO: 663239 - DNA, 25 bp, Mus musculus
gatatcaccacttttaaacttctca

SEQ ID NO: 663240 - DNA, 25 bp, Mus musculus
gatatcaccagaaactccaaggcaa

SEQ ID NO: 663241 - DNA, 25 bp, Mus musculus
gatatcaccagatactccaaggcaa

SEQ ID NO: 663242 - DNA, 25 bp, Mus musculus
gatatcactacgaagaaagacagag

SEQ ID NO: 663243 - DNA, 25 bp, Mus musculus
gatatcactacgtagaaagacagag

SEQ ID NO: 663244 - DNA, 25 bp, Mus musculus
gatatcacttttactaaccccaagg

SEQ ID NO: 663245 - DNA, 25 bp, Mus musculus
gatatcactttttctaaccccaagg

SEQ ID NO: 663246 - DNA, 25 bp, Mus musculus
gatatcagagaaagaaatccaaaga

SEQ ID NO: 663247 - DNA, 25 bp, Mus musculus
gatatcagagaatgaaatccaaaga

SEQ ID NO: 663248 - DNA, 25 bp, Mus musculus
gatatcagagttagtaattccaagt

SEQ ID NO: 663249 - DNA, 25 bp, Mus musculus
gatatcagagtttgtaattccaagt

SEQ ID NO: 663250 - DNA, 25 bp, Mus musculus
gatatcagccctaaacatcgttggg

SEQ ID NO: 663251 - DNA, 25 bp, Mus musculus
gatatcagcccttaacatcgttggg

SEQ ID NO: 663252 - DNA, 25 bp, Mus musculus
gatatcaggctgcttatggacgacc

SEQ ID NO: 663253 - DNA, 25 bp, Mus musculus
gatatcaggctggttatggacgacc

SEQ ID NO: 663254 - DNA, 25 bp, Mus musculus
gatatcaggtgtcgactggcaaccc

SEQ ID NO: 663255 - DNA, 25 bp, Mus musculus
gatatcaggtgtggactggcaaccc

SEQ ID NO: 663256 - DNA, 25 bp, Mus musculus
gatatcatagcaacacagcaaaatg

SEQ ID NO: 663257 - DNA, 25 bp, Mus musculus
gatatcatagcatcacagcaaaatg

SEQ ID NO: 663258 - DNA, 25 bp, Mus musculus
gatatcatgctacgtgtctgtgcca

SEQ ID NO: 663259 - DNA, 25 bp, Mus musculus
gatatcatgctaggtgtctgtgcca

SEQ ID NO: 663260 - DNA, 25 bp, Mus musculus
gatatcattcagagtcacctgaccg

SEQ ID NO: 663261 - DNA, 25 bp, Mus musculus
gatatcattcagtgtcacctgaccg

SEQ ID NO: 663262 - DNA, 25 bp, Mus musculus
gatatcattcggctacggaacaaga

SEQ ID NO: 663263 - DNA, 25 bp, Mus musculus
gatatcattcgggtacggaacaaga

SEQ ID NO: 663264 - DNA, 25 bp, Mus musculus
gatatcattggtctggctggaaacc

SEQ ID NO: 663265 - DNA, 25 bp, Mus musculus
gatatcattggtgtggctggaaacc

SEQ ID NO: 663266 - DNA, 25 bp, Mus musculus
gatatcattttcctggtaacagacc

SEQ ID NO: 663267 - DNA, 25 bp, Mus musculus
gatatcattttcgtggtaacagacc

SEQ ID NO: 663268 - DNA, 25 bp, Mus musculus
gatatccaaggaaagtctgtctagg

SEQ ID NO: 663269 - DNA, 25 bp, Mus musculus
gatatccaaggatagtctgtctagg

SEQ ID NO: 663270 - DNA, 25 bp, Mus musculus
gatatccaatataattgttggcgca

SEQ ID NO: 663271 - DNA, 25 bp, Mus musculus
gatatccaatattattgttggcgca

SEQ ID NO: 663272 - DNA, 25 bp, Mus musculus
gatatccccggtcgaggcccgaagt

SEQ ID NO: 663273 - DNA, 25 bp, Mus musculus
gatatccccggtggaggcccgaagt

SEQ ID NO: 663274 - DNA, 25 bp, Mus musculus
gatatccctggaacaggaaggaccc

SEQ ID NO: 663275 - DNA, 25 bp, Mus musculus
gatatccctggatcaggaaggaccc

SEQ ID NO: 663276 - DNA, 25 bp, Mus musculus
gatatccgggaaacagtcacacaaa

SEQ ID NO: 663277 - DNA, 25 bp, Mus musculus
gatatccgggaatcagtcacacaaa

SEQ ID NO: 663278 - DNA, 25 bp, Mus musculus
gatatccgtgcgacagtggctggca

SEQ ID NO: 663279 - DNA, 25 bp, Mus musculus
gatatccgtgcgtcagtggctggca

SEQ ID NO: 663280 - DNA, 25 bp, Mus musculus
gatatcctacagcaaggtggttccg

SEQ ID NO: 663281 - DNA, 25 bp, Mus musculus
gatatcctacaggaaggtggttccg

SEQ ID NO: 663282 - DNA, 25 bp, Mus musculus
gatatcctagtcctgtatgccaaga

SEQ ID NO: 663283 - DNA, 25 bp, Mus musculus
gatatcctagtcgtgtatgccaaga

SEQ ID NO: 663284 - DNA, 25 bp, Mus musculus
gatatcctccgtcatatggcccaga

SEQ ID NO: 663285 - DNA, 25 bp, Mus musculus
gatatcctccgtgatatggcccaga

SEQ ID NO: 663286 - DNA, 25 bp, Mus musculus
gatatcctcgataagctctcgcgcc

SEQ ID NO: 663287 - DNA, 25 bp, Mus musculus
gatatcctcgattagctctcgcgcc

SEQ ID NO: 663288 - DNA, 25 bp, Mus musculus
gatatcctctggcaagaggtcaaag

SEQ ID NO: 663289 - DNA, 25 bp, Mus musculus
gatatcctctgggaagaggtcaaag

SEQ ID NO: 663290 - DNA, 25 bp, Mus musculus
gatatcctgctgatccttattctta

SEQ ID NO: 663291 - DNA, 25 bp, Mus musculus
gatatcctgctgttccttattctta

SEQ ID NO: 663292 - DNA, 25 bp, Mus musculus
gatatcctggtcaccaatgctgctg

SEQ ID NO: 663293 - DNA, 25 bp, Mus musculus
gatatcctggtctccaatgctgctg

SEQ ID NO: 663294 - DNA, 25 bp, Mus musculus
gatatcctgtttcactactgtgccc

SEQ ID NO: 663295 - DNA, 25 bp, Mus musculus
gatatcctgtttgactactgtgccc

SEQ ID NO: 663296 - DNA, 25 bp, Mus musculus
gatatccttactactaatggcatcg

SEQ ID NO: 663297 - DNA, 25 bp, Mus musculus
gatatccttacttctaatggcatcg

SEQ ID NO: 663298 - DNA, 25 bp, Mus musculus
gatatccttcctatggggctaccac

SEQ ID NO: 663299 - DNA, 25 bp, Mus musculus
gatatccttcctttggggctaccac

SEQ ID NO: 663300 - DNA, 25 bp, Mus musculus
gatatcgctctgctcaagctaaaga

SEQ ID NO: 663301 - DNA, 25 bp, Mus musculus
gatatcgctctggtcaagctaaaga

SEQ ID NO: 663302 - DNA, 25 bp, Mus musculus
gatatcggcgcccaccgtgatggtt

SEQ ID NO: 663303 - DNA, 25 bp, Mus musculus
gatatcggcgccgaccgtgatggtt

SEQ ID NO: 663304 - DNA, 25 bp, Mus musculus
gatatcgggctcacggtgacgcaca

SEQ ID NO: 663305 - DNA, 25 bp, Mus musculus
gatatcgggctctcggtgacgcaca

SEQ ID NO: 663306 - DNA, 25 bp, Mus musculus
gatatcgtggccatggtggctcaag

SEQ ID NO: 663307 - DNA, 25 bp, Mus musculus
gatatcgtggccttggtggctcaag

SEQ ID NO: 663308 - DNA, 25 bp, Mus musculus
gatatctacaagcaagtcctgaaag

SEQ ID NO: 663309 - DNA, 25 bp, Mus musculus
gatatctacaaggaagtcctgaaag

SEQ ID NO: 663310 - DNA, 25 bp, Mus musculus
gatatctacaatcttctttccacct

SEQ ID NO: 663311 - DNA, 25 bp, Mus musculus
gatatctacaatgttctttccacct

SEQ ID NO: 663312 - DNA, 25 bp, Mus musculus
gatatctacgacactcagaccttgg

SEQ ID NO: 663313 - DNA, 25 bp, Mus musculus
gatatctacgactctcagaccttgg

SEQ ID NO: 663314 - DNA, 25 bp, Mus musculus
gatatctcggtgagggactacgaca

SEQ ID NO: 663315 - DNA, 25 bp, Mus musculus
gatatctcggtgtgggactacgaca

SEQ ID NO: 663316 - DNA, 25 bp, Mus musculus
gatatctgaaaacctaggcaccctg

SEQ ID NO: 663317 - DNA, 25 bp, Mus musculus
gatatctgaaaagctaggcaccctg

SEQ ID NO: 663318 - DNA, 25 bp, Mus musculus
gatatctgctgacaatggacaaact

SEQ ID NO: 663319 - DNA, 25 bp, Mus musculus
gatatctgctgagaatggacaaact

SEQ ID NO: 663320 - DNA, 25 bp, Mus musculus
gatatctggaccagttcaccaacta

SEQ ID NO: 663321 - DNA, 25 bp, Mus musculus
gatatctggacctgttcaccaacta

SEQ ID NO: 663322 - DNA, 25 bp, Mus musculus
gatatctggtccatcgctaacaact

SEQ ID NO: 663323 - DNA, 25 bp, Mus musculus
gatatctggtccttcgctaacaact

SEQ ID NO: 663324 - DNA, 25 bp, Mus musculus
gatatctgtaaacagaatggagcct

SEQ ID NO: 663325 - DNA, 25 bp, Mus musculus
gatatctgtaaagagaatggagcct

SEQ ID NO: 663326 - DNA, 25 bp, Mus musculus
gatatctgtcatcaactcttgggac

SEQ ID NO: 663327 - DNA, 25 bp, Mus musculus
gatatctgtcatgaactcttgggac

SEQ ID NO: 663328 - DNA, 25 bp, Mus musculus
gatatctgtccaattagagggccca

SEQ ID NO: 663329 - DNA, 25 bp, Mus musculus
gatatctgtccatttagagggccca

SEQ ID NO: 663330 - DNA, 25 bp, Mus musculus
gatatcttcataatggtggcaccac

SEQ ID NO: 663331 - DNA, 25 bp, Mus musculus
gatatcttcatattggtggcaccac

SEQ ID NO: 663332 - DNA, 25 bp, Mus musculus
gatatcttggcgcacaagggtctag

SEQ ID NO: 663333 - DNA, 25 bp, Mus musculus
gatatcttggcggacaagggtctag

SEQ ID NO: 663334 - DNA, 25 bp, Mus musculus
gatatcttgtgcctccgagaggcaa

SEQ ID NO: 663335 - DNA, 25 bp, Mus musculus
gatatcttgtgcgtccgagaggcaa

SEQ ID NO: 663336 - DNA, 25 bp, Mus musculus
gatatctttagtagatgaggcttcg

SEQ ID NO: 663337 - DNA, 25 bp, Mus musculus
gatatctttagttgatgaggcttcg

SEQ ID NO: 663338 - DNA, 25 bp, Mus musculus
gatatctttcttagacgagctcacc

SEQ ID NO: 663339 - DNA, 25 bp, Mus musculus
gatatctttctttgacgagctcacc

SEQ ID NO: 663340 - DNA, 25 bp, Mus musculus
gatatgaaaaagcagcaagaccacc

SEQ ID NO: 663341 - DNA, 25 bp, Mus musculus
gatatgaaaaaggagcaagaccacc

SEQ ID NO: 663342 - DNA, 25 bp, Mus musculus
gatatgaaatgacaacgtcaaccct

SEQ ID NO: 663343 - DNA, 25 bp, Mus musculus
gatatgaaatgagaacgtcaaccct

SEQ ID NO: 663344 - DNA, 25 bp, Mus musculus
gatatgaacatcctttatgctttcc

SEQ ID NO: 663345 - DNA, 25 bp, Mus musculus
gatatgaacatcgtttatgctttcc

SEQ ID NO: 663346 - DNA, 25 bp, Mus musculus
gatatgaagaccaaaatcccactgg

SEQ ID NO: 663347 - DNA, 25 bp, Mus musculus
gatatgaagacctaaatcccactgg

SEQ ID NO: 663348 - DNA, 25 bp, Mus musculus
gatatgaatcaaattctggatgcct

SEQ ID NO: 663349 - DNA, 25 bp, Mus musculus
gatatgaatcaatttctggatgcct

SEQ ID NO: 663350 - DNA, 25 bp, Mus musculus
gatatgaccacactaaccatcatga

SEQ ID NO: 663351 - DNA, 25 bp, Mus musculus
gatatgaccacagtaaccatcatga

SEQ ID NO: 663352 - DNA, 25 bp, Mus musculus
gatatgaccatgcagcttgtttcta

SEQ ID NO: 663353 - DNA, 25 bp, Mus musculus
gatatgaccatggagcttgtttcta

SEQ ID NO: 663354 - DNA, 25 bp, Mus musculus
gatatgactcctacctatgggctga

SEQ ID NO: 663355 - DNA, 25 bp, Mus musculus
gatatgactccttcctatgggctga

SEQ ID NO: 663356 - DNA, 25 bp, Mus musculus
gatatgagatcccagcaaggttgcg

SEQ ID NO: 663357 - DNA, 25 bp, Mus musculus
gatatgagatccgagcaaggttgcg

SEQ ID NO: 663358 - DNA, 25 bp, Mus musculus
gatatgagcaagaacaccatctatg

SEQ ID NO: 663359 - DNA, 25 bp, Mus musculus
gatatgagcaagcatgaatctatag

SEQ ID NO: 663360 - DNA, 25 bp, Mus musculus
gatatgagcaaggatgaatctatag

SEQ ID NO: 663361 - DNA, 25 bp, Mus musculus
gatatgagcaagtacaccatctatg

SEQ ID NO: 663362 - DNA, 25 bp, Mus musculus
gatatgaggtccaaaagttcaaggc

SEQ ID NO: 663363 - DNA, 25 bp, Mus musculus
gatatgaggtcctaaagttcaaggc

SEQ ID NO: 663364 - DNA, 25 bp, Mus musculus
gatatgatacagctgatgaacaccg

SEQ ID NO: 663365 - DNA, 25 bp, Mus musculus
gatatgatacaggtgatgaacaccg

SEQ ID NO: 663366 - DNA, 25 bp, Mus musculus
gatatgatcctgctccttctcacag

SEQ ID NO: 663367 - DNA, 25 bp, Mus musculus
gatatgatcctggtccttctcacag

SEQ ID NO: 663368 - DNA, 25 bp, Mus musculus
gatatgatcttcatcgtcaaagatg

SEQ ID NO: 663369 - DNA, 25 bp, Mus musculus
gatatgatcttcttcgtcaaagatg

SEQ ID NO: 663370 - DNA, 25 bp, Mus musculus
gatatgatgaaccttatgcggctgg

SEQ ID NO: 663371 - DNA, 25 bp, Mus musculus
gatatgatgaacgttatgcggctgg

SEQ ID NO: 663372 - DNA, 25 bp, Mus musculus
gatatgatgccgcacttggagacag

SEQ ID NO: 663373 - DNA, 25 bp, Mus musculus
gatatgatgccggacttggagacag

SEQ ID NO: 663374 - DNA, 25 bp, Mus musculus
gatatgatggtgaacgtctggacgc

SEQ ID NO: 663375 - DNA, 25 bp, Mus musculus
gatatgatggtgtacgtctggacgc

SEQ ID NO: 663376 - DNA, 25 bp, Mus musculus
gatatgcaaggcaaccatgtcctct

SEQ ID NO: 663377 - DNA, 25 bp, Mus musculus
gatatgcaaggctaccatgtcctct

SEQ ID NO: 663378 - DNA, 25 bp, Mus musculus
gatatgcaatcaacccatcccgtga

SEQ ID NO: 663379 - DNA, 25 bp, Mus musculus
gatatgcaatcatcccatcccgtga

SEQ ID NO: 663380 - DNA, 25 bp, Mus musculus
gatatgcacagcaacctctccaact

SEQ ID NO: 663381 - DNA, 25 bp, Mus musculus
gatatgcacagctacctctccaact

SEQ ID NO: 663382 - DNA, 25 bp, Mus musculus
gatatgcacccacggactggtggtc

SEQ ID NO: 663383 - DNA, 25 bp, Mus musculus
gatatgcacccagggactggtggtc

SEQ ID NO: 663384 - DNA, 25 bp, Mus musculus
gatatgcagtaccttactcccaaag

SEQ ID NO: 663385 - DNA, 25 bp, Mus musculus
gatatgcagtacgttactcccaaag

SEQ ID NO: 663386 - DNA, 25 bp, Mus musculus
gatatgcatcagaacagccagtggc

SEQ ID NO: 663387 - DNA, 25 bp, Mus musculus
gatatgcatcagtacagccagtggc

SEQ ID NO: 663388 - DNA, 25 bp, Mus musculus
gatatgcattggcttgacagaagaa

SEQ ID NO: 663389 - DNA, 25 bp, Mus musculus
gatatgcattgggttgacagaagaa

SEQ ID NO: 663390 - DNA, 25 bp, Mus musculus
gatatgccatgaaatattcaagtca

SEQ ID NO: 663391 - DNA, 25 bp, Mus musculus
gatatgccatgatatattcaagtca

SEQ ID NO: 663392 - DNA, 25 bp, Mus musculus
gatatgccctaccagccattcagca

SEQ ID NO: 663393 - DNA, 25 bp, Mus musculus
gatatgccctacgagccattcagca

SEQ ID NO: 663394 - DNA, 25 bp, Mus musculus
gatatgccttgcaggggacagtgca

SEQ ID NO: 663395 - DNA, 25 bp, Mus musculus
gatatgccttgctggggacagtgca

SEQ ID NO: 663396 - DNA, 25 bp, Mus musculus
gatatgctacaccagaagcggacat

SEQ ID NO: 663397 - DNA, 25 bp, Mus musculus
gatatgctacacgagaagcggacat

SEQ ID NO: 663398 - DNA, 25 bp, Mus musculus
gatatgctagaccacaaatttacct

SEQ ID NO: 663399 - DNA, 25 bp, Mus musculus
gatatgctagacgacaaatttacct

SEQ ID NO: 663400 - DNA, 25 bp, Mus musculus
gatatgctccgccacttccagcgtt

SEQ ID NO: 663401 - DNA, 25 bp, Mus musculus
gatatgctccgcgacttccagcgtt

SEQ ID NO: 663402 - DNA, 25 bp, Mus musculus
gatatgctggatatagccaagatca

SEQ ID NO: 663403 - DNA, 25 bp, Mus musculus
gatatgctggatttagccaagatca

SEQ ID NO: 663404 - DNA, 25 bp, Mus musculus
gatatggccttgctaatgaccgtag

SEQ ID NO: 663405 - DNA, 25 bp, Mus musculus
gatatggccttggtaatgaccgtag

SEQ ID NO: 663406 - DNA, 25 bp, Mus musculus
gatatggctttgactcctttttcaa

SEQ ID NO: 663407 - DNA, 25 bp, Mus musculus
gatatggctttgtctcctttttcaa

SEQ ID NO: 663408 - DNA, 25 bp, Mus musculus
gatatgggaagtaagtggaagaact

SEQ ID NO: 663409 - DNA, 25 bp, Mus musculus
gatatgggaagttagtggaagaact

SEQ ID NO: 663410 - DNA, 25 bp, Mus musculus
gatatgggacagaaggcttttacac

SEQ ID NO: 663411 - DNA, 25 bp, Mus musculus
gatatgggacagtaggcttttacac

SEQ ID NO: 663412 - DNA, 25 bp, Mus musculus
gatatgggagttcttttacagcggt

SEQ ID NO: 663413 - DNA, 25 bp, Mus musculus
gatatgggagttgttttacagcggt

SEQ ID NO: 663414 - DNA, 25 bp, Mus musculus
gatatgggtaaccaaactccatagc

SEQ ID NO: 663415 - DNA, 25 bp, Mus musculus
gatatgggtaacgaaactccatagc

SEQ ID NO: 663416 - DNA, 25 bp, Mus musculus
gatatggtcaagctcccgtttaaga

SEQ ID NO: 663417 - DNA, 25 bp, Mus musculus
gatatggtcaaggtcccgtttaaga

SEQ ID NO: 663418 - DNA, 25 bp, Mus musculus
gatatggtgaccatgcacaggtttc

SEQ ID NO: 663419 - DNA, 25 bp, Mus musculus
gatatggtgaccttgcacaggtttc

SEQ ID NO: 663420 - DNA, 25 bp, Mus musculus
gatatggttatccaagaagtggccg

SEQ ID NO: 663421 - DNA, 25 bp, Mus musculus
gatatggttatcgaagaagtggccg

SEQ ID NO: 663422 - DNA, 25 bp, Mus musculus
gatatggttcagaagccgagcaact

SEQ ID NO: 663423 - DNA, 25 bp, Mus musculus
gatatggttcagtagccgagcaact

SEQ ID NO: 663424 - DNA, 25 bp, Mus musculus
gatatggttcttccactaacagtgt

SEQ ID NO: 663425 - DNA, 25 bp, Mus musculus
gatatggttcttcttgggaaggccc

SEQ ID NO: 663426 - DNA, 25 bp, Mus musculus
gatatggttcttgcactaacagtgt

SEQ ID NO: 663427 - DNA, 25 bp, Mus musculus
gatatggttcttgttgggaaggccc

SEQ ID NO: 663428 - DNA, 25 bp, Mus musculus
gatatgtcaacaaaggatcatgtct

SEQ ID NO: 663429 - DNA, 25 bp, Mus musculus
gatatgtcaacataggatcatgtct

SEQ ID NO: 663430 - DNA, 25 bp, Mus musculus
gatatgtcccttctgaatggctggg

SEQ ID NO: 663431 - DNA, 25 bp, Mus musculus
gatatgtcccttgtgaatggctggg

SEQ ID NO: 663432 - DNA, 25 bp, Mus musculus
gatatgtcctttctgcccacctggg

SEQ ID NO: 663433 - DNA, 25 bp, Mus musculus
gatatgtcctttgtgcccacctggg

SEQ ID NO: 663434 - DNA, 25 bp, Mus musculus
gatatgtgccaaaaatctatgtccc

SEQ ID NO: 663435 - DNA, 25 bp, Mus musculus
gatatgtgccaataatctatgtccc

SEQ ID NO: 663436 - DNA, 25 bp, Mus musculus
gatatgtgccttctggaaagcccac

SEQ ID NO: 663437 - DNA, 25 bp, Mus musculus
gatatgtgccttgtggaaagcccac

SEQ ID NO: 663438 - DNA, 25 bp, Mus musculus
gatatgtggctaagcttgccttaaa

SEQ ID NO: 663439 - DNA, 25 bp, Mus musculus
gatatgtggctatgcttgccttaaa

SEQ ID NO: 663440 - DNA, 25 bp, Mus musculus
gatatgtgggcaacgttcttctgca

SEQ ID NO: 663441 - DNA, 25 bp, Mus musculus
gatatgtgggcatcgttcttctgca

SEQ ID NO: 663442 - DNA, 25 bp, Mus musculus
gatatgtggtacattcccttccctc

SEQ ID NO: 663443 - DNA, 25 bp, Mus musculus
gatatgtggtactttcccttccctc

SEQ ID NO: 663444 - DNA, 25 bp, Mus musculus
gatatgtggtccatcagaccgaggg

SEQ ID NO: 663445 - DNA, 25 bp, Mus musculus
gatatgtggtccttcagaccgaggg

SEQ ID NO: 663446 - DNA, 25 bp, Mus musculus
gatatgttagctatacagatgataa

SEQ ID NO: 663447 - DNA, 25 bp, Mus musculus
gatatgttagctttacagatgataa

SEQ ID NO: 663448 - DNA, 25 bp, Mus musculus
gatatgttgagtcgcttcccggctg

SEQ ID NO: 663449 - DNA, 25 bp, Mus musculus
gatatgttgagtggcttcccggctg

SEQ ID NO: 663450 - DNA, 25 bp, Mus musculus
gatatgttgtgtagtccttgctaaa

SEQ ID NO: 663451 - DNA, 25 bp, Mus musculus
gatatgttgtgttgtccttgctaaa

SEQ ID NO: 663452 - DNA, 25 bp, Mus musculus
gatattaaatcgctctcggcagaga

SEQ ID NO: 663453 - DNA, 25 bp, Mus musculus
gatattaaatcggtctcggcagaga

SEQ ID NO: 663454 - DNA, 25 bp, Mus musculus
gatattaagacaactctcaggaact

SEQ ID NO: 663455 - DNA, 25 bp, Mus musculus
gatattaagacatctctcaggaact

SEQ ID NO: 663456 - DNA, 25 bp, Mus musculus
gatattaagcagatagatcacgcca

SEQ ID NO: 663457 - DNA, 25 bp, Mus musculus
gatattaagcagttagatcacgcca

SEQ ID NO: 663458 - DNA, 25 bp, Mus musculus
gatattaaggagacggctggctacc

SEQ ID NO: 663459 - DNA, 25 bp, Mus musculus
gatattaaggagtcggctggctacc

SEQ ID NO: 663460 - DNA, 25 bp, Mus musculus
gatattacacctacttttggagaga

SEQ ID NO: 663461 - DNA, 25 bp, Mus musculus
gatattacaccttcttttggagaga

SEQ ID NO: 663462 - DNA, 25 bp, Mus musculus
gatattacactgacaaagctgtaca

SEQ ID NO: 663463 - DNA, 25 bp, Mus musculus
gatattacactgtcaaagctgtaca

SEQ ID NO: 663464 - DNA, 25 bp, Mus musculus
gatattacagatctacaacctggaa

SEQ ID NO: 663465 - DNA, 25 bp, Mus musculus
gatattacagatgtacaacctggaa

SEQ ID NO: 663466 - DNA, 25 bp, Mus musculus
gatattacatcgagctgggactttg

SEQ ID NO: 663467 - DNA, 25 bp, Mus musculus
gatattacatcgtgctgggactttg

SEQ ID NO: 663468 - DNA, 25 bp, Mus musculus
gatattacggaaagtgtccagcttg

SEQ ID NO: 663469 - DNA, 25 bp, Mus musculus
gatattacggaatgtgtccagcttg

SEQ ID NO: 663470 - DNA, 25 bp, Mus musculus
gatattactcaacctttgtacatgc

SEQ ID NO: 663471 - DNA, 25 bp, Mus musculus
gatattactcaagctttgtacatgc

SEQ ID NO: 663472 - DNA, 25 bp, Mus musculus
gatattacttggcaaagtacaacag

SEQ ID NO: 663473 - DNA, 25 bp, Mus musculus
gatattacttgggaaagtacaacag

SEQ ID NO: 663474 - DNA, 25 bp, Mus musculus
gatattactttgacgatttcccagc

SEQ ID NO: 663475 - DNA, 25 bp, Mus musculus
gatattactttgtcgatttcccagc

SEQ ID NO: 663476 - DNA, 25 bp, Mus musculus
gatattaggtaccacggatgcagga

SEQ ID NO: 663477 - DNA, 25 bp, Mus musculus
gatattaggtacgacggatgcagga

SEQ ID NO: 663478 - DNA, 25 bp, Mus musculus
gatattatactactatggtctactc

SEQ ID NO: 663479 - DNA, 25 bp, Mus musculus
gatattatactagtatggtctactc

SEQ ID NO: 663480 - DNA, 25 bp, Mus musculus
gatattcaattcactccaacaactg

SEQ ID NO: 663481 - DNA, 25 bp, Mus musculus
gatattcaattctctccaacaactg

SEQ ID NO: 663482 - DNA, 25 bp, Mus musculus
gatattcacatccaaagcgggcagc

SEQ ID NO: 663483 - DNA, 25 bp, Mus musculus
gatattcacatcgaaagcgggcagc

SEQ ID NO: 663484 - DNA, 25 bp, Mus musculus
gatattcagataacttaagacacag

SEQ ID NO: 663485 - DNA, 25 bp, Mus musculus
gatattcagatatcttaagacacag

SEQ ID NO: 663486 - DNA, 25 bp, Mus musculus
gatattcatccgaaacccacggaca

SEQ ID NO: 663487 - DNA, 25 bp, Mus musculus
gatattcatccgtaacccacggaca

SEQ ID NO: 663488 - DNA, 25 bp, Mus musculus
gatattccaggacctcacgctgcac

SEQ ID NO: 663489 - DNA, 25 bp, Mus musculus
gatattccaggagctcacgctgcac

SEQ ID NO: 663490 - DNA, 25 bp, Mus musculus
gatattccatgtctcttgcctccct

SEQ ID NO: 663491 - DNA, 25 bp, Mus musculus
gatattccatgtgtcttgcctccct

SEQ ID NO: 663492 - DNA, 25 bp, Mus musculus
gatattccctcccatagagtcatgc

SEQ ID NO: 663493 - DNA, 25 bp, Mus musculus
gatattccctccgatagagtcatgc

SEQ ID NO: 663494 - DNA, 25 bp, Mus musculus
gatattccggtcaaatagatgtcac

SEQ ID NO: 663495 - DNA, 25 bp, Mus musculus
gatattccggtctaatagatgtcac

SEQ ID NO: 663496 - DNA, 25 bp, Mus musculus
gatattcctaatcgtgcaaccttgc

SEQ ID NO: 663497 - DNA, 25 bp, Mus musculus
gatattcctaatggtgcaaccttgc

SEQ ID NO: 663498 - DNA, 25 bp, Mus musculus
gatattcctagtccccttcgcattg

SEQ ID NO: 663499 - DNA, 25 bp, Mus musculus
gatattcctagtgcccttcgcattg

SEQ ID NO: 663500 - DNA, 25 bp, Mus musculus
gatattctaagacacttctttgagc

SEQ ID NO: 663501 - DNA, 25 bp, Mus musculus
gatattctaagagacttctttgagc

SEQ ID NO: 663502 - DNA, 25 bp, Mus musculus
gatattctgaaccacgtgtttgacg

SEQ ID NO: 663503 - DNA, 25 bp, Mus musculus
gatattctgaacgacgtgtttgacg

SEQ ID NO: 663504 - DNA, 25 bp, Mus musculus
gatattcttactaggcaccagtggc

SEQ ID NO: 663505 - DNA, 25 bp, Mus musculus
gatattcttacttggcaccagtggc

SEQ ID NO: 663506 - DNA, 25 bp, Mus musculus
gatattcttttcacctcggactcag

SEQ ID NO: 663507 - DNA, 25 bp, Mus musculus
gatattcttttctcctcggactcag

SEQ ID NO: 663508 - DNA, 25 bp, Mus musculus
gatattgaatttcactttaaaggcg

SEQ ID NO: 663509 - DNA, 25 bp, Mus musculus
gatattgaatttgactttaaaggcg

SEQ ID NO: 663510 - DNA, 25 bp, Mus musculus
gatattgaccttatcagtgctaaca

SEQ ID NO: 663511 - DNA, 25 bp, Mus musculus
gatattgaccttttcagtgctaaca

SEQ ID NO: 663512 - DNA, 25 bp, Mus musculus
gatattgactagactggcccttgga

SEQ ID NO: 663513 - DNA, 25 bp, Mus musculus
gatattgactagtctggcccttgga

SEQ ID NO: 663514 - DNA, 25 bp, Mus musculus
gatattgactggatagacaatggag

SEQ ID NO: 663515 - DNA, 25 bp, Mus musculus
gatattgactggttagacaatggag

SEQ ID NO: 663516 - DNA, 25 bp, Mus musculus
gatattgagaaaatcgtttgtctcc

SEQ ID NO: 663517 - DNA, 25 bp, Mus musculus
gatattgagaaattcgtttgtctcc

SEQ ID NO: 663518 - DNA, 25 bp, Mus musculus
gatattgatatacttcctagcgggc

SEQ ID NO: 663519 - DNA, 25 bp, Mus musculus
gatattgatatagttcctagcgggc

SEQ ID NO: 663520 - DNA, 25 bp, Mus musculus
gatattgatgtacaaaagctcaccc

SEQ ID NO: 663521 - DNA, 25 bp, Mus musculus
gatattgatgtagaaaagctcaccc

SEQ ID NO: 663522 - DNA, 25 bp, Mus musculus
gatattgattggataatatcaaacc

SEQ ID NO: 663523 - DNA, 25 bp, Mus musculus
gatattgattggttaatatcaaacc

SEQ ID NO: 663524 - DNA, 25 bp, Mus musculus
gatattgcagcacgggacttcattg

SEQ ID NO: 663525 - DNA, 25 bp, Mus musculus
gatattgcagcaggggacttcattg

SEQ ID NO: 663526 - DNA, 25 bp, Mus musculus
gatattgccatcaactgggccggtg

SEQ ID NO: 663527 - DNA, 25 bp, Mus musculus
gatattgccatctactgggccggtg

SEQ ID NO: 663528 - DNA, 25 bp, Mus musculus
gatattgcctctcgtttccttcaga

SEQ ID NO: 663529 - DNA, 25 bp, Mus musculus
gatattgcctctggtttccttcaga

SEQ ID NO: 663530 - DNA, 25 bp, Mus musculus
gatattgcggatatgcacagcaacc

SEQ ID NO: 663531 - DNA, 25 bp, Mus musculus
gatattgcggatttgcacagcaacc

SEQ ID NO: 663532 - DNA, 25 bp, Mus musculus
gatattgctcaacggtacccaatgc

SEQ ID NO: 663533 - DNA, 25 bp, Mus musculus
gatattgctcaagggtacccaatgc

SEQ ID NO: 663534 - DNA, 25 bp, Mus musculus
gatattggaagtcgatgaaacacag

SEQ ID NO: 663535 - DNA, 25 bp, Mus musculus
gatattggaagtggatgaaacacag

SEQ ID NO: 663536 - DNA, 25 bp, Mus musculus
gatattggaatacctgatgctacag

SEQ ID NO: 663537 - DNA, 25 bp, Mus musculus
gatattggaatagctgatgctacag

SEQ ID NO: 663538 - DNA, 25 bp, Mus musculus
gatattggagagctgtgatcctcac

SEQ ID NO: 663539 - DNA, 25 bp, Mus musculus
gatattggagaggtgtgatcctcac

SEQ ID NO: 663540 - DNA, 25 bp, Mus musculus
gatattggaggtcggcaaaccaaga

SEQ ID NO: 663541 - DNA, 25 bp, Mus musculus
gatattggaggtgggcaaaccaaga

SEQ ID NO: 663542 - DNA, 25 bp, Mus musculus
gatattggcttcatgggtcccaggg

SEQ ID NO: 663543 - DNA, 25 bp, Mus musculus
gatattggcttcttgggtcccaggg

SEQ ID NO: 663544 - DNA, 25 bp, Mus musculus
gatattgggtatctcgaccggtcct

SEQ ID NO: 663545 - DNA, 25 bp, Mus musculus
gatattgggtatgtcgaccggtcct

SEQ ID NO: 663546 - DNA, 25 bp, Mus musculus
gatattgtacagaaagttcctcaga

SEQ ID NO: 663547 - DNA, 25 bp, Mus musculus
gatattgtacagtaagttcctcaga

SEQ ID NO: 663548 - DNA, 25 bp, Mus musculus
gatattgtctctcgaactcgataca

SEQ ID NO: 663549 - DNA, 25 bp, Mus musculus
gatattgtctctggaactcgataca

SEQ ID NO: 663550 - DNA, 25 bp, Mus musculus
gatattgtggatattgcctctcgtt

SEQ ID NO: 663551 - DNA, 25 bp, Mus musculus
gatattgtggattttgcctctcgtt

SEQ ID NO: 663552 - DNA, 25 bp, Mus musculus
gatattgtggccctcgtgcagagca

SEQ ID NO: 663553 - DNA, 25 bp, Mus musculus
gatattgtggccgtcgtgcagagca

SEQ ID NO: 663554 - DNA, 25 bp, Mus musculus
gatattgtgtttcgcttccggtgtg

SEQ ID NO: 663555 - DNA, 25 bp, Mus musculus
gatattgtgtttggcttccggtgtg

SEQ ID NO: 663556 - DNA, 25 bp, Mus musculus
gatatttaaaccatgtcctgtgtac

SEQ ID NO: 663557 - DNA, 25 bp, Mus musculus
gatatttaaaccttgtcctgtgtac

SEQ ID NO: 663558 - DNA, 25 bp, Mus musculus
gatatttatcctccggaagaaggac

SEQ ID NO: 663559 - DNA, 25 bp, Mus musculus
gatatttatcctgcggaagaaggac

SEQ ID NO: 663560 - DNA, 25 bp, Mus musculus
gatatttcaaacactcctaggtgag

SEQ ID NO: 663561 - DNA, 25 bp, Mus musculus
gatatttcaaactctcctaggtgag

SEQ ID NO: 663562 - DNA, 25 bp, Mus musculus
gatatttccaaactttgcaggaaag

SEQ ID NO: 663563 - DNA, 25 bp, Mus musculus
gatatttccaaagtttgcaggaaag

SEQ ID NO: 663564 - DNA, 25 bp, Mus musculus
gatatttccagcaagagccctgtgg

SEQ ID NO: 663565 - DNA, 25 bp, Mus musculus
gatatttccagctagagccctgtgg

SEQ ID NO: 663566 - DNA, 25 bp, Mus musculus
gatatttccagtcttcgtgacacgg

SEQ ID NO: 663567 - DNA, 25 bp, Mus musculus
gatatttccagtgttcgtgacacgg

SEQ ID NO: 663568 - DNA, 25 bp, Mus musculus
gatatttccgcaatcacctatgaga

SEQ ID NO: 663569 - DNA, 25 bp, Mus musculus
gatatttccgcattcacctatgaga

SEQ ID NO: 663570 - DNA, 25 bp, Mus musculus
gatatttctgcacaaatagctgaga

SEQ ID NO: 663571 - DNA, 25 bp, Mus musculus
gatatttctgcagaaatagctgaga

SEQ ID NO: 663572 - DNA, 25 bp, Mus musculus
gatatttgccaccatccgtgaattg

SEQ ID NO: 663573 - DNA, 25 bp, Mus musculus
gatatttgccacgatccgtgaattg

SEQ ID NO: 663574 - DNA, 25 bp, Mus musculus
gatatttgctaaatgctgttcttag

SEQ ID NO: 663575 - DNA, 25 bp, Mus musculus
gatatttgctaattgctgttcttag

SEQ ID NO: 663576 - DNA, 25 bp, Mus musculus
gatatttgtgctactgcctaaagtg

SEQ ID NO: 663577 - DNA, 25 bp, Mus musculus
gatatttgtgcttctgcctaaagtg

SEQ ID NO: 663578 - DNA, 25 bp, Mus musculus
gatatttgtgtcagttttccgcatg

SEQ ID NO: 663579 - DNA, 25 bp, Mus musculus
gatatttgtgtctgttttccgcatg

SEQ ID NO: 663580 - DNA, 25 bp, Mus musculus
gatattttcaatcctgttatcaaac

SEQ ID NO: 663581 - DNA, 25 bp, Mus musculus
gatattttcaatgctgttatcaaac

SEQ ID NO: 663582 - DNA, 25 bp, Mus musculus
gatattttcattagctcaccagact

SEQ ID NO: 663583 - DNA, 25 bp, Mus musculus
gatattttcatttgctcaccagact

SEQ ID NO: 663584 - DNA, 25 bp, Mus musculus
gatattttcgtcaagctgtttccga

SEQ ID NO: 663585 - DNA, 25 bp, Mus musculus
gatattttcgtctagctgtttccga

SEQ ID NO: 663586 - DNA, 25 bp, Mus musculus
gatattttgccaactgccacgtgga

SEQ ID NO: 663587 - DNA, 25 bp, Mus musculus
gatattttgccatctgccacgtgga

SEQ ID NO: 663588 - DNA, 25 bp, Mus musculus
gatattttgccccagttcatggtgt

SEQ ID NO: 663589 - DNA, 25 bp, Mus musculus
gatattttgcccgagttcatggtgt

SEQ ID NO: 663590 - DNA, 25 bp, Mus musculus
gatcaaaaaggcaaggcttctccat

SEQ ID NO: 663591 - DNA, 25 bp, Mus musculus
gatcaaaaaggctaggcttctccat

SEQ ID NO: 663592 - DNA, 25 bp, Mus musculus
gatcaaaacagacaagtcagcccac

SEQ ID NO: 663593 - DNA, 25 bp, Mus musculus
gatcaaaacagagaagtcagcccac

SEQ ID NO: 663594 - DNA, 25 bp, Mus musculus
gatcaaaacctgaagctagctctag

SEQ ID NO: 663595 - DNA, 25 bp, Mus musculus
gatcaaaacctgtagctagctctag

SEQ ID NO: 663596 - DNA, 25 bp, Mus musculus
gatcaaaagataaaaagacggacca

SEQ ID NO: 663597 - DNA, 25 bp, Mus musculus
gatcaaaagatataaagacggacca

SEQ ID NO: 663598 - DNA, 25 bp, Mus musculus
gatcaaaatcaccagcgaacttgtg

SEQ ID NO: 663599 - DNA, 25 bp, Mus musculus
gatcaaaatcacgagcgaacttgtg

SEQ ID NO: 663600 - DNA, 25 bp, Mus musculus
gatcaaaatcgcaaaccctggcgct

SEQ ID NO: 663601 - DNA, 25 bp, Mus musculus
gatcaaaatcgctaaccctggcgct

SEQ ID NO: 663602 - DNA, 25 bp, Mus musculus
gatcaaacacgtccatgcattcatc

SEQ ID NO: 663603 - DNA, 25 bp, Mus musculus
gatcaaacacgtgcatgcattcatc

SEQ ID NO: 663604 - DNA, 25 bp, Mus musculus
gatcaaacagtgctcattcttcatg

SEQ ID NO: 663605 - DNA, 25 bp, Mus musculus
gatcaaacagtggtcattcttcatg

SEQ ID NO: 663606 - DNA, 25 bp, Mus musculus
gatcaaacccagaattgttctcctt

SEQ ID NO: 663607 - DNA, 25 bp, Mus musculus
gatcaaacccagtattgttctcctt

SEQ ID NO: 663608 - DNA, 25 bp, Mus musculus
gatcaaaccgctactaaatgataag

SEQ ID NO: 663609 - DNA, 25 bp, Mus musculus
gatcaaaccgcttctaaatgataag

SEQ ID NO: 663610 - DNA, 25 bp, Mus musculus
gatcaaacctttagtgcagagtggc

SEQ ID NO: 663611 - DNA, 25 bp, Mus musculus
gatcaaaccttttgtgcagagtggc

SEQ ID NO: 663612 - DNA, 25 bp, Mus musculus
gatcaaactggaaggactgtctgat

SEQ ID NO: 663613 - DNA, 25 bp, Mus musculus
gatcaaactggatggactgtctgat

SEQ ID NO: 663614 - DNA, 25 bp, Mus musculus
gatcaaactgtcagtattcgtttca

SEQ ID NO: 663615 - DNA, 25 bp, Mus musculus
gatcaaactgtctgtattcgtttca

SEQ ID NO: 663616 - DNA, 25 bp, Mus musculus
gatcaaagaaggagactacaacccc

SEQ ID NO: 663617 - DNA, 25 bp, Mus musculus
gatcaaagaaggtgactacaacccc

SEQ ID NO: 663618 - DNA, 25 bp, Mus musculus
gatcaaagagaacctattagacctg

SEQ ID NO: 663619 - DNA, 25 bp, Mus musculus
gatcaaagagaagctattagacctg

SEQ ID NO: 663620 - DNA, 25 bp, Mus musculus
gatcaaagaggcaccatgtaccaaa

SEQ ID NO: 663621 - DNA, 25 bp, Mus musculus
gatcaaagaggctccatgtaccaaa

SEQ ID NO: 663622 - DNA, 25 bp, Mus musculus
gatcaaagctcgagtcagggagatg

SEQ ID NO: 663623 - DNA, 25 bp, Mus musculus
gatcaaagctcgtgtcagggagatg

SEQ ID NO: 663624 - DNA, 25 bp, Mus musculus
gatcaaaggtttcgccaaggacatg

SEQ ID NO: 663625 - DNA, 25 bp, Mus musculus
gatcaaaggtttggccaaggacatg

SEQ ID NO: 663626 - DNA, 25 bp, Mus musculus
gatcaaagtcccagttgattggaac

SEQ ID NO: 663627 - DNA, 25 bp, Mus musculus
gatcaaagtccctgttgattggaac

SEQ ID NO: 663628 - DNA, 25 bp, Mus musculus
gatcaaatccccaacaatgtggccc

SEQ ID NO: 663629 - DNA, 25 bp, Mus musculus
gatcaaatcccctacaatgtggccc

SEQ ID NO: 663630 - DNA, 25 bp, Mus musculus
gatcaaatctcaatgctttgtgacg

SEQ ID NO: 663631 - DNA, 25 bp, Mus musculus
gatcaaatctcattgctttgtgacg

SEQ ID NO: 663632 - DNA, 25 bp, Mus musculus
gatcaaatctggcaacgagggtcga

SEQ ID NO: 663633 - DNA, 25 bp, Mus musculus
gatcaaatctgggaacgagggtcga

SEQ ID NO: 663634 - DNA, 25 bp, Mus musculus
gatcaacaaaacctgaggctcccca

SEQ ID NO: 663635 - DNA, 25 bp, Mus musculus
gatcaacaaaacgtgaggctcccca

SEQ ID NO: 663636 - DNA, 25 bp, Mus musculus
gatcaacaaaatcagccccagttgg

SEQ ID NO: 663637 - DNA, 25 bp, Mus musculus
gatcaacaaaatgagccccagttgg

SEQ ID NO: 663638 - DNA, 25 bp, Mus musculus
gatcaacaactgcattgtacagctg

SEQ ID NO: 663639 - DNA, 25 bp, Mus musculus
gatcaacaactggattgtacagctg

SEQ ID NO: 663640 - DNA, 25 bp, Mus musculus
gatcaacaaggaaatccggtgtaag

SEQ ID NO: 663641 - DNA, 25 bp, Mus musculus
gatcaacaaggaagatccccattaa

SEQ ID NO: 663642 - DNA, 25 bp, Mus musculus
gatcaacaaggatatccggtgtaag

SEQ ID NO: 663643 - DNA, 25 bp, Mus musculus
gatcaacaaggatgatccccattaa

SEQ ID NO: 663644 - DNA, 25 bp, Mus musculus
gatcaacaatttcacctttttcctg

SEQ ID NO: 663645 - DNA, 25 bp, Mus musculus
gatcaacaatttgacctttttcctg

SEQ ID NO: 663646 - DNA, 25 bp, Mus musculus
gatcaacaccttcctcatccatgag

SEQ ID NO: 663647 - DNA, 25 bp, Mus musculus
gatcaacaccttgctcatccatgag

SEQ ID NO: 663648 - DNA, 25 bp, Mus musculus
gatcaacactttcctagctactgcg

SEQ ID NO: 663649 - DNA, 25 bp, Mus musculus
gatcaacactttgctagctactgcg

SEQ ID NO: 663650 - DNA, 25 bp, Mus musculus
gatcaacagaaaatcttggctgctc

SEQ ID NO: 663651 - DNA, 25 bp, Mus musculus
gatcaacagaaattcttggctgctc

SEQ ID NO: 663652 - DNA, 25 bp, Mus musculus
gatcaacagcagcttgagcgccatt

SEQ ID NO: 663653 - DNA, 25 bp, Mus musculus
gatcaacagcaggttgagcgccatt

SEQ ID NO: 663654 - DNA, 25 bp, Mus musculus
gatcaacagctcacacttggcaggg

SEQ ID NO: 663655 - DNA, 25 bp, Mus musculus
gatcaacagctctcacttggcaggg

SEQ ID NO: 663656 - DNA, 25 bp, Mus musculus
gatcaacatcgaagttcttttcccg

SEQ ID NO: 663657 - DNA, 25 bp, Mus musculus
gatcaacatcgatgttcttttcccg

SEQ ID NO: 663658 - DNA, 25 bp, Mus musculus
gatcaaccaaagcaagtttatgtag

SEQ ID NO: 663659 - DNA, 25 bp, Mus musculus
gatcaaccaaaggaagtttatgtag

SEQ ID NO: 663660 - DNA, 25 bp, Mus musculus
gatcaaccaatgacttcagcgctgc

SEQ ID NO: 663661 - DNA, 25 bp, Mus musculus
gatcaaccaatgtcttcagcgctgc

SEQ ID NO: 663662 - DNA, 25 bp, Mus musculus
gatcaaccccagagcatcagactct

SEQ ID NO: 663663 - DNA, 25 bp, Mus musculus
gatcaaccccagtgcatcagactct

SEQ ID NO: 663664 - DNA, 25 bp, Mus musculus
gatcaaccctgaagctagtgctgcc

SEQ ID NO: 663665 - DNA, 25 bp, Mus musculus
gatcaaccctgatgctagtgctgcc

SEQ ID NO: 663666 - DNA, 25 bp, Mus musculus
gatcaaccgacgcacggctgctgag

SEQ ID NO: 663667 - DNA, 25 bp, Mus musculus
gatcaaccgacggacggctgctgag

SEQ ID NO: 663668 - DNA, 25 bp, Mus musculus
gatcaacctaacctggaactgtcca

SEQ ID NO: 663669 - DNA, 25 bp, Mus musculus
gatcaacctaacgtggaactgtcca

SEQ ID NO: 663670 - DNA, 25 bp, Mus musculus
gatcaacctcagcaacattcgagct

SEQ ID NO: 663671 - DNA, 25 bp, Mus musculus
gatcaacctcaggaacattcgagct

SEQ ID NO: 663672 - DNA, 25 bp, Mus musculus
gatcaacctgtcagtgccagacacg

SEQ ID NO: 663673 - DNA, 25 bp, Mus musculus
gatcaacctgtctgtgccagacacg

SEQ ID NO: 663674 - DNA, 25 bp, Mus musculus
gatcaacgacaacctcaacaacgtg

SEQ ID NO: 663675 - DNA, 25 bp, Mus musculus
gatcaacgacaagctcaacaacgtg

SEQ ID NO: 663676 - DNA, 25 bp, Mus musculus
gatcaacgtcatcctgaatggctcg

SEQ ID NO: 663677 - DNA, 25 bp, Mus musculus
gatcaacgtcatgctgaatggctcg

SEQ ID NO: 663678 - DNA, 25 bp, Mus musculus
gatcaactctatagattcgagcggc

SEQ ID NO: 663679 - DNA, 25 bp, Mus musculus
gatcaactctattgattcgagcggc

SEQ ID NO: 663680 - DNA, 25 bp, Mus musculus
gatcaactgctacgatgtgtttggg

SEQ ID NO: 663681 - DNA, 25 bp, Mus musculus
gatcaactgctaggatgtgtttggg

SEQ ID NO: 663682 - DNA, 25 bp, Mus musculus
gatcaactgtccactcttgctcact

SEQ ID NO: 663683 - DNA, 25 bp, Mus musculus
gatcaactgtcctctcttgctcact

SEQ ID NO: 663684 - DNA, 25 bp, Mus musculus
gatcaagaaattccgcgaggcctgc

SEQ ID NO: 663685 - DNA, 25 bp, Mus musculus
gatcaagaaattgcgcgaggcctgc

SEQ ID NO: 663686 - DNA, 25 bp, Mus musculus
gatcaagaactaatatccacagacc

SEQ ID NO: 663687 - DNA, 25 bp, Mus musculus
gatcaagaactattatccacagacc

SEQ ID NO: 663688 - DNA, 25 bp, Mus musculus
gatcaagaaggaaccccagagtccc

SEQ ID NO: 663689 - DNA, 25 bp, Mus musculus
gatcaagaaggatccccagagtccc

SEQ ID NO: 663690 - DNA, 25 bp, Mus musculus
gatcaagaatgaagtggattctact

SEQ ID NO: 663691 - DNA, 25 bp, Mus musculus
gatcaagaatgatgtggattctact

SEQ ID NO: 663692 - DNA, 25 bp, Mus musculus
gatcaagacccgagaagctgttgcc

SEQ ID NO: 663693 - DNA, 25 bp, Mus musculus
gatcaagacccgtgaagctgttgcc

SEQ ID NO: 663694 - DNA, 25 bp, Mus musculus
gatcaagagagtcggcaaggataac

SEQ ID NO: 663695 - DNA, 25 bp, Mus musculus
gatcaagagagtgggcaaggataac

SEQ ID NO: 663696 - DNA, 25 bp, Mus musculus
gatcaagaggctcctcagtgagaag

SEQ ID NO: 663697 - DNA, 25 bp, Mus musculus
gatcaagaggctgctcagtgagaag

SEQ ID NO: 663698 - DNA, 25 bp, Mus musculus
gatcaagatatcagcgtggtttctg

SEQ ID NO: 663699 - DNA, 25 bp, Mus musculus
gatcaagatatctgcgtggtttctg

SEQ ID NO: 663700 - DNA, 25 bp, Mus musculus
gatcaagcaatcagaacgtctgtcc

SEQ ID NO: 663701 - DNA, 25 bp, Mus musculus
gatcaagcaatctgaacgtctgtcc

SEQ ID NO: 663702 - DNA, 25 bp, Mus musculus
gatcaagcacgtcgaaaagaacggc

SEQ ID NO: 663703 - DNA, 25 bp, Mus musculus
gatcaagcacgtggaaaagaacggc

SEQ ID NO: 663704 - DNA, 25 bp, Mus musculus
gatcaagcaggacggagatgcatct

SEQ ID NO: 663705 - DNA, 25 bp, Mus musculus
gatcaagcaggagggagatgcatct

SEQ ID NO: 663706 - DNA, 25 bp, Mus musculus
gatcaagctgcacggagcccctaaa

SEQ ID NO: 663707 - DNA, 25 bp, Mus musculus
gatcaagctgcagggagcccctaaa

SEQ ID NO: 663708 - DNA, 25 bp, Mus musculus
gatcaaggaacaaaccaggaaccgt

SEQ ID NO: 663709 - DNA, 25 bp, Mus musculus
gatcaaggaacataccaggaaccgt

SEQ ID NO: 663710 - DNA, 25 bp, Mus musculus
gatcaaggaagacgacaaccagctc

SEQ ID NO: 663711 - DNA, 25 bp, Mus musculus
gatcaaggaagaggacaaccagctc

SEQ ID NO: 663712 - DNA, 25 bp, Mus musculus
gatcaaggaagtcgcagacaaaggc

SEQ ID NO: 663713 - DNA, 25 bp, Mus musculus
gatcaaggaagtggcagacaaaggc

SEQ ID NO: 663714 - DNA, 25 bp, Mus musculus
gatcaaggacgacgaccagctagaa

SEQ ID NO: 663715 - DNA, 25 bp, Mus musculus
gatcaaggacgaggaccagctagaa

SEQ ID NO: 663716 - DNA, 25 bp, Mus musculus
gatcaaggagctacctagcccctgg

SEQ ID NO: 663717 - DNA, 25 bp, Mus musculus
gatcaaggagctcactaatgcttac

SEQ ID NO: 663718 - DNA, 25 bp, Mus musculus
gatcaaggagctgactaatgcttac

SEQ ID NO: 663719 - DNA, 25 bp, Mus musculus
gatcaaggagcttcctagcccctgg

SEQ ID NO: 663720 - DNA, 25 bp, Mus musculus
gatcaaggtggacagttgttgtctc

SEQ ID NO: 663721 - DNA, 25 bp, Mus musculus
gatcaaggtggagagttgttgtctc

SEQ ID NO: 663722 - DNA, 25 bp, Mus musculus
gatcaaggtgttagttctggacgag

SEQ ID NO: 663723 - DNA, 25 bp, Mus musculus
gatcaaggtgtttgttctggacgag

SEQ ID NO: 663724 - DNA, 25 bp, Mus musculus
gatcaaggttctctctgacaagctg

SEQ ID NO: 663725 - DNA, 25 bp, Mus musculus
gatcaaggttctgtctgacaagctg

SEQ ID NO: 663726 - DNA, 25 bp, Mus musculus
gatcaagtataaccgcgaaggagac

SEQ ID NO: 663727 - DNA, 25 bp, Mus musculus
gatcaagtataagcgcgaaggagac

SEQ ID NO: 663728 - DNA, 25 bp, Mus musculus
gatcaagtcccccatcaaaatggcg

SEQ ID NO: 663729 - DNA, 25 bp, Mus musculus
gatcaagtccccgatcaaaatggcg

SEQ ID NO: 663730 - DNA, 25 bp, Mus musculus
gatcaagtcttgctacaatagagag

SEQ ID NO: 663731 - DNA, 25 bp, Mus musculus
gatcaagtcttggtacaatagagag

SEQ ID NO: 663732 - DNA, 25 bp, Mus musculus
gatcaagtgcagacaggtggtccac

SEQ ID NO: 663733 - DNA, 25 bp, Mus musculus
gatcaagtgcagactgagctgtggc

SEQ ID NO: 663734 - DNA, 25 bp, Mus musculus
gatcaagtgcagtcaggtggtccac

SEQ ID NO: 663735 - DNA, 25 bp, Mus musculus
gatcaagtgcagtctgagctgtggc

SEQ ID NO: 663736 - DNA, 25 bp, Mus musculus
gatcaagtgcctattgaaagagact

SEQ ID NO: 663737 - DNA, 25 bp, Mus musculus
gatcaagtgccttttgaaagagact

SEQ ID NO: 663738 - DNA, 25 bp, Mus musculus
gatcaagtggaaattgtagaacacc

SEQ ID NO: 663739 - DNA, 25 bp, Mus musculus
gatcaagtggaatttgtagaacacc

SEQ ID NO: 663740 - DNA, 25 bp, Mus musculus
gatcaagttgggaattctcctccag

SEQ ID NO: 663741 - DNA, 25 bp, Mus musculus
gatcaagttgggtattctcctccag

SEQ ID NO: 663742 - DNA, 25 bp, Mus musculus
gatcaagttgtcagatgcagacctc

SEQ ID NO: 663743 - DNA, 25 bp, Mus musculus
gatcaagttgtctgatgcagacctc

SEQ ID NO: 663744 - DNA, 25 bp, Mus musculus
gatcaagtttgtcgtcctggcagac

SEQ ID NO: 663745 - DNA, 25 bp, Mus musculus
gatcaagtttgtggtcctggcagac

SEQ ID NO: 663746 - DNA, 25 bp, Mus musculus
gatcaatccaggatgctgcagactc

SEQ ID NO: 663747 - DNA, 25 bp, Mus musculus
gatcaatccaggttgctgcagactc

SEQ ID NO: 663748 - DNA, 25 bp, Mus musculus
gatcaatctttaaggacttctacat

SEQ ID NO: 663749 - DNA, 25 bp, Mus musculus
gatcaatctttatggacttctacat

SEQ ID NO: 663750 - DNA, 25 bp, Mus musculus
gatcaatgacatccagttgtctaga

SEQ ID NO: 663751 - DNA, 25 bp, Mus musculus
gatcaatgacatgcagttgtctaga

SEQ ID NO: 663752 - DNA, 25 bp, Mus musculus
gatcaatgactcactacaacttcca

SEQ ID NO: 663753 - DNA, 25 bp, Mus musculus
gatcaatgactctctacaacttcca

SEQ ID NO: 663754 - DNA, 25 bp, Mus musculus
gatcaatgcagccacgcagatcttc

SEQ ID NO: 663755 - DNA, 25 bp, Mus musculus
gatcaatgcagcgacgcagatcttc

SEQ ID NO: 663756 - DNA, 25 bp, Mus musculus
gatcaatgccatcctctgggacaaa

SEQ ID NO: 663757 - DNA, 25 bp, Mus musculus
gatcaatgccatgctctgggacaaa

SEQ ID NO: 663758 - DNA, 25 bp, Mus musculus
gatcaatgctttagtcatgctcacc

SEQ ID NO: 663759 - DNA, 25 bp, Mus musculus
gatcaatgcttttgtcatgctcacc

SEQ ID NO: 663760 - DNA, 25 bp, Mus musculus
gatcaatggcgacattcgggcaaag

SEQ ID NO: 663761 - DNA, 25 bp, Mus musculus
gatcaatggcgagattcgggcaaag

SEQ ID NO: 663762 - DNA, 25 bp, Mus musculus
gatcaatggcttaaacctcggccga

SEQ ID NO: 663763 - DNA, 25 bp, Mus musculus
gatcaatggctttaacctcggccga

SEQ ID NO: 663764 - DNA, 25 bp, Mus musculus
gatcaatgggaaactcaagcccgca

SEQ ID NO: 663765 - DNA, 25 bp, Mus musculus
gatcaatgggaatctcaagcccgca

SEQ ID NO: 663766 - DNA, 25 bp, Mus musculus
gatcaattcctcaatgactagaacc

SEQ ID NO: 663767 - DNA, 25 bp, Mus musculus
gatcaattcctctatgactagaacc

SEQ ID NO: 663768 - DNA, 25 bp, Mus musculus
gatcaattgaccacaaactacagca

SEQ ID NO: 663769 - DNA, 25 bp, Mus musculus
gatcaattgacctcaaactacagca

SEQ ID NO: 663770 - DNA, 25 bp, Mus musculus
gatcaattgccacgacccctctata

SEQ ID NO: 663771 - DNA, 25 bp, Mus musculus
gatcaattgccaggacccctctata

SEQ ID NO: 663772 - DNA, 25 bp, Mus musculus
gatcacaacagccaaaggaaagaaa

SEQ ID NO: 663773 - DNA, 25 bp, Mus musculus
gatcacaacagcgaaaggaaagaaa

SEQ ID NO: 663774 - DNA, 25 bp, Mus musculus
gatcacaacttgcagaagctcctgg

SEQ ID NO: 663775 - DNA, 25 bp, Mus musculus
gatcacaacttggagaagctcctgg

SEQ ID NO: 663776 - DNA, 25 bp, Mus musculus
gatcacaagctacactcaatcaagc

SEQ ID NO: 663777 - DNA, 25 bp, Mus musculus
gatcacaagctagactcaatcaagc

SEQ ID NO: 663778 - DNA, 25 bp, Mus musculus
gatcacaatccaaagggactggatt

SEQ ID NO: 663779 - DNA, 25 bp, Mus musculus
gatcacaatccatagggactggatt

SEQ ID NO: 663780 - DNA, 25 bp, Mus musculus
gatcacacagtactgtcactggcat

SEQ ID NO: 663781 - DNA, 25 bp, Mus musculus
gatcacacagtagtgtcactggcat

SEQ ID NO: 663782 - DNA, 25 bp, Mus musculus
gatcacacatctacgagctctgcca

SEQ ID NO: 663783 - DNA, 25 bp, Mus musculus
gatcacacatcttcgagctctgcca

SEQ ID NO: 663784 - DNA, 25 bp, Mus musculus
gatcacacccccatggagacggtgg

SEQ ID NO: 663785 - DNA, 25 bp, Mus musculus
gatcacacccccttggagacggtgg

SEQ ID NO: 663786 - DNA, 25 bp, Mus musculus
gatcacacctttacagttatacttc

SEQ ID NO: 663787 - DNA, 25 bp, Mus musculus
gatcacaccttttcagttatacttc

SEQ ID NO: 663788 - DNA, 25 bp, Mus musculus
gatcacactcgtagtcctggaaaaa

SEQ ID NO: 663789 - DNA, 25 bp, Mus musculus
gatcacactcgttgtcctggaaaaa

SEQ ID NO: 663790 - DNA, 25 bp, Mus musculus
gatcacagacctcagacggaccctg

SEQ ID NO: 663791 - DNA, 25 bp, Mus musculus
gatcacagacctgagacggaccctg

SEQ ID NO: 663792 - DNA, 25 bp, Mus musculus
gatcacagagtaacagagccgcaag

SEQ ID NO: 663793 - DNA, 25 bp, Mus musculus
gatcacagagtatcagagccgcaag

SEQ ID NO: 663794 - DNA, 25 bp, Mus musculus
gatcacagagttcggcatgatccct

SEQ ID NO: 663795 - DNA, 25 bp, Mus musculus
gatcacagagttgggcatgatccct

SEQ ID NO: 663796 - DNA, 25 bp, Mus musculus
gatcacagccaccatatactgacta

SEQ ID NO: 663797 - DNA, 25 bp, Mus musculus
gatcacagccacgatatactgacta

SEQ ID NO: 663798 - DNA, 25 bp, Mus musculus
gatcacaggaagagaccaaagtata

SEQ ID NO: 663799 - DNA, 25 bp, Mus musculus
gatcacaggaagtgaccaaagtata

SEQ ID NO: 663800 - DNA, 25 bp, Mus musculus
gatcacaggcttcttacctgccgaa

SEQ ID NO: 663801 - DNA, 25 bp, Mus musculus
gatcacaggcttgttacctgccgaa

SEQ ID NO: 663802 - DNA, 25 bp, Mus musculus
gatcacagggaaatgggagaaaccc

SEQ ID NO: 663803 - DNA, 25 bp, Mus musculus
gatcacagggaattgggagaaaccc

SEQ ID NO: 663804 - DNA, 25 bp, Mus musculus
gatcacaggtgcctgcagaagcata

SEQ ID NO: 663805 - DNA, 25 bp, Mus musculus
gatcacaggtgcgtgcagaagcata

SEQ ID NO: 663806 - DNA, 25 bp, Mus musculus
gatcacagtctgcaaatgtcttaca

SEQ ID NO: 663807 - DNA, 25 bp, Mus musculus
gatcacagtctggaaatgtcttaca

SEQ ID NO: 663808 - DNA, 25 bp, Mus musculus
gatcacatgattcacacttgtctcc

SEQ ID NO: 663809 - DNA, 25 bp, Mus musculus
gatcacatgattgacacttgtctcc

SEQ ID NO: 663810 - DNA, 25 bp, Mus musculus
gatcacatttctcgaacgacgacca

SEQ ID NO: 663811 - DNA, 25 bp, Mus musculus
gatcacatttctggaacgacgacca

SEQ ID NO: 663812 - DNA, 25 bp, Mus musculus
gatcaccaaggacgtggttctgcag

SEQ ID NO: 663813 - DNA, 25 bp, Mus musculus
gatcaccaaggaggtggttctgcag

SEQ ID NO: 663814 - DNA, 25 bp, Mus musculus
gatcaccaaggtagatgcacccagc

SEQ ID NO: 663815 - DNA, 25 bp, Mus musculus
gatcaccaaggttgatgcacccagc

SEQ ID NO: 663816 - DNA, 25 bp, Mus musculus
gatcaccaatctatgagcccaggag

SEQ ID NO: 663817 - DNA, 25 bp, Mus musculus
gatcaccaatctttgagcccaggag

SEQ ID NO: 663818 - DNA, 25 bp, Mus musculus
gatcaccacccaacagaaatcgcag

SEQ ID NO: 663819 - DNA, 25 bp, Mus musculus
gatcaccacccatcagaaatcgcag

SEQ ID NO: 663820 - DNA, 25 bp, Mus musculus
gatcaccacttcaatacaaagcaag

SEQ ID NO: 663821 - DNA, 25 bp, Mus musculus
gatcaccacttctatacaaagcaag

SEQ ID NO: 663822 - DNA, 25 bp, Mus musculus
gatcaccaggaacaactggaaatgc

SEQ ID NO: 663823 - DNA, 25 bp, Mus musculus
gatcaccaggaagaactggaaatgc

SEQ ID NO: 663824 - DNA, 25 bp, Mus musculus
gatcaccatggcaacgcagtgtact

SEQ ID NO: 663825 - DNA, 25 bp, Mus musculus
gatcaccatggctacgcagtgtact

SEQ ID NO: 663826 - DNA, 25 bp, Mus musculus
gatcaccattgccactcctgagagt

SEQ ID NO: 663827 - DNA, 25 bp, Mus musculus
gatcaccattgcgactcctgagagt

SEQ ID NO: 663828 - DNA, 25 bp, Mus musculus
gatcacccacggactcatggctggg

SEQ ID NO: 663829 - DNA, 25 bp, Mus musculus
gatcacccacggtctcatggctggg

SEQ ID NO: 663830 - DNA, 25 bp, Mus musculus
gatcacccagtgcagaccttttctt

SEQ ID NO: 663831 - DNA, 25 bp, Mus musculus
gatcacccagtggagaccttttctt

SEQ ID NO: 663832 - DNA, 25 bp, Mus musculus
gatcaccccttcatactatacaact

SEQ ID NO: 663833 - DNA, 25 bp, Mus musculus
gatcaccccttccagaacactgtag

SEQ ID NO: 663834 - DNA, 25 bp, Mus musculus
gatcaccccttcgagaacactgtag

SEQ ID NO: 663835 - DNA, 25 bp, Mus musculus
gatcaccccttcttactatacaact

SEQ ID NO: 663836 - DNA, 25 bp, Mus musculus
gatcacccgagaaattaagcagtta

SEQ ID NO: 663837 - DNA, 25 bp, Mus musculus
gatcacccgagatattaagcagtta

SEQ ID NO: 663838 - DNA, 25 bp, Mus musculus
gatcaccctggtcgatgagtccgac

SEQ ID NO: 663839 - DNA, 25 bp, Mus musculus
gatcaccctggtggatgagtccgac

SEQ ID NO: 663840 - DNA, 25 bp, Mus musculus
gatcaccgagatccaggagcagctg

SEQ ID NO: 663841 - DNA, 25 bp, Mus musculus
gatcaccgagatgcaggagcagctg

SEQ ID NO: 663842 - DNA, 25 bp, Mus musculus
gatcaccggctactcttgaaggcca

SEQ ID NO: 663843 - DNA, 25 bp, Mus musculus
gatcaccggctagtcttgaaggcca

SEQ ID NO: 663844 - DNA, 25 bp, Mus musculus
gatcaccgtgctcgagacaggaact

SEQ ID NO: 663845 - DNA, 25 bp, Mus musculus
gatcaccgtgctggagacaggaact

SEQ ID NO: 663846 - DNA, 25 bp, Mus musculus
gatcacctacctcgacggattcgac

SEQ ID NO: 663847 - DNA, 25 bp, Mus musculus
gatcacctacctggacggattcgac

SEQ ID NO: 663848 - DNA, 25 bp, Mus musculus
gatcacctcaaaaatgtttggctgc

SEQ ID NO: 663849 - DNA, 25 bp, Mus musculus
gatcacctcaaatatgtttggctgc

SEQ ID NO: 663850 - DNA, 25 bp, Mus musculus
gatcacctgaagctcttcctgtcac

SEQ ID NO: 663851 - DNA, 25 bp, Mus musculus
gatcacctgaaggtcttcctgtcac

SEQ ID NO: 663852 - DNA, 25 bp, Mus musculus
gatcacctttacctgcagcctagct

SEQ ID NO: 663853 - DNA, 25 bp, Mus musculus
gatcacctttacgtgcagcctagct

SEQ ID NO: 663854 - DNA, 25 bp, Mus musculus
gatcacgatgttccggatgctgagc

SEQ ID NO: 663855 - DNA, 25 bp, Mus musculus
gatcacgatgttgcggatgctgagc

SEQ ID NO: 663856 - DNA, 25 bp, Mus musculus
gatcacgcagctaagaaagttcatg

SEQ ID NO: 663857 - DNA, 25 bp, Mus musculus
gatcacgcagcttagaaagttcatg

SEQ ID NO: 663858 - DNA, 25 bp, Mus musculus
gatcactaatagaagatcaagtcca

SEQ ID NO: 663859 - DNA, 25 bp, Mus musculus
gatcactaatagtagatcaagtcca

SEQ ID NO: 663860 - DNA, 25 bp, Mus musculus
gatcactatactaaataaacacagc

SEQ ID NO: 663861 - DNA, 25 bp, Mus musculus
gatcactatacttaataaacacagc

SEQ ID NO: 663862 - DNA, 25 bp, Mus musculus
gatcactatcaacgctatgctgagg

SEQ ID NO: 663863 - DNA, 25 bp, Mus musculus
gatcactatcaaggctatgctgagg

SEQ ID NO: 663864 - DNA, 25 bp, Mus musculus
gatcactcaccaaaattcaccaaga

SEQ ID NO: 663865 - DNA, 25 bp, Mus musculus
gatcactcaccataattcaccaaga

SEQ ID NO: 663866 - DNA, 25 bp, Mus musculus
gatcactccaacaccggaaatgagt

SEQ ID NO: 663867 - DNA, 25 bp, Mus musculus
gatcactccaactccggaaatgagt

SEQ ID NO: 663868 - DNA, 25 bp, Mus musculus
gatcactcttgcatctgaaaaccat

SEQ ID NO: 663869 - DNA, 25 bp, Mus musculus
gatcactcttgcttctgaaaaccat

SEQ ID NO: 663870 - DNA, 25 bp, Mus musculus
gatcactgaagactctaaggctctc

SEQ ID NO: 663871 - DNA, 25 bp, Mus musculus
gatcactgaagagtctaaggctctc

SEQ ID NO: 663872 - DNA, 25 bp, Mus musculus
gatcactgaccaaccgtcggaactg

SEQ ID NO: 663873 - DNA, 25 bp, Mus musculus
gatcactgaccatccgtcggaactg

SEQ ID NO: 663874 - DNA, 25 bp, Mus musculus
gatcactgccctcagagtgaagaag

SEQ ID NO: 663875 - DNA, 25 bp, Mus musculus
gatcactgccctgagagtgaagaag

SEQ ID NO: 663876 - DNA, 25 bp, Mus musculus
gatcactgggtgagtttcaggcctt

SEQ ID NO: 663877 - DNA, 25 bp, Mus musculus
gatcactgggtgtgtttcaggcctt

SEQ ID NO: 663878 - DNA, 25 bp, Mus musculus
gatcactgtcagagagacctaccca

SEQ ID NO: 663879 - DNA, 25 bp, Mus musculus
gatcactgtcagtgagacctaccca

SEQ ID NO: 663880 - DNA, 25 bp, Mus musculus
gatcactgtgtcacctgacaagccc

SEQ ID NO: 663881 - DNA, 25 bp, Mus musculus
gatcactgtgtctcctgacaagccc

SEQ ID NO: 663882 - DNA, 25 bp, Mus musculus
gatcacttcacacacatcttcatcg

SEQ ID NO: 663883 - DNA, 25 bp, Mus musculus
gatcacttcacagacatcttcatcg

SEQ ID NO: 663884 - DNA, 25 bp, Mus musculus
gatcactttactccgcctcagtcgg

SEQ ID NO: 663885 - DNA, 25 bp, Mus musculus
gatcactttactgcgcctcagtcgg

SEQ ID NO: 663886 - DNA, 25 bp, Mus musculus
gatcactttgaccacaacatcagcc

SEQ ID NO: 663887 - DNA, 25 bp, Mus musculus
gatcactttgacgacaacatcagcc

SEQ ID NO: 663888 - DNA, 25 bp, Mus musculus
gatcacttttgaagtcacgtttcgc

SEQ ID NO: 663889 - DNA, 25 bp, Mus musculus
gatcacttttgatgtcacgtttcgc

SEQ ID NO: 663890 - DNA, 25 bp, Mus musculus
gatcagaaaaccacactcctccatt

SEQ ID NO: 663891 - DNA, 25 bp, Mus musculus
gatcagaaaaccatccacttccagg

SEQ ID NO: 663892 - DNA, 25 bp, Mus musculus
gatcagaaaacctcactcctccatt

SEQ ID NO: 663893 - DNA, 25 bp, Mus musculus
gatcagaaaaccttccacttccagg

SEQ ID NO: 663894 - DNA, 25 bp, Mus musculus
gatcagaaagacaaggtgactctca

SEQ ID NO: 663895 - DNA, 25 bp, Mus musculus
gatcagaaagactaggtgactctca

SEQ ID NO: 663896 - DNA, 25 bp, Mus musculus
gatcagaaagtacaccgaggagctg

SEQ ID NO: 663897 - DNA, 25 bp, Mus musculus
gatcagaaagtagaccgaggagctg

SEQ ID NO: 663898 - DNA, 25 bp, Mus musculus
gatcagaatgagaatgagtcccgca

SEQ ID NO: 663899 - DNA, 25 bp, Mus musculus
gatcagaatgagctggtcagtgcca

SEQ ID NO: 663900 - DNA, 25 bp, Mus musculus
gatcagaatgaggtggtcagtgcca

SEQ ID NO: 663901 - DNA, 25 bp, Mus musculus
gatcagaatgagtatgagtcccgca

SEQ ID NO: 663902 - DNA, 25 bp, Mus musculus
gatcagaatttgagtttctcagaaa

SEQ ID NO: 663903 - DNA, 25 bp, Mus musculus
gatcagaatttgtgtttctcagaaa

SEQ ID NO: 663904 - DNA, 25 bp, Mus musculus
gatcagaccaagacaattgttgaaa

SEQ ID NO: 663905 - DNA, 25 bp, Mus musculus
gatcagaccaagtcaattgttgaaa

SEQ ID NO: 663906 - DNA, 25 bp, Mus musculus
gatcagaccaataatgcctactgtg

SEQ ID NO: 663907 - DNA, 25 bp, Mus musculus
gatcagaccaattatgcctactgtg

SEQ ID NO: 663908 - DNA, 25 bp, Mus musculus
gatcagaccatgaagcttgttgaga

SEQ ID NO: 663909 - DNA, 25 bp, Mus musculus
gatcagaccatgtagcttgttgaga

SEQ ID NO: 663910 - DNA, 25 bp, Mus musculus
gatcagaccttgaaagcattaatgg

SEQ ID NO: 663911 - DNA, 25 bp, Mus musculus
gatcagaccttgtaagcattaatgg

SEQ ID NO: 663912 - DNA, 25 bp, Mus musculus
gatcagactcctagtgaaccacaga

SEQ ID NO: 663913 - DNA, 25 bp, Mus musculus
gatcagactccttgtgaaccacaga

SEQ ID NO: 663914 - DNA, 25 bp, Mus musculus
gatcagactgagaaaacccatagtt

SEQ ID NO: 663915 - DNA, 25 bp, Mus musculus
gatcagactgagtaaacccatagtt

SEQ ID NO: 663916 - DNA, 25 bp, Mus musculus
gatcagactgtgcagtgcacggtca

SEQ ID NO: 663917 - DNA, 25 bp, Mus musculus
gatcagactgtggagtgcacggtca

SEQ ID NO: 663918 - DNA, 25 bp, Mus musculus
gatcagagagagaggattacactag

SEQ ID NO: 663919 - DNA, 25 bp, Mus musculus
gatcagagagagtggattacactag

SEQ ID NO: 663920 - DNA, 25 bp, Mus musculus
gatcagaggataaccccggggtccg

SEQ ID NO: 663921 - DNA, 25 bp, Mus musculus
gatcagaggatatccccggggtccg

SEQ ID NO: 663922 - DNA, 25 bp, Mus musculus
gatcagaggcagaagatttatacag

SEQ ID NO: 663923 - DNA, 25 bp, Mus musculus
gatcagaggcagtagatttatacag

SEQ ID NO: 663924 - DNA, 25 bp, Mus musculus
gatcagaggcgcatcgaatggcaga

SEQ ID NO: 663925 - DNA, 25 bp, Mus musculus
gatcagaggcgcttcgaatggcaga

SEQ ID NO: 663926 - DNA, 25 bp, Mus musculus
gatcagagggaaccttggacccatc

SEQ ID NO: 663927 - DNA, 25 bp, Mus musculus
gatcagagggaagcttggacccatc

SEQ ID NO: 663928 - DNA, 25 bp, Mus musculus
gatcagagtaggaacaagggcagct

SEQ ID NO: 663929 - DNA, 25 bp, Mus musculus
gatcagagtaggtacaagggcagct

SEQ ID NO: 663930 - DNA, 25 bp, Mus musculus
gatcagataaagagccaggagcagc

SEQ ID NO: 663931 - DNA, 25 bp, Mus musculus
gatcagataaagtgccaggagcagc

SEQ ID NO: 663932 - DNA, 25 bp, Mus musculus
gatcagatcatccactgggtacggg

SEQ ID NO: 663933 - DNA, 25 bp, Mus musculus
gatcagatcatcgactgggtacggg

SEQ ID NO: 663934 - DNA, 25 bp, Mus musculus
gatcagatctgaatggcccacctgg

SEQ ID NO: 663935 - DNA, 25 bp, Mus musculus
gatcagatctgattggcccacctgg

SEQ ID NO: 663936 - DNA, 25 bp, Mus musculus
gatcagatcttcagtatacaaatcg

SEQ ID NO: 663937 - DNA, 25 bp, Mus musculus
gatcagatcttccaggaagacttct

SEQ ID NO: 663938 - DNA, 25 bp, Mus musculus
gatcagatcttcgaggaagacttct

SEQ ID NO: 663939 - DNA, 25 bp, Mus musculus
gatcagatcttctgtatacaaatcg

SEQ ID NO: 663940 - DNA, 25 bp, Mus musculus
gatcagatgctcatgaaagacctgg

SEQ ID NO: 663941 - DNA, 25 bp, Mus musculus
gatcagatgctcttgaaagacctgg

SEQ ID NO: 663942 - DNA, 25 bp, Mus musculus
gatcagattcaacggcttcgtgagg

SEQ ID NO: 663943 - DNA, 25 bp, Mus musculus
gatcagattcaagggcttcgtgagg

SEQ ID NO: 663944 - DNA, 25 bp, Mus musculus
gatcagattggcctgacctgcccaa

SEQ ID NO: 663945 - DNA, 25 bp, Mus musculus
gatcagattggcgtgacctgcccaa

SEQ ID NO: 663946 - DNA, 25 bp, Mus musculus
gatcagattgtgagcaaactcgttg

SEQ ID NO: 663947 - DNA, 25 bp, Mus musculus
gatcagattgtgtgcaaactcgttg

SEQ ID NO: 663948 - DNA, 25 bp, Mus musculus
gatcagcaagagagacgtgaagtca

SEQ ID NO: 663949 - DNA, 25 bp, Mus musculus
gatcagcaagagtgacgtgaagtca

SEQ ID NO: 663950 - DNA, 25 bp, Mus musculus
gatcagcaatggctttggactcaaa

SEQ ID NO: 663951 - DNA, 25 bp, Mus musculus
gatcagcaatgggtttggactcaaa

SEQ ID NO: 663952 - DNA, 25 bp, Mus musculus
gatcagcagctcagaggattcggac

SEQ ID NO: 663953 - DNA, 25 bp, Mus musculus
gatcagcagctctgaggattcggac

SEQ ID NO: 663954 - DNA, 25 bp, Mus musculus
gatcagcataagaccatctgtagtg

SEQ ID NO: 663955 - DNA, 25 bp, Mus musculus
gatcagcataagtccatctgtagtg

SEQ ID NO: 663956 - DNA, 25 bp, Mus musculus
gatcagcatccacccggcaggtgga

SEQ ID NO: 663957 - DNA, 25 bp, Mus musculus
gatcagcatccagccggcaggtgga

SEQ ID NO: 663958 - DNA, 25 bp, Mus musculus
gatcagcattctagagctggcagct

SEQ ID NO: 663959 - DNA, 25 bp, Mus musculus
gatcagcattcttgagctggcagct

SEQ ID NO: 663960 - DNA, 25 bp, Mus musculus
gatcagcattgaccgggcctaccct

SEQ ID NO: 663961 - DNA, 25 bp, Mus musculus
gatcagcattgagcgggcctaccct

SEQ ID NO: 663962 - DNA, 25 bp, Mus musculus
gatcagccaggacctaaaggaagtg

SEQ ID NO: 663963 - DNA, 25 bp, Mus musculus
gatcagccaggagctaaaggaagtg

SEQ ID NO: 663964 - DNA, 25 bp, Mus musculus
gatcagcccctgacattgttaaaag

SEQ ID NO: 663965 - DNA, 25 bp, Mus musculus
gatcagcccctgtcattgttaaaag

SEQ ID NO: 663966 - DNA, 25 bp, Mus musculus
gatcagccctcaaggctatggccgc

SEQ ID NO: 663967 - DNA, 25 bp, Mus musculus
gatcagccctcatggctatggccgc

SEQ ID NO: 663968 - DNA, 25 bp, Mus musculus
gatcagccctctcgctcagcagatg

SEQ ID NO: 663969 - DNA, 25 bp, Mus musculus
gatcagccctctggctcagcagatg

SEQ ID NO: 663970 - DNA, 25 bp, Mus musculus
gatcagcccttgaggcagcccacaa

SEQ ID NO: 663971 - DNA, 25 bp, Mus musculus
gatcagcccttgtggcagcccacaa

SEQ ID NO: 663972 - DNA, 25 bp, Mus musculus
gatcagccgtgtacatgctccctac

SEQ ID NO: 663973 - DNA, 25 bp, Mus musculus
gatcagccgtgttcatgctccctac

SEQ ID NO: 663974 - DNA, 25 bp, Mus musculus
gatcagcctctcagtgcttgtcttg

SEQ ID NO: 663975 - DNA, 25 bp, Mus musculus
gatcagcctctctgtgcttgtcttg

SEQ ID NO: 663976 - DNA, 25 bp, Mus musculus
gatcagcctgttcttacgaggagga

SEQ ID NO: 663977 - DNA, 25 bp, Mus musculus
gatcagcctgttgttacgaggagga

SEQ ID NO: 663978 - DNA, 25 bp, Mus musculus
gatcagccttcacttgtccacggaa

SEQ ID NO: 663979 - DNA, 25 bp, Mus musculus
gatcagccttcagttgtccacggaa

SEQ ID NO: 663980 - DNA, 25 bp, Mus musculus
gatcagccttgcaaataatcacaga

SEQ ID NO: 663981 - DNA, 25 bp, Mus musculus
gatcagccttgctaataatcacaga

SEQ ID NO: 663982 - DNA, 25 bp, Mus musculus
gatcagccttttagttccaatgagg

SEQ ID NO: 663983 - DNA, 25 bp, Mus musculus
gatcagcctttttgttccaatgagg

SEQ ID NO: 663984 - DNA, 25 bp, Mus musculus
gatcagcgactaagaagactccgtg

SEQ ID NO: 663985 - DNA, 25 bp, Mus musculus
gatcagcgactatgaagactccgtg

SEQ ID NO: 663986 - DNA, 25 bp, Mus musculus
gatcagcgccgacctggacctctag

SEQ ID NO: 663987 - DNA, 25 bp, Mus musculus
gatcagcgccgagctggacctctag

SEQ ID NO: 663988 - DNA, 25 bp, Mus musculus
gatcagctcatcaggactcagacat

SEQ ID NO: 663989 - DNA, 25 bp, Mus musculus
gatcagctcatctggactcagacat

SEQ ID NO: 663990 - DNA, 25 bp, Mus musculus
gatcagctcgagaggcaaagcaacc

SEQ ID NO: 663991 - DNA, 25 bp, Mus musculus
gatcagctcgagtggcaaagcaacc

SEQ ID NO: 663992 - DNA, 25 bp, Mus musculus
gatcagctctgacttggacgggcat

SEQ ID NO: 663993 - DNA, 25 bp, Mus musculus
gatcagctctgagttggacgggcat

SEQ ID NO: 663994 - DNA, 25 bp, Mus musculus
gatcagctgagcaagacaaacctct

SEQ ID NO: 663995 - DNA, 25 bp, Mus musculus
gatcagctgagcatggccctggctt

SEQ ID NO: 663996 - DNA, 25 bp, Mus musculus
gatcagctgagctagacaaacctct

SEQ ID NO: 663997 - DNA, 25 bp, Mus musculus
gatcagctgagcttggccctggctt

SEQ ID NO: 663998 - DNA, 25 bp, Mus musculus
gatcagctgaggctttgatgttgct

SEQ ID NO: 663999 - DNA, 25 bp, Mus musculus
gatcagctgagggtttgatgttgct

SEQ ID NO: 664000 - DNA, 25 bp, Mus musculus
gatcagctgcaccaactagggatgc

SEQ ID NO: 664001 - DNA, 25 bp, Mus musculus
gatcagctgcacgaactagggatgc

SEQ ID NO: 664002 - DNA, 25 bp, Mus musculus
gatcagctggttagtgaacaacgtg

SEQ ID NO: 664003 - DNA, 25 bp, Mus musculus
gatcagctggtttgtgaacaacgtg

SEQ ID NO: 664004 - DNA, 25 bp, Mus musculus
gatcagctttgaagagtttatcaag

SEQ ID NO: 664005 - DNA, 25 bp, Mus musculus
gatcagctttgatgagtttatcaag

SEQ ID NO: 664006 - DNA, 25 bp, Mus musculus
gatcaggaaatgaagagtgttgaag

SEQ ID NO: 664007 - DNA, 25 bp, Mus musculus
gatcaggaaatgtagagtgttgaag

SEQ ID NO: 664008 - DNA, 25 bp, Mus musculus
gatcaggagaatcgttgaagtctta

SEQ ID NO: 664009 - DNA, 25 bp, Mus musculus
gatcaggagaatggttgaagtctta

SEQ ID NO: 664010 - DNA, 25 bp, Mus musculus
gatcaggagtgcctacaagagcacc

SEQ ID NO: 664011 - DNA, 25 bp, Mus musculus
gatcaggagtgcgtacaagagcacc

SEQ ID NO: 664012 - DNA, 25 bp, Mus musculus
gatcaggattccatattgagtcgcg

SEQ ID NO: 664013 - DNA, 25 bp, Mus musculus
gatcaggattccttattgagtcgcg

SEQ ID NO: 664014 - DNA, 25 bp, Mus musculus
gatcaggcacctatttctttgtgtg

SEQ ID NO: 664015 - DNA, 25 bp, Mus musculus
gatcaggcacctttttctttgtgtg

SEQ ID NO: 664016 - DNA, 25 bp, Mus musculus
gatcaggccaatattcagcaaccgc

SEQ ID NO: 664017 - DNA, 25 bp, Mus musculus
gatcaggccaattttcagcaaccgc

SEQ ID NO: 664018 - DNA, 25 bp, Mus musculus
gatcaggccaggcacttaacttcag

SEQ ID NO: 664019 - DNA, 25 bp, Mus musculus
gatcaggccagggacttaacttcag

SEQ ID NO: 664020 - DNA, 25 bp, Mus musculus
gatcaggcgcctctctgtgctagtt

SEQ ID NO: 664021 - DNA, 25 bp, Mus musculus
gatcaggcgcctgtctgtgctagtt

SEQ ID NO: 664022 - DNA, 25 bp, Mus musculus
gatcaggctcccagggcagtcaata

SEQ ID NO: 664023 - DNA, 25 bp, Mus musculus
gatcaggctccctgggcagtcaata

SEQ ID NO: 664024 - DNA, 25 bp, Mus musculus
gatcaggtactcatggcagccaaag

SEQ ID NO: 664025 - DNA, 25 bp, Mus musculus
gatcaggtactcttggcagccaaag

SEQ ID NO: 664026 - DNA, 25 bp, Mus musculus
gatcaggtatggaatagtaagcatg

SEQ ID NO: 664027 - DNA, 25 bp, Mus musculus
gatcaggtatggtatagtaagcatg

SEQ ID NO: 664028 - DNA, 25 bp, Mus musculus
gatcaggtgactcatgatgaagaag

SEQ ID NO: 664029 - DNA, 25 bp, Mus musculus
gatcaggtgactgatgatgaagaag

SEQ ID NO: 664030 - DNA, 25 bp, Mus musculus
gatcaggtgtaacgctgcagtcgcc

SEQ ID NO: 664031 - DNA, 25 bp, Mus musculus
gatcaggtgtaaggctgcagtcgcc

SEQ ID NO: 664032 - DNA, 25 bp, Mus musculus
gatcaggttatccagctcatgaaca

SEQ ID NO: 664033 - DNA, 25 bp, Mus musculus
gatcaggttatcgagctcatgaaca

SEQ ID NO: 664034 - DNA, 25 bp, Mus musculus
gatcaggttcatccactgattcatc

SEQ ID NO: 664035 - DNA, 25 bp, Mus musculus
gatcaggttcatgcactgattcatc

SEQ ID NO: 664036 - DNA, 25 bp, Mus musculus
gatcagtaacaaacaggttggctct

SEQ ID NO: 664037 - DNA, 25 bp, Mus musculus
gatcagtaacaatcaggttggctct

SEQ ID NO: 664038 - DNA, 25 bp, Mus musculus
gatcagtaatagatatgcaggctcc

SEQ ID NO: 664039 - DNA, 25 bp, Mus musculus
gatcagtaatagttatgcaggctcc

SEQ ID NO: 664040 - DNA, 25 bp, Mus musculus
gatcagtacaacacccggtggctca

SEQ ID NO: 664041 - DNA, 25 bp, Mus musculus
gatcagtacaactcccggtggctca

SEQ ID NO: 664042 - DNA, 25 bp, Mus musculus
gatcagtactaaaacccgattctga

SEQ ID NO: 664043 - DNA, 25 bp, Mus musculus
gatcagtactaatacccgattctga

SEQ ID NO: 664044 - DNA, 25 bp, Mus musculus
gatcagtatgagactattctgggca

SEQ ID NO: 664045 - DNA, 25 bp, Mus musculus
gatcagtatgagtctattctgggca

SEQ ID NO: 664046 - DNA, 25 bp, Mus musculus
gatcagtattgacggcattggagcc

SEQ ID NO: 664047 - DNA, 25 bp, Mus musculus
gatcagtattgagggcattggagcc

SEQ ID NO: 664048 - DNA, 25 bp, Mus musculus
gatcagtcggcgaattaaagccctg

SEQ ID NO: 664049 - DNA, 25 bp, Mus musculus
gatcagtcggcgtattaaagccctg

SEQ ID NO: 664050 - DNA, 25 bp, Mus musculus
gatcagtctgctctccctgaacctg

SEQ ID NO: 664051 - DNA, 25 bp, Mus musculus
gatcagtctgctgtccctgaacctg

SEQ ID NO: 664052 - DNA, 25 bp, Mus musculus
gatcagtgagcgagatatactctgt

SEQ ID NO: 664053 - DNA, 25 bp, Mus musculus
gatcagtgagcgtgatatactctgt

SEQ ID NO: 664054 - DNA, 25 bp, Mus musculus
gatcagtgatacacttgaacaaaag

SEQ ID NO: 664055 - DNA, 25 bp, Mus musculus
gatcagtgatactcttgaacaaaag

SEQ ID NO: 664056 - DNA, 25 bp, Mus musculus
gatcagtgatccatctcctaaaata

SEQ ID NO: 664057 - DNA, 25 bp, Mus musculus
gatcagtgatccttctcctaaaata

SEQ ID NO: 664058 - DNA, 25 bp, Mus musculus
gatcagtgcctgagagagcatgctg

SEQ ID NO: 664059 - DNA, 25 bp, Mus musculus
gatcagtgcctgtgagagcatgctg

SEQ ID NO: 664060 - DNA, 25 bp, Mus musculus
gatcagtgccttaggctacctcgag

SEQ ID NO: 664061 - DNA, 25 bp, Mus musculus
gatcagtgcctttggctacctcgag

SEQ ID NO: 664062 - DNA, 25 bp, Mus musculus
gatcagtggagacctaacatgccct

SEQ ID NO: 664063 - DNA, 25 bp, Mus musculus
gatcagtggagagctaacatgccct

SEQ ID NO: 664064 - DNA, 25 bp, Mus musculus
gatcagtggatcagcgctcatgcca

SEQ ID NO: 664065 - DNA, 25 bp, Mus musculus
gatcagtggatctgcgctcatgcca

SEQ ID NO: 664066 - DNA, 25 bp, Mus musculus
gatcagtggcgactggaagaaccac

SEQ ID NO: 664067 - DNA, 25 bp, Mus musculus
gatcagtggcgagtggaagaaccac

SEQ ID NO: 664068 - DNA, 25 bp, Mus musculus
gatcagtgtgccctaggatttatag

SEQ ID NO: 664069 - DNA, 25 bp, Mus musculus
gatcagtgtgccgtaggatttatag

SEQ ID NO: 664070 - DNA, 25 bp, Mus musculus
gatcagttccctcagggaccccaag

SEQ ID NO: 664071 - DNA, 25 bp, Mus musculus
gatcagttccctgagggaccccaag

SEQ ID NO: 664072 - DNA, 25 bp, Mus musculus
gatcagttgaagctcattttaagac

SEQ ID NO: 664073 - DNA, 25 bp, Mus musculus
gatcagttgaaggtcattttaagac

SEQ ID NO: 664074 - DNA, 25 bp, Mus musculus
gatcagttgcagctggacaacgatg

SEQ ID NO: 664075 - DNA, 25 bp, Mus musculus
gatcagttgcaggtggacaacgatg

SEQ ID NO: 664076 - DNA, 25 bp, Mus musculus
gatcagtttctactaagtctctaag

SEQ ID NO: 664077 - DNA, 25 bp, Mus musculus
gatcagtttctagtaagtctctaag

SEQ ID NO: 664078 - DNA, 25 bp, Mus musculus
gatcagtttgatagaatcaagaccc

SEQ ID NO: 664079 - DNA, 25 bp, Mus musculus
gatcagtttgattgaatcaagaccc

SEQ ID NO: 664080 - DNA, 25 bp, Mus musculus
gatcagtttgggacaatcgattctg

SEQ ID NO: 664081 - DNA, 25 bp, Mus musculus
gatcagtttgggtcaatcgattctg

SEQ ID NO: 664082 - DNA, 25 bp, Mus musculus
gatcataaaggaaatgtcccacctg

SEQ ID NO: 664083 - DNA, 25 bp, Mus musculus
gatcataaaggatatgtcccacctg

SEQ ID NO: 664084 - DNA, 25 bp, Mus musculus
gatcataaagtgagactcctcccca

SEQ ID NO: 664085 - DNA, 25 bp, Mus musculus
gatcataaagtgtgactcctcccca

SEQ ID NO: 664086 - DNA, 25 bp, Mus musculus
gatcatacagaacttcgtgcgggtt

SEQ ID NO: 664087 - DNA, 25 bp, Mus musculus
gatcatacagaagttcgtgcgggtt

SEQ ID NO: 664088 - DNA, 25 bp, Mus musculus
gatcatacatacaagatgcatgtca

SEQ ID NO: 664089 - DNA, 25 bp, Mus musculus
gatcatacatactagatgcatgtca

SEQ ID NO: 664090 - DNA, 25 bp, Mus musculus
gatcataccaggctcgttctgcatg

SEQ ID NO: 664091 - DNA, 25 bp, Mus musculus
gatcataccagggtcgttctgcatg

SEQ ID NO: 664092 - DNA, 25 bp, Mus musculus
gatcatactttcatggacacccaga

SEQ ID NO: 664093 - DNA, 25 bp, Mus musculus
gatcatactttcttggacacccaga

SEQ ID NO: 664094 - DNA, 25 bp, Mus musculus
gatcatagacaacatgaaaagagcc

SEQ ID NO: 664095 - DNA, 25 bp, Mus musculus
gatcatagacaactgctgcatgcag

SEQ ID NO: 664096 - DNA, 25 bp, Mus musculus
gatcatagacaagatgaaaagagcc

SEQ ID NO: 664097 - DNA, 25 bp, Mus musculus
gatcatagacaagtgctgcatgcag

SEQ ID NO: 664098 - DNA, 25 bp, Mus musculus
gatcatagccaaagaatttgtgaag

SEQ ID NO: 664099 - DNA, 25 bp, Mus musculus
gatcatagccaatgaatttgtgaag

SEQ ID NO: 664100 - DNA, 25 bp, Mus musculus
gatcatagctctagcagaactactt

SEQ ID NO: 664101 - DNA, 25 bp, Mus musculus
gatcatagctcttgcagaactactt

SEQ ID NO: 664102 - DNA, 25 bp, Mus musculus
gatcatatatttcccagtaaagcag

SEQ ID NO: 664103 - DNA, 25 bp, Mus musculus
gatcatatatttgccagtaaagcag

SEQ ID NO: 664104 - DNA, 25 bp, Mus musculus
gatcatcaaatacagcagctcacca

SEQ ID NO: 664105 - DNA, 25 bp, Mus musculus
gatcatcaaatagagcagctcacca

SEQ ID NO: 664106 - DNA, 25 bp, Mus musculus
gatcatcaagatatagatgtggcca

SEQ ID NO: 664107 - DNA, 25 bp, Mus musculus
gatcatcaagatttagatgtggcca

SEQ ID NO: 664108 - DNA, 25 bp, Mus musculus
gatcatcaagccacaaatgtacctt

SEQ ID NO: 664109 - DNA, 25 bp, Mus musculus
gatcatcaagcctcaaatgtacctt

SEQ ID NO: 664110 - DNA, 25 bp, Mus musculus
gatcatcaatgacaggatctatcca

SEQ ID NO: 664111 - DNA, 25 bp, Mus musculus
gatcatcaatgagaggatctatcca

SEQ ID NO: 664112 - DNA, 25 bp, Mus musculus
gatcatcaatgcacgggagacagtg

SEQ ID NO: 664113 - DNA, 25 bp, Mus musculus
gatcatcaatgctcgggagacagtg

SEQ ID NO: 664114 - DNA, 25 bp, Mus musculus
gatcatcacaagctaatgaaccgcg

SEQ ID NO: 664115 - DNA, 25 bp, Mus musculus
gatcatcacaaggtaatgaaccgcg

SEQ ID NO: 664116 - DNA, 25 bp, Mus musculus
gatcatcacccaacttcgtaaagag

SEQ ID NO: 664117 - DNA, 25 bp, Mus musculus
gatcatcacccatcttcgtaaagag

SEQ ID NO: 664118 - DNA, 25 bp, Mus musculus
gatcatcacttaaaggaattccagg

SEQ ID NO: 664119 - DNA, 25 bp, Mus musculus
gatcatcacttataggaattccagg

SEQ ID NO: 664120 - DNA, 25 bp, Mus musculus
gatcatcagactactctgtccaaga

SEQ ID NO: 664121 - DNA, 25 bp, Mus musculus
gatcatcagacttctctgtccaaga

SEQ ID NO: 664122 - DNA, 25 bp, Mus musculus
gatcatcagcgacaaagatggctac

SEQ ID NO: 664123 - DNA, 25 bp, Mus musculus
gatcatcagcgagaaagatggctac

SEQ ID NO: 664124 - DNA, 25 bp, Mus musculus
gatcatcagttaaccagactgccag

SEQ ID NO: 664125 - DNA, 25 bp, Mus musculus
gatcatcagttatccagactgccag

SEQ ID NO: 664126 - DNA, 25 bp, Mus musculus
gatcatcatccgagctttccgcaca

SEQ ID NO: 664127 - DNA, 25 bp, Mus musculus
gatcatcatccgtgctttccgcaca

SEQ ID NO: 664128 - DNA, 25 bp, Mus musculus
gatcatcatggaagctgacctctcc

SEQ ID NO: 664129 - DNA, 25 bp, Mus musculus
gatcatcatggatgctgacctctcc

SEQ ID NO: 664130 - DNA, 25 bp, Mus musculus
gatcatcattctagatgaagcagac

SEQ ID NO: 664131 - DNA, 25 bp, Mus musculus
gatcatcattcttgatgaagcagac

SEQ ID NO: 664132 - DNA, 25 bp, Mus musculus
gatcatccagaacgataaggaatgc

SEQ ID NO: 664133 - DNA, 25 bp, Mus musculus
gatcatccagaaggataaggaatgc

SEQ ID NO: 664134 - DNA, 25 bp, Mus musculus
gatcatccatctcagcctcgaaagg

SEQ ID NO: 664135 - DNA, 25 bp, Mus musculus
gatcatccatctgagcctcgaaagg

SEQ ID NO: 664136 - DNA, 25 bp, Mus musculus
gatcatcccaatattgtcaaactga

SEQ ID NO: 664137 - DNA, 25 bp, Mus musculus
gatcatcccaattttgtcaaactga

SEQ ID NO: 664138 - DNA, 25 bp, Mus musculus
gatcatccgcttcctgctcctgttt

SEQ ID NO: 664139 - DNA, 25 bp, Mus musculus
gatcatccgcttgctgctcctgttt

SEQ ID NO: 664140 - DNA, 25 bp, Mus musculus
gatcatccgtgacgcgtacaagaag

SEQ ID NO: 664141 - DNA, 25 bp, Mus musculus
gatcatccgtgaggcgtacaagaag

SEQ ID NO: 664142 - DNA, 25 bp, Mus musculus
gatcatcctccacagtattcagcgg

SEQ ID NO: 664143 - DNA, 25 bp, Mus musculus
gatcatcctccagagtattcagcgg

SEQ ID NO: 664144 - DNA, 25 bp, Mus musculus
gatcatcctgagagtacaatctggg

SEQ ID NO: 664145 - DNA, 25 bp, Mus musculus
gatcatcctgagtgtacaatctggg

SEQ ID NO: 664146 - DNA, 25 bp, Mus musculus
gatcatcgacgacgaggaatttctg

SEQ ID NO: 664147 - DNA, 25 bp, Mus musculus
gatcatcgacgaggaggaatttctg

SEQ ID NO: 664148 - DNA, 25 bp, Mus musculus
gatcatcgagaccataggcaatggg

SEQ ID NO: 664149 - DNA, 25 bp, Mus musculus
gatcatcgagacgataggcaatggg

SEQ ID NO: 664150 - DNA, 25 bp, Mus musculus
gatcatcgcagtcgtgctgcagctg

SEQ ID NO: 664151 - DNA, 25 bp, Mus musculus
gatcatcgcagtggtgctgcagctg

SEQ ID NO: 664152 - DNA, 25 bp, Mus musculus
gatcatcggagccacggtgttcaag

SEQ ID NO: 664153 - DNA, 25 bp, Mus musculus
gatcatcggagcgacggtgttcaag

SEQ ID NO: 664154 - DNA, 25 bp, Mus musculus
gatcatcgtactcgactggcaccgt

SEQ ID NO: 664155 - DNA, 25 bp, Mus musculus
gatcatcgtactggactggcaccgt

SEQ ID NO: 664156 - DNA, 25 bp, Mus musculus
gatcatcgtgctcttcctcggcctg

SEQ ID NO: 664157 - DNA, 25 bp, Mus musculus
gatcatcgtgctgttcctcggcctg

SEQ ID NO: 664158 - DNA, 25 bp, Mus musculus
gatcatcgtggcactcaagtcggaa

SEQ ID NO: 664159 - DNA, 25 bp, Mus musculus
gatcatcgtggctctcaagtcggaa

SEQ ID NO: 664160 - DNA, 25 bp, Mus musculus
gatcatctacgacagaaagttcctg

SEQ ID NO: 664161 - DNA, 25 bp, Mus musculus
gatcatctacgagagaaagttcctg

SEQ ID NO: 664162 - DNA, 25 bp, Mus musculus
gatcatctcatcaaaggaaggctta

SEQ ID NO: 664163 - DNA, 25 bp, Mus musculus
gatcatctcatctaaggaaggctta

SEQ ID NO: 664164 - DNA, 25 bp, Mus musculus
gatcatctcgaaaaatttgcactat

SEQ ID NO: 664165 - DNA, 25 bp, Mus musculus
gatcatctcgaataatttgcactat

SEQ ID NO: 664166 - DNA, 25 bp, Mus musculus
gatcatctctggcttcaccaagaag

SEQ ID NO: 664167 - DNA, 25 bp, Mus musculus
gatcatctctgggttcaccaagaag

SEQ ID NO: 664168 - DNA, 25 bp, Mus musculus
gatcatctgcggactgcagtttcta

SEQ ID NO: 664169 - DNA, 25 bp, Mus musculus
gatcatctgcggtctgcagtttcta

SEQ ID NO: 664170 - DNA, 25 bp, Mus musculus
gatcatctgtccctatcgggtgagt

SEQ ID NO: 664171 - DNA, 25 bp, Mus musculus
gatcatctgtccgtatcgggtgagt

SEQ ID NO: 664172 - DNA, 25 bp, Mus musculus
gatcatcttactacattcacgagcg

SEQ ID NO: 664173 - DNA, 25 bp, Mus musculus
gatcatcttacttcattcacgagcg

SEQ ID NO: 664174 - DNA, 25 bp, Mus musculus
gatcatcttcaaagtcggccgagtt

SEQ ID NO: 664175 - DNA, 25 bp, Mus musculus
gatcatcttcaatgtcggccgagtt

SEQ ID NO: 664176 - DNA, 25 bp, Mus musculus
gatcatcttttgcaggaataatcag

SEQ ID NO: 664177 - DNA, 25 bp, Mus musculus
gatcatcttttggaggaataatcag

SEQ ID NO: 664178 - DNA, 25 bp, Mus musculus
gatcatgaaatcataagaaggagga

SEQ ID NO: 664179 - DNA, 25 bp, Mus musculus
gatcatgaaatcttaagaaggagga

SEQ ID NO: 664180 - DNA, 25 bp, Mus musculus
gatcatgaagagaatcattagcttc

SEQ ID NO: 664181 - DNA, 25 bp, Mus musculus
gatcatgaagagtatcattagcttc

SEQ ID NO: 664182 - DNA, 25 bp, Mus musculus
gatcatgaagatcacagggacgccc

SEQ ID NO: 664183 - DNA, 25 bp, Mus musculus
gatcatgaagatgacagggacgccc

SEQ ID NO: 664184 - DNA, 25 bp, Mus musculus
gatcatgaagcacacagggtacctg

SEQ ID NO: 664185 - DNA, 25 bp, Mus musculus
gatcatgaagcagacagggtacctg

SEQ ID NO: 664186 - DNA, 25 bp, Mus musculus
gatcatgaaggacctgaataagcgg

SEQ ID NO: 664187 - DNA, 25 bp, Mus musculus
gatcatgaaggagctgaataagcgg

SEQ ID NO: 664188 - DNA, 25 bp, Mus musculus
gatcatgactcacatcttgccctgc

SEQ ID NO: 664189 - DNA, 25 bp, Mus musculus
gatcatgactcagatcttgccctgc

SEQ ID NO: 664190 - DNA, 25 bp, Mus musculus
gatcatgagtgtcgttgatcccaac

SEQ ID NO: 664191 - DNA, 25 bp, Mus musculus
gatcatgagtgtggttgatcccaac

SEQ ID NO: 664192 - DNA, 25 bp, Mus musculus
gatcatgcaacacctgctttggaag

SEQ ID NO: 664193 - DNA, 25 bp, Mus musculus
gatcatgcaacagctgctttggaag

SEQ ID NO: 664194 - DNA, 25 bp, Mus musculus
gatcatgcagcaccggttctttgcc

SEQ ID NO: 664195 - DNA, 25 bp, Mus musculus
gatcatgcagcagcggttctttgcc

SEQ ID NO: 664196 - DNA, 25 bp, Mus musculus
gatcatgcatgcaatcaacagaaga

SEQ ID NO: 664197 - DNA, 25 bp, Mus musculus
gatcatgcatgctatcaacagaaga

SEQ ID NO: 664198 - DNA, 25 bp, Mus musculus
gatcatgctgccctgggacccaagt

SEQ ID NO: 664199 - DNA, 25 bp, Mus musculus
gatcatgctgccgtgggacccaagt

SEQ ID NO: 664200 - DNA, 25 bp, Mus musculus
gatcatgctgggagctatctgtgcc

SEQ ID NO: 664201 - DNA, 25 bp, Mus musculus
gatcatgctgggtgctatctgtgcc

SEQ ID NO: 664202 - DNA, 25 bp, Mus musculus
gatcatggaaaaccttgaaattgca

SEQ ID NO: 664203 - DNA, 25 bp, Mus musculus
gatcatggaaaagcttgaaattgca

SEQ ID NO: 664204 - DNA, 25 bp, Mus musculus
gatcatggaagacaaagcgctagaa

SEQ ID NO: 664205 - DNA, 25 bp, Mus musculus
gatcatggaagagaaagcgctagaa

SEQ ID NO: 664206 - DNA, 25 bp, Mus musculus
gatcatgggcaaaaagcccgacccc

SEQ ID NO: 664207 - DNA, 25 bp, Mus musculus
gatcatgggcaataagcccgacccc

SEQ ID NO: 664208 - DNA, 25 bp, Mus musculus
gatcatgtaagcacgcccattctcc

SEQ ID NO: 664209 - DNA, 25 bp, Mus musculus
gatcatgtaagctcgcccattctcc

SEQ ID NO: 664210 - DNA, 25 bp, Mus musculus
gatcatgtgacaatcaggtgtctga

SEQ ID NO: 664211 - DNA, 25 bp, Mus musculus
gatcatgtgacattcaggtgtctga

SEQ ID NO: 664212 - DNA, 25 bp, Mus musculus
gatcatgtgatgacaaaagctcaac

SEQ ID NO: 664213 - DNA, 25 bp, Mus musculus
gatcatgtgatgtcaaaagctcaac

SEQ ID NO: 664214 - DNA, 25 bp, Mus musculus
gatcatgtgtgccagtggtgacacc

SEQ ID NO: 664215 - DNA, 25 bp, Mus musculus
gatcatgtgtgcgagtggtgacacc

SEQ ID NO: 664216 - DNA, 25 bp, Mus musculus
gatcatgtttggagttccctatgtc

SEQ ID NO: 664217 - DNA, 25 bp, Mus musculus
gatcatgtttggtgttccctatgtc

SEQ ID NO: 664218 - DNA, 25 bp, Mus musculus
gatcattaatgccaccactgggaag

SEQ ID NO: 664219 - DNA, 25 bp, Mus musculus
gatcattaatgcgaccactgggaag

SEQ ID NO: 664220 - DNA, 25 bp, Mus musculus
gatcattagcctaaacacaaacttg

SEQ ID NO: 664221 - DNA, 25 bp, Mus musculus
gatcattagccttaacacaaacttg

SEQ ID NO: 664222 - DNA, 25 bp, Mus musculus
gatcattatctacgacttgcaaaca

SEQ ID NO: 664223 - DNA, 25 bp, Mus musculus
gatcattatctaggacttgcaaaca

SEQ ID NO: 664224 - DNA, 25 bp, Mus musculus
gatcattatgggacagaaatcaggc

SEQ ID NO: 664225 - DNA, 25 bp, Mus musculus
gatcattatgggtcagaaatcaggc

SEQ ID NO: 664226 - DNA, 25 bp, Mus musculus
gatcattattcacgcatgccgtgga

SEQ ID NO: 664227 - DNA, 25 bp, Mus musculus
gatcattattcaggcatgccgtgga

SEQ ID NO: 664228 - DNA, 25 bp, Mus musculus
gatcattatttcacacaattggtgg

SEQ ID NO: 664229 - DNA, 25 bp, Mus musculus
gatcattatttctcacaattggtgg

SEQ ID NO: 664230 - DNA, 25 bp, Mus musculus
gatcattcaccacgatggctactca

SEQ ID NO: 664231 - DNA, 25 bp, Mus musculus
gatcattcaccaggatggctactca

SEQ ID NO: 664232 - DNA, 25 bp, Mus musculus
gatcattcatcaatggtctggactg

SEQ ID NO: 664233 - DNA, 25 bp, Mus musculus
gatcattcatcattggtctggactg

SEQ ID NO: 664234 - DNA, 25 bp, Mus musculus
gatcattcccatcttctctaacctg

SEQ ID NO: 664235 - DNA, 25 bp, Mus musculus
gatcattcccatgttctctaacctg

SEQ ID NO: 664236 - DNA, 25 bp, Mus musculus
gatcattctaagcaagcggaggctt

SEQ ID NO: 664237 - DNA, 25 bp, Mus musculus
gatcattctaaggaagcggaggctt

SEQ ID NO: 664238 - DNA, 25 bp, Mus musculus
gatcattcttctctgacaagcaaat

SEQ ID NO: 664239 - DNA, 25 bp, Mus musculus
gatcattcttctgtgacaagcaaat

SEQ ID NO: 664240 - DNA, 25 bp, Mus musculus
gatcattgaacgagcaagctacgct

SEQ ID NO: 664241 - DNA, 25 bp, Mus musculus
gatcattgaacgtgcaagctacgct

SEQ ID NO: 664242 - DNA, 25 bp, Mus musculus
gatcattgacaccaatggagctgga

SEQ ID NO: 664243 - DNA, 25 bp, Mus musculus
gatcattgacacgaatggagctgga

SEQ ID NO: 664244 - DNA, 25 bp, Mus musculus
gatcattgacttcgaagaggccgag

SEQ ID NO: 664245 - DNA, 25 bp, Mus musculus
gatcattgacttggaagaggccgag

SEQ ID NO: 664246 - DNA, 25 bp, Mus musculus
gatcattgcgccatccccagtgaaa

SEQ ID NO: 664247 - DNA, 25 bp, Mus musculus
gatcattgcgccttccccagtgaaa

SEQ ID NO: 664248 - DNA, 25 bp, Mus musculus
gatcattgctgaactcaatgagacc

SEQ ID NO: 664249 - DNA, 25 bp, Mus musculus
gatcattgctgatctcaatgagacc

SEQ ID NO: 664250 - DNA, 25 bp, Mus musculus
gatcattgctggagtggcatttgga

SEQ ID NO: 664251 - DNA, 25 bp, Mus musculus
gatcattgctggcatcctggcctat

SEQ ID NO: 664252 - DNA, 25 bp, Mus musculus
gatcattgctgggatcctggcctat

SEQ ID NO: 664253 - DNA, 25 bp, Mus musculus
gatcattgctggtgtggcatttgga

SEQ ID NO: 664254 - DNA, 25 bp, Mus musculus
gatcattgtagaagaattgaagcaa

SEQ ID NO: 664255 - DNA, 25 bp, Mus musculus
gatcattgtagatgaattgaagcaa

SEQ ID NO: 664256 - DNA, 25 bp, Mus musculus
gatcatttcaaacctttgtgggcca

SEQ ID NO: 664257 - DNA, 25 bp, Mus musculus
gatcatttcaaagctttgtgggcca

SEQ ID NO: 664258 - DNA, 25 bp, Mus musculus
gatcatttttcaccggaggcagacg

SEQ ID NO: 664259 - DNA, 25 bp, Mus musculus
gatcatttttcagcggaggcagacg

SEQ ID NO: 664260 - DNA, 25 bp, Mus musculus
gatccaaaaactacacgtgaccaga

SEQ ID NO: 664261 - DNA, 25 bp, Mus musculus
gatccaaaaacttcacgtgaccaga

SEQ ID NO: 664262 - DNA, 25 bp, Mus musculus
gatccaaaacggcacctggacagaa

SEQ ID NO: 664263 - DNA, 25 bp, Mus musculus
gatccaaaacgggacctggacagaa

SEQ ID NO: 664264 - DNA, 25 bp, Mus musculus
gatccaaaactactctgaagacttg

SEQ ID NO: 664265 - DNA, 25 bp, Mus musculus
gatccaaaactagtctgaagacttg

SEQ ID NO: 664266 - DNA, 25 bp, Mus musculus
gatccaaaatacagaggccctcagc

SEQ ID NO: 664267 - DNA, 25 bp, Mus musculus
gatccaaaatactgaggccctcagc

SEQ ID NO: 664268 - DNA, 25 bp, Mus musculus
gatccaaagacccagaggctcctcg

SEQ ID NO: 664269 - DNA, 25 bp, Mus musculus
gatccaaagaccgagaggctcctcg

SEQ ID NO: 664270 - DNA, 25 bp, Mus musculus
gatccaaatacaaggactctgcttt

SEQ ID NO: 664271 - DNA, 25 bp, Mus musculus
gatccaaatacatggactctgcttt

SEQ ID NO: 664272 - DNA, 25 bp, Mus musculus
gatccaacaaaactcaaactcaggt

SEQ ID NO: 664273 - DNA, 25 bp, Mus musculus
gatccaacaaaagtcaaactcaggt

SEQ ID NO: 664274 - DNA, 25 bp, Mus musculus
gatccaaccagaacaatctctgcag

SEQ ID NO: 664275 - DNA, 25 bp, Mus musculus
gatccaaccagatcaatctctgcag

SEQ ID NO: 664276 - DNA, 25 bp, Mus musculus
gatccaacgattatgacatttaccg

SEQ ID NO: 664277 - DNA, 25 bp, Mus musculus
gatccaacgattttgacatttaccg

SEQ ID NO: 664278 - DNA, 25 bp, Mus musculus
gatccaactcaaaggatgtcagccc

SEQ ID NO: 664279 - DNA, 25 bp, Mus musculus
gatccaactcaatggatgtcagccc

SEQ ID NO: 664280 - DNA, 25 bp, Mus musculus
gatccaactggcatttctgagcggg

SEQ ID NO: 664281 - DNA, 25 bp, Mus musculus
gatccaactggcttttctgagcggg

SEQ ID NO: 664282 - DNA, 25 bp, Mus musculus
gatccaagaaccagctaccccattg

SEQ ID NO: 664283 - DNA, 25 bp, Mus musculus
gatccaagaacctgctaccccattg

SEQ ID NO: 664284 - DNA, 25 bp, Mus musculus
gatccaagacatcaaggcttacctg

SEQ ID NO: 664285 - DNA, 25 bp, Mus musculus
gatccaagacatgaaggcttacctg

SEQ ID NO: 664286 - DNA, 25 bp, Mus musculus
gatccaagatggcagattcaatctt

SEQ ID NO: 664287 - DNA, 25 bp, Mus musculus
gatccaagatgggagattcaatctt

SEQ ID NO: 664288 - DNA, 25 bp, Mus musculus
gatccaagcaagcatagagcaaata

SEQ ID NO: 664289 - DNA, 25 bp, Mus musculus
gatccaagcaaggatagagcaaata

SEQ ID NO: 664290 - DNA, 25 bp, Mus musculus
gatccaaggagtagctgcgtttcca

SEQ ID NO: 664291 - DNA, 25 bp, Mus musculus
gatccaaggagttgctgcgtttcca

SEQ ID NO: 664292 - DNA, 25 bp, Mus musculus
gatccaataaagatgaaagccgtga

SEQ ID NO: 664293 - DNA, 25 bp, Mus musculus
gatccaataaagttgaaagccgtga

SEQ ID NO: 664294 - DNA, 25 bp, Mus musculus
gatccaataccacttctaagccgag

SEQ ID NO: 664295 - DNA, 25 bp, Mus musculus
gatccaataccagttctaagccgag

SEQ ID NO: 664296 - DNA, 25 bp, Mus musculus
gatccacaacctaggaagagctgac

SEQ ID NO: 664297 - DNA, 25 bp, Mus musculus
gatccacaaccttggaagagctgac

SEQ ID NO: 664298 - DNA, 25 bp, Mus musculus
gatccacacatgaaccaacatcaac

SEQ ID NO: 664299 - DNA, 25 bp, Mus musculus
gatccacacatgtaccaacatcaac

SEQ ID NO: 664300 - DNA, 25 bp, Mus musculus
gatccacactgcctggaatgagctg

SEQ ID NO: 664301 - DNA, 25 bp, Mus musculus
gatccacactgcgtggaatgagctg

SEQ ID NO: 664302 - DNA, 25 bp, Mus musculus
gatccacactggcaattgtcaacac

SEQ ID NO: 664303 - DNA, 25 bp, Mus musculus
gatccacactgggaattgtcaacac

SEQ ID NO: 664304 - DNA, 25 bp, Mus musculus
gatccacagggtctgctccttggga

SEQ ID NO: 664305 - DNA, 25 bp, Mus musculus
gatccacagggtgtgctccttggga

SEQ ID NO: 664306 - DNA, 25 bp, Mus musculus
gatccacatatgcaccaattggaga

SEQ ID NO: 664307 - DNA, 25 bp, Mus musculus
gatccacatatggaccaattggaga

SEQ ID NO: 664308 - DNA, 25 bp, Mus musculus
gatccaccatgaagcccacagaact

SEQ ID NO: 664309 - DNA, 25 bp, Mus musculus
gatccaccatgatgcccacagaact

SEQ ID NO: 664310 - DNA, 25 bp, Mus musculus
gatccaccctgtcctactttggctt

SEQ ID NO: 664311 - DNA, 25 bp, Mus musculus
gatccaccctgtgctactttggctt

SEQ ID NO: 664312 - DNA, 25 bp, Mus musculus
gatccacctgcaacgaccgtgtggg

SEQ ID NO: 664313 - DNA, 25 bp, Mus musculus
gatccacctgcatcgaccgtgtggg

SEQ ID NO: 664314 - DNA, 25 bp, Mus musculus
gatccacgaacacctcagaaaatag

SEQ ID NO: 664315 - DNA, 25 bp, Mus musculus
gatccacgaacagctcagaaaatag

SEQ ID NO: 664316 - DNA, 25 bp, Mus musculus
gatccacgatatatctaactctttg

SEQ ID NO: 664317 - DNA, 25 bp, Mus musculus
gatccacgatatttctaactctttg

SEQ ID NO: 664318 - DNA, 25 bp, Mus musculus
gatccacgtcaccaatcacacggag

SEQ ID NO: 664319 - DNA, 25 bp, Mus musculus
gatccacgtcacgaatcacacggag

SEQ ID NO: 664320 - DNA, 25 bp, Mus musculus
gatccacgtgtacgagcagcacgag

SEQ ID NO: 664321 - DNA, 25 bp, Mus musculus
gatccacgtgtaggagcagcacgag

SEQ ID NO: 664322 - DNA, 25 bp, Mus musculus
gatccactacatcaagaaccacgag

SEQ ID NO: 664323 - DNA, 25 bp, Mus musculus
gatccactacatgaagaaccacgag

SEQ ID NO: 664324 - DNA, 25 bp, Mus musculus
gatccactgttgaccagaggcaaag

SEQ ID NO: 664325 - DNA, 25 bp, Mus musculus
gatccactgttgtccagaggcaaag

SEQ ID NO: 664326 - DNA, 25 bp, Mus musculus
gatccacttaaaatcgggagttatc

SEQ ID NO: 664327 - DNA, 25 bp, Mus musculus
gatccacttaaattcgggagttatc

SEQ ID NO: 664328 - DNA, 25 bp, Mus musculus
gatccactttggcacagaggtcact

SEQ ID NO: 664329 - DNA, 25 bp, Mus musculus
gatccactttgggacagaggtcact

SEQ ID NO: 664330 - DNA, 25 bp, Mus musculus
gatccagaacctctaaatcagaggg

SEQ ID NO: 664331 - DNA, 25 bp, Mus musculus
gatccagaacctgtaaatcagaggg

SEQ ID NO: 664332 - DNA, 25 bp, Mus musculus
gatccagaagcaacttcgattctac

SEQ ID NO: 664333 - DNA, 25 bp, Mus musculus
gatccagaagcatcttcgattctac

SEQ ID NO: 664334 - DNA, 25 bp, Mus musculus
gatccagacaataggtcacagggta

SEQ ID NO: 664335 - DNA, 25 bp, Mus musculus
gatccagacaattggtcacagggta

SEQ ID NO: 664336 - DNA, 25 bp, Mus musculus
gatccagagaccaagcgctttcctt

SEQ ID NO: 664337 - DNA, 25 bp, Mus musculus
gatccagagacctagcgctttcctt

SEQ ID NO: 664338 - DNA, 25 bp, Mus musculus
gatccagagcttcaataaaatgtgc

SEQ ID NO: 664339 - DNA, 25 bp, Mus musculus
gatccagagcttgaataaaatgtgc

SEQ ID NO: 664340 - DNA, 25 bp, Mus musculus
gatccagatacaatccatgttagcc

SEQ ID NO: 664341 - DNA, 25 bp, Mus musculus
gatccagatacattccatgttagcc

SEQ ID NO: 664342 - DNA, 25 bp, Mus musculus
gatccagatgacctcatagcgttag

SEQ ID NO: 664343 - DNA, 25 bp, Mus musculus
gatccagatgacgtcatagcgttag

SEQ ID NO: 664344 - DNA, 25 bp, Mus musculus
gatccagcactgattcgtgcgccct

SEQ ID NO: 664345 - DNA, 25 bp, Mus musculus
gatccagcactgtttcgtgcgccct

SEQ ID NO: 664346 - DNA, 25 bp, Mus musculus
gatccagcagctcttcaaagacaag

SEQ ID NO: 664347 - DNA, 25 bp, Mus musculus
gatccagcagctgttcaaagacaag

SEQ ID NO: 664348 - DNA, 25 bp, Mus musculus
gatccagcagttacgatatgataac

SEQ ID NO: 664349 - DNA, 25 bp, Mus musculus
gatccagcagtttcgatatgataac

SEQ ID NO: 664350 - DNA, 25 bp, Mus musculus
gatccagcccacagcaagtggtgcc

SEQ ID NO: 664351 - DNA, 25 bp, Mus musculus
gatccagcccactgcaagtggtgcc

SEQ ID NO: 664352 - DNA, 25 bp, Mus musculus
gatccagcccagctatcaagaacga

SEQ ID NO: 664353 - DNA, 25 bp, Mus musculus
gatccagcccaggtatcaagaacga

SEQ ID NO: 664354 - DNA, 25 bp, Mus musculus
gatccagcgaagcaggctatgccag

SEQ ID NO: 664355 - DNA, 25 bp, Mus musculus
gatccagcgaaggaggctatgccag

SEQ ID NO: 664356 - DNA, 25 bp, Mus musculus
gatccagctcgactcaacgtgcctg

SEQ ID NO: 664357 - DNA, 25 bp, Mus musculus
gatccagctcgagtcaacgtgcctg

SEQ ID NO: 664358 - DNA, 25 bp, Mus musculus
gatccagcttgcagctcagctttgt

SEQ ID NO: 664359 - DNA, 25 bp, Mus musculus
gatccagcttgctgctcagctttgt

SEQ ID NO: 664360 - DNA, 25 bp, Mus musculus
gatccaggagatcttcagctactag

SEQ ID NO: 664361 - DNA, 25 bp, Mus musculus
gatccaggagatgttcagctactag

SEQ ID NO: 664362 - DNA, 25 bp, Mus musculus
gatccaggagctcatattttgccca

SEQ ID NO: 664363 - DNA, 25 bp, Mus musculus
gatccaggagctgatattttgccca

SEQ ID NO: 664364 - DNA, 25 bp, Mus musculus
gatccaggaggcaggcacagaagtc

SEQ ID NO: 664365 - DNA, 25 bp, Mus musculus
gatccaggaggctggcacagaagtc

SEQ ID NO: 664366 - DNA, 25 bp, Mus musculus
gatccaggcctacttcgcgtgtgaa

SEQ ID NO: 664367 - DNA, 25 bp, Mus musculus
gatccaggcctagttcgcgtgtgaa

SEQ ID NO: 664368 - DNA, 25 bp, Mus musculus
gatccaggctccacgagttgctctc

SEQ ID NO: 664369 - DNA, 25 bp, Mus musculus
gatccaggctcctcgagttgctctc

SEQ ID NO: 664370 - DNA, 25 bp, Mus musculus
gatccaggcttaaggtcaaaacatg

SEQ ID NO: 664371 - DNA, 25 bp, Mus musculus
gatccaggcttatggtcaaaacatg

SEQ ID NO: 664372 - DNA, 25 bp, Mus musculus
gatccagggcctcggtaccagccat

SEQ ID NO: 664373 - DNA, 25 bp, Mus musculus
gatccagggcctgggtaccagccat

SEQ ID NO: 664374 - DNA, 25 bp, Mus musculus
gatccagtacgcaatgaacgtggcc

SEQ ID NO: 664375 - DNA, 25 bp, Mus musculus
gatccagtacgctatgaacgtggcc

SEQ ID NO: 664376 - DNA, 25 bp, Mus musculus
gatccagtattcaagtcaagtgcag

SEQ ID NO: 664377 - DNA, 25 bp, Mus musculus
gatccagtattctagtcaagtgcag

SEQ ID NO: 664378 - DNA, 25 bp, Mus musculus
gatccagtcaccaacctaaacaatg

SEQ ID NO: 664379 - DNA, 25 bp, Mus musculus
gatccagtcacctacctaaacaatg

SEQ ID NO: 664380 - DNA, 25 bp, Mus musculus
gatccagtccctctcaagcaggagg

SEQ ID NO: 664381 - DNA, 25 bp, Mus musculus
gatccagtccctgtcaagcaggagg

SEQ ID NO: 664382 - DNA, 25 bp, Mus musculus
gatccagtctcacatgggacgcctg

SEQ ID NO: 664383 - DNA, 25 bp, Mus musculus
gatccagtctcagatgggacgcctg

SEQ ID NO: 664384 - DNA, 25 bp, Mus musculus
gatccagtctctcaatggcgaacac

SEQ ID NO: 664385 - DNA, 25 bp, Mus musculus
gatccagtctctgaatggcgaacac

SEQ ID NO: 664386 - DNA, 25 bp, Mus musculus
gatccagtgaaaaggcgggcattta

SEQ ID NO: 664387 - DNA, 25 bp, Mus musculus
gatccagtgaaatggcgggcattta

SEQ ID NO: 664388 - DNA, 25 bp, Mus musculus
gatccagtgtgaaatctctcccctc

SEQ ID NO: 664389 - DNA, 25 bp, Mus musculus
gatccagtgtgatatctctcccctc

SEQ ID NO: 664390 - DNA, 25 bp, Mus musculus
gatccagttcaaatccaacgaagcc

SEQ ID NO: 664391 - DNA, 25 bp, Mus musculus
gatccagttcaattccaacgaagcc

SEQ ID NO: 664392 - DNA, 25 bp, Mus musculus
gatccagttgatccgcataaggtgt

SEQ ID NO: 664393 - DNA, 25 bp, Mus musculus
gatccagttgatgcgcataaggtgt

SEQ ID NO: 664394 - DNA, 25 bp, Mus musculus
gatccagtttctaaggcctcaccct

SEQ ID NO: 664395 - DNA, 25 bp, Mus musculus
gatccagtttcttaggcctcaccct

SEQ ID NO: 664396 - DNA, 25 bp, Mus musculus
gatccagtttgtctgttctctctgc

SEQ ID NO: 664397 - DNA, 25 bp, Mus musculus
gatccagtttgtgtgttctctctgc

SEQ ID NO: 664398 - DNA, 25 bp, Mus musculus
gatccatacgtcaaagtcttcctgc

SEQ ID NO: 664399 - DNA, 25 bp, Mus musculus
gatccatacgtctaagtcttcctgc

SEQ ID NO: 664400 - DNA, 25 bp, Mus musculus
gatccatcatgtcggtcaggatggc

SEQ ID NO: 664401 - DNA, 25 bp, Mus musculus
gatccatcatgtgggtcaggatggc

SEQ ID NO: 664402 - DNA, 25 bp, Mus musculus
gatccatccattaagggaacctttc

SEQ ID NO: 664403 - DNA, 25 bp, Mus musculus
gatccatccatttagggaacctttc

SEQ ID NO: 664404 - DNA, 25 bp, Mus musculus
gatccatccgctcgtcctgatgcag

SEQ ID NO: 664405 - DNA, 25 bp, Mus musculus
gatccatccgctggtcctgatgcag

SEQ ID NO: 664406 - DNA, 25 bp, Mus musculus
gatccatgagaaagagaagcgcctg

SEQ ID NO: 664407 - DNA, 25 bp, Mus musculus
gatccatgagaatgagaagcgcctg

SEQ ID NO: 664408 - DNA, 25 bp, Mus musculus
gatccatgcaggagattgtctttcc

SEQ ID NO: 664409 - DNA, 25 bp, Mus musculus
gatccatgcaggtgattgtctttcc

SEQ ID NO: 664410 - DNA, 25 bp, Mus musculus
gatccatgccagaaacaagcctgtg

SEQ ID NO: 664411 - DNA, 25 bp, Mus musculus
gatccatgccagtaacaagcctgtg

SEQ ID NO: 664412 - DNA, 25 bp, Mus musculus
gatccatgcctaacgaaagctgctg

SEQ ID NO: 664413 - DNA, 25 bp, Mus musculus
gatccatgcctatcgaaagctgctg

SEQ ID NO: 664414 - DNA, 25 bp, Mus musculus
gatccatgccttagaagaaactatt

SEQ ID NO: 664415 - DNA, 25 bp, Mus musculus
gatccatgcctttgaagaaactatt

SEQ ID NO: 664416 - DNA, 25 bp, Mus musculus
gatccatggacgctgcggacaagca

SEQ ID NO: 664417 - DNA, 25 bp, Mus musculus
gatccatggacggtgcggacaagca

SEQ ID NO: 664418 - DNA, 25 bp, Mus musculus
gatccatggagacccgggttgttca

SEQ ID NO: 664419 - DNA, 25 bp, Mus musculus
gatccatggagagccgggttgttca

SEQ ID NO: 664420 - DNA, 25 bp, Mus musculus
gatccatggatgaatccggtgaacg

SEQ ID NO: 664421 - DNA, 25 bp, Mus musculus
gatccatggatgtatccggtgaacg

SEQ ID NO: 664422 - DNA, 25 bp, Mus musculus
gatccatggtttcgagcaagagctg

SEQ ID NO: 664423 - DNA, 25 bp, Mus musculus
gatccatggtttggagcaagagctg

SEQ ID NO: 664424 - DNA, 25 bp, Mus musculus
gatccatgtcatccgtggaagattt

SEQ ID NO: 664425 - DNA, 25 bp, Mus musculus
gatccatgtcatgcgtggaagattt

SEQ ID NO: 664426 - DNA, 25 bp, Mus musculus
gatccattcatccaaagaaatatgt

SEQ ID NO: 664427 - DNA, 25 bp, Mus musculus
gatccattcatcgaaagaaatatgt

SEQ ID NO: 664428 - DNA, 25 bp, Mus musculus
gatccattgagaaccctccgagcaa

SEQ ID NO: 664429 - DNA, 25 bp, Mus musculus
gatccattgagatccctccgagcaa

SEQ ID NO: 664430 - DNA, 25 bp, Mus musculus
gatccattggataagcctatgaggg

SEQ ID NO: 664431 - DNA, 25 bp, Mus musculus
gatccattggattagcctatgaggg

SEQ ID NO: 664432 - DNA, 25 bp, Mus musculus
gatccatttggcaggtgtctccctg

SEQ ID NO: 664433 - DNA, 25 bp, Mus musculus
gatccatttggctggtgtctccctg

SEQ ID NO: 664434 - DNA, 25 bp, Mus musculus
gatcccaaagggacaggactgatcc

SEQ ID NO: 664435 - DNA, 25 bp, Mus musculus
gatcccaaagggtcaggactgatcc

SEQ ID NO: 664436 - DNA, 25 bp, Mus musculus
gatcccaaatacagcaatgatgagg

SEQ ID NO: 664437 - DNA, 25 bp, Mus musculus
gatcccaaatactgcaatgatgagg

SEQ ID NO: 664438 - DNA, 25 bp, Mus musculus
gatcccaaccatagtggcctcgtga

SEQ ID NO: 664439 - DNA, 25 bp, Mus musculus
gatcccaaccattgtggcctcgtga

SEQ ID NO: 664440 - DNA, 25 bp, Mus musculus
gatcccaacgggaaaaccttcactg

SEQ ID NO: 664441 - DNA, 25 bp, Mus musculus
gatcccaacgggtaaaccttcactg

SEQ ID NO: 664442 - DNA, 25 bp, Mus musculus
gatcccaagcacagtcaggaattcc

SEQ ID NO: 664443 - DNA, 25 bp, Mus musculus
gatcccaagcactgtcaggaattcc

SEQ ID NO: 664444 - DNA, 25 bp, Mus musculus
gatcccaagccgagactggtgtcaa

SEQ ID NO: 664445 - DNA, 25 bp, Mus musculus
gatcccaagccgtgactggtgtcaa

SEQ ID NO: 664446 - DNA, 25 bp, Mus musculus
gatcccaagtctaaatagagcaagg

SEQ ID NO: 664447 - DNA, 25 bp, Mus musculus
gatcccaagtctacctttcagagag

SEQ ID NO: 664448 - DNA, 25 bp, Mus musculus
gatcccaagtcttaatagagcaagg

SEQ ID NO: 664449 - DNA, 25 bp, Mus musculus
gatcccaagtcttcctttcagagag

SEQ ID NO: 664450 - DNA, 25 bp, Mus musculus
gatcccaagttgaacaaaagacggg

SEQ ID NO: 664451 - DNA, 25 bp, Mus musculus
gatcccaagttgtacaaaagacggg

SEQ ID NO: 664452 - DNA, 25 bp, Mus musculus
gatcccacagtcctatccaacgaaa

SEQ ID NO: 664453 - DNA, 25 bp, Mus musculus
gatcccacagtcgtatccaacgaaa

SEQ ID NO: 664454 - DNA, 25 bp, Mus musculus
gatcccactcatctggaaggataca

SEQ ID NO: 664455 - DNA, 25 bp, Mus musculus
gatcccactcatgtggaaggataca

SEQ ID NO: 664456 - DNA, 25 bp, Mus musculus
gatcccagaaaacgaacagggcaag

SEQ ID NO: 664457 - DNA, 25 bp, Mus musculus
gatcccagaaaaggaacagggcaag

SEQ ID NO: 664458 - DNA, 25 bp, Mus musculus
gatcccagaaacaccgcgtggagta

SEQ ID NO: 664459 - DNA, 25 bp, Mus musculus
gatcccagaaacaggtccacaggtt

SEQ ID NO: 664460 - DNA, 25 bp, Mus musculus
gatcccagaaactccgcgtggagta

SEQ ID NO: 664461 - DNA, 25 bp, Mus musculus
gatcccagaaactggtccacaggtt

SEQ ID NO: 664462 - DNA, 25 bp, Mus musculus
gatcccagaggacgttcaggtagca

SEQ ID NO: 664463 - DNA, 25 bp, Mus musculus
gatcccagaggaggttcaggtagca

SEQ ID NO: 664464 - DNA, 25 bp, Mus musculus
gatcccagagggatgcagacaccct

SEQ ID NO: 664465 - DNA, 25 bp, Mus musculus
gatcccagagggttgcagacaccct

SEQ ID NO: 664466 - DNA, 25 bp, Mus musculus
gatcccagagtccaggagcgctgcc

SEQ ID NO: 664467 - DNA, 25 bp, Mus musculus
gatcccagagtcgaggagcgctgcc

SEQ ID NO: 664468 - DNA, 25 bp, Mus musculus
gatcccagagtgcttgatgccatgc

SEQ ID NO: 664469 - DNA, 25 bp, Mus musculus
gatcccagagtggttgatgccatgc

SEQ ID NO: 664470 - DNA, 25 bp, Mus musculus
gatcccagcaacctggattctctct

SEQ ID NO: 664471 - DNA, 25 bp, Mus musculus
gatcccagcaacgtggattctctct

SEQ ID NO: 664472 - DNA, 25 bp, Mus musculus
gatcccagccctaactgtattgttg

SEQ ID NO: 664473 - DNA, 25 bp, Mus musculus
gatcccagcccttactgtattgttg

SEQ ID NO: 664474 - DNA, 25 bp, Mus musculus
gatcccagctacacctggtgttgga

SEQ ID NO: 664475 - DNA, 25 bp, Mus musculus
gatcccagctactcctggtgttgga

SEQ ID NO: 664476 - DNA, 25 bp, Mus musculus
gatcccagctccatcaatgccaaga

SEQ ID NO: 664477 - DNA, 25 bp, Mus musculus
gatcccagctccttcaatgccaaga

SEQ ID NO: 664478 - DNA, 25 bp, Mus musculus
gatcccaggactagatccccaactt

SEQ ID NO: 664479 - DNA, 25 bp, Mus musculus
gatcccaggacttgatccccaactt

SEQ ID NO: 664480 - DNA, 25 bp, Mus musculus
gatcccaggatcagaccaaacttca

SEQ ID NO: 664481 - DNA, 25 bp, Mus musculus
gatcccaggatctgaccaaacttca

SEQ ID NO: 664482 - DNA, 25 bp, Mus musculus
gatcccagtactattcgttcagcca

SEQ ID NO: 664483 - DNA, 25 bp, Mus musculus
gatcccagtacttttcgttcagcca

SEQ ID NO: 664484 - DNA, 25 bp, Mus musculus
gatcccagtgagctggagaaagcca

SEQ ID NO: 664485 - DNA, 25 bp, Mus musculus
gatcccagtgaggtggagaaagcca

SEQ ID NO: 664486 - DNA, 25 bp, Mus musculus
gatcccatcatactgaaaaccagcc

SEQ ID NO: 664487 - DNA, 25 bp, Mus musculus
gatcccatcatagtgaaaaccagcc

SEQ ID NO: 664488 - DNA, 25 bp, Mus musculus
gatcccatcgatctgaagatttctg

SEQ ID NO: 664489 - DNA, 25 bp, Mus musculus
gatcccatcgatgtgaagatttctg

SEQ ID NO: 664490 - DNA, 25 bp, Mus musculus
gatccccagagcctcattcgcgtgg

SEQ ID NO: 664491 - DNA, 25 bp, Mus musculus
gatccccagagcgtcattcgcgtgg

SEQ ID NO: 664492 - DNA, 25 bp, Mus musculus
gatccccagatgatgagctgctgta

SEQ ID NO: 664493 - DNA, 25 bp, Mus musculus
gatccccagatgttgagctgctgta

SEQ ID NO: 664494 - DNA, 25 bp, Mus musculus
gatccccattaaatgtttgtgaaga

SEQ ID NO: 664495 - DNA, 25 bp, Mus musculus
gatccccattaattgtttgtgaaga

SEQ ID NO: 664496 - DNA, 25 bp, Mus musculus
gatccccatttaagctgtgtcccac

SEQ ID NO: 664497 - DNA, 25 bp, Mus musculus
gatccccatttatgctgtgtcccac

SEQ ID NO: 664498 - DNA, 25 bp, Mus musculus
gatccccgacttagggatatccctc

SEQ ID NO: 664499 - DNA, 25 bp, Mus musculus
gatccccgactttgggatatccctc

SEQ ID NO: 664500 - DNA, 25 bp, Mus musculus
gatccccgagaaaggtgcccagagt

SEQ ID NO: 664501 - DNA, 25 bp, Mus musculus
gatccccgagaatggtgcccagagt

SEQ ID NO: 664502 - DNA, 25 bp, Mus musculus
gatccccgagctccggataccggtg

SEQ ID NO: 664503 - DNA, 25 bp, Mus musculus
gatccccgagctgcggataccggtg

SEQ ID NO: 664504 - DNA, 25 bp, Mus musculus
gatccccggcagaatgccctggttt

SEQ ID NO: 664505 - DNA, 25 bp, Mus musculus
gatccccggcagtatgccctggttt

SEQ ID NO: 664506 - DNA, 25 bp, Mus musculus
gatccccggtcaaactggaaaagta

SEQ ID NO: 664507 - DNA, 25 bp, Mus musculus
gatccccggtcatactggaaaagta

SEQ ID NO: 664508 - DNA, 25 bp, Mus musculus
gatcccctacaaaggagagccactg

SEQ ID NO: 664509 - DNA, 25 bp, Mus musculus
gatcccctacaatggagagccactg

SEQ ID NO: 664510 - DNA, 25 bp, Mus musculus
gatcccctcaacatcaaacagaaca

SEQ ID NO: 664511 - DNA, 25 bp, Mus musculus
gatcccctcaacttcaaacagaaca

SEQ ID NO: 664512 - DNA, 25 bp, Mus musculus
gatcccctgactcacatcctgagtg

SEQ ID NO: 664513 - DNA, 25 bp, Mus musculus
gatcccctgactgacatcctgagtg

SEQ ID NO: 664514 - DNA, 25 bp, Mus musculus
gatcccgaactaccggccatggcga

SEQ ID NO: 664515 - DNA, 25 bp, Mus musculus
gatcccgaactagcggccatggcga

SEQ ID NO: 664516 - DNA, 25 bp, Mus musculus
gatcccgcaaaaacccttgcagaac

SEQ ID NO: 664517 - DNA, 25 bp, Mus musculus
gatcccgcaaaatcccttgcagaac

SEQ ID NO: 664518 - DNA, 25 bp, Mus musculus
gatcccggacaaccagttagatgag

SEQ ID NO: 664519 - DNA, 25 bp, Mus musculus
gatcccggacaagcagttagatgag

SEQ ID NO: 664520 - DNA, 25 bp, Mus musculus
gatcccggagaacatctggagcgcc

SEQ ID NO: 664521 - DNA, 25 bp, Mus musculus
gatcccggagaagatctggagcgcc

SEQ ID NO: 664522 - DNA, 25 bp, Mus musculus
gatcccgggctacgagtatctcaga

SEQ ID NO: 664523 - DNA, 25 bp, Mus musculus
gatcccgggctaggagtatctcaga

SEQ ID NO: 664524 - DNA, 25 bp, Mus musculus
gatcccgtgcatcttccaggctgtg

SEQ ID NO: 664525 - DNA, 25 bp, Mus musculus
gatcccgtgcatgttccaggctgtg

SEQ ID NO: 664526 - DNA, 25 bp, Mus musculus
gatcccgtgcttatgctggtggcag

SEQ ID NO: 664527 - DNA, 25 bp, Mus musculus
gatcccgtgcttttgctggtggcag

SEQ ID NO: 664528 - DNA, 25 bp, Mus musculus
gatcccgtggaacctgtaaaagata

SEQ ID NO: 664529 - DNA, 25 bp, Mus musculus
gatcccgtggaagctgtaaaagata

SEQ ID NO: 664530 - DNA, 25 bp, Mus musculus
gatccctaaacaacccaatgtgctg

SEQ ID NO: 664531 - DNA, 25 bp, Mus musculus
gatccctaaacatcccaatgtgctg

SEQ ID NO: 664532 - DNA, 25 bp, Mus musculus
gatccctatgtgaagcttcatctgc

SEQ ID NO: 664533 - DNA, 25 bp, Mus musculus
gatccctatgtgtagcttcatctgc

SEQ ID NO: 664534 - DNA, 25 bp, Mus musculus
gatccctattcaagtgcagagccgc

SEQ ID NO: 664535 - DNA, 25 bp, Mus musculus
gatccctattcatgtgcagagccgc

SEQ ID NO: 664536 - DNA, 25 bp, Mus musculus
gatccctccaatatgttaattaaca

SEQ ID NO: 664537 - DNA, 25 bp, Mus musculus
gatccctccaatttgttaattaaca

SEQ ID NO: 664538 - DNA, 25 bp, Mus musculus
gatccctcgtggatccgatcggagc

SEQ ID NO: 664539 - DNA, 25 bp, Mus musculus
gatccctcgtggttccgatcggagc

SEQ ID NO: 664540 - DNA, 25 bp, Mus musculus
gatccctctgcacaatatggtggtg

SEQ ID NO: 664541 - DNA, 25 bp, Mus musculus
gatccctctgcagaatatggtggtg

SEQ ID NO: 664542 - DNA, 25 bp, Mus musculus
gatccctctgtcatggatgacacag

SEQ ID NO: 664543 - DNA, 25 bp, Mus musculus
gatccctctgtcttggatgacacag

SEQ ID NO: 664544 - DNA, 25 bp, Mus musculus
gatccctggatgacctggtgaaggt

SEQ ID NO: 664545 - DNA, 25 bp, Mus musculus
gatccctggatgtcctggtgaaggt

SEQ ID NO: 664546 - DNA, 25 bp, Mus musculus
gatccctgttcacactgcatgagaa

SEQ ID NO: 664547 - DNA, 25 bp, Mus musculus
gatccctgttcagactgcatgagaa

SEQ ID NO: 664548 - DNA, 25 bp, Mus musculus
gatcccttcggacagccagggagca

SEQ ID NO: 664549 - DNA, 25 bp, Mus musculus
gatcccttcggagagccagggagca

SEQ ID NO: 664550 - DNA, 25 bp, Mus musculus
gatcccttgcagatcatgattctgg

SEQ ID NO: 664551 - DNA, 25 bp, Mus musculus
gatcccttgcagatctgtgcctgtt

SEQ ID NO: 664552 - DNA, 25 bp, Mus musculus
gatcccttgcagttcatgattctgg

SEQ ID NO: 664553 - DNA, 25 bp, Mus musculus
gatcccttgcagttctgtgcctgtt

SEQ ID NO: 664554 - DNA, 25 bp, Mus musculus
gatcccttgctgagaggtcaacctg

SEQ ID NO: 664555 - DNA, 25 bp, Mus musculus
gatcccttgctgtgaggtcaacctg

SEQ ID NO: 664556 - DNA, 25 bp, Mus musculus
gatccgaaaacaagaggcctttgaa

SEQ ID NO: 664557 - DNA, 25 bp, Mus musculus
gatccgaaaacatgaggcctttgaa

SEQ ID NO: 664558 - DNA, 25 bp, Mus musculus
gatccgaacaagctcagaatgaaaa

SEQ ID NO: 664559 - DNA, 25 bp, Mus musculus
gatccgaacaaggtcagaatgaaaa

SEQ ID NO: 664560 - DNA, 25 bp, Mus musculus
gatccgaactctatacgaccacgtg

SEQ ID NO: 664561 - DNA, 25 bp, Mus musculus
gatccgaactctttacgaccacgtg

SEQ ID NO: 664562 - DNA, 25 bp, Mus musculus
gatccgaatgaaaagagtaaacata

SEQ ID NO: 664563 - DNA, 25 bp, Mus musculus
gatccgaatgaatagagtaaacata

SEQ ID NO: 664564 - DNA, 25 bp, Mus musculus
gatccgacggtcacgttgttgctga

SEQ ID NO: 664565 - DNA, 25 bp, Mus musculus
gatccgacggtctcgttgttgctga

SEQ ID NO: 664566 - DNA, 25 bp, Mus musculus
gatccgagccgtcctgaaggaccca

SEQ ID NO: 664567 - DNA, 25 bp, Mus musculus
gatccgagccgtgctgaaggaccca

SEQ ID NO: 664568 - DNA, 25 bp, Mus musculus
gatccgagcctcactacctggtgct

SEQ ID NO: 664569 - DNA, 25 bp, Mus musculus
gatccgagcctctctacctggtgct

SEQ ID NO: 664570 - DNA, 25 bp, Mus musculus
gatccgagctcacatcttaggctac

SEQ ID NO: 664571 - DNA, 25 bp, Mus musculus
gatccgagctcagatcttaggctac

SEQ ID NO: 664572 - DNA, 25 bp, Mus musculus
gatccgattctgcaacgttctttta

SEQ ID NO: 664573 - DNA, 25 bp, Mus musculus
gatccgattctggaacgttctttta

SEQ ID NO: 664574 - DNA, 25 bp, Mus musculus
gatccgatttctcattttgcctgac

SEQ ID NO: 664575 - DNA, 25 bp, Mus musculus
gatccgatttctgattttgcctgac

SEQ ID NO: 664576 - DNA, 25 bp, Mus musculus
gatccgcaagctcgtgagactacat

SEQ ID NO: 664577 - DNA, 25 bp, Mus musculus
gatccgcaagctggtgagactacat

SEQ ID NO: 664578 - DNA, 25 bp, Mus musculus
gatccgcagaccaagagggttttct

SEQ ID NO: 664579 - DNA, 25 bp, Mus musculus
gatccgcagacctagagggttttct

SEQ ID NO: 664580 - DNA, 25 bp, Mus musculus
gatccgcagcctcatgaagactcat

SEQ ID NO: 664581 - DNA, 25 bp, Mus musculus
gatccgcagcctgatgaagactcat

SEQ ID NO: 664582 - DNA, 25 bp, Mus musculus
gatccgcatgcgaagctggtgagaa

SEQ ID NO: 664583 - DNA, 25 bp, Mus musculus
gatccgcatgcgtagctggtgagaa

SEQ ID NO: 664584 - DNA, 25 bp, Mus musculus
gatccgcatggaacctgacgagacg

SEQ ID NO: 664585 - DNA, 25 bp, Mus musculus
gatccgcatggatcctgacgagacg

SEQ ID NO: 664586 - DNA, 25 bp, Mus musculus
gatccgccaggaaaccttcacttgt

SEQ ID NO: 664587 - DNA, 25 bp, Mus musculus
gatccgccaggataccttcacttgt

SEQ ID NO: 664588 - DNA, 25 bp, Mus musculus
gatccgccaggccattgaacggcaa

SEQ ID NO: 664589 - DNA, 25 bp, Mus musculus
gatccgccaggcgattgaacggcaa

SEQ ID NO: 664590 - DNA, 25 bp, Mus musculus
gatccgccaggtctctgatgtgcag

SEQ ID NO: 664591 - DNA, 25 bp, Mus musculus
gatccgccaggtgtctgatgtgcag

SEQ ID NO: 664592 - DNA, 25 bp, Mus musculus
gatccgccttcgaagcagtgaggtg

SEQ ID NO: 664593 - DNA, 25 bp, Mus musculus
gatccgccttcgtagcagtgaggtg

SEQ ID NO: 664594 - DNA, 25 bp, Mus musculus
gatccgcgcctgcactaaacagcag

SEQ ID NO: 664595 - DNA, 25 bp, Mus musculus
gatccgcgcctggactaaacagcag

SEQ ID NO: 664596 - DNA, 25 bp, Mus musculus
gatccgctcagccatccgggagctg

SEQ ID NO: 664597 - DNA, 25 bp, Mus musculus
gatccgctcagcgatccgggagctg

SEQ ID NO: 664598 - DNA, 25 bp, Mus musculus
gatccgctcggtcgctattggtgct

SEQ ID NO: 664599 - DNA, 25 bp, Mus musculus
gatccgctcggtggctattggtgct

SEQ ID NO: 664600 - DNA, 25 bp, Mus musculus
gatccgctctggagaggcagacagc

SEQ ID NO: 664601 - DNA, 25 bp, Mus musculus
gatccgctctggtgaggcagacagc

SEQ ID NO: 664602 - DNA, 25 bp, Mus musculus
gatccgctgtgaagaggaaacccag

SEQ ID NO: 664603 - DNA, 25 bp, Mus musculus
gatccgctgtgatgaggaaacccag

SEQ ID NO: 664604 - DNA, 25 bp, Mus musculus
gatccggaagtcaactgtccctaca

SEQ ID NO: 664605 - DNA, 25 bp, Mus musculus
gatccggaagtcatggtaagcctgt

SEQ ID NO: 664606 - DNA, 25 bp, Mus musculus
gatccggaagtctactgtccctaca

SEQ ID NO: 664607 - DNA, 25 bp, Mus musculus
gatccggaagtcttggtaagcctgt

SEQ ID NO: 664608 - DNA, 25 bp, Mus musculus
gatccggacctcacaaagcctttca

SEQ ID NO: 664609 - DNA, 25 bp, Mus musculus
gatccggacctctcaaagcctttca

SEQ ID NO: 664610 - DNA, 25 bp, Mus musculus
gatccggatccgcattgatgatgaa

SEQ ID NO: 664611 - DNA, 25 bp, Mus musculus
gatccggatccggattgatgatgaa

SEQ ID NO: 664612 - DNA, 25 bp, Mus musculus
gatccggcagaactaccggtccaag

SEQ ID NO: 664613 - DNA, 25 bp, Mus musculus
gatccggcagaagtaccggtccaag

SEQ ID NO: 664614 - DNA, 25 bp, Mus musculus
gatccggcattcaagagacaagaaa

SEQ ID NO: 664615 - DNA, 25 bp, Mus musculus
gatccggcattctagagacaagaaa

SEQ ID NO: 664616 - DNA, 25 bp, Mus musculus
gatccggcccttcgacttttgaagg

SEQ ID NO: 664617 - DNA, 25 bp, Mus musculus
gatccggcccttggacttttgaagg

SEQ ID NO: 664618 - DNA, 25 bp, Mus musculus
gatccggctcttccgagagttcctg

SEQ ID NO: 664619 - DNA, 25 bp, Mus musculus
gatccggctcttgcgagagttcctg

SEQ ID NO: 664620 - DNA, 25 bp, Mus musculus
gatccggctgacctgccgtgctgaa

SEQ ID NO: 664621 - DNA, 25 bp, Mus musculus
gatccggctgacgtgccgtgctgaa

SEQ ID NO: 664622 - DNA, 25 bp, Mus musculus
gatccgggagttagtgccacctttt

SEQ ID NO: 664623 - DNA, 25 bp, Mus musculus
gatccgggagtttgtgccacctttt

SEQ ID NO: 664624 - DNA, 25 bp, Mus musculus
gatccgggcccaacattcgactatt

SEQ ID NO: 664625 - DNA, 25 bp, Mus musculus
gatccgggcccaagtgacgtcatgt

SEQ ID NO: 664626 - DNA, 25 bp, Mus musculus
gatccgggcccatcattcgactatt

SEQ ID NO: 664627 - DNA, 25 bp, Mus musculus
gatccgggcccatgtgacgtcatgt

SEQ ID NO: 664628 - DNA, 25 bp, Mus musculus
gatccgggcttcattcccaatccaa

SEQ ID NO: 664629 - DNA, 25 bp, Mus musculus
gatccgggcttctttcccaatccaa

SEQ ID NO: 664630 - DNA, 25 bp, Mus musculus
gatccggtcagtcggcagacctgcc

SEQ ID NO: 664631 - DNA, 25 bp, Mus musculus
gatccggtcagtgggcagacctgcc

SEQ ID NO: 664632 - DNA, 25 bp, Mus musculus
gatccggtgaccatcgagaacaaag

SEQ ID NO: 664633 - DNA, 25 bp, Mus musculus
gatccggtgaccttcgagaacaaag

SEQ ID NO: 664634 - DNA, 25 bp, Mus musculus
gatccggttcttcgtgatacacagc

SEQ ID NO: 664635 - DNA, 25 bp, Mus musculus
gatccggttcttggtgatacacagc

SEQ ID NO: 664636 - DNA, 25 bp, Mus musculus
gatccggtttccatagaaatgcttg

SEQ ID NO: 664637 - DNA, 25 bp, Mus musculus
gatccggtttccttagaaatgcttg

SEQ ID NO: 664638 - DNA, 25 bp, Mus musculus
gatccgtacatccagcatcttgtaa

SEQ ID NO: 664639 - DNA, 25 bp, Mus musculus
gatccgtacatcgagcatcttgtaa

SEQ ID NO: 664640 - DNA, 25 bp, Mus musculus
gatccgtagggcaggaggtctacac

SEQ ID NO: 664641 - DNA, 25 bp, Mus musculus
gatccgtagggctggaggtctacac

SEQ ID NO: 664642 - DNA, 25 bp, Mus musculus
gatccgtcgaatcaaccagacatac

SEQ ID NO: 664643 - DNA, 25 bp, Mus musculus
gatccgtcgaatgaaccagacatac

SEQ ID NO: 664644 - DNA, 25 bp, Mus musculus
gatccgtgacatcccctacgtggac

SEQ ID NO: 664645 - DNA, 25 bp, Mus musculus
gatccgtgacatgccctacgtggac

SEQ ID NO: 664646 - DNA, 25 bp, Mus musculus
gatccgtgccggaggagctggagtc

SEQ ID NO: 664647 - DNA, 25 bp, Mus musculus
gatccgtgccggtggagctggagtc

SEQ ID NO: 664648 - DNA, 25 bp, Mus musculus
gatccgtgtatgactaaacattcta

SEQ ID NO: 664649 - DNA, 25 bp, Mus musculus
gatccgtgtatgtctaaacattcta

SEQ ID NO: 664650 - DNA, 25 bp, Mus musculus
gatccgtgtcatccagcagagtgtg

SEQ ID NO: 664651 - DNA, 25 bp, Mus musculus
gatccgtgtcatgcagcagagtgtg

SEQ ID NO: 664652 - DNA, 25 bp, Mus musculus
gatccgtgtggaaattctggagaat

SEQ ID NO: 664653 - DNA, 25 bp, Mus musculus
gatccgtgtggatattctggagaat

SEQ ID NO: 664654 - DNA, 25 bp, Mus musculus
gatccgttccatcgaagcccttctg

SEQ ID NO: 664655 - DNA, 25 bp, Mus musculus
gatccgttccatggaagcccttctg

SEQ ID NO: 664656 - DNA, 25 bp, Mus musculus
gatccgttctgtccgtgtgggcact

SEQ ID NO: 664657 - DNA, 25 bp, Mus musculus
gatccgttctgtgcgtgtgggcact

SEQ ID NO: 664658 - DNA, 25 bp, Mus musculus
gatccgtttgccagaatttacaaag

SEQ ID NO: 664659 - DNA, 25 bp, Mus musculus
gatccgtttgcctgaatttacaaag

SEQ ID NO: 664660 - DNA, 25 bp, Mus musculus
gatcctaaaactccgccacatctgg

SEQ ID NO: 664661 - DNA, 25 bp, Mus musculus
gatcctaaaactgcgccacatctgg

SEQ ID NO: 664662 - DNA, 25 bp, Mus musculus
gatcctaaaattcctcagaaccttt

SEQ ID NO: 664663 - DNA, 25 bp, Mus musculus
gatcctaaaattgctcagaaccttt

SEQ ID NO: 664664 - DNA, 25 bp, Mus musculus
gatcctaaactcatagacgtgtaag

SEQ ID NO: 664665 - DNA, 25 bp, Mus musculus
gatcctaaactcttagacgtgtaag

SEQ ID NO: 664666 - DNA, 25 bp, Mus musculus
gatcctaaaggtcgttgacccaact

SEQ ID NO: 664667 - DNA, 25 bp, Mus musculus
gatcctaaaggtggttgacccaact

SEQ ID NO: 664668 - DNA, 25 bp, Mus musculus
gatcctaacatcagggagaggactt

SEQ ID NO: 664669 - DNA, 25 bp, Mus musculus
gatcctaacatctgggagaggactt

SEQ ID NO: 664670 - DNA, 25 bp, Mus musculus
gatcctaactccaaggtgatgcaag

SEQ ID NO: 664671 - DNA, 25 bp, Mus musculus
gatcctaactcctaggtgatgcaag

SEQ ID NO: 664672 - DNA, 25 bp, Mus musculus
gatcctaagagcagaaggcgagtta

SEQ ID NO: 664673 - DNA, 25 bp, Mus musculus
gatcctaagagctgaaggcgagtta

SEQ ID NO: 664674 - DNA, 25 bp, Mus musculus
gatcctaaggccacacgtagcactg

SEQ ID NO: 664675 - DNA, 25 bp, Mus musculus
gatcctaaggcctcacgtagcactg

SEQ ID NO: 664676 - DNA, 25 bp, Mus musculus
gatcctaagtgccagtaggtttgaa

SEQ ID NO: 664677 - DNA, 25 bp, Mus musculus
gatcctaagtgcgagtaggtttgaa

SEQ ID NO: 664678 - DNA, 25 bp, Mus musculus
gatcctaattacaacgtgtgtaacg

SEQ ID NO: 664679 - DNA, 25 bp, Mus musculus
gatcctaattactacgtgtgtaacg

SEQ ID NO: 664680 - DNA, 25 bp, Mus musculus
gatcctacacaaccacgaagttcct

SEQ ID NO: 664681 - DNA, 25 bp, Mus musculus
gatcctacacaagcacgaagttcct

SEQ ID NO: 664682 - DNA, 25 bp, Mus musculus
gatcctactcggaaaggctcagtgg

SEQ ID NO: 664683 - DNA, 25 bp, Mus musculus
gatcctactcggtaaggctcagtgg

SEQ ID NO: 664684 - DNA, 25 bp, Mus musculus
gatcctactgcacagggcagggcct

SEQ ID NO: 664685 - DNA, 25 bp, Mus musculus
gatcctactgcagagggcagggcct

SEQ ID NO: 664686 - DNA, 25 bp, Mus musculus
gatcctacttttcacaactcagttc

SEQ ID NO: 664687 - DNA, 25 bp, Mus musculus
gatcctacttttgacaactcagttc

SEQ ID NO: 664688 - DNA, 25 bp, Mus musculus
gatcctaggaggagttgggctcttc

SEQ ID NO: 664689 - DNA, 25 bp, Mus musculus
gatcctaggaggtgttgggctcttc

SEQ ID NO: 664690 - DNA, 25 bp, Mus musculus
gatcctaggtgtagctctgtggttg

SEQ ID NO: 664691 - DNA, 25 bp, Mus musculus
gatcctaggtgttgctctgtggttg

SEQ ID NO: 664692 - DNA, 25 bp, Mus musculus
gatcctagtgaacaccggtggaccc

SEQ ID NO: 664693 - DNA, 25 bp, Mus musculus
gatcctagtgaagaccggtggaccc

SEQ ID NO: 664694 - DNA, 25 bp, Mus musculus
gatcctagtggtcacccggttggct

SEQ ID NO: 664695 - DNA, 25 bp, Mus musculus
gatcctagtggtgacccggttggct

SEQ ID NO: 664696 - DNA, 25 bp, Mus musculus
gatcctcactggaggaaggccagag

SEQ ID NO: 664697 - DNA, 25 bp, Mus musculus
gatcctcactggtggaaggccagag

SEQ ID NO: 664698 - DNA, 25 bp, Mus musculus
gatcctcagactaggtctccctcgg

SEQ ID NO: 664699 - DNA, 25 bp, Mus musculus
gatcctcagacttggtctccctcgg

SEQ ID NO: 664700 - DNA, 25 bp, Mus musculus
gatcctcagcgacgagatctactgc

SEQ ID NO: 664701 - DNA, 25 bp, Mus musculus
gatcctcagcgaggagatctactgc

SEQ ID NO: 664702 - DNA, 25 bp, Mus musculus
gatcctcaggaaaccctacgggatt

SEQ ID NO: 664703 - DNA, 25 bp, Mus musculus
gatcctcaggaatccctacgggatt

SEQ ID NO: 664704 - DNA, 25 bp, Mus musculus
gatcctcaggctatcattacctgcg

SEQ ID NO: 664705 - DNA, 25 bp, Mus musculus
gatcctcaggctttcattacctgcg

SEQ ID NO: 664706 - DNA, 25 bp, Mus musculus
gatcctcagttcattctgaagcccc

SEQ ID NO: 664707 - DNA, 25 bp, Mus musculus
gatcctcagttctttctgaagcccc

SEQ ID NO: 664708 - DNA, 25 bp, Mus musculus
gatcctcatcgcacaggtgaccgta

SEQ ID NO: 664709 - DNA, 25 bp, Mus musculus
gatcctcatcgctcaggtgaccgta

SEQ ID NO: 664710 - DNA, 25 bp, Mus musculus
gatcctcatgaaagactatcctaaa

SEQ ID NO: 664711 - DNA, 25 bp, Mus musculus
gatcctcatgaaaggcaactcatgt

SEQ ID NO: 664712 - DNA, 25 bp, Mus musculus
gatcctcatgaatgactatcctaaa

SEQ ID NO: 664713 - DNA, 25 bp, Mus musculus
gatcctcatgaatggcaactcatgt

SEQ ID NO: 664714 - DNA, 25 bp, Mus musculus
gatcctccacgtatccagatcctag

SEQ ID NO: 664715 - DNA, 25 bp, Mus musculus
gatcctccacgtttccagatcctag

SEQ ID NO: 664716 - DNA, 25 bp, Mus musculus
gatcctcccaagagaatgacagcca

SEQ ID NO: 664717 - DNA, 25 bp, Mus musculus
gatcctcccaagtgaatgacagcca

SEQ ID NO: 664718 - DNA, 25 bp, Mus musculus
gatcctcccaggattcatagacttc

SEQ ID NO: 664719 - DNA, 25 bp, Mus musculus
gatcctcccaggtttcatagacttc

SEQ ID NO: 664720 - DNA, 25 bp, Mus musculus
gatcctccctgactggtgggtccag

SEQ ID NO: 664721 - DNA, 25 bp, Mus musculus
gatcctccctgagtggtgggtccag

SEQ ID NO: 664722 - DNA, 25 bp, Mus musculus
gatcctccctttcaagtgcgtggtg

SEQ ID NO: 664723 - DNA, 25 bp, Mus musculus
gatcctccctttgaagtgcgtggtg

SEQ ID NO: 664724 - DNA, 25 bp, Mus musculus
gatcctccgcctctttgcagatgga

SEQ ID NO: 664725 - DNA, 25 bp, Mus musculus
gatcctccgcctgtttgcagatgga

SEQ ID NO: 664726 - DNA, 25 bp, Mus musculus
gatcctcctaaaatgggagacctga

SEQ ID NO: 664727 - DNA, 25 bp, Mus musculus
gatcctcctaaattgggagacctga

SEQ ID NO: 664728 - DNA, 25 bp, Mus musculus
gatcctcctcaacctggacaggctg

SEQ ID NO: 664729 - DNA, 25 bp, Mus musculus
gatcctcctcaagctggacaggctg

SEQ ID NO: 664730 - DNA, 25 bp, Mus musculus
gatcctcctgcaagataaacagcgg

SEQ ID NO: 664731 - DNA, 25 bp, Mus musculus
gatcctcctgcatgataaacagcgg

SEQ ID NO: 664732 - DNA, 25 bp, Mus musculus
gatcctcctgggatgttcggcaagc

SEQ ID NO: 664733 - DNA, 25 bp, Mus musculus
gatcctcctgggttgttcggcaagc

SEQ ID NO: 664734 - DNA, 25 bp, Mus musculus
gatcctcctgtgagtgctgccctga

SEQ ID NO: 664735 - DNA, 25 bp, Mus musculus
gatcctcctgtgtgtgctgccctga

SEQ ID NO: 664736 - DNA, 25 bp, Mus musculus
gatcctccttttagtcagggacaga

SEQ ID NO: 664737 - DNA, 25 bp, Mus musculus
gatcctcctttttgtcagggacaga

SEQ ID NO: 664738 - DNA, 25 bp, Mus musculus
gatcctcgcaatccccgtgtgtgct

SEQ ID NO: 664739 - DNA, 25 bp, Mus musculus
gatcctcgcaatgcccgtgtgtgct

SEQ ID NO: 664740 - DNA, 25 bp, Mus musculus
gatcctcgctctccaaagctgcttt

SEQ ID NO: 664741 - DNA, 25 bp, Mus musculus
gatcctcgctctgcaaagctgcttt

SEQ ID NO: 664742 - DNA, 25 bp, Mus musculus
gatcctcggctacatcaaatcggga

SEQ ID NO: 664743 - DNA, 25 bp, Mus musculus
gatcctcggctagatcaaatcggga

SEQ ID NO: 664744 - DNA, 25 bp, Mus musculus
gatcctcgggaaaattctctttgca

SEQ ID NO: 664745 - DNA, 25 bp, Mus musculus
gatcctcgggaatattctctttgca

SEQ ID NO: 664746 - DNA, 25 bp, Mus musculus
gatcctcgggagatcattttcacta

SEQ ID NO: 664747 - DNA, 25 bp, Mus musculus
gatcctcgggagttcattttcacta

SEQ ID NO: 664748 - DNA, 25 bp, Mus musculus
gatcctctacgtcgaacctttgccg

SEQ ID NO: 664749 - DNA, 25 bp, Mus musculus
gatcctctacgtggaacctttgccg

SEQ ID NO: 664750 - DNA, 25 bp, Mus musculus
gatcctctattcattgcagactcag

SEQ ID NO: 664751 - DNA, 25 bp, Mus musculus
gatcctctattctttgcagactcag

SEQ ID NO: 664752 - DNA, 25 bp, Mus musculus
gatcctctcgaaagaagcctgtgta

SEQ ID NO: 664753 - DNA, 25 bp, Mus musculus
gatcctctcgaatgaagcctgtgta

SEQ ID NO: 664754 - DNA, 25 bp, Mus musculus
gatcctctgagtaagcctaaggtag

SEQ ID NO: 664755 - DNA, 25 bp, Mus musculus
gatcctctgagttagcctaaggtag

SEQ ID NO: 664756 - DNA, 25 bp, Mus musculus
gatcctctgtcccatggaccggttt

SEQ ID NO: 664757 - DNA, 25 bp, Mus musculus
gatcctctgtccgatggaccggttt

SEQ ID NO: 664758 - DNA, 25 bp, Mus musculus
gatcctcttccgcagtcgatcctga

SEQ ID NO: 664759 - DNA, 25 bp, Mus musculus
gatcctcttccggagtcgatcctga

SEQ ID NO: 664760 - DNA, 25 bp, Mus musculus
gatcctcttgatcaagctgacttca

SEQ ID NO: 664761 - DNA, 25 bp, Mus musculus
gatcctcttgatgaagctgacttca

SEQ ID NO: 664762 - DNA, 25 bp, Mus musculus
gatcctctttggcagtgttttctcg

SEQ ID NO: 664763 - DNA, 25 bp, Mus musculus
gatcctctttgggagtgttttctcg

SEQ ID NO: 664764 - DNA, 25 bp, Mus musculus
gatcctgaaacaagtgtttcttatt

SEQ ID NO: 664765 - DNA, 25 bp, Mus musculus
gatcctgaaacatgtgtttcttatt

SEQ ID NO: 664766 - DNA, 25 bp, Mus musculus
gatcctgaagctcaaagacctgaag

SEQ ID NO: 664767 - DNA, 25 bp, Mus musculus
gatcctgaagctgaaagacctgaag

SEQ ID NO: 664768 - DNA, 25 bp, Mus musculus
gatcctgaccttatccctgcagagg

SEQ ID NO: 664769 - DNA, 25 bp, Mus musculus
gatcctgaccttttccctgcagagg

SEQ ID NO: 664770 - DNA, 25 bp, Mus musculus
gatcctgacgggaaatccgttcacg

SEQ ID NO: 664771 - DNA, 25 bp, Mus musculus
gatcctgacgggtaatccgttcacg

SEQ ID NO: 664772 - DNA, 25 bp, Mus musculus
gatcctgacttaaggcagtttttgg

SEQ ID NO: 664773 - DNA, 25 bp, Mus musculus
gatcctgacttatggcagtttttgg

SEQ ID NO: 664774 - DNA, 25 bp, Mus musculus
gatcctgagactcatgaacacttca

SEQ ID NO: 664775 - DNA, 25 bp, Mus musculus
gatcctgagactgatgaacacttca

SEQ ID NO: 664776 - DNA, 25 bp, Mus musculus
gatcctgagagtcgacccaaccttt

SEQ ID NO: 664777 - DNA, 25 bp, Mus musculus
gatcctgagagtggacccaaccttt

SEQ ID NO: 664778 - DNA, 25 bp, Mus musculus
gatcctgaggacaccagagatgagt

SEQ ID NO: 664779 - DNA, 25 bp, Mus musculus
gatcctgaggactccagagatgagt

SEQ ID NO: 664780 - DNA, 25 bp, Mus musculus
gatcctgaggccagggccctacatc

SEQ ID NO: 664781 - DNA, 25 bp, Mus musculus
gatcctgaggcccatgctgaacttc

SEQ ID NO: 664782 - DNA, 25 bp, Mus musculus
gatcctgaggccgatgctgaacttc

SEQ ID NO: 664783 - DNA, 25 bp, Mus musculus
gatcctgaggcctgggccctacatc

SEQ ID NO: 664784 - DNA, 25 bp, Mus musculus
gatcctgagtacatgcgacttcgca

SEQ ID NO: 664785 - DNA, 25 bp, Mus musculus
gatcctgagtacttgcgacttcgca

SEQ ID NO: 664786 - DNA, 25 bp, Mus musculus
gatcctgatggtaaccgtcctgaag

SEQ ID NO: 664787 - DNA, 25 bp, Mus musculus
gatcctgatggtcgcctcagcctgg

SEQ ID NO: 664788 - DNA, 25 bp, Mus musculus
gatcctgatggtggcctcagcctgg

SEQ ID NO: 664789 - DNA, 25 bp, Mus musculus
gatcctgatggttaccgtcctgaag

SEQ ID NO: 664790 - DNA, 25 bp, Mus musculus
gatcctgcacaactacctagtgtgg

SEQ ID NO: 664791 - DNA, 25 bp, Mus musculus
gatcctgcacaagtacctagtgtgg

SEQ ID NO: 664792 - DNA, 25 bp, Mus musculus
gatcctgcacagctatgagattacc

SEQ ID NO: 664793 - DNA, 25 bp, Mus musculus
gatcctgcacaggtatgagattacc

SEQ ID NO: 664794 - DNA, 25 bp, Mus musculus
gatcctgcaggtcttgagcgatgac

SEQ ID NO: 664795 - DNA, 25 bp, Mus musculus
gatcctgcaggtgttgagcgatgac

SEQ ID NO: 664796 - DNA, 25 bp, Mus musculus
gatcctgcccatctttgaccgactg

SEQ ID NO: 664797 - DNA, 25 bp, Mus musculus
gatcctgcccatgtttgaccgactg

SEQ ID NO: 664798 - DNA, 25 bp, Mus musculus
gatcctgccgagagccggattgcac

SEQ ID NO: 664799 - DNA, 25 bp, Mus musculus
gatcctgccgagtgccggattgcac

SEQ ID NO: 664800 - DNA, 25 bp, Mus musculus
gatcctgcgggtattgctggaagct

SEQ ID NO: 664801 - DNA, 25 bp, Mus musculus
gatcctgcgggttttgctggaagct

SEQ ID NO: 664802 - DNA, 25 bp, Mus musculus
gatcctgctagtaagcgctacgaag

SEQ ID NO: 664803 - DNA, 25 bp, Mus musculus
gatcctgctagttagcgctacgaag

SEQ ID NO: 664804 - DNA, 25 bp, Mus musculus
gatcctgctctacaacggagatgtg

SEQ ID NO: 664805 - DNA, 25 bp, Mus musculus
gatcctgctctagaacggagatgtg

SEQ ID NO: 664806 - DNA, 25 bp, Mus musculus
gatcctgctgaactccgagcgactc

SEQ ID NO: 664807 - DNA, 25 bp, Mus musculus
gatcctgctgaagtccgagcgactc

SEQ ID NO: 664808 - DNA, 25 bp, Mus musculus
gatcctgctttaattactgcctaca

SEQ ID NO: 664809 - DNA, 25 bp, Mus musculus
gatcctgctttatttactgcctaca

SEQ ID NO: 664810 - DNA, 25 bp, Mus musculus
gatcctggaagcaattccccaagtc

SEQ ID NO: 664811 - DNA, 25 bp, Mus musculus
gatcctggaagctattccccaagtc

SEQ ID NO: 664812 - DNA, 25 bp, Mus musculus
gatcctggaggtcgatctgaagaac

SEQ ID NO: 664813 - DNA, 25 bp, Mus musculus
gatcctggaggtggatctgaagaac

SEQ ID NO: 664814 - DNA, 25 bp, Mus musculus
gatcctggatatacactttctctca

SEQ ID NO: 664815 - DNA, 25 bp, Mus musculus
gatcctggatattcactttctctca

SEQ ID NO: 664816 - DNA, 25 bp, Mus musculus
gatcctggccagactagcatctggg

SEQ ID NO: 664817 - DNA, 25 bp, Mus musculus
gatcctggccagtctagcatctggg

SEQ ID NO: 664818 - DNA, 25 bp, Mus musculus
gatcctgggaaactctacaccctgg

SEQ ID NO: 664819 - DNA, 25 bp, Mus musculus
gatcctgggaaagtctacaccctgg

SEQ ID NO: 664820 - DNA, 25 bp, Mus musculus
gatcctgggccgcttactcattggc

SEQ ID NO: 664821 - DNA, 25 bp, Mus musculus
gatcctgggccggttactcattggc

SEQ ID NO: 664822 - DNA, 25 bp, Mus musculus
gatcctgggctacttttccgcgaaa

SEQ ID NO: 664823 - DNA, 25 bp, Mus musculus
gatcctgggctagttttccgcgaaa

SEQ ID NO: 664824 - DNA, 25 bp, Mus musculus
gatcctgggtttaggcggctcatca

SEQ ID NO: 664825 - DNA, 25 bp, Mus musculus
gatcctgggttttggcggctcatca

SEQ ID NO: 664826 - DNA, 25 bp, Mus musculus
gatcctggtacgagtgaaggtgtca

SEQ ID NO: 664827 - DNA, 25 bp, Mus musculus
gatcctggtacgtgtgaaggtgtca

SEQ ID NO: 664828 - DNA, 25 bp, Mus musculus
gatcctggtcctcatggctttcaga

SEQ ID NO: 664829 - DNA, 25 bp, Mus musculus
gatcctggtcctgatggctttcaga

SEQ ID NO: 664830 - DNA, 25 bp, Mus musculus
gatcctggtgatccagcccaacagg

SEQ ID NO: 664831 - DNA, 25 bp, Mus musculus
gatcctggtgatgcagcccaacagg

SEQ ID NO: 664832 - DNA, 25 bp, Mus musculus
gatcctggtgctcctcgtctacaga

SEQ ID NO: 664833 - DNA, 25 bp, Mus musculus
gatcctggtgctgctcgtctacaga

SEQ ID NO: 664834 - DNA, 25 bp, Mus musculus
gatcctggtggacgtcatggacctc

SEQ ID NO: 664835 - DNA, 25 bp, Mus musculus
gatcctggtggaggtcatggacctc

SEQ ID NO: 664836 - DNA, 25 bp, Mus musculus
gatcctgtacagaaactcttcgtgg

SEQ ID NO: 664837 - DNA, 25 bp, Mus musculus
gatcctgtacagtaactcttcgtgg

SEQ ID NO: 664838 - DNA, 25 bp, Mus musculus
gatcctgtgagaacacaacagggcc

SEQ ID NO: 664839 - DNA, 25 bp, Mus musculus
gatcctgtgagatcacaacagggcc

SEQ ID NO: 664840 - DNA, 25 bp, Mus musculus
gatcctgtgtagacctaagtctgac

SEQ ID NO: 664841 - DNA, 25 bp, Mus musculus
gatcctgtgtagtcctaagtctgac

SEQ ID NO: 664842 - DNA, 25 bp, Mus musculus
gatcctgttacacgaatggttatga

SEQ ID NO: 664843 - DNA, 25 bp, Mus musculus
gatcctgttacaggaatggttatga

SEQ ID NO: 664844 - DNA, 25 bp, Mus musculus
gatcctgttagccaacaaaaaagat

SEQ ID NO: 664845 - DNA, 25 bp, Mus musculus
gatcctgttagcgaacaaaaaagat

SEQ ID NO: 664846 - DNA, 25 bp, Mus musculus
gatcctgttcctccacatcgcggtg

SEQ ID NO: 664847 - DNA, 25 bp, Mus musculus
gatcctgttcctgcacatcgcggtg

SEQ ID NO: 664848 - DNA, 25 bp, Mus musculus
gatcctgttctcaccgtggaagaga

SEQ ID NO: 664849 - DNA, 25 bp, Mus musculus
gatcctgttctctccgtggaagaga

SEQ ID NO: 664850 - DNA, 25 bp, Mus musculus
gatcctgttgctcacagtgctgagc

SEQ ID NO: 664851 - DNA, 25 bp, Mus musculus
gatcctgttgctgacagtgctgagc

SEQ ID NO: 664852 - DNA, 25 bp, Mus musculus
gatccttaacagcatgggtgcagcg

SEQ ID NO: 664853 - DNA, 25 bp, Mus musculus
gatccttaacaggatgggtgcagcg

SEQ ID NO: 664854 - DNA, 25 bp, Mus musculus
gatccttactagatgttcgtttacc

SEQ ID NO: 664855 - DNA, 25 bp, Mus musculus
gatccttactagttgttcgtttacc

SEQ ID NO: 664856 - DNA, 25 bp, Mus musculus
gatccttatattagcatggcaagca

SEQ ID NO: 664857 - DNA, 25 bp, Mus musculus
gatccttatatttgcatggcaagca

SEQ ID NO: 664858 - DNA, 25 bp, Mus musculus
gatccttatcaccaagaatgaagag

SEQ ID NO: 664859 - DNA, 25 bp, Mus musculus
gatccttatcacgaagaatgaagag

SEQ ID NO: 664860 - DNA, 25 bp, Mus musculus
gatccttcaaacagggagccatgct

SEQ ID NO: 664861 - DNA, 25 bp, Mus musculus
gatccttcaaactgggagccatgct

SEQ ID NO: 664862 - DNA, 25 bp, Mus musculus
gatccttcatatccacacagcaagg

SEQ ID NO: 664863 - DNA, 25 bp, Mus musculus
gatccttcatatgcacacagcaagg

SEQ ID NO: 664864 - DNA, 25 bp, Mus musculus
gatccttccattatcaccgtgctga

SEQ ID NO: 664865 - DNA, 25 bp, Mus musculus
gatccttccattttcaccgtgctga

SEQ ID NO: 664866 - DNA, 25 bp, Mus musculus
gatccttcgacgcacatgtcgtgta

SEQ ID NO: 664867 - DNA, 25 bp, Mus musculus
gatccttcgacggacatgtcgtgta

SEQ ID NO: 664868 - DNA, 25 bp, Mus musculus
gatccttcgccaacagtacctgagg

SEQ ID NO: 664869 - DNA, 25 bp, Mus musculus
gatccttcgccatcagtacctgagg

SEQ ID NO: 664870 - DNA, 25 bp, Mus musculus
gatccttctaagagccatgagttgt

SEQ ID NO: 664871 - DNA, 25 bp, Mus musculus
gatccttctaagtgccatgagttgt

SEQ ID NO: 664872 - DNA, 25 bp, Mus musculus
gatccttgctgcagggctctgtaca

SEQ ID NO: 664873 - DNA, 25 bp, Mus musculus
gatccttgctgctgggctctgtaca

SEQ ID NO: 664874 - DNA, 25 bp, Mus musculus
gatccttggaaacctaactacagaa

SEQ ID NO: 664875 - DNA, 25 bp, Mus musculus
gatccttggaaagctaactacagaa

SEQ ID NO: 664876 - DNA, 25 bp, Mus musculus
gatccttggccaccgtaacagagcc

SEQ ID NO: 664877 - DNA, 25 bp, Mus musculus
gatccttggccagcgtaacagagcc

SEQ ID NO: 664878 - DNA, 25 bp, Mus musculus
gatcctttcatgcaccttcggtatg

SEQ ID NO: 664879 - DNA, 25 bp, Mus musculus
gatcctttcatggaccttcggtatg

SEQ ID NO: 664880 - DNA, 25 bp, Mus musculus
gatcctttgagtccaggagaccttg

SEQ ID NO: 664881 - DNA, 25 bp, Mus musculus
gatcctttgagtgcaggagaccttg

SEQ ID NO: 664882 - DNA, 25 bp, Mus musculus
gatcctttgcagaaatgactacatt

SEQ ID NO: 664883 - DNA, 25 bp, Mus musculus
gatcctttgcagtaatgactacatt

SEQ ID NO: 664884 - DNA, 25 bp, Mus musculus
gatcctttggtgatcgccctgcaag

SEQ ID NO: 664885 - DNA, 25 bp, Mus musculus
gatcctttggtgttcgccctgcaag

SEQ ID NO: 664886 - DNA, 25 bp, Mus musculus
gatccttttctaccgagttcttgag

SEQ ID NO: 664887 - DNA, 25 bp, Mus musculus
gatccttttctagcgagttcttgag

SEQ ID NO: 664888 - DNA, 25 bp, Mus musculus
gatccttttgttcgacgaggccacc

SEQ ID NO: 664889 - DNA, 25 bp, Mus musculus
gatccttttgttggacgaggccacc

SEQ ID NO: 664890 - DNA, 25 bp, Mus musculus
gatcctttttcgagagctggaggta

SEQ ID NO: 664891 - DNA, 25 bp, Mus musculus
gatcctttttcgtgagctggaggta

SEQ ID NO: 664892 - DNA, 25 bp, Mus musculus
gatcgaaactccagcgccccggaaa

SEQ ID NO: 664893 - DNA, 25 bp, Mus musculus
gatcgaaactcctgcgccccggaaa

SEQ ID NO: 664894 - DNA, 25 bp, Mus musculus
gatcgaaagatacctcctcccattg

SEQ ID NO: 664895 - DNA, 25 bp, Mus musculus
gatcgaaagatagctcctcccattg

SEQ ID NO: 664896 - DNA, 25 bp, Mus musculus
gatcgaaaggaaaggttaactaatt

SEQ ID NO: 664897 - DNA, 25 bp, Mus musculus
gatcgaaaggaatggttaactaatt

SEQ ID NO: 664898 - DNA, 25 bp, Mus musculus
gatcgaaaggccaatactgggccaa

SEQ ID NO: 664899 - DNA, 25 bp, Mus musculus
gatcgaaaggcctatactgggccaa

SEQ ID NO: 664900 - DNA, 25 bp, Mus musculus
gatcgaacccagagcctcaaatatg

SEQ ID NO: 664901 - DNA, 25 bp, Mus musculus
gatcgaacccagtgcctcaaatatg

SEQ ID NO: 664902 - DNA, 25 bp, Mus musculus
gatcgaacccgacgatgagcatagg

SEQ ID NO: 664903 - DNA, 25 bp, Mus musculus
gatcgaacccgaggatgagcatagg

SEQ ID NO: 664904 - DNA, 25 bp, Mus musculus
gatcgaacgcgacgtgagcatcctg

SEQ ID NO: 664905 - DNA, 25 bp, Mus musculus
gatcgaacgcgaggtgagcatcctg

SEQ ID NO: 664906 - DNA, 25 bp, Mus musculus
gatcgaagcctgatccacgctatgg

SEQ ID NO: 664907 - DNA, 25 bp, Mus musculus
gatcgaagcctgttccacgctatgg

SEQ ID NO: 664908 - DNA, 25 bp, Mus musculus
gatcgaatccaaagtcggcatgttc

SEQ ID NO: 664909 - DNA, 25 bp, Mus musculus
gatcgaatccaatgtcggcatgttc

SEQ ID NO: 664910 - DNA, 25 bp, Mus musculus
gatcgacaagcgcatgaacagcctc

SEQ ID NO: 664911 - DNA, 25 bp, Mus musculus
gatcgacaagcggatgaacagcctc

SEQ ID NO: 664912 - DNA, 25 bp, Mus musculus
gatcgacaatgtcctgggcattgac

SEQ ID NO: 664913 - DNA, 25 bp, Mus musculus
gatcgacaatgtgctgggcattgac

SEQ ID NO: 664914 - DNA, 25 bp, Mus musculus
gatcgacagctgaaagttaaggact

SEQ ID NO: 664915 - DNA, 25 bp, Mus musculus
gatcgacagctgtaagttaaggact

SEQ ID NO: 664916 - DNA, 25 bp, Mus musculus
gatcgacaggtaactggaggaccag

SEQ ID NO: 664917 - DNA, 25 bp, Mus musculus
gatcgacaggtatctggaggaccag

SEQ ID NO: 664918 - DNA, 25 bp, Mus musculus
gatcgacatcatcctttggtacaga

SEQ ID NO: 664919 - DNA, 25 bp, Mus musculus
gatcgacatcatgctttggtacaga

SEQ ID NO: 664920 - DNA, 25 bp, Mus musculus
gatcgacatggcattcaacgtgttc

SEQ ID NO: 664921 - DNA, 25 bp, Mus musculus
gatcgacatggctttcaacgtgttc

SEQ ID NO: 664922 - DNA, 25 bp, Mus musculus
gatcgaccaccgcaactacgactat

SEQ ID NO: 664923 - DNA, 25 bp, Mus musculus
gatcgaccaccggaactacgactat

SEQ ID NO: 664924 - DNA, 25 bp, Mus musculus
gatcgaccattaacagccagagaga

SEQ ID NO: 664925 - DNA, 25 bp, Mus musculus
gatcgaccattatcagccagagaga

SEQ ID NO: 664926 - DNA, 25 bp, Mus musculus
gatcgactacagcacagcagtgacc

SEQ ID NO: 664927 - DNA, 25 bp, Mus musculus
gatcgactacaggacagcagtgacc

SEQ ID NO: 664928 - DNA, 25 bp, Mus musculus
gatcgactctcactgtttcggccag

SEQ ID NO: 664929 - DNA, 25 bp, Mus musculus
gatcgactctcagtgtttcggccag

SEQ ID NO: 664930 - DNA, 25 bp, Mus musculus
gatcgacttcctatgtgggtggacg

SEQ ID NO: 664931 - DNA, 25 bp, Mus musculus
gatcgacttcctttgtgggtggacg

SEQ ID NO: 664932 - DNA, 25 bp, Mus musculus
gatcgacttgctcaaaataaggccc

SEQ ID NO: 664933 - DNA, 25 bp, Mus musculus
gatcgacttgctgaaaataaggccc

SEQ ID NO: 664934 - DNA, 25 bp, Mus musculus
gatcgagaatctcgagctgatgtca

SEQ ID NO: 664935 - DNA, 25 bp, Mus musculus
gatcgagaatctggagctgatgtca

SEQ ID NO: 664936 - DNA, 25 bp, Mus musculus
gatcgagactcaaccaaggactcca

SEQ ID NO: 664937 - DNA, 25 bp, Mus musculus
gatcgagactcatccaaggactcca

SEQ ID NO: 664938 - DNA, 25 bp, Mus musculus
gatcgagactgacaagactctctac

SEQ ID NO: 664939 - DNA, 25 bp, Mus musculus
gatcgagactgagaagactctctac

SEQ ID NO: 664940 - DNA, 25 bp, Mus musculus
gatcgagagcatagagacttcttgc

SEQ ID NO: 664941 - DNA, 25 bp, Mus musculus
gatcgagagcattgagacttcttgc

SEQ ID NO: 664942 - DNA, 25 bp, Mus musculus
gatcgagaggctcagactgtcagaa

SEQ ID NO: 664943 - DNA, 25 bp, Mus musculus
gatcgagaggctgagactgtcagaa

SEQ ID NO: 664944 - DNA, 25 bp, Mus musculus
gatcgagatcaacactatctctgcc

SEQ ID NO: 664945 - DNA, 25 bp, Mus musculus
gatcgagatcaagactatctctgcc

SEQ ID NO: 664946 - DNA, 25 bp, Mus musculus
gatcgagatcctctgcggtttccag

SEQ ID NO: 664947 - DNA, 25 bp, Mus musculus
gatcgagatcctgtgcggtttccag

SEQ ID NO: 664948 - DNA, 25 bp, Mus musculus
gatcgagccctccaaatgtaatagt

SEQ ID NO: 664949 - DNA, 25 bp, Mus musculus
gatcgagccctcgaaatgtaatagt

SEQ ID NO: 664950 - DNA, 25 bp, Mus musculus
gatcgagcgcttccgagaaggcaaa

SEQ ID NO: 664951 - DNA, 25 bp, Mus musculus
gatcgagcgcttgcgagaaggcaaa

SEQ ID NO: 664952 - DNA, 25 bp, Mus musculus
gatcgaggagacaggccacttcaat

SEQ ID NO: 664953 - DNA, 25 bp, Mus musculus
gatcgaggagactggccacttcaat

SEQ ID NO: 664954 - DNA, 25 bp, Mus musculus
gatcgaggagttataccagaagctg

SEQ ID NO: 664955 - DNA, 25 bp, Mus musculus
gatcgaggagttttaccagaagctg

SEQ ID NO: 664956 - DNA, 25 bp, Mus musculus
gatcgagttccgagggctaattatt

SEQ ID NO: 664957 - DNA, 25 bp, Mus musculus
gatcgagttccgtgggctaattatt

SEQ ID NO: 664958 - DNA, 25 bp, Mus musculus
gatcgagttctacagaaatcccagg

SEQ ID NO: 664959 - DNA, 25 bp, Mus musculus
gatcgagttctagagaaatcccagg

SEQ ID NO: 664960 - DNA, 25 bp, Mus musculus
gatcgagtttatcgtgaatccaagt

SEQ ID NO: 664961 - DNA, 25 bp, Mus musculus
gatcgagtttatggtgaatccaagt

SEQ ID NO: 664962 - DNA, 25 bp, Mus musculus
gatcgagtttctagcatgctacgcc

SEQ ID NO: 664963 - DNA, 25 bp, Mus musculus
gatcgagtttcttgcatgctacgcc

SEQ ID NO: 664964 - DNA, 25 bp, Mus musculus
gatcgataacagagtggcatccgcc

SEQ ID NO: 664965 - DNA, 25 bp, Mus musculus
gatcgataacagtgtggcatccgcc

SEQ ID NO: 664966 - DNA, 25 bp, Mus musculus
gatcgatacgtacttcaccggtcct

SEQ ID NO: 664967 - DNA, 25 bp, Mus musculus
gatcgatacgtagttcaccggtcct

SEQ ID NO: 664968 - DNA, 25 bp, Mus musculus
gatcgatatccacaaagacacggca

SEQ ID NO: 664969 - DNA, 25 bp, Mus musculus
gatcgatatccagaaagacacggca

SEQ ID NO: 664970 - DNA, 25 bp, Mus musculus
gatcgatatgtacctcataccaagg

SEQ ID NO: 664971 - DNA, 25 bp, Mus musculus
gatcgatatgtagctcataccaagg

SEQ ID NO: 664972 - DNA, 25 bp, Mus musculus
gatcgatccccactccatgaggctg

SEQ ID NO: 664973 - DNA, 25 bp, Mus musculus
gatcgatccccagtccatgaggctg

SEQ ID NO: 664974 - DNA, 25 bp, Mus musculus
gatcgatcctctcaccaagaaaagg

SEQ ID NO: 664975 - DNA, 25 bp, Mus musculus
gatcgatcctctgaccaagaaaagg

SEQ ID NO: 664976 - DNA, 25 bp, Mus musculus
gatcgatcctggacactgactgcac

SEQ ID NO: 664977 - DNA, 25 bp, Mus musculus
gatcgatcctggtcactgactgcac

SEQ ID NO: 664978 - DNA, 25 bp, Mus musculus
gatcgatctggaaactgtgtcctct

SEQ ID NO: 664979 - DNA, 25 bp, Mus musculus
gatcgatctggatactgtgtcctct

SEQ ID NO: 664980 - DNA, 25 bp, Mus musculus
gatcgatgattcaaaagacaacatg

SEQ ID NO: 664981 - DNA, 25 bp, Mus musculus
gatcgatgattctaaagacaacatg

SEQ ID NO: 664982 - DNA, 25 bp, Mus musculus
gatcgatggcaacttggtcattcgg

SEQ ID NO: 664983 - DNA, 25 bp, Mus musculus
gatcgatggcaagttggtcattcgg

SEQ ID NO: 664984 - DNA, 25 bp, Mus musculus
gatcgatgggcaaatatctgcagat

SEQ ID NO: 664985 - DNA, 25 bp, Mus musculus
gatcgatgggcatatatctgcagat

SEQ ID NO: 664986 - DNA, 25 bp, Mus musculus
gatcgatgttaccacggagctggac

SEQ ID NO: 664987 - DNA, 25 bp, Mus musculus
gatcgatgttacgacggagctggac

SEQ ID NO: 664988 - DNA, 25 bp, Mus musculus
gatcgattaggcagcttcaatctca

SEQ ID NO: 664989 - DNA, 25 bp, Mus musculus
gatcgattaggctgcttcaatctca

SEQ ID NO: 664990 - DNA, 25 bp, Mus musculus
gatcgattcaatcattctgtagaag

SEQ ID NO: 664991 - DNA, 25 bp, Mus musculus
gatcgattcaatgattctgtagaag

SEQ ID NO: 664992 - DNA, 25 bp, Mus musculus
gatcgattggagatcgaggactcac

SEQ ID NO: 664993 - DNA, 25 bp, Mus musculus
gatcgattggagttcgaggactcac

SEQ ID NO: 664994 - DNA, 25 bp, Mus musculus
gatcgatttcaaactgctgatgcaa

SEQ ID NO: 664995 - DNA, 25 bp, Mus musculus
gatcgatttcaatctgctgatgcaa

SEQ ID NO: 664996 - DNA, 25 bp, Mus musculus
gatcgcaaggacagccagcttccat

SEQ ID NO: 664997 - DNA, 25 bp, Mus musculus
gatcgcaaggactgccagcttccat

SEQ ID NO: 664998 - DNA, 25 bp, Mus musculus
gatcgcacaaggagtctccggttcc

SEQ ID NO: 664999 - DNA, 25 bp, Mus musculus
gatcgcacaaggtgtctccggttcc

SEQ ID NO: 665000 - DNA, 25 bp, Mus musculus
gatcgcagaaacctggtgaccttaa

SEQ ID NO: 665001 - DNA, 25 bp, Mus musculus
gatcgcagaaacgtggtgaccttaa

SEQ ID NO: 665002 - DNA, 25 bp, Mus musculus
gatcgcagcccgagcagatgtagga

SEQ ID NO: 665003 - DNA, 25 bp, Mus musculus
gatcgcagcccgtgcagatgtagga

SEQ ID NO: 665004 - DNA, 25 bp, Mus musculus
gatcgcagcctgaaagacctggaca

SEQ ID NO: 665005 - DNA, 25 bp, Mus musculus
gatcgcagcctgtaagacctggaca

SEQ ID NO: 665006 - DNA, 25 bp, Mus musculus
gatcgcagctgtccaggcacgcatg

SEQ ID NO: 665007 - DNA, 25 bp, Mus musculus
gatcgcagctgtgcaggcacgcatg

SEQ ID NO: 665008 - DNA, 25 bp, Mus musculus
gatcgcagggttatttcagtggacc

SEQ ID NO: 665009 - DNA, 25 bp, Mus musculus
gatcgcagggttttttcagtggacc

SEQ ID NO: 665010 - DNA, 25 bp, Mus musculus
gatcgcatcggaaccatcggagttg

SEQ ID NO: 665011 - DNA, 25 bp, Mus musculus
gatcgcatcggatccatcggagttg

SEQ ID NO: 665012 - DNA, 25 bp, Mus musculus
gatcgcattgtaacaatgactcttg

SEQ ID NO: 665013 - DNA, 25 bp, Mus musculus
gatcgcattgtatcaatgactcttg

SEQ ID NO: 665014 - DNA, 25 bp, Mus musculus
gatcgccaaagtcgaactctccctg

SEQ ID NO: 665015 - DNA, 25 bp, Mus musculus
gatcgccaaagtggaactctccctg

SEQ ID NO: 665016 - DNA, 25 bp, Mus musculus
gatcgccaactgcagcgtgtatgac

SEQ ID NO: 665017 - DNA, 25 bp, Mus musculus
gatcgccaactggagcgtgtatgac

SEQ ID NO: 665018 - DNA, 25 bp, Mus musculus
gatcgccaagttctcacctagaaag

SEQ ID NO: 665019 - DNA, 25 bp, Mus musculus
gatcgccaagttgtcacctagaaag

SEQ ID NO: 665020 - DNA, 25 bp, Mus musculus
gatcgccacaaccagagctgcgagt

SEQ ID NO: 665021 - DNA, 25 bp, Mus musculus
gatcgccacaacgagagctgcgagt

SEQ ID NO: 665022 - DNA, 25 bp, Mus musculus
gatcgcccagtacaagtgcctggtc

SEQ ID NO: 665023 - DNA, 25 bp, Mus musculus
gatcgcccagtagaagtgcctggtc

SEQ ID NO: 665024 - DNA, 25 bp, Mus musculus
gatcgcccttggcaaataagagatg

SEQ ID NO: 665025 - DNA, 25 bp, Mus musculus
gatcgcccttgggaaataagagatg

SEQ ID NO: 665026 - DNA, 25 bp, Mus musculus
gatcgccgacctcttcgtggcagac

SEQ ID NO: 665027 - DNA, 25 bp, Mus musculus
gatcgccgacctgttcgtggcagac

SEQ ID NO: 665028 - DNA, 25 bp, Mus musculus
gatcgccggcttcatagtgttggaa

SEQ ID NO: 665029 - DNA, 25 bp, Mus musculus
gatcgccggcttgatagtgttggaa

SEQ ID NO: 665030 - DNA, 25 bp, Mus musculus
gatcgcctacagagacgaagtacgg

SEQ ID NO: 665031 - DNA, 25 bp, Mus musculus
gatcgcctacagtgacgaagtacgg

SEQ ID NO: 665032 - DNA, 25 bp, Mus musculus
gatcgcctcggacattgcccagctt

SEQ ID NO: 665033 - DNA, 25 bp, Mus musculus
gatcgcctcggagattgcccagctt

SEQ ID NO: 665034 - DNA, 25 bp, Mus musculus
gatcgcctggagagagataacaaaa

SEQ ID NO: 665035 - DNA, 25 bp, Mus musculus
gatcgcctggagtgagataacaaaa

SEQ ID NO: 665036 - DNA, 25 bp, Mus musculus
gatcgcctggttactggcgctggct

SEQ ID NO: 665037 - DNA, 25 bp, Mus musculus
gatcgcctggtttctggcgctggct

SEQ ID NO: 665038 - DNA, 25 bp, Mus musculus
gatcgcgaattaactcgcccagtgt

SEQ ID NO: 665039 - DNA, 25 bp, Mus musculus
gatcgcgaattatctcgcccagtgt

SEQ ID NO: 665040 - DNA, 25 bp, Mus musculus
gatcgcgaccaactctgaattcctg

SEQ ID NO: 665041 - DNA, 25 bp, Mus musculus
gatcgcgaccaagtctgaattcctg

SEQ ID NO: 665042 - DNA, 25 bp, Mus musculus
gatcgcgatgagcaacctctgtccg

SEQ ID NO: 665043 - DNA, 25 bp, Mus musculus
gatcgcgatgaggaacctctgtccg

SEQ ID NO: 665044 - DNA, 25 bp, Mus musculus
gatcgcgccggtattctgggaaact

SEQ ID NO: 665045 - DNA, 25 bp, Mus musculus
gatcgcgccggttttctgggaaact

SEQ ID NO: 665046 - DNA, 25 bp, Mus musculus
gatcgcgctgatctttgctgctaag

SEQ ID NO: 665047 - DNA, 25 bp, Mus musculus
gatcgcgctgatgtttgctgctaag

SEQ ID NO: 665048 - DNA, 25 bp, Mus musculus
gatcgcgtatctcaaggatctgcag

SEQ ID NO: 665049 - DNA, 25 bp, Mus musculus
gatcgcgtatctgaaggatctgcag

SEQ ID NO: 665050 - DNA, 25 bp, Mus musculus
gatcgcgtctacaggatagatggag

SEQ ID NO: 665051 - DNA, 25 bp, Mus musculus
gatcgcgtctactggatagatggag

SEQ ID NO: 665052 - DNA, 25 bp, Mus musculus
gatcgcgtggacattgccaagagtg

SEQ ID NO: 665053 - DNA, 25 bp, Mus musculus
gatcgcgtggactttgccaagagtg

SEQ ID NO: 665054 - DNA, 25 bp, Mus musculus
gatcgcgtttaaccaatttcctgag

SEQ ID NO: 665055 - DNA, 25 bp, Mus musculus
gatcgcgtttaagcaatttcctgag

SEQ ID NO: 665056 - DNA, 25 bp, Mus musculus
gatcgctcaaatacagcaaagcaca

SEQ ID NO: 665057 - DNA, 25 bp, Mus musculus
gatcgctcaaattcagcaaagcaca

SEQ ID NO: 665058 - DNA, 25 bp, Mus musculus
gatcgctgaacaaggagctcaggcc

SEQ ID NO: 665059 - DNA, 25 bp, Mus musculus
gatcgctgaacatggagctcaggcc

SEQ ID NO: 665060 - DNA, 25 bp, Mus musculus
gatcgctgagagcaatcacatcaag

SEQ ID NO: 665061 - DNA, 25 bp, Mus musculus
gatcgctgagaggaatcacatcaag

SEQ ID NO: 665062 - DNA, 25 bp, Mus musculus
gatcgctggaatctgtgtcgcacga

SEQ ID NO: 665063 - DNA, 25 bp, Mus musculus
gatcgctggaatgtgtgtcgcacga

SEQ ID NO: 665064 - DNA, 25 bp, Mus musculus
gatcgctggcgaatgccttagccaa

SEQ ID NO: 665065 - DNA, 25 bp, Mus musculus
gatcgctggcgattgccttagccaa

SEQ ID NO: 665066 - DNA, 25 bp, Mus musculus
gatcgctgtctgctatcttttaaaa

SEQ ID NO: 665067 - DNA, 25 bp, Mus musculus
gatcgctgtctggtatcttttaaaa

SEQ ID NO: 665068 - DNA, 25 bp, Mus musculus
gatcgcttacacatgagaagaacta

SEQ ID NO: 665069 - DNA, 25 bp, Mus musculus
gatcgcttacacttgagaagaacta

SEQ ID NO: 665070 - DNA, 25 bp, Mus musculus
gatcgctttgaactacaagggctgc

SEQ ID NO: 665071 - DNA, 25 bp, Mus musculus
gatcgctttgaagtacaagggctgc

SEQ ID NO: 665072 - DNA, 25 bp, Mus musculus
gatcgctttgatcaccacaagggcc

SEQ ID NO: 665073 - DNA, 25 bp, Mus musculus
gatcgctttgatgaccacaagggcc

SEQ ID NO: 665074 - DNA, 25 bp, Mus musculus
gatcggaaacgcaagcaggaggaac

SEQ ID NO: 665075 - DNA, 25 bp, Mus musculus
gatcggaaacgctagcaggaggaac

SEQ ID NO: 665076 - DNA, 25 bp, Mus musculus
gatcggaaagcccagtgccgctgtc

SEQ ID NO: 665077 - DNA, 25 bp, Mus musculus
gatcggaaagccgagtgccgctgtc

SEQ ID NO: 665078 - DNA, 25 bp, Mus musculus
gatcggaacgtcaattaacgtcaat

SEQ ID NO: 665079 - DNA, 25 bp, Mus musculus
gatcggaacgtctattaacgtcaat

SEQ ID NO: 665080 - DNA, 25 bp, Mus musculus
gatcggaagtgtctagctcatgtca

SEQ ID NO: 665081 - DNA, 25 bp, Mus musculus
gatcggaagtgtgtagctcatgtca

SEQ ID NO: 665082 - DNA, 25 bp, Mus musculus
gatcggaagtttcgagtcacctttg

SEQ ID NO: 665083 - DNA, 25 bp, Mus musculus
gatcggaagtttggagtcacctttg

SEQ ID NO: 665084 - DNA, 25 bp, Mus musculus
gatcggaatggaaatcagttgagat

SEQ ID NO: 665085 - DNA, 25 bp, Mus musculus
gatcggaatggatatcagttgagat

SEQ ID NO: 665086 - DNA, 25 bp, Mus musculus
gatcggacgccacggcagcaagatc

SEQ ID NO: 665087 - DNA, 25 bp, Mus musculus
gatcggacgccagggcagcaagatc

SEQ ID NO: 665088 - DNA, 25 bp, Mus musculus
gatcggagatctcacggcgacgcct

SEQ ID NO: 665089 - DNA, 25 bp, Mus musculus
gatcggagatctgacggcgacgcct

SEQ ID NO: 665090 - DNA, 25 bp, Mus musculus
gatcggagcccaactggcaacgtgc

SEQ ID NO: 665091 - DNA, 25 bp, Mus musculus
gatcggagcccatctggcaacgtgc

SEQ ID NO: 665092 - DNA, 25 bp, Mus musculus
gatcggatgacacactgcggtgtac

SEQ ID NO: 665093 - DNA, 25 bp, Mus musculus
gatcggatgacagactgcggtgtac

SEQ ID NO: 665094 - DNA, 25 bp, Mus musculus
gatcggattggacccggtgactacc

SEQ ID NO: 665095 - DNA, 25 bp, Mus musculus
gatcggattggagccggtgactacc

SEQ ID NO: 665096 - DNA, 25 bp, Mus musculus
gatcggcaaagcagtggagcacatg

SEQ ID NO: 665097 - DNA, 25 bp, Mus musculus
gatcggcaaagctgtggagcacatg

SEQ ID NO: 665098 - DNA, 25 bp, Mus musculus
gatcggcaagaacaagacaacttgc

SEQ ID NO: 665099 - DNA, 25 bp, Mus musculus
gatcggcaagaagaagacaacttgc

SEQ ID NO: 665100 - DNA, 25 bp, Mus musculus
gatcggcacctgagtctctggtaca

SEQ ID NO: 665101 - DNA, 25 bp, Mus musculus
gatcggcacctgtgtctctggtaca

SEQ ID NO: 665102 - DNA, 25 bp, Mus musculus
gatcggcatggcaatatctgggacc

SEQ ID NO: 665103 - DNA, 25 bp, Mus musculus
gatcggcatggctatatctgggacc

SEQ ID NO: 665104 - DNA, 25 bp, Mus musculus
gatcggccatctcaaactaaggcag

SEQ ID NO: 665105 - DNA, 25 bp, Mus musculus
gatcggccatctgaaactaaggcag

SEQ ID NO: 665106 - DNA, 25 bp, Mus musculus
gatcggccttgcagtttgcaataat

SEQ ID NO: 665107 - DNA, 25 bp, Mus musculus
gatcggccttgctgtttgcaataat

SEQ ID NO: 665108 - DNA, 25 bp, Mus musculus
gatcggcgacggaaacgccaggtgg

SEQ ID NO: 665109 - DNA, 25 bp, Mus musculus
gatcggcgacggtaacgccaggtgg

SEQ ID NO: 665110 - DNA, 25 bp, Mus musculus
gatcggctcattcaggtaccctggg

SEQ ID NO: 665111 - DNA, 25 bp, Mus musculus
gatcggctcattgaggtaccctggg

SEQ ID NO: 665112 - DNA, 25 bp, Mus musculus
gatcggctgctgagctacaatccgg

SEQ ID NO: 665113 - DNA, 25 bp, Mus musculus
gatcggctgctgtgctacaatccgg

SEQ ID NO: 665114 - DNA, 25 bp, Mus musculus
gatcggctgggaaaggtattgggtc

SEQ ID NO: 665115 - DNA, 25 bp, Mus musculus
gatcggctgggataggtattgggtc

SEQ ID NO: 665116 - DNA, 25 bp, Mus musculus
gatcggctttgccatcgcccggcgc

SEQ ID NO: 665117 - DNA, 25 bp, Mus musculus
gatcggctttgcgatcgcccggcgc

SEQ ID NO: 665118 - DNA, 25 bp, Mus musculus
gatcgggactggaactcggataacg

SEQ ID NO: 665119 - DNA, 25 bp, Mus musculus
gatcgggactggtactcggataacg

SEQ ID NO: 665120 - DNA, 25 bp, Mus musculus
gatcgggatgtacgattacaccgcc

SEQ ID NO: 665121 - DNA, 25 bp, Mus musculus
gatcgggatgtaggattacaccgcc

SEQ ID NO: 665122 - DNA, 25 bp, Mus musculus
gatcgggcgcatctccattgagatg

SEQ ID NO: 665123 - DNA, 25 bp, Mus musculus
gatcgggcgcatgtccattgagatg

SEQ ID NO: 665124 - DNA, 25 bp, Mus musculus
gatcgggtcaggatcctttggcact

SEQ ID NO: 665125 - DNA, 25 bp, Mus musculus
gatcgggtcaggttcctttggcact

SEQ ID NO: 665126 - DNA, 25 bp, Mus musculus
gatcgggtgtctcaagtacctgcaa

SEQ ID NO: 665127 - DNA, 25 bp, Mus musculus
gatcgggtgtctgaagtacctgcaa

SEQ ID NO: 665128 - DNA, 25 bp, Mus musculus
gatcgggttggaaagctaactcagc

SEQ ID NO: 665129 - DNA, 25 bp, Mus musculus
gatcgggttggatagctaactcagc

SEQ ID NO: 665130 - DNA, 25 bp, Mus musculus
gatcggtttgccatcgatgatcacg

SEQ ID NO: 665131 - DNA, 25 bp, Mus musculus
gatcggtttgccttcgatgatcacg

SEQ ID NO: 665132 - DNA, 25 bp, Mus musculus
gatcgtaagagtcgccgcacagccc

SEQ ID NO: 665133 - DNA, 25 bp, Mus musculus
gatcgtaagagtggccgcacagccc

SEQ ID NO: 665134 - DNA, 25 bp, Mus musculus
gatcgtaagcctctatgagaaggac

SEQ ID NO: 665135 - DNA, 25 bp, Mus musculus
gatcgtaagcctgtatgagaaggac

SEQ ID NO: 665136 - DNA, 25 bp, Mus musculus
gatcgtaataaaaaagaaacagctt

SEQ ID NO: 665137 - DNA, 25 bp, Mus musculus
gatcgtaataaataagaaacagctt

SEQ ID NO: 665138 - DNA, 25 bp, Mus musculus
gatcgtacacagagagggctggcta

SEQ ID NO: 665139 - DNA, 25 bp, Mus musculus
gatcgtacacagtgagggctggcta

SEQ ID NO: 665140 - DNA, 25 bp, Mus musculus
gatcgtagagctagctcacagcggg

SEQ ID NO: 665141 - DNA, 25 bp, Mus musculus
gatcgtagagcttgctcacagcggg

SEQ ID NO: 665142 - DNA, 25 bp, Mus musculus
gatcgtaggtggactgattcagaag

SEQ ID NO: 665143 - DNA, 25 bp, Mus musculus
gatcgtaggtggtctgattcagaag

SEQ ID NO: 665144 - DNA, 25 bp, Mus musculus
gatcgtcaggtaacaaagcagtcac

SEQ ID NO: 665145 - DNA, 25 bp, Mus musculus
gatcgtcaggtatcaaagcagtcac

SEQ ID NO: 665146 - DNA, 25 bp, Mus musculus
gatcgtcattgtcctttttgttaaa

SEQ ID NO: 665147 - DNA, 25 bp, Mus musculus
gatcgtcattgtgctttttgttaaa

SEQ ID NO: 665148 - DNA, 25 bp, Mus musculus
gatcgtcgacccagaatactccttt

SEQ ID NO: 665149 - DNA, 25 bp, Mus musculus
gatcgtcgaccctgaatactccttt

SEQ ID NO: 665150 - DNA, 25 bp, Mus musculus
gatcgtcttaaaaggcctgtgtgcc

SEQ ID NO: 665151 - DNA, 25 bp, Mus musculus
gatcgtcttaaatggcctgtgtgcc

SEQ ID NO: 665152 - DNA, 25 bp, Mus musculus
gatcgtgaattgcagaagaagaaag

SEQ ID NO: 665153 - DNA, 25 bp, Mus musculus
gatcgtgaattggagaagaagaaag

SEQ ID NO: 665154 - DNA, 25 bp, Mus musculus
gatcgtgccctgctaacgacaagga

SEQ ID NO: 665155 - DNA, 25 bp, Mus musculus
gatcgtgccctggtaacgacaagga

SEQ ID NO: 665156 - DNA, 25 bp, Mus musculus
gatcgtgctcagcagcgtctggcca

SEQ ID NO: 665157 - DNA, 25 bp, Mus musculus
gatcgtgctcaggagcgtctggcca

SEQ ID NO: 665158 - DNA, 25 bp, Mus musculus
gatcgtggactaattgaagctggag

SEQ ID NO: 665159 - DNA, 25 bp, Mus musculus
gatcgtggactatttgaagctggag

SEQ ID NO: 665160 - DNA, 25 bp, Mus musculus
gatcgtggctcaccaagttccacaa

SEQ ID NO: 665161 - DNA, 25 bp, Mus musculus
gatcgtggctcagcaagttccacaa

SEQ ID NO: 665162 - DNA, 25 bp, Mus musculus
gatcgtggctcccatcagtgactcc

SEQ ID NO: 665163 - DNA, 25 bp, Mus musculus
gatcgtggctccgatcagtgactcc

SEQ ID NO: 665164 - DNA, 25 bp, Mus musculus
gatcgtggtcacctggacagtcctg

SEQ ID NO: 665165 - DNA, 25 bp, Mus musculus
gatcgtggtcacgtggacagtcctg

SEQ ID NO: 665166 - DNA, 25 bp, Mus musculus
gatcgtgtcatgaagtgaggataaa

SEQ ID NO: 665167 - DNA, 25 bp, Mus musculus
gatcgtgtcatgtagtgaggataaa

SEQ ID NO: 665168 - DNA, 25 bp, Mus musculus
gatcgtgtccacaaaggcgattttg

SEQ ID NO: 665169 - DNA, 25 bp, Mus musculus
gatcgtgtccactaaggcgattttg

SEQ ID NO: 665170 - DNA, 25 bp, Mus musculus
gatcgtgtgcatcgaaggccttctc

SEQ ID NO: 665171 - DNA, 25 bp, Mus musculus
gatcgtgtgcatggaaggccttctc

SEQ ID NO: 665172 - DNA, 25 bp, Mus musculus
gatcgtgtggccctggattactacg

SEQ ID NO: 665173 - DNA, 25 bp, Mus musculus
gatcgtgtggccgtggattactacg

SEQ ID NO: 665174 - DNA, 25 bp, Mus musculus
gatcgtgttcagcacgcgtacacct

SEQ ID NO: 665175 - DNA, 25 bp, Mus musculus
gatcgtgttcaggacgcgtacacct

SEQ ID NO: 665176 - DNA, 25 bp, Mus musculus
gatcgtgtttgtcacgggaaacgcc

SEQ ID NO: 665177 - DNA, 25 bp, Mus musculus
gatcgtgtttgtgacgggaaacgcc

SEQ ID NO: 665178 - DNA, 25 bp, Mus musculus
gatcgttaccttacaggcccaggtg

SEQ ID NO: 665179 - DNA, 25 bp, Mus musculus
gatcgttacctttcaggcccaggtg

SEQ ID NO: 665180 - DNA, 25 bp, Mus musculus
gatcgttacgaccagaggagattga

SEQ ID NO: 665181 - DNA, 25 bp, Mus musculus
gatcgttacgacgagaggagattga

SEQ ID NO: 665182 - DNA, 25 bp, Mus musculus
gatcgttattaactatgccatgttc

SEQ ID NO: 665183 - DNA, 25 bp, Mus musculus
gatcgttattaagtatgccatgttc

SEQ ID NO: 665184 - DNA, 25 bp, Mus musculus
gatcgttgtggacaagccgccttcg

SEQ ID NO: 665185 - DNA, 25 bp, Mus musculus
gatcgttgtggagaagccgccttcg

SEQ ID NO: 665186 - DNA, 25 bp, Mus musculus
gatcgtttcaacaacgtggtcatgc

SEQ ID NO: 665187 - DNA, 25 bp, Mus musculus
gatcgtttcaactacgtggtcatgc

SEQ ID NO: 665188 - DNA, 25 bp, Mus musculus
gatcgtttttcaagacagtgacata

SEQ ID NO: 665189 - DNA, 25 bp, Mus musculus
gatcgtttttcatgacagtgacata

SEQ ID NO: 665190 - DNA, 25 bp, Mus musculus
gatctaaaccctactgcactccgtt

SEQ ID NO: 665191 - DNA, 25 bp, Mus musculus
gatctaaacccttctgcactccgtt

SEQ ID NO: 665192 - DNA, 25 bp, Mus musculus
gatctaaagagtaatgagcctcggc

SEQ ID NO: 665193 - DNA, 25 bp, Mus musculus
gatctaaagagttatgagcctcggc

SEQ ID NO: 665194 - DNA, 25 bp, Mus musculus
gatctaaagcaaagcgttcccgcca

SEQ ID NO: 665195 - DNA, 25 bp, Mus musculus
gatctaaagcaatgcgttcccgcca

SEQ ID NO: 665196 - DNA, 25 bp, Mus musculus
gatctaaccaacagcagtgccccat

SEQ ID NO: 665197 - DNA, 25 bp, Mus musculus
gatctaaccaactgcagtgccccat

SEQ ID NO: 665198 - DNA, 25 bp, Mus musculus
gatctaactgcactcagcaacaatg

SEQ ID NO: 665199 - DNA, 25 bp, Mus musculus
gatctaactgcagtcagcaacaatg

SEQ ID NO: 665200 - DNA, 25 bp, Mus musculus
gatctaagaaccaccaccagggctg

SEQ ID NO: 665201 - DNA, 25 bp, Mus musculus
gatctaagaacctccaccagggctg

SEQ ID NO: 665202 - DNA, 25 bp, Mus musculus
gatctaagccgccagccaaaatgtg

SEQ ID NO: 665203 - DNA, 25 bp, Mus musculus
gatctaagccgcgagccaaaatgtg

SEQ ID NO: 665204 - DNA, 25 bp, Mus musculus
gatctaaggtggaaaaacagctgca

SEQ ID NO: 665205 - DNA, 25 bp, Mus musculus
gatctaaggtggtaaaacagctgca

SEQ ID NO: 665206 - DNA, 25 bp, Mus musculus
gatctaattcaaatactgtgtgaaa

SEQ ID NO: 665207 - DNA, 25 bp, Mus musculus
gatctaattcaattactgtgtgaaa

SEQ ID NO: 665208 - DNA, 25 bp, Mus musculus
gatctaattggtcctgagtggcgtc

SEQ ID NO: 665209 - DNA, 25 bp, Mus musculus
gatctaattggtgctgagtggcgtc

SEQ ID NO: 665210 - DNA, 25 bp, Mus musculus
gatctacaagtccaatctcggcgtg

SEQ ID NO: 665211 - DNA, 25 bp, Mus musculus
gatctacaagtcgaatctcggcgtg

SEQ ID NO: 665212 - DNA, 25 bp, Mus musculus
gatctacacattctggattccctgg

SEQ ID NO: 665213 - DNA, 25 bp, Mus musculus
gatctacacattgtggattccctgg

SEQ ID NO: 665214 - DNA, 25 bp, Mus musculus
gatctacaccgtcggatattccatg

SEQ ID NO: 665215 - DNA, 25 bp, Mus musculus
gatctacaccgtgggatattccatg

SEQ ID NO: 665216 - DNA, 25 bp, Mus musculus
gatctacactttacatgcacatggg

SEQ ID NO: 665217 - DNA, 25 bp, Mus musculus
gatctacacttttcatgcacatggg

SEQ ID NO: 665218 - DNA, 25 bp, Mus musculus
gatctacaggtaatggtaaaaccag

SEQ ID NO: 665219 - DNA, 25 bp, Mus musculus
gatctacaggtattggtaaaaccag

SEQ ID NO: 665220 - DNA, 25 bp, Mus musculus
gatctacagtgcatcgagcggaagc

SEQ ID NO: 665221 - DNA, 25 bp, Mus musculus
gatctacagtgcttcgagcggaagc

SEQ ID NO: 665222 - DNA, 25 bp, Mus musculus
gatctacagtggagtgacaacttgc

SEQ ID NO: 665223 - DNA, 25 bp, Mus musculus
gatctacagtggtgtgacaacttgc

SEQ ID NO: 665224 - DNA, 25 bp, Mus musculus
gatctacatcctcttcaatccctgg

SEQ ID NO: 665225 - DNA, 25 bp, Mus musculus
gatctacatcctgttcaatccctgg

SEQ ID NO: 665226 - DNA, 25 bp, Mus musculus
gatctaccaaggagctatggcgcaa

SEQ ID NO: 665227 - DNA, 25 bp, Mus musculus
gatctaccaaggtgctatggcgcaa

SEQ ID NO: 665228 - DNA, 25 bp, Mus musculus
gatctaccactcacgtcaggaaggc

SEQ ID NO: 665229 - DNA, 25 bp, Mus musculus
gatctaccactctcgtcaggaaggc

SEQ ID NO: 665230 - DNA, 25 bp, Mus musculus
gatctacctattctcgctcctggct

SEQ ID NO: 665231 - DNA, 25 bp, Mus musculus
gatctacctattgtcgctcctggct

SEQ ID NO: 665232 - DNA, 25 bp, Mus musculus
gatctacctgcaccgggagatgtca

SEQ ID NO: 665233 - DNA, 25 bp, Mus musculus
gatctacctgcagcgggagatgtca

SEQ ID NO: 665234 - DNA, 25 bp, Mus musculus
gatctacctgcccatgggctgtgac

SEQ ID NO: 665235 - DNA, 25 bp, Mus musculus
gatctacctgccgatgggctgtgac

SEQ ID NO: 665236 - DNA, 25 bp, Mus musculus
gatctacgacccacaggatgtgatg

SEQ ID NO: 665237 - DNA, 25 bp, Mus musculus
gatctacgaccctcaggatgtgatg

SEQ ID NO: 665238 - DNA, 25 bp, Mus musculus
gatctacgaggtctgctccaacggc

SEQ ID NO: 665239 - DNA, 25 bp, Mus musculus
gatctacgaggtgtgctccaacggc

SEQ ID NO: 665240 - DNA, 25 bp, Mus musculus
gatctacgatcccaagtattgccca

SEQ ID NO: 665241 - DNA, 25 bp, Mus musculus
gatctacgatccgaagtattgccca

SEQ ID NO: 665242 - DNA, 25 bp, Mus musculus
gatctacgtagccttctttgagatt

SEQ ID NO: 665243 - DNA, 25 bp, Mus musculus
gatctacgtagcgttctttgagatt

SEQ ID NO: 665244 - DNA, 25 bp, Mus musculus
gatctactaccacacagacatgcag

SEQ ID NO: 665245 - DNA, 25 bp, Mus musculus
gatctactaccagacagacatgcag

SEQ ID NO: 665246 - DNA, 25 bp, Mus musculus
gatctactagtcaccaaaggttcca

SEQ ID NO: 665247 - DNA, 25 bp, Mus musculus
gatctactagtctccaaaggttcca

SEQ ID NO: 665248 - DNA, 25 bp, Mus musculus
gatctactcccaaaatccttctggg

SEQ ID NO: 665249 - DNA, 25 bp, Mus musculus
gatctactcccataatccttctggg

SEQ ID NO: 665250 - DNA, 25 bp, Mus musculus
gatctactggaaacaggttgcccgc

SEQ ID NO: 665251 - DNA, 25 bp, Mus musculus
gatctactggaatcaggttgcccgc

SEQ ID NO: 665252 - DNA, 25 bp, Mus musculus
gatctagaacgtccccattttcttg

SEQ ID NO: 665253 - DNA, 25 bp, Mus musculus
gatctagaacgtgcccattttcttg

SEQ ID NO: 665254 - DNA, 25 bp, Mus musculus
gatctagaagcaagactttctggat

SEQ ID NO: 665255 - DNA, 25 bp, Mus musculus
gatctagaagcatgactttctggat

SEQ ID NO: 665256 - DNA, 25 bp, Mus musculus
gatctagaagtgcttttggccttgg

SEQ ID NO: 665257 - DNA, 25 bp, Mus musculus
gatctagaagtggttttggccttgg

SEQ ID NO: 665258 - DNA, 25 bp, Mus musculus
gatctagaatgtcagcacctcctcg

SEQ ID NO: 665259 - DNA, 25 bp, Mus musculus
gatctagaatgtgagcacctcctcg

SEQ ID NO: 665260 - DNA, 25 bp, Mus musculus
gatctagagcggaggcgctagcaca

SEQ ID NO: 665261 - DNA, 25 bp, Mus musculus
gatctagagcggtggcgctagcaca

SEQ ID NO: 665262 - DNA, 25 bp, Mus musculus
gatctagccatcagcgatctggacg

SEQ ID NO: 665263 - DNA, 25 bp, Mus musculus
gatctagccatctgcgatctggacg

SEQ ID NO: 665264 - DNA, 25 bp, Mus musculus
gatctagccttcctcgtccgctata

SEQ ID NO: 665265 - DNA, 25 bp, Mus musculus
gatctagccttcgtcgtccgctata

SEQ ID NO: 665266 - DNA, 25 bp, Mus musculus
gatctagcgaagaaaacgagccaga

SEQ ID NO: 665267 - DNA, 25 bp, Mus musculus
gatctagcgaagtaaacgagccaga

SEQ ID NO: 665268 - DNA, 25 bp, Mus musculus
gatctagctccccagtctgagtctc

SEQ ID NO: 665269 - DNA, 25 bp, Mus musculus
gatctagctcccgagtctgagtctc

SEQ ID NO: 665270 - DNA, 25 bp, Mus musculus
gatctaggaatgcttgactatagcg

SEQ ID NO: 665271 - DNA, 25 bp, Mus musculus
gatctaggaatggttgactatagcg

SEQ ID NO: 665272 - DNA, 25 bp, Mus musculus
gatctaggacttcctcgtggtataa

SEQ ID NO: 665273 - DNA, 25 bp, Mus musculus
gatctaggacttgctcgtggtataa

SEQ ID NO: 665274 - DNA, 25 bp, Mus musculus
gatctatagtgaccctgacccttcc

SEQ ID NO: 665275 - DNA, 25 bp, Mus musculus
gatctatagtgagcctgacccttcc

SEQ ID NO: 665276 - DNA, 25 bp, Mus musculus
gatctatcaagtctgtgacatcccc

SEQ ID NO: 665277 - DNA, 25 bp, Mus musculus
gatctatcaagtgtgtgacatcccc

SEQ ID NO: 665278 - DNA, 25 bp, Mus musculus
gatctatgaccgctatggccgggaa

SEQ ID NO: 665279 - DNA, 25 bp, Mus musculus
gatctatgaccggtatggccgggaa

SEQ ID NO: 665280 - DNA, 25 bp, Mus musculus
gatctatgacggaatagaggaggaa

SEQ ID NO: 665281 - DNA, 25 bp, Mus musculus
gatctatgacggtatagaggaggaa

SEQ ID NO: 665282 - DNA, 25 bp, Mus musculus
gatctatgccagagcggcgaacatg

SEQ ID NO: 665283 - DNA, 25 bp, Mus musculus
gatctatgccagtgcggcgaacatg

SEQ ID NO: 665284 - DNA, 25 bp, Mus musculus
gatctcaacaccaggctgaagaaga

SEQ ID NO: 665285 - DNA, 25 bp, Mus musculus
gatctcaacacctggctgaagaaga

SEQ ID NO: 665286 - DNA, 25 bp, Mus musculus
gatctcaagccacctgaagattttg

SEQ ID NO: 665287 - DNA, 25 bp, Mus musculus
gatctcaagccagctgaagattttg

SEQ ID NO: 665288 - DNA, 25 bp, Mus musculus
gatctcaaggaaagcagggtcagcg

SEQ ID NO: 665289 - DNA, 25 bp, Mus musculus
gatctcaaggaatgcagggtcagcg

SEQ ID NO: 665290 - DNA, 25 bp, Mus musculus
gatctcaaggagactgacatcaagc

SEQ ID NO: 665291 - DNA, 25 bp, Mus musculus
gatctcaaggagtctgacatcaagc

SEQ ID NO: 665292 - DNA, 25 bp, Mus musculus
gatctcaataagcaggccacaacct

SEQ ID NO: 665293 - DNA, 25 bp, Mus musculus
gatctcaataaggaggccacaacct

SEQ ID NO: 665294 - DNA, 25 bp, Mus musculus
gatctcaatgaacgcaagcacctct

SEQ ID NO: 665295 - DNA, 25 bp, Mus musculus
gatctcaatgaaggcaagcacctct

SEQ ID NO: 665296 - DNA, 25 bp, Mus musculus
gatctcacaggaatactatgacagg

SEQ ID NO: 665297 - DNA, 25 bp, Mus musculus
gatctcacaggattactatgacagg

SEQ ID NO: 665298 - DNA, 25 bp, Mus musculus
gatctcaccaacaatcctacaatga

SEQ ID NO: 665299 - DNA, 25 bp, Mus musculus
gatctcaccaactatcctacaatga

SEQ ID NO: 665300 - DNA, 25 bp, Mus musculus
gatctcaccagaagcttacgaacgg

SEQ ID NO: 665301 - DNA, 25 bp, Mus musculus
gatctcaccagatgcttacgaacgg

SEQ ID NO: 665302 - DNA, 25 bp, Mus musculus
gatctcactcttcagtattcctgtt

SEQ ID NO: 665303 - DNA, 25 bp, Mus musculus
gatctcactcttgagtattcctgtt

SEQ ID NO: 665304 - DNA, 25 bp, Mus musculus
gatctcactgctaaatgagcccaac

SEQ ID NO: 665305 - DNA, 25 bp, Mus musculus
gatctcactgcttaatgagcccaac

SEQ ID NO: 665306 - DNA, 25 bp, Mus musculus
gatctcagacgactctgtaaaacag

SEQ ID NO: 665307 - DNA, 25 bp, Mus musculus
gatctcagacgagtctgtaaaacag

SEQ ID NO: 665308 - DNA, 25 bp, Mus musculus
gatctcagcaccagcaaaatcagtg

SEQ ID NO: 665309 - DNA, 25 bp, Mus musculus
gatctcagcacctgcaaaatcagtg

SEQ ID NO: 665310 - DNA, 25 bp, Mus musculus
gatctcagcaggctctacaagaact

SEQ ID NO: 665311 - DNA, 25 bp, Mus musculus
gatctcagcagggtctacaagaact

SEQ ID NO: 665312 - DNA, 25 bp, Mus musculus
gatctcagggcaataactaatgttg

SEQ ID NO: 665313 - DNA, 25 bp, Mus musculus
gatctcagggcattaactaatgttg

SEQ ID NO: 665314 - DNA, 25 bp, Mus musculus
gatctcatccatagaatttgggtac

SEQ ID NO: 665315 - DNA, 25 bp, Mus musculus
gatctcatccattgaatttgggtac

SEQ ID NO: 665316 - DNA, 25 bp, Mus musculus
gatctcatgagcatcagcggtcaca

SEQ ID NO: 665317 - DNA, 25 bp, Mus musculus
gatctcatgagcttcagcggtcaca

SEQ ID NO: 665318 - DNA, 25 bp, Mus musculus
gatctcattggcatcggctgctacc

SEQ ID NO: 665319 - DNA, 25 bp, Mus musculus
gatctcattggcttcggctgctacc

SEQ ID NO: 665320 - DNA, 25 bp, Mus musculus
gatctccactgaagttggcatcaca

SEQ ID NO: 665321 - DNA, 25 bp, Mus musculus
gatctccactgatgttggcatcaca

SEQ ID NO: 665322 - DNA, 25 bp, Mus musculus
gatctccagaaacactttgcacagc

SEQ ID NO: 665323 - DNA, 25 bp, Mus musculus
gatctccagaaagactttgcacagc

SEQ ID NO: 665324 - DNA, 25 bp, Mus musculus
gatctccagatccatagttttagag

SEQ ID NO: 665325 - DNA, 25 bp, Mus musculus
gatctccagatcgatagttttagag

SEQ ID NO: 665326 - DNA, 25 bp, Mus musculus
gatctccagctcagatcttgcttag

SEQ ID NO: 665327 - DNA, 25 bp, Mus musculus
gatctccagctctgatcttgcttag

SEQ ID NO: 665328 - DNA, 25 bp, Mus musculus
gatctccaggtcctaaacccagggt

SEQ ID NO: 665329 - DNA, 25 bp, Mus musculus
gatctccaggtcgtaaacccagggt

SEQ ID NO: 665330 - DNA, 25 bp, Mus musculus
gatctccagttgaattttgtcataa

SEQ ID NO: 665331 - DNA, 25 bp, Mus musculus
gatctccagttgtattttgtcataa

SEQ ID NO: 665332 - DNA, 25 bp, Mus musculus
gatctccatgtcaacaagatctcca

SEQ ID NO: 665333 - DNA, 25 bp, Mus musculus
gatctccatgtctacaagatctcca

SEQ ID NO: 665334 - DNA, 25 bp, Mus musculus
gatctccattgaaataaacaaccag

SEQ ID NO: 665335 - DNA, 25 bp, Mus musculus
gatctccattgatataaacaaccag

SEQ ID NO: 665336 - DNA, 25 bp, Mus musculus
gatctcccaaatcttgagtccagtg

SEQ ID NO: 665337 - DNA, 25 bp, Mus musculus
gatctcccaaatgttgagtccagtg

SEQ ID NO: 665338 - DNA, 25 bp, Mus musculus
gatctcccagcaaaggactccaatg

SEQ ID NO: 665339 - DNA, 25 bp, Mus musculus
gatctcccagcataggactccaatg

SEQ ID NO: 665340 - DNA, 25 bp, Mus musculus
gatctcccaggacacaaccgcagat

SEQ ID NO: 665341 - DNA, 25 bp, Mus musculus
gatctcccaggagacaaccgcagat

SEQ ID NO: 665342 - DNA, 25 bp, Mus musculus
gatctcccgaggcttgctgtgaact

SEQ ID NO: 665343 - DNA, 25 bp, Mus musculus
gatctcccgagggttgctgtgaact

SEQ ID NO: 665344 - DNA, 25 bp, Mus musculus
gatctccgactacatgaagaccagt

SEQ ID NO: 665345 - DNA, 25 bp, Mus musculus
gatctccgactagatgaagaccagt

SEQ ID NO: 665346 - DNA, 25 bp, Mus musculus
gatctccgagttcctatttgggacc

SEQ ID NO: 665347 - DNA, 25 bp, Mus musculus
gatctccgagttgctatttgggacc

SEQ ID NO: 665348 - DNA, 25 bp, Mus musculus
gatctccgggaacgccagcctttta

SEQ ID NO: 665349 - DNA, 25 bp, Mus musculus
gatctccgggaaggccagcctttta

SEQ ID NO: 665350 - DNA, 25 bp, Mus musculus
gatctccgtagaagaagctctccag

SEQ ID NO: 665351 - DNA, 25 bp, Mus musculus
gatctccgtagatgaagctctccag

SEQ ID NO: 665352 - DNA, 25 bp, Mus musculus
gatctccgtcgtcatgtcagctccg

SEQ ID NO: 665353 - DNA, 25 bp, Mus musculus
gatctccgtcgtgatgtcagctccg

SEQ ID NO: 665354 - DNA, 25 bp, Mus musculus
gatctcctagagaatgccctgtgtg

SEQ ID NO: 665355 - DNA, 25 bp, Mus musculus
gatctcctagagtatgccctgtgtg

SEQ ID NO: 665356 - DNA, 25 bp, Mus musculus
gatctcctcataagtgggagaaaat

SEQ ID NO: 665357 - DNA, 25 bp, Mus musculus
gatctcctcatatgtgggagaaaat

SEQ ID NO: 665358 - DNA, 25 bp, Mus musculus
gatctcctccatagtgaacagcacg

SEQ ID NO: 665359 - DNA, 25 bp, Mus musculus
gatctcctccattgtgaacagcacg

SEQ ID NO: 665360 - DNA, 25 bp, Mus musculus
gatctcctcgccagaatcgggcaga

SEQ ID NO: 665361 - DNA, 25 bp, Mus musculus
gatctcctcgcctgaatcgggcaga

SEQ ID NO: 665362 - DNA, 25 bp, Mus musculus
gatctcctctaccttgggccttcag

SEQ ID NO: 665363 - DNA, 25 bp, Mus musculus
gatctcctctacgttgggccttcag

SEQ ID NO: 665364 - DNA, 25 bp, Mus musculus
gatctcctggcaacatgggaaaggc

SEQ ID NO: 665365 - DNA, 25 bp, Mus musculus
gatctcctggcatcatgggaaaggc

SEQ ID NO: 665366 - DNA, 25 bp, Mus musculus
gatctcctggtaccatgacctttgg

SEQ ID NO: 665367 - DNA, 25 bp, Mus musculus
gatctcctggtagcatgacctttgg

SEQ ID NO: 665368 - DNA, 25 bp, Mus musculus
gatctcctgtttcaaccagtggcag

SEQ ID NO: 665369 - DNA, 25 bp, Mus musculus
gatctcctgtttgaaccagtggcag

SEQ ID NO: 665370 - DNA, 25 bp, Mus musculus
gatctccttacccttggcctctgaa

SEQ ID NO: 665371 - DNA, 25 bp, Mus musculus
gatctccttaccgttggcctctgaa

SEQ ID NO: 665372 - DNA, 25 bp, Mus musculus
gatctccttgacctgagtgaacccg

SEQ ID NO: 665373 - DNA, 25 bp, Mus musculus
gatctccttgacgtgagtgaacccg

SEQ ID NO: 665374 - DNA, 25 bp, Mus musculus
gatctcgaaggacgagtcagctact

SEQ ID NO: 665375 - DNA, 25 bp, Mus musculus
gatctcgaaggaggagtcagctact

SEQ ID NO: 665376 - DNA, 25 bp, Mus musculus
gatctcgaggctcctcgctgatacc

SEQ ID NO: 665377 - DNA, 25 bp, Mus musculus
gatctcgaggctgctcgctgatacc

SEQ ID NO: 665378 - DNA, 25 bp, Mus musculus
gatctcgatgatccagtgaatggcc

SEQ ID NO: 665379 - DNA, 25 bp, Mus musculus
gatctcgatgatgcagtgaatggcc

SEQ ID NO: 665380 - DNA, 25 bp, Mus musculus
gatctcggacgcacagtgggaagat

SEQ ID NO: 665381 - DNA, 25 bp, Mus musculus
gatctcggacgctcagtgggaagat

SEQ ID NO: 665382 - DNA, 25 bp, Mus musculus
gatctcggagagctcaacttctctc

SEQ ID NO: 665383 - DNA, 25 bp, Mus musculus
gatctcggagaggtcaacttctctc

SEQ ID NO: 665384 - DNA, 25 bp, Mus musculus
gatctcggagtcctattacccagag

SEQ ID NO: 665385 - DNA, 25 bp, Mus musculus
gatctcggagtcgtattacccagag

SEQ ID NO: 665386 - DNA, 25 bp, Mus musculus
gatctcggatgcaaatctgcgtgtc

SEQ ID NO: 665387 - DNA, 25 bp, Mus musculus
gatctcggatgctaatctgcgtgtc

SEQ ID NO: 665388 - DNA, 25 bp, Mus musculus
gatctcggccaaaggcgagcgcttg

SEQ ID NO: 665389 - DNA, 25 bp, Mus musculus
gatctcggccaatggcgagcgcttg

SEQ ID NO: 665390 - DNA, 25 bp, Mus musculus
gatctcggccgcagcgcttccgatt

SEQ ID NO: 665391 - DNA, 25 bp, Mus musculus
gatctcggccgctgcgcttccgatt

SEQ ID NO: 665392 - DNA, 25 bp, Mus musculus
gatctcggcttgctgtgacccgcgc

SEQ ID NO: 665393 - DNA, 25 bp, Mus musculus
gatctcggcttggtgtgacccgcgc

SEQ ID NO: 665394 - DNA, 25 bp, Mus musculus
gatctcgtatccagtttgagttcct

SEQ ID NO: 665395 - DNA, 25 bp, Mus musculus
gatctcgtatcctgtttgagttcct

SEQ ID NO: 665396 - DNA, 25 bp, Mus musculus
gatctcgtctcccatggatacagtg

SEQ ID NO: 665397 - DNA, 25 bp, Mus musculus
gatctcgtctccgatggatacagtg

SEQ ID NO: 665398 - DNA, 25 bp, Mus musculus
gatctcgtctgcagtgttgcttcca

SEQ ID NO: 665399 - DNA, 25 bp, Mus musculus
gatctcgtctgctgtgttgcttcca

SEQ ID NO: 665400 - DNA, 25 bp, Mus musculus
gatctctacaggcatgacattgact

SEQ ID NO: 665401 - DNA, 25 bp, Mus musculus
gatctctacagggatgacattgact

SEQ ID NO: 665402 - DNA, 25 bp, Mus musculus
gatctctatagtcggctaataggcc

SEQ ID NO: 665403 - DNA, 25 bp, Mus musculus
gatctctatagtgggctaataggcc

SEQ ID NO: 665404 - DNA, 25 bp, Mus musculus
gatctctcatctcctagaatcagaa

SEQ ID NO: 665405 - DNA, 25 bp, Mus musculus
gatctctcatctgctagaatcagaa

SEQ ID NO: 665406 - DNA, 25 bp, Mus musculus
gatctctccataacaagcgagagct

SEQ ID NO: 665407 - DNA, 25 bp, Mus musculus
gatctctccatatcaagcgagagct

SEQ ID NO: 665408 - DNA, 25 bp, Mus musculus
gatctctcctggctgctaggctgta

SEQ ID NO: 665409 - DNA, 25 bp, Mus musculus
gatctctcctgggtgctaggctgta

SEQ ID NO: 665410 - DNA, 25 bp, Mus musculus
gatctctctactaaggacttacgag

SEQ ID NO: 665411 - DNA, 25 bp, Mus musculus
gatctctctacttaggacttacgag

SEQ ID NO: 665412 - DNA, 25 bp, Mus musculus
gatctctctggaatttattctctga

SEQ ID NO: 665413 - DNA, 25 bp, Mus musculus
gatctctctggattttattctctga

SEQ ID NO: 665414 - DNA, 25 bp, Mus musculus
gatctctctgtaataaacaaattct

SEQ ID NO: 665415 - DNA, 25 bp, Mus musculus
gatctctctgtattaaacaaattct

SEQ ID NO: 665416 - DNA, 25 bp, Mus musculus
gatctctctgttagacctggtcctg

SEQ ID NO: 665417 - DNA, 25 bp, Mus musculus
gatctctctgtttgacctggtcctg

SEQ ID NO: 665418 - DNA, 25 bp, Mus musculus
gatctctcttgaccttcagggtagg

SEQ ID NO: 665419 - DNA, 25 bp, Mus musculus
gatctctcttgagcttcagggtagg

SEQ ID NO: 665420 - DNA, 25 bp, Mus musculus
gatctctgagctcctctgcacaaga

SEQ ID NO: 665421 - DNA, 25 bp, Mus musculus
gatctctgagctgctctgcacaaga

SEQ ID NO: 665422 - DNA, 25 bp, Mus musculus
gatctctgcacgaagggctttccac

SEQ ID NO: 665423 - DNA, 25 bp, Mus musculus
gatctctgcacgtagggctttccac

SEQ ID NO: 665424 - DNA, 25 bp, Mus musculus
gatctctggaaccacaattctcatc

SEQ ID NO: 665425 - DNA, 25 bp, Mus musculus
gatctctggaacgacaattctcatc

SEQ ID NO: 665426 - DNA, 25 bp, Mus musculus
gatctctgggaaagtcagcacctca

SEQ ID NO: 665427 - DNA, 25 bp, Mus musculus
gatctctgggaatgtcagcacctca

SEQ ID NO: 665428 - DNA, 25 bp, Mus musculus
gatctctgggagctgttcagcaacc

SEQ ID NO: 665429 - DNA, 25 bp, Mus musculus
gatctctgggaggtgttcagcaacc

SEQ ID NO: 665430 - DNA, 25 bp, Mus musculus
gatctctgggctagaactgctgagc

SEQ ID NO: 665431 - DNA, 25 bp, Mus musculus
gatctctgggcttgaactgctgagc

SEQ ID NO: 665432 - DNA, 25 bp, Mus musculus
gatctctgtacaaccctccacaagg

SEQ ID NO: 665433 - DNA, 25 bp, Mus musculus
gatctctgtacatccctccacaagg

SEQ ID NO: 665434 - DNA, 25 bp, Mus musculus
gatctcttcattaacctctccaggc

SEQ ID NO: 665435 - DNA, 25 bp, Mus musculus
gatctcttcatttacctctccaggc

SEQ ID NO: 665436 - DNA, 25 bp, Mus musculus
gatctcttccagacaagaccagctt

SEQ ID NO: 665437 - DNA, 25 bp, Mus musculus
gatctcttccagtcaagaccagctt

SEQ ID NO: 665438 - DNA, 25 bp, Mus musculus
gatctcttcgatcgcagagagagtt

SEQ ID NO: 665439 - DNA, 25 bp, Mus musculus
gatctcttcgatggcagagagagtt

SEQ ID NO: 665440 - DNA, 25 bp, Mus musculus
gatctcttgcatctgtgactaacca

SEQ ID NO: 665441 - DNA, 25 bp, Mus musculus
gatctcttgcatgtgtgactaacca

SEQ ID NO: 665442 - DNA, 25 bp, Mus musculus
gatctcttgggacatcgagacacca

SEQ ID NO: 665443 - DNA, 25 bp, Mus musculus
gatctcttgggagatcgagacacca

SEQ ID NO: 665444 - DNA, 25 bp, Mus musculus
gatctgaaaatccaccacacgggct

SEQ ID NO: 665445 - DNA, 25 bp, Mus musculus
gatctgaaaatcgaccacacgggct

SEQ ID NO: 665446 - DNA, 25 bp, Mus musculus
gatctgaaagatcaattctgtgatg

SEQ ID NO: 665447 - DNA, 25 bp, Mus musculus
gatctgaaagatgaattctgtgatg

SEQ ID NO: 665448 - DNA, 25 bp, Mus musculus
gatctgaaatgtcccaggtgatgtg

SEQ ID NO: 665449 - DNA, 25 bp, Mus musculus
gatctgaaatgtgccaggtgatgtg

SEQ ID NO: 665450 - DNA, 25 bp, Mus musculus
gatctgaacgcgatcctgtgccaag

SEQ ID NO: 665451 - DNA, 25 bp, Mus musculus
gatctgaacgcgttcctgtgccaag

SEQ ID NO: 665452 - DNA, 25 bp, Mus musculus
gatctgaagccaagcagcgatggga

SEQ ID NO: 665453 - DNA, 25 bp, Mus musculus
gatctgaagccatgcagcgatggga

SEQ ID NO: 665454 - DNA, 25 bp, Mus musculus
gatctgaatcctacaagctcctgcc

SEQ ID NO: 665455 - DNA, 25 bp, Mus musculus
gatctgaatccttcaagctcctgcc

SEQ ID NO: 665456 - DNA, 25 bp, Mus musculus
gatctgaatctcaactctatgtcag

SEQ ID NO: 665457 - DNA, 25 bp, Mus musculus
gatctgaatctctactctatgtcag

SEQ ID NO: 665458 - DNA, 25 bp, Mus musculus
gatctgaatggaaatggagatatcg

SEQ ID NO: 665459 - DNA, 25 bp, Mus musculus
gatctgaatggatatggagatatcg

SEQ ID NO: 665460 - DNA, 25 bp, Mus musculus
gatctgacatctcatcaaggacttg

SEQ ID NO: 665461 - DNA, 25 bp, Mus musculus
gatctgacatctgatcaaggacttg

SEQ ID NO: 665462 - DNA, 25 bp, Mus musculus
gatctgaccatgctttgagtggtac

SEQ ID NO: 665463 - DNA, 25 bp, Mus musculus
gatctgaccatggtttgagtggtac

SEQ ID NO: 665464 - DNA, 25 bp, Mus musculus
gatctgacctcaaaccatcagtggg

SEQ ID NO: 665465 - DNA, 25 bp, Mus musculus
gatctgacctcataccatcagtggg

SEQ ID NO: 665466 - DNA, 25 bp, Mus musculus
gatctgacggcgacgcctgagtccg

SEQ ID NO: 665467 - DNA, 25 bp, Mus musculus
gatctgacggcgtcgcctgagtccg

SEQ ID NO: 665468 - DNA, 25 bp, Mus musculus
gatctgactgaaaatttgtctcgat

SEQ ID NO: 665469 - DNA, 25 bp, Mus musculus
gatctgactgaatatttgtctcgat

SEQ ID NO: 665470 - DNA, 25 bp, Mus musculus
gatctgagaatcatctctctctggg

SEQ ID NO: 665471 - DNA, 25 bp, Mus musculus
gatctgagaatcttctctctctggg

SEQ ID NO: 665472 - DNA, 25 bp, Mus musculus
gatctgagaccacgaatcaccatgg

SEQ ID NO: 665473 - DNA, 25 bp, Mus musculus
gatctgagaccaggaatcaccatgg

SEQ ID NO: 665474 - DNA, 25 bp, Mus musculus
gatctgaggaaactggaagccgcca

SEQ ID NO: 665475 - DNA, 25 bp, Mus musculus
gatctgaggaaagtggaagccgcca

SEQ ID NO: 665476 - DNA, 25 bp, Mus musculus
gatctgaggactaggtgttgcccca

SEQ ID NO: 665477 - DNA, 25 bp, Mus musculus
gatctgaggacttggtgttgcccca

SEQ ID NO: 665478 - DNA, 25 bp, Mus musculus
gatctgaggcataagatggctccca

SEQ ID NO: 665479 - DNA, 25 bp, Mus musculus
gatctgaggcattagatggctccca

SEQ ID NO: 665480 - DNA, 25 bp, Mus musculus
gatctgataaggagaagtggccaca

SEQ ID NO: 665481 - DNA, 25 bp, Mus musculus
gatctgataaggtgaagtggccaca

SEQ ID NO: 665482 - DNA, 25 bp, Mus musculus
gatctgatagatcgacgtgtcgaag

SEQ ID NO: 665483 - DNA, 25 bp, Mus musculus
gatctgatagatggacgtgtcgaag

SEQ ID NO: 665484 - DNA, 25 bp, Mus musculus
gatctgatatttcgctataagcaaa

SEQ ID NO: 665485 - DNA, 25 bp, Mus musculus
gatctgatatttggctataagcaaa

SEQ ID NO: 665486 - DNA, 25 bp, Mus musculus
gatctgatctgaatgctgtgaaggc

SEQ ID NO: 665487 - DNA, 25 bp, Mus musculus
gatctgatctgattgctgtgaaggc

SEQ ID NO: 665488 - DNA, 25 bp, Mus musculus
gatctgatgagacaaatccgggcaa

SEQ ID NO: 665489 - DNA, 25 bp, Mus musculus
gatctgatgagagaaatccgggcaa

SEQ ID NO: 665490 - DNA, 25 bp, Mus musculus
gatctgatggagatctgatagccta

SEQ ID NO: 665491 - DNA, 25 bp, Mus musculus
gatctgatggagttctgatagccta

SEQ ID NO: 665492 - DNA, 25 bp, Mus musculus
gatctgatgtacattccctactatg

SEQ ID NO: 665493 - DNA, 25 bp, Mus musculus
gatctgatgtactttccctactatg

SEQ ID NO: 665494 - DNA, 25 bp, Mus musculus
gatctgcaacttctccagaggttcg

SEQ ID NO: 665495 - DNA, 25 bp, Mus musculus
gatctgcaacttgtccagaggttcg

SEQ ID NO: 665496 - DNA, 25 bp, Mus musculus
gatctgcaatggcattcttcatgga

SEQ ID NO: 665497 - DNA, 25 bp, Mus musculus
gatctgcaatgggattcttcatgga

SEQ ID NO: 665498 - DNA, 25 bp, Mus musculus
gatctgcacaatctgactgtggccg

SEQ ID NO: 665499 - DNA, 25 bp, Mus musculus
gatctgcacaatgtgactgtggccg

SEQ ID NO: 665500 - DNA, 25 bp, Mus musculus
gatctgcaccaacgttgaacaccac

SEQ ID NO: 665501 - DNA, 25 bp, Mus musculus
gatctgcaccaaggttgaacaccac

SEQ ID NO: 665502 - DNA, 25 bp, Mus musculus
gatctgcagcatcaggccaaggtgc

SEQ ID NO: 665503 - DNA, 25 bp, Mus musculus
gatctgcagcatgaggccaaggtgc

SEQ ID NO: 665504 - DNA, 25 bp, Mus musculus
gatctgcagcttccaaatttcaacc

SEQ ID NO: 665505 - DNA, 25 bp, Mus musculus
gatctgcagcttgcaaatttcaacc

SEQ ID NO: 665506 - DNA, 25 bp, Mus musculus
gatctgcagggcacctcgcacccta

SEQ ID NO: 665507 - DNA, 25 bp, Mus musculus
gatctgcagggctcctcgcacccta

SEQ ID NO: 665508 - DNA, 25 bp, Mus musculus
gatctgcagtcacactccagtccag

SEQ ID NO: 665509 - DNA, 25 bp, Mus musculus
gatctgcagtcagactccagtccag

SEQ ID NO: 665510 - DNA, 25 bp, Mus musculus
gatctgcagtctctgctacagagtg

SEQ ID NO: 665511 - DNA, 25 bp, Mus musculus
gatctgcagtctgtgctacagagtg

SEQ ID NO: 665512 - DNA, 25 bp, Mus musculus
gatctgcatcgtcaccaaagagggc

SEQ ID NO: 665513 - DNA, 25 bp, Mus musculus
gatctgcatcgtgaccaaagagggc

SEQ ID NO: 665514 - DNA, 25 bp, Mus musculus
gatctgcatctgctgcccttggacc

SEQ ID NO: 665515 - DNA, 25 bp, Mus musculus
gatctgcatctggtgcccttggacc

SEQ ID NO: 665516 - DNA, 25 bp, Mus musculus
gatctgcatgaaacagcataacaaa

SEQ ID NO: 665517 - DNA, 25 bp, Mus musculus
gatctgcatgaaccagaagcatgga

SEQ ID NO: 665518 - DNA, 25 bp, Mus musculus
gatctgcatgaagcagaagcatgga

SEQ ID NO: 665519 - DNA, 25 bp, Mus musculus
gatctgcatgaatcagcataacaaa

SEQ ID NO: 665520 - DNA, 25 bp, Mus musculus
gatctgcatgcaattatcgctcagg

SEQ ID NO: 665521 - DNA, 25 bp, Mus musculus
gatctgcatgcatttatcgctcagg

SEQ ID NO: 665522 - DNA, 25 bp, Mus musculus
gatctgccaaccagtgcgcctgggt

SEQ ID NO: 665523 - DNA, 25 bp, Mus musculus
gatctgccaacctgtgcgcctgggt

SEQ ID NO: 665524 - DNA, 25 bp, Mus musculus
gatctgccactgaagtagacaacaa

SEQ ID NO: 665525 - DNA, 25 bp, Mus musculus
gatctgccactgtagtagacaacaa

SEQ ID NO: 665526 - DNA, 25 bp, Mus musculus
gatctgccatgtcgcagagcaccca

SEQ ID NO: 665527 - DNA, 25 bp, Mus musculus
gatctgccatgtggcagagcaccca

SEQ ID NO: 665528 - DNA, 25 bp, Mus musculus
gatctgccccggctacaaggaggct

SEQ ID NO: 665529 - DNA, 25 bp, Mus musculus
gatctgccccgggtacaaggaggct

SEQ ID NO: 665530 - DNA, 25 bp, Mus musculus
gatctgcccttcattaaaggagacc

SEQ ID NO: 665531 - DNA, 25 bp, Mus musculus
gatctgcccttctttaaaggagacc

SEQ ID NO: 665532 - DNA, 25 bp, Mus musculus
gatctgccgtccaaacttgaagcct

SEQ ID NO: 665533 - DNA, 25 bp, Mus musculus
gatctgccgtcctaacttgaagcct

SEQ ID NO: 665534 - DNA, 25 bp, Mus musculus
gatctgcctgcactagctgagtacc

SEQ ID NO: 665535 - DNA, 25 bp, Mus musculus
gatctgcctgcagtagctgagtacc

SEQ ID NO: 665536 - DNA, 25 bp, Mus musculus
gatctgcgacaaatcagctctcaag

SEQ ID NO: 665537 - DNA, 25 bp, Mus musculus
gatctgcgacaattcagctctcaag

SEQ ID NO: 665538 - DNA, 25 bp, Mus musculus
gatctgcgacttcgaccttggcagt

SEQ ID NO: 665539 - DNA, 25 bp, Mus musculus
gatctgcgacttggaccttggcagt

SEQ ID NO: 665540 - DNA, 25 bp, Mus musculus
gatctgcgcttcctagttattcacg

SEQ ID NO: 665541 - DNA, 25 bp, Mus musculus
gatctgcgcttcgtagttattcacg

SEQ ID NO: 665542 - DNA, 25 bp, Mus musculus
gatctgcgggatccaagccagatcg

SEQ ID NO: 665543 - DNA, 25 bp, Mus musculus
gatctgcgggatgcaagccagatcg

SEQ ID NO: 665544 - DNA, 25 bp, Mus musculus
gatctgcgtgagaggcaaaaacaac

SEQ ID NO: 665545 - DNA, 25 bp, Mus musculus
gatctgcgtgagtggcaaaaacaac

SEQ ID NO: 665546 - DNA, 25 bp, Mus musculus
gatctgcgtgtgctggatacccaaa

SEQ ID NO: 665547 - DNA, 25 bp, Mus musculus
gatctgcgtgtggtggatacccaaa

SEQ ID NO: 665548 - DNA, 25 bp, Mus musculus
gatctgctaattatcactttgtaag

SEQ ID NO: 665549 - DNA, 25 bp, Mus musculus
gatctgctaattttcactttgtaag

SEQ ID NO: 665550 - DNA, 25 bp, Mus musculus
gatctgctcagcagacactcacaca

SEQ ID NO: 665551 - DNA, 25 bp, Mus musculus
gatctgctcagctgacactcacaca

SEQ ID NO: 665552 - DNA, 25 bp, Mus musculus
gatctgctgaagcacagactttaaa

SEQ ID NO: 665553 - DNA, 25 bp, Mus musculus
gatctgctgaaggacagactttaaa

SEQ ID NO: 665554 - DNA, 25 bp, Mus musculus
gatctgctgagaacacccttatttg

SEQ ID NO: 665555 - DNA, 25 bp, Mus musculus
gatctgctgagatcacccttatttg

SEQ ID NO: 665556 - DNA, 25 bp, Mus musculus
gatctgctgtgcctgccagaagact

SEQ ID NO: 665557 - DNA, 25 bp, Mus musculus
gatctgctgtgcgtgccagaagact

SEQ ID NO: 665558 - DNA, 25 bp, Mus musculus
gatctgcttcggattcgattcagta

SEQ ID NO: 665559 - DNA, 25 bp, Mus musculus
gatctgcttcggtttcgattcagta

SEQ ID NO: 665560 - DNA, 25 bp, Mus musculus
gatctggaaataattttacatggcc

SEQ ID NO: 665561 - DNA, 25 bp, Mus musculus
gatctggaaatatttttacatggcc

SEQ ID NO: 665562 - DNA, 25 bp, Mus musculus
gatctggaagaacctgccaaaactg

SEQ ID NO: 665563 - DNA, 25 bp, Mus musculus
gatctggaagaagctgccaaaactg

SEQ ID NO: 665564 - DNA, 25 bp, Mus musculus
gatctggaagctcagcttagaaaga

SEQ ID NO: 665565 - DNA, 25 bp, Mus musculus
gatctggaagctgagcttagaaaga

SEQ ID NO: 665566 - DNA, 25 bp, Mus musculus
gatctggaattgagccatggcacca

SEQ ID NO: 665567 - DNA, 25 bp, Mus musculus
gatctggaattgtgccatggcacca

SEQ ID NO: 665568 - DNA, 25 bp, Mus musculus
gatctggacagacttttcatggaaa

SEQ ID NO: 665569 - DNA, 25 bp, Mus musculus
gatctggacagagttttcatggaaa

SEQ ID NO: 665570 - DNA, 25 bp, Mus musculus
gatctggacccaaataaaacaagtt

SEQ ID NO: 665571 - DNA, 25 bp, Mus musculus
gatctggacccaagagagaacctag

SEQ ID NO: 665572 - DNA, 25 bp, Mus musculus
gatctggacccatataaaacaagtt

SEQ ID NO: 665573 - DNA, 25 bp, Mus musculus
gatctggacccatgagagaacctag

SEQ ID NO: 665574 - DNA, 25 bp, Mus musculus
gatctggaccgtccggacttgctcg

SEQ ID NO: 665575 - DNA, 25 bp, Mus musculus
gatctggaccgtgcggacttgctcg

SEQ ID NO: 665576 - DNA, 25 bp, Mus musculus
gatctggacggtcactgtgagccca

SEQ ID NO: 665577 - DNA, 25 bp, Mus musculus
gatctggacggtgactgtgagccca

SEQ ID NO: 665578 - DNA, 25 bp, Mus musculus
gatctggactgtcccgactgggtcc

SEQ ID NO: 665579 - DNA, 25 bp, Mus musculus
gatctggactgtgccgactgggtcc

SEQ ID NO: 665580 - DNA, 25 bp, Mus musculus
gatctggacttcaagtcacccgatg

SEQ ID NO: 665581 - DNA, 25 bp, Mus musculus
gatctggacttctagtcacccgatg

SEQ ID NO: 665582 - DNA, 25 bp, Mus musculus
gatctggagcacatggttcgaccgg

SEQ ID NO: 665583 - DNA, 25 bp, Mus musculus
gatctggagcacttggttcgaccgg

SEQ ID NO: 665584 - DNA, 25 bp, Mus musculus
gatctggagcatatttaagccgaca

SEQ ID NO: 665585 - DNA, 25 bp, Mus musculus
gatctggagcatttttaagccgaca

SEQ ID NO: 665586 - DNA, 25 bp, Mus musculus
gatctggagctgcatcagtagcacc

SEQ ID NO: 665587 - DNA, 25 bp, Mus musculus
gatctggagctggatcagtagcacc

SEQ ID NO: 665588 - DNA, 25 bp, Mus musculus
gatctggataagaggaagtaccttg

SEQ ID NO: 665589 - DNA, 25 bp, Mus musculus
gatctggataagtggaagtaccttg

SEQ ID NO: 665590 - DNA, 25 bp, Mus musculus
gatctggatgagacgcacacggaag

SEQ ID NO: 665591 - DNA, 25 bp, Mus musculus
gatctggatgagtcgcacacggaag

SEQ ID NO: 665592 - DNA, 25 bp, Mus musculus
gatctggatgcaccctgtgaccctg

SEQ ID NO: 665593 - DNA, 25 bp, Mus musculus
gatctggatgcagcctgtgaccctg

SEQ ID NO: 665594 - DNA, 25 bp, Mus musculus
gatctggatggcaatggataccctg

SEQ ID NO: 665595 - DNA, 25 bp, Mus musculus
gatctggatggctatggataccctg

SEQ ID NO: 665596 - DNA, 25 bp, Mus musculus
gatctggcccacaacgaatgctgtg

SEQ ID NO: 665597 - DNA, 25 bp, Mus musculus
gatctggcccactacgaatgctgtg

SEQ ID NO: 665598 - DNA, 25 bp, Mus musculus
gatctggcccagatgacctacctga

SEQ ID NO: 665599 - DNA, 25 bp, Mus musculus
gatctggcccagttgacctacctga

SEQ ID NO: 665600 - DNA, 25 bp, Mus musculus
gatctggcctctccactggacactg

SEQ ID NO: 665601 - DNA, 25 bp, Mus musculus
gatctggcctctgcactggacactg

SEQ ID NO: 665602 - DNA, 25 bp, Mus musculus
gatctggcgatcagggcagaaagaa

SEQ ID NO: 665603 - DNA, 25 bp, Mus musculus
gatctggcgatctgggcagaaagaa

SEQ ID NO: 665604 - DNA, 25 bp, Mus musculus
gatctggctaccagtatctccgtgt

SEQ ID NO: 665605 - DNA, 25 bp, Mus musculus
gatctggctacctgtatctccgtgt

SEQ ID NO: 665606 - DNA, 25 bp, Mus musculus
gatctggctagaatggacactccct

SEQ ID NO: 665607 - DNA, 25 bp, Mus musculus
gatctggctagattggacactccct

SEQ ID NO: 665608 - DNA, 25 bp, Mus musculus
gatctggctgtacagattagccaca

SEQ ID NO: 665609 - DNA, 25 bp, Mus musculus
gatctggctgtacccctgtgtcagg

SEQ ID NO: 665610 - DNA, 25 bp, Mus musculus
gatctggctgtagagattagccaca

SEQ ID NO: 665611 - DNA, 25 bp, Mus musculus
gatctggctgtagccctgtgtcagg

SEQ ID NO: 665612 - DNA, 25 bp, Mus musculus
gatctggcttcgagaacataaccgc

SEQ ID NO: 665613 - DNA, 25 bp, Mus musculus
gatctggcttcgtgaacataaccgc

SEQ ID NO: 665614 - DNA, 25 bp, Mus musculus
gatctgggagcacgagaatacataa

SEQ ID NO: 665615 - DNA, 25 bp, Mus musculus
gatctgggagcaggagaatacataa

SEQ ID NO: 665616 - DNA, 25 bp, Mus musculus
gatctgggagccaaaggttgtttca

SEQ ID NO: 665617 - DNA, 25 bp, Mus musculus
gatctgggagcctaaggttgtttca

SEQ ID NO: 665618 - DNA, 25 bp, Mus musculus
gatctgggatgcatctccttccggt

SEQ ID NO: 665619 - DNA, 25 bp, Mus musculus
gatctgggatgcttctccttccggt

SEQ ID NO: 665620 - DNA, 25 bp, Mus musculus
gatctggggtataccgtgaaagtga

SEQ ID NO: 665621 - DNA, 25 bp, Mus musculus
gatctggggtattccgtgaaagtga

SEQ ID NO: 665622 - DNA, 25 bp, Mus musculus
gatctgggtatcacagtagccctga

SEQ ID NO: 665623 - DNA, 25 bp, Mus musculus
gatctgggtatctcagtagccctga

SEQ ID NO: 665624 - DNA, 25 bp, Mus musculus
gatctgggtgttacctccactgaac

SEQ ID NO: 665625 - DNA, 25 bp, Mus musculus
gatctgggtgtttcctccactgaac

SEQ ID NO: 665626 - DNA, 25 bp, Mus musculus
gatctgggttatccatgacgttgga

SEQ ID NO: 665627 - DNA, 25 bp, Mus musculus
gatctgggttatgcatgacgttgga

SEQ ID NO: 665628 - DNA, 25 bp, Mus musculus
gatctgggttgaagcagaagaaaca

SEQ ID NO: 665629 - DNA, 25 bp, Mus musculus
gatctgggttgatgcagaagaaaca

SEQ ID NO: 665630 - DNA, 25 bp, Mus musculus
gatctggtaagaagatgcattcaga

SEQ ID NO: 665631 - DNA, 25 bp, Mus musculus
gatctggtaagatgatgcattcaga

SEQ ID NO: 665632 - DNA, 25 bp, Mus musculus
gatctggtagtccactcatctcatg

SEQ ID NO: 665633 - DNA, 25 bp, Mus musculus
gatctggtagtcgactcatctcatg

SEQ ID NO: 665634 - DNA, 25 bp, Mus musculus
gatctggtgatgcttccgactccag

SEQ ID NO: 665635 - DNA, 25 bp, Mus musculus
gatctggtgatggttccgactccag

SEQ ID NO: 665636 - DNA, 25 bp, Mus musculus
gatctgtacctgagcacagtgagct

SEQ ID NO: 665637 - DNA, 25 bp, Mus musculus
gatctgtacctgtgcacagtgagct

SEQ ID NO: 665638 - DNA, 25 bp, Mus musculus
gatctgtcagctcgccaaggagcag

SEQ ID NO: 665639 - DNA, 25 bp, Mus musculus
gatctgtcagctggccaaggagcag

SEQ ID NO: 665640 - DNA, 25 bp, Mus musculus
gatctgtcccgcagtggtccggaac

SEQ ID NO: 665641 - DNA, 25 bp, Mus musculus
gatctgtcccgctgtggtccggaac

SEQ ID NO: 665642 - DNA, 25 bp, Mus musculus
gatctgtcctctcggagtgaaaccg

SEQ ID NO: 665643 - DNA, 25 bp, Mus musculus
gatctgtcctctgggagtgaaaccg

SEQ ID NO: 665644 - DNA, 25 bp, Mus musculus
gatctgtcgctgcagctgttctcaa

SEQ ID NO: 665645 - DNA, 25 bp, Mus musculus
gatctgtcgctggagctgttctcaa

SEQ ID NO: 665646 - DNA, 25 bp, Mus musculus
gatctgtcttggctacttggtgaaa

SEQ ID NO: 665647 - DNA, 25 bp, Mus musculus
gatctgtcttgggtacttggtgaaa

SEQ ID NO: 665648 - DNA, 25 bp, Mus musculus
gatctgtgatctcaatgtaggctgg

SEQ ID NO: 665649 - DNA, 25 bp, Mus musculus
gatctgtgatctgaatgtaggctgg

SEQ ID NO: 665650 - DNA, 25 bp, Mus musculus
gatctgtgcattctagccatcgact

SEQ ID NO: 665651 - DNA, 25 bp, Mus musculus
gatctgtgcattgtagccatcgact

SEQ ID NO: 665652 - DNA, 25 bp, Mus musculus
gatctgtgccacaaggtcccctatt

SEQ ID NO: 665653 - DNA, 25 bp, Mus musculus
gatctgtgccactaggtcccctatt

SEQ ID NO: 665654 - DNA, 25 bp, Mus musculus
gatctgtgccttagagagacctgta

SEQ ID NO: 665655 - DNA, 25 bp, Mus musculus
gatctgtgcctttgagagacctgta

SEQ ID NO: 665656 - DNA, 25 bp, Mus musculus
gatctgtggatgatgggtgtccata

SEQ ID NO: 665657 - DNA, 25 bp, Mus musculus
gatctgtggatgttgggtgtccata

SEQ ID NO: 665658 - DNA, 25 bp, Mus musculus
gatctgtggcataaagccttgctca

SEQ ID NO: 665659 - DNA, 25 bp, Mus musculus
gatctgtggcattaagccttgctca

SEQ ID NO: 665660 - DNA, 25 bp, Mus musculus
gatctgttagagaccacttgtagca

SEQ ID NO: 665661 - DNA, 25 bp, Mus musculus
gatctgttagagtccacttgtagca

SEQ ID NO: 665662 - DNA, 25 bp, Mus musculus
gatctgttgtagactgctgctctca

SEQ ID NO: 665663 - DNA, 25 bp, Mus musculus
gatctgttgtagtctgctgctctca

SEQ ID NO: 665664 - DNA, 25 bp, Mus musculus
gatctgttgtctaagagccctcact

SEQ ID NO: 665665 - DNA, 25 bp, Mus musculus
gatctgttgtcttagagccctcact

SEQ ID NO: 665666 - DNA, 25 bp, Mus musculus
gatctgttgtttatggtggatacca

SEQ ID NO: 665667 - DNA, 25 bp, Mus musculus
gatctgttgtttttggtggatacca

SEQ ID NO: 665668 - DNA, 25 bp, Mus musculus
gatcttaaaaagctatagcttctcc

SEQ ID NO: 665669 - DNA, 25 bp, Mus musculus
gatcttaaaaaggtatagcttctcc

SEQ ID NO: 665670 - DNA, 25 bp, Mus musculus
gatcttacatttaggactgcctcca

SEQ ID NO: 665671 - DNA, 25 bp, Mus musculus
gatcttacattttggactgcctcca

SEQ ID NO: 665672 - DNA, 25 bp, Mus musculus
gatcttacccagcatcttcaaaggg

SEQ ID NO: 665673 - DNA, 25 bp, Mus musculus
gatcttacccaggatcttcaaaggg

SEQ ID NO: 665674 - DNA, 25 bp, Mus musculus
gatcttactgtgatgcccatcctga

SEQ ID NO: 665675 - DNA, 25 bp, Mus musculus
gatcttactgtgttgcccatcctga

SEQ ID NO: 665676 - DNA, 25 bp, Mus musculus
gatcttagattaagaggtcaccaaa

SEQ ID NO: 665677 - DNA, 25 bp, Mus musculus
gatcttagattatgaggtcaccaaa

SEQ ID NO: 665678 - DNA, 25 bp, Mus musculus
gatcttaggccaagtcgagacgtga

SEQ ID NO: 665679 - DNA, 25 bp, Mus musculus
gatcttaggccatgtcgagacgtga

SEQ ID NO: 665680 - DNA, 25 bp, Mus musculus
gatcttatggctcctttggacccgc

SEQ ID NO: 665681 - DNA, 25 bp, Mus musculus
gatcttatggctgctttggacccgc

SEQ ID NO: 665682 - DNA, 25 bp, Mus musculus
gatcttatttgacgaccaccatccc

SEQ ID NO: 665683 - DNA, 25 bp, Mus musculus
gatcttatttgaggaccaccatccc

SEQ ID NO: 665684 - DNA, 25 bp, Mus musculus
gatcttcaaaatagcctcaatggcc

SEQ ID NO: 665685 - DNA, 25 bp, Mus musculus
gatcttcaaaattgcctcaatggcc

SEQ ID NO: 665686 - DNA, 25 bp, Mus musculus
gatcttcaaaccacgaagtaagctt

SEQ ID NO: 665687 - DNA, 25 bp, Mus musculus
gatcttcaaacctcgaagtaagctt

SEQ ID NO: 665688 - DNA, 25 bp, Mus musculus
gatcttcaacaaatgcaacagcttc

SEQ ID NO: 665689 - DNA, 25 bp, Mus musculus
gatcttcaacaattgcaacagcttc

SEQ ID NO: 665690 - DNA, 25 bp, Mus musculus
gatcttcaagaacagacctgtgacc

SEQ ID NO: 665691 - DNA, 25 bp, Mus musculus
gatcttcaagaagagacctgtgacc

SEQ ID NO: 665692 - DNA, 25 bp, Mus musculus
gatcttcagccaattcttgcaaagg

SEQ ID NO: 665693 - DNA, 25 bp, Mus musculus
gatcttcagccatttcttgcaaagg

SEQ ID NO: 665694 - DNA, 25 bp, Mus musculus
gatcttcagtgtcggaccacctggc

SEQ ID NO: 665695 - DNA, 25 bp, Mus musculus
gatcttcagtgtgggaccacctggc

SEQ ID NO: 665696 - DNA, 25 bp, Mus musculus
gatcttcagttaactctgaaacagc

SEQ ID NO: 665697 - DNA, 25 bp, Mus musculus
gatcttcagttatctctgaaacagc

SEQ ID NO: 665698 - DNA, 25 bp, Mus musculus
gatcttcataaaagtcttccccagc

SEQ ID NO: 665699 - DNA, 25 bp, Mus musculus
gatcttcataaatgtcttccccagc

SEQ ID NO: 665700 - DNA, 25 bp, Mus musculus
gatcttcatgcccatgactcccgaa

SEQ ID NO: 665701 - DNA, 25 bp, Mus musculus
gatcttcatgccgatgactcccgaa

SEQ ID NO: 665702 - DNA, 25 bp, Mus musculus
gatcttccccagcaagctcagtcta

SEQ ID NO: 665703 - DNA, 25 bp, Mus musculus
gatcttccccaggaagctcagtcta

SEQ ID NO: 665704 - DNA, 25 bp, Mus musculus
gatcttcccctgacaggagagagag

SEQ ID NO: 665705 - DNA, 25 bp, Mus musculus
gatcttcccctgtcaggagagagag

SEQ ID NO: 665706 - DNA, 25 bp, Mus musculus
gatcttcccggaagcgcctttgctc

SEQ ID NO: 665707 - DNA, 25 bp, Mus musculus
gatcttcccggatgcgcctttgctc

SEQ ID NO: 665708 - DNA, 25 bp, Mus musculus
gatcttccctccagttacatgtcgg

SEQ ID NO: 665709 - DNA, 25 bp, Mus musculus
gatcttccctcctgttacatgtcgg

SEQ ID NO: 665710 - DNA, 25 bp, Mus musculus
gatcttccgattcctgtgtggctgc

SEQ ID NO: 665711 - DNA, 25 bp, Mus musculus
gatcttccgattgctgtgtggctgc

SEQ ID NO: 665712 - DNA, 25 bp, Mus musculus
gatcttccgtcacggacaagcaagc

SEQ ID NO: 665713 - DNA, 25 bp, Mus musculus
gatcttccgtcagggacaagcaagc

SEQ ID NO: 665714 - DNA, 25 bp, Mus musculus
gatcttcctacacaaagtagcatcc

SEQ ID NO: 665715 - DNA, 25 bp, Mus musculus
gatcttcctacagaaagtagcatcc

SEQ ID NO: 665716 - DNA, 25 bp, Mus musculus
gatcttcctgccaacgagaggctca

SEQ ID NO: 665717 - DNA, 25 bp, Mus musculus
gatcttcctgcctacgagaggctca

SEQ ID NO: 665718 - DNA, 25 bp, Mus musculus
gatcttccttcacccctcagtgtgg

SEQ ID NO: 665719 - DNA, 25 bp, Mus musculus
gatcttccttcagccctcagtgtgg

SEQ ID NO: 665720 - DNA, 25 bp, Mus musculus
gatcttccttggcaattcatggttg

SEQ ID NO: 665721 - DNA, 25 bp, Mus musculus
gatcttccttgggaattcatggttg

SEQ ID NO: 665722 - DNA, 25 bp, Mus musculus
gatcttcgactgcagccatgaaatg

SEQ ID NO: 665723 - DNA, 25 bp, Mus musculus
gatcttcgactggagccatgaaatg

SEQ ID NO: 665724 - DNA, 25 bp, Mus musculus
gatcttcgatgacaatgccaagttg

SEQ ID NO: 665725 - DNA, 25 bp, Mus musculus
gatcttcgatgagaatgccaagttg

SEQ ID NO: 665726 - DNA, 25 bp, Mus musculus
gatcttcgatttcctgggctaccag

SEQ ID NO: 665727 - DNA, 25 bp, Mus musculus
gatcttcgatttgctgggctaccag

SEQ ID NO: 665728 - DNA, 25 bp, Mus musculus
gatcttcgcggccaaaacgcgctaa

SEQ ID NO: 665729 - DNA, 25 bp, Mus musculus
gatcttcgcggcgaaaacgcgctaa

SEQ ID NO: 665730 - DNA, 25 bp, Mus musculus
gatcttcggcaacatatgttagctt

SEQ ID NO: 665731 - DNA, 25 bp, Mus musculus
gatcttcggcaagatatgttagctt

SEQ ID NO: 665732 - DNA, 25 bp, Mus musculus
gatcttcgggaaagctgctgtgctt

SEQ ID NO: 665733 - DNA, 25 bp, Mus musculus
gatcttcgggaatgctgctgtgctt

SEQ ID NO: 665734 - DNA, 25 bp, Mus musculus
gatcttcggtgtcacaacccttgac

SEQ ID NO: 665735 - DNA, 25 bp, Mus musculus
gatcttcggtgtgacaacccttgac

SEQ ID NO: 665736 - DNA, 25 bp, Mus musculus
gatcttcgtggaagacgagaccaag

SEQ ID NO: 665737 - DNA, 25 bp, Mus musculus
gatcttcgtggatgacgagaccaag

SEQ ID NO: 665738 - DNA, 25 bp, Mus musculus
gatcttctacaacctgatgtcacgg

SEQ ID NO: 665739 - DNA, 25 bp, Mus musculus
gatcttctacaagctgatgtcacgg

SEQ ID NO: 665740 - DNA, 25 bp, Mus musculus
gatcttctagaacttgcccaggaaa

SEQ ID NO: 665741 - DNA, 25 bp, Mus musculus
gatcttctagaagttgcccaggaaa

SEQ ID NO: 665742 - DNA, 25 bp, Mus musculus
gatcttctcatcagcgcttcgtaca

SEQ ID NO: 665743 - DNA, 25 bp, Mus musculus
gatcttctcatctgcgcttcgtaca

SEQ ID NO: 665744 - DNA, 25 bp, Mus musculus
gatcttctctccacgtgggaagtca

SEQ ID NO: 665745 - DNA, 25 bp, Mus musculus
gatcttctctcctcgtgggaagtca

SEQ ID NO: 665746 - DNA, 25 bp, Mus musculus
gatcttctctggacccgcaaaactt

SEQ ID NO: 665747 - DNA, 25 bp, Mus musculus
gatcttctctggtcccgcaaaactt

SEQ ID NO: 665748 - DNA, 25 bp, Mus musculus
gatcttctgcatccacgctggctag

SEQ ID NO: 665749 - DNA, 25 bp, Mus musculus
gatcttctgcatgcacgctggctag

SEQ ID NO: 665750 - DNA, 25 bp, Mus musculus
gatcttctgcgtatcgatgtgaagg

SEQ ID NO: 665751 - DNA, 25 bp, Mus musculus
gatcttctgcgtttcgatgtgaagg

SEQ ID NO: 665752 - DNA, 25 bp, Mus musculus
gatcttctgtggcaagtgctcctcc

SEQ ID NO: 665753 - DNA, 25 bp, Mus musculus
gatcttctgtgggaagtgctcctcc

SEQ ID NO: 665754 - DNA, 25 bp, Mus musculus
gatcttcttgaacccggagaagagg

SEQ ID NO: 665755 - DNA, 25 bp, Mus musculus
gatcttcttgaagccggagaagagg

SEQ ID NO: 665756 - DNA, 25 bp, Mus musculus
gatcttcttgtcacagagagcagta

SEQ ID NO: 665757 - DNA, 25 bp, Mus musculus
gatcttcttgtctcagagagcagta

SEQ ID NO: 665758 - DNA, 25 bp, Mus musculus
gatcttgaactacctgcaaacagct

SEQ ID NO: 665759 - DNA, 25 bp, Mus musculus
gatcttgaactagctgcaaacagct

SEQ ID NO: 665760 - DNA, 25 bp, Mus musculus
gatcttgaagctaactgctgatgcc

SEQ ID NO: 665761 - DNA, 25 bp, Mus musculus
gatcttgaagcttactgctgatgcc

SEQ ID NO: 665762 - DNA, 25 bp, Mus musculus
gatcttgaccaaaccagtggctgcc

SEQ ID NO: 665763 - DNA, 25 bp, Mus musculus
gatcttgaccaatccagtggctgcc

SEQ ID NO: 665764 - DNA, 25 bp, Mus musculus
gatcttgaggagcagccgtgtttaa

SEQ ID NO: 665765 - DNA, 25 bp, Mus musculus
gatcttgaggaggagccgtgtttaa

SEQ ID NO: 665766 - DNA, 25 bp, Mus musculus
gatcttgaggcaacgaactatgatg

SEQ ID NO: 665767 - DNA, 25 bp, Mus musculus
gatcttgaggcatcgaactatgatg

SEQ ID NO: 665768 - DNA, 25 bp, Mus musculus
gatcttgaggcgaaccttaggcact

SEQ ID NO: 665769 - DNA, 25 bp, Mus musculus
gatcttgaggcgtaccttaggcact

SEQ ID NO: 665770 - DNA, 25 bp, Mus musculus
gatcttgatcgaacaacccaattta

SEQ ID NO: 665771 - DNA, 25 bp, Mus musculus
gatcttgatcgatcaacccaattta

SEQ ID NO: 665772 - DNA, 25 bp, Mus musculus
gatcttgcccagcaggtgagcagcc

SEQ ID NO: 665773 - DNA, 25 bp, Mus musculus
gatcttgcccaggaggtgagcagcc

SEQ ID NO: 665774 - DNA, 25 bp, Mus musculus
gatcttgcccgacgtgctggagaaa

SEQ ID NO: 665775 - DNA, 25 bp, Mus musculus
gatcttgcccgaggtgctggagaaa

SEQ ID NO: 665776 - DNA, 25 bp, Mus musculus
gatcttgctattccagcgactatgg

SEQ ID NO: 665777 - DNA, 25 bp, Mus musculus
gatcttgctattgcagcgactatgg

SEQ ID NO: 665778 - DNA, 25 bp, Mus musculus
gatcttggactgcacattggtgccc

SEQ ID NO: 665779 - DNA, 25 bp, Mus musculus
gatcttggactggacattggtgccc

SEQ ID NO: 665780 - DNA, 25 bp, Mus musculus
gatcttgggtctatgcaacaatttc

SEQ ID NO: 665781 - DNA, 25 bp, Mus musculus
gatcttgggtctttgcaacaatttc

SEQ ID NO: 665782 - DNA, 25 bp, Mus musculus
gatcttggttatcgccactcaggca

SEQ ID NO: 665783 - DNA, 25 bp, Mus musculus
gatcttggttatggccactcaggca

SEQ ID NO: 665784 - DNA, 25 bp, Mus musculus
gatcttggttctccaatttgatggg

SEQ ID NO: 665785 - DNA, 25 bp, Mus musculus
gatcttggttctgcaatttgatggg

SEQ ID NO: 665786 - DNA, 25 bp, Mus musculus
gatcttgtaagcagcctcagccgaa

SEQ ID NO: 665787 - DNA, 25 bp, Mus musculus
gatcttgtaagctgcctcagccgaa

SEQ ID NO: 665788 - DNA, 25 bp, Mus musculus
gatcttgtaccaccacttccggtca

SEQ ID NO: 665789 - DNA, 25 bp, Mus musculus
gatcttgtaccagcacttccggtca

SEQ ID NO: 665790 - DNA, 25 bp, Mus musculus
gatcttgtagacaagtatctggagg

SEQ ID NO: 665791 - DNA, 25 bp, Mus musculus
gatcttgtagactagtatctggagg

SEQ ID NO: 665792 - DNA, 25 bp, Mus musculus
gatcttgtccaacgcctggagcctg

SEQ ID NO: 665793 - DNA, 25 bp, Mus musculus
gatcttgtccaaggcctggagcctg

SEQ ID NO: 665794 - DNA, 25 bp, Mus musculus
gatcttgtcggtcgccatcggtgac

SEQ ID NO: 665795 - DNA, 25 bp, Mus musculus
gatcttgtcggtggccatcggtgac

SEQ ID NO: 665796 - DNA, 25 bp, Mus musculus
gatcttgtggccagctgcctaaggg

SEQ ID NO: 665797 - DNA, 25 bp, Mus musculus
gatcttgtggcctgctgcctaaggg

SEQ ID NO: 665798 - DNA, 25 bp, Mus musculus
gatctttacaggagacgtgcacaga

SEQ ID NO: 665799 - DNA, 25 bp, Mus musculus
gatctttacaggtgacgtgcacaga

SEQ ID NO: 665800 - DNA, 25 bp, Mus musculus
gatctttacccactcgacgacacgg

SEQ ID NO: 665801 - DNA, 25 bp, Mus musculus
gatctttacccagtcgacgacacgg

SEQ ID NO: 665802 - DNA, 25 bp, Mus musculus
gatctttagatcacaccgcagaggc

SEQ ID NO: 665803 - DNA, 25 bp, Mus musculus
gatctttagatctcaccgcagaggc

SEQ ID NO: 665804 - DNA, 25 bp, Mus musculus
gatctttcaaagctacgccatgttg

SEQ ID NO: 665805 - DNA, 25 bp, Mus musculus
gatctttcaaaggtacgccatgttg

SEQ ID NO: 665806 - DNA, 25 bp, Mus musculus
gatctttcaagcaatcgtcttgcaa

SEQ ID NO: 665807 - DNA, 25 bp, Mus musculus
gatctttcaagctatcgtcttgcaa

SEQ ID NO: 665808 - DNA, 25 bp, Mus musculus
gatctttcaatcctcccgtgtgtga

SEQ ID NO: 665809 - DNA, 25 bp, Mus musculus
gatctttcaatcgtcccgtgtgtga

SEQ ID NO: 665810 - DNA, 25 bp, Mus musculus
gatctttctcaacctgagactgagc

SEQ ID NO: 665811 - DNA, 25 bp, Mus musculus
gatctttctcaagctgagactgagc

SEQ ID NO: 665812 - DNA, 25 bp, Mus musculus
gatctttgaaccatcaggatccacc

SEQ ID NO: 665813 - DNA, 25 bp, Mus musculus
gatctttgaaccttcaggatccacc

SEQ ID NO: 665814 - DNA, 25 bp, Mus musculus
gatctttgatgaactttacaggcag

SEQ ID NO: 665815 - DNA, 25 bp, Mus musculus
gatctttgatgaagaacctactatc

SEQ ID NO: 665816 - DNA, 25 bp, Mus musculus
gatctttgatgatctttacaggcag

SEQ ID NO: 665817 - DNA, 25 bp, Mus musculus
gatctttgatgatgaacctactatc

SEQ ID NO: 665818 - DNA, 25 bp, Mus musculus
gatctttgcaataatcttttcggct

SEQ ID NO: 665819 - DNA, 25 bp, Mus musculus
gatctttgcaattatcttttcggct

SEQ ID NO: 665820 - DNA, 25 bp, Mus musculus
gatctttgccagaattatgatgtag

SEQ ID NO: 665821 - DNA, 25 bp, Mus musculus
gatctttgccagtattatgatgtag

SEQ ID NO: 665822 - DNA, 25 bp, Mus musculus
gatctttgggcaaatccctctggat

SEQ ID NO: 665823 - DNA, 25 bp, Mus musculus
gatctttgggcatatccctctggat

SEQ ID NO: 665824 - DNA, 25 bp, Mus musculus
gatctttgtcccagaatacacccag

SEQ ID NO: 665825 - DNA, 25 bp, Mus musculus
gatctttgtccctgaatacacccag

SEQ ID NO: 665826 - DNA, 25 bp, Mus musculus
gatctttgtgaaaaccttaactggt

SEQ ID NO: 665827 - DNA, 25 bp, Mus musculus
gatctttgtgaactccgtgcagcgc

SEQ ID NO: 665828 - DNA, 25 bp, Mus musculus
gatctttgtgaagtccgtgcagcgc

SEQ ID NO: 665829 - DNA, 25 bp, Mus musculus
gatctttgtgaataccttaactggt

SEQ ID NO: 665830 - DNA, 25 bp, Mus musculus
gatcttttcgcacgtaattgtcata

SEQ ID NO: 665831 - DNA, 25 bp, Mus musculus
gatcttttcgcaggtaattgtcata

SEQ ID NO: 665832 - DNA, 25 bp, Mus musculus
gatcttttgccgcaccaggctcatc

SEQ ID NO: 665833 - DNA, 25 bp, Mus musculus
gatcttttgccggaccaggctcatc

SEQ ID NO: 665834 - DNA, 25 bp, Mus musculus
gatctttttaagcaagaggagtctc

SEQ ID NO: 665835 - DNA, 25 bp, Mus musculus
gatctttttaaggaagaggagtctc

SEQ ID NO: 665836 - DNA, 25 bp, Mus musculus
gatgaaaaacccacggatgagaatg

SEQ ID NO: 665837 - DNA, 25 bp, Mus musculus
gatgaaaaaccctcggatgagaatg

SEQ ID NO: 665838 - DNA, 25 bp, Mus musculus
gatgaaaaaggcatccaatcctgtg

SEQ ID NO: 665839 - DNA, 25 bp, Mus musculus
gatgaaaaaggcttccaatcctgtg

SEQ ID NO: 665840 - DNA, 25 bp, Mus musculus
gatgaaaacaaacgcaggagaagcc

SEQ ID NO: 665841 - DNA, 25 bp, Mus musculus
gatgaaaacaaaggcaggagaagcc

SEQ ID NO: 665842 - DNA, 25 bp, Mus musculus
gatgaaaacacaataggctacttca

SEQ ID NO: 665843 - DNA, 25 bp, Mus musculus
gatgaaaacacattaggctacttca

SEQ ID NO: 665844 - DNA, 25 bp, Mus musculus
gatgaaaacataatgcgctccatgc

SEQ ID NO: 665845 - DNA, 25 bp, Mus musculus
gatgaaaacatattgcgctccatgc

SEQ ID NO: 665846 - DNA, 25 bp, Mus musculus
gatgaaaacgaactgaacatcgtat

SEQ ID NO: 665847 - DNA, 25 bp, Mus musculus
gatgaaaacgaagtgaacatcgtat

SEQ ID NO: 665848 - DNA, 25 bp, Mus musculus
gatgaaaacgacaaaggtgaaaaga

SEQ ID NO: 665849 - DNA, 25 bp, Mus musculus
gatgaaaacgactaaggtgaaaaga

SEQ ID NO: 665850 - DNA, 25 bp, Mus musculus
gatgaaaagattcaactcgtagttg

SEQ ID NO: 665851 - DNA, 25 bp, Mus musculus
gatgaaaagattgaactcgtagttg

SEQ ID NO: 665852 - DNA, 25 bp, Mus musculus
gatgaaaagctactccttcctgaga

SEQ ID NO: 665853 - DNA, 25 bp, Mus musculus
gatgaaaagctagtccttcctgaga

SEQ ID NO: 665854 - DNA, 25 bp, Mus musculus
gatgaaaaggaacgtgtcaaagtcg

SEQ ID NO: 665855 - DNA, 25 bp, Mus musculus
gatgaaaaggaaggtgtcaaagtcg

SEQ ID NO: 665856 - DNA, 25 bp, Mus musculus
gatgaaaaggcaatgaatggcaatc

SEQ ID NO: 665857 - DNA, 25 bp, Mus musculus
gatgaaaaggcattgaatggcaatc

SEQ ID NO: 665858 - DNA, 25 bp, Mus musculus
gatgaaaatgaacccctaaatattg

SEQ ID NO: 665859 - DNA, 25 bp, Mus musculus
gatgaaaatgaagccctaaatattg

SEQ ID NO: 665860 - DNA, 25 bp, Mus musculus
gatgaaaatgaccaggaagaatacg

SEQ ID NO: 665861 - DNA, 25 bp, Mus musculus
gatgaaaatgacgaggaagaatacg

SEQ ID NO: 665862 - DNA, 25 bp, Mus musculus
gatgaaaatggccaaaaaatcctga

SEQ ID NO: 665863 - DNA, 25 bp, Mus musculus
gatgaaaatggcgaaaaaatcctga

SEQ ID NO: 665864 - DNA, 25 bp, Mus musculus
gatgaaaatgttctaatgacaccca

SEQ ID NO: 665865 - DNA, 25 bp, Mus musculus
gatgaaaatgttgtaatgacaccca

SEQ ID NO: 665866 - DNA, 25 bp, Mus musculus
gatgaaacatgtctttttgaatctg

SEQ ID NO: 665867 - DNA, 25 bp, Mus musculus
gatgaaacatgtgtttttgaatctg

SEQ ID NO: 665868 - DNA, 25 bp, Mus musculus
gatgaaacccaaatccataccatat

SEQ ID NO: 665869 - DNA, 25 bp, Mus musculus
gatgaaacccaattccataccatat

SEQ ID NO: 665870 - DNA, 25 bp, Mus musculus
gatgaaacccgaagaaactcccatg

SEQ ID NO: 665871 - DNA, 25 bp, Mus musculus
gatgaaacccgatgaaactcccatg

SEQ ID NO: 665872 - DNA, 25 bp, Mus musculus
gatgaaacctctaagagtttaagct

SEQ ID NO: 665873 - DNA, 25 bp, Mus musculus
gatgaaacctcttagagtttaagct

SEQ ID NO: 665874 - DNA, 25 bp, Mus musculus
gatgaaactcccatgtttgacccaa

SEQ ID NO: 665875 - DNA, 25 bp, Mus musculus
gatgaaactcccttgtttgacccaa

SEQ ID NO: 665876 - DNA, 25 bp, Mus musculus
gatgaaagaagaattaaggaagccg

SEQ ID NO: 665877 - DNA, 25 bp, Mus musculus
gatgaaagaagatttaaggaagccg

SEQ ID NO: 665878 - DNA, 25 bp, Mus musculus
gatgaaagagccagactgagccagt

SEQ ID NO: 665879 - DNA, 25 bp, Mus musculus
gatgaaagagcctgactgagccagt

SEQ ID NO: 665880 - DNA, 25 bp, Mus musculus
gatgaaagcagaagactcctctaaa

SEQ ID NO: 665881 - DNA, 25 bp, Mus musculus
gatgaaagcagatgactcctctaaa

SEQ ID NO: 665882 - DNA, 25 bp, Mus musculus
gatgaaaggcggatacttggaccag

SEQ ID NO: 665883 - DNA, 25 bp, Mus musculus
gatgaaaggcggttacttggaccag

SEQ ID NO: 665884 - DNA, 25 bp, Mus musculus
gatgaaaggttaacctcattggcca

SEQ ID NO: 665885 - DNA, 25 bp, Mus musculus
gatgaaaggttatcctcattggcca

SEQ ID NO: 665886 - DNA, 25 bp, Mus musculus
gatgaaagtaccctctcttctgtac

SEQ ID NO: 665887 - DNA, 25 bp, Mus musculus
gatgaaagtaccgtctcttctgtac

SEQ ID NO: 665888 - DNA, 25 bp, Mus musculus
gatgaaagtggaaaatccaaaggat

SEQ ID NO: 665889 - DNA, 25 bp, Mus musculus
gatgaaagtggataatccaaaggat

SEQ ID NO: 665890 - DNA, 25 bp, Mus musculus
gatgaaagtggtaaagggccaccgc

SEQ ID NO: 665891 - DNA, 25 bp, Mus musculus
gatgaaagtggttaagggccaccgc

SEQ ID NO: 665892 - DNA, 25 bp, Mus musculus
gatgaaatactacaaaaagacgaag

SEQ ID NO: 665893 - DNA, 25 bp, Mus musculus
gatgaaatactagaaaaagacgaag

SEQ ID NO: 665894 - DNA, 25 bp, Mus musculus
gatgaaatagcaaaatgtaacagag

SEQ ID NO: 665895 - DNA, 25 bp, Mus musculus
gatgaaatagcataatgtaacagag

SEQ ID NO: 665896 - DNA, 25 bp, Mus musculus
gatgaaatccctcgagcagtctggt

SEQ ID NO: 665897 - DNA, 25 bp, Mus musculus
gatgaaatccctggagcagtctggt

SEQ ID NO: 665898 - DNA, 25 bp, Mus musculus
gatgaaatcgaacctctgatccacc

SEQ ID NO: 665899 - DNA, 25 bp, Mus musculus
gatgaaatcgaagctctgatccacc

SEQ ID NO: 665900 - DNA, 25 bp, Mus musculus
gatgaaatcgatagtctccccggcc

SEQ ID NO: 665901 - DNA, 25 bp, Mus musculus
gatgaaatcgattgtctccccggcc

SEQ ID NO: 665902 - DNA, 25 bp, Mus musculus
gatgaaatctccatctagactttga

SEQ ID NO: 665903 - DNA, 25 bp, Mus musculus
gatgaaatctccttctagactttga

SEQ ID NO: 665904 - DNA, 25 bp, Mus musculus
gatgaaatgccgctaagtccttgaa

SEQ ID NO: 665905 - DNA, 25 bp, Mus musculus
gatgaaatgccggtaagtccttgaa

SEQ ID NO: 665906 - DNA, 25 bp, Mus musculus
gatgaaatggacagtacacttgctg

SEQ ID NO: 665907 - DNA, 25 bp, Mus musculus
gatgaaatggactgtacacttgctg

SEQ ID NO: 665908 - DNA, 25 bp, Mus musculus
gatgaaattcctaagctaccgcgta

SEQ ID NO: 665909 - DNA, 25 bp, Mus musculus
gatgaaattccttagctaccgcgta

SEQ ID NO: 665910 - DNA, 25 bp, Mus musculus
gatgaaattgatcaacagcgctgaa

SEQ ID NO: 665911 - DNA, 25 bp, Mus musculus
gatgaaattgatgaacagcgctgaa

SEQ ID NO: 665912 - DNA, 25 bp, Mus musculus
gatgaaattgctccccttccacggg

SEQ ID NO: 665913 - DNA, 25 bp, Mus musculus
gatgaaattgctgcccttccacggg

SEQ ID NO: 665914 - DNA, 25 bp, Mus musculus
gatgaaatttctattacgcctgtgc

SEQ ID NO: 665915 - DNA, 25 bp, Mus musculus
gatgaaatttcttttacgcctgtgc

SEQ ID NO: 665916 - DNA, 25 bp, Mus musculus
gatgaaattttcatagctgtcttac

SEQ ID NO: 665917 - DNA, 25 bp, Mus musculus
gatgaaattttcttagctgtcttac

SEQ ID NO: 665918 - DNA, 25 bp, Mus musculus
gatgaacaagcacccctggaagaac

SEQ ID NO: 665919 - DNA, 25 bp, Mus musculus
gatgaacaagcagccctggaagaac

SEQ ID NO: 665920 - DNA, 25 bp, Mus musculus
gatgaacaaggcacccacagtgggt

SEQ ID NO: 665921 - DNA, 25 bp, Mus musculus
gatgaacaaggctcccacagtgggt

SEQ ID NO: 665922 - DNA, 25 bp, Mus musculus
gatgaacaaggtcatggcccgattt

SEQ ID NO: 665923 - DNA, 25 bp, Mus musculus
gatgaacaaggtgatggcccgattt

SEQ ID NO: 665924 - DNA, 25 bp, Mus musculus
gatgaacaattaaagtggaaaccgc

SEQ ID NO: 665925 - DNA, 25 bp, Mus musculus
gatgaacaattatagtggaaaccgc

SEQ ID NO: 665926 - DNA, 25 bp, Mus musculus
gatgaacactttcaagtgcccaagc

SEQ ID NO: 665927 - DNA, 25 bp, Mus musculus
gatgaacactttgaagtgcccaagc

SEQ ID NO: 665928 - DNA, 25 bp, Mus musculus
gatgaacagcagctgaactcatggc

SEQ ID NO: 665929 - DNA, 25 bp, Mus musculus
gatgaacagcaggtgaactcatggc

SEQ ID NO: 665930 - DNA, 25 bp, Mus musculus
gatgaacatgaaccatgagcgcatc

SEQ ID NO: 665931 - DNA, 25 bp, Mus musculus
gatgaacatgaagcatgagcgcatc

SEQ ID NO: 665932 - DNA, 25 bp, Mus musculus
gatgaacattctaatacattccttc

SEQ ID NO: 665933 - DNA, 25 bp, Mus musculus
gatgaacattcttatacattccttc

SEQ ID NO: 665934 - DNA, 25 bp, Mus musculus
gatgaaccaatgacaacatttgttg

SEQ ID NO: 665935 - DNA, 25 bp, Mus musculus
gatgaaccaatgtcaacatttgttg

SEQ ID NO: 665936 - DNA, 25 bp, Mus musculus
gatgaaccacctagtcatggagatt

SEQ ID NO: 665937 - DNA, 25 bp, Mus musculus
gatgaaccaccttgtcatggagatt

SEQ ID NO: 665938 - DNA, 25 bp, Mus musculus
gatgaaccaggaacaagccatggcc

SEQ ID NO: 665939 - DNA, 25 bp, Mus musculus
gatgaaccaggatcaagccatggcc

SEQ ID NO: 665940 - DNA, 25 bp, Mus musculus
gatgaaccaggtaatgacctagatt

SEQ ID NO: 665941 - DNA, 25 bp, Mus musculus
gatgaaccaggttatgacctagatt

SEQ ID NO: 665942 - DNA, 25 bp, Mus musculus
gatgaacccagtcttcaacaacgaa

SEQ ID NO: 665943 - DNA, 25 bp, Mus musculus
gatgaacccagtgttcaacaacgaa

SEQ ID NO: 665944 - DNA, 25 bp, Mus musculus
gatgaacctcccacactcacaaagg

SEQ ID NO: 665945 - DNA, 25 bp, Mus musculus
gatgaacctccctcactcacaaagg

SEQ ID NO: 665946 - DNA, 25 bp, Mus musculus
gatgaacctcctccgagacaagagc

SEQ ID NO: 665947 - DNA, 25 bp, Mus musculus
gatgaacctcctgcgagacaagagc

SEQ ID NO: 665948 - DNA, 25 bp, Mus musculus
gatgaacgaaatcgagactgctcag

SEQ ID NO: 665949 - DNA, 25 bp, Mus musculus
gatgaacgaaatggagactgctcag

SEQ ID NO: 665950 - DNA, 25 bp, Mus musculus
gatgaacgacttcagcctctgctca

SEQ ID NO: 665951 - DNA, 25 bp, Mus musculus
gatgaacgacttgagcctctgctca

SEQ ID NO: 665952 - DNA, 25 bp, Mus musculus
gatgaacgcctaccctaagattttt

SEQ ID NO: 665953 - DNA, 25 bp, Mus musculus
gatgaacgcctagcctaagattttt

SEQ ID NO: 665954 - DNA, 25 bp, Mus musculus
gatgaacgctctacacatgctggac

SEQ ID NO: 665955 - DNA, 25 bp, Mus musculus
gatgaacgctcttcacatgctggac

SEQ ID NO: 665956 - DNA, 25 bp, Mus musculus
gatgaactagcaaccatgcagaaga

SEQ ID NO: 665957 - DNA, 25 bp, Mus musculus
gatgaactagcatccatgcagaaga

SEQ ID NO: 665958 - DNA, 25 bp, Mus musculus
gatgaactatatccaggtgacaccg

SEQ ID NO: 665959 - DNA, 25 bp, Mus musculus
gatgaactatatgcaggtgacaccg

SEQ ID NO: 665960 - DNA, 25 bp, Mus musculus
gatgaactcacaccttttgatatga

SEQ ID NO: 665961 - DNA, 25 bp, Mus musculus
gatgaactcacagcttttgatatga

SEQ ID NO: 665962 - DNA, 25 bp, Mus musculus
gatgaactcagcaggatcatcgagc

SEQ ID NO: 665963 - DNA, 25 bp, Mus musculus
gatgaactcagctggatcatcgagc

SEQ ID NO: 665964 - DNA, 25 bp, Mus musculus
gatgaactctatctttaagggtata

SEQ ID NO: 665965 - DNA, 25 bp, Mus musculus
gatgaactctatgtttaagggtata

SEQ ID NO: 665966 - DNA, 25 bp, Mus musculus
gatgaactgacaagaggaccccttt

SEQ ID NO: 665967 - DNA, 25 bp, Mus musculus
gatgaactgacatgaggaccccttt

SEQ ID NO: 665968 - DNA, 25 bp, Mus musculus
gatgaactgcgacccatggcccgaa

SEQ ID NO: 665969 - DNA, 25 bp, Mus musculus
gatgaactgcgagccatggcccgaa

SEQ ID NO: 665970 - DNA, 25 bp, Mus musculus
gatgaactgctaagcgagaagcccg

SEQ ID NO: 665971 - DNA, 25 bp, Mus musculus
gatgaactgctatgcgagaagcccg

SEQ ID NO: 665972 - DNA, 25 bp, Mus musculus
gatgaactggacaaatactccgagg

SEQ ID NO: 665973 - DNA, 25 bp, Mus musculus
gatgaactggacctcaagttgcgcc

SEQ ID NO: 665974 - DNA, 25 bp, Mus musculus
gatgaactggacgtcaagttgcgcc

SEQ ID NO: 665975 - DNA, 25 bp, Mus musculus
gatgaactggactaatactccgagg

SEQ ID NO: 665976 - DNA, 25 bp, Mus musculus
gatgaactggtaaaaagcatgaatt

SEQ ID NO: 665977 - DNA, 25 bp, Mus musculus
gatgaactggtataaagcatgaatt

SEQ ID NO: 665978 - DNA, 25 bp, Mus musculus
gatgaactgtgaacttctagccacg

SEQ ID NO: 665979 - DNA, 25 bp, Mus musculus
gatgaactgtgatcttctagccacg

SEQ ID NO: 665980 - DNA, 25 bp, Mus musculus
gatgaacttcacatgggccagatag

SEQ ID NO: 665981 - DNA, 25 bp, Mus musculus
gatgaacttcacttgggccagatag

SEQ ID NO: 665982 - DNA, 25 bp, Mus musculus
gatgaacttcatatccactctgatg

SEQ ID NO: 665983 - DNA, 25 bp, Mus musculus
gatgaacttcatttccactctgatg

SEQ ID NO: 665984 - DNA, 25 bp, Mus musculus
gatgaactttgtatcctctagagcg

SEQ ID NO: 665985 - DNA, 25 bp, Mus musculus
gatgaactttgtttcctctagagcg

SEQ ID NO: 665986 - DNA, 25 bp, Mus musculus
gatgaagaaacaagttctgtgggcc

SEQ ID NO: 665987 - DNA, 25 bp, Mus musculus
gatgaagaaacatgttctgtgggcc

SEQ ID NO: 665988 - DNA, 25 bp, Mus musculus
gatgaagaaactagcaaaagtgtct

SEQ ID NO: 665989 - DNA, 25 bp, Mus musculus
gatgaagaaacttgcaaaagtgtct

SEQ ID NO: 665990 - DNA, 25 bp, Mus musculus
gatgaagaagaacattaacatggag

SEQ ID NO: 665991 - DNA, 25 bp, Mus musculus
gatgaagaagaagattaacatggag

SEQ ID NO: 665992 - DNA, 25 bp, Mus musculus
gatgaagaaggacttcactctggag

SEQ ID NO: 665993 - DNA, 25 bp, Mus musculus
gatgaagaaggagttcactctggag

SEQ ID NO: 665994 - DNA, 25 bp, Mus musculus
gatgaagaatgaagtggctgccctc

SEQ ID NO: 665995 - DNA, 25 bp, Mus musculus
gatgaagaatgatgtggctgccctc

SEQ ID NO: 665996 - DNA, 25 bp, Mus musculus
gatgaagaatggacaagatgctgcc

SEQ ID NO: 665997 - DNA, 25 bp, Mus musculus
gatgaagaatggtcaagatgctgcc

SEQ ID NO: 665998 - DNA, 25 bp, Mus musculus
gatgaagaattacaccccatggacc

SEQ ID NO: 665999 - DNA, 25 bp, Mus musculus
gatgaagaattagaccccatggacc

SEQ ID NO: 666000 - DNA, 25 bp, Mus musculus
gatgaagacagaccggccaaggccc

SEQ ID NO: 666001 - DNA, 25 bp, Mus musculus
gatgaagacagagcggccaaggccc

SEQ ID NO: 666002 - DNA, 25 bp, Mus musculus
gatgaagaccgtcctaacgtgcagc

SEQ ID NO: 666003 - DNA, 25 bp, Mus musculus
gatgaagaccgtgctaacgtgcagc

SEQ ID NO: 666004 - DNA, 25 bp, Mus musculus
gatgaagaccttagggcatctagct

SEQ ID NO: 666005 - DNA, 25 bp, Mus musculus
gatgaagacctttgggcatctagct

SEQ ID NO: 666006 - DNA, 25 bp, Mus musculus
gatgaagactgaactttctcctcgg

SEQ ID NO: 666007 - DNA, 25 bp, Mus musculus
gatgaagactgatctttctcctcgg

SEQ ID NO: 666008 - DNA, 25 bp, Mus musculus
gatgaagactgtcggcccaccaggt

SEQ ID NO: 666009 - DNA, 25 bp, Mus musculus
gatgaagactgtgggcccaccaggt

SEQ ID NO: 666010 - DNA, 25 bp, Mus musculus
gatgaagagacccatcaggagacct

SEQ ID NO: 666011 - DNA, 25 bp, Mus musculus
gatgaagagaccgatcaggagacct

SEQ ID NO: 666012 - DNA, 25 bp, Mus musculus
gatgaagagaggctatgacaaccct

SEQ ID NO: 666013 - DNA, 25 bp, Mus musculus
gatgaagagagggtatgacaaccct

SEQ ID NO: 666014 - DNA, 25 bp, Mus musculus
gatgaagaggatagccggagcatct

SEQ ID NO: 666015 - DNA, 25 bp, Mus musculus
gatgaagaggattgccggagcatct

SEQ ID NO: 666016 - DNA, 25 bp, Mus musculus
gatgaagaggccagatctgccctca

SEQ ID NO: 666017 - DNA, 25 bp, Mus musculus
gatgaagaggcctgatctgccctca

SEQ ID NO: 666018 - DNA, 25 bp, Mus musculus
gatgaagaggctatggagcagatcc

SEQ ID NO: 666019 - DNA, 25 bp, Mus musculus
gatgaagaggctttggagcagatcc

SEQ ID NO: 666020 - DNA, 25 bp, Mus musculus
gatgaagagtccaatagcctcctaa

SEQ ID NO: 666021 - DNA, 25 bp, Mus musculus
gatgaagagtcctatagcctcctaa

SEQ ID NO: 666022 - DNA, 25 bp, Mus musculus
gatgaagataaacgattttggtgcc

SEQ ID NO: 666023 - DNA, 25 bp, Mus musculus
gatgaagataaaggattttggtgcc

SEQ ID NO: 666024 - DNA, 25 bp, Mus musculus
gatgaagatagtataaccaagcagc

SEQ ID NO: 666025 - DNA, 25 bp, Mus musculus
gatgaagatagtttaaccaagcagc

SEQ ID NO: 666026 - DNA, 25 bp, Mus musculus
gatgaagatgaaatccggcctgtgc

SEQ ID NO: 666027 - DNA, 25 bp, Mus musculus
gatgaagatgaattccggcctgtgc

SEQ ID NO: 666028 - DNA, 25 bp, Mus musculus
gatgaagatgaccacgacgaacaag

SEQ ID NO: 666029 - DNA, 25 bp, Mus musculus
gatgaagatgacgacgacgaacaag

SEQ ID NO: 666030 - DNA, 25 bp, Mus musculus
gatgaagatgagactgcctactcgc

SEQ ID NO: 666031 - DNA, 25 bp, Mus musculus
gatgaagatgagctcctcttggcct

SEQ ID NO: 666032 - DNA, 25 bp, Mus musculus
gatgaagatgaggtcctcttggcct

SEQ ID NO: 666033 - DNA, 25 bp, Mus musculus
gatgaagatgagtctgcctactcgc

SEQ ID NO: 666034 - DNA, 25 bp, Mus musculus
gatgaagatgggaagctgatgtcct

SEQ ID NO: 666035 - DNA, 25 bp, Mus musculus
gatgaagatgggtagctgatgtcct

SEQ ID NO: 666036 - DNA, 25 bp, Mus musculus
gatgaagatgtcagttatcctcggc

SEQ ID NO: 666037 - DNA, 25 bp, Mus musculus
gatgaagatgtctgttatcctcggc

SEQ ID NO: 666038 - DNA, 25 bp, Mus musculus
gatgaagatgtgcctctggtttcct

SEQ ID NO: 666039 - DNA, 25 bp, Mus musculus
gatgaagatgtggctctggtttcct

SEQ ID NO: 666040 - DNA, 25 bp, Mus musculus
gatgaagatgttcgcattaactaca

SEQ ID NO: 666041 - DNA, 25 bp, Mus musculus
gatgaagatgttggcattaactaca

SEQ ID NO: 666042 - DNA, 25 bp, Mus musculus
gatgaagattgtcactcccctggac

SEQ ID NO: 666043 - DNA, 25 bp, Mus musculus
gatgaagattgtccgagttgcactg

SEQ ID NO: 666044 - DNA, 25 bp, Mus musculus
gatgaagattgtgactcccctggac

SEQ ID NO: 666045 - DNA, 25 bp, Mus musculus
gatgaagattgtgcgagttgcactg

SEQ ID NO: 666046 - DNA, 25 bp, Mus musculus
gatgaagatttacacgtcaagcacc

SEQ ID NO: 666047 - DNA, 25 bp, Mus musculus
gatgaagatttagacgtcaagcacc

SEQ ID NO: 666048 - DNA, 25 bp, Mus musculus
gatgaagatttcctcccattagatg

SEQ ID NO: 666049 - DNA, 25 bp, Mus musculus
gatgaagatttcgtcccattagatg

SEQ ID NO: 666050 - DNA, 25 bp, Mus musculus
gatgaagcaataatggctgccctgg

SEQ ID NO: 666051 - DNA, 25 bp, Mus musculus
gatgaagcaatattggctgccctgg

SEQ ID NO: 666052 - DNA, 25 bp, Mus musculus
gatgaagcagtcatgcagcaaaagc

SEQ ID NO: 666053 - DNA, 25 bp, Mus musculus
gatgaagcagtcttgcagcaaaagc

SEQ ID NO: 666054 - DNA, 25 bp, Mus musculus
gatgaagccacaaggaacccagttt

SEQ ID NO: 666055 - DNA, 25 bp, Mus musculus
gatgaagccacatggaacccagttt

SEQ ID NO: 666056 - DNA, 25 bp, Mus musculus
gatgaagcccataatatagtcaaag

SEQ ID NO: 666057 - DNA, 25 bp, Mus musculus
gatgaagcccattatatagtcaaag

SEQ ID NO: 666058 - DNA, 25 bp, Mus musculus
gatgaagccgctactctacatcccg

SEQ ID NO: 666059 - DNA, 25 bp, Mus musculus
gatgaagccgcttctctacatcccg

SEQ ID NO: 666060 - DNA, 25 bp, Mus musculus
gatgaagcctacagcagccttgcag

SEQ ID NO: 666061 - DNA, 25 bp, Mus musculus
gatgaagcctactgcagccttgcag

SEQ ID NO: 666062 - DNA, 25 bp, Mus musculus
gatgaagccttaactaaatcagtgc

SEQ ID NO: 666063 - DNA, 25 bp, Mus musculus
gatgaagccttatctaaatcagtgc

SEQ ID NO: 666064 - DNA, 25 bp, Mus musculus
gatgaagctcttcaaagactccagg

SEQ ID NO: 666065 - DNA, 25 bp, Mus musculus
gatgaagctcttgaaagactccagg

SEQ ID NO: 666066 - DNA, 25 bp, Mus musculus
gatgaagctgccagtagctttgctg

SEQ ID NO: 666067 - DNA, 25 bp, Mus musculus
gatgaagctgcctgtagctttgctg

SEQ ID NO: 666068 - DNA, 25 bp, Mus musculus
gatgaagctgtcactcgaggctgtg

SEQ ID NO: 666069 - DNA, 25 bp, Mus musculus
gatgaagctgtctctcgaggctgtg

SEQ ID NO: 666070 - DNA, 25 bp, Mus musculus
gatgaagcttccacactagggactg

SEQ ID NO: 666071 - DNA, 25 bp, Mus musculus
gatgaagcttcctcactagggactg

SEQ ID NO: 666072 - DNA, 25 bp, Mus musculus
gatgaaggaaaacactgctctgatc

SEQ ID NO: 666073 - DNA, 25 bp, Mus musculus
gatgaaggaaaagactgctctgatc

SEQ ID NO: 666074 - DNA, 25 bp, Mus musculus
gatgaaggacctactgagtaccaga

SEQ ID NO: 666075 - DNA, 25 bp, Mus musculus
gatgaaggaccttctgagtaccaga

SEQ ID NO: 666076 - DNA, 25 bp, Mus musculus
gatgaaggcctgatcagctaccctg

SEQ ID NO: 666077 - DNA, 25 bp, Mus musculus
gatgaaggcctgttcagctaccctg

SEQ ID NO: 666078 - DNA, 25 bp, Mus musculus
gatgaaggccttcgaaaataatgaa

SEQ ID NO: 666079 - DNA, 25 bp, Mus musculus
gatgaaggccttggaaaataatgaa

SEQ ID NO: 666080 - DNA, 25 bp, Mus musculus
gatgaaggctatctaccataccctg

SEQ ID NO: 666081 - DNA, 25 bp, Mus musculus
gatgaaggctatgtaccataccctg

SEQ ID NO: 666082 - DNA, 25 bp, Mus musculus
gatgaagggcccaggcatgcagaat

SEQ ID NO: 666083 - DNA, 25 bp, Mus musculus
gatgaagggccctggcatgcagaat

SEQ ID NO: 666084 - DNA, 25 bp, Mus musculus
gatgaaggtcaaatatatgcttggg

SEQ ID NO: 666085 - DNA, 25 bp, Mus musculus
gatgaaggtcaattatatgcttggg

SEQ ID NO: 666086 - DNA, 25 bp, Mus musculus
gatgaaggtcagagggcagtcctcc

SEQ ID NO: 666087 - DNA, 25 bp, Mus musculus
gatgaaggtcagtgggcagtcctcc

SEQ ID NO: 666088 - DNA, 25 bp, Mus musculus
gatgaaggtcttctcccaaataaat

SEQ ID NO: 666089 - DNA, 25 bp, Mus musculus
gatgaaggtcttgtcccaaataaat

SEQ ID NO: 666090 - DNA, 25 bp, Mus musculus
gatgaaggtgtaaggaagtatgaac

SEQ ID NO: 666091 - DNA, 25 bp, Mus musculus
gatgaaggtgtatggaagtatgaac

SEQ ID NO: 666092 - DNA, 25 bp, Mus musculus
gatgaagtaagtccctgtgtcattg

SEQ ID NO: 666093 - DNA, 25 bp, Mus musculus
gatgaagtaagtgcctgtgtcattg

SEQ ID NO: 666094 - DNA, 25 bp, Mus musculus
gatgaagtaattcaatggttggcca

SEQ ID NO: 666095 - DNA, 25 bp, Mus musculus
gatgaagtaattgaatggttggcca

SEQ ID NO: 666096 - DNA, 25 bp, Mus musculus
gatgaagtacgacgacgccatccag

SEQ ID NO: 666097 - DNA, 25 bp, Mus musculus
gatgaagtacgaggacgccatccag

SEQ ID NO: 666098 - DNA, 25 bp, Mus musculus
gatgaagtcaacagattgtcagctc

SEQ ID NO: 666099 - DNA, 25 bp, Mus musculus
gatgaagtcaactgattgtcagctc

SEQ ID NO: 666100 - DNA, 25 bp, Mus musculus
gatgaagtcatcatctcctatgtgc

SEQ ID NO: 666101 - DNA, 25 bp, Mus musculus
gatgaagtcatcttctcctatgtgc

SEQ ID NO: 666102 - DNA, 25 bp, Mus musculus
gatgaagtcattcaatatgacggcg

SEQ ID NO: 666103 - DNA, 25 bp, Mus musculus
gatgaagtcattgaatatgacggcg

SEQ ID NO: 666104 - DNA, 25 bp, Mus musculus
gatgaagtgagtcttccctgcccat

SEQ ID NO: 666105 - DNA, 25 bp, Mus musculus
gatgaagtgagtgttccctgcccat

SEQ ID NO: 666106 - DNA, 25 bp, Mus musculus
gatgaagtgcgtcttggtggccacc

SEQ ID NO: 666107 - DNA, 25 bp, Mus musculus
gatgaagtgcgtgttggtggccacc

SEQ ID NO: 666108 - DNA, 25 bp, Mus musculus
gatgaagtggaaaagtccagcagcg

SEQ ID NO: 666109 - DNA, 25 bp, Mus musculus
gatgaagtggaatagtccagcagcg

SEQ ID NO: 666110 - DNA, 25 bp, Mus musculus
gatgaagtgtccacttgctggtaca

SEQ ID NO: 666111 - DNA, 25 bp, Mus musculus
gatgaagtgtcctcttgctggtaca

SEQ ID NO: 666112 - DNA, 25 bp, Mus musculus
gatgaagttcatctacaccagtcag

SEQ ID NO: 666113 - DNA, 25 bp, Mus musculus
gatgaagttcatgtacaccagtcag

SEQ ID NO: 666114 - DNA, 25 bp, Mus musculus
gatgaagttcccaatctgagttcct

SEQ ID NO: 666115 - DNA, 25 bp, Mus musculus
gatgaagttccctatctgagttcct

SEQ ID NO: 666116 - DNA, 25 bp, Mus musculus
gatgaagttcgcattttgatggcaa

SEQ ID NO: 666117 - DNA, 25 bp, Mus musculus
gatgaagttcgctttttgatggcaa

SEQ ID NO: 666118 - DNA, 25 bp, Mus musculus
gatgaagttgaacgactaaaacgct

SEQ ID NO: 666119 - DNA, 25 bp, Mus musculus
gatgaagttgaaggactaaaacgct

SEQ ID NO: 666120 - DNA, 25 bp, Mus musculus
gatgaagttttccttggcaatctcc

SEQ ID NO: 666121 - DNA, 25 bp, Mus musculus
gatgaagttttcgttggcaatctcc

SEQ ID NO: 666122 - DNA, 25 bp, Mus musculus
gatgaataaggactcctcccgttcc

SEQ ID NO: 666123 - DNA, 25 bp, Mus musculus
gatgaataaggagtcctcccgttcc

SEQ ID NO: 666124 - DNA, 25 bp, Mus musculus
gatgaataccaaccaactgacctca

SEQ ID NO: 666125 - DNA, 25 bp, Mus musculus
gatgaataccaagcaactgacctca

SEQ ID NO: 666126 - DNA, 25 bp, Mus musculus
gatgaataccacaaggatcattaag

SEQ ID NO: 666127 - DNA, 25 bp, Mus musculus
gatgaataccactaggatcattaag

SEQ ID NO: 666128 - DNA, 25 bp, Mus musculus
gatgaatatccacgtagtatctcta

SEQ ID NO: 666129 - DNA, 25 bp, Mus musculus
gatgaatatccaggtagtatctcta

SEQ ID NO: 666130 - DNA, 25 bp, Mus musculus
gatgaatccagcaaagatggaccaa

SEQ ID NO: 666131 - DNA, 25 bp, Mus musculus
gatgaatccagctaagatggaccaa

SEQ ID NO: 666132 - DNA, 25 bp, Mus musculus
gatgaatcccacaccttcaccatga

SEQ ID NO: 666133 - DNA, 25 bp, Mus musculus
gatgaatcccactccttcaccatga

SEQ ID NO: 666134 - DNA, 25 bp, Mus musculus
gatgaatcctcactggcgtctgcag

SEQ ID NO: 666135 - DNA, 25 bp, Mus musculus
gatgaatcctcagtggcgtctgcag

SEQ ID NO: 666136 - DNA, 25 bp, Mus musculus
gatgaatctgatagggcactcccat

SEQ ID NO: 666137 - DNA, 25 bp, Mus musculus
gatgaatctgattgggcactcccat

SEQ ID NO: 666138 - DNA, 25 bp, Mus musculus
gatgaatgagcacgctactctagga

SEQ ID NO: 666139 - DNA, 25 bp, Mus musculus
gatgaatgagcaggctactctagga

SEQ ID NO: 666140 - DNA, 25 bp, Mus musculus
gatgaatgagccagttcacctaacg

SEQ ID NO: 666141 - DNA, 25 bp, Mus musculus
gatgaatgagcctgttcacctaacg

SEQ ID NO: 666142 - DNA, 25 bp, Mus musculus
gatgaatgcgcgaagtgaactgtac

SEQ ID NO: 666143 - DNA, 25 bp, Mus musculus
gatgaatgcgcgtagtgaactgtac

SEQ ID NO: 666144 - DNA, 25 bp, Mus musculus
gatgaatgtagcagacacgctgcct

SEQ ID NO: 666145 - DNA, 25 bp, Mus musculus
gatgaatgtagcatgaacaacggca

SEQ ID NO: 666146 - DNA, 25 bp, Mus musculus
gatgaatgtagctgacacgctgcct

SEQ ID NO: 666147 - DNA, 25 bp, Mus musculus
gatgaatgtagcttgaacaacggca

SEQ ID NO: 666148 - DNA, 25 bp, Mus musculus
gatgaattactaaagcatgactctg

SEQ ID NO: 666149 - DNA, 25 bp, Mus musculus
gatgaattactatagcatgactctg

SEQ ID NO: 666150 - DNA, 25 bp, Mus musculus
gatgaattccagattgtcagtagtt

SEQ ID NO: 666151 - DNA, 25 bp, Mus musculus
gatgaattccagtttgtcagtagtt

SEQ ID NO: 666152 - DNA, 25 bp, Mus musculus
gatgaattccatcaaagtggctcgt

SEQ ID NO: 666153 - DNA, 25 bp, Mus musculus
gatgaattccatgaaagtggctcgt

SEQ ID NO: 666154 - DNA, 25 bp, Mus musculus
gatgaattctctcgcgtgaggctgc

SEQ ID NO: 666155 - DNA, 25 bp, Mus musculus
gatgaattctctggcgtgaggctgc

SEQ ID NO: 666156 - DNA, 25 bp, Mus musculus
gatgacaaaagtccgcggttaccca

SEQ ID NO: 666157 - DNA, 25 bp, Mus musculus
gatgacaaaagtgcgcggttaccca

SEQ ID NO: 666158 - DNA, 25 bp, Mus musculus
gatgacaaacgccacagagacattt

SEQ ID NO: 666159 - DNA, 25 bp, Mus musculus
gatgacaaacgcgacagagacattt

SEQ ID NO: 666160 - DNA, 25 bp, Mus musculus
gatgacaaagagagacgatgatgtc

SEQ ID NO: 666161 - DNA, 25 bp, Mus musculus
gatgacaaagagtgacgatgatgtc

SEQ ID NO: 666162 - DNA, 25 bp, Mus musculus
gatgacaaagatctgcttcgagatg

SEQ ID NO: 666163 - DNA, 25 bp, Mus musculus
gatgacaaagatgtgcttcgagatg

SEQ ID NO: 666164 - DNA, 25 bp, Mus musculus
gatgacaaagtcactagaaaccaag

SEQ ID NO: 666165 - DNA, 25 bp, Mus musculus
gatgacaaagtctctagaaaccaag

SEQ ID NO: 666166 - DNA, 25 bp, Mus musculus
gatgacaacaggagtcttcgacgtc

SEQ ID NO: 666167 - DNA, 25 bp, Mus musculus
gatgacaacaggtgtcttcgacgtc

SEQ ID NO: 666168 - DNA, 25 bp, Mus musculus
gatgacaacccgatcagcttccagt

SEQ ID NO: 666169 - DNA, 25 bp, Mus musculus
gatgacaacccgttcagcttccagt

SEQ ID NO: 666170 - DNA, 25 bp, Mus musculus
gatgacaacgacaagatccccgatg

SEQ ID NO: 666171 - DNA, 25 bp, Mus musculus
gatgacaacgactagatccccgatg

SEQ ID NO: 666172 - DNA, 25 bp, Mus musculus
gatgacaagtggcaaaagaaatgcc

SEQ ID NO: 666173 - DNA, 25 bp, Mus musculus
gatgacaagtgggaaaagaaatgcc

SEQ ID NO: 666174 - DNA, 25 bp, Mus musculus
gatgacacaattctcatctgggact

SEQ ID NO: 666175 - DNA, 25 bp, Mus musculus
gatgacacaattgtcatctgggact

SEQ ID NO: 666176 - DNA, 25 bp, Mus musculus
gatgacacagagaccagtgaagcca

SEQ ID NO: 666177 - DNA, 25 bp, Mus musculus
gatgacacagagtccagtgaagcca

SEQ ID NO: 666178 - DNA, 25 bp, Mus musculus
gatgacacagatctgcagatcttct

SEQ ID NO: 666179 - DNA, 25 bp, Mus musculus
gatgacacagatgtgcagatcttct

SEQ ID NO: 666180 - DNA, 25 bp, Mus musculus
gatgacacagccctcagtgagagtg

SEQ ID NO: 666181 - DNA, 25 bp, Mus musculus
gatgacacagccgtcagtgagagtg

SEQ ID NO: 666182 - DNA, 25 bp, Mus musculus
gatgacaccaaacttctctgcagga

SEQ ID NO: 666183 - DNA, 25 bp, Mus musculus
gatgacaccaaagttctctgcagga

SEQ ID NO: 666184 - DNA, 25 bp, Mus musculus
gatgacacctcgctcacctgagtga

SEQ ID NO: 666185 - DNA, 25 bp, Mus musculus
gatgacacctcggtcacctgagtga

SEQ ID NO: 666186 - DNA, 25 bp, Mus musculus
gatgacacggagaaaaaagatgagc

SEQ ID NO: 666187 - DNA, 25 bp, Mus musculus
gatgacacggagtaaaaagatgagc

SEQ ID NO: 666188 - DNA, 25 bp, Mus musculus
gatgacacggcgcaacacttacgtt

SEQ ID NO: 666189 - DNA, 25 bp, Mus musculus
gatgacacggcggaacacttacgtt

SEQ ID NO: 666190 - DNA, 25 bp, Mus musculus
gatgacactgttcactgcttcaggg

SEQ ID NO: 666191 - DNA, 25 bp, Mus musculus
gatgacactgttgactgcttcaggg

SEQ ID NO: 666192 - DNA, 25 bp, Mus musculus
gatgacacttggatctagaatctta

SEQ ID NO: 666193 - DNA, 25 bp, Mus musculus
gatgacacttggttctagaatctta

SEQ ID NO: 666194 - DNA, 25 bp, Mus musculus
gatgacagaatactaccactatata

SEQ ID NO: 666195 - DNA, 25 bp, Mus musculus
gatgacagaatagtaccactatata

SEQ ID NO: 666196 - DNA, 25 bp, Mus musculus
gatgacagaatcaggagaaagatgc

SEQ ID NO: 666197 - DNA, 25 bp, Mus musculus
gatgacagaatctggagaaagatgc

SEQ ID NO: 666198 - DNA, 25 bp, Mus musculus
gatgacagactgcttaacagaaaac

SEQ ID NO: 666199 - DNA, 25 bp, Mus musculus
gatgacagactggttaacagaaaac

SEQ ID NO: 666200 - DNA, 25 bp, Mus musculus
gatgacagagaacatcttttcgcag

SEQ ID NO: 666201 - DNA, 25 bp, Mus musculus
gatgacagagaagatcttttcgcag

SEQ ID NO: 666202 - DNA, 25 bp, Mus musculus
gatgacagagccagatctaggacag

SEQ ID NO: 666203 - DNA, 25 bp, Mus musculus
gatgacagagcctgatctaggacag

SEQ ID NO: 666204 - DNA, 25 bp, Mus musculus
gatgacagatgtcctcgtgtttctc

SEQ ID NO: 666205 - DNA, 25 bp, Mus musculus
gatgacagatgtgctcgtgtttctc

SEQ ID NO: 666206 - DNA, 25 bp, Mus musculus
gatgacagcaacagaacaatggatt

SEQ ID NO: 666207 - DNA, 25 bp, Mus musculus
gatgacagcaactgaacaatggatt

SEQ ID NO: 666208 - DNA, 25 bp, Mus musculus
gatgacagcaagctagaggcgctct

SEQ ID NO: 666209 - DNA, 25 bp, Mus musculus
gatgacagcaaggtagaggcgctct

SEQ ID NO: 666210 - DNA, 25 bp, Mus musculus
gatgacagcaatatccacatggatt

SEQ ID NO: 666211 - DNA, 25 bp, Mus musculus
gatgacagcaatttccacatggatt

SEQ ID NO: 666212 - DNA, 25 bp, Mus musculus
gatgacagcctgagccgaatctgca

SEQ ID NO: 666213 - DNA, 25 bp, Mus musculus
gatgacagcctgtgccgaatctgca

SEQ ID NO: 666214 - DNA, 25 bp, Mus musculus
gatgacagcgagagctcgggagcca

SEQ ID NO: 666215 - DNA, 25 bp, Mus musculus
gatgacagcgagtgctcgggagcca

SEQ ID NO: 666216 - DNA, 25 bp, Mus musculus
gatgacagcttacatcacagaactg

SEQ ID NO: 666217 - DNA, 25 bp, Mus musculus
gatgacagcttagatcacagaactg

SEQ ID NO: 666218 - DNA, 25 bp, Mus musculus
gatgacaggaacacccatggtggct

SEQ ID NO: 666219 - DNA, 25 bp, Mus musculus
gatgacaggaactcccatggtggct

SEQ ID NO: 666220 - DNA, 25 bp, Mus musculus
gatgacaggataagtggtaacccgg

SEQ ID NO: 666221 - DNA, 25 bp, Mus musculus
gatgacaggatatgtggtaacccgg

SEQ ID NO: 666222 - DNA, 25 bp, Mus musculus
gatgacaggcaaaacagcactgttg

SEQ ID NO: 666223 - DNA, 25 bp, Mus musculus
gatgacaggcaatacagcactgttg

SEQ ID NO: 666224 - DNA, 25 bp, Mus musculus
gatgacaggccacatgagcatgacc

SEQ ID NO: 666225 - DNA, 25 bp, Mus musculus
gatgacaggccagatgagcatgacc

SEQ ID NO: 666226 - DNA, 25 bp, Mus musculus
gatgacaggtcaatcagaagtgttc

SEQ ID NO: 666227 - DNA, 25 bp, Mus musculus
gatgacaggtcattcagaagtgttc

SEQ ID NO: 666228 - DNA, 25 bp, Mus musculus
gatgacagtaagacggaaaccagct

SEQ ID NO: 666229 - DNA, 25 bp, Mus musculus
gatgacagtaagtcggaaaccagct

SEQ ID NO: 666230 - DNA, 25 bp, Mus musculus
gatgacagtaatagcagggaatcct

SEQ ID NO: 666231 - DNA, 25 bp, Mus musculus
gatgacagtaattgcagggaatcct

SEQ ID NO: 666232 - DNA, 25 bp, Mus musculus
gatgacagtgaaatagacttttcag

SEQ ID NO: 666233 - DNA, 25 bp, Mus musculus
gatgacagtgaattagacttttcag

SEQ ID NO: 666234 - DNA, 25 bp, Mus musculus
gatgacagtgacctccacatgagct

SEQ ID NO: 666235 - DNA, 25 bp, Mus musculus
gatgacagtgacgtccacatgagct

SEQ ID NO: 666236 - DNA, 25 bp, Mus musculus
gatgacagtgccactatctgccgtg

SEQ ID NO: 666237 - DNA, 25 bp, Mus musculus
gatgacagtgcctctatctgccgtg

SEQ ID NO: 666238 - DNA, 25 bp, Mus musculus
gatgacagtgctcagcttcccagga

SEQ ID NO: 666239 - DNA, 25 bp, Mus musculus
gatgacagtgctgagcttcccagga

SEQ ID NO: 666240 - DNA, 25 bp, Mus musculus
gatgacatcatactccactcctggc

SEQ ID NO: 666241 - DNA, 25 bp, Mus musculus
gatgacatcatagtccactcctggc

SEQ ID NO: 666242 - DNA, 25 bp, Mus musculus
gatgacatcctcagtcctgactgtg

SEQ ID NO: 666243 - DNA, 25 bp, Mus musculus
gatgacatcctctgtcctgactgtg

SEQ ID NO: 666244 - DNA, 25 bp, Mus musculus
gatgacatctcgcaatgtgtagact

SEQ ID NO: 666245 - DNA, 25 bp, Mus musculus
gatgacatctcggaatgtgtagact

SEQ ID NO: 666246 - DNA, 25 bp, Mus musculus
gatgacatctctattacctggcgct

SEQ ID NO: 666247 - DNA, 25 bp, Mus musculus
gatgacatctcttttacctggcgct

SEQ ID NO: 666248 - DNA, 25 bp, Mus musculus
gatgacatctgcattctgaatcatg

SEQ ID NO: 666249 - DNA, 25 bp, Mus musculus
gatgacatctgctttctgaatcatg

SEQ ID NO: 666250 - DNA, 25 bp, Mus musculus
gatgacatctgtcaaggactgggca

SEQ ID NO: 666251 - DNA, 25 bp, Mus musculus
gatgacatctgtgaaggactgggca

SEQ ID NO: 666252 - DNA, 25 bp, Mus musculus
gatgacatggacatcctcacaaggc

SEQ ID NO: 666253 - DNA, 25 bp, Mus musculus
gatgacatggacttcctcacaaggc

SEQ ID NO: 666254 - DNA, 25 bp, Mus musculus
gatgacattaacaaaaaggcttttg

SEQ ID NO: 666255 - DNA, 25 bp, Mus musculus
gatgacattaactaaaaggcttttg

SEQ ID NO: 666256 - DNA, 25 bp, Mus musculus
gatgacattccacatctctcagcca

SEQ ID NO: 666257 - DNA, 25 bp, Mus musculus
gatgacattccaccactccatgagc

SEQ ID NO: 666258 - DNA, 25 bp, Mus musculus
gatgacattccagatctctcagcca

SEQ ID NO: 666259 - DNA, 25 bp, Mus musculus
gatgacattccagcactccatgagc

SEQ ID NO: 666260 - DNA, 25 bp, Mus musculus
gatgacattcccatgtttgatgact

SEQ ID NO: 666261 - DNA, 25 bp, Mus musculus
gatgacattcccttgtttgatgact

SEQ ID NO: 666262 - DNA, 25 bp, Mus musculus
gatgacattcctacttcaaccaaga

SEQ ID NO: 666263 - DNA, 25 bp, Mus musculus
gatgacattccttcttcaaccaaga

SEQ ID NO: 666264 - DNA, 25 bp, Mus musculus
gatgacattcggcactttgtgcgtc

SEQ ID NO: 666265 - DNA, 25 bp, Mus musculus
gatgacattcgggactttgtgcgtc

SEQ ID NO: 666266 - DNA, 25 bp, Mus musculus
gatgacattctgattgaggacacag

SEQ ID NO: 666267 - DNA, 25 bp, Mus musculus
gatgacattctgtttgaggacacag

SEQ ID NO: 666268 - DNA, 25 bp, Mus musculus
gatgacattgatcctgatgtgctgc

SEQ ID NO: 666269 - DNA, 25 bp, Mus musculus
gatgacattgatgctgatgtgctgc

SEQ ID NO: 666270 - DNA, 25 bp, Mus musculus
gatgacatttttcaccttccaggaa

SEQ ID NO: 666271 - DNA, 25 bp, Mus musculus
gatgacatttttgaccttccaggaa

SEQ ID NO: 666272 - DNA, 25 bp, Mus musculus
gatgaccacactcccacagaagatt

SEQ ID NO: 666273 - DNA, 25 bp, Mus musculus
gatgaccacactgccacagaagatt

SEQ ID NO: 666274 - DNA, 25 bp, Mus musculus
gatgaccactacagcctacagagca

SEQ ID NO: 666275 - DNA, 25 bp, Mus musculus
gatgaccactactgcctacagagca

SEQ ID NO: 666276 - DNA, 25 bp, Mus musculus
gatgaccagagtaagttctgatgac

SEQ ID NO: 666277 - DNA, 25 bp, Mus musculus
gatgaccagagttagttctgatgac

SEQ ID NO: 666278 - DNA, 25 bp, Mus musculus
gatgaccagatgagtaatgacaaag

SEQ ID NO: 666279 - DNA, 25 bp, Mus musculus
gatgaccagatgtgtaatgacaaag

SEQ ID NO: 666280 - DNA, 25 bp, Mus musculus
gatgaccagctaccatctcagactt

SEQ ID NO: 666281 - DNA, 25 bp, Mus musculus
gatgaccagctagcatctcagactt

SEQ ID NO: 666282 - DNA, 25 bp, Mus musculus
gatgaccaggacatccgcagtttcc

SEQ ID NO: 666283 - DNA, 25 bp, Mus musculus
gatgaccaggacttccgcagtttcc

SEQ ID NO: 666284 - DNA, 25 bp, Mus musculus
gatgaccagtccattcatgctgatc

SEQ ID NO: 666285 - DNA, 25 bp, Mus musculus
gatgaccagtcctttcatgctgatc

SEQ ID NO: 666286 - DNA, 25 bp, Mus musculus
gatgaccatcgcacagagcctggag

SEQ ID NO: 666287 - DNA, 25 bp, Mus musculus
gatgaccatcgctcagagcctggag

SEQ ID NO: 666288 - DNA, 25 bp, Mus musculus
gatgaccatcttcgcgctcttggca

SEQ ID NO: 666289 - DNA, 25 bp, Mus musculus
gatgaccatcttggcgctcttggca

SEQ ID NO: 666290 - DNA, 25 bp, Mus musculus
gatgaccatgaaactaaacgacaga

SEQ ID NO: 666291 - DNA, 25 bp, Mus musculus
gatgaccatgaatctaaacgacaga

SEQ ID NO: 666292 - DNA, 25 bp, Mus musculus
gatgaccattatcaatttggcgcag

SEQ ID NO: 666293 - DNA, 25 bp, Mus musculus
gatgaccattatgaatttggcgcag

SEQ ID NO: 666294 - DNA, 25 bp, Mus musculus
gatgacccaacgctgattagtcgga

SEQ ID NO: 666295 - DNA, 25 bp, Mus musculus
gatgacccaacggtgattagtcgga

SEQ ID NO: 666296 - DNA, 25 bp, Mus musculus
gatgacccactcctgccagaaatag

SEQ ID NO: 666297 - DNA, 25 bp, Mus musculus
gatgacccactcgtgccagaaatag

SEQ ID NO: 666298 - DNA, 25 bp, Mus musculus
gatgaccccagactgcggcaaagag

SEQ ID NO: 666299 - DNA, 25 bp, Mus musculus
gatgaccccagagtgcggcaaagag

SEQ ID NO: 666300 - DNA, 25 bp, Mus musculus
gatgacccctctacgcatcgcatta

SEQ ID NO: 666301 - DNA, 25 bp, Mus musculus
gatgacccctcttcgcatcgcatta

SEQ ID NO: 666302 - DNA, 25 bp, Mus musculus
gatgacccggctactgacaatgctc

SEQ ID NO: 666303 - DNA, 25 bp, Mus musculus
gatgacccggcttctgacaatgctc

SEQ ID NO: 666304 - DNA, 25 bp, Mus musculus
gatgacccgggcagaagaatccctg

SEQ ID NO: 666305 - DNA, 25 bp, Mus musculus
gatgacccgggctgaagaatccctg

SEQ ID NO: 666306 - DNA, 25 bp, Mus musculus
gatgaccctcaacggacttccaagc

SEQ ID NO: 666307 - DNA, 25 bp, Mus musculus
gatgaccctcaagggacttccaagc

SEQ ID NO: 666308 - DNA, 25 bp, Mus musculus
gatgaccctgaacttaggatcctcc

SEQ ID NO: 666309 - DNA, 25 bp, Mus musculus
gatgaccctgaagttaggatcctcc

SEQ ID NO: 666310 - DNA, 25 bp, Mus musculus
gatgaccctgatcaagagccggaac

SEQ ID NO: 666311 - DNA, 25 bp, Mus musculus
gatgaccctgatgaagagccggaac

SEQ ID NO: 666312 - DNA, 25 bp, Mus musculus
gatgaccctgccaggcacatcagtg

SEQ ID NO: 666313 - DNA, 25 bp, Mus musculus
gatgaccctgcctggcacatcagtg

SEQ ID NO: 666314 - DNA, 25 bp, Mus musculus
gatgaccctttgctcagtgattcaa

SEQ ID NO: 666315 - DNA, 25 bp, Mus musculus
gatgaccctttggtcagtgattcaa

SEQ ID NO: 666316 - DNA, 25 bp, Mus musculus
gatgaccgaggtctctataaacaag

SEQ ID NO: 666317 - DNA, 25 bp, Mus musculus
gatgaccgaggtgtctataaacaag

SEQ ID NO: 666318 - DNA, 25 bp, Mus musculus
gatgaccgcataccttggacccaca

SEQ ID NO: 666319 - DNA, 25 bp, Mus musculus
gatgaccgcatagcttggacccaca

SEQ ID NO: 666320 - DNA, 25 bp, Mus musculus
gatgaccgggagcagttctacaaga

SEQ ID NO: 666321 - DNA, 25 bp, Mus musculus
gatgaccgggaggagttctacaaga

SEQ ID NO: 666322 - DNA, 25 bp, Mus musculus
gatgaccgggttatcctaagcagct

SEQ ID NO: 666323 - DNA, 25 bp, Mus musculus
gatgaccgggttttcctaagcagct

SEQ ID NO: 666324 - DNA, 25 bp, Mus musculus
gatgaccgtggcagtttgacctttg

SEQ ID NO: 666325 - DNA, 25 bp, Mus musculus
gatgaccgtggctgtttgacctttg

SEQ ID NO: 666326 - DNA, 25 bp, Mus musculus
gatgaccgtgttccaatccatgagg

SEQ ID NO: 666327 - DNA, 25 bp, Mus musculus
gatgaccgtgttgcaatccatgagg

SEQ ID NO: 666328 - DNA, 25 bp, Mus musculus
gatgacctagtaaactcagatgagg

SEQ ID NO: 666329 - DNA, 25 bp, Mus musculus
gatgacctagtatactcagatgagg

SEQ ID NO: 666330 - DNA, 25 bp, Mus musculus
gatgacctatgcagcagcatcattg

SEQ ID NO: 666331 - DNA, 25 bp, Mus musculus
gatgacctatgctgcagcatcattg

SEQ ID NO: 666332 - DNA, 25 bp, Mus musculus
gatgacctccagacaactgtccagg

SEQ ID NO: 666333 - DNA, 25 bp, Mus musculus
gatgacctccagtcaactgtccagg

SEQ ID NO: 666334 - DNA, 25 bp, Mus musculus
gatgacctccgccaacattctgtgg

SEQ ID NO: 666335 - DNA, 25 bp, Mus musculus
gatgacctccgcgaacattctgtgg

SEQ ID NO: 666336 - DNA, 25 bp, Mus musculus
gatgacctcgtgatatgcatggaag

SEQ ID NO: 666337 - DNA, 25 bp, Mus musculus
gatgacctcgtgttatgcatggaag

SEQ ID NO: 666338 - DNA, 25 bp, Mus musculus
gatgacctgaacaagtcctcagcca

SEQ ID NO: 666339 - DNA, 25 bp, Mus musculus
gatgacctgaactagtcctcagcca

SEQ ID NO: 666340 - DNA, 25 bp, Mus musculus
gatgacctgagtattcacaaaggag

SEQ ID NO: 666341 - DNA, 25 bp, Mus musculus
gatgacctgagttttcacaaaggag

SEQ ID NO: 666342 - DNA, 25 bp, Mus musculus
gatgacctgattagcatgggatcca

SEQ ID NO: 666343 - DNA, 25 bp, Mus musculus
gatgacctgatttgcatgggatcca

SEQ ID NO: 666344 - DNA, 25 bp, Mus musculus
gatgacctgcatctttccaccagtt

SEQ ID NO: 666345 - DNA, 25 bp, Mus musculus
gatgacctgcatgtttccaccagtt

SEQ ID NO: 666346 - DNA, 25 bp, Mus musculus
gatgacctgccacaagaaatgcgtg

SEQ ID NO: 666347 - DNA, 25 bp, Mus musculus
gatgacctgccagaagaaatgcgtg

SEQ ID NO: 666348 - DNA, 25 bp, Mus musculus
gatgacctgctcaactcattccctg

SEQ ID NO: 666349 - DNA, 25 bp, Mus musculus
gatgacctgctctactcattccctg

SEQ ID NO: 666350 - DNA, 25 bp, Mus musculus
gatgacctggcaaggttacgaagtg

SEQ ID NO: 666351 - DNA, 25 bp, Mus musculus
gatgacctggcatggttacgaagtg

SEQ ID NO: 666352 - DNA, 25 bp, Mus musculus
gatgacctggcgcagacgaaagcca

SEQ ID NO: 666353 - DNA, 25 bp, Mus musculus
gatgacctggcggagacgaaagcca

SEQ ID NO: 666354 - DNA, 25 bp, Mus musculus
gatgacctggctaccaagaggactg

SEQ ID NO: 666355 - DNA, 25 bp, Mus musculus
gatgacctggcttccaagaggactg

SEQ ID NO: 666356 - DNA, 25 bp, Mus musculus
gatgacctggtgaaggtctggaaat

SEQ ID NO: 666357 - DNA, 25 bp, Mus musculus
gatgacctggtgtaggtctggaaat

SEQ ID NO: 666358 - DNA, 25 bp, Mus musculus
gatgacctgttcaacaccaacgcta

SEQ ID NO: 666359 - DNA, 25 bp, Mus musculus
gatgacctgttctacaccaacgcta

SEQ ID NO: 666360 - DNA, 25 bp, Mus musculus
gatgaccttaccagacacgttgttg

SEQ ID NO: 666361 - DNA, 25 bp, Mus musculus
gatgaccttacctgacacgttgttg

SEQ ID NO: 666362 - DNA, 25 bp, Mus musculus
gatgaccttactaggatggatgctg

SEQ ID NO: 666363 - DNA, 25 bp, Mus musculus
gatgaccttacttggatggatgctg

SEQ ID NO: 666364 - DNA, 25 bp, Mus musculus
gatgaccttattaggagactgagcc

SEQ ID NO: 666365 - DNA, 25 bp, Mus musculus
gatgaccttatttggagactgagcc

SEQ ID NO: 666366 - DNA, 25 bp, Mus musculus
gatgaccttcaacgacttggtgtcc

SEQ ID NO: 666367 - DNA, 25 bp, Mus musculus
gatgaccttcaaggacttggtgtcc

SEQ ID NO: 666368 - DNA, 25 bp, Mus musculus
gatgaccttctcaacctgctcaggg

SEQ ID NO: 666369 - DNA, 25 bp, Mus musculus
gatgaccttctctacctgctcaggg

SEQ ID NO: 666370 - DNA, 25 bp, Mus musculus
gatgaccttgaccactacaacaaca

SEQ ID NO: 666371 - DNA, 25 bp, Mus musculus
gatgaccttgacgactacaacaaca

SEQ ID NO: 666372 - DNA, 25 bp, Mus musculus
gatgacctttctcttcaggagcggc

SEQ ID NO: 666373 - DNA, 25 bp, Mus musculus
gatgacctttctgttcaggagcggc

SEQ ID NO: 666374 - DNA, 25 bp, Mus musculus
gatgacgaccagaattgtctgcgga

SEQ ID NO: 666375 - DNA, 25 bp, Mus musculus
gatgacgaccagtattgtctgcgga

SEQ ID NO: 666376 - DNA, 25 bp, Mus musculus
gatgacgacgaccacaatgatcctg

SEQ ID NO: 666377 - DNA, 25 bp, Mus musculus
gatgacgacgacgacaatgatcctg

SEQ ID NO: 666378 - DNA, 25 bp, Mus musculus
gatgacgagaccaagttgacgctgc

SEQ ID NO: 666379 - DNA, 25 bp, Mus musculus
gatgacgagacctagttgacgctgc

SEQ ID NO: 666380 - DNA, 25 bp, Mus musculus
gatgacgatgacatctctgagtact

SEQ ID NO: 666381 - DNA, 25 bp, Mus musculus
gatgacgatgacttctctgagtact

SEQ ID NO: 666382 - DNA, 25 bp, Mus musculus
gatgacgatgatccagagacaggcc

SEQ ID NO: 666383 - DNA, 25 bp, Mus musculus
gatgacgatgatgcagagacaggcc

SEQ ID NO: 666384 - DNA, 25 bp, Mus musculus
gatgacgatggaaccctggacagag

SEQ ID NO: 666385 - DNA, 25 bp, Mus musculus
gatgacgatggatccctggacagag

SEQ ID NO: 666386 - DNA, 25 bp, Mus musculus
gatgacgatgttcacctttccaggg

SEQ ID NO: 666387 - DNA, 25 bp, Mus musculus
gatgacgatgttgacctttccaggg

SEQ ID NO: 666388 - DNA, 25 bp, Mus musculus
gatgacgccttaagtggtgactcgc

SEQ ID NO: 666389 - DNA, 25 bp, Mus musculus
gatgacgccttatgtggtgactcgc

SEQ ID NO: 666390 - DNA, 25 bp, Mus musculus
gatgacgctggtatccattgtcccc

SEQ ID NO: 666391 - DNA, 25 bp, Mus musculus
gatgacgctggtttccattgtcccc

SEQ ID NO: 666392 - DNA, 25 bp, Mus musculus
gatgacggaagtacaatgatggaga

SEQ ID NO: 666393 - DNA, 25 bp, Mus musculus
gatgacggaagttcaatgatggaga

SEQ ID NO: 666394 - DNA, 25 bp, Mus musculus
gatgacggtcacagccattgatgcg

SEQ ID NO: 666395 - DNA, 25 bp, Mus musculus
gatgacggtcactgccattgatgcg

SEQ ID NO: 666396 - DNA, 25 bp, Mus musculus
gatgacggtctacatttccaagcca

SEQ ID NO: 666397 - DNA, 25 bp, Mus musculus
gatgacggtctagatttccaagcca

SEQ ID NO: 666398 - DNA, 25 bp, Mus musculus
gatgacgtcacacatcccaaaagaa

SEQ ID NO: 666399 - DNA, 25 bp, Mus musculus
gatgacgtcacacgacctgccgcag

SEQ ID NO: 666400 - DNA, 25 bp, Mus musculus
gatgacgtcacagatcccaaaagaa

SEQ ID NO: 666401 - DNA, 25 bp, Mus musculus
gatgacgtcacaggacctgccgcag

SEQ ID NO: 666402 - DNA, 25 bp, Mus musculus
gatgacgtcatgctcctggacacct

SEQ ID NO: 666403 - DNA, 25 bp, Mus musculus
gatgacgtcatggtcctggacacct

SEQ ID NO: 666404 - DNA, 25 bp, Mus musculus
gatgacgtcccacctctggcagaca

SEQ ID NO: 666405 - DNA, 25 bp, Mus musculus
gatgacgtcccagctctggcagaca

SEQ ID NO: 666406 - DNA, 25 bp, Mus musculus
gatgactaagctaggatttttgcga

SEQ ID NO: 666407 - DNA, 25 bp, Mus musculus
gatgactaagcttggatttttgcga

SEQ ID NO: 666408 - DNA, 25 bp, Mus musculus
gatgactacagccattccattcccg

SEQ ID NO: 666409 - DNA, 25 bp, Mus musculus
gatgactacagcgattccattcccg

SEQ ID NO: 666410 - DNA, 25 bp, Mus musculus
gatgactaccgacatagccagttca

SEQ ID NO: 666411 - DNA, 25 bp, Mus musculus
gatgactaccgagatagccagttca

SEQ ID NO: 666412 - DNA, 25 bp, Mus musculus
gatgactacgatcctctgcaacagc

SEQ ID NO: 666413 - DNA, 25 bp, Mus musculus
gatgactacgatgctctgcaacagc

SEQ ID NO: 666414 - DNA, 25 bp, Mus musculus
gatgactagtgtagaggaagaacac

SEQ ID NO: 666415 - DNA, 25 bp, Mus musculus
gatgactagtgttgaggaagaacac

SEQ ID NO: 666416 - DNA, 25 bp, Mus musculus
gatgactatgaacccatgagctttg

SEQ ID NO: 666417 - DNA, 25 bp, Mus musculus
gatgactatgaagccatgagctttg

SEQ ID NO: 666418 - DNA, 25 bp, Mus musculus
gatgactatgagctcagctgccctg

SEQ ID NO: 666419 - DNA, 25 bp, Mus musculus
gatgactatgaggtcagctgccctg

SEQ ID NO: 666420 - DNA, 25 bp, Mus musculus
gatgactcaaatcataccataggag

SEQ ID NO: 666421 - DNA, 25 bp, Mus musculus
gatgactcaaatgataccataggag

SEQ ID NO: 666422 - DNA, 25 bp, Mus musculus
gatgactcagctctttctatgggaa

SEQ ID NO: 666423 - DNA, 25 bp, Mus musculus
gatgactcagctgtttctatgggaa

SEQ ID NO: 666424 - DNA, 25 bp, Mus musculus
gatgactcaggaaacaagccctcca

SEQ ID NO: 666425 - DNA, 25 bp, Mus musculus
gatgactcaggatacaagccctcca

SEQ ID NO: 666426 - DNA, 25 bp, Mus musculus
gatgactccaagacgtggtggcggg

SEQ ID NO: 666427 - DNA, 25 bp, Mus musculus
gatgactccaagtcgtggtggcggg

SEQ ID NO: 666428 - DNA, 25 bp, Mus musculus
gatgactccagaattcaccctgcct

SEQ ID NO: 666429 - DNA, 25 bp, Mus musculus
gatgactccagatttcaccctgcct

SEQ ID NO: 666430 - DNA, 25 bp, Mus musculus
gatgactcccgaatctctgaggatg

SEQ ID NO: 666431 - DNA, 25 bp, Mus musculus
gatgactcccgattctctgaggatg

SEQ ID NO: 666432 - DNA, 25 bp, Mus musculus
gatgactcctccacggaggagaaag

SEQ ID NO: 666433 - DNA, 25 bp, Mus musculus
gatgactcctcctcggaggagaaag

SEQ ID NO: 666434 - DNA, 25 bp, Mus musculus
gatgactcggatagcatgagccgga

SEQ ID NO: 666435 - DNA, 25 bp, Mus musculus
gatgactcggattgcatgagccgga

SEQ ID NO: 666436 - DNA, 25 bp, Mus musculus
gatgactcggtcatgttcgcgcggc

SEQ ID NO: 666437 - DNA, 25 bp, Mus musculus
gatgactcggtcttgttcgcgcggc

SEQ ID NO: 666438 - DNA, 25 bp, Mus musculus
gatgactctaacacgtcttactgag

SEQ ID NO: 666439 - DNA, 25 bp, Mus musculus
gatgactctaactcgtcttactgag

SEQ ID NO: 666440 - DNA, 25 bp, Mus musculus
gatgactcttcccaggagtttgtta

SEQ ID NO: 666441 - DNA, 25 bp, Mus musculus
gatgactcttccgaggagtttgtta

SEQ ID NO: 666442 - DNA, 25 bp, Mus musculus
gatgactgagaacgtcaagcccctc

SEQ ID NO: 666443 - DNA, 25 bp, Mus musculus
gatgactgagaaggtcaagcccctc

SEQ ID NO: 666444 - DNA, 25 bp, Mus musculus
gatgactgccatcctgatgcactgt

SEQ ID NO: 666445 - DNA, 25 bp, Mus musculus
gatgactgccatgctgatgcactgt

SEQ ID NO: 666446 - DNA, 25 bp, Mus musculus
gatgactgcgccagcaacccctgtg

SEQ ID NO: 666447 - DNA, 25 bp, Mus musculus
gatgactgcgcctgcaacccctgtg

SEQ ID NO: 666448 - DNA, 25 bp, Mus musculus
gatgactgcggtcactacctggtga

SEQ ID NO: 666449 - DNA, 25 bp, Mus musculus
gatgactgcggtgactacctggtga

SEQ ID NO: 666450 - DNA, 25 bp, Mus musculus
gatgactgctctcgtgaatgttgct

SEQ ID NO: 666451 - DNA, 25 bp, Mus musculus
gatgactgctctggtgaatgttgct

SEQ ID NO: 666452 - DNA, 25 bp, Mus musculus
gatgactggttaacaaaaactgaag

SEQ ID NO: 666453 - DNA, 25 bp, Mus musculus
gatgactggttatcaaaaactgaag

SEQ ID NO: 666454 - DNA, 25 bp, Mus musculus
gatgactgtcttccatcgaggtggc

SEQ ID NO: 666455 - DNA, 25 bp, Mus musculus
gatgactgtcttgcatcgaggtggc

SEQ ID NO: 666456 - DNA, 25 bp, Mus musculus
gatgactgtgaaagagtctgagcag

SEQ ID NO: 666457 - DNA, 25 bp, Mus musculus
gatgactgtgaatgagtctgagcag

SEQ ID NO: 666458 - DNA, 25 bp, Mus musculus
gatgactgtgccagtgccgcctgtt

SEQ ID NO: 666459 - DNA, 25 bp, Mus musculus
gatgactgtgcctgtgccgcctgtt

SEQ ID NO: 666460 - DNA, 25 bp, Mus musculus
gatgactgtggtaccaggcacacgc

SEQ ID NO: 666461 - DNA, 25 bp, Mus musculus
gatgactgtggttccaggcacacgc

SEQ ID NO: 666462 - DNA, 25 bp, Mus musculus
gatgacttcaacaaccggctaaatc

SEQ ID NO: 666463 - DNA, 25 bp, Mus musculus
gatgacttcaactaccggctaaatc

SEQ ID NO: 666464 - DNA, 25 bp, Mus musculus
gatgacttcagcacgcccaacttca

SEQ ID NO: 666465 - DNA, 25 bp, Mus musculus
gatgacttcagctcgcccaacttca

SEQ ID NO: 666466 - DNA, 25 bp, Mus musculus
gatgacttcatccagggctgcatcg

SEQ ID NO: 666467 - DNA, 25 bp, Mus musculus
gatgacttcatcgagggctgcatcg

SEQ ID NO: 666468 - DNA, 25 bp, Mus musculus
gatgacttccatcaagaaacggaga

SEQ ID NO: 666469 - DNA, 25 bp, Mus musculus
gatgacttccatgaagaaacggaga

SEQ ID NO: 666470 - DNA, 25 bp, Mus musculus
gatgacttccgaagccaggatggca

SEQ ID NO: 666471 - DNA, 25 bp, Mus musculus
gatgacttccgatgccaggatggca

SEQ ID NO: 666472 - DNA, 25 bp, Mus musculus
gatgacttccggagataattggttc

SEQ ID NO: 666473 - DNA, 25 bp, Mus musculus
gatgacttccggtgataattggttc

SEQ ID NO: 666474 - DNA, 25 bp, Mus musculus
gatgacttcgcaaataaccgtgagt

SEQ ID NO: 666475 - DNA, 25 bp, Mus musculus
gatgacttcgcatataaccgtgagt

SEQ ID NO: 666476 - DNA, 25 bp, Mus musculus
gatgacttctctcagtactctgtgt

SEQ ID NO: 666477 - DNA, 25 bp, Mus musculus
gatgacttctctctgctcactcgtc

SEQ ID NO: 666478 - DNA, 25 bp, Mus musculus
gatgacttctctgagtactctgtgt

SEQ ID NO: 666479 - DNA, 25 bp, Mus musculus
gatgacttctctgtgctcactcgtc

SEQ ID NO: 666480 - DNA, 25 bp, Mus musculus
gatgacttctttcgagccggagaga

SEQ ID NO: 666481 - DNA, 25 bp, Mus musculus
gatgacttctttggagccggagaga

SEQ ID NO: 666482 - DNA, 25 bp, Mus musculus
gatgacttgcacaggctgtatgcag

SEQ ID NO: 666483 - DNA, 25 bp, Mus musculus
gatgacttgcactggctgtatgcag

SEQ ID NO: 666484 - DNA, 25 bp, Mus musculus
gatgacttggaacctcaggatgccc

SEQ ID NO: 666485 - DNA, 25 bp, Mus musculus
gatgacttggaagctcaggatgccc

SEQ ID NO: 666486 - DNA, 25 bp, Mus musculus
gatgacttggacactcaggagagcg

SEQ ID NO: 666487 - DNA, 25 bp, Mus musculus
gatgacttggactctcaggagagcg

SEQ ID NO: 666488 - DNA, 25 bp, Mus musculus
gatgacttgtacctcaatgccagca

SEQ ID NO: 666489 - DNA, 25 bp, Mus musculus
gatgacttgtacgtcaatgccagca

SEQ ID NO: 666490 - DNA, 25 bp, Mus musculus
gatgactttgaactacttgaccagg

SEQ ID NO: 666491 - DNA, 25 bp, Mus musculus
gatgactttgaagtacttgaccagg

SEQ ID NO: 666492 - DNA, 25 bp, Mus musculus
gatgagaaaaaccagatgatgacga

SEQ ID NO: 666493 - DNA, 25 bp, Mus musculus
gatgagaaaaacgagatgatgacga

SEQ ID NO: 666494 - DNA, 25 bp, Mus musculus
gatgagaaaacgatacagtgttgac

SEQ ID NO: 666495 - DNA, 25 bp, Mus musculus
gatgagaaaacgttacagtgttgac

SEQ ID NO: 666496 - DNA, 25 bp, Mus musculus
gatgagaaactaaactctttgtgta

SEQ ID NO: 666497 - DNA, 25 bp, Mus musculus
gatgagaaactatactctttgtgta

SEQ ID NO: 666498 - DNA, 25 bp, Mus musculus
gatgagaacacacagcgcagaaacc

SEQ ID NO: 666499 - DNA, 25 bp, Mus musculus
gatgagaacacagagcgcagaaacc

SEQ ID NO: 666500 - DNA, 25 bp, Mus musculus
gatgagaacattaaaaacagctttt

SEQ ID NO: 666501 - DNA, 25 bp, Mus musculus
gatgagaacatttaaaacagctttt

SEQ ID NO: 666502 - DNA, 25 bp, Mus musculus
gatgagaaccccatcgcccagggcg

SEQ ID NO: 666503 - DNA, 25 bp, Mus musculus
gatgagaaccccttcgcccagggcg

SEQ ID NO: 666504 - DNA, 25 bp, Mus musculus
gatgagaacctaccaaacaagccca

SEQ ID NO: 666505 - DNA, 25 bp, Mus musculus
gatgagaacctagcaaacaagccca

SEQ ID NO: 666506 - DNA, 25 bp, Mus musculus
gatgagaacgagctcctttaccttc

SEQ ID NO: 666507 - DNA, 25 bp, Mus musculus
gatgagaacgaggtcctttaccttc

SEQ ID NO: 666508 - DNA, 25 bp, Mus musculus
gatgagaactatcaatgggattcgg

SEQ ID NO: 666509 - DNA, 25 bp, Mus musculus
gatgagaactatgaatgggattcgg

SEQ ID NO: 666510 - DNA, 25 bp, Mus musculus
gatgagaacttaccactgggcaagc

SEQ ID NO: 666511 - DNA, 25 bp, Mus musculus
gatgagaacttagcactgggcaagc

SEQ ID NO: 666512 - DNA, 25 bp, Mus musculus
gatgagaagcagatcaagactactg

SEQ ID NO: 666513 - DNA, 25 bp, Mus musculus
gatgagaagcagttcaagactactg

SEQ ID NO: 666514 - DNA, 25 bp, Mus musculus
gatgagaagcccaggttcaagagca

SEQ ID NO: 666515 - DNA, 25 bp, Mus musculus
gatgagaagccctggttcaagagca

SEQ ID NO: 666516 - DNA, 25 bp, Mus musculus
gatgagaatgaaacttggtacttag

SEQ ID NO: 666517 - DNA, 25 bp, Mus musculus
gatgagaatgaatcttggtacttag

SEQ ID NO: 666518 - DNA, 25 bp, Mus musculus
gatgagaatgagagtttactcttag

SEQ ID NO: 666519 - DNA, 25 bp, Mus musculus
gatgagaatgagtgtttactcttag

SEQ ID NO: 666520 - DNA, 25 bp, Mus musculus
gatgagaccatgactgtttaccagg

SEQ ID NO: 666521 - DNA, 25 bp, Mus musculus
gatgagaccatgtctgtttaccagg

SEQ ID NO: 666522 - DNA, 25 bp, Mus musculus
gatgagacctcaacactcaagtttg

SEQ ID NO: 666523 - DNA, 25 bp, Mus musculus
gatgagacctcatcactcaagtttg

SEQ ID NO: 666524 - DNA, 25 bp, Mus musculus
gatgagactgcaaccaagcttattg

SEQ ID NO: 666525 - DNA, 25 bp, Mus musculus
gatgagactgcatccaagcttattg

SEQ ID NO: 666526 - DNA, 25 bp, Mus musculus
gatgagactgccatgcggcagctca

SEQ ID NO: 666527 - DNA, 25 bp, Mus musculus
gatgagactgccttgcggcagctca

SEQ ID NO: 666528 - DNA, 25 bp, Mus musculus
gatgagagaggtcctatcaaaacca

SEQ ID NO: 666529 - DNA, 25 bp, Mus musculus
gatgagagaggtgctatcaaaacca

SEQ ID NO: 666530 - DNA, 25 bp, Mus musculus
gatgagagagtcctaccacagtgaa

SEQ ID NO: 666531 - DNA, 25 bp, Mus musculus
gatgagagagtcgtaccacagtgaa

SEQ ID NO: 666532 - DNA, 25 bp, Mus musculus
gatgagagcaatagagatctataca

SEQ ID NO: 666533 - DNA, 25 bp, Mus musculus
gatgagagcaattgagatctataca

SEQ ID NO: 666534 - DNA, 25 bp, Mus musculus
gatgagaggcttcgtccatgtctcc

SEQ ID NO: 666535 - DNA, 25 bp, Mus musculus
gatgagaggcttggtccatgtctcc

SEQ ID NO: 666536 - DNA, 25 bp, Mus musculus
gatgagagggtgatcatcacaggct

SEQ ID NO: 666537 - DNA, 25 bp, Mus musculus
gatgagagggtgttcatcacaggct

SEQ ID NO: 666538 - DNA, 25 bp, Mus musculus
gatgagaggtctacacaagcagtgc

SEQ ID NO: 666539 - DNA, 25 bp, Mus musculus
gatgagaggtcttcacaagcagtgc

SEQ ID NO: 666540 - DNA, 25 bp, Mus musculus
gatgagagtcatacagaatgggtgt

SEQ ID NO: 666541 - DNA, 25 bp, Mus musculus
gatgagagtcattcagaatgggtgt

SEQ ID NO: 666542 - DNA, 25 bp, Mus musculus
gatgagagttctcgcagcttcctac

SEQ ID NO: 666543 - DNA, 25 bp, Mus musculus
gatgagagttctggcagcttcctac

SEQ ID NO: 666544 - DNA, 25 bp, Mus musculus
gatgagatcaacatcctcaagaccc

SEQ ID NO: 666545 - DNA, 25 bp, Mus musculus
gatgagatcaaccttgccaagcagg

SEQ ID NO: 666546 - DNA, 25 bp, Mus musculus
gatgagatcaacgttgccaagcagg

SEQ ID NO: 666547 - DNA, 25 bp, Mus musculus
gatgagatcaacttcctcaagaccc

SEQ ID NO: 666548 - DNA, 25 bp, Mus musculus
gatgagatcaccatccagccaggag

SEQ ID NO: 666549 - DNA, 25 bp, Mus musculus
gatgagatcaccttccagccaggag

SEQ ID NO: 666550 - DNA, 25 bp, Mus musculus
gatgagatcgctcggacagaacccc

SEQ ID NO: 666551 - DNA, 25 bp, Mus musculus
gatgagatcgctgggacagaacccc

SEQ ID NO: 666552 - DNA, 25 bp, Mus musculus
gatgagatgccccaagatgtgtcct

SEQ ID NO: 666553 - DNA, 25 bp, Mus musculus
gatgagatgcccgaagatgtgtcct

SEQ ID NO: 666554 - DNA, 25 bp, Mus musculus
gatgagatggatacacacaatgctg

SEQ ID NO: 666555 - DNA, 25 bp, Mus musculus
gatgagatggatcacttcagctcgc

SEQ ID NO: 666556 - DNA, 25 bp, Mus musculus
gatgagatggatgacttcagctcgc

SEQ ID NO: 666557 - DNA, 25 bp, Mus musculus
gatgagatggattcacacaatgctg

SEQ ID NO: 666558 - DNA, 25 bp, Mus musculus
gatgagattgatactgcagtaaaga

SEQ ID NO: 666559 - DNA, 25 bp, Mus musculus
gatgagattgattctgcagtaaaga

SEQ ID NO: 666560 - DNA, 25 bp, Mus musculus
gatgagcaagtaagttggaacacca

SEQ ID NO: 666561 - DNA, 25 bp, Mus musculus
gatgagcaagtatgttggaacacca

SEQ ID NO: 666562 - DNA, 25 bp, Mus musculus
gatgagcaatccaagttcacctgca

SEQ ID NO: 666563 - DNA, 25 bp, Mus musculus
gatgagcaatcctagttcacctgca

SEQ ID NO: 666564 - DNA, 25 bp, Mus musculus
gatgagcacctccagaaagatttca

SEQ ID NO: 666565 - DNA, 25 bp, Mus musculus
gatgagcacctcgagaaagatttca

SEQ ID NO: 666566 - DNA, 25 bp, Mus musculus
gatgagcactctccctcactggcta

SEQ ID NO: 666567 - DNA, 25 bp, Mus musculus
gatgagcactctgcctcactggcta

SEQ ID NO: 666568 - DNA, 25 bp, Mus musculus
gatgagcagacacctagaatgggaa

SEQ ID NO: 666569 - DNA, 25 bp, Mus musculus
gatgagcagacagctagaatgggaa

SEQ ID NO: 666570 - DNA, 25 bp, Mus musculus
gatgagcagagccacacgtgaccag

SEQ ID NO: 666571 - DNA, 25 bp, Mus musculus
gatgagcagagcgacacgtgaccag

SEQ ID NO: 666572 - DNA, 25 bp, Mus musculus
gatgagcagataagaaaagcgtcct

SEQ ID NO: 666573 - DNA, 25 bp, Mus musculus
gatgagcagatatgaaaagcgtcct

SEQ ID NO: 666574 - DNA, 25 bp, Mus musculus
gatgagcagtgtcaacttccaaacc

SEQ ID NO: 666575 - DNA, 25 bp, Mus musculus
gatgagcagtgtgaacttccaaacc

SEQ ID NO: 666576 - DNA, 25 bp, Mus musculus
gatgagccagcacagctggacacca

SEQ ID NO: 666577 - DNA, 25 bp, Mus musculus
gatgagccagcagagctggacacca

SEQ ID NO: 666578 - DNA, 25 bp, Mus musculus
gatgagccccaacaacctcaagagc

SEQ ID NO: 666579 - DNA, 25 bp, Mus musculus
gatgagccccaagaacctcaagagc

SEQ ID NO: 666580 - DNA, 25 bp, Mus musculus
gatgagccccgactggctgacagaa

SEQ ID NO: 666581 - DNA, 25 bp, Mus musculus
gatgagccccgagtggctgacagaa

SEQ ID NO: 666582 - DNA, 25 bp, Mus musculus
gatgagccccggcttctgtaaacaa

SEQ ID NO: 666583 - DNA, 25 bp, Mus musculus
gatgagccccgggttctgtaaacaa

SEQ ID NO: 666584 - DNA, 25 bp, Mus musculus
gatgagcccttaactaaacgaagaa

SEQ ID NO: 666585 - DNA, 25 bp, Mus musculus
gatgagcccttatctaaacgaagaa

SEQ ID NO: 666586 - DNA, 25 bp, Mus musculus
gatgagccgaaaacgaatcgctgaa

SEQ ID NO: 666587 - DNA, 25 bp, Mus musculus
gatgagccgaaatcgaatcgctgaa

SEQ ID NO: 666588 - DNA, 25 bp, Mus musculus
gatgagcgactgaaggctatggacc

SEQ ID NO: 666589 - DNA, 25 bp, Mus musculus
gatgagcgactgtaggctatggacc

SEQ ID NO: 666590 - DNA, 25 bp, Mus musculus
gatgagcgcagcaaatacttgggtg

SEQ ID NO: 666591 - DNA, 25 bp, Mus musculus
gatgagcgcagctaatacttgggtg

SEQ ID NO: 666592 - DNA, 25 bp, Mus musculus
gatgagcgcagtctaaagagcacag

SEQ ID NO: 666593 - DNA, 25 bp, Mus musculus
gatgagcgcagtgtaaagagcacag

SEQ ID NO: 666594 - DNA, 25 bp, Mus musculus
gatgagcgccttaaggaactctttg

SEQ ID NO: 666595 - DNA, 25 bp, Mus musculus
gatgagcgcctttaggaactctttg

SEQ ID NO: 666596 - DNA, 25 bp, Mus musculus
gatgagcgctttctatccaaggctg

SEQ ID NO: 666597 - DNA, 25 bp, Mus musculus
gatgagcgctttgtatccaaggctg

SEQ ID NO: 666598 - DNA, 25 bp, Mus musculus
gatgagcggcaccactcggtcctca

SEQ ID NO: 666599 - DNA, 25 bp, Mus musculus
gatgagcggcacgactcggtcctca

SEQ ID NO: 666600 - DNA, 25 bp, Mus musculus
gatgagctaaaacaagcccttgacg

SEQ ID NO: 666601 - DNA, 25 bp, Mus musculus
gatgagctaaaagaagcccttgacg

SEQ ID NO: 666602 - DNA, 25 bp, Mus musculus
gatgagctaaatctctcctggtgct

SEQ ID NO: 666603 - DNA, 25 bp, Mus musculus
gatgagctaaatgtctcctggtgct

SEQ ID NO: 666604 - DNA, 25 bp, Mus musculus
gatgagctacgcaaaaatgttacag

SEQ ID NO: 666605 - DNA, 25 bp, Mus musculus
gatgagctacgctaaaatgttacag

SEQ ID NO: 666606 - DNA, 25 bp, Mus musculus
gatgagctagaactcattttgaaag

SEQ ID NO: 666607 - DNA, 25 bp, Mus musculus
gatgagctagaagtcattttgaaag

SEQ ID NO: 666608 - DNA, 25 bp, Mus musculus
gatgagctagctcagatgctgcctc

SEQ ID NO: 666609 - DNA, 25 bp, Mus musculus
gatgagctagctgagatgctgcctc

SEQ ID NO: 666610 - DNA, 25 bp, Mus musculus
gatgagctatagagccaaatttgcc

SEQ ID NO: 666611 - DNA, 25 bp, Mus musculus
gatgagctatagtgccaaatttgcc

SEQ ID NO: 666612 - DNA, 25 bp, Mus musculus
gatgagctcggaagaggacacagca

SEQ ID NO: 666613 - DNA, 25 bp, Mus musculus
gatgagctcggatgaggacacagca

SEQ ID NO: 666614 - DNA, 25 bp, Mus musculus
gatgagctctccatccgaaagggtg

SEQ ID NO: 666615 - DNA, 25 bp, Mus musculus
gatgagctctccttccgaaagggtg

SEQ ID NO: 666616 - DNA, 25 bp, Mus musculus
gatgagctgcacacagaacaagatg

SEQ ID NO: 666617 - DNA, 25 bp, Mus musculus
gatgagctgcactcagaacaagatg

SEQ ID NO: 666618 - DNA, 25 bp, Mus musculus
gatgagctgctgaatgatcctgaga

SEQ ID NO: 666619 - DNA, 25 bp, Mus musculus
gatgagctgctgtatgatcctgaga

SEQ ID NO: 666620 - DNA, 25 bp, Mus musculus
gatgagctggacaagtattcggaag

SEQ ID NO: 666621 - DNA, 25 bp, Mus musculus
gatgagctggacagtgctccaccaa

SEQ ID NO: 666622 - DNA, 25 bp, Mus musculus
gatgagctggactagtattcggaag

SEQ ID NO: 666623 - DNA, 25 bp, Mus musculus
gatgagctggactgtgctccaccaa

SEQ ID NO: 666624 - DNA, 25 bp, Mus musculus
gatgagctgggcaactttgtgctca

SEQ ID NO: 666625 - DNA, 25 bp, Mus musculus
gatgagctgggctactttgtgctca

SEQ ID NO: 666626 - DNA, 25 bp, Mus musculus
gatgagctgtaccagctctcactgc

SEQ ID NO: 666627 - DNA, 25 bp, Mus musculus
gatgagctgtacgagctctcactgc

SEQ ID NO: 666628 - DNA, 25 bp, Mus musculus
gatgagctgtgcaaacaaagaaacg

SEQ ID NO: 666629 - DNA, 25 bp, Mus musculus
gatgagctgtgctaacaaagaaacg

SEQ ID NO: 666630 - DNA, 25 bp, Mus musculus
gatgagctttggaatgaattcagaa

SEQ ID NO: 666631 - DNA, 25 bp, Mus musculus
gatgagctttggtatgaattcagaa

SEQ ID NO: 666632 - DNA, 25 bp, Mus musculus
gatgaggaacacactcgcctggtag

SEQ ID NO: 666633 - DNA, 25 bp, Mus musculus
gatgaggaacactctcgcctggtag

SEQ ID NO: 666634 - DNA, 25 bp, Mus musculus
gatgaggaacatcttggaatcctag

SEQ ID NO: 666635 - DNA, 25 bp, Mus musculus
gatgaggaacatgttggaatcctag

SEQ ID NO: 666636 - DNA, 25 bp, Mus musculus
gatgaggaagcaacttaggcattgc

SEQ ID NO: 666637 - DNA, 25 bp, Mus musculus
gatgaggaagcatcttaggcattgc

SEQ ID NO: 666638 - DNA, 25 bp, Mus musculus
gatgaggaagtaaaggacgacccag

SEQ ID NO: 666639 - DNA, 25 bp, Mus musculus
gatgaggaagtataggacgacccag

SEQ ID NO: 666640 - DNA, 25 bp, Mus musculus
gatgaggaagttacctctggacgga

SEQ ID NO: 666641 - DNA, 25 bp, Mus musculus
gatgaggaagtttcctctggacgga

SEQ ID NO: 666642 - DNA, 25 bp, Mus musculus
gatgaggacatgattcccatagaga

SEQ ID NO: 666643 - DNA, 25 bp, Mus musculus
gatgaggacatgtttcccatagaga

SEQ ID NO: 666644 - DNA, 25 bp, Mus musculus
gatgaggacgtcagtagccatcccg

SEQ ID NO: 666645 - DNA, 25 bp, Mus musculus
gatgaggacgtctgtagccatcccg

SEQ ID NO: 666646 - DNA, 25 bp, Mus musculus
gatgaggactatccctgctcgcttg

SEQ ID NO: 666647 - DNA, 25 bp, Mus musculus
gatgaggactatgcctgctcgcttg

SEQ ID NO: 666648 - DNA, 25 bp, Mus musculus
gatgaggactccaacttagtgcctg

SEQ ID NO: 666649 - DNA, 25 bp, Mus musculus
gatgaggactcctacttagtgcctg

SEQ ID NO: 666650 - DNA, 25 bp, Mus musculus
gatgaggacttccacgggaagctca

SEQ ID NO: 666651 - DNA, 25 bp, Mus musculus
gatgaggacttcgacgggaagctca

SEQ ID NO: 666652 - DNA, 25 bp, Mus musculus
gatgaggagacaccattggcagctc

SEQ ID NO: 666653 - DNA, 25 bp, Mus musculus
gatgaggagacagcattggcagctc

SEQ ID NO: 666654 - DNA, 25 bp, Mus musculus
gatgaggagctcatcagatactgcc

SEQ ID NO: 666655 - DNA, 25 bp, Mus musculus
gatgaggagctcttcagatactgcc

SEQ ID NO: 666656 - DNA, 25 bp, Mus musculus
gatgaggaggaaaattggaacagct

SEQ ID NO: 666657 - DNA, 25 bp, Mus musculus
gatgaggaggaatattggaacagct

SEQ ID NO: 666658 - DNA, 25 bp, Mus musculus
gatgaggaggtgaactttgagaacc

SEQ ID NO: 666659 - DNA, 25 bp, Mus musculus
gatgaggaggtgtactttgagaacc

SEQ ID NO: 666660 - DNA, 25 bp, Mus musculus
gatgaggatattctcacttcccaca

SEQ ID NO: 666661 - DNA, 25 bp, Mus musculus
gatgaggatattgtcacttcccaca

SEQ ID NO: 666662 - DNA, 25 bp, Mus musculus
gatgaggatcctcatgaaaggcaac

SEQ ID NO: 666663 - DNA, 25 bp, Mus musculus
gatgaggatcctgatgaaaggcaac

SEQ ID NO: 666664 - DNA, 25 bp, Mus musculus
gatgaggatgacacatcgtcaggag

SEQ ID NO: 666665 - DNA, 25 bp, Mus musculus
gatgaggatgactcatcgtcaggag

SEQ ID NO: 666666 - DNA, 25 bp, Mus musculus
gatgaggcacccctctctctgcaga

SEQ ID NO: 666667 - DNA, 25 bp, Mus musculus
gatgaggcacccgtctctctgcaga

SEQ ID NO: 666668 - DNA, 25 bp, Mus musculus
gatgaggcagacctgctcaaaactc

SEQ ID NO: 666669 - DNA, 25 bp, Mus musculus
gatgaggcagacgtgctcaaaactc

SEQ ID NO: 666670 - DNA, 25 bp, Mus musculus
gatgaggcagatctttgtccagaga

SEQ ID NO: 666671 - DNA, 25 bp, Mus musculus
gatgaggcagatgtttgtccagaga

SEQ ID NO: 666672 - DNA, 25 bp, Mus musculus
gatgaggcatatcaccggcgtctag

SEQ ID NO: 666673 - DNA, 25 bp, Mus musculus
gatgaggcatatgaccggcgtctag

SEQ ID NO: 666674 - DNA, 25 bp, Mus musculus
gatgaggccacgcagttcctcaaac

SEQ ID NO: 666675 - DNA, 25 bp, Mus musculus
gatgaggccacggagttcctcaaac

SEQ ID NO: 666676 - DNA, 25 bp, Mus musculus
gatgaggcccttcgcaatgttcgga

SEQ ID NO: 666677 - DNA, 25 bp, Mus musculus
gatgaggcccttggcaatgttcgga

SEQ ID NO: 666678 - DNA, 25 bp, Mus musculus
gatgaggctatcctagctgccctcg

SEQ ID NO: 666679 - DNA, 25 bp, Mus musculus
gatgaggctatcgtagctgccctcg

SEQ ID NO: 666680 - DNA, 25 bp, Mus musculus
gatgaggctcaacaaacagtttgct

SEQ ID NO: 666681 - DNA, 25 bp, Mus musculus
gatgaggctcaagaaacagtttgct

SEQ ID NO: 666682 - DNA, 25 bp, Mus musculus
gatgaggcttctcgcataatccctt

SEQ ID NO: 666683 - DNA, 25 bp, Mus musculus
gatgaggcttctggcataatccctt

SEQ ID NO: 666684 - DNA, 25 bp, Mus musculus
gatgaggctttactctgagttcctg

SEQ ID NO: 666685 - DNA, 25 bp, Mus musculus
gatgaggctttagtctgagttcctg

SEQ ID NO: 666686 - DNA, 25 bp, Mus musculus
gatgagggcaccagtaacaatggag

SEQ ID NO: 666687 - DNA, 25 bp, Mus musculus
gatgagggcacctgtaacaatggag

SEQ ID NO: 666688 - DNA, 25 bp, Mus musculus
gatgagggccccacctgggaattct

SEQ ID NO: 666689 - DNA, 25 bp, Mus musculus
gatgagggcccctcctgggaattct

SEQ ID NO: 666690 - DNA, 25 bp, Mus musculus
gatgagggctccagtactgcctata

SEQ ID NO: 666691 - DNA, 25 bp, Mus musculus
gatgagggctcctgtactgcctata

SEQ ID NO: 666692 - DNA, 25 bp, Mus musculus
gatgagggtggcattgcacccaaca

SEQ ID NO: 666693 - DNA, 25 bp, Mus musculus
gatgagggtggctttgcacccaaca

SEQ ID NO: 666694 - DNA, 25 bp, Mus musculus
gatgagggtttcacactcacccagg

SEQ ID NO: 666695 - DNA, 25 bp, Mus musculus
gatgagggtttctcactcacccagg

SEQ ID NO: 666696 - DNA, 25 bp, Mus musculus
gatgaggtacggcaccgagctacct

SEQ ID NO: 666697 - DNA, 25 bp, Mus musculus
gatgaggtacgggaccgagctacct

SEQ ID NO: 666698 - DNA, 25 bp, Mus musculus
gatgaggtagacactgactttgaca

SEQ ID NO: 666699 - DNA, 25 bp, Mus musculus
gatgaggtagactctgactttgaca

SEQ ID NO: 666700 - DNA, 25 bp, Mus musculus
gatgaggtagataccctctgtgggt

SEQ ID NO: 666701 - DNA, 25 bp, Mus musculus
gatgaggtagattccctctgtgggt

SEQ ID NO: 666702 - DNA, 25 bp, Mus musculus
gatgaggtccccaatacctcagagg

SEQ ID NO: 666703 - DNA, 25 bp, Mus musculus
gatgaggtcccctatacctcagagg

SEQ ID NO: 666704 - DNA, 25 bp, Mus musculus
gatgaggtcctcatggccttggctg

SEQ ID NO: 666705 - DNA, 25 bp, Mus musculus
gatgaggtcctcttggccttggctg

SEQ ID NO: 666706 - DNA, 25 bp, Mus musculus
gatgaggtgcgcaccctcacatacc

SEQ ID NO: 666707 - DNA, 25 bp, Mus musculus
gatgaggtgcgctccctcacatacc

SEQ ID NO: 666708 - DNA, 25 bp, Mus musculus
gatgaggttcctaaaccagaccagg

SEQ ID NO: 666709 - DNA, 25 bp, Mus musculus
gatgaggttccttaaccagaccagg

SEQ ID NO: 666710 - DNA, 25 bp, Mus musculus
gatgaggttgcccacacgcttactg

SEQ ID NO: 666711 - DNA, 25 bp, Mus musculus
gatgaggttgccgacacgcttactg

SEQ ID NO: 666712 - DNA, 25 bp, Mus musculus
gatgaggttgctccttctgccatcc

SEQ ID NO: 666713 - DNA, 25 bp, Mus musculus
gatgaggttgctgcttctgccatcc

SEQ ID NO: 666714 - DNA, 25 bp, Mus musculus
gatgaggttgtcacagagtattccc

SEQ ID NO: 666715 - DNA, 25 bp, Mus musculus
gatgaggttgtctcagagtattccc

SEQ ID NO: 666716 - DNA, 25 bp, Mus musculus
gatgagtacattcagaaactggcca

SEQ ID NO: 666717 - DNA, 25 bp, Mus musculus
gatgagtacattgagaaactggcca

SEQ ID NO: 666718 - DNA, 25 bp, Mus musculus
gatgagtactatacactgtccaagg

SEQ ID NO: 666719 - DNA, 25 bp, Mus musculus
gatgagtactattcactgtccaagg

SEQ ID NO: 666720 - DNA, 25 bp, Mus musculus
gatgagtactttcttcacaataacg

SEQ ID NO: 666721 - DNA, 25 bp, Mus musculus
gatgagtactttgttcacaataacg

SEQ ID NO: 666722 - DNA, 25 bp, Mus musculus
gatgagtatataaccccgatgttca

SEQ ID NO: 666723 - DNA, 25 bp, Mus musculus
gatgagtatatatccccgatgttca

SEQ ID NO: 666724 - DNA, 25 bp, Mus musculus
gatgagtcatctctcactgggcagc

SEQ ID NO: 666725 - DNA, 25 bp, Mus musculus
gatgagtcatctgtcactgggcagc

SEQ ID NO: 666726 - DNA, 25 bp, Mus musculus
gatgagtccgacctctacaactggg

SEQ ID NO: 666727 - DNA, 25 bp, Mus musculus
gatgagtccgacgtctacaactggg

SEQ ID NO: 666728 - DNA, 25 bp, Mus musculus
gatgagtcctcacacgacctgtgta

SEQ ID NO: 666729 - DNA, 25 bp, Mus musculus
gatgagtcctcagacgacctgtgta

SEQ ID NO: 666730 - DNA, 25 bp, Mus musculus
gatgagtctaacagcaggaacggag

SEQ ID NO: 666731 - DNA, 25 bp, Mus musculus
gatgagtctaactgcaggaacggag

SEQ ID NO: 666732 - DNA, 25 bp, Mus musculus
gatgagtctccactaggcaacctct

SEQ ID NO: 666733 - DNA, 25 bp, Mus musculus
gatgagtctccagtaggcaacctct

SEQ ID NO: 666734 - DNA, 25 bp, Mus musculus
gatgagtctctcaggcagtccctcg

SEQ ID NO: 666735 - DNA, 25 bp, Mus musculus
gatgagtctctctggcagtccctcg

SEQ ID NO: 666736 - DNA, 25 bp, Mus musculus
gatgagtctctgcacgacttcacag

SEQ ID NO: 666737 - DNA, 25 bp, Mus musculus
gatgagtctctggacgacttcacag

SEQ ID NO: 666738 - DNA, 25 bp, Mus musculus
gatgagtctggaactgacactttcg

SEQ ID NO: 666739 - DNA, 25 bp, Mus musculus
gatgagtctggatctgacactttcg

SEQ ID NO: 666740 - DNA, 25 bp, Mus musculus
gatgagtgcagaatatgccccgcag

SEQ ID NO: 666741 - DNA, 25 bp, Mus musculus
gatgagtgcagattatgccccgcag

SEQ ID NO: 666742 - DNA, 25 bp, Mus musculus
gatgagtgccagcagatccccgaga

SEQ ID NO: 666743 - DNA, 25 bp, Mus musculus
gatgagtgccagcatccggctgctt

SEQ ID NO: 666744 - DNA, 25 bp, Mus musculus
gatgagtgccaggagatccccgaga

SEQ ID NO: 666745 - DNA, 25 bp, Mus musculus
gatgagtgccaggatccggctgctt

SEQ ID NO: 666746 - DNA, 25 bp, Mus musculus
gatgagtggtgtagaccgtttctct

SEQ ID NO: 666747 - DNA, 25 bp, Mus musculus
gatgagtggtgttgaccgtttctct

SEQ ID NO: 666748 - DNA, 25 bp, Mus musculus
gatgagtgtctcacaaaccagcaca

SEQ ID NO: 666749 - DNA, 25 bp, Mus musculus
gatgagtgtctctcaaaccagcaca

SEQ ID NO: 666750 - DNA, 25 bp, Mus musculus
gatgagtgtctgagaccctggccag

SEQ ID NO: 666751 - DNA, 25 bp, Mus musculus
gatgagtgtctgtgaccctggccag

SEQ ID NO: 666752 - DNA, 25 bp, Mus musculus
gatgagttacacaaccaggacgtgg

SEQ ID NO: 666753 - DNA, 25 bp, Mus musculus
gatgagttacactaccaggacgtgg

SEQ ID NO: 666754 - DNA, 25 bp, Mus musculus
gatgagttactcagccagctagagg

SEQ ID NO: 666755 - DNA, 25 bp, Mus musculus
gatgagttactctgccagctagagg

SEQ ID NO: 666756 - DNA, 25 bp, Mus musculus
gatgagttcatgcaggcagcgtctt

SEQ ID NO: 666757 - DNA, 25 bp, Mus musculus
gatgagttcatggaggcagcgtctt

SEQ ID NO: 666758 - DNA, 25 bp, Mus musculus
gatgagttcattcaaagttgccaaa

SEQ ID NO: 666759 - DNA, 25 bp, Mus musculus
gatgagttcattgaaagttgccaaa

SEQ ID NO: 666760 - DNA, 25 bp, Mus musculus
gatgagttccttatactagccaggg

SEQ ID NO: 666761 - DNA, 25 bp, Mus musculus
gatgagttccttttactagccaggg

SEQ ID NO: 666762 - DNA, 25 bp, Mus musculus
gatgagtttaatcctgtggacttca

SEQ ID NO: 666763 - DNA, 25 bp, Mus musculus
gatgagtttaatgctgtggacttca

SEQ ID NO: 666764 - DNA, 25 bp, Mus musculus
gatgagtttcttaatcctgaggtga

SEQ ID NO: 666765 - DNA, 25 bp, Mus musculus
gatgagtttctttatcctgaggtga

SEQ ID NO: 666766 - DNA, 25 bp, Mus musculus
gatgagtttggcaacagtcgctaag

SEQ ID NO: 666767 - DNA, 25 bp, Mus musculus
gatgagtttggctacagtcgctaag

SEQ ID NO: 666768 - DNA, 25 bp, Mus musculus
gatgagtttggtatccgtgtggaca

SEQ ID NO: 666769 - DNA, 25 bp, Mus musculus
gatgagtttggtttccgtgtggaca

SEQ ID NO: 666770 - DNA, 25 bp, Mus musculus
gatgataaaactatcagatcttccc

SEQ ID NO: 666771 - DNA, 25 bp, Mus musculus
gatgataaaactttcagatcttccc

SEQ ID NO: 666772 - DNA, 25 bp, Mus musculus
gatgataaaccaatatgcccgtgca

SEQ ID NO: 666773 - DNA, 25 bp, Mus musculus
gatgataaaccattatgcccgtgca

SEQ ID NO: 666774 - DNA, 25 bp, Mus musculus
gatgataacagtagttgccagccca

SEQ ID NO: 666775 - DNA, 25 bp, Mus musculus
gatgataacagttgttgccagccca

SEQ ID NO: 666776 - DNA, 25 bp, Mus musculus
gatgataacatcaaaacatactctg

SEQ ID NO: 666777 - DNA, 25 bp, Mus musculus
gatgataacatctaaacatactctg

SEQ ID NO: 666778 - DNA, 25 bp, Mus musculus
gatgatacaccgctggttcttgtgg

SEQ ID NO: 666779 - DNA, 25 bp, Mus musculus
gatgatacaccggtggttcttgtgg

SEQ ID NO: 666780 - DNA, 25 bp, Mus musculus
gatgatacacctattgatgaaccac

SEQ ID NO: 666781 - DNA, 25 bp, Mus musculus
gatgatacaccttttgatgaaccac

SEQ ID NO: 666782 - DNA, 25 bp, Mus musculus
gatgatacagtactgcccctggccg

SEQ ID NO: 666783 - DNA, 25 bp, Mus musculus
gatgatacagtagtgcccctggccg

SEQ ID NO: 666784 - DNA, 25 bp, Mus musculus
gatgatacgtatacggaaagctaca

SEQ ID NO: 666785 - DNA, 25 bp, Mus musculus
gatgatacgtattcggaaagctaca

SEQ ID NO: 666786 - DNA, 25 bp, Mus musculus
gatgatactcatacacgcattgaac

SEQ ID NO: 666787 - DNA, 25 bp, Mus musculus
gatgatactcattcacgcattgaac

SEQ ID NO: 666788 - DNA, 25 bp, Mus musculus
gatgatacttcgcttcaggacaagg

SEQ ID NO: 666789 - DNA, 25 bp, Mus musculus
gatgatacttcggttcaggacaagg

SEQ ID NO: 666790 - DNA, 25 bp, Mus musculus
gatgatagaatgaatccagcagctg

SEQ ID NO: 666791 - DNA, 25 bp, Mus musculus
gatgatagaatgtatccagcagctg

SEQ ID NO: 666792 - DNA, 25 bp, Mus musculus
gatgatagagaaatgaccaagaaaa

SEQ ID NO: 666793 - DNA, 25 bp, Mus musculus
gatgatagagaattgaccaagaaaa

SEQ ID NO: 666794 - DNA, 25 bp, Mus musculus
gatgataggaacaaattaactgaac

SEQ ID NO: 666795 - DNA, 25 bp, Mus musculus
gatgataggaactaattaactgaac

SEQ ID NO: 666796 - DNA, 25 bp, Mus musculus
gatgataggctaaatcaaagcctat

SEQ ID NO: 666797 - DNA, 25 bp, Mus musculus
gatgataggctatatcaaagcctat

SEQ ID NO: 666798 - DNA, 25 bp, Mus musculus
gatgatataaaacaatggctagacg

SEQ ID NO: 666799 - DNA, 25 bp, Mus musculus
gatgatataaaagaatggctagacg

SEQ ID NO: 666800 - DNA, 25 bp, Mus musculus
gatgatataatgaccgtgaatccta

SEQ ID NO: 666801 - DNA, 25 bp, Mus musculus
gatgatataatgtccgtgaatccta

SEQ ID NO: 666802 - DNA, 25 bp, Mus musculus
gatgatatacccaagattgcttgac

SEQ ID NO: 666803 - DNA, 25 bp, Mus musculus
gatgatataccctagattgcttgac

SEQ ID NO: 666804 - DNA, 25 bp, Mus musculus
gatgatatctacaatgttctttcca

SEQ ID NO: 666805 - DNA, 25 bp, Mus musculus
gatgatatctactatgttctttcca

SEQ ID NO: 666806 - DNA, 25 bp, Mus musculus
gatgatattcctaaggaaaacttcc

SEQ ID NO: 666807 - DNA, 25 bp, Mus musculus
gatgatattcctagtgcccttcgca

SEQ ID NO: 666808 - DNA, 25 bp, Mus musculus
gatgatattccttaggaaaacttcc

SEQ ID NO: 666809 - DNA, 25 bp, Mus musculus
gatgatattccttgtgcccttcgca

SEQ ID NO: 666810 - DNA, 25 bp, Mus musculus
gatgatcacagaatcctgcctggaa

SEQ ID NO: 666811 - DNA, 25 bp, Mus musculus
gatgatcacagattcctgcctggaa

SEQ ID NO: 666812 - DNA, 25 bp, Mus musculus
gatgatcacatactgccagccaggg

SEQ ID NO: 666813 - DNA, 25 bp, Mus musculus
gatgatcacatagtgccagccaggg

SEQ ID NO: 666814 - DNA, 25 bp, Mus musculus
gatgatcaccatcacgccgcctgat

SEQ ID NO: 666815 - DNA, 25 bp, Mus musculus
gatgatcaccatgacgccgcctgat

SEQ ID NO: 666816 - DNA, 25 bp, Mus musculus
gatgatcatgcacgataaactggag

SEQ ID NO: 666817 - DNA, 25 bp, Mus musculus
gatgatcatgcaggataaactggag

SEQ ID NO: 666818 - DNA, 25 bp, Mus musculus
gatgatcatgctcggagctatctgt

SEQ ID NO: 666819 - DNA, 25 bp, Mus musculus
gatgatcatgctgggagctatctgt

SEQ ID NO: 666820 - DNA, 25 bp, Mus musculus
gatgatcatgtgatccgctggctgg

SEQ ID NO: 666821 - DNA, 25 bp, Mus musculus
gatgatcatgtgttccgctggctgg

SEQ ID NO: 666822 - DNA, 25 bp, Mus musculus
gatgatcattttacaccggaggcag

SEQ ID NO: 666823 - DNA, 25 bp, Mus musculus
gatgatcatttttcaccggaggcag

SEQ ID NO: 666824 - DNA, 25 bp, Mus musculus
gatgatccagaactctgtgacctct

SEQ ID NO: 666825 - DNA, 25 bp, Mus musculus
gatgatccagaagtctgtgacctct

SEQ ID NO: 666826 - DNA, 25 bp, Mus musculus
gatgatccagcactgcgtggacgcc

SEQ ID NO: 666827 - DNA, 25 bp, Mus musculus
gatgatccagcagtgcgtggacgcc

SEQ ID NO: 666828 - DNA, 25 bp, Mus musculus
gatgatccagtcaccaacctaaaca

SEQ ID NO: 666829 - DNA, 25 bp, Mus musculus
gatgatccagtctccaacctaaaca

SEQ ID NO: 666830 - DNA, 25 bp, Mus musculus
gatgatcccgagctccagttcagct

SEQ ID NO: 666831 - DNA, 25 bp, Mus musculus
gatgatcccgaggtccagttcagct

SEQ ID NO: 666832 - DNA, 25 bp, Mus musculus
gatgatccggagcacttagctgcca

SEQ ID NO: 666833 - DNA, 25 bp, Mus musculus
gatgatccggaggacttagctgcca

SEQ ID NO: 666834 - DNA, 25 bp, Mus musculus
gatgatccggctatcggcggccctt

SEQ ID NO: 666835 - DNA, 25 bp, Mus musculus
gatgatccggctttcggcggccctt

SEQ ID NO: 666836 - DNA, 25 bp, Mus musculus
gatgatcctccgatacgctcacatg

SEQ ID NO: 666837 - DNA, 25 bp, Mus musculus
gatgatcctccgttacgctcacatg

SEQ ID NO: 666838 - DNA, 25 bp, Mus musculus
gatgatcctgacctgacctgaggga

SEQ ID NO: 666839 - DNA, 25 bp, Mus musculus
gatgatcctgacgtgacctgaggga

SEQ ID NO: 666840 - DNA, 25 bp, Mus musculus
gatgatcctgttcactatgaggcca

SEQ ID NO: 666841 - DNA, 25 bp, Mus musculus
gatgatcctgttgactatgaggcca

SEQ ID NO: 666842 - DNA, 25 bp, Mus musculus
gatgatcgaaagcaatggttaacta

SEQ ID NO: 666843 - DNA, 25 bp, Mus musculus
gatgatcgaaaggaatggttaacta

SEQ ID NO: 666844 - DNA, 25 bp, Mus musculus
gatgatcgaacacatccagttcatc

SEQ ID NO: 666845 - DNA, 25 bp, Mus musculus
gatgatcgaacagatccagttcatc

SEQ ID NO: 666846 - DNA, 25 bp, Mus musculus
gatgatcgggtgaacccattcctgc

SEQ ID NO: 666847 - DNA, 25 bp, Mus musculus
gatgatcgggtgtacccattcctgc

SEQ ID NO: 666848 - DNA, 25 bp, Mus musculus
gatgatctaattcgtcctgagtggc

SEQ ID NO: 666849 - DNA, 25 bp, Mus musculus
gatgatctaattggtcctgagtggc

SEQ ID NO: 666850 - DNA, 25 bp, Mus musculus
gatgatctacacattgtggattccc

SEQ ID NO: 666851 - DNA, 25 bp, Mus musculus
gatgatctacactttgtggattccc

SEQ ID NO: 666852 - DNA, 25 bp, Mus musculus
gatgatctccgtcttgcaacaagga

SEQ ID NO: 666853 - DNA, 25 bp, Mus musculus
gatgatctccgtgttgcaacaagga

SEQ ID NO: 666854 - DNA, 25 bp, Mus musculus
gatgatctgaaacatgaattctgtg

SEQ ID NO: 666855 - DNA, 25 bp, Mus musculus
gatgatctgaaagatgaattctgtg

SEQ ID NO: 666856 - DNA, 25 bp, Mus musculus
gatgatctgaacctacgctgcgagt

SEQ ID NO: 666857 - DNA, 25 bp, Mus musculus
gatgatctgaacgtacgctgcgagt

SEQ ID NO: 666858 - DNA, 25 bp, Mus musculus
gatgatctgcgccaagacatgttga

SEQ ID NO: 666859 - DNA, 25 bp, Mus musculus
gatgatctgcgcgaagacatgttga

SEQ ID NO: 666860 - DNA, 25 bp, Mus musculus
gatgatctggctagagttctgaaca

SEQ ID NO: 666861 - DNA, 25 bp, Mus musculus
gatgatctggcttgagttctgaaca

SEQ ID NO: 666862 - DNA, 25 bp, Mus musculus
gatgatctgtaccacaagaggctga

SEQ ID NO: 666863 - DNA, 25 bp, Mus musculus
gatgatctgtacgacaagaggctga

SEQ ID NO: 666864 - DNA, 25 bp, Mus musculus
gatgatcttcttctcagcacatcca

SEQ ID NO: 666865 - DNA, 25 bp, Mus musculus
gatgatcttcttgtcagcacatcca

SEQ ID NO: 666866 - DNA, 25 bp, Mus musculus
gatgatgaaagccagtacctcccgt

SEQ ID NO: 666867 - DNA, 25 bp, Mus musculus
gatgatgaaagcgagtacctcccgt

SEQ ID NO: 666868 - DNA, 25 bp, Mus musculus
gatgatgaaccacgttatgacctag

SEQ ID NO: 666869 - DNA, 25 bp, Mus musculus
gatgatgaaccaggttatgacctag

SEQ ID NO: 666870 - DNA, 25 bp, Mus musculus
gatgatgaactaaacatccggtctg

SEQ ID NO: 666871 - DNA, 25 bp, Mus musculus
gatgatgaactatacatccggtctg

SEQ ID NO: 666872 - DNA, 25 bp, Mus musculus
gatgatgaactgagccgtcaggcac

SEQ ID NO: 666873 - DNA, 25 bp, Mus musculus
gatgatgaactgtgccgtcaggcac

SEQ ID NO: 666874 - DNA, 25 bp, Mus musculus
gatgatgaacttacctaccggcgag

SEQ ID NO: 666875 - DNA, 25 bp, Mus musculus
gatgatgaactttcctaccggcgag

SEQ ID NO: 666876 - DNA, 25 bp, Mus musculus
gatgatgaagcacctgtggatttaa

SEQ ID NO: 666877 - DNA, 25 bp, Mus musculus
gatgatgaagcagctgtggatttaa

SEQ ID NO: 666878 - DNA, 25 bp, Mus musculus
gatgatgaagttcaacaagttctcc

SEQ ID NO: 666879 - DNA, 25 bp, Mus musculus
gatgatgaagttgaacaagttctcc

SEQ ID NO: 666880 - DNA, 25 bp, Mus musculus
gatgatgaattaagccagaaggttc

SEQ ID NO: 666881 - DNA, 25 bp, Mus musculus
gatgatgaattatgccagaaggttc

SEQ ID NO: 666882 - DNA, 25 bp, Mus musculus
gatgatgacataagtccctgaggaa

SEQ ID NO: 666883 - DNA, 25 bp, Mus musculus
gatgatgacatatgtccctgaggaa

SEQ ID NO: 666884 - DNA, 25 bp, Mus musculus
gatgatgacatgaagttagcctgcg

SEQ ID NO: 666885 - DNA, 25 bp, Mus musculus
gatgatgacatgtagttagcctgcg

SEQ ID NO: 666886 - DNA, 25 bp, Mus musculus
gatgatgaccagatgtgtaatgaca

SEQ ID NO: 666887 - DNA, 25 bp, Mus musculus
gatgatgaccagttgtgtaatgaca

SEQ ID NO: 666888 - DNA, 25 bp, Mus musculus
gatgatgaccatcaaactaaacgac

SEQ ID NO: 666889 - DNA, 25 bp, Mus musculus
gatgatgaccatgaaactaaacgac

SEQ ID NO: 666890 - DNA, 25 bp, Mus musculus
gatgatgaccggacagcaggcattc

SEQ ID NO: 666891 - DNA, 25 bp, Mus musculus
gatgatgaccggtcagcaggcattc

SEQ ID NO: 666892 - DNA, 25 bp, Mus musculus
gatgatgacgtcagccatgtggatg

SEQ ID NO: 666893 - DNA, 25 bp, Mus musculus
gatgatgacgtctgccatgtggatg

SEQ ID NO: 666894 - DNA, 25 bp, Mus musculus
gatgatgactgccaagtgaaggccc

SEQ ID NO: 666895 - DNA, 25 bp, Mus musculus
gatgatgactgcgaagtgaaggccc

SEQ ID NO: 666896 - DNA, 25 bp, Mus musculus
gatgatgagataaaccgagactggt

SEQ ID NO: 666897 - DNA, 25 bp, Mus musculus
gatgatgagatataccgagactggt

SEQ ID NO: 666898 - DNA, 25 bp, Mus musculus
gatgatgagcgccttaaggaactct

SEQ ID NO: 666899 - DNA, 25 bp, Mus musculus
gatgatgagcgcgttaaggaactct

SEQ ID NO: 666900 - DNA, 25 bp, Mus musculus
gatgatgagtatcaaggagaccagt

SEQ ID NO: 666901 - DNA, 25 bp, Mus musculus
gatgatgagtatgaaggagaccagt

SEQ ID NO: 666902 - DNA, 25 bp, Mus musculus
gatgatgagtcactgcaacctctgg

SEQ ID NO: 666903 - DNA, 25 bp, Mus musculus
gatgatgagtcagtgcaacctctgg

SEQ ID NO: 666904 - DNA, 25 bp, Mus musculus
gatgatgatgatctaccacacagta

SEQ ID NO: 666905 - DNA, 25 bp, Mus musculus
gatgatgatgatgtaccacacagta

SEQ ID NO: 666906 - DNA, 25 bp, Mus musculus
gatgatgattaccttgaaaatgaag

SEQ ID NO: 666907 - DNA, 25 bp, Mus musculus
gatgatgattacgttgaaaatgaag

SEQ ID NO: 666908 - DNA, 25 bp, Mus musculus
gatgatgattccaccttacgtggac

SEQ ID NO: 666909 - DNA, 25 bp, Mus musculus
gatgatgattcctccttacgtggac

SEQ ID NO: 666910 - DNA, 25 bp, Mus musculus
gatgatgatttcatccaaaatttgg

SEQ ID NO: 666911 - DNA, 25 bp, Mus musculus
gatgatgatttcttccaaaatttgg

SEQ ID NO: 666912 - DNA, 25 bp, Mus musculus
gatgatgcacccaaagactacagac

SEQ ID NO: 666913 - DNA, 25 bp, Mus musculus
gatgatgcaccctaagactacagac

SEQ ID NO: 666914 - DNA, 25 bp, Mus musculus
gatgatgcagagacaggcctgactg

SEQ ID NO: 666915 - DNA, 25 bp, Mus musculus
gatgatgcagagtcaggcctgactg

SEQ ID NO: 666916 - DNA, 25 bp, Mus musculus
gatgatgcatggacgtaacaacggc

SEQ ID NO: 666917 - DNA, 25 bp, Mus musculus
gatgatgcatggtcgtaacaacggc

SEQ ID NO: 666918 - DNA, 25 bp, Mus musculus
gatgatgccagcatccacgaccgtc

SEQ ID NO: 666919 - DNA, 25 bp, Mus musculus
gatgatgccagcttccacgaccgtc

SEQ ID NO: 666920 - DNA, 25 bp, Mus musculus
gatgatgcccggaagctcatgcaca

SEQ ID NO: 666921 - DNA, 25 bp, Mus musculus
gatgatgcccggtagctcatgcaca

SEQ ID NO: 666922 - DNA, 25 bp, Mus musculus
gatgatgcgggactgctggcatgca

SEQ ID NO: 666923 - DNA, 25 bp, Mus musculus
gatgatgcgggagtgctggcatgca

SEQ ID NO: 666924 - DNA, 25 bp, Mus musculus
gatgatgcgggcacggcagtatcct

SEQ ID NO: 666925 - DNA, 25 bp, Mus musculus
gatgatgcgggctcggcagtatcct

SEQ ID NO: 666926 - DNA, 25 bp, Mus musculus
gatgatgcgtggactgcctaaacgc

SEQ ID NO: 666927 - DNA, 25 bp, Mus musculus
gatgatgcgtggtctgcctaaacgc

SEQ ID NO: 666928 - DNA, 25 bp, Mus musculus
gatgatgctcctcaaccagactggc

SEQ ID NO: 666929 - DNA, 25 bp, Mus musculus
gatgatgctcctgaaccagactggc

SEQ ID NO: 666930 - DNA, 25 bp, Mus musculus
gatgatgctgccaatttcagaactg

SEQ ID NO: 666931 - DNA, 25 bp, Mus musculus
gatgatgctgcctatttcagaactg

SEQ ID NO: 666932 - DNA, 25 bp, Mus musculus
gatgatgctgcgacccattaaggat

SEQ ID NO: 666933 - DNA, 25 bp, Mus musculus
gatgatgctgcgtcccattaaggat

SEQ ID NO: 666934 - DNA, 25 bp, Mus musculus
gatgatgcttacaaatctcagctca

SEQ ID NO: 666935 - DNA, 25 bp, Mus musculus
gatgatgcttactaatctcagctca

SEQ ID NO: 666936 - DNA, 25 bp, Mus musculus
gatgatgcttctcgtaggaagcacc

SEQ ID NO: 666937 - DNA, 25 bp, Mus musculus
gatgatgcttctggtaggaagcacc

SEQ ID NO: 666938 - DNA, 25 bp, Mus musculus
gatgatggacctaggactcctaatg

SEQ ID NO: 666939 - DNA, 25 bp, Mus musculus
gatgatggaccttggactcctaatg

SEQ ID NO: 666940 - DNA, 25 bp, Mus musculus
gatgatggagaacctctcggacaca

SEQ ID NO: 666941 - DNA, 25 bp, Mus musculus
gatgatggagaagctctcggacaca

SEQ ID NO: 666942 - DNA, 25 bp, Mus musculus
gatgatggatgccaaagccaggcaa

SEQ ID NO: 666943 - DNA, 25 bp, Mus musculus
gatgatggatgcgaaagccaggcaa

SEQ ID NO: 666944 - DNA, 25 bp, Mus musculus
gatgatggcaaaccaggcctgaatg

SEQ ID NO: 666945 - DNA, 25 bp, Mus musculus
gatgatggcaaagcaggcctgaatg

SEQ ID NO: 666946 - DNA, 25 bp, Mus musculus
gatgatggcacaaacatcagtaagc

SEQ ID NO: 666947 - DNA, 25 bp, Mus musculus
gatgatggcacatacatcagtaagc

SEQ ID NO: 666948 - DNA, 25 bp, Mus musculus
gatgatggcactacacaacagccta

SEQ ID NO: 666949 - DNA, 25 bp, Mus musculus
gatgatggcactcttggaaagtatg

SEQ ID NO: 666950 - DNA, 25 bp, Mus musculus
gatgatggcactgttggaaagtatg

SEQ ID NO: 666951 - DNA, 25 bp, Mus musculus
gatgatggcacttcacaacagccta

SEQ ID NO: 666952 - DNA, 25 bp, Mus musculus
gatgatgggaatctgaaagagctct

SEQ ID NO: 666953 - DNA, 25 bp, Mus musculus
gatgatgggaatgtgaaagagctct

SEQ ID NO: 666954 - DNA, 25 bp, Mus musculus
gatgatggttctcccgttattgata

SEQ ID NO: 666955 - DNA, 25 bp, Mus musculus
gatgatggttctgccgttattgata

SEQ ID NO: 666956 - DNA, 25 bp, Mus musculus
gatgatgtattgagaattcagctcc

SEQ ID NO: 666957 - DNA, 25 bp, Mus musculus
gatgatgtattgtgaattcagctcc

SEQ ID NO: 666958 - DNA, 25 bp, Mus musculus
gatgatgtcaacctggagattgtct

SEQ ID NO: 666959 - DNA, 25 bp, Mus musculus
gatgatgtcaacgtggagattgtct

SEQ ID NO: 666960 - DNA, 25 bp, Mus musculus
gatgatgtcaagattcacggtgacc

SEQ ID NO: 666961 - DNA, 25 bp, Mus musculus
gatgatgtcaagtttcacggtgacc

SEQ ID NO: 666962 - DNA, 25 bp, Mus musculus
gatgatgtcaccacaagaagtattg

SEQ ID NO: 666963 - DNA, 25 bp, Mus musculus
gatgatgtcaccagccactgtagtt

SEQ ID NO: 666964 - DNA, 25 bp, Mus musculus
gatgatgtcacctcaagaagtattg

SEQ ID NO: 666965 - DNA, 25 bp, Mus musculus
gatgatgtcacctgccactgtagtt

SEQ ID NO: 666966 - DNA, 25 bp, Mus musculus
gatgatgtcatcacggagccagtta

SEQ ID NO: 666967 - DNA, 25 bp, Mus musculus
gatgatgtcatctcggagccagtta

SEQ ID NO: 666968 - DNA, 25 bp, Mus musculus
gatgatgtcgcaaccacagagaaag

SEQ ID NO: 666969 - DNA, 25 bp, Mus musculus
gatgatgtcgcatccacagagaaag

SEQ ID NO: 666970 - DNA, 25 bp, Mus musculus
gatgatgtcgctcgatacaagtgca

SEQ ID NO: 666971 - DNA, 25 bp, Mus musculus
gatgatgtcgctggatacaagtgca

SEQ ID NO: 666972 - DNA, 25 bp, Mus musculus
gatgatgtctacactgtcttcggtg

SEQ ID NO: 666973 - DNA, 25 bp, Mus musculus
gatgatgtctactctgtcttcggtg

SEQ ID NO: 666974 - DNA, 25 bp, Mus musculus
gatgatgtctggatcctgaccaaga

SEQ ID NO: 666975 - DNA, 25 bp, Mus musculus
gatgatgtctggttcctgaccaaga

SEQ ID NO: 666976 - DNA, 25 bp, Mus musculus
gatgatgtgattctcacagcctcca

SEQ ID NO: 666977 - DNA, 25 bp, Mus musculus
gatgatgtgattgtcacagcctcca

SEQ ID NO: 666978 - DNA, 25 bp, Mus musculus
gatgatgtggatccctcagacttcc

SEQ ID NO: 666979 - DNA, 25 bp, Mus musculus
gatgatgtggatgcctcagacttcc

SEQ ID NO: 666980 - DNA, 25 bp, Mus musculus
gatgatgttcacctcactataggag

SEQ ID NO: 666981 - DNA, 25 bp, Mus musculus
gatgatgttcacgtcactataggag

SEQ ID NO: 666982 - DNA, 25 bp, Mus musculus
gatgatgtttggcaactgcagaaga

SEQ ID NO: 666983 - DNA, 25 bp, Mus musculus
gatgatgtttgggaactgcagaaga

SEQ ID NO: 666984 - DNA, 25 bp, Mus musculus
gatgattaacacaagacgccgcagg

SEQ ID NO: 666985 - DNA, 25 bp, Mus musculus
gatgattaacactagacgccgcagg

SEQ ID NO: 666986 - DNA, 25 bp, Mus musculus
gatgattcacatcccagggcttcgg

SEQ ID NO: 666987 - DNA, 25 bp, Mus musculus
gatgattcacatgccagggcttcgg

SEQ ID NO: 666988 - DNA, 25 bp, Mus musculus
gatgattcagacacctggacccttg

SEQ ID NO: 666989 - DNA, 25 bp, Mus musculus
gatgattcagactcctggacccttg

SEQ ID NO: 666990 - DNA, 25 bp, Mus musculus
gatgattcctctagatcccaaagga

SEQ ID NO: 666991 - DNA, 25 bp, Mus musculus
gatgattcctcttgatcccaaagga

SEQ ID NO: 666992 - DNA, 25 bp, Mus musculus
gatgattcgacccaagactgagaac

SEQ ID NO: 666993 - DNA, 25 bp, Mus musculus
gatgattcgaccgaagactgagaac

SEQ ID NO: 666994 - DNA, 25 bp, Mus musculus
gatgattcgccaaaggaaatagcaa

SEQ ID NO: 666995 - DNA, 25 bp, Mus musculus
gatgattcgccataggaaatagcaa

SEQ ID NO: 666996 - DNA, 25 bp, Mus musculus
gatgattctaccacgggaccagaag

SEQ ID NO: 666997 - DNA, 25 bp, Mus musculus
gatgattctacctcgggaccagaag

SEQ ID NO: 666998 - DNA, 25 bp, Mus musculus
gatgattctcttcctgaaaatccaa

SEQ ID NO: 666999 - DNA, 25 bp, Mus musculus
gatgattctcttgctgaaaatccaa

SEQ ID NO: 667000 - DNA, 25 bp, Mus musculus
gatgattgaaatcccagtcccaact

SEQ ID NO: 667001 - DNA, 25 bp, Mus musculus
gatgattgaaatgccagtcccaact

SEQ ID NO: 667002 - DNA, 25 bp, Mus musculus
gatgattgacatccagaccaagatg

SEQ ID NO: 667003 - DNA, 25 bp, Mus musculus
gatgattgacatgcagaccaagatg

SEQ ID NO: 667004 - DNA, 25 bp, Mus musculus
gatgattgaggaaggtcactacgcc

SEQ ID NO: 667005 - DNA, 25 bp, Mus musculus
gatgattgaggatggtcactacgcc

SEQ ID NO: 667006 - DNA, 25 bp, Mus musculus
gatgattgaggtccctgtcctctcg

SEQ ID NO: 667007 - DNA, 25 bp, Mus musculus
gatgattgaggtgcctgtcctctcg

SEQ ID NO: 667008 - DNA, 25 bp, Mus musculus
gatgattgccacaagactttatccc

SEQ ID NO: 667009 - DNA, 25 bp, Mus musculus
gatgattgccactagactttatccc

SEQ ID NO: 667010 - DNA, 25 bp, Mus musculus
gatgattggcgacatcctgagcgcc

SEQ ID NO: 667011 - DNA, 25 bp, Mus musculus
gatgattggcgagatcctgagcgcc

SEQ ID NO: 667012 - DNA, 25 bp, Mus musculus
gatgattgggaaacataagaacatt

SEQ ID NO: 667013 - DNA, 25 bp, Mus musculus
gatgattgggaatcataagaacatt

SEQ ID NO: 667014 - DNA, 25 bp, Mus musculus
gatgattgttctcatgcatggacag

SEQ ID NO: 667015 - DNA, 25 bp, Mus musculus
gatgattgttctgatgcatggacag

SEQ ID NO: 667016 - DNA, 25 bp, Mus musculus
gatgatttcaaaaccgtggtcagcg

SEQ ID NO: 667017 - DNA, 25 bp, Mus musculus
gatgatttcaaatccgtggtcagcg

SEQ ID NO: 667018 - DNA, 25 bp, Mus musculus
gatgatttctccatggatgagaatg

SEQ ID NO: 667019 - DNA, 25 bp, Mus musculus
gatgatttctccttggatgagaatg

SEQ ID NO: 667020 - DNA, 25 bp, Mus musculus
gatgatttgcacattacccttgggc

SEQ ID NO: 667021 - DNA, 25 bp, Mus musculus
gatgatttgcactttacccttgggc

SEQ ID NO: 667022 - DNA, 25 bp, Mus musculus
gatgatttttggagaagtttatgca

SEQ ID NO: 667023 - DNA, 25 bp, Mus musculus
gatgatttttggtgaagtttatgca

SEQ ID NO: 667024 - DNA, 25 bp, Mus musculus
gatgcaaaacgtctgcatggccttg

SEQ ID NO: 667025 - DNA, 25 bp, Mus musculus
gatgcaaaacgtgtgcatggccttg

SEQ ID NO: 667026 - DNA, 25 bp, Mus musculus
gatgcaaaagtcatgtcatggtggg

SEQ ID NO: 667027 - DNA, 25 bp, Mus musculus
gatgcaaaagtcttgtcatggtggg

SEQ ID NO: 667028 - DNA, 25 bp, Mus musculus
gatgcaaacagtctcctaagttcct

SEQ ID NO: 667029 - DNA, 25 bp, Mus musculus
gatgcaaacagtgtcctaagttcct

SEQ ID NO: 667030 - DNA, 25 bp, Mus musculus
gatgcaaacccaccaatgagccctg

SEQ ID NO: 667031 - DNA, 25 bp, Mus musculus
gatgcaaacccagcaatgagccctg

SEQ ID NO: 667032 - DNA, 25 bp, Mus musculus
gatgcaaagaatccaaatttaagga

SEQ ID NO: 667033 - DNA, 25 bp, Mus musculus
gatgcaaagaatgcaaatttaagga

SEQ ID NO: 667034 - DNA, 25 bp, Mus musculus
gatgcaaagactctccttcgcccgt

SEQ ID NO: 667035 - DNA, 25 bp, Mus musculus
gatgcaaagactgtccttcgcccgt

SEQ ID NO: 667036 - DNA, 25 bp, Mus musculus
gatgcaaatcctcaaattcaagacc

SEQ ID NO: 667037 - DNA, 25 bp, Mus musculus
gatgcaaatcctgaaattcaagacc

SEQ ID NO: 667038 - DNA, 25 bp, Mus musculus
gatgcaaatgacagctggcacttgg

SEQ ID NO: 667039 - DNA, 25 bp, Mus musculus
gatgcaaatgactgctggcacttgg

SEQ ID NO: 667040 - DNA, 25 bp, Mus musculus
gatgcaaattcaaccaacagcagag

SEQ ID NO: 667041 - DNA, 25 bp, Mus musculus
gatgcaaattcatccaacagcagag

SEQ ID NO: 667042 - DNA, 25 bp, Mus musculus
gatgcaacagacaaatgttgccctg

SEQ ID NO: 667043 - DNA, 25 bp, Mus musculus
gatgcaacagactaatgttgccctg

SEQ ID NO: 667044 - DNA, 25 bp, Mus musculus
gatgcaacgattagcccagcagcac

SEQ ID NO: 667045 - DNA, 25 bp, Mus musculus
gatgcaacgatttgcccagcagcac

SEQ ID NO: 667046 - DNA, 25 bp, Mus musculus
gatgcaactaagataaggccaaagg

SEQ ID NO: 667047 - DNA, 25 bp, Mus musculus
gatgcaactaagttaaggccaaagg

SEQ ID NO: 667048 - DNA, 25 bp, Mus musculus
gatgcaacttttaatctcaccaagg

SEQ ID NO: 667049 - DNA, 25 bp, Mus musculus
gatgcaactttttatctcaccaagg

SEQ ID NO: 667050 - DNA, 25 bp, Mus musculus
gatgcaagaagaaatttttggacca

SEQ ID NO: 667051 - DNA, 25 bp, Mus musculus
gatgcaagaagatatttttggacca

SEQ ID NO: 667052 - DNA, 25 bp, Mus musculus
gatgcaagacgtcggacaaaaaagc

SEQ ID NO: 667053 - DNA, 25 bp, Mus musculus
gatgcaagacgtgggacaaaaaagc

SEQ ID NO: 667054 - DNA, 25 bp, Mus musculus
gatgcaagatcacaatgtccctgaa

SEQ ID NO: 667055 - DNA, 25 bp, Mus musculus
gatgcaagatcagaatgtccctgaa

SEQ ID NO: 667056 - DNA, 25 bp, Mus musculus
gatgcaagcaaacaaccttttccct

SEQ ID NO: 667057 - DNA, 25 bp, Mus musculus
gatgcaagcaaagaaccttttccct

SEQ ID NO: 667058 - DNA, 25 bp, Mus musculus
gatgcaataccacttgtacttcacg

SEQ ID NO: 667059 - DNA, 25 bp, Mus musculus
gatgcaataccagttgtacttcacg

SEQ ID NO: 667060 - DNA, 25 bp, Mus musculus
gatgcaatataccagcctagtccct

SEQ ID NO: 667061 - DNA, 25 bp, Mus musculus
gatgcaatatacgagcctagtccct

SEQ ID NO: 667062 - DNA, 25 bp, Mus musculus
gatgcaatccaaaagaagatcacag

SEQ ID NO: 667063 - DNA, 25 bp, Mus musculus
gatgcaatccaatagaagatcacag

SEQ ID NO: 667064 - DNA, 25 bp, Mus musculus
gatgcaatggatcgtgagcttgtct

SEQ ID NO: 667065 - DNA, 25 bp, Mus musculus
gatgcaatggatggtgagcttgtct

SEQ ID NO: 667066 - DNA, 25 bp, Mus musculus
gatgcaatgttgatcgagaagttcg

SEQ ID NO: 667067 - DNA, 25 bp, Mus musculus
gatgcaatgttgttcgagaagttcg

SEQ ID NO: 667068 - DNA, 25 bp, Mus musculus
gatgcaattcgaagtcacagtgaat

SEQ ID NO: 667069 - DNA, 25 bp, Mus musculus
gatgcaattcgatgtcacagtgaat

SEQ ID NO: 667070 - DNA, 25 bp, Mus musculus
gatgcaattttaacccgaagaatcg

SEQ ID NO: 667071 - DNA, 25 bp, Mus musculus
gatgcaattttatcccgaagaatcg

SEQ ID NO: 667072 - DNA, 25 bp, Mus musculus
gatgcaatttttcaagatgatggca

SEQ ID NO: 667073 - DNA, 25 bp, Mus musculus
gatgcaatttttgaagatgatggca

SEQ ID NO: 667074 - DNA, 25 bp, Mus musculus
gatgcacacctgagagctcagcact

SEQ ID NO: 667075 - DNA, 25 bp, Mus musculus
gatgcacacctgtgagctcagcact

SEQ ID NO: 667076 - DNA, 25 bp, Mus musculus
gatgcacacgctccagcgacacaga

SEQ ID NO: 667077 - DNA, 25 bp, Mus musculus
gatgcacacgctgcagcgacacaga

SEQ ID NO: 667078 - DNA, 25 bp, Mus musculus
gatgcacagccacacatccagtggc

SEQ ID NO: 667079 - DNA, 25 bp, Mus musculus
gatgcacagccagacatccagtggc

SEQ ID NO: 667080 - DNA, 25 bp, Mus musculus
gatgcacaggccattcataactggc

SEQ ID NO: 667081 - DNA, 25 bp, Mus musculus
gatgcacaggcctttcataactggc

SEQ ID NO: 667082 - DNA, 25 bp, Mus musculus
gatgcacatatccaagctgagagac

SEQ ID NO: 667083 - DNA, 25 bp, Mus musculus
gatgcacatatcgaagctgagagac

SEQ ID NO: 667084 - DNA, 25 bp, Mus musculus
gatgcacccaaacactacagacaag

SEQ ID NO: 667085 - DNA, 25 bp, Mus musculus
gatgcacccaaagactacagacaag

SEQ ID NO: 667086 - DNA, 25 bp, Mus musculus
gatgcacccagcctgaaaggactga

SEQ ID NO: 667087 - DNA, 25 bp, Mus musculus
gatgcacccagcgtgaaaggactga

SEQ ID NO: 667088 - DNA, 25 bp, Mus musculus
gatgcacctagaaaattggtctctc

SEQ ID NO: 667089 - DNA, 25 bp, Mus musculus
gatgcacctagataattggtctctc

SEQ ID NO: 667090 - DNA, 25 bp, Mus musculus
gatgcacctggcagcattaatggag

SEQ ID NO: 667091 - DNA, 25 bp, Mus musculus
gatgcacctggctgcattaatggag

SEQ ID NO: 667092 - DNA, 25 bp, Mus musculus
gatgcacgtaagagcccggttcccg

SEQ ID NO: 667093 - DNA, 25 bp, Mus musculus
gatgcacgtaagtgcccggttcccg

SEQ ID NO: 667094 - DNA, 25 bp, Mus musculus
gatgcacgttcgagcagccaacatc

SEQ ID NO: 667095 - DNA, 25 bp, Mus musculus
gatgcacgttcgtgcagccaacatc

SEQ ID NO: 667096 - DNA, 25 bp, Mus musculus
gatgcactagttacgtttcctgttg

SEQ ID NO: 667097 - DNA, 25 bp, Mus musculus
gatgcactagtttcgtttcctgttg

SEQ ID NO: 667098 - DNA, 25 bp, Mus musculus
gatgcactatgacatgctcttcaac

SEQ ID NO: 667099 - DNA, 25 bp, Mus musculus
gatgcactatgagatgctcttcaac

SEQ ID NO: 667100 - DNA, 25 bp, Mus musculus
gatgcactcctcaagtgccgtgcga

SEQ ID NO: 667101 - DNA, 25 bp, Mus musculus
gatgcactcctctagtgccgtgcga

SEQ ID NO: 667102 - DNA, 25 bp, Mus musculus
gatgcactgacccagagatccatga

SEQ ID NO: 667103 - DNA, 25 bp, Mus musculus
gatgcactgaccgagagatccatga

SEQ ID NO: 667104 - DNA, 25 bp, Mus musculus
gatgcactggctagcagcgaacaga

SEQ ID NO: 667105 - DNA, 25 bp, Mus musculus
gatgcactggcttgcagcgaacaga

SEQ ID NO: 667106 - DNA, 25 bp, Mus musculus
gatgcactgtacaaaggaagcaaga

SEQ ID NO: 667107 - DNA, 25 bp, Mus musculus
gatgcactgtactaaggaagcaaga

SEQ ID NO: 667108 - DNA, 25 bp, Mus musculus
gatgcactgtggatggccaccttgc

SEQ ID NO: 667109 - DNA, 25 bp, Mus musculus
gatgcactgtggttggccaccttgc

SEQ ID NO: 667110 - DNA, 25 bp, Mus musculus
gatgcactgtgtcagaacacaccca

SEQ ID NO: 667111 - DNA, 25 bp, Mus musculus
gatgcactgtgtgagaacacaccca

SEQ ID NO: 667112 - DNA, 25 bp, Mus musculus
gatgcacttccaagtttcccagaga

SEQ ID NO: 667113 - DNA, 25 bp, Mus musculus
gatgcacttccatgtttcccagaga

SEQ ID NO: 667114 - DNA, 25 bp, Mus musculus
gatgcacttggtatctgtatacatg

SEQ ID NO: 667115 - DNA, 25 bp, Mus musculus
gatgcacttggtttctgtatacatg

SEQ ID NO: 667116 - DNA, 25 bp, Mus musculus
gatgcactttcaaggagactgactg

SEQ ID NO: 667117 - DNA, 25 bp, Mus musculus
gatgcactttcatggagactgactg

SEQ ID NO: 667118 - DNA, 25 bp, Mus musculus
gatgcagaagatctaatctacgtga

SEQ ID NO: 667119 - DNA, 25 bp, Mus musculus
gatgcagaagatgtaatctacgtga

SEQ ID NO: 667120 - DNA, 25 bp, Mus musculus
gatgcagaaggcactgaaccgccag

SEQ ID NO: 667121 - DNA, 25 bp, Mus musculus
gatgcagaaggctctgaaccgccag

SEQ ID NO: 667122 - DNA, 25 bp, Mus musculus
gatgcagacactcggcaagaaccac

SEQ ID NO: 667123 - DNA, 25 bp, Mus musculus
gatgcagacactgggcaagaaccac

SEQ ID NO: 667124 - DNA, 25 bp, Mus musculus
gatgcagactcaaagagggtcctgg

SEQ ID NO: 667125 - DNA, 25 bp, Mus musculus
gatgcagactcatagagggtcctgg

SEQ ID NO: 667126 - DNA, 25 bp, Mus musculus
gatgcagactctatatccgatgaag

SEQ ID NO: 667127 - DNA, 25 bp, Mus musculus
gatgcagactctttatccgatgaag

SEQ ID NO: 667128 - DNA, 25 bp, Mus musculus
gatgcagagaatccaattgtgcata

SEQ ID NO: 667129 - DNA, 25 bp, Mus musculus
gatgcagagaatgcaattgtgcata

SEQ ID NO: 667130 - DNA, 25 bp, Mus musculus
gatgcagagacacgcctgactgaag

SEQ ID NO: 667131 - DNA, 25 bp, Mus musculus
gatgcagagacaggcctgactgaag

SEQ ID NO: 667132 - DNA, 25 bp, Mus musculus
gatgcagagaccaacatcaccacag

SEQ ID NO: 667133 - DNA, 25 bp, Mus musculus
gatgcagagacctacatcaccacag

SEQ ID NO: 667134 - DNA, 25 bp, Mus musculus
gatgcagagggtcacccctccaaga

SEQ ID NO: 667135 - DNA, 25 bp, Mus musculus
gatgcagagggtgacccctccaaga

SEQ ID NO: 667136 - DNA, 25 bp, Mus musculus
gatgcagatccccaagtttgcaaga

SEQ ID NO: 667137 - DNA, 25 bp, Mus musculus
gatgcagatcccgaagtttgcaaga

SEQ ID NO: 667138 - DNA, 25 bp, Mus musculus
gatgcagatcgtcggctttctggat

SEQ ID NO: 667139 - DNA, 25 bp, Mus musculus
gatgcagatcgtgggctttctggat

SEQ ID NO: 667140 - DNA, 25 bp, Mus musculus
gatgcagattccagttatggccaga

SEQ ID NO: 667141 - DNA, 25 bp, Mus musculus
gatgcagattcctgttatggccaga

SEQ ID NO: 667142 - DNA, 25 bp, Mus musculus
gatgcagcactcagagggttaccgg

SEQ ID NO: 667143 - DNA, 25 bp, Mus musculus
gatgcagcactctgagggttaccgg

SEQ ID NO: 667144 - DNA, 25 bp, Mus musculus
gatgcagcagcacaatatgatgagc

SEQ ID NO: 667145 - DNA, 25 bp, Mus musculus
gatgcagcagcagaatatgatgagc

SEQ ID NO: 667146 - DNA, 25 bp, Mus musculus
gatgcagcagcgcatcgactccttc

SEQ ID NO: 667147 - DNA, 25 bp, Mus musculus
gatgcagcagcggatcgactccttc

SEQ ID NO: 667148 - DNA, 25 bp, Mus musculus
gatgcagcatcaaggacatagtcga

SEQ ID NO: 667149 - DNA, 25 bp, Mus musculus
gatgcagcatcatggacatagtcga

SEQ ID NO: 667150 - DNA, 25 bp, Mus musculus
gatgcagcatctcaggtaaagccct

SEQ ID NO: 667151 - DNA, 25 bp, Mus musculus
gatgcagcatctgaggtaaagccct

SEQ ID NO: 667152 - DNA, 25 bp, Mus musculus
gatgcagccaagatggccttggtgc

SEQ ID NO: 667153 - DNA, 25 bp, Mus musculus
gatgcagccaagttggccttggtgc

SEQ ID NO: 667154 - DNA, 25 bp, Mus musculus
gatgcagccagaagacaggctcacc

SEQ ID NO: 667155 - DNA, 25 bp, Mus musculus
gatgcagccagatgacaggctcacc

SEQ ID NO: 667156 - DNA, 25 bp, Mus musculus
gatgcagccatgcagcgatacacac

SEQ ID NO: 667157 - DNA, 25 bp, Mus musculus
gatgcagccatggagcgatacacac

SEQ ID NO: 667158 - DNA, 25 bp, Mus musculus
gatgcagccattatccgcacgctgg

SEQ ID NO: 667159 - DNA, 25 bp, Mus musculus
gatgcagccattttccgcacgctgg

SEQ ID NO: 667160 - DNA, 25 bp, Mus musculus
gatgcagcccagagtttcagaggtc

SEQ ID NO: 667161 - DNA, 25 bp, Mus musculus
gatgcagcccagtgtttcagaggtc

SEQ ID NO: 667162 - DNA, 25 bp, Mus musculus
gatgcagccgcacgcttctagaaga

SEQ ID NO: 667163 - DNA, 25 bp, Mus musculus
gatgcagccgcaggcttctagaaga

SEQ ID NO: 667164 - DNA, 25 bp, Mus musculus
gatgcagcctaccactgtgtggctg

SEQ ID NO: 667165 - DNA, 25 bp, Mus musculus
gatgcagcctacgactgtgtggctg

SEQ ID NO: 667166 - DNA, 25 bp, Mus musculus
gatgcagcctcaatacactctgtcc

SEQ ID NO: 667167 - DNA, 25 bp, Mus musculus
gatgcagcctcacccgtacattctg

SEQ ID NO: 667168 - DNA, 25 bp, Mus musculus
gatgcagcctcagccgtacattctg

SEQ ID NO: 667169 - DNA, 25 bp, Mus musculus
gatgcagcctcattacactctgtcc

SEQ ID NO: 667170 - DNA, 25 bp, Mus musculus
gatgcagcctctcaagagtgcagag

SEQ ID NO: 667171 - DNA, 25 bp, Mus musculus
gatgcagcctctgaagagtgcagag

SEQ ID NO: 667172 - DNA, 25 bp, Mus musculus
gatgcagcgactattttaagagagc

SEQ ID NO: 667173 - DNA, 25 bp, Mus musculus
gatgcagcgacttttttaagagagc

SEQ ID NO: 667174 - DNA, 25 bp, Mus musculus
gatgcagcgggcaagctcgtcctgc

SEQ ID NO: 667175 - DNA, 25 bp, Mus musculus
gatgcagcgggctagctcgtcctgc

SEQ ID NO: 667176 - DNA, 25 bp, Mus musculus
gatgcagctcaaccaaagcacgtgt

SEQ ID NO: 667177 - DNA, 25 bp, Mus musculus
gatgcagctcaagcaaagcacgtgt

SEQ ID NO: 667178 - DNA, 25 bp, Mus musculus
gatgcagctcagacaagcccagctt

SEQ ID NO: 667179 - DNA, 25 bp, Mus musculus
gatgcagctcagcttggactgagtc

SEQ ID NO: 667180 - DNA, 25 bp, Mus musculus
gatgcagctcaggttggactgagtc

SEQ ID NO: 667181 - DNA, 25 bp, Mus musculus
gatgcagctcagtcaagcccagctt

SEQ ID NO: 667182 - DNA, 25 bp, Mus musculus
gatgcagctgcaagggattgcccag

SEQ ID NO: 667183 - DNA, 25 bp, Mus musculus
gatgcagctgcatgggattgcccag

SEQ ID NO: 667184 - DNA, 25 bp, Mus musculus
gatgcagctgttccctctcctgttc

SEQ ID NO: 667185 - DNA, 25 bp, Mus musculus
gatgcagctgttgcctctcctgttc

SEQ ID NO: 667186 - DNA, 25 bp, Mus musculus
gatgcagcttttcagccgtcctggt

SEQ ID NO: 667187 - DNA, 25 bp, Mus musculus
gatgcagcttttgagccgtcctggt

SEQ ID NO: 667188 - DNA, 25 bp, Mus musculus
gatgcaggaaagcattgcactggct

SEQ ID NO: 667189 - DNA, 25 bp, Mus musculus
gatgcaggaaaggattgcactggct

SEQ ID NO: 667190 - DNA, 25 bp, Mus musculus
gatgcaggaaccaagagaacagact

SEQ ID NO: 667191 - DNA, 25 bp, Mus musculus
gatgcaggaaccagtaaagactgtg

SEQ ID NO: 667192 - DNA, 25 bp, Mus musculus
gatgcaggaacctagagaacagact

SEQ ID NO: 667193 - DNA, 25 bp, Mus musculus
gatgcaggaacctgtaaagactgtg

SEQ ID NO: 667194 - DNA, 25 bp, Mus musculus
gatgcaggaccaagatgaggacgcc

SEQ ID NO: 667195 - DNA, 25 bp, Mus musculus
gatgcaggaccatgatgaggacgcc

SEQ ID NO: 667196 - DNA, 25 bp, Mus musculus
gatgcaggacttattcctggctcac

SEQ ID NO: 667197 - DNA, 25 bp, Mus musculus
gatgcaggactttttcctggctcac

SEQ ID NO: 667198 - DNA, 25 bp, Mus musculus
gatgcaggagctacccctgggcatg

SEQ ID NO: 667199 - DNA, 25 bp, Mus musculus
gatgcaggagctagccattcagttg

SEQ ID NO: 667200 - DNA, 25 bp, Mus musculus
gatgcaggagcttcccctgggcatg

SEQ ID NO: 667201 - DNA, 25 bp, Mus musculus
gatgcaggagcttgccattcagttg

SEQ ID NO: 667202 - DNA, 25 bp, Mus musculus
gatgcaggcattcaatccagagaca

SEQ ID NO: 667203 - DNA, 25 bp, Mus musculus
gatgcaggcattgaatccagagaca

SEQ ID NO: 667204 - DNA, 25 bp, Mus musculus
gatgcaggccaaattgcaggtgttg

SEQ ID NO: 667205 - DNA, 25 bp, Mus musculus
gatgcaggccaatttgcaggtgttg

SEQ ID NO: 667206 - DNA, 25 bp, Mus musculus
gatgcaggccctctcgtggttcact

SEQ ID NO: 667207 - DNA, 25 bp, Mus musculus
gatgcaggccctgtcgtggttcact

SEQ ID NO: 667208 - DNA, 25 bp, Mus musculus
gatgcaggctgcagctacccttact

SEQ ID NO: 667209 - DNA, 25 bp, Mus musculus
gatgcaggctgctgctacccttact

SEQ ID NO: 667210 - DNA, 25 bp, Mus musculus
gatgcagggccactcctgatctgga

SEQ ID NO: 667211 - DNA, 25 bp, Mus musculus
gatgcagggccagtcctgatctgga

SEQ ID NO: 667212 - DNA, 25 bp, Mus musculus
gatgcagggtataacgggccccagt

SEQ ID NO: 667213 - DNA, 25 bp, Mus musculus
gatgcagggtattacgggccccagt

SEQ ID NO: 667214 - DNA, 25 bp, Mus musculus
gatgcaggtaaaccaataagctgac

SEQ ID NO: 667215 - DNA, 25 bp, Mus musculus
gatgcaggtaaagcaataagctgac

SEQ ID NO: 667216 - DNA, 25 bp, Mus musculus
gatgcaggttcactttacaaaatat

SEQ ID NO: 667217 - DNA, 25 bp, Mus musculus
gatgcaggttcagtttacaaaatat

SEQ ID NO: 667218 - DNA, 25 bp, Mus musculus
gatgcaggttctattggaacaatgg

SEQ ID NO: 667219 - DNA, 25 bp, Mus musculus
gatgcaggttcttttggaacaatgg

SEQ ID NO: 667220 - DNA, 25 bp, Mus musculus
gatgcagtaatgaatccagcagaag

SEQ ID NO: 667221 - DNA, 25 bp, Mus musculus
gatgcagtaatgtatccagcagaag

SEQ ID NO: 667222 - DNA, 25 bp, Mus musculus
gatgcagtcatgaacgtgagcgtgc

SEQ ID NO: 667223 - DNA, 25 bp, Mus musculus
gatgcagtcatgtacgtgagcgtgc

SEQ ID NO: 667224 - DNA, 25 bp, Mus musculus
gatgcagtctccactttaaaactaa

SEQ ID NO: 667225 - DNA, 25 bp, Mus musculus
gatgcagtctcctctttaaaactaa

SEQ ID NO: 667226 - DNA, 25 bp, Mus musculus
gatgcagtgcttcgctgtgtctcag

SEQ ID NO: 667227 - DNA, 25 bp, Mus musculus
gatgcagtgcttggctgtgtctcag

SEQ ID NO: 667228 - DNA, 25 bp, Mus musculus
gatgcagttaagatggctatcaacc

SEQ ID NO: 667229 - DNA, 25 bp, Mus musculus
gatgcagttaagttggctatcaacc

SEQ ID NO: 667230 - DNA, 25 bp, Mus musculus
gatgcagttccactatagtgtccgg

SEQ ID NO: 667231 - DNA, 25 bp, Mus musculus
gatgcagttccagtatagtgtccgg

SEQ ID NO: 667232 - DNA, 25 bp, Mus musculus
gatgcagttgaaatgtttaagaagg

SEQ ID NO: 667233 - DNA, 25 bp, Mus musculus
gatgcagttgaattgtttaagaagg

SEQ ID NO: 667234 - DNA, 25 bp, Mus musculus
gatgcagttgagacccatcctgccc

SEQ ID NO: 667235 - DNA, 25 bp, Mus musculus
gatgcagttgagtcccatcctgccc

SEQ ID NO: 667236 - DNA, 25 bp, Mus musculus
gatgcagtttatactggagctggcc

SEQ ID NO: 667237 - DNA, 25 bp, Mus musculus
gatgcagtttattctggagctggcc

SEQ ID NO: 667238 - DNA, 25 bp, Mus musculus
gatgcataatagagtgacacctagg

SEQ ID NO: 667239 - DNA, 25 bp, Mus musculus
gatgcataatagtgtgacacctagg

SEQ ID NO: 667240 - DNA, 25 bp, Mus musculus
gatgcataccgtccactactactgc

SEQ ID NO: 667241 - DNA, 25 bp, Mus musculus
gatgcataccgtgcactactactgc

SEQ ID NO: 667242 - DNA, 25 bp, Mus musculus
gatgcataggacacagatggccgca

SEQ ID NO: 667243 - DNA, 25 bp, Mus musculus
gatgcataggactcagatggccgca

SEQ ID NO: 667244 - DNA, 25 bp, Mus musculus
gatgcatattcgataccaatctaaa

SEQ ID NO: 667245 - DNA, 25 bp, Mus musculus
gatgcatattcgttaccaatctaaa

SEQ ID NO: 667246 - DNA, 25 bp, Mus musculus
gatgcatcacgtccactcagaaagc

SEQ ID NO: 667247 - DNA, 25 bp, Mus musculus
gatgcatcacgtgcactcagaaagc

SEQ ID NO: 667248 - DNA, 25 bp, Mus musculus
gatgcatcaggaccaacaaacctgt

SEQ ID NO: 667249 - DNA, 25 bp, Mus musculus
gatgcatcaggagcaacaaacctgt

SEQ ID NO: 667250 - DNA, 25 bp, Mus musculus
gatgcatcattcagaggagaaccca

SEQ ID NO: 667251 - DNA, 25 bp, Mus musculus
gatgcatcattctgaggagaaccca

SEQ ID NO: 667252 - DNA, 25 bp, Mus musculus
gatgcatccaaaaggatctccgtag

SEQ ID NO: 667253 - DNA, 25 bp, Mus musculus
gatgcatccaaatggatctccgtag

SEQ ID NO: 667254 - DNA, 25 bp, Mus musculus
gatgcatcgcgtacagcttgcctca

SEQ ID NO: 667255 - DNA, 25 bp, Mus musculus
gatgcatcgcgttcagcttgcctca

SEQ ID NO: 667256 - DNA, 25 bp, Mus musculus
gatgcatctactctaacctctgaag

SEQ ID NO: 667257 - DNA, 25 bp, Mus musculus
gatgcatctactgtaacctctgaag

SEQ ID NO: 667258 - DNA, 25 bp, Mus musculus
gatgcatctcctaccggtaccagag

SEQ ID NO: 667259 - DNA, 25 bp, Mus musculus
gatgcatctcctatgcacaatggac

SEQ ID NO: 667260 - DNA, 25 bp, Mus musculus
gatgcatctccttccggtaccagag

SEQ ID NO: 667261 - DNA, 25 bp, Mus musculus
gatgcatctcctttgcacaatggac

SEQ ID NO: 667262 - DNA, 25 bp, Mus musculus
gatgcatgaagtcttcctgcagcgc

SEQ ID NO: 667263 - DNA, 25 bp, Mus musculus
gatgcatgaagtgttcctgcagcgc

SEQ ID NO: 667264 - DNA, 25 bp, Mus musculus
gatgcatgcctgatccttgccaata

SEQ ID NO: 667265 - DNA, 25 bp, Mus musculus
gatgcatgcctgttccttgccaata

SEQ ID NO: 667266 - DNA, 25 bp, Mus musculus
gatgcatgcgcccaataacgttcct

SEQ ID NO: 667267 - DNA, 25 bp, Mus musculus
gatgcatgcgccgaataacgttcct

SEQ ID NO: 667268 - DNA, 25 bp, Mus musculus
gatgcatggcctctacactgagggc

SEQ ID NO: 667269 - DNA, 25 bp, Mus musculus
gatgcatggcctgtacactgagggc

SEQ ID NO: 667270 - DNA, 25 bp, Mus musculus
gatgcatgggtcctctgcctgcacc

SEQ ID NO: 667271 - DNA, 25 bp, Mus musculus
gatgcatgggtcgtctgcctgcacc

SEQ ID NO: 667272 - DNA, 25 bp, Mus musculus
gatgcatgggtgctttcagcctaag

SEQ ID NO: 667273 - DNA, 25 bp, Mus musculus
gatgcatgggtggtttcagcctaag

SEQ ID NO: 667274 - DNA, 25 bp, Mus musculus
gatgcattagcacaacaggcctttg

SEQ ID NO: 667275 - DNA, 25 bp, Mus musculus
gatgcattagcagaacaggcctttg

SEQ ID NO: 667276 - DNA, 25 bp, Mus musculus
gatgcattcccaaagtatcaatgcc

SEQ ID NO: 667277 - DNA, 25 bp, Mus musculus
gatgcattcccatagtatcaatgcc

SEQ ID NO: 667278 - DNA, 25 bp, Mus musculus
gatgcattcggcaggacttgcattg

SEQ ID NO: 667279 - DNA, 25 bp, Mus musculus
gatgcattcggctggacttgcattg

SEQ ID NO: 667280 - DNA, 25 bp, Mus musculus
gatgcattcttgcaccttctcatgg

SEQ ID NO: 667281 - DNA, 25 bp, Mus musculus
gatgcattcttggaccttctcatgg

SEQ ID NO: 667282 - DNA, 25 bp, Mus musculus
gatgcatttcgtacctttgttcctg

SEQ ID NO: 667283 - DNA, 25 bp, Mus musculus
gatgcatttcgttcctttgttcctg

SEQ ID NO: 667284 - DNA, 25 bp, Mus musculus
gatgcatttgagataacgtgtgaag

SEQ ID NO: 667285 - DNA, 25 bp, Mus musculus
gatgcatttgagttaacgtgtgaag

SEQ ID NO: 667286 - DNA, 25 bp, Mus musculus
gatgcatttgccatgtgtggccaaa

SEQ ID NO: 667287 - DNA, 25 bp, Mus musculus
gatgcatttgccttgtgtggccaaa

SEQ ID NO: 667288 - DNA, 25 bp, Mus musculus
gatgcattttgaaggccgcaagtgc

SEQ ID NO: 667289 - DNA, 25 bp, Mus musculus
gatgcattttgatggccgcaagtgc

SEQ ID NO: 667290 - DNA, 25 bp, Mus musculus
gatgcattttgtataagccatgaga

SEQ ID NO: 667291 - DNA, 25 bp, Mus musculus
gatgcattttgtttaagccatgaga

SEQ ID NO: 667292 - DNA, 25 bp, Mus musculus
gatgccaaaaaacctgcctcaaaga

SEQ ID NO: 667293 - DNA, 25 bp, Mus musculus
gatgccaaaaaagctgcctcaaaga

SEQ ID NO: 667294 - DNA, 25 bp, Mus musculus
gatgccaaagccatgtggaattttt

SEQ ID NO: 667295 - DNA, 25 bp, Mus musculus
gatgccaaagccttgtggaattttt

SEQ ID NO: 667296 - DNA, 25 bp, Mus musculus
gatgccaacattcgatgagagcccc

SEQ ID NO: 667297 - DNA, 25 bp, Mus musculus
gatgccaacattggatgagagcccc

SEQ ID NO: 667298 - DNA, 25 bp, Mus musculus
gatgccaaccgtaccagttacgatg

SEQ ID NO: 667299 - DNA, 25 bp, Mus musculus
gatgccaaccgttccagttacgatg

SEQ ID NO: 667300 - DNA, 25 bp, Mus musculus
gatgccaactcactcatggccaatg

SEQ ID NO: 667301 - DNA, 25 bp, Mus musculus
gatgccaactcagtcatggccaatg

SEQ ID NO: 667302 - DNA, 25 bp, Mus musculus
gatgccaagaagaaagcagctcatg

SEQ ID NO: 667303 - DNA, 25 bp, Mus musculus
gatgccaagaagacgttccactgcg

SEQ ID NO: 667304 - DNA, 25 bp, Mus musculus
gatgccaagaagtaagcagctcatg

SEQ ID NO: 667305 - DNA, 25 bp, Mus musculus
gatgccaagaagtcgttccactgcg

SEQ ID NO: 667306 - DNA, 25 bp, Mus musculus
gatgccaagaatcgctagaaagtca

SEQ ID NO: 667307 - DNA, 25 bp, Mus musculus
gatgccaagaatggctagaaagtca

SEQ ID NO: 667308 - DNA, 25 bp, Mus musculus
gatgccaagatcctgaatgacgttc

SEQ ID NO: 667309 - DNA, 25 bp, Mus musculus
gatgccaagatcgtgaatgacgttc

SEQ ID NO: 667310 - DNA, 25 bp, Mus musculus
gatgccaagctgcacctcatcctgg

SEQ ID NO: 667311 - DNA, 25 bp, Mus musculus
gatgccaagctggacctcatcctgg

SEQ ID NO: 667312 - DNA, 25 bp, Mus musculus
gatgccaaggagatcatgcagcacc

SEQ ID NO: 667313 - DNA, 25 bp, Mus musculus
gatgccaaggagttcatgcagcacc

SEQ ID NO: 667314 - DNA, 25 bp, Mus musculus
gatgccaatgaacttccaattcaaa

SEQ ID NO: 667315 - DNA, 25 bp, Mus musculus
gatgccaatgaagttccaattcaaa

SEQ ID NO: 667316 - DNA, 25 bp, Mus musculus
gatgccaatgatctaccgatccagt

SEQ ID NO: 667317 - DNA, 25 bp, Mus musculus
gatgccaatgatgtaccgatccagt

SEQ ID NO: 667318 - DNA, 25 bp, Mus musculus
gatgccacaaaaacgaccctcatca

SEQ ID NO: 667319 - DNA, 25 bp, Mus musculus
gatgccacaaaatcgaccctcatca

SEQ ID NO: 667320 - DNA, 25 bp, Mus musculus
gatgccacacagattgctggtctca

SEQ ID NO: 667321 - DNA, 25 bp, Mus musculus
gatgccacacagtttgctggtctca

SEQ ID NO: 667322 - DNA, 25 bp, Mus musculus
gatgccacaggaatcaaaggagcca

SEQ ID NO: 667323 - DNA, 25 bp, Mus musculus
gatgccacaggattcaaaggagcca

SEQ ID NO: 667324 - DNA, 25 bp, Mus musculus
gatgccacatgcaggctgtttgacc

SEQ ID NO: 667325 - DNA, 25 bp, Mus musculus
gatgccacatgctggctgtttgacc

SEQ ID NO: 667326 - DNA, 25 bp, Mus musculus
gatgccaccaatacaactagagaaa

SEQ ID NO: 667327 - DNA, 25 bp, Mus musculus
gatgccaccaatagccaggctgtgg

SEQ ID NO: 667328 - DNA, 25 bp, Mus musculus
gatgccaccaattcaactagagaaa

SEQ ID NO: 667329 - DNA, 25 bp, Mus musculus
gatgccaccaattgccaggctgtgg

SEQ ID NO: 667330 - DNA, 25 bp, Mus musculus
gatgccaccagtcagagagactttg

SEQ ID NO: 667331 - DNA, 25 bp, Mus musculus
gatgccaccagtgagagagactttg

SEQ ID NO: 667332 - DNA, 25 bp, Mus musculus
gatgccaccctcctgatacatgaag

SEQ ID NO: 667333 - DNA, 25 bp, Mus musculus
gatgccaccctcgtgatacatgaag

SEQ ID NO: 667334 - DNA, 25 bp, Mus musculus
gatgccaccgatacttgtatcatgg

SEQ ID NO: 667335 - DNA, 25 bp, Mus musculus
gatgccaccgattcttgtatcatgg

SEQ ID NO: 667336 - DNA, 25 bp, Mus musculus
gatgccacctatacttctgcccgga

SEQ ID NO: 667337 - DNA, 25 bp, Mus musculus
gatgccacctattcttctgcccgga

SEQ ID NO: 667338 - DNA, 25 bp, Mus musculus
gatgccacctgccttagagagcgag

SEQ ID NO: 667339 - DNA, 25 bp, Mus musculus
gatgccacctgcgttagagagcgag

SEQ ID NO: 667340 - DNA, 25 bp, Mus musculus
gatgccacctgtaggactctgtcct

SEQ ID NO: 667341 - DNA, 25 bp, Mus musculus
gatgccacctgttggactctgtcct

SEQ ID NO: 667342 - DNA, 25 bp, Mus musculus
gatgccaccttcaacatcattggac

SEQ ID NO: 667343 - DNA, 25 bp, Mus musculus
gatgccaccttctacatcattggac

SEQ ID NO: 667344 - DNA, 25 bp, Mus musculus
gatgccacgaagactgagcacacag

SEQ ID NO: 667345 - DNA, 25 bp, Mus musculus
gatgccacgaagtctgagcacacag

SEQ ID NO: 667346 - DNA, 25 bp, Mus musculus
gatgccactcctactgaatcctaag

SEQ ID NO: 667347 - DNA, 25 bp, Mus musculus
gatgccactccttctgaatcctaag

SEQ ID NO: 667348 - DNA, 25 bp, Mus musculus
gatgccactggcagcatgaatgaca

SEQ ID NO: 667349 - DNA, 25 bp, Mus musculus
gatgccactggctgcatgaatgaca

SEQ ID NO: 667350 - DNA, 25 bp, Mus musculus
gatgccacttccaaggtgagctcca

SEQ ID NO: 667351 - DNA, 25 bp, Mus musculus
gatgccacttcctaggtgagctcca

SEQ ID NO: 667352 - DNA, 25 bp, Mus musculus
gatgccacttgcctggaccagattg

SEQ ID NO: 667353 - DNA, 25 bp, Mus musculus
gatgccacttgcgtggaccagattg

SEQ ID NO: 667354 - DNA, 25 bp, Mus musculus
gatgccagaatgagtggtattgctg

SEQ ID NO: 667355 - DNA, 25 bp, Mus musculus
gatgccagaatgtgtggtattgctg

SEQ ID NO: 667356 - DNA, 25 bp, Mus musculus
gatgccagacgcatggttctgagga

SEQ ID NO: 667357 - DNA, 25 bp, Mus musculus
gatgccagacgcttggttctgagga

SEQ ID NO: 667358 - DNA, 25 bp, Mus musculus
gatgccagagctccgaagtgctacg

SEQ ID NO: 667359 - DNA, 25 bp, Mus musculus
gatgccagagctgcgaagtgctacg

SEQ ID NO: 667360 - DNA, 25 bp, Mus musculus
gatgccagcccgaggatctcctggg

SEQ ID NO: 667361 - DNA, 25 bp, Mus musculus
gatgccagcccgtggatctcctggg

SEQ ID NO: 667362 - DNA, 25 bp, Mus musculus
gatgccagcggtccctgtcactgca

SEQ ID NO: 667363 - DNA, 25 bp, Mus musculus
gatgccagcggtgcctgtcactgca

SEQ ID NO: 667364 - DNA, 25 bp, Mus musculus
gatgccagcgtgacctgaggtcttt

SEQ ID NO: 667365 - DNA, 25 bp, Mus musculus
gatgccagcgtgtcctgaggtcttt

SEQ ID NO: 667366 - DNA, 25 bp, Mus musculus
gatgccaggactccaatccttgcct

SEQ ID NO: 667367 - DNA, 25 bp, Mus musculus
gatgccaggactgcaatccttgcct

SEQ ID NO: 667368 - DNA, 25 bp, Mus musculus
gatgccagggccacaatggagctct

SEQ ID NO: 667369 - DNA, 25 bp, Mus musculus
gatgccagggcctcaatggagctct

SEQ ID NO: 667370 - DNA, 25 bp, Mus musculus
gatgccagtgatcagaagcctgaga

SEQ ID NO: 667371 - DNA, 25 bp, Mus musculus
gatgccagtgatgagaagcctgaga

SEQ ID NO: 667372 - DNA, 25 bp, Mus musculus
gatgccagtgcaacctcactgcagg

SEQ ID NO: 667373 - DNA, 25 bp, Mus musculus
gatgccagtgcacctcaaaggcctg

SEQ ID NO: 667374 - DNA, 25 bp, Mus musculus
gatgccagtgcagctcaaaggcctg

SEQ ID NO: 667375 - DNA, 25 bp, Mus musculus
gatgccagtgcatcctcactgcagg

SEQ ID NO: 667376 - DNA, 25 bp, Mus musculus
gatgccagtgtactgcactccttag

SEQ ID NO: 667377 - DNA, 25 bp, Mus musculus
gatgccagtgtagtgcactccttag

SEQ ID NO: 667378 - DNA, 25 bp, Mus musculus
gatgccatacctcaaatgtccgctc

SEQ ID NO: 667379 - DNA, 25 bp, Mus musculus
gatgccatacctgaaatgtccgctc

SEQ ID NO: 667380 - DNA, 25 bp, Mus musculus
gatgccatcaatcggttgctggtcc

SEQ ID NO: 667381 - DNA, 25 bp, Mus musculus
gatgccatcaatgggttgctggtcc

SEQ ID NO: 667382 - DNA, 25 bp, Mus musculus
gatgccatcgccaggaaactgaggc

SEQ ID NO: 667383 - DNA, 25 bp, Mus musculus
gatgccatcgcctggaaactgaggc

SEQ ID NO: 667384 - DNA, 25 bp, Mus musculus
gatgccatcgtaacagggtccagca

SEQ ID NO: 667385 - DNA, 25 bp, Mus musculus
gatgccatcgtatcagggtccagca

SEQ ID NO: 667386 - DNA, 25 bp, Mus musculus
gatgccatctatccctgaggagccg

SEQ ID NO: 667387 - DNA, 25 bp, Mus musculus
gatgccatctatgcctgaggagccg

SEQ ID NO: 667388 - DNA, 25 bp, Mus musculus
gatgccatctcgaggatccatggtg

SEQ ID NO: 667389 - DNA, 25 bp, Mus musculus
gatgccatctcgtggatccatggtg

SEQ ID NO: 667390 - DNA, 25 bp, Mus musculus
gatgccatctgcaccgttaactata

SEQ ID NO: 667391 - DNA, 25 bp, Mus musculus
gatgccatctgctccgttaactata

SEQ ID NO: 667392 - DNA, 25 bp, Mus musculus
gatgccatgcagaactacaatggca

SEQ ID NO: 667393 - DNA, 25 bp, Mus musculus
gatgccatgcagtactacaatggca

SEQ ID NO: 667394 - DNA, 25 bp, Mus musculus
gatgccattgagaaagcccaggact

SEQ ID NO: 667395 - DNA, 25 bp, Mus musculus
gatgccattgagtaagcccaggact

SEQ ID NO: 667396 - DNA, 25 bp, Mus musculus
gatgccatttagagtggaaagcctt

SEQ ID NO: 667397 - DNA, 25 bp, Mus musculus
gatgccatttagtgtggaaagcctt

SEQ ID NO: 667398 - DNA, 25 bp, Mus musculus
gatgccatttgaacttaaggaagat

SEQ ID NO: 667399 - DNA, 25 bp, Mus musculus
gatgccatttgatcttaaggaagat

SEQ ID NO: 667400 - DNA, 25 bp, Mus musculus
gatgcccaaccgctgtggcataatc

SEQ ID NO: 667401 - DNA, 25 bp, Mus musculus
gatgcccaaccggtgtggcataatc

SEQ ID NO: 667402 - DNA, 25 bp, Mus musculus
gatgcccaacctctgaaggtctctt

SEQ ID NO: 667403 - DNA, 25 bp, Mus musculus
gatgcccaacctgtgaaggtctctt

SEQ ID NO: 667404 - DNA, 25 bp, Mus musculus
gatgcccaagaaagtcgtggcagcc

SEQ ID NO: 667405 - DNA, 25 bp, Mus musculus
gatgcccaagaatgtcgtggcagcc

SEQ ID NO: 667406 - DNA, 25 bp, Mus musculus
gatgcccaagacatcattgtctacc

SEQ ID NO: 667407 - DNA, 25 bp, Mus musculus
gatgcccaagacttcattgtctacc

SEQ ID NO: 667408 - DNA, 25 bp, Mus musculus
gatgcccaagccatagctgacatgg

SEQ ID NO: 667409 - DNA, 25 bp, Mus musculus
gatgcccaagccttagctgacatgg

SEQ ID NO: 667410 - DNA, 25 bp, Mus musculus
gatgcccaagtcattcaagaggaaa

SEQ ID NO: 667411 - DNA, 25 bp, Mus musculus
gatgcccaagtctttcaagaggaaa

SEQ ID NO: 667412 - DNA, 25 bp, Mus musculus
gatgcccacggcctgttcctggtgc

SEQ ID NO: 667413 - DNA, 25 bp, Mus musculus
gatgcccacggcgtgttcctggtgc

SEQ ID NO: 667414 - DNA, 25 bp, Mus musculus
gatgcccactgcagatagggtgacc

SEQ ID NO: 667415 - DNA, 25 bp, Mus musculus
gatgcccactgctgatagggtgacc

SEQ ID NO: 667416 - DNA, 25 bp, Mus musculus
gatgcccactttaccatcaacagag

SEQ ID NO: 667417 - DNA, 25 bp, Mus musculus
gatgcccacttttccatcaacagag

SEQ ID NO: 667418 - DNA, 25 bp, Mus musculus
gatgcccagatgctgcgtgacattt

SEQ ID NO: 667419 - DNA, 25 bp, Mus musculus
gatgcccagatggtgcgtgacattt

SEQ ID NO: 667420 - DNA, 25 bp, Mus musculus
gatgcccaggcactgaacacaagct

SEQ ID NO: 667421 - DNA, 25 bp, Mus musculus
gatgcccaggcagtgaacacaagct

SEQ ID NO: 667422 - DNA, 25 bp, Mus musculus
gatgcccagggccactttgtgaagc

SEQ ID NO: 667423 - DNA, 25 bp, Mus musculus
gatgcccagggcgactttgtgaagc

SEQ ID NO: 667424 - DNA, 25 bp, Mus musculus
gatgcccagtatcattgcaactgtg

SEQ ID NO: 667425 - DNA, 25 bp, Mus musculus
gatgcccagtatgattgcaactgtg

SEQ ID NO: 667426 - DNA, 25 bp, Mus musculus
gatgcccagtggctagggtttatca

SEQ ID NO: 667427 - DNA, 25 bp, Mus musculus
gatgcccagtgggtagggtttatca

SEQ ID NO: 667428 - DNA, 25 bp, Mus musculus
gatgcccattcgctccttgaccttt

SEQ ID NO: 667429 - DNA, 25 bp, Mus musculus
gatgcccattcggtccttgaccttt

SEQ ID NO: 667430 - DNA, 25 bp, Mus musculus
gatgcccattctaatttctattgta

SEQ ID NO: 667431 - DNA, 25 bp, Mus musculus
gatgcccattcttatttctattgta

SEQ ID NO: 667432 - DNA, 25 bp, Mus musculus
gatgccccaagaagtgtcctctacc

SEQ ID NO: 667433 - DNA, 25 bp, Mus musculus
gatgccccaagatgtgtcctctacc

SEQ ID NO: 667434 - DNA, 25 bp, Mus musculus
gatgccccgctacgagttggctttg

SEQ ID NO: 667435 - DNA, 25 bp, Mus musculus
gatgccccgctaggagttggctttg

SEQ ID NO: 667436 - DNA, 25 bp, Mus musculus
gatgccccggatcatgttgacttct

SEQ ID NO: 667437 - DNA, 25 bp, Mus musculus
gatgccccggatgatgttgacttct

SEQ ID NO: 667438 - DNA, 25 bp, Mus musculus
gatgcccctgttacctcagggccaa

SEQ ID NO: 667439 - DNA, 25 bp, Mus musculus
gatgcccctgtttcctcagggccaa

SEQ ID NO: 667440 - DNA, 25 bp, Mus musculus
gatgccccttaaatagccttgtcag

SEQ ID NO: 667441 - DNA, 25 bp, Mus musculus
gatgccccttaattagccttgtcag

SEQ ID NO: 667442 - DNA, 25 bp, Mus musculus
gatgcccgaggtagactacgcgatt

SEQ ID NO: 667443 - DNA, 25 bp, Mus musculus
gatgcccgaggttgactacgcgatt

SEQ ID NO: 667444 - DNA, 25 bp, Mus musculus
gatgcccgatttaacgcactgtccg

SEQ ID NO: 667445 - DNA, 25 bp, Mus musculus
gatgcccgattttacgcactgtccg

SEQ ID NO: 667446 - DNA, 25 bp, Mus musculus
gatgcccgcaagacccttgattctg

SEQ ID NO: 667447 - DNA, 25 bp, Mus musculus
gatgcccgcaagtcccttgattctg

SEQ ID NO: 667448 - DNA, 25 bp, Mus musculus
gatgcccgcacaaagatagggtccc

SEQ ID NO: 667449 - DNA, 25 bp, Mus musculus
gatgcccgcacatagatagggtccc

SEQ ID NO: 667450 - DNA, 25 bp, Mus musculus
gatgcccgctctatctacgttggca

SEQ ID NO: 667451 - DNA, 25 bp, Mus musculus
gatgcccgctctttctacgttggca

SEQ ID NO: 667452 - DNA, 25 bp, Mus musculus
gatgcccgtccaagaacatcacagc

SEQ ID NO: 667453 - DNA, 25 bp, Mus musculus
gatgcccgtccatgaacatcacagc

SEQ ID NO: 667454 - DNA, 25 bp, Mus musculus
gatgcccgtgtgctaaaagacatgg

SEQ ID NO: 667455 - DNA, 25 bp, Mus musculus
gatgcccgtgtggtaaaagacatgg

SEQ ID NO: 667456 - DNA, 25 bp, Mus musculus
gatgccctacacaggtacagttatt

SEQ ID NO: 667457 - DNA, 25 bp, Mus musculus
gatgccctacactggtacagttatt

SEQ ID NO: 667458 - DNA, 25 bp, Mus musculus
gatgccctacgcattggactctgtg

SEQ ID NO: 667459 - DNA, 25 bp, Mus musculus
gatgccctacgctttggactctgtg

SEQ ID NO: 667460 - DNA, 25 bp, Mus musculus
gatgccctactgatgaattatcttt

SEQ ID NO: 667461 - DNA, 25 bp, Mus musculus
gatgccctactgttgaattatcttt

SEQ ID NO: 667462 - DNA, 25 bp, Mus musculus
gatgccctcaccctgggaaaaagcg

SEQ ID NO: 667463 - DNA, 25 bp, Mus musculus
gatgccctcaccgtgggaaaaagcg

SEQ ID NO: 667464 - DNA, 25 bp, Mus musculus
gatgccctcattatcatcgttcagg

SEQ ID NO: 667465 - DNA, 25 bp, Mus musculus
gatgccctcattttcatcgttcagg

SEQ ID NO: 667466 - DNA, 25 bp, Mus musculus
gatgccctctcaacttgccatatga

SEQ ID NO: 667467 - DNA, 25 bp, Mus musculus
gatgccctctcacctcagcaatgga

SEQ ID NO: 667468 - DNA, 25 bp, Mus musculus
gatgccctctcagctcagcaatgga

SEQ ID NO: 667469 - DNA, 25 bp, Mus musculus
gatgccctctcatcttgccatatga

SEQ ID NO: 667470 - DNA, 25 bp, Mus musculus
gatgccctctgtccttacggctgct

SEQ ID NO: 667471 - DNA, 25 bp, Mus musculus
gatgccctctgtgcttacggctgct

SEQ ID NO: 667472 - DNA, 25 bp, Mus musculus
gatgccctcttgatcaaccccagag

SEQ ID NO: 667473 - DNA, 25 bp, Mus musculus
gatgccctcttgttcaaccccagag

SEQ ID NO: 667474 - DNA, 25 bp, Mus musculus
gatgccctgcgcaggatgccgaagc

SEQ ID NO: 667475 - DNA, 25 bp, Mus musculus
gatgccctgcgctggatgccgaagc

SEQ ID NO: 667476 - DNA, 25 bp, Mus musculus
gatgccctggaccatgtcattgatg

SEQ ID NO: 667477 - DNA, 25 bp, Mus musculus
gatgccctggacgatgtcattgatg

SEQ ID NO: 667478 - DNA, 25 bp, Mus musculus
gatgccctggctaaaaacctctaca

SEQ ID NO: 667479 - DNA, 25 bp, Mus musculus
gatgccctggcttaaaacctctaca

SEQ ID NO: 667480 - DNA, 25 bp, Mus musculus
gatgccgacaacctcaagggcaggt

SEQ ID NO: 667481 - DNA, 25 bp, Mus musculus
gatgccgacaacgtcaagggcaggt

SEQ ID NO: 667482 - DNA, 25 bp, Mus musculus
gatgccgaccggcaagtcacttcta

SEQ ID NO: 667483 - DNA, 25 bp, Mus musculus
gatgccgaccgggaagtcacttcta

SEQ ID NO: 667484 - DNA, 25 bp, Mus musculus
gatgccgagtggaatattctctatg

SEQ ID NO: 667485 - DNA, 25 bp, Mus musculus
gatgccgagtggtatattctctatg

SEQ ID NO: 667486 - DNA, 25 bp, Mus musculus
gatgccgccatcagccttgcagcgg

SEQ ID NO: 667487 - DNA, 25 bp, Mus musculus
gatgccgccatctgccttgcagcgg

SEQ ID NO: 667488 - DNA, 25 bp, Mus musculus
gatgccgcccaaccggttgggaaaa

SEQ ID NO: 667489 - DNA, 25 bp, Mus musculus
gatgccgcccaagcggttgggaaaa

SEQ ID NO: 667490 - DNA, 25 bp, Mus musculus
gatgccgccctaagatgaggagacc

SEQ ID NO: 667491 - DNA, 25 bp, Mus musculus
gatgccgccctatgatgaggagacc

SEQ ID NO: 667492 - DNA, 25 bp, Mus musculus
gatgccgccctcctctgtgtcaggg

SEQ ID NO: 667493 - DNA, 25 bp, Mus musculus
gatgccgccctcgtctgtgtcaggg

SEQ ID NO: 667494 - DNA, 25 bp, Mus musculus
gatgccgcctctctgattggagaag

SEQ ID NO: 667495 - DNA, 25 bp, Mus musculus
gatgccgcctctgtgattggagaag

SEQ ID NO: 667496 - DNA, 25 bp, Mus musculus
gatgccgctcctctgagggagcacc

SEQ ID NO: 667497 - DNA, 25 bp, Mus musculus
gatgccgctcctgtgagggagcacc

SEQ ID NO: 667498 - DNA, 25 bp, Mus musculus
gatgccgctgataagatggccccgg

SEQ ID NO: 667499 - DNA, 25 bp, Mus musculus
gatgccgctgattagatggccccgg

SEQ ID NO: 667500 - DNA, 25 bp, Mus musculus
gatgccgctgcccaccttttggtct

SEQ ID NO: 667501 - DNA, 25 bp, Mus musculus
gatgccgctgccgaccttttggtct

SEQ ID NO: 667502 - DNA, 25 bp, Mus musculus
gatgccggacaaatcatcctgcagg

SEQ ID NO: 667503 - DNA, 25 bp, Mus musculus
gatgccggacaattcatcctgcagg

SEQ ID NO: 667504 - DNA, 25 bp, Mus musculus
gatgccggcagcattcctaaaaaca

SEQ ID NO: 667505 - DNA, 25 bp, Mus musculus
gatgccggcagctttcctaaaaaca

SEQ ID NO: 667506 - DNA, 25 bp, Mus musculus
gatgccggtttgatgaatcagttgc

SEQ ID NO: 667507 - DNA, 25 bp, Mus musculus
gatgccggtttgttgaatcagttgc

SEQ ID NO: 667508 - DNA, 25 bp, Mus musculus
gatgccgtcgggagaatttgcacgt

SEQ ID NO: 667509 - DNA, 25 bp, Mus musculus
gatgccgtcgggattccagcagatc

SEQ ID NO: 667510 - DNA, 25 bp, Mus musculus
gatgccgtcgggtgaatttgcacgt

SEQ ID NO: 667511 - DNA, 25 bp, Mus musculus
gatgccgtcgggtttccagcagatc

SEQ ID NO: 667512 - DNA, 25 bp, Mus musculus
gatgccgtgaagagaatactggaac

SEQ ID NO: 667513 - DNA, 25 bp, Mus musculus
gatgccgtgaagtgaatactggaac

SEQ ID NO: 667514 - DNA, 25 bp, Mus musculus
gatgccgttgacagtgccacacagg

SEQ ID NO: 667515 - DNA, 25 bp, Mus musculus
gatgccgttgactgtgccacacagg

SEQ ID NO: 667516 - DNA, 25 bp, Mus musculus
gatgcctacctgatgaagctgcgcc

SEQ ID NO: 667517 - DNA, 25 bp, Mus musculus
gatgcctacctgttgaagctgcgcc

SEQ ID NO: 667518 - DNA, 25 bp, Mus musculus
gatgcctataccctgagcggagctg

SEQ ID NO: 667519 - DNA, 25 bp, Mus musculus
gatgcctataccgtgagcggagctg

SEQ ID NO: 667520 - DNA, 25 bp, Mus musculus
gatgcctatactcagcagctgcaca

SEQ ID NO: 667521 - DNA, 25 bp, Mus musculus
gatgcctatactgagcagctgcaca

SEQ ID NO: 667522 - DNA, 25 bp, Mus musculus
gatgcctatcgcctctgctgtgctt

SEQ ID NO: 667523 - DNA, 25 bp, Mus musculus
gatgcctatcgcgtctgctgtgctt

SEQ ID NO: 667524 - DNA, 25 bp, Mus musculus
gatgcctcaacaaagtgcctggcta

SEQ ID NO: 667525 - DNA, 25 bp, Mus musculus
gatgcctcaacatagtgcctggcta

SEQ ID NO: 667526 - DNA, 25 bp, Mus musculus
gatgcctcagggatgccggacattt

SEQ ID NO: 667527 - DNA, 25 bp, Mus musculus
gatgcctcagggttgccggacattt

SEQ ID NO: 667528 - DNA, 25 bp, Mus musculus
gatgcctccagactgggccctcgtt

SEQ ID NO: 667529 - DNA, 25 bp, Mus musculus
gatgcctccagagtgggccctcgtt

SEQ ID NO: 667530 - DNA, 25 bp, Mus musculus
gatgcctctgaaattgtgagcaaga

SEQ ID NO: 667531 - DNA, 25 bp, Mus musculus
gatgcctctgaatttgtgagcaaga

SEQ ID NO: 667532 - DNA, 25 bp, Mus musculus
gatgcctctgcaaagccaggttggg

SEQ ID NO: 667533 - DNA, 25 bp, Mus musculus
gatgcctctgcatagccaggttggg

SEQ ID NO: 667534 - DNA, 25 bp, Mus musculus
gatgcctgactgatggatagcctgg

SEQ ID NO: 667535 - DNA, 25 bp, Mus musculus
gatgcctgactgttggatagcctgg

SEQ ID NO: 667536 - DNA, 25 bp, Mus musculus
gatgcctgagcaccctcgacttagt

SEQ ID NO: 667537 - DNA, 25 bp, Mus musculus
gatgcctgagcagcctcgacttagt

SEQ ID NO: 667538 - DNA, 25 bp, Mus musculus
gatgcctgcaggcatcacatggaag

SEQ ID NO: 667539 - DNA, 25 bp, Mus musculus
gatgcctgcagggatcacatggaag

SEQ ID NO: 667540 - DNA, 25 bp, Mus musculus
gatgcctgcctgcttagactttaaa

SEQ ID NO: 667541 - DNA, 25 bp, Mus musculus
gatgcctgcctggttagactttaaa

SEQ ID NO: 667542 - DNA, 25 bp, Mus musculus
gatgcctggcatctgtcgccatggt

SEQ ID NO: 667543 - DNA, 25 bp, Mus musculus
gatgcctggcatgtgtcgccatggt

SEQ ID NO: 667544 - DNA, 25 bp, Mus musculus
gatgcctggccgaaaggtcactgat

SEQ ID NO: 667545 - DNA, 25 bp, Mus musculus
gatgcctggccgtaaggtcactgat

SEQ ID NO: 667546 - DNA, 25 bp, Mus musculus
gatgcctgggacactagggtgacaa

SEQ ID NO: 667547 - DNA, 25 bp, Mus musculus
gatgcctgggactctagggtgacaa

SEQ ID NO: 667548 - DNA, 25 bp, Mus musculus
gatgcctggtccatgggcacaaaga

SEQ ID NO: 667549 - DNA, 25 bp, Mus musculus
gatgcctggtccttgggcacaaaga

SEQ ID NO: 667550 - DNA, 25 bp, Mus musculus
gatgcctgtaaacaagtcgtcctcc

SEQ ID NO: 667551 - DNA, 25 bp, Mus musculus
gatgcctgtaaagaagtcgtcctcc

SEQ ID NO: 667552 - DNA, 25 bp, Mus musculus
gatgcctgtacaagcttctagctgt

SEQ ID NO: 667553 - DNA, 25 bp, Mus musculus
gatgcctgtacatgcttctagctgt

SEQ ID NO: 667554 - DNA, 25 bp, Mus musculus
gatgcctgtataacccagggactgg

SEQ ID NO: 667555 - DNA, 25 bp, Mus musculus
gatgcctgtatatcccagggactgg

SEQ ID NO: 667556 - DNA, 25 bp, Mus musculus
gatgcctgtgacaaagaagccgcga

SEQ ID NO: 667557 - DNA, 25 bp, Mus musculus
gatgcctgtgactaagaagccgcga

SEQ ID NO: 667558 - DNA, 25 bp, Mus musculus
gatgccttacctctcctcaagctgg

SEQ ID NO: 667559 - DNA, 25 bp, Mus musculus
gatgccttacctgtcctcaagctgg

SEQ ID NO: 667560 - DNA, 25 bp, Mus musculus
gatgccttcgacattaatgtttccc

SEQ ID NO: 667561 - DNA, 25 bp, Mus musculus
gatgccttcgactttaatgtttccc

SEQ ID NO: 667562 - DNA, 25 bp, Mus musculus
gatgccttctggatgatgtgtgcca

SEQ ID NO: 667563 - DNA, 25 bp, Mus musculus
gatgccttctggttgatgtgtgcca

SEQ ID NO: 667564 - DNA, 25 bp, Mus musculus
gatgccttctttaccctgctttagc

SEQ ID NO: 667565 - DNA, 25 bp, Mus musculus
gatgccttcttttccctgctttagc

SEQ ID NO: 667566 - DNA, 25 bp, Mus musculus
gatgccttggaaagcggttacgtgt

SEQ ID NO: 667567 - DNA, 25 bp, Mus musculus
gatgccttggaatgcggttacgtgt

SEQ ID NO: 667568 - DNA, 25 bp, Mus musculus
gatgccttggacatgctcaccaggg

SEQ ID NO: 667569 - DNA, 25 bp, Mus musculus
gatgccttggacttgctcaccaggg

SEQ ID NO: 667570 - DNA, 25 bp, Mus musculus
gatgccttgtacattgaagactgta

SEQ ID NO: 667571 - DNA, 25 bp, Mus musculus
gatgccttgtactttgaagactgta

SEQ ID NO: 667572 - DNA, 25 bp, Mus musculus
gatgcctttgtcaccaacgagctag

SEQ ID NO: 667573 - DNA, 25 bp, Mus musculus
gatgcctttgtctccaacgagctag

SEQ ID NO: 667574 - DNA, 25 bp, Mus musculus
gatgccttttggacagctgatgtct

SEQ ID NO: 667575 - DNA, 25 bp, Mus musculus
gatgccttttggtcagctgatgtct

SEQ ID NO: 667576 - DNA, 25 bp, Mus musculus
gatgcgaaagccaggcgctactaga

SEQ ID NO: 667577 - DNA, 25 bp, Mus musculus
gatgcgaaagcctggcgctactaga

SEQ ID NO: 667578 - DNA, 25 bp, Mus musculus
gatgcgaacgcaccactgctcagca

SEQ ID NO: 667579 - DNA, 25 bp, Mus musculus
gatgcgaacgcagcactgctcagca

SEQ ID NO: 667580 - DNA, 25 bp, Mus musculus
gatgcgaatcggatgtggcaccccg

SEQ ID NO: 667581 - DNA, 25 bp, Mus musculus
gatgcgaatcggttgtggcaccccg

SEQ ID NO: 667582 - DNA, 25 bp, Mus musculus
gatgcgacctccattaattgaatcc

SEQ ID NO: 667583 - DNA, 25 bp, Mus musculus
gatgcgacctcctttaattgaatcc

SEQ ID NO: 667584 - DNA, 25 bp, Mus musculus
gatgcgagctgtcaagaagcatgcc

SEQ ID NO: 667585 - DNA, 25 bp, Mus musculus
gatgcgagctgtgaagaagcatgcc

SEQ ID NO: 667586 - DNA, 25 bp, Mus musculus
gatgcgagtgatactggcctctaac

SEQ ID NO: 667587 - DNA, 25 bp, Mus musculus
gatgcgagtgattctggcctctaac

SEQ ID NO: 667588 - DNA, 25 bp, Mus musculus
gatgcgcaggaacgtagtacctacg

SEQ ID NO: 667589 - DNA, 25 bp, Mus musculus
gatgcgcaggaaggtagtacctacg

SEQ ID NO: 667590 - DNA, 25 bp, Mus musculus
gatgcgcagtgaagtccatccaagt

SEQ ID NO: 667591 - DNA, 25 bp, Mus musculus
gatgcgcagtgatgtccatccaagt

SEQ ID NO: 667592 - DNA, 25 bp, Mus musculus
gatgcgccgcaaccggtttaaatgg

SEQ ID NO: 667593 - DNA, 25 bp, Mus musculus
gatgcgccgcaagcggtttaaatgg

SEQ ID NO: 667594 - DNA, 25 bp, Mus musculus
gatgcgcctacaccccttcaatgaa

SEQ ID NO: 667595 - DNA, 25 bp, Mus musculus
gatgcgcctacagcccttcaatgaa

SEQ ID NO: 667596 - DNA, 25 bp, Mus musculus
gatgcgcctatgaaccagtgctaca

SEQ ID NO: 667597 - DNA, 25 bp, Mus musculus
gatgcgcctatgtaccagtgctaca

SEQ ID NO: 667598 - DNA, 25 bp, Mus musculus
gatgcgcctgaacgattatgtcaag

SEQ ID NO: 667599 - DNA, 25 bp, Mus musculus
gatgcgcctgaaggattatgtcaag

SEQ ID NO: 667600 - DNA, 25 bp, Mus musculus
gatgcgcctggaaccccagtctatg

SEQ ID NO: 667601 - DNA, 25 bp, Mus musculus
gatgcgcctggatccccagtctatg

SEQ ID NO: 667602 - DNA, 25 bp, Mus musculus
gatgcgccttgaagcaagtaaactc

SEQ ID NO: 667603 - DNA, 25 bp, Mus musculus
gatgcgccttgatgcaagtaaactc

SEQ ID NO: 667604 - DNA, 25 bp, Mus musculus
gatgcgctcacgcagtgaaacctta

SEQ ID NO: 667605 - DNA, 25 bp, Mus musculus
gatgcgctcacggagtgaaacctta

SEQ ID NO: 667606 - DNA, 25 bp, Mus musculus
gatgcgctcggtctaccaccagaac

SEQ ID NO: 667607 - DNA, 25 bp, Mus musculus
gatgcgctcggtgtaccaccagaac

SEQ ID NO: 667608 - DNA, 25 bp, Mus musculus
gatgcgctctgccacagtgccagtg

SEQ ID NO: 667609 - DNA, 25 bp, Mus musculus
gatgcgctctgcgacagtgccagtg

SEQ ID NO: 667610 - DNA, 25 bp, Mus musculus
gatgcgctgccgctggctagatcct

SEQ ID NO: 667611 - DNA, 25 bp, Mus musculus
gatgcgctgccggtggctagatcct

SEQ ID NO: 667612 - DNA, 25 bp, Mus musculus
gatgcgctgcggaagaaaactgcct

SEQ ID NO: 667613 - DNA, 25 bp, Mus musculus
gatgcgctgcggtagaaaactgcct

SEQ ID NO: 667614 - DNA, 25 bp, Mus musculus
gatgcgctggtccagaagcacttga

SEQ ID NO: 667615 - DNA, 25 bp, Mus musculus
gatgcgctggtcgagaagcacttga

SEQ ID NO: 667616 - DNA, 25 bp, Mus musculus
gatgcgctgtttccctaggaagcag

SEQ ID NO: 667617 - DNA, 25 bp, Mus musculus
gatgcgctgtttgcctaggaagcag

SEQ ID NO: 667618 - DNA, 25 bp, Mus musculus
gatgcggacattccagctcagaagc

SEQ ID NO: 667619 - DNA, 25 bp, Mus musculus
gatgcggacattgcagctcagaagc

SEQ ID NO: 667620 - DNA, 25 bp, Mus musculus
gatgcggagttccacaccttcttca

SEQ ID NO: 667621 - DNA, 25 bp, Mus musculus
gatgcggagttcgacaccttcttca

SEQ ID NO: 667622 - DNA, 25 bp, Mus musculus
gatgcggatgaaagcggagttcatc

SEQ ID NO: 667623 - DNA, 25 bp, Mus musculus
gatgcggatgaatgcggagttcatc

SEQ ID NO: 667624 - DNA, 25 bp, Mus musculus
gatgcggcagcactttcataaaggg

SEQ ID NO: 667625 - DNA, 25 bp, Mus musculus
gatgcggcagcagtttcataaaggg

SEQ ID NO: 667626 - DNA, 25 bp, Mus musculus
gatgcggcatctactgagactactt

SEQ ID NO: 667627 - DNA, 25 bp, Mus musculus
gatgcggcatcttctgagactactt

SEQ ID NO: 667628 - DNA, 25 bp, Mus musculus
gatgcggcgcagagaagctgccttt

SEQ ID NO: 667629 - DNA, 25 bp, Mus musculus
gatgcggcgcagtgaagctgccttt

SEQ ID NO: 667630 - DNA, 25 bp, Mus musculus
gatgcgggatcacaaagaatccaaa

SEQ ID NO: 667631 - DNA, 25 bp, Mus musculus
gatgcgggatcagaaagaatccaaa

SEQ ID NO: 667632 - DNA, 25 bp, Mus musculus
gatgcgggcccaccgtaaattccga

SEQ ID NO: 667633 - DNA, 25 bp, Mus musculus
gatgcgggcccagcgtaaattccga

SEQ ID NO: 667634 - DNA, 25 bp, Mus musculus
gatgcgggcccgagacaatgtgtat

SEQ ID NO: 667635 - DNA, 25 bp, Mus musculus
gatgcgggcccgtgacaatgtgtat

SEQ ID NO: 667636 - DNA, 25 bp, Mus musculus
gatgcgggctgtacgcctcgtccgc

SEQ ID NO: 667637 - DNA, 25 bp, Mus musculus
gatgcgggctgttcgcctcgtccgc

SEQ ID NO: 667638 - DNA, 25 bp, Mus musculus
gatgcgggtctgagttgaaagcctt

SEQ ID NO: 667639 - DNA, 25 bp, Mus musculus
gatgcgggtctgtgttgaaagcctt

SEQ ID NO: 667640 - DNA, 25 bp, Mus musculus
gatgcggtctttcacgaatggctaa

SEQ ID NO: 667641 - DNA, 25 bp, Mus musculus
gatgcggtctttgacgaatggctaa

SEQ ID NO: 667642 - DNA, 25 bp, Mus musculus
gatgcgtattacatcctgctgtaca

SEQ ID NO: 667643 - DNA, 25 bp, Mus musculus
gatgcgtattacttcctgctgtaca

SEQ ID NO: 667644 - DNA, 25 bp, Mus musculus
gatgcgtcgatactcttctcatgcg

SEQ ID NO: 667645 - DNA, 25 bp, Mus musculus
gatgcgtcgatagtcttctcatgcg

SEQ ID NO: 667646 - DNA, 25 bp, Mus musculus
gatgcgtgcctgctggctaatattt

SEQ ID NO: 667647 - DNA, 25 bp, Mus musculus
gatgcgtgcctggtggctaatattt

SEQ ID NO: 667648 - DNA, 25 bp, Mus musculus
gatgcgttctatcttgcggacctcg

SEQ ID NO: 667649 - DNA, 25 bp, Mus musculus
gatgcgttctatgttgcggacctcg

SEQ ID NO: 667650 - DNA, 25 bp, Mus musculus
gatgcgttgctgctttctcacaacc

SEQ ID NO: 667651 - DNA, 25 bp, Mus musculus
gatgcgttgctggtttctcacaacc

SEQ ID NO: 667652 - DNA, 25 bp, Mus musculus
gatgctaaagatagctgaggaactg

SEQ ID NO: 667653 - DNA, 25 bp, Mus musculus
gatgctaaagattgctgaggaactg

SEQ ID NO: 667654 - DNA, 25 bp, Mus musculus
gatgctaagagcactccaactgctg

SEQ ID NO: 667655 - DNA, 25 bp, Mus musculus
gatgctaagagctctccaactgctg

SEQ ID NO: 667656 - DNA, 25 bp, Mus musculus
gatgctaagattagagctacccgcc

SEQ ID NO: 667657 - DNA, 25 bp, Mus musculus
gatgctaagatttgagctacccgcc

SEQ ID NO: 667658 - DNA, 25 bp, Mus musculus
gatgctacaacgacagaggaaccga

SEQ ID NO: 667659 - DNA, 25 bp, Mus musculus
gatgctacaacgtcagaggaaccga

SEQ ID NO: 667660 - DNA, 25 bp, Mus musculus
gatgctacaactattggaaagggta

SEQ ID NO: 667661 - DNA, 25 bp, Mus musculus
gatgctacaacttttggaaagggta

SEQ ID NO: 667662 - DNA, 25 bp, Mus musculus
gatgctacagcaagcctttgagggc

SEQ ID NO: 667663 - DNA, 25 bp, Mus musculus
gatgctacagcatgcctttgagggc

SEQ ID NO: 667664 - DNA, 25 bp, Mus musculus
gatgctacagctaaagttcaacagc

SEQ ID NO: 667665 - DNA, 25 bp, Mus musculus
gatgctacagcttaagttcaacagc

SEQ ID NO: 667666 - DNA, 25 bp, Mus musculus
gatgctaccacgcttcagtaccttc

SEQ ID NO: 667667 - DNA, 25 bp, Mus musculus
gatgctaccacggttcagtaccttc

SEQ ID NO: 667668 - DNA, 25 bp, Mus musculus
gatgctaccactctgttgtcccggg

SEQ ID NO: 667669 - DNA, 25 bp, Mus musculus
gatgctaccactgtgttgtcccggg

SEQ ID NO: 667670 - DNA, 25 bp, Mus musculus
gatgctaccgatcgcccatttgcca

SEQ ID NO: 667671 - DNA, 25 bp, Mus musculus
gatgctaccgatggcccatttgcca

SEQ ID NO: 667672 - DNA, 25 bp, Mus musculus
gatgctactccacctaaggccaaaa

SEQ ID NO: 667673 - DNA, 25 bp, Mus musculus
gatgctactccagctaaggccaaaa

SEQ ID NO: 667674 - DNA, 25 bp, Mus musculus
gatgctactgttccaagctctcctg

SEQ ID NO: 667675 - DNA, 25 bp, Mus musculus
gatgctactgttgcaagctctcctg

SEQ ID NO: 667676 - DNA, 25 bp, Mus musculus
gatgctacttcaattcaccttatgg

SEQ ID NO: 667677 - DNA, 25 bp, Mus musculus
gatgctacttcatttcaccttatgg

SEQ ID NO: 667678 - DNA, 25 bp, Mus musculus
gatgctagaagcatttgccaagcat

SEQ ID NO: 667679 - DNA, 25 bp, Mus musculus
gatgctagaagcttttgccaagcat

SEQ ID NO: 667680 - DNA, 25 bp, Mus musculus
gatgctaggactagcttcacccctc

SEQ ID NO: 667681 - DNA, 25 bp, Mus musculus
gatgctaggacttgcttcacccctc

SEQ ID NO: 667682 - DNA, 25 bp, Mus musculus
gatgctatagctacaccattcctgc

SEQ ID NO: 667683 - DNA, 25 bp, Mus musculus
gatgctatagcttcaccattcctgc

SEQ ID NO: 667684 - DNA, 25 bp, Mus musculus
gatgctatcaggcatcttgcccagg

SEQ ID NO: 667685 - DNA, 25 bp, Mus musculus
gatgctatcagggatcttgcccagg

SEQ ID NO: 667686 - DNA, 25 bp, Mus musculus
gatgctatgatgaactgcaagtcag

SEQ ID NO: 667687 - DNA, 25 bp, Mus musculus
gatgctatgatgtactgcaagtcag

SEQ ID NO: 667688 - DNA, 25 bp, Mus musculus
gatgctcaaaggactccaagccaag

SEQ ID NO: 667689 - DNA, 25 bp, Mus musculus
gatgctcaaaggtctccaagccaag

SEQ ID NO: 667690 - DNA, 25 bp, Mus musculus
gatgctcacctaagacccaatgctg

SEQ ID NO: 667691 - DNA, 25 bp, Mus musculus
gatgctcacctatgacccaatgctg

SEQ ID NO: 667692 - DNA, 25 bp, Mus musculus
gatgctcaggagattacccagtgcc

SEQ ID NO: 667693 - DNA, 25 bp, Mus musculus
gatgctcaggagtttacccagtgcc

SEQ ID NO: 667694 - DNA, 25 bp, Mus musculus
gatgctcagggaataccgagttctg

SEQ ID NO: 667695 - DNA, 25 bp, Mus musculus
gatgctcagggattaccgagttctg

SEQ ID NO: 667696 - DNA, 25 bp, Mus musculus
gatgctcagtatcttctactttgcc

SEQ ID NO: 667697 - DNA, 25 bp, Mus musculus
gatgctcagtatgttctactttgcc

SEQ ID NO: 667698 - DNA, 25 bp, Mus musculus
gatgctcatcaaatgacgatggagg

SEQ ID NO: 667699 - DNA, 25 bp, Mus musculus
gatgctcatcaattgacgatggagg

SEQ ID NO: 667700 - DNA, 25 bp, Mus musculus
gatgctcatgaaatttgcctgcaag

SEQ ID NO: 667701 - DNA, 25 bp, Mus musculus
gatgctcatgaattttgcctgcaag

SEQ ID NO: 667702 - DNA, 25 bp, Mus musculus
gatgctcatgttagatccagtccct

SEQ ID NO: 667703 - DNA, 25 bp, Mus musculus
gatgctcatgtttgatccagtccct

SEQ ID NO: 667704 - DNA, 25 bp, Mus musculus
gatgctcattacaatgagcagaacg

SEQ ID NO: 667705 - DNA, 25 bp, Mus musculus
gatgctcattactatgagcagaacg

SEQ ID NO: 667706 - DNA, 25 bp, Mus musculus
gatgctccacatctagactccttgt

SEQ ID NO: 667707 - DNA, 25 bp, Mus musculus
gatgctccacatgtagactccttgt

SEQ ID NO: 667708 - DNA, 25 bp, Mus musculus
gatgctccagatccggatacggcca

SEQ ID NO: 667709 - DNA, 25 bp, Mus musculus
gatgctccagatgcggatacggcca

SEQ ID NO: 667710 - DNA, 25 bp, Mus musculus
gatgctccagtgacaagaaataccg

SEQ ID NO: 667711 - DNA, 25 bp, Mus musculus
gatgctccagtgtcaagaaataccg

SEQ ID NO: 667712 - DNA, 25 bp, Mus musculus
gatgctccccgacagcatgtggaga

SEQ ID NO: 667713 - DNA, 25 bp, Mus musculus
gatgctccccgagagcatgtggaga

SEQ ID NO: 667714 - DNA, 25 bp, Mus musculus
gatgctcccgaacccgttcgagagc

SEQ ID NO: 667715 - DNA, 25 bp, Mus musculus
gatgctcccgaagccgttcgagagc

SEQ ID NO: 667716 - DNA, 25 bp, Mus musculus
gatgctcccgagaaagtagccgatg

SEQ ID NO: 667717 - DNA, 25 bp, Mus musculus
gatgctcccgagtaagtagccgatg

SEQ ID NO: 667718 - DNA, 25 bp, Mus musculus
gatgctccgaacagtcacctgggta

SEQ ID NO: 667719 - DNA, 25 bp, Mus musculus
gatgctccgaactgtcacctgggta

SEQ ID NO: 667720 - DNA, 25 bp, Mus musculus
gatgctccggtgaggttgtctctca

SEQ ID NO: 667721 - DNA, 25 bp, Mus musculus
gatgctccggtgtggttgtctctca

SEQ ID NO: 667722 - DNA, 25 bp, Mus musculus
gatgctcctcaaccagactggcttt

SEQ ID NO: 667723 - DNA, 25 bp, Mus musculus
gatgctcctcaagcagactggcttt

SEQ ID NO: 667724 - DNA, 25 bp, Mus musculus
gatgctcctgcccagggactagata

SEQ ID NO: 667725 - DNA, 25 bp, Mus musculus
gatgctcctgcccatggcctgaggc

SEQ ID NO: 667726 - DNA, 25 bp, Mus musculus
gatgctcctgccgagggactagata

SEQ ID NO: 667727 - DNA, 25 bp, Mus musculus
gatgctcctgccgatggcctgaggc

SEQ ID NO: 667728 - DNA, 25 bp, Mus musculus
gatgctcgagacagtatttcttggg

SEQ ID NO: 667729 - DNA, 25 bp, Mus musculus
gatgctcgagactgtatttcttggg

SEQ ID NO: 667730 - DNA, 25 bp, Mus musculus
gatgctcgatacagctgtcattggg

SEQ ID NO: 667731 - DNA, 25 bp, Mus musculus
gatgctcgatactgctgtcattggg

SEQ ID NO: 667732 - DNA, 25 bp, Mus musculus
gatgctcgcgctaggaagactttca

SEQ ID NO: 667733 - DNA, 25 bp, Mus musculus
gatgctcgcgcttggaagactttca

SEQ ID NO: 667734 - DNA, 25 bp, Mus musculus
gatgctcggcgcacggctgcatgcc

SEQ ID NO: 667735 - DNA, 25 bp, Mus musculus
gatgctcggcgctcggctgcatgcc

SEQ ID NO: 667736 - DNA, 25 bp, Mus musculus
gatgctcgggagacctgcgttacca

SEQ ID NO: 667737 - DNA, 25 bp, Mus musculus
gatgctcgggagtcctgcgttacca

SEQ ID NO: 667738 - DNA, 25 bp, Mus musculus
gatgctcgtaaaccgtgtgccgatg

SEQ ID NO: 667739 - DNA, 25 bp, Mus musculus
gatgctcgtaaagcgtgtgccgatg

SEQ ID NO: 667740 - DNA, 25 bp, Mus musculus
gatgctctagagagaacgcacatga

SEQ ID NO: 667741 - DNA, 25 bp, Mus musculus
gatgctctagagtgaacgcacatga

SEQ ID NO: 667742 - DNA, 25 bp, Mus musculus
gatgctctccccagaagttggtcca

SEQ ID NO: 667743 - DNA, 25 bp, Mus musculus
gatgctctcccctgaagttggtcca

SEQ ID NO: 667744 - DNA, 25 bp, Mus musculus
gatgctctgatacagaaatctcaga

SEQ ID NO: 667745 - DNA, 25 bp, Mus musculus
gatgctctgatagagaaatctcaga

SEQ ID NO: 667746 - DNA, 25 bp, Mus musculus
gatgctctgcaacgtgaaggctcgc

SEQ ID NO: 667747 - DNA, 25 bp, Mus musculus
gatgctctgcaaggtgaaggctcgc

SEQ ID NO: 667748 - DNA, 25 bp, Mus musculus
gatgctctgcagctaggctcgtcag

SEQ ID NO: 667749 - DNA, 25 bp, Mus musculus
gatgctctgcaggtaggctcgtcag

SEQ ID NO: 667750 - DNA, 25 bp, Mus musculus
gatgctctgcctcctcaacaaaaag

SEQ ID NO: 667751 - DNA, 25 bp, Mus musculus
gatgctctgcctgctcaacaaaaag

SEQ ID NO: 667752 - DNA, 25 bp, Mus musculus
gatgctctgcgaccagtattatcta

SEQ ID NO: 667753 - DNA, 25 bp, Mus musculus
gatgctctgcgagcagtattatcta

SEQ ID NO: 667754 - DNA, 25 bp, Mus musculus
gatgctctgcgtcccttggatgctt

SEQ ID NO: 667755 - DNA, 25 bp, Mus musculus
gatgctctgcgtgccttggatgctt

SEQ ID NO: 667756 - DNA, 25 bp, Mus musculus
gatgctctggagaggacaatgcctg

SEQ ID NO: 667757 - DNA, 25 bp, Mus musculus
gatgctctggagtggacaatgcctg

SEQ ID NO: 667758 - DNA, 25 bp, Mus musculus
gatgctctggctcaggagtatctca

SEQ ID NO: 667759 - DNA, 25 bp, Mus musculus
gatgctctggctgaggagtatctca

SEQ ID NO: 667760 - DNA, 25 bp, Mus musculus
gatgctctgtgacaccttgcccagt

SEQ ID NO: 667761 - DNA, 25 bp, Mus musculus
gatgctctgtgagaccttgcccagt

SEQ ID NO: 667762 - DNA, 25 bp, Mus musculus
gatgctctgtgtcctggacctaggt

SEQ ID NO: 667763 - DNA, 25 bp, Mus musculus
gatgctctgtgtgctggacctaggt

SEQ ID NO: 667764 - DNA, 25 bp, Mus musculus
gatgctctgtttcgagggttgaacc

SEQ ID NO: 667765 - DNA, 25 bp, Mus musculus
gatgctctgtttggagggttgaacc

SEQ ID NO: 667766 - DNA, 25 bp, Mus musculus
gatgctcttatcagacacttggaga

SEQ ID NO: 667767 - DNA, 25 bp, Mus musculus
gatgctcttatctgacacttggaga

SEQ ID NO: 667768 - DNA, 25 bp, Mus musculus
gatgctcttcgaactggagtccgct

SEQ ID NO: 667769 - DNA, 25 bp, Mus musculus
gatgctcttcgatctggagtccgct

SEQ ID NO: 667770 - DNA, 25 bp, Mus musculus
gatgctcttggcattgaggatcaac

SEQ ID NO: 667771 - DNA, 25 bp, Mus musculus
gatgctcttggctttgaggatcaac

SEQ ID NO: 667772 - DNA, 25 bp, Mus musculus
gatgctcttttgcaacagcagaaca

SEQ ID NO: 667773 - DNA, 25 bp, Mus musculus
gatgctcttttggaacagcagaaca

SEQ ID NO: 667774 - DNA, 25 bp, Mus musculus
gatgctgaaataagcgcttaaggag

SEQ ID NO: 667775 - DNA, 25 bp, Mus musculus
gatgctgaaatatgcgcttaaggag

SEQ ID NO: 667776 - DNA, 25 bp, Mus musculus
gatgctgaacaaacccaaaagggtt

SEQ ID NO: 667777 - DNA, 25 bp, Mus musculus
gatgctgaacaatcccaaaagggtt

SEQ ID NO: 667778 - DNA, 25 bp, Mus musculus
gatgctgaagaacgctacctatgac

SEQ ID NO: 667779 - DNA, 25 bp, Mus musculus
gatgctgaagaaggctacctatgac

SEQ ID NO: 667780 - DNA, 25 bp, Mus musculus
gatgctgaagctactattttcttta

SEQ ID NO: 667781 - DNA, 25 bp, Mus musculus
gatgctgaagctcgacaaagagaac

SEQ ID NO: 667782 - DNA, 25 bp, Mus musculus
gatgctgaagctggacaaagagaac

SEQ ID NO: 667783 - DNA, 25 bp, Mus musculus
gatgctgaagcttctattttcttta

SEQ ID NO: 667784 - DNA, 25 bp, Mus musculus
gatgctgaagttagacaaagagaat

SEQ ID NO: 667785 - DNA, 25 bp, Mus musculus
gatgctgaagtttgacaaagagaat

SEQ ID NO: 667786 - DNA, 25 bp, Mus musculus
gatgctgaataaacccctatttgct

SEQ ID NO: 667787 - DNA, 25 bp, Mus musculus
gatgctgaataatcccctatttgct

SEQ ID NO: 667788 - DNA, 25 bp, Mus musculus
gatgctgaatcgcttcaaggcctaa

SEQ ID NO: 667789 - DNA, 25 bp, Mus musculus
gatgctgaatcggttcaaggcctaa

SEQ ID NO: 667790 - DNA, 25 bp, Mus musculus
gatgctgacaacaagactgaccctt

SEQ ID NO: 667791 - DNA, 25 bp, Mus musculus
gatgctgacaactagactgaccctt

SEQ ID NO: 667792 - DNA, 25 bp, Mus musculus
gatgctgacattctgatctgggacc

SEQ ID NO: 667793 - DNA, 25 bp, Mus musculus
gatgctgacattgtgatctgggacc

SEQ ID NO: 667794 - DNA, 25 bp, Mus musculus
gatgctgaccgtatttcacacaaaa

SEQ ID NO: 667795 - DNA, 25 bp, Mus musculus
gatgctgaccgtttttcacacaaaa

SEQ ID NO: 667796 - DNA, 25 bp, Mus musculus
gatgctgacgggattaccacctcaa

SEQ ID NO: 667797 - DNA, 25 bp, Mus musculus
gatgctgacgggtttaccacctcaa

SEQ ID NO: 667798 - DNA, 25 bp, Mus musculus
gatgctgactgcatggatgtcaatg

SEQ ID NO: 667799 - DNA, 25 bp, Mus musculus
gatgctgactgcttggatgtcaatg

SEQ ID NO: 667800 - DNA, 25 bp, Mus musculus
gatgctgacttgaacaagctagccc

SEQ ID NO: 667801 - DNA, 25 bp, Mus musculus
gatgctgacttgtacaagctagccc

SEQ ID NO: 667802 - DNA, 25 bp, Mus musculus
gatgctgagaagctagcaaacttgc

SEQ ID NO: 667803 - DNA, 25 bp, Mus musculus
gatgctgagaaggtagcaaacttgc

SEQ ID NO: 667804 - DNA, 25 bp, Mus musculus
gatgctgagaccaacctctgagggc

SEQ ID NO: 667805 - DNA, 25 bp, Mus musculus
gatgctgagaccactggtggaagct

SEQ ID NO: 667806 - DNA, 25 bp, Mus musculus
gatgctgagacctacctctgagggc

SEQ ID NO: 667807 - DNA, 25 bp, Mus musculus
gatgctgagacctctggtggaagct

SEQ ID NO: 667808 - DNA, 25 bp, Mus musculus
gatgctgagagcacaggaggctcca

SEQ ID NO: 667809 - DNA, 25 bp, Mus musculus
gatgctgagagctcaggaggctcca

SEQ ID NO: 667810 - DNA, 25 bp, Mus musculus
gatgctgagataactttgctccatg

SEQ ID NO: 667811 - DNA, 25 bp, Mus musculus
gatgctgagatatctttgctccatg

SEQ ID NO: 667812 - DNA, 25 bp, Mus musculus
gatgctgagggcctgtggaggcgca

SEQ ID NO: 667813 - DNA, 25 bp, Mus musculus
gatgctgagggcgtgtggaggcgca

SEQ ID NO: 667814 - DNA, 25 bp, Mus musculus
gatgctgaggtcatgaattccctgg

SEQ ID NO: 667815 - DNA, 25 bp, Mus musculus
gatgctgaggtcttgaattccctgg

SEQ ID NO: 667816 - DNA, 25 bp, Mus musculus
gatgctgatcaacaagcctccagat

SEQ ID NO: 667817 - DNA, 25 bp, Mus musculus
gatgctgatcaacaagtgtctcctg

SEQ ID NO: 667818 - DNA, 25 bp, Mus musculus
gatgctgatcaagaagcctccagat

SEQ ID NO: 667819 - DNA, 25 bp, Mus musculus
gatgctgatcaagaagtgtctcctg

SEQ ID NO: 667820 - DNA, 25 bp, Mus musculus
gatgctgatgacaggaatgccccag

SEQ ID NO: 667821 - DNA, 25 bp, Mus musculus
gatgctgatgactggaatgccccag

SEQ ID NO: 667822 - DNA, 25 bp, Mus musculus
gatgctgatgagatagaaggtccag

SEQ ID NO: 667823 - DNA, 25 bp, Mus musculus
gatgctgatgagttagaaggtccag

SEQ ID NO: 667824 - DNA, 25 bp, Mus musculus
gatgctgatgccagcggtgcctgtc

SEQ ID NO: 667825 - DNA, 25 bp, Mus musculus
gatgctgatgcctgcggtgcctgtc

SEQ ID NO: 667826 - DNA, 25 bp, Mus musculus
gatgctgattacctggctgcatggc

SEQ ID NO: 667827 - DNA, 25 bp, Mus musculus
gatgctgattacgtggctgcatggc

SEQ ID NO: 667828 - DNA, 25 bp, Mus musculus
gatgctgcaagacgccatcagcaaa

SEQ ID NO: 667829 - DNA, 25 bp, Mus musculus
gatgctgcaagaggccatcagcaaa

SEQ ID NO: 667830 - DNA, 25 bp, Mus musculus
gatgctgcagagcactatgccagga

SEQ ID NO: 667831 - DNA, 25 bp, Mus musculus
gatgctgcagaggactatgccagga

SEQ ID NO: 667832 - DNA, 25 bp, Mus musculus
gatgctgcaggtatctcccttgggc

SEQ ID NO: 667833 - DNA, 25 bp, Mus musculus
gatgctgcaggtttctcccttgggc

SEQ ID NO: 667834 - DNA, 25 bp, Mus musculus
gatgctgccagcatccttaccagga

SEQ ID NO: 667835 - DNA, 25 bp, Mus musculus
gatgctgccagcttccttaccagga

SEQ ID NO: 667836 - DNA, 25 bp, Mus musculus
gatgctgcccagaaactgccagatg

SEQ ID NO: 667837 - DNA, 25 bp, Mus musculus
gatgctgcccagtaactgccagatg

SEQ ID NO: 667838 - DNA, 25 bp, Mus musculus
gatgctgcccttaaccggtacctgg

SEQ ID NO: 667839 - DNA, 25 bp, Mus musculus
gatgctgccctttaccggtacctgg

SEQ ID NO: 667840 - DNA, 25 bp, Mus musculus
gatgctgccgctcatctatttggga

SEQ ID NO: 667841 - DNA, 25 bp, Mus musculus
gatgctgccgctgatctatttggga

SEQ ID NO: 667842 - DNA, 25 bp, Mus musculus
gatgctgcgggcaggagcacctacc

SEQ ID NO: 667843 - DNA, 25 bp, Mus musculus
gatgctgcgggctggagcacctacc

SEQ ID NO: 667844 - DNA, 25 bp, Mus musculus
gatgctgcgtgacatttgctccaag

SEQ ID NO: 667845 - DNA, 25 bp, Mus musculus
gatgctgcgtgagatttgctccaag

SEQ ID NO: 667846 - DNA, 25 bp, Mus musculus
gatgctgctcatcattgtatgtcac

SEQ ID NO: 667847 - DNA, 25 bp, Mus musculus
gatgctgctcatcgcctcaaaggcc

SEQ ID NO: 667848 - DNA, 25 bp, Mus musculus
gatgctgctcatgattgtatgtcac

SEQ ID NO: 667849 - DNA, 25 bp, Mus musculus
gatgctgctcatggcctcaaaggcc

SEQ ID NO: 667850 - DNA, 25 bp, Mus musculus
gatgctgctccaccttctggaaatg

SEQ ID NO: 667851 - DNA, 25 bp, Mus musculus
gatgctgctccagcttctggaaatg

SEQ ID NO: 667852 - DNA, 25 bp, Mus musculus
gatgctgctgacctgacaaaggtag

SEQ ID NO: 667853 - DNA, 25 bp, Mus musculus
gatgctgctgacgtgacaaaggtag

SEQ ID NO: 667854 - DNA, 25 bp, Mus musculus
gatgctgctgtccaggagaaaccag

SEQ ID NO: 667855 - DNA, 25 bp, Mus musculus
gatgctgctgtcgaggagaaaccag

SEQ ID NO: 667856 - DNA, 25 bp, Mus musculus
gatgctgctgttcagacactgaagg

SEQ ID NO: 667857 - DNA, 25 bp, Mus musculus
gatgctgctgttgagacactgaagg

SEQ ID NO: 667858 - DNA, 25 bp, Mus musculus
gatgctggaagtacaaggtggcccc

SEQ ID NO: 667859 - DNA, 25 bp, Mus musculus
gatgctggaagttcaaggtggcccc

SEQ ID NO: 667860 - DNA, 25 bp, Mus musculus
gatgctggagttagacttactcctc

SEQ ID NO: 667861 - DNA, 25 bp, Mus musculus
gatgctggagtttgacttactcctc

SEQ ID NO: 667862 - DNA, 25 bp, Mus musculus
gatgctggatttcgtctctctgccc

SEQ ID NO: 667863 - DNA, 25 bp, Mus musculus
gatgctggatttggtctctctgccc

SEQ ID NO: 667864 - DNA, 25 bp, Mus musculus
gatgctggcactattgctggactga

SEQ ID NO: 667865 - DNA, 25 bp, Mus musculus
gatgctggcacttttgctggactga

SEQ ID NO: 667866 - DNA, 25 bp, Mus musculus
gatgctggcagccaacttgaagaaa

SEQ ID NO: 667867 - DNA, 25 bp, Mus musculus
gatgctggcagcgaacttgaagaaa

SEQ ID NO: 667868 - DNA, 25 bp, Mus musculus
gatgctggcccacaagaagcaacac

SEQ ID NO: 667869 - DNA, 25 bp, Mus musculus
gatgctggcccagaagaagcaacac

SEQ ID NO: 667870 - DNA, 25 bp, Mus musculus
gatgctggccgaaacctctgcctgg

SEQ ID NO: 667871 - DNA, 25 bp, Mus musculus
gatgctggccgatacctctgcctgg

SEQ ID NO: 667872 - DNA, 25 bp, Mus musculus
gatgctggctctactgtcagtttgg

SEQ ID NO: 667873 - DNA, 25 bp, Mus musculus
gatgctggctcttctgtcagtttgg

SEQ ID NO: 667874 - DNA, 25 bp, Mus musculus
gatgctgggagtcgcgccacctaca

SEQ ID NO: 667875 - DNA, 25 bp, Mus musculus
gatgctgggagtggcgccacctaca

SEQ ID NO: 667876 - DNA, 25 bp, Mus musculus
gatgctgggtgacacgtctcagccc

SEQ ID NO: 667877 - DNA, 25 bp, Mus musculus
gatgctgggtgagacgtctcagccc

SEQ ID NO: 667878 - DNA, 25 bp, Mus musculus
gatgctggtacccatagaagagtga

SEQ ID NO: 667879 - DNA, 25 bp, Mus musculus
gatgctggtaccgatagaagagtga

SEQ ID NO: 667880 - DNA, 25 bp, Mus musculus
gatgctggtcctagtaggaaaggat

SEQ ID NO: 667881 - DNA, 25 bp, Mus musculus
gatgctggtcctctacaactattgg

SEQ ID NO: 667882 - DNA, 25 bp, Mus musculus
gatgctggtcctgtacaactattgg

SEQ ID NO: 667883 - DNA, 25 bp, Mus musculus
gatgctggtccttgtaggaaaggat

SEQ ID NO: 667884 - DNA, 25 bp, Mus musculus
gatgctggtgctagtgtctgctccc

SEQ ID NO: 667885 - DNA, 25 bp, Mus musculus
gatgctggtgcttgtgtctgctccc

SEQ ID NO: 667886 - DNA, 25 bp, Mus musculus
gatgctgtaaaacggaatttggttg

SEQ ID NO: 667887 - DNA, 25 bp, Mus musculus
gatgctgtaaaagggaatttggttg

SEQ ID NO: 667888 - DNA, 25 bp, Mus musculus
gatgctgtcagcacgcttcagtggc

SEQ ID NO: 667889 - DNA, 25 bp, Mus musculus
gatgctgtcagctcgcttcagtggc

SEQ ID NO: 667890 - DNA, 25 bp, Mus musculus
gatgctgtcagtaagatctgttggc

SEQ ID NO: 667891 - DNA, 25 bp, Mus musculus
gatgctgtcagttagatctgttggc

SEQ ID NO: 667892 - DNA, 25 bp, Mus musculus
gatgctgtcctccttgatgaacaaa

SEQ ID NO: 667893 - DNA, 25 bp, Mus musculus
gatgctgtcctcgttgatgaacaaa

SEQ ID NO: 667894 - DNA, 25 bp, Mus musculus
gatgctgtctaaattgaggatcctg

SEQ ID NO: 667895 - DNA, 25 bp, Mus musculus
gatgctgtctaatttgaggatcctg

SEQ ID NO: 667896 - DNA, 25 bp, Mus musculus
gatgctgtctacacggatcgggtca

SEQ ID NO: 667897 - DNA, 25 bp, Mus musculus
gatgctgtctactcggatcgggtca

SEQ ID NO: 667898 - DNA, 25 bp, Mus musculus
gatgctgtctcgagaggtgtcctag

SEQ ID NO: 667899 - DNA, 25 bp, Mus musculus
gatgctgtctcgtgaggtgtcctag

SEQ ID NO: 667900 - DNA, 25 bp, Mus musculus
gatgctgtgcttcctgttaaataca

SEQ ID NO: 667901 - DNA, 25 bp, Mus musculus
gatgctgtgcttgctgttaaataca

SEQ ID NO: 667902 - DNA, 25 bp, Mus musculus
gatgctgtggaaaaaatctaaggtc

SEQ ID NO: 667903 - DNA, 25 bp, Mus musculus
gatgctgtggaataaatctaaggtc

SEQ ID NO: 667904 - DNA, 25 bp, Mus musculus
gatgctgttgcaaacctcaccggga

SEQ ID NO: 667905 - DNA, 25 bp, Mus musculus
gatgctgttgcatacctcaccggga

SEQ ID NO: 667906 - DNA, 25 bp, Mus musculus
gatgcttacaaaactcagctcagct

SEQ ID NO: 667907 - DNA, 25 bp, Mus musculus
gatgcttacaaatctcagctcagct

SEQ ID NO: 667908 - DNA, 25 bp, Mus musculus
gatgcttacgaaaccactctgaatg

SEQ ID NO: 667909 - DNA, 25 bp, Mus musculus
gatgcttacgaatccactctgaatg

SEQ ID NO: 667910 - DNA, 25 bp, Mus musculus
gatgcttacgtgactactttgacgg

SEQ ID NO: 667911 - DNA, 25 bp, Mus musculus
gatgcttacgtgtctactttgacgg

SEQ ID NO: 667912 - DNA, 25 bp, Mus musculus
gatgcttataaaacccaggtgagga

SEQ ID NO: 667913 - DNA, 25 bp, Mus musculus
gatgcttataaatcccaggtgagga

SEQ ID NO: 667914 - DNA, 25 bp, Mus musculus
gatgcttataagatccggatccgca

SEQ ID NO: 667915 - DNA, 25 bp, Mus musculus
gatgcttataagttccggatccgca

SEQ ID NO: 667916 - DNA, 25 bp, Mus musculus
gatgcttattgactttgagtacagc

SEQ ID NO: 667917 - DNA, 25 bp, Mus musculus
gatgcttattgagtttgagtacagc

SEQ ID NO: 667918 - DNA, 25 bp, Mus musculus
gatgcttcaaacattatagatgacg

SEQ ID NO: 667919 - DNA, 25 bp, Mus musculus
gatgcttcaaactttatagatgacg

SEQ ID NO: 667920 - DNA, 25 bp, Mus musculus
gatgcttcacctactaagtgtccaa

SEQ ID NO: 667921 - DNA, 25 bp, Mus musculus
gatgcttcaccttctaagtgtccaa

SEQ ID NO: 667922 - DNA, 25 bp, Mus musculus
gatgcttcagatcgcccttcaagcc

SEQ ID NO: 667923 - DNA, 25 bp, Mus musculus
gatgcttcagatggcccttcaagcc

SEQ ID NO: 667924 - DNA, 25 bp, Mus musculus
gatgcttccagaaagctggcagtca

SEQ ID NO: 667925 - DNA, 25 bp, Mus musculus
gatgcttccagatagctggcagtca

SEQ ID NO: 667926 - DNA, 25 bp, Mus musculus
gatgcttccatgaacagcagaccct

SEQ ID NO: 667927 - DNA, 25 bp, Mus musculus
gatgcttccatgtacagcagaccct

SEQ ID NO: 667928 - DNA, 25 bp, Mus musculus
gatgcttcggcaaatgcggctgtcc

SEQ ID NO: 667929 - DNA, 25 bp, Mus musculus
gatgcttcggcatatgcggctgtcc

SEQ ID NO: 667930 - DNA, 25 bp, Mus musculus
gatgcttgagctcaaatccctgcag

SEQ ID NO: 667931 - DNA, 25 bp, Mus musculus
gatgcttgagctgaaatccctgcag

SEQ ID NO: 667932 - DNA, 25 bp, Mus musculus
gatgcttgctacatacatctagatc

SEQ ID NO: 667933 - DNA, 25 bp, Mus musculus
gatgcttgctacttacatctagatc

SEQ ID NO: 667934 - DNA, 25 bp, Mus musculus
gatgcttgcttcaatcacaacggag

SEQ ID NO: 667935 - DNA, 25 bp, Mus musculus
gatgcttgcttcctatgtaagccgg

SEQ ID NO: 667936 - DNA, 25 bp, Mus musculus
gatgcttgcttcgtatgtaagccgg

SEQ ID NO: 667937 - DNA, 25 bp, Mus musculus
gatgcttgcttctatcacaacggag

SEQ ID NO: 667938 - DNA, 25 bp, Mus musculus
gatgcttggcagctcaaaaccggag

SEQ ID NO: 667939 - DNA, 25 bp, Mus musculus
gatgcttggcaggtcaaaaccggag

SEQ ID NO: 667940 - DNA, 25 bp, Mus musculus
gatgcttgtatactttgctccacct

SEQ ID NO: 667941 - DNA, 25 bp, Mus musculus
gatgcttgtatagtttgctccacct

SEQ ID NO: 667942 - DNA, 25 bp, Mus musculus
gatgcttgtggcagttcaccgtggt

SEQ ID NO: 667943 - DNA, 25 bp, Mus musculus
gatgcttgtggctgttcaccgtggt

SEQ ID NO: 667944 - DNA, 25 bp, Mus musculus
gatgctttatgcactacattacgag

SEQ ID NO: 667945 - DNA, 25 bp, Mus musculus
gatgctttatgctctacattacgag

SEQ ID NO: 667946 - DNA, 25 bp, Mus musculus
gatgctttatggaggcagtgttaac

SEQ ID NO: 667947 - DNA, 25 bp, Mus musculus
gatgctttatggtggcagtgttaac

SEQ ID NO: 667948 - DNA, 25 bp, Mus musculus
gatgctttcacaactgagttctttg

SEQ ID NO: 667949 - DNA, 25 bp, Mus musculus
gatgctttcacatctgagttctttg

SEQ ID NO: 667950 - DNA, 25 bp, Mus musculus
gatgctttcctaatagaaatgcaaa

SEQ ID NO: 667951 - DNA, 25 bp, Mus musculus
gatgctttcctattagaaatgcaaa

SEQ ID NO: 667952 - DNA, 25 bp, Mus musculus
gatgctttccttcaattcttaccag

SEQ ID NO: 667953 - DNA, 25 bp, Mus musculus
gatgctttccttgaattcttaccag

SEQ ID NO: 667954 - DNA, 25 bp, Mus musculus
gatgctttcgcaccagaagaggctc

SEQ ID NO: 667955 - DNA, 25 bp, Mus musculus
gatgctttcgcagcagaagaggctc

SEQ ID NO: 667956 - DNA, 25 bp, Mus musculus
gatgctttctgtatggctgggacaa

SEQ ID NO: 667957 - DNA, 25 bp, Mus musculus
gatgctttctgtttggctgggacaa

SEQ ID NO: 667958 - DNA, 25 bp, Mus musculus
gatgctttgcgcaggcttcttggag

SEQ ID NO: 667959 - DNA, 25 bp, Mus musculus
gatgctttgcgctggcttcttggag

SEQ ID NO: 667960 - DNA, 25 bp, Mus musculus
gatgctttgcggctattcctttcac

SEQ ID NO: 667961 - DNA, 25 bp, Mus musculus
gatgctttgcgggtattcctttcac

SEQ ID NO: 667962 - DNA, 25 bp, Mus musculus
gatgcttttcgacgccaaggcggtt

SEQ ID NO: 667963 - DNA, 25 bp, Mus musculus
gatgcttttcgaggccaaggcggtt

SEQ ID NO: 667964 - DNA, 25 bp, Mus musculus
gatggaaacagcagaagtcgagcaa

SEQ ID NO: 667965 - DNA, 25 bp, Mus musculus
gatggaaacagctgaagtcgagcaa

SEQ ID NO: 667966 - DNA, 25 bp, Mus musculus
gatggaaaccaaagccttctgacca

SEQ ID NO: 667967 - DNA, 25 bp, Mus musculus
gatggaaaccaatgccttctgacca

SEQ ID NO: 667968 - DNA, 25 bp, Mus musculus
gatggaaaccatatgagattccaaa

SEQ ID NO: 667969 - DNA, 25 bp, Mus musculus
gatggaaaccatttgagattccaaa

SEQ ID NO: 667970 - DNA, 25 bp, Mus musculus
gatggaaactcactcacctgtactg

SEQ ID NO: 667971 - DNA, 25 bp, Mus musculus
gatggaaactcagtcacctgtactg

SEQ ID NO: 667972 - DNA, 25 bp, Mus musculus
gatggaaagaatcaaatggagatac

SEQ ID NO: 667973 - DNA, 25 bp, Mus musculus
gatggaaagaatgaaatggagatac

SEQ ID NO: 667974 - DNA, 25 bp, Mus musculus
gatggaaagcccatcgatgatcaag

SEQ ID NO: 667975 - DNA, 25 bp, Mus musculus
gatggaaagcccttcgatgatcaag

SEQ ID NO: 667976 - DNA, 25 bp, Mus musculus
gatggaaagcgcactccagcagggt

SEQ ID NO: 667977 - DNA, 25 bp, Mus musculus
gatggaaagcgctctccagcagggt

SEQ ID NO: 667978 - DNA, 25 bp, Mus musculus
gatggaaagtcaaaaaccaagtact

SEQ ID NO: 667979 - DNA, 25 bp, Mus musculus
gatggaaagtcataaaccaagtact

SEQ ID NO: 667980 - DNA, 25 bp, Mus musculus
gatggaaagttcctctaccacaaat

SEQ ID NO: 667981 - DNA, 25 bp, Mus musculus
gatggaaagttcgtctaccacaaat

SEQ ID NO: 667982 - DNA, 25 bp, Mus musculus
gatggaaatgatagttcgagcaaga

SEQ ID NO: 667983 - DNA, 25 bp, Mus musculus
gatggaaatgattgttcgagcaaga

SEQ ID NO: 667984 - DNA, 25 bp, Mus musculus
gatggaaattccagtgagatatgcc

SEQ ID NO: 667985 - DNA, 25 bp, Mus musculus
gatggaaattcctgtgagatatgcc

SEQ ID NO: 667986 - DNA, 25 bp, Mus musculus
gatggaacaaaactgaccttgattg

SEQ ID NO: 667987 - DNA, 25 bp, Mus musculus
gatggaacaaaagtgaccttgattg

SEQ ID NO: 667988 - DNA, 25 bp, Mus musculus
gatggaacactaattggttaaggag

SEQ ID NO: 667989 - DNA, 25 bp, Mus musculus
gatggaacactatttggttaaggag

SEQ ID NO: 667990 - DNA, 25 bp, Mus musculus
gatggaacccggagaccccatcact

SEQ ID NO: 667991 - DNA, 25 bp, Mus musculus
gatggaacccggtgaccccatcact

SEQ ID NO: 667992 - DNA, 25 bp, Mus musculus
gatggaaccctgcacagagaagacc

SEQ ID NO: 667993 - DNA, 25 bp, Mus musculus
gatggaaccctggacagagaagacc

SEQ ID NO: 667994 - DNA, 25 bp, Mus musculus
gatggaaccggtaagaaatctgggc

SEQ ID NO: 667995 - DNA, 25 bp, Mus musculus
gatggaaccggttagaaatctgggc

SEQ ID NO: 667996 - DNA, 25 bp, Mus musculus
gatggaacctatcaaacgtggctgt

SEQ ID NO: 667997 - DNA, 25 bp, Mus musculus
gatggaacctatgaaacgtggctgt

SEQ ID NO: 667998 - DNA, 25 bp, Mus musculus
gatggaacctttcctgcaggaggct

SEQ ID NO: 667999 - DNA, 25 bp, Mus musculus
gatggaacctttgctgcaggaggct

SEQ ID NO: 668000 - DNA, 25 bp, Mus musculus
gatggaacgcttcgcctccagcgat

SEQ ID NO: 668001 - DNA, 25 bp, Mus musculus
gatggaacgcttggcctccagcgat

SEQ ID NO: 668002 - DNA, 25 bp, Mus musculus
gatggaactcgtccggagaaacacc

SEQ ID NO: 668003 - DNA, 25 bp, Mus musculus
gatggaactcgtgcggagaaacacc

SEQ ID NO: 668004 - DNA, 25 bp, Mus musculus
gatggaactgaaacgcaaagattcg

SEQ ID NO: 668005 - DNA, 25 bp, Mus musculus
gatggaactgaatcgcaaagattcg

SEQ ID NO: 668006 - DNA, 25 bp, Mus musculus
gatggaactgcaagactgtgccctt

SEQ ID NO: 668007 - DNA, 25 bp, Mus musculus
gatggaactgcatgactgtgccctt

SEQ ID NO: 668008 - DNA, 25 bp, Mus musculus
gatggaagacatagtggatttggca

SEQ ID NO: 668009 - DNA, 25 bp, Mus musculus
gatggaagacattgtggatttggca

SEQ ID NO: 668010 - DNA, 25 bp, Mus musculus
gatggaagacccattgagcaacagg

SEQ ID NO: 668011 - DNA, 25 bp, Mus musculus
gatggaagaccctttgagcaacagg

SEQ ID NO: 668012 - DNA, 25 bp, Mus musculus
gatggaagactaagaacgcctggcc

SEQ ID NO: 668013 - DNA, 25 bp, Mus musculus
gatggaagactatgaacgcctggcc

SEQ ID NO: 668014 - DNA, 25 bp, Mus musculus
gatggaagactgagaaacgctggaa

SEQ ID NO: 668015 - DNA, 25 bp, Mus musculus
gatggaagactgtgaaacgctggaa

SEQ ID NO: 668016 - DNA, 25 bp, Mus musculus
gatggaagccatatatgtgacatac

SEQ ID NO: 668017 - DNA, 25 bp, Mus musculus
gatggaagccatttatgtgacatac

SEQ ID NO: 668018 - DNA, 25 bp, Mus musculus
gatggaagctgcacgagaaggacat

SEQ ID NO: 668019 - DNA, 25 bp, Mus musculus
gatggaagctgctcgagaaggacat

SEQ ID NO: 668020 - DNA, 25 bp, Mus musculus
gatggaaggctcacgggtactgtca

SEQ ID NO: 668021 - DNA, 25 bp, Mus musculus
gatggaaggctctcgggtactgtca

SEQ ID NO: 668022 - DNA, 25 bp, Mus musculus
gatggaaggtttatcccacgggctc

SEQ ID NO: 668023 - DNA, 25 bp, Mus musculus
gatggaaggtttttcccacgggctc

SEQ ID NO: 668024 - DNA, 25 bp, Mus musculus
gatggaagttgacacactggagacc

SEQ ID NO: 668025 - DNA, 25 bp, Mus musculus
gatggaagttgagacactggagacc

SEQ ID NO: 668026 - DNA, 25 bp, Mus musculus
gatggaataaaaaggcccgaataat

SEQ ID NO: 668027 - DNA, 25 bp, Mus musculus
gatggaataaaatggcccgaataat

SEQ ID NO: 668028 - DNA, 25 bp, Mus musculus
gatggaataccacgaatgcccggga

SEQ ID NO: 668029 - DNA, 25 bp, Mus musculus
gatggaataccaggaatgcccggga

SEQ ID NO: 668030 - DNA, 25 bp, Mus musculus
gatggaatctacaacatcaccatgg

SEQ ID NO: 668031 - DNA, 25 bp, Mus musculus
gatggaatctactacatcaccatgg

SEQ ID NO: 668032 - DNA, 25 bp, Mus musculus
gatggaatctatccaaacgtgagga

SEQ ID NO: 668033 - DNA, 25 bp, Mus musculus
gatggaatctatgcaaacgtgagga

SEQ ID NO: 668034 - DNA, 25 bp, Mus musculus
gatggaatgaacacactaacgtacc

SEQ ID NO: 668035 - DNA, 25 bp, Mus musculus
gatggaatgaactcactaacgtacc

SEQ ID NO: 668036 - DNA, 25 bp, Mus musculus
gatggaatgcagaaacgacctggga

SEQ ID NO: 668037 - DNA, 25 bp, Mus musculus
gatggaatgcagtaacgacctggga

SEQ ID NO: 668038 - DNA, 25 bp, Mus musculus
gatggaatgctgagacgtgccagct

SEQ ID NO: 668039 - DNA, 25 bp, Mus musculus
gatggaatgctgtgacgtgccagct

SEQ ID NO: 668040 - DNA, 25 bp, Mus musculus
gatggaatggatatcttgtgcgtcc

SEQ ID NO: 668041 - DNA, 25 bp, Mus musculus
gatggaatggatcaacaccacactc

SEQ ID NO: 668042 - DNA, 25 bp, Mus musculus
gatggaatggatgaacaccacactc

SEQ ID NO: 668043 - DNA, 25 bp, Mus musculus
gatggaatggatttcttgtgcgtcc

SEQ ID NO: 668044 - DNA, 25 bp, Mus musculus
gatggaatggtcagtttccatgata

SEQ ID NO: 668045 - DNA, 25 bp, Mus musculus
gatggaatggtctgtttccatgata

SEQ ID NO: 668046 - DNA, 25 bp, Mus musculus
gatggaattcccacccgaaaatcaa

SEQ ID NO: 668047 - DNA, 25 bp, Mus musculus
gatggaattccctcccgaaaatcaa

SEQ ID NO: 668048 - DNA, 25 bp, Mus musculus
gatggaattcctagccttcagataa

SEQ ID NO: 668049 - DNA, 25 bp, Mus musculus
gatggaattccttgccttcagataa

SEQ ID NO: 668050 - DNA, 25 bp, Mus musculus
gatggaattggaaaagcatatgcag

SEQ ID NO: 668051 - DNA, 25 bp, Mus musculus
gatggaattggataagcatatgcag

SEQ ID NO: 668052 - DNA, 25 bp, Mus musculus
gatggacaaaaacgcatatttcttg

SEQ ID NO: 668053 - DNA, 25 bp, Mus musculus
gatggacaaaaaggcatatttcttg

SEQ ID NO: 668054 - DNA, 25 bp, Mus musculus
gatggacaaatcattacaagttcgg

SEQ ID NO: 668055 - DNA, 25 bp, Mus musculus
gatggacaaatctttacaagttcgg

SEQ ID NO: 668056 - DNA, 25 bp, Mus musculus
gatggacaaattcccctttgtggcc

SEQ ID NO: 668057 - DNA, 25 bp, Mus musculus
gatggacaaattgccctttgtggcc

SEQ ID NO: 668058 - DNA, 25 bp, Mus musculus
gatggacaacctctatcgggacggc

SEQ ID NO: 668059 - DNA, 25 bp, Mus musculus
gatggacaacctgtatcgggacggc

SEQ ID NO: 668060 - DNA, 25 bp, Mus musculus
gatggacaagcacaccttctgctcc

SEQ ID NO: 668061 - DNA, 25 bp, Mus musculus
gatggacaagcagaccttctgctcc

SEQ ID NO: 668062 - DNA, 25 bp, Mus musculus
gatggacaatagaagctggcctgct

SEQ ID NO: 668063 - DNA, 25 bp, Mus musculus
gatggacaatagtagctggcctgct

SEQ ID NO: 668064 - DNA, 25 bp, Mus musculus
gatggacaccgtaatttcccttttg

SEQ ID NO: 668065 - DNA, 25 bp, Mus musculus
gatggacaccgttatttcccttttg

SEQ ID NO: 668066 - DNA, 25 bp, Mus musculus
gatggacaccttcctggacttgaag

SEQ ID NO: 668067 - DNA, 25 bp, Mus musculus
gatggacaccttgctggacttgaag

SEQ ID NO: 668068 - DNA, 25 bp, Mus musculus
gatggacacgctagtccactcaagt

SEQ ID NO: 668069 - DNA, 25 bp, Mus musculus
gatggacacgcttgtccactcaagt

SEQ ID NO: 668070 - DNA, 25 bp, Mus musculus
gatggacactccctcctaatggtga

SEQ ID NO: 668071 - DNA, 25 bp, Mus musculus
gatggacactccgtcctaatggtga

SEQ ID NO: 668072 - DNA, 25 bp, Mus musculus
gatggacagacacgccaagtgttaa

SEQ ID NO: 668073 - DNA, 25 bp, Mus musculus
gatggacagacaggccaagtgttaa

SEQ ID NO: 668074 - DNA, 25 bp, Mus musculus
gatggacatccaatatgccaaagag

SEQ ID NO: 668075 - DNA, 25 bp, Mus musculus
gatggacatccattatgccaaagag

SEQ ID NO: 668076 - DNA, 25 bp, Mus musculus
gatggacattttcccctggaagagc

SEQ ID NO: 668077 - DNA, 25 bp, Mus musculus
gatggacattttgccctggaagagc

SEQ ID NO: 668078 - DNA, 25 bp, Mus musculus
gatggaccaaaacgaatattcctgg

SEQ ID NO: 668079 - DNA, 25 bp, Mus musculus
gatggaccaaaaggaatattcctgg

SEQ ID NO: 668080 - DNA, 25 bp, Mus musculus
gatggaccaggcctcaatgtaccag

SEQ ID NO: 668081 - DNA, 25 bp, Mus musculus
gatggaccaggcgtcaatgtaccag

SEQ ID NO: 668082 - DNA, 25 bp, Mus musculus
gatggaccatagatactcctccaac

SEQ ID NO: 668083 - DNA, 25 bp, Mus musculus
gatggaccatagttactcctccaac

SEQ ID NO: 668084 - DNA, 25 bp, Mus musculus
gatggacccgctagtggacattgag

SEQ ID NO: 668085 - DNA, 25 bp, Mus musculus
gatggacccgcttgtggacattgag

SEQ ID NO: 668086 - DNA, 25 bp, Mus musculus
gatggaccggtcagtggaacatgac

SEQ ID NO: 668087 - DNA, 25 bp, Mus musculus
gatggaccggtctgtggaacatgac

SEQ ID NO: 668088 - DNA, 25 bp, Mus musculus
gatggacctgacattcaagacagag

SEQ ID NO: 668089 - DNA, 25 bp, Mus musculus
gatggacctgactttcaagacagag

SEQ ID NO: 668090 - DNA, 25 bp, Mus musculus
gatggacctggaagtagtactcaag

SEQ ID NO: 668091 - DNA, 25 bp, Mus musculus
gatggacctggatgtagtactcaag

SEQ ID NO: 668092 - DNA, 25 bp, Mus musculus
gatggacgacaaacagaacgagtgg

SEQ ID NO: 668093 - DNA, 25 bp, Mus musculus
gatggacgacaatcagaacgagtgg

SEQ ID NO: 668094 - DNA, 25 bp, Mus musculus
gatggacgaccgaaatgcctacagg

SEQ ID NO: 668095 - DNA, 25 bp, Mus musculus
gatggacgaccgtaatgcctacagg

SEQ ID NO: 668096 - DNA, 25 bp, Mus musculus
gatggacgagatcaagaaattgcag

SEQ ID NO: 668097 - DNA, 25 bp, Mus musculus
gatggacgagatgaagaaattgcag

SEQ ID NO: 668098 - DNA, 25 bp, Mus musculus
gatggacgagcaccccgtttgttct

SEQ ID NO: 668099 - DNA, 25 bp, Mus musculus
gatggacgagcagcccgtttgttct

SEQ ID NO: 668100 - DNA, 25 bp, Mus musculus
gatggacgagctcggctacatgtat

SEQ ID NO: 668101 - DNA, 25 bp, Mus musculus
gatggacgagctgggctacatgtat

SEQ ID NO: 668102 - DNA, 25 bp, Mus musculus
gatggacgagtcagtgaatggcatc

SEQ ID NO: 668103 - DNA, 25 bp, Mus musculus
gatggacgagtctgtgaatggcatc

SEQ ID NO: 668104 - DNA, 25 bp, Mus musculus
gatggacgtctgcaagtttctcaca

SEQ ID NO: 668105 - DNA, 25 bp, Mus musculus
gatggacgtctggaagtttctcaca

SEQ ID NO: 668106 - DNA, 25 bp, Mus musculus
gatggactactgattaaatttttgg

SEQ ID NO: 668107 - DNA, 25 bp, Mus musculus
gatggactactgtttaaatttttgg

SEQ ID NO: 668108 - DNA, 25 bp, Mus musculus
gatggactcatgcttgcaactccag

SEQ ID NO: 668109 - DNA, 25 bp, Mus musculus
gatggactcatggttgcaactccag

SEQ ID NO: 668110 - DNA, 25 bp, Mus musculus
gatggactccccaggagatcagcct

SEQ ID NO: 668111 - DNA, 25 bp, Mus musculus
gatggactcccctggagatcagcct

SEQ ID NO: 668112 - DNA, 25 bp, Mus musculus
gatggactctgcactcgcctcatca

SEQ ID NO: 668113 - DNA, 25 bp, Mus musculus
gatggactctgctctcgcctcatca

SEQ ID NO: 668114 - DNA, 25 bp, Mus musculus
gatggactcttgctctcctagaacc

SEQ ID NO: 668115 - DNA, 25 bp, Mus musculus
gatggactcttggtctcctagaacc

SEQ ID NO: 668116 - DNA, 25 bp, Mus musculus
gatggactgcgcagcgcccacgatc

SEQ ID NO: 668117 - DNA, 25 bp, Mus musculus
gatggactgcgctgcgcccacgatc

SEQ ID NO: 668118 - DNA, 25 bp, Mus musculus
gatggactggcaaaatcaatttaac

SEQ ID NO: 668119 - DNA, 25 bp, Mus musculus
gatggactggcataatcaatttaac

SEQ ID NO: 668120 - DNA, 25 bp, Mus musculus
gatggacttattctgcaccacctgt

SEQ ID NO: 668121 - DNA, 25 bp, Mus musculus
gatggacttattgtgcaccacctgt

SEQ ID NO: 668122 - DNA, 25 bp, Mus musculus
gatggacttcatattggagaagctt

SEQ ID NO: 668123 - DNA, 25 bp, Mus musculus
gatggacttcattttggagaagctt

SEQ ID NO: 668124 - DNA, 25 bp, Mus musculus
gatggacttcccacagctgatgaag

SEQ ID NO: 668125 - DNA, 25 bp, Mus musculus
gatggacttccctcagctgatgaag

SEQ ID NO: 668126 - DNA, 25 bp, Mus musculus
gatggacttgaaccctggtccctgt

SEQ ID NO: 668127 - DNA, 25 bp, Mus musculus
gatggacttgaagcctggtccctgt

SEQ ID NO: 668128 - DNA, 25 bp, Mus musculus
gatggacttgagaggccaatacgag

SEQ ID NO: 668129 - DNA, 25 bp, Mus musculus
gatggacttgagtggccaatacgag

SEQ ID NO: 668130 - DNA, 25 bp, Mus musculus
gatggagaaaccagtgaccaccaga

SEQ ID NO: 668131 - DNA, 25 bp, Mus musculus
gatggagaaacctgtgaccaccaga

SEQ ID NO: 668132 - DNA, 25 bp, Mus musculus
gatggagaaatcaatgacgacatcg

SEQ ID NO: 668133 - DNA, 25 bp, Mus musculus
gatggagaaatctatgacgacatcg

SEQ ID NO: 668134 - DNA, 25 bp, Mus musculus
gatggagaaccacatgaaaggcctg

SEQ ID NO: 668135 - DNA, 25 bp, Mus musculus
gatggagaaccagatgaaaggcctg

SEQ ID NO: 668136 - DNA, 25 bp, Mus musculus
gatggagaacgaagacactgcggtc

SEQ ID NO: 668137 - DNA, 25 bp, Mus musculus
gatggagaacgatgacactgcggtc

SEQ ID NO: 668138 - DNA, 25 bp, Mus musculus
gatggagaactaccagatcgttgtc

SEQ ID NO: 668139 - DNA, 25 bp, Mus musculus
gatggagaactagcagatcgttgtc

SEQ ID NO: 668140 - DNA, 25 bp, Mus musculus
gatggagaactcaaatcttcgacaa

SEQ ID NO: 668141 - DNA, 25 bp, Mus musculus
gatggagaactctaatcttcgacaa

SEQ ID NO: 668142 - DNA, 25 bp, Mus musculus
gatggagaagatcaaccaaagcaag

SEQ ID NO: 668143 - DNA, 25 bp, Mus musculus
gatggagaagatgaaccaaagcaag

SEQ ID NO: 668144 - DNA, 25 bp, Mus musculus
gatggagaagccatcccatgccgct

SEQ ID NO: 668145 - DNA, 25 bp, Mus musculus
gatggagaagccttcccatgccgct

SEQ ID NO: 668146 - DNA, 25 bp, Mus musculus
gatggagaagcgaatgtcggaatac

SEQ ID NO: 668147 - DNA, 25 bp, Mus musculus
gatggagaagcgtatgtcggaatac

SEQ ID NO: 668148 - DNA, 25 bp, Mus musculus
gatggagaagctctcggacacatat

SEQ ID NO: 668149 - DNA, 25 bp, Mus musculus
gatggagaagctgtcggacacatat

SEQ ID NO: 668150 - DNA, 25 bp, Mus musculus
gatggagaagtcacgaaaatcatga

SEQ ID NO: 668151 - DNA, 25 bp, Mus musculus
gatggagaagtctcgaaaatcatga

SEQ ID NO: 668152 - DNA, 25 bp, Mus musculus
gatggagaatcacaagatcgtggac

SEQ ID NO: 668153 - DNA, 25 bp, Mus musculus
gatggagaatcagaagatcgtggac

SEQ ID NO: 668154 - DNA, 25 bp, Mus musculus
gatggagaatctattggacatatgc

SEQ ID NO: 668155 - DNA, 25 bp, Mus musculus
gatggagaatcttttggacatatgc

SEQ ID NO: 668156 - DNA, 25 bp, Mus musculus
gatggagacagacatcgagttctac

SEQ ID NO: 668157 - DNA, 25 bp, Mus musculus
gatggagacagagatcgagttctac

SEQ ID NO: 668158 - DNA, 25 bp, Mus musculus
gatggagaccatatcttcggtgaca

SEQ ID NO: 668159 - DNA, 25 bp, Mus musculus
gatggagaccatttcttcggtgaca

SEQ ID NO: 668160 - DNA, 25 bp, Mus musculus
gatggagagcgaacagtctactgta

SEQ ID NO: 668161 - DNA, 25 bp, Mus musculus
gatggagagcgatcagtctactgta

SEQ ID NO: 668162 - DNA, 25 bp, Mus musculus
gatggagagcgcaggaagatcctca

SEQ ID NO: 668163 - DNA, 25 bp, Mus musculus
gatggagagcgctggaagatcctca

SEQ ID NO: 668164 - DNA, 25 bp, Mus musculus
gatggagagctgctgaccctgtacc

SEQ ID NO: 668165 - DNA, 25 bp, Mus musculus
gatggagagctggtgaccctgtacc

SEQ ID NO: 668166 - DNA, 25 bp, Mus musculus
gatggagagtcacctccaggcaccc

SEQ ID NO: 668167 - DNA, 25 bp, Mus musculus
gatggagagtcagctccaggcaccc

SEQ ID NO: 668168 - DNA, 25 bp, Mus musculus
gatggagagtgtcattcccaagact

SEQ ID NO: 668169 - DNA, 25 bp, Mus musculus
gatggagagtgtgattcccaagact

SEQ ID NO: 668170 - DNA, 25 bp, Mus musculus
gatggagatgcaaatgccctggtgc

SEQ ID NO: 668171 - DNA, 25 bp, Mus musculus
gatggagatgcatatgccctggtgc

SEQ ID NO: 668172 - DNA, 25 bp, Mus musculus
gatggagatgccaactagtgatgga

SEQ ID NO: 668173 - DNA, 25 bp, Mus musculus
gatggagatgcctactagtgatgga

SEQ ID NO: 668174 - DNA, 25 bp, Mus musculus
gatggagcaactcaacaactccttc

SEQ ID NO: 668175 - DNA, 25 bp, Mus musculus
gatggagcaactgaacaactccttc

SEQ ID NO: 668176 - DNA, 25 bp, Mus musculus
gatggagcacagagtactaaattta

SEQ ID NO: 668177 - DNA, 25 bp, Mus musculus
gatggagcacagtgtactaaattta

SEQ ID NO: 668178 - DNA, 25 bp, Mus musculus
gatggagcaggtcccattatggact

SEQ ID NO: 668179 - DNA, 25 bp, Mus musculus
gatggagcaggtgccattatggact

SEQ ID NO: 668180 - DNA, 25 bp, Mus musculus
gatggagcccaaccacgagttcatg

SEQ ID NO: 668181 - DNA, 25 bp, Mus musculus
gatggagcccaagcacgagttcatg

SEQ ID NO: 668182 - DNA, 25 bp, Mus musculus
gatggagcggctcatcaaaaagctg

SEQ ID NO: 668183 - DNA, 25 bp, Mus musculus
gatggagcggctgatcaaaaagctg

SEQ ID NO: 668184 - DNA, 25 bp, Mus musculus
gatggagctctccatggaaccaagg

SEQ ID NO: 668185 - DNA, 25 bp, Mus musculus
gatggagctctcgatggaaccaagg

SEQ ID NO: 668186 - DNA, 25 bp, Mus musculus
gatggagctgaactctctgctgctg

SEQ ID NO: 668187 - DNA, 25 bp, Mus musculus
gatggagctgaagtctctgctgctg

SEQ ID NO: 668188 - DNA, 25 bp, Mus musculus
gatggagctggtcacttaagatcag

SEQ ID NO: 668189 - DNA, 25 bp, Mus musculus
gatggagctggtgacttaagatcag

SEQ ID NO: 668190 - DNA, 25 bp, Mus musculus
gatggagctgtaaaaccacccacaa

SEQ ID NO: 668191 - DNA, 25 bp, Mus musculus
gatggagctgtataaccacccacaa

SEQ ID NO: 668192 - DNA, 25 bp, Mus musculus
gatggagcttcgagagtatcacacc

SEQ ID NO: 668193 - DNA, 25 bp, Mus musculus
gatggagcttcgtgagtatcacacc

SEQ ID NO: 668194 - DNA, 25 bp, Mus musculus
gatggaggaaagactgcctattctg

SEQ ID NO: 668195 - DNA, 25 bp, Mus musculus
gatggaggaaagtctgcctattctg

SEQ ID NO: 668196 - DNA, 25 bp, Mus musculus
gatggaggacacaatgacggaagta

SEQ ID NO: 668197 - DNA, 25 bp, Mus musculus
gatggaggacactatgacggaagta

SEQ ID NO: 668198 - DNA, 25 bp, Mus musculus
gatggaggacatccgaataggattc

SEQ ID NO: 668199 - DNA, 25 bp, Mus musculus
gatggaggacatgcgaataggattc

SEQ ID NO: 668200 - DNA, 25 bp, Mus musculus
gatggaggccacctttgcagagtat

SEQ ID NO: 668201 - DNA, 25 bp, Mus musculus
gatggaggccacgtttgcagagtat

SEQ ID NO: 668202 - DNA, 25 bp, Mus musculus
gatggaggcgtcaatacctgtaccg

SEQ ID NO: 668203 - DNA, 25 bp, Mus musculus
gatggaggcgtctatacctgtaccg

SEQ ID NO: 668204 - DNA, 25 bp, Mus musculus
gatggaggctccaatattgtggaag

SEQ ID NO: 668205 - DNA, 25 bp, Mus musculus
gatggaggctcctatattgtggaag

SEQ ID NO: 668206 - DNA, 25 bp, Mus musculus
gatggagggattcgccacattatca

SEQ ID NO: 668207 - DNA, 25 bp, Mus musculus
gatggagggattggccacattatca

SEQ ID NO: 668208 - DNA, 25 bp, Mus musculus
gatggagggcacaagagaaatactg

SEQ ID NO: 668209 - DNA, 25 bp, Mus musculus
gatggagggcactagagaaatactg

SEQ ID NO: 668210 - DNA, 25 bp, Mus musculus
gatggagtaccgagaactattcctg

SEQ ID NO: 668211 - DNA, 25 bp, Mus musculus
gatggagtaccgtgaactattcctg

SEQ ID NO: 668212 - DNA, 25 bp, Mus musculus
gatggagtcagtcgaaaagaccacg

SEQ ID NO: 668213 - DNA, 25 bp, Mus musculus
gatggagtcagtggaaaagaccacg

SEQ ID NO: 668214 - DNA, 25 bp, Mus musculus
gatggagtcattcttggccagccaa

SEQ ID NO: 668215 - DNA, 25 bp, Mus musculus
gatggagtcattgttggccagccaa

SEQ ID NO: 668216 - DNA, 25 bp, Mus musculus
gatggagtccaacgcttctcggatg

SEQ ID NO: 668217 - DNA, 25 bp, Mus musculus
gatggagtccaaggcttctcggatg

SEQ ID NO: 668218 - DNA, 25 bp, Mus musculus
gatggagtctgcagtggaattcttc

SEQ ID NO: 668219 - DNA, 25 bp, Mus musculus
gatggagtctgctgtggaattcttc

SEQ ID NO: 668220 - DNA, 25 bp, Mus musculus
gatggagtgcttcacaatgcctccc

SEQ ID NO: 668221 - DNA, 25 bp, Mus musculus
gatggagtgcttgacaatgcctccc

SEQ ID NO: 668222 - DNA, 25 bp, Mus musculus
gatggagtgtgcagatgctgctcat

SEQ ID NO: 668223 - DNA, 25 bp, Mus musculus
gatggagtgtgctgatgctgctcat

SEQ ID NO: 668224 - DNA, 25 bp, Mus musculus
gatggagtttgaaccaaattcaaac

SEQ ID NO: 668225 - DNA, 25 bp, Mus musculus
gatggagtttgatccaaattcaaac

SEQ ID NO: 668226 - DNA, 25 bp, Mus musculus
gatggataacgacgaggacctgcct

SEQ ID NO: 668227 - DNA, 25 bp, Mus musculus
gatggataacgaggaggacctgcct

SEQ ID NO: 668228 - DNA, 25 bp, Mus musculus
gatggataggcgatctgttgagcca

SEQ ID NO: 668229 - DNA, 25 bp, Mus musculus
gatggataggcgttctgttgagcca

SEQ ID NO: 668230 - DNA, 25 bp, Mus musculus
gatggatcaacaatgcttattgaag

SEQ ID NO: 668231 - DNA, 25 bp, Mus musculus
gatggatcaacattgcttattgaag

SEQ ID NO: 668232 - DNA, 25 bp, Mus musculus
gatggatcaagtcgcaactaggagt

SEQ ID NO: 668233 - DNA, 25 bp, Mus musculus
gatggatcaagtggcaactaggagt

SEQ ID NO: 668234 - DNA, 25 bp, Mus musculus
gatggatcacttcttcctgcaggct

SEQ ID NO: 668235 - DNA, 25 bp, Mus musculus
gatggatcacttgttcctgcaggct

SEQ ID NO: 668236 - DNA, 25 bp, Mus musculus
gatggatcagctagcacacgcttcc

SEQ ID NO: 668237 - DNA, 25 bp, Mus musculus
gatggatcagctccacaagtcttca

SEQ ID NO: 668238 - DNA, 25 bp, Mus musculus
gatggatcagctgcacaagtcttca

SEQ ID NO: 668239 - DNA, 25 bp, Mus musculus
gatggatcagcttgcacacgcttcc

SEQ ID NO: 668240 - DNA, 25 bp, Mus musculus
gatggatcagtactaaaacccgatt

SEQ ID NO: 668241 - DNA, 25 bp, Mus musculus
gatggatcagtagtaaaacccgatt

SEQ ID NO: 668242 - DNA, 25 bp, Mus musculus
gatggatccaagaagatcaaaggct

SEQ ID NO: 668243 - DNA, 25 bp, Mus musculus
gatggatccaagtagatcaaaggct

SEQ ID NO: 668244 - DNA, 25 bp, Mus musculus
gatggatccctactacttatttaag

SEQ ID NO: 668245 - DNA, 25 bp, Mus musculus
gatggatccctagtacttatttaag

SEQ ID NO: 668246 - DNA, 25 bp, Mus musculus
gatggatccgcaccaagagtgcgac

SEQ ID NO: 668247 - DNA, 25 bp, Mus musculus
gatggatccgcagcaagagtgcgac

SEQ ID NO: 668248 - DNA, 25 bp, Mus musculus
gatggatccggccttgcaaatggca

SEQ ID NO: 668249 - DNA, 25 bp, Mus musculus
gatggatccggcgttgcaaatggca

SEQ ID NO: 668250 - DNA, 25 bp, Mus musculus
gatggatcgaacactgcacaagatc

SEQ ID NO: 668251 - DNA, 25 bp, Mus musculus
gatggatcgaactctgcacaagatc

SEQ ID NO: 668252 - DNA, 25 bp, Mus musculus
gatggatctcttcttggcagagaaa

SEQ ID NO: 668253 - DNA, 25 bp, Mus musculus
gatggatctcttgttggcagagaaa

SEQ ID NO: 668254 - DNA, 25 bp, Mus musculus
gatggatcttacagaggaaactgca

SEQ ID NO: 668255 - DNA, 25 bp, Mus musculus
gatggatcttactgaggaaactgca

SEQ ID NO: 668256 - DNA, 25 bp, Mus musculus
gatggatcttgcaaaaactgtgggt

SEQ ID NO: 668257 - DNA, 25 bp, Mus musculus
gatggatcttgctaaaactgtgggt

SEQ ID NO: 668258 - DNA, 25 bp, Mus musculus
gatggatgacgaagccaatggtgat

SEQ ID NO: 668259 - DNA, 25 bp, Mus musculus
gatggatgacgatgccaatggtgat

SEQ ID NO: 668260 - DNA, 25 bp, Mus musculus
gatggatgacttcagctcgcccaac

SEQ ID NO: 668261 - DNA, 25 bp, Mus musculus
gatggatgacttgagctcgcccaac

SEQ ID NO: 668262 - DNA, 25 bp, Mus musculus
gatggatgaggccacacgctactta

SEQ ID NO: 668263 - DNA, 25 bp, Mus musculus
gatggatgaggcgacacgctactta

SEQ ID NO: 668264 - DNA, 25 bp, Mus musculus
gatggatgatacagtcattcgaaag

SEQ ID NO: 668265 - DNA, 25 bp, Mus musculus
gatggatgatactgtcattcgaaag

SEQ ID NO: 668266 - DNA, 25 bp, Mus musculus
gatggatgatggcacaaacatcagt

SEQ ID NO: 668267 - DNA, 25 bp, Mus musculus
gatggatgatgggacaaacatcagt

SEQ ID NO: 668268 - DNA, 25 bp, Mus musculus
gatggatgcagacaataaagagctt

SEQ ID NO: 668269 - DNA, 25 bp, Mus musculus
gatggatgcagagaataaagagctt

SEQ ID NO: 668270 - DNA, 25 bp, Mus musculus
gatggatgcgctcatcataccggtg

SEQ ID NO: 668271 - DNA, 25 bp, Mus musculus
gatggatgcgctgatcataccggtg

SEQ ID NO: 668272 - DNA, 25 bp, Mus musculus
gatggatgctctcatcttctttgtc

SEQ ID NO: 668273 - DNA, 25 bp, Mus musculus
gatggatgctctgatcttctttgtc

SEQ ID NO: 668274 - DNA, 25 bp, Mus musculus
gatggatgctgcatcagaggtctgc

SEQ ID NO: 668275 - DNA, 25 bp, Mus musculus
gatggatgctgcttcagaggtctgc

SEQ ID NO: 668276 - DNA, 25 bp, Mus musculus
gatggatgtaccatcatgcctgtcc

SEQ ID NO: 668277 - DNA, 25 bp, Mus musculus
gatggatgtaccttcatgcctgtcc

SEQ ID NO: 668278 - DNA, 25 bp, Mus musculus
gatggattccaaactgcacctgtgg

SEQ ID NO: 668279 - DNA, 25 bp, Mus musculus
gatggattccaatctgcacctgtgg

SEQ ID NO: 668280 - DNA, 25 bp, Mus musculus
gatggattccgtacacatgacctca

SEQ ID NO: 668281 - DNA, 25 bp, Mus musculus
gatggattccgttcacatgacctca

SEQ ID NO: 668282 - DNA, 25 bp, Mus musculus
gatggattgaagactgcaaagaaca

SEQ ID NO: 668283 - DNA, 25 bp, Mus musculus
gatggattgaagtctgcaaagaaca

SEQ ID NO: 668284 - DNA, 25 bp, Mus musculus
gatggattgtctagtcctgccgccc

SEQ ID NO: 668285 - DNA, 25 bp, Mus musculus
gatggattgtcttgtcctgccgccc

SEQ ID NO: 668286 - DNA, 25 bp, Mus musculus
gatggatttacacatccttcaaata

SEQ ID NO: 668287 - DNA, 25 bp, Mus musculus
gatggatttacagatccttcaaata

SEQ ID NO: 668288 - DNA, 25 bp, Mus musculus
gatggatttgatactctgcatagag

SEQ ID NO: 668289 - DNA, 25 bp, Mus musculus
gatggatttgattctctgcatagag

SEQ ID NO: 668290 - DNA, 25 bp, Mus musculus
gatggatttgcacagctcgtctccc

SEQ ID NO: 668291 - DNA, 25 bp, Mus musculus
gatggatttgcagagctcgtctccc

SEQ ID NO: 668292 - DNA, 25 bp, Mus musculus
gatggattttcacgaagtgacctaa

SEQ ID NO: 668293 - DNA, 25 bp, Mus musculus
gatggattttcaggaagtgacctaa

SEQ ID NO: 668294 - DNA, 25 bp, Mus musculus
gatggcaaaccacgcctgaatggga

SEQ ID NO: 668295 - DNA, 25 bp, Mus musculus
gatggcaaaccaggcctgaatggga

SEQ ID NO: 668296 - DNA, 25 bp, Mus musculus
gatggcaaaccgcatcgtggattcc

SEQ ID NO: 668297 - DNA, 25 bp, Mus musculus
gatggcaaaccggatcgtggattcc

SEQ ID NO: 668298 - DNA, 25 bp, Mus musculus
gatggcaaagaaataaagcaactga

SEQ ID NO: 668299 - DNA, 25 bp, Mus musculus
gatggcaaagaattaaagcaactga

SEQ ID NO: 668300 - DNA, 25 bp, Mus musculus
gatggcaaagctatcggtgtcctga

SEQ ID NO: 668301 - DNA, 25 bp, Mus musculus
gatggcaaagctttcggtgtcctga

SEQ ID NO: 668302 - DNA, 25 bp, Mus musculus
gatggcaaagggaagaccattgact

SEQ ID NO: 668303 - DNA, 25 bp, Mus musculus
gatggcaaagggtagaccattgact

SEQ ID NO: 668304 - DNA, 25 bp, Mus musculus
gatggcaaagtcaatggctcccacg

SEQ ID NO: 668305 - DNA, 25 bp, Mus musculus
gatggcaaagtcctgacccctgaag

SEQ ID NO: 668306 - DNA, 25 bp, Mus musculus
gatggcaaagtcgtgacccctgaag

SEQ ID NO: 668307 - DNA, 25 bp, Mus musculus
gatggcaaagtctatggctcccacg

SEQ ID NO: 668308 - DNA, 25 bp, Mus musculus
gatggcaacacaccacaatttgaga

SEQ ID NO: 668309 - DNA, 25 bp, Mus musculus
gatggcaacacagcacaatttgaga

SEQ ID NO: 668310 - DNA, 25 bp, Mus musculus
gatggcaaccatcagtggacgatca

SEQ ID NO: 668311 - DNA, 25 bp, Mus musculus
gatggcaaccatgagtggacgatca

SEQ ID NO: 668312 - DNA, 25 bp, Mus musculus
gatggcaactccaatggtgtccctg

SEQ ID NO: 668313 - DNA, 25 bp, Mus musculus
gatggcaactcctatggtgtccctg

SEQ ID NO: 668314 - DNA, 25 bp, Mus musculus
gatggcaagaaaagattgtctattg

SEQ ID NO: 668315 - DNA, 25 bp, Mus musculus
gatggcaagaaatgattgtctattg

SEQ ID NO: 668316 - DNA, 25 bp, Mus musculus
gatggcaagaagctttactacccag

SEQ ID NO: 668317 - DNA, 25 bp, Mus musculus
gatggcaagaaggtttactacccag

SEQ ID NO: 668318 - DNA, 25 bp, Mus musculus
gatggcaagacgctggtcactcctg

SEQ ID NO: 668319 - DNA, 25 bp, Mus musculus
gatggcaagacggtggtcactcctg

SEQ ID NO: 668320 - DNA, 25 bp, Mus musculus
gatggcaagattacctcaacagaag

SEQ ID NO: 668321 - DNA, 25 bp, Mus musculus
gatggcaagatttcctcaacagaag

SEQ ID NO: 668322 - DNA, 25 bp, Mus musculus
gatggcaagctcacggattcttcta

SEQ ID NO: 668323 - DNA, 25 bp, Mus musculus
gatggcaagctctcggattcttcta

SEQ ID NO: 668324 - DNA, 25 bp, Mus musculus
gatggcaaggacaccggagtcctgt

SEQ ID NO: 668325 - DNA, 25 bp, Mus musculus
gatggcaaggactccggagtcctgt

SEQ ID NO: 668326 - DNA, 25 bp, Mus musculus
gatggcaagttcctctggccaggct

SEQ ID NO: 668327 - DNA, 25 bp, Mus musculus
gatggcaagttcgtctggccaggct

SEQ ID NO: 668328 - DNA, 25 bp, Mus musculus
gatggcaatctaagactttgaccgc

SEQ ID NO: 668329 - DNA, 25 bp, Mus musculus
gatggcaatctatgactttgaccgc

SEQ ID NO: 668330 - DNA, 25 bp, Mus musculus
gatggcaattcaccctgaccctgct

SEQ ID NO: 668331 - DNA, 25 bp, Mus musculus
gatggcaattcagcctgaccctgct

SEQ ID NO: 668332 - DNA, 25 bp, Mus musculus
gatggcacaaacatcagtaagcttc

SEQ ID NO: 668333 - DNA, 25 bp, Mus musculus
gatggcacaaacttcagtaagcttc

SEQ ID NO: 668334 - DNA, 25 bp, Mus musculus
gatggcacacttagacagagagcgg

SEQ ID NO: 668335 - DNA, 25 bp, Mus musculus
gatggcacactttgacagagagcgg

SEQ ID NO: 668336 - DNA, 25 bp, Mus musculus
gatggcacagaccagtacaacagcg

SEQ ID NO: 668337 - DNA, 25 bp, Mus musculus
gatggcacagacgagtacaacagcg

SEQ ID NO: 668338 - DNA, 25 bp, Mus musculus
gatggcacagtacaatccaccagtg

SEQ ID NO: 668339 - DNA, 25 bp, Mus musculus
gatggcacagtagaatccaccagtg

SEQ ID NO: 668340 - DNA, 25 bp, Mus musculus
gatggcacagtcagtcttcatggca

SEQ ID NO: 668341 - DNA, 25 bp, Mus musculus
gatggcacagtctgtcttcatggca

SEQ ID NO: 668342 - DNA, 25 bp, Mus musculus
gatggcacatacacagagtcccatg

SEQ ID NO: 668343 - DNA, 25 bp, Mus musculus
gatggcacatactcagagtcccatg

SEQ ID NO: 668344 - DNA, 25 bp, Mus musculus
gatggcacatttccaggactgactg

SEQ ID NO: 668345 - DNA, 25 bp, Mus musculus
gatggcacatttgcaggactgactg

SEQ ID NO: 668346 - DNA, 25 bp, Mus musculus
gatggcaccatgaccattgattggc

SEQ ID NO: 668347 - DNA, 25 bp, Mus musculus
gatggcaccatgtccattgattggc

SEQ ID NO: 668348 - DNA, 25 bp, Mus musculus
gatggcacctttattggctacaagg

SEQ ID NO: 668349 - DNA, 25 bp, Mus musculus
gatggcaccttttttggctacaagg

SEQ ID NO: 668350 - DNA, 25 bp, Mus musculus
gatggcactaatctttggctgaata

SEQ ID NO: 668351 - DNA, 25 bp, Mus musculus
gatggcactaatgtttggctgaata

SEQ ID NO: 668352 - DNA, 25 bp, Mus musculus
gatggcactaccagattcacctgca

SEQ ID NO: 668353 - DNA, 25 bp, Mus musculus
gatggcactacctgattcacctgca

SEQ ID NO: 668354 - DNA, 25 bp, Mus musculus
gatggcactctccttgctgcacaaa

SEQ ID NO: 668355 - DNA, 25 bp, Mus musculus
gatggcactctcgttgctgcacaaa

SEQ ID NO: 668356 - DNA, 25 bp, Mus musculus
gatggcactgaaactagtggccctc

SEQ ID NO: 668357 - DNA, 25 bp, Mus musculus
gatggcactgaatctagtggccctc

SEQ ID NO: 668358 - DNA, 25 bp, Mus musculus
gatggcacttccaaacgtcttggaa

SEQ ID NO: 668359 - DNA, 25 bp, Mus musculus
gatggcacttcctaacgtcttggaa

SEQ ID NO: 668360 - DNA, 25 bp, Mus musculus
gatggcagaatcagctttgtcttct

SEQ ID NO: 668361 - DNA, 25 bp, Mus musculus
gatggcagaatctgctttgtcttct

SEQ ID NO: 668362 - DNA, 25 bp, Mus musculus
gatggcagagaaaaagtatggattc

SEQ ID NO: 668363 - DNA, 25 bp, Mus musculus
gatggcagagaataagtatggattc

SEQ ID NO: 668364 - DNA, 25 bp, Mus musculus
gatggcagccaacgcacagatgtcc

SEQ ID NO: 668365 - DNA, 25 bp, Mus musculus
gatggcagccaaggcacagatgtcc

SEQ ID NO: 668366 - DNA, 25 bp, Mus musculus
gatggcagcgaccagaagaactgtg

SEQ ID NO: 668367 - DNA, 25 bp, Mus musculus
gatggcagcgacgagaagaactgtg

SEQ ID NO: 668368 - DNA, 25 bp, Mus musculus
gatggcagctctaagagccctgact

SEQ ID NO: 668369 - DNA, 25 bp, Mus musculus
gatggcagctcttagagccctgact

SEQ ID NO: 668370 - DNA, 25 bp, Mus musculus
gatggcagctttccttggacctgga

SEQ ID NO: 668371 - DNA, 25 bp, Mus musculus
gatggcagctttgcttggacctgga

SEQ ID NO: 668372 - DNA, 25 bp, Mus musculus
gatggcaggctcaatgcctctgaga

SEQ ID NO: 668373 - DNA, 25 bp, Mus musculus
gatggcaggctctatgcctctgaga

SEQ ID NO: 668374 - DNA, 25 bp, Mus musculus
gatggcagtatccttggttcgtgct

SEQ ID NO: 668375 - DNA, 25 bp, Mus musculus
gatggcagtatcgttggttcgtgct

SEQ ID NO: 668376 - DNA, 25 bp, Mus musculus
gatggcataaaaacataacaggttc

SEQ ID NO: 668377 - DNA, 25 bp, Mus musculus
gatggcataaaatcataacaggttc

SEQ ID NO: 668378 - DNA, 25 bp, Mus musculus
gatggcatccgcatgtggttccagt

SEQ ID NO: 668379 - DNA, 25 bp, Mus musculus
gatggcatccgcttgtggttccagt

SEQ ID NO: 668380 - DNA, 25 bp, Mus musculus
gatggcatcgatatcaacaacaact

SEQ ID NO: 668381 - DNA, 25 bp, Mus musculus
gatggcatcgatttcaacaacaact

SEQ ID NO: 668382 - DNA, 25 bp, Mus musculus
gatggcatctacacaagatacttta

SEQ ID NO: 668383 - DNA, 25 bp, Mus musculus
gatggcatctactcaagatacttta

SEQ ID NO: 668384 - DNA, 25 bp, Mus musculus
gatggcatgaatccttacatggcat

SEQ ID NO: 668385 - DNA, 25 bp, Mus musculus
gatggcatgaatgcttacatggcat

SEQ ID NO: 668386 - DNA, 25 bp, Mus musculus
gatggcattaagaaggcccatatag

SEQ ID NO: 668387 - DNA, 25 bp, Mus musculus
gatggcattaagtaggcccatatag

SEQ ID NO: 668388 - DNA, 25 bp, Mus musculus
gatggcattgtgcagcccattcttt

SEQ ID NO: 668389 - DNA, 25 bp, Mus musculus
gatggcattgtggagcccattcttt

SEQ ID NO: 668390 - DNA, 25 bp, Mus musculus
gatggcatttcaatcagtagccaaa

SEQ ID NO: 668391 - DNA, 25 bp, Mus musculus
gatggcatttcattcagtagccaaa

SEQ ID NO: 668392 - DNA, 25 bp, Mus musculus
gatggcatttggaggctgacgattt

SEQ ID NO: 668393 - DNA, 25 bp, Mus musculus
gatggcatttggtggctgacgattt

SEQ ID NO: 668394 - DNA, 25 bp, Mus musculus
gatggccaaagcagtccgagagaag

SEQ ID NO: 668395 - DNA, 25 bp, Mus musculus
gatggccaaagctgtccgagagaag

SEQ ID NO: 668396 - DNA, 25 bp, Mus musculus
gatggccaactcatcctgtgtgcaa

SEQ ID NO: 668397 - DNA, 25 bp, Mus musculus
gatggccaactcttcctgtgtgcaa

SEQ ID NO: 668398 - DNA, 25 bp, Mus musculus
gatggccaaggcacagagggactat

SEQ ID NO: 668399 - DNA, 25 bp, Mus musculus
gatggccaaggctcagagggactat

SEQ ID NO: 668400 - DNA, 25 bp, Mus musculus
gatggccacacacgcagccctattg

SEQ ID NO: 668401 - DNA, 25 bp, Mus musculus
gatggccacacaggcagccctattg

SEQ ID NO: 668402 - DNA, 25 bp, Mus musculus
gatggccacagactctacagccgct

SEQ ID NO: 668403 - DNA, 25 bp, Mus musculus
gatggccacagagtctacagccgct

SEQ ID NO: 668404 - DNA, 25 bp, Mus musculus
gatggccacagcatcctaaccaaag

SEQ ID NO: 668405 - DNA, 25 bp, Mus musculus
gatggccacagcttcctaaccaaag

SEQ ID NO: 668406 - DNA, 25 bp, Mus musculus
gatggccactgaagtacacgctgaa

SEQ ID NO: 668407 - DNA, 25 bp, Mus musculus
gatggccactgatgtacacgctgaa

SEQ ID NO: 668408 - DNA, 25 bp, Mus musculus
gatggccagattctacaaacacctg

SEQ ID NO: 668409 - DNA, 25 bp, Mus musculus
gatggccagattgtacaaacacctg

SEQ ID NO: 668410 - DNA, 25 bp, Mus musculus
gatggccagcccatatatcttctac

SEQ ID NO: 668411 - DNA, 25 bp, Mus musculus
gatggccagcccatcaatgtgtact

SEQ ID NO: 668412 - DNA, 25 bp, Mus musculus
gatggccagcccttatatcttctac

SEQ ID NO: 668413 - DNA, 25 bp, Mus musculus
gatggccagcccttcaatgtgtact

SEQ ID NO: 668414 - DNA, 25 bp, Mus musculus
gatggccaggtgcagcttgaccggc

SEQ ID NO: 668415 - DNA, 25 bp, Mus musculus
gatggccaggtggagcttgaccggc

SEQ ID NO: 668416 - DNA, 25 bp, Mus musculus
gatggccatcagacctctagagagc

SEQ ID NO: 668417 - DNA, 25 bp, Mus musculus
gatggccatcagtcctctagagagc

SEQ ID NO: 668418 - DNA, 25 bp, Mus musculus
gatggccatcttcggcaacctgctg

SEQ ID NO: 668419 - DNA, 25 bp, Mus musculus
gatggccatcttgggcaacctgctg

SEQ ID NO: 668420 - DNA, 25 bp, Mus musculus
gatggccatgtacttaaatgtgtga

SEQ ID NO: 668421 - DNA, 25 bp, Mus musculus
gatggccatgtagttaaatgtgtga

SEQ ID NO: 668422 - DNA, 25 bp, Mus musculus
gatggccattttaacctaagagatt

SEQ ID NO: 668423 - DNA, 25 bp, Mus musculus
gatggccatttttacctaagagatt

SEQ ID NO: 668424 - DNA, 25 bp, Mus musculus
gatggcccaggaatctataccagct

SEQ ID NO: 668425 - DNA, 25 bp, Mus musculus
gatggcccaggattctataccagct

SEQ ID NO: 668426 - DNA, 25 bp, Mus musculus
gatggccccatgagcatgcatgaca

SEQ ID NO: 668427 - DNA, 25 bp, Mus musculus
gatggccccatgtgcatgcatgaca

SEQ ID NO: 668428 - DNA, 25 bp, Mus musculus
gatggcccctaacagctatctggag

SEQ ID NO: 668429 - DNA, 25 bp, Mus musculus
gatggcccctaagagctatctggag

SEQ ID NO: 668430 - DNA, 25 bp, Mus musculus
gatggcccctcaagaaccgttggtg

SEQ ID NO: 668431 - DNA, 25 bp, Mus musculus
gatggcccctcatgaaccgttggtg

SEQ ID NO: 668432 - DNA, 25 bp, Mus musculus
gatggcccctgacgcgttgtttgac

SEQ ID NO: 668433 - DNA, 25 bp, Mus musculus
gatggcccctgaggcgttgtttgac

SEQ ID NO: 668434 - DNA, 25 bp, Mus musculus
gatggcccgagcacactcgaatcac

SEQ ID NO: 668435 - DNA, 25 bp, Mus musculus
gatggcccgagctcactcgaatcac

SEQ ID NO: 668436 - DNA, 25 bp, Mus musculus
gatggccctagtcgccgatgagcaa

SEQ ID NO: 668437 - DNA, 25 bp, Mus musculus
gatggccctagtggccgatgagcaa

SEQ ID NO: 668438 - DNA, 25 bp, Mus musculus
gatggccctcaacaagtttgtgatg

SEQ ID NO: 668439 - DNA, 25 bp, Mus musculus
gatggccctcaagaagtttgtgatg

SEQ ID NO: 668440 - DNA, 25 bp, Mus musculus
gatggccctgaaagctacatatatc

SEQ ID NO: 668441 - DNA, 25 bp, Mus musculus
gatggccctgaatgctacatatatc

SEQ ID NO: 668442 - DNA, 25 bp, Mus musculus
gatggccgacggctcgtctacaagt

SEQ ID NO: 668443 - DNA, 25 bp, Mus musculus
gatggccgacgggtcgtctacaagt

SEQ ID NO: 668444 - DNA, 25 bp, Mus musculus
gatggccgagatcgaataccaggaa

SEQ ID NO: 668445 - DNA, 25 bp, Mus musculus
gatggccgagatggaataccaggaa

SEQ ID NO: 668446 - DNA, 25 bp, Mus musculus
gatggccggcgcaacatgatgatcg

SEQ ID NO: 668447 - DNA, 25 bp, Mus musculus
gatggccggcgctacatgatgatcg

SEQ ID NO: 668448 - DNA, 25 bp, Mus musculus
gatggccgtttccttatctcctatg

SEQ ID NO: 668449 - DNA, 25 bp, Mus musculus
gatggccgtttcgttatctcctatg

SEQ ID NO: 668450 - DNA, 25 bp, Mus musculus
gatggcctctatccagtccttcagt

SEQ ID NO: 668451 - DNA, 25 bp, Mus musculus
gatggcctctatgcagtccttcagt

SEQ ID NO: 668452 - DNA, 25 bp, Mus musculus
gatggcctcttgaatcctgtagggc

SEQ ID NO: 668453 - DNA, 25 bp, Mus musculus
gatggcctcttgatgagtactggtg

SEQ ID NO: 668454 - DNA, 25 bp, Mus musculus
gatggcctcttgtatcctgtagggc

SEQ ID NO: 668455 - DNA, 25 bp, Mus musculus
gatggcctcttgttgagtactggtg

SEQ ID NO: 668456 - DNA, 25 bp, Mus musculus
gatggcctgaccagtggatcctaac

SEQ ID NO: 668457 - DNA, 25 bp, Mus musculus
gatggcctgacctgtggatcctaac

SEQ ID NO: 668458 - DNA, 25 bp, Mus musculus
gatggcctggatatacaacttaaag

SEQ ID NO: 668459 - DNA, 25 bp, Mus musculus
gatggcctggatctcatcagtattt

SEQ ID NO: 668460 - DNA, 25 bp, Mus musculus
gatggcctggatgtcatcagtattt

SEQ ID NO: 668461 - DNA, 25 bp, Mus musculus
gatggcctggatttacaacttaaag

SEQ ID NO: 668462 - DNA, 25 bp, Mus musculus
gatggcctggctctttgcacctgac

SEQ ID NO: 668463 - DNA, 25 bp, Mus musculus
gatggcctggctgtttgcacctgac

SEQ ID NO: 668464 - DNA, 25 bp, Mus musculus
gatggccttctacacgggattgtca

SEQ ID NO: 668465 - DNA, 25 bp, Mus musculus
gatggccttctagacgggattgtca

SEQ ID NO: 668466 - DNA, 25 bp, Mus musculus
gatggccttggcagtaagttacacc

SEQ ID NO: 668467 - DNA, 25 bp, Mus musculus
gatggccttggctgtaagttacacc

SEQ ID NO: 668468 - DNA, 25 bp, Mus musculus
gatggccttggtcacttagaaatgt

SEQ ID NO: 668469 - DNA, 25 bp, Mus musculus
gatggccttggtgacttagaaatgt

SEQ ID NO: 668470 - DNA, 25 bp, Mus musculus
gatggcgacagtaccacggcccagg

SEQ ID NO: 668471 - DNA, 25 bp, Mus musculus
gatggcgacagttccacggcccagg

SEQ ID NO: 668472 - DNA, 25 bp, Mus musculus
gatggcgaccatcacaacgacaagg

SEQ ID NO: 668473 - DNA, 25 bp, Mus musculus
gatggcgaccatgacaacgacaagg

SEQ ID NO: 668474 - DNA, 25 bp, Mus musculus
gatggcgacggccactatagctctc

SEQ ID NO: 668475 - DNA, 25 bp, Mus musculus
gatggcgacggcgactatagctctc

SEQ ID NO: 668476 - DNA, 25 bp, Mus musculus
gatggcgacgtcacgttgaaatcct

SEQ ID NO: 668477 - DNA, 25 bp, Mus musculus
gatggcgacgtctcgttgaaatcct

SEQ ID NO: 668478 - DNA, 25 bp, Mus musculus
gatggcgatttgagttttaggtcga

SEQ ID NO: 668479 - DNA, 25 bp, Mus musculus
gatggcgatttgtgttttaggtcga

SEQ ID NO: 668480 - DNA, 25 bp, Mus musculus
gatggcgattttctcaccgatatgc

SEQ ID NO: 668481 - DNA, 25 bp, Mus musculus
gatggcgattttgtcaccgatatgc

SEQ ID NO: 668482 - DNA, 25 bp, Mus musculus
gatggcgcagaacaaatatcttcaa

SEQ ID NO: 668483 - DNA, 25 bp, Mus musculus
gatggcgcagaagaaatatcttcaa

SEQ ID NO: 668484 - DNA, 25 bp, Mus musculus
gatggcgcctacaacatagaacact

SEQ ID NO: 668485 - DNA, 25 bp, Mus musculus
gatggcgcctactacatagaacact

SEQ ID NO: 668486 - DNA, 25 bp, Mus musculus
gatggcgctgatactgaacaaccac

SEQ ID NO: 668487 - DNA, 25 bp, Mus musculus
gatggcgctgattctgaacaaccac

SEQ ID NO: 668488 - DNA, 25 bp, Mus musculus
gatggcgctgctagaggccacgcct

SEQ ID NO: 668489 - DNA, 25 bp, Mus musculus
gatggcgctgcttgaggccacgcct

SEQ ID NO: 668490 - DNA, 25 bp, Mus musculus
gatggcgcttatagacatcactgtg

SEQ ID NO: 668491 - DNA, 25 bp, Mus musculus
gatggcgcttattgacatcactgtg

SEQ ID NO: 668492 - DNA, 25 bp, Mus musculus
gatggcggaggcaatcataagaaca

SEQ ID NO: 668493 - DNA, 25 bp, Mus musculus
gatggcggaggctatcataagaaca

SEQ ID NO: 668494 - DNA, 25 bp, Mus musculus
gatggcggataaactcccttcggac

SEQ ID NO: 668495 - DNA, 25 bp, Mus musculus
gatggcggataatctcccttcggac

SEQ ID NO: 668496 - DNA, 25 bp, Mus musculus
gatggcggcaagaacagcctggaac

SEQ ID NO: 668497 - DNA, 25 bp, Mus musculus
gatggcggcaagtacagcctggaac

SEQ ID NO: 668498 - DNA, 25 bp, Mus musculus
gatggcggcaggaaccagcaattac

SEQ ID NO: 668499 - DNA, 25 bp, Mus musculus
gatggcggcaggtaccagcaattac

SEQ ID NO: 668500 - DNA, 25 bp, Mus musculus
gatggcggtgcacatttccaagaag

SEQ ID NO: 668501 - DNA, 25 bp, Mus musculus
gatggcggtgcagatttccaagaag

SEQ ID NO: 668502 - DNA, 25 bp, Mus musculus
gatggcgtaccacagcctccggctg

SEQ ID NO: 668503 - DNA, 25 bp, Mus musculus
gatggcgtaccagagcctccggctg

SEQ ID NO: 668504 - DNA, 25 bp, Mus musculus
gatggcgtcctcacatctagcaagg

SEQ ID NO: 668505 - DNA, 25 bp, Mus musculus
gatggcgtcctctcatctagcaagg

SEQ ID NO: 668506 - DNA, 25 bp, Mus musculus
gatggcgttatcactccctggcaat

SEQ ID NO: 668507 - DNA, 25 bp, Mus musculus
gatggcgttatctctccctggcaat

SEQ ID NO: 668508 - DNA, 25 bp, Mus musculus
gatggcgttgctctctctaggctat

SEQ ID NO: 668509 - DNA, 25 bp, Mus musculus
gatggcgttgctgtctctaggctat

SEQ ID NO: 668510 - DNA, 25 bp, Mus musculus
gatggcgtttaaaggctgctgtcca

SEQ ID NO: 668511 - DNA, 25 bp, Mus musculus
gatggcgtttaatggctgctgtcca

SEQ ID NO: 668512 - DNA, 25 bp, Mus musculus
gatggctacaaacacatctgccact

SEQ ID NO: 668513 - DNA, 25 bp, Mus musculus
gatggctacaaagacatctgccact

SEQ ID NO: 668514 - DNA, 25 bp, Mus musculus
gatggctacaatccttaacctagag

SEQ ID NO: 668515 - DNA, 25 bp, Mus musculus
gatggctacaatgcttaacctagag

SEQ ID NO: 668516 - DNA, 25 bp, Mus musculus
gatggctacagcctcatggaggcaa

SEQ ID NO: 668517 - DNA, 25 bp, Mus musculus
gatggctacagcgtcatggaggcaa

SEQ ID NO: 668518 - DNA, 25 bp, Mus musculus
gatggctacatcaagatctatgatg

SEQ ID NO: 668519 - DNA, 25 bp, Mus musculus
gatggctacatctagatctatgatg

SEQ ID NO: 668520 - DNA, 25 bp, Mus musculus
gatggctacgaaagtgcctgtgaac

SEQ ID NO: 668521 - DNA, 25 bp, Mus musculus
gatggctacgaatgtgcctgtgaac

SEQ ID NO: 668522 - DNA, 25 bp, Mus musculus
gatggctacgtgatcaacattgcac

SEQ ID NO: 668523 - DNA, 25 bp, Mus musculus
gatggctacgtgttcaacattgcac

SEQ ID NO: 668524 - DNA, 25 bp, Mus musculus
gatggctactacatcttgctgcagg

SEQ ID NO: 668525 - DNA, 25 bp, Mus musculus
gatggctactacttcttgctgcagg

SEQ ID NO: 668526 - DNA, 25 bp, Mus musculus
gatggctactgtcaggcatcggcct

SEQ ID NO: 668527 - DNA, 25 bp, Mus musculus
gatggctactgtgaggcatcggcct

SEQ ID NO: 668528 - DNA, 25 bp, Mus musculus
gatggctatattctgagtattcacc

SEQ ID NO: 668529 - DNA, 25 bp, Mus musculus
gatggctatattgtgagtattcacc

SEQ ID NO: 668530 - DNA, 25 bp, Mus musculus
gatggctatcaacgcatctctttgc

SEQ ID NO: 668531 - DNA, 25 bp, Mus musculus
gatggctatcaaggcatctctttgc

SEQ ID NO: 668532 - DNA, 25 bp, Mus musculus
gatggctcaagacacaactgtcacc

SEQ ID NO: 668533 - DNA, 25 bp, Mus musculus
gatggctcaagagacaactgtcacc

SEQ ID NO: 668534 - DNA, 25 bp, Mus musculus
gatggctcacatctttcccacaaaa

SEQ ID NO: 668535 - DNA, 25 bp, Mus musculus
gatggctcacatgtttcccacaaaa

SEQ ID NO: 668536 - DNA, 25 bp, Mus musculus
gatggctcaggtcatgagaatagct

SEQ ID NO: 668537 - DNA, 25 bp, Mus musculus
gatggctcaggtgatgagaatagct

SEQ ID NO: 668538 - DNA, 25 bp, Mus musculus
gatggctcagttatgtggcgccttc

SEQ ID NO: 668539 - DNA, 25 bp, Mus musculus
gatggctcagttttgtggcgccttc

SEQ ID NO: 668540 - DNA, 25 bp, Mus musculus
gatggctccagcacaaaagtgaaag

SEQ ID NO: 668541 - DNA, 25 bp, Mus musculus
gatggctccagctcaaaagtgaaag

SEQ ID NO: 668542 - DNA, 25 bp, Mus musculus
gatggctccgacctcatcagtgcag

SEQ ID NO: 668543 - DNA, 25 bp, Mus musculus
gatggctccgacgtcatcagtgcag

SEQ ID NO: 668544 - DNA, 25 bp, Mus musculus
gatggctcctgaagccctttttgat

SEQ ID NO: 668545 - DNA, 25 bp, Mus musculus
gatggctcctgatgccctttttgat

SEQ ID NO: 668546 - DNA, 25 bp, Mus musculus
gatggctcggagaacctgatccagc

SEQ ID NO: 668547 - DNA, 25 bp, Mus musculus
gatggctcggagtacctgatccagc

SEQ ID NO: 668548 - DNA, 25 bp, Mus musculus
gatggctcgtcgaccattggccgca

SEQ ID NO: 668549 - DNA, 25 bp, Mus musculus
gatggctcgtcgtccattggccgca

SEQ ID NO: 668550 - DNA, 25 bp, Mus musculus
gatggctctaccaaaggccacaggc

SEQ ID NO: 668551 - DNA, 25 bp, Mus musculus
gatggctctacctaaggccacaggc

SEQ ID NO: 668552 - DNA, 25 bp, Mus musculus
gatggctctcctacagggcagcaac

SEQ ID NO: 668553 - DNA, 25 bp, Mus musculus
gatggctctccttcagggcagcaac

SEQ ID NO: 668554 - DNA, 25 bp, Mus musculus
gatggctctctgctcatcagccgag

SEQ ID NO: 668555 - DNA, 25 bp, Mus musculus
gatggctctctggtcatcagccgag

SEQ ID NO: 668556 - DNA, 25 bp, Mus musculus
gatggctctgcaaagcactgtggac

SEQ ID NO: 668557 - DNA, 25 bp, Mus musculus
gatggctctgcatagcactgtggac

SEQ ID NO: 668558 - DNA, 25 bp, Mus musculus
gatggctctgctctgttcagcccag

SEQ ID NO: 668559 - DNA, 25 bp, Mus musculus
gatggctctgctgtgttcagcccag

SEQ ID NO: 668560 - DNA, 25 bp, Mus musculus
gatggctctttaagcgacttttggt

SEQ ID NO: 668561 - DNA, 25 bp, Mus musculus
gatggctctttatgcgacttttggt

SEQ ID NO: 668562 - DNA, 25 bp, Mus musculus
gatggctgaagcaaaatattacctc

SEQ ID NO: 668563 - DNA, 25 bp, Mus musculus
gatggctgaagctaaatattacctc

SEQ ID NO: 668564 - DNA, 25 bp, Mus musculus
gatggctgaagtagatgttttcctg

SEQ ID NO: 668565 - DNA, 25 bp, Mus musculus
gatggctgaagttgatgttttcctg

SEQ ID NO: 668566 - DNA, 25 bp, Mus musculus
gatggctgagccagcacttgctaag

SEQ ID NO: 668567 - DNA, 25 bp, Mus musculus
gatggctgagcctgcacttgctaag

SEQ ID NO: 668568 - DNA, 25 bp, Mus musculus
gatggctgaggaccctgattcaatt

SEQ ID NO: 668569 - DNA, 25 bp, Mus musculus
gatggctgaggagcctgattcaatt

SEQ ID NO: 668570 - DNA, 25 bp, Mus musculus
gatggctgatccagcaaagaatcca

SEQ ID NO: 668571 - DNA, 25 bp, Mus musculus
gatggctgatcctgcaaagaatcca

SEQ ID NO: 668572 - DNA, 25 bp, Mus musculus
gatggctgcagcaactcctctgcgg

SEQ ID NO: 668573 - DNA, 25 bp, Mus musculus
gatggctgcagccatacctgcccgg

SEQ ID NO: 668574 - DNA, 25 bp, Mus musculus
gatggctgcagcgatacctgcccgg

SEQ ID NO: 668575 - DNA, 25 bp, Mus musculus
gatggctgcagctactcctctgcgg

SEQ ID NO: 668576 - DNA, 25 bp, Mus musculus
gatggctgtacaacgggctcatcct

SEQ ID NO: 668577 - DNA, 25 bp, Mus musculus
gatggctgtacatcgggctcatcct

SEQ ID NO: 668578 - DNA, 25 bp, Mus musculus
gatggctgtcagaatgccctgtgca

SEQ ID NO: 668579 - DNA, 25 bp, Mus musculus
gatggctgtcagtatgccctgtgca

SEQ ID NO: 668580 - DNA, 25 bp, Mus musculus
gatggctgtttaaccctgacccagg

SEQ ID NO: 668581 - DNA, 25 bp, Mus musculus
gatggctgtttatccctgacccagg

SEQ ID NO: 668582 - DNA, 25 bp, Mus musculus
gatggcttcaagcttacttcgcgga

SEQ ID NO: 668583 - DNA, 25 bp, Mus musculus
gatggcttcaaggttacttcgcgga

SEQ ID NO: 668584 - DNA, 25 bp, Mus musculus
gatggcttccagctctaatagaact

SEQ ID NO: 668585 - DNA, 25 bp, Mus musculus
gatggcttccaggtctaatagaact

SEQ ID NO: 668586 - DNA, 25 bp, Mus musculus
gatggcttcggtacccgacggatgc

SEQ ID NO: 668587 - DNA, 25 bp, Mus musculus
gatggcttcggttcccgacggatgc

SEQ ID NO: 668588 - DNA, 25 bp, Mus musculus
gatggcttcttcagagtttgctact

SEQ ID NO: 668589 - DNA, 25 bp, Mus musculus
gatggcttcttctgagtttgctact

SEQ ID NO: 668590 - DNA, 25 bp, Mus musculus
gatggcttgatgatttgatgttcag

SEQ ID NO: 668591 - DNA, 25 bp, Mus musculus
gatggcttgatgttttgatgttcag

SEQ ID NO: 668592 - DNA, 25 bp, Mus musculus
gatggctttcatagaacaagaagcc

SEQ ID NO: 668593 - DNA, 25 bp, Mus musculus
gatggctttcattgaacaagaagcc

SEQ ID NO: 668594 - DNA, 25 bp, Mus musculus
gatggctttccaagcgcggtgctcc

SEQ ID NO: 668595 - DNA, 25 bp, Mus musculus
gatggctttccatgcgcggtgctcc

SEQ ID NO: 668596 - DNA, 25 bp, Mus musculus
gatggctttgttcctgcacacttca

SEQ ID NO: 668597 - DNA, 25 bp, Mus musculus
gatggctttgttgctgcacacttca

SEQ ID NO: 668598 - DNA, 25 bp, Mus musculus
gatggcttttgtcaggagactcgct

SEQ ID NO: 668599 - DNA, 25 bp, Mus musculus
gatggcttttgtgaggagactcgct

SEQ ID NO: 668600 - DNA, 25 bp, Mus musculus
gatgggaaaacaataaaggcacaga

SEQ ID NO: 668601 - DNA, 25 bp, Mus musculus
gatgggaaaacattaaaggcacaga

SEQ ID NO: 668602 - DNA, 25 bp, Mus musculus
gatgggaaaagaaagccgaagctgt

SEQ ID NO: 668603 - DNA, 25 bp, Mus musculus
gatgggaaaagatagccgaagctgt

SEQ ID NO: 668604 - DNA, 25 bp, Mus musculus
gatgggaaacataggccgtcaactg

SEQ ID NO: 668605 - DNA, 25 bp, Mus musculus
gatgggaaacattggccgtcaactg

SEQ ID NO: 668606 - DNA, 25 bp, Mus musculus
gatgggaaaggcacaatcctgatat

SEQ ID NO: 668607 - DNA, 25 bp, Mus musculus
gatgggaaaggctcaatcctgatat

SEQ ID NO: 668608 - DNA, 25 bp, Mus musculus
gatgggaaagtcattacagtgccac

SEQ ID NO: 668609 - DNA, 25 bp, Mus musculus
gatgggaaagtctttacagtgccac

SEQ ID NO: 668610 - DNA, 25 bp, Mus musculus
gatgggaacataagctctgggaaaa

SEQ ID NO: 668611 - DNA, 25 bp, Mus musculus
gatgggaacatatgctctgggaaaa

SEQ ID NO: 668612 - DNA, 25 bp, Mus musculus
gatgggaagagcctcaagaagtaca

SEQ ID NO: 668613 - DNA, 25 bp, Mus musculus
gatgggaagagcgtcaagaagtaca

SEQ ID NO: 668614 - DNA, 25 bp, Mus musculus
gatgggaaggtaaatgatcacctca

SEQ ID NO: 668615 - DNA, 25 bp, Mus musculus
gatgggaaggtatatgatcacctca

SEQ ID NO: 668616 - DNA, 25 bp, Mus musculus
gatgggaagtgaccataatattcag

SEQ ID NO: 668617 - DNA, 25 bp, Mus musculus
gatgggaagtgagcataatattcag

SEQ ID NO: 668618 - DNA, 25 bp, Mus musculus
gatgggaatcctcccgttcctactg

SEQ ID NO: 668619 - DNA, 25 bp, Mus musculus
gatgggaatcctgccgttcctactg

SEQ ID NO: 668620 - DNA, 25 bp, Mus musculus
gatgggaatgacagtcttggttgct

SEQ ID NO: 668621 - DNA, 25 bp, Mus musculus
gatgggaatgactgtcttggttgct

SEQ ID NO: 668622 - DNA, 25 bp, Mus musculus
gatgggaatggcaatattagcgctg

SEQ ID NO: 668623 - DNA, 25 bp, Mus musculus
gatgggaatggctatattagcgctg

SEQ ID NO: 668624 - DNA, 25 bp, Mus musculus
gatgggacccatcacaagggactga

SEQ ID NO: 668625 - DNA, 25 bp, Mus musculus
gatgggacccatgacaagggactga

SEQ ID NO: 668626 - DNA, 25 bp, Mus musculus
gatgggaccccacgatcctagtgtg

SEQ ID NO: 668627 - DNA, 25 bp, Mus musculus
gatgggaccccaggatcctagtgtg

SEQ ID NO: 668628 - DNA, 25 bp, Mus musculus
gatgggactcccatagttgctgcac

SEQ ID NO: 668629 - DNA, 25 bp, Mus musculus
gatgggactcccttagttgctgcac

SEQ ID NO: 668630 - DNA, 25 bp, Mus musculus
gatgggactcttcgtatttgtgcgc

SEQ ID NO: 668631 - DNA, 25 bp, Mus musculus
gatgggactcttggtatttgtgcgc

SEQ ID NO: 668632 - DNA, 25 bp, Mus musculus
gatgggacttccaaccctgagagca

SEQ ID NO: 668633 - DNA, 25 bp, Mus musculus
gatgggacttcctaccctgagagca

SEQ ID NO: 668634 - DNA, 25 bp, Mus musculus
gatgggagaaaacacctctgacccg

SEQ ID NO: 668635 - DNA, 25 bp, Mus musculus
gatgggagaaaagacctctgacccg

SEQ ID NO: 668636 - DNA, 25 bp, Mus musculus
gatgggagaatcatcattggcacct

SEQ ID NO: 668637 - DNA, 25 bp, Mus musculus
gatgggagaatcttcattggcacct

SEQ ID NO: 668638 - DNA, 25 bp, Mus musculus
gatgggagactgagtttagacctgt

SEQ ID NO: 668639 - DNA, 25 bp, Mus musculus
gatgggagactgtgtttagacctgt

SEQ ID NO: 668640 - DNA, 25 bp, Mus musculus
gatgggagccaccaaactctttctg

SEQ ID NO: 668641 - DNA, 25 bp, Mus musculus
gatgggagccacgaaactctttctg

SEQ ID NO: 668642 - DNA, 25 bp, Mus musculus
gatgggagcctgatctttgaatttc

SEQ ID NO: 668643 - DNA, 25 bp, Mus musculus
gatgggagcctgttctttgaatttc

SEQ ID NO: 668644 - DNA, 25 bp, Mus musculus
gatgggagctcacacaagttattgc

SEQ ID NO: 668645 - DNA, 25 bp, Mus musculus
gatgggagctcagacaagttattgc

SEQ ID NO: 668646 - DNA, 25 bp, Mus musculus
gatgggaggccaacacattgtggcc

SEQ ID NO: 668647 - DNA, 25 bp, Mus musculus
gatgggaggccatcacattgtggcc

SEQ ID NO: 668648 - DNA, 25 bp, Mus musculus
gatgggatgatgaccgatggtttcc

SEQ ID NO: 668649 - DNA, 25 bp, Mus musculus
gatgggatgatgtccgatggtttcc

SEQ ID NO: 668650 - DNA, 25 bp, Mus musculus
gatgggatgcctctcacaattggag

SEQ ID NO: 668651 - DNA, 25 bp, Mus musculus
gatgggatgcctgtcacaattggag

SEQ ID NO: 668652 - DNA, 25 bp, Mus musculus
gatgggatgcttactgaagttttca

SEQ ID NO: 668653 - DNA, 25 bp, Mus musculus
gatgggatgctttctgaagttttca

SEQ ID NO: 668654 - DNA, 25 bp, Mus musculus
gatgggattaccctccacgtggaga

SEQ ID NO: 668655 - DNA, 25 bp, Mus musculus
gatgggattaccgtccacgtggaga

SEQ ID NO: 668656 - DNA, 25 bp, Mus musculus
gatgggcaagttataccctgaactg

SEQ ID NO: 668657 - DNA, 25 bp, Mus musculus
gatgggcaagttttaccctgaactg

SEQ ID NO: 668658 - DNA, 25 bp, Mus musculus
gatgggcaatgaagtggtgaacttc

SEQ ID NO: 668659 - DNA, 25 bp, Mus musculus
gatgggcaatgatgtggtgaacttc

SEQ ID NO: 668660 - DNA, 25 bp, Mus musculus
gatgggcacccaaaatctgtcttgg

SEQ ID NO: 668661 - DNA, 25 bp, Mus musculus
gatgggcacccataatctgtcttgg

SEQ ID NO: 668662 - DNA, 25 bp, Mus musculus
gatgggcacctcacatgtgtctgtg

SEQ ID NO: 668663 - DNA, 25 bp, Mus musculus
gatgggcacctctcatgtgtctgtg

SEQ ID NO: 668664 - DNA, 25 bp, Mus musculus
gatgggcagctgctctcttctccca

SEQ ID NO: 668665 - DNA, 25 bp, Mus musculus
gatgggcagctggtctcttctccca

SEQ ID NO: 668666 - DNA, 25 bp, Mus musculus
gatgggcatgctatgctacagcgct

SEQ ID NO: 668667 - DNA, 25 bp, Mus musculus
gatgggcatgctttgctacagcgct

SEQ ID NO: 668668 - DNA, 25 bp, Mus musculus
gatgggccatcaaagaaggactggc

SEQ ID NO: 668669 - DNA, 25 bp, Mus musculus
gatgggccatcatagaaggactggc

SEQ ID NO: 668670 - DNA, 25 bp, Mus musculus
gatgggcctaaaagagtcttcccca

SEQ ID NO: 668671 - DNA, 25 bp, Mus musculus
gatgggcctaaatgagtcttcccca

SEQ ID NO: 668672 - DNA, 25 bp, Mus musculus
gatgggccttggaccccaaaatgaa

SEQ ID NO: 668673 - DNA, 25 bp, Mus musculus
gatgggccttggtccccaaaatgaa

SEQ ID NO: 668674 - DNA, 25 bp, Mus musculus
gatgggcgaggcagaaacaccttcc

SEQ ID NO: 668675 - DNA, 25 bp, Mus musculus
gatgggcgaggctgaaacaccttcc

SEQ ID NO: 668676 - DNA, 25 bp, Mus musculus
gatgggcgtaggagacatgatctca

SEQ ID NO: 668677 - DNA, 25 bp, Mus musculus
gatgggcgtaggtgacatgatctca

SEQ ID NO: 668678 - DNA, 25 bp, Mus musculus
gatgggctccagctcaacttcagag

SEQ ID NO: 668679 - DNA, 25 bp, Mus musculus
gatgggctccaggtcaacttcagag

SEQ ID NO: 668680 - DNA, 25 bp, Mus musculus
gatgggctccctaactcactatgtg

SEQ ID NO: 668681 - DNA, 25 bp, Mus musculus
gatgggctcccttactcactatgtg

SEQ ID NO: 668682 - DNA, 25 bp, Mus musculus
gatgggctggacacctacacctgcc

SEQ ID NO: 668683 - DNA, 25 bp, Mus musculus
gatgggctggactcctacacctgcc

SEQ ID NO: 668684 - DNA, 25 bp, Mus musculus
gatgggctttgaccaacccctggaa

SEQ ID NO: 668685 - DNA, 25 bp, Mus musculus
gatgggctttgagcaacccctggaa

SEQ ID NO: 668686 - DNA, 25 bp, Mus musculus
gatgggctttgcactacatgagtag

SEQ ID NO: 668687 - DNA, 25 bp, Mus musculus
gatgggctttgctctacatgagtag

SEQ ID NO: 668688 - DNA, 25 bp, Mus musculus
gatgggctttgtctgtgaacgactc

SEQ ID NO: 668689 - DNA, 25 bp, Mus musculus
gatgggctttgtgtgtgaacgactc

SEQ ID NO: 668690 - DNA, 25 bp, Mus musculus
gatgggctttttcccctcgttccta

SEQ ID NO: 668691 - DNA, 25 bp, Mus musculus
gatgggctttttgccctcgttccta

SEQ ID NO: 668692 - DNA, 25 bp, Mus musculus
gatggggctaacctgtctgtcctgc

SEQ ID NO: 668693 - DNA, 25 bp, Mus musculus
gatggggctaacgtgtctgtcctgc

SEQ ID NO: 668694 - DNA, 25 bp, Mus musculus
gatggggtaacaagactctggacca

SEQ ID NO: 668695 - DNA, 25 bp, Mus musculus
gatggggtaacatgactctggacca

SEQ ID NO: 668696 - DNA, 25 bp, Mus musculus
gatgggtacccgaaggtcctagcga

SEQ ID NO: 668697 - DNA, 25 bp, Mus musculus
gatgggtacccgtaggtcctagcga

SEQ ID NO: 668698 - DNA, 25 bp, Mus musculus
gatgggtagccaccttgacagcaag

SEQ ID NO: 668699 - DNA, 25 bp, Mus musculus
gatgggtagccagcttgacagcaag

SEQ ID NO: 668700 - DNA, 25 bp, Mus musculus
gatgggtccagtagatactccacaa

SEQ ID NO: 668701 - DNA, 25 bp, Mus musculus
gatgggtccagttgatactccacaa

SEQ ID NO: 668702 - DNA, 25 bp, Mus musculus
gatgggtcgtcacatgatgaacctg

SEQ ID NO: 668703 - DNA, 25 bp, Mus musculus
gatgggtcgtcagatgatgaacctg

SEQ ID NO: 668704 - DNA, 25 bp, Mus musculus
gatgggtctctcagacatgcataat

SEQ ID NO: 668705 - DNA, 25 bp, Mus musculus
gatgggtctctctgacatgcataat

SEQ ID NO: 668706 - DNA, 25 bp, Mus musculus
gatgggtgacccatgagccaatagt

SEQ ID NO: 668707 - DNA, 25 bp, Mus musculus
gatgggtgacccttgagccaatagt

SEQ ID NO: 668708 - DNA, 25 bp, Mus musculus
gatgggtgactacatgacctgtatg

SEQ ID NO: 668709 - DNA, 25 bp, Mus musculus
gatgggtgactagatgacctgtatg

SEQ ID NO: 668710 - DNA, 25 bp, Mus musculus
gatgggtgcacaactgtattccttc

SEQ ID NO: 668711 - DNA, 25 bp, Mus musculus
gatgggtgcacatctgtattccttc

SEQ ID NO: 668712 - DNA, 25 bp, Mus musculus
gatgggtgtcatcaggaattttctg

SEQ ID NO: 668713 - DNA, 25 bp, Mus musculus
gatgggtgtcatgaggaattttctg

SEQ ID NO: 668714 - DNA, 25 bp, Mus musculus
gatgggtgtttcatttgccaagcga

SEQ ID NO: 668715 - DNA, 25 bp, Mus musculus
gatgggtgtttcttttgccaagcga

SEQ ID NO: 668716 - DNA, 25 bp, Mus musculus
gatgggttaccaaatagtcctataa

SEQ ID NO: 668717 - DNA, 25 bp, Mus musculus
gatgggttaccatatagtcctataa

SEQ ID NO: 668718 - DNA, 25 bp, Mus musculus
gatgggttcaatccgcttcctgtac

SEQ ID NO: 668719 - DNA, 25 bp, Mus musculus
gatgggttcaatgcgcttcctgtac

SEQ ID NO: 668720 - DNA, 25 bp, Mus musculus
gatgggttccccaacatgctaagag

SEQ ID NO: 668721 - DNA, 25 bp, Mus musculus
gatgggttcccctacatgctaagag

SEQ ID NO: 668722 - DNA, 25 bp, Mus musculus
gatgggttcttacagctcgatcgag

SEQ ID NO: 668723 - DNA, 25 bp, Mus musculus
gatgggttcttagagctcgatcgag

SEQ ID NO: 668724 - DNA, 25 bp, Mus musculus
gatgggttctttaccaccattagaa

SEQ ID NO: 668725 - DNA, 25 bp, Mus musculus
gatgggttcttttccaccattagaa

SEQ ID NO: 668726 - DNA, 25 bp, Mus musculus
gatgggttgaagacagctccgtccc

SEQ ID NO: 668727 - DNA, 25 bp, Mus musculus
gatgggttgaagtcagctccgtccc

SEQ ID NO: 668728 - DNA, 25 bp, Mus musculus
gatggtaaatttcacacagccagcc

SEQ ID NO: 668729 - DNA, 25 bp, Mus musculus
gatggtaaatttgacacagccagcc

SEQ ID NO: 668730 - DNA, 25 bp, Mus musculus
gatggtaccactcaaactgcaggcg

SEQ ID NO: 668731 - DNA, 25 bp, Mus musculus
gatggtaccactgaaactgcaggcg

SEQ ID NO: 668732 - DNA, 25 bp, Mus musculus
gatggtacctgcagtgcgagtagac

SEQ ID NO: 668733 - DNA, 25 bp, Mus musculus
gatggtacctgctgtgcgagtagac

SEQ ID NO: 668734 - DNA, 25 bp, Mus musculus
gatggtacctgtcttaaccctgtat

SEQ ID NO: 668735 - DNA, 25 bp, Mus musculus
gatggtacctgtgttaaccctgtat

SEQ ID NO: 668736 - DNA, 25 bp, Mus musculus
gatggtactgaaattcgccgccaca

SEQ ID NO: 668737 - DNA, 25 bp, Mus musculus
gatggtactgaatttcgccgccaca

SEQ ID NO: 668738 - DNA, 25 bp, Mus musculus
gatggtagaactagagagactcagt

SEQ ID NO: 668739 - DNA, 25 bp, Mus musculus
gatggtagaacttgagagactcagt

SEQ ID NO: 668740 - DNA, 25 bp, Mus musculus
gatggtagctgtatccacggcagca

SEQ ID NO: 668741 - DNA, 25 bp, Mus musculus
gatggtagctgtttccacggcagca

SEQ ID NO: 668742 - DNA, 25 bp, Mus musculus
gatggtagtactcgcctcatccaga

SEQ ID NO: 668743 - DNA, 25 bp, Mus musculus
gatggtagtactggcctcatccaga

SEQ ID NO: 668744 - DNA, 25 bp, Mus musculus
gatggtatccgtcggctgtcgctca

SEQ ID NO: 668745 - DNA, 25 bp, Mus musculus
gatggtatccgtgggctgtcgctca

SEQ ID NO: 668746 - DNA, 25 bp, Mus musculus
gatggtatgtagagttgcatgttac

SEQ ID NO: 668747 - DNA, 25 bp, Mus musculus
gatggtatgtagtgttgcatgttac

SEQ ID NO: 668748 - DNA, 25 bp, Mus musculus
gatggtattgagacccacttcgacg

SEQ ID NO: 668749 - DNA, 25 bp, Mus musculus
gatggtattgagtcccacttcgacg

SEQ ID NO: 668750 - DNA, 25 bp, Mus musculus
gatggtcaatctctacaaggccagt

SEQ ID NO: 668751 - DNA, 25 bp, Mus musculus
gatggtcaatctgtacaaggccagt

SEQ ID NO: 668752 - DNA, 25 bp, Mus musculus
gatggtcacactatcgtggaaccca

SEQ ID NO: 668753 - DNA, 25 bp, Mus musculus
gatggtcacactttcgtggaaccca

SEQ ID NO: 668754 - DNA, 25 bp, Mus musculus
gatggtcaccggcacatgaatggct

SEQ ID NO: 668755 - DNA, 25 bp, Mus musculus
gatggtcaccgggacatgaatggct

SEQ ID NO: 668756 - DNA, 25 bp, Mus musculus
gatggtcacgtacaaggaccaggca

SEQ ID NO: 668757 - DNA, 25 bp, Mus musculus
gatggtcacgtagaaggaccaggca

SEQ ID NO: 668758 - DNA, 25 bp, Mus musculus
gatggtcactctcaaggacaccctg

SEQ ID NO: 668759 - DNA, 25 bp, Mus musculus
gatggtcactctgaaggacaccctg

SEQ ID NO: 668760 - DNA, 25 bp, Mus musculus
gatggtcagctgctccactcagatg

SEQ ID NO: 668761 - DNA, 25 bp, Mus musculus
gatggtcagctggtccactcagatg

SEQ ID NO: 668762 - DNA, 25 bp, Mus musculus
gatggtcagtaacatctggactcct

SEQ ID NO: 668763 - DNA, 25 bp, Mus musculus
gatggtcagtaagatctggactcct

SEQ ID NO: 668764 - DNA, 25 bp, Mus musculus
gatggtcatcatccagtggaatggc

SEQ ID NO: 668765 - DNA, 25 bp, Mus musculus
gatggtcatcatgcagtggaatggc

SEQ ID NO: 668766 - DNA, 25 bp, Mus musculus
gatggtcatggtaggctatccagac

SEQ ID NO: 668767 - DNA, 25 bp, Mus musculus
gatggtcatggttggctatccagac

SEQ ID NO: 668768 - DNA, 25 bp, Mus musculus
gatggtcattcaacacttggacgaa

SEQ ID NO: 668769 - DNA, 25 bp, Mus musculus
gatggtcattcatcacttggacgaa

SEQ ID NO: 668770 - DNA, 25 bp, Mus musculus
gatggtccagacagcacaataagtg

SEQ ID NO: 668771 - DNA, 25 bp, Mus musculus
gatggtccagactgcacaataagtg

SEQ ID NO: 668772 - DNA, 25 bp, Mus musculus
gatggtcccgcacggaaagctcatg

SEQ ID NO: 668773 - DNA, 25 bp, Mus musculus
gatggtcccgcagggaaagctcatg

SEQ ID NO: 668774 - DNA, 25 bp, Mus musculus
gatggtcctggaccttctacttcat

SEQ ID NO: 668775 - DNA, 25 bp, Mus musculus
gatggtcctggagcttctacttcat

SEQ ID NO: 668776 - DNA, 25 bp, Mus musculus
gatggtcgctatcagcaaggctctg

SEQ ID NO: 668777 - DNA, 25 bp, Mus musculus
gatggtcgctatgagcaaggctctg

SEQ ID NO: 668778 - DNA, 25 bp, Mus musculus
gatggtctaataactcacactagta

SEQ ID NO: 668779 - DNA, 25 bp, Mus musculus
gatggtctaatatctcacactagta

SEQ ID NO: 668780 - DNA, 25 bp, Mus musculus
gatggtctacgtccactactcgtcc

SEQ ID NO: 668781 - DNA, 25 bp, Mus musculus
gatggtctacgtgcactactcgtcc

SEQ ID NO: 668782 - DNA, 25 bp, Mus musculus
gatggtctatgcagtgtgctcacca

SEQ ID NO: 668783 - DNA, 25 bp, Mus musculus
gatggtctatgctgtgtgctcacca

SEQ ID NO: 668784 - DNA, 25 bp, Mus musculus
gatggtctgatccaacaaatctaca

SEQ ID NO: 668785 - DNA, 25 bp, Mus musculus
gatggtctgatcgaacaaatctaca

SEQ ID NO: 668786 - DNA, 25 bp, Mus musculus
gatggtcttccacgacataggccca

SEQ ID NO: 668787 - DNA, 25 bp, Mus musculus
gatggtcttccaggacataggccca

SEQ ID NO: 668788 - DNA, 25 bp, Mus musculus
gatggtgaaattctttaatgattcc

SEQ ID NO: 668789 - DNA, 25 bp, Mus musculus
gatggtgaaattgtttaatgattcc

SEQ ID NO: 668790 - DNA, 25 bp, Mus musculus
gatggtgaacaacgctgccgacgct

SEQ ID NO: 668791 - DNA, 25 bp, Mus musculus
gatggtgaacaaggctgccgacgct

SEQ ID NO: 668792 - DNA, 25 bp, Mus musculus
gatggtgacagaacctgggctcgaa

SEQ ID NO: 668793 - DNA, 25 bp, Mus musculus
gatggtgacagatcctgggctcgaa

SEQ ID NO: 668794 - DNA, 25 bp, Mus musculus
gatggtgacattatagctccactca

SEQ ID NO: 668795 - DNA, 25 bp, Mus musculus
gatggtgacattttagctccactca

SEQ ID NO: 668796 - DNA, 25 bp, Mus musculus
gatggtgaccctcgacctaaaggag

SEQ ID NO: 668797 - DNA, 25 bp, Mus musculus
gatggtgaccctggacctaaaggag

SEQ ID NO: 668798 - DNA, 25 bp, Mus musculus
gatggtgacctccatccgcacacat

SEQ ID NO: 668799 - DNA, 25 bp, Mus musculus
gatggtgacctcgatccgcacacat

SEQ ID NO: 668800 - DNA, 25 bp, Mus musculus
gatggtgacctgcaaactggaaaca

SEQ ID NO: 668801 - DNA, 25 bp, Mus musculus
gatggtgacctggaaactggaaaca

SEQ ID NO: 668802 - DNA, 25 bp, Mus musculus
gatggtgataatcacagcgagaccc

SEQ ID NO: 668803 - DNA, 25 bp, Mus musculus
gatggtgataatgacagcgagaccc

SEQ ID NO: 668804 - DNA, 25 bp, Mus musculus
gatggtgatattcagatgcctgtca

SEQ ID NO: 668805 - DNA, 25 bp, Mus musculus
gatggtgatattgagatgcctgtca

SEQ ID NO: 668806 - DNA, 25 bp, Mus musculus
gatggtgatcggcaacaacatccag

SEQ ID NO: 668807 - DNA, 25 bp, Mus musculus
gatggtgatcgggaacaacatccag

SEQ ID NO: 668808 - DNA, 25 bp, Mus musculus
gatggtgcaattcagcaagtagtta

SEQ ID NO: 668809 - DNA, 25 bp, Mus musculus
gatggtgcaattgagcaagtagtta

SEQ ID NO: 668810 - DNA, 25 bp, Mus musculus
gatggtgccactactaccttcgacc

SEQ ID NO: 668811 - DNA, 25 bp, Mus musculus
gatggtgccacttctaccttcgacc

SEQ ID NO: 668812 - DNA, 25 bp, Mus musculus
gatggtgccagcaggcaaaggactc

SEQ ID NO: 668813 - DNA, 25 bp, Mus musculus
gatggtgccagctggcaaaggactc

SEQ ID NO: 668814 - DNA, 25 bp, Mus musculus
gatggtgcctatcattgctctctgg

SEQ ID NO: 668815 - DNA, 25 bp, Mus musculus
gatggtgcctatgattgctctctgg

SEQ ID NO: 668816 - DNA, 25 bp, Mus musculus
gatggtgcctccactcaatctgctc

SEQ ID NO: 668817 - DNA, 25 bp, Mus musculus
gatggtgcctcctctcaatctgctc

SEQ ID NO: 668818 - DNA, 25 bp, Mus musculus
gatggtgcctttagttagtgttgta

SEQ ID NO: 668819 - DNA, 25 bp, Mus musculus
gatggtgccttttgttagtgttgta

SEQ ID NO: 668820 - DNA, 25 bp, Mus musculus
gatggtgctaaactgtgctccgaga

SEQ ID NO: 668821 - DNA, 25 bp, Mus musculus
gatggtgctaaagtgtgctccgaga

SEQ ID NO: 668822 - DNA, 25 bp, Mus musculus
gatggtgctcacctcacctgggagc

SEQ ID NO: 668823 - DNA, 25 bp, Mus musculus
gatggtgctcacgtcacctgggagc

SEQ ID NO: 668824 - DNA, 25 bp, Mus musculus
gatggtgctgagagtcttcatagga

SEQ ID NO: 668825 - DNA, 25 bp, Mus musculus
gatggtgctgagtgtcttcatagga

SEQ ID NO: 668826 - DNA, 25 bp, Mus musculus
gatggtggacagatgtgaccaagac

SEQ ID NO: 668827 - DNA, 25 bp, Mus musculus
gatggtggacagttgtgaccaagac

SEQ ID NO: 668828 - DNA, 25 bp, Mus musculus
gatggtggcaccatggagaacctca

SEQ ID NO: 668829 - DNA, 25 bp, Mus musculus
gatggtggcaccttggagaacctca

SEQ ID NO: 668830 - DNA, 25 bp, Mus musculus
gatggtggcactactattggcacaa

SEQ ID NO: 668831 - DNA, 25 bp, Mus musculus
gatggtggcacttctattggcacaa

SEQ ID NO: 668832 - DNA, 25 bp, Mus musculus
gatggtggcgctcaccatccagacg

SEQ ID NO: 668833 - DNA, 25 bp, Mus musculus
gatggtggcgctgaccatccagacg

SEQ ID NO: 668834 - DNA, 25 bp, Mus musculus
gatggtggctatctgcagagattca

SEQ ID NO: 668835 - DNA, 25 bp, Mus musculus
gatggtggctatgtgcagagattca

SEQ ID NO: 668836 - DNA, 25 bp, Mus musculus
gatggtggcttcaccctgtgtgaga

SEQ ID NO: 668837 - DNA, 25 bp, Mus musculus
gatggtggcttctccctgtgtgaga

SEQ ID NO: 668838 - DNA, 25 bp, Mus musculus
gatggtgggcatctctcaagctgcc

SEQ ID NO: 668839 - DNA, 25 bp, Mus musculus
gatggtgggcatgtctcaagctgcc

SEQ ID NO: 668840 - DNA, 25 bp, Mus musculus
gatggtggtcccaattgctgtgtag

SEQ ID NO: 668841 - DNA, 25 bp, Mus musculus
gatggtggtccctattgctgtgtag

SEQ ID NO: 668842 - DNA, 25 bp, Mus musculus
gatggtggtctgaagcactcttcta

SEQ ID NO: 668843 - DNA, 25 bp, Mus musculus
gatggtggtctgtagcactcttcta

SEQ ID NO: 668844 - DNA, 25 bp, Mus musculus
gatggtggtgaactcttccgttgcc

SEQ ID NO: 668845 - DNA, 25 bp, Mus musculus
gatggtggtgaagtcttccgttgcc

SEQ ID NO: 668846 - DNA, 25 bp, Mus musculus
gatggtggtttacaggctaacccag

SEQ ID NO: 668847 - DNA, 25 bp, Mus musculus
gatggtggtttagaggctaacccag

SEQ ID NO: 668848 - DNA, 25 bp, Mus musculus
gatggtgtacctctgtcctagagga

SEQ ID NO: 668849 - DNA, 25 bp, Mus musculus
gatggtgtacctgtgtcctagagga

SEQ ID NO: 668850 - DNA, 25 bp, Mus musculus
gatggtgtcataagcaaaattgaga

SEQ ID NO: 668851 - DNA, 25 bp, Mus musculus
gatggtgtcatatgcaaaattgaga

SEQ ID NO: 668852 - DNA, 25 bp, Mus musculus
gatggtgtcgttaccatagatgagt

SEQ ID NO: 668853 - DNA, 25 bp, Mus musculus
gatggtgtcgtttccatagatgagt

SEQ ID NO: 668854 - DNA, 25 bp, Mus musculus
gatggtgtctccagattgtttgctc

SEQ ID NO: 668855 - DNA, 25 bp, Mus musculus
gatggtgtctcctgattgtttgctc

SEQ ID NO: 668856 - DNA, 25 bp, Mus musculus
gatggtgtctctcgaagattcatcc

SEQ ID NO: 668857 - DNA, 25 bp, Mus musculus
gatggtgtctctggaagattcatcc

SEQ ID NO: 668858 - DNA, 25 bp, Mus musculus
gatggtgtgagaaccttccgggttc

SEQ ID NO: 668859 - DNA, 25 bp, Mus musculus
gatggtgtgagatccttccgggttc

SEQ ID NO: 668860 - DNA, 25 bp, Mus musculus
gatggtgtgagcacagccatcttgc

SEQ ID NO: 668861 - DNA, 25 bp, Mus musculus
gatggtgtgagctcagccatcttgc

SEQ ID NO: 668862 - DNA, 25 bp, Mus musculus
gatggtgttaaacgaatactggaaa

SEQ ID NO: 668863 - DNA, 25 bp, Mus musculus
gatggtgttaaaggaatactggaaa

SEQ ID NO: 668864 - DNA, 25 bp, Mus musculus
gatggtgttcaaccggctgcacctg

SEQ ID NO: 668865 - DNA, 25 bp, Mus musculus
gatggtgttcaagcggctgcacctg

SEQ ID NO: 668866 - DNA, 25 bp, Mus musculus
gatggttaccgcaggtgcgccacca

SEQ ID NO: 668867 - DNA, 25 bp, Mus musculus
gatggttaccgctggtgcgccacca

SEQ ID NO: 668868 - DNA, 25 bp, Mus musculus
gatggttcaagacgtccttagcaag

SEQ ID NO: 668869 - DNA, 25 bp, Mus musculus
gatggttcaagaggtccttagcaag

SEQ ID NO: 668870 - DNA, 25 bp, Mus musculus
gatggttctgagcacaagttctaca

SEQ ID NO: 668871 - DNA, 25 bp, Mus musculus
gatggttctgaggacaagttctaca

SEQ ID NO: 668872 - DNA, 25 bp, Mus musculus
gatggttcttggaagaacacacata

SEQ ID NO: 668873 - DNA, 25 bp, Mus musculus
gatggttcttggtagaacacacata

SEQ ID NO: 668874 - DNA, 25 bp, Mus musculus
gatggttcttgtcgtgcaccaaagc

SEQ ID NO: 668875 - DNA, 25 bp, Mus musculus
gatggttcttgtggtgcaccaaagc

SEQ ID NO: 668876 - DNA, 25 bp, Mus musculus
gatggttgaacaacacctagggcaa

SEQ ID NO: 668877 - DNA, 25 bp, Mus musculus
gatggttgaacatcacctagggcaa

SEQ ID NO: 668878 - DNA, 25 bp, Mus musculus
gatggttgaagtcaatttcacaacc

SEQ ID NO: 668879 - DNA, 25 bp, Mus musculus
gatggttgaagtgaatttcacaacc

SEQ ID NO: 668880 - DNA, 25 bp, Mus musculus
gatggttgctaacacactctggctc

SEQ ID NO: 668881 - DNA, 25 bp, Mus musculus
gatggttgctaagacactctggctc

SEQ ID NO: 668882 - DNA, 25 bp, Mus musculus
gatggtttacaaaatcatgtctaaa

SEQ ID NO: 668883 - DNA, 25 bp, Mus musculus
gatggtttacaatatcatgtctaaa

SEQ ID NO: 668884 - DNA, 25 bp, Mus musculus
gatggtttacggcaaagagaagttc

SEQ ID NO: 668885 - DNA, 25 bp, Mus musculus
gatggtttacgggaaagagaagttc

SEQ ID NO: 668886 - DNA, 25 bp, Mus musculus
gatggtttccaaatccgggatgtgg

SEQ ID NO: 668887 - DNA, 25 bp, Mus musculus
gatggtttccaattccgggatgtgg

SEQ ID NO: 668888 - DNA, 25 bp, Mus musculus
gatggtttccagaccgtccctctca

SEQ ID NO: 668889 - DNA, 25 bp, Mus musculus
gatggtttccagtccgtccctctca

SEQ ID NO: 668890 - DNA, 25 bp, Mus musculus
gatggtttcctgcaatttgatgacc

SEQ ID NO: 668891 - DNA, 25 bp, Mus musculus
gatggtttcctggaatttgatgacc

SEQ ID NO: 668892 - DNA, 25 bp, Mus musculus
gatggtttctatctgtgaacagaag

SEQ ID NO: 668893 - DNA, 25 bp, Mus musculus
gatggtttctatgtgtgaacagaag

SEQ ID NO: 668894 - DNA, 25 bp, Mus musculus
gatggtttgatcactctactaagga

SEQ ID NO: 668895 - DNA, 25 bp, Mus musculus
gatggtttgatctctctactaagga

SEQ ID NO: 668896 - DNA, 25 bp, Mus musculus
gatggttttcatagtctgatgtgac

SEQ ID NO: 668897 - DNA, 25 bp, Mus musculus
gatggttttcattgtctgatgtgac

SEQ ID NO: 668898 - DNA, 25 bp, Mus musculus
gatggttttcctacacaagaatgag

SEQ ID NO: 668899 - DNA, 25 bp, Mus musculus
gatggttttccttcacaagaatgag

SEQ ID NO: 668900 - DNA, 25 bp, Mus musculus
gatgtaaagaatctcattatctggg

SEQ ID NO: 668901 - DNA, 25 bp, Mus musculus
gatgtaaagaatgtcattatctggg

SEQ ID NO: 668902 - DNA, 25 bp, Mus musculus
gatgtaaagccaccagcgtcatgtg

SEQ ID NO: 668903 - DNA, 25 bp, Mus musculus
gatgtaaagccagcagcgtcatgtg

SEQ ID NO: 668904 - DNA, 25 bp, Mus musculus
gatgtaaatcctaagctcaaatgtg

SEQ ID NO: 668905 - DNA, 25 bp, Mus musculus
gatgtaaatccttagctcaaatgtg

SEQ ID NO: 668906 - DNA, 25 bp, Mus musculus
gatgtaaatgaacccataaggttga

SEQ ID NO: 668907 - DNA, 25 bp, Mus musculus
gatgtaaatgaagccataaggttga

SEQ ID NO: 668908 - DNA, 25 bp, Mus musculus
gatgtaacaaccacagatgccctca

SEQ ID NO: 668909 - DNA, 25 bp, Mus musculus
gatgtaacaacctcagatgccctca

SEQ ID NO: 668910 - DNA, 25 bp, Mus musculus
gatgtaacagctaagaacattcaca

SEQ ID NO: 668911 - DNA, 25 bp, Mus musculus
gatgtaacagcttagaacattcaca

SEQ ID NO: 668912 - DNA, 25 bp, Mus musculus
gatgtaaccattactaacgatggtg

SEQ ID NO: 668913 - DNA, 25 bp, Mus musculus
gatgtaaccatttctaacgatggtg

SEQ ID NO: 668914 - DNA, 25 bp, Mus musculus
gatgtaagcagccaaagggtgatcc

SEQ ID NO: 668915 - DNA, 25 bp, Mus musculus
gatgtaagcagcgaaagggtgatcc

SEQ ID NO: 668916 - DNA, 25 bp, Mus musculus
gatgtaaggttaaatggacccacga

SEQ ID NO: 668917 - DNA, 25 bp, Mus musculus
gatgtaaggttatatggacccacga

SEQ ID NO: 668918 - DNA, 25 bp, Mus musculus
gatgtaatcggcagtactcaggaga

SEQ ID NO: 668919 - DNA, 25 bp, Mus musculus
gatgtaatcggctgtactcaggaga

SEQ ID NO: 668920 - DNA, 25 bp, Mus musculus
gatgtaatctacctgaactggctca

SEQ ID NO: 668921 - DNA, 25 bp, Mus musculus
gatgtaatctacgtgaactggctca

SEQ ID NO: 668922 - DNA, 25 bp, Mus musculus
gatgtacagatgctgcaagacgcca

SEQ ID NO: 668923 - DNA, 25 bp, Mus musculus
gatgtacagatggtgcaagacgcca

SEQ ID NO: 668924 - DNA, 25 bp, Mus musculus
gatgtacagcacaaattatgaccag

SEQ ID NO: 668925 - DNA, 25 bp, Mus musculus
gatgtacagcacatctctggagagt

SEQ ID NO: 668926 - DNA, 25 bp, Mus musculus
gatgtacagcactaattatgaccag

SEQ ID NO: 668927 - DNA, 25 bp, Mus musculus
gatgtacagcacttctctggagagt

SEQ ID NO: 668928 - DNA, 25 bp, Mus musculus
gatgtacagcagcagtatttatcaa

SEQ ID NO: 668929 - DNA, 25 bp, Mus musculus
gatgtacagcaggagtatttatcaa

SEQ ID NO: 668930 - DNA, 25 bp, Mus musculus
gatgtacaggaccagagctatcgcc

SEQ ID NO: 668931 - DNA, 25 bp, Mus musculus
gatgtacaggacgagagctatcgcc

SEQ ID NO: 668932 - DNA, 25 bp, Mus musculus
gatgtaccaccaatccaagatgata

SEQ ID NO: 668933 - DNA, 25 bp, Mus musculus
gatgtaccaccattccaagatgata

SEQ ID NO: 668934 - DNA, 25 bp, Mus musculus
gatgtaccagatctatgggggcccc

SEQ ID NO: 668935 - DNA, 25 bp, Mus musculus
gatgtaccagatgtatgggggcccc

SEQ ID NO: 668936 - DNA, 25 bp, Mus musculus
gatgtaccagctaaactccaagccc

SEQ ID NO: 668937 - DNA, 25 bp, Mus musculus
gatgtaccagcttaactccaagccc

SEQ ID NO: 668938 - DNA, 25 bp, Mus musculus
gatgtacccaagagtgcacagccct

SEQ ID NO: 668939 - DNA, 25 bp, Mus musculus
gatgtacccaagtgtgcacagccct

SEQ ID NO: 668940 - DNA, 25 bp, Mus musculus
gatgtaccccatagattttgagaag

SEQ ID NO: 668941 - DNA, 25 bp, Mus musculus
gatgtaccccattgattttgagaag

SEQ ID NO: 668942 - DNA, 25 bp, Mus musculus
gatgtaccctttcggtttcaaacag

SEQ ID NO: 668943 - DNA, 25 bp, Mus musculus
gatgtaccctttgggtttcaaacag

SEQ ID NO: 668944 - DNA, 25 bp, Mus musculus
gatgtaccgatccagtgtgaaatct

SEQ ID NO: 668945 - DNA, 25 bp, Mus musculus
gatgtaccgatcgagtgtgaaatct

SEQ ID NO: 668946 - DNA, 25 bp, Mus musculus
gatgtaccgcaaatagcacccagca

SEQ ID NO: 668947 - DNA, 25 bp, Mus musculus
gatgtaccgcaattagcacccagca

SEQ ID NO: 668948 - DNA, 25 bp, Mus musculus
gatgtacgacatcctcactggatcg

SEQ ID NO: 668949 - DNA, 25 bp, Mus musculus
gatgtacgacatgctcactggatcg

SEQ ID NO: 668950 - DNA, 25 bp, Mus musculus
gatgtacgcctaccatcgtggtgga

SEQ ID NO: 668951 - DNA, 25 bp, Mus musculus
gatgtacgcctagcatcgtggtgga

SEQ ID NO: 668952 - DNA, 25 bp, Mus musculus
gatgtacgtgaccaatgacacagag

SEQ ID NO: 668953 - DNA, 25 bp, Mus musculus
gatgtacgtgacgaatgacacagag

SEQ ID NO: 668954 - DNA, 25 bp, Mus musculus
gatgtactacaaccacactcgaagg

SEQ ID NO: 668955 - DNA, 25 bp, Mus musculus
gatgtactacaagcacactcgaagg

SEQ ID NO: 668956 - DNA, 25 bp, Mus musculus
gatgtactactcaggcgttgacccc

SEQ ID NO: 668957 - DNA, 25 bp, Mus musculus
gatgtactactctggcgttgacccc

SEQ ID NO: 668958 - DNA, 25 bp, Mus musculus
gatgtactctctacggggtcctcat

SEQ ID NO: 668959 - DNA, 25 bp, Mus musculus
gatgtactctcttcggggtcctcat

SEQ ID NO: 668960 - DNA, 25 bp, Mus musculus
gatgtactgagcaatctgataccta

SEQ ID NO: 668961 - DNA, 25 bp, Mus musculus
gatgtactgagctatctgataccta

SEQ ID NO: 668962 - DNA, 25 bp, Mus musculus
gatgtactgaggaagagtctccacc

SEQ ID NO: 668963 - DNA, 25 bp, Mus musculus
gatgtactgaggtagagtctccacc

SEQ ID NO: 668964 - DNA, 25 bp, Mus musculus
gatgtagaagacatgcctggtactg

SEQ ID NO: 668965 - DNA, 25 bp, Mus musculus
gatgtagaagacttgcctggtactg

SEQ ID NO: 668966 - DNA, 25 bp, Mus musculus
gatgtagaagcccaaacaatgtaca

SEQ ID NO: 668967 - DNA, 25 bp, Mus musculus
gatgtagaagccgaaacaatgtaca

SEQ ID NO: 668968 - DNA, 25 bp, Mus musculus
gatgtagacaaacagttctacttgt

SEQ ID NO: 668969 - DNA, 25 bp, Mus musculus
gatgtagacaaagagttctacttgt

SEQ ID NO: 668970 - DNA, 25 bp, Mus musculus
gatgtagacaccaaagaccattatt

SEQ ID NO: 668971 - DNA, 25 bp, Mus musculus
gatgtagacacctaagaccattatt

SEQ ID NO: 668972 - DNA, 25 bp, Mus musculus
gatgtagaccagagctgtcaagccc

SEQ ID NO: 668973 - DNA, 25 bp, Mus musculus
gatgtagaccagtgctgtcaagccc

SEQ ID NO: 668974 - DNA, 25 bp, Mus musculus
gatgtagaccgcacccttgaggaat

SEQ ID NO: 668975 - DNA, 25 bp, Mus musculus
gatgtagaccgctcccttgaggaat

SEQ ID NO: 668976 - DNA, 25 bp, Mus musculus
gatgtagacctgcacaagtaccacc

SEQ ID NO: 668977 - DNA, 25 bp, Mus musculus
gatgtagacctggacaagtaccacc

SEQ ID NO: 668978 - DNA, 25 bp, Mus musculus
gatgtagatacacatcccgcatgtg

SEQ ID NO: 668979 - DNA, 25 bp, Mus musculus
gatgtagatacagatcccgcatgtg

SEQ ID NO: 668980 - DNA, 25 bp, Mus musculus
gatgtagatatcagccacctcggtg

SEQ ID NO: 668981 - DNA, 25 bp, Mus musculus
gatgtagatatctgccacctcggtg

SEQ ID NO: 668982 - DNA, 25 bp, Mus musculus
gatgtagcaaagaggtcagagttct

SEQ ID NO: 668983 - DNA, 25 bp, Mus musculus
gatgtagcaaagtggtcagagttct

SEQ ID NO: 668984 - DNA, 25 bp, Mus musculus
gatgtagcatgtcacctggactcct

SEQ ID NO: 668985 - DNA, 25 bp, Mus musculus
gatgtagcatgtgacctggactcct

SEQ ID NO: 668986 - DNA, 25 bp, Mus musculus
gatgtaggaacactgcagagactgc

SEQ ID NO: 668987 - DNA, 25 bp, Mus musculus
gatgtaggaacagtgcagagactgc

SEQ ID NO: 668988 - DNA, 25 bp, Mus musculus
gatgtagtaaaccagtcaagtccaa

SEQ ID NO: 668989 - DNA, 25 bp, Mus musculus
gatgtagtaaacgagtcaagtccaa

SEQ ID NO: 668990 - DNA, 25 bp, Mus musculus
gatgtagtaacacagacgaaaattg

SEQ ID NO: 668991 - DNA, 25 bp, Mus musculus
gatgtagtaacagagacgaaaattg

SEQ ID NO: 668992 - DNA, 25 bp, Mus musculus
gatgtagtacaaatgctagtgcaag

SEQ ID NO: 668993 - DNA, 25 bp, Mus musculus
gatgtagtacaattgctagtgcaag

SEQ ID NO: 668994 - DNA, 25 bp, Mus musculus
gatgtagtcactcgatctcagagcg

SEQ ID NO: 668995 - DNA, 25 bp, Mus musculus
gatgtagtcactggatctcagagcg

SEQ ID NO: 668996 - DNA, 25 bp, Mus musculus
gatgtagtggccatcattctgcgcc

SEQ ID NO: 668997 - DNA, 25 bp, Mus musculus
gatgtagtggccttcattctgcgcc

SEQ ID NO: 668998 - DNA, 25 bp, Mus musculus
gatgtataccgacgcccagccatca

SEQ ID NO: 668999 - DNA, 25 bp, Mus musculus
gatgtataccgaggcccagccatca

SEQ ID NO: 669000 - DNA, 25 bp, Mus musculus
gatgtatagtccatgaatgccaggt

SEQ ID NO: 669001 - DNA, 25 bp, Mus musculus
gatgtatagtccttgaatgccaggt

SEQ ID NO: 669002 - DNA, 25 bp, Mus musculus
gatgtatccgtgatctacagggaca

SEQ ID NO: 669003 - DNA, 25 bp, Mus musculus
gatgtatccgtgttctacagggaca

SEQ ID NO: 669004 - DNA, 25 bp, Mus musculus
gatgtatcgcttctctccatccagg

SEQ ID NO: 669005 - DNA, 25 bp, Mus musculus
gatgtatcgcttgtctccatccagg

SEQ ID NO: 669006 - DNA, 25 bp, Mus musculus
gatgtatctcaacttacctctccgt

SEQ ID NO: 669007 - DNA, 25 bp, Mus musculus
gatgtatctcaagttacctctccgt

SEQ ID NO: 669008 - DNA, 25 bp, Mus musculus
gatgtatctgagaaccccggttgtt

SEQ ID NO: 669009 - DNA, 25 bp, Mus musculus
gatgtatctgagtaccccggttgtt

SEQ ID NO: 669010 - DNA, 25 bp, Mus musculus
gatgtatgatgcagtgcacgttgtg

SEQ ID NO: 669011 - DNA, 25 bp, Mus musculus
gatgtatgatgctgtgcacgttgtg

SEQ ID NO: 669012 - DNA, 25 bp, Mus musculus
gatgtatgcccaaaactcaaggctt

SEQ ID NO: 669013 - DNA, 25 bp, Mus musculus
gatgtatgcccataactcaaggctt

SEQ ID NO: 669014 - DNA, 25 bp, Mus musculus
gatgtatgccgcatatgggaagcct

SEQ ID NO: 669015 - DNA, 25 bp, Mus musculus
gatgtatgccgcttatgggaagcct

SEQ ID NO: 669016 - DNA, 25 bp, Mus musculus
gatgtatggcacatcttaaagggcc

SEQ ID NO: 669017 - DNA, 25 bp, Mus musculus
gatgtatggcacttcttaaagggcc

SEQ ID NO: 669018 - DNA, 25 bp, Mus musculus
gatgtatgggctaactaatgaccac

SEQ ID NO: 669019 - DNA, 25 bp, Mus musculus
gatgtatgggcttactaatgaccac

SEQ ID NO: 669020 - DNA, 25 bp, Mus musculus
gatgtattcacgcaggagaagttcc

SEQ ID NO: 669021 - DNA, 25 bp, Mus musculus
gatgtattcacggaggagaagttcc

SEQ ID NO: 669022 - DNA, 25 bp, Mus musculus
gatgtattcatgacaccagctcagc

SEQ ID NO: 669023 - DNA, 25 bp, Mus musculus
gatgtattcatgtcaccagctcagc

SEQ ID NO: 669024 - DNA, 25 bp, Mus musculus
gatgtattgtcgcttataccgcagt

SEQ ID NO: 669025 - DNA, 25 bp, Mus musculus
gatgtattgtcggttataccgcagt

SEQ ID NO: 669026 - DNA, 25 bp, Mus musculus
gatgtattttatcctgtgaccccac

SEQ ID NO: 669027 - DNA, 25 bp, Mus musculus
gatgtattttatgctgtgaccccac

SEQ ID NO: 669028 - DNA, 25 bp, Mus musculus
gatgtattttgtagctccggcggaa

SEQ ID NO: 669029 - DNA, 25 bp, Mus musculus
gatgtattttgttgctccggcggaa

SEQ ID NO: 669030 - DNA, 25 bp, Mus musculus
gatgtcaaacgtcagcttcaggagt

SEQ ID NO: 669031 - DNA, 25 bp, Mus musculus
gatgtcaaacgtgagcttcaggagt

SEQ ID NO: 669032 - DNA, 25 bp, Mus musculus
gatgtcaaagacagcatgccatgga

SEQ ID NO: 669033 - DNA, 25 bp, Mus musculus
gatgtcaaagactgcatgccatgga

SEQ ID NO: 669034 - DNA, 25 bp, Mus musculus
gatgtcaaccagctgcagttcccac

SEQ ID NO: 669035 - DNA, 25 bp, Mus musculus
gatgtcaaccaggtgcagttcccac

SEQ ID NO: 669036 - DNA, 25 bp, Mus musculus
gatgtcaaccggcaaagcacaaggc

SEQ ID NO: 669037 - DNA, 25 bp, Mus musculus
gatgtcaaccgggaaagcacaaggc

SEQ ID NO: 669038 - DNA, 25 bp, Mus musculus
gatgtcaagcacatcattgataagc

SEQ ID NO: 669039 - DNA, 25 bp, Mus musculus
gatgtcaagcacttcattgataagc

SEQ ID NO: 669040 - DNA, 25 bp, Mus musculus
gatgtcaagccacctgaaatgtagg

SEQ ID NO: 669041 - DNA, 25 bp, Mus musculus
gatgtcaagccagctgaaatgtagg

SEQ ID NO: 669042 - DNA, 25 bp, Mus musculus
gatgtcaaggaaacgggcaatcccg

SEQ ID NO: 669043 - DNA, 25 bp, Mus musculus
gatgtcaaggaacagattgataaga

SEQ ID NO: 669044 - DNA, 25 bp, Mus musculus
gatgtcaaggaagagattgataaga

SEQ ID NO: 669045 - DNA, 25 bp, Mus musculus
gatgtcaaggaatcgggcaatcccg

SEQ ID NO: 669046 - DNA, 25 bp, Mus musculus
gatgtcaagggtaccaagtcctcca

SEQ ID NO: 669047 - DNA, 25 bp, Mus musculus
gatgtcaagggttccaagtcctcca

SEQ ID NO: 669048 - DNA, 25 bp, Mus musculus
gatgtcaagtccaaactgagcaaca

SEQ ID NO: 669049 - DNA, 25 bp, Mus musculus
gatgtcaagtcctaactgagcaaca

SEQ ID NO: 669050 - DNA, 25 bp, Mus musculus
gatgtcaatgaacctatccagtgga

SEQ ID NO: 669051 - DNA, 25 bp, Mus musculus
gatgtcaatgaagctatccagtgga

SEQ ID NO: 669052 - DNA, 25 bp, Mus musculus
gatgtcaatgcaagacacaaacttg

SEQ ID NO: 669053 - DNA, 25 bp, Mus musculus
gatgtcaatgcatgacacaaacttg

SEQ ID NO: 669054 - DNA, 25 bp, Mus musculus
gatgtcacacacaatgacacagagg

SEQ ID NO: 669055 - DNA, 25 bp, Mus musculus
gatgtcacacactatgacacagagg

SEQ ID NO: 669056 - DNA, 25 bp, Mus musculus
gatgtcacacctcaacacagacagg

SEQ ID NO: 669057 - DNA, 25 bp, Mus musculus
gatgtcacacctgaacacagacagg

SEQ ID NO: 669058 - DNA, 25 bp, Mus musculus
gatgtcacaggcctgaaccaatccc

SEQ ID NO: 669059 - DNA, 25 bp, Mus musculus
gatgtcacaggcgtgaaccaatccc

SEQ ID NO: 669060 - DNA, 25 bp, Mus musculus
gatgtcaccaagacagagagtattg

SEQ ID NO: 669061 - DNA, 25 bp, Mus musculus
gatgtcaccaagtcagagagtattg

SEQ ID NO: 669062 - DNA, 25 bp, Mus musculus
gatgtcaccaatacaggaaaacgag

SEQ ID NO: 669063 - DNA, 25 bp, Mus musculus
gatgtcaccaattcaggaaaacgag

SEQ ID NO: 669064 - DNA, 25 bp, Mus musculus
gatgtcaccacaagaagtattgcag

SEQ ID NO: 669065 - DNA, 25 bp, Mus musculus
gatgtcaccacatgaagtattgcag

SEQ ID NO: 669066 - DNA, 25 bp, Mus musculus
gatgtcacggcactcttcaaaccac

SEQ ID NO: 669067 - DNA, 25 bp, Mus musculus
gatgtcacggcagtcttcaaaccac

SEQ ID NO: 669068 - DNA, 25 bp, Mus musculus
gatgtcacgggcagtcctttcaaag

SEQ ID NO: 669069 - DNA, 25 bp, Mus musculus
gatgtcacgggctgtcctttcaaag

SEQ ID NO: 669070 - DNA, 25 bp, Mus musculus
gatgtcactcaacagcagctgggtg

SEQ ID NO: 669071 - DNA, 25 bp, Mus musculus
gatgtcactcaagagcagctgggtg

SEQ ID NO: 669072 - DNA, 25 bp, Mus musculus
gatgtcactgaacacttctctgaaa

SEQ ID NO: 669073 - DNA, 25 bp, Mus musculus
gatgtcactgaagacttctctgaaa

SEQ ID NO: 669074 - DNA, 25 bp, Mus musculus
gatgtcactggcatctcgggctcct

SEQ ID NO: 669075 - DNA, 25 bp, Mus musculus
gatgtcactggcttctcgggctcct

SEQ ID NO: 669076 - DNA, 25 bp, Mus musculus
gatgtcagaacaccaaaactcacta

SEQ ID NO: 669077 - DNA, 25 bp, Mus musculus
gatgtcagaacagcaaaactcacta

SEQ ID NO: 669078 - DNA, 25 bp, Mus musculus
gatgtcagaaccatgtacgatggct

SEQ ID NO: 669079 - DNA, 25 bp, Mus musculus
gatgtcagaaccttgtacgatggct

SEQ ID NO: 669080 - DNA, 25 bp, Mus musculus
gatgtcagacatcattcagcgcttg

SEQ ID NO: 669081 - DNA, 25 bp, Mus musculus
gatgtcagacatgattcagcgcttg

SEQ ID NO: 669082 - DNA, 25 bp, Mus musculus
gatgtcagatttctcagcaacttgt

SEQ ID NO: 669083 - DNA, 25 bp, Mus musculus
gatgtcagatttgtcagcaacttgt

SEQ ID NO: 669084 - DNA, 25 bp, Mus musculus
gatgtcagcaacctcaacaggcagt

SEQ ID NO: 669085 - DNA, 25 bp, Mus musculus
gatgtcagcaacgtcaacaggcagt

SEQ ID NO: 669086 - DNA, 25 bp, Mus musculus
gatgtcagcaggcattttgtggcca

SEQ ID NO: 669087 - DNA, 25 bp, Mus musculus
gatgtcagcagggattttgtggcca

SEQ ID NO: 669088 - DNA, 25 bp, Mus musculus
gatgtcagcccaaggagatcaaagt

SEQ ID NO: 669089 - DNA, 25 bp, Mus musculus
gatgtcagcccatggagatcaaagt

SEQ ID NO: 669090 - DNA, 25 bp, Mus musculus
gatgtcagccttcggtgttgttcca

SEQ ID NO: 669091 - DNA, 25 bp, Mus musculus
gatgtcagccttgggtgttgttcca

SEQ ID NO: 669092 - DNA, 25 bp, Mus musculus
gatgtcagtggacagctcaactcca

SEQ ID NO: 669093 - DNA, 25 bp, Mus musculus
gatgtcagtggagagctcaactcca

SEQ ID NO: 669094 - DNA, 25 bp, Mus musculus
gatgtcatcacgcagccagttagaa

SEQ ID NO: 669095 - DNA, 25 bp, Mus musculus
gatgtcatcacggagccagttagaa

SEQ ID NO: 669096 - DNA, 25 bp, Mus musculus
gatgtcatcagcaccatcgggcagg

SEQ ID NO: 669097 - DNA, 25 bp, Mus musculus
gatgtcatcagctccatcgggcagg

SEQ ID NO: 669098 - DNA, 25 bp, Mus musculus
gatgtcatcatgcacttcactgtta

SEQ ID NO: 669099 - DNA, 25 bp, Mus musculus
gatgtcatcatggacttcactgtta

SEQ ID NO: 669100 - DNA, 25 bp, Mus musculus
gatgtcatcccacagggcgccatta

SEQ ID NO: 669101 - DNA, 25 bp, Mus musculus
gatgtcatcccagagggcgccatta

SEQ ID NO: 669102 - DNA, 25 bp, Mus musculus
gatgtcatccctcgaaaagccaaca

SEQ ID NO: 669103 - DNA, 25 bp, Mus musculus
gatgtcatccctggaaaagccaaca

SEQ ID NO: 669104 - DNA, 25 bp, Mus musculus
gatgtcatcggcaacattttccgag

SEQ ID NO: 669105 - DNA, 25 bp, Mus musculus
gatgtcatcggctacattttccgag

SEQ ID NO: 669106 - DNA, 25 bp, Mus musculus
gatgtcatcgttctgggccggacca

SEQ ID NO: 669107 - DNA, 25 bp, Mus musculus
gatgtcatcgttgtgggccggacca

SEQ ID NO: 669108 - DNA, 25 bp, Mus musculus
gatgtcatctacctccatcgaattg

SEQ ID NO: 669109 - DNA, 25 bp, Mus musculus
gatgtcatctacgtccatcgaattg

SEQ ID NO: 669110 - DNA, 25 bp, Mus musculus
gatgtcatctttaagtgcaatagtg

SEQ ID NO: 669111 - DNA, 25 bp, Mus musculus
gatgtcatcttttagtgcaatagtg

SEQ ID NO: 669112 - DNA, 25 bp, Mus musculus
gatgtcatgcagacagttgcaagca

SEQ ID NO: 669113 - DNA, 25 bp, Mus musculus
gatgtcatgcagtcagttgcaagca

SEQ ID NO: 669114 - DNA, 25 bp, Mus musculus
gatgtcatgtaccttcagctacttg

SEQ ID NO: 669115 - DNA, 25 bp, Mus musculus
gatgtcatgtacgttcagctacttg

SEQ ID NO: 669116 - DNA, 25 bp, Mus musculus
gatgtcattatgagcatccgtgtgc

SEQ ID NO: 669117 - DNA, 25 bp, Mus musculus
gatgtcattatgtgcatccgtgtgc

SEQ ID NO: 669118 - DNA, 25 bp, Mus musculus
gatgtcattcataatcggaaaacgg

SEQ ID NO: 669119 - DNA, 25 bp, Mus musculus
gatgtcattcattatcggaaaacgg

SEQ ID NO: 669120 - DNA, 25 bp, Mus musculus
gatgtccaacgcattgccttcagga

SEQ ID NO: 669121 - DNA, 25 bp, Mus musculus
gatgtccaacgctttgccttcagga

SEQ ID NO: 669122 - DNA, 25 bp, Mus musculus
gatgtccaacttcatgaatcaagca

SEQ ID NO: 669123 - DNA, 25 bp, Mus musculus
gatgtccaacttgatgaatcaagca

SEQ ID NO: 669124 - DNA, 25 bp, Mus musculus
gatgtccaagaacaagccatagaag

SEQ ID NO: 669125 - DNA, 25 bp, Mus musculus
gatgtccaagaagaagccatagaag

SEQ ID NO: 669126 - DNA, 25 bp, Mus musculus
gatgtccacggaagagattgtccag

SEQ ID NO: 669127 - DNA, 25 bp, Mus musculus
gatgtccacggatgagattgtccag

SEQ ID NO: 669128 - DNA, 25 bp, Mus musculus
gatgtccactctccaagctttatct

SEQ ID NO: 669129 - DNA, 25 bp, Mus musculus
gatgtccactctgcaagctttatct

SEQ ID NO: 669130 - DNA, 25 bp, Mus musculus
gatgtccagcccagtagggaggcca

SEQ ID NO: 669131 - DNA, 25 bp, Mus musculus
gatgtccagccctgtagggaggcca

SEQ ID NO: 669132 - DNA, 25 bp, Mus musculus
gatgtccaggcaactcgtgactacc

SEQ ID NO: 669133 - DNA, 25 bp, Mus musculus
gatgtccaggcatctcgtgactacc

SEQ ID NO: 669134 - DNA, 25 bp, Mus musculus
gatgtccagggacctctggctgtac

SEQ ID NO: 669135 - DNA, 25 bp, Mus musculus
gatgtccagggagctctggctgtac

SEQ ID NO: 669136 - DNA, 25 bp, Mus musculus
gatgtccagtctaacttagcggtga

SEQ ID NO: 669137 - DNA, 25 bp, Mus musculus
gatgtccagtcttacttagcggtga

SEQ ID NO: 669138 - DNA, 25 bp, Mus musculus
gatgtccattctactatgggaagga

SEQ ID NO: 669139 - DNA, 25 bp, Mus musculus
gatgtccattcttctatgggaagga

SEQ ID NO: 669140 - DNA, 25 bp, Mus musculus
gatgtcccaccaacccttgcagtgg

SEQ ID NO: 669141 - DNA, 25 bp, Mus musculus
gatgtcccaccatcccttgcagtgg

SEQ ID NO: 669142 - DNA, 25 bp, Mus musculus
gatgtccccgtaactaagcaaaggc

SEQ ID NO: 669143 - DNA, 25 bp, Mus musculus
gatgtccccgtatctaagcaaaggc

SEQ ID NO: 669144 - DNA, 25 bp, Mus musculus
gatgtccccgtgattgccatgtgcg

SEQ ID NO: 669145 - DNA, 25 bp, Mus musculus
gatgtccccgtgtttgccatgtgcg

SEQ ID NO: 669146 - DNA, 25 bp, Mus musculus
gatgtcccctgacccttgggtgcaa

SEQ ID NO: 669147 - DNA, 25 bp, Mus musculus
gatgtcccctgagccttgggtgcaa

SEQ ID NO: 669148 - DNA, 25 bp, Mus musculus
gatgtccctctaattcctgtcttgt

SEQ ID NO: 669149 - DNA, 25 bp, Mus musculus
gatgtccctctatttcctgtcttgt

SEQ ID NO: 669150 - DNA, 25 bp, Mus musculus
gatgtccctgagaccaactacctct

SEQ ID NO: 669151 - DNA, 25 bp, Mus musculus
gatgtccctgagtccaactacctct

SEQ ID NO: 669152 - DNA, 25 bp, Mus musculus
gatgtccctgctcttttctcgatgc

SEQ ID NO: 669153 - DNA, 25 bp, Mus musculus
gatgtccctgctgttttctcgatgc

SEQ ID NO: 669154 - DNA, 25 bp, Mus musculus
gatgtcccttacaccgcagctctta

SEQ ID NO: 669155 - DNA, 25 bp, Mus musculus
gatgtcccttactccgcagctctta

SEQ ID NO: 669156 - DNA, 25 bp, Mus musculus
gatgtccgcctgcagctttcgcctt

SEQ ID NO: 669157 - DNA, 25 bp, Mus musculus
gatgtccgcctggagctttcgcctt

SEQ ID NO: 669158 - DNA, 25 bp, Mus musculus
gatgtccggcgcatttacaaaagga

SEQ ID NO: 669159 - DNA, 25 bp, Mus musculus
gatgtccggcgcttttacaaaagga

SEQ ID NO: 669160 - DNA, 25 bp, Mus musculus
gatgtccgtcataagctcttcttct

SEQ ID NO: 669161 - DNA, 25 bp, Mus musculus
gatgtccgtcattagctcttcttct

SEQ ID NO: 669162 - DNA, 25 bp, Mus musculus
gatgtcctacggattgaacatcgag

SEQ ID NO: 669163 - DNA, 25 bp, Mus musculus
gatgtcctacggtttgaacatcgag

SEQ ID NO: 669164 - DNA, 25 bp, Mus musculus
gatgtcctatcaacaaaacctgtcc

SEQ ID NO: 669165 - DNA, 25 bp, Mus musculus
gatgtcctatcatcaaaacctgtcc

SEQ ID NO: 669166 - DNA, 25 bp, Mus musculus
gatgtcctcaatctccgctggcgcc

SEQ ID NO: 669167 - DNA, 25 bp, Mus musculus
gatgtcctcaatgtccgctggcgcc

SEQ ID NO: 669168 - DNA, 25 bp, Mus musculus
gatgtcctcaccagcacgtacggcg

SEQ ID NO: 669169 - DNA, 25 bp, Mus musculus
gatgtcctcacctgcacgtacggcg

SEQ ID NO: 669170 - DNA, 25 bp, Mus musculus
gatgtcctcagaaagcaagtagaaa

SEQ ID NO: 669171 - DNA, 25 bp, Mus musculus
gatgtcctcagatagcaagtagaaa

SEQ ID NO: 669172 - DNA, 25 bp, Mus musculus
gatgtcctcagtctggcctctgtgc

SEQ ID NO: 669173 - DNA, 25 bp, Mus musculus
gatgtcctcagtgtggcctctgtgc

SEQ ID NO: 669174 - DNA, 25 bp, Mus musculus
gatgtcctcatcaccgcatcgacgg

SEQ ID NO: 669175 - DNA, 25 bp, Mus musculus
gatgtcctcatctccgcatcgacgg

SEQ ID NO: 669176 - DNA, 25 bp, Mus musculus
gatgtcctccaacctattgaccgtg

SEQ ID NO: 669177 - DNA, 25 bp, Mus musculus
gatgtcctccaagctattgaccgtg

SEQ ID NO: 669178 - DNA, 25 bp, Mus musculus
gatgtcctccctcaaactgaagaaa

SEQ ID NO: 669179 - DNA, 25 bp, Mus musculus
gatgtcctccctgaaactgaagaaa

SEQ ID NO: 669180 - DNA, 25 bp, Mus musculus
gatgtcctctgaagctccaatggta

SEQ ID NO: 669181 - DNA, 25 bp, Mus musculus
gatgtcctctgactaccgggaatat

SEQ ID NO: 669182 - DNA, 25 bp, Mus musculus
gatgtcctctgagtaccgggaatat

SEQ ID NO: 669183 - DNA, 25 bp, Mus musculus
gatgtcctctgatgctccaatggta

SEQ ID NO: 669184 - DNA, 25 bp, Mus musculus
gatgtcctggcacgatttgcccaag

SEQ ID NO: 669185 - DNA, 25 bp, Mus musculus
gatgtcctggcaggatttgcccaag

SEQ ID NO: 669186 - DNA, 25 bp, Mus musculus
gatgtcctgtttaatccgccaaagc

SEQ ID NO: 669187 - DNA, 25 bp, Mus musculus
gatgtcctgttttatccgccaaagc

SEQ ID NO: 669188 - DNA, 25 bp, Mus musculus
gatgtccttccaccggtgtgctcga

SEQ ID NO: 669189 - DNA, 25 bp, Mus musculus
gatgtccttccagcggtgtgctcga

SEQ ID NO: 669190 - DNA, 25 bp, Mus musculus
gatgtccttctgagagaacgctagc

SEQ ID NO: 669191 - DNA, 25 bp, Mus musculus
gatgtccttctgtgagaacgctagc

SEQ ID NO: 669192 - DNA, 25 bp, Mus musculus
gatgtcctttctatcgattcaacca

SEQ ID NO: 669193 - DNA, 25 bp, Mus musculus
gatgtcctttctttcgattcaacca

SEQ ID NO: 669194 - DNA, 25 bp, Mus musculus
gatgtcgaatccaagagccatgcag

SEQ ID NO: 669195 - DNA, 25 bp, Mus musculus
gatgtcgaatcctagagccatgcag

SEQ ID NO: 669196 - DNA, 25 bp, Mus musculus
gatgtcgactgtcttgacggctccg

SEQ ID NO: 669197 - DNA, 25 bp, Mus musculus
gatgtcgactgtgttgacggctccg

SEQ ID NO: 669198 - DNA, 25 bp, Mus musculus
gatgtcgatgcaaattcaaccaaca

SEQ ID NO: 669199 - DNA, 25 bp, Mus musculus
gatgtcgatgcatattcaaccaaca

SEQ ID NO: 669200 - DNA, 25 bp, Mus musculus
gatgtcgcaaccacagagaaagagc

SEQ ID NO: 669201 - DNA, 25 bp, Mus musculus
gatgtcgcaacctcagagaaagagc

SEQ ID NO: 669202 - DNA, 25 bp, Mus musculus
gatgtcgccaccatccttcgctggg

SEQ ID NO: 669203 - DNA, 25 bp, Mus musculus
gatgtcgccaccttccttcgctggg

SEQ ID NO: 669204 - DNA, 25 bp, Mus musculus
gatgtcgccgtaatgttcctggcca

SEQ ID NO: 669205 - DNA, 25 bp, Mus musculus
gatgtcgccgtattgttcctggcca

SEQ ID NO: 669206 - DNA, 25 bp, Mus musculus
gatgtcgcctgcaaatgtcacggag

SEQ ID NO: 669207 - DNA, 25 bp, Mus musculus
gatgtcgcctgctaatgtcacggag

SEQ ID NO: 669208 - DNA, 25 bp, Mus musculus
gatgtcggactgacaggcacagcca

SEQ ID NO: 669209 - DNA, 25 bp, Mus musculus
gatgtcggactgtcaggcacagcca

SEQ ID NO: 669210 - DNA, 25 bp, Mus musculus
gatgtcgtggtcaccctctattatt

SEQ ID NO: 669211 - DNA, 25 bp, Mus musculus
gatgtcgtggtctccctctattatt

SEQ ID NO: 669212 - DNA, 25 bp, Mus musculus
gatgtctacaatcctcagagcaaga

SEQ ID NO: 669213 - DNA, 25 bp, Mus musculus
gatgtctacaatgctcagagcaaga

SEQ ID NO: 669214 - DNA, 25 bp, Mus musculus
gatgtctatagtaacctcagtcacc

SEQ ID NO: 669215 - DNA, 25 bp, Mus musculus
gatgtctatagttacctcagtcacc

SEQ ID NO: 669216 - DNA, 25 bp, Mus musculus
gatgtctatgatcatgtggctgagc

SEQ ID NO: 669217 - DNA, 25 bp, Mus musculus
gatgtctatgatgatgtggctgagc

SEQ ID NO: 669218 - DNA, 25 bp, Mus musculus
gatgtctatgctactgcctttcaag

SEQ ID NO: 669219 - DNA, 25 bp, Mus musculus
gatgtctatgctatccggagtgcgg

SEQ ID NO: 669220 - DNA, 25 bp, Mus musculus
gatgtctatgcttctgcctttcaag

SEQ ID NO: 669221 - DNA, 25 bp, Mus musculus
gatgtctatgctttccggagtgcgg

SEQ ID NO: 669222 - DNA, 25 bp, Mus musculus
gatgtctcagcaagagtgtggcccc

SEQ ID NO: 669223 - DNA, 25 bp, Mus musculus
gatgtctcagcatgagtgtggcccc

SEQ ID NO: 669224 - DNA, 25 bp, Mus musculus
gatgtctcctgaattcattccgtcg

SEQ ID NO: 669225 - DNA, 25 bp, Mus musculus
gatgtctcctgatttcattccgtcg

SEQ ID NO: 669226 - DNA, 25 bp, Mus musculus
gatgtctccttaacgcgggtcaggg

SEQ ID NO: 669227 - DNA, 25 bp, Mus musculus
gatgtctccttatcgcgggtcaggg

SEQ ID NO: 669228 - DNA, 25 bp, Mus musculus
gatgtctccttgaacaggtttatcc

SEQ ID NO: 669229 - DNA, 25 bp, Mus musculus
gatgtctccttgaacatcgagagtg

SEQ ID NO: 669230 - DNA, 25 bp, Mus musculus
gatgtctccttgtacaggtttatcc

SEQ ID NO: 669231 - DNA, 25 bp, Mus musculus
gatgtctccttgtacatcgagagtg

SEQ ID NO: 669232 - DNA, 25 bp, Mus musculus
gatgtctctccaatcaatgtcgtgg

SEQ ID NO: 669233 - DNA, 25 bp, Mus musculus
gatgtctctccattcaatgtcgtgg

SEQ ID NO: 669234 - DNA, 25 bp, Mus musculus
gatgtctctcttctgagcactgcag

SEQ ID NO: 669235 - DNA, 25 bp, Mus musculus
gatgtctctcttgtgagcactgcag

SEQ ID NO: 669236 - DNA, 25 bp, Mus musculus
gatgtctctgagattcaacagagct

SEQ ID NO: 669237 - DNA, 25 bp, Mus musculus
gatgtctctgagtttcaacagagct

SEQ ID NO: 669238 - DNA, 25 bp, Mus musculus
gatgtctcttacaacaggaagcata

SEQ ID NO: 669239 - DNA, 25 bp, Mus musculus
gatgtctcttactacaggaagcata

SEQ ID NO: 669240 - DNA, 25 bp, Mus musculus
gatgtctgacagagaaatggatgga

SEQ ID NO: 669241 - DNA, 25 bp, Mus musculus
gatgtctgacagtgaaatggatgga

SEQ ID NO: 669242 - DNA, 25 bp, Mus musculus
gatgtctgcaaaaaattcccctcca

SEQ ID NO: 669243 - DNA, 25 bp, Mus musculus
gatgtctgcaaataattcccctcca

SEQ ID NO: 669244 - DNA, 25 bp, Mus musculus
gatgtctgcagtattctcttgggta

SEQ ID NO: 669245 - DNA, 25 bp, Mus musculus
gatgtctgcagttttctcttgggta

SEQ ID NO: 669246 - DNA, 25 bp, Mus musculus
gatgtctgcctcaccgcttactact

SEQ ID NO: 669247 - DNA, 25 bp, Mus musculus
gatgtctgcctctccgcttactact

SEQ ID NO: 669248 - DNA, 25 bp, Mus musculus
gatgtctgcttgaacttcttgccca

SEQ ID NO: 669249 - DNA, 25 bp, Mus musculus
gatgtctgcttgtacttcttgccca

SEQ ID NO: 669250 - DNA, 25 bp, Mus musculus
gatgtctgggctacgctacccgtac

SEQ ID NO: 669251 - DNA, 25 bp, Mus musculus
gatgtctgggcttcgctacccgtac

SEQ ID NO: 669252 - DNA, 25 bp, Mus musculus
gatgtctgttatccagacgtacaga

SEQ ID NO: 669253 - DNA, 25 bp, Mus musculus
gatgtctgttatgcagacgtacaga

SEQ ID NO: 669254 - DNA, 25 bp, Mus musculus
gatgtcttaggcaacttaaaccatg

SEQ ID NO: 669255 - DNA, 25 bp, Mus musculus
gatgtcttaggctacttaaaccatg

SEQ ID NO: 669256 - DNA, 25 bp, Mus musculus
gatgtcttcaatagcaaacaactta

SEQ ID NO: 669257 - DNA, 25 bp, Mus musculus
gatgtcttcaattgcaaacaactta

SEQ ID NO: 669258 - DNA, 25 bp, Mus musculus
gatgtcttcacaccgcatctcaaca

SEQ ID NO: 669259 - DNA, 25 bp, Mus musculus
gatgtcttcacagcgcatctcaaca

SEQ ID NO: 669260 - DNA, 25 bp, Mus musculus
gatgtcttccgaacaactaggagga

SEQ ID NO: 669261 - DNA, 25 bp, Mus musculus
gatgtcttccgatcaactaggagga

SEQ ID NO: 669262 - DNA, 25 bp, Mus musculus
gatgtcttgaagaaagcgcggacta

SEQ ID NO: 669263 - DNA, 25 bp, Mus musculus
gatgtcttgaagtaagcgcggacta

SEQ ID NO: 669264 - DNA, 25 bp, Mus musculus
gatgtcttgagtctaccctgggcag

SEQ ID NO: 669265 - DNA, 25 bp, Mus musculus
gatgtcttgagtgtaccctgggcag

SEQ ID NO: 669266 - DNA, 25 bp, Mus musculus
gatgtcttggagagtgaatgatcac

SEQ ID NO: 669267 - DNA, 25 bp, Mus musculus
gatgtcttggagtgtgaatgatcac

SEQ ID NO: 669268 - DNA, 25 bp, Mus musculus
gatgtcttgtcaatgccctgtgtca

SEQ ID NO: 669269 - DNA, 25 bp, Mus musculus
gatgtcttgtcattgccctgtgtca

SEQ ID NO: 669270 - DNA, 25 bp, Mus musculus
gatgtctttctgatcagaacaggtg

SEQ ID NO: 669271 - DNA, 25 bp, Mus musculus
gatgtctttctgttcagaacaggtg

SEQ ID NO: 669272 - DNA, 25 bp, Mus musculus
gatgtgaaatgaactttcattgaaa

SEQ ID NO: 669273 - DNA, 25 bp, Mus musculus
gatgtgaaatgatctttcattgaaa

SEQ ID NO: 669274 - DNA, 25 bp, Mus musculus
gatgtgaacagcacccttctctggg

SEQ ID NO: 669275 - DNA, 25 bp, Mus musculus
gatgtgaacagctcccttctctggg

SEQ ID NO: 669276 - DNA, 25 bp, Mus musculus
gatgtgaaccgcatgtctccgggag

SEQ ID NO: 669277 - DNA, 25 bp, Mus musculus
gatgtgaaccgcttgtctccgggag

SEQ ID NO: 669278 - DNA, 25 bp, Mus musculus
gatgtgaacgacaatactctcttca

SEQ ID NO: 669279 - DNA, 25 bp, Mus musculus
gatgtgaacgactatactctcttca

SEQ ID NO: 669280 - DNA, 25 bp, Mus musculus
gatgtgaacgggaaaccccattaca

SEQ ID NO: 669281 - DNA, 25 bp, Mus musculus
gatgtgaacgggtaaccccattaca

SEQ ID NO: 669282 - DNA, 25 bp, Mus musculus
gatgtgaagaaaaggatcgaaaact

SEQ ID NO: 669283 - DNA, 25 bp, Mus musculus
gatgtgaagaaatggatcgaaaact

SEQ ID NO: 669284 - DNA, 25 bp, Mus musculus
gatgtgaagagaatagctgaacttt

SEQ ID NO: 669285 - DNA, 25 bp, Mus musculus
gatgtgaagagattagctgaacttt

SEQ ID NO: 669286 - DNA, 25 bp, Mus musculus
gatgtgaagattactgatgctatca

SEQ ID NO: 669287 - DNA, 25 bp, Mus musculus
gatgtgaagatttctgatgctatca

SEQ ID NO: 669288 - DNA, 25 bp, Mus musculus
gatgtgaagcagatctatgaccagg

SEQ ID NO: 669289 - DNA, 25 bp, Mus musculus
gatgtgaagcagttctatgaccagg

SEQ ID NO: 669290 - DNA, 25 bp, Mus musculus
gatgtgaaggatctacagatgctgc

SEQ ID NO: 669291 - DNA, 25 bp, Mus musculus
gatgtgaaggatgtacagatgctgc

SEQ ID NO: 669292 - DNA, 25 bp, Mus musculus
gatgtgaagttcatggcagacacca

SEQ ID NO: 669293 - DNA, 25 bp, Mus musculus
gatgtgaagttcttggcagacacca

SEQ ID NO: 669294 - DNA, 25 bp, Mus musculus
gatgtgaatatcactgcctgccagc

SEQ ID NO: 669295 - DNA, 25 bp, Mus musculus
gatgtgaatatctctgcctgccagc

SEQ ID NO: 669296 - DNA, 25 bp, Mus musculus
gatgtgacagaacctctcatcctcc

SEQ ID NO: 669297 - DNA, 25 bp, Mus musculus
gatgtgacagaagctctcatcctcc

SEQ ID NO: 669298 - DNA, 25 bp, Mus musculus
gatgtgacagagctaggagacctct

SEQ ID NO: 669299 - DNA, 25 bp, Mus musculus
gatgtgacagaggtaggagacctct

SEQ ID NO: 669300 - DNA, 25 bp, Mus musculus
gatgtgaccgttaggagaaaaccct

SEQ ID NO: 669301 - DNA, 25 bp, Mus musculus
gatgtgaccgtttggagaaaaccct

SEQ ID NO: 669302 - DNA, 25 bp, Mus musculus
gatgtgacctcaagcagaactatag

SEQ ID NO: 669303 - DNA, 25 bp, Mus musculus
gatgtgacctcatgcagaactatag

SEQ ID NO: 669304 - DNA, 25 bp, Mus musculus
gatgtgacctccacaaaaggaaatg

SEQ ID NO: 669305 - DNA, 25 bp, Mus musculus
gatgtgacctcctcaaaaggaaatg

SEQ ID NO: 669306 - DNA, 25 bp, Mus musculus
gatgtgacctttcaattttggtagc

SEQ ID NO: 669307 - DNA, 25 bp, Mus musculus
gatgtgacctttgaattttggtagc

SEQ ID NO: 669308 - DNA, 25 bp, Mus musculus
gatgtgactagaagtgggcactctg

SEQ ID NO: 669309 - DNA, 25 bp, Mus musculus
gatgtgactagatgtgggcactctg

SEQ ID NO: 669310 - DNA, 25 bp, Mus musculus
gatgtgactcagctcatccctaaga

SEQ ID NO: 669311 - DNA, 25 bp, Mus musculus
gatgtgactcaggtcatccctaaga

SEQ ID NO: 669312 - DNA, 25 bp, Mus musculus
gatgtgactggtctccaacctgccc

SEQ ID NO: 669313 - DNA, 25 bp, Mus musculus
gatgtgactggtgtccaacctgccc

SEQ ID NO: 669314 - DNA, 25 bp, Mus musculus
gatgtgagaccaaccatgttttcag

SEQ ID NO: 669315 - DNA, 25 bp, Mus musculus
gatgtgagaccatccatgttttcag

SEQ ID NO: 669316 - DNA, 25 bp, Mus musculus
gatgtgagagtgatgaaaaaacgtg

SEQ ID NO: 669317 - DNA, 25 bp, Mus musculus
gatgtgagagtgttgaaaaaacgtg

SEQ ID NO: 669318 - DNA, 25 bp, Mus musculus
gatgtgagatcacggcagcctctgc

SEQ ID NO: 669319 - DNA, 25 bp, Mus musculus
gatgtgagatcagggcagcctctgc

SEQ ID NO: 669320 - DNA, 25 bp, Mus musculus
gatgtgagcggcaccagtcaagaaa

SEQ ID NO: 669321 - DNA, 25 bp, Mus musculus
gatgtgagcggctccagtcaagaaa

SEQ ID NO: 669322 - DNA, 25 bp, Mus musculus
gatgtgagcttaaggctgctctttg

SEQ ID NO: 669323 - DNA, 25 bp, Mus musculus
gatgtgagcttatggctgctctttg

SEQ ID NO: 669324 - DNA, 25 bp, Mus musculus
gatgtgatctgcatgcgaactcaaa

SEQ ID NO: 669325 - DNA, 25 bp, Mus musculus
gatgtgatctgcttgcgaactcaaa

SEQ ID NO: 669326 - DNA, 25 bp, Mus musculus
gatgtgatgataccgactcagggcc

SEQ ID NO: 669327 - DNA, 25 bp, Mus musculus
gatgtgatgatagcgactcagggcc

SEQ ID NO: 669328 - DNA, 25 bp, Mus musculus
gatgtgatggaaactgcccaatgac

SEQ ID NO: 669329 - DNA, 25 bp, Mus musculus
gatgtgatggaatctgcccaatgac

SEQ ID NO: 669330 - DNA, 25 bp, Mus musculus
gatgtgatgtgcaaccccttctaca

SEQ ID NO: 669331 - DNA, 25 bp, Mus musculus
gatgtgatgtgctaccccttctaca

SEQ ID NO: 669332 - DNA, 25 bp, Mus musculus
gatgtgatgttcactctgaagagta

SEQ ID NO: 669333 - DNA, 25 bp, Mus musculus
gatgtgatgttctctctgaagagta

SEQ ID NO: 669334 - DNA, 25 bp, Mus musculus
gatgtgattcagacgcttattaaag

SEQ ID NO: 669335 - DNA, 25 bp, Mus musculus
gatgtgattcagtcgcttattaaag

SEQ ID NO: 669336 - DNA, 25 bp, Mus musculus
gatgtgcaaagaacaccggcccata

SEQ ID NO: 669337 - DNA, 25 bp, Mus musculus
gatgtgcaaagatcaccggcccata

SEQ ID NO: 669338 - DNA, 25 bp, Mus musculus
gatgtgcaacatctgccacggcctc

SEQ ID NO: 669339 - DNA, 25 bp, Mus musculus
gatgtgcaacatgtgccacggcctc

SEQ ID NO: 669340 - DNA, 25 bp, Mus musculus
gatgtgcacccactttgaagaacac

SEQ ID NO: 669341 - DNA, 25 bp, Mus musculus
gatgtgcacccagtttgaagaacac

SEQ ID NO: 669342 - DNA, 25 bp, Mus musculus
gatgtgcacgccctcacgggcatca

SEQ ID NO: 669343 - DNA, 25 bp, Mus musculus
gatgtgcacgccgtcacgggcatca

SEQ ID NO: 669344 - DNA, 25 bp, Mus musculus
gatgtgcacgttcttgtcatgcctc

SEQ ID NO: 669345 - DNA, 25 bp, Mus musculus
gatgtgcacgttgttgtcatgcctc

SEQ ID NO: 669346 - DNA, 25 bp, Mus musculus
gatgtgcagcctcactttgttggtc

SEQ ID NO: 669347 - DNA, 25 bp, Mus musculus
gatgtgcagcctgactttgttggtc

SEQ ID NO: 669348 - DNA, 25 bp, Mus musculus
gatgtgcagcttctggctaccacca

SEQ ID NO: 669349 - DNA, 25 bp, Mus musculus
gatgtgcagcttgtggctaccacca

SEQ ID NO: 669350 - DNA, 25 bp, Mus musculus
gatgtgcaggccacaaagctgtgcc

SEQ ID NO: 669351 - DNA, 25 bp, Mus musculus
gatgtgcaggcctcaaagctgtgcc

SEQ ID NO: 669352 - DNA, 25 bp, Mus musculus
gatgtgcatctactatttccaggag

SEQ ID NO: 669353 - DNA, 25 bp, Mus musculus
gatgtgcatctagtatttccaggag

SEQ ID NO: 669354 - DNA, 25 bp, Mus musculus
gatgtgcccaaactgtgaccatgct

SEQ ID NO: 669355 - DNA, 25 bp, Mus musculus
gatgtgcccaaagtgtgaccatgct

SEQ ID NO: 669356 - DNA, 25 bp, Mus musculus
gatgtgcccatgcatctgaactgca

SEQ ID NO: 669357 - DNA, 25 bp, Mus musculus
gatgtgcccatggatctgaactgca

SEQ ID NO: 669358 - DNA, 25 bp, Mus musculus
gatgtgcccgatattccagatctcc

SEQ ID NO: 669359 - DNA, 25 bp, Mus musculus
gatgtgcccgattttccagatctcc

SEQ ID NO: 669360 - DNA, 25 bp, Mus musculus
gatgtgccctcccaaagcctgagga

SEQ ID NO: 669361 - DNA, 25 bp, Mus musculus
gatgtgccctccgaaagcctgagga

SEQ ID NO: 669362 - DNA, 25 bp, Mus musculus
gatgtgcccttccagaggaataagt

SEQ ID NO: 669363 - DNA, 25 bp, Mus musculus
gatgtgcccttcgagaggaataagt

SEQ ID NO: 669364 - DNA, 25 bp, Mus musculus
gatgtgccgactacggaatggctgc

SEQ ID NO: 669365 - DNA, 25 bp, Mus musculus
gatgtgccgacttcggaatggctgc

SEQ ID NO: 669366 - DNA, 25 bp, Mus musculus
gatgtgccggcacacctttacagga

SEQ ID NO: 669367 - DNA, 25 bp, Mus musculus
gatgtgccggcagacctttacagga

SEQ ID NO: 669368 - DNA, 25 bp, Mus musculus
gatgtgccgtacattgcggatgctg

SEQ ID NO: 669369 - DNA, 25 bp, Mus musculus
gatgtgccgtactttgcggatgctg

SEQ ID NO: 669370 - DNA, 25 bp, Mus musculus
gatgtgcctaccatttgatacatct

SEQ ID NO: 669371 - DNA, 25 bp, Mus musculus
gatgtgcctaccttttgatacatct

SEQ ID NO: 669372 - DNA, 25 bp, Mus musculus
gatgtgcctcctctttgcagtggac

SEQ ID NO: 669373 - DNA, 25 bp, Mus musculus
gatgtgcctcctgtttgcagtggac

SEQ ID NO: 669374 - DNA, 25 bp, Mus musculus
gatgtgcctgaaaccaatatcctgt

SEQ ID NO: 669375 - DNA, 25 bp, Mus musculus
gatgtgcctgaatccaatatcctgt

SEQ ID NO: 669376 - DNA, 25 bp, Mus musculus
gatgtgccttctaacttcatttgtg

SEQ ID NO: 669377 - DNA, 25 bp, Mus musculus
gatgtgccttcttacttcatttgtg

SEQ ID NO: 669378 - DNA, 25 bp, Mus musculus
gatgtgcgacctcattgaaccgcag

SEQ ID NO: 669379 - DNA, 25 bp, Mus musculus
gatgtgcgacctgattgaaccgcag

SEQ ID NO: 669380 - DNA, 25 bp, Mus musculus
gatgtgcgccagcaactgtttcagg

SEQ ID NO: 669381 - DNA, 25 bp, Mus musculus
gatgtgcgccaggaactgtttcagg

SEQ ID NO: 669382 - DNA, 25 bp, Mus musculus
gatgtgcggcaacaacatgtccgct

SEQ ID NO: 669383 - DNA, 25 bp, Mus musculus
gatgtgcggcaagaacatgtccgct

SEQ ID NO: 669384 - DNA, 25 bp, Mus musculus
gatgtgctaccgaaagacagaggac

SEQ ID NO: 669385 - DNA, 25 bp, Mus musculus
gatgtgctaccgtaagacagaggac

SEQ ID NO: 669386 - DNA, 25 bp, Mus musculus
gatgtgctacctcaccatcaaggaa

SEQ ID NO: 669387 - DNA, 25 bp, Mus musculus
gatgtgctacctgaccatcaaggaa

SEQ ID NO: 669388 - DNA, 25 bp, Mus musculus
gatgtgctaggtcttcacgaagcag

SEQ ID NO: 669389 - DNA, 25 bp, Mus musculus
gatgtgctaggtgttcacgaagcag

SEQ ID NO: 669390 - DNA, 25 bp, Mus musculus
gatgtgctagtcctcagggacttga

SEQ ID NO: 669391 - DNA, 25 bp, Mus musculus
gatgtgctagtcgtcagggacttga

SEQ ID NO: 669392 - DNA, 25 bp, Mus musculus
gatgtgctcaccatcgtggctgtca

SEQ ID NO: 669393 - DNA, 25 bp, Mus musculus
gatgtgctcaccttcgtggctgtca

SEQ ID NO: 669394 - DNA, 25 bp, Mus musculus
gatgtgctcgaacgcctaaatgtcc

SEQ ID NO: 669395 - DNA, 25 bp, Mus musculus
gatgtgctcgaaggcctaaatgtcc

SEQ ID NO: 669396 - DNA, 25 bp, Mus musculus
gatgtgctcgggagctcaataaatg

SEQ ID NO: 669397 - DNA, 25 bp, Mus musculus
gatgtgctcgggtgctcaataaatg

SEQ ID NO: 669398 - DNA, 25 bp, Mus musculus
gatgtgctcgtgatgcccaatctct

SEQ ID NO: 669399 - DNA, 25 bp, Mus musculus
gatgtgctcgtgattctccaggaaa

SEQ ID NO: 669400 - DNA, 25 bp, Mus musculus
gatgtgctcgtgttgcccaatctct

SEQ ID NO: 669401 - DNA, 25 bp, Mus musculus
gatgtgctcgtgtttctccaggaaa

SEQ ID NO: 669402 - DNA, 25 bp, Mus musculus
gatgtgctgcggacccgtgtgaaga

SEQ ID NO: 669403 - DNA, 25 bp, Mus musculus
gatgtgctgcggtcccgtgtgaaga

SEQ ID NO: 669404 - DNA, 25 bp, Mus musculus
gatgtgctgcgtcccaccttgggtc

SEQ ID NO: 669405 - DNA, 25 bp, Mus musculus
gatgtgctgcgtgccaccttgggtc

SEQ ID NO: 669406 - DNA, 25 bp, Mus musculus
gatgtgctggaaaatataacctcac

SEQ ID NO: 669407 - DNA, 25 bp, Mus musculus
gatgtgctggaatatataacctcac

SEQ ID NO: 669408 - DNA, 25 bp, Mus musculus
gatgtgctgtgcaaagtgtcctcct

SEQ ID NO: 669409 - DNA, 25 bp, Mus musculus
gatgtgctgtgctaagtgtcctcct

SEQ ID NO: 669410 - DNA, 25 bp, Mus musculus
gatgtgcttctcatgtaccgatcag

SEQ ID NO: 669411 - DNA, 25 bp, Mus musculus
gatgtgcttctcttgtaccgatcag

SEQ ID NO: 669412 - DNA, 25 bp, Mus musculus
gatgtgctttcgagaagcctcccag

SEQ ID NO: 669413 - DNA, 25 bp, Mus musculus
gatgtgctttcgtgaagcctcccag

SEQ ID NO: 669414 - DNA, 25 bp, Mus musculus
gatgtggaaacacaaggttttccct

SEQ ID NO: 669415 - DNA, 25 bp, Mus musculus
gatgtggaaacagaaggttttccct

SEQ ID NO: 669416 - DNA, 25 bp, Mus musculus
gatgtggaacacaacctgttcaaga

SEQ ID NO: 669417 - DNA, 25 bp, Mus musculus
gatgtggaacactacctgttcaaga

SEQ ID NO: 669418 - DNA, 25 bp, Mus musculus
gatgtggaagaaattgaagctcttt

SEQ ID NO: 669419 - DNA, 25 bp, Mus musculus
gatgtggaagaatttgaagctcttt

SEQ ID NO: 669420 - DNA, 25 bp, Mus musculus
gatgtggaagccaactgcctgctct

SEQ ID NO: 669421 - DNA, 25 bp, Mus musculus
gatgtggaagcctactgcctgctct

SEQ ID NO: 669422 - DNA, 25 bp, Mus musculus
gatgtggaaggtcaactcaaaaggc

SEQ ID NO: 669423 - DNA, 25 bp, Mus musculus
gatgtggaaggtgaactcaaaaggc

SEQ ID NO: 669424 - DNA, 25 bp, Mus musculus
gatgtggaagtgatgcctgggagtt

SEQ ID NO: 669425 - DNA, 25 bp, Mus musculus
gatgtggaagtgttgcctgggagtt

SEQ ID NO: 669426 - DNA, 25 bp, Mus musculus
gatgtggacaaaaccatagctcagt

SEQ ID NO: 669427 - DNA, 25 bp, Mus musculus
gatgtggacaaatccatagctcagt

SEQ ID NO: 669428 - DNA, 25 bp, Mus musculus
gatgtggacaccactggttttcagt

SEQ ID NO: 669429 - DNA, 25 bp, Mus musculus
gatgtggacacctctggttttcagt

SEQ ID NO: 669430 - DNA, 25 bp, Mus musculus
gatgtggacatcctccggcactgcc

SEQ ID NO: 669431 - DNA, 25 bp, Mus musculus
gatgtggacatcgtccggcactgcc

SEQ ID NO: 669432 - DNA, 25 bp, Mus musculus
gatgtggaccacactactctagtca

SEQ ID NO: 669433 - DNA, 25 bp, Mus musculus
gatgtggaccactctactctagtca

SEQ ID NO: 669434 - DNA, 25 bp, Mus musculus
gatgtggaccctccaattcctttgg

SEQ ID NO: 669435 - DNA, 25 bp, Mus musculus
gatgtggaccctcttccccagggtc

SEQ ID NO: 669436 - DNA, 25 bp, Mus musculus
gatgtggaccctgcaattcctttgg

SEQ ID NO: 669437 - DNA, 25 bp, Mus musculus
gatgtggaccctgttccccagggtc

SEQ ID NO: 669438 - DNA, 25 bp, Mus musculus
gatgtggacctcattccgatggacg

SEQ ID NO: 669439 - DNA, 25 bp, Mus musculus
gatgtggacctctttccgatggacg

SEQ ID NO: 669440 - DNA, 25 bp, Mus musculus
gatgtggagaacaagccaggcctac

SEQ ID NO: 669441 - DNA, 25 bp, Mus musculus
gatgtggagaacagcttcttcttga

SEQ ID NO: 669442 - DNA, 25 bp, Mus musculus
gatgtggagaactagccaggcctac

SEQ ID NO: 669443 - DNA, 25 bp, Mus musculus
gatgtggagaactgcttcttcttga

SEQ ID NO: 669444 - DNA, 25 bp, Mus musculus
gatgtggagaccctcttcctttcgc

SEQ ID NO: 669445 - DNA, 25 bp, Mus musculus
gatgtggagaccgtcttcctttcgc

SEQ ID NO: 669446 - DNA, 25 bp, Mus musculus
gatgtggagccacatcggcacctgt

SEQ ID NO: 669447 - DNA, 25 bp, Mus musculus
gatgtggagccagatcggcacctgt

SEQ ID NO: 669448 - DNA, 25 bp, Mus musculus
gatgtggagcgaatctgccgccagc

SEQ ID NO: 669449 - DNA, 25 bp, Mus musculus
gatgtggagcgattctgccgccagc

SEQ ID NO: 669450 - DNA, 25 bp, Mus musculus
gatgtggagcgcatctttaagggct

SEQ ID NO: 669451 - DNA, 25 bp, Mus musculus
gatgtggagcgcttctttaagggct

SEQ ID NO: 669452 - DNA, 25 bp, Mus musculus
gatgtggaggaaaagtcaaaagagt

SEQ ID NO: 669453 - DNA, 25 bp, Mus musculus
gatgtggaggaatagtcaaaagagt

SEQ ID NO: 669454 - DNA, 25 bp, Mus musculus
gatgtggaggctaacaagaatcaat

SEQ ID NO: 669455 - DNA, 25 bp, Mus musculus
gatgtggaggcttacaagaatcaat

SEQ ID NO: 669456 - DNA, 25 bp, Mus musculus
gatgtggatacgaggtccttcgatg

SEQ ID NO: 669457 - DNA, 25 bp, Mus musculus
gatgtggatacgtggtccttcgatg

SEQ ID NO: 669458 - DNA, 25 bp, Mus musculus
gatgtggatagtcaagctaagaaac

SEQ ID NO: 669459 - DNA, 25 bp, Mus musculus
gatgtggatagtgaagctaagaaac

SEQ ID NO: 669460 - DNA, 25 bp, Mus musculus
gatgtggcatttcgtgttccatcgg

SEQ ID NO: 669461 - DNA, 25 bp, Mus musculus
gatgtggcatttggtgttccatcgg

SEQ ID NO: 669462 - DNA, 25 bp, Mus musculus
gatgtggccaagctcatgaaagcgt

SEQ ID NO: 669463 - DNA, 25 bp, Mus musculus
gatgtggccaaggtcatgaaagcgt

SEQ ID NO: 669464 - DNA, 25 bp, Mus musculus
gatgtggcccttccaaaacaggatt

SEQ ID NO: 669465 - DNA, 25 bp, Mus musculus
gatgtggcccttgcaaaacaggatt

SEQ ID NO: 669466 - DNA, 25 bp, Mus musculus
gatgtggccgtactcttcagtgaag

SEQ ID NO: 669467 - DNA, 25 bp, Mus musculus
gatgtggccgtagtcttcagtgaag

SEQ ID NO: 669468 - DNA, 25 bp, Mus musculus
gatgtggcttctcatgacaatggcc

SEQ ID NO: 669469 - DNA, 25 bp, Mus musculus
gatgtggcttctcctatccggaacc

SEQ ID NO: 669470 - DNA, 25 bp, Mus musculus
gatgtggcttctgatgacaatggcc

SEQ ID NO: 669471 - DNA, 25 bp, Mus musculus
gatgtggcttctgctatccggaacc

SEQ ID NO: 669472 - DNA, 25 bp, Mus musculus
gatgtgggaaaaatagtcccctgtg

SEQ ID NO: 669473 - DNA, 25 bp, Mus musculus
gatgtgggaaaattagtcccctgtg

SEQ ID NO: 669474 - DNA, 25 bp, Mus musculus
gatgtgggacggaagcctcctactt

SEQ ID NO: 669475 - DNA, 25 bp, Mus musculus
gatgtgggacggtagcctcctactt

SEQ ID NO: 669476 - DNA, 25 bp, Mus musculus
gatgtgggaggaaagctcagttctt

SEQ ID NO: 669477 - DNA, 25 bp, Mus musculus
gatgtgggaggatagctcagttctt

SEQ ID NO: 669478 - DNA, 25 bp, Mus musculus
gatgtgggccgtacatcttgcctct

SEQ ID NO: 669479 - DNA, 25 bp, Mus musculus
gatgtgggccgttcatcttgcctct

SEQ ID NO: 669480 - DNA, 25 bp, Mus musculus
gatgtgggctttatcccctggtggt

SEQ ID NO: 669481 - DNA, 25 bp, Mus musculus
gatgtgggctttttcccctggtggt

SEQ ID NO: 669482 - DNA, 25 bp, Mus musculus
gatgtggggaccaagttcagcctca

SEQ ID NO: 669483 - DNA, 25 bp, Mus musculus
gatgtggggacctagttcagcctca

SEQ ID NO: 669484 - DNA, 25 bp, Mus musculus
gatgtggtacagaaagccctccaag

SEQ ID NO: 669485 - DNA, 25 bp, Mus musculus
gatgtggtacagtaagccctccaag

SEQ ID NO: 669486 - DNA, 25 bp, Mus musculus
gatgtggtaccaaatccaatatctt

SEQ ID NO: 669487 - DNA, 25 bp, Mus musculus
gatgtggtaccatatccaatatctt

SEQ ID NO: 669488 - DNA, 25 bp, Mus musculus
gatgtggtgaacaggatgtgctacc

SEQ ID NO: 669489 - DNA, 25 bp, Mus musculus
gatgtggtgaactggatgtgctacc

SEQ ID NO: 669490 - DNA, 25 bp, Mus musculus
gatgtggtgcatcttcataggcctg

SEQ ID NO: 669491 - DNA, 25 bp, Mus musculus
gatgtggtgcatgttcataggcctg

SEQ ID NO: 669492 - DNA, 25 bp, Mus musculus
gatgtggtttgtccgtcctcctggc

SEQ ID NO: 669493 - DNA, 25 bp, Mus musculus
gatgtggtttgtgcgtcctcctggc

SEQ ID NO: 669494 - DNA, 25 bp, Mus musculus
gatgtggtttttcccaaccgcccag

SEQ ID NO: 669495 - DNA, 25 bp, Mus musculus
gatgtggtttttgccaaccgcccag

SEQ ID NO: 669496 - DNA, 25 bp, Mus musculus
gatgtgtaatctccctgtcaaagtg

SEQ ID NO: 669497 - DNA, 25 bp, Mus musculus
gatgtgtaatctgcctgtcaaagtg

SEQ ID NO: 669498 - DNA, 25 bp, Mus musculus
gatgtgtaatgacaaagagcggttt

SEQ ID NO: 669499 - DNA, 25 bp, Mus musculus
gatgtgtaatgagaaagagcggttt

SEQ ID NO: 669500 - DNA, 25 bp, Mus musculus
gatgtgtacagcaccgactactatc

SEQ ID NO: 669501 - DNA, 25 bp, Mus musculus
gatgtgtacagctccgactactatc

SEQ ID NO: 669502 - DNA, 25 bp, Mus musculus
gatgtgtaccgactgtcctctgtgg

SEQ ID NO: 669503 - DNA, 25 bp, Mus musculus
gatgtgtaccgagtgtcctctgtgg

SEQ ID NO: 669504 - DNA, 25 bp, Mus musculus
gatgtgtaccttcatgtcattgaca

SEQ ID NO: 669505 - DNA, 25 bp, Mus musculus
gatgtgtaccttgatgtcattgaca

SEQ ID NO: 669506 - DNA, 25 bp, Mus musculus
gatgtgtatgagcaggccatccgca

SEQ ID NO: 669507 - DNA, 25 bp, Mus musculus
gatgtgtatgaggaggccatccgca

SEQ ID NO: 669508 - DNA, 25 bp, Mus musculus
gatgtgtatgtgatcctaggcccag

SEQ ID NO: 669509 - DNA, 25 bp, Mus musculus
gatgtgtatgtgttcctaggcccag

SEQ ID NO: 669510 - DNA, 25 bp, Mus musculus
gatgtgtattccaacaagcaagtgg

SEQ ID NO: 669511 - DNA, 25 bp, Mus musculus
gatgtgtattcctacaagcaagtgg

SEQ ID NO: 669512 - DNA, 25 bp, Mus musculus
gatgtgtcagagatgccatcaccca

SEQ ID NO: 669513 - DNA, 25 bp, Mus musculus
gatgtgtcagagttgccatcaccca

SEQ ID NO: 669514 - DNA, 25 bp, Mus musculus
gatgtgtcattgacccaggaagtcc

SEQ ID NO: 669515 - DNA, 25 bp, Mus musculus
gatgtgtcattgtcccaggaagtcc

SEQ ID NO: 669516 - DNA, 25 bp, Mus musculus
gatgtgtccccactgcgtcgagtga

SEQ ID NO: 669517 - DNA, 25 bp, Mus musculus
gatgtgtccccagtgcgtcgagtga

SEQ ID NO: 669518 - DNA, 25 bp, Mus musculus
gatgtgtccttcattttcaagacga

SEQ ID NO: 669519 - DNA, 25 bp, Mus musculus
gatgtgtccttccagcagtcaagca

SEQ ID NO: 669520 - DNA, 25 bp, Mus musculus
gatgtgtccttcgagcagtcaagca

SEQ ID NO: 669521 - DNA, 25 bp, Mus musculus
gatgtgtccttctttttcaagacga

SEQ ID NO: 669522 - DNA, 25 bp, Mus musculus
gatgtgtcgcccattatgaataagc

SEQ ID NO: 669523 - DNA, 25 bp, Mus musculus
gatgtgtcgccctttatgaataagc

SEQ ID NO: 669524 - DNA, 25 bp, Mus musculus
gatgtgtctctgagcttcaacacta

SEQ ID NO: 669525 - DNA, 25 bp, Mus musculus
gatgtgtctctgtgcttcaacacta

SEQ ID NO: 669526 - DNA, 25 bp, Mus musculus
gatgtgtctgctaaggactttgaga

SEQ ID NO: 669527 - DNA, 25 bp, Mus musculus
gatgtgtctgctcagtcgcctccaa

SEQ ID NO: 669528 - DNA, 25 bp, Mus musculus
gatgtgtctgctgagtcgcctccaa

SEQ ID NO: 669529 - DNA, 25 bp, Mus musculus
gatgtgtctgcttaggactttgaga

SEQ ID NO: 669530 - DNA, 25 bp, Mus musculus
gatgtgtgacgcacttcctgtgcgc

SEQ ID NO: 669531 - DNA, 25 bp, Mus musculus
gatgtgtgacgctcttcctgtgcgc

SEQ ID NO: 669532 - DNA, 25 bp, Mus musculus
gatgtgtgagaaccttgaccatggc

SEQ ID NO: 669533 - DNA, 25 bp, Mus musculus
gatgtgtgagaagcttgaccatggc

SEQ ID NO: 669534 - DNA, 25 bp, Mus musculus
gatgtgtgagatcttctattctaga

SEQ ID NO: 669535 - DNA, 25 bp, Mus musculus
gatgtgtgagatgttctattctaga

SEQ ID NO: 669536 - DNA, 25 bp, Mus musculus
gatgtgtgatgaactcctagcaaga

SEQ ID NO: 669537 - DNA, 25 bp, Mus musculus
gatgtgtgatgatctcctagcaaga

SEQ ID NO: 669538 - DNA, 25 bp, Mus musculus
gatgtgtgccccagaactgcaagcg

SEQ ID NO: 669539 - DNA, 25 bp, Mus musculus
gatgtgtgcccctgaactgcaagcg

SEQ ID NO: 669540 - DNA, 25 bp, Mus musculus
gatgtgtgctgacgtcttgccttct

SEQ ID NO: 669541 - DNA, 25 bp, Mus musculus
gatgtgtgctgaggtcttgccttct

SEQ ID NO: 669542 - DNA, 25 bp, Mus musculus
gatgtgtggtcccaatgccaacgct

SEQ ID NO: 669543 - DNA, 25 bp, Mus musculus
gatgtgtggtccgaatgccaacgct

SEQ ID NO: 669544 - DNA, 25 bp, Mus musculus
gatgtgtgtgatatttgagaatagc

SEQ ID NO: 669545 - DNA, 25 bp, Mus musculus
gatgtgtgtgatttttgagaatagc

SEQ ID NO: 669546 - DNA, 25 bp, Mus musculus
gatgtgttaccgagagtggaacaga

SEQ ID NO: 669547 - DNA, 25 bp, Mus musculus
gatgtgttaccgtgagtggaacaga

SEQ ID NO: 669548 - DNA, 25 bp, Mus musculus
gatgtgttcaatctgcctttggtca

SEQ ID NO: 669549 - DNA, 25 bp, Mus musculus
gatgtgttcaatgtgcctttggtca

SEQ ID NO: 669550 - DNA, 25 bp, Mus musculus
gatgtgttcacacccgcaaggtcac

SEQ ID NO: 669551 - DNA, 25 bp, Mus musculus
gatgtgttcacagccgcaaggtcac

SEQ ID NO: 669552 - DNA, 25 bp, Mus musculus
gatgtgttcattccttgtggtcctg

SEQ ID NO: 669553 - DNA, 25 bp, Mus musculus
gatgtgttcattgcttgtggtcctg

SEQ ID NO: 669554 - DNA, 25 bp, Mus musculus
gatgtgttctgtctaccgctcctgg

SEQ ID NO: 669555 - DNA, 25 bp, Mus musculus
gatgtgttctgtgtaccgctcctgg

SEQ ID NO: 669556 - DNA, 25 bp, Mus musculus
gatgtgtttgagattcgctatgcca

SEQ ID NO: 669557 - DNA, 25 bp, Mus musculus
gatgtgtttgagtttcgctatgcca

SEQ ID NO: 669558 - DNA, 25 bp, Mus musculus
gatgtgtttggcagctggctcacag

SEQ ID NO: 669559 - DNA, 25 bp, Mus musculus
gatgtgtttggctgctggctcacag

SEQ ID NO: 669560 - DNA, 25 bp, Mus musculus
gatgtgtttgggaatgatgtcgtcc

SEQ ID NO: 669561 - DNA, 25 bp, Mus musculus
gatgtgtttgggtatgatgtcgtcc

SEQ ID NO: 669562 - DNA, 25 bp, Mus musculus
gatgtgtttgtccagcagacccagg

SEQ ID NO: 669563 - DNA, 25 bp, Mus musculus
gatgtgtttgtcgagcagacccagg

SEQ ID NO: 669564 - DNA, 25 bp, Mus musculus
gatgtgttttgtcccaccttagtcc

SEQ ID NO: 669565 - DNA, 25 bp, Mus musculus
gatgtgttttgtgccaccttagtcc

SEQ ID NO: 669566 - DNA, 25 bp, Mus musculus
gatgttaaatttcaccaggtacagg

SEQ ID NO: 669567 - DNA, 25 bp, Mus musculus
gatgttaaatttgaccaggtacagg

SEQ ID NO: 669568 - DNA, 25 bp, Mus musculus
gatgttaagattcagagtgatgctc

SEQ ID NO: 669569 - DNA, 25 bp, Mus musculus
gatgttaagattgagagtgatgctc

SEQ ID NO: 669570 - DNA, 25 bp, Mus musculus
gatgttaagctcaaaggcatccctg

SEQ ID NO: 669571 - DNA, 25 bp, Mus musculus
gatgttaagctctaaggcatccctg

SEQ ID NO: 669572 - DNA, 25 bp, Mus musculus
gatgttaagctgaagcctctgttga

SEQ ID NO: 669573 - DNA, 25 bp, Mus musculus
gatgttaagctgtagcctctgttga

SEQ ID NO: 669574 - DNA, 25 bp, Mus musculus
gatgttacactcagtaatgtgcccg

SEQ ID NO: 669575 - DNA, 25 bp, Mus musculus
gatgttacactctgtaatgtgcccg

SEQ ID NO: 669576 - DNA, 25 bp, Mus musculus
gatgttaccacgcagctggacagct

SEQ ID NO: 669577 - DNA, 25 bp, Mus musculus
gatgttaccacggagctggacagct

SEQ ID NO: 669578 - DNA, 25 bp, Mus musculus
gatgttaccatacgcccttctgctg

SEQ ID NO: 669579 - DNA, 25 bp, Mus musculus
gatgttaccataggcccttctgctg

SEQ ID NO: 669580 - DNA, 25 bp, Mus musculus
gatgttacctaaccaaggagtagaa

SEQ ID NO: 669581 - DNA, 25 bp, Mus musculus
gatgttacctaagcaaggagtagaa

SEQ ID NO: 669582 - DNA, 25 bp, Mus musculus
gatgttagcccgcacactttctctg

SEQ ID NO: 669583 - DNA, 25 bp, Mus musculus
gatgttagcccggacactttctctg

SEQ ID NO: 669584 - DNA, 25 bp, Mus musculus
gatgttagtcacagtgtcctcagcc

SEQ ID NO: 669585 - DNA, 25 bp, Mus musculus
gatgttagtcactgtgtcctcagcc

SEQ ID NO: 669586 - DNA, 25 bp, Mus musculus
gatgttatccgaatgatagccaact

SEQ ID NO: 669587 - DNA, 25 bp, Mus musculus
gatgttatccgattgatagccaact

SEQ ID NO: 669588 - DNA, 25 bp, Mus musculus
gatgttatcgagctcaagtacccgc

SEQ ID NO: 669589 - DNA, 25 bp, Mus musculus
gatgttatcgaggtcaagtacccgc

SEQ ID NO: 669590 - DNA, 25 bp, Mus musculus
gatgttatgaacagtacattagtta

SEQ ID NO: 669591 - DNA, 25 bp, Mus musculus
gatgttatgaactgtacattagtta

SEQ ID NO: 669592 - DNA, 25 bp, Mus musculus
gatgttatgacacctatgcggcaga

SEQ ID NO: 669593 - DNA, 25 bp, Mus musculus
gatgttatgacagctatgcggcaga

SEQ ID NO: 669594 - DNA, 25 bp, Mus musculus
gatgttcaaccaaagtgtgtagctg

SEQ ID NO: 669595 - DNA, 25 bp, Mus musculus
gatgttcaaccatagtgtgtagctg

SEQ ID NO: 669596 - DNA, 25 bp, Mus musculus
gatgttcaagaacactctttgggtg

SEQ ID NO: 669597 - DNA, 25 bp, Mus musculus
gatgttcaagaagactctttgggtg

SEQ ID NO: 669598 - DNA, 25 bp, Mus musculus
gatgttcaagtgaatccaactgccc

SEQ ID NO: 669599 - DNA, 25 bp, Mus musculus
gatgttcaagtgtatccaactgccc

SEQ ID NO: 669600 - DNA, 25 bp, Mus musculus
gatgttcacaagaaatgtcccctct

SEQ ID NO: 669601 - DNA, 25 bp, Mus musculus
gatgttcacaagtaatgtcccctct

SEQ ID NO: 669602 - DNA, 25 bp, Mus musculus
gatgttcacgtcactataggagaca

SEQ ID NO: 669603 - DNA, 25 bp, Mus musculus
gatgttcacgtctctataggagaca

SEQ ID NO: 669604 - DNA, 25 bp, Mus musculus
gatgttcagatcattctggagagct

SEQ ID NO: 669605 - DNA, 25 bp, Mus musculus
gatgttcagatctttctggagagct

SEQ ID NO: 669606 - DNA, 25 bp, Mus musculus
gatgttcagcttctggcccaacagc

SEQ ID NO: 669607 - DNA, 25 bp, Mus musculus
gatgttcagcttgtggcccaacagc

SEQ ID NO: 669608 - DNA, 25 bp, Mus musculus
gatgttcatggcactcacctggcag

SEQ ID NO: 669609 - DNA, 25 bp, Mus musculus
gatgttcatggctctcacctggcag

SEQ ID NO: 669610 - DNA, 25 bp, Mus musculus
gatgttcatgtacgacctctatcag

SEQ ID NO: 669611 - DNA, 25 bp, Mus musculus
gatgttcatgtaggacctctatcag

SEQ ID NO: 669612 - DNA, 25 bp, Mus musculus
gatgttccacaccagtgtccccatg

SEQ ID NO: 669613 - DNA, 25 bp, Mus musculus
gatgttccacacgagtgtccccatg

SEQ ID NO: 669614 - DNA, 25 bp, Mus musculus
gatgttccacatacaggacaaaggc

SEQ ID NO: 669615 - DNA, 25 bp, Mus musculus
gatgttccacattcaggacaaaggc

SEQ ID NO: 669616 - DNA, 25 bp, Mus musculus
gatgttcccatcaaggaataccata

SEQ ID NO: 669617 - DNA, 25 bp, Mus musculus
gatgttcccatctaggaataccata

SEQ ID NO: 669618 - DNA, 25 bp, Mus musculus
gatgttccccatactttatcccttg

SEQ ID NO: 669619 - DNA, 25 bp, Mus musculus
gatgttccccattctttatcccttg

SEQ ID NO: 669620 - DNA, 25 bp, Mus musculus
gatgttccggatcctgagcagcagc

SEQ ID NO: 669621 - DNA, 25 bp, Mus musculus
gatgttccggatgctgagcagcagc

SEQ ID NO: 669622 - DNA, 25 bp, Mus musculus
gatgttccgtcgcaagtatgggact

SEQ ID NO: 669623 - DNA, 25 bp, Mus musculus
gatgttccgtcggaagtatgggact

SEQ ID NO: 669624 - DNA, 25 bp, Mus musculus
gatgttcctaatcagtttcataagc

SEQ ID NO: 669625 - DNA, 25 bp, Mus musculus
gatgttcctaatgagtttcataagc

SEQ ID NO: 669626 - DNA, 25 bp, Mus musculus
gatgttcctggaaaccagtgcactg

SEQ ID NO: 669627 - DNA, 25 bp, Mus musculus
gatgttcctggataccagtgcactg

SEQ ID NO: 669628 - DNA, 25 bp, Mus musculus
gatgttccttagcactctgttcctg

SEQ ID NO: 669629 - DNA, 25 bp, Mus musculus
gatgttccttaggactctgttcctg

SEQ ID NO: 669630 - DNA, 25 bp, Mus musculus
gatgttcgagttcctggagtacagc

SEQ ID NO: 669631 - DNA, 25 bp, Mus musculus
gatgttcgagttgctggagtacagc

SEQ ID NO: 669632 - DNA, 25 bp, Mus musculus
gatgttcgtttacctatggaataca

SEQ ID NO: 669633 - DNA, 25 bp, Mus musculus
gatgttcgtttagctatggaataca

SEQ ID NO: 669634 - DNA, 25 bp, Mus musculus
gatgttctacggctcacttgggtag

SEQ ID NO: 669635 - DNA, 25 bp, Mus musculus
gatgttctacgggtcacttgggtag

SEQ ID NO: 669636 - DNA, 25 bp, Mus musculus
gatgttctcagtcttccattggaca

SEQ ID NO: 669637 - DNA, 25 bp, Mus musculus
gatgttctcagtgttccattggaca

SEQ ID NO: 669638 - DNA, 25 bp, Mus musculus
gatgttctcccacctacggcggatt

SEQ ID NO: 669639 - DNA, 25 bp, Mus musculus
gatgttctcccagctacggcggatt

SEQ ID NO: 669640 - DNA, 25 bp, Mus musculus
gatgttctctacagcccacagatgg

SEQ ID NO: 669641 - DNA, 25 bp, Mus musculus
gatgttctctactgcccacagatgg

SEQ ID NO: 669642 - DNA, 25 bp, Mus musculus
gatgttctgaacaagagtctcaacc

SEQ ID NO: 669643 - DNA, 25 bp, Mus musculus
gatgttctgaactagagtctcaacc

SEQ ID NO: 669644 - DNA, 25 bp, Mus musculus
gatgttctgcggaggcttcctggtt

SEQ ID NO: 669645 - DNA, 25 bp, Mus musculus
gatgttctgcggtggcttcctggtt

SEQ ID NO: 669646 - DNA, 25 bp, Mus musculus
gatgttctgcttacagagttcccaa

SEQ ID NO: 669647 - DNA, 25 bp, Mus musculus
gatgttctgctttcagagttcccaa

SEQ ID NO: 669648 - DNA, 25 bp, Mus musculus
gatgttcttcaaccaaatatagaag

SEQ ID NO: 669649 - DNA, 25 bp, Mus musculus
gatgttcttcaagcaaatatagaag

SEQ ID NO: 669650 - DNA, 25 bp, Mus musculus
gatgttcttcaccttgcagatgcca

SEQ ID NO: 669651 - DNA, 25 bp, Mus musculus
gatgttcttcacgttgcagatgcca

SEQ ID NO: 669652 - DNA, 25 bp, Mus musculus
gatgttgaaaagatcatgcctattg

SEQ ID NO: 669653 - DNA, 25 bp, Mus musculus
gatgttgaaaagttcatgcctattg

SEQ ID NO: 669654 - DNA, 25 bp, Mus musculus
gatgttgacaccacccaagtccttt

SEQ ID NO: 669655 - DNA, 25 bp, Mus musculus
gatgttgacacctcccaagtccttt

SEQ ID NO: 669656 - DNA, 25 bp, Mus musculus
gatgttgaccagagagaaactgtcc

SEQ ID NO: 669657 - DNA, 25 bp, Mus musculus
gatgttgaccagtgagaaactgtcc

SEQ ID NO: 669658 - DNA, 25 bp, Mus musculus
gatgttgatgaactgtcctctctgc

SEQ ID NO: 669659 - DNA, 25 bp, Mus musculus
gatgttgatgaagtgtcctctctgc

SEQ ID NO: 669660 - DNA, 25 bp, Mus musculus
gatgttgatgtccagattgaccagg

SEQ ID NO: 669661 - DNA, 25 bp, Mus musculus
gatgttgatgtcgagattgaccagg

SEQ ID NO: 669662 - DNA, 25 bp, Mus musculus
gatgttgcacgcacgatttgacgtt

SEQ ID NO: 669663 - DNA, 25 bp, Mus musculus
gatgttgcacgctcgatttgacgtt

SEQ ID NO: 669664 - DNA, 25 bp, Mus musculus
gatgttgcactcaaacgagcggcag

SEQ ID NO: 669665 - DNA, 25 bp, Mus musculus
gatgttgcactctaacgagcggcag

SEQ ID NO: 669666 - DNA, 25 bp, Mus musculus
gatgttgcagccaagaggaaaattg

SEQ ID NO: 669667 - DNA, 25 bp, Mus musculus
gatgttgcagcctagaggaaaattg

SEQ ID NO: 669668 - DNA, 25 bp, Mus musculus
gatgttgccagactgatattcagta

SEQ ID NO: 669669 - DNA, 25 bp, Mus musculus
gatgttgccagagtgatattcagta

SEQ ID NO: 669670 - DNA, 25 bp, Mus musculus
gatgttgctcctcctcaagttggcg

SEQ ID NO: 669671 - DNA, 25 bp, Mus musculus
gatgttgctcctgctcaagttggcg

SEQ ID NO: 669672 - DNA, 25 bp, Mus musculus
gatgttgctgaccaaagcaatcggg

SEQ ID NO: 669673 - DNA, 25 bp, Mus musculus
gatgttgctgacgaaagcaatcggg

SEQ ID NO: 669674 - DNA, 25 bp, Mus musculus
gatgttgctgccagatgactttaaa

SEQ ID NO: 669675 - DNA, 25 bp, Mus musculus
gatgttgctgcccagagcttgacag

SEQ ID NO: 669676 - DNA, 25 bp, Mus musculus
gatgttgctgccgagagcttgacag

SEQ ID NO: 669677 - DNA, 25 bp, Mus musculus
gatgttgctgcctgatgactttaaa

SEQ ID NO: 669678 - DNA, 25 bp, Mus musculus
gatgttggaaaacctgagtcatgac

SEQ ID NO: 669679 - DNA, 25 bp, Mus musculus
gatgttggaaaagctgagtcatgac

SEQ ID NO: 669680 - DNA, 25 bp, Mus musculus
gatgttggaacaaggacctgtattc

SEQ ID NO: 669681 - DNA, 25 bp, Mus musculus
gatgttggaacatggacctgtattc

SEQ ID NO: 669682 - DNA, 25 bp, Mus musculus
gatgttggaagaagatacgggttca

SEQ ID NO: 669683 - DNA, 25 bp, Mus musculus
gatgttggaagatgatacgggttca

SEQ ID NO: 669684 - DNA, 25 bp, Mus musculus
gatgttggaggacttagaagatcta

SEQ ID NO: 669685 - DNA, 25 bp, Mus musculus
gatgttggaggagttagaagatcta

SEQ ID NO: 669686 - DNA, 25 bp, Mus musculus
gatgttggctcgatgctgaagtccc

SEQ ID NO: 669687 - DNA, 25 bp, Mus musculus
gatgttggctcgttgctgaagtccc

SEQ ID NO: 669688 - DNA, 25 bp, Mus musculus
gatgttgggatcactacaggcatga

SEQ ID NO: 669689 - DNA, 25 bp, Mus musculus
gatgttgggatctctacaggcatga

SEQ ID NO: 669690 - DNA, 25 bp, Mus musculus
gatgttggtcctccttccaagcaga

SEQ ID NO: 669691 - DNA, 25 bp, Mus musculus
gatgttggtcctgcttccaagcaga

SEQ ID NO: 669692 - DNA, 25 bp, Mus musculus
gatgttggtggcaatgaccagtcac

SEQ ID NO: 669693 - DNA, 25 bp, Mus musculus
gatgttggtggccaggacaaaatta

SEQ ID NO: 669694 - DNA, 25 bp, Mus musculus
gatgttggtggcgaggacaaaatta

SEQ ID NO: 669695 - DNA, 25 bp, Mus musculus
gatgttggtggctatgaccagtcac

SEQ ID NO: 669696 - DNA, 25 bp, Mus musculus
gatgttgtaatcaaccctgctgaac

SEQ ID NO: 669697 - DNA, 25 bp, Mus musculus
gatgttgtaatctaccctgctgaac

SEQ ID NO: 669698 - DNA, 25 bp, Mus musculus
gatgttgtcagaaggaaagaagttt

SEQ ID NO: 669699 - DNA, 25 bp, Mus musculus
gatgttgtcagatggaaagaagttt

SEQ ID NO: 669700 - DNA, 25 bp, Mus musculus
gatgttgttctacgtgattggtccc

SEQ ID NO: 669701 - DNA, 25 bp, Mus musculus
gatgttgttctaggtgattggtccc

SEQ ID NO: 669702 - DNA, 25 bp, Mus musculus
gatgtttacagcatgttatgggaca

SEQ ID NO: 669703 - DNA, 25 bp, Mus musculus
gatgtttacagcttgttatgggaca

SEQ ID NO: 669704 - DNA, 25 bp, Mus musculus
gatgtttatagtcagttcttggtgg

SEQ ID NO: 669705 - DNA, 25 bp, Mus musculus
gatgtttatagtgagttcttggtgg

SEQ ID NO: 669706 - DNA, 25 bp, Mus musculus
gatgtttatatccagccatgggacc

SEQ ID NO: 669707 - DNA, 25 bp, Mus musculus
gatgtttatatcgagccatgggacc

SEQ ID NO: 669708 - DNA, 25 bp, Mus musculus
gatgtttcatctcccaatggtatct

SEQ ID NO: 669709 - DNA, 25 bp, Mus musculus
gatgtttcatctgccaatggtatct

SEQ ID NO: 669710 - DNA, 25 bp, Mus musculus
gatgtttcccgtcttctccctggtt

SEQ ID NO: 669711 - DNA, 25 bp, Mus musculus
gatgtttcccgtgttctccctggtt

SEQ ID NO: 669712 - DNA, 25 bp, Mus musculus
gatgtttccgcaaagccggcactcg

SEQ ID NO: 669713 - DNA, 25 bp, Mus musculus
gatgtttccgcatagccggcactcg

SEQ ID NO: 669714 - DNA, 25 bp, Mus musculus
gatgtttcctggacagatttcttcg

SEQ ID NO: 669715 - DNA, 25 bp, Mus musculus
gatgtttcctggtcagatttcttcg

SEQ ID NO: 669716 - DNA, 25 bp, Mus musculus
gatgtttcgaaaaatgcagaacgca

SEQ ID NO: 669717 - DNA, 25 bp, Mus musculus
gatgtttcgaaatatgcagaacgca

SEQ ID NO: 669718 - DNA, 25 bp, Mus musculus
gatgtttcggaacacagcggatcct

SEQ ID NO: 669719 - DNA, 25 bp, Mus musculus
gatgtttcggaagacagcggatcct

SEQ ID NO: 669720 - DNA, 25 bp, Mus musculus
gatgtttcgtctactcgcttgtcaa

SEQ ID NO: 669721 - DNA, 25 bp, Mus musculus
gatgtttcgtcttctcgcttgtcaa

SEQ ID NO: 669722 - DNA, 25 bp, Mus musculus
gatgtttctaagaacccagacctga

SEQ ID NO: 669723 - DNA, 25 bp, Mus musculus
gatgtttctaagtacccagacctga

SEQ ID NO: 669724 - DNA, 25 bp, Mus musculus
gatgtttcttggagacctgccagaa

SEQ ID NO: 669725 - DNA, 25 bp, Mus musculus
gatgtttcttggtgacctgccagaa

SEQ ID NO: 669726 - DNA, 25 bp, Mus musculus
gatgtttgacccattcataaccatg

SEQ ID NO: 669727 - DNA, 25 bp, Mus musculus
gatgtttgaccctttcataaccatg

SEQ ID NO: 669728 - DNA, 25 bp, Mus musculus
gatgtttgactgaaccatcgactgt

SEQ ID NO: 669729 - DNA, 25 bp, Mus musculus
gatgtttgactgtaccatcgactgt

SEQ ID NO: 669730 - DNA, 25 bp, Mus musculus
gatgtttgcgccaggcggagaatcc

SEQ ID NO: 669731 - DNA, 25 bp, Mus musculus
gatgtttgcgcctggcggagaatcc

SEQ ID NO: 669732 - DNA, 25 bp, Mus musculus
gatgtttggacaatctatctcagga

SEQ ID NO: 669733 - DNA, 25 bp, Mus musculus
gatgtttggacattctatctcagga

SEQ ID NO: 669734 - DNA, 25 bp, Mus musculus
gatgtttggaccacaagtgcttacg

SEQ ID NO: 669735 - DNA, 25 bp, Mus musculus
gatgtttggacctcaagtgcttacg

SEQ ID NO: 669736 - DNA, 25 bp, Mus musculus
gatgtttggcgtcacactctgggaa

SEQ ID NO: 669737 - DNA, 25 bp, Mus musculus
gatgtttggcgtgacactctgggaa

SEQ ID NO: 669738 - DNA, 25 bp, Mus musculus
gatgtttggtttacacaagccaaag

SEQ ID NO: 669739 - DNA, 25 bp, Mus musculus
gatgtttggttttcacaagccaaag

SEQ ID NO: 669740 - DNA, 25 bp, Mus musculus
gatgtttgtccacagagtcaaagag

SEQ ID NO: 669741 - DNA, 25 bp, Mus musculus
gatgtttgtccagagagtcaaagag

SEQ ID NO: 669742 - DNA, 25 bp, Mus musculus
gatgtttgtccccttacacttggta

SEQ ID NO: 669743 - DNA, 25 bp, Mus musculus
gatgtttgtcccgttacacttggta

SEQ ID NO: 669744 - DNA, 25 bp, Mus musculus
gatgttttgcacatgaaccctgaag

SEQ ID NO: 669745 - DNA, 25 bp, Mus musculus
gatgttttgcacttgaaccctgaag

SEQ ID NO: 669746 - DNA, 25 bp, Mus musculus
gatgttttggcgagagatgtattca

SEQ ID NO: 669747 - DNA, 25 bp, Mus musculus
gatgttttggcgtgagatgtattca

SEQ ID NO: 669748 - DNA, 25 bp, Mus musculus
gatgttttttgtccaggcagctcca

SEQ ID NO: 669749 - DNA, 25 bp, Mus musculus
gatgttttttgtgcaggcagctcca

SEQ ID NO: 669750 - DNA, 25 bp, Mus musculus
gattaaaatgcactccacaaaaaag

SEQ ID NO: 669751 - DNA, 25 bp, Mus musculus
gattaaaatgcagtccacaaaaaag

SEQ ID NO: 669752 - DNA, 25 bp, Mus musculus
gattaaacttctcgtggcagatgaa

SEQ ID NO: 669753 - DNA, 25 bp, Mus musculus
gattaaacttctggtggcagatgaa

SEQ ID NO: 669754 - DNA, 25 bp, Mus musculus
gattaaagaggtccacagctctgct

SEQ ID NO: 669755 - DNA, 25 bp, Mus musculus
gattaaagaggtgcacagctctgct

SEQ ID NO: 669756 - DNA, 25 bp, Mus musculus
gattaaatacctcgatcctgagtac

SEQ ID NO: 669757 - DNA, 25 bp, Mus musculus
gattaaatacctggatcctgagtac

SEQ ID NO: 669758 - DNA, 25 bp, Mus musculus
gattaaatacgaaagccaacaaaga

SEQ ID NO: 669759 - DNA, 25 bp, Mus musculus
gattaaatacgatagccaacaaaga

SEQ ID NO: 669760 - DNA, 25 bp, Mus musculus
gattaaatgatgacccagactgcac

SEQ ID NO: 669761 - DNA, 25 bp, Mus musculus
gattaaatgatgtcccagactgcac

SEQ ID NO: 669762 - DNA, 25 bp, Mus musculus
gattaaatgcttaccgtgaagtaac

SEQ ID NO: 669763 - DNA, 25 bp, Mus musculus
gattaaatgctttccgtgaagtaac

SEQ ID NO: 669764 - DNA, 25 bp, Mus musculus
gattaaattacacctcttgaccttg

SEQ ID NO: 669765 - DNA, 25 bp, Mus musculus
gattaaattacagctcttgaccttg

SEQ ID NO: 669766 - DNA, 25 bp, Mus musculus
gattaaattagtcagccctcagaga

SEQ ID NO: 669767 - DNA, 25 bp, Mus musculus
gattaaattagtgagccctcagaga

SEQ ID NO: 669768 - DNA, 25 bp, Mus musculus
gattaaattatcataaacgatgtgc

SEQ ID NO: 669769 - DNA, 25 bp, Mus musculus
gattaaattatcttaaacgatgtgc

SEQ ID NO: 669770 - DNA, 25 bp, Mus musculus
gattaacaacgtattccttcttgaa

SEQ ID NO: 669771 - DNA, 25 bp, Mus musculus
gattaacaacgttttccttcttgaa

SEQ ID NO: 669772 - DNA, 25 bp, Mus musculus
gattaacaatccctcttcaccaggg

SEQ ID NO: 669773 - DNA, 25 bp, Mus musculus
gattaacaatccgtcttcaccaggg

SEQ ID NO: 669774 - DNA, 25 bp, Mus musculus
gattaacaggacctgatggatcccc

SEQ ID NO: 669775 - DNA, 25 bp, Mus musculus
gattaacaggacgtgatggatcccc

SEQ ID NO: 669776 - DNA, 25 bp, Mus musculus
gattaacagttcctcattcaatttc

SEQ ID NO: 669777 - DNA, 25 bp, Mus musculus
gattaacagttcgtcattcaatttc

SEQ ID NO: 669778 - DNA, 25 bp, Mus musculus
gattaacatcctcagaagccgtcac

SEQ ID NO: 669779 - DNA, 25 bp, Mus musculus
gattaacatcctgagaagccgtcac

SEQ ID NO: 669780 - DNA, 25 bp, Mus musculus
gattaaccgccccatcatcgtgttc

SEQ ID NO: 669781 - DNA, 25 bp, Mus musculus
gattaaccgcccgatcatcgtgttc

SEQ ID NO: 669782 - DNA, 25 bp, Mus musculus
gattaaccgtgcagccacttttgtg

SEQ ID NO: 669783 - DNA, 25 bp, Mus musculus
gattaaccgtgctgccacttttgtg

SEQ ID NO: 669784 - DNA, 25 bp, Mus musculus
gattaacctggtcatgtcctacacg

SEQ ID NO: 669785 - DNA, 25 bp, Mus musculus
gattaacctggtgatgtcctacacg

SEQ ID NO: 669786 - DNA, 25 bp, Mus musculus
gattaacgaggcaggaattagcaga

SEQ ID NO: 669787 - DNA, 25 bp, Mus musculus
gattaacgaggctggaattagcaga

SEQ ID NO: 669788 - DNA, 25 bp, Mus musculus
gattaacgattaatatggaagggcc

SEQ ID NO: 669789 - DNA, 25 bp, Mus musculus
gattaacgattattatggaagggcc

SEQ ID NO: 669790 - DNA, 25 bp, Mus musculus
gattaactaggaaaggcgatatcat

SEQ ID NO: 669791 - DNA, 25 bp, Mus musculus
gattaactaggataggcgatatcat

SEQ ID NO: 669792 - DNA, 25 bp, Mus musculus
gattaactcaaaaccagagaatgcg

SEQ ID NO: 669793 - DNA, 25 bp, Mus musculus
gattaactcaaatccagagaatgcg

SEQ ID NO: 669794 - DNA, 25 bp, Mus musculus
gattaactgtgcagagactcccggt

SEQ ID NO: 669795 - DNA, 25 bp, Mus musculus
gattaactgtgctgagactcccggt

SEQ ID NO: 669796 - DNA, 25 bp, Mus musculus
gattaagacctacccatggcagtgt

SEQ ID NO: 669797 - DNA, 25 bp, Mus musculus
gattaagacctagccatggcagtgt

SEQ ID NO: 669798 - DNA, 25 bp, Mus musculus
gattaagaggtcaccaaaaggaagg

SEQ ID NO: 669799 - DNA, 25 bp, Mus musculus
gattaagaggtctccaaaaggaagg

SEQ ID NO: 669800 - DNA, 25 bp, Mus musculus
gattaagcaaaacccaaagtacaag

SEQ ID NO: 669801 - DNA, 25 bp, Mus musculus
gattaagcaaaagccaaagtacaag

SEQ ID NO: 669802 - DNA, 25 bp, Mus musculus
gattaagcattgctgtggcttcagg

SEQ ID NO: 669803 - DNA, 25 bp, Mus musculus
gattaagcattggtgtggcttcagg

SEQ ID NO: 669804 - DNA, 25 bp, Mus musculus
gattaaggacctcccctgatgtggc

SEQ ID NO: 669805 - DNA, 25 bp, Mus musculus
gattaaggacctgccctgatgtggc

SEQ ID NO: 669806 - DNA, 25 bp, Mus musculus
gattaagggctccttccttgaaaag

SEQ ID NO: 669807 - DNA, 25 bp, Mus musculus
gattaagggctcgttccttgaaaag

SEQ ID NO: 669808 - DNA, 25 bp, Mus musculus
gattaagtcagaagggacctgtctg

SEQ ID NO: 669809 - DNA, 25 bp, Mus musculus
gattaagtcagatgggacctgtctg

SEQ ID NO: 669810 - DNA, 25 bp, Mus musculus
gattaataaattccagggcaagctg

SEQ ID NO: 669811 - DNA, 25 bp, Mus musculus
gattaataaattgcagggcaagctg

SEQ ID NO: 669812 - DNA, 25 bp, Mus musculus
gattaataaggactcagtcccagca

SEQ ID NO: 669813 - DNA, 25 bp, Mus musculus
gattaataaggagtcagtcccagca

SEQ ID NO: 669814 - DNA, 25 bp, Mus musculus
gattaatcagcccaaagttgtagca

SEQ ID NO: 669815 - DNA, 25 bp, Mus musculus
gattaatcagccgaaagttgtagca

SEQ ID NO: 669816 - DNA, 25 bp, Mus musculus
gattaatctttcagggaatacagaa

SEQ ID NO: 669817 - DNA, 25 bp, Mus musculus
gattaatctttctgggaatacagaa

SEQ ID NO: 669818 - DNA, 25 bp, Mus musculus
gattaatggagaagtagctattctg

SEQ ID NO: 669819 - DNA, 25 bp, Mus musculus
gattaatggagatgtagctattctg

SEQ ID NO: 669820 - DNA, 25 bp, Mus musculus
gattaattccaaccaaatcccaggg

SEQ ID NO: 669821 - DNA, 25 bp, Mus musculus
gattaattccaagcaaatcccaggg

SEQ ID NO: 669822 - DNA, 25 bp, Mus musculus
gattaattcttcagcctccgatagg

SEQ ID NO: 669823 - DNA, 25 bp, Mus musculus
gattaattcttctgcctccgatagg

SEQ ID NO: 669824 - DNA, 25 bp, Mus musculus
gattacaaaagacttgttccacctt

SEQ ID NO: 669825 - DNA, 25 bp, Mus musculus
gattacaaaagagttgttccacctt

SEQ ID NO: 669826 - DNA, 25 bp, Mus musculus
gattacaaagacagcaactcagcag

SEQ ID NO: 669827 - DNA, 25 bp, Mus musculus
gattacaaagactgcaactcagcag

SEQ ID NO: 669828 - DNA, 25 bp, Mus musculus
gattacaacactcccctggatgtcc

SEQ ID NO: 669829 - DNA, 25 bp, Mus musculus
gattacaacactgccctggatgtcc

SEQ ID NO: 669830 - DNA, 25 bp, Mus musculus
gattacaacgatcccgacatggcgc

SEQ ID NO: 669831 - DNA, 25 bp, Mus musculus
gattacaacgatgccgacatggcgc

SEQ ID NO: 669832 - DNA, 25 bp, Mus musculus
gattacaagcctcaaaaccgcccta

SEQ ID NO: 669833 - DNA, 25 bp, Mus musculus
gattacaagcctgaaaaccgcccta

SEQ ID NO: 669834 - DNA, 25 bp, Mus musculus
gattacacaacacctcccagtgagg

SEQ ID NO: 669835 - DNA, 25 bp, Mus musculus
gattacacaacagctcccagtgagg

SEQ ID NO: 669836 - DNA, 25 bp, Mus musculus
gattacacacccaacctaaaattca

SEQ ID NO: 669837 - DNA, 25 bp, Mus musculus
gattacacaccctacctaaaattca

SEQ ID NO: 669838 - DNA, 25 bp, Mus musculus
gattacacagcgctaacaaagttct

SEQ ID NO: 669839 - DNA, 25 bp, Mus musculus
gattacacagcggtaacaaagttct

SEQ ID NO: 669840 - DNA, 25 bp, Mus musculus
gattacagactacgtacaagtaaac

SEQ ID NO: 669841 - DNA, 25 bp, Mus musculus
gattacagactaggtacaagtaaac

SEQ ID NO: 669842 - DNA, 25 bp, Mus musculus
gattacagagccaaattgacccaga

SEQ ID NO: 669843 - DNA, 25 bp, Mus musculus
gattacagagcctaattgacccaga

SEQ ID NO: 669844 - DNA, 25 bp, Mus musculus
gattacagatctcgtgccctgctgc

SEQ ID NO: 669845 - DNA, 25 bp, Mus musculus
gattacagatctggtgccctgctgc

SEQ ID NO: 669846 - DNA, 25 bp, Mus musculus
gattacagatggatcagtactaaaa

SEQ ID NO: 669847 - DNA, 25 bp, Mus musculus
gattacagatggttcagtactaaaa

SEQ ID NO: 669848 - DNA, 25 bp, Mus musculus
gattacagccttagtagagccgttt

SEQ ID NO: 669849 - DNA, 25 bp, Mus musculus
gattacagcctttgtagagccgttt

SEQ ID NO: 669850 - DNA, 25 bp, Mus musculus
gattacaggagacaagatgcgagcc

SEQ ID NO: 669851 - DNA, 25 bp, Mus musculus
gattacaggagagaagatgcgagcc

SEQ ID NO: 669852 - DNA, 25 bp, Mus musculus
gattacaggcagcttccaccagaca

SEQ ID NO: 669853 - DNA, 25 bp, Mus musculus
gattacaggcaggttccaccagaca

SEQ ID NO: 669854 - DNA, 25 bp, Mus musculus
gattacataggcctgagccatccca

SEQ ID NO: 669855 - DNA, 25 bp, Mus musculus
gattacataggcgtgagccatccca

SEQ ID NO: 669856 - DNA, 25 bp, Mus musculus
gattacatcaaccaccggcagtacg

SEQ ID NO: 669857 - DNA, 25 bp, Mus musculus
gattacatcaacgaccggcagtacg

SEQ ID NO: 669858 - DNA, 25 bp, Mus musculus
gattacatccctcgctcatccaatg

SEQ ID NO: 669859 - DNA, 25 bp, Mus musculus
gattacatccctggctcatccaatg

SEQ ID NO: 669860 - DNA, 25 bp, Mus musculus
gattacatcgtgaccagctccttct

SEQ ID NO: 669861 - DNA, 25 bp, Mus musculus
gattacatcgtgtccagctccttct

SEQ ID NO: 669862 - DNA, 25 bp, Mus musculus
gattacatcttactgagggaccaaa

SEQ ID NO: 669863 - DNA, 25 bp, Mus musculus
gattacatcttagtgagggaccaaa

SEQ ID NO: 669864 - DNA, 25 bp, Mus musculus
gattacatgaggcatctttaccggc

SEQ ID NO: 669865 - DNA, 25 bp, Mus musculus
gattacatgagggatctttaccggc

SEQ ID NO: 669866 - DNA, 25 bp, Mus musculus
gattacattaacagcaacaggagtg

SEQ ID NO: 669867 - DNA, 25 bp, Mus musculus
gattacattaactgcaacaggagtg

SEQ ID NO: 669868 - DNA, 25 bp, Mus musculus
gattacattgcgctgaatccacatt

SEQ ID NO: 669869 - DNA, 25 bp, Mus musculus
gattacattgcggtgaatccacatt

SEQ ID NO: 669870 - DNA, 25 bp, Mus musculus
gattacattggtagacaaactgtct

SEQ ID NO: 669871 - DNA, 25 bp, Mus musculus
gattacattggttgacaaactgtct

SEQ ID NO: 669872 - DNA, 25 bp, Mus musculus
gattaccaaattcatggtcacacag

SEQ ID NO: 669873 - DNA, 25 bp, Mus musculus
gattaccaaattgatggtcacacag

SEQ ID NO: 669874 - DNA, 25 bp, Mus musculus
gattaccaattccaagtggagctgg

SEQ ID NO: 669875 - DNA, 25 bp, Mus musculus
gattaccaattcgaagtggagctgg

SEQ ID NO: 669876 - DNA, 25 bp, Mus musculus
gattaccaggcaattgttgatgccg

SEQ ID NO: 669877 - DNA, 25 bp, Mus musculus
gattaccaggcatttgttgatgccg

SEQ ID NO: 669878 - DNA, 25 bp, Mus musculus
gattaccagggtacaggcaaaccac

SEQ ID NO: 669879 - DNA, 25 bp, Mus musculus
gattaccagggttcaggcaaaccac

SEQ ID NO: 669880 - DNA, 25 bp, Mus musculus
gattacccaccacgcatcagctgtt

SEQ ID NO: 669881 - DNA, 25 bp, Mus musculus
gattacccaccaggcatcagctgtt

SEQ ID NO: 669882 - DNA, 25 bp, Mus musculus
gattaccccaagctcagccagtctt

SEQ ID NO: 669883 - DNA, 25 bp, Mus musculus
gattaccccaaggtcagccagtctt

SEQ ID NO: 669884 - DNA, 25 bp, Mus musculus
gattaccctatcctctccaaatgaa

SEQ ID NO: 669885 - DNA, 25 bp, Mus musculus
gattaccctatcgtctccaaatgaa

SEQ ID NO: 669886 - DNA, 25 bp, Mus musculus
gattaccctgaaccggcggtgttcc

SEQ ID NO: 669887 - DNA, 25 bp, Mus musculus
gattaccctgaagcggcggtgttcc

SEQ ID NO: 669888 - DNA, 25 bp, Mus musculus
gattaccgccacctgggtttaccag

SEQ ID NO: 669889 - DNA, 25 bp, Mus musculus
gattaccgccacgtgggtttaccag

SEQ ID NO: 669890 - DNA, 25 bp, Mus musculus
gattaccggtgtaggtgctgtctcc

SEQ ID NO: 669891 - DNA, 25 bp, Mus musculus
gattaccggtgttggtgctgtctcc

SEQ ID NO: 669892 - DNA, 25 bp, Mus musculus
gattaccgtggccaggtagacgtta

SEQ ID NO: 669893 - DNA, 25 bp, Mus musculus
gattaccgtggcgaggtagacgtta

SEQ ID NO: 669894 - DNA, 25 bp, Mus musculus
gattacgcacgcaattcgggctcct

SEQ ID NO: 669895 - DNA, 25 bp, Mus musculus
gattacgcacgctattcgggctcct

SEQ ID NO: 669896 - DNA, 25 bp, Mus musculus
gattacggatccaaagtcagtctct

SEQ ID NO: 669897 - DNA, 25 bp, Mus musculus
gattacggatcctaagtcagtctct

SEQ ID NO: 669898 - DNA, 25 bp, Mus musculus
gattacggtggtcccgtctgccaag

SEQ ID NO: 669899 - DNA, 25 bp, Mus musculus
gattacggtggtgccgtctgccaag

SEQ ID NO: 669900 - DNA, 25 bp, Mus musculus
gattacgtaagccactgcggcccta

SEQ ID NO: 669901 - DNA, 25 bp, Mus musculus
gattacgtaagcgactgcggcccta

SEQ ID NO: 669902 - DNA, 25 bp, Mus musculus
gattactatgccagtgcccggttgg

SEQ ID NO: 669903 - DNA, 25 bp, Mus musculus
gattactatgcctgtgcccggttgg

SEQ ID NO: 669904 - DNA, 25 bp, Mus musculus
gattactcacctatgaaacatggcc

SEQ ID NO: 669905 - DNA, 25 bp, Mus musculus
gattactcacctttgaaacatggcc

SEQ ID NO: 669906 - DNA, 25 bp, Mus musculus
gattactcccatcaaggcacaaaca

SEQ ID NO: 669907 - DNA, 25 bp, Mus musculus
gattactcccatgaaggcacaaaca

SEQ ID NO: 669908 - DNA, 25 bp, Mus musculus
gattactccggaccgaagcatgatt

SEQ ID NO: 669909 - DNA, 25 bp, Mus musculus
gattactccggagcgaagcatgatt

SEQ ID NO: 669910 - DNA, 25 bp, Mus musculus
gattactcctacaggtcacatacct

SEQ ID NO: 669911 - DNA, 25 bp, Mus musculus
gattactcctactggtcacatacct

SEQ ID NO: 669912 - DNA, 25 bp, Mus musculus
gattactctgtacaaccattgcagg

SEQ ID NO: 669913 - DNA, 25 bp, Mus musculus
gattactctgtagaaccattgcagg

SEQ ID NO: 669914 - DNA, 25 bp, Mus musculus
gattactgcttcctcctagaagatg

SEQ ID NO: 669915 - DNA, 25 bp, Mus musculus
gattactgcttcgtcctagaagatg

SEQ ID NO: 669916 - DNA, 25 bp, Mus musculus
gattactggcgtctactgaaccctg

SEQ ID NO: 669917 - DNA, 25 bp, Mus musculus
gattactggcgtgtactgaaccctg

SEQ ID NO: 669918 - DNA, 25 bp, Mus musculus
gattactgtttgaaacgagagttgc

SEQ ID NO: 669919 - DNA, 25 bp, Mus musculus
gattactgtttgtaacgagagttgc

SEQ ID NO: 669920 - DNA, 25 bp, Mus musculus
gattacttacacacgttaggaaagg

SEQ ID NO: 669921 - DNA, 25 bp, Mus musculus
gattacttacactcgttaggaaagg

SEQ ID NO: 669922 - DNA, 25 bp, Mus musculus
gattacttcaccactgcgtgccctg

SEQ ID NO: 669923 - DNA, 25 bp, Mus musculus
gattacttcacctctgcgtgccctg

SEQ ID NO: 669924 - DNA, 25 bp, Mus musculus
gattacttcagacttaccagtgtta

SEQ ID NO: 669925 - DNA, 25 bp, Mus musculus
gattacttcagagttaccagtgtta

SEQ ID NO: 669926 - DNA, 25 bp, Mus musculus
gattacttccctaccggcacgatga

SEQ ID NO: 669927 - DNA, 25 bp, Mus musculus
gattacttcccttccggcacgatga

SEQ ID NO: 669928 - DNA, 25 bp, Mus musculus
gattacttctgtaccatcgcccaca

SEQ ID NO: 669929 - DNA, 25 bp, Mus musculus
gattacttctgttccatcgcccaca

SEQ ID NO: 669930 - DNA, 25 bp, Mus musculus
gattacttctttcagccagcatcgg

SEQ ID NO: 669931 - DNA, 25 bp, Mus musculus
gattacttctttgagccagcatcgg

SEQ ID NO: 669932 - DNA, 25 bp, Mus musculus
gattacttgattatgctggcctgcc

SEQ ID NO: 669933 - DNA, 25 bp, Mus musculus
gattacttgattttgctggcctgcc

SEQ ID NO: 669934 - DNA, 25 bp, Mus musculus
gattagaacgacaccgcaaagagag

SEQ ID NO: 669935 - DNA, 25 bp, Mus musculus
gattagaacgactccgcaaagagag

SEQ ID NO: 669936 - DNA, 25 bp, Mus musculus
gattagaagacaacagcctatgtta

SEQ ID NO: 669937 - DNA, 25 bp, Mus musculus
gattagaagacatcagcctatgtta

SEQ ID NO: 669938 - DNA, 25 bp, Mus musculus
gattagaagactcagctgccaggca

SEQ ID NO: 669939 - DNA, 25 bp, Mus musculus
gattagaagactgagctgccaggca

SEQ ID NO: 669940 - DNA, 25 bp, Mus musculus
gattagaattgaaaactgtcttgac

SEQ ID NO: 669941 - DNA, 25 bp, Mus musculus
gattagaattgataactgtcttgac

SEQ ID NO: 669942 - DNA, 25 bp, Mus musculus
gattagacaatcagaaattaagaca

SEQ ID NO: 669943 - DNA, 25 bp, Mus musculus
gattagacaatctgaaattaagaca

SEQ ID NO: 669944 - DNA, 25 bp, Mus musculus
gattagacccagcaacaggaagaga

SEQ ID NO: 669945 - DNA, 25 bp, Mus musculus
gattagacccaggaacaggaagaga

SEQ ID NO: 669946 - DNA, 25 bp, Mus musculus
gattagactgtaagctcgccaaggg

SEQ ID NO: 669947 - DNA, 25 bp, Mus musculus
gattagactgtatgctcgccaaggg

SEQ ID NO: 669948 - DNA, 25 bp, Mus musculus
gattagagctgcctcactgactaca

SEQ ID NO: 669949 - DNA, 25 bp, Mus musculus
gattagagctgcgtcactgactaca

SEQ ID NO: 669950 - DNA, 25 bp, Mus musculus
gattagagcttacactgttgcccaa

SEQ ID NO: 669951 - DNA, 25 bp, Mus musculus
gattagagcttagactgttgcccaa

SEQ ID NO: 669952 - DNA, 25 bp, Mus musculus
gattagatgggcaggttctggtcct

SEQ ID NO: 669953 - DNA, 25 bp, Mus musculus
gattagatgggctggttctggtcct

SEQ ID NO: 669954 - DNA, 25 bp, Mus musculus
gattagatttgtaggtctctgtccc

SEQ ID NO: 669955 - DNA, 25 bp, Mus musculus
gattagatttgttggtctctgtccc

SEQ ID NO: 669956 - DNA, 25 bp, Mus musculus
gattagcagcgtctgaaaacagggc

SEQ ID NO: 669957 - DNA, 25 bp, Mus musculus
gattagcagcgtgtgaaaacagggc

SEQ ID NO: 669958 - DNA, 25 bp, Mus musculus
gattagcctcacaatcagtcacaag

SEQ ID NO: 669959 - DNA, 25 bp, Mus musculus
gattagcctcactatcagtcacaag

SEQ ID NO: 669960 - DNA, 25 bp, Mus musculus
gattagccttacagggcacagagcc

SEQ ID NO: 669961 - DNA, 25 bp, Mus musculus
gattagccttactgggcacagagcc

SEQ ID NO: 669962 - DNA, 25 bp, Mus musculus
gattagctactgagagagatacagt

SEQ ID NO: 669963 - DNA, 25 bp, Mus musculus
gattagctactgtgagagatacagt

SEQ ID NO: 669964 - DNA, 25 bp, Mus musculus
gattaggagcagaacggttcatgac

SEQ ID NO: 669965 - DNA, 25 bp, Mus musculus
gattaggagcagtacggttcatgac

SEQ ID NO: 669966 - DNA, 25 bp, Mus musculus
gattaggcccaacaaaccagttagg

SEQ ID NO: 669967 - DNA, 25 bp, Mus musculus
gattaggcccaagaaaccagttagg

SEQ ID NO: 669968 - DNA, 25 bp, Mus musculus
gattaggctaccatgtagggaaaca

SEQ ID NO: 669969 - DNA, 25 bp, Mus musculus
gattaggctaccttgtagggaaaca

SEQ ID NO: 669970 - DNA, 25 bp, Mus musculus
gattaggctgctacaatctcagcat

SEQ ID NO: 669971 - DNA, 25 bp, Mus musculus
gattaggctgcttcaatctcagcat

SEQ ID NO: 669972 - DNA, 25 bp, Mus musculus
gattagtcagccaggatgggaaaag

SEQ ID NO: 669973 - DNA, 25 bp, Mus musculus
gattagtcagcctggatgggaaaag

SEQ ID NO: 669974 - DNA, 25 bp, Mus musculus
gattagtcggaactcgagattctct

SEQ ID NO: 669975 - DNA, 25 bp, Mus musculus
gattagtcggaagtcgagattctct

SEQ ID NO: 669976 - DNA, 25 bp, Mus musculus
gattagtcgtatctaatggccagac

SEQ ID NO: 669977 - DNA, 25 bp, Mus musculus
gattagtcgtatgtaatggccagac

SEQ ID NO: 669978 - DNA, 25 bp, Mus musculus
gattagtcttcaccacagccaccgg

SEQ ID NO: 669979 - DNA, 25 bp, Mus musculus
gattagtcttcagcacagccaccgg

SEQ ID NO: 669980 - DNA, 25 bp, Mus musculus
gattagtcttgaaccagagaacttg

SEQ ID NO: 669981 - DNA, 25 bp, Mus musculus
gattagtcttgatccagagaacttg

SEQ ID NO: 669982 - DNA, 25 bp, Mus musculus
gattagtgccccactctcatttgaa

SEQ ID NO: 669983 - DNA, 25 bp, Mus musculus
gattagtgcccctctctcatttgaa

SEQ ID NO: 669984 - DNA, 25 bp, Mus musculus
gattagtgggatatgccctcagaag

SEQ ID NO: 669985 - DNA, 25 bp, Mus musculus
gattagtgggatttgccctcagaag

SEQ ID NO: 669986 - DNA, 25 bp, Mus musculus
gattagtgtcccaccagtctgagca

SEQ ID NO: 669987 - DNA, 25 bp, Mus musculus
gattagtgtccctccagtctgagca

SEQ ID NO: 669988 - DNA, 25 bp, Mus musculus
gattataaactaaaccatgcactct

SEQ ID NO: 669989 - DNA, 25 bp, Mus musculus
gattataaactataccatgcactct

SEQ ID NO: 669990 - DNA, 25 bp, Mus musculus
gattataaatctagagccatcacac

SEQ ID NO: 669991 - DNA, 25 bp, Mus musculus
gattataaatcttgagccatcacac

SEQ ID NO: 669992 - DNA, 25 bp, Mus musculus
gattataacccacagtgcttctcag

SEQ ID NO: 669993 - DNA, 25 bp, Mus musculus
gattataacccagagtgcttctcag

SEQ ID NO: 669994 - DNA, 25 bp, Mus musculus
gattataatcgccatgcagtgatca

SEQ ID NO: 669995 - DNA, 25 bp, Mus musculus
gattataatcgcgatgcagtgatca

SEQ ID NO: 669996 - DNA, 25 bp, Mus musculus
gattataccttgaaagatcactgac

SEQ ID NO: 669997 - DNA, 25 bp, Mus musculus
gattataccttgtaagatcactgac

SEQ ID NO: 669998 - DNA, 25 bp, Mus musculus
gattataggcacacatcaccctgcc

SEQ ID NO: 669999 - DNA, 25 bp, Mus musculus
gattataggcactcatcaccctgcc

SEQ ID NO: 670000 - DNA, 25 bp, Mus musculus
gattataggttaacttcatagtcca

SEQ ID NO: 670001 - DNA, 25 bp, Mus musculus
gattataggttatcttcatagtcca

SEQ ID NO: 670002 - DNA, 25 bp, Mus musculus
gattatagtacccagaagaacaccg

SEQ ID NO: 670003 - DNA, 25 bp, Mus musculus
gattatagtaccgagaagaacaccg

SEQ ID NO: 670004 - DNA, 25 bp, Mus musculus
gattatatccagcagctgcggcaga

SEQ ID NO: 670005 - DNA, 25 bp, Mus musculus
gattatatccaggagctgcggcaga

SEQ ID NO: 670006 - DNA, 25 bp, Mus musculus
gattatatctcacaagagggacact

SEQ ID NO: 670007 - DNA, 25 bp, Mus musculus
gattatatctcagaagagggacact

SEQ ID NO: 670008 - DNA, 25 bp, Mus musculus
gattatatctgtcaatattgtgctc

SEQ ID NO: 670009 - DNA, 25 bp, Mus musculus
gattatatctgtgaatattgtgctc

SEQ ID NO: 670010 - DNA, 25 bp, Mus musculus
gattatatgtgcctctctgaagctg

SEQ ID NO: 670011 - DNA, 25 bp, Mus musculus
gattatatgtgcgtctctgaagctg

SEQ ID NO: 670012 - DNA, 25 bp, Mus musculus
gattatatttctagagctgagtctc

SEQ ID NO: 670013 - DNA, 25 bp, Mus musculus
gattatatttcttgagctgagtctc

SEQ ID NO: 670014 - DNA, 25 bp, Mus musculus
gattatcaattcagagtctgcgccc

SEQ ID NO: 670015 - DNA, 25 bp, Mus musculus
gattatcaattctgagtctgcgccc

SEQ ID NO: 670016 - DNA, 25 bp, Mus musculus
gattatcaggatcttatagaccgag

SEQ ID NO: 670017 - DNA, 25 bp, Mus musculus
gattatcaggatgttatagaccgag

SEQ ID NO: 670018 - DNA, 25 bp, Mus musculus
gattatcatcaaacatccaggtgct

SEQ ID NO: 670019 - DNA, 25 bp, Mus musculus
gattatcatcaatcatccaggtgct

SEQ ID NO: 670020 - DNA, 25 bp, Mus musculus
gattatcatggaaatggtagataca

SEQ ID NO: 670021 - DNA, 25 bp, Mus musculus
gattatcatggatatggtagataca

SEQ ID NO: 670022 - DNA, 25 bp, Mus musculus
gattatccaccacgacgggtattcg

SEQ ID NO: 670023 - DNA, 25 bp, Mus musculus
gattatccaccaggacgggtattcg

SEQ ID NO: 670024 - DNA, 25 bp, Mus musculus
gattatccccagctaagttcagtat

SEQ ID NO: 670025 - DNA, 25 bp, Mus musculus
gattatccccaggtaagttcagtat

SEQ ID NO: 670026 - DNA, 25 bp, Mus musculus
gattatccttacattgaagccctca

SEQ ID NO: 670027 - DNA, 25 bp, Mus musculus
gattatccttactttgaagccctca

SEQ ID NO: 670028 - DNA, 25 bp, Mus musculus
gattatcgacagcaaaaagcacata

SEQ ID NO: 670029 - DNA, 25 bp, Mus musculus
gattatcgacaggaaaaagcacata

SEQ ID NO: 670030 - DNA, 25 bp, Mus musculus
gattatctgagcactcagctcctcc

SEQ ID NO: 670031 - DNA, 25 bp, Mus musculus
gattatctgagctctcagctcctcc

SEQ ID NO: 670032 - DNA, 25 bp, Mus musculus
gattatctggagcagtttggaactt

SEQ ID NO: 670033 - DNA, 25 bp, Mus musculus
gattatctggaggagtttggaactt

SEQ ID NO: 670034 - DNA, 25 bp, Mus musculus
gattatcttgagatgaccaggttga

SEQ ID NO: 670035 - DNA, 25 bp, Mus musculus
gattatcttgagttgaccaggttga

SEQ ID NO: 670036 - DNA, 25 bp, Mus musculus
gattatgaaggcatcaaggttaaga

SEQ ID NO: 670037 - DNA, 25 bp, Mus musculus
gattatgaaggcttcaaggttaaga

SEQ ID NO: 670038 - DNA, 25 bp, Mus musculus
gattatgacgttccagccccgctgt

SEQ ID NO: 670039 - DNA, 25 bp, Mus musculus
gattatgacgttgcagccccgctgt

SEQ ID NO: 670040 - DNA, 25 bp, Mus musculus
gattatgaggccatccttctcatag

SEQ ID NO: 670041 - DNA, 25 bp, Mus musculus
gattatgaggccttccttctcatag

SEQ ID NO: 670042 - DNA, 25 bp, Mus musculus
gattatgagtcaacttggaccccac

SEQ ID NO: 670043 - DNA, 25 bp, Mus musculus
gattatgagtcatcttggaccccac

SEQ ID NO: 670044 - DNA, 25 bp, Mus musculus
gattatgagttcaacgtggtggcct

SEQ ID NO: 670045 - DNA, 25 bp, Mus musculus
gattatgagttctacgtggtggcct

SEQ ID NO: 670046 - DNA, 25 bp, Mus musculus
gattatgatatacattttgttccac

SEQ ID NO: 670047 - DNA, 25 bp, Mus musculus
gattatgatatagattttgttccac

SEQ ID NO: 670048 - DNA, 25 bp, Mus musculus
gattatgcaaaaagagcactagaga

SEQ ID NO: 670049 - DNA, 25 bp, Mus musculus
gattatgcaaaatgagcactagaga

SEQ ID NO: 670050 - DNA, 25 bp, Mus musculus
gattatgcccctatggagtcctcag

SEQ ID NO: 670051 - DNA, 25 bp, Mus musculus
gattatgcccctttggagtcctcag

SEQ ID NO: 670052 - DNA, 25 bp, Mus musculus
gattatgctcaaatacccagatgct

SEQ ID NO: 670053 - DNA, 25 bp, Mus musculus
gattatgctcaattacccagatgct

SEQ ID NO: 670054 - DNA, 25 bp, Mus musculus
gattatggcatcaatacaatgccag

SEQ ID NO: 670055 - DNA, 25 bp, Mus musculus
gattatggcatctatacaatgccag

SEQ ID NO: 670056 - DNA, 25 bp, Mus musculus
gattatggccagagtcgactccgtg

SEQ ID NO: 670057 - DNA, 25 bp, Mus musculus
gattatggccagtgtcgactccgtg

SEQ ID NO: 670058 - DNA, 25 bp, Mus musculus
gattatggctatctgcagactacat

SEQ ID NO: 670059 - DNA, 25 bp, Mus musculus
gattatggctatgtgcagactacat

SEQ ID NO: 670060 - DNA, 25 bp, Mus musculus
gattatggtactccccgtcggacag

SEQ ID NO: 670061 - DNA, 25 bp, Mus musculus
gattatggtactgcccgtcggacag

SEQ ID NO: 670062 - DNA, 25 bp, Mus musculus
gattatggtcagacagtcttgatct

SEQ ID NO: 670063 - DNA, 25 bp, Mus musculus
gattatggtcagtcagtcttgatct

SEQ ID NO: 670064 - DNA, 25 bp, Mus musculus
gattatggtgccatggctatcatca

SEQ ID NO: 670065 - DNA, 25 bp, Mus musculus
gattatggtgccttggctatcatca

SEQ ID NO: 670066 - DNA, 25 bp, Mus musculus
gattatggtgctaaagtccccaccc

SEQ ID NO: 670067 - DNA, 25 bp, Mus musculus
gattatggtgcttaagtccccaccc

SEQ ID NO: 670068 - DNA, 25 bp, Mus musculus
gattatgtcaatcggactgatcagg

SEQ ID NO: 670069 - DNA, 25 bp, Mus musculus
gattatgtcaatgggactgatcagg

SEQ ID NO: 670070 - DNA, 25 bp, Mus musculus
gattatgtctcgcatcgaatccctc

SEQ ID NO: 670071 - DNA, 25 bp, Mus musculus
gattatgtctcggatcgaatccctc

SEQ ID NO: 670072 - DNA, 25 bp, Mus musculus
gattatgtgcatcttaggcagctca

SEQ ID NO: 670073 - DNA, 25 bp, Mus musculus
gattatgtgcatgttaggcagctca

SEQ ID NO: 670074 - DNA, 25 bp, Mus musculus
gattatgtggcgaaccgccacctgg

SEQ ID NO: 670075 - DNA, 25 bp, Mus musculus
gattatgtggcgtaccgccacctgg

SEQ ID NO: 670076 - DNA, 25 bp, Mus musculus
gattatgttcgactaacccagcttt

SEQ ID NO: 670077 - DNA, 25 bp, Mus musculus
gattatgttcgagtaacccagcttt

SEQ ID NO: 670078 - DNA, 25 bp, Mus musculus
gattatgttgcaattggagctgatg

SEQ ID NO: 670079 - DNA, 25 bp, Mus musculus
gattatgttgcatttggagctgatg

SEQ ID NO: 670080 - DNA, 25 bp, Mus musculus
gattattaacacagacgaacttgga

SEQ ID NO: 670081 - DNA, 25 bp, Mus musculus
gattattaacactgacgaacttgga

SEQ ID NO: 670082 - DNA, 25 bp, Mus musculus
gattattactacctgtcggtgaagg

SEQ ID NO: 670083 - DNA, 25 bp, Mus musculus
gattattactacgtgtcggtgaagg

SEQ ID NO: 670084 - DNA, 25 bp, Mus musculus
gattattcattgattccagaatccc

SEQ ID NO: 670085 - DNA, 25 bp, Mus musculus
gattattcattgtttccagaatccc

SEQ ID NO: 670086 - DNA, 25 bp, Mus musculus
gattattccaaaaaccagccaattt

SEQ ID NO: 670087 - DNA, 25 bp, Mus musculus
gattattccaaataccagccaattt

SEQ ID NO: 670088 - DNA, 25 bp, Mus musculus
gattattccaggaatcctccaagag

SEQ ID NO: 670089 - DNA, 25 bp, Mus musculus
gattattccaggtatcctccaagag

SEQ ID NO: 670090 - DNA, 25 bp, Mus musculus
gattattcctgcacgccagtgagag

SEQ ID NO: 670091 - DNA, 25 bp, Mus musculus
gattattcctgctcgccagtgagag

SEQ ID NO: 670092 - DNA, 25 bp, Mus musculus
gattattgctggacattttggaaaa

SEQ ID NO: 670093 - DNA, 25 bp, Mus musculus
gattattgctggtcattttggaaaa

SEQ ID NO: 670094 - DNA, 25 bp, Mus musculus
gattattggagcatggaattaccct

SEQ ID NO: 670095 - DNA, 25 bp, Mus musculus
gattattggagcttggaattaccct

SEQ ID NO: 670096 - DNA, 25 bp, Mus musculus
gattattgtcaccttaattacctga

SEQ ID NO: 670097 - DNA, 25 bp, Mus musculus
gattattgtcacgttaattacctga

SEQ ID NO: 670098 - DNA, 25 bp, Mus musculus
gattatttctcccttgatcccctca

SEQ ID NO: 670099 - DNA, 25 bp, Mus musculus
gattatttctccgttgatcccctca

SEQ ID NO: 670100 - DNA, 25 bp, Mus musculus
gattatttgtcaccacaatccggtc

SEQ ID NO: 670101 - DNA, 25 bp, Mus musculus
gattatttgtcagcacaatccggtc

SEQ ID NO: 670102 - DNA, 25 bp, Mus musculus
gattattttactaagtttggagagg

SEQ ID NO: 670103 - DNA, 25 bp, Mus musculus
gattattttacttagtttggagagg

SEQ ID NO: 670104 - DNA, 25 bp, Mus musculus
gattattttctgaagatgttttggg

SEQ ID NO: 670105 - DNA, 25 bp, Mus musculus
gattattttctgtagatgttttggg

SEQ ID NO: 670106 - DNA, 25 bp, Mus musculus
gattcaaaaaatacatccgcagaga

SEQ ID NO: 670107 - DNA, 25 bp, Mus musculus
gattcaaaaaattcatccgcagaga

SEQ ID NO: 670108 - DNA, 25 bp, Mus musculus
gattcaaaaagaagtccgcagcaga

SEQ ID NO: 670109 - DNA, 25 bp, Mus musculus
gattcaaaaagatgtccgcagcaga

SEQ ID NO: 670110 - DNA, 25 bp, Mus musculus
gattcaaaatggagtagcacacgcc

SEQ ID NO: 670111 - DNA, 25 bp, Mus musculus
gattcaaaatggtgtagcacacgcc

SEQ ID NO: 670112 - DNA, 25 bp, Mus musculus
gattcaaagatgaccggaaccctga

SEQ ID NO: 670113 - DNA, 25 bp, Mus musculus
gattcaaagatgtccggaaccctga

SEQ ID NO: 670114 - DNA, 25 bp, Mus musculus
gattcaaaggagagttaatccacgt

SEQ ID NO: 670115 - DNA, 25 bp, Mus musculus
gattcaaaggagtgttaatccacgt

SEQ ID NO: 670116 - DNA, 25 bp, Mus musculus
gattcaacagagcttccgagcacta

SEQ ID NO: 670117 - DNA, 25 bp, Mus musculus
gattcaacagaggttccgagcacta

SEQ ID NO: 670118 - DNA, 25 bp, Mus musculus
gattcaactttacaagaacatccat

SEQ ID NO: 670119 - DNA, 25 bp, Mus musculus
gattcaactttagaagaacatccat

SEQ ID NO: 670120 - DNA, 25 bp, Mus musculus
gattcaagaaggacttttggtgacc

SEQ ID NO: 670121 - DNA, 25 bp, Mus musculus
gattcaagaaggtcttttggtgacc

SEQ ID NO: 670122 - DNA, 25 bp, Mus musculus
gattcaagcaataaaacatttctct

SEQ ID NO: 670123 - DNA, 25 bp, Mus musculus
gattcaagcaattaaacatttctct

SEQ ID NO: 670124 - DNA, 25 bp, Mus musculus
gattcaagcaccagttctacttcac

SEQ ID NO: 670125 - DNA, 25 bp, Mus musculus
gattcaagcacctgttctacttcac

SEQ ID NO: 670126 - DNA, 25 bp, Mus musculus
gattcaagggctacgtgaggcttgt

SEQ ID NO: 670127 - DNA, 25 bp, Mus musculus
gattcaagggcttcgtgaggcttgt

SEQ ID NO: 670128 - DNA, 25 bp, Mus musculus
gattcaataagaagttaattaccag

SEQ ID NO: 670129 - DNA, 25 bp, Mus musculus
gattcaataagatgttaattaccag

SEQ ID NO: 670130 - DNA, 25 bp, Mus musculus
gattcaatgggactagccttgccac

SEQ ID NO: 670131 - DNA, 25 bp, Mus musculus
gattcaatgggagtagccttgccac

SEQ ID NO: 670132 - DNA, 25 bp, Mus musculus
gattcacaaattcacatcgctacag

SEQ ID NO: 670133 - DNA, 25 bp, Mus musculus
gattcacaaattgacatcgctacag

SEQ ID NO: 670134 - DNA, 25 bp, Mus musculus
gattcacaactgcagtccatccaca

SEQ ID NO: 670135 - DNA, 25 bp, Mus musculus
gattcacaactggagtccatccaca

SEQ ID NO: 670136 - DNA, 25 bp, Mus musculus
gattcacaagatcctgctctccatt

SEQ ID NO: 670137 - DNA, 25 bp, Mus musculus
gattcacaagatgctgctctccatt

SEQ ID NO: 670138 - DNA, 25 bp, Mus musculus
gattcacaagtacgcaaagagcaca

SEQ ID NO: 670139 - DNA, 25 bp, Mus musculus
gattcacaagtaggcaaagagcaca

SEQ ID NO: 670140 - DNA, 25 bp, Mus musculus
gattcacacggcagacgccggtaga

SEQ ID NO: 670141 - DNA, 25 bp, Mus musculus
gattcacacggctgacgccggtaga

SEQ ID NO: 670142 - DNA, 25 bp, Mus musculus
gattcacagtacagtttccctctgg

SEQ ID NO: 670143 - DNA, 25 bp, Mus musculus
gattcacagtactgtttccctctgg

SEQ ID NO: 670144 - DNA, 25 bp, Mus musculus
gattcacctcgaaccggaagaccaa

SEQ ID NO: 670145 - DNA, 25 bp, Mus musculus
gattcacctcgatccggaagaccaa

SEQ ID NO: 670146 - DNA, 25 bp, Mus musculus
gattcacctgtgagatgttccatcc

SEQ ID NO: 670147 - DNA, 25 bp, Mus musculus
gattcacctgtgtgatgttccatcc

SEQ ID NO: 670148 - DNA, 25 bp, Mus musculus
gattcacgctgcagccagatggaaa

SEQ ID NO: 670149 - DNA, 25 bp, Mus musculus
gattcacgctgctgccagatggaaa

SEQ ID NO: 670150 - DNA, 25 bp, Mus musculus
gattcacgtcgtaagggtcgcaaca

SEQ ID NO: 670151 - DNA, 25 bp, Mus musculus
gattcacgtcgttagggtcgcaaca

SEQ ID NO: 670152 - DNA, 25 bp, Mus musculus
gattcactaatccaggtggcttgtt

SEQ ID NO: 670153 - DNA, 25 bp, Mus musculus
gattcactaatcgaggtggcttgtt

SEQ ID NO: 670154 - DNA, 25 bp, Mus musculus
gattcactgcccctcaaagcatttg

SEQ ID NO: 670155 - DNA, 25 bp, Mus musculus
gattcactgcccgtcaaagcatttg

SEQ ID NO: 670156 - DNA, 25 bp, Mus musculus
gattcactggctcacagcccttcgg

SEQ ID NO: 670157 - DNA, 25 bp, Mus musculus
gattcactggctgacagcccttcgg

SEQ ID NO: 670158 - DNA, 25 bp, Mus musculus
gattcacttggccaggaacctcagg

SEQ ID NO: 670159 - DNA, 25 bp, Mus musculus
gattcacttggcgaggaacctcagg

SEQ ID NO: 670160 - DNA, 25 bp, Mus musculus
gattcactttctaccatcctacaag

SEQ ID NO: 670161 - DNA, 25 bp, Mus musculus
gattcactttcttccatcctacaag

SEQ ID NO: 670162 - DNA, 25 bp, Mus musculus
gattcagaaattccagccctacgat

SEQ ID NO: 670163 - DNA, 25 bp, Mus musculus
gattcagaaattgcagccctacgat

SEQ ID NO: 670164 - DNA, 25 bp, Mus musculus
gattcagaactaatccgtgatggct

SEQ ID NO: 670165 - DNA, 25 bp, Mus musculus
gattcagaactattccgtgatggct

SEQ ID NO: 670166 - DNA, 25 bp, Mus musculus
gattcagaagacaccgactttcagg

SEQ ID NO: 670167 - DNA, 25 bp, Mus musculus
gattcagaagaccaagacgatcaag

SEQ ID NO: 670168 - DNA, 25 bp, Mus musculus
gattcagaagacgaagacgatcaag

SEQ ID NO: 670169 - DNA, 25 bp, Mus musculus
gattcagaagactccgactttcagg

SEQ ID NO: 670170 - DNA, 25 bp, Mus musculus
gattcagacactagaaaagcttggc

SEQ ID NO: 670171 - DNA, 25 bp, Mus musculus
gattcagacacttgaaaagcttggc

SEQ ID NO: 670172 - DNA, 25 bp, Mus musculus
gattcagagaggctacgactctgac

SEQ ID NO: 670173 - DNA, 25 bp, Mus musculus
gattcagagagggtacgactctgac

SEQ ID NO: 670174 - DNA, 25 bp, Mus musculus
gattcagatcctcctcaagctggac

SEQ ID NO: 670175 - DNA, 25 bp, Mus musculus
gattcagatcctgctcaagctggac

SEQ ID NO: 670176 - DNA, 25 bp, Mus musculus
gattcagatgagagccgttgtgtga

SEQ ID NO: 670177 - DNA, 25 bp, Mus musculus
gattcagatgagtgccgttgtgtga

SEQ ID NO: 670178 - DNA, 25 bp, Mus musculus
gattcagcaagcaaaagccagggac

SEQ ID NO: 670179 - DNA, 25 bp, Mus musculus
gattcagcaagctaaagccagggac

SEQ ID NO: 670180 - DNA, 25 bp, Mus musculus
gattcagcaggacgatgagatacgc

SEQ ID NO: 670181 - DNA, 25 bp, Mus musculus
gattcagcaggaggatgagatacgc

SEQ ID NO: 670182 - DNA, 25 bp, Mus musculus
gattcagcatccctcgggtaccgaa

SEQ ID NO: 670183 - DNA, 25 bp, Mus musculus
gattcagcatccgtcgggtaccgaa

SEQ ID NO: 670184 - DNA, 25 bp, Mus musculus
gattcagccgagaatacacgaggag

SEQ ID NO: 670185 - DNA, 25 bp, Mus musculus
gattcagccgagtatacacgaggag

SEQ ID NO: 670186 - DNA, 25 bp, Mus musculus
gattcagcgtcgatgtctttgagga

SEQ ID NO: 670187 - DNA, 25 bp, Mus musculus
gattcagcgtcgttgtctttgagga

SEQ ID NO: 670188 - DNA, 25 bp, Mus musculus
gattcagctatgaggacctagtgga

SEQ ID NO: 670189 - DNA, 25 bp, Mus musculus
gattcagctatgtggacctagtgga

SEQ ID NO: 670190 - DNA, 25 bp, Mus musculus
gattcaggaataagtcgggctatct

SEQ ID NO: 670191 - DNA, 25 bp, Mus musculus
gattcaggaatatgtcgggctatct

SEQ ID NO: 670192 - DNA, 25 bp, Mus musculus
gattcaggaatgcttcaccctggtc

SEQ ID NO: 670193 - DNA, 25 bp, Mus musculus
gattcaggaatggttcaccctggtc

SEQ ID NO: 670194 - DNA, 25 bp, Mus musculus
gattcaggaggtattcaaccagttc

SEQ ID NO: 670195 - DNA, 25 bp, Mus musculus
gattcaggaggttttcaaccagttc

SEQ ID NO: 670196 - DNA, 25 bp, Mus musculus
gattcaggccacagtcagaagcctg

SEQ ID NO: 670197 - DNA, 25 bp, Mus musculus
gattcaggccactgtcagaagcctg

SEQ ID NO: 670198 - DNA, 25 bp, Mus musculus
gattcaggccttcgaaaagactgct

SEQ ID NO: 670199 - DNA, 25 bp, Mus musculus
gattcaggccttggaaaagactgct

SEQ ID NO: 670200 - DNA, 25 bp, Mus musculus
gattcaggcttgactctcgggagca

SEQ ID NO: 670201 - DNA, 25 bp, Mus musculus
gattcaggcttgtctctcgggagca

SEQ ID NO: 670202 - DNA, 25 bp, Mus musculus
gattcagggcccattccttaggagg

SEQ ID NO: 670203 - DNA, 25 bp, Mus musculus
gattcagggccctttccttaggagg

SEQ ID NO: 670204 - DNA, 25 bp, Mus musculus
gattcaggttaacgagtcttctctt

SEQ ID NO: 670205 - DNA, 25 bp, Mus musculus
gattcaggttaaggagtcttctctt

SEQ ID NO: 670206 - DNA, 25 bp, Mus musculus
gattcagtaagacactctgaagagg

SEQ ID NO: 670207 - DNA, 25 bp, Mus musculus
gattcagtaagagactctgaagagg

SEQ ID NO: 670208 - DNA, 25 bp, Mus musculus
gattcagtacagcaagatagtgtcc

SEQ ID NO: 670209 - DNA, 25 bp, Mus musculus
gattcagtacaggaagatagtgtcc

SEQ ID NO: 670210 - DNA, 25 bp, Mus musculus
gattcagtacatcctatggctctct

SEQ ID NO: 670211 - DNA, 25 bp, Mus musculus
gattcagtacatgctatggctctct

SEQ ID NO: 670212 - DNA, 25 bp, Mus musculus
gattcagtaggcagcatacacagag

SEQ ID NO: 670213 - DNA, 25 bp, Mus musculus
gattcagtaggctgcatacacagag

SEQ ID NO: 670214 - DNA, 25 bp, Mus musculus
gattcagtatccagttgtccgtcaa

SEQ ID NO: 670215 - DNA, 25 bp, Mus musculus
gattcagtatcctgttgtccgtcaa

SEQ ID NO: 670216 - DNA, 25 bp, Mus musculus
gattcagtgactatcttggtttgca

SEQ ID NO: 670217 - DNA, 25 bp, Mus musculus
gattcagtgactttcttggtttgca

SEQ ID NO: 670218 - DNA, 25 bp, Mus musculus
gattcagtgaggaaacctcgagaga

SEQ ID NO: 670219 - DNA, 25 bp, Mus musculus
gattcagtgaggtaacctcgagaga

SEQ ID NO: 670220 - DNA, 25 bp, Mus musculus
gattcagtgtctcgtataccccact

SEQ ID NO: 670221 - DNA, 25 bp, Mus musculus
gattcagtgtctggtataccccact

SEQ ID NO: 670222 - DNA, 25 bp, Mus musculus
gattcagttcaactccaatgaaggg

SEQ ID NO: 670223 - DNA, 25 bp, Mus musculus
gattcagttcaagtccaatgaaggg

SEQ ID NO: 670224 - DNA, 25 bp, Mus musculus
gattcagttgcacactctcctagga

SEQ ID NO: 670225 - DNA, 25 bp, Mus musculus
gattcagttgcagactctcctagga

SEQ ID NO: 670226 - DNA, 25 bp, Mus musculus
gattcagttggtcaaataacgaaag

SEQ ID NO: 670227 - DNA, 25 bp, Mus musculus
gattcagttggtgaaataacgaaag

SEQ ID NO: 670228 - DNA, 25 bp, Mus musculus
gattcagtttgcctgttctgtatgc

SEQ ID NO: 670229 - DNA, 25 bp, Mus musculus
gattcagtttgcgtgttctgtatgc

SEQ ID NO: 670230 - DNA, 25 bp, Mus musculus
gattcatagactacatagctgatga

SEQ ID NO: 670231 - DNA, 25 bp, Mus musculus
gattcatagacttcatagctgatga

SEQ ID NO: 670232 - DNA, 25 bp, Mus musculus
gattcatcccaacgctatctgtgca

SEQ ID NO: 670233 - DNA, 25 bp, Mus musculus
gattcatcccaaggctatctgtgca

SEQ ID NO: 670234 - DNA, 25 bp, Mus musculus
gattcatctaagcaacgagacaaga

SEQ ID NO: 670235 - DNA, 25 bp, Mus musculus
gattcatctaaggaacgagacaaga

SEQ ID NO: 670236 - DNA, 25 bp, Mus musculus
gattcatctcccacttcaacagtgt

SEQ ID NO: 670237 - DNA, 25 bp, Mus musculus
gattcatctccctcttcaacagtgt

SEQ ID NO: 670238 - DNA, 25 bp, Mus musculus
gattcatctggacctctggatagac

SEQ ID NO: 670239 - DNA, 25 bp, Mus musculus
gattcatctggagctctggatagac

SEQ ID NO: 670240 - DNA, 25 bp, Mus musculus
gattcatgaaatccctcaaagtggg

SEQ ID NO: 670241 - DNA, 25 bp, Mus musculus
gattcatgaaatgcctcaaagtggg

SEQ ID NO: 670242 - DNA, 25 bp, Mus musculus
gattcatgatggacttacggttcac

SEQ ID NO: 670243 - DNA, 25 bp, Mus musculus
gattcatgatggatctgacatctca

SEQ ID NO: 670244 - DNA, 25 bp, Mus musculus
gattcatgatggtcttacggttcac

SEQ ID NO: 670245 - DNA, 25 bp, Mus musculus
gattcatgatggttctgacatctca

SEQ ID NO: 670246 - DNA, 25 bp, Mus musculus
gattcatggtacaggtgagcagctc

SEQ ID NO: 670247 - DNA, 25 bp, Mus musculus
gattcatggtactggtgagcagctc

SEQ ID NO: 670248 - DNA, 25 bp, Mus musculus
gattcatgtaagatgtcgcgtggag

SEQ ID NO: 670249 - DNA, 25 bp, Mus musculus
gattcatgtaagttgtcgcgtggag

SEQ ID NO: 670250 - DNA, 25 bp, Mus musculus
gattcatgtgtaagaaaagcatgct

SEQ ID NO: 670251 - DNA, 25 bp, Mus musculus
gattcatgtgtatgaaaagcatgct

SEQ ID NO: 670252 - DNA, 25 bp, Mus musculus
gattcattgaaaactcttcgttatg

SEQ ID NO: 670253 - DNA, 25 bp, Mus musculus
gattcattgaaatctcttcgttatg

SEQ ID NO: 670254 - DNA, 25 bp, Mus musculus
gattccaaaagcctctgagaagaaa

SEQ ID NO: 670255 - DNA, 25 bp, Mus musculus
gattccaaaagcgtctgagaagaaa

SEQ ID NO: 670256 - DNA, 25 bp, Mus musculus
gattccaaaatcaacatctatgatg

SEQ ID NO: 670257 - DNA, 25 bp, Mus musculus
gattccaaaatctacatctatgatg

SEQ ID NO: 670258 - DNA, 25 bp, Mus musculus
gattccaaaatgatgcaaatcaacc

SEQ ID NO: 670259 - DNA, 25 bp, Mus musculus
gattccaaaatgttgcaaatcaacc

SEQ ID NO: 670260 - DNA, 25 bp, Mus musculus
gattccaaaggaaagtacagtgaca

SEQ ID NO: 670261 - DNA, 25 bp, Mus musculus
gattccaaaggatagtacagtgaca

SEQ ID NO: 670262 - DNA, 25 bp, Mus musculus
gattccaacaaacgatgagctgctg

SEQ ID NO: 670263 - DNA, 25 bp, Mus musculus
gattccaacaaaggatgagctgctg

SEQ ID NO: 670264 - DNA, 25 bp, Mus musculus
gattccaaggcaagttatgccagga

SEQ ID NO: 670265 - DNA, 25 bp, Mus musculus
gattccaaggcatgttatgccagga

SEQ ID NO: 670266 - DNA, 25 bp, Mus musculus
gattccaagtttcgccagaagatgc

SEQ ID NO: 670267 - DNA, 25 bp, Mus musculus
gattccaagtttggccagaagatgc

SEQ ID NO: 670268 - DNA, 25 bp, Mus musculus
gattccaatggcatggcagatccct

SEQ ID NO: 670269 - DNA, 25 bp, Mus musculus
gattccaatggcttggcagatccct

SEQ ID NO: 670270 - DNA, 25 bp, Mus musculus
gattccaatgtgctgtgccgtgcac

SEQ ID NO: 670271 - DNA, 25 bp, Mus musculus
gattccaatgtggtgtgccgtgcac

SEQ ID NO: 670272 - DNA, 25 bp, Mus musculus
gattccacatagcaaatgaaaagca

SEQ ID NO: 670273 - DNA, 25 bp, Mus musculus
gattccacataggaaatgaaaagca

SEQ ID NO: 670274 - DNA, 25 bp, Mus musculus
gattccacgggaatgtctctggacc

SEQ ID NO: 670275 - DNA, 25 bp, Mus musculus
gattccacgggattgtctctggacc

SEQ ID NO: 670276 - DNA, 25 bp, Mus musculus
gattccacgtgcctgtacggtcctg

SEQ ID NO: 670277 - DNA, 25 bp, Mus musculus
gattccacgtgcgtgtacggtcctg

SEQ ID NO: 670278 - DNA, 25 bp, Mus musculus
gattccagaaaaagggctgacctcc

SEQ ID NO: 670279 - DNA, 25 bp, Mus musculus
gattccagaaaatgggctgacctcc

SEQ ID NO: 670280 - DNA, 25 bp, Mus musculus
gattccagaaatctcaagtatcacc

SEQ ID NO: 670281 - DNA, 25 bp, Mus musculus
gattccagaaatgtcaagtatcacc

SEQ ID NO: 670282 - DNA, 25 bp, Mus musculus
gattccagaatcaggtccacgtgct

SEQ ID NO: 670283 - DNA, 25 bp, Mus musculus
gattccagaatctggtccacgtgct

SEQ ID NO: 670284 - DNA, 25 bp, Mus musculus
gattccagacctctggaaacctgga

SEQ ID NO: 670285 - DNA, 25 bp, Mus musculus
gattccagacctgtggaaacctgga

SEQ ID NO: 670286 - DNA, 25 bp, Mus musculus
gattccagagtacccatcgacctca

SEQ ID NO: 670287 - DNA, 25 bp, Mus musculus
gattccagagtagccatcgacctca

SEQ ID NO: 670288 - DNA, 25 bp, Mus musculus
gattccagcatcacttgaaaaccag

SEQ ID NO: 670289 - DNA, 25 bp, Mus musculus
gattccagcatccacagataccaag

SEQ ID NO: 670290 - DNA, 25 bp, Mus musculus
gattccagcatcgacagataccaag

SEQ ID NO: 670291 - DNA, 25 bp, Mus musculus
gattccagcatctcttgaaaaccag

SEQ ID NO: 670292 - DNA, 25 bp, Mus musculus
gattccagcccactctggcagcaaa

SEQ ID NO: 670293 - DNA, 25 bp, Mus musculus
gattccagcccagtctggcagcaaa

SEQ ID NO: 670294 - DNA, 25 bp, Mus musculus
gattccaggaaactctctgtagacc

SEQ ID NO: 670295 - DNA, 25 bp, Mus musculus
gattccaggaaagtctctgtagacc

SEQ ID NO: 670296 - DNA, 25 bp, Mus musculus
gattccaggcttcaagatcagaggc

SEQ ID NO: 670297 - DNA, 25 bp, Mus musculus
gattccaggcttgaagatcagaggc

SEQ ID NO: 670298 - DNA, 25 bp, Mus musculus
gattccaggtcaacaatactcaccc

SEQ ID NO: 670299 - DNA, 25 bp, Mus musculus
gattccaggtcatcaatactcaccc

SEQ ID NO: 670300 - DNA, 25 bp, Mus musculus
gattccaggtccctttccagctgct

SEQ ID NO: 670301 - DNA, 25 bp, Mus musculus
gattccaggtccgtttccagctgct

SEQ ID NO: 670302 - DNA, 25 bp, Mus musculus
gattccagtattacagaagtactca

SEQ ID NO: 670303 - DNA, 25 bp, Mus musculus
gattccagtatttcagaagtactca

SEQ ID NO: 670304 - DNA, 25 bp, Mus musculus
gattccataaatcttcgctgctgcc

SEQ ID NO: 670305 - DNA, 25 bp, Mus musculus
gattccataaatgttcgctgctgcc

SEQ ID NO: 670306 - DNA, 25 bp, Mus musculus
gattccatatttcccagtctcagct

SEQ ID NO: 670307 - DNA, 25 bp, Mus musculus
gattccatatttgccagtctcagct

SEQ ID NO: 670308 - DNA, 25 bp, Mus musculus
gattccatggaaccacgctgctaag

SEQ ID NO: 670309 - DNA, 25 bp, Mus musculus
gattccatggaagcacgctgctaag

SEQ ID NO: 670310 - DNA, 25 bp, Mus musculus
gattccatggatattgtactactca

SEQ ID NO: 670311 - DNA, 25 bp, Mus musculus
gattccatggattttgtactactca

SEQ ID NO: 670312 - DNA, 25 bp, Mus musculus
gattccatgggcctgcattctccga

SEQ ID NO: 670313 - DNA, 25 bp, Mus musculus
gattccatgggcgtgcattctccga

SEQ ID NO: 670314 - DNA, 25 bp, Mus musculus
gattcccaaaccaagaggcagacct

SEQ ID NO: 670315 - DNA, 25 bp, Mus musculus
gattcccaaacctagaggcagacct

SEQ ID NO: 670316 - DNA, 25 bp, Mus musculus
gattcccaacatagggctctcggag

SEQ ID NO: 670317 - DNA, 25 bp, Mus musculus
gattcccaacattgggctctcggag

SEQ ID NO: 670318 - DNA, 25 bp, Mus musculus
gattcccaaccaacaagagctcaag

SEQ ID NO: 670319 - DNA, 25 bp, Mus musculus
gattcccaaccatcaagagctcaag

SEQ ID NO: 670320 - DNA, 25 bp, Mus musculus
gattcccaagacagactgcaggcta

SEQ ID NO: 670321 - DNA, 25 bp, Mus musculus
gattcccaagactgactgcaggcta

SEQ ID NO: 670322 - DNA, 25 bp, Mus musculus
gattcccagaggcaaatctgccgtg

SEQ ID NO: 670323 - DNA, 25 bp, Mus musculus
gattcccagagggaaatctgccgtg

SEQ ID NO: 670324 - DNA, 25 bp, Mus musculus
gattcccagatgcacaaagcgagag

SEQ ID NO: 670325 - DNA, 25 bp, Mus musculus
gattcccagatggacaaagcgagag

SEQ ID NO: 670326 - DNA, 25 bp, Mus musculus
gattcccagtagatcccatgatgga

SEQ ID NO: 670327 - DNA, 25 bp, Mus musculus
gattcccagtagttcccatgatgga

SEQ ID NO: 670328 - DNA, 25 bp, Mus musculus
gattcccatggtcatctttggcagc

SEQ ID NO: 670329 - DNA, 25 bp, Mus musculus
gattcccatggtgatctttggcagc

SEQ ID NO: 670330 - DNA, 25 bp, Mus musculus
gattcccatttaccaaaccaaagat

SEQ ID NO: 670331 - DNA, 25 bp, Mus musculus
gattcccatttagcaaaccaaagat

SEQ ID NO: 670332 - DNA, 25 bp, Mus musculus
gattcccgaggaagcccctcgagag

SEQ ID NO: 670333 - DNA, 25 bp, Mus musculus
gattcccgaggatgcccctcgagag

SEQ ID NO: 670334 - DNA, 25 bp, Mus musculus
gattcccgggaaagcaagctgatga

SEQ ID NO: 670335 - DNA, 25 bp, Mus musculus
gattcccgggaatgcaagctgatga

SEQ ID NO: 670336 - DNA, 25 bp, Mus musculus
gattccctagttagtgttggtcagt

SEQ ID NO: 670337 - DNA, 25 bp, Mus musculus
gattccctagtttgtgttggtcagt

SEQ ID NO: 670338 - DNA, 25 bp, Mus musculus
gattccctcttgcaagataacccac

SEQ ID NO: 670339 - DNA, 25 bp, Mus musculus
gattccctcttggaagataacccac

SEQ ID NO: 670340 - DNA, 25 bp, Mus musculus
gattccctgaaaatgcctaagatgg

SEQ ID NO: 670341 - DNA, 25 bp, Mus musculus
gattccctgaaattgcctaagatgg

SEQ ID NO: 670342 - DNA, 25 bp, Mus musculus
gattccctgctccacctcatggtga

SEQ ID NO: 670343 - DNA, 25 bp, Mus musculus
gattccctgctcgacctcatggtga

SEQ ID NO: 670344 - DNA, 25 bp, Mus musculus
gattccctgggaagtaggttgaccc

SEQ ID NO: 670345 - DNA, 25 bp, Mus musculus
gattccctgggatgtaggttgaccc

SEQ ID NO: 670346 - DNA, 25 bp, Mus musculus
gattccctggtgcaggacggactcc

SEQ ID NO: 670347 - DNA, 25 bp, Mus musculus
gattccctggtggaggacggactcc

SEQ ID NO: 670348 - DNA, 25 bp, Mus musculus
gattcccttagtctccactgcagtg

SEQ ID NO: 670349 - DNA, 25 bp, Mus musculus
gattcccttagtgtccactgcagtg

SEQ ID NO: 670350 - DNA, 25 bp, Mus musculus
gattccgaaaggctgactctgcaaa

SEQ ID NO: 670351 - DNA, 25 bp, Mus musculus
gattccgaaagggtgactctgcaaa

SEQ ID NO: 670352 - DNA, 25 bp, Mus musculus
gattccgaagccagcgtggacaagg

SEQ ID NO: 670353 - DNA, 25 bp, Mus musculus
gattccgaagcctgcgtggacaagg

SEQ ID NO: 670354 - DNA, 25 bp, Mus musculus
gattccgacatgacggtcgtcccca

SEQ ID NO: 670355 - DNA, 25 bp, Mus musculus
gattccgacatgagtttctgcgcca

SEQ ID NO: 670356 - DNA, 25 bp, Mus musculus
gattccgacatgtcggtcgtcccca

SEQ ID NO: 670357 - DNA, 25 bp, Mus musculus
gattccgacatgtgtttctgcgcca

SEQ ID NO: 670358 - DNA, 25 bp, Mus musculus
gattccgagagcctattcattatcc

SEQ ID NO: 670359 - DNA, 25 bp, Mus musculus
gattccgagagcgtattcattatcc

SEQ ID NO: 670360 - DNA, 25 bp, Mus musculus
gattccgagctcaacagaaagcaag

SEQ ID NO: 670361 - DNA, 25 bp, Mus musculus
gattccgagctctacagaaagcaag

SEQ ID NO: 670362 - DNA, 25 bp, Mus musculus
gattccgagctgactgaattccctc

SEQ ID NO: 670363 - DNA, 25 bp, Mus musculus
gattccgagctgtctgaattccctc

SEQ ID NO: 670364 - DNA, 25 bp, Mus musculus
gattccgccatgatgagtcttgtgg

SEQ ID NO: 670365 - DNA, 25 bp, Mus musculus
gattccgccatgttgagtcttgtgg

SEQ ID NO: 670366 - DNA, 25 bp, Mus musculus
gattccggatatagactgcaagcag

SEQ ID NO: 670367 - DNA, 25 bp, Mus musculus
gattccggatattgactgcaagcag

SEQ ID NO: 670368 - DNA, 25 bp, Mus musculus
gattccgtacacatgacctcacgct

SEQ ID NO: 670369 - DNA, 25 bp, Mus musculus
gattccgtacacttgacctcacgct

SEQ ID NO: 670370 - DNA, 25 bp, Mus musculus
gattccgtccagacttcaagcgcaa

SEQ ID NO: 670371 - DNA, 25 bp, Mus musculus
gattccgtccagtcttcaagcgcaa

SEQ ID NO: 670372 - DNA, 25 bp, Mus musculus
gattccgtctaaagactgtgaaaac

SEQ ID NO: 670373 - DNA, 25 bp, Mus musculus
gattccgtctaatgactgtgaaaac

SEQ ID NO: 670374 - DNA, 25 bp, Mus musculus
gattccgtggttcacaagatcacag

SEQ ID NO: 670375 - DNA, 25 bp, Mus musculus
gattccgtggttgacaagatcacag

SEQ ID NO: 670376 - DNA, 25 bp, Mus musculus
gattccgtttgaaggcagagtccca

SEQ ID NO: 670377 - DNA, 25 bp, Mus musculus
gattccgtttgatggcagagtccca

SEQ ID NO: 670378 - DNA, 25 bp, Mus musculus
gattcctaagcaaaacggcgtggtg

SEQ ID NO: 670379 - DNA, 25 bp, Mus musculus
gattcctaagcataacggcgtggtg

SEQ ID NO: 670380 - DNA, 25 bp, Mus musculus
gattcctagctacattcgagactcc

SEQ ID NO: 670381 - DNA, 25 bp, Mus musculus
gattcctagctagattcgagactcc

SEQ ID NO: 670382 - DNA, 25 bp, Mus musculus
gattcctatagtccaccgagtcctg

SEQ ID NO: 670383 - DNA, 25 bp, Mus musculus
gattcctatagtgcaccgagtcctg

SEQ ID NO: 670384 - DNA, 25 bp, Mus musculus
gattcctatcacaaccaagtagaac

SEQ ID NO: 670385 - DNA, 25 bp, Mus musculus
gattcctatcactaccaagtagaac

SEQ ID NO: 670386 - DNA, 25 bp, Mus musculus
gattcctatgagctgaccctccgag

SEQ ID NO: 670387 - DNA, 25 bp, Mus musculus
gattcctatgaggtgaccctccgag

SEQ ID NO: 670388 - DNA, 25 bp, Mus musculus
gattcctcagtcagcctcagcctga

SEQ ID NO: 670389 - DNA, 25 bp, Mus musculus
gattcctcagtctgcctcagcctga

SEQ ID NO: 670390 - DNA, 25 bp, Mus musculus
gattcctccaaaccactctatctag

SEQ ID NO: 670391 - DNA, 25 bp, Mus musculus
gattcctccaaagcactctatctag

SEQ ID NO: 670392 - DNA, 25 bp, Mus musculus
gattcctccttacgtggaccctcgg

SEQ ID NO: 670393 - DNA, 25 bp, Mus musculus
gattcctccttaggtggaccctcgg

SEQ ID NO: 670394 - DNA, 25 bp, Mus musculus
gattcctgagacctatctggtggaa

SEQ ID NO: 670395 - DNA, 25 bp, Mus musculus
gattcctgagacgtatctggtggaa

SEQ ID NO: 670396 - DNA, 25 bp, Mus musculus
gattcctgagagagtggtacacgca

SEQ ID NO: 670397 - DNA, 25 bp, Mus musculus
gattcctgagagtgtggtacacgca

SEQ ID NO: 670398 - DNA, 25 bp, Mus musculus
gattcctgatgacctatttgatgcc

SEQ ID NO: 670399 - DNA, 25 bp, Mus musculus
gattcctgatgagctatttgatgcc

SEQ ID NO: 670400 - DNA, 25 bp, Mus musculus
gattcctgcaagagagctcgtcatg

SEQ ID NO: 670401 - DNA, 25 bp, Mus musculus
gattcctgcaagtgagctcgtcatg

SEQ ID NO: 670402 - DNA, 25 bp, Mus musculus
gattcctgccgcaccctggaagctg

SEQ ID NO: 670403 - DNA, 25 bp, Mus musculus
gattcctgccgctccctggaagctg

SEQ ID NO: 670404 - DNA, 25 bp, Mus musculus
gattcctgctgtaactctgggcacg

SEQ ID NO: 670405 - DNA, 25 bp, Mus musculus
gattcctgctgttactctgggcacg

SEQ ID NO: 670406 - DNA, 25 bp, Mus musculus
gattcctggaacatccacctatgcc

SEQ ID NO: 670407 - DNA, 25 bp, Mus musculus
gattcctggaacttccacctatgcc

SEQ ID NO: 670408 - DNA, 25 bp, Mus musculus
gattcctgggtacatccacctgtcc

SEQ ID NO: 670409 - DNA, 25 bp, Mus musculus
gattcctgggtagatccacctgtcc

SEQ ID NO: 670410 - DNA, 25 bp, Mus musculus
gattcctgggtcaccctttgacgca

SEQ ID NO: 670411 - DNA, 25 bp, Mus musculus
gattcctgggtctccctttgacgca

SEQ ID NO: 670412 - DNA, 25 bp, Mus musculus
gattcctggtacacactggcagcca

SEQ ID NO: 670413 - DNA, 25 bp, Mus musculus
gattcctggtactcactggcagcca

SEQ ID NO: 670414 - DNA, 25 bp, Mus musculus
gattcctgtgagataaccatcattg

SEQ ID NO: 670415 - DNA, 25 bp, Mus musculus
gattcctgtgagttaaccatcattg

SEQ ID NO: 670416 - DNA, 25 bp, Mus musculus
gattcctgtggacagacttattctt

SEQ ID NO: 670417 - DNA, 25 bp, Mus musculus
gattcctgtggagagacttattctt

SEQ ID NO: 670418 - DNA, 25 bp, Mus musculus
gattccttccacaaattcacattca

SEQ ID NO: 670419 - DNA, 25 bp, Mus musculus
gattccttccactaattcacattca

SEQ ID NO: 670420 - DNA, 25 bp, Mus musculus
gattccttgcatcctgcagtaccta

SEQ ID NO: 670421 - DNA, 25 bp, Mus musculus
gattccttgcatgctgcagtaccta

SEQ ID NO: 670422 - DNA, 25 bp, Mus musculus
gattccttggcaacacggtggtctg

SEQ ID NO: 670423 - DNA, 25 bp, Mus musculus
gattccttggcatcacggtggtctg

SEQ ID NO: 670424 - DNA, 25 bp, Mus musculus
gattcctttcacaaggcccagcagt

SEQ ID NO: 670425 - DNA, 25 bp, Mus musculus
gattcctttcactaggcccagcagt

SEQ ID NO: 670426 - DNA, 25 bp, Mus musculus
gattcctttgcacctcaccattgga

SEQ ID NO: 670427 - DNA, 25 bp, Mus musculus
gattcctttgcagctcaccattgga

SEQ ID NO: 670428 - DNA, 25 bp, Mus musculus
gattcgaattacagacaacatgttc

SEQ ID NO: 670429 - DNA, 25 bp, Mus musculus
gattcgaattactgacaacatgttc

SEQ ID NO: 670430 - DNA, 25 bp, Mus musculus
gattcgaccaggaggacaacgaagc

SEQ ID NO: 670431 - DNA, 25 bp, Mus musculus
gattcgaccaggtggacaacgaagc

SEQ ID NO: 670432 - DNA, 25 bp, Mus musculus
gattcgactcacaaggagctaaaaa

SEQ ID NO: 670433 - DNA, 25 bp, Mus musculus
gattcgactcactaggagctaaaaa

SEQ ID NO: 670434 - DNA, 25 bp, Mus musculus
gattcgagaccgcagcgggatcttc

SEQ ID NO: 670435 - DNA, 25 bp, Mus musculus
gattcgagaccggagcgggatcttc

SEQ ID NO: 670436 - DNA, 25 bp, Mus musculus
gattcgagtagaagggaacagccat

SEQ ID NO: 670437 - DNA, 25 bp, Mus musculus
gattcgagtagatgggaacagccat

SEQ ID NO: 670438 - DNA, 25 bp, Mus musculus
gattcgagtgaaagcagagcctgcg

SEQ ID NO: 670439 - DNA, 25 bp, Mus musculus
gattcgagtgaatgcagagcctgcg

SEQ ID NO: 670440 - DNA, 25 bp, Mus musculus
gattcgagttgaagaggtgtcattc

SEQ ID NO: 670441 - DNA, 25 bp, Mus musculus
gattcgagttgatgaggtgtcattc

SEQ ID NO: 670442 - DNA, 25 bp, Mus musculus
gattcgataaacacgtggatgtgtc

SEQ ID NO: 670443 - DNA, 25 bp, Mus musculus
gattcgataaactcgtggatgtgtc

SEQ ID NO: 670444 - DNA, 25 bp, Mus musculus
gattcgatgtcgacaccctgtctgg

SEQ ID NO: 670445 - DNA, 25 bp, Mus musculus
gattcgatgtcgtcaccctgtctgg

SEQ ID NO: 670446 - DNA, 25 bp, Mus musculus
gattcgcaagccagatactctccag

SEQ ID NO: 670447 - DNA, 25 bp, Mus musculus
gattcgcaagcctgatactctccag

SEQ ID NO: 670448 - DNA, 25 bp, Mus musculus
gattcgccaagaaagcggagtctgt

SEQ ID NO: 670449 - DNA, 25 bp, Mus musculus
gattcgccaagatagcggagtctgt

SEQ ID NO: 670450 - DNA, 25 bp, Mus musculus
gattcgccaatcagattctcagcta

SEQ ID NO: 670451 - DNA, 25 bp, Mus musculus
gattcgccaatctgattctcagcta

SEQ ID NO: 670452 - DNA, 25 bp, Mus musculus
gattcgcccgagagtacgtcctggg

SEQ ID NO: 670453 - DNA, 25 bp, Mus musculus
gattcgcccgagtgtacgtcctggg

SEQ ID NO: 670454 - DNA, 25 bp, Mus musculus
gattcgcgggttccgcgtcctcctg

SEQ ID NO: 670455 - DNA, 25 bp, Mus musculus
gattcgcgggttgcgcgtcctcctg

SEQ ID NO: 670456 - DNA, 25 bp, Mus musculus
gattcgctacgtcgactatggtgga

SEQ ID NO: 670457 - DNA, 25 bp, Mus musculus
gattcgctacgtggactatggtgga

SEQ ID NO: 670458 - DNA, 25 bp, Mus musculus
gattcgcttcacactgccacctttg

SEQ ID NO: 670459 - DNA, 25 bp, Mus musculus
gattcgcttcactctgccacctttg

SEQ ID NO: 670460 - DNA, 25 bp, Mus musculus
gattcggaaagcagggtatgccgtc

SEQ ID NO: 670461 - DNA, 25 bp, Mus musculus
gattcggaaagctgggtatgccgtc

SEQ ID NO: 670462 - DNA, 25 bp, Mus musculus
gattcggacaagcacctcctcaaga

SEQ ID NO: 670463 - DNA, 25 bp, Mus musculus
gattcggacaaggacctcctcaaga

SEQ ID NO: 670464 - DNA, 25 bp, Mus musculus
gattcggcaccaccatacagaagtc

SEQ ID NO: 670465 - DNA, 25 bp, Mus musculus
gattcggcaccagcatacagaagtc

SEQ ID NO: 670466 - DNA, 25 bp, Mus musculus
gattcggcatccacgcttacctatg

SEQ ID NO: 670467 - DNA, 25 bp, Mus musculus
gattcggcatcctcgcttacctatg

SEQ ID NO: 670468 - DNA, 25 bp, Mus musculus
gattcggcccatccaaaccatttca

SEQ ID NO: 670469 - DNA, 25 bp, Mus musculus
gattcggcccatgcaaaccatttca

SEQ ID NO: 670470 - DNA, 25 bp, Mus musculus
gattcggcgactcgacaaaccaaag

SEQ ID NO: 670471 - DNA, 25 bp, Mus musculus
gattcggcgactggacaaaccaaag

SEQ ID NO: 670472 - DNA, 25 bp, Mus musculus
gattcggcttttctcggttcagtct

SEQ ID NO: 670473 - DNA, 25 bp, Mus musculus
gattcggcttttgtcggttcagtct

SEQ ID NO: 670474 - DNA, 25 bp, Mus musculus
gattcgggcaccaatacttgcaacg

SEQ ID NO: 670475 - DNA, 25 bp, Mus musculus
gattcgggcacctatacttgcaacg

SEQ ID NO: 670476 - DNA, 25 bp, Mus musculus
gattcggtcgacactagcggttgct

SEQ ID NO: 670477 - DNA, 25 bp, Mus musculus
gattcggtcgactctagcggttgct

SEQ ID NO: 670478 - DNA, 25 bp, Mus musculus
gattcggtgagactctgccacaaaa

SEQ ID NO: 670479 - DNA, 25 bp, Mus musculus
gattcggtgagagtctgccacaaaa

SEQ ID NO: 670480 - DNA, 25 bp, Mus musculus
gattcgtcacccctatgagacccag

SEQ ID NO: 670481 - DNA, 25 bp, Mus musculus
gattcgtcacccgtatgagacccag

SEQ ID NO: 670482 - DNA, 25 bp, Mus musculus
gattcgtcaggaacaaagtttgcct

SEQ ID NO: 670483 - DNA, 25 bp, Mus musculus
gattcgtcaggatcaaagtttgcct

SEQ ID NO: 670484 - DNA, 25 bp, Mus musculus
gattcgtcaggcatgtgtcttcggc

SEQ ID NO: 670485 - DNA, 25 bp, Mus musculus
gattcgtcaggcttgtgtcttcggc

SEQ ID NO: 670486 - DNA, 25 bp, Mus musculus
gattcgtcagtgatggaccacggga

SEQ ID NO: 670487 - DNA, 25 bp, Mus musculus
gattcgtcagtgttggaccacggga

SEQ ID NO: 670488 - DNA, 25 bp, Mus musculus
gattcgtcgagtcaggccgtcaaga

SEQ ID NO: 670489 - DNA, 25 bp, Mus musculus
gattcgtcgagtgaggccgtcaaga

SEQ ID NO: 670490 - DNA, 25 bp, Mus musculus
gattcgtgagctaaagcggttggac

SEQ ID NO: 670491 - DNA, 25 bp, Mus musculus
gattcgtgagcttaagcggttggac

SEQ ID NO: 670492 - DNA, 25 bp, Mus musculus
gattcgtgctgacagccgcccactg

SEQ ID NO: 670493 - DNA, 25 bp, Mus musculus
gattcgtgctgagagccgcccactg

SEQ ID NO: 670494 - DNA, 25 bp, Mus musculus
gattcgttggaaatgtcggtccggt

SEQ ID NO: 670495 - DNA, 25 bp, Mus musculus
gattcgttggaattgtcggtccggt

SEQ ID NO: 670496 - DNA, 25 bp, Mus musculus
gattcgttggctaccgtccccgctg

SEQ ID NO: 670497 - DNA, 25 bp, Mus musculus
gattcgttggcttccgtccccgctg

SEQ ID NO: 670498 - DNA, 25 bp, Mus musculus
gattcgtttggaacctggagggcca

SEQ ID NO: 670499 - DNA, 25 bp, Mus musculus
gattcgtttggatcctggagggcca

SEQ ID NO: 670500 - DNA, 25 bp, Mus musculus
gattctaaaggacgacatccttcat

SEQ ID NO: 670501 - DNA, 25 bp, Mus musculus
gattctaaaggaggacatccttcat

SEQ ID NO: 670502 - DNA, 25 bp, Mus musculus
gattctaaccctcaggaccaaccaa

SEQ ID NO: 670503 - DNA, 25 bp, Mus musculus
gattctaaccctgaggaccaaccaa

SEQ ID NO: 670504 - DNA, 25 bp, Mus musculus
gattctaacggaagacactgaaaag

SEQ ID NO: 670505 - DNA, 25 bp, Mus musculus
gattctaacggatgacactgaaaag

SEQ ID NO: 670506 - DNA, 25 bp, Mus musculus
gattctaagtatcggctggcagccg

SEQ ID NO: 670507 - DNA, 25 bp, Mus musculus
gattctaagtatgggctggcagccg

SEQ ID NO: 670508 - DNA, 25 bp, Mus musculus
gattctacaaatcttgaagctgctt

SEQ ID NO: 670509 - DNA, 25 bp, Mus musculus
gattctacaaatgttgaagctgctt

SEQ ID NO: 670510 - DNA, 25 bp, Mus musculus
gattctacagcaactagcccaagtg

SEQ ID NO: 670511 - DNA, 25 bp, Mus musculus
gattctacagcatctagcccaagtg

SEQ ID NO: 670512 - DNA, 25 bp, Mus musculus
gattctacagctcctaaaacatgag

SEQ ID NO: 670513 - DNA, 25 bp, Mus musculus
gattctacagctgctaaaacatgag

SEQ ID NO: 670514 - DNA, 25 bp, Mus musculus
gattctacctggcattttcctttgg

SEQ ID NO: 670515 - DNA, 25 bp, Mus musculus
gattctacctgggattttcctttgg

SEQ ID NO: 670516 - DNA, 25 bp, Mus musculus
gattctaccttgataatccaggcag

SEQ ID NO: 670517 - DNA, 25 bp, Mus musculus
gattctaccttgttaatccaggcag

SEQ ID NO: 670518 - DNA, 25 bp, Mus musculus
gattctactacaaagactcagatgg

SEQ ID NO: 670519 - DNA, 25 bp, Mus musculus
gattctactacatagactcagatgg

SEQ ID NO: 670520 - DNA, 25 bp, Mus musculus
gattctagacagcatgcctgtgcta

SEQ ID NO: 670521 - DNA, 25 bp, Mus musculus
gattctagacaggatgcctgtgcta

SEQ ID NO: 670522 - DNA, 25 bp, Mus musculus
gattctagagacctcagggacagcc

SEQ ID NO: 670523 - DNA, 25 bp, Mus musculus
gattctagagacgtcagggacagcc

SEQ ID NO: 670524 - DNA, 25 bp, Mus musculus
gattctagagccctacccagtgtgg

SEQ ID NO: 670525 - DNA, 25 bp, Mus musculus
gattctagagccgtacccagtgtgg

SEQ ID NO: 670526 - DNA, 25 bp, Mus musculus
gattctagccaaccatttctgtagt

SEQ ID NO: 670527 - DNA, 25 bp, Mus musculus
gattctagccaagcatttctgtagt

SEQ ID NO: 670528 - DNA, 25 bp, Mus musculus
gattctcaaaagacggaggctgccc

SEQ ID NO: 670529 - DNA, 25 bp, Mus musculus
gattctcaaaagtcggaggctgccc

SEQ ID NO: 670530 - DNA, 25 bp, Mus musculus
gattctcaaagcaggattggtggaa

SEQ ID NO: 670531 - DNA, 25 bp, Mus musculus
gattctcaaagctggattggtggaa

SEQ ID NO: 670532 - DNA, 25 bp, Mus musculus
gattctcaacagaccaatcagtggg

SEQ ID NO: 670533 - DNA, 25 bp, Mus musculus
gattctcaacagtccaatcagtggg

SEQ ID NO: 670534 - DNA, 25 bp, Mus musculus
gattctcactacagcacagacccag

SEQ ID NO: 670535 - DNA, 25 bp, Mus musculus
gattctcactactgcacagacccag

SEQ ID NO: 670536 - DNA, 25 bp, Mus musculus
gattctcagctaaggagccgaactg

SEQ ID NO: 670537 - DNA, 25 bp, Mus musculus
gattctcagctatggagccgaactg

SEQ ID NO: 670538 - DNA, 25 bp, Mus musculus
gattctcaggcgcaggcagctgtac

SEQ ID NO: 670539 - DNA, 25 bp, Mus musculus
gattctcaggcggaggcagctgtac

SEQ ID NO: 670540 - DNA, 25 bp, Mus musculus
gattctcagttcagctaccagcacg

SEQ ID NO: 670541 - DNA, 25 bp, Mus musculus
gattctcagttctgctaccagcacg

SEQ ID NO: 670542 - DNA, 25 bp, Mus musculus
gattctcataaacgcttctggtgtc

SEQ ID NO: 670543 - DNA, 25 bp, Mus musculus
gattctcataaaggcttctggtgtc

SEQ ID NO: 670544 - DNA, 25 bp, Mus musculus
gattctcatcatccaggcctgcaga

SEQ ID NO: 670545 - DNA, 25 bp, Mus musculus
gattctcatcatgcaggcctgcaga

SEQ ID NO: 670546 - DNA, 25 bp, Mus musculus
gattctcatcttcaacatcctcaaa

SEQ ID NO: 670547 - DNA, 25 bp, Mus musculus
gattctcatcttgaacatcctcaaa

SEQ ID NO: 670548 - DNA, 25 bp, Mus musculus
gattctcatggtcggcttagatgca

SEQ ID NO: 670549 - DNA, 25 bp, Mus musculus
gattctcatggtgggcttagatgca

SEQ ID NO: 670550 - DNA, 25 bp, Mus musculus
gattctcattgacgagtggaagaca

SEQ ID NO: 670551 - DNA, 25 bp, Mus musculus
gattctcattgaggagtggaagaca

SEQ ID NO: 670552 - DNA, 25 bp, Mus musculus
gattctccagacaccttgctttttg

SEQ ID NO: 670553 - DNA, 25 bp, Mus musculus
gattctccagactccttgctttttg

SEQ ID NO: 670554 - DNA, 25 bp, Mus musculus
gattctccctgtccaaggtcaaaga

SEQ ID NO: 670555 - DNA, 25 bp, Mus musculus
gattctccctgtgcaaggtcaaaga

SEQ ID NO: 670556 - DNA, 25 bp, Mus musculus
gattctccgagcacattctgagtct

SEQ ID NO: 670557 - DNA, 25 bp, Mus musculus
gattctccgagctcattctgagtct

SEQ ID NO: 670558 - DNA, 25 bp, Mus musculus
gattctccggctcctgtctcaactt

SEQ ID NO: 670559 - DNA, 25 bp, Mus musculus
gattctccggctgctgtctcaactt

SEQ ID NO: 670560 - DNA, 25 bp, Mus musculus
gattctccttttccgacgcgcttgg

SEQ ID NO: 670561 - DNA, 25 bp, Mus musculus
gattctccttttgcgacgcgcttgg

SEQ ID NO: 670562 - DNA, 25 bp, Mus musculus
gattctcgacttcaaaggatacatg

SEQ ID NO: 670563 - DNA, 25 bp, Mus musculus
gattctcgacttgaaaggatacatg

SEQ ID NO: 670564 - DNA, 25 bp, Mus musculus
gattctcgagccacttcaggaccgt

SEQ ID NO: 670565 - DNA, 25 bp, Mus musculus
gattctcgagcctcttcaggaccgt

SEQ ID NO: 670566 - DNA, 25 bp, Mus musculus
gattctcggagaaaattttccatgc

SEQ ID NO: 670567 - DNA, 25 bp, Mus musculus
gattctcggagataattttccatgc

SEQ ID NO: 670568 - DNA, 25 bp, Mus musculus
gattctctcagacgtgccacattct

SEQ ID NO: 670569 - DNA, 25 bp, Mus musculus
gattctctcagaggtgccacattct

SEQ ID NO: 670570 - DNA, 25 bp, Mus musculus
gattctctcctgatgggaacagatt

SEQ ID NO: 670571 - DNA, 25 bp, Mus musculus
gattctctcctgttgggaacagatt

SEQ ID NO: 670572 - DNA, 25 bp, Mus musculus
gattctctcgagaggaatttccgac

SEQ ID NO: 670573 - DNA, 25 bp, Mus musculus
gattctctcgagtggaatttccgac

SEQ ID NO: 670574 - DNA, 25 bp, Mus musculus
gattctctcgccagtctttcaacct

SEQ ID NO: 670575 - DNA, 25 bp, Mus musculus
gattctctcgcctgtctttcaacct

SEQ ID NO: 670576 - DNA, 25 bp, Mus musculus
gattctctggaacatttcgtggaaa

SEQ ID NO: 670577 - DNA, 25 bp, Mus musculus
gattctctggaagatttcgtggaaa

SEQ ID NO: 670578 - DNA, 25 bp, Mus musculus
gattctctggctcataccgtgttca

SEQ ID NO: 670579 - DNA, 25 bp, Mus musculus
gattctctggctgataccgtgttca

SEQ ID NO: 670580 - DNA, 25 bp, Mus musculus
gattctctgtatacttgtgtcactc

SEQ ID NO: 670581 - DNA, 25 bp, Mus musculus
gattctctgtattcttgtgtcactc

SEQ ID NO: 670582 - DNA, 25 bp, Mus musculus
gattctcttcctcaaaatccaatag

SEQ ID NO: 670583 - DNA, 25 bp, Mus musculus
gattctcttcctgaaaatccaatag

SEQ ID NO: 670584 - DNA, 25 bp, Mus musculus
gattctgaaaagcttccttcttgta

SEQ ID NO: 670585 - DNA, 25 bp, Mus musculus
gattctgaaaaggttccttcttgta

SEQ ID NO: 670586 - DNA, 25 bp, Mus musculus
gattctgaaccccatatccttctca

SEQ ID NO: 670587 - DNA, 25 bp, Mus musculus
gattctgaacccgatatccttctca

SEQ ID NO: 670588 - DNA, 25 bp, Mus musculus
gattctgaacctcggatctgaacca

SEQ ID NO: 670589 - DNA, 25 bp, Mus musculus
gattctgaacctgggatctgaacca

SEQ ID NO: 670590 - DNA, 25 bp, Mus musculus
gattctgaagaaactaagaagccaa

SEQ ID NO: 670591 - DNA, 25 bp, Mus musculus
gattctgaagaatctaagaagccaa

SEQ ID NO: 670592 - DNA, 25 bp, Mus musculus
gattctgaatgacaattgcccctcg

SEQ ID NO: 670593 - DNA, 25 bp, Mus musculus
gattctgaatgagaattgcccctcg

SEQ ID NO: 670594 - DNA, 25 bp, Mus musculus
gattctgacgataagagaggctgtg

SEQ ID NO: 670595 - DNA, 25 bp, Mus musculus
gattctgacgattagagaggctgtg

SEQ ID NO: 670596 - DNA, 25 bp, Mus musculus
gattctgagggcagggaccatgccc

SEQ ID NO: 670597 - DNA, 25 bp, Mus musculus
gattctgagggcatcgatatcatgc

SEQ ID NO: 670598 - DNA, 25 bp, Mus musculus
gattctgagggctgggaccatgccc

SEQ ID NO: 670599 - DNA, 25 bp, Mus musculus
gattctgagggcttcgatatcatgc

SEQ ID NO: 670600 - DNA, 25 bp, Mus musculus
gattctgagtctccatgctttaaca

SEQ ID NO: 670601 - DNA, 25 bp, Mus musculus
gattctgagtctgcatgctttaaca

SEQ ID NO: 670602 - DNA, 25 bp, Mus musculus
gattctgatcatccccggaaaagct

SEQ ID NO: 670603 - DNA, 25 bp, Mus musculus
gattctgatcatgcccggaaaagct

SEQ ID NO: 670604 - DNA, 25 bp, Mus musculus
gattctgcaggaagccgagagtttg

SEQ ID NO: 670605 - DNA, 25 bp, Mus musculus
gattctgcaggatgccgagagtttg

SEQ ID NO: 670606 - DNA, 25 bp, Mus musculus
gattctgccaccattcggcgcaaga

SEQ ID NO: 670607 - DNA, 25 bp, Mus musculus
gattctgccacctttcggcgcaaga

SEQ ID NO: 670608 - DNA, 25 bp, Mus musculus
gattctgcccaaagaggacgataaa

SEQ ID NO: 670609 - DNA, 25 bp, Mus musculus
gattctgcccaatgaggacgataaa

SEQ ID NO: 670610 - DNA, 25 bp, Mus musculus
gattctgcctaaaggactaactttc

SEQ ID NO: 670611 - DNA, 25 bp, Mus musculus
gattctgcctaatggactaactttc

SEQ ID NO: 670612 - DNA, 25 bp, Mus musculus
gattctgcctctacccttgtggtgg

SEQ ID NO: 670613 - DNA, 25 bp, Mus musculus
gattctgcctcttcccttgtggtgg

SEQ ID NO: 670614 - DNA, 25 bp, Mus musculus
gattctgcgcaactccattggtcgg

SEQ ID NO: 670615 - DNA, 25 bp, Mus musculus
gattctgcgcaagtccattggtcgg

SEQ ID NO: 670616 - DNA, 25 bp, Mus musculus
gattctgctcagattcccactcagc

SEQ ID NO: 670617 - DNA, 25 bp, Mus musculus
gattctgctcagtttcccactcagc

SEQ ID NO: 670618 - DNA, 25 bp, Mus musculus
gattctggaaatcaggagtcgtgac

SEQ ID NO: 670619 - DNA, 25 bp, Mus musculus
gattctggaaatgaggagtcgtgac

SEQ ID NO: 670620 - DNA, 25 bp, Mus musculus
gattctggaatccattctggtgcca

SEQ ID NO: 670621 - DNA, 25 bp, Mus musculus
gattctggaatcgattctggtgcca

SEQ ID NO: 670622 - DNA, 25 bp, Mus musculus
gattctggacctacgagacgggctg

SEQ ID NO: 670623 - DNA, 25 bp, Mus musculus
gattctggaccttcgagacgggctg

SEQ ID NO: 670624 - DNA, 25 bp, Mus musculus
gattctgggaacactcgctgctatt

SEQ ID NO: 670625 - DNA, 25 bp, Mus musculus
gattctgggaactctcgctgctatt

SEQ ID NO: 670626 - DNA, 25 bp, Mus musculus
gattctgggagacgctcaagctgaa

SEQ ID NO: 670627 - DNA, 25 bp, Mus musculus
gattctgggagaggctcaagctgaa

SEQ ID NO: 670628 - DNA, 25 bp, Mus musculus
gattctgggagcaggtggcagcggt

SEQ ID NO: 670629 - DNA, 25 bp, Mus musculus
gattctgggagctggtggcagcggt

SEQ ID NO: 670630 - DNA, 25 bp, Mus musculus
gattctgggatcctcagagtctggt

SEQ ID NO: 670631 - DNA, 25 bp, Mus musculus
gattctgggatcgtcagagtctggt

SEQ ID NO: 670632 - DNA, 25 bp, Mus musculus
gattctgggcctccatttggacttg

SEQ ID NO: 670633 - DNA, 25 bp, Mus musculus
gattctgggcctgcatttggacttg

SEQ ID NO: 670634 - DNA, 25 bp, Mus musculus
gattctggtcacaggatcctctgga

SEQ ID NO: 670635 - DNA, 25 bp, Mus musculus
gattctggtcactggatcctctgga

SEQ ID NO: 670636 - DNA, 25 bp, Mus musculus
gattctggtggacggactgtactta

SEQ ID NO: 670637 - DNA, 25 bp, Mus musculus
gattctggtggagggactgtactta

SEQ ID NO: 670638 - DNA, 25 bp, Mus musculus
gattctggttgtccgcatagccaga

SEQ ID NO: 670639 - DNA, 25 bp, Mus musculus
gattctggttgtgcgcatagccaga

SEQ ID NO: 670640 - DNA, 25 bp, Mus musculus
gattctgtacccagagattccaaag

SEQ ID NO: 670641 - DNA, 25 bp, Mus musculus
gattctgtaccctgagattccaaag

SEQ ID NO: 670642 - DNA, 25 bp, Mus musculus
gattctgtagccagcacagtctcag

SEQ ID NO: 670643 - DNA, 25 bp, Mus musculus
gattctgtagcctgcacagtctcag

SEQ ID NO: 670644 - DNA, 25 bp, Mus musculus
gattctgtatgcagccgagtgtgcc

SEQ ID NO: 670645 - DNA, 25 bp, Mus musculus
gattctgtatgctgccgagtgtgcc

SEQ ID NO: 670646 - DNA, 25 bp, Mus musculus
gattctgtcgtgcttcgggctctaa

SEQ ID NO: 670647 - DNA, 25 bp, Mus musculus
gattctgtcgtggttcgggctctaa

SEQ ID NO: 670648 - DNA, 25 bp, Mus musculus
gattctgtctctcccacaataaagg

SEQ ID NO: 670649 - DNA, 25 bp, Mus musculus
gattctgtctctgccacaataaagg

SEQ ID NO: 670650 - DNA, 25 bp, Mus musculus
gattctgtgaacctcactgtgcatt

SEQ ID NO: 670651 - DNA, 25 bp, Mus musculus
gattctgtgaacgtcactgtgcatt

SEQ ID NO: 670652 - DNA, 25 bp, Mus musculus
gattctgtgacgcattcaacattcc

SEQ ID NO: 670653 - DNA, 25 bp, Mus musculus
gattctgtgacggattcaacattcc

SEQ ID NO: 670654 - DNA, 25 bp, Mus musculus
gattctgtgactctgccactgatga

SEQ ID NO: 670655 - DNA, 25 bp, Mus musculus
gattctgtgactgtgccactgatga

SEQ ID NO: 670656 - DNA, 25 bp, Mus musculus
gattctgtggccaaggagcgcgccc

SEQ ID NO: 670657 - DNA, 25 bp, Mus musculus
gattctgtggcctaggagcgcgccc

SEQ ID NO: 670658 - DNA, 25 bp, Mus musculus
gattctgtgtgcatctagggaggca

SEQ ID NO: 670659 - DNA, 25 bp, Mus musculus
gattctgtgtgcttctagggaggca

SEQ ID NO: 670660 - DNA, 25 bp, Mus musculus
gattctgttcctcagactgccatga

SEQ ID NO: 670661 - DNA, 25 bp, Mus musculus
gattctgttcctgagactgccatga

SEQ ID NO: 670662 - DNA, 25 bp, Mus musculus
gattctgttcgtcaaatcttccaaa

SEQ ID NO: 670663 - DNA, 25 bp, Mus musculus
gattctgttcgtgaaatcttccaaa

SEQ ID NO: 670664 - DNA, 25 bp, Mus musculus
gattctgttgccagggcaccaccag

SEQ ID NO: 670665 - DNA, 25 bp, Mus musculus
gattctgttgcctgggcaccaccag

SEQ ID NO: 670666 - DNA, 25 bp, Mus musculus
gattcttaccaacggtcccaagtcg

SEQ ID NO: 670667 - DNA, 25 bp, Mus musculus
gattcttaccaagggtcccaagtcg

SEQ ID NO: 670668 - DNA, 25 bp, Mus musculus
gattcttattcacgcattctgtgga

SEQ ID NO: 670669 - DNA, 25 bp, Mus musculus
gattcttattcaggcattctgtgga

SEQ ID NO: 670670 - DNA, 25 bp, Mus musculus
gattcttcaggacctactgtaggcc

SEQ ID NO: 670671 - DNA, 25 bp, Mus musculus
gattcttcaggagctactgtaggcc

SEQ ID NO: 670672 - DNA, 25 bp, Mus musculus
gattcttccactcctgccagtgcat

SEQ ID NO: 670673 - DNA, 25 bp, Mus musculus
gattcttccactgctgccagtgcat

SEQ ID NO: 670674 - DNA, 25 bp, Mus musculus
gattcttcctatatcaggcggtatc

SEQ ID NO: 670675 - DNA, 25 bp, Mus musculus
gattcttcctatttcaggcggtatc

SEQ ID NO: 670676 - DNA, 25 bp, Mus musculus
gattcttctagtagtactgatattc

SEQ ID NO: 670677 - DNA, 25 bp, Mus musculus
gattcttctagttgtactgatattc

SEQ ID NO: 670678 - DNA, 25 bp, Mus musculus
gattcttctcaacgagatcttggaa

SEQ ID NO: 670679 - DNA, 25 bp, Mus musculus
gattcttctcaaggagatcttggaa

SEQ ID NO: 670680 - DNA, 25 bp, Mus musculus
gattcttctcagcacgaggcagaag

SEQ ID NO: 670681 - DNA, 25 bp, Mus musculus
gattcttctcaggacgaggcagaag

SEQ ID NO: 670682 - DNA, 25 bp, Mus musculus
gattcttgacaacttgctggaaggc

SEQ ID NO: 670683 - DNA, 25 bp, Mus musculus
gattcttgacaagttgctggaaggc

SEQ ID NO: 670684 - DNA, 25 bp, Mus musculus
gattcttgaccaaaatgtggcaccc

SEQ ID NO: 670685 - DNA, 25 bp, Mus musculus
gattcttgaccataatgtggcaccc

SEQ ID NO: 670686 - DNA, 25 bp, Mus musculus
gattcttgcagacaagaacagcttc

SEQ ID NO: 670687 - DNA, 25 bp, Mus musculus
gattcttgcagagaagaacagcttc

SEQ ID NO: 670688 - DNA, 25 bp, Mus musculus
gattcttggaatctgggctgcctgc

SEQ ID NO: 670689 - DNA, 25 bp, Mus musculus
gattcttggaatgtgggctgcctgc

SEQ ID NO: 670690 - DNA, 25 bp, Mus musculus
gattcttggacaacttttcagccag

SEQ ID NO: 670691 - DNA, 25 bp, Mus musculus
gattcttggacatcttttcagccag

SEQ ID NO: 670692 - DNA, 25 bp, Mus musculus
gattcttggagccttgccgtggaca

SEQ ID NO: 670693 - DNA, 25 bp, Mus musculus
gattcttggagcgttgccgtggaca

SEQ ID NO: 670694 - DNA, 25 bp, Mus musculus
gattcttggcagacagcagtctgcg

SEQ ID NO: 670695 - DNA, 25 bp, Mus musculus
gattcttggcagtcagcagtctgcg

SEQ ID NO: 670696 - DNA, 25 bp, Mus musculus
gattcttgggcgagttatcatgcag

SEQ ID NO: 670697 - DNA, 25 bp, Mus musculus
gattcttgggcgtgttatcatgcag

SEQ ID NO: 670698 - DNA, 25 bp, Mus musculus
gattcttgggctctaagcctgaggt

SEQ ID NO: 670699 - DNA, 25 bp, Mus musculus
gattcttgggctgtaagcctgaggt

SEQ ID NO: 670700 - DNA, 25 bp, Mus musculus
gattcttgtcatcgtgagcctcctg

SEQ ID NO: 670701 - DNA, 25 bp, Mus musculus
gattcttgtcatggtgagcctcctg

SEQ ID NO: 670702 - DNA, 25 bp, Mus musculus
gattctttactgcaacctatttttt

SEQ ID NO: 670703 - DNA, 25 bp, Mus musculus
gattctttactggaacctatttttt

SEQ ID NO: 670704 - DNA, 25 bp, Mus musculus
gattctttggtgcactatcaacccc

SEQ ID NO: 670705 - DNA, 25 bp, Mus musculus
gattctttggtggactatcaacccc

SEQ ID NO: 670706 - DNA, 25 bp, Mus musculus
gattcttttccactccttagcgcca

SEQ ID NO: 670707 - DNA, 25 bp, Mus musculus
gattcttttccagtccttagcgcca

SEQ ID NO: 670708 - DNA, 25 bp, Mus musculus
gattcttttgagcagttggcacttc

SEQ ID NO: 670709 - DNA, 25 bp, Mus musculus
gattcttttgaggagttggcacttc

SEQ ID NO: 670710 - DNA, 25 bp, Mus musculus
gattctttttctcgaactgaaccag

SEQ ID NO: 670711 - DNA, 25 bp, Mus musculus
gattctttttctggaactgaaccag

SEQ ID NO: 670712 - DNA, 25 bp, Mus musculus
gattgaaacacacctgtcaaccgta

SEQ ID NO: 670713 - DNA, 25 bp, Mus musculus
gattgaaacacagctgtcaaccgta

SEQ ID NO: 670714 - DNA, 25 bp, Mus musculus
gattgaaaccttagacagagaagca

SEQ ID NO: 670715 - DNA, 25 bp, Mus musculus
gattgaaacctttgacagagaagca

SEQ ID NO: 670716 - DNA, 25 bp, Mus musculus
gattgaaagtgtactggctcgagta

SEQ ID NO: 670717 - DNA, 25 bp, Mus musculus
gattgaaagtgttctggctcgagta

SEQ ID NO: 670718 - DNA, 25 bp, Mus musculus
gattgaaatgctagacaggctcctg

SEQ ID NO: 670719 - DNA, 25 bp, Mus musculus
gattgaaatgcttgacaggctcctg

SEQ ID NO: 670720 - DNA, 25 bp, Mus musculus
gattgaacacccataacctgatgcg

SEQ ID NO: 670721 - DNA, 25 bp, Mus musculus
gattgaacacccttaacctgatgcg

SEQ ID NO: 670722 - DNA, 25 bp, Mus musculus
gattgaacatgcacagaaagagctt

SEQ ID NO: 670723 - DNA, 25 bp, Mus musculus
gattgaacatgctcagaaagagctt

SEQ ID NO: 670724 - DNA, 25 bp, Mus musculus
gattgaaccagaatatctgtggcca

SEQ ID NO: 670725 - DNA, 25 bp, Mus musculus
gattgaaccagattatctgtggcca

SEQ ID NO: 670726 - DNA, 25 bp, Mus musculus
gattgaacccaaagaccacacactc

SEQ ID NO: 670727 - DNA, 25 bp, Mus musculus
gattgaacccaatgaccacacactc

SEQ ID NO: 670728 - DNA, 25 bp, Mus musculus
gattgaaccttaacggcttcatgaa

SEQ ID NO: 670729 - DNA, 25 bp, Mus musculus
gattgaaccttatcggcttcatgaa

SEQ ID NO: 670730 - DNA, 25 bp, Mus musculus
gattgaacgtagaactcagtcgcta

SEQ ID NO: 670731 - DNA, 25 bp, Mus musculus
gattgaacgtagtactcagtcgcta

SEQ ID NO: 670732 - DNA, 25 bp, Mus musculus
gattgaactcgtagttgtcggacca

SEQ ID NO: 670733 - DNA, 25 bp, Mus musculus
gattgaactcgttgttgtcggacca

SEQ ID NO: 670734 - DNA, 25 bp, Mus musculus
gattgaagatgtcatgttctctctg

SEQ ID NO: 670735 - DNA, 25 bp, Mus musculus
gattgaagatgtgatgttctctctg

SEQ ID NO: 670736 - DNA, 25 bp, Mus musculus
gattgaagccgcacattgcctagcc

SEQ ID NO: 670737 - DNA, 25 bp, Mus musculus
gattgaagccgctcattgcctagcc

SEQ ID NO: 670738 - DNA, 25 bp, Mus musculus
gattgaaggagaagtggcaaccatc

SEQ ID NO: 670739 - DNA, 25 bp, Mus musculus
gattgaaggagatgtggcaaccatc

SEQ ID NO: 670740 - DNA, 25 bp, Mus musculus
gattgaaggcagatctgccgtgcac

SEQ ID NO: 670741 - DNA, 25 bp, Mus musculus
gattgaaggcagttctgccgtgcac

SEQ ID NO: 670742 - DNA, 25 bp, Mus musculus
gattgaataccaacatcacaagcct

SEQ ID NO: 670743 - DNA, 25 bp, Mus musculus
gattgaataccatcatcacaagcct

SEQ ID NO: 670744 - DNA, 25 bp, Mus musculus
gattgaatgacgagacgatggtgct

SEQ ID NO: 670745 - DNA, 25 bp, Mus musculus
gattgaatgacgtgacgatggtgct

SEQ ID NO: 670746 - DNA, 25 bp, Mus musculus
gattgaattcctagccctcttgggt

SEQ ID NO: 670747 - DNA, 25 bp, Mus musculus
gattgaattccttgccctcttgggt

SEQ ID NO: 670748 - DNA, 25 bp, Mus musculus
gattgaatttgactctgcctctggc

SEQ ID NO: 670749 - DNA, 25 bp, Mus musculus
gattgaatttgagtctgcctctggc

SEQ ID NO: 670750 - DNA, 25 bp, Mus musculus
gattgacaacaccaacccagatgtc

SEQ ID NO: 670751 - DNA, 25 bp, Mus musculus
gattgacaacacgaacccagatgtc

SEQ ID NO: 670752 - DNA, 25 bp, Mus musculus
gattgacaagatctggccaaagctg

SEQ ID NO: 670753 - DNA, 25 bp, Mus musculus
gattgacaagatgtggccaaagctg

SEQ ID NO: 670754 - DNA, 25 bp, Mus musculus
gattgacaatcactgggccatcttg

SEQ ID NO: 670755 - DNA, 25 bp, Mus musculus
gattgacaatcagtgggccatcttg

SEQ ID NO: 670756 - DNA, 25 bp, Mus musculus
gattgacaatgaaagtgggtttccc

SEQ ID NO: 670757 - DNA, 25 bp, Mus musculus
gattgacaatgatagtgggtttccc

SEQ ID NO: 670758 - DNA, 25 bp, Mus musculus
gattgacagaccaaatggaacaaaa

SEQ ID NO: 670759 - DNA, 25 bp, Mus musculus
gattgacagacctaatggaacaaaa

SEQ ID NO: 670760 - DNA, 25 bp, Mus musculus
gattgacagctaaaacagcagggag

SEQ ID NO: 670761 - DNA, 25 bp, Mus musculus
gattgacagctataacagcagggag

SEQ ID NO: 670762 - DNA, 25 bp, Mus musculus
gattgacatcatcgcatctctctca

SEQ ID NO: 670763 - DNA, 25 bp, Mus musculus
gattgacatcatggcatctctctca

SEQ ID NO: 670764 - DNA, 25 bp, Mus musculus
gattgacatccaacaagtctacaac

SEQ ID NO: 670765 - DNA, 25 bp, Mus musculus
gattgacatccatcaagtctacaac

SEQ ID NO: 670766 - DNA, 25 bp, Mus musculus
gattgacatcctccctgaccgctta

SEQ ID NO: 670767 - DNA, 25 bp, Mus musculus
gattgacatcctgcctgaccgctta

SEQ ID NO: 670768 - DNA, 25 bp, Mus musculus
gattgacatgctcgacatccgggcg

SEQ ID NO: 670769 - DNA, 25 bp, Mus musculus
gattgacatgctggacatccgggcg

SEQ ID NO: 670770 - DNA, 25 bp, Mus musculus
gattgacatgtgacctgccaacatc

SEQ ID NO: 670771 - DNA, 25 bp, Mus musculus
gattgacatgtgtcctgccaacatc

SEQ ID NO: 670772 - DNA, 25 bp, Mus musculus
gattgaccataaaactatgaccctc

SEQ ID NO: 670773 - DNA, 25 bp, Mus musculus
gattgaccataatactatgaccctc

SEQ ID NO: 670774 - DNA, 25 bp, Mus musculus
gattgacccagacctgcagacaggt

SEQ ID NO: 670775 - DNA, 25 bp, Mus musculus
gattgacccagagctgcagacaggt

SEQ ID NO: 670776 - DNA, 25 bp, Mus musculus
gattgaccgcttagatgttcgtgca

SEQ ID NO: 670777 - DNA, 25 bp, Mus musculus
gattgaccgctttgatgttcgtgca

SEQ ID NO: 670778 - DNA, 25 bp, Mus musculus
gattgaccgggaaaatcagaggctt

SEQ ID NO: 670779 - DNA, 25 bp, Mus musculus
gattgaccgggataatcagaggctt

SEQ ID NO: 670780 - DNA, 25 bp, Mus musculus
gattgacctggcattccagcagtcg

SEQ ID NO: 670781 - DNA, 25 bp, Mus musculus
gattgacctggctttccagcagtcg

SEQ ID NO: 670782 - DNA, 25 bp, Mus musculus
gattgacgagagaacgatcaacaag

SEQ ID NO: 670783 - DNA, 25 bp, Mus musculus
gattgacgagagtacgatcaacaag

SEQ ID NO: 670784 - DNA, 25 bp, Mus musculus
gattgacgatgaagtagagtgtacc

SEQ ID NO: 670785 - DNA, 25 bp, Mus musculus
gattgacgatgatgtagagtgtacc

SEQ ID NO: 670786 - DNA, 25 bp, Mus musculus
gattgacgcgggaccttcttgtgca

SEQ ID NO: 670787 - DNA, 25 bp, Mus musculus
gattgacgcgggtccttcttgtgca

SEQ ID NO: 670788 - DNA, 25 bp, Mus musculus
gattgacggagcatacctgaccata

SEQ ID NO: 670789 - DNA, 25 bp, Mus musculus
gattgacggagcttacctgaccata

SEQ ID NO: 670790 - DNA, 25 bp, Mus musculus
gattgacggcttcgtcctgaaccgc

SEQ ID NO: 670791 - DNA, 25 bp, Mus musculus
gattgacggcttggtcctgaaccgc

SEQ ID NO: 670792 - DNA, 25 bp, Mus musculus
gattgactcacaaagagttccgctc

SEQ ID NO: 670793 - DNA, 25 bp, Mus musculus
gattgactcacatagagttccgctc

SEQ ID NO: 670794 - DNA, 25 bp, Mus musculus
gattgactccctctgggagatcagc

SEQ ID NO: 670795 - DNA, 25 bp, Mus musculus
gattgactccctgtgggagatcagc

SEQ ID NO: 670796 - DNA, 25 bp, Mus musculus
gattgactggaaaagacctgaaccc

SEQ ID NO: 670797 - DNA, 25 bp, Mus musculus
gattgactggaatagacctgaaccc

SEQ ID NO: 670798 - DNA, 25 bp, Mus musculus
gattgactggtgctctctgacactc

SEQ ID NO: 670799 - DNA, 25 bp, Mus musculus
gattgactggtggtctctgacactc

SEQ ID NO: 670800 - DNA, 25 bp, Mus musculus
gattgacttgctcgtgtttgatctc

SEQ ID NO: 670801 - DNA, 25 bp, Mus musculus
gattgacttgctggtgtttgatctc

SEQ ID NO: 670802 - DNA, 25 bp, Mus musculus
gattgagaaaatcgccaactgaggc

SEQ ID NO: 670803 - DNA, 25 bp, Mus musculus
gattgagaaaatggccaactgaggc

SEQ ID NO: 670804 - DNA, 25 bp, Mus musculus
gattgagaaacacaaggctcacttg

SEQ ID NO: 670805 - DNA, 25 bp, Mus musculus
gattgagaaacagaaggctcacttg

SEQ ID NO: 670806 - DNA, 25 bp, Mus musculus
gattgagaagtacacaccctgagca

SEQ ID NO: 670807 - DNA, 25 bp, Mus musculus
gattgagaagtagacaccctgagca

SEQ ID NO: 670808 - DNA, 25 bp, Mus musculus
gattgagaccttaaatgaaatgtca

SEQ ID NO: 670809 - DNA, 25 bp, Mus musculus
gattgagacctttaatgaaatgtca

SEQ ID NO: 670810 - DNA, 25 bp, Mus musculus
gattgagacttgattgtctgggccg

SEQ ID NO: 670811 - DNA, 25 bp, Mus musculus
gattgagacttgtttgtctgggccg

SEQ ID NO: 670812 - DNA, 25 bp, Mus musculus
gattgagagcaaccggagacaactg

SEQ ID NO: 670813 - DNA, 25 bp, Mus musculus
gattgagagcaagcggagacaactg

SEQ ID NO: 670814 - DNA, 25 bp, Mus musculus
gattgagagtgaagctcaagagcca

SEQ ID NO: 670815 - DNA, 25 bp, Mus musculus
gattgagagtgatgctcaagagcca

SEQ ID NO: 670816 - DNA, 25 bp, Mus musculus
gattgagatagacatcgaacccaca

SEQ ID NO: 670817 - DNA, 25 bp, Mus musculus
gattgagatagagatcgaacccaca

SEQ ID NO: 670818 - DNA, 25 bp, Mus musculus
gattgagatgttacagaaagtcacc

SEQ ID NO: 670819 - DNA, 25 bp, Mus musculus
gattgagatgtttcagaaagtcacc

SEQ ID NO: 670820 - DNA, 25 bp, Mus musculus
gattgagattcacctccacgggcct

SEQ ID NO: 670821 - DNA, 25 bp, Mus musculus
gattgagattcagctccacgggcct

SEQ ID NO: 670822 - DNA, 25 bp, Mus musculus
gattgagattgacgtcgtacagcgc

SEQ ID NO: 670823 - DNA, 25 bp, Mus musculus
gattgagattgaggtcgtacagcgc

SEQ ID NO: 670824 - DNA, 25 bp, Mus musculus
gattgagcacggagacacgttgccg

SEQ ID NO: 670825 - DNA, 25 bp, Mus musculus
gattgagcacggtgacacgttgccg

SEQ ID NO: 670826 - DNA, 25 bp, Mus musculus
gattgagcagttagaagacttacta

SEQ ID NO: 670827 - DNA, 25 bp, Mus musculus
gattgagcagttcatccatgacgta

SEQ ID NO: 670828 - DNA, 25 bp, Mus musculus
gattgagcagttgatccatgacgta

SEQ ID NO: 670829 - DNA, 25 bp, Mus musculus
gattgagcagtttgaagacttacta

SEQ ID NO: 670830 - DNA, 25 bp, Mus musculus
gattgagcatcccatgagcatcggc

SEQ ID NO: 670831 - DNA, 25 bp, Mus musculus
gattgagcatccgatgagcatcggc

SEQ ID NO: 670832 - DNA, 25 bp, Mus musculus
gattgagccggcacaggctgtcgct

SEQ ID NO: 670833 - DNA, 25 bp, Mus musculus
gattgagccggctcaggctgtcgct

SEQ ID NO: 670834 - DNA, 25 bp, Mus musculus
gattgagcgggcagagtgcaccatc

SEQ ID NO: 670835 - DNA, 25 bp, Mus musculus
gattgagcgggctgagtgcaccatc

SEQ ID NO: 670836 - DNA, 25 bp, Mus musculus
gattgagctacacctgaatggaccc

SEQ ID NO: 670837 - DNA, 25 bp, Mus musculus
gattgagctacagctgaatggaccc

SEQ ID NO: 670838 - DNA, 25 bp, Mus musculus
gattgagcttcaacagcatcaccgt

SEQ ID NO: 670839 - DNA, 25 bp, Mus musculus
gattgagcttcatcagcatcaccgt

SEQ ID NO: 670840 - DNA, 25 bp, Mus musculus
gattgaggaacactgtgagccacag

SEQ ID NO: 670841 - DNA, 25 bp, Mus musculus
gattgaggaacagtgtgagccacag

SEQ ID NO: 670842 - DNA, 25 bp, Mus musculus
gattgaggattgacaccagggcctc

SEQ ID NO: 670843 - DNA, 25 bp, Mus musculus
gattgaggattgtcaccagggcctc

SEQ ID NO: 670844 - DNA, 25 bp, Mus musculus
gattgaggctaactagcgaccagct

SEQ ID NO: 670845 - DNA, 25 bp, Mus musculus
gattgaggctaagtagcgaccagct

SEQ ID NO: 670846 - DNA, 25 bp, Mus musculus
gattgagtatctcatgggaggaacc

SEQ ID NO: 670847 - DNA, 25 bp, Mus musculus
gattgagtatctgatgggaggaacc

SEQ ID NO: 670848 - DNA, 25 bp, Mus musculus
gattgagtattaccagcagcttgct

SEQ ID NO: 670849 - DNA, 25 bp, Mus musculus
gattgagtattagcagcagcttgct

SEQ ID NO: 670850 - DNA, 25 bp, Mus musculus
gattgagtcctgcatgttatgacac

SEQ ID NO: 670851 - DNA, 25 bp, Mus musculus
gattgagtcctggatgttatgacac

SEQ ID NO: 670852 - DNA, 25 bp, Mus musculus
gattgagtgtgacatggcttttgtc

SEQ ID NO: 670853 - DNA, 25 bp, Mus musculus
gattgagtgtgagatggcttttgtc

SEQ ID NO: 670854 - DNA, 25 bp, Mus musculus
gattgataagaaatgccgggctctc

SEQ ID NO: 670855 - DNA, 25 bp, Mus musculus
gattgataagaattgccgggctctc

SEQ ID NO: 670856 - DNA, 25 bp, Mus musculus
gattgataatccagctgacattctg

SEQ ID NO: 670857 - DNA, 25 bp, Mus musculus
gattgataatcctgctgacattctg

SEQ ID NO: 670858 - DNA, 25 bp, Mus musculus
gattgatacagaactgaactcaagg

SEQ ID NO: 670859 - DNA, 25 bp, Mus musculus
gattgatacagatctgaactcaagg

SEQ ID NO: 670860 - DNA, 25 bp, Mus musculus
gattgatatcctcgtctccaatgct

SEQ ID NO: 670861 - DNA, 25 bp, Mus musculus
gattgatatcctggtctccaatgct

SEQ ID NO: 670862 - DNA, 25 bp, Mus musculus
gattgatatgataccctctgctctt

SEQ ID NO: 670863 - DNA, 25 bp, Mus musculus
gattgatatgattccctctgctctt

SEQ ID NO: 670864 - DNA, 25 bp, Mus musculus
gattgatcaaaccaatgacttcaag

SEQ ID NO: 670865 - DNA, 25 bp, Mus musculus
gattgatcaaacgaatgacttcaag

SEQ ID NO: 670866 - DNA, 25 bp, Mus musculus
gattgatcccaacgctagtctggaa

SEQ ID NO: 670867 - DNA, 25 bp, Mus musculus
gattgatcccaaggctagtctggaa

SEQ ID NO: 670868 - DNA, 25 bp, Mus musculus
gattgatcctgaagacttcccgctg

SEQ ID NO: 670869 - DNA, 25 bp, Mus musculus
gattgatcctgatgacttcccgctg

SEQ ID NO: 670870 - DNA, 25 bp, Mus musculus
gattgatctccacagattggatggt

SEQ ID NO: 670871 - DNA, 25 bp, Mus musculus
gattgatctccagagattggatggt

SEQ ID NO: 670872 - DNA, 25 bp, Mus musculus
gattgatctgttcaagggtgaccag

SEQ ID NO: 670873 - DNA, 25 bp, Mus musculus
gattgatctgttgaagggtgaccag

SEQ ID NO: 670874 - DNA, 25 bp, Mus musculus
gattgatctttccagagtgccagga

SEQ ID NO: 670875 - DNA, 25 bp, Mus musculus
gattgatctttcgagagtgccagga

SEQ ID NO: 670876 - DNA, 25 bp, Mus musculus
gattgatgaagacgaacccagccaa

SEQ ID NO: 670877 - DNA, 25 bp, Mus musculus
gattgatgaagaggaacccagccaa

SEQ ID NO: 670878 - DNA, 25 bp, Mus musculus
gattgatgaagcagcccggagaaga

SEQ ID NO: 670879 - DNA, 25 bp, Mus musculus
gattgatgaagctgcccggagaaga

SEQ ID NO: 670880 - DNA, 25 bp, Mus musculus
gattgatgacatactggacaagatc

SEQ ID NO: 670881 - DNA, 25 bp, Mus musculus
gattgatgacattctggacaagatc

SEQ ID NO: 670882 - DNA, 25 bp, Mus musculus
gattgatgagaccaaagatgcactc

SEQ ID NO: 670883 - DNA, 25 bp, Mus musculus
gattgatgagacgaaagatgcactc

SEQ ID NO: 670884 - DNA, 25 bp, Mus musculus
gattgatgatgtcagaacagagaga

SEQ ID NO: 670885 - DNA, 25 bp, Mus musculus
gattgatgatgtgagaacagagaga

SEQ ID NO: 670886 - DNA, 25 bp, Mus musculus
gattgatgcataatcctgatcttcc

SEQ ID NO: 670887 - DNA, 25 bp, Mus musculus
gattgatgcatattcctgatcttcc

SEQ ID NO: 670888 - DNA, 25 bp, Mus musculus
gattgatgccaacctgaaattactg

SEQ ID NO: 670889 - DNA, 25 bp, Mus musculus
gattgatgccaagctgaaattactg

SEQ ID NO: 670890 - DNA, 25 bp, Mus musculus
gattgatgccctccgagtgaacaac

SEQ ID NO: 670891 - DNA, 25 bp, Mus musculus
gattgatgccctgcgagtgaacaac

SEQ ID NO: 670892 - DNA, 25 bp, Mus musculus
gattgattatctacagcccatccca

SEQ ID NO: 670893 - DNA, 25 bp, Mus musculus
gattgattatcttcagcccatccca

SEQ ID NO: 670894 - DNA, 25 bp, Mus musculus
gattgattccaacatatcttaattt

SEQ ID NO: 670895 - DNA, 25 bp, Mus musculus
gattgattccaagatatcttaattt

SEQ ID NO: 670896 - DNA, 25 bp, Mus musculus
gattgattcgaaaccttgccctttg

SEQ ID NO: 670897 - DNA, 25 bp, Mus musculus
gattgattcgaatccttgccctttg

SEQ ID NO: 670898 - DNA, 25 bp, Mus musculus
gattgattctgtatgcgcctctgac

SEQ ID NO: 670899 - DNA, 25 bp, Mus musculus
gattgattctgtttgcgcctctgac

SEQ ID NO: 670900 - DNA, 25 bp, Mus musculus
gattgcaaagcgaagcacatctgca

SEQ ID NO: 670901 - DNA, 25 bp, Mus musculus
gattgcaaagcgtagcacatctgca

SEQ ID NO: 670902 - DNA, 25 bp, Mus musculus
gattgcaagatcagcggtaccccgc

SEQ ID NO: 670903 - DNA, 25 bp, Mus musculus
gattgcaagatctgcggtaccccgc

SEQ ID NO: 670904 - DNA, 25 bp, Mus musculus
gattgcacactgaaaatcctcgact

SEQ ID NO: 670905 - DNA, 25 bp, Mus musculus
gattgcacactgtaaatcctcgact

SEQ ID NO: 670906 - DNA, 25 bp, Mus musculus
gattgcacagccaggaatgctcact

SEQ ID NO: 670907 - DNA, 25 bp, Mus musculus
gattgcacagcctggaatgctcact

SEQ ID NO: 670908 - DNA, 25 bp, Mus musculus
gattgcacccctctgtagaagccat

SEQ ID NO: 670909 - DNA, 25 bp, Mus musculus
gattgcacccctgtgtagaagccat

SEQ ID NO: 670910 - DNA, 25 bp, Mus musculus
gattgcagaaaaacaacgtatcctc

SEQ ID NO: 670911 - DNA, 25 bp, Mus musculus
gattgcagaaaatcaacgtatcctc

SEQ ID NO: 670912 - DNA, 25 bp, Mus musculus
gattgcagacgacgaagagccgatc

SEQ ID NO: 670913 - DNA, 25 bp, Mus musculus
gattgcagacgaggaagagccgatc

SEQ ID NO: 670914 - DNA, 25 bp, Mus musculus
gattgcagagctatcatatccacga

SEQ ID NO: 670915 - DNA, 25 bp, Mus musculus
gattgcagagctttcatatccacga

SEQ ID NO: 670916 - DNA, 25 bp, Mus musculus
gattgcagatctagtgagtgctcag

SEQ ID NO: 670917 - DNA, 25 bp, Mus musculus
gattgcagatcttgtgagtgctcag

SEQ ID NO: 670918 - DNA, 25 bp, Mus musculus
gattgcagatgaactctttgagcca

SEQ ID NO: 670919 - DNA, 25 bp, Mus musculus
gattgcagatgatctctttgagcca

SEQ ID NO: 670920 - DNA, 25 bp, Mus musculus
gattgcaggatcaccaacaacttga

SEQ ID NO: 670921 - DNA, 25 bp, Mus musculus
gattgcaggatctccaacaacttga

SEQ ID NO: 670922 - DNA, 25 bp, Mus musculus
gattgcagggaacatcatcccagcc

SEQ ID NO: 670923 - DNA, 25 bp, Mus musculus
gattgcagggaagatcatcccagcc

SEQ ID NO: 670924 - DNA, 25 bp, Mus musculus
gattgcagggacagagtcctctgac

SEQ ID NO: 670925 - DNA, 25 bp, Mus musculus
gattgcagggactgagtcctctgac

SEQ ID NO: 670926 - DNA, 25 bp, Mus musculus
gattgcagtggaagacctgagccct

SEQ ID NO: 670927 - DNA, 25 bp, Mus musculus
gattgcagtggatgacctgagccct

SEQ ID NO: 670928 - DNA, 25 bp, Mus musculus
gattgcatttagctgtgcccaacaa

SEQ ID NO: 670929 - DNA, 25 bp, Mus musculus
gattgcatttaggtgtgcccaacaa

SEQ ID NO: 670930 - DNA, 25 bp, Mus musculus
gattgccaacccaaatatacctgct

SEQ ID NO: 670931 - DNA, 25 bp, Mus musculus
gattgccaaccctaatatacctgct

SEQ ID NO: 670932 - DNA, 25 bp, Mus musculus
gattgccaactgctgtatgcgccag

SEQ ID NO: 670933 - DNA, 25 bp, Mus musculus
gattgccaactggtgtatgcgccag

SEQ ID NO: 670934 - DNA, 25 bp, Mus musculus
gattgccaccatatccttcttcggg

SEQ ID NO: 670935 - DNA, 25 bp, Mus musculus
gattgccaccatcttcgtctttgcc

SEQ ID NO: 670936 - DNA, 25 bp, Mus musculus
gattgccaccatgttcgtctttgcc

SEQ ID NO: 670937 - DNA, 25 bp, Mus musculus
gattgccaccatttccttcttcggg

SEQ ID NO: 670938 - DNA, 25 bp, Mus musculus
gattgccagcctcgcctgtgttgtg

SEQ ID NO: 670939 - DNA, 25 bp, Mus musculus
gattgccagcctggcctgtgttgtg

SEQ ID NO: 670940 - DNA, 25 bp, Mus musculus
gattgccatgcaatcagatagccag

SEQ ID NO: 670941 - DNA, 25 bp, Mus musculus
gattgccatgcattcagatagccag

SEQ ID NO: 670942 - DNA, 25 bp, Mus musculus
gattgcccagctaagcattgctgag

SEQ ID NO: 670943 - DNA, 25 bp, Mus musculus
gattgcccagcttagcattgctgag

SEQ ID NO: 670944 - DNA, 25 bp, Mus musculus
gattgcccctcccagtcatctgatt

SEQ ID NO: 670945 - DNA, 25 bp, Mus musculus
gattgcccctccgagtcatctgatt

SEQ ID NO: 670946 - DNA, 25 bp, Mus musculus
gattgccgaggaatccaacttcccc

SEQ ID NO: 670947 - DNA, 25 bp, Mus musculus
gattgccgaggattccaacttcccc

SEQ ID NO: 670948 - DNA, 25 bp, Mus musculus
gattgccgctatccgtatgagtacc

SEQ ID NO: 670949 - DNA, 25 bp, Mus musculus
gattgccgctatgcgtatgagtacc

SEQ ID NO: 670950 - DNA, 25 bp, Mus musculus
gattgcctacctctacaatgaaggc

SEQ ID NO: 670951 - DNA, 25 bp, Mus musculus
gattgcctacctgtacaatgaaggc

SEQ ID NO: 670952 - DNA, 25 bp, Mus musculus
gattgcctcagtccggagatcccta

SEQ ID NO: 670953 - DNA, 25 bp, Mus musculus
gattgcctcagtgcggagatcccta

SEQ ID NO: 670954 - DNA, 25 bp, Mus musculus
gattgcctcggtaactttactaagg

SEQ ID NO: 670955 - DNA, 25 bp, Mus musculus
gattgcctcggttactttactaagg

SEQ ID NO: 670956 - DNA, 25 bp, Mus musculus
gattgcctgcagataccaacctttg

SEQ ID NO: 670957 - DNA, 25 bp, Mus musculus
gattgcctgcagttaccaacctttg

SEQ ID NO: 670958 - DNA, 25 bp, Mus musculus
gattgcctggtacgcccggcaacag

SEQ ID NO: 670959 - DNA, 25 bp, Mus musculus
gattgcctggtaggcccggcaacag

SEQ ID NO: 670960 - DNA, 25 bp, Mus musculus
gattgcctgtacctaaatatttaca

SEQ ID NO: 670961 - DNA, 25 bp, Mus musculus
gattgcctgtacgtaaatatttaca

SEQ ID NO: 670962 - DNA, 25 bp, Mus musculus
gattgccttgtcacacagctgctgc

SEQ ID NO: 670963 - DNA, 25 bp, Mus musculus
gattgccttgtctcacagctgctgc

SEQ ID NO: 670964 - DNA, 25 bp, Mus musculus
gattgcggattacatcgtgaccagc

SEQ ID NO: 670965 - DNA, 25 bp, Mus musculus
gattgcggattagatcgtgaccagc

SEQ ID NO: 670966 - DNA, 25 bp, Mus musculus
gattgcggatttacggaggacacac

SEQ ID NO: 670967 - DNA, 25 bp, Mus musculus
gattgcggattttcggaggacacac

SEQ ID NO: 670968 - DNA, 25 bp, Mus musculus
gattgcgtcaccatgtctcctgtac

SEQ ID NO: 670969 - DNA, 25 bp, Mus musculus
gattgcgtcaccttgtctcctgtac

SEQ ID NO: 670970 - DNA, 25 bp, Mus musculus
gattgcgtgataaattagctgttct

SEQ ID NO: 670971 - DNA, 25 bp, Mus musculus
gattgcgtgatatattagctgttct

SEQ ID NO: 670972 - DNA, 25 bp, Mus musculus
gattgctatatgaaaaactgctgtc

SEQ ID NO: 670973 - DNA, 25 bp, Mus musculus
gattgctatatgtaaaactgctgtc

SEQ ID NO: 670974 - DNA, 25 bp, Mus musculus
gattgctatcaactacaatgagaag

SEQ ID NO: 670975 - DNA, 25 bp, Mus musculus
gattgctatcaagtacaatgagaag

SEQ ID NO: 670976 - DNA, 25 bp, Mus musculus
gattgctcaaatcggtgactccatg

SEQ ID NO: 670977 - DNA, 25 bp, Mus musculus
gattgctcaaatgggtgactccatg

SEQ ID NO: 670978 - DNA, 25 bp, Mus musculus
gattgctcacttcgttgttatggcc

SEQ ID NO: 670979 - DNA, 25 bp, Mus musculus
gattgctcacttggttgttatggcc

SEQ ID NO: 670980 - DNA, 25 bp, Mus musculus
gattgctctgggagtaactttgaga

SEQ ID NO: 670981 - DNA, 25 bp, Mus musculus
gattgctctgggtgtaactttgaga

SEQ ID NO: 670982 - DNA, 25 bp, Mus musculus
gattgctcttccactgcctatgcag

SEQ ID NO: 670983 - DNA, 25 bp, Mus musculus
gattgctcttcctctgcctatgcag

SEQ ID NO: 670984 - DNA, 25 bp, Mus musculus
gattgctgaacacctcaatatggaa

SEQ ID NO: 670985 - DNA, 25 bp, Mus musculus
gattgctgaacagctcaatatggaa

SEQ ID NO: 670986 - DNA, 25 bp, Mus musculus
gattgctgaagccttggcccaaggc

SEQ ID NO: 670987 - DNA, 25 bp, Mus musculus
gattgctgaagcgttggcccaaggc

SEQ ID NO: 670988 - DNA, 25 bp, Mus musculus
gattgctgagatcctcctgtggttt

SEQ ID NO: 670989 - DNA, 25 bp, Mus musculus
gattgctgagatgctcctgtggttt

SEQ ID NO: 670990 - DNA, 25 bp, Mus musculus
gattgctgagttcgacaccctgaat

SEQ ID NO: 670991 - DNA, 25 bp, Mus musculus
gattgctgagttggacaccctgaat

SEQ ID NO: 670992 - DNA, 25 bp, Mus musculus
gattgctgatctccgcttgctgacg

SEQ ID NO: 670993 - DNA, 25 bp, Mus musculus
gattgctgatctgcgcttgctgacg

SEQ ID NO: 670994 - DNA, 25 bp, Mus musculus
gattgctgatgaaaagctactcctt

SEQ ID NO: 670995 - DNA, 25 bp, Mus musculus
gattgctgatgataagctactcctt

SEQ ID NO: 670996 - DNA, 25 bp, Mus musculus
gattgctgcctgctacaggagatat

SEQ ID NO: 670997 - DNA, 25 bp, Mus musculus
gattgctgcctggtacaggagatat

SEQ ID NO: 670998 - DNA, 25 bp, Mus musculus
gattgctgccttcctggctagccca

SEQ ID NO: 670999 - DNA, 25 bp, Mus musculus
gattgctgccttgctggctagccca

SEQ ID NO: 671000 - DNA, 25 bp, Mus musculus
gattgctgcggtagcatcggtactg

SEQ ID NO: 671001 - DNA, 25 bp, Mus musculus
gattgctgcggttgcatcggtactg

SEQ ID NO: 671002 - DNA, 25 bp, Mus musculus
gattgctggagtcttcccatggttc

SEQ ID NO: 671003 - DNA, 25 bp, Mus musculus
gattgctggagtgttcccatggttc

SEQ ID NO: 671004 - DNA, 25 bp, Mus musculus
gattgctggcatcctgtaccctcac

SEQ ID NO: 671005 - DNA, 25 bp, Mus musculus
gattgctggcatgctgtaccctcac

SEQ ID NO: 671006 - DNA, 25 bp, Mus musculus
gattgctgggcaattaaaggaccct

SEQ ID NO: 671007 - DNA, 25 bp, Mus musculus
gattgctgggcatttaaaggaccct

SEQ ID NO: 671008 - DNA, 25 bp, Mus musculus
gattgctggtctcaattgtttgcgg

SEQ ID NO: 671009 - DNA, 25 bp, Mus musculus
gattgctggtctgaattgtttgcgg

SEQ ID NO: 671010 - DNA, 25 bp, Mus musculus
gattgctgtctcacatgagtgatgg

SEQ ID NO: 671011 - DNA, 25 bp, Mus musculus
gattgctgtctctcatgagtgatgg

SEQ ID NO: 671012 - DNA, 25 bp, Mus musculus
gattgcttcagcctgccatcggctt

SEQ ID NO: 671013 - DNA, 25 bp, Mus musculus
gattgcttcagcgtgccatcggctt

SEQ ID NO: 671014 - DNA, 25 bp, Mus musculus
gattgcttcatgcattggagaactt

SEQ ID NO: 671015 - DNA, 25 bp, Mus musculus
gattgcttcatggattggagaactt

SEQ ID NO: 671016 - DNA, 25 bp, Mus musculus
gattgcttctatagccagcctgaaa

SEQ ID NO: 671017 - DNA, 25 bp, Mus musculus
gattgcttctattgccagcctgaaa

SEQ ID NO: 671018 - DNA, 25 bp, Mus musculus
gattgcttctctacctaccccttgg

SEQ ID NO: 671019 - DNA, 25 bp, Mus musculus
gattgcttctcttcctaccccttgg

SEQ ID NO: 671020 - DNA, 25 bp, Mus musculus
gattgcttgacaactttatcccagg

SEQ ID NO: 671021 - DNA, 25 bp, Mus musculus
gattgcttgacatctttatcccagg

SEQ ID NO: 671022 - DNA, 25 bp, Mus musculus
gattgcttgatcatctgttgaccta

SEQ ID NO: 671023 - DNA, 25 bp, Mus musculus
gattgcttgatcttctgttgaccta

SEQ ID NO: 671024 - DNA, 25 bp, Mus musculus
gattgcttgcagatcaacatgacac

SEQ ID NO: 671025 - DNA, 25 bp, Mus musculus
gattgcttgcagttcaacatgacac

SEQ ID NO: 671026 - DNA, 25 bp, Mus musculus
gattgctttgcaacgctgcactgcc

SEQ ID NO: 671027 - DNA, 25 bp, Mus musculus
gattgctttgcatcgctgcactgcc

SEQ ID NO: 671028 - DNA, 25 bp, Mus musculus
gattgctttggacggagcaaatgta

SEQ ID NO: 671029 - DNA, 25 bp, Mus musculus
gattgctttggagggagcaaatgta

SEQ ID NO: 671030 - DNA, 25 bp, Mus musculus
gattggaaaccacatctctcggact

SEQ ID NO: 671031 - DNA, 25 bp, Mus musculus
gattggaaaccagatctctcggact

SEQ ID NO: 671032 - DNA, 25 bp, Mus musculus
gattggaagccaagtgaagaccctt

SEQ ID NO: 671033 - DNA, 25 bp, Mus musculus
gattggaagccatgtgaagaccctt

SEQ ID NO: 671034 - DNA, 25 bp, Mus musculus
gattggaataaccaggacacgcttg

SEQ ID NO: 671035 - DNA, 25 bp, Mus musculus
gattggaataacgaggacacgcttg

SEQ ID NO: 671036 - DNA, 25 bp, Mus musculus
gattggaatggtatcctggcgacca

SEQ ID NO: 671037 - DNA, 25 bp, Mus musculus
gattggaatggtttcctggcgacca

SEQ ID NO: 671038 - DNA, 25 bp, Mus musculus
gattggacaatgaaaggtaatagcc

SEQ ID NO: 671039 - DNA, 25 bp, Mus musculus
gattggacaatgtaaggtaatagcc

SEQ ID NO: 671040 - DNA, 25 bp, Mus musculus
gattggaccagaacaagacccgaga

SEQ ID NO: 671041 - DNA, 25 bp, Mus musculus
gattggaccagatcaagacccgaga

SEQ ID NO: 671042 - DNA, 25 bp, Mus musculus
gattggaccttgaaaaaactgcaaa

SEQ ID NO: 671043 - DNA, 25 bp, Mus musculus
gattggaccttgtaaaaactgcaaa

SEQ ID NO: 671044 - DNA, 25 bp, Mus musculus
gattggacgagccatgaagtgccaa

SEQ ID NO: 671045 - DNA, 25 bp, Mus musculus
gattggacgagcgatgaagtgccaa

SEQ ID NO: 671046 - DNA, 25 bp, Mus musculus
gattggacgcgtcgcacctacagag

SEQ ID NO: 671047 - DNA, 25 bp, Mus musculus
gattggacgcgtggcacctacagag

SEQ ID NO: 671048 - DNA, 25 bp, Mus musculus
gattggactcctagatccaggaaga

SEQ ID NO: 671049 - DNA, 25 bp, Mus musculus
gattggactccttgatccaggaaga

SEQ ID NO: 671050 - DNA, 25 bp, Mus musculus
gattggactggtcgcctgcgaatca

SEQ ID NO: 671051 - DNA, 25 bp, Mus musculus
gattggactggtggcctgcgaatca

SEQ ID NO: 671052 - DNA, 25 bp, Mus musculus
gattggagaatgatctctttggacc

SEQ ID NO: 671053 - DNA, 25 bp, Mus musculus
gattggagaatgttctctttggacc

SEQ ID NO: 671054 - DNA, 25 bp, Mus musculus
gattggagacaccaagcgtgccaca

SEQ ID NO: 671055 - DNA, 25 bp, Mus musculus
gattggagacaccattgaattccgg

SEQ ID NO: 671056 - DNA, 25 bp, Mus musculus
gattggagacacgaagcgtgccaca

SEQ ID NO: 671057 - DNA, 25 bp, Mus musculus
gattggagacacgattgaattccgg

SEQ ID NO: 671058 - DNA, 25 bp, Mus musculus
gattggagataaacagcaggcgcac

SEQ ID NO: 671059 - DNA, 25 bp, Mus musculus
gattggagataatcagcaggcgcac

SEQ ID NO: 671060 - DNA, 25 bp, Mus musculus
gattggagattgaccacataaaggg

SEQ ID NO: 671061 - DNA, 25 bp, Mus musculus
gattggagattgtccacataaaggg

SEQ ID NO: 671062 - DNA, 25 bp, Mus musculus
gattggagccttcaatgttcagagc

SEQ ID NO: 671063 - DNA, 25 bp, Mus musculus
gattggagccttgaatgttcagagc

SEQ ID NO: 671064 - DNA, 25 bp, Mus musculus
gattggaggcctctcagaacagatt

SEQ ID NO: 671065 - DNA, 25 bp, Mus musculus
gattggaggcctgtcagaacagatt

SEQ ID NO: 671066 - DNA, 25 bp, Mus musculus
gattggagtgaactaccatcgccac

SEQ ID NO: 671067 - DNA, 25 bp, Mus musculus
gattggagtgaagtaccatcgccac

SEQ ID NO: 671068 - DNA, 25 bp, Mus musculus
gattggagttatccttatgagcact

SEQ ID NO: 671069 - DNA, 25 bp, Mus musculus
gattggagttatgcttatgagcact

SEQ ID NO: 671070 - DNA, 25 bp, Mus musculus
gattggagttcgaggactcacagga

SEQ ID NO: 671071 - DNA, 25 bp, Mus musculus
gattggagttcgtggactcacagga

SEQ ID NO: 671072 - DNA, 25 bp, Mus musculus
gattggagttctaaggcagtgtttc

SEQ ID NO: 671073 - DNA, 25 bp, Mus musculus
gattggagttcttaggcagtgtttc

SEQ ID NO: 671074 - DNA, 25 bp, Mus musculus
gattggatgtcgcactgacaggcac

SEQ ID NO: 671075 - DNA, 25 bp, Mus musculus
gattggatgtcggactgacaggcac

SEQ ID NO: 671076 - DNA, 25 bp, Mus musculus
gattggcaaaatataggacactacg

SEQ ID NO: 671077 - DNA, 25 bp, Mus musculus
gattggcaaaatttaggacactacg

SEQ ID NO: 671078 - DNA, 25 bp, Mus musculus
gattggcaaagcctactccacagaa

SEQ ID NO: 671079 - DNA, 25 bp, Mus musculus
gattggcaaagcgtactccacagaa

SEQ ID NO: 671080 - DNA, 25 bp, Mus musculus
gattggcaagagatacattttgatg

SEQ ID NO: 671081 - DNA, 25 bp, Mus musculus
gattggcaagagttacattttgatg

SEQ ID NO: 671082 - DNA, 25 bp, Mus musculus
gattggcaagcacaagaacatcatt

SEQ ID NO: 671083 - DNA, 25 bp, Mus musculus
gattggcaagcagaagaacatcatt

SEQ ID NO: 671084 - DNA, 25 bp, Mus musculus
gattggcacatcaccatattcacca

SEQ ID NO: 671085 - DNA, 25 bp, Mus musculus
gattggcacatctccatattcacca

SEQ ID NO: 671086 - DNA, 25 bp, Mus musculus
gattggcaccttatccaccgggcct

SEQ ID NO: 671087 - DNA, 25 bp, Mus musculus
gattggcaccttttccaccgggcct

SEQ ID NO: 671088 - DNA, 25 bp, Mus musculus
gattggcacttcagagaggatgctg

SEQ ID NO: 671089 - DNA, 25 bp, Mus musculus
gattggcacttctgagaggatgctg

SEQ ID NO: 671090 - DNA, 25 bp, Mus musculus
gattggcagccgctgtagaagctat

SEQ ID NO: 671091 - DNA, 25 bp, Mus musculus
gattggcagccggtgtagaagctat

SEQ ID NO: 671092 - DNA, 25 bp, Mus musculus
gattggcaggagatcgtaagcctgt

SEQ ID NO: 671093 - DNA, 25 bp, Mus musculus
gattggcaggagttcgtaagcctgt

SEQ ID NO: 671094 - DNA, 25 bp, Mus musculus
gattggcatcgcattaacttaaaac

SEQ ID NO: 671095 - DNA, 25 bp, Mus musculus
gattggcatcgctttaacttaaaac

SEQ ID NO: 671096 - DNA, 25 bp, Mus musculus
gattggcctccgcaacctggtgatg

SEQ ID NO: 671097 - DNA, 25 bp, Mus musculus
gattggcctccggaacctggtgatg

SEQ ID NO: 671098 - DNA, 25 bp, Mus musculus
gattggcgaacgaacctggaactat

SEQ ID NO: 671099 - DNA, 25 bp, Mus musculus
gattggcgaacgtacctggaactat

SEQ ID NO: 671100 - DNA, 25 bp, Mus musculus
gattggcgacatcctgagcgcccag

SEQ ID NO: 671101 - DNA, 25 bp, Mus musculus
gattggcgacatgctgagcgcccag

SEQ ID NO: 671102 - DNA, 25 bp, Mus musculus
gattggcgggctcgccttccctttt

SEQ ID NO: 671103 - DNA, 25 bp, Mus musculus
gattggcgggctggccttccctttt

SEQ ID NO: 671104 - DNA, 25 bp, Mus musculus
gattggcgtccgatccaccatgatg

SEQ ID NO: 671105 - DNA, 25 bp, Mus musculus
gattggcgtccgttccaccatgatg

SEQ ID NO: 671106 - DNA, 25 bp, Mus musculus
gattggctaacaagtaacacctgga

SEQ ID NO: 671107 - DNA, 25 bp, Mus musculus
gattggctaacatgtaacacctgga

SEQ ID NO: 671108 - DNA, 25 bp, Mus musculus
gattggctatgtctacagcttgggc

SEQ ID NO: 671109 - DNA, 25 bp, Mus musculus
gattggctatgtgtacagcttgggc

SEQ ID NO: 671110 - DNA, 25 bp, Mus musculus
gattggctccaaccaatagcatcta

SEQ ID NO: 671111 - DNA, 25 bp, Mus musculus
gattggctccaagcaatagcatcta

SEQ ID NO: 671112 - DNA, 25 bp, Mus musculus
gattggctccttcgataatatcacc

SEQ ID NO: 671113 - DNA, 25 bp, Mus musculus
gattggctccttggataatatcacc

SEQ ID NO: 671114 - DNA, 25 bp, Mus musculus
gattggctcggcatcgactgaggcc

SEQ ID NO: 671115 - DNA, 25 bp, Mus musculus
gattggctcggcttcgactgaggcc

SEQ ID NO: 671116 - DNA, 25 bp, Mus musculus
gattggctctacagagaacctgaag

SEQ ID NO: 671117 - DNA, 25 bp, Mus musculus
gattggctctactgagaacctgaag

SEQ ID NO: 671118 - DNA, 25 bp, Mus musculus
gattggctgcgtatgccgccacctt

SEQ ID NO: 671119 - DNA, 25 bp, Mus musculus
gattggctgcgtttgccgccacctt

SEQ ID NO: 671120 - DNA, 25 bp, Mus musculus
gattggctgctgctcagcgtatcca

SEQ ID NO: 671121 - DNA, 25 bp, Mus musculus
gattggctgctggtcagcgtatcca

SEQ ID NO: 671122 - DNA, 25 bp, Mus musculus
gattggctggatctacttcatggcg

SEQ ID NO: 671123 - DNA, 25 bp, Mus musculus
gattggctggatgtacttcatggcg

SEQ ID NO: 671124 - DNA, 25 bp, Mus musculus
gattggcttgatctccgagttccta

SEQ ID NO: 671125 - DNA, 25 bp, Mus musculus
gattggcttgatgtccgagttccta

SEQ ID NO: 671126 - DNA, 25 bp, Mus musculus
gattggctttcacgtaagtacaggg

SEQ ID NO: 671127 - DNA, 25 bp, Mus musculus
gattggctttcaggtaagtacaggg

SEQ ID NO: 671128 - DNA, 25 bp, Mus musculus
gattgggaaacaaaagaacattatc

SEQ ID NO: 671129 - DNA, 25 bp, Mus musculus
gattgggaaacataagaacattatc

SEQ ID NO: 671130 - DNA, 25 bp, Mus musculus
gattgggaagcacaagaatatcatc

SEQ ID NO: 671131 - DNA, 25 bp, Mus musculus
gattgggaagcagaagaatatcatc

SEQ ID NO: 671132 - DNA, 25 bp, Mus musculus
gattgggaagcccttcagtacactc

SEQ ID NO: 671133 - DNA, 25 bp, Mus musculus
gattgggaagccgttcagtacactc

SEQ ID NO: 671134 - DNA, 25 bp, Mus musculus
gattgggactttctgccacccaaga

SEQ ID NO: 671135 - DNA, 25 bp, Mus musculus
gattgggactttgtgccacccaaga

SEQ ID NO: 671136 - DNA, 25 bp, Mus musculus
gattgggagcagagtaactcgtcaa

SEQ ID NO: 671137 - DNA, 25 bp, Mus musculus
gattgggagcagtgtaactcgtcaa

SEQ ID NO: 671138 - DNA, 25 bp, Mus musculus
gattgggatgagaacacctcagccg

SEQ ID NO: 671139 - DNA, 25 bp, Mus musculus
gattgggatgagtacacctcagccg

SEQ ID NO: 671140 - DNA, 25 bp, Mus musculus
gattgggattgcatacgtaacggcg

SEQ ID NO: 671141 - DNA, 25 bp, Mus musculus
gattgggattgcttacgtaacggcg

SEQ ID NO: 671142 - DNA, 25 bp, Mus musculus
gattgggcctggctcttccccttct

SEQ ID NO: 671143 - DNA, 25 bp, Mus musculus
gattgggcctgggtcttccccttct

SEQ ID NO: 671144 - DNA, 25 bp, Mus musculus
gattgggctgtaaacctgatattcc

SEQ ID NO: 671145 - DNA, 25 bp, Mus musculus
gattgggctgtatacctgatattcc

SEQ ID NO: 671146 - DNA, 25 bp, Mus musculus
gattgggtactgaccctctctgggc

SEQ ID NO: 671147 - DNA, 25 bp, Mus musculus
gattgggtactgtccctctctgggc

SEQ ID NO: 671148 - DNA, 25 bp, Mus musculus
gattgggttcagaggtcaaatcgcc

SEQ ID NO: 671149 - DNA, 25 bp, Mus musculus
gattgggttcagtggtcaaatcgcc

SEQ ID NO: 671150 - DNA, 25 bp, Mus musculus
gattggtagcccaatgtttgcatca

SEQ ID NO: 671151 - DNA, 25 bp, Mus musculus
gattggtagccctatgtttgcatca

SEQ ID NO: 671152 - DNA, 25 bp, Mus musculus
gattggtagcttcatgattcgagag

SEQ ID NO: 671153 - DNA, 25 bp, Mus musculus
gattggtagcttgatgattcgagag

SEQ ID NO: 671154 - DNA, 25 bp, Mus musculus
gattggtatgggattcagaccttct

SEQ ID NO: 671155 - DNA, 25 bp, Mus musculus
gattggtatgggtttcagaccttct

SEQ ID NO: 671156 - DNA, 25 bp, Mus musculus
gattggtcacgtacatcgaggtggc

SEQ ID NO: 671157 - DNA, 25 bp, Mus musculus
gattggtcacgttcatcgaggtggc

SEQ ID NO: 671158 - DNA, 25 bp, Mus musculus
gattggtccacacacctcagagtgc

SEQ ID NO: 671159 - DNA, 25 bp, Mus musculus
gattggtccacagacctcagagtgc

SEQ ID NO: 671160 - DNA, 25 bp, Mus musculus
gattggtccgcacagtccacggcag

SEQ ID NO: 671161 - DNA, 25 bp, Mus musculus
gattggtccgcagagtccacggcag

SEQ ID NO: 671162 - DNA, 25 bp, Mus musculus
gattggtctcctccacttagcttca

SEQ ID NO: 671163 - DNA, 25 bp, Mus musculus
gattggtctcctgcacttagcttca

SEQ ID NO: 671164 - DNA, 25 bp, Mus musculus
gattggtctgttcgatgtgttcaca

SEQ ID NO: 671165 - DNA, 25 bp, Mus musculus
gattggtctgttggatgtgttcaca

SEQ ID NO: 671166 - DNA, 25 bp, Mus musculus
gattggtgagccagggataccgatc

SEQ ID NO: 671167 - DNA, 25 bp, Mus musculus
gattggtgagcctgggataccgatc

SEQ ID NO: 671168 - DNA, 25 bp, Mus musculus
gattggtgcaaaactcagcccctga

SEQ ID NO: 671169 - DNA, 25 bp, Mus musculus
gattggtgcaaatctcagcccctga

SEQ ID NO: 671170 - DNA, 25 bp, Mus musculus
gattggtgctgtaactcaggcatca

SEQ ID NO: 671171 - DNA, 25 bp, Mus musculus
gattggtgctgttactcaggcatca

SEQ ID NO: 671172 - DNA, 25 bp, Mus musculus
gattggtggaaacaatgaacccttg

SEQ ID NO: 671173 - DNA, 25 bp, Mus musculus
gattggtggaaagaatgaacccttg

SEQ ID NO: 671174 - DNA, 25 bp, Mus musculus
gattggtggccgagtttcttttgcc

SEQ ID NO: 671175 - DNA, 25 bp, Mus musculus
gattggtggccgtgtttcttttgcc

SEQ ID NO: 671176 - DNA, 25 bp, Mus musculus
gattggtggcctaatagactccaaa

SEQ ID NO: 671177 - DNA, 25 bp, Mus musculus
gattggtggccttatagactccaaa

SEQ ID NO: 671178 - DNA, 25 bp, Mus musculus
gattggtggcgtcgtagccgtggtg

SEQ ID NO: 671179 - DNA, 25 bp, Mus musculus
gattggtggcgtggtagccgtggtg

SEQ ID NO: 671180 - DNA, 25 bp, Mus musculus
gattggtggctcaatcctagcatct

SEQ ID NO: 671181 - DNA, 25 bp, Mus musculus
gattggtggctctatcctagcatct

SEQ ID NO: 671182 - DNA, 25 bp, Mus musculus
gattggtgtcctccagaaaacagag

SEQ ID NO: 671183 - DNA, 25 bp, Mus musculus
gattggtgtcctgcagaaaacagag

SEQ ID NO: 671184 - DNA, 25 bp, Mus musculus
gattggtgtcggcaagcttttacga

SEQ ID NO: 671185 - DNA, 25 bp, Mus musculus
gattggtgtcgggaagcttttacga

SEQ ID NO: 671186 - DNA, 25 bp, Mus musculus
gattggtgtttgcagctgctccagc

SEQ ID NO: 671187 - DNA, 25 bp, Mus musculus
gattggtgtttggagctgctccagc

SEQ ID NO: 671188 - DNA, 25 bp, Mus musculus
gattggttacgacatagaccatcaa

SEQ ID NO: 671189 - DNA, 25 bp, Mus musculus
gattggttacgagatagaccatcaa

SEQ ID NO: 671190 - DNA, 25 bp, Mus musculus
gattggttcactcaccataggactc

SEQ ID NO: 671191 - DNA, 25 bp, Mus musculus
gattggttcactgaccataggactc

SEQ ID NO: 671192 - DNA, 25 bp, Mus musculus
gattggttccgactggagtccaaca

SEQ ID NO: 671193 - DNA, 25 bp, Mus musculus
gattggttccgagtggagtccaaca

SEQ ID NO: 671194 - DNA, 25 bp, Mus musculus
gattggttctcaaatactatagagc

SEQ ID NO: 671195 - DNA, 25 bp, Mus musculus
gattggttctcatatactatagagc

SEQ ID NO: 671196 - DNA, 25 bp, Mus musculus
gattggttggaaatcgaagttgcac

SEQ ID NO: 671197 - DNA, 25 bp, Mus musculus
gattggttggaattcgaagttgcac

SEQ ID NO: 671198 - DNA, 25 bp, Mus musculus
gattgtaaaaatagagccacctgat

SEQ ID NO: 671199 - DNA, 25 bp, Mus musculus
gattgtaaaaattgagccacctgat

SEQ ID NO: 671200 - DNA, 25 bp, Mus musculus
gattgtaaatgtaagcgctgtcccc

SEQ ID NO: 671201 - DNA, 25 bp, Mus musculus
gattgtaaatgttagcgctgtcccc

SEQ ID NO: 671202 - DNA, 25 bp, Mus musculus
gattgtaagaggcagaataccagga

SEQ ID NO: 671203 - DNA, 25 bp, Mus musculus
gattgtaagagggagaataccagga

SEQ ID NO: 671204 - DNA, 25 bp, Mus musculus
gattgtaatccgaggactcaatacc

SEQ ID NO: 671205 - DNA, 25 bp, Mus musculus
gattgtaatccgtggactcaatacc

SEQ ID NO: 671206 - DNA, 25 bp, Mus musculus
gattgtaccttgctcactgttgcct

SEQ ID NO: 671207 - DNA, 25 bp, Mus musculus
gattgtaccttggtcactgttgcct

SEQ ID NO: 671208 - DNA, 25 bp, Mus musculus
gattgtactcagagtctatgggccg

SEQ ID NO: 671209 - DNA, 25 bp, Mus musculus
gattgtactcagtgtctatgggccg

SEQ ID NO: 671210 - DNA, 25 bp, Mus musculus
gattgtactcgcacgggctactcag

SEQ ID NO: 671211 - DNA, 25 bp, Mus musculus
gattgtactcgctcgggctactcag

SEQ ID NO: 671212 - DNA, 25 bp, Mus musculus
gattgtactgcgacagcttgctcca

SEQ ID NO: 671213 - DNA, 25 bp, Mus musculus
gattgtactgcgtcagcttgctcca

SEQ ID NO: 671214 - DNA, 25 bp, Mus musculus
gattgtagccttcatggaaactcac

SEQ ID NO: 671215 - DNA, 25 bp, Mus musculus
gattgtagccttgatggaaactcac

SEQ ID NO: 671216 - DNA, 25 bp, Mus musculus
gattgtaggaatcagtggtctatgt

SEQ ID NO: 671217 - DNA, 25 bp, Mus musculus
gattgtaggaatgagtggtctatgt

SEQ ID NO: 671218 - DNA, 25 bp, Mus musculus
gattgtaggacaccctcagattgcg

SEQ ID NO: 671219 - DNA, 25 bp, Mus musculus
gattgtaggacagcctcagattgcg

SEQ ID NO: 671220 - DNA, 25 bp, Mus musculus
gattgtataattagaatgagccaag

SEQ ID NO: 671221 - DNA, 25 bp, Mus musculus
gattgtataatttgaatgagccaag

SEQ ID NO: 671222 - DNA, 25 bp, Mus musculus
gattgtataccaagttctcggcccg

SEQ ID NO: 671223 - DNA, 25 bp, Mus musculus
gattgtataccatgttctcggcccg

SEQ ID NO: 671224 - DNA, 25 bp, Mus musculus
gattgtatacgcctcgctgggcgct

SEQ ID NO: 671225 - DNA, 25 bp, Mus musculus
gattgtatacgcgtcgctgggcgct

SEQ ID NO: 671226 - DNA, 25 bp, Mus musculus
gattgtatccgcatgcaagactcag

SEQ ID NO: 671227 - DNA, 25 bp, Mus musculus
gattgtatccgcttgcaagactcag

SEQ ID NO: 671228 - DNA, 25 bp, Mus musculus
gattgtcaaaggagatctgtctgag

SEQ ID NO: 671229 - DNA, 25 bp, Mus musculus
gattgtcaaaggtgatctgtctgag

SEQ ID NO: 671230 - DNA, 25 bp, Mus musculus
gattgtcacagcctccaacttcagc

SEQ ID NO: 671231 - DNA, 25 bp, Mus musculus
gattgtcacagcgtccaacttcagc

SEQ ID NO: 671232 - DNA, 25 bp, Mus musculus
gattgtcacctcaatgggactgcct

SEQ ID NO: 671233 - DNA, 25 bp, Mus musculus
gattgtcacctctatgggactgcct

SEQ ID NO: 671234 - DNA, 25 bp, Mus musculus
gattgtcagcaaaacccagatcatt

SEQ ID NO: 671235 - DNA, 25 bp, Mus musculus
gattgtcagcaatacccagatcatt

SEQ ID NO: 671236 - DNA, 25 bp, Mus musculus
gattgtcagtggatctgacgacacc

SEQ ID NO: 671237 - DNA, 25 bp, Mus musculus
gattgtcagtggttctgacgacacc

SEQ ID NO: 671238 - DNA, 25 bp, Mus musculus
gattgtccaagaattcctcacagca

SEQ ID NO: 671239 - DNA, 25 bp, Mus musculus
gattgtccaagatttcctcacagca

SEQ ID NO: 671240 - DNA, 25 bp, Mus musculus
gattgtccacccaactatgtccgtg

SEQ ID NO: 671241 - DNA, 25 bp, Mus musculus
gattgtccaccctactatgtccgtg

SEQ ID NO: 671242 - DNA, 25 bp, Mus musculus
gattgtccacgtattcagcttttcc

SEQ ID NO: 671243 - DNA, 25 bp, Mus musculus
gattgtccacgttttcagcttttcc

SEQ ID NO: 671244 - DNA, 25 bp, Mus musculus
gattgtccagtacctgcctcgctta

SEQ ID NO: 671245 - DNA, 25 bp, Mus musculus
gattgtccagtagctgcctcgctta

SEQ ID NO: 671246 - DNA, 25 bp, Mus musculus
gattgtcccagcatttgaaacgctg

SEQ ID NO: 671247 - DNA, 25 bp, Mus musculus
gattgtcccagcttttgaaacgctg

SEQ ID NO: 671248 - DNA, 25 bp, Mus musculus
gattgtccctccactggtccttgtt

SEQ ID NO: 671249 - DNA, 25 bp, Mus musculus
gattgtccctcctctggtccttgtt

SEQ ID NO: 671250 - DNA, 25 bp, Mus musculus
gattgtccgagtagcactgaaaaag

SEQ ID NO: 671251 - DNA, 25 bp, Mus musculus
gattgtccgagttgcactgaaaaag

SEQ ID NO: 671252 - DNA, 25 bp, Mus musculus
gattgtcgccaactacacgagggac

SEQ ID NO: 671253 - DNA, 25 bp, Mus musculus
gattgtcgccaagtacacgagggac

SEQ ID NO: 671254 - DNA, 25 bp, Mus musculus
gattgtcgtgaaaggcatgacccgg

SEQ ID NO: 671255 - DNA, 25 bp, Mus musculus
gattgtcgtgaatggcatgacccgg

SEQ ID NO: 671256 - DNA, 25 bp, Mus musculus
gattgtctacaaagggtgaaccaca

SEQ ID NO: 671257 - DNA, 25 bp, Mus musculus
gattgtctacaaccacagctctggg

SEQ ID NO: 671258 - DNA, 25 bp, Mus musculus
gattgtctacaagcacagctctggg

SEQ ID NO: 671259 - DNA, 25 bp, Mus musculus
gattgtctacaatgggtgaaccaca

SEQ ID NO: 671260 - DNA, 25 bp, Mus musculus
gattgtctatatatcggagcaggca

SEQ ID NO: 671261 - DNA, 25 bp, Mus musculus
gattgtctatatttcggagcaggca

SEQ ID NO: 671262 - DNA, 25 bp, Mus musculus
gattgtcttctaagtgctgtcctat

SEQ ID NO: 671263 - DNA, 25 bp, Mus musculus
gattgtcttctatgtgctgtcctat

SEQ ID NO: 671264 - DNA, 25 bp, Mus musculus
gattgtgaaatacctttaggcttgt

SEQ ID NO: 671265 - DNA, 25 bp, Mus musculus
gattgtgaaatagctttaggcttgt

SEQ ID NO: 671266 - DNA, 25 bp, Mus musculus
gattgtgaacttagctccaccctgt

SEQ ID NO: 671267 - DNA, 25 bp, Mus musculus
gattgtgaactttgctccaccctgt

SEQ ID NO: 671268 - DNA, 25 bp, Mus musculus
gattgtgaagaaccgctatagcacc

SEQ ID NO: 671269 - DNA, 25 bp, Mus musculus
gattgtgaagaagcgctatagcacc

SEQ ID NO: 671270 - DNA, 25 bp, Mus musculus
gattgtgacaaccatccctaccata

SEQ ID NO: 671271 - DNA, 25 bp, Mus musculus
gattgtgacaacgatccctaccata

SEQ ID NO: 671272 - DNA, 25 bp, Mus musculus
gattgtgacataacactgtaaggaa

SEQ ID NO: 671273 - DNA, 25 bp, Mus musculus
gattgtgacataagatctcctgtca

SEQ ID NO: 671274 - DNA, 25 bp, Mus musculus
gattgtgacatatcactgtaaggaa

SEQ ID NO: 671275 - DNA, 25 bp, Mus musculus
gattgtgacatatgatctcctgtca

SEQ ID NO: 671276 - DNA, 25 bp, Mus musculus
gattgtgagcaaactcgttgatgtg

SEQ ID NO: 671277 - DNA, 25 bp, Mus musculus
gattgtgagcaatctcgttgatgtg

SEQ ID NO: 671278 - DNA, 25 bp, Mus musculus
gattgtgagtccattaattgacgaa

SEQ ID NO: 671279 - DNA, 25 bp, Mus musculus
gattgtgagtcctttaattgacgaa

SEQ ID NO: 671280 - DNA, 25 bp, Mus musculus
gattgtgatggacactgtgccagtc

SEQ ID NO: 671281 - DNA, 25 bp, Mus musculus
gattgtgatggagactgtgccagtc

SEQ ID NO: 671282 - DNA, 25 bp, Mus musculus
gattgtgattggaggttcttctgaa

SEQ ID NO: 671283 - DNA, 25 bp, Mus musculus
gattgtgattggtggttcttctgaa

SEQ ID NO: 671284 - DNA, 25 bp, Mus musculus
gattgtgccctccttttccggaagc

SEQ ID NO: 671285 - DNA, 25 bp, Mus musculus
gattgtgccctcgttttccggaagc

SEQ ID NO: 671286 - DNA, 25 bp, Mus musculus
gattgtggagaaagtgacagaacac

SEQ ID NO: 671287 - DNA, 25 bp, Mus musculus
gattgtggagaatgtgacagaacac

SEQ ID NO: 671288 - DNA, 25 bp, Mus musculus
gattgtggatgactctaagaactat

SEQ ID NO: 671289 - DNA, 25 bp, Mus musculus
gattgtggatgagtctaagaactat

SEQ ID NO: 671290 - DNA, 25 bp, Mus musculus
gattgtggctagagcagcttgctgt

SEQ ID NO: 671291 - DNA, 25 bp, Mus musculus
gattgtggctagtgcagcttgctgt

SEQ ID NO: 671292 - DNA, 25 bp, Mus musculus
gattgtggctcactcctgccgctgc

SEQ ID NO: 671293 - DNA, 25 bp, Mus musculus
gattgtggctcagtcctgccgctgc

SEQ ID NO: 671294 - DNA, 25 bp, Mus musculus
gattgtggctgactctgacgttatg

SEQ ID NO: 671295 - DNA, 25 bp, Mus musculus
gattgtggctgagtctgacgttatg

SEQ ID NO: 671296 - DNA, 25 bp, Mus musculus
gattgtggctgcagtcggtatcacc

SEQ ID NO: 671297 - DNA, 25 bp, Mus musculus
gattgtggctgctgtcggtatcacc

SEQ ID NO: 671298 - DNA, 25 bp, Mus musculus
gattgtgggcaaccacagcagcagt

SEQ ID NO: 671299 - DNA, 25 bp, Mus musculus
gattgtgggcaagcacagcagcagt

SEQ ID NO: 671300 - DNA, 25 bp, Mus musculus
gattgtgggccgatggaatcctcct

SEQ ID NO: 671301 - DNA, 25 bp, Mus musculus
gattgtgggccgttggaatcctcct

SEQ ID NO: 671302 - DNA, 25 bp, Mus musculus
gattgtgggtggattgaatgcctca

SEQ ID NO: 671303 - DNA, 25 bp, Mus musculus
gattgtgggtggtttgaatgcctca

SEQ ID NO: 671304 - DNA, 25 bp, Mus musculus
gattgtggttgcaggagctctgctc

SEQ ID NO: 671305 - DNA, 25 bp, Mus musculus
gattgtggttgctggagctctgctc

SEQ ID NO: 671306 - DNA, 25 bp, Mus musculus
gattgtggttgtaagccttgcatat

SEQ ID NO: 671307 - DNA, 25 bp, Mus musculus
gattgtggttgttagccttgcatat

SEQ ID NO: 671308 - DNA, 25 bp, Mus musculus
gattgtgtacgccacagagaagaag

SEQ ID NO: 671309 - DNA, 25 bp, Mus musculus
gattgtgtacgcgacagagaagaag

SEQ ID NO: 671310 - DNA, 25 bp, Mus musculus
gattgtgtcgcccttgtccatgcag

SEQ ID NO: 671311 - DNA, 25 bp, Mus musculus
gattgtgtcgccgttgtccatgcag

SEQ ID NO: 671312 - DNA, 25 bp, Mus musculus
gattgtgtgacaaacacctgagagg

SEQ ID NO: 671313 - DNA, 25 bp, Mus musculus
gattgtgtgacatacacctgagagg

SEQ ID NO: 671314 - DNA, 25 bp, Mus musculus
gattgtgtgcgacaggtgatgtgca

SEQ ID NO: 671315 - DNA, 25 bp, Mus musculus
gattgtgtgcgagaggtgatgtgca

SEQ ID NO: 671316 - DNA, 25 bp, Mus musculus
gattgtgttattaggtgcgagacta

SEQ ID NO: 671317 - DNA, 25 bp, Mus musculus
gattgtgttatttggtgcgagacta

SEQ ID NO: 671318 - DNA, 25 bp, Mus musculus
gattgtgttgtgcactttcctgtcc

SEQ ID NO: 671319 - DNA, 25 bp, Mus musculus
gattgtgttgtggactttcctgtcc

SEQ ID NO: 671320 - DNA, 25 bp, Mus musculus
gattgtgtttaaccagagcatctgc

SEQ ID NO: 671321 - DNA, 25 bp, Mus musculus
gattgtgtttaagcagagcatctgc

SEQ ID NO: 671322 - DNA, 25 bp, Mus musculus
gattgttaaattctcgcaaaaccat

SEQ ID NO: 671323 - DNA, 25 bp, Mus musculus
gattgttaaattgtcgcaaaaccat

SEQ ID NO: 671324 - DNA, 25 bp, Mus musculus
gattgttatccgaggcctgcagaag

SEQ ID NO: 671325 - DNA, 25 bp, Mus musculus
gattgttatccgtggcctgcagaag

SEQ ID NO: 671326 - DNA, 25 bp, Mus musculus
gattgttatcgacggctttcagacc

SEQ ID NO: 671327 - DNA, 25 bp, Mus musculus
gattgttatcgagggctttcagacc

SEQ ID NO: 671328 - DNA, 25 bp, Mus musculus
gattgttcacggcagccaggacaac

SEQ ID NO: 671329 - DNA, 25 bp, Mus musculus
gattgttcacgggagccaggacaac

SEQ ID NO: 671330 - DNA, 25 bp, Mus musculus
gattgttcattgctgctagtatcct

SEQ ID NO: 671331 - DNA, 25 bp, Mus musculus
gattgttcattggtgctagtatcct

SEQ ID NO: 671332 - DNA, 25 bp, Mus musculus
gattgttcccacaagagaacttgct

SEQ ID NO: 671333 - DNA, 25 bp, Mus musculus
gattgttcccactagagaacttgct

SEQ ID NO: 671334 - DNA, 25 bp, Mus musculus
gattgttcctttctggcatcgttgg

SEQ ID NO: 671335 - DNA, 25 bp, Mus musculus
gattgttcctttgtggcatcgttgg

SEQ ID NO: 671336 - DNA, 25 bp, Mus musculus
gattgttgacaactgtaaccaaaag

SEQ ID NO: 671337 - DNA, 25 bp, Mus musculus
gattgttgacaagtgtaaccaaaag

SEQ ID NO: 671338 - DNA, 25 bp, Mus musculus
gattgttgacccagcatttgttgcc

SEQ ID NO: 671339 - DNA, 25 bp, Mus musculus
gattgttgaccctgcatttgttgcc

SEQ ID NO: 671340 - DNA, 25 bp, Mus musculus
gattgttggagtcacatcactgggt

SEQ ID NO: 671341 - DNA, 25 bp, Mus musculus
gattgttggagtgacatcactgggt

SEQ ID NO: 671342 - DNA, 25 bp, Mus musculus
gattgttggataaacttcaaaggaa

SEQ ID NO: 671343 - DNA, 25 bp, Mus musculus
gattgttggatatacttcaaaggaa

SEQ ID NO: 671344 - DNA, 25 bp, Mus musculus
gattgtttgcctacccaagcgagtt

SEQ ID NO: 671345 - DNA, 25 bp, Mus musculus
gattgtttgccttcccaagcgagtt

SEQ ID NO: 671346 - DNA, 25 bp, Mus musculus
gattgtttgctcaggtctgcgacga

SEQ ID NO: 671347 - DNA, 25 bp, Mus musculus
gattgtttgctctggtctgcgacga

SEQ ID NO: 671348 - DNA, 25 bp, Mus musculus
gattgttttgcactctgcccgcaac

SEQ ID NO: 671349 - DNA, 25 bp, Mus musculus
gattgttttgcagtctgcccgcaac

SEQ ID NO: 671350 - DNA, 25 bp, Mus musculus
gatttaaagccccaaaatgtgctgc

SEQ ID NO: 671351 - DNA, 25 bp, Mus musculus
gatttaaagcccgaaaatgtgctgc

SEQ ID NO: 671352 - DNA, 25 bp, Mus musculus
gatttaaagcgaaagacgcggttgg

SEQ ID NO: 671353 - DNA, 25 bp, Mus musculus
gatttaaagcgatagacgcggttgg

SEQ ID NO: 671354 - DNA, 25 bp, Mus musculus
gatttaacaaggaagactggcgaga

SEQ ID NO: 671355 - DNA, 25 bp, Mus musculus
gatttaacaaggtagactggcgaga

SEQ ID NO: 671356 - DNA, 25 bp, Mus musculus
gatttaagcgagaactggagtaggt

SEQ ID NO: 671357 - DNA, 25 bp, Mus musculus
gatttaagcgagtactggagtaggt

SEQ ID NO: 671358 - DNA, 25 bp, Mus musculus
gatttaaggcacagaccttgctggc

SEQ ID NO: 671359 - DNA, 25 bp, Mus musculus
gatttaaggcactgaccttgctggc

SEQ ID NO: 671360 - DNA, 25 bp, Mus musculus
gatttaaggcagcatgctggctgca

SEQ ID NO: 671361 - DNA, 25 bp, Mus musculus
gatttaaggcaggatgctggctgca

SEQ ID NO: 671362 - DNA, 25 bp, Mus musculus
gatttaagtcctctctttgctgtca

SEQ ID NO: 671363 - DNA, 25 bp, Mus musculus
gatttaagtcctgtctttgctgtca

SEQ ID NO: 671364 - DNA, 25 bp, Mus musculus
gatttaagttacagagcctgagccg

SEQ ID NO: 671365 - DNA, 25 bp, Mus musculus
gatttaagttactgagcctgagccg

SEQ ID NO: 671366 - DNA, 25 bp, Mus musculus
gatttaattgctcaagcccggacag

SEQ ID NO: 671367 - DNA, 25 bp, Mus musculus
gatttaattgctgaagcccggacag

SEQ ID NO: 671368 - DNA, 25 bp, Mus musculus
gatttacagcggacgttggaactgg

SEQ ID NO: 671369 - DNA, 25 bp, Mus musculus
gatttacagcggtcgttggaactgg

SEQ ID NO: 671370 - DNA, 25 bp, Mus musculus
gatttaccagtgaatcaatcaggtg

SEQ ID NO: 671371 - DNA, 25 bp, Mus musculus
gatttaccagtgtatcaatcaggtg

SEQ ID NO: 671372 - DNA, 25 bp, Mus musculus
gatttacccagcataattgcgcccc

SEQ ID NO: 671373 - DNA, 25 bp, Mus musculus
gatttacccagcttaattgcgcccc

SEQ ID NO: 671374 - DNA, 25 bp, Mus musculus
gatttaccccacagggatcgggcag

SEQ ID NO: 671375 - DNA, 25 bp, Mus musculus
gatttaccccactgggatcgggcag

SEQ ID NO: 671376 - DNA, 25 bp, Mus musculus
gatttacctgagatccaagtaccag

SEQ ID NO: 671377 - DNA, 25 bp, Mus musculus
gatttacctgagttccaagtaccag

SEQ ID NO: 671378 - DNA, 25 bp, Mus musculus
gatttaccttgcacgaaatggcaag

SEQ ID NO: 671379 - DNA, 25 bp, Mus musculus
gatttaccttgctcgaaatggcaag

SEQ ID NO: 671380 - DNA, 25 bp, Mus musculus
gatttactctgaacatgctggtcga

SEQ ID NO: 671381 - DNA, 25 bp, Mus musculus
gatttactctgatcatgctggtcga

SEQ ID NO: 671382 - DNA, 25 bp, Mus musculus
gatttactggagcataactctcacc

SEQ ID NO: 671383 - DNA, 25 bp, Mus musculus
gatttactggaggataactctcacc

SEQ ID NO: 671384 - DNA, 25 bp, Mus musculus
gatttacttatgcaggatgctccag

SEQ ID NO: 671385 - DNA, 25 bp, Mus musculus
gatttacttatggaggatgctccag

SEQ ID NO: 671386 - DNA, 25 bp, Mus musculus
gatttagaccgcatcctcactgtga

SEQ ID NO: 671387 - DNA, 25 bp, Mus musculus
gatttagaccgcttcctcactgtga

SEQ ID NO: 671388 - DNA, 25 bp, Mus musculus
gatttagactccaagcggcagtgca

SEQ ID NO: 671389 - DNA, 25 bp, Mus musculus
gatttagactcctagcggcagtgca

SEQ ID NO: 671390 - DNA, 25 bp, Mus musculus
gatttagactcgcatgaagatttct

SEQ ID NO: 671391 - DNA, 25 bp, Mus musculus
gatttagactcggatgaagatttct

SEQ ID NO: 671392 - DNA, 25 bp, Mus musculus
gatttagacttgcagaccgaggaag

SEQ ID NO: 671393 - DNA, 25 bp, Mus musculus
gatttagacttggagaccgaggaag

SEQ ID NO: 671394 - DNA, 25 bp, Mus musculus
gatttagagaatcagatgcgtagtc

SEQ ID NO: 671395 - DNA, 25 bp, Mus musculus
gatttagagaatgagatgcgtagtc

SEQ ID NO: 671396 - DNA, 25 bp, Mus musculus
gatttagcttcaaggacattaagaa

SEQ ID NO: 671397 - DNA, 25 bp, Mus musculus
gatttagcttcatggacattaagaa

SEQ ID NO: 671398 - DNA, 25 bp, Mus musculus
gatttaggaagacctgactcagcct

SEQ ID NO: 671399 - DNA, 25 bp, Mus musculus
gatttaggaagagctgactcagcct

SEQ ID NO: 671400 - DNA, 25 bp, Mus musculus
gatttaggaagtctggctttccgac

SEQ ID NO: 671401 - DNA, 25 bp, Mus musculus
gatttaggaagtgtggctttccgac

SEQ ID NO: 671402 - DNA, 25 bp, Mus musculus
gatttagggataaagcgcggccccg

SEQ ID NO: 671403 - DNA, 25 bp, Mus musculus
gatttagggatatagcgcggccccg

SEQ ID NO: 671404 - DNA, 25 bp, Mus musculus
gatttagggatgagaaaccttccac

SEQ ID NO: 671405 - DNA, 25 bp, Mus musculus
gatttagggatgtgaaaccttccac

SEQ ID NO: 671406 - DNA, 25 bp, Mus musculus
gatttagtgaatataggaagcactg

SEQ ID NO: 671407 - DNA, 25 bp, Mus musculus
gatttagtgaatttaggaagcactg

SEQ ID NO: 671408 - DNA, 25 bp, Mus musculus
gatttataagaccaatggagaccag

SEQ ID NO: 671409 - DNA, 25 bp, Mus musculus
gatttataagacgaatggagaccag

SEQ ID NO: 671410 - DNA, 25 bp, Mus musculus
gatttataagtaccaaactgcccga

SEQ ID NO: 671411 - DNA, 25 bp, Mus musculus
gatttataagtagcaaactgcccga

SEQ ID NO: 671412 - DNA, 25 bp, Mus musculus
gatttatcaaagatgtccacgaaga

SEQ ID NO: 671413 - DNA, 25 bp, Mus musculus
gatttatcaaagttgtccacgaaga

SEQ ID NO: 671414 - DNA, 25 bp, Mus musculus
gatttatccctgactccacttgagc

SEQ ID NO: 671415 - DNA, 25 bp, Mus musculus
gatttatccctgtctccacttgagc

SEQ ID NO: 671416 - DNA, 25 bp, Mus musculus
gatttatcgatgctccaacccgggc

SEQ ID NO: 671417 - DNA, 25 bp, Mus musculus
gatttatcgatggtccaacccgggc

SEQ ID NO: 671418 - DNA, 25 bp, Mus musculus
gatttatgggaaatacttcgagctg

SEQ ID NO: 671419 - DNA, 25 bp, Mus musculus
gatttatgggaattacttcgagctg

SEQ ID NO: 671420 - DNA, 25 bp, Mus musculus
gatttatgtcagaacatggacaagc

SEQ ID NO: 671421 - DNA, 25 bp, Mus musculus
gatttatgtcagtacatggacaagc

SEQ ID NO: 671422 - DNA, 25 bp, Mus musculus
gatttattcatcagctacgttctga

SEQ ID NO: 671423 - DNA, 25 bp, Mus musculus
gatttattcatctgctacgttctga

SEQ ID NO: 671424 - DNA, 25 bp, Mus musculus
gatttattcggtcgcgctcactgtg

SEQ ID NO: 671425 - DNA, 25 bp, Mus musculus
gatttattcggtggcgctcactgtg

SEQ ID NO: 671426 - DNA, 25 bp, Mus musculus
gatttattctggcagctactgggac

SEQ ID NO: 671427 - DNA, 25 bp, Mus musculus
gatttattctgggagctactgggac

SEQ ID NO: 671428 - DNA, 25 bp, Mus musculus
gatttattgcacatactgagtacag

SEQ ID NO: 671429 - DNA, 25 bp, Mus musculus
gatttattgcacttactgagtacag

SEQ ID NO: 671430 - DNA, 25 bp, Mus musculus
gatttattttgtcctgttccctggc

SEQ ID NO: 671431 - DNA, 25 bp, Mus musculus
gatttattttgtgctgttccctggc

SEQ ID NO: 671432 - DNA, 25 bp, Mus musculus
gatttcaaaactcgtcagaaggcag

SEQ ID NO: 671433 - DNA, 25 bp, Mus musculus
gatttcaaaactggtcagaaggcag

SEQ ID NO: 671434 - DNA, 25 bp, Mus musculus
gatttcaaggatccatgaggctcat

SEQ ID NO: 671435 - DNA, 25 bp, Mus musculus
gatttcaaggatgcatgaggctcat

SEQ ID NO: 671436 - DNA, 25 bp, Mus musculus
gatttcaatctgctgatgcaactgg

SEQ ID NO: 671437 - DNA, 25 bp, Mus musculus
gatttcaatctggtgatgcaactgg

SEQ ID NO: 671438 - DNA, 25 bp, Mus musculus
gatttcacactccatccagatgtca

SEQ ID NO: 671439 - DNA, 25 bp, Mus musculus
gatttcacactcgatccagatgtca

SEQ ID NO: 671440 - DNA, 25 bp, Mus musculus
gatttcacagggaatattgaatccc

SEQ ID NO: 671441 - DNA, 25 bp, Mus musculus
gatttcacagggtatattgaatccc

SEQ ID NO: 671442 - DNA, 25 bp, Mus musculus
gatttcacattacagatcgacatgg

SEQ ID NO: 671443 - DNA, 25 bp, Mus musculus
gatttcacattagagatcgacatgg

SEQ ID NO: 671444 - DNA, 25 bp, Mus musculus
gatttcacctggcagcctccgactg

SEQ ID NO: 671445 - DNA, 25 bp, Mus musculus
gatttcacctgggagcctccgactg

SEQ ID NO: 671446 - DNA, 25 bp, Mus musculus
gatttcacctttagcccagaggaga

SEQ ID NO: 671447 - DNA, 25 bp, Mus musculus
gatttcaccttttgcccagaggaga

SEQ ID NO: 671448 - DNA, 25 bp, Mus musculus
gatttcactcccaacaaatgtacag

SEQ ID NO: 671449 - DNA, 25 bp, Mus musculus
gatttcactccctacaaatgtacag

SEQ ID NO: 671450 - DNA, 25 bp, Mus musculus
gatttcactctcctgagacacactg

SEQ ID NO: 671451 - DNA, 25 bp, Mus musculus
gatttcactctcgtgagacacactg

SEQ ID NO: 671452 - DNA, 25 bp, Mus musculus
gatttcagaagacccaatggagtgt

SEQ ID NO: 671453 - DNA, 25 bp, Mus musculus
gatttcagaagagccaatggagtgt

SEQ ID NO: 671454 - DNA, 25 bp, Mus musculus
gatttcagacctaggacctggagtg

SEQ ID NO: 671455 - DNA, 25 bp, Mus musculus
gatttcagaccttggacctggagtg

SEQ ID NO: 671456 - DNA, 25 bp, Mus musculus
gatttcagctatcgtgatgtgcagc

SEQ ID NO: 671457 - DNA, 25 bp, Mus musculus
gatttcagctatggtgatgtgcagc

SEQ ID NO: 671458 - DNA, 25 bp, Mus musculus
gatttcatagatccgtgtggctaca

SEQ ID NO: 671459 - DNA, 25 bp, Mus musculus
gatttcatagatgcgtgtggctaca

SEQ ID NO: 671460 - DNA, 25 bp, Mus musculus
gatttcatcaaacgtctttccattt

SEQ ID NO: 671461 - DNA, 25 bp, Mus musculus
gatttcatcaaaggtctttccattt

SEQ ID NO: 671462 - DNA, 25 bp, Mus musculus
gatttcatcatcatcgaggctgcac

SEQ ID NO: 671463 - DNA, 25 bp, Mus musculus
gatttcatcatcttcgaggctgcac

SEQ ID NO: 671464 - DNA, 25 bp, Mus musculus
gatttcatccatcagcagcgaaccc

SEQ ID NO: 671465 - DNA, 25 bp, Mus musculus
gatttcatccatgagcagcgaaccc

SEQ ID NO: 671466 - DNA, 25 bp, Mus musculus
gatttcatctctcggttccctcagg

SEQ ID NO: 671467 - DNA, 25 bp, Mus musculus
gatttcatctctgggttccctcagg

SEQ ID NO: 671468 - DNA, 25 bp, Mus musculus
gatttcattgcacagccggctcagc

SEQ ID NO: 671469 - DNA, 25 bp, Mus musculus
gatttcattgcagagccggctcagc

SEQ ID NO: 671470 - DNA, 25 bp, Mus musculus
gatttcattgctacaggaagaacag

SEQ ID NO: 671471 - DNA, 25 bp, Mus musculus
gatttcattgcttcaggaagaacag

SEQ ID NO: 671472 - DNA, 25 bp, Mus musculus
gatttccacactactatgcctcctg

SEQ ID NO: 671473 - DNA, 25 bp, Mus musculus
gatttccacacttctatgcctcctg

SEQ ID NO: 671474 - DNA, 25 bp, Mus musculus
gatttccacctgacagcttcgtgca

SEQ ID NO: 671475 - DNA, 25 bp, Mus musculus
gatttccacctgtcagcttcgtgca

SEQ ID NO: 671476 - DNA, 25 bp, Mus musculus
gatttccagccacttcgctatttgg

SEQ ID NO: 671477 - DNA, 25 bp, Mus musculus
gatttccagccagttcgctatttgg

SEQ ID NO: 671478 - DNA, 25 bp, Mus musculus
gatttccagctgcacaggctgttaa

SEQ ID NO: 671479 - DNA, 25 bp, Mus musculus
gatttccagctgcttccggttgtat

SEQ ID NO: 671480 - DNA, 25 bp, Mus musculus
gatttccagctggacaggctgttaa

SEQ ID NO: 671481 - DNA, 25 bp, Mus musculus
gatttccagctggttccggttgtat

SEQ ID NO: 671482 - DNA, 25 bp, Mus musculus
gatttcccagcgagagagctctaaa

SEQ ID NO: 671483 - DNA, 25 bp, Mus musculus
gatttcccagcgtgagagctctaaa

SEQ ID NO: 671484 - DNA, 25 bp, Mus musculus
gatttcccagctcgtagtatcttgg

SEQ ID NO: 671485 - DNA, 25 bp, Mus musculus
gatttcccagctggtagtatcttgg

SEQ ID NO: 671486 - DNA, 25 bp, Mus musculus
gatttcccattcagcagatgcacct

SEQ ID NO: 671487 - DNA, 25 bp, Mus musculus
gatttcccattctgcagatgcacct

SEQ ID NO: 671488 - DNA, 25 bp, Mus musculus
gatttccccaccagctaaaaagcca

SEQ ID NO: 671489 - DNA, 25 bp, Mus musculus
gatttccccacctgctaaaaagcca

SEQ ID NO: 671490 - DNA, 25 bp, Mus musculus
gatttccccgtgatcctctatgaag

SEQ ID NO: 671491 - DNA, 25 bp, Mus musculus
gatttccccgtgttcctctatgaag

SEQ ID NO: 671492 - DNA, 25 bp, Mus musculus
gatttccctaaaagaactagtcctg

SEQ ID NO: 671493 - DNA, 25 bp, Mus musculus
gatttccctaaacagcccacgttga

SEQ ID NO: 671494 - DNA, 25 bp, Mus musculus
gatttccctaaagagcccacgttga

SEQ ID NO: 671495 - DNA, 25 bp, Mus musculus
gatttccctaaatgaactagtcctg

SEQ ID NO: 671496 - DNA, 25 bp, Mus musculus
gatttccctagacattatgacgttg

SEQ ID NO: 671497 - DNA, 25 bp, Mus musculus
gatttccctagagattatgacgttg

SEQ ID NO: 671498 - DNA, 25 bp, Mus musculus
gatttccctgggatctatacaacca

SEQ ID NO: 671499 - DNA, 25 bp, Mus musculus
gatttccctgggttctatacaacca

SEQ ID NO: 671500 - DNA, 25 bp, Mus musculus
gatttccctgtacatcccctctgag

SEQ ID NO: 671501 - DNA, 25 bp, Mus musculus
gatttccctgtagatcccctctgag

SEQ ID NO: 671502 - DNA, 25 bp, Mus musculus
gatttccgatatcctctttgcccgc

SEQ ID NO: 671503 - DNA, 25 bp, Mus musculus
gatttccgatatgctctttgcccgc

SEQ ID NO: 671504 - DNA, 25 bp, Mus musculus
gatttccgcataatttggatctggg

SEQ ID NO: 671505 - DNA, 25 bp, Mus musculus
gatttccgcatattttggatctggg

SEQ ID NO: 671506 - DNA, 25 bp, Mus musculus
gatttccggcttaatcgttatgttg

SEQ ID NO: 671507 - DNA, 25 bp, Mus musculus
gatttccggctttatcgttatgttg

SEQ ID NO: 671508 - DNA, 25 bp, Mus musculus
gatttccgggtgaaaggtgtgacca

SEQ ID NO: 671509 - DNA, 25 bp, Mus musculus
gatttccgggtgtaaggtgtgacca

SEQ ID NO: 671510 - DNA, 25 bp, Mus musculus
gatttccgtaaacagagccgaacct

SEQ ID NO: 671511 - DNA, 25 bp, Mus musculus
gatttccgtaaagagagccgaacct

SEQ ID NO: 671512 - DNA, 25 bp, Mus musculus
gatttcctacctcgctgaaacttga

SEQ ID NO: 671513 - DNA, 25 bp, Mus musculus
gatttcctacctggctgaaacttga

SEQ ID NO: 671514 - DNA, 25 bp, Mus musculus
gatttcctagaacctgactgctgcc

SEQ ID NO: 671515 - DNA, 25 bp, Mus musculus
gatttcctagaagctgactgctgcc

SEQ ID NO: 671516 - DNA, 25 bp, Mus musculus
gatttcctcaaaaatgagttcgaca

SEQ ID NO: 671517 - DNA, 25 bp, Mus musculus
gatttcctcaaatatgagttcgaca

SEQ ID NO: 671518 - DNA, 25 bp, Mus musculus
gatttcctcccaatagatgctactc

SEQ ID NO: 671519 - DNA, 25 bp, Mus musculus
gatttcctcccattagatgctactc

SEQ ID NO: 671520 - DNA, 25 bp, Mus musculus
gatttcctgaagatgtttacagcgc

SEQ ID NO: 671521 - DNA, 25 bp, Mus musculus
gatttcctgaagttgtttacagcgc

SEQ ID NO: 671522 - DNA, 25 bp, Mus musculus
gatttcctgattcctattggaaaag

SEQ ID NO: 671523 - DNA, 25 bp, Mus musculus
gatttcctgattgctattggaaaag

SEQ ID NO: 671524 - DNA, 25 bp, Mus musculus
gatttcctgccaattccatttctaa

SEQ ID NO: 671525 - DNA, 25 bp, Mus musculus
gatttcctgccatttccatttctaa

SEQ ID NO: 671526 - DNA, 25 bp, Mus musculus
gatttcctggatctggtaacatggc

SEQ ID NO: 671527 - DNA, 25 bp, Mus musculus
gatttcctggatgtggtaacatggc

SEQ ID NO: 671528 - DNA, 25 bp, Mus musculus
gatttcctgggaagatctttgccag

SEQ ID NO: 671529 - DNA, 25 bp, Mus musculus
gatttcctgggatgatctttgccag

SEQ ID NO: 671530 - DNA, 25 bp, Mus musculus
gatttcctgggcaaccagtgggctc

SEQ ID NO: 671531 - DNA, 25 bp, Mus musculus
gatttcctgggctaccagtgggctc

SEQ ID NO: 671532 - DNA, 25 bp, Mus musculus
gatttccttgaactgaatgcagcaa

SEQ ID NO: 671533 - DNA, 25 bp, Mus musculus
gatttccttgaagtgaatgcagcaa

SEQ ID NO: 671534 - DNA, 25 bp, Mus musculus
gatttccttgacctgtctcccgagg

SEQ ID NO: 671535 - DNA, 25 bp, Mus musculus
gatttccttgacgtgtctcccgagg

SEQ ID NO: 671536 - DNA, 25 bp, Mus musculus
gatttcgaacaaacacttccagtta

SEQ ID NO: 671537 - DNA, 25 bp, Mus musculus
gatttcgaacaatcacttccagtta

SEQ ID NO: 671538 - DNA, 25 bp, Mus musculus
gatttcggacctagagaacgttgcc

SEQ ID NO: 671539 - DNA, 25 bp, Mus musculus
gatttcggaccttgagaacgttgcc

SEQ ID NO: 671540 - DNA, 25 bp, Mus musculus
gatttcggatcacctggaggacagg

SEQ ID NO: 671541 - DNA, 25 bp, Mus musculus
gatttcggatcagctggaggacagg

SEQ ID NO: 671542 - DNA, 25 bp, Mus musculus
gatttcggccttagcaaggaatgtg

SEQ ID NO: 671543 - DNA, 25 bp, Mus musculus
gatttcggccttcatctcgtcttga

SEQ ID NO: 671544 - DNA, 25 bp, Mus musculus
gatttcggccttgatctcgtcttga

SEQ ID NO: 671545 - DNA, 25 bp, Mus musculus
gatttcggcctttgcaaggaatgtg

SEQ ID NO: 671546 - DNA, 25 bp, Mus musculus
gatttcggtcccactggagagtttg

SEQ ID NO: 671547 - DNA, 25 bp, Mus musculus
gatttcggtccctctggagagtttg

SEQ ID NO: 671548 - DNA, 25 bp, Mus musculus
gatttcgtacttcctcacagacaag

SEQ ID NO: 671549 - DNA, 25 bp, Mus musculus
gatttcgtacttgctcacagacaag

SEQ ID NO: 671550 - DNA, 25 bp, Mus musculus
gatttcgtggctccctggtcaacca

SEQ ID NO: 671551 - DNA, 25 bp, Mus musculus
gatttcgtggctgcctggtcaacca

SEQ ID NO: 671552 - DNA, 25 bp, Mus musculus
gatttctaggaacatacgctcctct

SEQ ID NO: 671553 - DNA, 25 bp, Mus musculus
gatttctaggaagatacgctcctct

SEQ ID NO: 671554 - DNA, 25 bp, Mus musculus
gatttctataataggcctgatgaat

SEQ ID NO: 671555 - DNA, 25 bp, Mus musculus
gatttctataattggcctgatgaat

SEQ ID NO: 671556 - DNA, 25 bp, Mus musculus
gatttctcagaacaaagtagcagtt

SEQ ID NO: 671557 - DNA, 25 bp, Mus musculus
gatttctcagaagaaagtagcagtt

SEQ ID NO: 671558 - DNA, 25 bp, Mus musculus
gatttctcatcacccgaaagtccag

SEQ ID NO: 671559 - DNA, 25 bp, Mus musculus
gatttctcatcagccgaaagtccag

SEQ ID NO: 671560 - DNA, 25 bp, Mus musculus
gatttctcccaacatgccagtgtgc

SEQ ID NO: 671561 - DNA, 25 bp, Mus musculus
gatttctcccaagatgccagtgtgc

SEQ ID NO: 671562 - DNA, 25 bp, Mus musculus
gatttctcctatactgtgggctatg

SEQ ID NO: 671563 - DNA, 25 bp, Mus musculus
gatttctcctattctgtgggctatg

SEQ ID NO: 671564 - DNA, 25 bp, Mus musculus
gatttctcgacacaactctaccact

SEQ ID NO: 671565 - DNA, 25 bp, Mus musculus
gatttctcgacagaactctaccact

SEQ ID NO: 671566 - DNA, 25 bp, Mus musculus
gatttctctcaccagttggagagca

SEQ ID NO: 671567 - DNA, 25 bp, Mus musculus
gatttctctcacgagttggagagca

SEQ ID NO: 671568 - DNA, 25 bp, Mus musculus
gatttctctgatcatgggcccgtgt

SEQ ID NO: 671569 - DNA, 25 bp, Mus musculus
gatttctctgatgatgggcccgtgt

SEQ ID NO: 671570 - DNA, 25 bp, Mus musculus
gatttctgacatagcaagaactatg

SEQ ID NO: 671571 - DNA, 25 bp, Mus musculus
gatttctgacattgcaagaactatg

SEQ ID NO: 671572 - DNA, 25 bp, Mus musculus
gatttctgccacacatttacaggaa

SEQ ID NO: 671573 - DNA, 25 bp, Mus musculus
gatttctgccactcatttacaggaa

SEQ ID NO: 671574 - DNA, 25 bp, Mus musculus
gatttctgcccacattgtggctcag

SEQ ID NO: 671575 - DNA, 25 bp, Mus musculus
gatttctgcccagattgtggctcag

SEQ ID NO: 671576 - DNA, 25 bp, Mus musculus
gatttctgccctacggatgtctgtc

SEQ ID NO: 671577 - DNA, 25 bp, Mus musculus
gatttctgcccttcggatgtctgtc

SEQ ID NO: 671578 - DNA, 25 bp, Mus musculus
gatttctggaaccttcatgacccca

SEQ ID NO: 671579 - DNA, 25 bp, Mus musculus
gatttctggaacgttcatgacccca

SEQ ID NO: 671580 - DNA, 25 bp, Mus musculus
gatttctggactcctgcgtgacccg

SEQ ID NO: 671581 - DNA, 25 bp, Mus musculus
gatttctggactgctgcgtgacccg

SEQ ID NO: 671582 - DNA, 25 bp, Mus musculus
gatttctggtagctcccacgttcag

SEQ ID NO: 671583 - DNA, 25 bp, Mus musculus
gatttctggtaggtcccacgttcag

SEQ ID NO: 671584 - DNA, 25 bp, Mus musculus
gatttctggtgtcaatgtccccggc

SEQ ID NO: 671585 - DNA, 25 bp, Mus musculus
gatttctggtgtgaatgtccccggc

SEQ ID NO: 671586 - DNA, 25 bp, Mus musculus
gatttctgtgaaatgatggccaacg

SEQ ID NO: 671587 - DNA, 25 bp, Mus musculus
gatttctgtgaattgatggccaacg

SEQ ID NO: 671588 - DNA, 25 bp, Mus musculus
gatttcttaaagactggatagctga

SEQ ID NO: 671589 - DNA, 25 bp, Mus musculus
gatttcttaaagtctggatagctga

SEQ ID NO: 671590 - DNA, 25 bp, Mus musculus
gatttcttatctcatccgggagaga

SEQ ID NO: 671591 - DNA, 25 bp, Mus musculus
gatttcttatctgatccgggagaga

SEQ ID NO: 671592 - DNA, 25 bp, Mus musculus
gatttcttcacactccctcctgtgt

SEQ ID NO: 671593 - DNA, 25 bp, Mus musculus
gatttcttcacagtccctcctgtgt

SEQ ID NO: 671594 - DNA, 25 bp, Mus musculus
gatttcttcccactcccatctaatg

SEQ ID NO: 671595 - DNA, 25 bp, Mus musculus
gatttcttcccagtcccatctaatg

SEQ ID NO: 671596 - DNA, 25 bp, Mus musculus
gatttcttgagcaggtgtcgacagg

SEQ ID NO: 671597 - DNA, 25 bp, Mus musculus
gatttcttgagctggtgtcgacagg

SEQ ID NO: 671598 - DNA, 25 bp, Mus musculus
gatttcttggccctgaacttgacgg

SEQ ID NO: 671599 - DNA, 25 bp, Mus musculus
gatttcttggccgtgaacttgacgg

SEQ ID NO: 671600 - DNA, 25 bp, Mus musculus
gatttctttgtacttcagctagccg

SEQ ID NO: 671601 - DNA, 25 bp, Mus musculus
gatttctttgtagttcagctagccg

SEQ ID NO: 671602 - DNA, 25 bp, Mus musculus
gatttcttttgtcgcgcagcaacca

SEQ ID NO: 671603 - DNA, 25 bp, Mus musculus
gatttcttttgtggcgcagcaacca

SEQ ID NO: 671604 - DNA, 25 bp, Mus musculus
gatttctttttccataactccttag

SEQ ID NO: 671605 - DNA, 25 bp, Mus musculus
gatttctttttcgataactccttag

SEQ ID NO: 671606 - DNA, 25 bp, Mus musculus
gatttgaaaagccttgagaaagaga

SEQ ID NO: 671607 - DNA, 25 bp, Mus musculus
gatttgaaaagcgttgagaaagaga

SEQ ID NO: 671608 - DNA, 25 bp, Mus musculus
gatttgaacagaccccagaggtacc

SEQ ID NO: 671609 - DNA, 25 bp, Mus musculus
gatttgaacagagcccagaggtacc

SEQ ID NO: 671610 - DNA, 25 bp, Mus musculus
gatttgaagaagagtacagcagctc

SEQ ID NO: 671611 - DNA, 25 bp, Mus musculus
gatttgaagaagtgtacagcagctc

SEQ ID NO: 671612 - DNA, 25 bp, Mus musculus
gatttgaagatgaagtaaaccagtc

SEQ ID NO: 671613 - DNA, 25 bp, Mus musculus
gatttgaagatgtagtaaaccagtc

SEQ ID NO: 671614 - DNA, 25 bp, Mus musculus
gatttgaagcagcatgaagatcagc

SEQ ID NO: 671615 - DNA, 25 bp, Mus musculus
gatttgaagcaggatgaagatcagc

SEQ ID NO: 671616 - DNA, 25 bp, Mus musculus
gatttgaaggcactacaaagtgttg

SEQ ID NO: 671617 - DNA, 25 bp, Mus musculus
gatttgaaggcagtacaaagtgttg

SEQ ID NO: 671618 - DNA, 25 bp, Mus musculus
gatttgaatctgaaattgagaggca

SEQ ID NO: 671619 - DNA, 25 bp, Mus musculus
gatttgaatctgtaattgagaggca

SEQ ID NO: 671620 - DNA, 25 bp, Mus musculus
gatttgaatgaacaggtctgcagac

SEQ ID NO: 671621 - DNA, 25 bp, Mus musculus
gatttgaatgaagaggtctgcagac

SEQ ID NO: 671622 - DNA, 25 bp, Mus musculus
gatttgaccccaacaccagggagga

SEQ ID NO: 671623 - DNA, 25 bp, Mus musculus
gatttgaccccatcaccagggagga

SEQ ID NO: 671624 - DNA, 25 bp, Mus musculus
gatttgaccgtcaccttttaggtct

SEQ ID NO: 671625 - DNA, 25 bp, Mus musculus
gatttgaccgtctccttttaggtct

SEQ ID NO: 671626 - DNA, 25 bp, Mus musculus
gatttgaccttacctctctctgtaa

SEQ ID NO: 671627 - DNA, 25 bp, Mus musculus
gatttgaccttagctctctctgtaa

SEQ ID NO: 671628 - DNA, 25 bp, Mus musculus
gatttgacgtttaaatcgggaggag

SEQ ID NO: 671629 - DNA, 25 bp, Mus musculus
gatttgacgttttaatcgggaggag

SEQ ID NO: 671630 - DNA, 25 bp, Mus musculus
gatttgagaacgaaaactggaaaga

SEQ ID NO: 671631 - DNA, 25 bp, Mus musculus
gatttgagaacgtaaactggaaaga

SEQ ID NO: 671632 - DNA, 25 bp, Mus musculus
gatttgagacccagatcattggggg

SEQ ID NO: 671633 - DNA, 25 bp, Mus musculus
gatttgagaccctgatcattggggg

SEQ ID NO: 671634 - DNA, 25 bp, Mus musculus
gatttgagacctaggacctcctggg

SEQ ID NO: 671635 - DNA, 25 bp, Mus musculus
gatttgagaccttggacctcctggg

SEQ ID NO: 671636 - DNA, 25 bp, Mus musculus
gatttgagagtgactatagcaaggt

SEQ ID NO: 671637 - DNA, 25 bp, Mus musculus
gatttgagagtgtctatagcaaggt

SEQ ID NO: 671638 - DNA, 25 bp, Mus musculus
gatttgagatgcacatcccctgctc

SEQ ID NO: 671639 - DNA, 25 bp, Mus musculus
gatttgagatgctcatcccctgctc

SEQ ID NO: 671640 - DNA, 25 bp, Mus musculus
gatttgagccagaaggcaaaccctt

SEQ ID NO: 671641 - DNA, 25 bp, Mus musculus
gatttgagccagtaggcaaaccctt

SEQ ID NO: 671642 - DNA, 25 bp, Mus musculus
gatttgagccccacagagcttagca

SEQ ID NO: 671643 - DNA, 25 bp, Mus musculus
gatttgagcccctcagagcttagca

SEQ ID NO: 671644 - DNA, 25 bp, Mus musculus
gatttgagctcaagggcagtccttc

SEQ ID NO: 671645 - DNA, 25 bp, Mus musculus
gatttgagctcatgggcagtccttc

SEQ ID NO: 671646 - DNA, 25 bp, Mus musculus
gatttgagcttcctgattcccatgg

SEQ ID NO: 671647 - DNA, 25 bp, Mus musculus
gatttgagcttcgtgattcccatgg

SEQ ID NO: 671648 - DNA, 25 bp, Mus musculus
gatttgagggatagagtcccagaga

SEQ ID NO: 671649 - DNA, 25 bp, Mus musculus
gatttgagggattgagtcccagaga

SEQ ID NO: 671650 - DNA, 25 bp, Mus musculus
gatttgagtaacatctacgcacaat

SEQ ID NO: 671651 - DNA, 25 bp, Mus musculus
gatttgagtaacttctacgcacaat

SEQ ID NO: 671652 - DNA, 25 bp, Mus musculus
gatttgagtggaatgtgaggtcttc

SEQ ID NO: 671653 - DNA, 25 bp, Mus musculus
gatttgagtggattgtgaggtcttc

SEQ ID NO: 671654 - DNA, 25 bp, Mus musculus
gatttgataatgcagataggatgtt

SEQ ID NO: 671655 - DNA, 25 bp, Mus musculus
gatttgataatggagataggatgtt

SEQ ID NO: 671656 - DNA, 25 bp, Mus musculus
gatttgatagaccaagctctccttc

SEQ ID NO: 671657 - DNA, 25 bp, Mus musculus
gatttgatagacctcctctggtgac

SEQ ID NO: 671658 - DNA, 25 bp, Mus musculus
gatttgatagacgaagctctccttc

SEQ ID NO: 671659 - DNA, 25 bp, Mus musculus
gatttgatagacgtcctctggtgac

SEQ ID NO: 671660 - DNA, 25 bp, Mus musculus
gatttgatcaaaactccttgagtcc

SEQ ID NO: 671661 - DNA, 25 bp, Mus musculus
gatttgatcaaatctccttgagtcc

SEQ ID NO: 671662 - DNA, 25 bp, Mus musculus
gatttgatcaggaagacacggactc

SEQ ID NO: 671663 - DNA, 25 bp, Mus musculus
gatttgatcaggtagacacggactc

SEQ ID NO: 671664 - DNA, 25 bp, Mus musculus
gatttgatccgaaacctgaggcacg

SEQ ID NO: 671665 - DNA, 25 bp, Mus musculus
gatttgatccgatacctgaggcacg

SEQ ID NO: 671666 - DNA, 25 bp, Mus musculus
gatttgatgaagatgtctcctgaag

SEQ ID NO: 671667 - DNA, 25 bp, Mus musculus
gatttgatgaagttgtctcctgaag

SEQ ID NO: 671668 - DNA, 25 bp, Mus musculus
gatttgatgcccaccacggagaccc

SEQ ID NO: 671669 - DNA, 25 bp, Mus musculus
gatttgatgccctccacggagaccc

SEQ ID NO: 671670 - DNA, 25 bp, Mus musculus
gatttgcaacgcaatggagcgagga

SEQ ID NO: 671671 - DNA, 25 bp, Mus musculus
gatttgcaacgctatggagcgagga

SEQ ID NO: 671672 - DNA, 25 bp, Mus musculus
gatttgcacatgaagttgggagaca

SEQ ID NO: 671673 - DNA, 25 bp, Mus musculus
gatttgcacatgtagttgggagaca

SEQ ID NO: 671674 - DNA, 25 bp, Mus musculus
gatttgcagagccatcacgagctaa

SEQ ID NO: 671675 - DNA, 25 bp, Mus musculus
gatttgcagagcgatcacgagctaa

SEQ ID NO: 671676 - DNA, 25 bp, Mus musculus
gatttgcatcctagaactaccctga

SEQ ID NO: 671677 - DNA, 25 bp, Mus musculus
gatttgcatccttgaactaccctga

SEQ ID NO: 671678 - DNA, 25 bp, Mus musculus
gatttgccacagctagcgctgatgg

SEQ ID NO: 671679 - DNA, 25 bp, Mus musculus
gatttgccacaggtagcgctgatgg

SEQ ID NO: 671680 - DNA, 25 bp, Mus musculus
gatttgccagtccactcacagggat

SEQ ID NO: 671681 - DNA, 25 bp, Mus musculus
gatttgccagtcgactcacagggat

SEQ ID NO: 671682 - DNA, 25 bp, Mus musculus
gatttgcccaccaaacccatttgct

SEQ ID NO: 671683 - DNA, 25 bp, Mus musculus
gatttgcccacctaacccatttgct

SEQ ID NO: 671684 - DNA, 25 bp, Mus musculus
gatttgccctatccagatcctgcta

SEQ ID NO: 671685 - DNA, 25 bp, Mus musculus
gatttgccctatgcagatcctgcta

SEQ ID NO: 671686 - DNA, 25 bp, Mus musculus
gatttgccctctataagcggaccta

SEQ ID NO: 671687 - DNA, 25 bp, Mus musculus
gatttgccctctttaagcggaccta

SEQ ID NO: 671688 - DNA, 25 bp, Mus musculus
gatttgcctgtgactgttcgttccc

SEQ ID NO: 671689 - DNA, 25 bp, Mus musculus
gatttgcctgtgtctgttcgttccc

SEQ ID NO: 671690 - DNA, 25 bp, Mus musculus
gatttgcggagtattatcagcttgt

SEQ ID NO: 671691 - DNA, 25 bp, Mus musculus
gatttgcggagttttatcagcttgt

SEQ ID NO: 671692 - DNA, 25 bp, Mus musculus
gatttgctcagcagcatccgaacca

SEQ ID NO: 671693 - DNA, 25 bp, Mus musculus
gatttgctcagctgcatccgaacca

SEQ ID NO: 671694 - DNA, 25 bp, Mus musculus
gatttgctgatactaaagacgtggg

SEQ ID NO: 671695 - DNA, 25 bp, Mus musculus
gatttgctgatagtaaagacgtggg

SEQ ID NO: 671696 - DNA, 25 bp, Mus musculus
gatttgcttacgaccttagctgaga

SEQ ID NO: 671697 - DNA, 25 bp, Mus musculus
gatttgcttacgtccttagctgaga

SEQ ID NO: 671698 - DNA, 25 bp, Mus musculus
gatttggaatataatcctccactgg

SEQ ID NO: 671699 - DNA, 25 bp, Mus musculus
gatttggaatattatcctccactgg

SEQ ID NO: 671700 - DNA, 25 bp, Mus musculus
gatttggaatctcgttgccgggccc

SEQ ID NO: 671701 - DNA, 25 bp, Mus musculus
gatttggaatctggttgccgggccc

SEQ ID NO: 671702 - DNA, 25 bp, Mus musculus
gatttggacaatagccaccagtctt

SEQ ID NO: 671703 - DNA, 25 bp, Mus musculus
gatttggacaattgccaccagtctt

SEQ ID NO: 671704 - DNA, 25 bp, Mus musculus
gatttggaccgccatctaagaatcc

SEQ ID NO: 671705 - DNA, 25 bp, Mus musculus
gatttggaccgcgatctaagaatcc

SEQ ID NO: 671706 - DNA, 25 bp, Mus musculus
gatttggacttcaggcttcacctca

SEQ ID NO: 671707 - DNA, 25 bp, Mus musculus
gatttggacttctggcttcacctca

SEQ ID NO: 671708 - DNA, 25 bp, Mus musculus
gatttggagcaaaatggaactatat

SEQ ID NO: 671709 - DNA, 25 bp, Mus musculus
gatttggagcaatatggaactatat

SEQ ID NO: 671710 - DNA, 25 bp, Mus musculus
gatttggagcgaaaacacctggatc

SEQ ID NO: 671711 - DNA, 25 bp, Mus musculus
gatttggagcgataacacctggatc

SEQ ID NO: 671712 - DNA, 25 bp, Mus musculus
gatttggaggaaccattcagcatct

SEQ ID NO: 671713 - DNA, 25 bp, Mus musculus
gatttggaggaagcattcagcatct

SEQ ID NO: 671714 - DNA, 25 bp, Mus musculus
gatttggagtctcccttctactcca

SEQ ID NO: 671715 - DNA, 25 bp, Mus musculus
gatttggagtctgccttctactcca

SEQ ID NO: 671716 - DNA, 25 bp, Mus musculus
gatttggattctccggctcctgtct

SEQ ID NO: 671717 - DNA, 25 bp, Mus musculus
gatttggattctgcggctcctgtct

SEQ ID NO: 671718 - DNA, 25 bp, Mus musculus
gatttggcactgaaacttcttcggg

SEQ ID NO: 671719 - DNA, 25 bp, Mus musculus
gatttggcactgtaacttcttcggg

SEQ ID NO: 671720 - DNA, 25 bp, Mus musculus
gatttggcagacctggtctccgaga

SEQ ID NO: 671721 - DNA, 25 bp, Mus musculus
gatttggcagacgtggtctccgaga

SEQ ID NO: 671722 - DNA, 25 bp, Mus musculus
gatttggcagccctatgttcagagg

SEQ ID NO: 671723 - DNA, 25 bp, Mus musculus
gatttggcagccgtatgttcagagg

SEQ ID NO: 671724 - DNA, 25 bp, Mus musculus
gatttggccttgacgccgttagctt

SEQ ID NO: 671725 - DNA, 25 bp, Mus musculus
gatttggccttgtcgccgttagctt

SEQ ID NO: 671726 - DNA, 25 bp, Mus musculus
gatttggctggacaggttaccatca

SEQ ID NO: 671727 - DNA, 25 bp, Mus musculus
gatttggctggagaggttaccatca

SEQ ID NO: 671728 - DNA, 25 bp, Mus musculus
gatttggctttgagttgacgtttcg

SEQ ID NO: 671729 - DNA, 25 bp, Mus musculus
gatttggctttgtgttgacgtttcg

SEQ ID NO: 671730 - DNA, 25 bp, Mus musculus
gatttgggcaggctttcagtctcca

SEQ ID NO: 671731 - DNA, 25 bp, Mus musculus
gatttgggcagggtttcagtctcca

SEQ ID NO: 671732 - DNA, 25 bp, Mus musculus
gatttgggcctcagtctctagtcct

SEQ ID NO: 671733 - DNA, 25 bp, Mus musculus
gatttgggcctctgtctctagtcct

SEQ ID NO: 671734 - DNA, 25 bp, Mus musculus
gatttgggtaaccagttggaagcaa

SEQ ID NO: 671735 - DNA, 25 bp, Mus musculus
gatttgggtaacgagttggaagcaa

SEQ ID NO: 671736 - DNA, 25 bp, Mus musculus
gatttgggtgatcaccgactgtgcc

SEQ ID NO: 671737 - DNA, 25 bp, Mus musculus
gatttgggtgatgaccgactgtgcc

SEQ ID NO: 671738 - DNA, 25 bp, Mus musculus
gatttgggtttgactacagggagca

SEQ ID NO: 671739 - DNA, 25 bp, Mus musculus
gatttgggtttgtctacagggagca

SEQ ID NO: 671740 - DNA, 25 bp, Mus musculus
gatttggtccaactcgaactgaaag

SEQ ID NO: 671741 - DNA, 25 bp, Mus musculus
gatttggtccaagtcgaactgaaag

SEQ ID NO: 671742 - DNA, 25 bp, Mus musculus
gatttggtgggaattgcctgtggct

SEQ ID NO: 671743 - DNA, 25 bp, Mus musculus
gatttggtgggatttgcctgtggct

SEQ ID NO: 671744 - DNA, 25 bp, Mus musculus
gatttggtgtcacccagacacaaca

SEQ ID NO: 671745 - DNA, 25 bp, Mus musculus
gatttggtgtcagccagacacaaca

SEQ ID NO: 671746 - DNA, 25 bp, Mus musculus
gatttggtgtctccgtctgaccgtc

SEQ ID NO: 671747 - DNA, 25 bp, Mus musculus
gatttggtgtctgcgtctgaccgtc

SEQ ID NO: 671748 - DNA, 25 bp, Mus musculus
gatttggttatacactaccagctga

SEQ ID NO: 671749 - DNA, 25 bp, Mus musculus
gatttggttatagactaccagctga

SEQ ID NO: 671750 - DNA, 25 bp, Mus musculus
gatttgtactcactgtaacaagcac

SEQ ID NO: 671751 - DNA, 25 bp, Mus musculus
gatttgtactcagtgtaacaagcac

SEQ ID NO: 671752 - DNA, 25 bp, Mus musculus
gatttgtccaaacaggtgctggccc

SEQ ID NO: 671753 - DNA, 25 bp, Mus musculus
gatttgtccaaagaggtgctggccc

SEQ ID NO: 671754 - DNA, 25 bp, Mus musculus
gatttgtccttgcagaacggaacac

SEQ ID NO: 671755 - DNA, 25 bp, Mus musculus
gatttgtccttggagaacggaacac

SEQ ID NO: 671756 - DNA, 25 bp, Mus musculus
gatttgtcggccacaccaaggatgt

SEQ ID NO: 671757 - DNA, 25 bp, Mus musculus
gatttgtcggcctcaccaaggatgt

SEQ ID NO: 671758 - DNA, 25 bp, Mus musculus
gatttgtgactgatgtcagcgagct

SEQ ID NO: 671759 - DNA, 25 bp, Mus musculus
gatttgtgactgttgtcagcgagct

SEQ ID NO: 671760 - DNA, 25 bp, Mus musculus
gatttgtgcaggaatgccagagcag

SEQ ID NO: 671761 - DNA, 25 bp, Mus musculus
gatttgtgcaggtatgccagagcag

SEQ ID NO: 671762 - DNA, 25 bp, Mus musculus
gatttgtgctatatcggcagaggca

SEQ ID NO: 671763 - DNA, 25 bp, Mus musculus
gatttgtgctatttcggcagaggca

SEQ ID NO: 671764 - DNA, 25 bp, Mus musculus
gatttgtggataccaagcgagttgc

SEQ ID NO: 671765 - DNA, 25 bp, Mus musculus
gatttgtggatagcaagcgagttgc

SEQ ID NO: 671766 - DNA, 25 bp, Mus musculus
gatttgtggattcactcgatcactg

SEQ ID NO: 671767 - DNA, 25 bp, Mus musculus
gatttgtggattgactcgatcactg

SEQ ID NO: 671768 - DNA, 25 bp, Mus musculus
gatttgtgtggcacgaagagtcccc

SEQ ID NO: 671769 - DNA, 25 bp, Mus musculus
gatttgtgtggctcgaagagtcccc

SEQ ID NO: 671770 - DNA, 25 bp, Mus musculus
gatttgtgtgtcagttacagccagc

SEQ ID NO: 671771 - DNA, 25 bp, Mus musculus
gatttgtgtgtctgttacagccagc

SEQ ID NO: 671772 - DNA, 25 bp, Mus musculus
gatttgttatccaaaatgctagtaa

SEQ ID NO: 671773 - DNA, 25 bp, Mus musculus
gatttgttatcctaaatgctagtaa

SEQ ID NO: 671774 - DNA, 25 bp, Mus musculus
gatttgttcccaacctggctgatgg

SEQ ID NO: 671775 - DNA, 25 bp, Mus musculus
gatttgttcccatcctggctgatgg

SEQ ID NO: 671776 - DNA, 25 bp, Mus musculus
gatttgttctaacatgctgccagaa

SEQ ID NO: 671777 - DNA, 25 bp, Mus musculus
gatttgttctaagatgctgccagaa

SEQ ID NO: 671778 - DNA, 25 bp, Mus musculus
gatttgtttgccaacgtagtccacg

SEQ ID NO: 671779 - DNA, 25 bp, Mus musculus
gatttgtttgcctacgtagtccacg

SEQ ID NO: 671780 - DNA, 25 bp, Mus musculus
gattttaaaattcccagtaatccag

SEQ ID NO: 671781 - DNA, 25 bp, Mus musculus
gattttaaaattgccagtaatccag

SEQ ID NO: 671782 - DNA, 25 bp, Mus musculus
gattttaaagctatccagacaccgc

SEQ ID NO: 671783 - DNA, 25 bp, Mus musculus
gattttaaagctttccagacaccgc

SEQ ID NO: 671784 - DNA, 25 bp, Mus musculus
gattttaaatcacgacgagtggcac

SEQ ID NO: 671785 - DNA, 25 bp, Mus musculus
gattttaaatcaggacgagtggcac

SEQ ID NO: 671786 - DNA, 25 bp, Mus musculus
gattttaacaatcctactttagtga

SEQ ID NO: 671787 - DNA, 25 bp, Mus musculus
gattttaacaatgctactttagtga

SEQ ID NO: 671788 - DNA, 25 bp, Mus musculus
gattttaaccccaacggcacatgca

SEQ ID NO: 671789 - DNA, 25 bp, Mus musculus
gattttaacccctacggcacatgca

SEQ ID NO: 671790 - DNA, 25 bp, Mus musculus
gattttaacctcaccctgagtgttg

SEQ ID NO: 671791 - DNA, 25 bp, Mus musculus
gattttaacctctccctgagtgttg

SEQ ID NO: 671792 - DNA, 25 bp, Mus musculus
gattttaagcaccacaactataagg

SEQ ID NO: 671793 - DNA, 25 bp, Mus musculus
gattttaagcacgacaactataagg

SEQ ID NO: 671794 - DNA, 25 bp, Mus musculus
gattttacacgcagggcatctccca

SEQ ID NO: 671795 - DNA, 25 bp, Mus musculus
gattttacacgctgggcatctccca

SEQ ID NO: 671796 - DNA, 25 bp, Mus musculus
gattttacagttattggaggcagtc

SEQ ID NO: 671797 - DNA, 25 bp, Mus musculus
gattttacagtttttggaggcagtc

SEQ ID NO: 671798 - DNA, 25 bp, Mus musculus
gattttaggcagcttgaagagcagc

SEQ ID NO: 671799 - DNA, 25 bp, Mus musculus
gattttaggcaggttgaagagcagc

SEQ ID NO: 671800 - DNA, 25 bp, Mus musculus
gattttatcagtcagttgttcatgc

SEQ ID NO: 671801 - DNA, 25 bp, Mus musculus
gattttatcagtgagttgttcatgc

SEQ ID NO: 671802 - DNA, 25 bp, Mus musculus
gattttatcgatccctttgcctccc

SEQ ID NO: 671803 - DNA, 25 bp, Mus musculus
gattttatcgatgcctttgcctccc

SEQ ID NO: 671804 - DNA, 25 bp, Mus musculus
gattttatcgctaatcagctacgtg

SEQ ID NO: 671805 - DNA, 25 bp, Mus musculus
gattttatcgcttatcagctacgtg

SEQ ID NO: 671806 - DNA, 25 bp, Mus musculus
gattttatcggcacatctactgatg

SEQ ID NO: 671807 - DNA, 25 bp, Mus musculus
gattttatcggctcatctactgatg

SEQ ID NO: 671808 - DNA, 25 bp, Mus musculus
gattttatctggaaaaatagaccag

SEQ ID NO: 671809 - DNA, 25 bp, Mus musculus
gattttatctggtaaaatagaccag

SEQ ID NO: 671810 - DNA, 25 bp, Mus musculus
gattttattcaacttcccaggaatc

SEQ ID NO: 671811 - DNA, 25 bp, Mus musculus
gattttattcaagttcccaggaatc

SEQ ID NO: 671812 - DNA, 25 bp, Mus musculus
gattttattctcagacctcaggcag

SEQ ID NO: 671813 - DNA, 25 bp, Mus musculus
gattttattctctgacctcaggcag

SEQ ID NO: 671814 - DNA, 25 bp, Mus musculus
gattttcaagcacttgctctggaag

SEQ ID NO: 671815 - DNA, 25 bp, Mus musculus
gattttcaagcagttgctctggaag

SEQ ID NO: 671816 - DNA, 25 bp, Mus musculus
gattttcactggctcacccgttcta

SEQ ID NO: 671817 - DNA, 25 bp, Mus musculus
gattttcactgggtcacccgttcta

SEQ ID NO: 671818 - DNA, 25 bp, Mus musculus
gattttcaggaactgacctaaaaga

SEQ ID NO: 671819 - DNA, 25 bp, Mus musculus
gattttcaggaagtgacctaaaaga

SEQ ID NO: 671820 - DNA, 25 bp, Mus musculus
gattttcagtctacgcctttcttgc

SEQ ID NO: 671821 - DNA, 25 bp, Mus musculus
gattttcagtcttcgcctttcttgc

SEQ ID NO: 671822 - DNA, 25 bp, Mus musculus
gattttccacagaacagctacccaa

SEQ ID NO: 671823 - DNA, 25 bp, Mus musculus
gattttccacagtacagctacccaa

SEQ ID NO: 671824 - DNA, 25 bp, Mus musculus
gattttccacatcgacaccaatgcc

SEQ ID NO: 671825 - DNA, 25 bp, Mus musculus
gattttccacatggacaccaatgcc

SEQ ID NO: 671826 - DNA, 25 bp, Mus musculus
gattttccacggcttatggagctgc

SEQ ID NO: 671827 - DNA, 25 bp, Mus musculus
gattttccacgggttatggagctgc

SEQ ID NO: 671828 - DNA, 25 bp, Mus musculus
gattttccagtaagggaacctccag

SEQ ID NO: 671829 - DNA, 25 bp, Mus musculus
gattttccagtatgggaacctccag

SEQ ID NO: 671830 - DNA, 25 bp, Mus musculus
gattttcccagtcagcgactggaat

SEQ ID NO: 671831 - DNA, 25 bp, Mus musculus
gattttcccagtgagcgactggaat

SEQ ID NO: 671832 - DNA, 25 bp, Mus musculus
gattttcccctcctggcggtgggca

SEQ ID NO: 671833 - DNA, 25 bp, Mus musculus
gattttcccctcgtggcggtgggca

SEQ ID NO: 671834 - DNA, 25 bp, Mus musculus
gattttccgagaacagtcttctcac

SEQ ID NO: 671835 - DNA, 25 bp, Mus musculus
gattttccgagatcagtcttctcac

SEQ ID NO: 671836 - DNA, 25 bp, Mus musculus
gattttccgccactggattccaatg

SEQ ID NO: 671837 - DNA, 25 bp, Mus musculus
gattttccgccagtggattccaatg

SEQ ID NO: 671838 - DNA, 25 bp, Mus musculus
gattttccgccgagtgctatacagg

SEQ ID NO: 671839 - DNA, 25 bp, Mus musculus
gattttccgccgtgtgctatacagg

SEQ ID NO: 671840 - DNA, 25 bp, Mus musculus
gattttcctgggactgggaagccag

SEQ ID NO: 671841 - DNA, 25 bp, Mus musculus
gattttcctgggtctgggaagccag

SEQ ID NO: 671842 - DNA, 25 bp, Mus musculus
gattttcctgtgatgggctgagacc

SEQ ID NO: 671843 - DNA, 25 bp, Mus musculus
gattttcctgtgttgggctgagacc

SEQ ID NO: 671844 - DNA, 25 bp, Mus musculus
gattttcctgttcccgtatccttgg

SEQ ID NO: 671845 - DNA, 25 bp, Mus musculus
gattttcctgttgccgtatccttgg

SEQ ID NO: 671846 - DNA, 25 bp, Mus musculus
gattttccttctcctgcgtttgaca

SEQ ID NO: 671847 - DNA, 25 bp, Mus musculus
gattttccttctgctgcgtttgaca

SEQ ID NO: 671848 - DNA, 25 bp, Mus musculus
gattttcgccgtaaccagggagcca

SEQ ID NO: 671849 - DNA, 25 bp, Mus musculus
gattttcgccgttaccagggagcca

SEQ ID NO: 671850 - DNA, 25 bp, Mus musculus
gattttcttgaaatggctagtaggg

SEQ ID NO: 671851 - DNA, 25 bp, Mus musculus
gattttcttgaattggctagtaggg

SEQ ID NO: 671852 - DNA, 25 bp, Mus musculus
gattttgaaacactcaagccgtcca

SEQ ID NO: 671853 - DNA, 25 bp, Mus musculus
gattttgaaacagtcaagccgtcca

SEQ ID NO: 671854 - DNA, 25 bp, Mus musculus
gattttgaaagcctcagtagtgaag

SEQ ID NO: 671855 - DNA, 25 bp, Mus musculus
gattttgaaagcgtcagtagtgaag

SEQ ID NO: 671856 - DNA, 25 bp, Mus musculus
gattttgaacacatatctgcccacc

SEQ ID NO: 671857 - DNA, 25 bp, Mus musculus
gattttgaacacttatctgcccacc

SEQ ID NO: 671858 - DNA, 25 bp, Mus musculus
gattttgaatataaaactccagatg

SEQ ID NO: 671859 - DNA, 25 bp, Mus musculus
gattttgaatattaaactccagatg

SEQ ID NO: 671860 - DNA, 25 bp, Mus musculus
gattttgagtggaacaatttcatag

SEQ ID NO: 671861 - DNA, 25 bp, Mus musculus
gattttgagtggtacaatttcatag

SEQ ID NO: 671862 - DNA, 25 bp, Mus musculus
gattttgatgcaagcagggcaagca

SEQ ID NO: 671863 - DNA, 25 bp, Mus musculus
gattttgatgcatgcagggcaagca

SEQ ID NO: 671864 - DNA, 25 bp, Mus musculus
gattttgcagtgactcttgagctgg

SEQ ID NO: 671865 - DNA, 25 bp, Mus musculus
gattttgcagtgtctcttgagctgg

SEQ ID NO: 671866 - DNA, 25 bp, Mus musculus
gattttgcatggctggaagacagaa

SEQ ID NO: 671867 - DNA, 25 bp, Mus musculus
gattttgcatgggtggaagacagaa

SEQ ID NO: 671868 - DNA, 25 bp, Mus musculus
gattttgccaataaaattcccacac

SEQ ID NO: 671869 - DNA, 25 bp, Mus musculus
gattttgccaatcggaatgcatttc

SEQ ID NO: 671870 - DNA, 25 bp, Mus musculus
gattttgccaatgggaatgcatttc

SEQ ID NO: 671871 - DNA, 25 bp, Mus musculus
gattttgccaattaaattcccacac

SEQ ID NO: 671872 - DNA, 25 bp, Mus musculus
gattttgctcagctcaatttaaaga

SEQ ID NO: 671873 - DNA, 25 bp, Mus musculus
gattttgctcaggtcaatttaaaga

SEQ ID NO: 671874 - DNA, 25 bp, Mus musculus
gattttgctctgctgaaagcatgga

SEQ ID NO: 671875 - DNA, 25 bp, Mus musculus
gattttgctctggtgaaagcatgga

SEQ ID NO: 671876 - DNA, 25 bp, Mus musculus
gattttgctggcagatgaaggatca

SEQ ID NO: 671877 - DNA, 25 bp, Mus musculus
gattttgctggctgatgaaggatca

SEQ ID NO: 671878 - DNA, 25 bp, Mus musculus
gattttgctttccagtacattaagg

SEQ ID NO: 671879 - DNA, 25 bp, Mus musculus
gattttgctttcgagtacattaagg

SEQ ID NO: 671880 - DNA, 25 bp, Mus musculus
gattttggaactaggaccagtatgg

SEQ ID NO: 671881 - DNA, 25 bp, Mus musculus
gattttggaacttggaccagtatgg

SEQ ID NO: 671882 - DNA, 25 bp, Mus musculus
gattttggccacctcaccgaggagt

SEQ ID NO: 671883 - DNA, 25 bp, Mus musculus
gattttggccacgtcaccgaggagt

SEQ ID NO: 671884 - DNA, 25 bp, Mus musculus
gattttggccagaatccttgcctgg

SEQ ID NO: 671885 - DNA, 25 bp, Mus musculus
gattttggccagtatccttgcctgg

SEQ ID NO: 671886 - DNA, 25 bp, Mus musculus
gattttggcctcattcagttagcag

SEQ ID NO: 671887 - DNA, 25 bp, Mus musculus
gattttggcctctttcagttagcag

SEQ ID NO: 671888 - DNA, 25 bp, Mus musculus
gattttggtatcaaatgatcttgcc

SEQ ID NO: 671889 - DNA, 25 bp, Mus musculus
gattttggtatctaatgatcttgcc

SEQ ID NO: 671890 - DNA, 25 bp, Mus musculus
gattttggtccacacctcattgagt

SEQ ID NO: 671891 - DNA, 25 bp, Mus musculus
gattttggtccagacctcattgagt

SEQ ID NO: 671892 - DNA, 25 bp, Mus musculus
gattttggtctcagcatcccgggat

SEQ ID NO: 671893 - DNA, 25 bp, Mus musculus
gattttggtctctgcatcccgggat

SEQ ID NO: 671894 - DNA, 25 bp, Mus musculus
gattttgtaactcaatgtcatgctg

SEQ ID NO: 671895 - DNA, 25 bp, Mus musculus
gattttgtaactgaatgtcatgctg

SEQ ID NO: 671896 - DNA, 25 bp, Mus musculus
gattttgtcaagcaaggagcccttg

SEQ ID NO: 671897 - DNA, 25 bp, Mus musculus
gattttgtcaaggaaggagcccttg

SEQ ID NO: 671898 - DNA, 25 bp, Mus musculus
gattttgtcgcccatgacgacatcc

SEQ ID NO: 671899 - DNA, 25 bp, Mus musculus
gattttgtcgccgatgacgacatcc

SEQ ID NO: 671900 - DNA, 25 bp, Mus musculus
gattttgtgaccctccaggcgaacg

SEQ ID NO: 671901 - DNA, 25 bp, Mus musculus
gattttgtgaccgtccaggcgaacg

SEQ ID NO: 671902 - DNA, 25 bp, Mus musculus
gattttgtgatacatggtggccccg

SEQ ID NO: 671903 - DNA, 25 bp, Mus musculus
gattttgtgatagatggtggccccg

SEQ ID NO: 671904 - DNA, 25 bp, Mus musculus
gattttgttacacatactgatgctg

SEQ ID NO: 671905 - DNA, 25 bp, Mus musculus
gattttgttacagatactgatgctg

SEQ ID NO: 671906 - DNA, 25 bp, Mus musculus
gattttgttccaccttctccagaag

SEQ ID NO: 671907 - DNA, 25 bp, Mus musculus
gattttgttccagcttctccagaag

SEQ ID NO: 671908 - DNA, 25 bp, Mus musculus
gatttttaacacatagaatgtagtc

SEQ ID NO: 671909 - DNA, 25 bp, Mus musculus
gatttttaacacttagaatgtagtc

SEQ ID NO: 671910 - DNA, 25 bp, Mus musculus
gatttttaccaccaccctaggtctg

SEQ ID NO: 671911 - DNA, 25 bp, Mus musculus
gatttttaccacgaccctaggtctg

SEQ ID NO: 671912 - DNA, 25 bp, Mus musculus
gatttttactaactaccaatgtcct

SEQ ID NO: 671913 - DNA, 25 bp, Mus musculus
gatttttactaagtaccaatgtcct

SEQ ID NO: 671914 - DNA, 25 bp, Mus musculus
gatttttactctactcctctgcagc

SEQ ID NO: 671915 - DNA, 25 bp, Mus musculus
gatttttactcttctcctctgcagc

SEQ ID NO: 671916 - DNA, 25 bp, Mus musculus
gatttttagcttcggctgcacctca

SEQ ID NO: 671917 - DNA, 25 bp, Mus musculus
gatttttagcttgggctgcacctca

SEQ ID NO: 671918 - DNA, 25 bp, Mus musculus
gatttttatggcatagacagtgttg

SEQ ID NO: 671919 - DNA, 25 bp, Mus musculus
gatttttatggcttagacagtgttg

SEQ ID NO: 671920 - DNA, 25 bp, Mus musculus
gatttttattcaagtgcacgtcgcg

SEQ ID NO: 671921 - DNA, 25 bp, Mus musculus
gatttttattcatgtgcacgtcgcg

SEQ ID NO: 671922 - DNA, 25 bp, Mus musculus
gatttttcaggactgccaggaggta

SEQ ID NO: 671923 - DNA, 25 bp, Mus musculus
gatttttcaggagtgccaggaggta

SEQ ID NO: 671924 - DNA, 25 bp, Mus musculus
gatttttcatcgcaagtgatgccaa

SEQ ID NO: 671925 - DNA, 25 bp, Mus musculus
gatttttcatcggaagtgatgccaa

SEQ ID NO: 671926 - DNA, 25 bp, Mus musculus
gatttttctacccaaatgacaccca

SEQ ID NO: 671927 - DNA, 25 bp, Mus musculus
gatttttctaccgaaatgacaccca

SEQ ID NO: 671928 - DNA, 25 bp, Mus musculus
gatttttctggtagatgcctccagg

SEQ ID NO: 671929 - DNA, 25 bp, Mus musculus
gatttttctggttgatgcctccagg

SEQ ID NO: 671930 - DNA, 25 bp, Mus musculus
gatttttgaacacaacgacatatta

SEQ ID NO: 671931 - DNA, 25 bp, Mus musculus
gatttttgaacagaacgacatatta

SEQ ID NO: 671932 - DNA, 25 bp, Mus musculus
gatttttggcgtcaagtgcaaacac

SEQ ID NO: 671933 - DNA, 25 bp, Mus musculus
gatttttggcgtgaagtgcaaacac

SEQ ID NO: 671934 - DNA, 25 bp, Mus musculus
gatttttgggcaaaacttcatacct

SEQ ID NO: 671935 - DNA, 25 bp, Mus musculus
gatttttgggcataacttcatacct

SEQ ID NO: 671936 - DNA, 25 bp, Mus musculus
gatttttggtgacagttccgcacac

SEQ ID NO: 671937 - DNA, 25 bp, Mus musculus
gatttttggtgagagttccgcacac

SEQ ID NO: 671938 - DNA, 25 bp, Mus musculus
gatttttgtttgctctgccacccat

SEQ ID NO: 671939 - DNA, 25 bp, Mus musculus
gatttttgtttggtctgccacccat

SEQ ID NO: 671940 - DNA, 25 bp, Mus musculus
gattttttccgaccatcagctcaaa

SEQ ID NO: 671941 - DNA, 25 bp, Mus musculus
gattttttccgagcatcagctcaaa

SEQ ID NO: 671942 - DNA, 25 bp, Mus musculus
gattttttcctacaagccccatcag

SEQ ID NO: 671943 - DNA, 25 bp, Mus musculus
gattttttcctagaagccccatcag

SEQ ID NO: 671944 - DNA, 25 bp, Mus musculus
gattttttgagcaacatctgcccag

SEQ ID NO: 671945 - DNA, 25 bp, Mus musculus
gattttttgagctacatctgcccag

SEQ ID NO: 671946 - DNA, 25 bp, Mus musculus
gattttttggatcatgttccactca

SEQ ID NO: 671947 - DNA, 25 bp, Mus musculus
gattttttggatgatgttccactca

SEQ ID NO: 671948 - DNA, 25 bp, Mus musculus
gcaaaaaagacgaggctcaaatttt

SEQ ID NO: 671949 - DNA, 25 bp, Mus musculus
gcaaaaaagacgtggctcaaatttt

SEQ ID NO: 671950 - DNA, 25 bp, Mus musculus
gcaaaaaagagacaacctgacacta

SEQ ID NO: 671951 - DNA, 25 bp, Mus musculus
gcaaaaaagagagaacctgacacta

SEQ ID NO: 671952 - DNA, 25 bp, Mus musculus
gcaaaaaagagtcgctttgccttcc

SEQ ID NO: 671953 - DNA, 25 bp, Mus musculus
gcaaaaaagagtggctttgccttcc

SEQ ID NO: 671954 - DNA, 25 bp, Mus musculus
gcaaaaaaggtgcaaggatttgata

SEQ ID NO: 671955 - DNA, 25 bp, Mus musculus
gcaaaaaaggtggaaggatttgata

SEQ ID NO: 671956 - DNA, 25 bp, Mus musculus
gcaaaaacaccgagggcagttttga

SEQ ID NO: 671957 - DNA, 25 bp, Mus musculus
gcaaaaacaccgtgggcagttttga

SEQ ID NO: 671958 - DNA, 25 bp, Mus musculus
gcaaaaaccctacgagataaacctg

SEQ ID NO: 671959 - DNA, 25 bp, Mus musculus
gcaaaaaccctaggagataaacctg

SEQ ID NO: 671960 - DNA, 25 bp, Mus musculus
gcaaaaaccttgaacagatcgtgta

SEQ ID NO: 671961 - DNA, 25 bp, Mus musculus
gcaaaaaccttgtacagatcgtgta

SEQ ID NO: 671962 - DNA, 25 bp, Mus musculus
gcaaaaactgcactagcgatggatg

SEQ ID NO: 671963 - DNA, 25 bp, Mus musculus
gcaaaaactgcagtagcgatggatg

SEQ ID NO: 671964 - DNA, 25 bp, Mus musculus
gcaaaaagcacactcaggatgtgac

SEQ ID NO: 671965 - DNA, 25 bp, Mus musculus
gcaaaaagcacagtcaggatgtgac

SEQ ID NO: 671966 - DNA, 25 bp, Mus musculus
gcaaaaaggataagttacgtgtcta

SEQ ID NO: 671967 - DNA, 25 bp, Mus musculus
gcaaaaaggataatatcaacccgga

SEQ ID NO: 671968 - DNA, 25 bp, Mus musculus
gcaaaaaggatatgttacgtgtcta

SEQ ID NO: 671969 - DNA, 25 bp, Mus musculus
gcaaaaaggatattatcaacccgga

SEQ ID NO: 671970 - DNA, 25 bp, Mus musculus
gcaaaaagggcacctcccctggcag

SEQ ID NO: 671971 - DNA, 25 bp, Mus musculus
gcaaaaagggcagctcccctggcag

SEQ ID NO: 671972 - DNA, 25 bp, Mus musculus
gcaaaaagggtaagcctctatcaag

SEQ ID NO: 671973 - DNA, 25 bp, Mus musculus
gcaaaaagggtatgcctctatcaag

SEQ ID NO: 671974 - DNA, 25 bp, Mus musculus
gcaaaaagtatgatggtcctgaggt

SEQ ID NO: 671975 - DNA, 25 bp, Mus musculus
gcaaaaagtatgttggtcctgaggt

SEQ ID NO: 671976 - DNA, 25 bp, Mus musculus
gcaaaaagtcacctttaaagggcag

SEQ ID NO: 671977 - DNA, 25 bp, Mus musculus
gcaaaaagtcacgtttaaagggcag

SEQ ID NO: 671978 - DNA, 25 bp, Mus musculus
gcaaaaataacacggtcctgcggga

SEQ ID NO: 671979 - DNA, 25 bp, Mus musculus
gcaaaaataacagggtcctgcggga

SEQ ID NO: 671980 - DNA, 25 bp, Mus musculus
gcaaaaatacttcttggaaatgaaa

SEQ ID NO: 671981 - DNA, 25 bp, Mus musculus
gcaaaaatacttgttggaaatgaaa

SEQ ID NO: 671982 - DNA, 25 bp, Mus musculus
gcaaaaatcaaaagactctgccttt

SEQ ID NO: 671983 - DNA, 25 bp, Mus musculus
gcaaaaatcaaatgactctgccttt

SEQ ID NO: 671984 - DNA, 25 bp, Mus musculus
gcaaaaatctgtatagacagctcat

SEQ ID NO: 671985 - DNA, 25 bp, Mus musculus
gcaaaaatctgtttagacagctcat

SEQ ID NO: 671986 - DNA, 25 bp, Mus musculus
gcaaaaatgagcagtctcctgagga

SEQ ID NO: 671987 - DNA, 25 bp, Mus musculus
gcaaaaatgagctgtctcctgagga

SEQ ID NO: 671988 - DNA, 25 bp, Mus musculus
gcaaaacaccatcagaagttccagc

SEQ ID NO: 671989 - DNA, 25 bp, Mus musculus
gcaaaacaccatgagaagttccagc

SEQ ID NO: 671990 - DNA, 25 bp, Mus musculus
gcaaaacacgttaacaagatttatg

SEQ ID NO: 671991 - DNA, 25 bp, Mus musculus
gcaaaacacgtttacaagatttatg

SEQ ID NO: 671992 - DNA, 25 bp, Mus musculus
gcaaaacagctgaacaacttggccc

SEQ ID NO: 671993 - DNA, 25 bp, Mus musculus
gcaaaacagctgtacaacttggccc

SEQ ID NO: 671994 - DNA, 25 bp, Mus musculus
gcaaaacaggatcaagtcaatgctg

SEQ ID NO: 671995 - DNA, 25 bp, Mus musculus
gcaaaacaggatgaagtcaatgctg

SEQ ID NO: 671996 - DNA, 25 bp, Mus musculus
gcaaaacatgagacacacaaaacac

SEQ ID NO: 671997 - DNA, 25 bp, Mus musculus
gcaaaacatgagtcacacaaaacac

SEQ ID NO: 671998 - DNA, 25 bp, Mus musculus
gcaaaacatgtcacaatccatagaa

SEQ ID NO: 671999 - DNA, 25 bp, Mus musculus
gcaaaacatgtctcaatccatagaa

SEQ ID NO: 672000 - DNA, 25 bp, Mus musculus
gcaaaaccaacacttgcgcgatcct

SEQ ID NO: 672001 - DNA, 25 bp, Mus musculus
gcaaaaccaacagttgcgcgatcct

SEQ ID NO: 672002 - DNA, 25 bp, Mus musculus
gcaaaaccatgtactgtgccaggta

SEQ ID NO: 672003 - DNA, 25 bp, Mus musculus
gcaaaaccatgttctgtgccaggta

SEQ ID NO: 672004 - DNA, 25 bp, Mus musculus
gcaaaacctgtaccttgggaacatt

SEQ ID NO: 672005 - DNA, 25 bp, Mus musculus
gcaaaacctgtagcttgggaacatt

SEQ ID NO: 672006 - DNA, 25 bp, Mus musculus
gcaaaacctgttacctgatccaatt

SEQ ID NO: 672007 - DNA, 25 bp, Mus musculus
gcaaaacctgtttcctgatccaatt

SEQ ID NO: 672008 - DNA, 25 bp, Mus musculus
gcaaaacgagggagattgtgccacg

SEQ ID NO: 672009 - DNA, 25 bp, Mus musculus
gcaaaacgagggtgattgtgccacg

SEQ ID NO: 672010 - DNA, 25 bp, Mus musculus
gcaaaacgtccaactacctggtctc

SEQ ID NO: 672011 - DNA, 25 bp, Mus musculus
gcaaaacgtccatctacctggtctc

SEQ ID NO: 672012 - DNA, 25 bp, Mus musculus
gcaaaacgtctgcatggccttgatg

SEQ ID NO: 672013 - DNA, 25 bp, Mus musculus
gcaaaacgtctggatggccttgatg

SEQ ID NO: 672014 - DNA, 25 bp, Mus musculus
gcaaaacgtggaatgaagattgtcc

SEQ ID NO: 672015 - DNA, 25 bp, Mus musculus
gcaaaacgtggattgaagattgtcc

SEQ ID NO: 672016 - DNA, 25 bp, Mus musculus
gcaaaactaagaaattggcctagca

SEQ ID NO: 672017 - DNA, 25 bp, Mus musculus
gcaaaactaagatattggcctagca

SEQ ID NO: 672018 - DNA, 25 bp, Mus musculus
gcaaaactcatgcaagtcagtgcag

SEQ ID NO: 672019 - DNA, 25 bp, Mus musculus
gcaaaactcatggaagtcagtgcag

SEQ ID NO: 672020 - DNA, 25 bp, Mus musculus
gcaaaactcggtcagatctaacaag

SEQ ID NO: 672021 - DNA, 25 bp, Mus musculus
gcaaaactcggtgagatctaacaag

SEQ ID NO: 672022 - DNA, 25 bp, Mus musculus
gcaaaactgattactcccttctggg

SEQ ID NO: 672023 - DNA, 25 bp, Mus musculus
gcaaaactgatttctcccttctggg

SEQ ID NO: 672024 - DNA, 25 bp, Mus musculus
gcaaaactgcttccaagcacctctg

SEQ ID NO: 672025 - DNA, 25 bp, Mus musculus
gcaaaactgcttgcaagcacctctg

SEQ ID NO: 672026 - DNA, 25 bp, Mus musculus
gcaaaactgtctcgcttgggtcagc

SEQ ID NO: 672027 - DNA, 25 bp, Mus musculus
gcaaaactgtctggcttgggtcagc

SEQ ID NO: 672028 - DNA, 25 bp, Mus musculus
gcaaaactttcacaattggttagga

SEQ ID NO: 672029 - DNA, 25 bp, Mus musculus
gcaaaactttcagaattggttagga

SEQ ID NO: 672030 - DNA, 25 bp, Mus musculus
gcaaaagaaagacatctggttgaga

SEQ ID NO: 672031 - DNA, 25 bp, Mus musculus
gcaaaagaaagagatctggttgaga

SEQ ID NO: 672032 - DNA, 25 bp, Mus musculus
gcaaaagaagaactgtggaagcaca

SEQ ID NO: 672033 - DNA, 25 bp, Mus musculus
gcaaaagaagaagtgtggaagcaca

SEQ ID NO: 672034 - DNA, 25 bp, Mus musculus
gcaaaagaggatactcctgaggacc

SEQ ID NO: 672035 - DNA, 25 bp, Mus musculus
gcaaaagaggattctcctgaggacc

SEQ ID NO: 672036 - DNA, 25 bp, Mus musculus
gcaaaagagtccatcagatctgtgg

SEQ ID NO: 672037 - DNA, 25 bp, Mus musculus
gcaaaagagtccttcagatctgtgg

SEQ ID NO: 672038 - DNA, 25 bp, Mus musculus
gcaaaagattgcatcagaagttact

SEQ ID NO: 672039 - DNA, 25 bp, Mus musculus
gcaaaagattgcttcagaagttact

SEQ ID NO: 672040 - DNA, 25 bp, Mus musculus
gcaaaagcgctcaggcgcgcatctt

SEQ ID NO: 672041 - DNA, 25 bp, Mus musculus
gcaaaagcgctctggcgcgcatctt

SEQ ID NO: 672042 - DNA, 25 bp, Mus musculus
gcaaaagctactcagaaaacaggag

SEQ ID NO: 672043 - DNA, 25 bp, Mus musculus
gcaaaagctactgagaaaacaggag

SEQ ID NO: 672044 - DNA, 25 bp, Mus musculus
gcaaaagctagacagagctactcca

SEQ ID NO: 672045 - DNA, 25 bp, Mus musculus
gcaaaagctagagagagctactcca

SEQ ID NO: 672046 - DNA, 25 bp, Mus musculus
gcaaaaggaggtagtcaggccaccg

SEQ ID NO: 672047 - DNA, 25 bp, Mus musculus
gcaaaaggaggttgtcaggccaccg

SEQ ID NO: 672048 - DNA, 25 bp, Mus musculus
gcaaaaggagttcggactgttgtac

SEQ ID NO: 672049 - DNA, 25 bp, Mus musculus
gcaaaaggagttgggactgttgtac

SEQ ID NO: 672050 - DNA, 25 bp, Mus musculus
gcaaaaggatgaaaagccagtgaag

SEQ ID NO: 672051 - DNA, 25 bp, Mus musculus
gcaaaaggatgataagccagtgaag

SEQ ID NO: 672052 - DNA, 25 bp, Mus musculus
gcaaaaggcatcctgcacaaggacc

SEQ ID NO: 672053 - DNA, 25 bp, Mus musculus
gcaaaaggcatcgtgcacaaggacc

SEQ ID NO: 672054 - DNA, 25 bp, Mus musculus
gcaaaaggtcaactcaatggaagga

SEQ ID NO: 672055 - DNA, 25 bp, Mus musculus
gcaaaaggtcaagtcaatggaagga

SEQ ID NO: 672056 - DNA, 25 bp, Mus musculus
gcaaaagtgcacagcagctgcaaga

SEQ ID NO: 672057 - DNA, 25 bp, Mus musculus
gcaaaagtgcactgcagctgcaaga

SEQ ID NO: 672058 - DNA, 25 bp, Mus musculus
gcaaaagtggccaaagggaacaagg

SEQ ID NO: 672059 - DNA, 25 bp, Mus musculus
gcaaaagtggcctaagggaacaagg

SEQ ID NO: 672060 - DNA, 25 bp, Mus musculus
gcaaaagttggtactgtacgagcac

SEQ ID NO: 672061 - DNA, 25 bp, Mus musculus
gcaaaagttggttctgtacgagcac

SEQ ID NO: 672062 - DNA, 25 bp, Mus musculus
gcaaaagttgtaccgccaggctacc

SEQ ID NO: 672063 - DNA, 25 bp, Mus musculus
gcaaaagttgtagcgccaggctacc

SEQ ID NO: 672064 - DNA, 25 bp, Mus musculus
gcaaaagttgttcctatgaaagcca

SEQ ID NO: 672065 - DNA, 25 bp, Mus musculus
gcaaaagttgttgctatgaaagcca

SEQ ID NO: 672066 - DNA, 25 bp, Mus musculus
gcaaaatactcacaggtacaacagt

SEQ ID NO: 672067 - DNA, 25 bp, Mus musculus
gcaaaatactcagaggtacaacagt

SEQ ID NO: 672068 - DNA, 25 bp, Mus musculus
gcaaaatatgctctaaactccatca

SEQ ID NO: 672069 - DNA, 25 bp, Mus musculus
gcaaaatatgctgtaaactccatca

SEQ ID NO: 672070 - DNA, 25 bp, Mus musculus
gcaaaatctactccctgaaggcaaa

SEQ ID NO: 672071 - DNA, 25 bp, Mus musculus
gcaaaatctactgcctgaaggcaaa

SEQ ID NO: 672072 - DNA, 25 bp, Mus musculus
gcaaaatcttttaacgcaactacct

SEQ ID NO: 672073 - DNA, 25 bp, Mus musculus
gcaaaatctttttacgcaactacct

SEQ ID NO: 672074 - DNA, 25 bp, Mus musculus
gcaaaatgaaatacgatgaaatcac

SEQ ID NO: 672075 - DNA, 25 bp, Mus musculus
gcaaaatgaaattcgatgaaatcac

SEQ ID NO: 672076 - DNA, 25 bp, Mus musculus
gcaaaatgcagtccacttgaggagt

SEQ ID NO: 672077 - DNA, 25 bp, Mus musculus
gcaaaatgcagtgcacttgaggagt

SEQ ID NO: 672078 - DNA, 25 bp, Mus musculus
gcaaaatgcgagagggcgcttcccg

SEQ ID NO: 672079 - DNA, 25 bp, Mus musculus
gcaaaatgcgagtgggcgcttcccg

SEQ ID NO: 672080 - DNA, 25 bp, Mus musculus
gcaaaatggtggacttttcataatg

SEQ ID NO: 672081 - DNA, 25 bp, Mus musculus
gcaaaatggtggtcttttcataatg

SEQ ID NO: 672082 - DNA, 25 bp, Mus musculus
gcaaaattccgaaggtgcctccact

SEQ ID NO: 672083 - DNA, 25 bp, Mus musculus
gcaaaattccgatggtgcctccact

SEQ ID NO: 672084 - DNA, 25 bp, Mus musculus
gcaaaattgcgacataggaaaaccc

SEQ ID NO: 672085 - DNA, 25 bp, Mus musculus
gcaaaattgcgagataggaaaaccc

SEQ ID NO: 672086 - DNA, 25 bp, Mus musculus
gcaaaattggcaaagaattatggca

SEQ ID NO: 672087 - DNA, 25 bp, Mus musculus
gcaaaattggcatagaattatggca

SEQ ID NO: 672088 - DNA, 25 bp, Mus musculus
gcaaaattgttgaaagacgccatta

SEQ ID NO: 672089 - DNA, 25 bp, Mus musculus
gcaaaattgttgtaagacgccatta

SEQ ID NO: 672090 - DNA, 25 bp, Mus musculus
gcaaaatttatcatctgtaccagaa

SEQ ID NO: 672091 - DNA, 25 bp, Mus musculus
gcaaaatttatcttctgtaccagaa

SEQ ID NO: 672092 - DNA, 25 bp, Mus musculus
gcaaacaaaatcacaacagaattct

SEQ ID NO: 672093 - DNA, 25 bp, Mus musculus
gcaaacaaaatctcaacagaattct

SEQ ID NO: 672094 - DNA, 25 bp, Mus musculus
gcaaacaacacgacggtggagcgga

SEQ ID NO: 672095 - DNA, 25 bp, Mus musculus
gcaaacaacacgtcggtggagcgga

SEQ ID NO: 672096 - DNA, 25 bp, Mus musculus
gcaaacaatctacaacttgaagaaa

SEQ ID NO: 672097 - DNA, 25 bp, Mus musculus
gcaaacaatctagaacttgaagaaa

SEQ ID NO: 672098 - DNA, 25 bp, Mus musculus
gcaaacaccagcatgtatagtaaca

SEQ ID NO: 672099 - DNA, 25 bp, Mus musculus
gcaaacaccagcttgtatagtaaca

SEQ ID NO: 672100 - DNA, 25 bp, Mus musculus
gcaaacactgttaatggactgggat

SEQ ID NO: 672101 - DNA, 25 bp, Mus musculus
gcaaacactgtttatggactgggat

SEQ ID NO: 672102 - DNA, 25 bp, Mus musculus
gcaaacactttgaaggagccctgct

SEQ ID NO: 672103 - DNA, 25 bp, Mus musculus
gcaaacactttgtaggagccctgct

SEQ ID NO: 672104 - DNA, 25 bp, Mus musculus
gcaaacagatacagagaacaacgct

SEQ ID NO: 672105 - DNA, 25 bp, Mus musculus
gcaaacagatactgagaacaacgct

SEQ ID NO: 672106 - DNA, 25 bp, Mus musculus
gcaaacagccatacaccagtgcatg

SEQ ID NO: 672107 - DNA, 25 bp, Mus musculus
gcaaacagccattcaccagtgcatg

SEQ ID NO: 672108 - DNA, 25 bp, Mus musculus
gcaaacagcgccagcgccatgagat

SEQ ID NO: 672109 - DNA, 25 bp, Mus musculus
gcaaacagcgcctgcgccatgagat

SEQ ID NO: 672110 - DNA, 25 bp, Mus musculus
gcaaacagctgtcgcgaggttcctc

SEQ ID NO: 672111 - DNA, 25 bp, Mus musculus
gcaaacagctgtggcgaggttcctc

SEQ ID NO: 672112 - DNA, 25 bp, Mus musculus
gcaaacaggtatcggtatcagtaac

SEQ ID NO: 672113 - DNA, 25 bp, Mus musculus
gcaaacaggtatgggtatcagtaac

SEQ ID NO: 672114 - DNA, 25 bp, Mus musculus
gcaaacagtctaattcggcgaatct

SEQ ID NO: 672115 - DNA, 25 bp, Mus musculus
gcaaacagtctatttcggcgaatct

SEQ ID NO: 672116 - DNA, 25 bp, Mus musculus
gcaaacatggtcaacgtaccaaaaa

SEQ ID NO: 672117 - DNA, 25 bp, Mus musculus
gcaaacatggtctacgtaccaaaaa

SEQ ID NO: 672118 - DNA, 25 bp, Mus musculus
gcaaacatgtcaagtccgagccaaa

SEQ ID NO: 672119 - DNA, 25 bp, Mus musculus
gcaaacatgtcatgtccgagccaaa

SEQ ID NO: 672120 - DNA, 25 bp, Mus musculus
gcaaacattccgagcgctcagtgat

SEQ ID NO: 672121 - DNA, 25 bp, Mus musculus
gcaaacattccgtgcgctcagtgat

SEQ ID NO: 672122 - DNA, 25 bp, Mus musculus
gcaaacattctgcaactgagctact

SEQ ID NO: 672123 - DNA, 25 bp, Mus musculus
gcaaacattctggaactgagctact

SEQ ID NO: 672124 - DNA, 25 bp, Mus musculus
gcaaaccaaaaccaggctaagaagg

SEQ ID NO: 672125 - DNA, 25 bp, Mus musculus
gcaaaccaaaacgaggctaagaagg

SEQ ID NO: 672126 - DNA, 25 bp, Mus musculus
gcaaaccaacatctcagagtgggag

SEQ ID NO: 672127 - DNA, 25 bp, Mus musculus
gcaaaccaacatgtcagagtgggag

SEQ ID NO: 672128 - DNA, 25 bp, Mus musculus
gcaaaccaatgcactcagctcgaac

SEQ ID NO: 672129 - DNA, 25 bp, Mus musculus
gcaaaccaatgctctcagctcgaac

SEQ ID NO: 672130 - DNA, 25 bp, Mus musculus
gcaaaccacgaaatcgcccatcatt

SEQ ID NO: 672131 - DNA, 25 bp, Mus musculus
gcaaaccacgaattcgcccatcatt

SEQ ID NO: 672132 - DNA, 25 bp, Mus musculus
gcaaaccagcacatacgtagtcatg

SEQ ID NO: 672133 - DNA, 25 bp, Mus musculus
gcaaaccagcacttacgtagtcatg

SEQ ID NO: 672134 - DNA, 25 bp, Mus musculus
gcaaaccaggccagaatgggaaaaa

SEQ ID NO: 672135 - DNA, 25 bp, Mus musculus
gcaaaccaggcctgaatgggaaaaa

SEQ ID NO: 672136 - DNA, 25 bp, Mus musculus
gcaaaccaggtactgaattaccaga

SEQ ID NO: 672137 - DNA, 25 bp, Mus musculus
gcaaaccaggtagtgaattaccaga

SEQ ID NO: 672138 - DNA, 25 bp, Mus musculus
gcaaacccaatacgccgggagtcta

SEQ ID NO: 672139 - DNA, 25 bp, Mus musculus
gcaaacccaataggccgggagtcta

SEQ ID NO: 672140 - DNA, 25 bp, Mus musculus
gcaaacccagatcaccttgcgaggg

SEQ ID NO: 672141 - DNA, 25 bp, Mus musculus
gcaaacccagatgaccttgcgaggg

SEQ ID NO: 672142 - DNA, 25 bp, Mus musculus
gcaaaccctcacactgagtcctgag

SEQ ID NO: 672143 - DNA, 25 bp, Mus musculus
gcaaaccctcactctgagtcctgag

SEQ ID NO: 672144 - DNA, 25 bp, Mus musculus
gcaaaccgagctatcatgctccaga

SEQ ID NO: 672145 - DNA, 25 bp, Mus musculus
gcaaaccgagctttcatgctccaga

SEQ ID NO: 672146 - DNA, 25 bp, Mus musculus
gcaaaccggcttatgttacacggct

SEQ ID NO: 672147 - DNA, 25 bp, Mus musculus
gcaaaccggcttttgttacacggct

SEQ ID NO: 672148 - DNA, 25 bp, Mus musculus
gcaaacctctgtcggaggttctgct

SEQ ID NO: 672149 - DNA, 25 bp, Mus musculus
gcaaacctctgtgggaggttctgct

SEQ ID NO: 672150 - DNA, 25 bp, Mus musculus
gcaaacctggaaagaacaccttggg

SEQ ID NO: 672151 - DNA, 25 bp, Mus musculus
gcaaacctggaatgaacaccttggg

SEQ ID NO: 672152 - DNA, 25 bp, Mus musculus
gcaaaccttacaagcagccctggca

SEQ ID NO: 672153 - DNA, 25 bp, Mus musculus
gcaaaccttacatgcagccctggca

SEQ ID NO: 672154 - DNA, 25 bp, Mus musculus
gcaaaccttctgaagacatagctgc

SEQ ID NO: 672155 - DNA, 25 bp, Mus musculus
gcaaaccttctgtagacatagctgc

SEQ ID NO: 672156 - DNA, 25 bp, Mus musculus
gcaaaccttgcgaggcgctcaggct

SEQ ID NO: 672157 - DNA, 25 bp, Mus musculus
gcaaaccttgcgtggcgctcaggct

SEQ ID NO: 672158 - DNA, 25 bp, Mus musculus
gcaaacgaagctacatgggaaacag

SEQ ID NO: 672159 - DNA, 25 bp, Mus musculus
gcaaacgaagcttcatgggaaacag

SEQ ID NO: 672160 - DNA, 25 bp, Mus musculus
gcaaacgcaaagactgaagattatg

SEQ ID NO: 672161 - DNA, 25 bp, Mus musculus
gcaaacgcaaagtctgaagattatg

SEQ ID NO: 672162 - DNA, 25 bp, Mus musculus
gcaaacgcactccttggcgaggcat

SEQ ID NO: 672163 - DNA, 25 bp, Mus musculus
gcaaacgcactcgttggcgaggcat

SEQ ID NO: 672164 - DNA, 25 bp, Mus musculus
gcaaacgctgagcacagcctttgag

SEQ ID NO: 672165 - DNA, 25 bp, Mus musculus
gcaaacgctgaggacagcctttgag

SEQ ID NO: 672166 - DNA, 25 bp, Mus musculus
gcaaacgctgtgcacagccacaaga

SEQ ID NO: 672167 - DNA, 25 bp, Mus musculus
gcaaacgctgtggacagccacaaga

SEQ ID NO: 672168 - DNA, 25 bp, Mus musculus
gcaaacggaggaaacggaagatgtc

SEQ ID NO: 672169 - DNA, 25 bp, Mus musculus
gcaaacggaggatacggaagatgtc

SEQ ID NO: 672170 - DNA, 25 bp, Mus musculus
gcaaacgtatgccagtcaaggaggt

SEQ ID NO: 672171 - DNA, 25 bp, Mus musculus
gcaaacgtatgcgagtcaaggaggt

SEQ ID NO: 672172 - DNA, 25 bp, Mus musculus
gcaaactacattccagaaatggtgg

SEQ ID NO: 672173 - DNA, 25 bp, Mus musculus
gcaaactacattgcagaaatggtgg

SEQ ID NO: 672174 - DNA, 25 bp, Mus musculus
gcaaactaccctacccggatgagac

SEQ ID NO: 672175 - DNA, 25 bp, Mus musculus
gcaaactacccttcccggatgagac

SEQ ID NO: 672176 - DNA, 25 bp, Mus musculus
gcaaactacctgacctcagcaaaat

SEQ ID NO: 672177 - DNA, 25 bp, Mus musculus
gcaaactacctgtcctcagcaaaat

SEQ ID NO: 672178 - DNA, 25 bp, Mus musculus
gcaaactatgcacaaaagattccag

SEQ ID NO: 672179 - DNA, 25 bp, Mus musculus
gcaaactatgcagaaaagattccag

SEQ ID NO: 672180 - DNA, 25 bp, Mus musculus
gcaaactcaagtcagcaaatatgaa

SEQ ID NO: 672181 - DNA, 25 bp, Mus musculus
gcaaactcaagtgagcaaatatgaa

SEQ ID NO: 672182 - DNA, 25 bp, Mus musculus
gcaaactccaatctaagttgcccag

SEQ ID NO: 672183 - DNA, 25 bp, Mus musculus
gcaaactccaatgtaagttgcccag

SEQ ID NO: 672184 - DNA, 25 bp, Mus musculus
gcaaactccagcatatggaaaagca

SEQ ID NO: 672185 - DNA, 25 bp, Mus musculus
gcaaactccagcttatggaaaagca

SEQ ID NO: 672186 - DNA, 25 bp, Mus musculus
gcaaactcctagaggccaagggacc

SEQ ID NO: 672187 - DNA, 25 bp, Mus musculus
gcaaactcctagtggccaagggacc

SEQ ID NO: 672188 - DNA, 25 bp, Mus musculus
gcaaactctaatcgctccaaacctg

SEQ ID NO: 672189 - DNA, 25 bp, Mus musculus
gcaaactctaatggctccaaacctg

SEQ ID NO: 672190 - DNA, 25 bp, Mus musculus
gcaaactctctgaaccttatcttag

SEQ ID NO: 672191 - DNA, 25 bp, Mus musculus
gcaaactctctgtaccttatcttag

SEQ ID NO: 672192 - DNA, 25 bp, Mus musculus
gcaaactcttcgctgggtgacctgg

SEQ ID NO: 672193 - DNA, 25 bp, Mus musculus
gcaaactcttcggtgggtgacctgg

SEQ ID NO: 672194 - DNA, 25 bp, Mus musculus
gcaaactggacaaccaggcaccact

SEQ ID NO: 672195 - DNA, 25 bp, Mus musculus
gcaaactggacatccaggcaccact

SEQ ID NO: 672196 - DNA, 25 bp, Mus musculus
gcaaactggcaactaggaaagtgtc

SEQ ID NO: 672197 - DNA, 25 bp, Mus musculus
gcaaactggcaagtaggaaagtgtc

SEQ ID NO: 672198 - DNA, 25 bp, Mus musculus
gcaaactggcacagagcaaggctat

SEQ ID NO: 672199 - DNA, 25 bp, Mus musculus
gcaaactggcactgagcaaggctat

SEQ ID NO: 672200 - DNA, 25 bp, Mus musculus
gcaaactgggctccaggacagtttg

SEQ ID NO: 672201 - DNA, 25 bp, Mus musculus
gcaaactgggctgcaggacagtttg

SEQ ID NO: 672202 - DNA, 25 bp, Mus musculus
gcaaactggttgcaatctgcggcag

SEQ ID NO: 672203 - DNA, 25 bp, Mus musculus
gcaaactggttggaatctgcggcag

SEQ ID NO: 672204 - DNA, 25 bp, Mus musculus
gcaaacttctctatagccgaaaaga

SEQ ID NO: 672205 - DNA, 25 bp, Mus musculus
gcaaacttctctttagccgaaaaga

SEQ ID NO: 672206 - DNA, 25 bp, Mus musculus
gcaaacttcttcattggaactgtca

SEQ ID NO: 672207 - DNA, 25 bp, Mus musculus
gcaaacttcttctttggaactgtca

SEQ ID NO: 672208 - DNA, 25 bp, Mus musculus
gcaaactttaatcatattgacaact

SEQ ID NO: 672209 - DNA, 25 bp, Mus musculus
gcaaactttaatgatattgacaact

SEQ ID NO: 672210 - DNA, 25 bp, Mus musculus
gcaaactttgctatccctggttaag

SEQ ID NO: 672211 - DNA, 25 bp, Mus musculus
gcaaactttgctttccctggttaag

SEQ ID NO: 672212 - DNA, 25 bp, Mus musculus
gcaaagaaacggcagaaactagaga

SEQ ID NO: 672213 - DNA, 25 bp, Mus musculus
gcaaagaaacgggagaaactagaga

SEQ ID NO: 672214 - DNA, 25 bp, Mus musculus
gcaaagaactgcaggcagccttcct

SEQ ID NO: 672215 - DNA, 25 bp, Mus musculus
gcaaagaactgctggcagccttcct

SEQ ID NO: 672216 - DNA, 25 bp, Mus musculus
gcaaagaagaagactggttccagga

SEQ ID NO: 672217 - DNA, 25 bp, Mus musculus
gcaaagaagaagtctggttccagga

SEQ ID NO: 672218 - DNA, 25 bp, Mus musculus
gcaaagaagcatcggaagtctcctg

SEQ ID NO: 672219 - DNA, 25 bp, Mus musculus
gcaaagaagcatgggaagtctcctg

SEQ ID NO: 672220 - DNA, 25 bp, Mus musculus
gcaaagaaggtgcttgtttcacaaa

SEQ ID NO: 672221 - DNA, 25 bp, Mus musculus
gcaaagaaggtggttgtttcacaaa

SEQ ID NO: 672222 - DNA, 25 bp, Mus musculus
gcaaagaagtatatttggatagaaa

SEQ ID NO: 672223 - DNA, 25 bp, Mus musculus
gcaaagaagtatttttggatagaaa

SEQ ID NO: 672224 - DNA, 25 bp, Mus musculus
gcaaagaatgctaccacggagctga

SEQ ID NO: 672225 - DNA, 25 bp, Mus musculus
gcaaagaatgcttccacggagctga

SEQ ID NO: 672226 - DNA, 25 bp, Mus musculus
gcaaagaattctcggatgtctgaca

SEQ ID NO: 672227 - DNA, 25 bp, Mus musculus
gcaaagaattctgggatgtctgaca

SEQ ID NO: 672228 - DNA, 25 bp, Mus musculus
gcaaagacaaagagccctaaaccgg

SEQ ID NO: 672229 - DNA, 25 bp, Mus musculus
gcaaagacaaagtgccctaaaccgg

SEQ ID NO: 672230 - DNA, 25 bp, Mus musculus
gcaaagacaacaccatcgaacacct

SEQ ID NO: 672231 - DNA, 25 bp, Mus musculus
gcaaagacaacagcatcgaacacct

SEQ ID NO: 672232 - DNA, 25 bp, Mus musculus
gcaaagacagcaccatttcccagga

SEQ ID NO: 672233 - DNA, 25 bp, Mus musculus
gcaaagacagcagcatttcccagga

SEQ ID NO: 672234 - DNA, 25 bp, Mus musculus
gcaaagacccttcggaagaccaagg

SEQ ID NO: 672235 - DNA, 25 bp, Mus musculus
gcaaagacccttgggaagaccaagg

SEQ ID NO: 672236 - DNA, 25 bp, Mus musculus
gcaaagaccgagaggagacgctcag

SEQ ID NO: 672237 - DNA, 25 bp, Mus musculus
gcaaagaccgagtggagacgctcag

SEQ ID NO: 672238 - DNA, 25 bp, Mus musculus
gcaaagaccttcatactgagatagg

SEQ ID NO: 672239 - DNA, 25 bp, Mus musculus
gcaaagaccttcttactgagatagg

SEQ ID NO: 672240 - DNA, 25 bp, Mus musculus
gcaaagacgtgtcagatgagaagtt

SEQ ID NO: 672241 - DNA, 25 bp, Mus musculus
gcaaagacgtgtgagatgagaagtt

SEQ ID NO: 672242 - DNA, 25 bp, Mus musculus
gcaaagactgaacattatggaatac

SEQ ID NO: 672243 - DNA, 25 bp, Mus musculus
gcaaagactgaagattatggaatac

SEQ ID NO: 672244 - DNA, 25 bp, Mus musculus
gcaaagagaagtacttcggaacctt

SEQ ID NO: 672245 - DNA, 25 bp, Mus musculus
gcaaagagaagttcttcggaacctt

SEQ ID NO: 672246 - DNA, 25 bp, Mus musculus
gcaaagagcgcacaactctctgtcc

SEQ ID NO: 672247 - DNA, 25 bp, Mus musculus
gcaaagagcgcagaactctctgtcc

SEQ ID NO: 672248 - DNA, 25 bp, Mus musculus
gcaaagagctttcctacgtgatcag

SEQ ID NO: 672249 - DNA, 25 bp, Mus musculus
gcaaagagctttgctacgtgatcag

SEQ ID NO: 672250 - DNA, 25 bp, Mus musculus
gcaaagatatgcagatgagactccc

SEQ ID NO: 672251 - DNA, 25 bp, Mus musculus
gcaaagatatgctgatgagactccc

SEQ ID NO: 672252 - DNA, 25 bp, Mus musculus
gcaaagatcaagaaaattcgaagag

SEQ ID NO: 672253 - DNA, 25 bp, Mus musculus
gcaaagatcaagtaaattcgaagag

SEQ ID NO: 672254 - DNA, 25 bp, Mus musculus
gcaaagatgaccctgggaatgatct

SEQ ID NO: 672255 - DNA, 25 bp, Mus musculus
gcaaagatgaccgtgggaatgatct

SEQ ID NO: 672256 - DNA, 25 bp, Mus musculus
gcaaagatggcacgtggacaacagt

SEQ ID NO: 672257 - DNA, 25 bp, Mus musculus
gcaaagatggcaggtggacaacagt

SEQ ID NO: 672258 - DNA, 25 bp, Mus musculus
gcaaagattaatcagcttcaagcag

SEQ ID NO: 672259 - DNA, 25 bp, Mus musculus
gcaaagattaatgagcttcaagcag

SEQ ID NO: 672260 - DNA, 25 bp, Mus musculus
gcaaagattaccatagaccctaagg

SEQ ID NO: 672261 - DNA, 25 bp, Mus musculus
gcaaagattaccttagaccctaagg

SEQ ID NO: 672262 - DNA, 25 bp, Mus musculus
gcaaagcaaagaactgcaggcagcc

SEQ ID NO: 672263 - DNA, 25 bp, Mus musculus
gcaaagcaaagatctgcaggcagcc

SEQ ID NO: 672264 - DNA, 25 bp, Mus musculus
gcaaagcaaattagagaaaagaaga

SEQ ID NO: 672265 - DNA, 25 bp, Mus musculus
gcaaagcaaatttgagaaaagaaga

SEQ ID NO: 672266 - DNA, 25 bp, Mus musculus
gcaaagcaacaaaatctaatgatgg

SEQ ID NO: 672267 - DNA, 25 bp, Mus musculus
gcaaagcaacaatatctaatgatgg

SEQ ID NO: 672268 - DNA, 25 bp, Mus musculus
gcaaagcacaacattcctcggcgtt

SEQ ID NO: 672269 - DNA, 25 bp, Mus musculus
gcaaagcacaactttcctcggcgtt

SEQ ID NO: 672270 - DNA, 25 bp, Mus musculus
gcaaagcactcgaacgtgtaaaaca

SEQ ID NO: 672271 - DNA, 25 bp, Mus musculus
gcaaagcactcgtacgtgtaaaaca

SEQ ID NO: 672272 - DNA, 25 bp, Mus musculus
gcaaagcactggagtcagcctgcaa

SEQ ID NO: 672273 - DNA, 25 bp, Mus musculus
gcaaagcactggtgtcagcctgcaa

SEQ ID NO: 672274 - DNA, 25 bp, Mus musculus
gcaaagcagcttcggatcgcctgca

SEQ ID NO: 672275 - DNA, 25 bp, Mus musculus
gcaaagcagcttgggatcgcctgca

SEQ ID NO: 672276 - DNA, 25 bp, Mus musculus
gcaaagcaggccatagacagggccc

SEQ ID NO: 672277 - DNA, 25 bp, Mus musculus
gcaaagcaggccttagacagggccc

SEQ ID NO: 672278 - DNA, 25 bp, Mus musculus
gcaaagcagtcaattttacaaattg

SEQ ID NO: 672279 - DNA, 25 bp, Mus musculus
gcaaagcagtcatttttacaaattg

SEQ ID NO: 672280 - DNA, 25 bp, Mus musculus
gcaaagcatcgtcggcagcagctgc

SEQ ID NO: 672281 - DNA, 25 bp, Mus musculus
gcaaagcatcgtgggcagcagctgc

SEQ ID NO: 672282 - DNA, 25 bp, Mus musculus
gcaaagccaaagctgacatccagga

SEQ ID NO: 672283 - DNA, 25 bp, Mus musculus
gcaaagccaaaggtgacatccagga

SEQ ID NO: 672284 - DNA, 25 bp, Mus musculus
gcaaagccactgagtcatcgatgag

SEQ ID NO: 672285 - DNA, 25 bp, Mus musculus
gcaaagccactgtgtcatcgatgag

SEQ ID NO: 672286 - DNA, 25 bp, Mus musculus
gcaaagccacttagtatctggactc

SEQ ID NO: 672287 - DNA, 25 bp, Mus musculus
gcaaagccactttgtatctggactc

SEQ ID NO: 672288 - DNA, 25 bp, Mus musculus
gcaaagcccttgcttagaaccccag

SEQ ID NO: 672289 - DNA, 25 bp, Mus musculus
gcaaagcccttggttagaaccccag

SEQ ID NO: 672290 - DNA, 25 bp, Mus musculus
gcaaagcctatccaagaatcaccta

SEQ ID NO: 672291 - DNA, 25 bp, Mus musculus
gcaaagcctatcgaagaatcaccta

SEQ ID NO: 672292 - DNA, 25 bp, Mus musculus
gcaaagcgacatagatcagcctgct

SEQ ID NO: 672293 - DNA, 25 bp, Mus musculus
gcaaagcgacattgatcagcctgct

SEQ ID NO: 672294 - DNA, 25 bp, Mus musculus
gcaaagcggaagaagcctgagatcc

SEQ ID NO: 672295 - DNA, 25 bp, Mus musculus
gcaaagcggaagtagcctgagatcc

SEQ ID NO: 672296 - DNA, 25 bp, Mus musculus
gcaaagcggagtcctctgcagagca

SEQ ID NO: 672297 - DNA, 25 bp, Mus musculus
gcaaagcggagtgctctgcagagca

SEQ ID NO: 672298 - DNA, 25 bp, Mus musculus
gcaaagcgtagcacatctgcacata

SEQ ID NO: 672299 - DNA, 25 bp, Mus musculus
gcaaagcgtagctcatctgcacata

SEQ ID NO: 672300 - DNA, 25 bp, Mus musculus
gcaaagctaaaaccaaggaaaatcg

SEQ ID NO: 672301 - DNA, 25 bp, Mus musculus
gcaaagctaaaagcaaggaaaatcg

SEQ ID NO: 672302 - DNA, 25 bp, Mus musculus
gcaaagctccacaggtgatgcttgt

SEQ ID NO: 672303 - DNA, 25 bp, Mus musculus
gcaaagctccactggtgatgcttgt

SEQ ID NO: 672304 - DNA, 25 bp, Mus musculus
gcaaagctcgttctgtgggcctcag

SEQ ID NO: 672305 - DNA, 25 bp, Mus musculus
gcaaagctcgttgtgtgggcctcag

SEQ ID NO: 672306 - DNA, 25 bp, Mus musculus
gcaaagctggccaaagcaggcttct

SEQ ID NO: 672307 - DNA, 25 bp, Mus musculus
gcaaagctggcctaagcaggcttct

SEQ ID NO: 672308 - DNA, 25 bp, Mus musculus
gcaaagctgtctcgagaacagatgt

SEQ ID NO: 672309 - DNA, 25 bp, Mus musculus
gcaaagctgtctggagaacagatgt

SEQ ID NO: 672310 - DNA, 25 bp, Mus musculus
gcaaagctttttcaagatttccaaa

SEQ ID NO: 672311 - DNA, 25 bp, Mus musculus
gcaaagctttttgaagatttccaaa

SEQ ID NO: 672312 - DNA, 25 bp, Mus musculus
gcaaaggacttcagcacgggttgat

SEQ ID NO: 672313 - DNA, 25 bp, Mus musculus
gcaaaggacttctgcacgggttgat

SEQ ID NO: 672314 - DNA, 25 bp, Mus musculus
gcaaaggagacaccggcctaagcca

SEQ ID NO: 672315 - DNA, 25 bp, Mus musculus
gcaaaggagacagcggcctaagcca

SEQ ID NO: 672316 - DNA, 25 bp, Mus musculus
gcaaaggagttcaaccctcgttctt

SEQ ID NO: 672317 - DNA, 25 bp, Mus musculus
gcaaaggagttcaccaatgtttaca

SEQ ID NO: 672318 - DNA, 25 bp, Mus musculus
gcaaaggagttctaccctcgttctt

SEQ ID NO: 672319 - DNA, 25 bp, Mus musculus
gcaaaggagttctccaatgtttaca

SEQ ID NO: 672320 - DNA, 25 bp, Mus musculus
gcaaaggcacagatcaattcctcaa

SEQ ID NO: 672321 - DNA, 25 bp, Mus musculus
gcaaaggcacagttcaattcctcaa

SEQ ID NO: 672322 - DNA, 25 bp, Mus musculus
gcaaaggcagccagaacatcaatga

SEQ ID NO: 672323 - DNA, 25 bp, Mus musculus
gcaaaggcagcctgaacatcaatga

SEQ ID NO: 672324 - DNA, 25 bp, Mus musculus
gcaaaggccacgacagaaacaacag

SEQ ID NO: 672325 - DNA, 25 bp, Mus musculus
gcaaaggccacgtcagaaacaacag

SEQ ID NO: 672326 - DNA, 25 bp, Mus musculus
gcaaaggccagcagatgctctgcag

SEQ ID NO: 672327 - DNA, 25 bp, Mus musculus
gcaaaggccagctgatgctctgcag

SEQ ID NO: 672328 - DNA, 25 bp, Mus musculus
gcaaaggccggaccagggagaagga

SEQ ID NO: 672329 - DNA, 25 bp, Mus musculus
gcaaaggccggagcagggagaagga

SEQ ID NO: 672330 - DNA, 25 bp, Mus musculus
gcaaaggctctgaggcgcctcttcc

SEQ ID NO: 672331 - DNA, 25 bp, Mus musculus
gcaaaggctctgtggcgcctcttcc

SEQ ID NO: 672332 - DNA, 25 bp, Mus musculus
gcaaaggctttaccaagttgctgga

SEQ ID NO: 672333 - DNA, 25 bp, Mus musculus
gcaaaggctttagcaagttgctgga

SEQ ID NO: 672334 - DNA, 25 bp, Mus musculus
gcaaagggcaaacaactgaacgaat

SEQ ID NO: 672335 - DNA, 25 bp, Mus musculus
gcaaagggcaaagaactgaacgaat

SEQ ID NO: 672336 - DNA, 25 bp, Mus musculus
gcaaagggccataaaatgcactacc

SEQ ID NO: 672337 - DNA, 25 bp, Mus musculus
gcaaagggccattaaatgcactacc

SEQ ID NO: 672338 - DNA, 25 bp, Mus musculus
gcaaaggtccgacgcatcattcctg

SEQ ID NO: 672339 - DNA, 25 bp, Mus musculus
gcaaaggtccgaggcatcattcctg

SEQ ID NO: 672340 - DNA, 25 bp, Mus musculus
gcaaaggtcctacttgagccacagg

SEQ ID NO: 672341 - DNA, 25 bp, Mus musculus
gcaaaggtcctagttgagccacagg

SEQ ID NO: 672342 - DNA, 25 bp, Mus musculus
gcaaaggtgtccaagcagaagcaga

SEQ ID NO: 672343 - DNA, 25 bp, Mus musculus
gcaaaggtgtcctagcagaagcaga

SEQ ID NO: 672344 - DNA, 25 bp, Mus musculus
gcaaagtaccgaagtgcttcaagca

SEQ ID NO: 672345 - DNA, 25 bp, Mus musculus
gcaaagtaccgatgtgcttcaagca

SEQ ID NO: 672346 - DNA, 25 bp, Mus musculus
gcaaagtacctgagtacattaagaa

SEQ ID NO: 672347 - DNA, 25 bp, Mus musculus
gcaaagtacctgtgtacattaagaa

SEQ ID NO: 672348 - DNA, 25 bp, Mus musculus
gcaaagtatcagaagggattgactt

SEQ ID NO: 672349 - DNA, 25 bp, Mus musculus
gcaaagtatcagtagggattgactt

SEQ ID NO: 672350 - DNA, 25 bp, Mus musculus
gcaaagtcaaggatcggcacaaaag

SEQ ID NO: 672351 - DNA, 25 bp, Mus musculus
gcaaagtcaaggttcggcacaaaag

SEQ ID NO: 672352 - DNA, 25 bp, Mus musculus
gcaaagtcaagtccattctattaaa

SEQ ID NO: 672353 - DNA, 25 bp, Mus musculus
gcaaagtcaagtgcattctattaaa

SEQ ID NO: 672354 - DNA, 25 bp, Mus musculus
gcaaagtccctgatgacattccttc

SEQ ID NO: 672355 - DNA, 25 bp, Mus musculus
gcaaagtccctgttgacattccttc

SEQ ID NO: 672356 - DNA, 25 bp, Mus musculus
gcaaagtctattatcagacattgcc

SEQ ID NO: 672357 - DNA, 25 bp, Mus musculus
gcaaagtctattttcagacattgcc

SEQ ID NO: 672358 - DNA, 25 bp, Mus musculus
gcaaagtctgctctttaccccagta

SEQ ID NO: 672359 - DNA, 25 bp, Mus musculus
gcaaagtctgctgtttaccccagta

SEQ ID NO: 672360 - DNA, 25 bp, Mus musculus
gcaaagtgacatctcgccgttagtg

SEQ ID NO: 672361 - DNA, 25 bp, Mus musculus
gcaaagtgacatgtcgccgttagtg

SEQ ID NO: 672362 - DNA, 25 bp, Mus musculus
gcaaagtgcatcattactattgaag

SEQ ID NO: 672363 - DNA, 25 bp, Mus musculus
gcaaagtgcatctttactattgaag

SEQ ID NO: 672364 - DNA, 25 bp, Mus musculus
gcaaagtgtatcaatggcaggtcct

SEQ ID NO: 672365 - DNA, 25 bp, Mus musculus
gcaaagtgtatctatggcaggtcct

SEQ ID NO: 672366 - DNA, 25 bp, Mus musculus
gcaaagtgtgtgcaagcaaatgcct

SEQ ID NO: 672367 - DNA, 25 bp, Mus musculus
gcaaagtgtgtggaagcaaatgcct

SEQ ID NO: 672368 - DNA, 25 bp, Mus musculus
gcaaagttcaacagtaagagcccct

SEQ ID NO: 672369 - DNA, 25 bp, Mus musculus
gcaaagttcaactgtaagagcccct

SEQ ID NO: 672370 - DNA, 25 bp, Mus musculus
gcaaagtttgatccttcttcgaaaa

SEQ ID NO: 672371 - DNA, 25 bp, Mus musculus
gcaaagtttgatgcttcttcgaaaa

SEQ ID NO: 672372 - DNA, 25 bp, Mus musculus
gcaaataaaaatccaagcattctcc

SEQ ID NO: 672373 - DNA, 25 bp, Mus musculus
gcaaataaaaatgcaagcattctcc

SEQ ID NO: 672374 - DNA, 25 bp, Mus musculus
gcaaatacaccaagatcttccacac

SEQ ID NO: 672375 - DNA, 25 bp, Mus musculus
gcaaatacaccatgatcttccacac

SEQ ID NO: 672376 - DNA, 25 bp, Mus musculus
gcaaatagtctacaagccggtggac

SEQ ID NO: 672377 - DNA, 25 bp, Mus musculus
gcaaatagtctagaagccggtggac

SEQ ID NO: 672378 - DNA, 25 bp, Mus musculus
gcaaatagtcttacaggcagcacaa

SEQ ID NO: 672379 - DNA, 25 bp, Mus musculus
gcaaatagtctttcaggcagcacaa

SEQ ID NO: 672380 - DNA, 25 bp, Mus musculus
gcaaatagtttcatcaatcggccta

SEQ ID NO: 672381 - DNA, 25 bp, Mus musculus
gcaaatagtttcttcaatcggccta

SEQ ID NO: 672382 - DNA, 25 bp, Mus musculus
gcaaatatctgcagatggactgaag

SEQ ID NO: 672383 - DNA, 25 bp, Mus musculus
gcaaatatctgctgatggactgaag

SEQ ID NO: 672384 - DNA, 25 bp, Mus musculus
gcaaatatgcgaagtggtatacagg

SEQ ID NO: 672385 - DNA, 25 bp, Mus musculus
gcaaatatgcgatgtggtatacagg

SEQ ID NO: 672386 - DNA, 25 bp, Mus musculus
gcaaatattaccagaaagtccacaa

SEQ ID NO: 672387 - DNA, 25 bp, Mus musculus
gcaaatattacctgaaagtccacaa

SEQ ID NO: 672388 - DNA, 25 bp, Mus musculus
gcaaatatttgcaagtcatgatggt

SEQ ID NO: 672389 - DNA, 25 bp, Mus musculus
gcaaatatttgctagtcatgatggt

SEQ ID NO: 672390 - DNA, 25 bp, Mus musculus
gcaaatcactgcagctgtcagatga

SEQ ID NO: 672391 - DNA, 25 bp, Mus musculus
gcaaatcactgctgctgtcagatga

SEQ ID NO: 672392 - DNA, 25 bp, Mus musculus
gcaaatcagcaaatcattaaggatg

SEQ ID NO: 672393 - DNA, 25 bp, Mus musculus
gcaaatcagcaattcattaaggatg

SEQ ID NO: 672394 - DNA, 25 bp, Mus musculus
gcaaatcatgtcagccccttagggc

SEQ ID NO: 672395 - DNA, 25 bp, Mus musculus
gcaaatcatgtctgccccttagggc

SEQ ID NO: 672396 - DNA, 25 bp, Mus musculus
gcaaatcatttcaatcctggagtct

SEQ ID NO: 672397 - DNA, 25 bp, Mus musculus
gcaaatcatttctatcctggagtct

SEQ ID NO: 672398 - DNA, 25 bp, Mus musculus
gcaaatccaaaacctcgaccagaat

SEQ ID NO: 672399 - DNA, 25 bp, Mus musculus
gcaaatccaaaagctcgaccagaat

SEQ ID NO: 672400 - DNA, 25 bp, Mus musculus
gcaaatccaacactatatgaaagtg

SEQ ID NO: 672401 - DNA, 25 bp, Mus musculus
gcaaatccaacagtatatgaaagtg

SEQ ID NO: 672402 - DNA, 25 bp, Mus musculus
gcaaatccagccaggatagcgacac

SEQ ID NO: 672403 - DNA, 25 bp, Mus musculus
gcaaatccagcctggatagcgacac

SEQ ID NO: 672404 - DNA, 25 bp, Mus musculus
gcaaatcctagaaaattcaacttgg

SEQ ID NO: 672405 - DNA, 25 bp, Mus musculus
gcaaatcctagataattcaacttgg

SEQ ID NO: 672406 - DNA, 25 bp, Mus musculus
gcaaatcctcctagttccacctatg

SEQ ID NO: 672407 - DNA, 25 bp, Mus musculus
gcaaatcctccttgttccacctatg

SEQ ID NO: 672408 - DNA, 25 bp, Mus musculus
gcaaatcgctaaccttttggaagac

SEQ ID NO: 672409 - DNA, 25 bp, Mus musculus
gcaaatcgctaagcttttggaagac

SEQ ID NO: 672410 - DNA, 25 bp, Mus musculus
gcaaatcggccaagagatgttggaa

SEQ ID NO: 672411 - DNA, 25 bp, Mus musculus
gcaaatcggccatgagatgttggaa

SEQ ID NO: 672412 - DNA, 25 bp, Mus musculus
gcaaatctaacaacatggcctcgct

SEQ ID NO: 672413 - DNA, 25 bp, Mus musculus
gcaaatctaacatcatggcctcgct

SEQ ID NO: 672414 - DNA, 25 bp, Mus musculus
gcaaatctaaggcaaaactcatgga

SEQ ID NO: 672415 - DNA, 25 bp, Mus musculus
gcaaatctaagggaaaactcatgga

SEQ ID NO: 672416 - DNA, 25 bp, Mus musculus
gcaaatctcatgcaccttgggaaga

SEQ ID NO: 672417 - DNA, 25 bp, Mus musculus
gcaaatctcatgcataatcttggtg

SEQ ID NO: 672418 - DNA, 25 bp, Mus musculus
gcaaatctcatggaccttgggaaga

SEQ ID NO: 672419 - DNA, 25 bp, Mus musculus
gcaaatctcatggataatcttggtg

SEQ ID NO: 672420 - DNA, 25 bp, Mus musculus
gcaaatctggaactcattcgcctct

SEQ ID NO: 672421 - DNA, 25 bp, Mus musculus
gcaaatctggaagtcattcgcctct

SEQ ID NO: 672422 - DNA, 25 bp, Mus musculus
gcaaatctggccacaacatctacaa

SEQ ID NO: 672423 - DNA, 25 bp, Mus musculus
gcaaatctggcctcaacatctacaa

SEQ ID NO: 672424 - DNA, 25 bp, Mus musculus
gcaaatctttgccaagtgattcaga

SEQ ID NO: 672425 - DNA, 25 bp, Mus musculus
gcaaatctttgcgaagtgattcaga

SEQ ID NO: 672426 - DNA, 25 bp, Mus musculus
gcaaatgaacacctcactgaagaca

SEQ ID NO: 672427 - DNA, 25 bp, Mus musculus
gcaaatgaacacgtcactgaagaca

SEQ ID NO: 672428 - DNA, 25 bp, Mus musculus
gcaaatgaagaacggcaacaactcc

SEQ ID NO: 672429 - DNA, 25 bp, Mus musculus
gcaaatgaagaagggcaacaactcc

SEQ ID NO: 672430 - DNA, 25 bp, Mus musculus
gcaaatgacagcaggcacttgggcc

SEQ ID NO: 672431 - DNA, 25 bp, Mus musculus
gcaaatgacagctggcacttgggcc

SEQ ID NO: 672432 - DNA, 25 bp, Mus musculus
gcaaatgaccaacagccatgtggat

SEQ ID NO: 672433 - DNA, 25 bp, Mus musculus
gcaaatgaccaagagccatgtggat

SEQ ID NO: 672434 - DNA, 25 bp, Mus musculus
gcaaatgcaagtacagacagaaacc

SEQ ID NO: 672435 - DNA, 25 bp, Mus musculus
gcaaatgcaagttcagacagaaacc

SEQ ID NO: 672436 - DNA, 25 bp, Mus musculus
gcaaatgcaatgctgccacagggct

SEQ ID NO: 672437 - DNA, 25 bp, Mus musculus
gcaaatgcaatggtgccacagggct

SEQ ID NO: 672438 - DNA, 25 bp, Mus musculus
gcaaatgccaccattgaagtgaaag

SEQ ID NO: 672439 - DNA, 25 bp, Mus musculus
gcaaatgccacctttgaagtgaaag

SEQ ID NO: 672440 - DNA, 25 bp, Mus musculus
gcaaatggagctccttttactacag

SEQ ID NO: 672441 - DNA, 25 bp, Mus musculus
gcaaatggagctgcttttactacag

SEQ ID NO: 672442 - DNA, 25 bp, Mus musculus
gcaaatgggaacaaagtgtcaacaa

SEQ ID NO: 672443 - DNA, 25 bp, Mus musculus
gcaaatgggaacaagatcagcatcc

SEQ ID NO: 672444 - DNA, 25 bp, Mus musculus
gcaaatgggaactaagtgtcaacaa

SEQ ID NO: 672445 - DNA, 25 bp, Mus musculus
gcaaatgggaactagatcagcatcc

SEQ ID NO: 672446 - DNA, 25 bp, Mus musculus
gcaaatgggtggcaagtaccaccct

SEQ ID NO: 672447 - DNA, 25 bp, Mus musculus
gcaaatgggtgggaagtaccaccct

SEQ ID NO: 672448 - DNA, 25 bp, Mus musculus
gcaaatgtaattaataagcgtgatg

SEQ ID NO: 672449 - DNA, 25 bp, Mus musculus
gcaaatgtaatttataagcgtgatg

SEQ ID NO: 672450 - DNA, 25 bp, Mus musculus
gcaaatgtcagacaccagtccccag

SEQ ID NO: 672451 - DNA, 25 bp, Mus musculus
gcaaatgtcagagaccagtccccag

SEQ ID NO: 672452 - DNA, 25 bp, Mus musculus
gcaaatgtccctatgaccccaagct

SEQ ID NO: 672453 - DNA, 25 bp, Mus musculus
gcaaatgtccctttgaccccaagct

SEQ ID NO: 672454 - DNA, 25 bp, Mus musculus
gcaaatgtgaaaacaaacctggcag

SEQ ID NO: 672455 - DNA, 25 bp, Mus musculus
gcaaatgtgaaatcaaacctggcag

SEQ ID NO: 672456 - DNA, 25 bp, Mus musculus
gcaaatgtgtgacttagaaaactaa

SEQ ID NO: 672457 - DNA, 25 bp, Mus musculus
gcaaatgtgtgagttagaaaactaa

SEQ ID NO: 672458 - DNA, 25 bp, Mus musculus
gcaaattagaatctggcttgacaaa

SEQ ID NO: 672459 - DNA, 25 bp, Mus musculus
gcaaattagaatgtggcttgacaaa

SEQ ID NO: 672460 - DNA, 25 bp, Mus musculus
gcaaattcaactcccataaacgctg

SEQ ID NO: 672461 - DNA, 25 bp, Mus musculus
gcaaattcaactgccataaacgctg

SEQ ID NO: 672462 - DNA, 25 bp, Mus musculus
gcaaattctgccaagtggccattgg

SEQ ID NO: 672463 - DNA, 25 bp, Mus musculus
gcaaattctgcctagtggccattgg

SEQ ID NO: 672464 - DNA, 25 bp, Mus musculus
gcaaattctgctcctcttcagacag

SEQ ID NO: 672465 - DNA, 25 bp, Mus musculus
gcaaattctgctgctcttcagacag

SEQ ID NO: 672466 - DNA, 25 bp, Mus musculus
gcaaattctggacattcacaagatg

SEQ ID NO: 672467 - DNA, 25 bp, Mus musculus
gcaaattctggagattcacaagatg

SEQ ID NO: 672468 - DNA, 25 bp, Mus musculus
gcaaattcttatcgccagttgggca

SEQ ID NO: 672469 - DNA, 25 bp, Mus musculus
gcaaattcttatggccagttgggca

SEQ ID NO: 672470 - DNA, 25 bp, Mus musculus
gcaaattgaagtagctttccgattc

SEQ ID NO: 672471 - DNA, 25 bp, Mus musculus
gcaaattgaagttgctttccgattc

SEQ ID NO: 672472 - DNA, 25 bp, Mus musculus
gcaaatttcacaccgtccggacagc

SEQ ID NO: 672473 - DNA, 25 bp, Mus musculus
gcaaatttcacagcgtccggacagc

SEQ ID NO: 672474 - DNA, 25 bp, Mus musculus
gcaaattttgtaccaggcctacgac

SEQ ID NO: 672475 - DNA, 25 bp, Mus musculus
gcaaattttgtagcaggcctacgac

SEQ ID NO: 672476 - DNA, 25 bp, Mus musculus
gcaaatttttggagatgtgtgatga

SEQ ID NO: 672477 - DNA, 25 bp, Mus musculus
gcaaatttttggtgatgtgtgatga

SEQ ID NO: 672478 - DNA, 25 bp, Mus musculus
gcaacaaaacctatggccagcggtt

SEQ ID NO: 672479 - DNA, 25 bp, Mus musculus
gcaacaaaacctttggccagcggtt

SEQ ID NO: 672480 - DNA, 25 bp, Mus musculus
gcaacaaaatggcttcaactatctg

SEQ ID NO: 672481 - DNA, 25 bp, Mus musculus
gcaacaaaatgggttcaactatctg

SEQ ID NO: 672482 - DNA, 25 bp, Mus musculus
gcaacaaacgaaacaggtacaagaa

SEQ ID NO: 672483 - DNA, 25 bp, Mus musculus
gcaacaaacgaatcaggtacaagaa

SEQ ID NO: 672484 - DNA, 25 bp, Mus musculus
gcaacaaacgggattgttcgtggag

SEQ ID NO: 672485 - DNA, 25 bp, Mus musculus
gcaacaaacgggtttgttcgtggag

SEQ ID NO: 672486 - DNA, 25 bp, Mus musculus
gcaacaaatctcaggtcggattgat

SEQ ID NO: 672487 - DNA, 25 bp, Mus musculus
gcaacaaatctctggtcggattgat

SEQ ID NO: 672488 - DNA, 25 bp, Mus musculus
gcaacaaatggaccaagatacgttg

SEQ ID NO: 672489 - DNA, 25 bp, Mus musculus
gcaacaaatggagcaagatacgttg

SEQ ID NO: 672490 - DNA, 25 bp, Mus musculus
gcaacaacaccaagtagccagaaaa

SEQ ID NO: 672491 - DNA, 25 bp, Mus musculus
gcaacaacaccatgtagccagaaaa

SEQ ID NO: 672492 - DNA, 25 bp, Mus musculus
gcaacaacagtgaacgtgaggccac

SEQ ID NO: 672493 - DNA, 25 bp, Mus musculus
gcaacaacagtgtacgtgaggccac

SEQ ID NO: 672494 - DNA, 25 bp, Mus musculus
gcaacaacatccatatccagccagg

SEQ ID NO: 672495 - DNA, 25 bp, Mus musculus
gcaacaacatccttatccagccagg

SEQ ID NO: 672496 - DNA, 25 bp, Mus musculus
gcaacaacccatagcagtcaaaaga

SEQ ID NO: 672497 - DNA, 25 bp, Mus musculus
gcaacaacccattgcagtcaaaaga

SEQ ID NO: 672498 - DNA, 25 bp, Mus musculus
gcaacaacccggatgtggaggtcag

SEQ ID NO: 672499 - DNA, 25 bp, Mus musculus
gcaacaacccggttgtggaggtcag

SEQ ID NO: 672500 - DNA, 25 bp, Mus musculus
gcaacaagacagagtgcggcctgct

SEQ ID NO: 672501 - DNA, 25 bp, Mus musculus
gcaacaagacagtgtgcggcctgct

SEQ ID NO: 672502 - DNA, 25 bp, Mus musculus
gcaacaagacctcggacaccgtgtg

SEQ ID NO: 672503 - DNA, 25 bp, Mus musculus
gcaacaagacctgggacaccgtgtg

SEQ ID NO: 672504 - DNA, 25 bp, Mus musculus
gcaacaagatgacttgcactggctg

SEQ ID NO: 672505 - DNA, 25 bp, Mus musculus
gcaacaagatgagttgcactggctg

SEQ ID NO: 672506 - DNA, 25 bp, Mus musculus
gcaacaaggatgactagaatgggcc

SEQ ID NO: 672507 - DNA, 25 bp, Mus musculus
gcaacaaggatgtctagaatgggcc

SEQ ID NO: 672508 - DNA, 25 bp, Mus musculus
gcaacaaggcgcctcatgggtgcta

SEQ ID NO: 672509 - DNA, 25 bp, Mus musculus
gcaacaaggcgcgtcatgggtgcta

SEQ ID NO: 672510 - DNA, 25 bp, Mus musculus
gcaacaatacttcccatggagccaa

SEQ ID NO: 672511 - DNA, 25 bp, Mus musculus
gcaacaatacttgccatggagccaa

SEQ ID NO: 672512 - DNA, 25 bp, Mus musculus
gcaacaatccgaatggccacgggca

SEQ ID NO: 672513 - DNA, 25 bp, Mus musculus
gcaacaatccgattggccacgggca

SEQ ID NO: 672514 - DNA, 25 bp, Mus musculus
gcaacaatccttaccttctctcgga

SEQ ID NO: 672515 - DNA, 25 bp, Mus musculus
gcaacaatcctttccttctctcgga

SEQ ID NO: 672516 - DNA, 25 bp, Mus musculus
gcaacaatcgatcttccttcaggag

SEQ ID NO: 672517 - DNA, 25 bp, Mus musculus
gcaacaatcgatgttccttcaggag

SEQ ID NO: 672518 - DNA, 25 bp, Mus musculus
gcaacaattggcattgacttcttat

SEQ ID NO: 672519 - DNA, 25 bp, Mus musculus
gcaacaattggctttgacttcttat

SEQ ID NO: 672520 - DNA, 25 bp, Mus musculus
gcaacacaatttcgagcaacagatt

SEQ ID NO: 672521 - DNA, 25 bp, Mus musculus
gcaacacaatttggagcaacagatt

SEQ ID NO: 672522 - DNA, 25 bp, Mus musculus
gcaacacagcctctaagttagagcg

SEQ ID NO: 672523 - DNA, 25 bp, Mus musculus
gcaacacagcctgtaagttagagcg

SEQ ID NO: 672524 - DNA, 25 bp, Mus musculus
gcaacacaggcactatccaatggaa

SEQ ID NO: 672525 - DNA, 25 bp, Mus musculus
gcaacacaggcagtatccaatggaa

SEQ ID NO: 672526 - DNA, 25 bp, Mus musculus
gcaacacatctcagtctgctgaagt

SEQ ID NO: 672527 - DNA, 25 bp, Mus musculus
gcaacacatctctgtctgctgaagt

SEQ ID NO: 672528 - DNA, 25 bp, Mus musculus
gcaacacatgcacgtctaaaccgaa

SEQ ID NO: 672529 - DNA, 25 bp, Mus musculus
gcaacacatgcaggtctaaaccgaa

SEQ ID NO: 672530 - DNA, 25 bp, Mus musculus
gcaacaccactaacagcagcctgat

SEQ ID NO: 672531 - DNA, 25 bp, Mus musculus
gcaacaccactatcagcagcctgat

SEQ ID NO: 672532 - DNA, 25 bp, Mus musculus
gcaacaccccgcagaacttggagca

SEQ ID NO: 672533 - DNA, 25 bp, Mus musculus
gcaacaccccgctgaacttggagca

SEQ ID NO: 672534 - DNA, 25 bp, Mus musculus
gcaacacgagctacgccagcttcga

SEQ ID NO: 672535 - DNA, 25 bp, Mus musculus
gcaacacgagcttcgccagcttcga

SEQ ID NO: 672536 - DNA, 25 bp, Mus musculus
gcaacacgtagacgcaggctctgaa

SEQ ID NO: 672537 - DNA, 25 bp, Mus musculus
gcaacacgtagaggcaggctctgaa

SEQ ID NO: 672538 - DNA, 25 bp, Mus musculus
gcaacacgtcggcaattgaatccca

SEQ ID NO: 672539 - DNA, 25 bp, Mus musculus
gcaacacgtcgggaattgaatccca

SEQ ID NO: 672540 - DNA, 25 bp, Mus musculus
gcaacactcggaaccctgtgtggaa

SEQ ID NO: 672541 - DNA, 25 bp, Mus musculus
gcaacactcggatccctgtgtggaa

SEQ ID NO: 672542 - DNA, 25 bp, Mus musculus
gcaacactgcaacatttggaacaga

SEQ ID NO: 672543 - DNA, 25 bp, Mus musculus
gcaacactgcaagatttggaacaga

SEQ ID NO: 672544 - DNA, 25 bp, Mus musculus
gcaacactgtgaagacaatcatggg

SEQ ID NO: 672545 - DNA, 25 bp, Mus musculus
gcaacactgtgatgacaatcatggg

SEQ ID NO: 672546 - DNA, 25 bp, Mus musculus
gcaacacttaccacacttttcaaag

SEQ ID NO: 672547 - DNA, 25 bp, Mus musculus
gcaacacttacctcacttttcaaag

SEQ ID NO: 672548 - DNA, 25 bp, Mus musculus
gcaacacttggaaatcacgcaggac

SEQ ID NO: 672549 - DNA, 25 bp, Mus musculus
gcaacacttggatatcacgcaggac

SEQ ID NO: 672550 - DNA, 25 bp, Mus musculus
gcaacagaagccaacaactctacct

SEQ ID NO: 672551 - DNA, 25 bp, Mus musculus
gcaacagaagcctacaactctacct

SEQ ID NO: 672552 - DNA, 25 bp, Mus musculus
gcaacagagatcagctatcactgct

SEQ ID NO: 672553 - DNA, 25 bp, Mus musculus
gcaacagagatctgctatcactgct

SEQ ID NO: 672554 - DNA, 25 bp, Mus musculus
gcaacagatgaaagagatagttacc

SEQ ID NO: 672555 - DNA, 25 bp, Mus musculus
gcaacagatgaatgagatagttacc

SEQ ID NO: 672556 - DNA, 25 bp, Mus musculus
gcaacagcaagcaagcggtcaggat

SEQ ID NO: 672557 - DNA, 25 bp, Mus musculus
gcaacagcaagctagcggtcaggat

SEQ ID NO: 672558 - DNA, 25 bp, Mus musculus
gcaacagcacgcaggattgcattag

SEQ ID NO: 672559 - DNA, 25 bp, Mus musculus
gcaacagcacgctggattgcattag

SEQ ID NO: 672560 - DNA, 25 bp, Mus musculus
gcaacagcagctatcaataacgtgg

SEQ ID NO: 672561 - DNA, 25 bp, Mus musculus
gcaacagcagctttcaataacgtgg

SEQ ID NO: 672562 - DNA, 25 bp, Mus musculus
gcaacagctcctcaacagaatgcag

SEQ ID NO: 672563 - DNA, 25 bp, Mus musculus
gcaacagctcctgaacagaatgcag

SEQ ID NO: 672564 - DNA, 25 bp, Mus musculus
gcaacagcttctccacacatgatcg

SEQ ID NO: 672565 - DNA, 25 bp, Mus musculus
gcaacagcttctgcacacatgatcg

SEQ ID NO: 672566 - DNA, 25 bp, Mus musculus
gcaacaggatgtactgtaagattac

SEQ ID NO: 672567 - DNA, 25 bp, Mus musculus
gcaacaggatgttctgtaagattac

SEQ ID NO: 672568 - DNA, 25 bp, Mus musculus
gcaacaggcagtattccaaggtatt

SEQ ID NO: 672569 - DNA, 25 bp, Mus musculus
gcaacaggcagttttccaaggtatt

SEQ ID NO: 672570 - DNA, 25 bp, Mus musculus
gcaacaggctgaccagggctgatat

SEQ ID NO: 672571 - DNA, 25 bp, Mus musculus
gcaacaggctgagcagggctgatat

SEQ ID NO: 672572 - DNA, 25 bp, Mus musculus
gcaacaggtgctctagatctctccg

SEQ ID NO: 672573 - DNA, 25 bp, Mus musculus
gcaacaggtgctgtagatctctccg

SEQ ID NO: 672574 - DNA, 25 bp, Mus musculus
gcaacaggtgtaccagatgaggccc

SEQ ID NO: 672575 - DNA, 25 bp, Mus musculus
gcaacaggtgtagcagatgaggccc

SEQ ID NO: 672576 - DNA, 25 bp, Mus musculus
gcaacagtctccacctgcctgtacc

SEQ ID NO: 672577 - DNA, 25 bp, Mus musculus
gcaacagtctcctcctgcctgtacc

SEQ ID NO: 672578 - DNA, 25 bp, Mus musculus
gcaacagtgaaaaagcacaaggcat

SEQ ID NO: 672579 - DNA, 25 bp, Mus musculus
gcaacagtgaaatagcacaaggcat

SEQ ID NO: 672580 - DNA, 25 bp, Mus musculus
gcaacagtgctcaagccagagagaa

SEQ ID NO: 672581 - DNA, 25 bp, Mus musculus
gcaacagtgctctagccagagagaa

SEQ ID NO: 672582 - DNA, 25 bp, Mus musculus
gcaacagtgtacaaagggaaaagca

SEQ ID NO: 672583 - DNA, 25 bp, Mus musculus
gcaacagtgtactaagggaaaagca

SEQ ID NO: 672584 - DNA, 25 bp, Mus musculus
gcaacagtttgtcttggtgcaccca

SEQ ID NO: 672585 - DNA, 25 bp, Mus musculus
gcaacagtttgtgttggtgcaccca

SEQ ID NO: 672586 - DNA, 25 bp, Mus musculus
gcaacatatggcacatgtccattct

SEQ ID NO: 672587 - DNA, 25 bp, Mus musculus
gcaacatatggctcatgtccattct

SEQ ID NO: 672588 - DNA, 25 bp, Mus musculus
gcaacatcaagaccatgtattcggt

SEQ ID NO: 672589 - DNA, 25 bp, Mus musculus
gcaacatcaagagcatgtattcggt

SEQ ID NO: 672590 - DNA, 25 bp, Mus musculus
gcaacatcaagcagaccttcaatag

SEQ ID NO: 672591 - DNA, 25 bp, Mus musculus
gcaacatcaagctgaccttcaatag

SEQ ID NO: 672592 - DNA, 25 bp, Mus musculus
gcaacatcacggcatttgcactgaa

SEQ ID NO: 672593 - DNA, 25 bp, Mus musculus
gcaacatcacgggatttgcactgaa

SEQ ID NO: 672594 - DNA, 25 bp, Mus musculus
gcaacatcatttactccaacggtga

SEQ ID NO: 672595 - DNA, 25 bp, Mus musculus
gcaacatcattttctccaacggtga

SEQ ID NO: 672596 - DNA, 25 bp, Mus musculus
gcaacatccagtacgaggccttcca

SEQ ID NO: 672597 - DNA, 25 bp, Mus musculus
gcaacatccagttcgaggccttcca

SEQ ID NO: 672598 - DNA, 25 bp, Mus musculus
gcaacatcctttcgccacaggacat

SEQ ID NO: 672599 - DNA, 25 bp, Mus musculus
gcaacatcctttggccacaggacat

SEQ ID NO: 672600 - DNA, 25 bp, Mus musculus
gcaacatcgagtacaactgcccggc

SEQ ID NO: 672601 - DNA, 25 bp, Mus musculus
gcaacatcgagttcaactgcccggc

SEQ ID NO: 672602 - DNA, 25 bp, Mus musculus
gcaacatcggcaccggtcattttgt

SEQ ID NO: 672603 - DNA, 25 bp, Mus musculus
gcaacatcggcagcggtcattttgt

SEQ ID NO: 672604 - DNA, 25 bp, Mus musculus
gcaacatctggcagggctattacct

SEQ ID NO: 672605 - DNA, 25 bp, Mus musculus
gcaacatctggctgggctattacct

SEQ ID NO: 672606 - DNA, 25 bp, Mus musculus
gcaacatgaaggacgaagtggctct

SEQ ID NO: 672607 - DNA, 25 bp, Mus musculus
gcaacatgaaggtcgaagtggctct

SEQ ID NO: 672608 - DNA, 25 bp, Mus musculus
gcaacatgagctagcgactctgagg

SEQ ID NO: 672609 - DNA, 25 bp, Mus musculus
gcaacatgagcttgcgactctgagg

SEQ ID NO: 672610 - DNA, 25 bp, Mus musculus
gcaacatgcatactgggaactgaag

SEQ ID NO: 672611 - DNA, 25 bp, Mus musculus
gcaacatgcatagtgggaactgaag

SEQ ID NO: 672612 - DNA, 25 bp, Mus musculus
gcaacatgcatgctttactgcaagt

SEQ ID NO: 672613 - DNA, 25 bp, Mus musculus
gcaacatgcatggtttactgcaagt

SEQ ID NO: 672614 - DNA, 25 bp, Mus musculus
gcaacatggctccttggcactgtgg

SEQ ID NO: 672615 - DNA, 25 bp, Mus musculus
gcaacatggctcgttggcactgtgg

SEQ ID NO: 672616 - DNA, 25 bp, Mus musculus
gcaacatgggcacccttttcgggcg

SEQ ID NO: 672617 - DNA, 25 bp, Mus musculus
gcaacatgggcacctatacagccta

SEQ ID NO: 672618 - DNA, 25 bp, Mus musculus
gcaacatgggcagccttttcgggcg

SEQ ID NO: 672619 - DNA, 25 bp, Mus musculus
gcaacatgggcagctatacagccta

SEQ ID NO: 672620 - DNA, 25 bp, Mus musculus
gcaacattaaggctttcagggcttt

SEQ ID NO: 672621 - DNA, 25 bp, Mus musculus
gcaacattaagggtttcagggcttt

SEQ ID NO: 672622 - DNA, 25 bp, Mus musculus
gcaacatttggtctccactttaaag

SEQ ID NO: 672623 - DNA, 25 bp, Mus musculus
gcaacatttggtgtccactttaaag

SEQ ID NO: 672624 - DNA, 25 bp, Mus musculus
gcaaccaaatgcctaataaaatctg

SEQ ID NO: 672625 - DNA, 25 bp, Mus musculus
gcaaccaaatgcgtaataaaatctg

SEQ ID NO: 672626 - DNA, 25 bp, Mus musculus
gcaaccaacttcagcagttcaaagg

SEQ ID NO: 672627 - DNA, 25 bp, Mus musculus
gcaaccaacttctgcagttcaaagg

SEQ ID NO: 672628 - DNA, 25 bp, Mus musculus
gcaaccaagaagaaggtagctgagc

SEQ ID NO: 672629 - DNA, 25 bp, Mus musculus
gcaaccaagaagtaggtagctgagc

SEQ ID NO: 672630 - DNA, 25 bp, Mus musculus
gcaaccaagagcataagaaaaagga

SEQ ID NO: 672631 - DNA, 25 bp, Mus musculus
gcaaccaagagcttaagaaaaagga

SEQ ID NO: 672632 - DNA, 25 bp, Mus musculus
gcaaccaagcacaaacctgcagtct

SEQ ID NO: 672633 - DNA, 25 bp, Mus musculus
gcaaccaagcactaacctgcagtct

SEQ ID NO: 672634 - DNA, 25 bp, Mus musculus
gcaaccaagcttattgacaatgacc

SEQ ID NO: 672635 - DNA, 25 bp, Mus musculus
gcaaccaagctttttgacaatgacc

SEQ ID NO: 672636 - DNA, 25 bp, Mus musculus
gcaaccaatattaatcacctcttga

SEQ ID NO: 672637 - DNA, 25 bp, Mus musculus
gcaaccaatatttatcacctcttga

SEQ ID NO: 672638 - DNA, 25 bp, Mus musculus
gcaaccacgttgactgggcagacag

SEQ ID NO: 672639 - DNA, 25 bp, Mus musculus
gcaaccacgttgtctgggcagacag

SEQ ID NO: 672640 - DNA, 25 bp, Mus musculus
gcaaccactccaagccttgtgacaa

SEQ ID NO: 672641 - DNA, 25 bp, Mus musculus
gcaaccactccatgccttgtgacaa

SEQ ID NO: 672642 - DNA, 25 bp, Mus musculus
gcaaccagaactagacacacctgtg

SEQ ID NO: 672643 - DNA, 25 bp, Mus musculus
gcaaccagaacttgacacacctgtg

SEQ ID NO: 672644 - DNA, 25 bp, Mus musculus
gcaaccagactgaagctagctctcc

SEQ ID NO: 672645 - DNA, 25 bp, Mus musculus
gcaaccagactgtagctagctctcc

SEQ ID NO: 672646 - DNA, 25 bp, Mus musculus
gcaaccagagataggcagccaataa

SEQ ID NO: 672647 - DNA, 25 bp, Mus musculus
gcaaccagagattggcagccaataa

SEQ ID NO: 672648 - DNA, 25 bp, Mus musculus
gcaaccagattccatgggacatgat

SEQ ID NO: 672649 - DNA, 25 bp, Mus musculus
gcaaccagattcgatgggacatgat

SEQ ID NO: 672650 - DNA, 25 bp, Mus musculus
gcaaccagcacactttatcatctca

SEQ ID NO: 672651 - DNA, 25 bp, Mus musculus
gcaaccagcacagtttatcatctca

SEQ ID NO: 672652 - DNA, 25 bp, Mus musculus
gcaaccagtcatctacagattctcg

SEQ ID NO: 672653 - DNA, 25 bp, Mus musculus
gcaaccagtcatgtacagattctcg

SEQ ID NO: 672654 - DNA, 25 bp, Mus musculus
gcaaccatatctacgtggatacggg

SEQ ID NO: 672655 - DNA, 25 bp, Mus musculus
gcaaccatatcttcgtggatacggg

SEQ ID NO: 672656 - DNA, 25 bp, Mus musculus
gcaaccatgtggatcagaagtgcat

SEQ ID NO: 672657 - DNA, 25 bp, Mus musculus
gcaaccatgtggttcagaagtgcat

SEQ ID NO: 672658 - DNA, 25 bp, Mus musculus
gcaacccaaggaaaaagaaactgtg

SEQ ID NO: 672659 - DNA, 25 bp, Mus musculus
gcaacccaaggataaagaaactgtg

SEQ ID NO: 672660 - DNA, 25 bp, Mus musculus
gcaacccagcctcagtatctggtct

SEQ ID NO: 672661 - DNA, 25 bp, Mus musculus
gcaacccagcctgagtatctggtct

SEQ ID NO: 672662 - DNA, 25 bp, Mus musculus
gcaacccagggtacactctctatag

SEQ ID NO: 672663 - DNA, 25 bp, Mus musculus
gcaacccagggttcactctctatag

SEQ ID NO: 672664 - DNA, 25 bp, Mus musculus
gcaacccatctgctctcagacgaat

SEQ ID NO: 672665 - DNA, 25 bp, Mus musculus
gcaacccatctggtctcagacgaat

SEQ ID NO: 672666 - DNA, 25 bp, Mus musculus
gcaacccatttgacttcgctagtcg

SEQ ID NO: 672667 - DNA, 25 bp, Mus musculus
gcaacccatttgtcttcgctagtcg

SEQ ID NO: 672668 - DNA, 25 bp, Mus musculus
gcaaccccaaagcagcaatgatcac

SEQ ID NO: 672669 - DNA, 25 bp, Mus musculus
gcaaccccaaaggagcaatgatcac

SEQ ID NO: 672670 - DNA, 25 bp, Mus musculus
gcaaccccacggaggaggtggacct

SEQ ID NO: 672671 - DNA, 25 bp, Mus musculus
gcaaccccacggtggaggtggacct

SEQ ID NO: 672672 - DNA, 25 bp, Mus musculus
gcaaccccatcactggaatcctgat

SEQ ID NO: 672673 - DNA, 25 bp, Mus musculus
gcaaccccatcagtggaatcctgat

SEQ ID NO: 672674 - DNA, 25 bp, Mus musculus
gcaaccccatggagtcatcactgct

SEQ ID NO: 672675 - DNA, 25 bp, Mus musculus
gcaaccccatggtgtcatcactgct

SEQ ID NO: 672676 - DNA, 25 bp, Mus musculus
gcaacccgcttacgaggcggtcttc

SEQ ID NO: 672677 - DNA, 25 bp, Mus musculus
gcaacccgcttaggaggcggtcttc

SEQ ID NO: 672678 - DNA, 25 bp, Mus musculus
gcaaccctgccaattgataccgctg

SEQ ID NO: 672679 - DNA, 25 bp, Mus musculus
gcaaccctgccatttgataccgctg

SEQ ID NO: 672680 - DNA, 25 bp, Mus musculus
gcaacccttccaaattctctgcaaa

SEQ ID NO: 672681 - DNA, 25 bp, Mus musculus
gcaacccttccatattctctgcaaa

SEQ ID NO: 672682 - DNA, 25 bp, Mus musculus
gcaaccgggaagaggtgtaccagat

SEQ ID NO: 672683 - DNA, 25 bp, Mus musculus
gcaaccgggaagtggtgtaccagat

SEQ ID NO: 672684 - DNA, 25 bp, Mus musculus
gcaaccgggagaaggcaaaacaggc

SEQ ID NO: 672685 - DNA, 25 bp, Mus musculus
gcaaccgggagatggcaaaacaggc

SEQ ID NO: 672686 - DNA, 25 bp, Mus musculus
gcaaccgtagatcatagccaaagaa

SEQ ID NO: 672687 - DNA, 25 bp, Mus musculus
gcaaccgtagatgatagccaaagaa

SEQ ID NO: 672688 - DNA, 25 bp, Mus musculus
gcaaccgtggagactctaagtcaca

SEQ ID NO: 672689 - DNA, 25 bp, Mus musculus
gcaaccgtggagtctctaagtcaca

SEQ ID NO: 672690 - DNA, 25 bp, Mus musculus
gcaacctacagcatctcaagtggaa

SEQ ID NO: 672691 - DNA, 25 bp, Mus musculus
gcaacctacagcttctcaagtggaa

SEQ ID NO: 672692 - DNA, 25 bp, Mus musculus
gcaacctatttgctaattccagcac

SEQ ID NO: 672693 - DNA, 25 bp, Mus musculus
gcaacctatttggtaattccagcac

SEQ ID NO: 672694 - DNA, 25 bp, Mus musculus
gcaacctcaacacgcagttcttgtt

SEQ ID NO: 672695 - DNA, 25 bp, Mus musculus
gcaacctcaacaggcagttcttgtt

SEQ ID NO: 672696 - DNA, 25 bp, Mus musculus
gcaacctcagaccatgatcacagag

SEQ ID NO: 672697 - DNA, 25 bp, Mus musculus
gcaacctcagacgatgatcacagag

SEQ ID NO: 672698 - DNA, 25 bp, Mus musculus
gcaacctccctcacctgaagaagct

SEQ ID NO: 672699 - DNA, 25 bp, Mus musculus
gcaacctccctctcctgaagaagct

SEQ ID NO: 672700 - DNA, 25 bp, Mus musculus
gcaacctccgcacagacaaagatcg

SEQ ID NO: 672701 - DNA, 25 bp, Mus musculus
gcaacctccgcagagacaaagatcg

SEQ ID NO: 672702 - DNA, 25 bp, Mus musculus
gcaacctcgatcaattagtggccct

SEQ ID NO: 672703 - DNA, 25 bp, Mus musculus
gcaacctcgatctattagtggccct

SEQ ID NO: 672704 - DNA, 25 bp, Mus musculus
gcaacctctaccagaccttcttgga

SEQ ID NO: 672705 - DNA, 25 bp, Mus musculus
gcaacctctacctgaccttcttgga

SEQ ID NO: 672706 - DNA, 25 bp, Mus musculus
gcaacctctttgaattgggattctc

SEQ ID NO: 672707 - DNA, 25 bp, Mus musculus
gcaacctctttgtattgggattctc

SEQ ID NO: 672708 - DNA, 25 bp, Mus musculus
gcaacctgcatgaagcagcctcagg

SEQ ID NO: 672709 - DNA, 25 bp, Mus musculus
gcaacctgcatgtagcagcctcagg

SEQ ID NO: 672710 - DNA, 25 bp, Mus musculus
gcaacctgctagagctgcggctgtg

SEQ ID NO: 672711 - DNA, 25 bp, Mus musculus
gcaacctgctagtgctgcggctgtg

SEQ ID NO: 672712 - DNA, 25 bp, Mus musculus
gcaacctgctgtacgtgagctggag

SEQ ID NO: 672713 - DNA, 25 bp, Mus musculus
gcaacctgctgttcgtgagctggag

SEQ ID NO: 672714 - DNA, 25 bp, Mus musculus
gcaacctggatgctccagagcccta

SEQ ID NO: 672715 - DNA, 25 bp, Mus musculus
gcaacctggatggtccagagcccta

SEQ ID NO: 672716 - DNA, 25 bp, Mus musculus
gcaacctggctaccgaaaagcaaca

SEQ ID NO: 672717 - DNA, 25 bp, Mus musculus
gcaacctggctagcgaaaagcaaca

SEQ ID NO: 672718 - DNA, 25 bp, Mus musculus
gcaacctgggctcgtgcattcctta

SEQ ID NO: 672719 - DNA, 25 bp, Mus musculus
gcaacctgggctggtgcattcctta

SEQ ID NO: 672720 - DNA, 25 bp, Mus musculus
gcaacctgtctgatgctcggatttt

SEQ ID NO: 672721 - DNA, 25 bp, Mus musculus
gcaacctgtctgttgctcggatttt

SEQ ID NO: 672722 - DNA, 25 bp, Mus musculus
gcaacctgtgccatgggagacagta

SEQ ID NO: 672723 - DNA, 25 bp, Mus musculus
gcaacctgtgccttgggagacagta

SEQ ID NO: 672724 - DNA, 25 bp, Mus musculus
gcaaccttcagtagcccctgggctg

SEQ ID NO: 672725 - DNA, 25 bp, Mus musculus
gcaaccttcagttgcccctgggctg

SEQ ID NO: 672726 - DNA, 25 bp, Mus musculus
gcaaccttcatcctcggcaaacaga

SEQ ID NO: 672727 - DNA, 25 bp, Mus musculus
gcaaccttcatcgtcggcaaacaga

SEQ ID NO: 672728 - DNA, 25 bp, Mus musculus
gcaaccttccgacatcttagtaagc

SEQ ID NO: 672729 - DNA, 25 bp, Mus musculus
gcaaccttccgagatcttagtaagc

SEQ ID NO: 672730 - DNA, 25 bp, Mus musculus
gcaaccttcgtaaagcctttgagga

SEQ ID NO: 672731 - DNA, 25 bp, Mus musculus
gcaaccttcgtatagcctttgagga

SEQ ID NO: 672732 - DNA, 25 bp, Mus musculus
gcaaccttgattcctgatgacctat

SEQ ID NO: 672733 - DNA, 25 bp, Mus musculus
gcaaccttgattgctgatgacctat

SEQ ID NO: 672734 - DNA, 25 bp, Mus musculus
gcaaccttggatcaacacttttctc

SEQ ID NO: 672735 - DNA, 25 bp, Mus musculus
gcaaccttggatgaacacttttctc

SEQ ID NO: 672736 - DNA, 25 bp, Mus musculus
gcaaccttggcaaatggagaccgca

SEQ ID NO: 672737 - DNA, 25 bp, Mus musculus
gcaaccttggcatatggagaccgca

SEQ ID NO: 672738 - DNA, 25 bp, Mus musculus
gcaaccttgtctcattcgttctcta

SEQ ID NO: 672739 - DNA, 25 bp, Mus musculus
gcaaccttgtctgattcgttctcta

SEQ ID NO: 672740 - DNA, 25 bp, Mus musculus
gcaacctttggaaataactcatgtc

SEQ ID NO: 672741 - DNA, 25 bp, Mus musculus
gcaacctttggatataactcatgtc

SEQ ID NO: 672742 - DNA, 25 bp, Mus musculus
gcaacgaaagcaatgcctactttct

SEQ ID NO: 672743 - DNA, 25 bp, Mus musculus
gcaacgaaagcattgcctactttct

SEQ ID NO: 672744 - DNA, 25 bp, Mus musculus
gcaacgaatagacaagaagcagaag

SEQ ID NO: 672745 - DNA, 25 bp, Mus musculus
gcaacgaatagagaagaagcagaag

SEQ ID NO: 672746 - DNA, 25 bp, Mus musculus
gcaacgacttccatgggcttgtgca

SEQ ID NO: 672747 - DNA, 25 bp, Mus musculus
gcaacgacttccttgggcttgtgca

SEQ ID NO: 672748 - DNA, 25 bp, Mus musculus
gcaacgagcgacataagccagagca

SEQ ID NO: 672749 - DNA, 25 bp, Mus musculus
gcaacgagcgacttaagccagagca

SEQ ID NO: 672750 - DNA, 25 bp, Mus musculus
gcaacgcatctgagagttcctgggc

SEQ ID NO: 672751 - DNA, 25 bp, Mus musculus
gcaacgcatctgtgagttcctgggc

SEQ ID NO: 672752 - DNA, 25 bp, Mus musculus
gcaacgcctgctatgccaatgtgaa

SEQ ID NO: 672753 - DNA, 25 bp, Mus musculus
gcaacgcctgctttgccaatgtgaa

SEQ ID NO: 672754 - DNA, 25 bp, Mus musculus
gcaacgctgcctcattggctacggg

SEQ ID NO: 672755 - DNA, 25 bp, Mus musculus
gcaacgctgcctgattggctacggg

SEQ ID NO: 672756 - DNA, 25 bp, Mus musculus
gcaacggaagcaaagcacagacttg

SEQ ID NO: 672757 - DNA, 25 bp, Mus musculus
gcaacggaagcatagcacagacttg

SEQ ID NO: 672758 - DNA, 25 bp, Mus musculus
gcaacggacgaacaaataagccagc

SEQ ID NO: 672759 - DNA, 25 bp, Mus musculus
gcaacggacgaagaaataagccagc

SEQ ID NO: 672760 - DNA, 25 bp, Mus musculus
gcaacgggaagacgtcaacaagttt

SEQ ID NO: 672761 - DNA, 25 bp, Mus musculus
gcaacgggaagaggtcaacaagttt

SEQ ID NO: 672762 - DNA, 25 bp, Mus musculus
gcaacgggcagtatacacacaaggt

SEQ ID NO: 672763 - DNA, 25 bp, Mus musculus
gcaacgggcagtttacacacaaggt

SEQ ID NO: 672764 - DNA, 25 bp, Mus musculus
gcaacggtgaaacagaatctgtgaa

SEQ ID NO: 672765 - DNA, 25 bp, Mus musculus
gcaacggtgaaagagaatctgtgaa

SEQ ID NO: 672766 - DNA, 25 bp, Mus musculus
gcaacggtggcaatgcagccagcgc

SEQ ID NO: 672767 - DNA, 25 bp, Mus musculus
gcaacggtggcattgcagccagcgc

SEQ ID NO: 672768 - DNA, 25 bp, Mus musculus
gcaacggttcacacaccatccggga

SEQ ID NO: 672769 - DNA, 25 bp, Mus musculus
gcaacggttcactcaccatccggga

SEQ ID NO: 672770 - DNA, 25 bp, Mus musculus
gcaacgtcatctcggcactggtgga

SEQ ID NO: 672771 - DNA, 25 bp, Mus musculus
gcaacgtcatctgggcactggtgga

SEQ ID NO: 672772 - DNA, 25 bp, Mus musculus
gcaacgtctcagagccagccaagct

SEQ ID NO: 672773 - DNA, 25 bp, Mus musculus
gcaacgtctcagtgccagccaagct

SEQ ID NO: 672774 - DNA, 25 bp, Mus musculus
gcaacgtggaaaacataaaccacaa

SEQ ID NO: 672775 - DNA, 25 bp, Mus musculus
gcaacgtggaaatcataaaccacaa

SEQ ID NO: 672776 - DNA, 25 bp, Mus musculus
gcaacgtgggaaagaggtctcagct

SEQ ID NO: 672777 - DNA, 25 bp, Mus musculus
gcaacgtgggaatgaggtctcagct

SEQ ID NO: 672778 - DNA, 25 bp, Mus musculus
gcaacgttgacgactgatgtcgaga

SEQ ID NO: 672779 - DNA, 25 bp, Mus musculus
gcaacgttgacgtctgatgtcgaga

SEQ ID NO: 672780 - DNA, 25 bp, Mus musculus
gcaacgtttcatactccattcagcc

SEQ ID NO: 672781 - DNA, 25 bp, Mus musculus
gcaacgtttcattctccattcagcc

SEQ ID NO: 672782 - DNA, 25 bp, Mus musculus
gcaactaagaccagtcagagcagaa

SEQ ID NO: 672783 - DNA, 25 bp, Mus musculus
gcaactaagacctgtcagagcagaa

SEQ ID NO: 672784 - DNA, 25 bp, Mus musculus
gcaactaagctgatttgtcatctag

SEQ ID NO: 672785 - DNA, 25 bp, Mus musculus
gcaactaagctgttttgtcatctag

SEQ ID NO: 672786 - DNA, 25 bp, Mus musculus
gcaactaagttaaggccaaaggcag

SEQ ID NO: 672787 - DNA, 25 bp, Mus musculus
gcaactaagttatggccaaaggcag

SEQ ID NO: 672788 - DNA, 25 bp, Mus musculus
gcaactacaagtcctttggtgacac

SEQ ID NO: 672789 - DNA, 25 bp, Mus musculus
gcaactacaagtgctttggtgacac

SEQ ID NO: 672790 - DNA, 25 bp, Mus musculus
gcaactacgactatatcctcagcac

SEQ ID NO: 672791 - DNA, 25 bp, Mus musculus
gcaactacgactttatcctcagcac

SEQ ID NO: 672792 - DNA, 25 bp, Mus musculus
gcaactatcaccaggccaccaagaa

SEQ ID NO: 672793 - DNA, 25 bp, Mus musculus
gcaactatcacctggccaccaagaa

SEQ ID NO: 672794 - DNA, 25 bp, Mus musculus
gcaactatccatagaaaaataggct

SEQ ID NO: 672795 - DNA, 25 bp, Mus musculus
gcaactatccattgaaaaataggct

SEQ ID NO: 672796 - DNA, 25 bp, Mus musculus
gcaactcaaggaatccaaatccagg

SEQ ID NO: 672797 - DNA, 25 bp, Mus musculus
gcaactcaaggacagccatggtggc

SEQ ID NO: 672798 - DNA, 25 bp, Mus musculus
gcaactcaaggagagccatggtggc

SEQ ID NO: 672799 - DNA, 25 bp, Mus musculus
gcaactcaaggattccaaatccagg

SEQ ID NO: 672800 - DNA, 25 bp, Mus musculus
gcaactcatgtaatgaagaactcct

SEQ ID NO: 672801 - DNA, 25 bp, Mus musculus
gcaactcatgtattgaagaactcct

SEQ ID NO: 672802 - DNA, 25 bp, Mus musculus
gcaactccagcaccttcatacgtag

SEQ ID NO: 672803 - DNA, 25 bp, Mus musculus
gcaactccagcagcttcatacgtag

SEQ ID NO: 672804 - DNA, 25 bp, Mus musculus
gcaactccccagcgctgacagtgag

SEQ ID NO: 672805 - DNA, 25 bp, Mus musculus
gcaactccccagggctgacagtgag

SEQ ID NO: 672806 - DNA, 25 bp, Mus musculus
gcaactccctggaatgatgaggctt

SEQ ID NO: 672807 - DNA, 25 bp, Mus musculus
gcaactccctggtatgatgaggctt

SEQ ID NO: 672808 - DNA, 25 bp, Mus musculus
gcaactcctttaagggaatcacact

SEQ ID NO: 672809 - DNA, 25 bp, Mus musculus
gcaactcctttatgggaatcacact

SEQ ID NO: 672810 - DNA, 25 bp, Mus musculus
gcaactcgcctcactttagaagaca

SEQ ID NO: 672811 - DNA, 25 bp, Mus musculus
gcaactcgcctctctttagaagaca

SEQ ID NO: 672812 - DNA, 25 bp, Mus musculus
gcaactctctaccagctagctcggg

SEQ ID NO: 672813 - DNA, 25 bp, Mus musculus
gcaactctctacgagctagctcggg

SEQ ID NO: 672814 - DNA, 25 bp, Mus musculus
gcaactctcttgctttgaggcaaaa

SEQ ID NO: 672815 - DNA, 25 bp, Mus musculus
gcaactctcttggtttgaggcaaaa

SEQ ID NO: 672816 - DNA, 25 bp, Mus musculus
gcaactctgaccaccgtatacagaa

SEQ ID NO: 672817 - DNA, 25 bp, Mus musculus
gcaactctgacctccgtatacagaa

SEQ ID NO: 672818 - DNA, 25 bp, Mus musculus
gcaactctggctacaagctagcacc

SEQ ID NO: 672819 - DNA, 25 bp, Mus musculus
gcaactctggcttcaagctagcacc

SEQ ID NO: 672820 - DNA, 25 bp, Mus musculus
gcaactctgtgactaattgactcaa

SEQ ID NO: 672821 - DNA, 25 bp, Mus musculus
gcaactctgtgagtaattgactcaa

SEQ ID NO: 672822 - DNA, 25 bp, Mus musculus
gcaactcttccgctagcgacgtgac

SEQ ID NO: 672823 - DNA, 25 bp, Mus musculus
gcaactcttccggtagcgacgtgac

SEQ ID NO: 672824 - DNA, 25 bp, Mus musculus
gcaactgaacccctgtcttctgcag

SEQ ID NO: 672825 - DNA, 25 bp, Mus musculus
gcaactgaacccgtgtcttctgcag

SEQ ID NO: 672826 - DNA, 25 bp, Mus musculus
gcaactgaatttctcccagtcagaa

SEQ ID NO: 672827 - DNA, 25 bp, Mus musculus
gcaactgaatttgtcccagtcagaa

SEQ ID NO: 672828 - DNA, 25 bp, Mus musculus
gcaactgcagcaagaatacagccgc

SEQ ID NO: 672829 - DNA, 25 bp, Mus musculus
gcaactgcagcatgaatacagccgc

SEQ ID NO: 672830 - DNA, 25 bp, Mus musculus
gcaactgcaggccatgaagcacatt

SEQ ID NO: 672831 - DNA, 25 bp, Mus musculus
gcaactgcaggcgatgaagcacatt

SEQ ID NO: 672832 - DNA, 25 bp, Mus musculus
gcaactgccattctgcgaatcaccg

SEQ ID NO: 672833 - DNA, 25 bp, Mus musculus
gcaactgccattgtgcgaatcaccg

SEQ ID NO: 672834 - DNA, 25 bp, Mus musculus
gcaactgccctgacccaagactttg

SEQ ID NO: 672835 - DNA, 25 bp, Mus musculus
gcaactgccctgtcccaagactttg

SEQ ID NO: 672836 - DNA, 25 bp, Mus musculus
gcaactgcgcaacagctgtgtggct

SEQ ID NO: 672837 - DNA, 25 bp, Mus musculus
gcaactgcgcaagagctgtgtggct

SEQ ID NO: 672838 - DNA, 25 bp, Mus musculus
gcaactgcgtcaagtcgccactaag

SEQ ID NO: 672839 - DNA, 25 bp, Mus musculus
gcaactgcgtcatgtcgccactaag

SEQ ID NO: 672840 - DNA, 25 bp, Mus musculus
gcaactgctgccatccaaatactgt

SEQ ID NO: 672841 - DNA, 25 bp, Mus musculus
gcaactgctgccttccaaatactgt

SEQ ID NO: 672842 - DNA, 25 bp, Mus musculus
gcaactggacgacacctgtgctgag

SEQ ID NO: 672843 - DNA, 25 bp, Mus musculus
gcaactggacgagacctgtgctgag

SEQ ID NO: 672844 - DNA, 25 bp, Mus musculus
gcaactggatgcatattcgttacca

SEQ ID NO: 672845 - DNA, 25 bp, Mus musculus
gcaactggatgcttattcgttacca

SEQ ID NO: 672846 - DNA, 25 bp, Mus musculus
gcaactggcagaacaggcgtcagaa

SEQ ID NO: 672847 - DNA, 25 bp, Mus musculus
gcaactggcagatcaggcgtcagaa

SEQ ID NO: 672848 - DNA, 25 bp, Mus musculus
gcaactgggaacctggtatttgcca

SEQ ID NO: 672849 - DNA, 25 bp, Mus musculus
gcaactgggaacgtggtatttgcca

SEQ ID NO: 672850 - DNA, 25 bp, Mus musculus
gcaactgggctaagtgttggccacg

SEQ ID NO: 672851 - DNA, 25 bp, Mus musculus
gcaactgggctatgtgttggccacg

SEQ ID NO: 672852 - DNA, 25 bp, Mus musculus
gcaactgtaatgactcgaaactgga

SEQ ID NO: 672853 - DNA, 25 bp, Mus musculus
gcaactgtaatgtctcgaaactgga

SEQ ID NO: 672854 - DNA, 25 bp, Mus musculus
gcaactgtgaaaagatgtcgctgtc

SEQ ID NO: 672855 - DNA, 25 bp, Mus musculus
gcaactgtgaaacgtcctcaggaga

SEQ ID NO: 672856 - DNA, 25 bp, Mus musculus
gcaactgtgaaaggtcctcaggaga

SEQ ID NO: 672857 - DNA, 25 bp, Mus musculus
gcaactgtgaaatgatgtcgctgtc

SEQ ID NO: 672858 - DNA, 25 bp, Mus musculus
gcaactgtgaagagagtaaatatct

SEQ ID NO: 672859 - DNA, 25 bp, Mus musculus
gcaactgtgaagtgagtaaatatct

SEQ ID NO: 672860 - DNA, 25 bp, Mus musculus
gcaactgtgatgcagatctgaacga

SEQ ID NO: 672861 - DNA, 25 bp, Mus musculus
gcaactgtgatggagatctgaacga

SEQ ID NO: 672862 - DNA, 25 bp, Mus musculus
gcaactgtgcatatcctcagatgga

SEQ ID NO: 672863 - DNA, 25 bp, Mus musculus
gcaactgtgcatttcctcagatgga

SEQ ID NO: 672864 - DNA, 25 bp, Mus musculus
gcaactgtgcggatgtgaacgaaaa

SEQ ID NO: 672865 - DNA, 25 bp, Mus musculus
gcaactgtgcggttgtgaacgaaaa

SEQ ID NO: 672866 - DNA, 25 bp, Mus musculus
gcaactgttggaatgattcgaaacc

SEQ ID NO: 672867 - DNA, 25 bp, Mus musculus
gcaactgttggattgattcgaaacc

SEQ ID NO: 672868 - DNA, 25 bp, Mus musculus
gcaactgttttgatactgaatatcg

SEQ ID NO: 672869 - DNA, 25 bp, Mus musculus
gcaactgttttgttactgaatatcg

SEQ ID NO: 672870 - DNA, 25 bp, Mus musculus
gcaacttagatcacctgcagagtaa

SEQ ID NO: 672871 - DNA, 25 bp, Mus musculus
gcaacttagatctcctgcagagtaa

SEQ ID NO: 672872 - DNA, 25 bp, Mus musculus
gcaacttagttacagctgaccaagg

SEQ ID NO: 672873 - DNA, 25 bp, Mus musculus
gcaacttagttagagctgaccaagg

SEQ ID NO: 672874 - DNA, 25 bp, Mus musculus
gcaacttatatgacttccccaaggt

SEQ ID NO: 672875 - DNA, 25 bp, Mus musculus
gcaacttatatgtcttccccaaggt

SEQ ID NO: 672876 - DNA, 25 bp, Mus musculus
gcaacttcagttctatgaagtacag

SEQ ID NO: 672877 - DNA, 25 bp, Mus musculus
gcaacttcagttgtatgaagtacag

SEQ ID NO: 672878 - DNA, 25 bp, Mus musculus
gcaacttcggaaacttcatgccagt

SEQ ID NO: 672879 - DNA, 25 bp, Mus musculus
gcaacttcggaatcttcatgccagt

SEQ ID NO: 672880 - DNA, 25 bp, Mus musculus
gcaacttcgggcacccggcgctatg

SEQ ID NO: 672881 - DNA, 25 bp, Mus musculus
gcaacttcgggctcccggcgctatg

SEQ ID NO: 672882 - DNA, 25 bp, Mus musculus
gcaacttctgctaaaagaatggcaa

SEQ ID NO: 672883 - DNA, 25 bp, Mus musculus
gcaacttctgcttaaagaatggcaa

SEQ ID NO: 672884 - DNA, 25 bp, Mus musculus
gcaacttgctagaagaatttagaag

SEQ ID NO: 672885 - DNA, 25 bp, Mus musculus
gcaacttgctagtagaatttagaag

SEQ ID NO: 672886 - DNA, 25 bp, Mus musculus
gcaacttggagtcccagtgaatgat

SEQ ID NO: 672887 - DNA, 25 bp, Mus musculus
gcaacttggagtgccagtgaatgat

SEQ ID NO: 672888 - DNA, 25 bp, Mus musculus
gcaacttggtcaatcggccctacac

SEQ ID NO: 672889 - DNA, 25 bp, Mus musculus
gcaacttggtcattcggccctacac

SEQ ID NO: 672890 - DNA, 25 bp, Mus musculus
gcaacttggtctaggctacgccaac

SEQ ID NO: 672891 - DNA, 25 bp, Mus musculus
gcaacttggtcttggctacgccaac

SEQ ID NO: 672892 - DNA, 25 bp, Mus musculus
gcaactttagggacattgaggtggc

SEQ ID NO: 672893 - DNA, 25 bp, Mus musculus
gcaactttagggtcattgaggtggc

SEQ ID NO: 672894 - DNA, 25 bp, Mus musculus
gcaactttcggcagctgcaggagaa

SEQ ID NO: 672895 - DNA, 25 bp, Mus musculus
gcaactttcggccaagactagcaag

SEQ ID NO: 672896 - DNA, 25 bp, Mus musculus
gcaactttcggcgaagactagcaag

SEQ ID NO: 672897 - DNA, 25 bp, Mus musculus
gcaactttcggctgctgcaggagaa

SEQ ID NO: 672898 - DNA, 25 bp, Mus musculus
gcaagaaaagacacaagcactcagt

SEQ ID NO: 672899 - DNA, 25 bp, Mus musculus
gcaagaaaagactcaagcactcagt

SEQ ID NO: 672900 - DNA, 25 bp, Mus musculus
gcaagaaaccatcactgtaacgctc

SEQ ID NO: 672901 - DNA, 25 bp, Mus musculus
gcaagaaaccatgactgtaacgctc

SEQ ID NO: 672902 - DNA, 25 bp, Mus musculus
gcaagaaactacattcagtctctgg

SEQ ID NO: 672903 - DNA, 25 bp, Mus musculus
gcaagaaactactttcagtctctgg

SEQ ID NO: 672904 - DNA, 25 bp, Mus musculus
gcaagaaagaatccgccatctgagt

SEQ ID NO: 672905 - DNA, 25 bp, Mus musculus
gcaagaaagaatgcgccatctgagt

SEQ ID NO: 672906 - DNA, 25 bp, Mus musculus
gcaagaaagagacacctccccttcc

SEQ ID NO: 672907 - DNA, 25 bp, Mus musculus
gcaagaaagagacctgtacagctct

SEQ ID NO: 672908 - DNA, 25 bp, Mus musculus
gcaagaaagagagacctccccttcc

SEQ ID NO: 672909 - DNA, 25 bp, Mus musculus
gcaagaaagagagctgtacagctct

SEQ ID NO: 672910 - DNA, 25 bp, Mus musculus
gcaagaaagtatcccagcagtatgc

SEQ ID NO: 672911 - DNA, 25 bp, Mus musculus
gcaagaaagtatgccagcagtatgc

SEQ ID NO: 672912 - DNA, 25 bp, Mus musculus
gcaagaacatcaaggcagggccaca

SEQ ID NO: 672913 - DNA, 25 bp, Mus musculus
gcaagaacatcatggcagggccaca

SEQ ID NO: 672914 - DNA, 25 bp, Mus musculus
gcaagaacctgcagctgcagcacgg

SEQ ID NO: 672915 - DNA, 25 bp, Mus musculus
gcaagaacctgctgctgcagcacgg

SEQ ID NO: 672916 - DNA, 25 bp, Mus musculus
gcaagaactctgagccccaggtgca

SEQ ID NO: 672917 - DNA, 25 bp, Mus musculus
gcaagaactctgtgccccaggtgca

SEQ ID NO: 672918 - DNA, 25 bp, Mus musculus
gcaagaactggcacattgtcgagaa

SEQ ID NO: 672919 - DNA, 25 bp, Mus musculus
gcaagaactggctcattgtcgagaa

SEQ ID NO: 672920 - DNA, 25 bp, Mus musculus
gcaagaacttgtagctcccacaggg

SEQ ID NO: 672921 - DNA, 25 bp, Mus musculus
gcaagaacttgttgctcccacaggg

SEQ ID NO: 672922 - DNA, 25 bp, Mus musculus
gcaagaagaaatacctggccgcagc

SEQ ID NO: 672923 - DNA, 25 bp, Mus musculus
gcaagaagaaattcctggccgcagc

SEQ ID NO: 672924 - DNA, 25 bp, Mus musculus
gcaagaagacataaggaagaaaaag

SEQ ID NO: 672925 - DNA, 25 bp, Mus musculus
gcaagaagacatcccggcatccctt

SEQ ID NO: 672926 - DNA, 25 bp, Mus musculus
gcaagaagacatgccggcatccctt

SEQ ID NO: 672927 - DNA, 25 bp, Mus musculus
gcaagaagacattaggaagaaaaag

SEQ ID NO: 672928 - DNA, 25 bp, Mus musculus
gcaagaagactacgatcgcctgcgg

SEQ ID NO: 672929 - DNA, 25 bp, Mus musculus
gcaagaagactaggatcgcctgcgg

SEQ ID NO: 672930 - DNA, 25 bp, Mus musculus
gcaagaaggccgagctctctgacat

SEQ ID NO: 672931 - DNA, 25 bp, Mus musculus
gcaagaaggccgtgctctctgacat

SEQ ID NO: 672932 - DNA, 25 bp, Mus musculus
gcaagaagtaccacaccatgctggg

SEQ ID NO: 672933 - DNA, 25 bp, Mus musculus
gcaagaagtacctcaccatgctggg

SEQ ID NO: 672934 - DNA, 25 bp, Mus musculus
gcaagaagtgtcagtgtgacgagct

SEQ ID NO: 672935 - DNA, 25 bp, Mus musculus
gcaagaagtgtctgtgtgacgagct

SEQ ID NO: 672936 - DNA, 25 bp, Mus musculus
gcaagaagttctccgccagccgctt

SEQ ID NO: 672937 - DNA, 25 bp, Mus musculus
gcaagaagttctgcgccagccgctt

SEQ ID NO: 672938 - DNA, 25 bp, Mus musculus
gcaagaatccctaaacaaatggaag

SEQ ID NO: 672939 - DNA, 25 bp, Mus musculus
gcaagaatcccttaacaaatggaag

SEQ ID NO: 672940 - DNA, 25 bp, Mus musculus
gcaagaatgcttctggctccgacta

SEQ ID NO: 672941 - DNA, 25 bp, Mus musculus
gcaagaatgcttgtggctccgacta

SEQ ID NO: 672942 - DNA, 25 bp, Mus musculus
gcaagaatgtgcagatcaacaagga

SEQ ID NO: 672943 - DNA, 25 bp, Mus musculus
gcaagaatgtgctgatcaacaagga

SEQ ID NO: 672944 - DNA, 25 bp, Mus musculus
gcaagaattcagagacccgtcgttg

SEQ ID NO: 672945 - DNA, 25 bp, Mus musculus
gcaagaattcagtgacccgtcgttg

SEQ ID NO: 672946 - DNA, 25 bp, Mus musculus
gcaagaattcgtatattaaccaaca

SEQ ID NO: 672947 - DNA, 25 bp, Mus musculus
gcaagaattcgtttattaaccaaca

SEQ ID NO: 672948 - DNA, 25 bp, Mus musculus
gcaagacaagttcgaaacactggag

SEQ ID NO: 672949 - DNA, 25 bp, Mus musculus
gcaagacaagttggaaacactggag

SEQ ID NO: 672950 - DNA, 25 bp, Mus musculus
gcaagacagaaaatagacaaatgct

SEQ ID NO: 672951 - DNA, 25 bp, Mus musculus
gcaagacagaaattagacaaatgct

SEQ ID NO: 672952 - DNA, 25 bp, Mus musculus
gcaagacagcgactggatccgctct

SEQ ID NO: 672953 - DNA, 25 bp, Mus musculus
gcaagacagcgagtggatccgctct

SEQ ID NO: 672954 - DNA, 25 bp, Mus musculus
gcaagacagtcaacatcacccaaga

SEQ ID NO: 672955 - DNA, 25 bp, Mus musculus
gcaagacagtcatcatcacccaaga

SEQ ID NO: 672956 - DNA, 25 bp, Mus musculus
gcaagacataagcaatggcgacccc

SEQ ID NO: 672957 - DNA, 25 bp, Mus musculus
gcaagacataaggaatggcgacccc

SEQ ID NO: 672958 - DNA, 25 bp, Mus musculus
gcaagacattgtcctgagtggacac

SEQ ID NO: 672959 - DNA, 25 bp, Mus musculus
gcaagacattgtgctgagtggacac

SEQ ID NO: 672960 - DNA, 25 bp, Mus musculus
gcaagaccaatcagctgtcccggtt

SEQ ID NO: 672961 - DNA, 25 bp, Mus musculus
gcaagaccaatctgctgtcccggtt

SEQ ID NO: 672962 - DNA, 25 bp, Mus musculus
gcaagaccggaaactcacttggacg

SEQ ID NO: 672963 - DNA, 25 bp, Mus musculus
gcaagaccggaatctcacttggacg

SEQ ID NO: 672964 - DNA, 25 bp, Mus musculus
gcaagacctactcttctagagcaag

SEQ ID NO: 672965 - DNA, 25 bp, Mus musculus
gcaagacctactgttctagagcaag

SEQ ID NO: 672966 - DNA, 25 bp, Mus musculus
gcaagacctcccagctgcgggtgct

SEQ ID NO: 672967 - DNA, 25 bp, Mus musculus
gcaagacctccctgctgcgggtgct

SEQ ID NO: 672968 - DNA, 25 bp, Mus musculus
gcaagacggatgcaaagatcgttca

SEQ ID NO: 672969 - DNA, 25 bp, Mus musculus
gcaagacggatggaaagatcgttca

SEQ ID NO: 672970 - DNA, 25 bp, Mus musculus
gcaagacggcgacgcgagacctctt

SEQ ID NO: 672971 - DNA, 25 bp, Mus musculus
gcaagacggcgaggcgagacctctt

SEQ ID NO: 672972 - DNA, 25 bp, Mus musculus
gcaagacgtcggacaaaaaagctgg

SEQ ID NO: 672973 - DNA, 25 bp, Mus musculus
gcaagacgtcggtcaaaaaagctgg

SEQ ID NO: 672974 - DNA, 25 bp, Mus musculus
gcaagactccagagcccgggagaaa

SEQ ID NO: 672975 - DNA, 25 bp, Mus musculus
gcaagactccagtgcccgggagaaa

SEQ ID NO: 672976 - DNA, 25 bp, Mus musculus
gcaagactcctgacacatcacaaca

SEQ ID NO: 672977 - DNA, 25 bp, Mus musculus
gcaagactcctgtcacatcacaaca

SEQ ID NO: 672978 - DNA, 25 bp, Mus musculus
gcaagactctacacatcacatgtgg

SEQ ID NO: 672979 - DNA, 25 bp, Mus musculus
gcaagactctactcatcacatgtgg

SEQ ID NO: 672980 - DNA, 25 bp, Mus musculus
gcaagactctcaatgccagtgacgt

SEQ ID NO: 672981 - DNA, 25 bp, Mus musculus
gcaagactctcattgccagtgacgt

SEQ ID NO: 672982 - DNA, 25 bp, Mus musculus
gcaagacttgtcagcagggaggccc

SEQ ID NO: 672983 - DNA, 25 bp, Mus musculus
gcaagacttgtctgcagggaggccc

SEQ ID NO: 672984 - DNA, 25 bp, Mus musculus
gcaagagaaactacagaattttgca

SEQ ID NO: 672985 - DNA, 25 bp, Mus musculus
gcaagagaaacttcagaattttgca

SEQ ID NO: 672986 - DNA, 25 bp, Mus musculus
gcaagagaacagacatgctaccagt

SEQ ID NO: 672987 - DNA, 25 bp, Mus musculus
gcaagagaacagtcatgctaccagt

SEQ ID NO: 672988 - DNA, 25 bp, Mus musculus
gcaagagaagatatagaacgagtag

SEQ ID NO: 672989 - DNA, 25 bp, Mus musculus
gcaagagaagatttagaacgagtag

SEQ ID NO: 672990 - DNA, 25 bp, Mus musculus
gcaagagaaggcaatgtgcccaata

SEQ ID NO: 672991 - DNA, 25 bp, Mus musculus
gcaagagaaggctatgtgcccaata

SEQ ID NO: 672992 - DNA, 25 bp, Mus musculus
gcaagagaagtaagtacaatctgaa

SEQ ID NO: 672993 - DNA, 25 bp, Mus musculus
gcaagagaagtatgtacaatctgaa

SEQ ID NO: 672994 - DNA, 25 bp, Mus musculus
gcaagagaatttagacgtgaaaaag

SEQ ID NO: 672995 - DNA, 25 bp, Mus musculus
gcaagagaattttgacgtgaaaaag

SEQ ID NO: 672996 - DNA, 25 bp, Mus musculus
gcaagagagagaacctttcttctct

SEQ ID NO: 672997 - DNA, 25 bp, Mus musculus
gcaagagagagatcctttcttctct

SEQ ID NO: 672998 - DNA, 25 bp, Mus musculus
gcaagagagccaattctacttcggt

SEQ ID NO: 672999 - DNA, 25 bp, Mus musculus
gcaagagagccatttctacttcggt

SEQ ID NO: 673000 - DNA, 25 bp, Mus musculus
gcaagagagctacacttcatgaaag

SEQ ID NO: 673001 - DNA, 25 bp, Mus musculus
gcaagagagctagacttcatgaaag

SEQ ID NO: 673002 - DNA, 25 bp, Mus musculus
gcaagagagctgaaccatcccagta

SEQ ID NO: 673003 - DNA, 25 bp, Mus musculus
gcaagagagctgtaccatcccagta

SEQ ID NO: 673004 - DNA, 25 bp, Mus musculus
gcaagagaggttaccgaagactaaa

SEQ ID NO: 673005 - DNA, 25 bp, Mus musculus
gcaagagaggtttccgaagactaaa

SEQ ID NO: 673006 - DNA, 25 bp, Mus musculus
gcaagagcaaaaaccgtccctagcc

SEQ ID NO: 673007 - DNA, 25 bp, Mus musculus
gcaagagcaaaatccgtccctagcc

SEQ ID NO: 673008 - DNA, 25 bp, Mus musculus
gcaagagccagtccctgactgaggc

SEQ ID NO: 673009 - DNA, 25 bp, Mus musculus
gcaagagccagtgcctgactgaggc

SEQ ID NO: 673010 - DNA, 25 bp, Mus musculus
gcaagagctgccctccaagtacctt

SEQ ID NO: 673011 - DNA, 25 bp, Mus musculus
gcaagagctgccgtccaagtacctt

SEQ ID NO: 673012 - DNA, 25 bp, Mus musculus
gcaagagctgctccctcgctatgaa

SEQ ID NO: 673013 - DNA, 25 bp, Mus musculus
gcaagagctgctgcctcgctatgaa

SEQ ID NO: 673014 - DNA, 25 bp, Mus musculus
gcaagaggagccagtcaacatccct

SEQ ID NO: 673015 - DNA, 25 bp, Mus musculus
gcaagaggagcctgtcaacatccct

SEQ ID NO: 673016 - DNA, 25 bp, Mus musculus
gcaagaggatgtagaggaccattat

SEQ ID NO: 673017 - DNA, 25 bp, Mus musculus
gcaagaggatgttgaggaccattat

SEQ ID NO: 673018 - DNA, 25 bp, Mus musculus
gcaagaggcggacttgtcctcgctt

SEQ ID NO: 673019 - DNA, 25 bp, Mus musculus
gcaagaggcggagttgtcctcgctt

SEQ ID NO: 673020 - DNA, 25 bp, Mus musculus
gcaagaggcttactctgtcacctgt

SEQ ID NO: 673021 - DNA, 25 bp, Mus musculus
gcaagaggcttagtctgtcacctgt

SEQ ID NO: 673022 - DNA, 25 bp, Mus musculus
gcaagaggctttagcagctgctcgt

SEQ ID NO: 673023 - DNA, 25 bp, Mus musculus
gcaagaggcttttgcagctgctcgt

SEQ ID NO: 673024 - DNA, 25 bp, Mus musculus
gcaagagggtgaatcagaaggccct

SEQ ID NO: 673025 - DNA, 25 bp, Mus musculus
gcaagagggtgattcagaaggccct

SEQ ID NO: 673026 - DNA, 25 bp, Mus musculus
gcaagagggttgaactactcggcct

SEQ ID NO: 673027 - DNA, 25 bp, Mus musculus
gcaagagggttgtactactcggcct

SEQ ID NO: 673028 - DNA, 25 bp, Mus musculus
gcaagaggtaccatatttacctcag

SEQ ID NO: 673029 - DNA, 25 bp, Mus musculus
gcaagaggtaccttatttacctcag

SEQ ID NO: 673030 - DNA, 25 bp, Mus musculus
gcaagaggttgtactgagcctgttg

SEQ ID NO: 673031 - DNA, 25 bp, Mus musculus
gcaagaggttgttctgagcctgttg

SEQ ID NO: 673032 - DNA, 25 bp, Mus musculus
gcaagagtcagccaccctctgggct

SEQ ID NO: 673033 - DNA, 25 bp, Mus musculus
gcaagagtcagcgaccctctgggct

SEQ ID NO: 673034 - DNA, 25 bp, Mus musculus
gcaagagttgtgagtacaaccacct

SEQ ID NO: 673035 - DNA, 25 bp, Mus musculus
gcaagagttgtgtgtacaaccacct

SEQ ID NO: 673036 - DNA, 25 bp, Mus musculus
gcaagagtttgcaagccagaatcct

SEQ ID NO: 673037 - DNA, 25 bp, Mus musculus
gcaagagtttgctagccagaatcct

SEQ ID NO: 673038 - DNA, 25 bp, Mus musculus
gcaagataaacaccggaaaatctac

SEQ ID NO: 673039 - DNA, 25 bp, Mus musculus
gcaagataaacagcggaaaatctac

SEQ ID NO: 673040 - DNA, 25 bp, Mus musculus
gcaagatataaaagggcagtcagag

SEQ ID NO: 673041 - DNA, 25 bp, Mus musculus
gcaagatataaatgggcagtcagag

SEQ ID NO: 673042 - DNA, 25 bp, Mus musculus
gcaagatatgtgaattacatcaaaa

SEQ ID NO: 673043 - DNA, 25 bp, Mus musculus
gcaagatatgtgtattacatcaaaa

SEQ ID NO: 673044 - DNA, 25 bp, Mus musculus
gcaagatcaaggaccggtacctgct

SEQ ID NO: 673045 - DNA, 25 bp, Mus musculus
gcaagatcaaggtccggtacctgct

SEQ ID NO: 673046 - DNA, 25 bp, Mus musculus
gcaagatcacttcactggacactag

SEQ ID NO: 673047 - DNA, 25 bp, Mus musculus
gcaagatcacttgactggacactag

SEQ ID NO: 673048 - DNA, 25 bp, Mus musculus
gcaagatcagcgagatccggcagat

SEQ ID NO: 673049 - DNA, 25 bp, Mus musculus
gcaagatcagcgtgatccggcagat

SEQ ID NO: 673050 - DNA, 25 bp, Mus musculus
gcaagatcagggaccagtacctcgt

SEQ ID NO: 673051 - DNA, 25 bp, Mus musculus
gcaagatcagggtccagtacctcgt

SEQ ID NO: 673052 - DNA, 25 bp, Mus musculus
gcaagatcatcaagcacgacccctt

SEQ ID NO: 673053 - DNA, 25 bp, Mus musculus
gcaagatcatcatgcacgacccctt

SEQ ID NO: 673054 - DNA, 25 bp, Mus musculus
gcaagatccaagcagagtacacgct

SEQ ID NO: 673055 - DNA, 25 bp, Mus musculus
gcaagatccaaggagagtacacgct

SEQ ID NO: 673056 - DNA, 25 bp, Mus musculus
gcaagatcgactatgtgctgtctgt

SEQ ID NO: 673057 - DNA, 25 bp, Mus musculus
gcaagatcgactttgtgctgtctgt

SEQ ID NO: 673058 - DNA, 25 bp, Mus musculus
gcaagatctgcaagcactacccctg

SEQ ID NO: 673059 - DNA, 25 bp, Mus musculus
gcaagatctgcatgcactacccctg

SEQ ID NO: 673060 - DNA, 25 bp, Mus musculus
gcaagatctggacagagagctttat

SEQ ID NO: 673061 - DNA, 25 bp, Mus musculus
gcaagatctggagagagagctttat

SEQ ID NO: 673062 - DNA, 25 bp, Mus musculus
gcaagatcttgacctaccaatatgg

SEQ ID NO: 673063 - DNA, 25 bp, Mus musculus
gcaagatcttgagctaccaatatgg

SEQ ID NO: 673064 - DNA, 25 bp, Mus musculus
gcaagatgacctcccacaagaaatg

SEQ ID NO: 673065 - DNA, 25 bp, Mus musculus
gcaagatgacctgccacaagaaatg

SEQ ID NO: 673066 - DNA, 25 bp, Mus musculus
gcaagatgatcgagacccagctgtc

SEQ ID NO: 673067 - DNA, 25 bp, Mus musculus
gcaagatgatcgtgacccagctgtc

SEQ ID NO: 673068 - DNA, 25 bp, Mus musculus
gcaagatgcaaacgcgcaaggcgac

SEQ ID NO: 673069 - DNA, 25 bp, Mus musculus
gcaagatgcaaaggcgcaaggcgac

SEQ ID NO: 673070 - DNA, 25 bp, Mus musculus
gcaagatgccctacagggccggctg

SEQ ID NO: 673071 - DNA, 25 bp, Mus musculus
gcaagatgcccttcagggccggctg

SEQ ID NO: 673072 - DNA, 25 bp, Mus musculus
gcaagatgccttatggtcagctgat

SEQ ID NO: 673073 - DNA, 25 bp, Mus musculus
gcaagatgccttttggtcagctgat

SEQ ID NO: 673074 - DNA, 25 bp, Mus musculus
gcaagatgctgcacaaatgccaggc

SEQ ID NO: 673075 - DNA, 25 bp, Mus musculus
gcaagatgctgctcaaatgccaggc

SEQ ID NO: 673076 - DNA, 25 bp, Mus musculus
gcaagatggaaacgatggacagctc

SEQ ID NO: 673077 - DNA, 25 bp, Mus musculus
gcaagatggaaaggatggacagctc

SEQ ID NO: 673078 - DNA, 25 bp, Mus musculus
gcaagatggattccgtacacatgac

SEQ ID NO: 673079 - DNA, 25 bp, Mus musculus
gcaagatggattgcgtacacatgac

SEQ ID NO: 673080 - DNA, 25 bp, Mus musculus
gcaagatgggaaccttggactccaa

SEQ ID NO: 673081 - DNA, 25 bp, Mus musculus
gcaagatgggaagcttggactccaa

SEQ ID NO: 673082 - DNA, 25 bp, Mus musculus
gcaagatgggagaatcttcattggc

SEQ ID NO: 673083 - DNA, 25 bp, Mus musculus
gcaagatgggagtatcttcattggc

SEQ ID NO: 673084 - DNA, 25 bp, Mus musculus
gcaagatgtacaccaagagcagcca

SEQ ID NO: 673085 - DNA, 25 bp, Mus musculus
gcaagatgtacagcaagagcagcca

SEQ ID NO: 673086 - DNA, 25 bp, Mus musculus
gcaagatgtcagaactatccaccat

SEQ ID NO: 673087 - DNA, 25 bp, Mus musculus
gcaagatgtcagtactatccaccat

SEQ ID NO: 673088 - DNA, 25 bp, Mus musculus
gcaagatgtcgacatggcaatttta

SEQ ID NO: 673089 - DNA, 25 bp, Mus musculus
gcaagatgtcgagatggcaatttta

SEQ ID NO: 673090 - DNA, 25 bp, Mus musculus
gcaagattgagtatccaatgcccaa

SEQ ID NO: 673091 - DNA, 25 bp, Mus musculus
gcaagattgagtttccaatgcccaa

SEQ ID NO: 673092 - DNA, 25 bp, Mus musculus
gcaagattgcaacggtccctcggct

SEQ ID NO: 673093 - DNA, 25 bp, Mus musculus
gcaagattgcaagggtccctcggct

SEQ ID NO: 673094 - DNA, 25 bp, Mus musculus
gcaagattgcctctctctccagaag

SEQ ID NO: 673095 - DNA, 25 bp, Mus musculus
gcaagattgcctgtctctccagaag

SEQ ID NO: 673096 - DNA, 25 bp, Mus musculus
gcaagattgtcgcaaattttgcact

SEQ ID NO: 673097 - DNA, 25 bp, Mus musculus
gcaagattgtcggaaattttgcact

SEQ ID NO: 673098 - DNA, 25 bp, Mus musculus
gcaagatttggcaccaaacattttt

SEQ ID NO: 673099 - DNA, 25 bp, Mus musculus
gcaagatttggctccaaacattttt

SEQ ID NO: 673100 - DNA, 25 bp, Mus musculus
gcaagcaaagaaccttttccctaat

SEQ ID NO: 673101 - DNA, 25 bp, Mus musculus
gcaagcaaagaagcttttccctaat

SEQ ID NO: 673102 - DNA, 25 bp, Mus musculus
gcaagcaagacgcatggaaagatcg

SEQ ID NO: 673103 - DNA, 25 bp, Mus musculus
gcaagcaagacggatggaaagatcg

SEQ ID NO: 673104 - DNA, 25 bp, Mus musculus
gcaagcaagcacatttgtattgagt

SEQ ID NO: 673105 - DNA, 25 bp, Mus musculus
gcaagcaagcacttttgtattgagt

SEQ ID NO: 673106 - DNA, 25 bp, Mus musculus
gcaagcaagcagagagcgctggcct

SEQ ID NO: 673107 - DNA, 25 bp, Mus musculus
gcaagcaagcagtgagcgctggcct

SEQ ID NO: 673108 - DNA, 25 bp, Mus musculus
gcaagcaagcggaataaatacaaag

SEQ ID NO: 673109 - DNA, 25 bp, Mus musculus
gcaagcaagcggacaggatcaataa

SEQ ID NO: 673110 - DNA, 25 bp, Mus musculus
gcaagcaagcggtataaatacaaag

SEQ ID NO: 673111 - DNA, 25 bp, Mus musculus
gcaagcaagcggtcaggatcaataa

SEQ ID NO: 673112 - DNA, 25 bp, Mus musculus
gcaagcaagctcatggagaggccat

SEQ ID NO: 673113 - DNA, 25 bp, Mus musculus
gcaagcaagctcttggagaggccat

SEQ ID NO: 673114 - DNA, 25 bp, Mus musculus
gcaagcaaggagagcattgatgccc

SEQ ID NO: 673115 - DNA, 25 bp, Mus musculus
gcaagcaaggagtgcattgatgccc

SEQ ID NO: 673116 - DNA, 25 bp, Mus musculus
gcaagcacacagacgtggcatataa

SEQ ID NO: 673117 - DNA, 25 bp, Mus musculus
gcaagcacacagtcgtggcatataa

SEQ ID NO: 673118 - DNA, 25 bp, Mus musculus
gcaagcacattaagaagccgatccg

SEQ ID NO: 673119 - DNA, 25 bp, Mus musculus
gcaagcacattatgaagccgatccg

SEQ ID NO: 673120 - DNA, 25 bp, Mus musculus
gcaagcacctacagaaaaaggcaaa

SEQ ID NO: 673121 - DNA, 25 bp, Mus musculus
gcaagcacctactgaaaaaggcaaa

SEQ ID NO: 673122 - DNA, 25 bp, Mus musculus
gcaagcacggcaagcaaaagactga

SEQ ID NO: 673123 - DNA, 25 bp, Mus musculus
gcaagcacggcatgcaaaagactga

SEQ ID NO: 673124 - DNA, 25 bp, Mus musculus
gcaagcactaggctccagagcctgt

SEQ ID NO: 673125 - DNA, 25 bp, Mus musculus
gcaagcactagggtccagagcctgt

SEQ ID NO: 673126 - DNA, 25 bp, Mus musculus
gcaagcacttcaaccaggccatctg

SEQ ID NO: 673127 - DNA, 25 bp, Mus musculus
gcaagcacttcatccaggccatctg

SEQ ID NO: 673128 - DNA, 25 bp, Mus musculus
gcaagcagaatcatttaacatgcct

SEQ ID NO: 673129 - DNA, 25 bp, Mus musculus
gcaagcagaatcttttaacatgcct

SEQ ID NO: 673130 - DNA, 25 bp, Mus musculus
gcaagcagacagacgccaggtattt

SEQ ID NO: 673131 - DNA, 25 bp, Mus musculus
gcaagcagacagtcgccaggtattt

SEQ ID NO: 673132 - DNA, 25 bp, Mus musculus
gcaagcagagtcacttgcagcagct

SEQ ID NO: 673133 - DNA, 25 bp, Mus musculus
gcaagcagagtctcttgcagcagct

SEQ ID NO: 673134 - DNA, 25 bp, Mus musculus
gcaagcagcaatccaatgagcacct

SEQ ID NO: 673135 - DNA, 25 bp, Mus musculus
gcaagcagcaatgcaatgagcacct

SEQ ID NO: 673136 - DNA, 25 bp, Mus musculus
gcaagcagtattccactgagcagaa

SEQ ID NO: 673137 - DNA, 25 bp, Mus musculus
gcaagcagtattgcactgagcagaa

SEQ ID NO: 673138 - DNA, 25 bp, Mus musculus
gcaagcatgcttatggctgtgcact

SEQ ID NO: 673139 - DNA, 25 bp, Mus musculus
gcaagcatgcttttggctgtgcact

SEQ ID NO: 673140 - DNA, 25 bp, Mus musculus
gcaagcattctcctaaaagagctgg

SEQ ID NO: 673141 - DNA, 25 bp, Mus musculus
gcaagcattctcgtaaaagagctgg

SEQ ID NO: 673142 - DNA, 25 bp, Mus musculus
gcaagcattgttcgccaagaaggaa

SEQ ID NO: 673143 - DNA, 25 bp, Mus musculus
gcaagcattgttggccaagaaggaa

SEQ ID NO: 673144 - DNA, 25 bp, Mus musculus
gcaagccactttattgtgtgccccg

SEQ ID NO: 673145 - DNA, 25 bp, Mus musculus
gcaagccacttttttgtgtgccccg

SEQ ID NO: 673146 - DNA, 25 bp, Mus musculus
gcaagccagcccagagaggacgctg

SEQ ID NO: 673147 - DNA, 25 bp, Mus musculus
gcaagccagccctgagaggacgctg

SEQ ID NO: 673148 - DNA, 25 bp, Mus musculus
gcaagccagtaacctttgtggatgg

SEQ ID NO: 673149 - DNA, 25 bp, Mus musculus
gcaagccagtaagctttgtggatgg

SEQ ID NO: 673150 - DNA, 25 bp, Mus musculus
gcaagccccagcctctgtattagga

SEQ ID NO: 673151 - DNA, 25 bp, Mus musculus
gcaagccccagcgtctgtattagga

SEQ ID NO: 673152 - DNA, 25 bp, Mus musculus
gcaagccccgctactgagtgcgctg

SEQ ID NO: 673153 - DNA, 25 bp, Mus musculus
gcaagccccgcttctgagtgcgctg

SEQ ID NO: 673154 - DNA, 25 bp, Mus musculus
gcaagcccctgtcccctggggagat

SEQ ID NO: 673155 - DNA, 25 bp, Mus musculus
gcaagcccctgtgccctggggagat

SEQ ID NO: 673156 - DNA, 25 bp, Mus musculus
gcaagcccgaaaagatgctgaagaa

SEQ ID NO: 673157 - DNA, 25 bp, Mus musculus
gcaagcccgaaatgatgctgaagaa

SEQ ID NO: 673158 - DNA, 25 bp, Mus musculus
gcaagccctggtatatgacgccata

SEQ ID NO: 673159 - DNA, 25 bp, Mus musculus
gcaagccctggtttatgacgccata

SEQ ID NO: 673160 - DNA, 25 bp, Mus musculus
gcaagccctttgaccccgtgtttat

SEQ ID NO: 673161 - DNA, 25 bp, Mus musculus
gcaagccctttgtccccgtgtttat

SEQ ID NO: 673162 - DNA, 25 bp, Mus musculus
gcaagccgagggagacatcagctgt

SEQ ID NO: 673163 - DNA, 25 bp, Mus musculus
gcaagccgagggtgacatcagctgt

SEQ ID NO: 673164 - DNA, 25 bp, Mus musculus
gcaagccgagtgctggttgcttccc

SEQ ID NO: 673165 - DNA, 25 bp, Mus musculus
gcaagccgagtggtggttgcttccc

SEQ ID NO: 673166 - DNA, 25 bp, Mus musculus
gcaagccgctttaattcagacccat

SEQ ID NO: 673167 - DNA, 25 bp, Mus musculus
gcaagccgcttttattcagacccat

SEQ ID NO: 673168 - DNA, 25 bp, Mus musculus
gcaagccgtccaagtacaatcacag

SEQ ID NO: 673169 - DNA, 25 bp, Mus musculus
gcaagccgtccatgtacaatcacag

SEQ ID NO: 673170 - DNA, 25 bp, Mus musculus
gcaagcctgggcaaccgtggagaaa

SEQ ID NO: 673171 - DNA, 25 bp, Mus musculus
gcaagcctgggctaccgtggagaaa

SEQ ID NO: 673172 - DNA, 25 bp, Mus musculus
gcaagcctgttcacattcctgggag

SEQ ID NO: 673173 - DNA, 25 bp, Mus musculus
gcaagcctgttctcattcctgggag

SEQ ID NO: 673174 - DNA, 25 bp, Mus musculus
gcaagctaagaactaagaacagatg

SEQ ID NO: 673175 - DNA, 25 bp, Mus musculus
gcaagctaagaagtaagaacagatg

SEQ ID NO: 673176 - DNA, 25 bp, Mus musculus
gcaagctaagccagcgcacaggtct

SEQ ID NO: 673177 - DNA, 25 bp, Mus musculus
gcaagctaagcctgcgcacaggtct

SEQ ID NO: 673178 - DNA, 25 bp, Mus musculus
gcaagctcagccaggtattcttcca

SEQ ID NO: 673179 - DNA, 25 bp, Mus musculus
gcaagctcagcctggtattcttcca

SEQ ID NO: 673180 - DNA, 25 bp, Mus musculus
gcaagctcagtcaacttcctgaggt

SEQ ID NO: 673181 - DNA, 25 bp, Mus musculus
gcaagctcagtctacttcctgaggt

SEQ ID NO: 673182 - DNA, 25 bp, Mus musculus
gcaagctcccagagctcacgggtga

SEQ ID NO: 673183 - DNA, 25 bp, Mus musculus
gcaagctcccagtgctcacgggtga

SEQ ID NO: 673184 - DNA, 25 bp, Mus musculus
gcaagctccggaacctcatcattga

SEQ ID NO: 673185 - DNA, 25 bp, Mus musculus
gcaagctccggatcctcatcattga

SEQ ID NO: 673186 - DNA, 25 bp, Mus musculus
gcaagctcgtcaagtcctatgtcgc

SEQ ID NO: 673187 - DNA, 25 bp, Mus musculus
gcaagctcgtcatgtcctatgtcgc

SEQ ID NO: 673188 - DNA, 25 bp, Mus musculus
gcaagctctatcaatactacttaga

SEQ ID NO: 673189 - DNA, 25 bp, Mus musculus
gcaagctctatctatactacttaga

SEQ ID NO: 673190 - DNA, 25 bp, Mus musculus
gcaagctctttacaaggaacccctg

SEQ ID NO: 673191 - DNA, 25 bp, Mus musculus
gcaagctctttagaaggaacccctg

SEQ ID NO: 673192 - DNA, 25 bp, Mus musculus
gcaagctgacagaggctttcaagta

SEQ ID NO: 673193 - DNA, 25 bp, Mus musculus
gcaagctgacagtggctttcaagta

SEQ ID NO: 673194 - DNA, 25 bp, Mus musculus
gcaagctgacgaactgagtctcaca

SEQ ID NO: 673195 - DNA, 25 bp, Mus musculus
gcaagctgacgatctgagtctcaca

SEQ ID NO: 673196 - DNA, 25 bp, Mus musculus
gcaagctgataacaaatgcctctga

SEQ ID NO: 673197 - DNA, 25 bp, Mus musculus
gcaagctgataagaaatgcctctga

SEQ ID NO: 673198 - DNA, 25 bp, Mus musculus
gcaagctgcctgctgatagacccag

SEQ ID NO: 673199 - DNA, 25 bp, Mus musculus
gcaagctgcctggtgatagacccag

SEQ ID NO: 673200 - DNA, 25 bp, Mus musculus
gcaagctgctggatgcaaccaaagt

SEQ ID NO: 673201 - DNA, 25 bp, Mus musculus
gcaagctgctggttgcaaccaaagt

SEQ ID NO: 673202 - DNA, 25 bp, Mus musculus
gcaagctgcttgaatgactgagcga

SEQ ID NO: 673203 - DNA, 25 bp, Mus musculus
gcaagctgcttgtatgactgagcga

SEQ ID NO: 673204 - DNA, 25 bp, Mus musculus
gcaagctggattagcttggaagcag

SEQ ID NO: 673205 - DNA, 25 bp, Mus musculus
gcaagctggatttgcttggaagcag

SEQ ID NO: 673206 - DNA, 25 bp, Mus musculus
gcaagctggcaaacggactgttgct

SEQ ID NO: 673207 - DNA, 25 bp, Mus musculus
gcaagctggcaatcggactgttgct

SEQ ID NO: 673208 - DNA, 25 bp, Mus musculus
gcaagctgtcgtctggaccccagac

SEQ ID NO: 673209 - DNA, 25 bp, Mus musculus
gcaagctgtcgtgtggaccccagac

SEQ ID NO: 673210 - DNA, 25 bp, Mus musculus
gcaagctgtgatcgatgatgatgcc

SEQ ID NO: 673211 - DNA, 25 bp, Mus musculus
gcaagctgtgatggatgatgatgcc

SEQ ID NO: 673212 - DNA, 25 bp, Mus musculus
gcaagctgttggctttctactccgg

SEQ ID NO: 673213 - DNA, 25 bp, Mus musculus
gcaagctgttgggtttctactccgg

SEQ ID NO: 673214 - DNA, 25 bp, Mus musculus
gcaagcttaccccaaacaagacaga

SEQ ID NO: 673215 - DNA, 25 bp, Mus musculus
gcaagcttacccgaaacaagacaga

SEQ ID NO: 673216 - DNA, 25 bp, Mus musculus
gcaagcttatgacgtgcgtccaccc

SEQ ID NO: 673217 - DNA, 25 bp, Mus musculus
gcaagcttatgaggtgcgtccaccc

SEQ ID NO: 673218 - DNA, 25 bp, Mus musculus
gcaagcttcttaacatcgggaccac

SEQ ID NO: 673219 - DNA, 25 bp, Mus musculus
gcaagcttcttatcatcgggaccac

SEQ ID NO: 673220 - DNA, 25 bp, Mus musculus
gcaagctttactcgctctgaacaga

SEQ ID NO: 673221 - DNA, 25 bp, Mus musculus
gcaagctttactggctctgaacaga

SEQ ID NO: 673222 - DNA, 25 bp, Mus musculus
gcaagctttataaggctattggata

SEQ ID NO: 673223 - DNA, 25 bp, Mus musculus
gcaagctttatatggctattggata

SEQ ID NO: 673224 - DNA, 25 bp, Mus musculus
gcaaggaaaggcagctgcacatgca

SEQ ID NO: 673225 - DNA, 25 bp, Mus musculus
gcaaggaaaggctgctgcacatgca

SEQ ID NO: 673226 - DNA, 25 bp, Mus musculus
gcaaggaaatcaagatgagctcatg

SEQ ID NO: 673227 - DNA, 25 bp, Mus musculus
gcaaggaaatcatgatgagctcatg

SEQ ID NO: 673228 - DNA, 25 bp, Mus musculus
gcaaggaatactcggactgtctgga

SEQ ID NO: 673229 - DNA, 25 bp, Mus musculus
gcaaggaatactgggactgtctgga

SEQ ID NO: 673230 - DNA, 25 bp, Mus musculus
gcaaggaatggtaccgcgtgacgtc

SEQ ID NO: 673231 - DNA, 25 bp, Mus musculus
gcaaggaatggttccgcgtgacgtc

SEQ ID NO: 673232 - DNA, 25 bp, Mus musculus
gcaaggacaagaccgtccgaatcat

SEQ ID NO: 673233 - DNA, 25 bp, Mus musculus
gcaaggacaagagcgtccgaatcat

SEQ ID NO: 673234 - DNA, 25 bp, Mus musculus
gcaaggacatccctgagacccctgt

SEQ ID NO: 673235 - DNA, 25 bp, Mus musculus
gcaaggacatccgtgagacccctgt

SEQ ID NO: 673236 - DNA, 25 bp, Mus musculus
gcaaggacatcgcatatcagctaat

SEQ ID NO: 673237 - DNA, 25 bp, Mus musculus
gcaaggacatcggatatcagctaat

SEQ ID NO: 673238 - DNA, 25 bp, Mus musculus
gcaaggacattgaggagcacctgca

SEQ ID NO: 673239 - DNA, 25 bp, Mus musculus
gcaaggacattgtggagcacctgca

SEQ ID NO: 673240 - DNA, 25 bp, Mus musculus
gcaaggacctcaagattggctctga

SEQ ID NO: 673241 - DNA, 25 bp, Mus musculus
gcaaggacctcatgattggctctga

SEQ ID NO: 673242 - DNA, 25 bp, Mus musculus
gcaaggacgccaattttgttcttaa

SEQ ID NO: 673243 - DNA, 25 bp, Mus musculus
gcaaggacgccatttttgttcttaa

SEQ ID NO: 673244 - DNA, 25 bp, Mus musculus
gcaaggacggttagagcgcatcagt

SEQ ID NO: 673245 - DNA, 25 bp, Mus musculus
gcaaggacggtttgagcgcatcagt

SEQ ID NO: 673246 - DNA, 25 bp, Mus musculus
gcaaggactcagctagtcctaggta

SEQ ID NO: 673247 - DNA, 25 bp, Mus musculus
gcaaggactcaggtagtcctaggta

SEQ ID NO: 673248 - DNA, 25 bp, Mus musculus
gcaaggaggaccaggctaagctgca

SEQ ID NO: 673249 - DNA, 25 bp, Mus musculus
gcaaggaggacctggctaagctgca

SEQ ID NO: 673250 - DNA, 25 bp, Mus musculus
gcaaggaggtacaaaccctacggct

SEQ ID NO: 673251 - DNA, 25 bp, Mus musculus
gcaaggaggtactaaccctacggct

SEQ ID NO: 673252 - DNA, 25 bp, Mus musculus
gcaaggataaggagccagctcaaag

SEQ ID NO: 673253 - DNA, 25 bp, Mus musculus
gcaaggataaggtgccagctcaaag

SEQ ID NO: 673254 - DNA, 25 bp, Mus musculus
gcaaggataatcaatgaggactata

SEQ ID NO: 673255 - DNA, 25 bp, Mus musculus
gcaaggataatctatgaggactata

SEQ ID NO: 673256 - DNA, 25 bp, Mus musculus
gcaaggcagtttccgttcttttcct

SEQ ID NO: 673257 - DNA, 25 bp, Mus musculus
gcaaggcagtttgcgttcttttcct

SEQ ID NO: 673258 - DNA, 25 bp, Mus musculus
gcaaggcatacaccagaaaacgctg

SEQ ID NO: 673259 - DNA, 25 bp, Mus musculus
gcaaggcatacagcagaaaacgctg

SEQ ID NO: 673260 - DNA, 25 bp, Mus musculus
gcaaggcatcacaggtcctgagggc

SEQ ID NO: 673261 - DNA, 25 bp, Mus musculus
gcaaggcatcactggtcctgagggc

SEQ ID NO: 673262 - DNA, 25 bp, Mus musculus
gcaaggccaaacacgagccagagag

SEQ ID NO: 673263 - DNA, 25 bp, Mus musculus
gcaaggccaaactcgagccagagag

SEQ ID NO: 673264 - DNA, 25 bp, Mus musculus
gcaaggccctccaggaaaagtagga

SEQ ID NO: 673265 - DNA, 25 bp, Mus musculus
gcaaggccctcctggaaaagtagga

SEQ ID NO: 673266 - DNA, 25 bp, Mus musculus
gcaaggcccttcactcgctttaaca

SEQ ID NO: 673267 - DNA, 25 bp, Mus musculus
gcaaggcccttctctcgctttaaca

SEQ ID NO: 673268 - DNA, 25 bp, Mus musculus
gcaaggccttagcaaacagggcaaa

SEQ ID NO: 673269 - DNA, 25 bp, Mus musculus
gcaaggccttaggaaacagggcaaa

SEQ ID NO: 673270 - DNA, 25 bp, Mus musculus
gcaaggccttgcatcaggagcagga

SEQ ID NO: 673271 - DNA, 25 bp, Mus musculus
gcaaggccttgcttcaggagcagga

SEQ ID NO: 673272 - DNA, 25 bp, Mus musculus
gcaaggccttttacacaggagcgga

SEQ ID NO: 673273 - DNA, 25 bp, Mus musculus
gcaaggcctttttcacaggagcgga

SEQ ID NO: 673274 - DNA, 25 bp, Mus musculus
gcaaggcgtacccatctgttactcg

SEQ ID NO: 673275 - DNA, 25 bp, Mus musculus
gcaaggcgtaccgatctgttactcg

SEQ ID NO: 673276 - DNA, 25 bp, Mus musculus
gcaaggctacatccatgaactcatt

SEQ ID NO: 673277 - DNA, 25 bp, Mus musculus
gcaaggctacatgcatgaactcatt

SEQ ID NO: 673278 - DNA, 25 bp, Mus musculus
gcaaggctattgagagtggagacac

SEQ ID NO: 673279 - DNA, 25 bp, Mus musculus
gcaaggctattgtgagtggagacac

SEQ ID NO: 673280 - DNA, 25 bp, Mus musculus
gcaaggctcccaaggctgggagatc

SEQ ID NO: 673281 - DNA, 25 bp, Mus musculus
gcaaggctcccatggctgggagatc

SEQ ID NO: 673282 - DNA, 25 bp, Mus musculus
gcaaggctcttcagcatacagatga

SEQ ID NO: 673283 - DNA, 25 bp, Mus musculus
gcaaggctcttctgcatacagatga

SEQ ID NO: 673284 - DNA, 25 bp, Mus musculus
gcaaggctggacacttacctgtcaa

SEQ ID NO: 673285 - DNA, 25 bp, Mus musculus
gcaaggctggactcttacctgtcaa

SEQ ID NO: 673286 - DNA, 25 bp, Mus musculus
gcaaggcttccaaaccacacaaggt

SEQ ID NO: 673287 - DNA, 25 bp, Mus musculus
gcaaggcttccataccacacaaggt

SEQ ID NO: 673288 - DNA, 25 bp, Mus musculus
gcaagggaaggcaaagaacccttgg

SEQ ID NO: 673289 - DNA, 25 bp, Mus musculus
gcaagggaaggctaagaacccttgg

SEQ ID NO: 673290 - DNA, 25 bp, Mus musculus
gcaagggagcagaaacacaagacct

SEQ ID NO: 673291 - DNA, 25 bp, Mus musculus
gcaagggagcagtaacacaagacct

SEQ ID NO: 673292 - DNA, 25 bp, Mus musculus
gcaagggagtcaactgggaccatgt

SEQ ID NO: 673293 - DNA, 25 bp, Mus musculus
gcaagggagtcatctgggaccatgt

SEQ ID NO: 673294 - DNA, 25 bp, Mus musculus
gcaagggcacgtcggtgacatactc

SEQ ID NO: 673295 - DNA, 25 bp, Mus musculus
gcaagggcacgtgggtgacatactc

SEQ ID NO: 673296 - DNA, 25 bp, Mus musculus
gcaagggccagcacctgtcggcact

SEQ ID NO: 673297 - DNA, 25 bp, Mus musculus
gcaagggccagctcctgtcggcact

SEQ ID NO: 673298 - DNA, 25 bp, Mus musculus
gcaagggcctgaagggagcctataa

SEQ ID NO: 673299 - DNA, 25 bp, Mus musculus
gcaagggcctgatgggagcctataa

SEQ ID NO: 673300 - DNA, 25 bp, Mus musculus
gcaagggctgttaaaggtaactcca

SEQ ID NO: 673301 - DNA, 25 bp, Mus musculus
gcaagggctgtttaaggtaactcca

SEQ ID NO: 673302 - DNA, 25 bp, Mus musculus
gcaagggttaatattcttgcctctc

SEQ ID NO: 673303 - DNA, 25 bp, Mus musculus
gcaagggttaattttcttgcctctc

SEQ ID NO: 673304 - DNA, 25 bp, Mus musculus
gcaaggtacagtctgccaggcatgt

SEQ ID NO: 673305 - DNA, 25 bp, Mus musculus
gcaaggtacagtgtgccaggcatgt

SEQ ID NO: 673306 - DNA, 25 bp, Mus musculus
gcaaggtaccataagctgttcacac

SEQ ID NO: 673307 - DNA, 25 bp, Mus musculus
gcaaggtaccattagctgttcacac

SEQ ID NO: 673308 - DNA, 25 bp, Mus musculus
gcaaggtagagaacatcaatgcacg

SEQ ID NO: 673309 - DNA, 25 bp, Mus musculus
gcaaggtagagatcatcaatgcacg

SEQ ID NO: 673310 - DNA, 25 bp, Mus musculus
gcaaggtcaagaacctttaactgct

SEQ ID NO: 673311 - DNA, 25 bp, Mus musculus
gcaaggtcaagatcctttaactgct

SEQ ID NO: 673312 - DNA, 25 bp, Mus musculus
gcaaggtcacctcaagcggaaacga

SEQ ID NO: 673313 - DNA, 25 bp, Mus musculus
gcaaggtcacctgaagcggaaacga

SEQ ID NO: 673314 - DNA, 25 bp, Mus musculus
gcaaggtcagcaccccagcaagcag

SEQ ID NO: 673315 - DNA, 25 bp, Mus musculus
gcaaggtcagcagcccagcaagcag

SEQ ID NO: 673316 - DNA, 25 bp, Mus musculus
gcaaggtcccttagtttcttgccct

SEQ ID NO: 673317 - DNA, 25 bp, Mus musculus
gcaaggtccctttgtttcttgccct

SEQ ID NO: 673318 - DNA, 25 bp, Mus musculus
gcaaggtctcctactggaccattca

SEQ ID NO: 673319 - DNA, 25 bp, Mus musculus
gcaaggtctccttctggaccattca

SEQ ID NO: 673320 - DNA, 25 bp, Mus musculus
gcaaggtgaagcagtttgacttcct

SEQ ID NO: 673321 - DNA, 25 bp, Mus musculus
gcaaggtgaagctgtttgacttcct

SEQ ID NO: 673322 - DNA, 25 bp, Mus musculus
gcaaggtgcactagatatacaggcc

SEQ ID NO: 673323 - DNA, 25 bp, Mus musculus
gcaaggtgcacttgatatacaggcc

SEQ ID NO: 673324 - DNA, 25 bp, Mus musculus
gcaaggtggagcactaccgcatcat

SEQ ID NO: 673325 - DNA, 25 bp, Mus musculus
gcaaggtggagctctaccgcatcat

SEQ ID NO: 673326 - DNA, 25 bp, Mus musculus
gcaaggttcaccaggattctgcagt

SEQ ID NO: 673327 - DNA, 25 bp, Mus musculus
gcaaggttcaccctgcctaagctga

SEQ ID NO: 673328 - DNA, 25 bp, Mus musculus
gcaaggttcaccgtgcctaagctga

SEQ ID NO: 673329 - DNA, 25 bp, Mus musculus
gcaaggttcacctggattctgcagt

SEQ ID NO: 673330 - DNA, 25 bp, Mus musculus
gcaaggttcctcatgactggcggga

SEQ ID NO: 673331 - DNA, 25 bp, Mus musculus
gcaaggttcctcttgactggcggga

SEQ ID NO: 673332 - DNA, 25 bp, Mus musculus
gcaaggttctgtcggctgagcacca

SEQ ID NO: 673333 - DNA, 25 bp, Mus musculus
gcaaggttctgtgggctgagcacca

SEQ ID NO: 673334 - DNA, 25 bp, Mus musculus
gcaaggtttgaaaccccacccaaga

SEQ ID NO: 673335 - DNA, 25 bp, Mus musculus
gcaaggtttgaatccccacccaaga

SEQ ID NO: 673336 - DNA, 25 bp, Mus musculus
gcaagtaacatgctacctaagggca

SEQ ID NO: 673337 - DNA, 25 bp, Mus musculus
gcaagtaacatggtacctaagggca

SEQ ID NO: 673338 - DNA, 25 bp, Mus musculus
gcaagtacaatgcaaaagatgaggt

SEQ ID NO: 673339 - DNA, 25 bp, Mus musculus
gcaagtacaatggaaaagatgaggt

SEQ ID NO: 673340 - DNA, 25 bp, Mus musculus
gcaagtacacagagttcaactcttc

SEQ ID NO: 673341 - DNA, 25 bp, Mus musculus
gcaagtacacagtgttcaactcttc

SEQ ID NO: 673342 - DNA, 25 bp, Mus musculus
gcaagtaccaccctatggagtatat

SEQ ID NO: 673343 - DNA, 25 bp, Mus musculus
gcaagtaccaccgtatggagtatat

SEQ ID NO: 673344 - DNA, 25 bp, Mus musculus
gcaagtaccagaagaccttcactgt

SEQ ID NO: 673345 - DNA, 25 bp, Mus musculus
gcaagtaccagatgaccttcactgt

SEQ ID NO: 673346 - DNA, 25 bp, Mus musculus
gcaagtacctgcctatggagtgtat

SEQ ID NO: 673347 - DNA, 25 bp, Mus musculus
gcaagtacctgcgtatggagtgtat

SEQ ID NO: 673348 - DNA, 25 bp, Mus musculus
gcaagtagctttcttggccgtggac

SEQ ID NO: 673349 - DNA, 25 bp, Mus musculus
gcaagtagctttgttggccgtggac

SEQ ID NO: 673350 - DNA, 25 bp, Mus musculus
gcaagtaggctccattaaggagaga

SEQ ID NO: 673351 - DNA, 25 bp, Mus musculus
gcaagtaggctcgattaaggagaga

SEQ ID NO: 673352 - DNA, 25 bp, Mus musculus
gcaagtatcggtcaacaggcaaaca

SEQ ID NO: 673353 - DNA, 25 bp, Mus musculus
gcaagtatcggtgaacaggcaaaca

SEQ ID NO: 673354 - DNA, 25 bp, Mus musculus
gcaagtatctacctcggtttaaagc

SEQ ID NO: 673355 - DNA, 25 bp, Mus musculus
gcaagtatctacgtcggtttaaagc

SEQ ID NO: 673356 - DNA, 25 bp, Mus musculus
gcaagtatgaggacctcaacacaaa

SEQ ID NO: 673357 - DNA, 25 bp, Mus musculus
gcaagtatgaggtcctcaacacaaa

SEQ ID NO: 673358 - DNA, 25 bp, Mus musculus
gcaagtatgtcaccttttgatcctc

SEQ ID NO: 673359 - DNA, 25 bp, Mus musculus
gcaagtatgtcagcttttgatcctc

SEQ ID NO: 673360 - DNA, 25 bp, Mus musculus
gcaagtatgtgcaacgccatcaagt

SEQ ID NO: 673361 - DNA, 25 bp, Mus musculus
gcaagtatgtgctacgccatcaagt

SEQ ID NO: 673362 - DNA, 25 bp, Mus musculus
gcaagtcatcaccatagttacagat

SEQ ID NO: 673363 - DNA, 25 bp, Mus musculus
gcaagtcatcacgatagttacagat

SEQ ID NO: 673364 - DNA, 25 bp, Mus musculus
gcaagtcatccgaggccactactct

SEQ ID NO: 673365 - DNA, 25 bp, Mus musculus
gcaagtcatccgtggccactactct

SEQ ID NO: 673366 - DNA, 25 bp, Mus musculus
gcaagtccagcaacaagcgggtgct

SEQ ID NO: 673367 - DNA, 25 bp, Mus musculus
gcaagtccagcatcaagcgggtgct

SEQ ID NO: 673368 - DNA, 25 bp, Mus musculus
gcaagtccaggactcttccatgcca

SEQ ID NO: 673369 - DNA, 25 bp, Mus musculus
gcaagtccaggagtcttccatgcca

SEQ ID NO: 673370 - DNA, 25 bp, Mus musculus
gcaagtccatccaaccttgtaaact

SEQ ID NO: 673371 - DNA, 25 bp, Mus musculus
gcaagtccatcctaccttgtaaact

SEQ ID NO: 673372 - DNA, 25 bp, Mus musculus
gcaagtcccacgagtcccagctggg

SEQ ID NO: 673373 - DNA, 25 bp, Mus musculus
gcaagtcccacgtgtcccagctggg

SEQ ID NO: 673374 - DNA, 25 bp, Mus musculus
gcaagtccggagctgttgtcctaga

SEQ ID NO: 673375 - DNA, 25 bp, Mus musculus
gcaagtccggaggtgttgtcctaga

SEQ ID NO: 673376 - DNA, 25 bp, Mus musculus
gcaagtcctggcagtaggagaaact

SEQ ID NO: 673377 - DNA, 25 bp, Mus musculus
gcaagtcctggctgtaggagaaact

SEQ ID NO: 673378 - DNA, 25 bp, Mus musculus
gcaagtccttcgacaccctggagaa

SEQ ID NO: 673379 - DNA, 25 bp, Mus musculus
gcaagtccttcgtcaccctggagaa

SEQ ID NO: 673380 - DNA, 25 bp, Mus musculus
gcaagtcctttgaatccattaacta

SEQ ID NO: 673381 - DNA, 25 bp, Mus musculus
gcaagtcctttgtatccattaacta

SEQ ID NO: 673382 - DNA, 25 bp, Mus musculus
gcaagtcgacagaacgtctacaatg

SEQ ID NO: 673383 - DNA, 25 bp, Mus musculus
gcaagtcgacagtacgtctacaatg

SEQ ID NO: 673384 - DNA, 25 bp, Mus musculus
gcaagtcggacgcagccttctacgc

SEQ ID NO: 673385 - DNA, 25 bp, Mus musculus
gcaagtcggacggagccttctacgc

SEQ ID NO: 673386 - DNA, 25 bp, Mus musculus
gcaagtctatgcctcagtctacagc

SEQ ID NO: 673387 - DNA, 25 bp, Mus musculus
gcaagtctatgcgtcagtctacagc

SEQ ID NO: 673388 - DNA, 25 bp, Mus musculus
gcaagtctcacaagtctccggcaga

SEQ ID NO: 673389 - DNA, 25 bp, Mus musculus
gcaagtctcacatgtctccggcaga

SEQ ID NO: 673390 - DNA, 25 bp, Mus musculus
gcaagtctctggctctcgacattat

SEQ ID NO: 673391 - DNA, 25 bp, Mus musculus
gcaagtctctgggtctcgacattat

SEQ ID NO: 673392 - DNA, 25 bp, Mus musculus
gcaagtctgacaccagactgcatga

SEQ ID NO: 673393 - DNA, 25 bp, Mus musculus
gcaagtctgacagcagactgcatga

SEQ ID NO: 673394 - DNA, 25 bp, Mus musculus
gcaagtcttagtagcctaggtcaag

SEQ ID NO: 673395 - DNA, 25 bp, Mus musculus
gcaagtcttagttgcctaggtcaag

SEQ ID NO: 673396 - DNA, 25 bp, Mus musculus
gcaagtcttgccatgaaatactcag

SEQ ID NO: 673397 - DNA, 25 bp, Mus musculus
gcaagtcttgccttgaaatactcag

SEQ ID NO: 673398 - DNA, 25 bp, Mus musculus
gcaagtgaaacaacacctagctttt

SEQ ID NO: 673399 - DNA, 25 bp, Mus musculus
gcaagtgaaacatcacctagctttt

SEQ ID NO: 673400 - DNA, 25 bp, Mus musculus
gcaagtgatggcaagagctcttcct

SEQ ID NO: 673401 - DNA, 25 bp, Mus musculus
gcaagtgatggctagagctcttcct

SEQ ID NO: 673402 - DNA, 25 bp, Mus musculus
gcaagtgattcaacagaacccagcg

SEQ ID NO: 673403 - DNA, 25 bp, Mus musculus
gcaagtgattcatcagaacccagcg

SEQ ID NO: 673404 - DNA, 25 bp, Mus musculus
gcaagtgcccatcgtagagatcgac

SEQ ID NO: 673405 - DNA, 25 bp, Mus musculus
gcaagtgcccatggtagagatcgac

SEQ ID NO: 673406 - DNA, 25 bp, Mus musculus
gcaagtgctcgaaatgacatccaga

SEQ ID NO: 673407 - DNA, 25 bp, Mus musculus
gcaagtgctcgatatgacatccaga

SEQ ID NO: 673408 - DNA, 25 bp, Mus musculus
gcaagtgctgccatgcaagtgccca

SEQ ID NO: 673409 - DNA, 25 bp, Mus musculus
gcaagtgctgccttgcaagtgccca

SEQ ID NO: 673410 - DNA, 25 bp, Mus musculus
gcaagtggacatagtgaatcagtac

SEQ ID NO: 673411 - DNA, 25 bp, Mus musculus
gcaagtggacattgtgaatcagtac

SEQ ID NO: 673412 - DNA, 25 bp, Mus musculus
gcaagtggcattccagcaacagcag

SEQ ID NO: 673413 - DNA, 25 bp, Mus musculus
gcaagtggcattgcagcaacagcag

SEQ ID NO: 673414 - DNA, 25 bp, Mus musculus
gcaagtggttcgagcagaggccttt

SEQ ID NO: 673415 - DNA, 25 bp, Mus musculus
gcaagtggttcgtgcagaggccttt

SEQ ID NO: 673416 - DNA, 25 bp, Mus musculus
gcaagtgtacgacctgtgcccaacc

SEQ ID NO: 673417 - DNA, 25 bp, Mus musculus
gcaagtgtacgagctgtgcccaacc

SEQ ID NO: 673418 - DNA, 25 bp, Mus musculus
gcaagtgtccaacccccgggtgtga

SEQ ID NO: 673419 - DNA, 25 bp, Mus musculus
gcaagtgtccaagccccgggtgtga

SEQ ID NO: 673420 - DNA, 25 bp, Mus musculus
gcaagtgttaaaacagaaaagactg

SEQ ID NO: 673421 - DNA, 25 bp, Mus musculus
gcaagtgttaaatcagaaaagactg

SEQ ID NO: 673422 - DNA, 25 bp, Mus musculus
gcaagtgttcgacgagcaggacata

SEQ ID NO: 673423 - DNA, 25 bp, Mus musculus
gcaagtgttcgaggagcaggacata

SEQ ID NO: 673424 - DNA, 25 bp, Mus musculus
gcaagtgtttatcaccaggatctag

SEQ ID NO: 673425 - DNA, 25 bp, Mus musculus
gcaagtgtttatgaccaggatctag

SEQ ID NO: 673426 - DNA, 25 bp, Mus musculus
gcaagttaactactgctgctcaccg

SEQ ID NO: 673427 - DNA, 25 bp, Mus musculus
gcaagttaactagtgctgctcaccg

SEQ ID NO: 673428 - DNA, 25 bp, Mus musculus
gcaagttagctcatagaataccaga

SEQ ID NO: 673429 - DNA, 25 bp, Mus musculus
gcaagttagctcttagaataccaga

SEQ ID NO: 673430 - DNA, 25 bp, Mus musculus
gcaagttcacatctatccgtcggac

SEQ ID NO: 673431 - DNA, 25 bp, Mus musculus
gcaagttcacatgtatccgtcggac

SEQ ID NO: 673432 - DNA, 25 bp, Mus musculus
gcaagttcatcaccatgtcggatgg

SEQ ID NO: 673433 - DNA, 25 bp, Mus musculus
gcaagttcatcagcatgtcggatgg

SEQ ID NO: 673434 - DNA, 25 bp, Mus musculus
gcaagttcatgaccacatcctccat

SEQ ID NO: 673435 - DNA, 25 bp, Mus musculus
gcaagttcatgagcacatcctccat

SEQ ID NO: 673436 - DNA, 25 bp, Mus musculus
gcaagttccgtcctggcagtggctc

SEQ ID NO: 673437 - DNA, 25 bp, Mus musculus
gcaagttccgtcgtggcagtggctc

SEQ ID NO: 673438 - DNA, 25 bp, Mus musculus
gcaagttcgtgtccctggctgagct

SEQ ID NO: 673439 - DNA, 25 bp, Mus musculus
gcaagttcgtgtgcctggctgagct

SEQ ID NO: 673440 - DNA, 25 bp, Mus musculus
gcaagttctgaaagtgcgacatgat

SEQ ID NO: 673441 - DNA, 25 bp, Mus musculus
gcaagttctgaatgtgcgacatgat

SEQ ID NO: 673442 - DNA, 25 bp, Mus musculus
gcaagttggagcactgcacataatc

SEQ ID NO: 673443 - DNA, 25 bp, Mus musculus
gcaagttggagctctgcacataatc

SEQ ID NO: 673444 - DNA, 25 bp, Mus musculus
gcaagtttccacaaacacggaggtc

SEQ ID NO: 673445 - DNA, 25 bp, Mus musculus
gcaagtttccactaacacggaggtc

SEQ ID NO: 673446 - DNA, 25 bp, Mus musculus
gcaagtttcgtacctttgaagatga

SEQ ID NO: 673447 - DNA, 25 bp, Mus musculus
gcaagtttcgtagctttgaagatga

SEQ ID NO: 673448 - DNA, 25 bp, Mus musculus
gcaagtttcgtcacctgcaaaggga

SEQ ID NO: 673449 - DNA, 25 bp, Mus musculus
gcaagtttcgtctcctgcaaaggga

SEQ ID NO: 673450 - DNA, 25 bp, Mus musculus
gcaagtttgcacagccctacattcg

SEQ ID NO: 673451 - DNA, 25 bp, Mus musculus
gcaagtttgcactgccctacattcg

SEQ ID NO: 673452 - DNA, 25 bp, Mus musculus
gcaagtttgggtccataagttataa

SEQ ID NO: 673453 - DNA, 25 bp, Mus musculus
gcaagtttgggtgcataagttataa

SEQ ID NO: 673454 - DNA, 25 bp, Mus musculus
gcaagtttgttcaagattggctccc

SEQ ID NO: 673455 - DNA, 25 bp, Mus musculus
gcaagtttgttctagattggctccc

SEQ ID NO: 673456 - DNA, 25 bp, Mus musculus
gcaagtttttccctagcgtagcgct

SEQ ID NO: 673457 - DNA, 25 bp, Mus musculus
gcaagtttttccgtagcgtagcgct

SEQ ID NO: 673458 - DNA, 25 bp, Mus musculus
gcaataaaaaacatcagagccaaac

SEQ ID NO: 673459 - DNA, 25 bp, Mus musculus
gcaataaaaaacttcagagccaaac

SEQ ID NO: 673460 - DNA, 25 bp, Mus musculus
gcaataaactgtaggtggaaccagg

SEQ ID NO: 673461 - DNA, 25 bp, Mus musculus
gcaataaactgttggtggaaccagg

SEQ ID NO: 673462 - DNA, 25 bp, Mus musculus
gcaataaacttcagtctctctctga

SEQ ID NO: 673463 - DNA, 25 bp, Mus musculus
gcaataaacttctgtctctctctga

SEQ ID NO: 673464 - DNA, 25 bp, Mus musculus
gcaataaggtagagaacagactccg

SEQ ID NO: 673465 - DNA, 25 bp, Mus musculus
gcaataaggtagtgaacagactccg

SEQ ID NO: 673466 - DNA, 25 bp, Mus musculus
gcaataatatccaactgccccaggg

SEQ ID NO: 673467 - DNA, 25 bp, Mus musculus
gcaataatatcctactgccccaggg

SEQ ID NO: 673468 - DNA, 25 bp, Mus musculus
gcaataatcaagacagacgcagctt

SEQ ID NO: 673469 - DNA, 25 bp, Mus musculus
gcaataatcaagtcagacgcagctt

SEQ ID NO: 673470 - DNA, 25 bp, Mus musculus
gcaataatccaacatcaacttggta

SEQ ID NO: 673471 - DNA, 25 bp, Mus musculus
gcaataatccaagatcaacttggta

SEQ ID NO: 673472 - DNA, 25 bp, Mus musculus
gcaatacaagatcttactggtgccc

SEQ ID NO: 673473 - DNA, 25 bp, Mus musculus
gcaatacaagatgttactggtgccc

SEQ ID NO: 673474 - DNA, 25 bp, Mus musculus
gcaataccgcatctgtctcaaaacc

SEQ ID NO: 673475 - DNA, 25 bp, Mus musculus
gcaataccgcatgtgtctcaaaacc

SEQ ID NO: 673476 - DNA, 25 bp, Mus musculus
gcaatacgggaaagggagaatctca

SEQ ID NO: 673477 - DNA, 25 bp, Mus musculus
gcaatacgggaatgggagaatctca

SEQ ID NO: 673478 - DNA, 25 bp, Mus musculus
gcaatactccggctacctcagagca

SEQ ID NO: 673479 - DNA, 25 bp, Mus musculus
gcaatactccgggtacctcagagca

SEQ ID NO: 673480 - DNA, 25 bp, Mus musculus
gcaatactggaaaaatgggactaat

SEQ ID NO: 673481 - DNA, 25 bp, Mus musculus
gcaatactggaataatgggactaat

SEQ ID NO: 673482 - DNA, 25 bp, Mus musculus
gcaatagaagctcttaaggaatatg

SEQ ID NO: 673483 - DNA, 25 bp, Mus musculus
gcaatagaagctgttaaggaatatg

SEQ ID NO: 673484 - DNA, 25 bp, Mus musculus
gcaatagaccctagacctggcatct

SEQ ID NO: 673485 - DNA, 25 bp, Mus musculus
gcaatagacccttgacctggcatct

SEQ ID NO: 673486 - DNA, 25 bp, Mus musculus
gcaatagagctgataaaaaggaaaa

SEQ ID NO: 673487 - DNA, 25 bp, Mus musculus
gcaatagagctgttaaaaaggaaaa

SEQ ID NO: 673488 - DNA, 25 bp, Mus musculus
gcaatagcatctaacatttcaaacc

SEQ ID NO: 673489 - DNA, 25 bp, Mus musculus
gcaatagcatcttacatttcaaacc

SEQ ID NO: 673490 - DNA, 25 bp, Mus musculus
gcaatagtgtcaccccactagccag

SEQ ID NO: 673491 - DNA, 25 bp, Mus musculus
gcaatagtgtcagcccactagccag

SEQ ID NO: 673492 - DNA, 25 bp, Mus musculus
gcaatataatgtcgttagtaaataa

SEQ ID NO: 673493 - DNA, 25 bp, Mus musculus
gcaatataatgtggttagtaaataa

SEQ ID NO: 673494 - DNA, 25 bp, Mus musculus
gcaatatcgaatcggccagctgcac

SEQ ID NO: 673495 - DNA, 25 bp, Mus musculus
gcaatatcgaatgggccagctgcac

SEQ ID NO: 673496 - DNA, 25 bp, Mus musculus
gcaatatcgctgatattgttacagc

SEQ ID NO: 673497 - DNA, 25 bp, Mus musculus
gcaatatcgctgttattgttacagc

SEQ ID NO: 673498 - DNA, 25 bp, Mus musculus
gcaatatcgggtcttaattaccacc

SEQ ID NO: 673499 - DNA, 25 bp, Mus musculus
gcaatatcgggtgttaattaccacc

SEQ ID NO: 673500 - DNA, 25 bp, Mus musculus
gcaatatgtttactcatcgtcttcc

SEQ ID NO: 673501 - DNA, 25 bp, Mus musculus
gcaatatgtttagtcatcgtcttcc

SEQ ID NO: 673502 - DNA, 25 bp, Mus musculus
gcaatattcaaaccagagaccctgg

SEQ ID NO: 673503 - DNA, 25 bp, Mus musculus
gcaatattcaaagcagagaccctgg

SEQ ID NO: 673504 - DNA, 25 bp, Mus musculus
gcaatcaaaagccactctgcagtga

SEQ ID NO: 673505 - DNA, 25 bp, Mus musculus
gcaatcaaaagcgactctgcagtga

SEQ ID NO: 673506 - DNA, 25 bp, Mus musculus
gcaatcaaatatatctggccagtgt

SEQ ID NO: 673507 - DNA, 25 bp, Mus musculus
gcaatcaaatatttctggccagtgt

SEQ ID NO: 673508 - DNA, 25 bp, Mus musculus
gcaatcaagaagctagaacaatcat

SEQ ID NO: 673509 - DNA, 25 bp, Mus musculus
gcaatcaagaaggtagaacaatcat

SEQ ID NO: 673510 - DNA, 25 bp, Mus musculus
gcaatcacacttctttctgcgtata

SEQ ID NO: 673511 - DNA, 25 bp, Mus musculus
gcaatcacacttgtttctgcgtata

SEQ ID NO: 673512 - DNA, 25 bp, Mus musculus
gcaatcacagacctcacaaggttcc

SEQ ID NO: 673513 - DNA, 25 bp, Mus musculus
gcaatcacagacgtcacaaggttcc

SEQ ID NO: 673514 - DNA, 25 bp, Mus musculus
gcaatcacatcaagctgtcgggcag

SEQ ID NO: 673515 - DNA, 25 bp, Mus musculus
gcaatcacatcatgctgtcgggcag

SEQ ID NO: 673516 - DNA, 25 bp, Mus musculus
gcaatcataaagacatccctgtgta

SEQ ID NO: 673517 - DNA, 25 bp, Mus musculus
gcaatcataaagtcatccctgtgta

SEQ ID NO: 673518 - DNA, 25 bp, Mus musculus
gcaatcatgtcccacaaacaaatct

SEQ ID NO: 673519 - DNA, 25 bp, Mus musculus
gcaatcatgtccgacaaacaaatct

SEQ ID NO: 673520 - DNA, 25 bp, Mus musculus
gcaatccaactcattgaactatggg

SEQ ID NO: 673521 - DNA, 25 bp, Mus musculus
gcaatccaactctttgaactatggg

SEQ ID NO: 673522 - DNA, 25 bp, Mus musculus
gcaatccacctaaaaatgaagagcc

SEQ ID NO: 673523 - DNA, 25 bp, Mus musculus
gcaatccacctataaatgaagagcc

SEQ ID NO: 673524 - DNA, 25 bp, Mus musculus
gcaatccagaagaagaggttgagtt

SEQ ID NO: 673525 - DNA, 25 bp, Mus musculus
gcaatccagaagtagaggttgagtt

SEQ ID NO: 673526 - DNA, 25 bp, Mus musculus
gcaatccagtagatatgaggatccc

SEQ ID NO: 673527 - DNA, 25 bp, Mus musculus
gcaatccagtagttatgaggatccc

SEQ ID NO: 673528 - DNA, 25 bp, Mus musculus
gcaatccatacaccttacttgataa

SEQ ID NO: 673529 - DNA, 25 bp, Mus musculus
gcaatccatacagcttacttgataa

SEQ ID NO: 673530 - DNA, 25 bp, Mus musculus
gcaatcccgccgagtgggctttgta

SEQ ID NO: 673531 - DNA, 25 bp, Mus musculus
gcaatcccgccgtgtgggctttgta

SEQ ID NO: 673532 - DNA, 25 bp, Mus musculus
gcaatccctgccaaaatggtgccaa

SEQ ID NO: 673533 - DNA, 25 bp, Mus musculus
gcaatccctgcctaaatggtgccaa

SEQ ID NO: 673534 - DNA, 25 bp, Mus musculus
gcaatcctgaacaccaccaacaagt

SEQ ID NO: 673535 - DNA, 25 bp, Mus musculus
gcaatcctgaactccaccaacaagt

SEQ ID NO: 673536 - DNA, 25 bp, Mus musculus
gcaatcctgctgctattccttgtca

SEQ ID NO: 673537 - DNA, 25 bp, Mus musculus
gcaatcctgctggtattccttgtca

SEQ ID NO: 673538 - DNA, 25 bp, Mus musculus
gcaatccttatcattgtgacagtct

SEQ ID NO: 673539 - DNA, 25 bp, Mus musculus
gcaatccttatctttgtgacagtct

SEQ ID NO: 673540 - DNA, 25 bp, Mus musculus
gcaatcgcatccagacactaggaga

SEQ ID NO: 673541 - DNA, 25 bp, Mus musculus
gcaatcgcatcctgacactaggaga

SEQ ID NO: 673542 - DNA, 25 bp, Mus musculus
gcaatcgtcttgcaactgtgcctgc

SEQ ID NO: 673543 - DNA, 25 bp, Mus musculus
gcaatcgtcttggaactgtgcctgc

SEQ ID NO: 673544 - DNA, 25 bp, Mus musculus
gcaatcgtgcgtcatgctcatggca

SEQ ID NO: 673545 - DNA, 25 bp, Mus musculus
gcaatcgtgcgtgatgctcatggca

SEQ ID NO: 673546 - DNA, 25 bp, Mus musculus
gcaatctagttgattgtgccacagc

SEQ ID NO: 673547 - DNA, 25 bp, Mus musculus
gcaatctagttgtttgtgccacagc

SEQ ID NO: 673548 - DNA, 25 bp, Mus musculus
gcaatctatctcattcgcgtccggt

SEQ ID NO: 673549 - DNA, 25 bp, Mus musculus
gcaatctatctctttcgcgtccggt

SEQ ID NO: 673550 - DNA, 25 bp, Mus musculus
gcaatctcagaacctcatcatgacc

SEQ ID NO: 673551 - DNA, 25 bp, Mus musculus
gcaatctcagaagctcatcatgacc

SEQ ID NO: 673552 - DNA, 25 bp, Mus musculus
gcaatctcaggccatgattatcgga

SEQ ID NO: 673553 - DNA, 25 bp, Mus musculus
gcaatctcaggcgatgattatcgga

SEQ ID NO: 673554 - DNA, 25 bp, Mus musculus
gcaatctctctcctcatgatcctga

SEQ ID NO: 673555 - DNA, 25 bp, Mus musculus
gcaatctctctcgtcatgatcctga

SEQ ID NO: 673556 - DNA, 25 bp, Mus musculus
gcaatctgaaatcacctggacaagg

SEQ ID NO: 673557 - DNA, 25 bp, Mus musculus
gcaatctgaaatgacctggacaagg

SEQ ID NO: 673558 - DNA, 25 bp, Mus musculus
gcaatctgcagaaccatcatgtggg

SEQ ID NO: 673559 - DNA, 25 bp, Mus musculus
gcaatctgcagatccatcatgtggg

SEQ ID NO: 673560 - DNA, 25 bp, Mus musculus
gcaatctgctgtcagctgagacccg

SEQ ID NO: 673561 - DNA, 25 bp, Mus musculus
gcaatctgctgtgagctgagacccg

SEQ ID NO: 673562 - DNA, 25 bp, Mus musculus
gcaatcttgaaaccacgtggattgg

SEQ ID NO: 673563 - DNA, 25 bp, Mus musculus
gcaatcttgaaagcacgtggattgg

SEQ ID NO: 673564 - DNA, 25 bp, Mus musculus
gcaatcttgtaaagtggcctgaaaa

SEQ ID NO: 673565 - DNA, 25 bp, Mus musculus
gcaatcttgtaatgtggcctgaaaa

SEQ ID NO: 673566 - DNA, 25 bp, Mus musculus
gcaatcttgtggataacaccaacca

SEQ ID NO: 673567 - DNA, 25 bp, Mus musculus
gcaatcttgtggttaacaccaacca

SEQ ID NO: 673568 - DNA, 25 bp, Mus musculus
gcaatgaaaatcctgcgcaaagcag

SEQ ID NO: 673569 - DNA, 25 bp, Mus musculus
gcaatgaaaatcgtgcgcaaagcag

SEQ ID NO: 673570 - DNA, 25 bp, Mus musculus
gcaatgaacactacatcacctgtgg

SEQ ID NO: 673571 - DNA, 25 bp, Mus musculus
gcaatgaacacttcatcacctgtgg

SEQ ID NO: 673572 - DNA, 25 bp, Mus musculus
gcaatgaacatactcaacttcccca

SEQ ID NO: 673573 - DNA, 25 bp, Mus musculus
gcaatgaacatagtcaacttcccca

SEQ ID NO: 673574 - DNA, 25 bp, Mus musculus
gcaatgaagacactgtgagcaggct

SEQ ID NO: 673575 - DNA, 25 bp, Mus musculus
gcaatgaagacagtgtgagcaggct

SEQ ID NO: 673576 - DNA, 25 bp, Mus musculus
gcaatgaatgcacccaggatgagag

SEQ ID NO: 673577 - DNA, 25 bp, Mus musculus
gcaatgaatgcagccaggatgagag

SEQ ID NO: 673578 - DNA, 25 bp, Mus musculus
gcaatgacacctactactcactggg

SEQ ID NO: 673579 - DNA, 25 bp, Mus musculus
gcaatgacaccttctactcactggg

SEQ ID NO: 673580 - DNA, 25 bp, Mus musculus
gcaatgacagccctaaagcacgaac

SEQ ID NO: 673581 - DNA, 25 bp, Mus musculus
gcaatgacagccgtaaagcacgaac

SEQ ID NO: 673582 - DNA, 25 bp, Mus musculus
gcaatgacctgaagttactacgcct

SEQ ID NO: 673583 - DNA, 25 bp, Mus musculus
gcaatgacctgatgttactacgcct

SEQ ID NO: 673584 - DNA, 25 bp, Mus musculus
gcaatgacgctgacaccaggaataa

SEQ ID NO: 673585 - DNA, 25 bp, Mus musculus
gcaatgacgctgtcaccaggaataa

SEQ ID NO: 673586 - DNA, 25 bp, Mus musculus
gcaatgactacaacgtccctcggca

SEQ ID NO: 673587 - DNA, 25 bp, Mus musculus
gcaatgactacatcgtccctcggca

SEQ ID NO: 673588 - DNA, 25 bp, Mus musculus
gcaatgactgatctggaaactacgt

SEQ ID NO: 673589 - DNA, 25 bp, Mus musculus
gcaatgactgatgtggaaactacgt

SEQ ID NO: 673590 - DNA, 25 bp, Mus musculus
gcaatgactggaccctcagtgatac

SEQ ID NO: 673591 - DNA, 25 bp, Mus musculus
gcaatgactggagcctcagtgatac

SEQ ID NO: 673592 - DNA, 25 bp, Mus musculus
gcaatgagagatactgacagtggac

SEQ ID NO: 673593 - DNA, 25 bp, Mus musculus
gcaatgagagattctgacagtggac

SEQ ID NO: 673594 - DNA, 25 bp, Mus musculus
gcaatgagaggtatgaccttcttgt

SEQ ID NO: 673595 - DNA, 25 bp, Mus musculus
gcaatgagaggtttgaccttcttgt

SEQ ID NO: 673596 - DNA, 25 bp, Mus musculus
gcaatgaggaggactctgcccagca

SEQ ID NO: 673597 - DNA, 25 bp, Mus musculus
gcaatgaggaggtctctgcccagca

SEQ ID NO: 673598 - DNA, 25 bp, Mus musculus
gcaatgattatcctgcttctgccac

SEQ ID NO: 673599 - DNA, 25 bp, Mus musculus
gcaatgattatcgtgcttctgccac

SEQ ID NO: 673600 - DNA, 25 bp, Mus musculus
gcaatgcaaagaagaccctgggaat

SEQ ID NO: 673601 - DNA, 25 bp, Mus musculus
gcaatgcaaagaccgcctgtcagtg

SEQ ID NO: 673602 - DNA, 25 bp, Mus musculus
gcaatgcaaagagcgcctgtcagtg

SEQ ID NO: 673603 - DNA, 25 bp, Mus musculus
gcaatgcaaagatgaccctgggaat

SEQ ID NO: 673604 - DNA, 25 bp, Mus musculus
gcaatgcaatggcatccgagactgt

SEQ ID NO: 673605 - DNA, 25 bp, Mus musculus
gcaatgcaatgggatccgagactgt

SEQ ID NO: 673606 - DNA, 25 bp, Mus musculus
gcaatgcacgtcatgcagttaacaa

SEQ ID NO: 673607 - DNA, 25 bp, Mus musculus
gcaatgcacgtcttgcagttaacaa

SEQ ID NO: 673608 - DNA, 25 bp, Mus musculus
gcaatgcctcgacacatcctgatgg

SEQ ID NO: 673609 - DNA, 25 bp, Mus musculus
gcaatgcctcgagacatcctgatgg

SEQ ID NO: 673610 - DNA, 25 bp, Mus musculus
gcaatgcctgcgcactctaccataa

SEQ ID NO: 673611 - DNA, 25 bp, Mus musculus
gcaatgcctgcggactctaccataa

SEQ ID NO: 673612 - DNA, 25 bp, Mus musculus
gcaatgcctggaaggtgtacaatga

SEQ ID NO: 673613 - DNA, 25 bp, Mus musculus
gcaatgcctggatggtgtacaatga

SEQ ID NO: 673614 - DNA, 25 bp, Mus musculus
gcaatgctgctgctagtaccagcct

SEQ ID NO: 673615 - DNA, 25 bp, Mus musculus
gcaatgctgctggtagtaccagcct

SEQ ID NO: 673616 - DNA, 25 bp, Mus musculus
gcaatgctgtcaccatggtcctgca

SEQ ID NO: 673617 - DNA, 25 bp, Mus musculus
gcaatgctgtcagcatggtcctgca

SEQ ID NO: 673618 - DNA, 25 bp, Mus musculus
gcaatgcttgaacttacaggacaaa

SEQ ID NO: 673619 - DNA, 25 bp, Mus musculus
gcaatgcttgaagttacaggacaaa

SEQ ID NO: 673620 - DNA, 25 bp, Mus musculus
gcaatgcttgttctccagccaaagg

SEQ ID NO: 673621 - DNA, 25 bp, Mus musculus
gcaatgcttgttgtccagccaaagg

SEQ ID NO: 673622 - DNA, 25 bp, Mus musculus
gcaatggacaggagctgaagtacaa

SEQ ID NO: 673623 - DNA, 25 bp, Mus musculus
gcaatggacaggtgctgaagtacaa

SEQ ID NO: 673624 - DNA, 25 bp, Mus musculus
gcaatggaccctcggtgcaaaggaa

SEQ ID NO: 673625 - DNA, 25 bp, Mus musculus
gcaatggaccctgggtgcaaaggaa

SEQ ID NO: 673626 - DNA, 25 bp, Mus musculus
gcaatggagaaccaacagtttcagc

SEQ ID NO: 673627 - DNA, 25 bp, Mus musculus
gcaatggagaacgaacagtttcagc

SEQ ID NO: 673628 - DNA, 25 bp, Mus musculus
gcaatggcatcccagactgtgttga

SEQ ID NO: 673629 - DNA, 25 bp, Mus musculus
gcaatggcatccgagactgtgttga

SEQ ID NO: 673630 - DNA, 25 bp, Mus musculus
gcaatggccctgatacccagtggaa

SEQ ID NO: 673631 - DNA, 25 bp, Mus musculus
gcaatggccctgttacccagtggaa

SEQ ID NO: 673632 - DNA, 25 bp, Mus musculus
gcaatggccgaaagcggtacaccta

SEQ ID NO: 673633 - DNA, 25 bp, Mus musculus
gcaatggccgaatgcggtacaccta

SEQ ID NO: 673634 - DNA, 25 bp, Mus musculus
gcaatggccgctcaggctgctcttc

SEQ ID NO: 673635 - DNA, 25 bp, Mus musculus
gcaatggccgctgaggctgctcttc

SEQ ID NO: 673636 - DNA, 25 bp, Mus musculus
gcaatggcgtggacatccacttgcc

SEQ ID NO: 673637 - DNA, 25 bp, Mus musculus
gcaatggcgtggtcatccacttgcc

SEQ ID NO: 673638 - DNA, 25 bp, Mus musculus
gcaatggctggactatgcgattaca

SEQ ID NO: 673639 - DNA, 25 bp, Mus musculus
gcaatggctggagtatgcgattaca

SEQ ID NO: 673640 - DNA, 25 bp, Mus musculus
gcaatgggaacaataagttgtcaca

SEQ ID NO: 673641 - DNA, 25 bp, Mus musculus
gcaatgggaacattaagttgtcaca

SEQ ID NO: 673642 - DNA, 25 bp, Mus musculus
gcaatgggaattccagccccagggt

SEQ ID NO: 673643 - DNA, 25 bp, Mus musculus
gcaatgggaattgcagccccagggt

SEQ ID NO: 673644 - DNA, 25 bp, Mus musculus
gcaatgggcttactgttctgggaaa

SEQ ID NO: 673645 - DNA, 25 bp, Mus musculus
gcaatgggcttagtgttctgggaaa

SEQ ID NO: 673646 - DNA, 25 bp, Mus musculus
gcaatggtggtcacagataccagta

SEQ ID NO: 673647 - DNA, 25 bp, Mus musculus
gcaatggtggtctcagataccagta

SEQ ID NO: 673648 - DNA, 25 bp, Mus musculus
gcaatggttctgaaaccccagggta

SEQ ID NO: 673649 - DNA, 25 bp, Mus musculus
gcaatggttctgtaaccccagggta

SEQ ID NO: 673650 - DNA, 25 bp, Mus musculus
gcaatgtccgctctaccatgaaggg

SEQ ID NO: 673651 - DNA, 25 bp, Mus musculus
gcaatgtccgctgtaccatgaaggg

SEQ ID NO: 673652 - DNA, 25 bp, Mus musculus
gcaatgtcttctccaataagcagga

SEQ ID NO: 673653 - DNA, 25 bp, Mus musculus
gcaatgtcttctgcaataagcagga

SEQ ID NO: 673654 - DNA, 25 bp, Mus musculus
gcaatgtcttgccagatgctacgag

SEQ ID NO: 673655 - DNA, 25 bp, Mus musculus
gcaatgtcttgcgagatgctacgag

SEQ ID NO: 673656 - DNA, 25 bp, Mus musculus
gcaatgtgaagaccttgacaagtct

SEQ ID NO: 673657 - DNA, 25 bp, Mus musculus
gcaatgtgaagagcttgacaagtct

SEQ ID NO: 673658 - DNA, 25 bp, Mus musculus
gcaatgtgacaacctgctcaaggaa

SEQ ID NO: 673659 - DNA, 25 bp, Mus musculus
gcaatgtgacaagctgctcaaggaa

SEQ ID NO: 673660 - DNA, 25 bp, Mus musculus
gcaatgtggagcagtccttcttcaa

SEQ ID NO: 673661 - DNA, 25 bp, Mus musculus
gcaatgtggagctgtccttcttcaa

SEQ ID NO: 673662 - DNA, 25 bp, Mus musculus
gcaatgttcccacatgtatcctgaa

SEQ ID NO: 673663 - DNA, 25 bp, Mus musculus
gcaatgttcccagatgtatcctgaa

SEQ ID NO: 673664 - DNA, 25 bp, Mus musculus
gcaatgttcccgactgcagagagaa

SEQ ID NO: 673665 - DNA, 25 bp, Mus musculus
gcaatgttcccgtctgcagagagaa

SEQ ID NO: 673666 - DNA, 25 bp, Mus musculus
gcaatgttcctgcagtaaaatggga

SEQ ID NO: 673667 - DNA, 25 bp, Mus musculus
gcaatgttcctggagtaaaatggga

SEQ ID NO: 673668 - DNA, 25 bp, Mus musculus
gcaatgttgtatcggctacgcggcc

SEQ ID NO: 673669 - DNA, 25 bp, Mus musculus
gcaatgttgtatgggctacgcggcc

SEQ ID NO: 673670 - DNA, 25 bp, Mus musculus
gcaatgtttctacccatcctgtctg

SEQ ID NO: 673671 - DNA, 25 bp, Mus musculus
gcaatgtttctagccatcctgtctg

SEQ ID NO: 673672 - DNA, 25 bp, Mus musculus
gcaattacctccagtgaccagagca

SEQ ID NO: 673673 - DNA, 25 bp, Mus musculus
gcaattacctcctgtgaccagagca

SEQ ID NO: 673674 - DNA, 25 bp, Mus musculus
gcaattagaaacagtcatatgtcat

SEQ ID NO: 673675 - DNA, 25 bp, Mus musculus
gcaattagaaactgtcatatgtcat

SEQ ID NO: 673676 - DNA, 25 bp, Mus musculus
gcaattagcctcatatttcgcagca

SEQ ID NO: 673677 - DNA, 25 bp, Mus musculus
gcaattagcctcttatttcgcagca

SEQ ID NO: 673678 - DNA, 25 bp, Mus musculus
gcaattaggattccccaggagtcca

SEQ ID NO: 673679 - DNA, 25 bp, Mus musculus
gcaattaggattgcccaggagtcca

SEQ ID NO: 673680 - DNA, 25 bp, Mus musculus
gcaattatcatgcagtgcatgaaga

SEQ ID NO: 673681 - DNA, 25 bp, Mus musculus
gcaattatcatggagtgcatgaaga

SEQ ID NO: 673682 - DNA, 25 bp, Mus musculus
gcaattcaaatgagtctctccagaa

SEQ ID NO: 673683 - DNA, 25 bp, Mus musculus
gcaattcaaatgtgtctctccagaa

SEQ ID NO: 673684 - DNA, 25 bp, Mus musculus
gcaattccactaaccagatatgtac

SEQ ID NO: 673685 - DNA, 25 bp, Mus musculus
gcaattccactatccagatatgtac

SEQ ID NO: 673686 - DNA, 25 bp, Mus musculus
gcaattccagccaatcacctcagag

SEQ ID NO: 673687 - DNA, 25 bp, Mus musculus
gcaattccagcctatcacctcagag

SEQ ID NO: 673688 - DNA, 25 bp, Mus musculus
gcaattccatcaagtacttcacaga

SEQ ID NO: 673689 - DNA, 25 bp, Mus musculus
gcaattccatcatgtacttcacaga

SEQ ID NO: 673690 - DNA, 25 bp, Mus musculus
gcaattccggtcatagaggcccgag

SEQ ID NO: 673691 - DNA, 25 bp, Mus musculus
gcaattccggtcttagaggcccgag

SEQ ID NO: 673692 - DNA, 25 bp, Mus musculus
gcaattcgaagtcacagtgaatcag

SEQ ID NO: 673693 - DNA, 25 bp, Mus musculus
gcaattcgaagtgacagtgaatcag

SEQ ID NO: 673694 - DNA, 25 bp, Mus musculus
gcaattcgcccactgtaaaataaac

SEQ ID NO: 673695 - DNA, 25 bp, Mus musculus
gcaattcgcccagtgtaaaataaac

SEQ ID NO: 673696 - DNA, 25 bp, Mus musculus
gcaattctgaaacgccaactagaag

SEQ ID NO: 673697 - DNA, 25 bp, Mus musculus
gcaattctgaaaggccaactagaag

SEQ ID NO: 673698 - DNA, 25 bp, Mus musculus
gcaattctgcagattcagaggaacc

SEQ ID NO: 673699 - DNA, 25 bp, Mus musculus
gcaattctgcagtttcagaggaacc

SEQ ID NO: 673700 - DNA, 25 bp, Mus musculus
gcaattgatgtcattggtcaaacaa

SEQ ID NO: 673701 - DNA, 25 bp, Mus musculus
gcaattgatgtctttggtcaaacaa

SEQ ID NO: 673702 - DNA, 25 bp, Mus musculus
gcaattgattatcgccaatccacag

SEQ ID NO: 673703 - DNA, 25 bp, Mus musculus
gcaattgattatggccaatccacag

SEQ ID NO: 673704 - DNA, 25 bp, Mus musculus
gcaattgattcgactcttacccgca

SEQ ID NO: 673705 - DNA, 25 bp, Mus musculus
gcaattgattcgtctcttacccgca

SEQ ID NO: 673706 - DNA, 25 bp, Mus musculus
gcaattgccaatattccagcagcag

SEQ ID NO: 673707 - DNA, 25 bp, Mus musculus
gcaattgccaattttccagcagcag

SEQ ID NO: 673708 - DNA, 25 bp, Mus musculus
gcaattgctggacaagatttttcca

SEQ ID NO: 673709 - DNA, 25 bp, Mus musculus
gcaattgctggagaagatttttcca

SEQ ID NO: 673710 - DNA, 25 bp, Mus musculus
gcaattgtaaagctttcagatggct

SEQ ID NO: 673711 - DNA, 25 bp, Mus musculus
gcaattgtaaaggtttcagatggct

SEQ ID NO: 673712 - DNA, 25 bp, Mus musculus
gcaattgtagatcagtttggtcaaa

SEQ ID NO: 673713 - DNA, 25 bp, Mus musculus
gcaattgtagatgagtttggtcaaa

SEQ ID NO: 673714 - DNA, 25 bp, Mus musculus
gcaattgttgatcccgagtggaata

SEQ ID NO: 673715 - DNA, 25 bp, Mus musculus
gcaattgttgatgccgagtggaata

SEQ ID NO: 673716 - DNA, 25 bp, Mus musculus
gcaatttaggcaaaagggattccgt

SEQ ID NO: 673717 - DNA, 25 bp, Mus musculus
gcaatttaggcataagggattccgt

SEQ ID NO: 673718 - DNA, 25 bp, Mus musculus
gcaatttcagtcacccctacgctgg

SEQ ID NO: 673719 - DNA, 25 bp, Mus musculus
gcaatttcagtctcccctacgctgg

SEQ ID NO: 673720 - DNA, 25 bp, Mus musculus
gcaatttcatcacagaatagccctg

SEQ ID NO: 673721 - DNA, 25 bp, Mus musculus
gcaatttcatcagagaatagccctg

SEQ ID NO: 673722 - DNA, 25 bp, Mus musculus
gcaatttccataacagtgtggagga

SEQ ID NO: 673723 - DNA, 25 bp, Mus musculus
gcaatttccatatcagtgtggagga

SEQ ID NO: 673724 - DNA, 25 bp, Mus musculus
gcaatttcggaaaaatggaaagtgg

SEQ ID NO: 673725 - DNA, 25 bp, Mus musculus
gcaatttcggaataatggaaagtgg

SEQ ID NO: 673726 - DNA, 25 bp, Mus musculus
gcaattttcattctttactctccag

SEQ ID NO: 673727 - DNA, 25 bp, Mus musculus
gcaattttcattgtttactctccag

SEQ ID NO: 673728 - DNA, 25 bp, Mus musculus
gcaattttgctcagtttcgaagact

SEQ ID NO: 673729 - DNA, 25 bp, Mus musculus
gcaattttgctctgtttcgaagact

SEQ ID NO: 673730 - DNA, 25 bp, Mus musculus
gcacaaaaatccataccataacctg

SEQ ID NO: 673731 - DNA, 25 bp, Mus musculus
gcacaaaaatccttaccataacctg

SEQ ID NO: 673732 - DNA, 25 bp, Mus musculus
gcacaaaactggatttttgccctat

SEQ ID NO: 673733 - DNA, 25 bp, Mus musculus
gcacaaaactggttttttgccctat

SEQ ID NO: 673734 - DNA, 25 bp, Mus musculus
gcacaaaaggaccatccccatgttt

SEQ ID NO: 673735 - DNA, 25 bp, Mus musculus
gcacaaaaggacgatccccatgttt

SEQ ID NO: 673736 - DNA, 25 bp, Mus musculus
gcacaaacatgtcaacagagactag

SEQ ID NO: 673737 - DNA, 25 bp, Mus musculus
gcacaaacatgtgaacagagactag

SEQ ID NO: 673738 - DNA, 25 bp, Mus musculus
gcacaaagatatctggtccaaggag

SEQ ID NO: 673739 - DNA, 25 bp, Mus musculus
gcacaaagatatgtggtccaaggag

SEQ ID NO: 673740 - DNA, 25 bp, Mus musculus
gcacaaagccatagccgaaggcatc

SEQ ID NO: 673741 - DNA, 25 bp, Mus musculus
gcacaaagccattgccgaaggcatc

SEQ ID NO: 673742 - DNA, 25 bp, Mus musculus
gcacaaatgcagaaccactcgctgg

SEQ ID NO: 673743 - DNA, 25 bp, Mus musculus
gcacaaatgcagtaccactcgctgg

SEQ ID NO: 673744 - DNA, 25 bp, Mus musculus
gcacaaatggatctcaagctccgct

SEQ ID NO: 673745 - DNA, 25 bp, Mus musculus
gcacaaatggatgtcaagctccgct

SEQ ID NO: 673746 - DNA, 25 bp, Mus musculus
gcacaacatcttagtttgagagtaa

SEQ ID NO: 673747 - DNA, 25 bp, Mus musculus
gcacaacatctttgtttgagagtaa

SEQ ID NO: 673748 - DNA, 25 bp, Mus musculus
gcacaacatgggaaaccacctgccg

SEQ ID NO: 673749 - DNA, 25 bp, Mus musculus
gcacaacatgggtaaccacctgccg

SEQ ID NO: 673750 - DNA, 25 bp, Mus musculus
gcacaacattgtcgcaccgtataag

SEQ ID NO: 673751 - DNA, 25 bp, Mus musculus
gcacaacattgtggcaccgtataag

SEQ ID NO: 673752 - DNA, 25 bp, Mus musculus
gcacaaccgtagaccctgaaggaca

SEQ ID NO: 673753 - DNA, 25 bp, Mus musculus
gcacaaccgtagtccctgaaggaca

SEQ ID NO: 673754 - DNA, 25 bp, Mus musculus
gcacaacgacttcccttggcaactg

SEQ ID NO: 673755 - DNA, 25 bp, Mus musculus
gcacaacgacttgccttggcaactg

SEQ ID NO: 673756 - DNA, 25 bp, Mus musculus
gcacaacgcaggaagcgcgttagca

SEQ ID NO: 673757 - DNA, 25 bp, Mus musculus
gcacaacgcaggtagcgcgttagca

SEQ ID NO: 673758 - DNA, 25 bp, Mus musculus
gcacaacgtaaacctggcgtggaga

SEQ ID NO: 673759 - DNA, 25 bp, Mus musculus
gcacaacgtaaagctggcgtggaga

SEQ ID NO: 673760 - DNA, 25 bp, Mus musculus
gcacaactgtatctatgcagcaggg

SEQ ID NO: 673761 - DNA, 25 bp, Mus musculus
gcacaactgtatgtatgcagcaggg

SEQ ID NO: 673762 - DNA, 25 bp, Mus musculus
gcacaacttcaaagagtgtgtcatg

SEQ ID NO: 673763 - DNA, 25 bp, Mus musculus
gcacaacttcaatgagtgtgtcatg

SEQ ID NO: 673764 - DNA, 25 bp, Mus musculus
gcacaacttgaactactggcagctg

SEQ ID NO: 673765 - DNA, 25 bp, Mus musculus
gcacaacttgaagtactggcagctg

SEQ ID NO: 673766 - DNA, 25 bp, Mus musculus
gcacaagaagtgcatcatccaggtg

SEQ ID NO: 673767 - DNA, 25 bp, Mus musculus
gcacaagaagtggatcatccaggtg

SEQ ID NO: 673768 - DNA, 25 bp, Mus musculus
gcacaagactatagaaagcatggta

SEQ ID NO: 673769 - DNA, 25 bp, Mus musculus
gcacaagactattgaaagcatggta

SEQ ID NO: 673770 - DNA, 25 bp, Mus musculus
gcacaagagcgtaatcatgcacctc

SEQ ID NO: 673771 - DNA, 25 bp, Mus musculus
gcacaagagcgttatcatgcacctc

SEQ ID NO: 673772 - DNA, 25 bp, Mus musculus
gcacaagatcctctcttacaacctg

SEQ ID NO: 673773 - DNA, 25 bp, Mus musculus
gcacaagatcctgtcttacaacctg

SEQ ID NO: 673774 - DNA, 25 bp, Mus musculus
gcacaagcacctctagggaccagtt

SEQ ID NO: 673775 - DNA, 25 bp, Mus musculus
gcacaagcacctgtagggaccagtt

SEQ ID NO: 673776 - DNA, 25 bp, Mus musculus
gcacaagctccgaaaattcctacag

SEQ ID NO: 673777 - DNA, 25 bp, Mus musculus
gcacaagctccgtaaattcctacag

SEQ ID NO: 673778 - DNA, 25 bp, Mus musculus
gcacaagctggccaagagcatccct

SEQ ID NO: 673779 - DNA, 25 bp, Mus musculus
gcacaagctggcgaagagcatccct

SEQ ID NO: 673780 - DNA, 25 bp, Mus musculus
gcacaaggagatagacggccgtctt

SEQ ID NO: 673781 - DNA, 25 bp, Mus musculus
gcacaaggagattgacggccgtctt

SEQ ID NO: 673782 - DNA, 25 bp, Mus musculus
gcacaaggcataatggactatgtag

SEQ ID NO: 673783 - DNA, 25 bp, Mus musculus
gcacaaggcatattggactatgtag

SEQ ID NO: 673784 - DNA, 25 bp, Mus musculus
gcacaagggaacagctctgcacagc

SEQ ID NO: 673785 - DNA, 25 bp, Mus musculus
gcacaagggaactgctctgcacagc

SEQ ID NO: 673786 - DNA, 25 bp, Mus musculus
gcacaagggataatttgggtttgcc

SEQ ID NO: 673787 - DNA, 25 bp, Mus musculus
gcacaagggatattttgggtttgcc

SEQ ID NO: 673788 - DNA, 25 bp, Mus musculus
gcacaagtacttagaggagagcttc

SEQ ID NO: 673789 - DNA, 25 bp, Mus musculus
gcacaagtactttgaggagagcttc

SEQ ID NO: 673790 - DNA, 25 bp, Mus musculus
gcacaagtctatctccttccagatt

SEQ ID NO: 673791 - DNA, 25 bp, Mus musculus
gcacaagtctatgtccttccagatt

SEQ ID NO: 673792 - DNA, 25 bp, Mus musculus
gcacaagtgtgtccaggcaaacccc

SEQ ID NO: 673793 - DNA, 25 bp, Mus musculus
gcacaagtgtgtgcaggcaaacccc

SEQ ID NO: 673794 - DNA, 25 bp, Mus musculus
gcacaatatgaccacagcccatctg

SEQ ID NO: 673795 - DNA, 25 bp, Mus musculus
gcacaatatgacgacagcccatctg

SEQ ID NO: 673796 - DNA, 25 bp, Mus musculus
gcacaatcgagtacatggctcccga

SEQ ID NO: 673797 - DNA, 25 bp, Mus musculus
gcacaatcgagttcatggctcccga

SEQ ID NO: 673798 - DNA, 25 bp, Mus musculus
gcacaatgaattcaactgcacaaaa

SEQ ID NO: 673799 - DNA, 25 bp, Mus musculus
gcacaatgaattgaactgcacaaaa

SEQ ID NO: 673800 - DNA, 25 bp, Mus musculus
gcacaatgccttacatatctttatg

SEQ ID NO: 673801 - DNA, 25 bp, Mus musculus
gcacaatgcctttcatatctttatg

SEQ ID NO: 673802 - DNA, 25 bp, Mus musculus
gcacaatgggtcctccagaaaaaga

SEQ ID NO: 673803 - DNA, 25 bp, Mus musculus
gcacaatgggtcgtccagaaaaaga

SEQ ID NO: 673804 - DNA, 25 bp, Mus musculus
gcacaatgtaagaactgatttaagg

SEQ ID NO: 673805 - DNA, 25 bp, Mus musculus
gcacaatgtaagtactgatttaagg

SEQ ID NO: 673806 - DNA, 25 bp, Mus musculus
gcacaatgtggcctgtcttcacaag

SEQ ID NO: 673807 - DNA, 25 bp, Mus musculus
gcacaatgtggcgtgtcttcacaag

SEQ ID NO: 673808 - DNA, 25 bp, Mus musculus
gcacaatgttatcgcactacgggag

SEQ ID NO: 673809 - DNA, 25 bp, Mus musculus
gcacaatgttatggcactacgggag

SEQ ID NO: 673810 - DNA, 25 bp, Mus musculus
gcacaattcctccaacagtcagaag

SEQ ID NO: 673811 - DNA, 25 bp, Mus musculus
gcacaattcctcgaacagtcagaag

SEQ ID NO: 673812 - DNA, 25 bp, Mus musculus
gcacaattgcgtacccaactccgtg

SEQ ID NO: 673813 - DNA, 25 bp, Mus musculus
gcacaattgcgttcccaactccgtg

SEQ ID NO: 673814 - DNA, 25 bp, Mus musculus
gcacaattgtttatctgggtaggta

SEQ ID NO: 673815 - DNA, 25 bp, Mus musculus
gcacaattgtttttctgggtaggta

SEQ ID NO: 673816 - DNA, 25 bp, Mus musculus
gcacacaaaccaatggtctggactt

SEQ ID NO: 673817 - DNA, 25 bp, Mus musculus
gcacacaaaccattggtctggactt

SEQ ID NO: 673818 - DNA, 25 bp, Mus musculus
gcacacaagtataaggttcctgacc

SEQ ID NO: 673819 - DNA, 25 bp, Mus musculus
gcacacaagtattaggttcctgacc

SEQ ID NO: 673820 - DNA, 25 bp, Mus musculus
gcacacaatgcacactatgagcggg

SEQ ID NO: 673821 - DNA, 25 bp, Mus musculus
gcacacaatgcagactatgagcggg

SEQ ID NO: 673822 - DNA, 25 bp, Mus musculus
gcacacacaagaacttcagaacatt

SEQ ID NO: 673823 - DNA, 25 bp, Mus musculus
gcacacacaagatcttcagaacatt

SEQ ID NO: 673824 - DNA, 25 bp, Mus musculus
gcacacacaggcctcgacctgtctg

SEQ ID NO: 673825 - DNA, 25 bp, Mus musculus
gcacacacaggcgtcgacctgtctg

SEQ ID NO: 673826 - DNA, 25 bp, Mus musculus
gcacacacctatctgtatgtctaca

SEQ ID NO: 673827 - DNA, 25 bp, Mus musculus
gcacacacctatgtgtatgtctaca

SEQ ID NO: 673828 - DNA, 25 bp, Mus musculus
gcacacagaactcgatatggtacca

SEQ ID NO: 673829 - DNA, 25 bp, Mus musculus
gcacacagaactggatatggtacca

SEQ ID NO: 673830 - DNA, 25 bp, Mus musculus
gcacacagaccacctcacaggagtt

SEQ ID NO: 673831 - DNA, 25 bp, Mus musculus
gcacacagaccagctcacaggagtt

SEQ ID NO: 673832 - DNA, 25 bp, Mus musculus
gcacacagcctaccacaaggcaagg

SEQ ID NO: 673833 - DNA, 25 bp, Mus musculus
gcacacagcctagcacaaggcaagg

SEQ ID NO: 673834 - DNA, 25 bp, Mus musculus
gcacacaggttgcttcttgaccaaa

SEQ ID NO: 673835 - DNA, 25 bp, Mus musculus
gcacacaggttggttcttgaccaaa

SEQ ID NO: 673836 - DNA, 25 bp, Mus musculus
gcacacagtcgtcgcatataaggat

SEQ ID NO: 673837 - DNA, 25 bp, Mus musculus
gcacacagtcgtggcatataaggat

SEQ ID NO: 673838 - DNA, 25 bp, Mus musculus
gcacacatttaacaaaactatgcag

SEQ ID NO: 673839 - DNA, 25 bp, Mus musculus
gcacacatttaagaaaactatgcag

SEQ ID NO: 673840 - DNA, 25 bp, Mus musculus
gcacaccaagatcacagatgtcaaa

SEQ ID NO: 673841 - DNA, 25 bp, Mus musculus
gcacaccaagatgacagatgtcaaa

SEQ ID NO: 673842 - DNA, 25 bp, Mus musculus
gcacaccacccaaatctgatcaaat

SEQ ID NO: 673843 - DNA, 25 bp, Mus musculus
gcacaccacccatatctgatcaaat

SEQ ID NO: 673844 - DNA, 25 bp, Mus musculus
gcacaccaggccacgagaactttgt

SEQ ID NO: 673845 - DNA, 25 bp, Mus musculus
gcacaccaggcctcgagaactttgt

SEQ ID NO: 673846 - DNA, 25 bp, Mus musculus
gcacaccatccaaagtacttgtcaa

SEQ ID NO: 673847 - DNA, 25 bp, Mus musculus
gcacaccatccatagtacttgtcaa

SEQ ID NO: 673848 - DNA, 25 bp, Mus musculus
gcacaccatttgaggagagagacga

SEQ ID NO: 673849 - DNA, 25 bp, Mus musculus
gcacaccatttgtggagagagacga

SEQ ID NO: 673850 - DNA, 25 bp, Mus musculus
gcacaccgacatccacatcagtgga

SEQ ID NO: 673851 - DNA, 25 bp, Mus musculus
gcacaccgacatgcacatcagtgga

SEQ ID NO: 673852 - DNA, 25 bp, Mus musculus
gcacaccggcttcttcactactgtg

SEQ ID NO: 673853 - DNA, 25 bp, Mus musculus
gcacaccggcttgttcactactgtg

SEQ ID NO: 673854 - DNA, 25 bp, Mus musculus
gcacacctttacacctggcagctgg

SEQ ID NO: 673855 - DNA, 25 bp, Mus musculus
gcacacctttactcctggcagctgg

SEQ ID NO: 673856 - DNA, 25 bp, Mus musculus
gcacacgcgcctcgcgagctggctc

SEQ ID NO: 673857 - DNA, 25 bp, Mus musculus
gcacacgcgcctggcgagctggctc

SEQ ID NO: 673858 - DNA, 25 bp, Mus musculus
gcacacggaggaagatgctgacttt

SEQ ID NO: 673859 - DNA, 25 bp, Mus musculus
gcacacggaggatgatgctgacttt

SEQ ID NO: 673860 - DNA, 25 bp, Mus musculus
gcacacgtgtttcggatcacgttct

SEQ ID NO: 673861 - DNA, 25 bp, Mus musculus
gcacacgtgtttgggatcacgttct

SEQ ID NO: 673862 - DNA, 25 bp, Mus musculus
gcacactcaagtctgaagatgtccc

SEQ ID NO: 673863 - DNA, 25 bp, Mus musculus
gcacactcaagtgtgaagatgtccc

SEQ ID NO: 673864 - DNA, 25 bp, Mus musculus
gcacactctggacgcatgcgcacgg

SEQ ID NO: 673865 - DNA, 25 bp, Mus musculus
gcacactctggaggcatgcgcacgg

SEQ ID NO: 673866 - DNA, 25 bp, Mus musculus
gcacactggacacaagatgcctctg

SEQ ID NO: 673867 - DNA, 25 bp, Mus musculus
gcacactggacagaagatgcctctg

SEQ ID NO: 673868 - DNA, 25 bp, Mus musculus
gcacactggatgacgggctgattga

SEQ ID NO: 673869 - DNA, 25 bp, Mus musculus
gcacactggatgtcgggctgattga

SEQ ID NO: 673870 - DNA, 25 bp, Mus musculus
gcacacttactgctcgattccaggt

SEQ ID NO: 673871 - DNA, 25 bp, Mus musculus
gcacacttactggtcgattccaggt

SEQ ID NO: 673872 - DNA, 25 bp, Mus musculus
gcacacttcattcgctggtatctga

SEQ ID NO: 673873 - DNA, 25 bp, Mus musculus
gcacacttcattggctggtatctga

SEQ ID NO: 673874 - DNA, 25 bp, Mus musculus
gcacacttgagtacttttttactag

SEQ ID NO: 673875 - DNA, 25 bp, Mus musculus
gcacacttgagttcttttttactag

SEQ ID NO: 673876 - DNA, 25 bp, Mus musculus
gcacacttgcatacaccgctcagaa

SEQ ID NO: 673877 - DNA, 25 bp, Mus musculus
gcacacttgcattcaccgctcagaa

SEQ ID NO: 673878 - DNA, 25 bp, Mus musculus
gcacacttggaacacaagtacagat

SEQ ID NO: 673879 - DNA, 25 bp, Mus musculus
gcacacttggaagacaagtacagat

SEQ ID NO: 673880 - DNA, 25 bp, Mus musculus
gcacagaaaccgagggcaccagact

SEQ ID NO: 673881 - DNA, 25 bp, Mus musculus
gcacagaaaccgtgggcaccagact

SEQ ID NO: 673882 - DNA, 25 bp, Mus musculus
gcacagaaagagaaataccttccca

SEQ ID NO: 673883 - DNA, 25 bp, Mus musculus
gcacagaaagagtaataccttccca

SEQ ID NO: 673884 - DNA, 25 bp, Mus musculus
gcacagaagtcgagaaggccaaggc

SEQ ID NO: 673885 - DNA, 25 bp, Mus musculus
gcacagaagtcgtgaaggccaaggc

SEQ ID NO: 673886 - DNA, 25 bp, Mus musculus
gcacagacacggcatgaccagtgga

SEQ ID NO: 673887 - DNA, 25 bp, Mus musculus
gcacagacacgggatgaccagtgga

SEQ ID NO: 673888 - DNA, 25 bp, Mus musculus
gcacagaccgtgatggctacttccc

SEQ ID NO: 673889 - DNA, 25 bp, Mus musculus
gcacagaccgtgttggctacttccc

SEQ ID NO: 673890 - DNA, 25 bp, Mus musculus
gcacagacttgactgactacctcaa

SEQ ID NO: 673891 - DNA, 25 bp, Mus musculus
gcacagacttgagtgactacctcaa

SEQ ID NO: 673892 - DNA, 25 bp, Mus musculus
gcacagacttgtagcagagccaaac

SEQ ID NO: 673893 - DNA, 25 bp, Mus musculus
gcacagacttgttgcagagccaaac

SEQ ID NO: 673894 - DNA, 25 bp, Mus musculus
gcacagagaatcagtttgcctcccg

SEQ ID NO: 673895 - DNA, 25 bp, Mus musculus
gcacagagaatctgtttgcctcccg

SEQ ID NO: 673896 - DNA, 25 bp, Mus musculus
gcacagagacctcaaaccgcagaac

SEQ ID NO: 673897 - DNA, 25 bp, Mus musculus
gcacagagacctgaaaccgcagaac

SEQ ID NO: 673898 - DNA, 25 bp, Mus musculus
gcacagagcaaacaggacaaggaag

SEQ ID NO: 673899 - DNA, 25 bp, Mus musculus
gcacagagcaaagaggacaaggaag

SEQ ID NO: 673900 - DNA, 25 bp, Mus musculus
gcacagagcaacctgcatgaagcag

SEQ ID NO: 673901 - DNA, 25 bp, Mus musculus
gcacagagcaacgtgcatgaagcag

SEQ ID NO: 673902 - DNA, 25 bp, Mus musculus
gcacagagctcaaggcacagctgga

SEQ ID NO: 673903 - DNA, 25 bp, Mus musculus
gcacagagctcatggcacagctgga

SEQ ID NO: 673904 - DNA, 25 bp, Mus musculus
gcacagaggtcacttaaaggtccag

SEQ ID NO: 673905 - DNA, 25 bp, Mus musculus
gcacagaggtcagttaaaggtccag

SEQ ID NO: 673906 - DNA, 25 bp, Mus musculus
gcacagagtctaaggtcagtcaccg

SEQ ID NO: 673907 - DNA, 25 bp, Mus musculus
gcacagagtctatggtcagtcaccg

SEQ ID NO: 673908 - DNA, 25 bp, Mus musculus
gcacagagttcacctaaagtcaatt

SEQ ID NO: 673909 - DNA, 25 bp, Mus musculus
gcacagagttcagctaaagtcaatt

SEQ ID NO: 673910 - DNA, 25 bp, Mus musculus
gcacagatcaatacctcaatgacta

SEQ ID NO: 673911 - DNA, 25 bp, Mus musculus
gcacagatcaattcctcaatgacta

SEQ ID NO: 673912 - DNA, 25 bp, Mus musculus
gcacagatgaccatataataaaagg

SEQ ID NO: 673913 - DNA, 25 bp, Mus musculus
gcacagatgaccttataataaaagg

SEQ ID NO: 673914 - DNA, 25 bp, Mus musculus
gcacagatggccatgaggccttcct

SEQ ID NO: 673915 - DNA, 25 bp, Mus musculus
gcacagatggccttgaggccttcct

SEQ ID NO: 673916 - DNA, 25 bp, Mus musculus
gcacagattgcaacaaagattgcac

SEQ ID NO: 673917 - DNA, 25 bp, Mus musculus
gcacagattgcatcaaagattgcac

SEQ ID NO: 673918 - DNA, 25 bp, Mus musculus
gcacagattgtccatctccttctag

SEQ ID NO: 673919 - DNA, 25 bp, Mus musculus
gcacagattgtcgatctccttctag

SEQ ID NO: 673920 - DNA, 25 bp, Mus musculus
gcacagcaacgacagcatgggcagc

SEQ ID NO: 673921 - DNA, 25 bp, Mus musculus
gcacagcaacgagagcatgggcagc

SEQ ID NO: 673922 - DNA, 25 bp, Mus musculus
gcacagcacacgatagagatggcct

SEQ ID NO: 673923 - DNA, 25 bp, Mus musculus
gcacagcacacgttagagatggcct

SEQ ID NO: 673924 - DNA, 25 bp, Mus musculus
gcacagcactccaatgcagccattg

SEQ ID NO: 673925 - DNA, 25 bp, Mus musculus
gcacagcactcctatgcagccattg

SEQ ID NO: 673926 - DNA, 25 bp, Mus musculus
gcacagcagcgcatttgactcagaa

SEQ ID NO: 673927 - DNA, 25 bp, Mus musculus
gcacagcagcgcttttgactcagaa

SEQ ID NO: 673928 - DNA, 25 bp, Mus musculus
gcacagcatgcgaactgactgggca

SEQ ID NO: 673929 - DNA, 25 bp, Mus musculus
gcacagcatgcgtactgactgggca

SEQ ID NO: 673930 - DNA, 25 bp, Mus musculus
gcacagccaaggaggtctaccattt

SEQ ID NO: 673931 - DNA, 25 bp, Mus musculus
gcacagccaaggtggtctaccattt

SEQ ID NO: 673932 - DNA, 25 bp, Mus musculus
gcacagccggaacttcctatccgtg

SEQ ID NO: 673933 - DNA, 25 bp, Mus musculus
gcacagccggaagttcctatccgtg

SEQ ID NO: 673934 - DNA, 25 bp, Mus musculus
gcacagcctcttcatatgtagacag

SEQ ID NO: 673935 - DNA, 25 bp, Mus musculus
gcacagcctcttgatatgtagacag

SEQ ID NO: 673936 - DNA, 25 bp, Mus musculus
gcacagcctgtccaagaatacgcag

SEQ ID NO: 673937 - DNA, 25 bp, Mus musculus
gcacagcctgtcgaagaatacgcag

SEQ ID NO: 673938 - DNA, 25 bp, Mus musculus
gcacagcggcagcatcctggactct

SEQ ID NO: 673939 - DNA, 25 bp, Mus musculus
gcacagcggcaggatcctggactct

SEQ ID NO: 673940 - DNA, 25 bp, Mus musculus
gcacagcgtctactgaagactccca

SEQ ID NO: 673941 - DNA, 25 bp, Mus musculus
gcacagcgtctagtgaagactccca

SEQ ID NO: 673942 - DNA, 25 bp, Mus musculus
gcacagcgtgcaacaaggcagggac

SEQ ID NO: 673943 - DNA, 25 bp, Mus musculus
gcacagcgtgcatcaaggcagggac

SEQ ID NO: 673944 - DNA, 25 bp, Mus musculus
gcacagctatgtcgaagccctgcat

SEQ ID NO: 673945 - DNA, 25 bp, Mus musculus
gcacagctatgtggaagccctgcat

SEQ ID NO: 673946 - DNA, 25 bp, Mus musculus
gcacagctcggacctccctggaggt

SEQ ID NO: 673947 - DNA, 25 bp, Mus musculus
gcacagctcggagctccctggaggt

SEQ ID NO: 673948 - DNA, 25 bp, Mus musculus
gcacagctgcagcatgccggcatat

SEQ ID NO: 673949 - DNA, 25 bp, Mus musculus
gcacagctgcaggatgccggcatat

SEQ ID NO: 673950 - DNA, 25 bp, Mus musculus
gcacagctggtccatgtcccggaat

SEQ ID NO: 673951 - DNA, 25 bp, Mus musculus
gcacagctggtcgatgtcccggaat

SEQ ID NO: 673952 - DNA, 25 bp, Mus musculus
gcacagctggtgaaagatcgaaact

SEQ ID NO: 673953 - DNA, 25 bp, Mus musculus
gcacagctggtgtaagatcgaaact

SEQ ID NO: 673954 - DNA, 25 bp, Mus musculus
gcacagctgtctatggggacgccag

SEQ ID NO: 673955 - DNA, 25 bp, Mus musculus
gcacagctgtctttggggacgccag

SEQ ID NO: 673956 - DNA, 25 bp, Mus musculus
gcacagcttagtaagacttcagaag

SEQ ID NO: 673957 - DNA, 25 bp, Mus musculus
gcacagcttagttagacttcagaag

SEQ ID NO: 673958 - DNA, 25 bp, Mus musculus
gcacaggaaagtaagccaggagtaa

SEQ ID NO: 673959 - DNA, 25 bp, Mus musculus
gcacaggaaagttagccaggagtaa

SEQ ID NO: 673960 - DNA, 25 bp, Mus musculus
gcacaggacggcctcagttgcatag

SEQ ID NO: 673961 - DNA, 25 bp, Mus musculus
gcacaggacggcgtcagttgcatag

SEQ ID NO: 673962 - DNA, 25 bp, Mus musculus
gcacaggagaccaggcccagagacc

SEQ ID NO: 673963 - DNA, 25 bp, Mus musculus
gcacaggagacctggcccagagacc

SEQ ID NO: 673964 - DNA, 25 bp, Mus musculus
gcacaggagccccaagtgtctagct

SEQ ID NO: 673965 - DNA, 25 bp, Mus musculus
gcacaggagcccgaagtgtctagct

SEQ ID NO: 673966 - DNA, 25 bp, Mus musculus
gcacaggagcgtatgcaccacgata

SEQ ID NO: 673967 - DNA, 25 bp, Mus musculus
gcacaggagcgtttgcaccacgata

SEQ ID NO: 673968 - DNA, 25 bp, Mus musculus
gcacaggatgcacggcttacggcta

SEQ ID NO: 673969 - DNA, 25 bp, Mus musculus
gcacaggatgcagggcttacggcta

SEQ ID NO: 673970 - DNA, 25 bp, Mus musculus
gcacaggattccaggaacatccacc

SEQ ID NO: 673971 - DNA, 25 bp, Mus musculus
gcacaggattcctggaacatccacc

SEQ ID NO: 673972 - DNA, 25 bp, Mus musculus
gcacaggcccatcggacaagcacaa

SEQ ID NO: 673973 - DNA, 25 bp, Mus musculus
gcacaggcccatgggacaagcacaa

SEQ ID NO: 673974 - DNA, 25 bp, Mus musculus
gcacaggcctgacctgattgagtat

SEQ ID NO: 673975 - DNA, 25 bp, Mus musculus
gcacaggcctgagctgattgagtat

SEQ ID NO: 673976 - DNA, 25 bp, Mus musculus
gcacaggctctcaatgccagcatga

SEQ ID NO: 673977 - DNA, 25 bp, Mus musculus
gcacaggctctctatgccagcatga

SEQ ID NO: 673978 - DNA, 25 bp, Mus musculus
gcacagggaaacatgtattgtagaa

SEQ ID NO: 673979 - DNA, 25 bp, Mus musculus
gcacagggaaacttgtattgtagaa

SEQ ID NO: 673980 - DNA, 25 bp, Mus musculus
gcacagggactcagacttcagccca

SEQ ID NO: 673981 - DNA, 25 bp, Mus musculus
gcacagggactctgacttcagccca

SEQ ID NO: 673982 - DNA, 25 bp, Mus musculus
gcacaggtgactaaatggtggcctc

SEQ ID NO: 673983 - DNA, 25 bp, Mus musculus
gcacaggtgacttaatggtggcctc

SEQ ID NO: 673984 - DNA, 25 bp, Mus musculus
gcacaggtgcttatcgccaaggacg

SEQ ID NO: 673985 - DNA, 25 bp, Mus musculus
gcacaggtgcttttcgccaaggacg

SEQ ID NO: 673986 - DNA, 25 bp, Mus musculus
gcacaggtggaaagcacacaggctg

SEQ ID NO: 673987 - DNA, 25 bp, Mus musculus
gcacaggtggaatgcacacaggctg

SEQ ID NO: 673988 - DNA, 25 bp, Mus musculus
gcacagtaagaaccctcgggcaggt

SEQ ID NO: 673989 - DNA, 25 bp, Mus musculus
gcacagtaagaagcctcgggcaggt

SEQ ID NO: 673990 - DNA, 25 bp, Mus musculus
gcacagtaccggaagaagcagctgg

SEQ ID NO: 673991 - DNA, 25 bp, Mus musculus
gcacagtaccggtagaagcagctgg

SEQ ID NO: 673992 - DNA, 25 bp, Mus musculus
gcacagtctcttccggcgacagctg

SEQ ID NO: 673993 - DNA, 25 bp, Mus musculus
gcacagtctcttgcggcgacagctg

SEQ ID NO: 673994 - DNA, 25 bp, Mus musculus
gcacagtctgcgctgtccgaagtgt

SEQ ID NO: 673995 - DNA, 25 bp, Mus musculus
gcacagtctgcggtgtccgaagtgt

SEQ ID NO: 673996 - DNA, 25 bp, Mus musculus
gcacagtgaacgagtattactacag

SEQ ID NO: 673997 - DNA, 25 bp, Mus musculus
gcacagtgaacgtgtattactacag

SEQ ID NO: 673998 - DNA, 25 bp, Mus musculus
gcacagtgactgagaatggagtcaa

SEQ ID NO: 673999 - DNA, 25 bp, Mus musculus
gcacagtgactgtgaatggagtcaa

SEQ ID NO: 674000 - DNA, 25 bp, Mus musculus
gcacagtgcagaaatgaggccatac

SEQ ID NO: 674001 - DNA, 25 bp, Mus musculus
gcacagtgcagatatgaggccatac

SEQ ID NO: 674002 - DNA, 25 bp, Mus musculus
gcacagtgccaaccagaaaattcag

SEQ ID NO: 674003 - DNA, 25 bp, Mus musculus
gcacagtgccaagcagaaaattcag

SEQ ID NO: 674004 - DNA, 25 bp, Mus musculus
gcacagtgccggacactgctggcca

SEQ ID NO: 674005 - DNA, 25 bp, Mus musculus
gcacagtgccggtcactgctggcca

SEQ ID NO: 674006 - DNA, 25 bp, Mus musculus
gcacagtggagcagtcggttctgca

SEQ ID NO: 674007 - DNA, 25 bp, Mus musculus
gcacagtggagctgtcggttctgca

SEQ ID NO: 674008 - DNA, 25 bp, Mus musculus
gcacagtggtacagaagacttctac

SEQ ID NO: 674009 - DNA, 25 bp, Mus musculus
gcacagtggtactgaagacttctac

SEQ ID NO: 674010 - DNA, 25 bp, Mus musculus
gcacagttaccaaaaccgagcgcct

SEQ ID NO: 674011 - DNA, 25 bp, Mus musculus
gcacagttaccataaccgagcgcct

SEQ ID NO: 674012 - DNA, 25 bp, Mus musculus
gcacagttcttcaaaagagaatctc

SEQ ID NO: 674013 - DNA, 25 bp, Mus musculus
gcacagttcttctaaagagaatctc

SEQ ID NO: 674014 - DNA, 25 bp, Mus musculus
gcacagttggataaaagcagtctct

SEQ ID NO: 674015 - DNA, 25 bp, Mus musculus
gcacagttggattaaagcagtctct

SEQ ID NO: 674016 - DNA, 25 bp, Mus musculus
gcacagtttctcaagatttcatcag

SEQ ID NO: 674017 - DNA, 25 bp, Mus musculus
gcacagtttctctagatttcatcag

SEQ ID NO: 674018 - DNA, 25 bp, Mus musculus
gcacatacccggacctcaaggaaga

SEQ ID NO: 674019 - DNA, 25 bp, Mus musculus
gcacatacccggtcctcaaggaaga

SEQ ID NO: 674020 - DNA, 25 bp, Mus musculus
gcacatacgcacctttaaaaccaga

SEQ ID NO: 674021 - DNA, 25 bp, Mus musculus
gcacatacgcacgtttaaaaccaga

SEQ ID NO: 674022 - DNA, 25 bp, Mus musculus
gcacatagaccaccggttggtgttc

SEQ ID NO: 674023 - DNA, 25 bp, Mus musculus
gcacatagaccagcggttggtgttc

SEQ ID NO: 674024 - DNA, 25 bp, Mus musculus
gcacatattcagctcagcatcagcg

SEQ ID NO: 674025 - DNA, 25 bp, Mus musculus
gcacatattcaggtcagcatcagcg

SEQ ID NO: 674026 - DNA, 25 bp, Mus musculus
gcacatattgatcttcgtaacaaga

SEQ ID NO: 674027 - DNA, 25 bp, Mus musculus
gcacatattgatgttcgtaacaaga

SEQ ID NO: 674028 - DNA, 25 bp, Mus musculus
gcacatatttaaactagcccaagga

SEQ ID NO: 674029 - DNA, 25 bp, Mus musculus
gcacatatttaatctagcccaagga

SEQ ID NO: 674030 - DNA, 25 bp, Mus musculus
gcacatcacgctcgagctccatgga

SEQ ID NO: 674031 - DNA, 25 bp, Mus musculus
gcacatcacgctggagctccatgga

SEQ ID NO: 674032 - DNA, 25 bp, Mus musculus
gcacatcagcgcatccagttcagca

SEQ ID NO: 674033 - DNA, 25 bp, Mus musculus
gcacatcagcgcttccagttcagca

SEQ ID NO: 674034 - DNA, 25 bp, Mus musculus
gcacatcagtcccaacaaccgaaat

SEQ ID NO: 674035 - DNA, 25 bp, Mus musculus
gcacatcagtccgaacaaccgaaat

SEQ ID NO: 674036 - DNA, 25 bp, Mus musculus
gcacatccaccaagatccgtgtagt

SEQ ID NO: 674037 - DNA, 25 bp, Mus musculus
gcacatccaccatgatccgtgtagt

SEQ ID NO: 674038 - DNA, 25 bp, Mus musculus
gcacatcgccctcttgctgtggcag

SEQ ID NO: 674039 - DNA, 25 bp, Mus musculus
gcacatcgccctgttgctgtggcag

SEQ ID NO: 674040 - DNA, 25 bp, Mus musculus
gcacatcgtctgaatccttacacag

SEQ ID NO: 674041 - DNA, 25 bp, Mus musculus
gcacatcgtctgtatccttacacag

SEQ ID NO: 674042 - DNA, 25 bp, Mus musculus
gcacatctactgatgagtcctcaga

SEQ ID NO: 674043 - DNA, 25 bp, Mus musculus
gcacatctactgttgagtcctcaga

SEQ ID NO: 674044 - DNA, 25 bp, Mus musculus
gcacatctataacaagaatgggagt

SEQ ID NO: 674045 - DNA, 25 bp, Mus musculus
gcacatctataagaagaatgggagt

SEQ ID NO: 674046 - DNA, 25 bp, Mus musculus
gcacatctccatattcaccacgtta

SEQ ID NO: 674047 - DNA, 25 bp, Mus musculus
gcacatctccattttcaccacgtta

SEQ ID NO: 674048 - DNA, 25 bp, Mus musculus
gcacatctctgaaccaagacatgaa

SEQ ID NO: 674049 - DNA, 25 bp, Mus musculus
gcacatctctgatccaagacatgaa

SEQ ID NO: 674050 - DNA, 25 bp, Mus musculus
gcacatcttcctctatcgtggtcag

SEQ ID NO: 674051 - DNA, 25 bp, Mus musculus
gcacatcttcctgtatcgtggtcag

SEQ ID NO: 674052 - DNA, 25 bp, Mus musculus
gcacatgaccaaatgaacatattgt

SEQ ID NO: 674053 - DNA, 25 bp, Mus musculus
gcacatgaccaattgaacatattgt

SEQ ID NO: 674054 - DNA, 25 bp, Mus musculus
gcacatgactcacggcttggacatg

SEQ ID NO: 674055 - DNA, 25 bp, Mus musculus
gcacatgactcagggcttggacatg

SEQ ID NO: 674056 - DNA, 25 bp, Mus musculus
gcacatgagcatctcgggcagcagt

SEQ ID NO: 674057 - DNA, 25 bp, Mus musculus
gcacatgagcatgtcgggcagcagt

SEQ ID NO: 674058 - DNA, 25 bp, Mus musculus
gcacatgagcgaccaattctcccag

SEQ ID NO: 674059 - DNA, 25 bp, Mus musculus
gcacatgagcgagcaattctcccag

SEQ ID NO: 674060 - DNA, 25 bp, Mus musculus
gcacatgatggaattcaggtgttgt

SEQ ID NO: 674061 - DNA, 25 bp, Mus musculus
gcacatgatggatttcaggtgttgt

SEQ ID NO: 674062 - DNA, 25 bp, Mus musculus
gcacatgattgacagacagagaatg

SEQ ID NO: 674063 - DNA, 25 bp, Mus musculus
gcacatgattgagagacagagaatg

SEQ ID NO: 674064 - DNA, 25 bp, Mus musculus
gcacatgccacaaaacgccacgttt

SEQ ID NO: 674065 - DNA, 25 bp, Mus musculus
gcacatgccacataacgccacgttt

SEQ ID NO: 674066 - DNA, 25 bp, Mus musculus
gcacatgcgattctttctgttaatg

SEQ ID NO: 674067 - DNA, 25 bp, Mus musculus
gcacatgcgattgtttctgttaatg

SEQ ID NO: 674068 - DNA, 25 bp, Mus musculus
gcacatgctgcccacagttcttcgt

SEQ ID NO: 674069 - DNA, 25 bp, Mus musculus
gcacatgctgccgacagttcttcgt

SEQ ID NO: 674070 - DNA, 25 bp, Mus musculus
gcacatggatttcagaactacctgt

SEQ ID NO: 674071 - DNA, 25 bp, Mus musculus
gcacatggatttgagaactacctgt

SEQ ID NO: 674072 - DNA, 25 bp, Mus musculus
gcacatggcttcaccttcactcggg

SEQ ID NO: 674073 - DNA, 25 bp, Mus musculus
gcacatggcttctccttcactcggg

SEQ ID NO: 674074 - DNA, 25 bp, Mus musculus
gcacatgggattaatctcagcaatt

SEQ ID NO: 674075 - DNA, 25 bp, Mus musculus
gcacatgggatttatctcagcaatt

SEQ ID NO: 674076 - DNA, 25 bp, Mus musculus
gcacatgtcaatatttccatggaga

SEQ ID NO: 674077 - DNA, 25 bp, Mus musculus
gcacatgtcaatttttccatggaga

SEQ ID NO: 674078 - DNA, 25 bp, Mus musculus
gcacatgtccgcaggatctcaacag

SEQ ID NO: 674079 - DNA, 25 bp, Mus musculus
gcacatgtccgctggatctcaacag

SEQ ID NO: 674080 - DNA, 25 bp, Mus musculus
gcacatgttccactacacatgacca

SEQ ID NO: 674081 - DNA, 25 bp, Mus musculus
gcacatgttccagtacacatgacca

SEQ ID NO: 674082 - DNA, 25 bp, Mus musculus
gcacatgtttacagaccatattgta

SEQ ID NO: 674083 - DNA, 25 bp, Mus musculus
gcacatgtttactgaccatattgta

SEQ ID NO: 674084 - DNA, 25 bp, Mus musculus
gcacatgtttcaatacattcagaag

SEQ ID NO: 674085 - DNA, 25 bp, Mus musculus
gcacatgtttcattacattcagaag

SEQ ID NO: 674086 - DNA, 25 bp, Mus musculus
gcacattaaaggaagtgagctcacc

SEQ ID NO: 674087 - DNA, 25 bp, Mus musculus
gcacattaaaggtagtgagctcacc

SEQ ID NO: 674088 - DNA, 25 bp, Mus musculus
gcacattccaggaaatgcaagaggg

SEQ ID NO: 674089 - DNA, 25 bp, Mus musculus
gcacattccaggtaatgcaagaggg

SEQ ID NO: 674090 - DNA, 25 bp, Mus musculus
gcacattgacagaaacaacggttgt

SEQ ID NO: 674091 - DNA, 25 bp, Mus musculus
gcacattgacagtaacaacggttgt

SEQ ID NO: 674092 - DNA, 25 bp, Mus musculus
gcacattgcttcagttcttaatgca

SEQ ID NO: 674093 - DNA, 25 bp, Mus musculus
gcacattgcttctgttcttaatgca

SEQ ID NO: 674094 - DNA, 25 bp, Mus musculus
gcacattgtagtctgtggacacatt

SEQ ID NO: 674095 - DNA, 25 bp, Mus musculus
gcacattgtagtgtgtggacacatt

SEQ ID NO: 674096 - DNA, 25 bp, Mus musculus
gcacattgtcccaactctaatctgt

SEQ ID NO: 674097 - DNA, 25 bp, Mus musculus
gcacattgtccctactctaatctgt

SEQ ID NO: 674098 - DNA, 25 bp, Mus musculus
gcacatttaaatctcctaactatga

SEQ ID NO: 674099 - DNA, 25 bp, Mus musculus
gcacatttaaatgtcctaactatga

SEQ ID NO: 674100 - DNA, 25 bp, Mus musculus
gcacatttagacaaagctagcagag

SEQ ID NO: 674101 - DNA, 25 bp, Mus musculus
gcacatttagactaagctagcagag

SEQ ID NO: 674102 - DNA, 25 bp, Mus musculus
gcacatttattgatcagggagtcac

SEQ ID NO: 674103 - DNA, 25 bp, Mus musculus
gcacatttattgttcagggagtcac

SEQ ID NO: 674104 - DNA, 25 bp, Mus musculus
gcacatttccctatcatgacaccag

SEQ ID NO: 674105 - DNA, 25 bp, Mus musculus
gcacatttccctttcatgacaccag

SEQ ID NO: 674106 - DNA, 25 bp, Mus musculus
gcacatttgtcacatccaaggatgc

SEQ ID NO: 674107 - DNA, 25 bp, Mus musculus
gcacatttgtcagatccaaggatgc

SEQ ID NO: 674108 - DNA, 25 bp, Mus musculus
gcacattttctcatcaatgcattcg

SEQ ID NO: 674109 - DNA, 25 bp, Mus musculus
gcacattttctcttcaatgcattcg

SEQ ID NO: 674110 - DNA, 25 bp, Mus musculus
gcaccaaaagatatgtcccaagctg

SEQ ID NO: 674111 - DNA, 25 bp, Mus musculus
gcaccaaaagatttgtcccaagctg

SEQ ID NO: 674112 - DNA, 25 bp, Mus musculus
gcaccaaaggcgacacagcaaatga

SEQ ID NO: 674113 - DNA, 25 bp, Mus musculus
gcaccaaaggcgtcacagcaaatga

SEQ ID NO: 674114 - DNA, 25 bp, Mus musculus
gcaccaaagtagaagtagacatgga

SEQ ID NO: 674115 - DNA, 25 bp, Mus musculus
gcaccaaagtagtagtagacatgga

SEQ ID NO: 674116 - DNA, 25 bp, Mus musculus
gcaccaaatatgagccctggcagct

SEQ ID NO: 674117 - DNA, 25 bp, Mus musculus
gcaccaaatatgtgccctggcagct

SEQ ID NO: 674118 - DNA, 25 bp, Mus musculus
gcaccaacgtgacatataagccatt

SEQ ID NO: 674119 - DNA, 25 bp, Mus musculus
gcaccaacgtgagatataagccatt

SEQ ID NO: 674120 - DNA, 25 bp, Mus musculus
gcaccaactgaacgcttttaccagg

SEQ ID NO: 674121 - DNA, 25 bp, Mus musculus
gcaccaactgaaggcttttaccagg

SEQ ID NO: 674122 - DNA, 25 bp, Mus musculus
gcaccaagctctacagtcagggcat

SEQ ID NO: 674123 - DNA, 25 bp, Mus musculus
gcaccaagctcttcagtcagggcat

SEQ ID NO: 674124 - DNA, 25 bp, Mus musculus
gcaccaagctgtcgattatcatgga

SEQ ID NO: 674125 - DNA, 25 bp, Mus musculus
gcaccaagctgtggattatcatgga

SEQ ID NO: 674126 - DNA, 25 bp, Mus musculus
gcaccaaggaaaagcttctggattc

SEQ ID NO: 674127 - DNA, 25 bp, Mus musculus
gcaccaaggaaatgcttctggattc

SEQ ID NO: 674128 - DNA, 25 bp, Mus musculus
gcaccaaggagacaccaaggaacag

SEQ ID NO: 674129 - DNA, 25 bp, Mus musculus
gcaccaaggagagaccaaggaacag

SEQ ID NO: 674130 - DNA, 25 bp, Mus musculus
gcaccaagggaaaagccagaacagg

SEQ ID NO: 674131 - DNA, 25 bp, Mus musculus
gcaccaagggaatagccagaacagg

SEQ ID NO: 674132 - DNA, 25 bp, Mus musculus
gcaccaagggagagcgattcaaaga

SEQ ID NO: 674133 - DNA, 25 bp, Mus musculus
gcaccaagggagtgcgattcaaaga

SEQ ID NO: 674134 - DNA, 25 bp, Mus musculus
gcaccaaggtatctttccacccagg

SEQ ID NO: 674135 - DNA, 25 bp, Mus musculus
gcaccaaggtatgtttccacccagg

SEQ ID NO: 674136 - DNA, 25 bp, Mus musculus
gcaccaagtgctcagtgtctaacga

SEQ ID NO: 674137 - DNA, 25 bp, Mus musculus
gcaccaagtgctgagtgtctaacga

SEQ ID NO: 674138 - DNA, 25 bp, Mus musculus
gcaccaatacccaggaagccctaaa

SEQ ID NO: 674139 - DNA, 25 bp, Mus musculus
gcaccaataccctggaagccctaaa

SEQ ID NO: 674140 - DNA, 25 bp, Mus musculus
gcaccaattgtaaagttctggttta

SEQ ID NO: 674141 - DNA, 25 bp, Mus musculus
gcaccaattgtatagttctggttta

SEQ ID NO: 674142 - DNA, 25 bp, Mus musculus
gcaccacaaactacaggtagagcag

SEQ ID NO: 674143 - DNA, 25 bp, Mus musculus
gcaccacaaacttcaggtagagcag

SEQ ID NO: 674144 - DNA, 25 bp, Mus musculus
gcaccacagagacccaagtgtttgt

SEQ ID NO: 674145 - DNA, 25 bp, Mus musculus
gcaccacagagagccaagtgtttgt

SEQ ID NO: 674146 - DNA, 25 bp, Mus musculus
gcaccacaggcaatcagtgtctgtg

SEQ ID NO: 674147 - DNA, 25 bp, Mus musculus
gcaccacaggcattcagtgtctgtg

SEQ ID NO: 674148 - DNA, 25 bp, Mus musculus
gcaccacatgttcgagcctgtgcaa

SEQ ID NO: 674149 - DNA, 25 bp, Mus musculus
gcaccacatgttggagcctgtgcaa

SEQ ID NO: 674150 - DNA, 25 bp, Mus musculus
gcaccaccacacactattatcatta

SEQ ID NO: 674151 - DNA, 25 bp, Mus musculus
gcaccaccacactctattatcatta

SEQ ID NO: 674152 - DNA, 25 bp, Mus musculus
gcaccaccacggcttgctactttgg

SEQ ID NO: 674153 - DNA, 25 bp, Mus musculus
gcaccaccacgggttgctactttgg

SEQ ID NO: 674154 - DNA, 25 bp, Mus musculus
gcaccacccctgagtgtgaagacat

SEQ ID NO: 674155 - DNA, 25 bp, Mus musculus
gcaccacccctgtgtgtgaagacat

SEQ ID NO: 674156 - DNA, 25 bp, Mus musculus
gcaccacgaaggagcatgcactgaa

SEQ ID NO: 674157 - DNA, 25 bp, Mus musculus
gcaccacgaaggtgcatgcactgaa

SEQ ID NO: 674158 - DNA, 25 bp, Mus musculus
gcaccacgctctcgctgaggaggga

SEQ ID NO: 674159 - DNA, 25 bp, Mus musculus
gcaccacgctctggctgaggaggga

SEQ ID NO: 674160 - DNA, 25 bp, Mus musculus
gcaccactccttatgagtgcctggg

SEQ ID NO: 674161 - DNA, 25 bp, Mus musculus
gcaccactccttttgagtgcctggg

SEQ ID NO: 674162 - DNA, 25 bp, Mus musculus
gcaccactctggacctctttttggg

SEQ ID NO: 674163 - DNA, 25 bp, Mus musculus
gcaccactctggtcctctttttggg

SEQ ID NO: 674164 - DNA, 25 bp, Mus musculus
gcaccactgaacagggtggacttaa

SEQ ID NO: 674165 - DNA, 25 bp, Mus musculus
gcaccactgaactgggtggacttaa

SEQ ID NO: 674166 - DNA, 25 bp, Mus musculus
gcaccactgatcagtataacctaca

SEQ ID NO: 674167 - DNA, 25 bp, Mus musculus
gcaccactgatctgtataacctaca

SEQ ID NO: 674168 - DNA, 25 bp, Mus musculus
gcaccactggataaccctgctgcag

SEQ ID NO: 674169 - DNA, 25 bp, Mus musculus
gcaccactggattaccctgctgcag

SEQ ID NO: 674170 - DNA, 25 bp, Mus musculus
gcaccacttagcagggaagtgcgtt

SEQ ID NO: 674171 - DNA, 25 bp, Mus musculus
gcaccacttagctgggaagtgcgtt

SEQ ID NO: 674172 - DNA, 25 bp, Mus musculus
gcaccacttcggattctctagcaca

SEQ ID NO: 674173 - DNA, 25 bp, Mus musculus
gcaccacttcggtttctctagcaca

SEQ ID NO: 674174 - DNA, 25 bp, Mus musculus
gcaccacttttgctacgcctttatt

SEQ ID NO: 674175 - DNA, 25 bp, Mus musculus
gcaccacttttggtacgcctttatt

SEQ ID NO: 674176 - DNA, 25 bp, Mus musculus
gcaccagaggccctttttgaccgag

SEQ ID NO: 674177 - DNA, 25 bp, Mus musculus
gcaccagaggccgtttttgaccgag

SEQ ID NO: 674178 - DNA, 25 bp, Mus musculus
gcaccagataacaagaattgtttgg

SEQ ID NO: 674179 - DNA, 25 bp, Mus musculus
gcaccagataactagaattgtttgg

SEQ ID NO: 674180 - DNA, 25 bp, Mus musculus
gcaccagatggaaattcctgtgaga

SEQ ID NO: 674181 - DNA, 25 bp, Mus musculus
gcaccagatggatattcctgtgaga

SEQ ID NO: 674182 - DNA, 25 bp, Mus musculus
gcaccagcatttcgtaagtgcttgg

SEQ ID NO: 674183 - DNA, 25 bp, Mus musculus
gcaccagcatttggtaagtgcttgg

SEQ ID NO: 674184 - DNA, 25 bp, Mus musculus
gcaccagctcgaaacctcagaggct

SEQ ID NO: 674185 - DNA, 25 bp, Mus musculus
gcaccagctcgatacctcagaggct

SEQ ID NO: 674186 - DNA, 25 bp, Mus musculus
gcaccagctgcaaccagatacctgt

SEQ ID NO: 674187 - DNA, 25 bp, Mus musculus
gcaccagctgcatccagatacctgt

SEQ ID NO: 674188 - DNA, 25 bp, Mus musculus
gcaccagcttccacgtaagtgatca

SEQ ID NO: 674189 - DNA, 25 bp, Mus musculus
gcaccagcttcctcgtaagtgatca

SEQ ID NO: 674190 - DNA, 25 bp, Mus musculus
gcaccagctttcaggtggatgagct

SEQ ID NO: 674191 - DNA, 25 bp, Mus musculus
gcaccagctttctggtggatgagct

SEQ ID NO: 674192 - DNA, 25 bp, Mus musculus
gcaccaggatcaactacgacagaaa

SEQ ID NO: 674193 - DNA, 25 bp, Mus musculus
gcaccaggatcatctacgacagaaa

SEQ ID NO: 674194 - DNA, 25 bp, Mus musculus
gcaccaggatctcggacccaggaaa

SEQ ID NO: 674195 - DNA, 25 bp, Mus musculus
gcaccaggatctgggacccaggaaa

SEQ ID NO: 674196 - DNA, 25 bp, Mus musculus
gcaccaggctatctgcttgaaggaa

SEQ ID NO: 674197 - DNA, 25 bp, Mus musculus
gcaccaggctatgtgcttgaaggaa

SEQ ID NO: 674198 - DNA, 25 bp, Mus musculus
gcaccaggctccacaagacaagtga

SEQ ID NO: 674199 - DNA, 25 bp, Mus musculus
gcaccaggctcctcaagacaagtga

SEQ ID NO: 674200 - DNA, 25 bp, Mus musculus
gcaccaggctgaatggaaaatgcaa

SEQ ID NO: 674201 - DNA, 25 bp, Mus musculus
gcaccaggctgattggaaaatgcaa

SEQ ID NO: 674202 - DNA, 25 bp, Mus musculus
gcaccagggacaacagctcttcatt

SEQ ID NO: 674203 - DNA, 25 bp, Mus musculus
gcaccagggacatcagctcttcatt

SEQ ID NO: 674204 - DNA, 25 bp, Mus musculus
gcaccaggtaacataagtgcccatg

SEQ ID NO: 674205 - DNA, 25 bp, Mus musculus
gcaccaggtaacttaagtgcccatg

SEQ ID NO: 674206 - DNA, 25 bp, Mus musculus
gcaccagtaaatcttaatatcaagg

SEQ ID NO: 674207 - DNA, 25 bp, Mus musculus
gcaccagtaaatgttaatatcaagg

SEQ ID NO: 674208 - DNA, 25 bp, Mus musculus
gcaccatagagcacattccgtttat

SEQ ID NO: 674209 - DNA, 25 bp, Mus musculus
gcaccatagagctcattccgtttat

SEQ ID NO: 674210 - DNA, 25 bp, Mus musculus
gcaccatcaagtctgggcgtctgca

SEQ ID NO: 674211 - DNA, 25 bp, Mus musculus
gcaccatcaagtgtgggcgtctgca

SEQ ID NO: 674212 - DNA, 25 bp, Mus musculus
gcaccatccgtaagagcttcgtcaa

SEQ ID NO: 674213 - DNA, 25 bp, Mus musculus
gcaccatccgtatgagcttcgtcaa

SEQ ID NO: 674214 - DNA, 25 bp, Mus musculus
gcaccatcctggcattgtaaacctg

SEQ ID NO: 674215 - DNA, 25 bp, Mus musculus
gcaccatcctgggattgtaaacctg

SEQ ID NO: 674216 - DNA, 25 bp, Mus musculus
gcaccatcgcaccttgccaaataaa

SEQ ID NO: 674217 - DNA, 25 bp, Mus musculus
gcaccatcgcacgttgccaaataaa

SEQ ID NO: 674218 - DNA, 25 bp, Mus musculus
gcaccatcgctgagaacggctttac

SEQ ID NO: 674219 - DNA, 25 bp, Mus musculus
gcaccatcgctgtgaacggctttac

SEQ ID NO: 674220 - DNA, 25 bp, Mus musculus
gcaccatcgtgaccactctgcagga

SEQ ID NO: 674221 - DNA, 25 bp, Mus musculus
gcaccatcgtgagcactctgcagga

SEQ ID NO: 674222 - DNA, 25 bp, Mus musculus
gcaccatctcacaacggacagaaac

SEQ ID NO: 674223 - DNA, 25 bp, Mus musculus
gcaccatctcactacggacagaaac

SEQ ID NO: 674224 - DNA, 25 bp, Mus musculus
gcaccatgaagaactggacttcgga

SEQ ID NO: 674225 - DNA, 25 bp, Mus musculus
gcaccatgaagatctggacttcgga

SEQ ID NO: 674226 - DNA, 25 bp, Mus musculus
gcaccatgaggtctgtgcgcagaca

SEQ ID NO: 674227 - DNA, 25 bp, Mus musculus
gcaccatgaggtgtgtgcgcagaca

SEQ ID NO: 674228 - DNA, 25 bp, Mus musculus
gcaccatggaggacgatgacagcta

SEQ ID NO: 674229 - DNA, 25 bp, Mus musculus
gcaccatggaggtcgatgacagcta

SEQ ID NO: 674230 - DNA, 25 bp, Mus musculus
gcaccatgggtgacagtgatgatga

SEQ ID NO: 674231 - DNA, 25 bp, Mus musculus
gcaccatgggtgtcagtgatgatga

SEQ ID NO: 674232 - DNA, 25 bp, Mus musculus
gcaccatggtgacgctcgccgagct

SEQ ID NO: 674233 - DNA, 25 bp, Mus musculus
gcaccatggtgaggctcgccgagct

SEQ ID NO: 674234 - DNA, 25 bp, Mus musculus
gcaccatggtggatagcactcttcc

SEQ ID NO: 674235 - DNA, 25 bp, Mus musculus
gcaccatggtggttagcactcttcc

SEQ ID NO: 674236 - DNA, 25 bp, Mus musculus
gcaccatggtgtatagttcctacag

SEQ ID NO: 674237 - DNA, 25 bp, Mus musculus
gcaccatggtgtttagttcctacag

SEQ ID NO: 674238 - DNA, 25 bp, Mus musculus
gcaccatgtagacaaagctctgaac

SEQ ID NO: 674239 - DNA, 25 bp, Mus musculus
gcaccatgtagagaaagctctgaac

SEQ ID NO: 674240 - DNA, 25 bp, Mus musculus
gcaccatgtggcacgaggctcggaa

SEQ ID NO: 674241 - DNA, 25 bp, Mus musculus
gcaccatgtggctcgaggctcggaa

SEQ ID NO: 674242 - DNA, 25 bp, Mus musculus
gcaccatgtgtaaacgtgaatgctg

SEQ ID NO: 674243 - DNA, 25 bp, Mus musculus
gcaccatgtgtatacgtgaatgctg

SEQ ID NO: 674244 - DNA, 25 bp, Mus musculus
gcaccattcattccagagagaatct

SEQ ID NO: 674245 - DNA, 25 bp, Mus musculus
gcaccattcattgcagagagaatct

SEQ ID NO: 674246 - DNA, 25 bp, Mus musculus
gcaccattgcggcaaaaagacttcg

SEQ ID NO: 674247 - DNA, 25 bp, Mus musculus
gcaccattgcgggaaaaagacttcg

SEQ ID NO: 674248 - DNA, 25 bp, Mus musculus
gcaccattgtttcagctgtatgaca

SEQ ID NO: 674249 - DNA, 25 bp, Mus musculus
gcaccattgtttgagctgtatgaca

SEQ ID NO: 674250 - DNA, 25 bp, Mus musculus
gcacccaaaccaagtgcaaagtcta

SEQ ID NO: 674251 - DNA, 25 bp, Mus musculus
gcacccaaaccatgtgcaaagtcta

SEQ ID NO: 674252 - DNA, 25 bp, Mus musculus
gcacccaaagccagcgctgagtcta

SEQ ID NO: 674253 - DNA, 25 bp, Mus musculus
gcacccaaagcctgcgctgagtcta

SEQ ID NO: 674254 - DNA, 25 bp, Mus musculus
gcacccaagggaatggtcctccagg

SEQ ID NO: 674255 - DNA, 25 bp, Mus musculus
gcacccaagggattggtcctccagg

SEQ ID NO: 674256 - DNA, 25 bp, Mus musculus
gcacccaaggtgacagcacaaatat

SEQ ID NO: 674257 - DNA, 25 bp, Mus musculus
gcacccaaggtgtcagcacaaatat

SEQ ID NO: 674258 - DNA, 25 bp, Mus musculus
gcacccaccatgatggaagacgacg

SEQ ID NO: 674259 - DNA, 25 bp, Mus musculus
gcacccaccatgttggaagacgacg

SEQ ID NO: 674260 - DNA, 25 bp, Mus musculus
gcacccagacctagttaggcctctg

SEQ ID NO: 674261 - DNA, 25 bp, Mus musculus
gcacccagaccttgttaggcctctg

SEQ ID NO: 674262 - DNA, 25 bp, Mus musculus
gcacccagatagatggtggccacgg

SEQ ID NO: 674263 - DNA, 25 bp, Mus musculus
gcacccagatagttggtggccacgg

SEQ ID NO: 674264 - DNA, 25 bp, Mus musculus
gcacccagcagtataagcccaatga

SEQ ID NO: 674265 - DNA, 25 bp, Mus musculus
gcacccagcagtttaagcccaatga

SEQ ID NO: 674266 - DNA, 25 bp, Mus musculus
gcacccagctccctttctggagtta

SEQ ID NO: 674267 - DNA, 25 bp, Mus musculus
gcacccagctccgtttctggagtta

SEQ ID NO: 674268 - DNA, 25 bp, Mus musculus
gcacccagctggaaaagctgatgga

SEQ ID NO: 674269 - DNA, 25 bp, Mus musculus
gcacccagctggtaaagctgatgga

SEQ ID NO: 674270 - DNA, 25 bp, Mus musculus
gcacccaggaagacctataataaga

SEQ ID NO: 674271 - DNA, 25 bp, Mus musculus
gcacccaggaagtcctataataaga

SEQ ID NO: 674272 - DNA, 25 bp, Mus musculus
gcacccagggtgagtccaccacaga

SEQ ID NO: 674273 - DNA, 25 bp, Mus musculus
gcacccagggtgtgtccaccacaga

SEQ ID NO: 674274 - DNA, 25 bp, Mus musculus
gcacccagtagaactaaagcctttc

SEQ ID NO: 674275 - DNA, 25 bp, Mus musculus
gcacccagtagatctaaagcctttc

SEQ ID NO: 674276 - DNA, 25 bp, Mus musculus
gcacccagtgatcctggccagacta

SEQ ID NO: 674277 - DNA, 25 bp, Mus musculus
gcacccagtgatgctggccagacta

SEQ ID NO: 674278 - DNA, 25 bp, Mus musculus
gcacccagtggacaatgctggactt

SEQ ID NO: 674279 - DNA, 25 bp, Mus musculus
gcacccagtggagaatgctggactt

SEQ ID NO: 674280 - DNA, 25 bp, Mus musculus
gcacccatcggcaagatgctttttt

SEQ ID NO: 674281 - DNA, 25 bp, Mus musculus
gcacccatcggctagatgctttttt

SEQ ID NO: 674282 - DNA, 25 bp, Mus musculus
gcacccatgttcctggatgactcct

SEQ ID NO: 674283 - DNA, 25 bp, Mus musculus
gcacccatgttcgtggatgactcct

SEQ ID NO: 674284 - DNA, 25 bp, Mus musculus
gcacccattccaaagctttattacc

SEQ ID NO: 674285 - DNA, 25 bp, Mus musculus
gcacccattccatagctttattacc

SEQ ID NO: 674286 - DNA, 25 bp, Mus musculus
gcacccattggcatccatcgagttg

SEQ ID NO: 674287 - DNA, 25 bp, Mus musculus
gcacccattggcttccatcgagttg

SEQ ID NO: 674288 - DNA, 25 bp, Mus musculus
gcaccccaagtaactaaagtttgaa

SEQ ID NO: 674289 - DNA, 25 bp, Mus musculus
gcaccccaagtatctaaagtttgaa

SEQ ID NO: 674290 - DNA, 25 bp, Mus musculus
gcaccccagacgctgtgaatcctga

SEQ ID NO: 674291 - DNA, 25 bp, Mus musculus
gcaccccagacggtgtgaatcctga

SEQ ID NO: 674292 - DNA, 25 bp, Mus musculus
gcaccccgagacctttttgacatga

SEQ ID NO: 674293 - DNA, 25 bp, Mus musculus
gcaccccgagacgtttttgacatga

SEQ ID NO: 674294 - DNA, 25 bp, Mus musculus
gcaccccgcaagagttagacccatg

SEQ ID NO: 674295 - DNA, 25 bp, Mus musculus
gcaccccgcaagtgttagacccatg

SEQ ID NO: 674296 - DNA, 25 bp, Mus musculus
gcaccccgcatcacctggatgaaag

SEQ ID NO: 674297 - DNA, 25 bp, Mus musculus
gcaccccgcatctcctggatgaaag

SEQ ID NO: 674298 - DNA, 25 bp, Mus musculus
gcaccccgttctaatgtctctggct

SEQ ID NO: 674299 - DNA, 25 bp, Mus musculus
gcaccccgttcttatgtctctggct

SEQ ID NO: 674300 - DNA, 25 bp, Mus musculus
gcacccctagctcctgtaagttcag

SEQ ID NO: 674301 - DNA, 25 bp, Mus musculus
gcacccctagctgctgtaagttcag

SEQ ID NO: 674302 - DNA, 25 bp, Mus musculus
gcacccctgctcatggagcggacag

SEQ ID NO: 674303 - DNA, 25 bp, Mus musculus
gcacccctgctcttggagcggacag

SEQ ID NO: 674304 - DNA, 25 bp, Mus musculus
gcacccctgttacaaagacgtttgg

SEQ ID NO: 674305 - DNA, 25 bp, Mus musculus
gcacccctgttagaaagacgtttgg

SEQ ID NO: 674306 - DNA, 25 bp, Mus musculus
gcacccgcacgacaacagaactttt

SEQ ID NO: 674307 - DNA, 25 bp, Mus musculus
gcacccgcacgagaacagaactttt

SEQ ID NO: 674308 - DNA, 25 bp, Mus musculus
gcacccgcatcgagaatcagaactc

SEQ ID NO: 674309 - DNA, 25 bp, Mus musculus
gcacccgcatcgtgaatcagaactc

SEQ ID NO: 674310 - DNA, 25 bp, Mus musculus
gcacccgccttcaggaaatggagcg

SEQ ID NO: 674311 - DNA, 25 bp, Mus musculus
gcacccgccttctggaaatggagcg

SEQ ID NO: 674312 - DNA, 25 bp, Mus musculus
gcacccgcgacgacgagtacgacta

SEQ ID NO: 674313 - DNA, 25 bp, Mus musculus
gcacccgcgacgtcgagtacgacta

SEQ ID NO: 674314 - DNA, 25 bp, Mus musculus
gcacccgctctgaagctggagagtt

SEQ ID NO: 674315 - DNA, 25 bp, Mus musculus
gcacccgctctgtagctggagagtt

SEQ ID NO: 674316 - DNA, 25 bp, Mus musculus
gcacccggctttcctagtgctgagg

SEQ ID NO: 674317 - DNA, 25 bp, Mus musculus
gcacccggctttgctagtgctgagg

SEQ ID NO: 674318 - DNA, 25 bp, Mus musculus
gcaccctaatataagttccgtcaca

SEQ ID NO: 674319 - DNA, 25 bp, Mus musculus
gcaccctaatattagttccgtcaca

SEQ ID NO: 674320 - DNA, 25 bp, Mus musculus
gcaccctacaggatctgctgctgtc

SEQ ID NO: 674321 - DNA, 25 bp, Mus musculus
gcaccctacaggttctgctgctgtc

SEQ ID NO: 674322 - DNA, 25 bp, Mus musculus
gcaccctatgacaggcgtctggcac

SEQ ID NO: 674323 - DNA, 25 bp, Mus musculus
gcaccctatgactggcgtctggcac

SEQ ID NO: 674324 - DNA, 25 bp, Mus musculus
gcaccctcaaaacaagctatgaagc

SEQ ID NO: 674325 - DNA, 25 bp, Mus musculus
gcaccctcaaaagaagctatgaagc

SEQ ID NO: 674326 - DNA, 25 bp, Mus musculus
gcaccctgaacacgtggttctgggt

SEQ ID NO: 674327 - DNA, 25 bp, Mus musculus
gcaccctgaacaggtggttctgggt

SEQ ID NO: 674328 - DNA, 25 bp, Mus musculus
gcaccctgacaccagtgttcaggga

SEQ ID NO: 674329 - DNA, 25 bp, Mus musculus
gcaccctgacacgagtgttcaggga

SEQ ID NO: 674330 - DNA, 25 bp, Mus musculus
gcaccctgagagatggtttcaaagg

SEQ ID NO: 674331 - DNA, 25 bp, Mus musculus
gcaccctgagagttggtttcaaagg

SEQ ID NO: 674332 - DNA, 25 bp, Mus musculus
gcaccctgctctacagggaggtcag

SEQ ID NO: 674333 - DNA, 25 bp, Mus musculus
gcaccctgctcttcagggaggtcag

SEQ ID NO: 674334 - DNA, 25 bp, Mus musculus
gcaccctggccaacgacttcattga

SEQ ID NO: 674335 - DNA, 25 bp, Mus musculus
gcaccctggccatcgacttcattga

SEQ ID NO: 674336 - DNA, 25 bp, Mus musculus
gcaccctgtcttagctcagacctga

SEQ ID NO: 674337 - DNA, 25 bp, Mus musculus
gcaccctgtctttgctcagacctga

SEQ ID NO: 674338 - DNA, 25 bp, Mus musculus
gcaccctgtgagagaacaagaaccc

SEQ ID NO: 674339 - DNA, 25 bp, Mus musculus
gcaccctgtgagtgaacaagaaccc

SEQ ID NO: 674340 - DNA, 25 bp, Mus musculus
gcaccctgtggaagaccctgagagc

SEQ ID NO: 674341 - DNA, 25 bp, Mus musculus
gcaccctgtggatgaccctgagagc

SEQ ID NO: 674342 - DNA, 25 bp, Mus musculus
gcacccttggaacagtccgagagcc

SEQ ID NO: 674343 - DNA, 25 bp, Mus musculus
gcacccttggaagagtccgagagcc

SEQ ID NO: 674344 - DNA, 25 bp, Mus musculus
gcacccttgggaaaggagagtctag

SEQ ID NO: 674345 - DNA, 25 bp, Mus musculus
gcacccttgggataggagagtctag

SEQ ID NO: 674346 - DNA, 25 bp, Mus musculus
gcaccgaagccaaatcacaaattta

SEQ ID NO: 674347 - DNA, 25 bp, Mus musculus
gcaccgaagccatatcacaaattta

SEQ ID NO: 674348 - DNA, 25 bp, Mus musculus
gcaccgaatatcatatcaaaaagac

SEQ ID NO: 674349 - DNA, 25 bp, Mus musculus
gcaccgaatatcttatcaaaaagac

SEQ ID NO: 674350 - DNA, 25 bp, Mus musculus
gcaccgacaccgagacagagataca

SEQ ID NO: 674351 - DNA, 25 bp, Mus musculus
gcaccgacaccgtgacagagataca

SEQ ID NO: 674352 - DNA, 25 bp, Mus musculus
gcaccgacttccagggtcggcgcta

SEQ ID NO: 674353 - DNA, 25 bp, Mus musculus
gcaccgacttcctgggtcggcgcta

SEQ ID NO: 674354 - DNA, 25 bp, Mus musculus
gcaccgagcgtgctcgtcactggta

SEQ ID NO: 674355 - DNA, 25 bp, Mus musculus
gcaccgagcgtggtcgtcactggta

SEQ ID NO: 674356 - DNA, 25 bp, Mus musculus
gcaccgaggcgtccaccaaaaatat

SEQ ID NO: 674357 - DNA, 25 bp, Mus musculus
gcaccgaggcgtgcaccaaaaatat

SEQ ID NO: 674358 - DNA, 25 bp, Mus musculus
gcaccgaggctgcaagtgccaagct

SEQ ID NO: 674359 - DNA, 25 bp, Mus musculus
gcaccgaggctggaagtgccaagct

SEQ ID NO: 674360 - DNA, 25 bp, Mus musculus
gcaccgaggcttcgctcgaagccta

SEQ ID NO: 674361 - DNA, 25 bp, Mus musculus
gcaccgaggcttggctcgaagccta

SEQ ID NO: 674362 - DNA, 25 bp, Mus musculus
gcaccgaggtaaagctgaggctcca

SEQ ID NO: 674363 - DNA, 25 bp, Mus musculus
gcaccgaggtaatgctgaggctcca

SEQ ID NO: 674364 - DNA, 25 bp, Mus musculus
gcaccgagtctgaagtctacgacga

SEQ ID NO: 674365 - DNA, 25 bp, Mus musculus
gcaccgagtctgagtccatcctcag

SEQ ID NO: 674366 - DNA, 25 bp, Mus musculus
gcaccgagtctgtagtctacgacga

SEQ ID NO: 674367 - DNA, 25 bp, Mus musculus
gcaccgagtctgtgtccatcctcag

SEQ ID NO: 674368 - DNA, 25 bp, Mus musculus
gcaccgatcggacgagttcttttta

SEQ ID NO: 674369 - DNA, 25 bp, Mus musculus
gcaccgatcggaggagttcttttta

SEQ ID NO: 674370 - DNA, 25 bp, Mus musculus
gcaccgatgacgagtttgcctgctt

SEQ ID NO: 674371 - DNA, 25 bp, Mus musculus
gcaccgatgacgtgtttgcctgctt

SEQ ID NO: 674372 - DNA, 25 bp, Mus musculus
gcaccgatgggtactggcttctgga

SEQ ID NO: 674373 - DNA, 25 bp, Mus musculus
gcaccgatgggttctggcttctgga

SEQ ID NO: 674374 - DNA, 25 bp, Mus musculus
gcaccgattttgatggttccaccaa

SEQ ID NO: 674375 - DNA, 25 bp, Mus musculus
gcaccgattttgttggttccaccaa

SEQ ID NO: 674376 - DNA, 25 bp, Mus musculus
gcaccgcaaggaagaggtgtcaact

SEQ ID NO: 674377 - DNA, 25 bp, Mus musculus
gcaccgcaaggatgaggtgtcaact

SEQ ID NO: 674378 - DNA, 25 bp, Mus musculus
gcaccgcactgaagttcgaggatct

SEQ ID NO: 674379 - DNA, 25 bp, Mus musculus
gcaccgcactgatgttcgaggatct

SEQ ID NO: 674380 - DNA, 25 bp, Mus musculus
gcaccgcatctcacgtgactgctgg

SEQ ID NO: 674381 - DNA, 25 bp, Mus musculus
gcaccgcatctctcgtgactgctgg

SEQ ID NO: 674382 - DNA, 25 bp, Mus musculus
gcaccgccttgtatgatgctgttaa

SEQ ID NO: 674383 - DNA, 25 bp, Mus musculus
gcaccgccttgtttgatgctgttaa

SEQ ID NO: 674384 - DNA, 25 bp, Mus musculus
gcaccgcgagcaactcctgttggag

SEQ ID NO: 674385 - DNA, 25 bp, Mus musculus
gcaccgcgagcatctcctgttggag

SEQ ID NO: 674386 - DNA, 25 bp, Mus musculus
gcaccggaacaaacacaccttcttg

SEQ ID NO: 674387 - DNA, 25 bp, Mus musculus
gcaccggaacaatcacaccttcttg

SEQ ID NO: 674388 - DNA, 25 bp, Mus musculus
gcaccggagactcatggctctgcgc

SEQ ID NO: 674389 - DNA, 25 bp, Mus musculus
gcaccggagactgatggctctgcgc

SEQ ID NO: 674390 - DNA, 25 bp, Mus musculus
gcaccggctggcactaaagaacatt

SEQ ID NO: 674391 - DNA, 25 bp, Mus musculus
gcaccggctggctctaaagaacatt

SEQ ID NO: 674392 - DNA, 25 bp, Mus musculus
gcaccgggaccactaacactgtaga

SEQ ID NO: 674393 - DNA, 25 bp, Mus musculus
gcaccgggaccagtaacactgtaga

SEQ ID NO: 674394 - DNA, 25 bp, Mus musculus
gcaccgggtattagacagtgaggct

SEQ ID NO: 674395 - DNA, 25 bp, Mus musculus
gcaccgggtatttgacagtgaggct

SEQ ID NO: 674396 - DNA, 25 bp, Mus musculus
gcaccggttcttagccaacatcgtg

SEQ ID NO: 674397 - DNA, 25 bp, Mus musculus
gcaccggttctttgccaacatcgtg

SEQ ID NO: 674398 - DNA, 25 bp, Mus musculus
gcaccgtaagcaccggtctctggct

SEQ ID NO: 674399 - DNA, 25 bp, Mus musculus
gcaccgtaagcagcggtctctggct

SEQ ID NO: 674400 - DNA, 25 bp, Mus musculus
gcaccgtatcttccatagacccttg

SEQ ID NO: 674401 - DNA, 25 bp, Mus musculus
gcaccgtatcttgcatagacccttg

SEQ ID NO: 674402 - DNA, 25 bp, Mus musculus
gcaccgtcaaggacctcaggctggt

SEQ ID NO: 674403 - DNA, 25 bp, Mus musculus
gcaccgtcaaggtcctcaggctggt

SEQ ID NO: 674404 - DNA, 25 bp, Mus musculus
gcaccgtcaggtaggcaccgctcta

SEQ ID NO: 674405 - DNA, 25 bp, Mus musculus
gcaccgtcaggttggcaccgctcta

SEQ ID NO: 674406 - DNA, 25 bp, Mus musculus
gcaccgtcgggcattgtcagtccct

SEQ ID NO: 674407 - DNA, 25 bp, Mus musculus
gcaccgtcgggctttgtcagtccct

SEQ ID NO: 674408 - DNA, 25 bp, Mus musculus
gcaccgtcttgccacttcttagctg

SEQ ID NO: 674409 - DNA, 25 bp, Mus musculus
gcaccgtcttgcgacttcttagctg

SEQ ID NO: 674410 - DNA, 25 bp, Mus musculus
gcaccgtgaagtaattattggacaa

SEQ ID NO: 674411 - DNA, 25 bp, Mus musculus
gcaccgtgaagttattattggacaa

SEQ ID NO: 674412 - DNA, 25 bp, Mus musculus
gcaccgtggccaacgtctttctcaa

SEQ ID NO: 674413 - DNA, 25 bp, Mus musculus
gcaccgtggccatcgtctttctcaa

SEQ ID NO: 674414 - DNA, 25 bp, Mus musculus
gcaccgtggtatcgatggttcctga

SEQ ID NO: 674415 - DNA, 25 bp, Mus musculus
gcaccgtggtatggatggttcctga

SEQ ID NO: 674416 - DNA, 25 bp, Mus musculus
gcaccgttcattagccagttcttca

SEQ ID NO: 674417 - DNA, 25 bp, Mus musculus
gcaccgttcatttgccagttcttca

SEQ ID NO: 674418 - DNA, 25 bp, Mus musculus
gcacctaatcacagtcaagttgaag

SEQ ID NO: 674419 - DNA, 25 bp, Mus musculus
gcacctaatcactgtcaagttgaag

SEQ ID NO: 674420 - DNA, 25 bp, Mus musculus
gcacctaatgaccttggcctacgat

SEQ ID NO: 674421 - DNA, 25 bp, Mus musculus
gcacctaatgacgttggcctacgat

SEQ ID NO: 674422 - DNA, 25 bp, Mus musculus
gcacctaatggacgcagaaaaggta

SEQ ID NO: 674423 - DNA, 25 bp, Mus musculus
gcacctaatggaggcagaaaaggta

SEQ ID NO: 674424 - DNA, 25 bp, Mus musculus
gcacctaatgttagtgtttgctcaa

SEQ ID NO: 674425 - DNA, 25 bp, Mus musculus
gcacctaatgtttgtgtttgctcaa

SEQ ID NO: 674426 - DNA, 25 bp, Mus musculus
gcacctacatcgcatgctgcaggaa

SEQ ID NO: 674427 - DNA, 25 bp, Mus musculus
gcacctacatcggatgctgcaggaa

SEQ ID NO: 674428 - DNA, 25 bp, Mus musculus
gcacctagaaaaatggtctctcttt

SEQ ID NO: 674429 - DNA, 25 bp, Mus musculus
gcacctagaaaattggtctctcttt

SEQ ID NO: 674430 - DNA, 25 bp, Mus musculus
gcacctagacgaccctaacctgaag

SEQ ID NO: 674431 - DNA, 25 bp, Mus musculus
gcacctagacgagcctaacctgaag

SEQ ID NO: 674432 - DNA, 25 bp, Mus musculus
gcacctagctgccagattctctcgg

SEQ ID NO: 674433 - DNA, 25 bp, Mus musculus
gcacctagctgcgagattctctcgg

SEQ ID NO: 674434 - DNA, 25 bp, Mus musculus
gcacctaggcttcggcgggactatt

SEQ ID NO: 674435 - DNA, 25 bp, Mus musculus
gcacctaggcttgggcgggactatt

SEQ ID NO: 674436 - DNA, 25 bp, Mus musculus
gcacctatgaggacagattctttga

SEQ ID NO: 674437 - DNA, 25 bp, Mus musculus
gcacctatgaggtcagattctttga

SEQ ID NO: 674438 - DNA, 25 bp, Mus musculus
gcacctatggcacccacgggctgga

SEQ ID NO: 674439 - DNA, 25 bp, Mus musculus
gcacctatggcagccacgggctgga

SEQ ID NO: 674440 - DNA, 25 bp, Mus musculus
gcacctatgtgaaccgtggccgtcg

SEQ ID NO: 674441 - DNA, 25 bp, Mus musculus
gcacctatgtgatccgtggccgtcg

SEQ ID NO: 674442 - DNA, 25 bp, Mus musculus
gcacctcaacagaaagtgctccagc

SEQ ID NO: 674443 - DNA, 25 bp, Mus musculus
gcacctcaacagtaagtgctccagc

SEQ ID NO: 674444 - DNA, 25 bp, Mus musculus
gcacctcaatggacaggcgctcaga

SEQ ID NO: 674445 - DNA, 25 bp, Mus musculus
gcacctcaatggtcaggcgctcaga

SEQ ID NO: 674446 - DNA, 25 bp, Mus musculus
gcacctcaatttccagattgagcac

SEQ ID NO: 674447 - DNA, 25 bp, Mus musculus
gcacctcaatttgcagattgagcac

SEQ ID NO: 674448 - DNA, 25 bp, Mus musculus
gcacctcagtgaagacaaatccaaa

SEQ ID NO: 674449 - DNA, 25 bp, Mus musculus
gcacctcagtgatgacaaatccaaa

SEQ ID NO: 674450 - DNA, 25 bp, Mus musculus
gcacctccccgaactggatgatgag

SEQ ID NO: 674451 - DNA, 25 bp, Mus musculus
gcacctccccgatctggatgatgag

SEQ ID NO: 674452 - DNA, 25 bp, Mus musculus
gcacctccttcacgttacttcatgg

SEQ ID NO: 674453 - DNA, 25 bp, Mus musculus
gcacctccttcaggttacttcatgg

SEQ ID NO: 674454 - DNA, 25 bp, Mus musculus
gcacctcgattgagtacgccacaga

SEQ ID NO: 674455 - DNA, 25 bp, Mus musculus
gcacctcgattgtgtacgccacaga

SEQ ID NO: 674456 - DNA, 25 bp, Mus musculus
gcacctcggacgaggtccaggagat

SEQ ID NO: 674457 - DNA, 25 bp, Mus musculus
gcacctcggacgtggtccaggagat

SEQ ID NO: 674458 - DNA, 25 bp, Mus musculus
gcacctcggcgcagccatgagtgcg

SEQ ID NO: 674459 - DNA, 25 bp, Mus musculus
gcacctcggcgctgccatgagtgcg

SEQ ID NO: 674460 - DNA, 25 bp, Mus musculus
gcacctcggtttcagtctatcatgg

SEQ ID NO: 674461 - DNA, 25 bp, Mus musculus
gcacctcggtttgagtctatcatgg

SEQ ID NO: 674462 - DNA, 25 bp, Mus musculus
gcacctctacacattagatggtggg

SEQ ID NO: 674463 - DNA, 25 bp, Mus musculus
gcacctctacactttagatggtggg

SEQ ID NO: 674464 - DNA, 25 bp, Mus musculus
gcacctctcatgagtctgtgttggg

SEQ ID NO: 674465 - DNA, 25 bp, Mus musculus
gcacctctcatgtgtctgtgttggg

SEQ ID NO: 674466 - DNA, 25 bp, Mus musculus
gcacctctgtccagagcatcgagct

SEQ ID NO: 674467 - DNA, 25 bp, Mus musculus
gcacctctgtcctgagcatcgagct

SEQ ID NO: 674468 - DNA, 25 bp, Mus musculus
gcacctcttctcagtctcagacaag

SEQ ID NO: 674469 - DNA, 25 bp, Mus musculus
gcacctcttctctgtctcagacaag

SEQ ID NO: 674470 - DNA, 25 bp, Mus musculus
gcacctgaaagccatccaggattat

SEQ ID NO: 674471 - DNA, 25 bp, Mus musculus
gcacctgaaagcgatccaggattat

SEQ ID NO: 674472 - DNA, 25 bp, Mus musculus
gcacctgactggaattgaaagccga

SEQ ID NO: 674473 - DNA, 25 bp, Mus musculus
gcacctgactggtattgaaagccga

SEQ ID NO: 674474 - DNA, 25 bp, Mus musculus
gcacctgagcaacaaaccccataag

SEQ ID NO: 674475 - DNA, 25 bp, Mus musculus
gcacctgagcaagaaaccccataag

SEQ ID NO: 674476 - DNA, 25 bp, Mus musculus
gcacctgagggcactctgcttgggt

SEQ ID NO: 674477 - DNA, 25 bp, Mus musculus
gcacctgagggctctctgcttgggt

SEQ ID NO: 674478 - DNA, 25 bp, Mus musculus
gcacctgatgagaacattgagaaac

SEQ ID NO: 674479 - DNA, 25 bp, Mus musculus
gcacctgatgagtacattgagaaac

SEQ ID NO: 674480 - DNA, 25 bp, Mus musculus
gcacctgatgcactagaggtgacac

SEQ ID NO: 674481 - DNA, 25 bp, Mus musculus
gcacctgatgcagtagaggtgacac

SEQ ID NO: 674482 - DNA, 25 bp, Mus musculus
gcacctgcacaacattatccacaga

SEQ ID NO: 674483 - DNA, 25 bp, Mus musculus
gcacctgcacaagattatccacaga

SEQ ID NO: 674484 - DNA, 25 bp, Mus musculus
gcacctgcaggcagcatgagcgaag

SEQ ID NO: 674485 - DNA, 25 bp, Mus musculus
gcacctgcaggctgcatgagcgaag

SEQ ID NO: 674486 - DNA, 25 bp, Mus musculus
gcacctgcagtgaatcgaagagctt

SEQ ID NO: 674487 - DNA, 25 bp, Mus musculus
gcacctgcagtgtatcgaagagctt

SEQ ID NO: 674488 - DNA, 25 bp, Mus musculus
gcacctgcattgagatcgctcaccg

SEQ ID NO: 674489 - DNA, 25 bp, Mus musculus
gcacctgcattgtgatcgctcaccg

SEQ ID NO: 674490 - DNA, 25 bp, Mus musculus
gcacctgccactcagtgaagcaagg

SEQ ID NO: 674491 - DNA, 25 bp, Mus musculus
gcacctgccactgagtgaagcaagg

SEQ ID NO: 674492 - DNA, 25 bp, Mus musculus
gcacctgccgacaactctacagaga

SEQ ID NO: 674493 - DNA, 25 bp, Mus musculus
gcacctgccgactactctacagaga

SEQ ID NO: 674494 - DNA, 25 bp, Mus musculus
gcacctgccttcatcgggtggagaa

SEQ ID NO: 674495 - DNA, 25 bp, Mus musculus
gcacctgccttcttcgggtggagaa

SEQ ID NO: 674496 - DNA, 25 bp, Mus musculus
gcacctgcgaagcagactgcatgcg

SEQ ID NO: 674497 - DNA, 25 bp, Mus musculus
gcacctgcgaaggagactgcatgcg

SEQ ID NO: 674498 - DNA, 25 bp, Mus musculus
gcacctgctcgcacaggataaacag

SEQ ID NO: 674499 - DNA, 25 bp, Mus musculus
gcacctgctcgctcaggataaacag

SEQ ID NO: 674500 - DNA, 25 bp, Mus musculus
gcacctgctgcgaggtctcgggcaa

SEQ ID NO: 674501 - DNA, 25 bp, Mus musculus
gcacctgctgcgtggtctcgggcaa

SEQ ID NO: 674502 - DNA, 25 bp, Mus musculus
gcacctgctttcaaacctaacaact

SEQ ID NO: 674503 - DNA, 25 bp, Mus musculus
gcacctgctttctaacctaacaact

SEQ ID NO: 674504 - DNA, 25 bp, Mus musculus
gcacctgcttttaggacatcactta

SEQ ID NO: 674505 - DNA, 25 bp, Mus musculus
gcacctgcttttccccagcttgtga

SEQ ID NO: 674506 - DNA, 25 bp, Mus musculus
gcacctgcttttgcccagcttgtga

SEQ ID NO: 674507 - DNA, 25 bp, Mus musculus
gcacctgctttttggacatcactta

SEQ ID NO: 674508 - DNA, 25 bp, Mus musculus
gcacctggagtaccgcttttacaag

SEQ ID NO: 674509 - DNA, 25 bp, Mus musculus
gcacctggagtagcgcttttacaag

SEQ ID NO: 674510 - DNA, 25 bp, Mus musculus
gcacctggcaaaaacgtacatctcg

SEQ ID NO: 674511 - DNA, 25 bp, Mus musculus
gcacctggcaaatacgtacatctcg

SEQ ID NO: 674512 - DNA, 25 bp, Mus musculus
gcacctggccacagaagctgatgcc

SEQ ID NO: 674513 - DNA, 25 bp, Mus musculus
gcacctggccactgaagctgatgcc

SEQ ID NO: 674514 - DNA, 25 bp, Mus musculus
gcacctggcgccactggactcaaag

SEQ ID NO: 674515 - DNA, 25 bp, Mus musculus
gcacctggcgcctctggactcaaag

SEQ ID NO: 674516 - DNA, 25 bp, Mus musculus
gcacctgggcgcagaacaaaagggc

SEQ ID NO: 674517 - DNA, 25 bp, Mus musculus
gcacctgggcgctgaacaaaagggc

SEQ ID NO: 674518 - DNA, 25 bp, Mus musculus
gcacctgggtgacaaaaccaccgga

SEQ ID NO: 674519 - DNA, 25 bp, Mus musculus
gcacctgggtgagaaaaccaccgga

SEQ ID NO: 674520 - DNA, 25 bp, Mus musculus
gcacctggttacatccctggcaaag

SEQ ID NO: 674521 - DNA, 25 bp, Mus musculus
gcacctggttacttccctggcaaag

SEQ ID NO: 674522 - DNA, 25 bp, Mus musculus
gcacctgtacttcgagtccgacgca

SEQ ID NO: 674523 - DNA, 25 bp, Mus musculus
gcacctgtacttggagtccgacgca

SEQ ID NO: 674524 - DNA, 25 bp, Mus musculus
gcacctgtggccagattgccagtta

SEQ ID NO: 674525 - DNA, 25 bp, Mus musculus
gcacctgtggcctgattgccagtta

SEQ ID NO: 674526 - DNA, 25 bp, Mus musculus
gcacctgtgtcgcacatggtcatgt

SEQ ID NO: 674527 - DNA, 25 bp, Mus musculus
gcacctgtgtcggacatggtcatgt

SEQ ID NO: 674528 - DNA, 25 bp, Mus musculus
gcacctgtttccctcccattgggtt

SEQ ID NO: 674529 - DNA, 25 bp, Mus musculus
gcacctgtttccgtcccattgggtt

SEQ ID NO: 674530 - DNA, 25 bp, Mus musculus
gcaccttaggagaagggaccttcgg

SEQ ID NO: 674531 - DNA, 25 bp, Mus musculus
gcaccttaggagtagggaccttcgg

SEQ ID NO: 674532 - DNA, 25 bp, Mus musculus
gcaccttcaagcagctactccaaag

SEQ ID NO: 674533 - DNA, 25 bp, Mus musculus
gcaccttcaagctgctactccaaag

SEQ ID NO: 674534 - DNA, 25 bp, Mus musculus
gcaccttcaggacattccggaccag

SEQ ID NO: 674535 - DNA, 25 bp, Mus musculus
gcaccttcaggagattccggaccag

SEQ ID NO: 674536 - DNA, 25 bp, Mus musculus
gcaccttcatctcatagcaggaaca

SEQ ID NO: 674537 - DNA, 25 bp, Mus musculus
gcaccttcatctgatagcaggaaca

SEQ ID NO: 674538 - DNA, 25 bp, Mus musculus
gcaccttcgattacctcaaagacaa

SEQ ID NO: 674539 - DNA, 25 bp, Mus musculus
gcaccttcgatttcctcaaagacaa

SEQ ID NO: 674540 - DNA, 25 bp, Mus musculus
gcaccttcgggcctgtagcctacgt

SEQ ID NO: 674541 - DNA, 25 bp, Mus musculus
gcaccttcgggcgtgtagcctacgt

SEQ ID NO: 674542 - DNA, 25 bp, Mus musculus
gcaccttctactagctctgaggcca

SEQ ID NO: 674543 - DNA, 25 bp, Mus musculus
gcaccttctacttgctctgaggcca

SEQ ID NO: 674544 - DNA, 25 bp, Mus musculus
gcaccttgaaataaagctgactttg

SEQ ID NO: 674545 - DNA, 25 bp, Mus musculus
gcaccttgaaattaagctgactttg

SEQ ID NO: 674546 - DNA, 25 bp, Mus musculus
gcaccttgcctgacatgaccatggg

SEQ ID NO: 674547 - DNA, 25 bp, Mus musculus
gcaccttgcctgtcatgaccatggg

SEQ ID NO: 674548 - DNA, 25 bp, Mus musculus
gcaccttggattatatcttagaacg

SEQ ID NO: 674549 - DNA, 25 bp, Mus musculus
gcaccttggattttatcttagaacg

SEQ ID NO: 674550 - DNA, 25 bp, Mus musculus
gcaccttggctgaacctccatggat

SEQ ID NO: 674551 - DNA, 25 bp, Mus musculus
gcaccttggctgtacctccatggat

SEQ ID NO: 674552 - DNA, 25 bp, Mus musculus
gcaccttggtagcagcttgtgtgaa

SEQ ID NO: 674553 - DNA, 25 bp, Mus musculus
gcaccttggtaggagcttgtgtgaa

SEQ ID NO: 674554 - DNA, 25 bp, Mus musculus
gcacctttaagcatgaattagacta

SEQ ID NO: 674555 - DNA, 25 bp, Mus musculus
gcacctttaagcttgaattagacta

SEQ ID NO: 674556 - DNA, 25 bp, Mus musculus
gcacctttacggcttcccagaatta

SEQ ID NO: 674557 - DNA, 25 bp, Mus musculus
gcacctttacgggttcccagaatta

SEQ ID NO: 674558 - DNA, 25 bp, Mus musculus
gcacctttaggtccgtcggcttcgg

SEQ ID NO: 674559 - DNA, 25 bp, Mus musculus
gcacctttaggtgcgtcggcttcgg

SEQ ID NO: 674560 - DNA, 25 bp, Mus musculus
gcacctttcagcattcgggacagca

SEQ ID NO: 674561 - DNA, 25 bp, Mus musculus
gcacctttcagctttcgggacagca

SEQ ID NO: 674562 - DNA, 25 bp, Mus musculus
gcacctttctcacgactctgttcat

SEQ ID NO: 674563 - DNA, 25 bp, Mus musculus
gcacctttctcaggactctgttcat

SEQ ID NO: 674564 - DNA, 25 bp, Mus musculus
gcacctttgcaaccagtaccctggg

SEQ ID NO: 674565 - DNA, 25 bp, Mus musculus
gcacctttgcaagcagtaccctggg

SEQ ID NO: 674566 - DNA, 25 bp, Mus musculus
gcacctttgttcagacctgctcggg

SEQ ID NO: 674567 - DNA, 25 bp, Mus musculus
gcacctttgttctgacctgctcggg

SEQ ID NO: 674568 - DNA, 25 bp, Mus musculus
gcaccttttccaccgggcctgtgta

SEQ ID NO: 674569 - DNA, 25 bp, Mus musculus
gcaccttttccagcgggcctgtgta

SEQ ID NO: 674570 - DNA, 25 bp, Mus musculus
gcacgaaagttgcaggtgagcttaa

SEQ ID NO: 674571 - DNA, 25 bp, Mus musculus
gcacgaaagttggaggtgagcttaa

SEQ ID NO: 674572 - DNA, 25 bp, Mus musculus
gcacgaacagctcaggaaagacgct

SEQ ID NO: 674573 - DNA, 25 bp, Mus musculus
gcacgaacagctgaggaaagacgct

SEQ ID NO: 674574 - DNA, 25 bp, Mus musculus
gcacgaagttaacctgacagtacag

SEQ ID NO: 674575 - DNA, 25 bp, Mus musculus
gcacgaagttaagctgacagtacag

SEQ ID NO: 674576 - DNA, 25 bp, Mus musculus
gcacgaattgctcagtcttgctagc

SEQ ID NO: 674577 - DNA, 25 bp, Mus musculus
gcacgaattgctgagtcttgctagc

SEQ ID NO: 674578 - DNA, 25 bp, Mus musculus
gcacgaccaagaacttgcatgggct

SEQ ID NO: 674579 - DNA, 25 bp, Mus musculus
gcacgaccaagatcttgcatgggct

SEQ ID NO: 674580 - DNA, 25 bp, Mus musculus
gcacgaccgggacaaacataacgag

SEQ ID NO: 674581 - DNA, 25 bp, Mus musculus
gcacgaccgggagaaacataacgag

SEQ ID NO: 674582 - DNA, 25 bp, Mus musculus
gcacgactcgacctgggatcctgca

SEQ ID NO: 674583 - DNA, 25 bp, Mus musculus
gcacgactcgacgtgggatcctgca

SEQ ID NO: 674584 - DNA, 25 bp, Mus musculus
gcacgagaatatcaaatagaattca

SEQ ID NO: 674585 - DNA, 25 bp, Mus musculus
gcacgagaatatgaaatagaattca

SEQ ID NO: 674586 - DNA, 25 bp, Mus musculus
gcacgagaattacgatgaggcctta

SEQ ID NO: 674587 - DNA, 25 bp, Mus musculus
gcacgagaattaggatgaggcctta

SEQ ID NO: 674588 - DNA, 25 bp, Mus musculus
gcacgagcacagacaccacttctta

SEQ ID NO: 674589 - DNA, 25 bp, Mus musculus
gcacgagcacagtcaccacttctta

SEQ ID NO: 674590 - DNA, 25 bp, Mus musculus
gcacgagcgtttccctatggcaatg

SEQ ID NO: 674591 - DNA, 25 bp, Mus musculus
gcacgagcgtttgcctatggcaatg

SEQ ID NO: 674592 - DNA, 25 bp, Mus musculus
gcacgagggctcagaatctaccaac

SEQ ID NO: 674593 - DNA, 25 bp, Mus musculus
gcacgagggctctgaatctaccaac

SEQ ID NO: 674594 - DNA, 25 bp, Mus musculus
gcacgagtgactaccctgagcacgt

SEQ ID NO: 674595 - DNA, 25 bp, Mus musculus
gcacgagtgacttccctgagcacgt

SEQ ID NO: 674596 - DNA, 25 bp, Mus musculus
gcacgagtggaaagactgccctgca

SEQ ID NO: 674597 - DNA, 25 bp, Mus musculus
gcacgagtggaatgactgccctgca

SEQ ID NO: 674598 - DNA, 25 bp, Mus musculus
gcacgatacctgaaaaccttaccca

SEQ ID NO: 674599 - DNA, 25 bp, Mus musculus
gcacgatacctgtaaaccttaccca

SEQ ID NO: 674600 - DNA, 25 bp, Mus musculus
gcacgatggagccacaccacgtgaa

SEQ ID NO: 674601 - DNA, 25 bp, Mus musculus
gcacgatggagcgacaccacgtgaa

SEQ ID NO: 674602 - DNA, 25 bp, Mus musculus
gcacgatggtccaacacattccaga

SEQ ID NO: 674603 - DNA, 25 bp, Mus musculus
gcacgatggtcctacacattccaga

SEQ ID NO: 674604 - DNA, 25 bp, Mus musculus
gcacgcacgtagagaggttccacga

SEQ ID NO: 674605 - DNA, 25 bp, Mus musculus
gcacgcacgtagtgaggttccacga

SEQ ID NO: 674606 - DNA, 25 bp, Mus musculus
gcacgcatattcaacgaaacgccca

SEQ ID NO: 674607 - DNA, 25 bp, Mus musculus
gcacgcatattctacgaaacgccca

SEQ ID NO: 674608 - DNA, 25 bp, Mus musculus
gcacgccattaaatagcagtaggcc

SEQ ID NO: 674609 - DNA, 25 bp, Mus musculus
gcacgccattaattagcagtaggcc

SEQ ID NO: 674610 - DNA, 25 bp, Mus musculus
gcacgccgcgtccacaggaatgttt

SEQ ID NO: 674611 - DNA, 25 bp, Mus musculus
gcacgccgcgtcgacaggaatgttt

SEQ ID NO: 674612 - DNA, 25 bp, Mus musculus
gcacgcctacaaattcttcttcaag

SEQ ID NO: 674613 - DNA, 25 bp, Mus musculus
gcacgcctacaatttcttcttcaag

SEQ ID NO: 674614 - DNA, 25 bp, Mus musculus
gcacgcctggccagctgcatttcat

SEQ ID NO: 674615 - DNA, 25 bp, Mus musculus
gcacgcctggcctgctgcatttcat

SEQ ID NO: 674616 - DNA, 25 bp, Mus musculus
gcacgcctggctaattgaaggtccc

SEQ ID NO: 674617 - DNA, 25 bp, Mus musculus
gcacgcctggcttattgaaggtccc

SEQ ID NO: 674618 - DNA, 25 bp, Mus musculus
gcacgcgatgcaacaccactcaggg

SEQ ID NO: 674619 - DNA, 25 bp, Mus musculus
gcacgcgatgcatcaccactcaggg

SEQ ID NO: 674620 - DNA, 25 bp, Mus musculus
gcacgcgctggtcgcttacttcaac

SEQ ID NO: 674621 - DNA, 25 bp, Mus musculus
gcacgcgctggtggcttacttcaac

SEQ ID NO: 674622 - DNA, 25 bp, Mus musculus
gcacgctattgcagttatttgggct

SEQ ID NO: 674623 - DNA, 25 bp, Mus musculus
gcacgctattgctgttatttgggct

SEQ ID NO: 674624 - DNA, 25 bp, Mus musculus
gcacgctcctgtcaggcgccaaagt

SEQ ID NO: 674625 - DNA, 25 bp, Mus musculus
gcacgctcctgtgaggcgccaaagt

SEQ ID NO: 674626 - DNA, 25 bp, Mus musculus
gcacgctggagacccagaacgcctg

SEQ ID NO: 674627 - DNA, 25 bp, Mus musculus
gcacgctggagagccagaacgcctg

SEQ ID NO: 674628 - DNA, 25 bp, Mus musculus
gcacgctggcaaatcgcaactttga

SEQ ID NO: 674629 - DNA, 25 bp, Mus musculus
gcacgctggcaattcgcaactttga

SEQ ID NO: 674630 - DNA, 25 bp, Mus musculus
gcacggaatcagaagaaagaagcca

SEQ ID NO: 674631 - DNA, 25 bp, Mus musculus
gcacggaatcagtagaaagaagcca

SEQ ID NO: 674632 - DNA, 25 bp, Mus musculus
gcacggaccctcagattggcgggct

SEQ ID NO: 674633 - DNA, 25 bp, Mus musculus
gcacggaccctctgattggcgggct

SEQ ID NO: 674634 - DNA, 25 bp, Mus musculus
gcacggagacggctatcccttcgac

SEQ ID NO: 674635 - DNA, 25 bp, Mus musculus
gcacggagacgggtatcccttcgac

SEQ ID NO: 674636 - DNA, 25 bp, Mus musculus
gcacggagccacagaacgaagatgc

SEQ ID NO: 674637 - DNA, 25 bp, Mus musculus
gcacggagccactgaacgaagatgc

SEQ ID NO: 674638 - DNA, 25 bp, Mus musculus
gcacggataactcagtcataactgt

SEQ ID NO: 674639 - DNA, 25 bp, Mus musculus
gcacggataactgagtcataactgt

SEQ ID NO: 674640 - DNA, 25 bp, Mus musculus
gcacggattatcagctctacagagg

SEQ ID NO: 674641 - DNA, 25 bp, Mus musculus
gcacggattatctgctctacagagg

SEQ ID NO: 674642 - DNA, 25 bp, Mus musculus
gcacggcagggtcataaaaatgtaa

SEQ ID NO: 674643 - DNA, 25 bp, Mus musculus
gcacggcagggtgataaaaatgtaa

SEQ ID NO: 674644 - DNA, 25 bp, Mus musculus
gcacggcattttcatgacgctgttt

SEQ ID NO: 674645 - DNA, 25 bp, Mus musculus
gcacggcattttgatgacgctgttt

SEQ ID NO: 674646 - DNA, 25 bp, Mus musculus
gcacggccacccctgttacgtgtgg

SEQ ID NO: 674647 - DNA, 25 bp, Mus musculus
gcacggccacccgtgttacgtgtgg

SEQ ID NO: 674648 - DNA, 25 bp, Mus musculus
gcacggcccgttctcctttagactt

SEQ ID NO: 674649 - DNA, 25 bp, Mus musculus
gcacggcccgttgtcctttagactt

SEQ ID NO: 674650 - DNA, 25 bp, Mus musculus
gcacggcctatgaggtgctcacctg

SEQ ID NO: 674651 - DNA, 25 bp, Mus musculus
gcacggcctatgtggtgctcacctg

SEQ ID NO: 674652 - DNA, 25 bp, Mus musculus
gcacggctgcagatattgttatgga

SEQ ID NO: 674653 - DNA, 25 bp, Mus musculus
gcacggctgcagttattgttatgga

SEQ ID NO: 674654 - DNA, 25 bp, Mus musculus
gcacgggaagccatatttctacaac

SEQ ID NO: 674655 - DNA, 25 bp, Mus musculus
gcacgggaagccttatttctacaac

SEQ ID NO: 674656 - DNA, 25 bp, Mus musculus
gcacgggatatcactgtctaaagga

SEQ ID NO: 674657 - DNA, 25 bp, Mus musculus
gcacgggatatctctgtctaaagga

SEQ ID NO: 674658 - DNA, 25 bp, Mus musculus
gcacgggatctgatttcattaagga

SEQ ID NO: 674659 - DNA, 25 bp, Mus musculus
gcacgggatctgttttcattaagga

SEQ ID NO: 674660 - DNA, 25 bp, Mus musculus
gcacgggcgtagatggatgtctcaa

SEQ ID NO: 674661 - DNA, 25 bp, Mus musculus
gcacgggcgtagttggatgtctcaa

SEQ ID NO: 674662 - DNA, 25 bp, Mus musculus
gcacgggcttcaccttcaagtacag

SEQ ID NO: 674663 - DNA, 25 bp, Mus musculus
gcacgggcttcagcttcaagtacag

SEQ ID NO: 674664 - DNA, 25 bp, Mus musculus
gcacgggctttgctagtgcttcgcc

SEQ ID NO: 674665 - DNA, 25 bp, Mus musculus
gcacgggctttggtagtgcttcgcc

SEQ ID NO: 674666 - DNA, 25 bp, Mus musculus
gcacgggtcatcacacggatgctca

SEQ ID NO: 674667 - DNA, 25 bp, Mus musculus
gcacgggtcatctcacggatgctca

SEQ ID NO: 674668 - DNA, 25 bp, Mus musculus
gcacggtatcccagtgttcatattt

SEQ ID NO: 674669 - DNA, 25 bp, Mus musculus
gcacggtatccctgtgttcatattt

SEQ ID NO: 674670 - DNA, 25 bp, Mus musculus
gcacggtctgcgagaacacctgcag

SEQ ID NO: 674671 - DNA, 25 bp, Mus musculus
gcacggtctgcgtgaacacctgcag

SEQ ID NO: 674672 - DNA, 25 bp, Mus musculus
gcacggtgtgtacaaccctaacaag

SEQ ID NO: 674673 - DNA, 25 bp, Mus musculus
gcacggtgtgtagaaccctaacaag

SEQ ID NO: 674674 - DNA, 25 bp, Mus musculus
gcacgtcatcgacaacagggagaag

SEQ ID NO: 674675 - DNA, 25 bp, Mus musculus
gcacgtcatcgagaacagggagaag

SEQ ID NO: 674676 - DNA, 25 bp, Mus musculus
gcacgtcctcccaagatagccgagt

SEQ ID NO: 674677 - DNA, 25 bp, Mus musculus
gcacgtcctccctagatagccgagt

SEQ ID NO: 674678 - DNA, 25 bp, Mus musculus
gcacgtcctttgacatccactacgg

SEQ ID NO: 674679 - DNA, 25 bp, Mus musculus
gcacgtcctttgtcatccactacgg

SEQ ID NO: 674680 - DNA, 25 bp, Mus musculus
gcacgtcttgcacttaacaatcaag

SEQ ID NO: 674681 - DNA, 25 bp, Mus musculus
gcacgtcttgcagttaacaatcaag

SEQ ID NO: 674682 - DNA, 25 bp, Mus musculus
gcacgtgctatcagcctgcccaggg

SEQ ID NO: 674683 - DNA, 25 bp, Mus musculus
gcacgtgctatctgcctgcccaggg

SEQ ID NO: 674684 - DNA, 25 bp, Mus musculus
gcacgtggccgacatgcttgttaag

SEQ ID NO: 674685 - DNA, 25 bp, Mus musculus
gcacgtggccgagatgcttgttaag

SEQ ID NO: 674686 - DNA, 25 bp, Mus musculus
gcacgtgggcacctcatattggaaa

SEQ ID NO: 674687 - DNA, 25 bp, Mus musculus
gcacgtgggcacgtcatattggaaa

SEQ ID NO: 674688 - DNA, 25 bp, Mus musculus
gcacgtggtcctacgctgcagaggt

SEQ ID NO: 674689 - DNA, 25 bp, Mus musculus
gcacgtggtccttcgctgcagaggt

SEQ ID NO: 674690 - DNA, 25 bp, Mus musculus
gcacgtggttcaagccatcaacgcc

SEQ ID NO: 674691 - DNA, 25 bp, Mus musculus
gcacgtggttcatgccatcaacgcc

SEQ ID NO: 674692 - DNA, 25 bp, Mus musculus
gcacgtgtacgacctctttgagaga

SEQ ID NO: 674693 - DNA, 25 bp, Mus musculus
gcacgtgtacgagctctttgagaga

SEQ ID NO: 674694 - DNA, 25 bp, Mus musculus
gcacgtgtctggctgtgccccagct

SEQ ID NO: 674695 - DNA, 25 bp, Mus musculus
gcacgtgtctgggtgtgccccagct

SEQ ID NO: 674696 - DNA, 25 bp, Mus musculus
gcacgtgttacaagctccacatggg

SEQ ID NO: 674697 - DNA, 25 bp, Mus musculus
gcacgtgttacatgctccacatggg

SEQ ID NO: 674698 - DNA, 25 bp, Mus musculus
gcacgtgtttgaagtcatctgtccc

SEQ ID NO: 674699 - DNA, 25 bp, Mus musculus
gcacgtgtttgatgtcatctgtccc

SEQ ID NO: 674700 - DNA, 25 bp, Mus musculus
gcacgttaacaacgcgcggtcctgg

SEQ ID NO: 674701 - DNA, 25 bp, Mus musculus
gcacgttaacaaggcgcggtcctgg

SEQ ID NO: 674702 - DNA, 25 bp, Mus musculus
gcacgttcaggaccgcttcgtggct

SEQ ID NO: 674703 - DNA, 25 bp, Mus musculus
gcacgttcaggagcgcttcgtggct

SEQ ID NO: 674704 - DNA, 25 bp, Mus musculus
gcacgttcgttaacgtattcctttc

SEQ ID NO: 674705 - DNA, 25 bp, Mus musculus
gcacgttcgttatcgtattcctttc

SEQ ID NO: 674706 - DNA, 25 bp, Mus musculus
gcacgttctcacagtattgtccaga

SEQ ID NO: 674707 - DNA, 25 bp, Mus musculus
gcacgttctcactgtattgtccaga

SEQ ID NO: 674708 - DNA, 25 bp, Mus musculus
gcacgttcttgtcatgcctcagggc

SEQ ID NO: 674709 - DNA, 25 bp, Mus musculus
gcacgttcttgtgatgcctcagggc

SEQ ID NO: 674710 - DNA, 25 bp, Mus musculus
gcacgttgaagaaataattttgcac

SEQ ID NO: 674711 - DNA, 25 bp, Mus musculus
gcacgttgaagatataattttgcac

SEQ ID NO: 674712 - DNA, 25 bp, Mus musculus
gcacgttgccttctggaggaactta

SEQ ID NO: 674713 - DNA, 25 bp, Mus musculus
gcacgttgccttgtggaggaactta

SEQ ID NO: 674714 - DNA, 25 bp, Mus musculus
gcactaaagaaaccattgggaatgt

SEQ ID NO: 674715 - DNA, 25 bp, Mus musculus
gcactaaagaaagcattgggaatgt

SEQ ID NO: 674716 - DNA, 25 bp, Mus musculus
gcactaaattgcacgggctgcggca

SEQ ID NO: 674717 - DNA, 25 bp, Mus musculus
gcactaaattgctcgggctgcggca

SEQ ID NO: 674718 - DNA, 25 bp, Mus musculus
gcactaaccctacgcggcatcaata

SEQ ID NO: 674719 - DNA, 25 bp, Mus musculus
gcactaaccctaggcggcatcaata

SEQ ID NO: 674720 - DNA, 25 bp, Mus musculus
gcactaactttgagtgtcccctgtc

SEQ ID NO: 674721 - DNA, 25 bp, Mus musculus
gcactaactttgtgtgtcccctgtc

SEQ ID NO: 674722 - DNA, 25 bp, Mus musculus
gcactaagtcaccaaagtttccctg

SEQ ID NO: 674723 - DNA, 25 bp, Mus musculus
gcactaagtcacgaaagtttccctg

SEQ ID NO: 674724 - DNA, 25 bp, Mus musculus
gcactaataccgctcctggttggcg

SEQ ID NO: 674725 - DNA, 25 bp, Mus musculus
gcactaataccggtcctggttggcg

SEQ ID NO: 674726 - DNA, 25 bp, Mus musculus
gcactacaaacgcaacgagacaggc

SEQ ID NO: 674727 - DNA, 25 bp, Mus musculus
gcactacaaacggaacgagacaggc

SEQ ID NO: 674728 - DNA, 25 bp, Mus musculus
gcactacaatcgaaggacatgtggt

SEQ ID NO: 674729 - DNA, 25 bp, Mus musculus
gcactacaatcgtaggacatgtggt

SEQ ID NO: 674730 - DNA, 25 bp, Mus musculus
gcactacacgacaccgagatccgag

SEQ ID NO: 674731 - DNA, 25 bp, Mus musculus
gcactacacgactccgagatccgag

SEQ ID NO: 674732 - DNA, 25 bp, Mus musculus
gcactacagactcgacgtccaacaa

SEQ ID NO: 674733 - DNA, 25 bp, Mus musculus
gcactacagactggacgtccaacaa

SEQ ID NO: 674734 - DNA, 25 bp, Mus musculus
gcactacagcatcgatgaagctgag

SEQ ID NO: 674735 - DNA, 25 bp, Mus musculus
gcactacagcatggatgaagctgag

SEQ ID NO: 674736 - DNA, 25 bp, Mus musculus
gcactacctttgcaatgcctgcgga

SEQ ID NO: 674737 - DNA, 25 bp, Mus musculus
gcactacctttggaatgcctgcgga

SEQ ID NO: 674738 - DNA, 25 bp, Mus musculus
gcactacgcatgctacaccatatgt

SEQ ID NO: 674739 - DNA, 25 bp, Mus musculus
gcactacgcatggtacaccatatgt

SEQ ID NO: 674740 - DNA, 25 bp, Mus musculus
gcactacgtgggatcagcagctgct

SEQ ID NO: 674741 - DNA, 25 bp, Mus musculus
gcactacgtgggttcagcagctgct

SEQ ID NO: 674742 - DNA, 25 bp, Mus musculus
gcactactcctgctgtctggcctat

SEQ ID NO: 674743 - DNA, 25 bp, Mus musculus
gcactactcctggtgtctggcctat

SEQ ID NO: 674744 - DNA, 25 bp, Mus musculus
gcactactgaggactacaatctgat

SEQ ID NO: 674745 - DNA, 25 bp, Mus musculus
gcactactgaggtctacaatctgat

SEQ ID NO: 674746 - DNA, 25 bp, Mus musculus
gcactagacaacacggaaaaacacg

SEQ ID NO: 674747 - DNA, 25 bp, Mus musculus
gcactagacaactcggaaaaacacg

SEQ ID NO: 674748 - DNA, 25 bp, Mus musculus
gcactagaggtgaccttgggtagcc

SEQ ID NO: 674749 - DNA, 25 bp, Mus musculus
gcactagaggtgtccttgggtagcc

SEQ ID NO: 674750 - DNA, 25 bp, Mus musculus
gcactaggtatcaccatctcactgg

SEQ ID NO: 674751 - DNA, 25 bp, Mus musculus
gcactaggtatcaggggtcccgtcc

SEQ ID NO: 674752 - DNA, 25 bp, Mus musculus
gcactaggtatctccatctcactgg

SEQ ID NO: 674753 - DNA, 25 bp, Mus musculus
gcactaggtatctggggtcccgtcc

SEQ ID NO: 674754 - DNA, 25 bp, Mus musculus
gcactagtgtcaaccgcctcgtgca

SEQ ID NO: 674755 - DNA, 25 bp, Mus musculus
gcactagtgtcatccgcctcgtgca

SEQ ID NO: 674756 - DNA, 25 bp, Mus musculus
gcactagttccacaagtcgcattac

SEQ ID NO: 674757 - DNA, 25 bp, Mus musculus
gcactagttccagaagtcgcattac

SEQ ID NO: 674758 - DNA, 25 bp, Mus musculus
gcactatgaattctaccgccgctgt

SEQ ID NO: 674759 - DNA, 25 bp, Mus musculus
gcactatgaattgtaccgccgctgt

SEQ ID NO: 674760 - DNA, 25 bp, Mus musculus
gcactatgagatactcgaggtggat

SEQ ID NO: 674761 - DNA, 25 bp, Mus musculus
gcactatgagattctcgaggtggat

SEQ ID NO: 674762 - DNA, 25 bp, Mus musculus
gcactattccccattaaagccacag

SEQ ID NO: 674763 - DNA, 25 bp, Mus musculus
gcactattcccctttaaagccacag

SEQ ID NO: 674764 - DNA, 25 bp, Mus musculus
gcactattgtggatatcttggaaag

SEQ ID NO: 674765 - DNA, 25 bp, Mus musculus
gcactattgtggttatcttggaaag

SEQ ID NO: 674766 - DNA, 25 bp, Mus musculus
gcactatttgacacgctgcgacccg

SEQ ID NO: 674767 - DNA, 25 bp, Mus musculus
gcactatttgactcgctgcgacccg

SEQ ID NO: 674768 - DNA, 25 bp, Mus musculus
gcactcaacactagccacggtcagg

SEQ ID NO: 674769 - DNA, 25 bp, Mus musculus
gcactcaacacttgccacggtcagg

SEQ ID NO: 674770 - DNA, 25 bp, Mus musculus
gcactcacatgccaatggctggaga

SEQ ID NO: 674771 - DNA, 25 bp, Mus musculus
gcactcacatgcgaatggctggaga

SEQ ID NO: 674772 - DNA, 25 bp, Mus musculus
gcactcaccccgactgtatcatgaa

SEQ ID NO: 674773 - DNA, 25 bp, Mus musculus
gcactcaccccgtctgtatcatgaa

SEQ ID NO: 674774 - DNA, 25 bp, Mus musculus
gcactcactgttcactttaataagt

SEQ ID NO: 674775 - DNA, 25 bp, Mus musculus
gcactcactgttgactttaataagt

SEQ ID NO: 674776 - DNA, 25 bp, Mus musculus
gcactcaggtctatttcttcagaaa

SEQ ID NO: 674777 - DNA, 25 bp, Mus musculus
gcactcaggtctttttcttcagaaa

SEQ ID NO: 674778 - DNA, 25 bp, Mus musculus
gcactcagtaccaggtctacacgag

SEQ ID NO: 674779 - DNA, 25 bp, Mus musculus
gcactcagtacctggtctacacgag

SEQ ID NO: 674780 - DNA, 25 bp, Mus musculus
gcactcagtgtcattcatgggaaga

SEQ ID NO: 674781 - DNA, 25 bp, Mus musculus
gcactcagtgtctttcatgggaaga

SEQ ID NO: 674782 - DNA, 25 bp, Mus musculus
gcactccaaactcttgctgtcagag

SEQ ID NO: 674783 - DNA, 25 bp, Mus musculus
gcactccaaactgttgctgtcagag

SEQ ID NO: 674784 - DNA, 25 bp, Mus musculus
gcactccagcctccgggtggtgtga

SEQ ID NO: 674785 - DNA, 25 bp, Mus musculus
gcactccagcctgcgggtggtgtga

SEQ ID NO: 674786 - DNA, 25 bp, Mus musculus
gcactcccgacgagtgatgcaccga

SEQ ID NO: 674787 - DNA, 25 bp, Mus musculus
gcactcccgacgtgtgatgcaccga

SEQ ID NO: 674788 - DNA, 25 bp, Mus musculus
gcactccgttctccttgactctaga

SEQ ID NO: 674789 - DNA, 25 bp, Mus musculus
gcactccgttctgcttgactctaga

SEQ ID NO: 674790 - DNA, 25 bp, Mus musculus
gcactcctagttacaacagacaaca

SEQ ID NO: 674791 - DNA, 25 bp, Mus musculus
gcactcctagtttcaacagacaaca

SEQ ID NO: 674792 - DNA, 25 bp, Mus musculus
gcactccttcggcagatccaagata

SEQ ID NO: 674793 - DNA, 25 bp, Mus musculus
gcactccttcgggagatccaagata

SEQ ID NO: 674794 - DNA, 25 bp, Mus musculus
gcactcgagcctaatcaaacacctg

SEQ ID NO: 674795 - DNA, 25 bp, Mus musculus
gcactcgagccttatcaaacacctg

SEQ ID NO: 674796 - DNA, 25 bp, Mus musculus
gcactcgcaatgctttgctgcatgg

SEQ ID NO: 674797 - DNA, 25 bp, Mus musculus
gcactcgcaatggtttgctgcatgg

SEQ ID NO: 674798 - DNA, 25 bp, Mus musculus
gcactcgtacgtctaaaacaaataa

SEQ ID NO: 674799 - DNA, 25 bp, Mus musculus
gcactcgtacgtgtaaaacaaataa

SEQ ID NO: 674800 - DNA, 25 bp, Mus musculus
gcactctcccggcaatacaaactag

SEQ ID NO: 674801 - DNA, 25 bp, Mus musculus
gcactctcccgggaatacaaactag

SEQ ID NO: 674802 - DNA, 25 bp, Mus musculus
gcactctcgagcctcgtgcatgcag

SEQ ID NO: 674803 - DNA, 25 bp, Mus musculus
gcactctcgagcgtcgtgcatgcag

SEQ ID NO: 674804 - DNA, 25 bp, Mus musculus
gcactctgactgcatcttcaagaag

SEQ ID NO: 674805 - DNA, 25 bp, Mus musculus
gcactctgactggatcttcaagaag

SEQ ID NO: 674806 - DNA, 25 bp, Mus musculus
gcactctggtctacactattaagca

SEQ ID NO: 674807 - DNA, 25 bp, Mus musculus
gcactctggtcttcactattaagca

SEQ ID NO: 674808 - DNA, 25 bp, Mus musculus
gcactcttcctgatcataccgtttg

SEQ ID NO: 674809 - DNA, 25 bp, Mus musculus
gcactcttcctgttcataccgtttg

SEQ ID NO: 674810 - DNA, 25 bp, Mus musculus
gcactcttctgacctggtggcaaag

SEQ ID NO: 674811 - DNA, 25 bp, Mus musculus
gcactcttctgagctggtggcaaag

SEQ ID NO: 674812 - DNA, 25 bp, Mus musculus
gcactgaaaaagaacatggaggtgg

SEQ ID NO: 674813 - DNA, 25 bp, Mus musculus
gcactgaaaaagtacatggaggtgg

SEQ ID NO: 674814 - DNA, 25 bp, Mus musculus
gcactgaaacgcaacgaaggccctc

SEQ ID NO: 674815 - DNA, 25 bp, Mus musculus
gcactgaaacgctacgaaggccctc

SEQ ID NO: 674816 - DNA, 25 bp, Mus musculus
gcactgaagacccagggaagctcca

SEQ ID NO: 674817 - DNA, 25 bp, Mus musculus
gcactgaagaccgagggaagctcca

SEQ ID NO: 674818 - DNA, 25 bp, Mus musculus
gcactgaagagaccggaggaatatc

SEQ ID NO: 674819 - DNA, 25 bp, Mus musculus
gcactgaagagagcggaggaatatc

SEQ ID NO: 674820 - DNA, 25 bp, Mus musculus
gcactgaatccccatgcagttgaat

SEQ ID NO: 674821 - DNA, 25 bp, Mus musculus
gcactgaatcccgatgcagttgaat

SEQ ID NO: 674822 - DNA, 25 bp, Mus musculus
gcactgaccgagagcaggtaccttc

SEQ ID NO: 674823 - DNA, 25 bp, Mus musculus
gcactgaccgagtgcaggtaccttc

SEQ ID NO: 674824 - DNA, 25 bp, Mus musculus
gcactgaccgctacgccatgtataa

SEQ ID NO: 674825 - DNA, 25 bp, Mus musculus
gcactgaccgcttcgccatgtataa

SEQ ID NO: 674826 - DNA, 25 bp, Mus musculus
gcactgagagaaagcgcatgacctt

SEQ ID NO: 674827 - DNA, 25 bp, Mus musculus
gcactgagagaatgcgcatgacctt

SEQ ID NO: 674828 - DNA, 25 bp, Mus musculus
gcactgagcgacacggccctgaaga

SEQ ID NO: 674829 - DNA, 25 bp, Mus musculus
gcactgagcgactcggccctgaaga

SEQ ID NO: 674830 - DNA, 25 bp, Mus musculus
gcactgaggcaaagtgtgcagcaca

SEQ ID NO: 674831 - DNA, 25 bp, Mus musculus
gcactgaggcaatgtgtgcagcaca

SEQ ID NO: 674832 - DNA, 25 bp, Mus musculus
gcactgataacactgtcatggctgt

SEQ ID NO: 674833 - DNA, 25 bp, Mus musculus
gcactgataacagtgtcatggctgt

SEQ ID NO: 674834 - DNA, 25 bp, Mus musculus
gcactgatgacgagcagatcaacga

SEQ ID NO: 674835 - DNA, 25 bp, Mus musculus
gcactgatgacgtgcagatcaacga

SEQ ID NO: 674836 - DNA, 25 bp, Mus musculus
gcactgatgactatgtattgttacc

SEQ ID NO: 674837 - DNA, 25 bp, Mus musculus
gcactgatgactttgtattgttacc

SEQ ID NO: 674838 - DNA, 25 bp, Mus musculus
gcactgatggaaatggaaaagcata

SEQ ID NO: 674839 - DNA, 25 bp, Mus musculus
gcactgatggaattggaaaagcata

SEQ ID NO: 674840 - DNA, 25 bp, Mus musculus
gcactgatggctcacactactggag

SEQ ID NO: 674841 - DNA, 25 bp, Mus musculus
gcactgatggctgacactactggag

SEQ ID NO: 674842 - DNA, 25 bp, Mus musculus
gcactgcaaggccagaaaattttac

SEQ ID NO: 674843 - DNA, 25 bp, Mus musculus
gcactgcaaggcgagaaaattttac

SEQ ID NO: 674844 - DNA, 25 bp, Mus musculus
gcactgcacaaactaggcacgtgct

SEQ ID NO: 674845 - DNA, 25 bp, Mus musculus
gcactgcacaaagtaggcacgtgct

SEQ ID NO: 674846 - DNA, 25 bp, Mus musculus
gcactgcacggcagagcagacctta

SEQ ID NO: 674847 - DNA, 25 bp, Mus musculus
gcactgcacggctgagcagacctta

SEQ ID NO: 674848 - DNA, 25 bp, Mus musculus
gcactgcagaggactcggagacact

SEQ ID NO: 674849 - DNA, 25 bp, Mus musculus
gcactgcagaggtctcggagacact

SEQ ID NO: 674850 - DNA, 25 bp, Mus musculus
gcactgcagcatccgtacatcaacg

SEQ ID NO: 674851 - DNA, 25 bp, Mus musculus
gcactgcagcatgcgtacatcaacg

SEQ ID NO: 674852 - DNA, 25 bp, Mus musculus
gcactgcagctcatggcggagttcc

SEQ ID NO: 674853 - DNA, 25 bp, Mus musculus
gcactgcagctcttggcggagttcc

SEQ ID NO: 674854 - DNA, 25 bp, Mus musculus
gcactgcagctgcaagaacctggcc

SEQ ID NO: 674855 - DNA, 25 bp, Mus musculus
gcactgcagctggaagaacctggcc

SEQ ID NO: 674856 - DNA, 25 bp, Mus musculus
gcactgcaggtgctcttcctagctg

SEQ ID NO: 674857 - DNA, 25 bp, Mus musculus
gcactgcaggtggtcttcctagctg

SEQ ID NO: 674858 - DNA, 25 bp, Mus musculus
gcactgcagtgtacccattactcaa

SEQ ID NO: 674859 - DNA, 25 bp, Mus musculus
gcactgcagtgtcacgtctcagtgg

SEQ ID NO: 674860 - DNA, 25 bp, Mus musculus
gcactgcagtgtgacgtctcagtgg

SEQ ID NO: 674861 - DNA, 25 bp, Mus musculus
gcactgcagtgttcccattactcaa

SEQ ID NO: 674862 - DNA, 25 bp, Mus musculus
gcactgccagcgatgccctttagta

SEQ ID NO: 674863 - DNA, 25 bp, Mus musculus
gcactgccagcgttgccctttagta

SEQ ID NO: 674864 - DNA, 25 bp, Mus musculus
gcactgcccgagctgattatcttgc

SEQ ID NO: 674865 - DNA, 25 bp, Mus musculus
gcactgcccgaggtgattatcttgc

SEQ ID NO: 674866 - DNA, 25 bp, Mus musculus
gcactgcctgcgacttctggaggag

SEQ ID NO: 674867 - DNA, 25 bp, Mus musculus
gcactgcctgcgtcttctggaggag

SEQ ID NO: 674868 - DNA, 25 bp, Mus musculus
gcactgcgggtcatacagaaaaata

SEQ ID NO: 674869 - DNA, 25 bp, Mus musculus
gcactgcgggtcttacagaaaaata

SEQ ID NO: 674870 - DNA, 25 bp, Mus musculus
gcactgcgttccatcgggctcaagt

SEQ ID NO: 674871 - DNA, 25 bp, Mus musculus
gcactgcgttccttcgggctcaagt

SEQ ID NO: 674872 - DNA, 25 bp, Mus musculus
gcactgctatgaagactgaaaattg

SEQ ID NO: 674873 - DNA, 25 bp, Mus musculus
gcactgctatgatgactgaaaattg

SEQ ID NO: 674874 - DNA, 25 bp, Mus musculus
gcactgcttcctccagcatctgatg

SEQ ID NO: 674875 - DNA, 25 bp, Mus musculus
gcactgcttcctgcagcatctgatg

SEQ ID NO: 674876 - DNA, 25 bp, Mus musculus
gcactggaatcacaaggactgtgtg

SEQ ID NO: 674877 - DNA, 25 bp, Mus musculus
gcactggaatcagaaggactgtgtg

SEQ ID NO: 674878 - DNA, 25 bp, Mus musculus
gcactggaatcgaatcaagattgcc

SEQ ID NO: 674879 - DNA, 25 bp, Mus musculus
gcactggaatcgtatcaagattgcc

SEQ ID NO: 674880 - DNA, 25 bp, Mus musculus
gcactggacatgaagcggcactgtt

SEQ ID NO: 674881 - DNA, 25 bp, Mus musculus
gcactggacatgatcttctcagctg

SEQ ID NO: 674882 - DNA, 25 bp, Mus musculus
gcactggacatgcagctccgagcag

SEQ ID NO: 674883 - DNA, 25 bp, Mus musculus
gcactggacatggagctccgagcag

SEQ ID NO: 674884 - DNA, 25 bp, Mus musculus
gcactggacatgtagcggcactgtt

SEQ ID NO: 674885 - DNA, 25 bp, Mus musculus
gcactggacatgttcttctcagctg

SEQ ID NO: 674886 - DNA, 25 bp, Mus musculus
gcactggaccatagaggcagcccag

SEQ ID NO: 674887 - DNA, 25 bp, Mus musculus
gcactggaccattgaggcagcccag

SEQ ID NO: 674888 - DNA, 25 bp, Mus musculus
gcactggagtggactgaccacatgg

SEQ ID NO: 674889 - DNA, 25 bp, Mus musculus
gcactggagtggtctgaccacatgg

SEQ ID NO: 674890 - DNA, 25 bp, Mus musculus
gcactggccattcgcttgtcctggt

SEQ ID NO: 674891 - DNA, 25 bp, Mus musculus
gcactggccattggcttgtcctggt

SEQ ID NO: 674892 - DNA, 25 bp, Mus musculus
gcactggccttacctgagcgggcct

SEQ ID NO: 674893 - DNA, 25 bp, Mus musculus
gcactggccttagctgagcgggcct

SEQ ID NO: 674894 - DNA, 25 bp, Mus musculus
gcactggcggagatcagctggcctt

SEQ ID NO: 674895 - DNA, 25 bp, Mus musculus
gcactggcggagttcagctggcctt

SEQ ID NO: 674896 - DNA, 25 bp, Mus musculus
gcactggctaatcaagagtgaaaaa

SEQ ID NO: 674897 - DNA, 25 bp, Mus musculus
gcactggctaatgaagagtgaaaaa

SEQ ID NO: 674898 - DNA, 25 bp, Mus musculus
gcactgggaaaacactcttggcacg

SEQ ID NO: 674899 - DNA, 25 bp, Mus musculus
gcactgggaaaagactcttggcacg

SEQ ID NO: 674900 - DNA, 25 bp, Mus musculus
gcactgggaaatcatgaatttgata

SEQ ID NO: 674901 - DNA, 25 bp, Mus musculus
gcactgggaaatgatgaatttgata

SEQ ID NO: 674902 - DNA, 25 bp, Mus musculus
gcactgggacagagcagactttgta

SEQ ID NO: 674903 - DNA, 25 bp, Mus musculus
gcactgggacagtgcagactttgta

SEQ ID NO: 674904 - DNA, 25 bp, Mus musculus
gcactgggcaagactcctggaagag

SEQ ID NO: 674905 - DNA, 25 bp, Mus musculus
gcactgggcaagtctcctggaagag

SEQ ID NO: 674906 - DNA, 25 bp, Mus musculus
gcactggggctcactccgagccaga

SEQ ID NO: 674907 - DNA, 25 bp, Mus musculus
gcactggggctctctccgagccaga

SEQ ID NO: 674908 - DNA, 25 bp, Mus musculus
gcactgggtggtccggccttcctgg

SEQ ID NO: 674909 - DNA, 25 bp, Mus musculus
gcactgggtggtgcggccttcctgg

SEQ ID NO: 674910 - DNA, 25 bp, Mus musculus
gcactgggttttacgagtgctgacc

SEQ ID NO: 674911 - DNA, 25 bp, Mus musculus
gcactgggtttttcgagtgctgacc

SEQ ID NO: 674912 - DNA, 25 bp, Mus musculus
gcactggtccgtacccgaatgcagg

SEQ ID NO: 674913 - DNA, 25 bp, Mus musculus
gcactggtccgttcccgaatgcagg

SEQ ID NO: 674914 - DNA, 25 bp, Mus musculus
gcactggtgaatagcctctggcatt

SEQ ID NO: 674915 - DNA, 25 bp, Mus musculus
gcactggtgaattgcctctggcatt

SEQ ID NO: 674916 - DNA, 25 bp, Mus musculus
gcactggtgatgacctttctcttca

SEQ ID NO: 674917 - DNA, 25 bp, Mus musculus
gcactggtgatgtcctttctcttca

SEQ ID NO: 674918 - DNA, 25 bp, Mus musculus
gcactggtgctgagcaatgtgcact

SEQ ID NO: 674919 - DNA, 25 bp, Mus musculus
gcactggtgctgtgcaatgtgcact

SEQ ID NO: 674920 - DNA, 25 bp, Mus musculus
gcactggtggacaaatgacaatgga

SEQ ID NO: 674921 - DNA, 25 bp, Mus musculus
gcactggtggactaatgacaatgga

SEQ ID NO: 674922 - DNA, 25 bp, Mus musculus
gcactggtgttcatgagcaaccaag

SEQ ID NO: 674923 - DNA, 25 bp, Mus musculus
gcactggtgttcttgagcaaccaag

SEQ ID NO: 674924 - DNA, 25 bp, Mus musculus
gcactggttgtcattggccagtcta

SEQ ID NO: 674925 - DNA, 25 bp, Mus musculus
gcactggttgtctttggccagtcta

SEQ ID NO: 674926 - DNA, 25 bp, Mus musculus
gcactgtagatacccaagggcagat

SEQ ID NO: 674927 - DNA, 25 bp, Mus musculus
gcactgtagatagccaagggcagat

SEQ ID NO: 674928 - DNA, 25 bp, Mus musculus
gcactgtagattcagctttgtatcc

SEQ ID NO: 674929 - DNA, 25 bp, Mus musculus
gcactgtagattgagctttgtatcc

SEQ ID NO: 674930 - DNA, 25 bp, Mus musculus
gcactgtccaagcacctgccaaaag

SEQ ID NO: 674931 - DNA, 25 bp, Mus musculus
gcactgtccaaggacctgccaaaag

SEQ ID NO: 674932 - DNA, 25 bp, Mus musculus
gcactgtgatccctgcagcgctgtt

SEQ ID NO: 674933 - DNA, 25 bp, Mus musculus
gcactgtgatccgtgcagcgctgtt

SEQ ID NO: 674934 - DNA, 25 bp, Mus musculus
gcactgtgatgtcaggaccgccata

SEQ ID NO: 674935 - DNA, 25 bp, Mus musculus
gcactgtgatgtgaggaccgccata

SEQ ID NO: 674936 - DNA, 25 bp, Mus musculus
gcactgtgatttaaagcccgaaaat

SEQ ID NO: 674937 - DNA, 25 bp, Mus musculus
gcactgtgattttaagcccgaaaat

SEQ ID NO: 674938 - DNA, 25 bp, Mus musculus
gcactgtgccatctcctgctgggaa

SEQ ID NO: 674939 - DNA, 25 bp, Mus musculus
gcactgtgccatgtcctgctgggaa

SEQ ID NO: 674940 - DNA, 25 bp, Mus musculus
gcactgtggctcacgggtgccatac

SEQ ID NO: 674941 - DNA, 25 bp, Mus musculus
gcactgtggctctcgggtgccatac

SEQ ID NO: 674942 - DNA, 25 bp, Mus musculus
gcactgtgggaaatgagttagttca

SEQ ID NO: 674943 - DNA, 25 bp, Mus musculus
gcactgtgggaattgagttagttca

SEQ ID NO: 674944 - DNA, 25 bp, Mus musculus
gcactgttattactacttttaagaa

SEQ ID NO: 674945 - DNA, 25 bp, Mus musculus
gcactgttattagtacttttaagaa

SEQ ID NO: 674946 - DNA, 25 bp, Mus musculus
gcactgttcagtatcttattagcaa

SEQ ID NO: 674947 - DNA, 25 bp, Mus musculus
gcactgttcagtttcttattagcaa

SEQ ID NO: 674948 - DNA, 25 bp, Mus musculus
gcactgttgtacatgactgaagccc

SEQ ID NO: 674949 - DNA, 25 bp, Mus musculus
gcactgttgtacttgactgaagccc

SEQ ID NO: 674950 - DNA, 25 bp, Mus musculus
gcactgttgtccagtaacgctgaag

SEQ ID NO: 674951 - DNA, 25 bp, Mus musculus
gcactgttgtcctgtaacgctgaag

SEQ ID NO: 674952 - DNA, 25 bp, Mus musculus
gcactgttgtgaagaagtcatgaag

SEQ ID NO: 674953 - DNA, 25 bp, Mus musculus
gcactgttgtgatgaagtcatgaag

SEQ ID NO: 674954 - DNA, 25 bp, Mus musculus
gcactgttttggaagcggctcctca

SEQ ID NO: 674955 - DNA, 25 bp, Mus musculus
gcactgttttggtagcggctcctca

SEQ ID NO: 674956 - DNA, 25 bp, Mus musculus
gcacttaagtgacagtgtcccctcc

SEQ ID NO: 674957 - DNA, 25 bp, Mus musculus
gcacttaagtgagagtgtcccctcc

SEQ ID NO: 674958 - DNA, 25 bp, Mus musculus
gcacttaatgctcaataggaatata

SEQ ID NO: 674959 - DNA, 25 bp, Mus musculus
gcacttaatgctgaataggaatata

SEQ ID NO: 674960 - DNA, 25 bp, Mus musculus
gcacttacacagaggtgcacctaag

SEQ ID NO: 674961 - DNA, 25 bp, Mus musculus
gcacttacacagtggtgcacctaag

SEQ ID NO: 674962 - DNA, 25 bp, Mus musculus
gcacttacccatagagaccgctagg

SEQ ID NO: 674963 - DNA, 25 bp, Mus musculus
gcacttacccattgagaccgctagg

SEQ ID NO: 674964 - DNA, 25 bp, Mus musculus
gcacttactggtctacacaatagca

SEQ ID NO: 674965 - DNA, 25 bp, Mus musculus
gcacttactggtgtacacaatagca

SEQ ID NO: 674966 - DNA, 25 bp, Mus musculus
gcacttatgctaccgcaatgacaag

SEQ ID NO: 674967 - DNA, 25 bp, Mus musculus
gcacttatgctagcgcaatgacaag

SEQ ID NO: 674968 - DNA, 25 bp, Mus musculus
gcacttcagagccaggcctgtttca

SEQ ID NO: 674969 - DNA, 25 bp, Mus musculus
gcacttcagagcgaggcctgtttca

SEQ ID NO: 674970 - DNA, 25 bp, Mus musculus
gcacttcagatactccgtggacacc

SEQ ID NO: 674971 - DNA, 25 bp, Mus musculus
gcacttcagatagtccgtggacacc

SEQ ID NO: 674972 - DNA, 25 bp, Mus musculus
gcacttcagtggctacagcagcgtg

SEQ ID NO: 674973 - DNA, 25 bp, Mus musculus
gcacttcagtgggtacagcagcgtg

SEQ ID NO: 674974 - DNA, 25 bp, Mus musculus
gcacttcatgccacctgtcagtgag

SEQ ID NO: 674975 - DNA, 25 bp, Mus musculus
gcacttcatgcctcctgtcagtgag

SEQ ID NO: 674976 - DNA, 25 bp, Mus musculus
gcacttccaagacaccaatgaccag

SEQ ID NO: 674977 - DNA, 25 bp, Mus musculus
gcacttccaagagaccaatgaccag

SEQ ID NO: 674978 - DNA, 25 bp, Mus musculus
gcacttccaaggaagctgttacttc

SEQ ID NO: 674979 - DNA, 25 bp, Mus musculus
gcacttccaaggtagctgttacttc

SEQ ID NO: 674980 - DNA, 25 bp, Mus musculus
gcacttccactactggtgcttggct

SEQ ID NO: 674981 - DNA, 25 bp, Mus musculus
gcacttccactagtggtgcttggct

SEQ ID NO: 674982 - DNA, 25 bp, Mus musculus
gcacttccactccaaatcgggcaaa

SEQ ID NO: 674983 - DNA, 25 bp, Mus musculus
gcacttccactcgaaatcgggcaaa

SEQ ID NO: 674984 - DNA, 25 bp, Mus musculus
gcacttccctctcgctgtatttgat

SEQ ID NO: 674985 - DNA, 25 bp, Mus musculus
gcacttccctctggctgtatttgat

SEQ ID NO: 674986 - DNA, 25 bp, Mus musculus
gcacttcgacgtcgtagttatcgga

SEQ ID NO: 674987 - DNA, 25 bp, Mus musculus
gcacttcgacgtggtagttatcgga

SEQ ID NO: 674988 - DNA, 25 bp, Mus musculus
gcacttcgtaccagacctataatga

SEQ ID NO: 674989 - DNA, 25 bp, Mus musculus
gcacttcgtacctgacctataatga

SEQ ID NO: 674990 - DNA, 25 bp, Mus musculus
gcacttcgtgcaagaaatgctgaat

SEQ ID NO: 674991 - DNA, 25 bp, Mus musculus
gcacttcgtgcatgaaatgctgaat

SEQ ID NO: 674992 - DNA, 25 bp, Mus musculus
gcacttctgacacaacagaacgatg

SEQ ID NO: 674993 - DNA, 25 bp, Mus musculus
gcacttctgacagaacagaacgatg

SEQ ID NO: 674994 - DNA, 25 bp, Mus musculus
gcacttcttggacagctgagaaatc

SEQ ID NO: 674995 - DNA, 25 bp, Mus musculus
gcacttcttggagagctgagaaatc

SEQ ID NO: 674996 - DNA, 25 bp, Mus musculus
gcacttctttctccaccggtgctgt

SEQ ID NO: 674997 - DNA, 25 bp, Mus musculus
gcacttctttctgcaccggtgctgt

SEQ ID NO: 674998 - DNA, 25 bp, Mus musculus
gcacttgaacatacaggaccctgaa

SEQ ID NO: 674999 - DNA, 25 bp, Mus musculus
gcacttgaacattcaggaccctgaa

SEQ ID NO: 675000 - DNA, 25 bp, Mus musculus
gcacttgctcctacacgatcagact

SEQ ID NO: 675001 - DNA, 25 bp, Mus musculus
gcacttgctccttcacgatcagact

SEQ ID NO: 675002 - DNA, 25 bp, Mus musculus
gcacttgctctgcaagggagagcta

SEQ ID NO: 675003 - DNA, 25 bp, Mus musculus
gcacttgctctgcactagaccctga

SEQ ID NO: 675004 - DNA, 25 bp, Mus musculus
gcacttgctctggaagggagagcta

SEQ ID NO: 675005 - DNA, 25 bp, Mus musculus
gcacttgctctggactagaccctga

SEQ ID NO: 675006 - DNA, 25 bp, Mus musculus
gcacttgcttggactatacgacact

SEQ ID NO: 675007 - DNA, 25 bp, Mus musculus
gcacttgcttggtctatacgacact

SEQ ID NO: 675008 - DNA, 25 bp, Mus musculus
gcacttggacacctggcatgggaca

SEQ ID NO: 675009 - DNA, 25 bp, Mus musculus
gcacttggacacgtggcatgggaca

SEQ ID NO: 675010 - DNA, 25 bp, Mus musculus
gcacttgggccccatttgggatctg

SEQ ID NO: 675011 - DNA, 25 bp, Mus musculus
gcacttgggcccgatttgggatctg

SEQ ID NO: 675012 - DNA, 25 bp, Mus musculus
gcacttggtatcagtatacatggat

SEQ ID NO: 675013 - DNA, 25 bp, Mus musculus
gcacttggtatctgtatacatggat

SEQ ID NO: 675014 - DNA, 25 bp, Mus musculus
gcacttgtcttaacctccttgtgaa

SEQ ID NO: 675015 - DNA, 25 bp, Mus musculus
gcacttgtcttatcctccttgtgaa

SEQ ID NO: 675016 - DNA, 25 bp, Mus musculus
gcactttattaacggcaggactggg

SEQ ID NO: 675017 - DNA, 25 bp, Mus musculus
gcactttattaagggcaggactggg

SEQ ID NO: 675018 - DNA, 25 bp, Mus musculus
gcactttattgacggaaccatctca

SEQ ID NO: 675019 - DNA, 25 bp, Mus musculus
gcactttattgagggaaccatctca

SEQ ID NO: 675020 - DNA, 25 bp, Mus musculus
gcactttcaagtcagctgttgcgta

SEQ ID NO: 675021 - DNA, 25 bp, Mus musculus
gcactttcaagtgagctgttgcgta

SEQ ID NO: 675022 - DNA, 25 bp, Mus musculus
gcactttcagaacgttatgagacaa

SEQ ID NO: 675023 - DNA, 25 bp, Mus musculus
gcactttcagaaggttatgagacaa

SEQ ID NO: 675024 - DNA, 25 bp, Mus musculus
gcactttcgtgcatggtgaccacca

SEQ ID NO: 675025 - DNA, 25 bp, Mus musculus
gcactttcgtgcttggtgaccacca

SEQ ID NO: 675026 - DNA, 25 bp, Mus musculus
gcactttctggccagaatccgcggg

SEQ ID NO: 675027 - DNA, 25 bp, Mus musculus
gcactttctggcgagaatccgcggg

SEQ ID NO: 675028 - DNA, 25 bp, Mus musculus
gcactttctgttaggacctctgcag

SEQ ID NO: 675029 - DNA, 25 bp, Mus musculus
gcactttctgtttggacctctgcag

SEQ ID NO: 675030 - DNA, 25 bp, Mus musculus
gcactttgaggccacatcgctgcga

SEQ ID NO: 675031 - DNA, 25 bp, Mus musculus
gcactttgaggcgacatcgctgcga

SEQ ID NO: 675032 - DNA, 25 bp, Mus musculus
gcactttgattcagtctctgccaca

SEQ ID NO: 675033 - DNA, 25 bp, Mus musculus
gcactttgattctgtctctgccaca

SEQ ID NO: 675034 - DNA, 25 bp, Mus musculus
gcactttgggccataaacaagtgat

SEQ ID NO: 675035 - DNA, 25 bp, Mus musculus
gcactttgggccttaaacaagtgat

SEQ ID NO: 675036 - DNA, 25 bp, Mus musculus
gcacttttgaaaaggctagggttct

SEQ ID NO: 675037 - DNA, 25 bp, Mus musculus
gcacttttgaaatggctagggttct

SEQ ID NO: 675038 - DNA, 25 bp, Mus musculus
gcacttttgtccactccggtgagga

SEQ ID NO: 675039 - DNA, 25 bp, Mus musculus
gcacttttgtcctctccggtgagga

SEQ ID NO: 675040 - DNA, 25 bp, Mus musculus
gcactttttcaaactccctttgaca

SEQ ID NO: 675041 - DNA, 25 bp, Mus musculus
gcactttttcaatctccctttgaca

SEQ ID NO: 675042 - DNA, 25 bp, Mus musculus
gcagaaaaaggacaatcacaacttg

SEQ ID NO: 675043 - DNA, 25 bp, Mus musculus
gcagaaaaaggagaatcacaacttg

SEQ ID NO: 675044 - DNA, 25 bp, Mus musculus
gcagaaaaatctaatcttgcatatg

SEQ ID NO: 675045 - DNA, 25 bp, Mus musculus
gcagaaaaatcttatcttgcatatg

SEQ ID NO: 675046 - DNA, 25 bp, Mus musculus
gcagaaaacagcagaaaccgaagag

SEQ ID NO: 675047 - DNA, 25 bp, Mus musculus
gcagaaaacagctgaaaccgaagag

SEQ ID NO: 675048 - DNA, 25 bp, Mus musculus
gcagaaaacctgctcctggatgctg

SEQ ID NO: 675049 - DNA, 25 bp, Mus musculus
gcagaaaacctggtcctggatgctg

SEQ ID NO: 675050 - DNA, 25 bp, Mus musculus
gcagaaaagataccatctcagatga

SEQ ID NO: 675051 - DNA, 25 bp, Mus musculus
gcagaaaagatagcatctcagatga

SEQ ID NO: 675052 - DNA, 25 bp, Mus musculus
gcagaaaaggcaacccagacaatcc

SEQ ID NO: 675053 - DNA, 25 bp, Mus musculus
gcagaaaaggcatcccagacaatcc

SEQ ID NO: 675054 - DNA, 25 bp, Mus musculus
gcagaaaagggtatttgtcaggctt

SEQ ID NO: 675055 - DNA, 25 bp, Mus musculus
gcagaaaagggtttttgtcaggctt

SEQ ID NO: 675056 - DNA, 25 bp, Mus musculus
gcagaaaatcaacgcggcgtctgag

SEQ ID NO: 675057 - DNA, 25 bp, Mus musculus
gcagaaaatcaacgtatcctccttc

SEQ ID NO: 675058 - DNA, 25 bp, Mus musculus
gcagaaaatcaaggcggcgtctgag

SEQ ID NO: 675059 - DNA, 25 bp, Mus musculus
gcagaaaatcaaggtatcctccttc

SEQ ID NO: 675060 - DNA, 25 bp, Mus musculus
gcagaaaatgtaactgtgacaaaga

SEQ ID NO: 675061 - DNA, 25 bp, Mus musculus
gcagaaaatgtatctgtgacaaaga

SEQ ID NO: 675062 - DNA, 25 bp, Mus musculus
gcagaaaattcgacgctcaatctta

SEQ ID NO: 675063 - DNA, 25 bp, Mus musculus
gcagaaaattcgtcgctcaatctta

SEQ ID NO: 675064 - DNA, 25 bp, Mus musculus
gcagaaaattctcgcgtgaaggcca

SEQ ID NO: 675065 - DNA, 25 bp, Mus musculus
gcagaaaattctggcgtgaaggcca

SEQ ID NO: 675066 - DNA, 25 bp, Mus musculus
gcagaaacacaacaccttcgttgaa

SEQ ID NO: 675067 - DNA, 25 bp, Mus musculus
gcagaaacacaagaccttcgttgaa

SEQ ID NO: 675068 - DNA, 25 bp, Mus musculus
gcagaaacagaccaggaatactatt

SEQ ID NO: 675069 - DNA, 25 bp, Mus musculus
gcagaaacagacgaggaatactatt

SEQ ID NO: 675070 - DNA, 25 bp, Mus musculus
gcagaaacctatcattcagtgtatc

SEQ ID NO: 675071 - DNA, 25 bp, Mus musculus
gcagaaacctatgattcagtgtatc

SEQ ID NO: 675072 - DNA, 25 bp, Mus musculus
gcagaaactcttccatatggtaaaa

SEQ ID NO: 675073 - DNA, 25 bp, Mus musculus
gcagaaactcttgcatatggtaaaa

SEQ ID NO: 675074 - DNA, 25 bp, Mus musculus
gcagaaagcaagctcttgctgctaa

SEQ ID NO: 675075 - DNA, 25 bp, Mus musculus
gcagaaagcaaggtcttgctgctaa

SEQ ID NO: 675076 - DNA, 25 bp, Mus musculus
gcagaaagcctcacagtctgggctg

SEQ ID NO: 675077 - DNA, 25 bp, Mus musculus
gcagaaagcctctcagtctgggctg

SEQ ID NO: 675078 - DNA, 25 bp, Mus musculus
gcagaaagcgacattgcctccacct

SEQ ID NO: 675079 - DNA, 25 bp, Mus musculus
gcagaaagcgactttgcctccacct

SEQ ID NO: 675080 - DNA, 25 bp, Mus musculus
gcagaaagctctaaggacagacaga

SEQ ID NO: 675081 - DNA, 25 bp, Mus musculus
gcagaaagctcttaggacagacaga

SEQ ID NO: 675082 - DNA, 25 bp, Mus musculus
gcagaaagtaaccaggaccttgagt

SEQ ID NO: 675083 - DNA, 25 bp, Mus musculus
gcagaaagtaacgaggaccttgagt

SEQ ID NO: 675084 - DNA, 25 bp, Mus musculus
gcagaaagtctgagctgagtccaat

SEQ ID NO: 675085 - DNA, 25 bp, Mus musculus
gcagaaagtctgtgctgagtccaat

SEQ ID NO: 675086 - DNA, 25 bp, Mus musculus
gcagaaagtgccacgactccacaca

SEQ ID NO: 675087 - DNA, 25 bp, Mus musculus
gcagaaagtgcctcgactccacaca

SEQ ID NO: 675088 - DNA, 25 bp, Mus musculus
gcagaaataaatagaatcctgatct

SEQ ID NO: 675089 - DNA, 25 bp, Mus musculus
gcagaaataaattgaatcctgatct

SEQ ID NO: 675090 - DNA, 25 bp, Mus musculus
gcagaaataccacgacctggccttc

SEQ ID NO: 675091 - DNA, 25 bp, Mus musculus
gcagaaataccaggacctggccttc

SEQ ID NO: 675092 - DNA, 25 bp, Mus musculus
gcagaaatactactcggatctcttc

SEQ ID NO: 675093 - DNA, 25 bp, Mus musculus
gcagaaatactagtcggatctcttc

SEQ ID NO: 675094 - DNA, 25 bp, Mus musculus
gcagaaatcctcatccttgataaga

SEQ ID NO: 675095 - DNA, 25 bp, Mus musculus
gcagaaatcctcttccttgataaga

SEQ ID NO: 675096 - DNA, 25 bp, Mus musculus
gcagaaatcctgagcgtcctcagtc

SEQ ID NO: 675097 - DNA, 25 bp, Mus musculus
gcagaaatcctgtgcgtcctcagtc

SEQ ID NO: 675098 - DNA, 25 bp, Mus musculus
gcagaaatctggcagacaccccata

SEQ ID NO: 675099 - DNA, 25 bp, Mus musculus
gcagaaatctgggagacaccccata

SEQ ID NO: 675100 - DNA, 25 bp, Mus musculus
gcagaaatgagaaaccgggaaaatc

SEQ ID NO: 675101 - DNA, 25 bp, Mus musculus
gcagaaatgagataccgggaaaatc

SEQ ID NO: 675102 - DNA, 25 bp, Mus musculus
gcagaaatggttcctggacacctca

SEQ ID NO: 675103 - DNA, 25 bp, Mus musculus
gcagaaatggttgctggacacctca

SEQ ID NO: 675104 - DNA, 25 bp, Mus musculus
gcagaaatgtctctttatccatctc

SEQ ID NO: 675105 - DNA, 25 bp, Mus musculus
gcagaaatgtctgtttatccatctc

SEQ ID NO: 675106 - DNA, 25 bp, Mus musculus
gcagaaattaaaaacagccaacaaa

SEQ ID NO: 675107 - DNA, 25 bp, Mus musculus
gcagaaattaaatacagccaacaaa

SEQ ID NO: 675108 - DNA, 25 bp, Mus musculus
gcagaaattcgccaaggatgactcg

SEQ ID NO: 675109 - DNA, 25 bp, Mus musculus
gcagaaattcgcgaaggatgactcg

SEQ ID NO: 675110 - DNA, 25 bp, Mus musculus
gcagaaattcttacctgtgaacacg

SEQ ID NO: 675111 - DNA, 25 bp, Mus musculus
gcagaaattctttcctgtgaacacg

SEQ ID NO: 675112 - DNA, 25 bp, Mus musculus
gcagaacaaggaccgcatctcctgg

SEQ ID NO: 675113 - DNA, 25 bp, Mus musculus
gcagaacaaggagcgcatctcctgg

SEQ ID NO: 675114 - DNA, 25 bp, Mus musculus
gcagaacaatcacgctggagttgca

SEQ ID NO: 675115 - DNA, 25 bp, Mus musculus
gcagaacaatcaggctggagttgca

SEQ ID NO: 675116 - DNA, 25 bp, Mus musculus
gcagaacacggtcaatgacttctgg

SEQ ID NO: 675117 - DNA, 25 bp, Mus musculus
gcagaacacggtgaatgacttctgg

SEQ ID NO: 675118 - DNA, 25 bp, Mus musculus
gcagaacagagaatgagctcacaga

SEQ ID NO: 675119 - DNA, 25 bp, Mus musculus
gcagaacagagattgagctcacaga

SEQ ID NO: 675120 - DNA, 25 bp, Mus musculus
gcagaacagagccacgagggcacaa

SEQ ID NO: 675121 - DNA, 25 bp, Mus musculus
gcagaacagagcgacgagggcacaa

SEQ ID NO: 675122 - DNA, 25 bp, Mus musculus
gcagaacataacatcccggttgtca

SEQ ID NO: 675123 - DNA, 25 bp, Mus musculus
gcagaacataacttcccggttgtca

SEQ ID NO: 675124 - DNA, 25 bp, Mus musculus
gcagaaccttacatgcgcatctttt

SEQ ID NO: 675125 - DNA, 25 bp, Mus musculus
gcagaaccttacttgcgcatctttt

SEQ ID NO: 675126 - DNA, 25 bp, Mus musculus
gcagaacgcattcggactctcctta

SEQ ID NO: 675127 - DNA, 25 bp, Mus musculus
gcagaacgcattgggactctcctta

SEQ ID NO: 675128 - DNA, 25 bp, Mus musculus
gcagaacgccatagtagccaagatg

SEQ ID NO: 675129 - DNA, 25 bp, Mus musculus
gcagaacgccattgtagccaagatg

SEQ ID NO: 675130 - DNA, 25 bp, Mus musculus
gcagaacgctttccaagttgttgct

SEQ ID NO: 675131 - DNA, 25 bp, Mus musculus
gcagaacgctttgcaagttgttgct

SEQ ID NO: 675132 - DNA, 25 bp, Mus musculus
gcagaacggagacccgttcctctgt

SEQ ID NO: 675133 - DNA, 25 bp, Mus musculus
gcagaacggagagccgttcctctgt

SEQ ID NO: 675134 - DNA, 25 bp, Mus musculus
gcagaacgtctgctgttggtacgaa

SEQ ID NO: 675135 - DNA, 25 bp, Mus musculus
gcagaacgtctggtgttggtacgaa

SEQ ID NO: 675136 - DNA, 25 bp, Mus musculus
gcagaacgtgaacaccaagtgcatt

SEQ ID NO: 675137 - DNA, 25 bp, Mus musculus
gcagaacgtgaagaccaagtgcatt

SEQ ID NO: 675138 - DNA, 25 bp, Mus musculus
gcagaactacaaaggcaatgatgag

SEQ ID NO: 675139 - DNA, 25 bp, Mus musculus
gcagaactacaatggcaatgatgag

SEQ ID NO: 675140 - DNA, 25 bp, Mus musculus
gcagaactatggctggaaattacag

SEQ ID NO: 675141 - DNA, 25 bp, Mus musculus
gcagaactatgggtggaaattacag

SEQ ID NO: 675142 - DNA, 25 bp, Mus musculus
gcagaactcctgagataactgtcag

SEQ ID NO: 675143 - DNA, 25 bp, Mus musculus
gcagaactcctgtgataactgtcag

SEQ ID NO: 675144 - DNA, 25 bp, Mus musculus
gcagaactctccagcagggagtaaa

SEQ ID NO: 675145 - DNA, 25 bp, Mus musculus
gcagaactctcctgcagggagtaaa

SEQ ID NO: 675146 - DNA, 25 bp, Mus musculus
gcagaactcttactaggcataggaa

SEQ ID NO: 675147 - DNA, 25 bp, Mus musculus
gcagaactcttagtaggcataggaa

SEQ ID NO: 675148 - DNA, 25 bp, Mus musculus
gcagaactgagtctatagcccaggt

SEQ ID NO: 675149 - DNA, 25 bp, Mus musculus
gcagaactgagtgtatagcccaggt

SEQ ID NO: 675150 - DNA, 25 bp, Mus musculus
gcagaactgggaccggcttgggcat

SEQ ID NO: 675151 - DNA, 25 bp, Mus musculus
gcagaactgggagcggcttgggcat

SEQ ID NO: 675152 - DNA, 25 bp, Mus musculus
gcagaactgtaccacatccgccttg

SEQ ID NO: 675153 - DNA, 25 bp, Mus musculus
gcagaactgtacgacatccgccttg

SEQ ID NO: 675154 - DNA, 25 bp, Mus musculus
gcagaactgtgaatcttggaacaaa

SEQ ID NO: 675155 - DNA, 25 bp, Mus musculus
gcagaactgtgattcttggaacaaa

SEQ ID NO: 675156 - DNA, 25 bp, Mus musculus
gcagaacttactacagcatgtgatt

SEQ ID NO: 675157 - DNA, 25 bp, Mus musculus
gcagaacttacttcagcatgtgatt

SEQ ID NO: 675158 - DNA, 25 bp, Mus musculus
gcagaacttccaagtcacgctattt

SEQ ID NO: 675159 - DNA, 25 bp, Mus musculus
gcagaacttccatgtcacgctattt

SEQ ID NO: 675160 - DNA, 25 bp, Mus musculus
gcagaacttctaccgaagcccagga

SEQ ID NO: 675161 - DNA, 25 bp, Mus musculus
gcagaacttctagcgaagcccagga

SEQ ID NO: 675162 - DNA, 25 bp, Mus musculus
gcagaacttcttatgacttcaggag

SEQ ID NO: 675163 - DNA, 25 bp, Mus musculus
gcagaacttcttttgacttcaggag

SEQ ID NO: 675164 - DNA, 25 bp, Mus musculus
gcagaagaccatattgcccatgaag

SEQ ID NO: 675165 - DNA, 25 bp, Mus musculus
gcagaagaccattttgcccatgaag

SEQ ID NO: 675166 - DNA, 25 bp, Mus musculus
gcagaagactccactaaagtcagta

SEQ ID NO: 675167 - DNA, 25 bp, Mus musculus
gcagaagactcctctaaagtcagta

SEQ ID NO: 675168 - DNA, 25 bp, Mus musculus
gcagaagagaacagccgaacttcag

SEQ ID NO: 675169 - DNA, 25 bp, Mus musculus
gcagaagagaactgccgaacttcag

SEQ ID NO: 675170 - DNA, 25 bp, Mus musculus
gcagaagagctacaccagagcccag

SEQ ID NO: 675171 - DNA, 25 bp, Mus musculus
gcagaagagctagaccagagcccag

SEQ ID NO: 675172 - DNA, 25 bp, Mus musculus
gcagaagaggcaattaccagtttca

SEQ ID NO: 675173 - DNA, 25 bp, Mus musculus
gcagaagaggcatttaccagtttca

SEQ ID NO: 675174 - DNA, 25 bp, Mus musculus
gcagaagagtcacgaagttttgctg

SEQ ID NO: 675175 - DNA, 25 bp, Mus musculus
gcagaagagtcaggaagttttgctg

SEQ ID NO: 675176 - DNA, 25 bp, Mus musculus
gcagaagatgaaacccactccttca

SEQ ID NO: 675177 - DNA, 25 bp, Mus musculus
gcagaagatgaatcccactccttca

SEQ ID NO: 675178 - DNA, 25 bp, Mus musculus
gcagaagatgcactcctacaagatc

SEQ ID NO: 675179 - DNA, 25 bp, Mus musculus
gcagaagatgcagtcctacaagatc

SEQ ID NO: 675180 - DNA, 25 bp, Mus musculus
gcagaagcaactcactcaaccagaa

SEQ ID NO: 675181 - DNA, 25 bp, Mus musculus
gcagaagcaactgactcaaccagaa

SEQ ID NO: 675182 - DNA, 25 bp, Mus musculus
gcagaagcaagtctccctggagacc

SEQ ID NO: 675183 - DNA, 25 bp, Mus musculus
gcagaagcaagtgtccctggagacc

SEQ ID NO: 675184 - DNA, 25 bp, Mus musculus
gcagaagcacgtcggatgtaatcaa

SEQ ID NO: 675185 - DNA, 25 bp, Mus musculus
gcagaagcacgtgggatgtaatcaa

SEQ ID NO: 675186 - DNA, 25 bp, Mus musculus
gcagaagcactacgaattgatagat

SEQ ID NO: 675187 - DNA, 25 bp, Mus musculus
gcagaagcactaggaattgatagat

SEQ ID NO: 675188 - DNA, 25 bp, Mus musculus
gcagaagcatgtcaaatctagatca

SEQ ID NO: 675189 - DNA, 25 bp, Mus musculus
gcagaagcatgtgaaatctagatca

SEQ ID NO: 675190 - DNA, 25 bp, Mus musculus
gcagaagcattgagtgaacctttga

SEQ ID NO: 675191 - DNA, 25 bp, Mus musculus
gcagaagcattgtgtgaacctttga

SEQ ID NO: 675192 - DNA, 25 bp, Mus musculus
gcagaagcccatcctaaagtaagat

SEQ ID NO: 675193 - DNA, 25 bp, Mus musculus
gcagaagcccatgctaaagtaagat

SEQ ID NO: 675194 - DNA, 25 bp, Mus musculus
gcagaagccgaacctgagtctgtgc

SEQ ID NO: 675195 - DNA, 25 bp, Mus musculus
gcagaagccgaagctgagtctgtgc

SEQ ID NO: 675196 - DNA, 25 bp, Mus musculus
gcagaagccgcgagcctcgcagcag

SEQ ID NO: 675197 - DNA, 25 bp, Mus musculus
gcagaagccgcgtgcctcgcagcag

SEQ ID NO: 675198 - DNA, 25 bp, Mus musculus
gcagaagccgtacctcagggaaagc

SEQ ID NO: 675199 - DNA, 25 bp, Mus musculus
gcagaagccgtagctcagggaaagc

SEQ ID NO: 675200 - DNA, 25 bp, Mus musculus
gcagaagcctaacgttgtagcttaa

SEQ ID NO: 675201 - DNA, 25 bp, Mus musculus
gcagaagcctaaggttgtagcttaa

SEQ ID NO: 675202 - DNA, 25 bp, Mus musculus
gcagaagccttccagatgtaccagg

SEQ ID NO: 675203 - DNA, 25 bp, Mus musculus
gcagaagccttcgagatgtaccagg

SEQ ID NO: 675204 - DNA, 25 bp, Mus musculus
gcagaagcctttccaggtatcaaaa

SEQ ID NO: 675205 - DNA, 25 bp, Mus musculus
gcagaagcctttgcaggtatcaaaa

SEQ ID NO: 675206 - DNA, 25 bp, Mus musculus
gcagaagcggctaatccctgagagg

SEQ ID NO: 675207 - DNA, 25 bp, Mus musculus
gcagaagcggcttatccctgagagg

SEQ ID NO: 675208 - DNA, 25 bp, Mus musculus
gcagaagctcagacaaaagatttcc

SEQ ID NO: 675209 - DNA, 25 bp, Mus musculus
gcagaagctcagtcaaaagatttcc

SEQ ID NO: 675210 - DNA, 25 bp, Mus musculus
gcagaagctgagacacattttcaac

SEQ ID NO: 675211 - DNA, 25 bp, Mus musculus
gcagaagctgagtcacattttcaac

SEQ ID NO: 675212 - DNA, 25 bp, Mus musculus
gcagaagctttcatccaggatcaaa

SEQ ID NO: 675213 - DNA, 25 bp, Mus musculus
gcagaagctttcttccaggatcaaa

SEQ ID NO: 675214 - DNA, 25 bp, Mus musculus
gcagaaggaaaacacccgctggctt

SEQ ID NO: 675215 - DNA, 25 bp, Mus musculus
gcagaaggaaaagacccgctggctt

SEQ ID NO: 675216 - DNA, 25 bp, Mus musculus
gcagaaggaacaagaggccatgaag

SEQ ID NO: 675217 - DNA, 25 bp, Mus musculus
gcagaaggaacatgaggccatgaag

SEQ ID NO: 675218 - DNA, 25 bp, Mus musculus
gcagaaggcacaagagctggaccag

SEQ ID NO: 675219 - DNA, 25 bp, Mus musculus
gcagaaggcacatgagctggaccag

SEQ ID NO: 675220 - DNA, 25 bp, Mus musculus
gcagaaggcagcaatggtgtcccgt

SEQ ID NO: 675221 - DNA, 25 bp, Mus musculus
gcagaaggcagctatggtgtcccgt

SEQ ID NO: 675222 - DNA, 25 bp, Mus musculus
gcagaaggccatcaagagtctgttt

SEQ ID NO: 675223 - DNA, 25 bp, Mus musculus
gcagaaggccatgaagagtctgttt

SEQ ID NO: 675224 - DNA, 25 bp, Mus musculus
gcagaagggtcaactcttctgttgg

SEQ ID NO: 675225 - DNA, 25 bp, Mus musculus
gcagaagggtcatctcttctgttgg

SEQ ID NO: 675226 - DNA, 25 bp, Mus musculus
gcagaaggtcatcgtgctgcccaag

SEQ ID NO: 675227 - DNA, 25 bp, Mus musculus
gcagaaggtcatggtgctgcccaag

SEQ ID NO: 675228 - DNA, 25 bp, Mus musculus
gcagaaggtccacgagctagctcac

SEQ ID NO: 675229 - DNA, 25 bp, Mus musculus
gcagaaggtccaggagctagctcac

SEQ ID NO: 675230 - DNA, 25 bp, Mus musculus
gcagaagtaaaaccccggattcagg

SEQ ID NO: 675231 - DNA, 25 bp, Mus musculus
gcagaagtaaaagcccggattcagg

SEQ ID NO: 675232 - DNA, 25 bp, Mus musculus
gcagaagtacttacagcagcgtcca

SEQ ID NO: 675233 - DNA, 25 bp, Mus musculus
gcagaagtactttcagcagcgtcca

SEQ ID NO: 675234 - DNA, 25 bp, Mus musculus
gcagaagtagctcagcacgtgcagt

SEQ ID NO: 675235 - DNA, 25 bp, Mus musculus
gcagaagtagctgagcacgtgcagt

SEQ ID NO: 675236 - DNA, 25 bp, Mus musculus
gcagaagtcaatcaggtcaaggaac

SEQ ID NO: 675237 - DNA, 25 bp, Mus musculus
gcagaagtcaatgaggtcaaggaac

SEQ ID NO: 675238 - DNA, 25 bp, Mus musculus
gcagaagtcagactgagaagagaac

SEQ ID NO: 675239 - DNA, 25 bp, Mus musculus
gcagaagtcagagtgagaagagaac

SEQ ID NO: 675240 - DNA, 25 bp, Mus musculus
gcagaagtgcttagatgtgaaggat

SEQ ID NO: 675241 - DNA, 25 bp, Mus musculus
gcagaagtgctttgatgtgaaggat

SEQ ID NO: 675242 - DNA, 25 bp, Mus musculus
gcagaagtgggcagcacagcccttc

SEQ ID NO: 675243 - DNA, 25 bp, Mus musculus
gcagaagtgggctgcacagcccttc

SEQ ID NO: 675244 - DNA, 25 bp, Mus musculus
gcagaagttcatccccgtagaaggg

SEQ ID NO: 675245 - DNA, 25 bp, Mus musculus
gcagaagttcatgcccgtagaaggg

SEQ ID NO: 675246 - DNA, 25 bp, Mus musculus
gcagaagttcccatgtcactaccag

SEQ ID NO: 675247 - DNA, 25 bp, Mus musculus
gcagaagttcccttgtcactaccag

SEQ ID NO: 675248 - DNA, 25 bp, Mus musculus
gcagaataccagagtccttccgtgg

SEQ ID NO: 675249 - DNA, 25 bp, Mus musculus
gcagaataccagtgtccttccgtgg

SEQ ID NO: 675250 - DNA, 25 bp, Mus musculus
gcagaatactttatcaaccagggac

SEQ ID NO: 675251 - DNA, 25 bp, Mus musculus
gcagaatactttttcaaccagggac

SEQ ID NO: 675252 - DNA, 25 bp, Mus musculus
gcagaatcagcgctcaacaactcct

SEQ ID NO: 675253 - DNA, 25 bp, Mus musculus
gcagaatcagcggtcaacaactcct

SEQ ID NO: 675254 - DNA, 25 bp, Mus musculus
gcagaatcctttcgagttggccttc

SEQ ID NO: 675255 - DNA, 25 bp, Mus musculus
gcagaatcctttggagttggccttc

SEQ ID NO: 675256 - DNA, 25 bp, Mus musculus
gcagaatcgttaagagatggccaca

SEQ ID NO: 675257 - DNA, 25 bp, Mus musculus
gcagaatcgttatgagatggccaca

SEQ ID NO: 675258 - DNA, 25 bp, Mus musculus
gcagaatgactgatgggcgccttca

SEQ ID NO: 675259 - DNA, 25 bp, Mus musculus
gcagaatgactgttgggcgccttca

SEQ ID NO: 675260 - DNA, 25 bp, Mus musculus
gcagaatggaatcaaccatctatca

SEQ ID NO: 675261 - DNA, 25 bp, Mus musculus
gcagaatggaatgaaccatctatca

SEQ ID NO: 675262 - DNA, 25 bp, Mus musculus
gcagaatggaccagtggatggccaa

SEQ ID NO: 675263 - DNA, 25 bp, Mus musculus
gcagaatggacctgtggatggccaa

SEQ ID NO: 675264 - DNA, 25 bp, Mus musculus
gcagaatggcgcagaccgccatgtc

SEQ ID NO: 675265 - DNA, 25 bp, Mus musculus
gcagaatggcgctgaccgccatgtc

SEQ ID NO: 675266 - DNA, 25 bp, Mus musculus
gcagaatgggacactggtacatgga

SEQ ID NO: 675267 - DNA, 25 bp, Mus musculus
gcagaatgggactctggtacatgga

SEQ ID NO: 675268 - DNA, 25 bp, Mus musculus
gcagaatgggagcaaatggcccgga

SEQ ID NO: 675269 - DNA, 25 bp, Mus musculus
gcagaatgggaggaaatggcccgga

SEQ ID NO: 675270 - DNA, 25 bp, Mus musculus
gcagaatggtttcggatcatgagaa

SEQ ID NO: 675271 - DNA, 25 bp, Mus musculus
gcagaatggtttgggatcatgagaa

SEQ ID NO: 675272 - DNA, 25 bp, Mus musculus
gcagaatgttacaatccagagagga

SEQ ID NO: 675273 - DNA, 25 bp, Mus musculus
gcagaatgttactatccagagagga

SEQ ID NO: 675274 - DNA, 25 bp, Mus musculus
gcagaattctggcatcgtccttgag

SEQ ID NO: 675275 - DNA, 25 bp, Mus musculus
gcagaattctgggatcgtccttgag

SEQ ID NO: 675276 - DNA, 25 bp, Mus musculus
gcagaattggagctgctgcgccaac

SEQ ID NO: 675277 - DNA, 25 bp, Mus musculus
gcagaattggaggtgctgcgccaac

SEQ ID NO: 675278 - DNA, 25 bp, Mus musculus
gcagaattggcaaactctgtgccag

SEQ ID NO: 675279 - DNA, 25 bp, Mus musculus
gcagaattggcatactctgtgccag

SEQ ID NO: 675280 - DNA, 25 bp, Mus musculus
gcagaatttcccaaggcacacgatt

SEQ ID NO: 675281 - DNA, 25 bp, Mus musculus
gcagaatttccctaggcacacgatt

SEQ ID NO: 675282 - DNA, 25 bp, Mus musculus
gcagaatttgctcttggaggaaggg

SEQ ID NO: 675283 - DNA, 25 bp, Mus musculus
gcagaatttgctgttggaggaaggg

SEQ ID NO: 675284 - DNA, 25 bp, Mus musculus
gcagacaaagctccttgacccagta

SEQ ID NO: 675285 - DNA, 25 bp, Mus musculus
gcagacaaagctgcttgacccagta

SEQ ID NO: 675286 - DNA, 25 bp, Mus musculus
gcagacaagccaagatgcccgattt

SEQ ID NO: 675287 - DNA, 25 bp, Mus musculus
gcagacaagccacacacttcagctg

SEQ ID NO: 675288 - DNA, 25 bp, Mus musculus
gcagacaagccagacacttcagctg

SEQ ID NO: 675289 - DNA, 25 bp, Mus musculus
gcagacaagccatgatgcccgattt

SEQ ID NO: 675290 - DNA, 25 bp, Mus musculus
gcagacaagctgatgatttcccatt

SEQ ID NO: 675291 - DNA, 25 bp, Mus musculus
gcagacaagctgttgatttcccatt

SEQ ID NO: 675292 - DNA, 25 bp, Mus musculus
gcagacacaaaaatatccataccca

SEQ ID NO: 675293 - DNA, 25 bp, Mus musculus
gcagacacaaaattatccataccca

SEQ ID NO: 675294 - DNA, 25 bp, Mus musculus
gcagacacaactcatcctttaacca

SEQ ID NO: 675295 - DNA, 25 bp, Mus musculus
gcagacacaactgatcctttaacca

SEQ ID NO: 675296 - DNA, 25 bp, Mus musculus
gcagacaccacacgcgccaggaagt

SEQ ID NO: 675297 - DNA, 25 bp, Mus musculus
gcagacaccacaggcgccaggaagt

SEQ ID NO: 675298 - DNA, 25 bp, Mus musculus
gcagacaccttaccactagtattcg

SEQ ID NO: 675299 - DNA, 25 bp, Mus musculus
gcagacaccttagcactagtattcg

SEQ ID NO: 675300 - DNA, 25 bp, Mus musculus
gcagacacgctgaaggagcgctacc

SEQ ID NO: 675301 - DNA, 25 bp, Mus musculus
gcagacacgctgtaggagcgctacc

SEQ ID NO: 675302 - DNA, 25 bp, Mus musculus
gcagacagaaaaacccaaagagctt

SEQ ID NO: 675303 - DNA, 25 bp, Mus musculus
gcagacagaaaatcccaaagagctt

SEQ ID NO: 675304 - DNA, 25 bp, Mus musculus
gcagacagaacaccttagtaggata

SEQ ID NO: 675305 - DNA, 25 bp, Mus musculus
gcagacagaacagcttagtaggata

SEQ ID NO: 675306 - DNA, 25 bp, Mus musculus
gcagacagaagtactcgagccaacc

SEQ ID NO: 675307 - DNA, 25 bp, Mus musculus
gcagacagaagttctcgagccaacc

SEQ ID NO: 675308 - DNA, 25 bp, Mus musculus
gcagacagacatactgtgattcaga

SEQ ID NO: 675309 - DNA, 25 bp, Mus musculus
gcagacagacattctgtgattcaga

SEQ ID NO: 675310 - DNA, 25 bp, Mus musculus
gcagacagacgacgtgcccatcatt

SEQ ID NO: 675311 - DNA, 25 bp, Mus musculus
gcagacagacgaggtgcccatcatt

SEQ ID NO: 675312 - DNA, 25 bp, Mus musculus
gcagacagactgacaacttcagcag

SEQ ID NO: 675313 - DNA, 25 bp, Mus musculus
gcagacagactgtcaacttcagcag

SEQ ID NO: 675314 - DNA, 25 bp, Mus musculus
gcagacagccgcctggttcctgaca

SEQ ID NO: 675315 - DNA, 25 bp, Mus musculus
gcagacagccgcgtggttcctgaca

SEQ ID NO: 675316 - DNA, 25 bp, Mus musculus
gcagacaggactcgtcaggaccttc

SEQ ID NO: 675317 - DNA, 25 bp, Mus musculus
gcagacaggactggtcaggaccttc

SEQ ID NO: 675318 - DNA, 25 bp, Mus musculus
gcagacaggcagcatggactcagat

SEQ ID NO: 675319 - DNA, 25 bp, Mus musculus
gcagacaggcaggatggactcagat

SEQ ID NO: 675320 - DNA, 25 bp, Mus musculus
gcagacaggtgcaaataaacaacag

SEQ ID NO: 675321 - DNA, 25 bp, Mus musculus
gcagacaggtgctaataaacaacag

SEQ ID NO: 675322 - DNA, 25 bp, Mus musculus
gcagacaggttgacgccaaagaata

SEQ ID NO: 675323 - DNA, 25 bp, Mus musculus
gcagacaggttgtcgccaaagaata

SEQ ID NO: 675324 - DNA, 25 bp, Mus musculus
gcagacagtggcacggcttcctgag

SEQ ID NO: 675325 - DNA, 25 bp, Mus musculus
gcagacagtggctcggcttcctgag

SEQ ID NO: 675326 - DNA, 25 bp, Mus musculus
gcagacagtggtaccgcaagctggc

SEQ ID NO: 675327 - DNA, 25 bp, Mus musculus
gcagacagtggttccgcaagctggc

SEQ ID NO: 675328 - DNA, 25 bp, Mus musculus
gcagacagttgcctgatccggaacc

SEQ ID NO: 675329 - DNA, 25 bp, Mus musculus
gcagacagttgcgtgatccggaacc

SEQ ID NO: 675330 - DNA, 25 bp, Mus musculus
gcagacagtttgagggttgtgaaaa

SEQ ID NO: 675331 - DNA, 25 bp, Mus musculus
gcagacagtttgtgggttgtgaaaa

SEQ ID NO: 675332 - DNA, 25 bp, Mus musculus
gcagacatagaccagagcctttact

SEQ ID NO: 675333 - DNA, 25 bp, Mus musculus
gcagacatagacgagagcctttact

SEQ ID NO: 675334 - DNA, 25 bp, Mus musculus
gcagacataggcagcatgttggcca

SEQ ID NO: 675335 - DNA, 25 bp, Mus musculus
gcagacataggctgcatgttggcca

SEQ ID NO: 675336 - DNA, 25 bp, Mus musculus
gcagacatccatataattggagaca

SEQ ID NO: 675337 - DNA, 25 bp, Mus musculus
gcagacatccatttaattggagaca

SEQ ID NO: 675338 - DNA, 25 bp, Mus musculus
gcagacatctgccgcccagcaggat

SEQ ID NO: 675339 - DNA, 25 bp, Mus musculus
gcagacatctgcggcccagcaggat

SEQ ID NO: 675340 - DNA, 25 bp, Mus musculus
gcagacatgaagaacccttcctcct

SEQ ID NO: 675341 - DNA, 25 bp, Mus musculus
gcagacatgaagtacccttcctcct

SEQ ID NO: 675342 - DNA, 25 bp, Mus musculus
gcagacatgcaaccggactttcaga

SEQ ID NO: 675343 - DNA, 25 bp, Mus musculus
gcagacatgcaagcggactttcaga

SEQ ID NO: 675344 - DNA, 25 bp, Mus musculus
gcagacatggatacaaaattcaaac

SEQ ID NO: 675345 - DNA, 25 bp, Mus musculus
gcagacatggattcaaaattcaaac

SEQ ID NO: 675346 - DNA, 25 bp, Mus musculus
gcagacatggctcaatttgcacagg

SEQ ID NO: 675347 - DNA, 25 bp, Mus musculus
gcagacatggctgaatttgcacagg

SEQ ID NO: 675348 - DNA, 25 bp, Mus musculus
gcagacatgtcgattatgtagctga

SEQ ID NO: 675349 - DNA, 25 bp, Mus musculus
gcagacatgtcgtttatgtagctga

SEQ ID NO: 675350 - DNA, 25 bp, Mus musculus
gcagacatgttaatcttcgcagttc

SEQ ID NO: 675351 - DNA, 25 bp, Mus musculus
gcagacatgttattcttcgcagttc

SEQ ID NO: 675352 - DNA, 25 bp, Mus musculus
gcagacattgacagtgaccttaaaa

SEQ ID NO: 675353 - DNA, 25 bp, Mus musculus
gcagacattgactgtgaccttaaaa

SEQ ID NO: 675354 - DNA, 25 bp, Mus musculus
gcagacattgtgctcaggcacctga

SEQ ID NO: 675355 - DNA, 25 bp, Mus musculus
gcagacattgtggtcaggcacctga

SEQ ID NO: 675356 - DNA, 25 bp, Mus musculus
gcagacatttttcctgttccaggaa

SEQ ID NO: 675357 - DNA, 25 bp, Mus musculus
gcagacatttttgctgttccaggaa

SEQ ID NO: 675358 - DNA, 25 bp, Mus musculus
gcagaccaagaaatgatgagatgac

SEQ ID NO: 675359 - DNA, 25 bp, Mus musculus
gcagaccaagaattgatgagatgac

SEQ ID NO: 675360 - DNA, 25 bp, Mus musculus
gcagaccaagccatagtgagctgga

SEQ ID NO: 675361 - DNA, 25 bp, Mus musculus
gcagaccaagccttagtgagctgga

SEQ ID NO: 675362 - DNA, 25 bp, Mus musculus
gcagaccacctgagtatgaattctt

SEQ ID NO: 675363 - DNA, 25 bp, Mus musculus
gcagaccacctgtgtatgaattctt

SEQ ID NO: 675364 - DNA, 25 bp, Mus musculus
gcagaccactccctgaagtgacgga

SEQ ID NO: 675365 - DNA, 25 bp, Mus musculus
gcagaccactccgtgaagtgacgga

SEQ ID NO: 675366 - DNA, 25 bp, Mus musculus
gcagaccaggccaccgagtccatgt

SEQ ID NO: 675367 - DNA, 25 bp, Mus musculus
gcagaccaggcctccgagtccatgt

SEQ ID NO: 675368 - DNA, 25 bp, Mus musculus
gcagaccatcatcctggacgacgag

SEQ ID NO: 675369 - DNA, 25 bp, Mus musculus
gcagaccatcatgctggacgacgag

SEQ ID NO: 675370 - DNA, 25 bp, Mus musculus
gcagaccatgtgatcgcgggatgcc

SEQ ID NO: 675371 - DNA, 25 bp, Mus musculus
gcagaccatgtgttcgcgggatgcc

SEQ ID NO: 675372 - DNA, 25 bp, Mus musculus
gcagaccattacagcttcggagcag

SEQ ID NO: 675373 - DNA, 25 bp, Mus musculus
gcagaccattactgcttcggagcag

SEQ ID NO: 675374 - DNA, 25 bp, Mus musculus
gcagaccattgcagctctgcgccga

SEQ ID NO: 675375 - DNA, 25 bp, Mus musculus
gcagaccattgctgctctgcgccga

SEQ ID NO: 675376 - DNA, 25 bp, Mus musculus
gcagacccaaccagagaagcactct

SEQ ID NO: 675377 - DNA, 25 bp, Mus musculus
gcagacccaacctgagaagcactct

SEQ ID NO: 675378 - DNA, 25 bp, Mus musculus
gcagacccacttatggagagctcca

SEQ ID NO: 675379 - DNA, 25 bp, Mus musculus
gcagacccacttttggagagctcca

SEQ ID NO: 675380 - DNA, 25 bp, Mus musculus
gcagacccagcgcagtgccttgctg

SEQ ID NO: 675381 - DNA, 25 bp, Mus musculus
gcagacccagcggagtgccttgctg

SEQ ID NO: 675382 - DNA, 25 bp, Mus musculus
gcagacccagtactccgggcgatta

SEQ ID NO: 675383 - DNA, 25 bp, Mus musculus
gcagacccagtagtccgggcgatta

SEQ ID NO: 675384 - DNA, 25 bp, Mus musculus
gcagaccccaagctagagtgagaag

SEQ ID NO: 675385 - DNA, 25 bp, Mus musculus
gcagaccccaaggtagagtgagaag

SEQ ID NO: 675386 - DNA, 25 bp, Mus musculus
gcagacccctacctggagattacag

SEQ ID NO: 675387 - DNA, 25 bp, Mus musculus
gcagacccctacgtggagattacag

SEQ ID NO: 675388 - DNA, 25 bp, Mus musculus
gcagacccgagtcctgcctcatgtt

SEQ ID NO: 675389 - DNA, 25 bp, Mus musculus
gcagacccgagtgctgcctcatgtt

SEQ ID NO: 675390 - DNA, 25 bp, Mus musculus
gcagaccctgaaagccggacagtgg

SEQ ID NO: 675391 - DNA, 25 bp, Mus musculus
gcagaccctgaatgccggacagtgg

SEQ ID NO: 675392 - DNA, 25 bp, Mus musculus
gcagaccctgcgagtgctgtgtcta

SEQ ID NO: 675393 - DNA, 25 bp, Mus musculus
gcagaccctgcgtgtgctgtgtcta

SEQ ID NO: 675394 - DNA, 25 bp, Mus musculus
gcagaccgtttaagtgcagcagcct

SEQ ID NO: 675395 - DNA, 25 bp, Mus musculus
gcagaccgtttatgtgcagcagcct

SEQ ID NO: 675396 - DNA, 25 bp, Mus musculus
gcagacctaaagaggtaaagcagcc

SEQ ID NO: 675397 - DNA, 25 bp, Mus musculus
gcagacctaaagtggtaaagcagcc

SEQ ID NO: 675398 - DNA, 25 bp, Mus musculus
gcagacctctatacagtggaatcaa

SEQ ID NO: 675399 - DNA, 25 bp, Mus musculus
gcagacctctattcagtggaatcaa

SEQ ID NO: 675400 - DNA, 25 bp, Mus musculus
gcagacctgagaaatgtttgtactg

SEQ ID NO: 675401 - DNA, 25 bp, Mus musculus
gcagacctgagatatgtttgtactg

SEQ ID NO: 675402 - DNA, 25 bp, Mus musculus
gcagacctgcctaggagcggttcct

SEQ ID NO: 675403 - DNA, 25 bp, Mus musculus
gcagacctgccttggagcggttcct

SEQ ID NO: 675404 - DNA, 25 bp, Mus musculus
gcagacctggctacaatgtgctcaa

SEQ ID NO: 675405 - DNA, 25 bp, Mus musculus
gcagacctggcttcaatgtgctcaa

SEQ ID NO: 675406 - DNA, 25 bp, Mus musculus
gcagacctgtacagcttgcacagct

SEQ ID NO: 675407 - DNA, 25 bp, Mus musculus
gcagacctgtactgcttgcacagct

SEQ ID NO: 675408 - DNA, 25 bp, Mus musculus
gcagaccttcgtcattcttgccggg

SEQ ID NO: 675409 - DNA, 25 bp, Mus musculus
gcagaccttcgtgattcttgccggg

SEQ ID NO: 675410 - DNA, 25 bp, Mus musculus
gcagacgacttcctccaggactata

SEQ ID NO: 675411 - DNA, 25 bp, Mus musculus
gcagacgacttcgtccaggactata

SEQ ID NO: 675412 - DNA, 25 bp, Mus musculus
gcagacgaggcaaattccattggcc

SEQ ID NO: 675413 - DNA, 25 bp, Mus musculus
gcagacgaggcatattccattggcc

SEQ ID NO: 675414 - DNA, 25 bp, Mus musculus
gcagacgcacccatgagtgagatga

SEQ ID NO: 675415 - DNA, 25 bp, Mus musculus
gcagacgcacccttgagtgagatga

SEQ ID NO: 675416 - DNA, 25 bp, Mus musculus
gcagacgccggtagatagtccagat

SEQ ID NO: 675417 - DNA, 25 bp, Mus musculus
gcagacgccggttgatagtccagat

SEQ ID NO: 675418 - DNA, 25 bp, Mus musculus
gcagacgcctccctgtttaacaact

SEQ ID NO: 675419 - DNA, 25 bp, Mus musculus
gcagacgcctccgtgtttaacaact

SEQ ID NO: 675420 - DNA, 25 bp, Mus musculus
gcagacgcggagactgactgacctg

SEQ ID NO: 675421 - DNA, 25 bp, Mus musculus
gcagacgcggagtctgactgacctg

SEQ ID NO: 675422 - DNA, 25 bp, Mus musculus
gcagacggctgcctttgcgtcgcct

SEQ ID NO: 675423 - DNA, 25 bp, Mus musculus
gcagacggctgcgtttgcgtcgcct

SEQ ID NO: 675424 - DNA, 25 bp, Mus musculus
gcagacgttgggagccggaccaccc

SEQ ID NO: 675425 - DNA, 25 bp, Mus musculus
gcagacgttgggtgccggaccaccc

SEQ ID NO: 675426 - DNA, 25 bp, Mus musculus
gcagactactggctcggttaaagag

SEQ ID NO: 675427 - DNA, 25 bp, Mus musculus
gcagactactgggtcggttaaagag

SEQ ID NO: 675428 - DNA, 25 bp, Mus musculus
gcagactcacgcagatgactttaaa

SEQ ID NO: 675429 - DNA, 25 bp, Mus musculus
gcagactcacgctgatgactttaaa

SEQ ID NO: 675430 - DNA, 25 bp, Mus musculus
gcagactcagcaaaccaaggtaaca

SEQ ID NO: 675431 - DNA, 25 bp, Mus musculus
gcagactcagcataccaaggtaaca

SEQ ID NO: 675432 - DNA, 25 bp, Mus musculus
gcagactctgcccatttccatggaa

SEQ ID NO: 675433 - DNA, 25 bp, Mus musculus
gcagactctgccgatttccatggaa

SEQ ID NO: 675434 - DNA, 25 bp, Mus musculus
gcagactgaaatcccgggttctgct

SEQ ID NO: 675435 - DNA, 25 bp, Mus musculus
gcagactgaaatgccgggttctgct

SEQ ID NO: 675436 - DNA, 25 bp, Mus musculus
gcagactgatcccaactgggccaac

SEQ ID NO: 675437 - DNA, 25 bp, Mus musculus
gcagactgatccgaactgggccaac

SEQ ID NO: 675438 - DNA, 25 bp, Mus musculus
gcagactgccctcaggaactttcag

SEQ ID NO: 675439 - DNA, 25 bp, Mus musculus
gcagactgccctgaggaactttcag

SEQ ID NO: 675440 - DNA, 25 bp, Mus musculus
gcagactgcgttctcctgtggctcg

SEQ ID NO: 675441 - DNA, 25 bp, Mus musculus
gcagactgcgttgtcctgtggctcg

SEQ ID NO: 675442 - DNA, 25 bp, Mus musculus
gcagacttatcgaacagccttgagg

SEQ ID NO: 675443 - DNA, 25 bp, Mus musculus
gcagacttatcgtacagccttgagg

SEQ ID NO: 675444 - DNA, 25 bp, Mus musculus
gcagacttcttgagcgcagctagcc

SEQ ID NO: 675445 - DNA, 25 bp, Mus musculus
gcagacttcttgtgcgcagctagcc

SEQ ID NO: 675446 - DNA, 25 bp, Mus musculus
gcagacttgctacaatctacaaggg

SEQ ID NO: 675447 - DNA, 25 bp, Mus musculus
gcagacttgctagaatctacaaggg

SEQ ID NO: 675448 - DNA, 25 bp, Mus musculus
gcagagaaaaccatctccgtgtgtg

SEQ ID NO: 675449 - DNA, 25 bp, Mus musculus
gcagagaaaaccttctccgtgtgtg

SEQ ID NO: 675450 - DNA, 25 bp, Mus musculus
gcagagaaagaaccgccttgagcca

SEQ ID NO: 675451 - DNA, 25 bp, Mus musculus
gcagagaaagaagcgccttgagcca

SEQ ID NO: 675452 - DNA, 25 bp, Mus musculus
gcagagaaagataatgctgaaatca

SEQ ID NO: 675453 - DNA, 25 bp, Mus musculus
gcagagaaagattatgctgaaatca

SEQ ID NO: 675454 - DNA, 25 bp, Mus musculus
gcagagaaatggaaagagagcaaag

SEQ ID NO: 675455 - DNA, 25 bp, Mus musculus
gcagagaaatggtaagagagcaaag

SEQ ID NO: 675456 - DNA, 25 bp, Mus musculus
gcagagaaatgtatgatgatggagt

SEQ ID NO: 675457 - DNA, 25 bp, Mus musculus
gcagagaaatgtttgatgatggagt

SEQ ID NO: 675458 - DNA, 25 bp, Mus musculus
gcagagaacactcggcagagatgct

SEQ ID NO: 675459 - DNA, 25 bp, Mus musculus
gcagagaacactgggcagagatgct

SEQ ID NO: 675460 - DNA, 25 bp, Mus musculus
gcagagaaccggaagaaaactatgg

SEQ ID NO: 675461 - DNA, 25 bp, Mus musculus
gcagagaaccggtagaaaactatgg

SEQ ID NO: 675462 - DNA, 25 bp, Mus musculus
gcagagaactctacgatgacccctc

SEQ ID NO: 675463 - DNA, 25 bp, Mus musculus
gcagagaactcttcgatgacccctc

SEQ ID NO: 675464 - DNA, 25 bp, Mus musculus
gcagagaagacaataccgacggcag

SEQ ID NO: 675465 - DNA, 25 bp, Mus musculus
gcagagaagacattaccgacggcag

SEQ ID NO: 675466 - DNA, 25 bp, Mus musculus
gcagagaagattcctggagagtcca

SEQ ID NO: 675467 - DNA, 25 bp, Mus musculus
gcagagaagattgctggagagtcca

SEQ ID NO: 675468 - DNA, 25 bp, Mus musculus
gcagagaagtgtatcctcaagtcag

SEQ ID NO: 675469 - DNA, 25 bp, Mus musculus
gcagagaagtgtttcctcaagtcag

SEQ ID NO: 675470 - DNA, 25 bp, Mus musculus
gcagagacagagaatttcgttcgct

SEQ ID NO: 675471 - DNA, 25 bp, Mus musculus
gcagagacagagtatttcgttcgct

SEQ ID NO: 675472 - DNA, 25 bp, Mus musculus
gcagagacagtccagcaggcctgca

SEQ ID NO: 675473 - DNA, 25 bp, Mus musculus
gcagagacagtcgagcaggcctgca

SEQ ID NO: 675474 - DNA, 25 bp, Mus musculus
gcagagaccagaaaacgcaaggaat

SEQ ID NO: 675475 - DNA, 25 bp, Mus musculus
gcagagaccagataacgcaaggaat

SEQ ID NO: 675476 - DNA, 25 bp, Mus musculus
gcagagacggttaaaaaagaaagca

SEQ ID NO: 675477 - DNA, 25 bp, Mus musculus
gcagagacggtttaaaaagaaagca

SEQ ID NO: 675478 - DNA, 25 bp, Mus musculus
gcagagactaaacgagtggctctca

SEQ ID NO: 675479 - DNA, 25 bp, Mus musculus
gcagagactaaaggagtggctctca

SEQ ID NO: 675480 - DNA, 25 bp, Mus musculus
gcagagactcagaaaggtggtaaaa

SEQ ID NO: 675481 - DNA, 25 bp, Mus musculus
gcagagactcagtaaggtggtaaaa

SEQ ID NO: 675482 - DNA, 25 bp, Mus musculus
gcagagacttttcccggacaaactt

SEQ ID NO: 675483 - DNA, 25 bp, Mus musculus
gcagagacttttgccggacaaactt

SEQ ID NO: 675484 - DNA, 25 bp, Mus musculus
gcagagagaggcaatgagcgccata

SEQ ID NO: 675485 - DNA, 25 bp, Mus musculus
gcagagagaggctatgagcgccata

SEQ ID NO: 675486 - DNA, 25 bp, Mus musculus
gcagagagatcactaaccaaattgg

SEQ ID NO: 675487 - DNA, 25 bp, Mus musculus
gcagagagatcagtaaccaaattgg

SEQ ID NO: 675488 - DNA, 25 bp, Mus musculus
gcagagagcacaagtgatagttatg

SEQ ID NO: 675489 - DNA, 25 bp, Mus musculus
gcagagagcacatgtgatagttatg

SEQ ID NO: 675490 - DNA, 25 bp, Mus musculus
gcagagagcccaaagcaggtaggtc

SEQ ID NO: 675491 - DNA, 25 bp, Mus musculus
gcagagagcccatagcaggtaggtc

SEQ ID NO: 675492 - DNA, 25 bp, Mus musculus
gcagagagcggacaagacattcccc

SEQ ID NO: 675493 - DNA, 25 bp, Mus musculus
gcagagagcggagaagacattcccc

SEQ ID NO: 675494 - DNA, 25 bp, Mus musculus
gcagagagctcaccccattcgctgg

SEQ ID NO: 675495 - DNA, 25 bp, Mus musculus
gcagagagctcagcccattcgctgg

SEQ ID NO: 675496 - DNA, 25 bp, Mus musculus
gcagagaggcccctttcaaggtgtt

SEQ ID NO: 675497 - DNA, 25 bp, Mus musculus
gcagagaggcccgtttcaaggtgtt

SEQ ID NO: 675498 - DNA, 25 bp, Mus musculus
gcagagagggccatcagcctttggt

SEQ ID NO: 675499 - DNA, 25 bp, Mus musculus
gcagagagggccttcagcctttggt

SEQ ID NO: 675500 - DNA, 25 bp, Mus musculus
gcagagagtaccagaacatgatgat

SEQ ID NO: 675501 - DNA, 25 bp, Mus musculus
gcagagagtacctgaacatgatgat

SEQ ID NO: 675502 - DNA, 25 bp, Mus musculus
gcagagagtgctcctccaaggacaa

SEQ ID NO: 675503 - DNA, 25 bp, Mus musculus
gcagagagtgctgctccaaggacaa

SEQ ID NO: 675504 - DNA, 25 bp, Mus musculus
gcagagagtggaacttaggctttca

SEQ ID NO: 675505 - DNA, 25 bp, Mus musculus
gcagagagtggatcttaggctttca

SEQ ID NO: 675506 - DNA, 25 bp, Mus musculus
gcagagatccaacatggcagattca

SEQ ID NO: 675507 - DNA, 25 bp, Mus musculus
gcagagatccaagatggcagattca

SEQ ID NO: 675508 - DNA, 25 bp, Mus musculus
gcagagatcctgcaagagtcccgga

SEQ ID NO: 675509 - DNA, 25 bp, Mus musculus
gcagagatcctggaagagtcccgga

SEQ ID NO: 675510 - DNA, 25 bp, Mus musculus
gcagagatcgacaatgtcctgggca

SEQ ID NO: 675511 - DNA, 25 bp, Mus musculus
gcagagatcgactatgtcctgggca

SEQ ID NO: 675512 - DNA, 25 bp, Mus musculus
gcagagatcggcagccccggctttc

SEQ ID NO: 675513 - DNA, 25 bp, Mus musculus
gcagagatcggccttgcagtttgca

SEQ ID NO: 675514 - DNA, 25 bp, Mus musculus
gcagagatcggcgttgcagtttgca

SEQ ID NO: 675515 - DNA, 25 bp, Mus musculus
gcagagatcggctgccccggctttc

SEQ ID NO: 675516 - DNA, 25 bp, Mus musculus
gcagagatctatcggcccgacagaa

SEQ ID NO: 675517 - DNA, 25 bp, Mus musculus
gcagagatctatgggcccgacagaa

SEQ ID NO: 675518 - DNA, 25 bp, Mus musculus
gcagagatgcagctgttccctctcc

SEQ ID NO: 675519 - DNA, 25 bp, Mus musculus
gcagagatgcaggtgttccctctcc

SEQ ID NO: 675520 - DNA, 25 bp, Mus musculus
gcagagatgctgcaccatgccgtgc

SEQ ID NO: 675521 - DNA, 25 bp, Mus musculus
gcagagatgctggaccatgccgtgc

SEQ ID NO: 675522 - DNA, 25 bp, Mus musculus
gcagagatgcttaataaaaacaacc

SEQ ID NO: 675523 - DNA, 25 bp, Mus musculus
gcagagatgctttataaaaacaacc

SEQ ID NO: 675524 - DNA, 25 bp, Mus musculus
gcagagatggctctcctggcttcag

SEQ ID NO: 675525 - DNA, 25 bp, Mus musculus
gcagagatggctgtcctggcttcag

SEQ ID NO: 675526 - DNA, 25 bp, Mus musculus
gcagagatgtggactcgtagcccta

SEQ ID NO: 675527 - DNA, 25 bp, Mus musculus
gcagagatgtggtctcgtagcccta

SEQ ID NO: 675528 - DNA, 25 bp, Mus musculus
gcagagcaaattccggcatgtattc

SEQ ID NO: 675529 - DNA, 25 bp, Mus musculus
gcagagcaaattgcggcatgtattc

SEQ ID NO: 675530 - DNA, 25 bp, Mus musculus
gcagagcaactccaaggtggatcaa

SEQ ID NO: 675531 - DNA, 25 bp, Mus musculus
gcagagcaactcgaaggtggatcaa

SEQ ID NO: 675532 - DNA, 25 bp, Mus musculus
gcagagcaagctaagtgtgacccca

SEQ ID NO: 675533 - DNA, 25 bp, Mus musculus
gcagagcaagcttagtgtgacccca

SEQ ID NO: 675534 - DNA, 25 bp, Mus musculus
gcagagcacctaatgaccttggcct

SEQ ID NO: 675535 - DNA, 25 bp, Mus musculus
gcagagcacctattgaccttggcct

SEQ ID NO: 675536 - DNA, 25 bp, Mus musculus
gcagagcagcctacaacgtgacttt

SEQ ID NO: 675537 - DNA, 25 bp, Mus musculus
gcagagcagccttcaacgtgacttt

SEQ ID NO: 675538 - DNA, 25 bp, Mus musculus
gcagagcaggaacccatgcagctgt

SEQ ID NO: 675539 - DNA, 25 bp, Mus musculus
gcagagcaggaagccatgcagctgt

SEQ ID NO: 675540 - DNA, 25 bp, Mus musculus
gcagagcaggagaccaagttggatc

SEQ ID NO: 675541 - DNA, 25 bp, Mus musculus
gcagagcaggagtccaagttggatc

SEQ ID NO: 675542 - DNA, 25 bp, Mus musculus
gcagagcatcttcggacatgtagtc

SEQ ID NO: 675543 - DNA, 25 bp, Mus musculus
gcagagcatcttgggacatgtagtc

SEQ ID NO: 675544 - DNA, 25 bp, Mus musculus
gcagagccaaacaacggtgagagtg

SEQ ID NO: 675545 - DNA, 25 bp, Mus musculus
gcagagccaaactacggtgagagtg

SEQ ID NO: 675546 - DNA, 25 bp, Mus musculus
gcagagccacgcagcggttcgtcca

SEQ ID NO: 675547 - DNA, 25 bp, Mus musculus
gcagagccacgctgcggttcgtcca

SEQ ID NO: 675548 - DNA, 25 bp, Mus musculus
gcagagccactgagccagcgggcac

SEQ ID NO: 675549 - DNA, 25 bp, Mus musculus
gcagagccactgtgccagcgggcac

SEQ ID NO: 675550 - DNA, 25 bp, Mus musculus
gcagagccaggaaataatgcaggca

SEQ ID NO: 675551 - DNA, 25 bp, Mus musculus
gcagagccaggatataatgcaggca

SEQ ID NO: 675552 - DNA, 25 bp, Mus musculus
gcagagccaggcaggctgtaaataa

SEQ ID NO: 675553 - DNA, 25 bp, Mus musculus
gcagagccaggctggctgtaaataa

SEQ ID NO: 675554 - DNA, 25 bp, Mus musculus
gcagagcccactagcgaccaggaga

SEQ ID NO: 675555 - DNA, 25 bp, Mus musculus
gcagagcccacttgcgaccaggaga

SEQ ID NO: 675556 - DNA, 25 bp, Mus musculus
gcagagcccagcactacagcacagg

SEQ ID NO: 675557 - DNA, 25 bp, Mus musculus
gcagagcccagctctacagcacagg

SEQ ID NO: 675558 - DNA, 25 bp, Mus musculus
gcagagcccatcatcttctcacaga

SEQ ID NO: 675559 - DNA, 25 bp, Mus musculus
gcagagcccatcttcttctcacaga

SEQ ID NO: 675560 - DNA, 25 bp, Mus musculus
gcagagcccatgcagactccttgct

SEQ ID NO: 675561 - DNA, 25 bp, Mus musculus
gcagagcccatggagactccttgct

SEQ ID NO: 675562 - DNA, 25 bp, Mus musculus
gcagagccccatattggaacccttc

SEQ ID NO: 675563 - DNA, 25 bp, Mus musculus
gcagagccccattttggaacccttc

SEQ ID NO: 675564 - DNA, 25 bp, Mus musculus
gcagagcccctcatggatgcagcct

SEQ ID NO: 675565 - DNA, 25 bp, Mus musculus
gcagagcccctcttggatgcagcct

SEQ ID NO: 675566 - DNA, 25 bp, Mus musculus
gcagagccctataacctggtacggg

SEQ ID NO: 675567 - DNA, 25 bp, Mus musculus
gcagagccctattacctggtacggg

SEQ ID NO: 675568 - DNA, 25 bp, Mus musculus
gcagagccgtcaaggcttccacggg

SEQ ID NO: 675569 - DNA, 25 bp, Mus musculus
gcagagccgtcatggcttccacggg

SEQ ID NO: 675570 - DNA, 25 bp, Mus musculus
gcagagcctcttcgcctggtgcaga

SEQ ID NO: 675571 - DNA, 25 bp, Mus musculus
gcagagcctcttggcctggtgcaga

SEQ ID NO: 675572 - DNA, 25 bp, Mus musculus
gcagagcctggtatttgggattaaa

SEQ ID NO: 675573 - DNA, 25 bp, Mus musculus
gcagagcctggtttttgggattaaa

SEQ ID NO: 675574 - DNA, 25 bp, Mus musculus
gcagagcgactgctacagaacataa

SEQ ID NO: 675575 - DNA, 25 bp, Mus musculus
gcagagcgactggtacagaacataa

SEQ ID NO: 675576 - DNA, 25 bp, Mus musculus
gcagagcgagcgagaacccgaacgc

SEQ ID NO: 675577 - DNA, 25 bp, Mus musculus
gcagagcgagcgtgaacccgaacgc

SEQ ID NO: 675578 - DNA, 25 bp, Mus musculus
gcagagcgtcctctctacagtgacc

SEQ ID NO: 675579 - DNA, 25 bp, Mus musculus
gcagagcgtcctgtctacagtgacc

SEQ ID NO: 675580 - DNA, 25 bp, Mus musculus
gcagagctacctcgcaatggagaaa

SEQ ID NO: 675581 - DNA, 25 bp, Mus musculus
gcagagctacctggcaatggagaaa

SEQ ID NO: 675582 - DNA, 25 bp, Mus musculus
gcagagctcccaagtcacacaagaa

SEQ ID NO: 675583 - DNA, 25 bp, Mus musculus
gcagagctcccatgtcacacaagaa

SEQ ID NO: 675584 - DNA, 25 bp, Mus musculus
gcagagctctcaaaagagggccacc

SEQ ID NO: 675585 - DNA, 25 bp, Mus musculus
gcagagctctcataagagggccacc

SEQ ID NO: 675586 - DNA, 25 bp, Mus musculus
gcagagctcttcaaccggaagctga

SEQ ID NO: 675587 - DNA, 25 bp, Mus musculus
gcagagctcttctaccggaagctga

SEQ ID NO: 675588 - DNA, 25 bp, Mus musculus
gcagagctctttcccgtggtgaaga

SEQ ID NO: 675589 - DNA, 25 bp, Mus musculus
gcagagctctttgccgtggtgaaga

SEQ ID NO: 675590 - DNA, 25 bp, Mus musculus
gcagagctgaccagagaagtcatga

SEQ ID NO: 675591 - DNA, 25 bp, Mus musculus
gcagagctgacctgagaagtcatga

SEQ ID NO: 675592 - DNA, 25 bp, Mus musculus
gcagagctgactatgacacattatc

SEQ ID NO: 675593 - DNA, 25 bp, Mus musculus
gcagagctgactttgacacattatc

SEQ ID NO: 675594 - DNA, 25 bp, Mus musculus
gcagagctgcatcttcaagcttgag

SEQ ID NO: 675595 - DNA, 25 bp, Mus musculus
gcagagctgcatgttcaagcttgag

SEQ ID NO: 675596 - DNA, 25 bp, Mus musculus
gcagagctgcccaaagccactctga

SEQ ID NO: 675597 - DNA, 25 bp, Mus musculus
gcagagctgccctaagccactctga

SEQ ID NO: 675598 - DNA, 25 bp, Mus musculus
gcagagctgcctacttgtatcaaga

SEQ ID NO: 675599 - DNA, 25 bp, Mus musculus
gcagagctgccttcttgtatcaaga

SEQ ID NO: 675600 - DNA, 25 bp, Mus musculus
gcagagctgcgacactggtcagaca

SEQ ID NO: 675601 - DNA, 25 bp, Mus musculus
gcagagctgcgagactggtcagaca

SEQ ID NO: 675602 - DNA, 25 bp, Mus musculus
gcagagctggaaaatgagtccgtgc

SEQ ID NO: 675603 - DNA, 25 bp, Mus musculus
gcagagctggaatatgagtccgtgc

SEQ ID NO: 675604 - DNA, 25 bp, Mus musculus
gcagagctgggaattctcatcgcct

SEQ ID NO: 675605 - DNA, 25 bp, Mus musculus
gcagagctgggatttctcatcgcct

SEQ ID NO: 675606 - DNA, 25 bp, Mus musculus
gcagagctggtgcttgttaatctca

SEQ ID NO: 675607 - DNA, 25 bp, Mus musculus
gcagagctggtggttgttaatctca

SEQ ID NO: 675608 - DNA, 25 bp, Mus musculus
gcagagctgtccaaaggcgagtctg

SEQ ID NO: 675609 - DNA, 25 bp, Mus musculus
gcagagctgtcctaaggcgagtctg

SEQ ID NO: 675610 - DNA, 25 bp, Mus musculus
gcagagctgtgcagacagcatcagg

SEQ ID NO: 675611 - DNA, 25 bp, Mus musculus
gcagagctgtgctgacagcatcagg

SEQ ID NO: 675612 - DNA, 25 bp, Mus musculus
gcagagctgttgcatcgggccctat

SEQ ID NO: 675613 - DNA, 25 bp, Mus musculus
gcagagctgttggatcgggccctat

SEQ ID NO: 675614 - DNA, 25 bp, Mus musculus
gcagagcttgagatgaaagacatcc

SEQ ID NO: 675615 - DNA, 25 bp, Mus musculus
gcagagcttgagttgaaagacatcc

SEQ ID NO: 675616 - DNA, 25 bp, Mus musculus
gcagagctttagaaggcccgattgg

SEQ ID NO: 675617 - DNA, 25 bp, Mus musculus
gcagagctttagtaggcccgattgg

SEQ ID NO: 675618 - DNA, 25 bp, Mus musculus
gcagagctttccagaaaagaaaaga

SEQ ID NO: 675619 - DNA, 25 bp, Mus musculus
gcagagctttcctgaaaagaaaaga

SEQ ID NO: 675620 - DNA, 25 bp, Mus musculus
gcagaggaacaacggatgcttcctg

SEQ ID NO: 675621 - DNA, 25 bp, Mus musculus
gcagaggaacaagggatgcttcctg

SEQ ID NO: 675622 - DNA, 25 bp, Mus musculus
gcagaggaagatccccggaaccgac

SEQ ID NO: 675623 - DNA, 25 bp, Mus musculus
gcagaggaagatgcccggaaccgac

SEQ ID NO: 675624 - DNA, 25 bp, Mus musculus
gcagaggaattgagcagtattggca

SEQ ID NO: 675625 - DNA, 25 bp, Mus musculus
gcagaggaattgtgcagtattggca

SEQ ID NO: 675626 - DNA, 25 bp, Mus musculus
gcagaggaccaacaggcagaatgcc

SEQ ID NO: 675627 - DNA, 25 bp, Mus musculus
gcagaggaccaagaggcagaatgcc

SEQ ID NO: 675628 - DNA, 25 bp, Mus musculus
gcagaggaccatcctggagctactg

SEQ ID NO: 675629 - DNA, 25 bp, Mus musculus
gcagaggaccatgctggagctactg

SEQ ID NO: 675630 - DNA, 25 bp, Mus musculus
gcagaggacctaattctctatggta

SEQ ID NO: 675631 - DNA, 25 bp, Mus musculus
gcagaggacctacatgacccagggc

SEQ ID NO: 675632 - DNA, 25 bp, Mus musculus
gcagaggacctagatgacccagggc

SEQ ID NO: 675633 - DNA, 25 bp, Mus musculus
gcagaggacctatttctctatggta

SEQ ID NO: 675634 - DNA, 25 bp, Mus musculus
gcagaggagttaagttatacctccg

SEQ ID NO: 675635 - DNA, 25 bp, Mus musculus
gcagaggagttatgttatacctccg

SEQ ID NO: 675636 - DNA, 25 bp, Mus musculus
gcagaggatcctagggatgctgttc

SEQ ID NO: 675637 - DNA, 25 bp, Mus musculus
gcagaggatccttgggatgctgttc

SEQ ID NO: 675638 - DNA, 25 bp, Mus musculus
gcagaggcaacccactaagaagatg

SEQ ID NO: 675639 - DNA, 25 bp, Mus musculus
gcagaggcaaccgactaagaagatg

SEQ ID NO: 675640 - DNA, 25 bp, Mus musculus
gcagaggcaagaccgcagagacaac

SEQ ID NO: 675641 - DNA, 25 bp, Mus musculus
gcagaggcaagagcgcagagacaac

SEQ ID NO: 675642 - DNA, 25 bp, Mus musculus
gcagaggcggctcaagttctaattc

SEQ ID NO: 675643 - DNA, 25 bp, Mus musculus
gcagaggcggctgaagttctaattc

SEQ ID NO: 675644 - DNA, 25 bp, Mus musculus
gcagaggctaccctgaatctcctaa

SEQ ID NO: 675645 - DNA, 25 bp, Mus musculus
gcagaggctaccgtgaatctcctaa

SEQ ID NO: 675646 - DNA, 25 bp, Mus musculus
gcagaggctagacccggctttgaac

SEQ ID NO: 675647 - DNA, 25 bp, Mus musculus
gcagaggctagagccggctttgaac

SEQ ID NO: 675648 - DNA, 25 bp, Mus musculus
gcagagggagtgagagattttcacc

SEQ ID NO: 675649 - DNA, 25 bp, Mus musculus
gcagagggagtgtgagattttcacc

SEQ ID NO: 675650 - DNA, 25 bp, Mus musculus
gcagagggcctcagaatgttttcaa

SEQ ID NO: 675651 - DNA, 25 bp, Mus musculus
gcagagggcctctgaatgttttcaa

SEQ ID NO: 675652 - DNA, 25 bp, Mus musculus
gcagagggctcacaagttatcggaa

SEQ ID NO: 675653 - DNA, 25 bp, Mus musculus
gcagagggctcagaagttatcggaa

SEQ ID NO: 675654 - DNA, 25 bp, Mus musculus
gcagagggtcctctacctccaggtc

SEQ ID NO: 675655 - DNA, 25 bp, Mus musculus
gcagagggtcctgtacctccaggtc

SEQ ID NO: 675656 - DNA, 25 bp, Mus musculus
gcagagggttttatcgggattgcct

SEQ ID NO: 675657 - DNA, 25 bp, Mus musculus
gcagagggttttttcgggattgcct

SEQ ID NO: 675658 - DNA, 25 bp, Mus musculus
gcagaggtcatcatgaactaccacg

SEQ ID NO: 675659 - DNA, 25 bp, Mus musculus
gcagaggtcatcttgaactaccacg

SEQ ID NO: 675660 - DNA, 25 bp, Mus musculus
gcagaggtgcacacagaatgactca

SEQ ID NO: 675661 - DNA, 25 bp, Mus musculus
gcagaggtgcactcagaatgactca

SEQ ID NO: 675662 - DNA, 25 bp, Mus musculus
gcagaggttccccacacatgtgaaa

SEQ ID NO: 675663 - DNA, 25 bp, Mus musculus
gcagaggttcccgacacatgtgaaa

SEQ ID NO: 675664 - DNA, 25 bp, Mus musculus
gcagaggttgttagaccaacagctc

SEQ ID NO: 675665 - DNA, 25 bp, Mus musculus
gcagaggttgtttgaccaacagctc

SEQ ID NO: 675666 - DNA, 25 bp, Mus musculus
gcagaggttttcagatgcttgctac

SEQ ID NO: 675667 - DNA, 25 bp, Mus musculus
gcagaggttttctgatgcttgctac

SEQ ID NO: 675668 - DNA, 25 bp, Mus musculus
gcagagtaaatgaagagagcaaact

SEQ ID NO: 675669 - DNA, 25 bp, Mus musculus
gcagagtaaatgtagagagcaaact

SEQ ID NO: 675670 - DNA, 25 bp, Mus musculus
gcagagtacaagcagcgcggtcatt

SEQ ID NO: 675671 - DNA, 25 bp, Mus musculus
gcagagtacaaggagcgcggtcatt

SEQ ID NO: 675672 - DNA, 25 bp, Mus musculus
gcagagtacaatcaccaaccagaag

SEQ ID NO: 675673 - DNA, 25 bp, Mus musculus
gcagagtacaatgaccaaccagaag

SEQ ID NO: 675674 - DNA, 25 bp, Mus musculus
gcagagtacaccacgctgctgagcc

SEQ ID NO: 675675 - DNA, 25 bp, Mus musculus
gcagagtacacctcgctgctgagcc

SEQ ID NO: 675676 - DNA, 25 bp, Mus musculus
gcagagtatgcacctctagaggaag

SEQ ID NO: 675677 - DNA, 25 bp, Mus musculus
gcagagtatgcagctctagaggaag

SEQ ID NO: 675678 - DNA, 25 bp, Mus musculus
gcagagtatggaaatacagtttctt

SEQ ID NO: 675679 - DNA, 25 bp, Mus musculus
gcagagtatggatatacagtttctt

SEQ ID NO: 675680 - DNA, 25 bp, Mus musculus
gcagagtatgtgcagaagttcgcca

SEQ ID NO: 675681 - DNA, 25 bp, Mus musculus
gcagagtatgtggagaagttcgcca

SEQ ID NO: 675682 - DNA, 25 bp, Mus musculus
gcagagtcaaacagctccacttcca

SEQ ID NO: 675683 - DNA, 25 bp, Mus musculus
gcagagtcaaactgctccacttcca

SEQ ID NO: 675684 - DNA, 25 bp, Mus musculus
gcagagtcacatcttcagcatttac

SEQ ID NO: 675685 - DNA, 25 bp, Mus musculus
gcagagtcacatgttcagcatttac

SEQ ID NO: 675686 - DNA, 25 bp, Mus musculus
gcagagtcagtaacggaagagaagt

SEQ ID NO: 675687 - DNA, 25 bp, Mus musculus
gcagagtcagtatcggaagagaagt

SEQ ID NO: 675688 - DNA, 25 bp, Mus musculus
gcagagtcctgcaacctcagtcagt

SEQ ID NO: 675689 - DNA, 25 bp, Mus musculus
gcagagtcctgctacctcagtcagt

SEQ ID NO: 675690 - DNA, 25 bp, Mus musculus
gcagagtcggccatgttcaaacagt

SEQ ID NO: 675691 - DNA, 25 bp, Mus musculus
gcagagtcggccttgttcaaacagt

SEQ ID NO: 675692 - DNA, 25 bp, Mus musculus
gcagagtctctacgctacaaactcc

SEQ ID NO: 675693 - DNA, 25 bp, Mus musculus
gcagagtctctaggctacaaactcc

SEQ ID NO: 675694 - DNA, 25 bp, Mus musculus
gcagagtctgatatctatacagaga

SEQ ID NO: 675695 - DNA, 25 bp, Mus musculus
gcagagtctgatttctatacagaga

SEQ ID NO: 675696 - DNA, 25 bp, Mus musculus
gcagagtctgttcacaggcctctgg

SEQ ID NO: 675697 - DNA, 25 bp, Mus musculus
gcagagtctgttgacaggcctctgg

SEQ ID NO: 675698 - DNA, 25 bp, Mus musculus
gcagagtcttggcactgggaccctt

SEQ ID NO: 675699 - DNA, 25 bp, Mus musculus
gcagagtcttgggactgggaccctt

SEQ ID NO: 675700 - DNA, 25 bp, Mus musculus
gcagagtgagccaaacatcgctgtg

SEQ ID NO: 675701 - DNA, 25 bp, Mus musculus
gcagagtgagcctaacatcgctgtg

SEQ ID NO: 675702 - DNA, 25 bp, Mus musculus
gcagagtgatacagaatgtacctca

SEQ ID NO: 675703 - DNA, 25 bp, Mus musculus
gcagagtgatactgaatgtacctca

SEQ ID NO: 675704 - DNA, 25 bp, Mus musculus
gcagagtggcgaagacagcttcgat

SEQ ID NO: 675705 - DNA, 25 bp, Mus musculus
gcagagtggcgatgacagcttcgat

SEQ ID NO: 675706 - DNA, 25 bp, Mus musculus
gcagagtggctccaacagcaaatat

SEQ ID NO: 675707 - DNA, 25 bp, Mus musculus
gcagagtggctcgaacagcaaatat

SEQ ID NO: 675708 - DNA, 25 bp, Mus musculus
gcagagtgggcaccccaagcacttg

SEQ ID NO: 675709 - DNA, 25 bp, Mus musculus
gcagagtgggcagcccaagcacttg

SEQ ID NO: 675710 - DNA, 25 bp, Mus musculus
gcagagtgtgctcggcagaccctct

SEQ ID NO: 675711 - DNA, 25 bp, Mus musculus
gcagagtgtgctgggcagaccctct

SEQ ID NO: 675712 - DNA, 25 bp, Mus musculus
gcagagtgttgactgcattcagaca

SEQ ID NO: 675713 - DNA, 25 bp, Mus musculus
gcagagtgttgagtgcattcagaca

SEQ ID NO: 675714 - DNA, 25 bp, Mus musculus
gcagagttaatcattggccaagcag

SEQ ID NO: 675715 - DNA, 25 bp, Mus musculus
gcagagttaatctttggccaagcag

SEQ ID NO: 675716 - DNA, 25 bp, Mus musculus
gcagagttcctaccgggtcacgacc

SEQ ID NO: 675717 - DNA, 25 bp, Mus musculus
gcagagttcctagcgggtcacgacc

SEQ ID NO: 675718 - DNA, 25 bp, Mus musculus
gcagagttcttcctattcggataga

SEQ ID NO: 675719 - DNA, 25 bp, Mus musculus
gcagagttcttcgtattcggataga

SEQ ID NO: 675720 - DNA, 25 bp, Mus musculus
gcagagtttacacccatgcgggatc

SEQ ID NO: 675721 - DNA, 25 bp, Mus musculus
gcagagtttacagccatgcgggatc

SEQ ID NO: 675722 - DNA, 25 bp, Mus musculus
gcagagtttcttcagtgttcccagt

SEQ ID NO: 675723 - DNA, 25 bp, Mus musculus
gcagagtttcttgagtgttcccagt

SEQ ID NO: 675724 - DNA, 25 bp, Mus musculus
gcagataaacatccaagccaagcag

SEQ ID NO: 675725 - DNA, 25 bp, Mus musculus
gcagataaacatgcaagccaagcag

SEQ ID NO: 675726 - DNA, 25 bp, Mus musculus
gcagataaagagatcagccctggtg

SEQ ID NO: 675727 - DNA, 25 bp, Mus musculus
gcagataaagagttcagccctggtg

SEQ ID NO: 675728 - DNA, 25 bp, Mus musculus
gcagataacagacgccctggaaaat

SEQ ID NO: 675729 - DNA, 25 bp, Mus musculus
gcagataacagaggccctggaaaat

SEQ ID NO: 675730 - DNA, 25 bp, Mus musculus
gcagataaccagcttctggcagttg

SEQ ID NO: 675731 - DNA, 25 bp, Mus musculus
gcagataaccaggttctggcagttg

SEQ ID NO: 675732 - DNA, 25 bp, Mus musculus
gcagataacctaaagggcccacctt

SEQ ID NO: 675733 - DNA, 25 bp, Mus musculus
gcagataacctatagggcccacctt

SEQ ID NO: 675734 - DNA, 25 bp, Mus musculus
gcagatacgatacaagctaaataag

SEQ ID NO: 675735 - DNA, 25 bp, Mus musculus
gcagatacgatagaagctaaataag

SEQ ID NO: 675736 - DNA, 25 bp, Mus musculus
gcagatacttggactgtcagccagg

SEQ ID NO: 675737 - DNA, 25 bp, Mus musculus
gcagatacttggtctgtcagccagg

SEQ ID NO: 675738 - DNA, 25 bp, Mus musculus
gcagatagacaacatgaaggccatt

SEQ ID NO: 675739 - DNA, 25 bp, Mus musculus
gcagatagacaagatgaaggccatt

SEQ ID NO: 675740 - DNA, 25 bp, Mus musculus
gcagatagacctaaacaaggagaag

SEQ ID NO: 675741 - DNA, 25 bp, Mus musculus
gcagatagaccttaacaaggagaag

SEQ ID NO: 675742 - DNA, 25 bp, Mus musculus
gcagatagccttaatgtggagaaga

SEQ ID NO: 675743 - DNA, 25 bp, Mus musculus
gcagatagcctttatgtggagaaga

SEQ ID NO: 675744 - DNA, 25 bp, Mus musculus
gcagatatcgtgcagaacagtagtc

SEQ ID NO: 675745 - DNA, 25 bp, Mus musculus
gcagatatcgtggagaacagtagtc

SEQ ID NO: 675746 - DNA, 25 bp, Mus musculus
gcagatatcttcatttgtgtctgaa

SEQ ID NO: 675747 - DNA, 25 bp, Mus musculus
gcagatatcttcttttgtgtctgaa

SEQ ID NO: 675748 - DNA, 25 bp, Mus musculus
gcagatcaacgaaatttctctgcag

SEQ ID NO: 675749 - DNA, 25 bp, Mus musculus
gcagatcaacgatatttctctgcag

SEQ ID NO: 675750 - DNA, 25 bp, Mus musculus
gcagatcaagacaactgttcaaaat

SEQ ID NO: 675751 - DNA, 25 bp, Mus musculus
gcagatcaagactactgttcaaaat

SEQ ID NO: 675752 - DNA, 25 bp, Mus musculus
gcagatcaatgacatccagttgtct

SEQ ID NO: 675753 - DNA, 25 bp, Mus musculus
gcagatcaatgagatccagttgtct

SEQ ID NO: 675754 - DNA, 25 bp, Mus musculus
gcagatcacaacaggccaggacttg

SEQ ID NO: 675755 - DNA, 25 bp, Mus musculus
gcagatcacaactggccaggacttg

SEQ ID NO: 675756 - DNA, 25 bp, Mus musculus
gcagatcacctacctggacggattc

SEQ ID NO: 675757 - DNA, 25 bp, Mus musculus
gcagatcacctagctggacggattc

SEQ ID NO: 675758 - DNA, 25 bp, Mus musculus
gcagatcagaagaaatttggcaaag

SEQ ID NO: 675759 - DNA, 25 bp, Mus musculus
gcagatcagaagagtataatagcca

SEQ ID NO: 675760 - DNA, 25 bp, Mus musculus
gcagatcagaagtaatttggcaaag

SEQ ID NO: 675761 - DNA, 25 bp, Mus musculus
gcagatcagaagtgtataatagcca

SEQ ID NO: 675762 - DNA, 25 bp, Mus musculus
gcagatcaggcgacagaatggtgac

SEQ ID NO: 675763 - DNA, 25 bp, Mus musculus
gcagatcaggcgtcagaatggtgac

SEQ ID NO: 675764 - DNA, 25 bp, Mus musculus
gcagatccaaccagcaaccagaggt

SEQ ID NO: 675765 - DNA, 25 bp, Mus musculus
gcagatccaacctgcaaccagaggt

SEQ ID NO: 675766 - DNA, 25 bp, Mus musculus
gcagatccaagactttccagtccca

SEQ ID NO: 675767 - DNA, 25 bp, Mus musculus
gcagatccaagagtttccagtccca

SEQ ID NO: 675768 - DNA, 25 bp, Mus musculus
gcagatccactcacggaagatgaat

SEQ ID NO: 675769 - DNA, 25 bp, Mus musculus
gcagatccactctcggaagatgaat

SEQ ID NO: 675770 - DNA, 25 bp, Mus musculus
gcagatccagagcttgaataaaatg

SEQ ID NO: 675771 - DNA, 25 bp, Mus musculus
gcagatccagaggttgaataaaatg

SEQ ID NO: 675772 - DNA, 25 bp, Mus musculus
gcagatccagcacggcttgcagacg

SEQ ID NO: 675773 - DNA, 25 bp, Mus musculus
gcagatccagcagggcttgcagacg

SEQ ID NO: 675774 - DNA, 25 bp, Mus musculus
gcagatccagctcgatgcccaggca

SEQ ID NO: 675775 - DNA, 25 bp, Mus musculus
gcagatccagctggatgcccaggca

SEQ ID NO: 675776 - DNA, 25 bp, Mus musculus
gcagatccatcgattgctgctgcag

SEQ ID NO: 675777 - DNA, 25 bp, Mus musculus
gcagatccatcgtttgctgctgcag

SEQ ID NO: 675778 - DNA, 25 bp, Mus musculus
gcagatcctggccactggtgagaac

SEQ ID NO: 675779 - DNA, 25 bp, Mus musculus
gcagatcctggcgactggtgagaac

SEQ ID NO: 675780 - DNA, 25 bp, Mus musculus
gcagatcgacttagctgatccccag

SEQ ID NO: 675781 - DNA, 25 bp, Mus musculus
gcagatcgactttgctgatccccag

SEQ ID NO: 675782 - DNA, 25 bp, Mus musculus
gcagatcgcactcaacgtggacggt

SEQ ID NO: 675783 - DNA, 25 bp, Mus musculus
gcagatcgcactgaacgtggacggt

SEQ ID NO: 675784 - DNA, 25 bp, Mus musculus
gcagatcgcccacgagatcatcaag

SEQ ID NO: 675785 - DNA, 25 bp, Mus musculus
gcagatcgcccaggagatcatcaag

SEQ ID NO: 675786 - DNA, 25 bp, Mus musculus
gcagatcgctatcggcgccttgacc

SEQ ID NO: 675787 - DNA, 25 bp, Mus musculus
gcagatcgctatgggcgccttgacc

SEQ ID NO: 675788 - DNA, 25 bp, Mus musculus
gcagatcgggagcttgtgttcctca

SEQ ID NO: 675789 - DNA, 25 bp, Mus musculus
gcagatcgggaggttgtgttcctca

SEQ ID NO: 675790 - DNA, 25 bp, Mus musculus
gcagatctctagcatcttccagacg

SEQ ID NO: 675791 - DNA, 25 bp, Mus musculus
gcagatctctaggatcttccagacg

SEQ ID NO: 675792 - DNA, 25 bp, Mus musculus
gcagatcttatgaggcttccgagcc

SEQ ID NO: 675793 - DNA, 25 bp, Mus musculus
gcagatcttatgtggcttccgagcc

SEQ ID NO: 675794 - DNA, 25 bp, Mus musculus
gcagatcttgatagaacaattaaag

SEQ ID NO: 675795 - DNA, 25 bp, Mus musculus
gcagatcttgattgaacaattaaag

SEQ ID NO: 675796 - DNA, 25 bp, Mus musculus
gcagatgaaactagtacagctttta

SEQ ID NO: 675797 - DNA, 25 bp, Mus musculus
gcagatgaaacttgtacagctttta

SEQ ID NO: 675798 - DNA, 25 bp, Mus musculus
gcagatgaagcaagataggatcacc

SEQ ID NO: 675799 - DNA, 25 bp, Mus musculus
gcagatgaagcatgataggatcacc

SEQ ID NO: 675800 - DNA, 25 bp, Mus musculus
gcagatgaagcgcacagccatagag

SEQ ID NO: 675801 - DNA, 25 bp, Mus musculus
gcagatgaagcggacagccatagag

SEQ ID NO: 675802 - DNA, 25 bp, Mus musculus
gcagatgaccaactatgaaatggcg

SEQ ID NO: 675803 - DNA, 25 bp, Mus musculus
gcagatgaccaagtatgaaatggcg

SEQ ID NO: 675804 - DNA, 25 bp, Mus musculus
gcagatgacctgcaaagtcccttat

SEQ ID NO: 675805 - DNA, 25 bp, Mus musculus
gcagatgacctggaaagtcccttat

SEQ ID NO: 675806 - DNA, 25 bp, Mus musculus
gcagatgagctcattaatgctgcca

SEQ ID NO: 675807 - DNA, 25 bp, Mus musculus
gcagatgagctctttaatgctgcca

SEQ ID NO: 675808 - DNA, 25 bp, Mus musculus
gcagatgaggcccttggcaatgttc

SEQ ID NO: 675809 - DNA, 25 bp, Mus musculus
gcagatgaggccgttggcaatgttc

SEQ ID NO: 675810 - DNA, 25 bp, Mus musculus
gcagatgatcttcccgtactatggc

SEQ ID NO: 675811 - DNA, 25 bp, Mus musculus
gcagatgatcttgccgtactatggc

SEQ ID NO: 675812 - DNA, 25 bp, Mus musculus
gcagatgatggacctaggactccta

SEQ ID NO: 675813 - DNA, 25 bp, Mus musculus
gcagatgatggagctaggactccta

SEQ ID NO: 675814 - DNA, 25 bp, Mus musculus
gcagatgcaatgaggagactccagg

SEQ ID NO: 675815 - DNA, 25 bp, Mus musculus
gcagatgcaatgtggagactccagg

SEQ ID NO: 675816 - DNA, 25 bp, Mus musculus
gcagatgcatgcctgatccttgcca

SEQ ID NO: 675817 - DNA, 25 bp, Mus musculus
gcagatgcatgcgtgatccttgcca

SEQ ID NO: 675818 - DNA, 25 bp, Mus musculus
gcagatgcctctatccagaactgga

SEQ ID NO: 675819 - DNA, 25 bp, Mus musculus
gcagatgcctctttccagaactgga

SEQ ID NO: 675820 - DNA, 25 bp, Mus musculus
gcagatgccttaagtcctagcactc

SEQ ID NO: 675821 - DNA, 25 bp, Mus musculus
gcagatgccttatgtcctagcactc

SEQ ID NO: 675822 - DNA, 25 bp, Mus musculus
gcagatgcctttcattgccgcaaga

SEQ ID NO: 675823 - DNA, 25 bp, Mus musculus
gcagatgcctttgattgccgcaaga

SEQ ID NO: 675824 - DNA, 25 bp, Mus musculus
gcagatgctacacgatgaggcagct

SEQ ID NO: 675825 - DNA, 25 bp, Mus musculus
gcagatgctacaggatgaggcagct

SEQ ID NO: 675826 - DNA, 25 bp, Mus musculus
gcagatgctgctcgcctacgtgcta

SEQ ID NO: 675827 - DNA, 25 bp, Mus musculus
gcagatgctgctggcctacgtgcta

SEQ ID NO: 675828 - DNA, 25 bp, Mus musculus
gcagatggaaagcatccagcccact

SEQ ID NO: 675829 - DNA, 25 bp, Mus musculus
gcagatggaaaggatccagcccact

SEQ ID NO: 675830 - DNA, 25 bp, Mus musculus
gcagatggcgtcatcctgctcctgc

SEQ ID NO: 675831 - DNA, 25 bp, Mus musculus
gcagatggcgtcttcctgctcctgc

SEQ ID NO: 675832 - DNA, 25 bp, Mus musculus
gcagatgggaaaagctgaactcgcc

SEQ ID NO: 675833 - DNA, 25 bp, Mus musculus
gcagatgggaaatgctgaactcgcc

SEQ ID NO: 675834 - DNA, 25 bp, Mus musculus
gcagatgggcacagagtgccactac

SEQ ID NO: 675835 - DNA, 25 bp, Mus musculus
gcagatgggcactgagtgccactac

SEQ ID NO: 675836 - DNA, 25 bp, Mus musculus
gcagatggtgctatttatccagatg

SEQ ID NO: 675837 - DNA, 25 bp, Mus musculus
gcagatggtgctttttatccagatg

SEQ ID NO: 675838 - DNA, 25 bp, Mus musculus
gcagatggttgaagacgtggacctt

SEQ ID NO: 675839 - DNA, 25 bp, Mus musculus
gcagatggttgatgacgtggacctt

SEQ ID NO: 675840 - DNA, 25 bp, Mus musculus
gcagatgtcaatccaagacacaaac

SEQ ID NO: 675841 - DNA, 25 bp, Mus musculus
gcagatgtcaatccacctcctgtgc

SEQ ID NO: 675842 - DNA, 25 bp, Mus musculus
gcagatgtcaatgcaagacacaaac

SEQ ID NO: 675843 - DNA, 25 bp, Mus musculus
gcagatgtcaatgcacctcctgtgc

SEQ ID NO: 675844 - DNA, 25 bp, Mus musculus
gcagatgtgtttactccgggacaaa

SEQ ID NO: 675845 - DNA, 25 bp, Mus musculus
gcagatgtgttttctccgggacaaa

SEQ ID NO: 675846 - DNA, 25 bp, Mus musculus
gcagatgttactcggattcctctag

SEQ ID NO: 675847 - DNA, 25 bp, Mus musculus
gcagatgttactgggattcctctag

SEQ ID NO: 675848 - DNA, 25 bp, Mus musculus
gcagatgtttggaccacaagtgctt

SEQ ID NO: 675849 - DNA, 25 bp, Mus musculus
gcagatgtttggtccacaagtgctt

SEQ ID NO: 675850 - DNA, 25 bp, Mus musculus
gcagatgttttgcacatgaaccctg

SEQ ID NO: 675851 - DNA, 25 bp, Mus musculus
gcagatgttttggacatgaaccctg

SEQ ID NO: 675852 - DNA, 25 bp, Mus musculus
gcagattatagtcttcccagaagat

SEQ ID NO: 675853 - DNA, 25 bp, Mus musculus
gcagattatagtgttcccagaagat

SEQ ID NO: 675854 - DNA, 25 bp, Mus musculus
gcagattcacatcctctcagtagtt

SEQ ID NO: 675855 - DNA, 25 bp, Mus musculus
gcagattcacatgctctcagtagtt

SEQ ID NO: 675856 - DNA, 25 bp, Mus musculus
gcagattcacgacagtgccgtccag

SEQ ID NO: 675857 - DNA, 25 bp, Mus musculus
gcagattcacgagagtgccgtccag

SEQ ID NO: 675858 - DNA, 25 bp, Mus musculus
gcagattcagaacggctcctcgtcc

SEQ ID NO: 675859 - DNA, 25 bp, Mus musculus
gcagattcagaagggctcctcgtcc

SEQ ID NO: 675860 - DNA, 25 bp, Mus musculus
gcagattcaggaacctgagtctgag

SEQ ID NO: 675861 - DNA, 25 bp, Mus musculus
gcagattcaggacgtattcaaccag

SEQ ID NO: 675862 - DNA, 25 bp, Mus musculus
gcagattcaggaggtattcaaccag

SEQ ID NO: 675863 - DNA, 25 bp, Mus musculus
gcagattcaggatcctgagtctgag

SEQ ID NO: 675864 - DNA, 25 bp, Mus musculus
gcagattcctgtacttcctcaagag

SEQ ID NO: 675865 - DNA, 25 bp, Mus musculus
gcagattcctgttcttcctcaagag

SEQ ID NO: 675866 - DNA, 25 bp, Mus musculus
gcagattctaggagccctactccaa

SEQ ID NO: 675867 - DNA, 25 bp, Mus musculus
gcagattctaggtgccctactccaa

SEQ ID NO: 675868 - DNA, 25 bp, Mus musculus
gcagattctgaaacattgagtgcac

SEQ ID NO: 675869 - DNA, 25 bp, Mus musculus
gcagattctgaatcattgagtgcac

SEQ ID NO: 675870 - DNA, 25 bp, Mus musculus
gcagattgaaaccaggaaccgggac

SEQ ID NO: 675871 - DNA, 25 bp, Mus musculus
gcagattgaaacgaggaaccgggac

SEQ ID NO: 675872 - DNA, 25 bp, Mus musculus
gcagattgctgaccccgggaaacag

SEQ ID NO: 675873 - DNA, 25 bp, Mus musculus
gcagattgctgagcccgggaaacag

SEQ ID NO: 675874 - DNA, 25 bp, Mus musculus
gcagattgtctcagggtcccgagac

SEQ ID NO: 675875 - DNA, 25 bp, Mus musculus
gcagattgtctctgggtcccgagac

SEQ ID NO: 675876 - DNA, 25 bp, Mus musculus
gcagattgtttcatcagcctccagg

SEQ ID NO: 675877 - DNA, 25 bp, Mus musculus
gcagattgtttcttcagcctccagg

SEQ ID NO: 675878 - DNA, 25 bp, Mus musculus
gcagatttacaaccggaacccgatc

SEQ ID NO: 675879 - DNA, 25 bp, Mus musculus
gcagatttacaagcggaacccgatc

SEQ ID NO: 675880 - DNA, 25 bp, Mus musculus
gcagatttcaaccacagaatcaagg

SEQ ID NO: 675881 - DNA, 25 bp, Mus musculus
gcagatttcaacgacagaatcaagg

SEQ ID NO: 675882 - DNA, 25 bp, Mus musculus
gcagatttcagccaatttgaagtat

SEQ ID NO: 675883 - DNA, 25 bp, Mus musculus
gcagatttcagcgaatttgaagtat

SEQ ID NO: 675884 - DNA, 25 bp, Mus musculus
gcagatttcatccatcagcagcgaa

SEQ ID NO: 675885 - DNA, 25 bp, Mus musculus
gcagatttcatcgatcagcagcgaa

SEQ ID NO: 675886 - DNA, 25 bp, Mus musculus
gcagcaaaagcccagcgtcaatgcg

SEQ ID NO: 675887 - DNA, 25 bp, Mus musculus
gcagcaaaagccgagcgtcaatgcg

SEQ ID NO: 675888 - DNA, 25 bp, Mus musculus
gcagcaaaatctcaacttgcaacag

SEQ ID NO: 675889 - DNA, 25 bp, Mus musculus
gcagcaaaatctgaacttgcaacag

SEQ ID NO: 675890 - DNA, 25 bp, Mus musculus
gcagcaaagtttcatccttcttcga

SEQ ID NO: 675891 - DNA, 25 bp, Mus musculus
gcagcaaagtttgatccttcttcga

SEQ ID NO: 675892 - DNA, 25 bp, Mus musculus
gcagcaaatcaaacgatcagctcgg

SEQ ID NO: 675893 - DNA, 25 bp, Mus musculus
gcagcaaatcaatcgatcagctcgg

SEQ ID NO: 675894 - DNA, 25 bp, Mus musculus
gcagcaaatcctattgagtctcagt

SEQ ID NO: 675895 - DNA, 25 bp, Mus musculus
gcagcaaatccttttgagtctcagt

SEQ ID NO: 675896 - DNA, 25 bp, Mus musculus
gcagcaacagccagccaggactcat

SEQ ID NO: 675897 - DNA, 25 bp, Mus musculus
gcagcaacagcctgccaggactcat

SEQ ID NO: 675898 - DNA, 25 bp, Mus musculus
gcagcaacagttccaagcagtagtg

SEQ ID NO: 675899 - DNA, 25 bp, Mus musculus
gcagcaacagttgcaagcagtagtg

SEQ ID NO: 675900 - DNA, 25 bp, Mus musculus
gcagcaacccggctcttgggagcca

SEQ ID NO: 675901 - DNA, 25 bp, Mus musculus
gcagcaacccgggtcttgggagcca

SEQ ID NO: 675902 - DNA, 25 bp, Mus musculus
gcagcaacctcaagagagtaaccct

SEQ ID NO: 675903 - DNA, 25 bp, Mus musculus
gcagcaacctcatgagagtaaccct

SEQ ID NO: 675904 - DNA, 25 bp, Mus musculus
gcagcaacctccctatgcaggagct

SEQ ID NO: 675905 - DNA, 25 bp, Mus musculus
gcagcaacctccgtatgcaggagct

SEQ ID NO: 675906 - DNA, 25 bp, Mus musculus
gcagcaaccttcagttgcccctggg

SEQ ID NO: 675907 - DNA, 25 bp, Mus musculus
gcagcaaccttctgttgcccctggg

SEQ ID NO: 675908 - DNA, 25 bp, Mus musculus
gcagcaactacacgccgtgaggcag

SEQ ID NO: 675909 - DNA, 25 bp, Mus musculus
gcagcaactacaggccgtgaggcag

SEQ ID NO: 675910 - DNA, 25 bp, Mus musculus
gcagcaactactacaacagctgaga

SEQ ID NO: 675911 - DNA, 25 bp, Mus musculus
gcagcaactacttcaacagctgaga

SEQ ID NO: 675912 - DNA, 25 bp, Mus musculus
gcagcaactgcgcttaaccgcttaa

SEQ ID NO: 675913 - DNA, 25 bp, Mus musculus
gcagcaactgcggttaaccgcttaa

SEQ ID NO: 675914 - DNA, 25 bp, Mus musculus
gcagcaactgtgcaggagaaattca

SEQ ID NO: 675915 - DNA, 25 bp, Mus musculus
gcagcaactgtggaggagaaattca

SEQ ID NO: 675916 - DNA, 25 bp, Mus musculus
gcagcaagcacacagtcgtggcata

SEQ ID NO: 675917 - DNA, 25 bp, Mus musculus
gcagcaagcacagagtcgtggcata

SEQ ID NO: 675918 - DNA, 25 bp, Mus musculus
gcagcaagcttgctatctgaaatct

SEQ ID NO: 675919 - DNA, 25 bp, Mus musculus
gcagcaagcttggtatctgaaatct

SEQ ID NO: 675920 - DNA, 25 bp, Mus musculus
gcagcaaggactccgagtcaagagt

SEQ ID NO: 675921 - DNA, 25 bp, Mus musculus
gcagcaaggactgcgagtcaagagt

SEQ ID NO: 675922 - DNA, 25 bp, Mus musculus
gcagcaagggacctaggctaagttt

SEQ ID NO: 675923 - DNA, 25 bp, Mus musculus
gcagcaagggacgtaggctaagttt

SEQ ID NO: 675924 - DNA, 25 bp, Mus musculus
gcagcaagtgtcatatcgggcagaa

SEQ ID NO: 675925 - DNA, 25 bp, Mus musculus
gcagcaagtgtcttatcgggcagaa

SEQ ID NO: 675926 - DNA, 25 bp, Mus musculus
gcagcaatgaagcaagacgtgctct

SEQ ID NO: 675927 - DNA, 25 bp, Mus musculus
gcagcaatgaaggaagacgtgctct

SEQ ID NO: 675928 - DNA, 25 bp, Mus musculus
gcagcaatgcatccgcaccgtcgag

SEQ ID NO: 675929 - DNA, 25 bp, Mus musculus
gcagcaatgcatgcgcaccgtcgag

SEQ ID NO: 675930 - DNA, 25 bp, Mus musculus
gcagcaatttccatatcagtgtgga

SEQ ID NO: 675931 - DNA, 25 bp, Mus musculus
gcagcaatttccttatcagtgtgga

SEQ ID NO: 675932 - DNA, 25 bp, Mus musculus
gcagcacaaactactcagccacaat

SEQ ID NO: 675933 - DNA, 25 bp, Mus musculus
gcagcacaaacttctcagccacaat

SEQ ID NO: 675934 - DNA, 25 bp, Mus musculus
gcagcacacacaagaacttcagaac

SEQ ID NO: 675935 - DNA, 25 bp, Mus musculus
gcagcacacacatgaacttcagaac

SEQ ID NO: 675936 - DNA, 25 bp, Mus musculus
gcagcacacaccaacttctgatgta

SEQ ID NO: 675937 - DNA, 25 bp, Mus musculus
gcagcacacacctacttctgatgta

SEQ ID NO: 675938 - DNA, 25 bp, Mus musculus
gcagcacacagaactggatatggta

SEQ ID NO: 675939 - DNA, 25 bp, Mus musculus
gcagcacacagatctggatatggta

SEQ ID NO: 675940 - DNA, 25 bp, Mus musculus
gcagcacaccatatgtggagagaga

SEQ ID NO: 675941 - DNA, 25 bp, Mus musculus
gcagcacaccatttgtggagagaga

SEQ ID NO: 675942 - DNA, 25 bp, Mus musculus
gcagcacacggtaccagtggaagct

SEQ ID NO: 675943 - DNA, 25 bp, Mus musculus
gcagcacacggttccagtggaagct

SEQ ID NO: 675944 - DNA, 25 bp, Mus musculus
gcagcacagtctccccagatggtag

SEQ ID NO: 675945 - DNA, 25 bp, Mus musculus
gcagcacagtctgcccagatggtag

SEQ ID NO: 675946 - DNA, 25 bp, Mus musculus
gcagcacatcccatctcagaaacag

SEQ ID NO: 675947 - DNA, 25 bp, Mus musculus
gcagcacatcccttctcagaaacag

SEQ ID NO: 675948 - DNA, 25 bp, Mus musculus
gcagcacatccgaggaaagtccagg

SEQ ID NO: 675949 - DNA, 25 bp, Mus musculus
gcagcacatccgtggaaagtccagg

SEQ ID NO: 675950 - DNA, 25 bp, Mus musculus
gcagcacatgcgattgtttctgtta

SEQ ID NO: 675951 - DNA, 25 bp, Mus musculus
gcagcacatgcgtttgtttctgtta

SEQ ID NO: 675952 - DNA, 25 bp, Mus musculus
gcagcacattagctgcaggtgtgta

SEQ ID NO: 675953 - DNA, 25 bp, Mus musculus
gcagcacattaggtgcaggtgtgta

SEQ ID NO: 675954 - DNA, 25 bp, Mus musculus
gcagcacattcacaacccggtggtg

SEQ ID NO: 675955 - DNA, 25 bp, Mus musculus
gcagcacattcagaacccggtggtg

SEQ ID NO: 675956 - DNA, 25 bp, Mus musculus
gcagcaccagcacctacttcagaaa

SEQ ID NO: 675957 - DNA, 25 bp, Mus musculus
gcagcaccagcagctacttcagaaa

SEQ ID NO: 675958 - DNA, 25 bp, Mus musculus
gcagcaccagggaaaaggattcgaa

SEQ ID NO: 675959 - DNA, 25 bp, Mus musculus
gcagcaccagggtaaaggattcgaa

SEQ ID NO: 675960 - DNA, 25 bp, Mus musculus
gcagcaccatgtcgctcaaaagaag

SEQ ID NO: 675961 - DNA, 25 bp, Mus musculus
gcagcaccatgtggctcaaaagaag

SEQ ID NO: 675962 - DNA, 25 bp, Mus musculus
gcagcacccctcagttgcgaaagag

SEQ ID NO: 675963 - DNA, 25 bp, Mus musculus
gcagcacccctctgttgcgaaagag

SEQ ID NO: 675964 - DNA, 25 bp, Mus musculus
gcagcaccctacatgggctcagaac

SEQ ID NO: 675965 - DNA, 25 bp, Mus musculus
gcagcaccctacttgggctcagaac

SEQ ID NO: 675966 - DNA, 25 bp, Mus musculus
gcagcacccttccagataagatgca

SEQ ID NO: 675967 - DNA, 25 bp, Mus musculus
gcagcacccttcgagataagatgca

SEQ ID NO: 675968 - DNA, 25 bp, Mus musculus
gcagcaccgcgacattatccagaag

SEQ ID NO: 675969 - DNA, 25 bp, Mus musculus
gcagcaccgcgagattatccagaag

SEQ ID NO: 675970 - DNA, 25 bp, Mus musculus
gcagcaccgtggcttctgtgtatca

SEQ ID NO: 675971 - DNA, 25 bp, Mus musculus
gcagcaccgtgggttctgtgtatca

SEQ ID NO: 675972 - DNA, 25 bp, Mus musculus
gcagcacctaggctacaggtccagg

SEQ ID NO: 675973 - DNA, 25 bp, Mus musculus
gcagcacctagggtacaggtccagg

SEQ ID NO: 675974 - DNA, 25 bp, Mus musculus
gcagcacctgcgcttctagagcttc

SEQ ID NO: 675975 - DNA, 25 bp, Mus musculus
gcagcacctgcggttctagagcttc

SEQ ID NO: 675976 - DNA, 25 bp, Mus musculus
gcagcacgacacagctgcagttcca

SEQ ID NO: 675977 - DNA, 25 bp, Mus musculus
gcagcacgacactgctgcagttcca

SEQ ID NO: 675978 - DNA, 25 bp, Mus musculus
gcagcacgccgaactctcaaacttt

SEQ ID NO: 675979 - DNA, 25 bp, Mus musculus
gcagcacgccgatctctcaaacttt

SEQ ID NO: 675980 - DNA, 25 bp, Mus musculus
gcagcacgctgaccccaagatgagg

SEQ ID NO: 675981 - DNA, 25 bp, Mus musculus
gcagcacgctgagcccaagatgagg

SEQ ID NO: 675982 - DNA, 25 bp, Mus musculus
gcagcacggcttatccatggagatg

SEQ ID NO: 675983 - DNA, 25 bp, Mus musculus
gcagcacggcttttccatggagatg

SEQ ID NO: 675984 - DNA, 25 bp, Mus musculus
gcagcacgggaacgtggtcatggcc

SEQ ID NO: 675985 - DNA, 25 bp, Mus musculus
gcagcacgggaaggtggtcatggcc

SEQ ID NO: 675986 - DNA, 25 bp, Mus musculus
gcagcacgtgtcaggctgtgcccca

SEQ ID NO: 675987 - DNA, 25 bp, Mus musculus
gcagcacgtgtctggctgtgcccca

SEQ ID NO: 675988 - DNA, 25 bp, Mus musculus
gcagcactgaggatatcaagccgcc

SEQ ID NO: 675989 - DNA, 25 bp, Mus musculus
gcagcactgaggttatcaagccgcc

SEQ ID NO: 675990 - DNA, 25 bp, Mus musculus
gcagcactgatcaaggacatgaagt

SEQ ID NO: 675991 - DNA, 25 bp, Mus musculus
gcagcactgatctaggacatgaagt

SEQ ID NO: 675992 - DNA, 25 bp, Mus musculus
gcagcactgcgcatgtcacagagca

SEQ ID NO: 675993 - DNA, 25 bp, Mus musculus
gcagcactgcgcttgtcacagagca

SEQ ID NO: 675994 - DNA, 25 bp, Mus musculus
gcagcactgcttacatcctatgaga

SEQ ID NO: 675995 - DNA, 25 bp, Mus musculus
gcagcactgctttcatcctatgaga

SEQ ID NO: 675996 - DNA, 25 bp, Mus musculus
gcagcactgtttatcgtgccatcag

SEQ ID NO: 675997 - DNA, 25 bp, Mus musculus
gcagcactgtttttcgtgccatcag

SEQ ID NO: 675998 - DNA, 25 bp, Mus musculus
gcagcacttagcattcagaaatggt

SEQ ID NO: 675999 - DNA, 25 bp, Mus musculus
gcagcacttagctttcagaaatggt

SEQ ID NO: 676000 - DNA, 25 bp, Mus musculus
gcagcacttcagcaatctggatgcc

SEQ ID NO: 676001 - DNA, 25 bp, Mus musculus
gcagcacttcaggaatctggatgcc

SEQ ID NO: 676002 - DNA, 25 bp, Mus musculus
gcagcacttgctaggactatacgac

SEQ ID NO: 676003 - DNA, 25 bp, Mus musculus
gcagcacttgcttggactatacgac

SEQ ID NO: 676004 - DNA, 25 bp, Mus musculus
gcagcagaaaacagctgaaaccgaa

SEQ ID NO: 676005 - DNA, 25 bp, Mus musculus
gcagcagaaaactgctgaaaccgaa

SEQ ID NO: 676006 - DNA, 25 bp, Mus musculus
gcagcagaaaagcagaaacgtgcca

SEQ ID NO: 676007 - DNA, 25 bp, Mus musculus
gcagcagaaaaggagaaacgtgcca

SEQ ID NO: 676008 - DNA, 25 bp, Mus musculus
gcagcagaactgaacttaactcaaa

SEQ ID NO: 676009 - DNA, 25 bp, Mus musculus
gcagcagaactgtacttaactcaaa

SEQ ID NO: 676010 - DNA, 25 bp, Mus musculus
gcagcagaagaaccctttgtaaacg

SEQ ID NO: 676011 - DNA, 25 bp, Mus musculus
gcagcagaagaagcctttgtaaacg

SEQ ID NO: 676012 - DNA, 25 bp, Mus musculus
gcagcagacaaacaggtgttcagtt

SEQ ID NO: 676013 - DNA, 25 bp, Mus musculus
gcagcagacaaagaggtgttcagtt

SEQ ID NO: 676014 - DNA, 25 bp, Mus musculus
gcagcagacagacattctgtgattc

SEQ ID NO: 676015 - DNA, 25 bp, Mus musculus
gcagcagacagagattctgtgattc

SEQ ID NO: 676016 - DNA, 25 bp, Mus musculus
gcagcagacccaccggagtgccttg

SEQ ID NO: 676017 - DNA, 25 bp, Mus musculus
gcagcagacccagcggagtgccttg

SEQ ID NO: 676018 - DNA, 25 bp, Mus musculus
gcagcagacctccagcgatttaaaa

SEQ ID NO: 676019 - DNA, 25 bp, Mus musculus
gcagcagacctcgagcgatttaaaa

SEQ ID NO: 676020 - DNA, 25 bp, Mus musculus
gcagcagagaagacaataccgacgg

SEQ ID NO: 676021 - DNA, 25 bp, Mus musculus
gcagcagagaagtcaataccgacgg

SEQ ID NO: 676022 - DNA, 25 bp, Mus musculus
gcagcagagccccattttggaaccc

SEQ ID NO: 676023 - DNA, 25 bp, Mus musculus
gcagcagagcccgattttggaaccc

SEQ ID NO: 676024 - DNA, 25 bp, Mus musculus
gcagcagagcctcatattatatcaa

SEQ ID NO: 676025 - DNA, 25 bp, Mus musculus
gcagcagagcctgatattatatcaa

SEQ ID NO: 676026 - DNA, 25 bp, Mus musculus
gcagcagatctgagtcacattgaga

SEQ ID NO: 676027 - DNA, 25 bp, Mus musculus
gcagcagatctgtgtcacattgaga

SEQ ID NO: 676028 - DNA, 25 bp, Mus musculus
gcagcagatggcacgagaatacaga

SEQ ID NO: 676029 - DNA, 25 bp, Mus musculus
gcagcagatggctcgagaatacaga

SEQ ID NO: 676030 - DNA, 25 bp, Mus musculus
gcagcagatgtacgctcatcagtat

SEQ ID NO: 676031 - DNA, 25 bp, Mus musculus
gcagcagatgtaggctcatcagtat

SEQ ID NO: 676032 - DNA, 25 bp, Mus musculus
gcagcagattgcctgaaacatccag

SEQ ID NO: 676033 - DNA, 25 bp, Mus musculus
gcagcagattgcgtgaaacatccag

SEQ ID NO: 676034 - DNA, 25 bp, Mus musculus
gcagcagcaaatcctattgagtctc

SEQ ID NO: 676035 - DNA, 25 bp, Mus musculus
gcagcagcaaatgctattgagtctc

SEQ ID NO: 676036 - DNA, 25 bp, Mus musculus
gcagcagcaacccaacgacaaaact

SEQ ID NO: 676037 - DNA, 25 bp, Mus musculus
gcagcagcaaccgaacgacaaaact

SEQ ID NO: 676038 - DNA, 25 bp, Mus musculus
gcagcagcaatgactctgcgcacgg

SEQ ID NO: 676039 - DNA, 25 bp, Mus musculus
gcagcagcaatgtctctgcgcacgg

SEQ ID NO: 676040 - DNA, 25 bp, Mus musculus
gcagcagcaattaccatatcagtgt

SEQ ID NO: 676041 - DNA, 25 bp, Mus musculus
gcagcagcaatttccatatcagtgt

SEQ ID NO: 676042 - DNA, 25 bp, Mus musculus
gcagcagcagaacacatcgtaccaa

SEQ ID NO: 676043 - DNA, 25 bp, Mus musculus
gcagcagcagaagacatcgtaccaa

SEQ ID NO: 676044 - DNA, 25 bp, Mus musculus
gcagcagcagtcatacttggattct

SEQ ID NO: 676045 - DNA, 25 bp, Mus musculus
gcagcagcagtcttacttggattct

SEQ ID NO: 676046 - DNA, 25 bp, Mus musculus
gcagcagcatgaccataaaggcctg

SEQ ID NO: 676047 - DNA, 25 bp, Mus musculus
gcagcagcatgagcataaaggcctg

SEQ ID NO: 676048 - DNA, 25 bp, Mus musculus
gcagcagccagactaaagcaaccag

SEQ ID NO: 676049 - DNA, 25 bp, Mus musculus
gcagcagccagagtaaagcaaccag

SEQ ID NO: 676050 - DNA, 25 bp, Mus musculus
gcagcagccatgcaattacctggaa

SEQ ID NO: 676051 - DNA, 25 bp, Mus musculus
gcagcagccatggaattacctggaa

SEQ ID NO: 676052 - DNA, 25 bp, Mus musculus
gcagcagcccagaaacaatctggct

SEQ ID NO: 676053 - DNA, 25 bp, Mus musculus
gcagcagcccagaaagctgtctccg

SEQ ID NO: 676054 - DNA, 25 bp, Mus musculus
gcagcagcccagtaacaatctggct

SEQ ID NO: 676055 - DNA, 25 bp, Mus musculus
gcagcagcccagtaagctgtctccg

SEQ ID NO: 676056 - DNA, 25 bp, Mus musculus
gcagcagccgcaattgtgatttgga

SEQ ID NO: 676057 - DNA, 25 bp, Mus musculus
gcagcagccgcatttgtgatttgga

SEQ ID NO: 676058 - DNA, 25 bp, Mus musculus
gcagcagccgctaggattcacagta

SEQ ID NO: 676059 - DNA, 25 bp, Mus musculus
gcagcagccgcttggattcacagta

SEQ ID NO: 676060 - DNA, 25 bp, Mus musculus
gcagcagccgtgctggatcgataca

SEQ ID NO: 676061 - DNA, 25 bp, Mus musculus
gcagcagccgtggtggatcgataca

SEQ ID NO: 676062 - DNA, 25 bp, Mus musculus
gcagcagcctcactacagcaatcaa

SEQ ID NO: 676063 - DNA, 25 bp, Mus musculus
gcagcagcctcagtacagcaatcaa

SEQ ID NO: 676064 - DNA, 25 bp, Mus musculus
gcagcagcctctcttcttcgggatg

SEQ ID NO: 676065 - DNA, 25 bp, Mus musculus
gcagcagcctctgttcttcgggatg

SEQ ID NO: 676066 - DNA, 25 bp, Mus musculus
gcagcagccttaacaagcacctgcg

SEQ ID NO: 676067 - DNA, 25 bp, Mus musculus
gcagcagccttatcaagcacctgcg

SEQ ID NO: 676068 - DNA, 25 bp, Mus musculus
gcagcagcgacacccctgtggattt

SEQ ID NO: 676069 - DNA, 25 bp, Mus musculus
gcagcagcgacagccctgtggattt

SEQ ID NO: 676070 - DNA, 25 bp, Mus musculus
gcagcagcgagtacttctgtcgtga

SEQ ID NO: 676071 - DNA, 25 bp, Mus musculus
gcagcagcgagttcttctgtcgtga

SEQ ID NO: 676072 - DNA, 25 bp, Mus musculus
gcagcagcggatcctggagcttatc

SEQ ID NO: 676073 - DNA, 25 bp, Mus musculus
gcagcagcggatgctggagcttatc

SEQ ID NO: 676074 - DNA, 25 bp, Mus musculus
gcagcagctagcacaggagatcaag

SEQ ID NO: 676075 - DNA, 25 bp, Mus musculus
gcagcagctagctcaggagatcaag

SEQ ID NO: 676076 - DNA, 25 bp, Mus musculus
gcagcagctcttagccaacgcggat

SEQ ID NO: 676077 - DNA, 25 bp, Mus musculus
gcagcagctctttgccaacgcggat

SEQ ID NO: 676078 - DNA, 25 bp, Mus musculus
gcagcagctgctcagcgaatggaaa

SEQ ID NO: 676079 - DNA, 25 bp, Mus musculus
gcagcagctgctgagcgaatggaaa

SEQ ID NO: 676080 - DNA, 25 bp, Mus musculus
gcagcagctggcacgagacctgctt

SEQ ID NO: 676081 - DNA, 25 bp, Mus musculus
gcagcagctggctcgagacctgctt

SEQ ID NO: 676082 - DNA, 25 bp, Mus musculus
gcagcagctgttcgatgccgagcct

SEQ ID NO: 676083 - DNA, 25 bp, Mus musculus
gcagcagctgttggatgccgagcct

SEQ ID NO: 676084 - DNA, 25 bp, Mus musculus
gcagcagcttatacatgtgatggag

SEQ ID NO: 676085 - DNA, 25 bp, Mus musculus
gcagcagcttattcatgtgatggag

SEQ ID NO: 676086 - DNA, 25 bp, Mus musculus
gcagcagcttcgccgccgacggttt

SEQ ID NO: 676087 - DNA, 25 bp, Mus musculus
gcagcagcttcggcgccgacggttt

SEQ ID NO: 676088 - DNA, 25 bp, Mus musculus
gcagcaggaagcagcttcaagctgt

SEQ ID NO: 676089 - DNA, 25 bp, Mus musculus
gcagcaggaagctgcttcaagctgt

SEQ ID NO: 676090 - DNA, 25 bp, Mus musculus
gcagcaggaattcaaggatcgatct

SEQ ID NO: 676091 - DNA, 25 bp, Mus musculus
gcagcaggaattgaaggatcgatct

SEQ ID NO: 676092 - DNA, 25 bp, Mus musculus
gcagcaggatgaagtgcagccaccc

SEQ ID NO: 676093 - DNA, 25 bp, Mus musculus
gcagcaggatgatgtgcagccaccc

SEQ ID NO: 676094 - DNA, 25 bp, Mus musculus
gcagcaggatttctccattggctcc

SEQ ID NO: 676095 - DNA, 25 bp, Mus musculus
gcagcaggatttgtccattggctcc

SEQ ID NO: 676096 - DNA, 25 bp, Mus musculus
gcagcaggccaccatgcagaaggct

SEQ ID NO: 676097 - DNA, 25 bp, Mus musculus
gcagcaggccacgatgcagaaggct

SEQ ID NO: 676098 - DNA, 25 bp, Mus musculus
gcagcaggccttctcctttgaggaa

SEQ ID NO: 676099 - DNA, 25 bp, Mus musculus
gcagcaggccttgtcctttgaggaa

SEQ ID NO: 676100 - DNA, 25 bp, Mus musculus
gcagcaggcgcgcagcttcgggaat

SEQ ID NO: 676101 - DNA, 25 bp, Mus musculus
gcagcaggcgcggagcttcgggaat

SEQ ID NO: 676102 - DNA, 25 bp, Mus musculus
gcagcaggctctagccgctcagcta

SEQ ID NO: 676103 - DNA, 25 bp, Mus musculus
gcagcaggctcttgccgctcagcta

SEQ ID NO: 676104 - DNA, 25 bp, Mus musculus
gcagcaggtcctccttgaactgatt

SEQ ID NO: 676105 - DNA, 25 bp, Mus musculus
gcagcaggtcctgcttgaactgatt

SEQ ID NO: 676106 - DNA, 25 bp, Mus musculus
gcagcaggtgcacttatacatgaca

SEQ ID NO: 676107 - DNA, 25 bp, Mus musculus
gcagcaggtgcagttatacatgaca

SEQ ID NO: 676108 - DNA, 25 bp, Mus musculus
gcagcaggttctcagagccaaccag

SEQ ID NO: 676109 - DNA, 25 bp, Mus musculus
gcagcaggttctgagagccaaccag

SEQ ID NO: 676110 - DNA, 25 bp, Mus musculus
gcagcagtagtcagcccttgcctga

SEQ ID NO: 676111 - DNA, 25 bp, Mus musculus
gcagcagtagtctgcccttgcctga

SEQ ID NO: 676112 - DNA, 25 bp, Mus musculus
gcagcagtagtgcagccccagaccg

SEQ ID NO: 676113 - DNA, 25 bp, Mus musculus
gcagcagtagtggagccccagaccg

SEQ ID NO: 676114 - DNA, 25 bp, Mus musculus
gcagcagtcagaccagccatacaag

SEQ ID NO: 676115 - DNA, 25 bp, Mus musculus
gcagcagtcagagcagccatacaag

SEQ ID NO: 676116 - DNA, 25 bp, Mus musculus
gcagcagtcattcaggcaatgggca

SEQ ID NO: 676117 - DNA, 25 bp, Mus musculus
gcagcagtcattgaggcaatgggca

SEQ ID NO: 676118 - DNA, 25 bp, Mus musculus
gcagcagtcggcaaataattttaaa

SEQ ID NO: 676119 - DNA, 25 bp, Mus musculus
gcagcagtcggctaataattttaaa

SEQ ID NO: 676120 - DNA, 25 bp, Mus musculus
gcagcagtctctctgagtggcatat

SEQ ID NO: 676121 - DNA, 25 bp, Mus musculus
gcagcagtctctgtgagtggcatat

SEQ ID NO: 676122 - DNA, 25 bp, Mus musculus
gcagcagtgaagagatgcgccccat

SEQ ID NO: 676123 - DNA, 25 bp, Mus musculus
gcagcagtgaagtgatgcgccccat

SEQ ID NO: 676124 - DNA, 25 bp, Mus musculus
gcagcagtgggcacccctcgagaga

SEQ ID NO: 676125 - DNA, 25 bp, Mus musculus
gcagcagtgggctcccctcgagaga

SEQ ID NO: 676126 - DNA, 25 bp, Mus musculus
gcagcagttgccaggagtgccatga

SEQ ID NO: 676127 - DNA, 25 bp, Mus musculus
gcagcagttgccaggttggtccacc

SEQ ID NO: 676128 - DNA, 25 bp, Mus musculus
gcagcagttgcctggagtgccatga

SEQ ID NO: 676129 - DNA, 25 bp, Mus musculus
gcagcagttgcctggttggtccacc

SEQ ID NO: 676130 - DNA, 25 bp, Mus musculus
gcagcatcaccaacgactcggctgt

SEQ ID NO: 676131 - DNA, 25 bp, Mus musculus
gcagcatcaccatcgactcggctgt

SEQ ID NO: 676132 - DNA, 25 bp, Mus musculus
gcagcatcataacagcgtgatggag

SEQ ID NO: 676133 - DNA, 25 bp, Mus musculus
gcagcatcataagagcgtgatggag

SEQ ID NO: 676134 - DNA, 25 bp, Mus musculus
gcagcatcattgacggccgctttcg

SEQ ID NO: 676135 - DNA, 25 bp, Mus musculus
gcagcatcattgtcggccgctttcg

SEQ ID NO: 676136 - DNA, 25 bp, Mus musculus
gcagcatccagcaatgatccagcag

SEQ ID NO: 676137 - DNA, 25 bp, Mus musculus
gcagcatccagctatgatccagcag

SEQ ID NO: 676138 - DNA, 25 bp, Mus musculus
gcagcatccagtcatgtgcgggaca

SEQ ID NO: 676139 - DNA, 25 bp, Mus musculus
gcagcatccagtgatgtgcgggaca

SEQ ID NO: 676140 - DNA, 25 bp, Mus musculus
gcagcatccatacccatggagaagc

SEQ ID NO: 676141 - DNA, 25 bp, Mus musculus
gcagcatccatagccatggagaagc

SEQ ID NO: 676142 - DNA, 25 bp, Mus musculus
gcagcatccatccagaatgtcgctt

SEQ ID NO: 676143 - DNA, 25 bp, Mus musculus
gcagcatccatcgagaatgtcgctt

SEQ ID NO: 676144 - DNA, 25 bp, Mus musculus
gcagcatccgttctcccttatggcg

SEQ ID NO: 676145 - DNA, 25 bp, Mus musculus
gcagcatccgttgtcccttatggcg

SEQ ID NO: 676146 - DNA, 25 bp, Mus musculus
gcagcatcctcaaggcccacatggt

SEQ ID NO: 676147 - DNA, 25 bp, Mus musculus
gcagcatcctcatggcccacatggt

SEQ ID NO: 676148 - DNA, 25 bp, Mus musculus
gcagcatcgacaaggtggactcacc

SEQ ID NO: 676149 - DNA, 25 bp, Mus musculus
gcagcatcgacatggtggactcacc

SEQ ID NO: 676150 - DNA, 25 bp, Mus musculus
gcagcatctagccaggcagttcaag

SEQ ID NO: 676151 - DNA, 25 bp, Mus musculus
gcagcatctagcgaggcagttcaag

SEQ ID NO: 676152 - DNA, 25 bp, Mus musculus
gcagcatcttgcaggatgagaagca

SEQ ID NO: 676153 - DNA, 25 bp, Mus musculus
gcagcatcttgctggatgagaagca

SEQ ID NO: 676154 - DNA, 25 bp, Mus musculus
gcagcatctttgatcagagtaggaa

SEQ ID NO: 676155 - DNA, 25 bp, Mus musculus
gcagcatctttgttcagagtaggaa

SEQ ID NO: 676156 - DNA, 25 bp, Mus musculus
gcagcatgaggacaataagtacttc

SEQ ID NO: 676157 - DNA, 25 bp, Mus musculus
gcagcatgaggagaataagtacttc

SEQ ID NO: 676158 - DNA, 25 bp, Mus musculus
gcagcatgcctaaatttgggaccac

SEQ ID NO: 676159 - DNA, 25 bp, Mus musculus
gcagcatgcctatatttgggaccac

SEQ ID NO: 676160 - DNA, 25 bp, Mus musculus
gcagcatggcaacgccatcttcatc

SEQ ID NO: 676161 - DNA, 25 bp, Mus musculus
gcagcatggcaaggccatcttcatc

SEQ ID NO: 676162 - DNA, 25 bp, Mus musculus
gcagcatgggctactgtccccagtc

SEQ ID NO: 676163 - DNA, 25 bp, Mus musculus
gcagcatgggctatgatgacctcga

SEQ ID NO: 676164 - DNA, 25 bp, Mus musculus
gcagcatgggcttctgtccccagtc

SEQ ID NO: 676165 - DNA, 25 bp, Mus musculus
gcagcatgggctttgatgacctcga

SEQ ID NO: 676166 - DNA, 25 bp, Mus musculus
gcagcattggcaatcctattgctgt

SEQ ID NO: 676167 - DNA, 25 bp, Mus musculus
gcagcattggcattcctattgctgt

SEQ ID NO: 676168 - DNA, 25 bp, Mus musculus
gcagcatttcatcggacggccttga

SEQ ID NO: 676169 - DNA, 25 bp, Mus musculus
gcagcatttcatgggacggccttga

SEQ ID NO: 676170 - DNA, 25 bp, Mus musculus
gcagcatttcgcctgcctcctgggt

SEQ ID NO: 676171 - DNA, 25 bp, Mus musculus
gcagcatttcgcgtgcctcctgggt

SEQ ID NO: 676172 - DNA, 25 bp, Mus musculus
gcagcatttgttatgagatccatca

SEQ ID NO: 676173 - DNA, 25 bp, Mus musculus
gcagcatttgttttgagatccatca

SEQ ID NO: 676174 - DNA, 25 bp, Mus musculus
gcagccaagcgcatcgacctttatg

SEQ ID NO: 676175 - DNA, 25 bp, Mus musculus
gcagccaagcgcttcgacctttatg

SEQ ID NO: 676176 - DNA, 25 bp, Mus musculus
gcagccaagctaatccacacactgg

SEQ ID NO: 676177 - DNA, 25 bp, Mus musculus
gcagccaagctattccacacactgg

SEQ ID NO: 676178 - DNA, 25 bp, Mus musculus
gcagccacaagtctggaaggacaaa

SEQ ID NO: 676179 - DNA, 25 bp, Mus musculus
gcagccacaagtgtggaaggacaaa

SEQ ID NO: 676180 - DNA, 25 bp, Mus musculus
gcagccacagacaccagcagaaaac

SEQ ID NO: 676181 - DNA, 25 bp, Mus musculus
gcagccacagactccagcagaaaac

SEQ ID NO: 676182 - DNA, 25 bp, Mus musculus
gcagccacatggaatgaggttcctg

SEQ ID NO: 676183 - DNA, 25 bp, Mus musculus
gcagccacatggtatgaggttcctg

SEQ ID NO: 676184 - DNA, 25 bp, Mus musculus
gcagccacgtccattgatttttaat

SEQ ID NO: 676185 - DNA, 25 bp, Mus musculus
gcagccacgtcctttgatttttaat

SEQ ID NO: 676186 - DNA, 25 bp, Mus musculus
gcagccacttcacggctcaacagtt

SEQ ID NO: 676187 - DNA, 25 bp, Mus musculus
gcagccacttcagggctcaacagtt

SEQ ID NO: 676188 - DNA, 25 bp, Mus musculus
gcagccagagacaagtatcagctag

SEQ ID NO: 676189 - DNA, 25 bp, Mus musculus
gcagccagagactagtatcagctag

SEQ ID NO: 676190 - DNA, 25 bp, Mus musculus
gcagccagatatcctcagtgttgga

SEQ ID NO: 676191 - DNA, 25 bp, Mus musculus
gcagccagatatgctcagtgttgga

SEQ ID NO: 676192 - DNA, 25 bp, Mus musculus
gcagccagcagaaaatgttaatcag

SEQ ID NO: 676193 - DNA, 25 bp, Mus musculus
gcagccagcagataatgttaatcag

SEQ ID NO: 676194 - DNA, 25 bp, Mus musculus
gcagccagcagtccagaggtgttaa

SEQ ID NO: 676195 - DNA, 25 bp, Mus musculus
gcagccagcagtgcagaggtgttaa

SEQ ID NO: 676196 - DNA, 25 bp, Mus musculus
gcagccagcctgataggtcccacgt

SEQ ID NO: 676197 - DNA, 25 bp, Mus musculus
gcagccagcctgttaggtcccacgt

SEQ ID NO: 676198 - DNA, 25 bp, Mus musculus
gcagccagcgctcctgttgtagctg

SEQ ID NO: 676199 - DNA, 25 bp, Mus musculus
gcagccagcgctgctgttgtagctg

SEQ ID NO: 676200 - DNA, 25 bp, Mus musculus
gcagccagctcccttaggaatgaca

SEQ ID NO: 676201 - DNA, 25 bp, Mus musculus
gcagccagctccgttaggaatgaca

SEQ ID NO: 676202 - DNA, 25 bp, Mus musculus
gcagccagctgcactccctttatga

SEQ ID NO: 676203 - DNA, 25 bp, Mus musculus
gcagccagctgctctccctttatga

SEQ ID NO: 676204 - DNA, 25 bp, Mus musculus
gcagccaggagcagtgaaagtccca

SEQ ID NO: 676205 - DNA, 25 bp, Mus musculus
gcagccaggagctgtgaaagtccca

SEQ ID NO: 676206 - DNA, 25 bp, Mus musculus
gcagccaggccaagcgcaagttgca

SEQ ID NO: 676207 - DNA, 25 bp, Mus musculus
gcagccaggccatgcgcaagttgca

SEQ ID NO: 676208 - DNA, 25 bp, Mus musculus
gcagccagtgccatccaggaacttg

SEQ ID NO: 676209 - DNA, 25 bp, Mus musculus
gcagccagtgccttccaggaacttg

SEQ ID NO: 676210 - DNA, 25 bp, Mus musculus
gcagccagtggaccgtcatgctact

SEQ ID NO: 676211 - DNA, 25 bp, Mus musculus
gcagccagtggagcgtcatgctact

SEQ ID NO: 676212 - DNA, 25 bp, Mus musculus
gcagccagttttagcctgttttaga

SEQ ID NO: 676213 - DNA, 25 bp, Mus musculus
gcagccagtttttgcctgttttaga

SEQ ID NO: 676214 - DNA, 25 bp, Mus musculus
gcagccatacctacaactgtcgcat

SEQ ID NO: 676215 - DNA, 25 bp, Mus musculus
gcagccataccttcaactgtcgcat

SEQ ID NO: 676216 - DNA, 25 bp, Mus musculus
gcagccatcgcaagcctgctgtgta

SEQ ID NO: 676217 - DNA, 25 bp, Mus musculus
gcagccatcgcatgcctgctgtgta

SEQ ID NO: 676218 - DNA, 25 bp, Mus musculus
gcagccatgagaactgaggccacag

SEQ ID NO: 676219 - DNA, 25 bp, Mus musculus
gcagccatgagatctgaggccacag

SEQ ID NO: 676220 - DNA, 25 bp, Mus musculus
gcagccattaaacatgcccttagcg

SEQ ID NO: 676221 - DNA, 25 bp, Mus musculus
gcagccattaaagatgcccttagcg

SEQ ID NO: 676222 - DNA, 25 bp, Mus musculus
gcagccattcatatgatgatagcac

SEQ ID NO: 676223 - DNA, 25 bp, Mus musculus
gcagccattcatttgatgatagcac

SEQ ID NO: 676224 - DNA, 25 bp, Mus musculus
gcagccattgtgctagctgtcatta

SEQ ID NO: 676225 - DNA, 25 bp, Mus musculus
gcagccattgtggtagctgtcatta

SEQ ID NO: 676226 - DNA, 25 bp, Mus musculus
gcagcccacaggcagcacatgtgaa

SEQ ID NO: 676227 - DNA, 25 bp, Mus musculus
gcagcccacagggagcacatgtgaa

SEQ ID NO: 676228 - DNA, 25 bp, Mus musculus
gcagcccactgtaaatcttggccag

SEQ ID NO: 676229 - DNA, 25 bp, Mus musculus
gcagcccactgttaatcttggccag

SEQ ID NO: 676230 - DNA, 25 bp, Mus musculus
gcagcccagggaatagaagaccatt

SEQ ID NO: 676231 - DNA, 25 bp, Mus musculus
gcagcccagggattagaagaccatt

SEQ ID NO: 676232 - DNA, 25 bp, Mus musculus
gcagcccatggcagcaaacctaatg

SEQ ID NO: 676233 - DNA, 25 bp, Mus musculus
gcagcccatggctgcaaacctaatg

SEQ ID NO: 676234 - DNA, 25 bp, Mus musculus
gcagcccatgtcagaacggaggcac

SEQ ID NO: 676235 - DNA, 25 bp, Mus musculus
gcagcccatgtctgaacggaggcac

SEQ ID NO: 676236 - DNA, 25 bp, Mus musculus
gcagcccattggaaccaagagcttc

SEQ ID NO: 676237 - DNA, 25 bp, Mus musculus
gcagcccattggtaccaagagcttc

SEQ ID NO: 676238 - DNA, 25 bp, Mus musculus
gcagccccagagctcattacacatg

SEQ ID NO: 676239 - DNA, 25 bp, Mus musculus
gcagccccagaggtcattacacatg

SEQ ID NO: 676240 - DNA, 25 bp, Mus musculus
gcagccccgagaagtgtgtctctgt

SEQ ID NO: 676241 - DNA, 25 bp, Mus musculus
gcagccccgagatgtgtgtctctgt

SEQ ID NO: 676242 - DNA, 25 bp, Mus musculus
gcagcccctacccaggacactcagc

SEQ ID NO: 676243 - DNA, 25 bp, Mus musculus
gcagcccctaccgaggacactcagc

SEQ ID NO: 676244 - DNA, 25 bp, Mus musculus
gcagccccttggaggcggccttgac

SEQ ID NO: 676245 - DNA, 25 bp, Mus musculus
gcagccccttggtggcggccttgac

SEQ ID NO: 676246 - DNA, 25 bp, Mus musculus
gcagcccgacatccagcttgaacat

SEQ ID NO: 676247 - DNA, 25 bp, Mus musculus
gcagcccgacatgcagcttgaacat

SEQ ID NO: 676248 - DNA, 25 bp, Mus musculus
gcagcccgcaagcattcccagaata

SEQ ID NO: 676249 - DNA, 25 bp, Mus musculus
gcagcccgcaaggattcccagaata

SEQ ID NO: 676250 - DNA, 25 bp, Mus musculus
gcagcccgcagaattaaaggaaaag

SEQ ID NO: 676251 - DNA, 25 bp, Mus musculus
gcagcccgcagatttaaaggaaaag

SEQ ID NO: 676252 - DNA, 25 bp, Mus musculus
gcagcccgggaacctaatggctttc

SEQ ID NO: 676253 - DNA, 25 bp, Mus musculus
gcagcccgggaagctaatggctttc

SEQ ID NO: 676254 - DNA, 25 bp, Mus musculus
gcagcccgggaccttgctgtcttct

SEQ ID NO: 676255 - DNA, 25 bp, Mus musculus
gcagcccgggacgttgctgtcttct

SEQ ID NO: 676256 - DNA, 25 bp, Mus musculus
gcagcccgggctagggccattcgct

SEQ ID NO: 676257 - DNA, 25 bp, Mus musculus
gcagcccgggcttgggccattcgct

SEQ ID NO: 676258 - DNA, 25 bp, Mus musculus
gcagccctacgaacagagctgagag

SEQ ID NO: 676259 - DNA, 25 bp, Mus musculus
gcagccctacgatcagagctgagag

SEQ ID NO: 676260 - DNA, 25 bp, Mus musculus
gcagccctacgtcgttgtgtccaac

SEQ ID NO: 676261 - DNA, 25 bp, Mus musculus
gcagccctacgtggttgtgtccaac

SEQ ID NO: 676262 - DNA, 25 bp, Mus musculus
gcagccctcaggagatgatgcggcc

SEQ ID NO: 676263 - DNA, 25 bp, Mus musculus
gcagccctcaggtgatgatgcggcc

SEQ ID NO: 676264 - DNA, 25 bp, Mus musculus
gcagccctgctgatattgatgcttc

SEQ ID NO: 676265 - DNA, 25 bp, Mus musculus
gcagccctgctgttattgatgcttc

SEQ ID NO: 676266 - DNA, 25 bp, Mus musculus
gcagccctgcttcctgcatggaact

SEQ ID NO: 676267 - DNA, 25 bp, Mus musculus
gcagccctgcttgctgcatggaact

SEQ ID NO: 676268 - DNA, 25 bp, Mus musculus
gcagccctggcacaaggaatgcttt

SEQ ID NO: 676269 - DNA, 25 bp, Mus musculus
gcagccctggcagaaggaatgcttt

SEQ ID NO: 676270 - DNA, 25 bp, Mus musculus
gcagcccttttccagggcagaacag

SEQ ID NO: 676271 - DNA, 25 bp, Mus musculus
gcagcccttttcgagggcagaacag

SEQ ID NO: 676272 - DNA, 25 bp, Mus musculus
gcagccgacaaaagacctgtttgag

SEQ ID NO: 676273 - DNA, 25 bp, Mus musculus
gcagccgacaaatgacctgtttgag

SEQ ID NO: 676274 - DNA, 25 bp, Mus musculus
gcagccgacctaattctgaaggact

SEQ ID NO: 676275 - DNA, 25 bp, Mus musculus
gcagccgacctatttctgaaggact

SEQ ID NO: 676276 - DNA, 25 bp, Mus musculus
gcagccgccgcccacttgtgaatgg

SEQ ID NO: 676277 - DNA, 25 bp, Mus musculus
gcagccgccgccgacttgtgaatgg

SEQ ID NO: 676278 - DNA, 25 bp, Mus musculus
gcagccgcctacagaaaacatatcg

SEQ ID NO: 676279 - DNA, 25 bp, Mus musculus
gcagccgcctactgaaaacatatcg

SEQ ID NO: 676280 - DNA, 25 bp, Mus musculus
gcagccgcctttagagatctactta

SEQ ID NO: 676281 - DNA, 25 bp, Mus musculus
gcagccgccttttgagatctactta

SEQ ID NO: 676282 - DNA, 25 bp, Mus musculus
gcagccgctctcagaacaaactggc

SEQ ID NO: 676283 - DNA, 25 bp, Mus musculus
gcagccgctctctgaacaaactggc

SEQ ID NO: 676284 - DNA, 25 bp, Mus musculus
gcagccgctgagacagttgtgccaa

SEQ ID NO: 676285 - DNA, 25 bp, Mus musculus
gcagccgctgagtcagttgtgccaa

SEQ ID NO: 676286 - DNA, 25 bp, Mus musculus
gcagccgcttagattaccagaagga

SEQ ID NO: 676287 - DNA, 25 bp, Mus musculus
gcagccgcttagtttaccagaagga

SEQ ID NO: 676288 - DNA, 25 bp, Mus musculus
gcagccggcaggcatttatctccaa

SEQ ID NO: 676289 - DNA, 25 bp, Mus musculus
gcagccggcagggatttatctccaa

SEQ ID NO: 676290 - DNA, 25 bp, Mus musculus
gcagccggcttcaagcagacgactt

SEQ ID NO: 676291 - DNA, 25 bp, Mus musculus
gcagccggcttctagcagacgactt

SEQ ID NO: 676292 - DNA, 25 bp, Mus musculus
gcagccggcttgctgctctcagttt

SEQ ID NO: 676293 - DNA, 25 bp, Mus musculus
gcagccggcttggtgctctcagttt

SEQ ID NO: 676294 - DNA, 25 bp, Mus musculus
gcagccgtaccgcagagtacaaggc

SEQ ID NO: 676295 - DNA, 25 bp, Mus musculus
gcagccgtaccggagagtacaaggc

SEQ ID NO: 676296 - DNA, 25 bp, Mus musculus
gcagccgtctcacattggctttcag

SEQ ID NO: 676297 - DNA, 25 bp, Mus musculus
gcagccgtctcagattggctttcag

SEQ ID NO: 676298 - DNA, 25 bp, Mus musculus
gcagccgtttgtctagcagccactg

SEQ ID NO: 676299 - DNA, 25 bp, Mus musculus
gcagccgtttgtgtagcagccactg

SEQ ID NO: 676300 - DNA, 25 bp, Mus musculus
gcagcctacgccatcagcaagtttg

SEQ ID NO: 676301 - DNA, 25 bp, Mus musculus
gcagcctacgccttcagcaagtttg

SEQ ID NO: 676302 - DNA, 25 bp, Mus musculus
gcagcctacttgctggacagcttgt

SEQ ID NO: 676303 - DNA, 25 bp, Mus musculus
gcagcctacttggtggacagcttgt

SEQ ID NO: 676304 - DNA, 25 bp, Mus musculus
gcagcctagctgaaaacgtgtcgag

SEQ ID NO: 676305 - DNA, 25 bp, Mus musculus
gcagcctagctgtaaacgtgtcgag

SEQ ID NO: 676306 - DNA, 25 bp, Mus musculus
gcagcctatctacagttgatccaag

SEQ ID NO: 676307 - DNA, 25 bp, Mus musculus
gcagcctatctagagttgatccaag

SEQ ID NO: 676308 - DNA, 25 bp, Mus musculus
gcagcctatgagcaggacctgctac

SEQ ID NO: 676309 - DNA, 25 bp, Mus musculus
gcagcctatgaggaggacctgctac

SEQ ID NO: 676310 - DNA, 25 bp, Mus musculus
gcagcctatggcattgtgtgtgatg

SEQ ID NO: 676311 - DNA, 25 bp, Mus musculus
gcagcctatggctttgtgtgtgatg

SEQ ID NO: 676312 - DNA, 25 bp, Mus musculus
gcagcctatgtgcaaacccagagga

SEQ ID NO: 676313 - DNA, 25 bp, Mus musculus
gcagcctatgtggaaacccagagga

SEQ ID NO: 676314 - DNA, 25 bp, Mus musculus
gcagcctcaagaagcaccttcgcat

SEQ ID NO: 676315 - DNA, 25 bp, Mus musculus
gcagcctcaagatgcaccttcgcat

SEQ ID NO: 676316 - DNA, 25 bp, Mus musculus
gcagcctcaatgcagatcatccaga

SEQ ID NO: 676317 - DNA, 25 bp, Mus musculus
gcagcctcaatggagatcatccaga

SEQ ID NO: 676318 - DNA, 25 bp, Mus musculus
gcagcctcactgagcgcgagacgtt

SEQ ID NO: 676319 - DNA, 25 bp, Mus musculus
gcagcctcactgtgcgcgagacgtt

SEQ ID NO: 676320 - DNA, 25 bp, Mus musculus
gcagcctcagcccaaactacaagga

SEQ ID NO: 676321 - DNA, 25 bp, Mus musculus
gcagcctcagccgaaactacaagga

SEQ ID NO: 676322 - DNA, 25 bp, Mus musculus
gcagcctcatcgacatcgagagtgt

SEQ ID NO: 676323 - DNA, 25 bp, Mus musculus
gcagcctcatcgtcatcgagagtgt

SEQ ID NO: 676324 - DNA, 25 bp, Mus musculus
gcagcctccagcataggagaatggg

SEQ ID NO: 676325 - DNA, 25 bp, Mus musculus
gcagcctccagcttaggagaatggg

SEQ ID NO: 676326 - DNA, 25 bp, Mus musculus
gcagcctccgcccaggagttctgtt

SEQ ID NO: 676327 - DNA, 25 bp, Mus musculus
gcagcctccgccgaggagttctgtt

SEQ ID NO: 676328 - DNA, 25 bp, Mus musculus
gcagcctcggcactctggagtctat

SEQ ID NO: 676329 - DNA, 25 bp, Mus musculus
gcagcctcggcagtctggagtctat

SEQ ID NO: 676330 - DNA, 25 bp, Mus musculus
gcagcctcgtgtctttcgcaaccat

SEQ ID NO: 676331 - DNA, 25 bp, Mus musculus
gcagcctcgtgtgtttcgcaaccat

SEQ ID NO: 676332 - DNA, 25 bp, Mus musculus
gcagcctgatctctctgcacatcta

SEQ ID NO: 676333 - DNA, 25 bp, Mus musculus
gcagcctgatctgtctgcacatcta

SEQ ID NO: 676334 - DNA, 25 bp, Mus musculus
gcagcctggacaacgcatccttcta

SEQ ID NO: 676335 - DNA, 25 bp, Mus musculus
gcagcctggacatcgcatccttcta

SEQ ID NO: 676336 - DNA, 25 bp, Mus musculus
gcagcctggacgagctgcagtcctg

SEQ ID NO: 676337 - DNA, 25 bp, Mus musculus
gcagcctggacgtgctgcagtcctg

SEQ ID NO: 676338 - DNA, 25 bp, Mus musculus
gcagcctgtcctccccgtggagaag

SEQ ID NO: 676339 - DNA, 25 bp, Mus musculus
gcagcctgtcctgcccgtggagaag

SEQ ID NO: 676340 - DNA, 25 bp, Mus musculus
gcagcctgtttcacagatgaccaca

SEQ ID NO: 676341 - DNA, 25 bp, Mus musculus
gcagcctgtttctcagatgaccaca

SEQ ID NO: 676342 - DNA, 25 bp, Mus musculus
gcagccttaacaagcacctgcgcat

SEQ ID NO: 676343 - DNA, 25 bp, Mus musculus
gcagccttaacatgcacctgcgcat

SEQ ID NO: 676344 - DNA, 25 bp, Mus musculus
gcagccttcagtcttatcagtgtgg

SEQ ID NO: 676345 - DNA, 25 bp, Mus musculus
gcagccttcagtgttatcagtgtgg

SEQ ID NO: 676346 - DNA, 25 bp, Mus musculus
gcagccttcgccatgtcaacattga

SEQ ID NO: 676347 - DNA, 25 bp, Mus musculus
gcagccttcgccttgtcaacattga

SEQ ID NO: 676348 - DNA, 25 bp, Mus musculus
gcagccttcttaccaagccagtgag

SEQ ID NO: 676349 - DNA, 25 bp, Mus musculus
gcagccttcttagcaagccagtgag

SEQ ID NO: 676350 - DNA, 25 bp, Mus musculus
gcagccttgccaaacactcatggtc

SEQ ID NO: 676351 - DNA, 25 bp, Mus musculus
gcagccttgccatacactcatggtc

SEQ ID NO: 676352 - DNA, 25 bp, Mus musculus
gcagcgaaagggagatccgttctga

SEQ ID NO: 676353 - DNA, 25 bp, Mus musculus
gcagcgaaagggtgatccgttctga

SEQ ID NO: 676354 - DNA, 25 bp, Mus musculus
gcagcgaaatatcaatgagaacttt

SEQ ID NO: 676355 - DNA, 25 bp, Mus musculus
gcagcgaaatatgaatgagaacttt

SEQ ID NO: 676356 - DNA, 25 bp, Mus musculus
gcagcgaactttccagagcacccag

SEQ ID NO: 676357 - DNA, 25 bp, Mus musculus
gcagcgaactttgcagagcacccag

SEQ ID NO: 676358 - DNA, 25 bp, Mus musculus
gcagcgacaactagaatgggaacgg

SEQ ID NO: 676359 - DNA, 25 bp, Mus musculus
gcagcgacaacttgaatgggaacgg

SEQ ID NO: 676360 - DNA, 25 bp, Mus musculus
gcagcgacactccaacaagcattgt

SEQ ID NO: 676361 - DNA, 25 bp, Mus musculus
gcagcgacactcgaacaagcattgt

SEQ ID NO: 676362 - DNA, 25 bp, Mus musculus
gcagcgacccaaaggaacgctacct

SEQ ID NO: 676363 - DNA, 25 bp, Mus musculus
gcagcgacccaatggaacgctacct

SEQ ID NO: 676364 - DNA, 25 bp, Mus musculus
gcagcgacctgcatttatgccttcg

SEQ ID NO: 676365 - DNA, 25 bp, Mus musculus
gcagcgacctgcttttatgccttcg

SEQ ID NO: 676366 - DNA, 25 bp, Mus musculus
gcagcgactaaacgaggaatatcag

SEQ ID NO: 676367 - DNA, 25 bp, Mus musculus
gcagcgactaaaggaggaatatcag

SEQ ID NO: 676368 - DNA, 25 bp, Mus musculus
gcagcgactgcaatgtggtggacac

SEQ ID NO: 676369 - DNA, 25 bp, Mus musculus
gcagcgactgcattgtggtggacac

SEQ ID NO: 676370 - DNA, 25 bp, Mus musculus
gcagcgactgtaccgccagttttcc

SEQ ID NO: 676371 - DNA, 25 bp, Mus musculus
gcagcgactgtagcgccagttttcc

SEQ ID NO: 676372 - DNA, 25 bp, Mus musculus
gcagcgagactgaggcaatggctct

SEQ ID NO: 676373 - DNA, 25 bp, Mus musculus
gcagcgagactgtggcaatggctct

SEQ ID NO: 676374 - DNA, 25 bp, Mus musculus
gcagcgagaggcagaagaatcttga

SEQ ID NO: 676375 - DNA, 25 bp, Mus musculus
gcagcgagaggctgaagaatcttga

SEQ ID NO: 676376 - DNA, 25 bp, Mus musculus
gcagcgagcattagtgggcaaagta

SEQ ID NO: 676377 - DNA, 25 bp, Mus musculus
gcagcgagcatttgtgggcaaagta

SEQ ID NO: 676378 - DNA, 25 bp, Mus musculus
gcagcgagccagcagatttcaaggt

SEQ ID NO: 676379 - DNA, 25 bp, Mus musculus
gcagcgagccaggagatttcaaggt

SEQ ID NO: 676380 - DNA, 25 bp, Mus musculus
gcagcgagctaactgccaagcggta

SEQ ID NO: 676381 - DNA, 25 bp, Mus musculus
gcagcgagctaagtgccaagcggta

SEQ ID NO: 676382 - DNA, 25 bp, Mus musculus
gcagcgagtactatccgctgttcct

SEQ ID NO: 676383 - DNA, 25 bp, Mus musculus
gcagcgagtactttccgctgttcct

SEQ ID NO: 676384 - DNA, 25 bp, Mus musculus
gcagcgagttgtccggagagcggca

SEQ ID NO: 676385 - DNA, 25 bp, Mus musculus
gcagcgagttgtgcggagagcggca

SEQ ID NO: 676386 - DNA, 25 bp, Mus musculus
gcagcgattatgaccgttcccggga

SEQ ID NO: 676387 - DNA, 25 bp, Mus musculus
gcagcgattatgtccgttcccggga

SEQ ID NO: 676388 - DNA, 25 bp, Mus musculus
gcagcgccgtttccgactggaacgt

SEQ ID NO: 676389 - DNA, 25 bp, Mus musculus
gcagcgccgtttgcgactggaacgt

SEQ ID NO: 676390 - DNA, 25 bp, Mus musculus
gcagcgcctcttcacctacatggta

SEQ ID NO: 676391 - DNA, 25 bp, Mus musculus
gcagcgcctcttgacctacatggta

SEQ ID NO: 676392 - DNA, 25 bp, Mus musculus
gcagcgcgactgaagcagaaagagc

SEQ ID NO: 676393 - DNA, 25 bp, Mus musculus
gcagcgcgactgtagcagaaagagc

SEQ ID NO: 676394 - DNA, 25 bp, Mus musculus
gcagcgctacgcctctaatgcagtg

SEQ ID NO: 676395 - DNA, 25 bp, Mus musculus
gcagcgctacgcgtctaatgcagtg

SEQ ID NO: 676396 - DNA, 25 bp, Mus musculus
gcagcgctcaccactgaatgacttc

SEQ ID NO: 676397 - DNA, 25 bp, Mus musculus
gcagcgctcacctctgaatgacttc

SEQ ID NO: 676398 - DNA, 25 bp, Mus musculus
gcagcgctgccgagatcatggctgt

SEQ ID NO: 676399 - DNA, 25 bp, Mus musculus
gcagcgctgccgtgatcatggctgt

SEQ ID NO: 676400 - DNA, 25 bp, Mus musculus
gcagcgctgtcgacaagctgcagca

SEQ ID NO: 676401 - DNA, 25 bp, Mus musculus
gcagcgctgtcgacctgcaggacct

SEQ ID NO: 676402 - DNA, 25 bp, Mus musculus
gcagcgctgtcgtcaagctgcagca

SEQ ID NO: 676403 - DNA, 25 bp, Mus musculus
gcagcgctgtcgtcctgcaggacct

SEQ ID NO: 676404 - DNA, 25 bp, Mus musculus
gcagcgctgtgaactaaatcggcat

SEQ ID NO: 676405 - DNA, 25 bp, Mus musculus
gcagcgctgtgatctaaatcggcat

SEQ ID NO: 676406 - DNA, 25 bp, Mus musculus
gcagcgctgtgtcaacagcaccagc

SEQ ID NO: 676407 - DNA, 25 bp, Mus musculus
gcagcgctgtgtgaacagcaccagc

SEQ ID NO: 676408 - DNA, 25 bp, Mus musculus
gcagcgcttgctctgaaggctccag

SEQ ID NO: 676409 - DNA, 25 bp, Mus musculus
gcagcgcttgctgtgaaggctccag

SEQ ID NO: 676410 - DNA, 25 bp, Mus musculus
gcagcggaaactctcagcaagctat

SEQ ID NO: 676411 - DNA, 25 bp, Mus musculus
gcagcggaaactgtcagcaagctat

SEQ ID NO: 676412 - DNA, 25 bp, Mus musculus
gcagcggaaagcacacatggctgtt

SEQ ID NO: 676413 - DNA, 25 bp, Mus musculus
gcagcggaaagctcacatggctgtt

SEQ ID NO: 676414 - DNA, 25 bp, Mus musculus
gcagcggaatccaatttctctccag

SEQ ID NO: 676415 - DNA, 25 bp, Mus musculus
gcagcggaatcctatttctctccag

SEQ ID NO: 676416 - DNA, 25 bp, Mus musculus
gcagcggaggaactctggtatcact

SEQ ID NO: 676417 - DNA, 25 bp, Mus musculus
gcagcggaggaagtctggtatcact

SEQ ID NO: 676418 - DNA, 25 bp, Mus musculus
gcagcggcaaccatgtctcattcgt

SEQ ID NO: 676419 - DNA, 25 bp, Mus musculus
gcagcggcaaccttgtctcattcgt

SEQ ID NO: 676420 - DNA, 25 bp, Mus musculus
gcagcggcagtgctgggagccagca

SEQ ID NO: 676421 - DNA, 25 bp, Mus musculus
gcagcggcagtggtgggagccagca

SEQ ID NO: 676422 - DNA, 25 bp, Mus musculus
gcagcggccctcaacagagcaactt

SEQ ID NO: 676423 - DNA, 25 bp, Mus musculus
gcagcggccctctacagagcaactt

SEQ ID NO: 676424 - DNA, 25 bp, Mus musculus
gcagcggcctgcatgctcgggaact

SEQ ID NO: 676425 - DNA, 25 bp, Mus musculus
gcagcggcctgcttgctcgggaact

SEQ ID NO: 676426 - DNA, 25 bp, Mus musculus
gcagcggctacgagtttgactacga

SEQ ID NO: 676427 - DNA, 25 bp, Mus musculus
gcagcggctacgtgtttgactacga

SEQ ID NO: 676428 - DNA, 25 bp, Mus musculus
gcagcggctcatctacagtggcaag

SEQ ID NO: 676429 - DNA, 25 bp, Mus musculus
gcagcggctcatgtacagtggcaag

SEQ ID NO: 676430 - DNA, 25 bp, Mus musculus
gcagcggctgacaaggagtgaccaa

SEQ ID NO: 676431 - DNA, 25 bp, Mus musculus
gcagcggctgactaggagtgaccaa

SEQ ID NO: 676432 - DNA, 25 bp, Mus musculus
gcagcggcttaaccaagagcagaag

SEQ ID NO: 676433 - DNA, 25 bp, Mus musculus
gcagcggcttaagcaagagcagaag

SEQ ID NO: 676434 - DNA, 25 bp, Mus musculus
gcagcgggaacaaggctctaaaacg

SEQ ID NO: 676435 - DNA, 25 bp, Mus musculus
gcagcgggaacatggctctaaaacg

SEQ ID NO: 676436 - DNA, 25 bp, Mus musculus
gcagcgggagctacgcaagtatacc

SEQ ID NO: 676437 - DNA, 25 bp, Mus musculus
gcagcgggagcttcgcaagtatacc

SEQ ID NO: 676438 - DNA, 25 bp, Mus musculus
gcagcgggcactcgctatcatgtgc

SEQ ID NO: 676439 - DNA, 25 bp, Mus musculus
gcagcgggcactggctatcatgtgc

SEQ ID NO: 676440 - DNA, 25 bp, Mus musculus
gcagcggtgtctcggacaacatcac

SEQ ID NO: 676441 - DNA, 25 bp, Mus musculus
gcagcggtgtctgggacaacatcac

SEQ ID NO: 676442 - DNA, 25 bp, Mus musculus
gcagcgtccgcgaacaccaggattc

SEQ ID NO: 676443 - DNA, 25 bp, Mus musculus
gcagcgtccgcgtacaccaggattc

SEQ ID NO: 676444 - DNA, 25 bp, Mus musculus
gcagcgtgagaacggttgattttta

SEQ ID NO: 676445 - DNA, 25 bp, Mus musculus
gcagcgtgagaagggttgattttta

SEQ ID NO: 676446 - DNA, 25 bp, Mus musculus
gcagcgtgccctactgtcgagaatc

SEQ ID NO: 676447 - DNA, 25 bp, Mus musculus
gcagcgtgcccttctgtcgagaatc

SEQ ID NO: 676448 - DNA, 25 bp, Mus musculus
gcagcgtggcctacctgggtaccgc

SEQ ID NO: 676449 - DNA, 25 bp, Mus musculus
gcagcgtggccttcctgggtaccgc

SEQ ID NO: 676450 - DNA, 25 bp, Mus musculus
gcagcgttaagcaggaactggaaga

SEQ ID NO: 676451 - DNA, 25 bp, Mus musculus
gcagcgttaagctggaactggaaga

SEQ ID NO: 676452 - DNA, 25 bp, Mus musculus
gcagcgttccgaccgcaaaaagtgg

SEQ ID NO: 676453 - DNA, 25 bp, Mus musculus
gcagcgttccgagcgcaaaaagtgg

SEQ ID NO: 676454 - DNA, 25 bp, Mus musculus
gcagcgttcctaaccatcgtctgta

SEQ ID NO: 676455 - DNA, 25 bp, Mus musculus
gcagcgttcctatccatcgtctgta

SEQ ID NO: 676456 - DNA, 25 bp, Mus musculus
gcagcgttcgacaaacttgagacaa

SEQ ID NO: 676457 - DNA, 25 bp, Mus musculus
gcagcgttcgactaacttgagacaa

SEQ ID NO: 676458 - DNA, 25 bp, Mus musculus
gcagcgttgcctctgaatgcaggcc

SEQ ID NO: 676459 - DNA, 25 bp, Mus musculus
gcagcgttgcctgtgaatgcaggcc

SEQ ID NO: 676460 - DNA, 25 bp, Mus musculus
gcagcgtttgaaacaagccattgaa

SEQ ID NO: 676461 - DNA, 25 bp, Mus musculus
gcagcgtttgaatcaagccattgaa

SEQ ID NO: 676462 - DNA, 25 bp, Mus musculus
gcagcgtttgcaccatttggaagaa

SEQ ID NO: 676463 - DNA, 25 bp, Mus musculus
gcagcgtttgcagcatttggaagaa

SEQ ID NO: 676464 - DNA, 25 bp, Mus musculus
gcagcgtttggaagcccctgcagag

SEQ ID NO: 676465 - DNA, 25 bp, Mus musculus
gcagcgtttggatgcccctgcagag

SEQ ID NO: 676466 - DNA, 25 bp, Mus musculus
gcagctaaaatacagttgctatcaa

SEQ ID NO: 676467 - DNA, 25 bp, Mus musculus
gcagctaaaatagagttgctatcaa

SEQ ID NO: 676468 - DNA, 25 bp, Mus musculus
gcagctaaagaacctccgagaaaaa

SEQ ID NO: 676469 - DNA, 25 bp, Mus musculus
gcagctaaagaagctccgagaaaaa

SEQ ID NO: 676470 - DNA, 25 bp, Mus musculus
gcagctaaagcaccaacatacataa

SEQ ID NO: 676471 - DNA, 25 bp, Mus musculus
gcagctaaagcagcaacatacataa

SEQ ID NO: 676472 - DNA, 25 bp, Mus musculus
gcagctaaagctaccagcatcagaa

SEQ ID NO: 676473 - DNA, 25 bp, Mus musculus
gcagctaaagcttccagcatcagaa

SEQ ID NO: 676474 - DNA, 25 bp, Mus musculus
gcagctaaagtgcaacggtccccaa

SEQ ID NO: 676475 - DNA, 25 bp, Mus musculus
gcagctaaagtggaacggtccccaa

SEQ ID NO: 676476 - DNA, 25 bp, Mus musculus
gcagctaacatcagggcttacggag

SEQ ID NO: 676477 - DNA, 25 bp, Mus musculus
gcagctaacatctgggcttacggag

SEQ ID NO: 676478 - DNA, 25 bp, Mus musculus
gcagctacacatctacaacttgcaa

SEQ ID NO: 676479 - DNA, 25 bp, Mus musculus
gcagctacacatgtacaacttgcaa

SEQ ID NO: 676480 - DNA, 25 bp, Mus musculus
gcagctacagctacctcccgaaatt

SEQ ID NO: 676481 - DNA, 25 bp, Mus musculus
gcagctacagcttcctcccgaaatt

SEQ ID NO: 676482 - DNA, 25 bp, Mus musculus
gcagctacagggaagtattgaagat

SEQ ID NO: 676483 - DNA, 25 bp, Mus musculus
gcagctacagggtagtattgaagat

SEQ ID NO: 676484 - DNA, 25 bp, Mus musculus
gcagctacagtcaaaagaagtagaa

SEQ ID NO: 676485 - DNA, 25 bp, Mus musculus
gcagctacagtctaaagaagtagaa

SEQ ID NO: 676486 - DNA, 25 bp, Mus musculus
gcagctacattcagaaagtttgtgg

SEQ ID NO: 676487 - DNA, 25 bp, Mus musculus
gcagctacattctgaaagtttgtgg

SEQ ID NO: 676488 - DNA, 25 bp, Mus musculus
gcagctaccagaacccagtcaggag

SEQ ID NO: 676489 - DNA, 25 bp, Mus musculus
gcagctaccagatcccagtcaggag

SEQ ID NO: 676490 - DNA, 25 bp, Mus musculus
gcagctacccagcaggagacgtgtt

SEQ ID NO: 676491 - DNA, 25 bp, Mus musculus
gcagctacccaggaggagacgtgtt

SEQ ID NO: 676492 - DNA, 25 bp, Mus musculus
gcagctacccgtcaaaggcagtaac

SEQ ID NO: 676493 - DNA, 25 bp, Mus musculus
gcagctacccgtgaaaggcagtaac

SEQ ID NO: 676494 - DNA, 25 bp, Mus musculus
gcagctactgggacagaaactactt

SEQ ID NO: 676495 - DNA, 25 bp, Mus musculus
gcagctactgggtcagaaactactt

SEQ ID NO: 676496 - DNA, 25 bp, Mus musculus
gcagctagatgacggaagcctcacc

SEQ ID NO: 676497 - DNA, 25 bp, Mus musculus
gcagctagatgagggaagcctcacc

SEQ ID NO: 676498 - DNA, 25 bp, Mus musculus
gcagctagctaaccctccctttctt

SEQ ID NO: 676499 - DNA, 25 bp, Mus musculus
gcagctagctaagcctccctttctt

SEQ ID NO: 676500 - DNA, 25 bp, Mus musculus
gcagctagctcacataaaggagatg

SEQ ID NO: 676501 - DNA, 25 bp, Mus musculus
gcagctagctcagataaaggagatg

SEQ ID NO: 676502 - DNA, 25 bp, Mus musculus
gcagctagtgagacgcttgactact

SEQ ID NO: 676503 - DNA, 25 bp, Mus musculus
gcagctagtgagtcgcttgactact

SEQ ID NO: 676504 - DNA, 25 bp, Mus musculus
gcagctagtggaagatatcaagtac

SEQ ID NO: 676505 - DNA, 25 bp, Mus musculus
gcagctagtggatgatatcaagtac

SEQ ID NO: 676506 - DNA, 25 bp, Mus musculus
gcagctatacaacatctacgccaaa

SEQ ID NO: 676507 - DNA, 25 bp, Mus musculus
gcagctatacaagatctacgccaaa

SEQ ID NO: 676508 - DNA, 25 bp, Mus musculus
gcagctatatctctgggatgccaga

SEQ ID NO: 676509 - DNA, 25 bp, Mus musculus
gcagctatatctgtgggatgccaga

SEQ ID NO: 676510 - DNA, 25 bp, Mus musculus
gcagctatcggcagggctgaccatg

SEQ ID NO: 676511 - DNA, 25 bp, Mus musculus
gcagctatcggctgggctgaccatg

SEQ ID NO: 676512 - DNA, 25 bp, Mus musculus
gcagctatctcgctgtcaacttggg

SEQ ID NO: 676513 - DNA, 25 bp, Mus musculus
gcagctatctcggtgtcaacttggg

SEQ ID NO: 676514 - DNA, 25 bp, Mus musculus
gcagctatgcacctagcagcagcag

SEQ ID NO: 676515 - DNA, 25 bp, Mus musculus
gcagctatgcacgtagcagcagcag

SEQ ID NO: 676516 - DNA, 25 bp, Mus musculus
gcagctatgcttatcgaccccttta

SEQ ID NO: 676517 - DNA, 25 bp, Mus musculus
gcagctatgcttttcgaccccttta

SEQ ID NO: 676518 - DNA, 25 bp, Mus musculus
gcagctatggagactccaaccaagg

SEQ ID NO: 676519 - DNA, 25 bp, Mus musculus
gcagctatggagtctccaaccaagg

SEQ ID NO: 676520 - DNA, 25 bp, Mus musculus
gcagctatggcaacccctacattga

SEQ ID NO: 676521 - DNA, 25 bp, Mus musculus
gcagctatggcatcccctacattga

SEQ ID NO: 676522 - DNA, 25 bp, Mus musculus
gcagctcacagcattaaagccctgg

SEQ ID NO: 676523 - DNA, 25 bp, Mus musculus
gcagctcacagctttaaagccctgg

SEQ ID NO: 676524 - DNA, 25 bp, Mus musculus
gcagctcacctaacaaagcaatttt

SEQ ID NO: 676525 - DNA, 25 bp, Mus musculus
gcagctcacctatcaaagcaatttt

SEQ ID NO: 676526 - DNA, 25 bp, Mus musculus
gcagctcagagaaatgtagacccag

SEQ ID NO: 676527 - DNA, 25 bp, Mus musculus
gcagctcagagatatgtagacccag

SEQ ID NO: 676528 - DNA, 25 bp, Mus musculus
gcagctcagcttagttcattcgaat

SEQ ID NO: 676529 - DNA, 25 bp, Mus musculus
gcagctcagctttgttcattcgaat

SEQ ID NO: 676530 - DNA, 25 bp, Mus musculus
gcagctcaggttcgactgagtcact

SEQ ID NO: 676531 - DNA, 25 bp, Mus musculus
gcagctcaggttggactgagtcact

SEQ ID NO: 676532 - DNA, 25 bp, Mus musculus
gcagctcagtcacctcagcagcgag

SEQ ID NO: 676533 - DNA, 25 bp, Mus musculus
gcagctcagtcagctcagcagcgag

SEQ ID NO: 676534 - DNA, 25 bp, Mus musculus
gcagctcagtgacacctacgtcacg

SEQ ID NO: 676535 - DNA, 25 bp, Mus musculus
gcagctcagtgagacctacgtcacg

SEQ ID NO: 676536 - DNA, 25 bp, Mus musculus
gcagctcagttacaggcagcacgga

SEQ ID NO: 676537 - DNA, 25 bp, Mus musculus
gcagctcagttagaggcagcacgga

SEQ ID NO: 676538 - DNA, 25 bp, Mus musculus
gcagctcataaaagctctcgttaca

SEQ ID NO: 676539 - DNA, 25 bp, Mus musculus
gcagctcataaatgctctcgttaca

SEQ ID NO: 676540 - DNA, 25 bp, Mus musculus
gcagctcatgagacagagatctact

SEQ ID NO: 676541 - DNA, 25 bp, Mus musculus
gcagctcatgagtcagagatctact

SEQ ID NO: 676542 - DNA, 25 bp, Mus musculus
gcagctccatcgcgaacacctggag

SEQ ID NO: 676543 - DNA, 25 bp, Mus musculus
gcagctccatcgggaacacctggag

SEQ ID NO: 676544 - DNA, 25 bp, Mus musculus
gcagctccatttcaagacatctact

SEQ ID NO: 676545 - DNA, 25 bp, Mus musculus
gcagctccatttgaagacatctact

SEQ ID NO: 676546 - DNA, 25 bp, Mus musculus
gcagctcccaaacgaggtagctcag

SEQ ID NO: 676547 - DNA, 25 bp, Mus musculus
gcagctcccaaaggaggtagctcag

SEQ ID NO: 676548 - DNA, 25 bp, Mus musculus
gcagctcccagaatcaaaaaatttg

SEQ ID NO: 676549 - DNA, 25 bp, Mus musculus
gcagctcccagattcaaaaaatttg

SEQ ID NO: 676550 - DNA, 25 bp, Mus musculus
gcagctcccgaaaaagatgtcgcag

SEQ ID NO: 676551 - DNA, 25 bp, Mus musculus
gcagctcccgaataagatgtcgcag

SEQ ID NO: 676552 - DNA, 25 bp, Mus musculus
gcagctccctcaacgaggcctttga

SEQ ID NO: 676553 - DNA, 25 bp, Mus musculus
gcagctccctcatcgaggcctttga

SEQ ID NO: 676554 - DNA, 25 bp, Mus musculus
gcagctccgcggacttctacaacaa

SEQ ID NO: 676555 - DNA, 25 bp, Mus musculus
gcagctccgcggtcttctacaacaa

SEQ ID NO: 676556 - DNA, 25 bp, Mus musculus
gcagctccggaaatagcttaaaacg

SEQ ID NO: 676557 - DNA, 25 bp, Mus musculus
gcagctccggaattagcttaaaacg

SEQ ID NO: 676558 - DNA, 25 bp, Mus musculus
gcagctccggcgacggaatatccag

SEQ ID NO: 676559 - DNA, 25 bp, Mus musculus
gcagctccggcgtcggaatatccag

SEQ ID NO: 676560 - DNA, 25 bp, Mus musculus
gcagctcctcgactggtcatgtcta

SEQ ID NO: 676561 - DNA, 25 bp, Mus musculus
gcagctcctcgagtggtcatgtcta

SEQ ID NO: 676562 - DNA, 25 bp, Mus musculus
gcagctcctgcaactcatcaagcta

SEQ ID NO: 676563 - DNA, 25 bp, Mus musculus
gcagctcctgcatctcatcaagcta

SEQ ID NO: 676564 - DNA, 25 bp, Mus musculus
gcagctcctggcacttggctaagtt

SEQ ID NO: 676565 - DNA, 25 bp, Mus musculus
gcagctcctggctcttggctaagtt

SEQ ID NO: 676566 - DNA, 25 bp, Mus musculus
gcagctccttgacttagacccagaa

SEQ ID NO: 676567 - DNA, 25 bp, Mus musculus
gcagctccttgagttagacccagaa

SEQ ID NO: 676568 - DNA, 25 bp, Mus musculus
gcagctcgaggtctggatattccta

SEQ ID NO: 676569 - DNA, 25 bp, Mus musculus
gcagctcgaggtgtggatattccta

SEQ ID NO: 676570 - DNA, 25 bp, Mus musculus
gcagctcgccggctggctctgcttc

SEQ ID NO: 676571 - DNA, 25 bp, Mus musculus
gcagctcgccgggtggctctgcttc

SEQ ID NO: 676572 - DNA, 25 bp, Mus musculus
gcagctcgtcccacaactgcatgag

SEQ ID NO: 676573 - DNA, 25 bp, Mus musculus
gcagctcgtccctcaactgcatgag

SEQ ID NO: 676574 - DNA, 25 bp, Mus musculus
gcagctctaccaagccatcttctat

SEQ ID NO: 676575 - DNA, 25 bp, Mus musculus
gcagctctaccacgaccaagaggta

SEQ ID NO: 676576 - DNA, 25 bp, Mus musculus
gcagctctaccaggaccaagaggta

SEQ ID NO: 676577 - DNA, 25 bp, Mus musculus
gcagctctaccatgccatcttctat

SEQ ID NO: 676578 - DNA, 25 bp, Mus musculus
gcagctctatgcaatcacagaacag

SEQ ID NO: 676579 - DNA, 25 bp, Mus musculus
gcagctctatgctatcacagaacag

SEQ ID NO: 676580 - DNA, 25 bp, Mus musculus
gcagctctcaggcatggacctcgat

SEQ ID NO: 676581 - DNA, 25 bp, Mus musculus
gcagctctcagggatggacctcgat

SEQ ID NO: 676582 - DNA, 25 bp, Mus musculus
gcagctctcgggatcagccttcact

SEQ ID NO: 676583 - DNA, 25 bp, Mus musculus
gcagctctcgggttcagccttcact

SEQ ID NO: 676584 - DNA, 25 bp, Mus musculus
gcagctctctctcggcttagcagta

SEQ ID NO: 676585 - DNA, 25 bp, Mus musculus
gcagctctctctgggcttagcagta

SEQ ID NO: 676586 - DNA, 25 bp, Mus musculus
gcagctctctttcttgtggttggag

SEQ ID NO: 676587 - DNA, 25 bp, Mus musculus
gcagctctctttgttgtggttggag

SEQ ID NO: 676588 - DNA, 25 bp, Mus musculus
gcagctctgaaaattagcttctatg

SEQ ID NO: 676589 - DNA, 25 bp, Mus musculus
gcagctctgaaatttagcttctatg

SEQ ID NO: 676590 - DNA, 25 bp, Mus musculus
gcagctctgactcccagtgtatcga

SEQ ID NO: 676591 - DNA, 25 bp, Mus musculus
gcagctctgactgccagtgtatcga

SEQ ID NO: 676592 - DNA, 25 bp, Mus musculus
gcagctctgagacgactaccccagt

SEQ ID NO: 676593 - DNA, 25 bp, Mus musculus
gcagctctgagaggactaccccagt

SEQ ID NO: 676594 - DNA, 25 bp, Mus musculus
gcagctctgcctccggtaccaggat

SEQ ID NO: 676595 - DNA, 25 bp, Mus musculus
gcagctctgcctgcggtaccaggat

SEQ ID NO: 676596 - DNA, 25 bp, Mus musculus
gcagctctgctgagcgggtgtaccg

SEQ ID NO: 676597 - DNA, 25 bp, Mus musculus
gcagctctgctgtgcgggtgtaccg

SEQ ID NO: 676598 - DNA, 25 bp, Mus musculus
gcagctctggatcggactgcagaat

SEQ ID NO: 676599 - DNA, 25 bp, Mus musculus
gcagctctggatgggactgcagaat

SEQ ID NO: 676600 - DNA, 25 bp, Mus musculus
gcagctcttagcaggtgccaagata

SEQ ID NO: 676601 - DNA, 25 bp, Mus musculus
gcagctcttagctggtgccaagata

SEQ ID NO: 676602 - DNA, 25 bp, Mus musculus
gcagctcttcctcgatcggttacag

SEQ ID NO: 676603 - DNA, 25 bp, Mus musculus
gcagctcttcctggatcggttacag

SEQ ID NO: 676604 - DNA, 25 bp, Mus musculus
gcagctcttgaaagctggtattgag

SEQ ID NO: 676605 - DNA, 25 bp, Mus musculus
gcagctcttgaatgctggtattgag

SEQ ID NO: 676606 - DNA, 25 bp, Mus musculus
gcagctcttgttcaactccgtggtc

SEQ ID NO: 676607 - DNA, 25 bp, Mus musculus
gcagctcttgttgaactccgtggtc

SEQ ID NO: 676608 - DNA, 25 bp, Mus musculus
gcagctctttgccaacgcggatggc

SEQ ID NO: 676609 - DNA, 25 bp, Mus musculus
gcagctctttgcgaacgcggatggc

SEQ ID NO: 676610 - DNA, 25 bp, Mus musculus
gcagctgaaactactcaaggaaaag

SEQ ID NO: 676611 - DNA, 25 bp, Mus musculus
gcagctgaaacttctcaaggaaaag

SEQ ID NO: 676612 - DNA, 25 bp, Mus musculus
gcagctgaaagacatcctcagaaaa

SEQ ID NO: 676613 - DNA, 25 bp, Mus musculus
gcagctgaaagagatcctcagaaaa

SEQ ID NO: 676614 - DNA, 25 bp, Mus musculus
gcagctgaaattagcagaatgctta

SEQ ID NO: 676615 - DNA, 25 bp, Mus musculus
gcagctgaaatttgcagaatgctta

SEQ ID NO: 676616 - DNA, 25 bp, Mus musculus
gcagctgaactacctgggcaactac

SEQ ID NO: 676617 - DNA, 25 bp, Mus musculus
gcagctgaactagctgggcaactac

SEQ ID NO: 676618 - DNA, 25 bp, Mus musculus
gcagctgaactcatggctggcagag

SEQ ID NO: 676619 - DNA, 25 bp, Mus musculus
gcagctgaactcttggctggcagag

SEQ ID NO: 676620 - DNA, 25 bp, Mus musculus
gcagctgaagagatccatccctaca

SEQ ID NO: 676621 - DNA, 25 bp, Mus musculus
gcagctgaagagttccatccctaca

SEQ ID NO: 676622 - DNA, 25 bp, Mus musculus
gcagctgacaaaacaacgcgtaatg

SEQ ID NO: 676623 - DNA, 25 bp, Mus musculus
gcagctgacaaatcaacgcgtaatg

SEQ ID NO: 676624 - DNA, 25 bp, Mus musculus
gcagctgacactactacttgtagta

SEQ ID NO: 676625 - DNA, 25 bp, Mus musculus
gcagctgacacttctacttgtagta

SEQ ID NO: 676626 - DNA, 25 bp, Mus musculus
gcagctgagcgaagctaggaacaaa

SEQ ID NO: 676627 - DNA, 25 bp, Mus musculus
gcagctgagcgatgctaggaacaaa

SEQ ID NO: 676628 - DNA, 25 bp, Mus musculus
gcagctgagggtcctacctagcact

SEQ ID NO: 676629 - DNA, 25 bp, Mus musculus
gcagctgagggtgctacctagcact

SEQ ID NO: 676630 - DNA, 25 bp, Mus musculus
gcagctgagtccctgagctccatgc

SEQ ID NO: 676631 - DNA, 25 bp, Mus musculus
gcagctgagtccgtgagctccatgc

SEQ ID NO: 676632 - DNA, 25 bp, Mus musculus
gcagctgatcttagtgtctacccca

SEQ ID NO: 676633 - DNA, 25 bp, Mus musculus
gcagctgatctttgtgtctacccca

SEQ ID NO: 676634 - DNA, 25 bp, Mus musculus
gcagctgatgatcgccagagcacta

SEQ ID NO: 676635 - DNA, 25 bp, Mus musculus
gcagctgatgatggccagagcacta

SEQ ID NO: 676636 - DNA, 25 bp, Mus musculus
gcagctgattctctgcagcagagaa

SEQ ID NO: 676637 - DNA, 25 bp, Mus musculus
gcagctgattctgtgcagcagagaa

SEQ ID NO: 676638 - DNA, 25 bp, Mus musculus
gcagctgcacggacagacatggaga

SEQ ID NO: 676639 - DNA, 25 bp, Mus musculus
gcagctgcacggtcagacatggaga

SEQ ID NO: 676640 - DNA, 25 bp, Mus musculus
gcagctgcagctctactccaaggag

SEQ ID NO: 676641 - DNA, 25 bp, Mus musculus
gcagctgcagctgtactccaaggag

SEQ ID NO: 676642 - DNA, 25 bp, Mus musculus
gcagctgcagtaaggaggaacagtt

SEQ ID NO: 676643 - DNA, 25 bp, Mus musculus
gcagctgcagtatggaggaacagtt

SEQ ID NO: 676644 - DNA, 25 bp, Mus musculus
gcagctgcagtgactacacctctgg

SEQ ID NO: 676645 - DNA, 25 bp, Mus musculus
gcagctgcagtgtctacacctctgg

SEQ ID NO: 676646 - DNA, 25 bp, Mus musculus
gcagctgccagacctctgcatgaac

SEQ ID NO: 676647 - DNA, 25 bp, Mus musculus
gcagctgccagagctctgcatgaac

SEQ ID NO: 676648 - DNA, 25 bp, Mus musculus
gcagctgcccaacgacgtggtcctc

SEQ ID NO: 676649 - DNA, 25 bp, Mus musculus
gcagctgcccaaggacgtggtcctc

SEQ ID NO: 676650 - DNA, 25 bp, Mus musculus
gcagctgcctccacgtggaggacca

SEQ ID NO: 676651 - DNA, 25 bp, Mus musculus
gcagctgcctcctcgtggaggacca

SEQ ID NO: 676652 - DNA, 25 bp, Mus musculus
gcagctgcgctcagagtacgtggca

SEQ ID NO: 676653 - DNA, 25 bp, Mus musculus
gcagctgcgctctgagtacgtggca

SEQ ID NO: 676654 - DNA, 25 bp, Mus musculus
gcagctgcggcacaagaactgccag

SEQ ID NO: 676655 - DNA, 25 bp, Mus musculus
gcagctgcggcagaagaactgccag

SEQ ID NO: 676656 - DNA, 25 bp, Mus musculus
gcagctgcggctccaatggacatga

SEQ ID NO: 676657 - DNA, 25 bp, Mus musculus
gcagctgcggctgcaatggacatga

SEQ ID NO: 676658 - DNA, 25 bp, Mus musculus
gcagctgctaaaacgtcctctgagg

SEQ ID NO: 676659 - DNA, 25 bp, Mus musculus
gcagctgctaaatcgtcctctgagg

SEQ ID NO: 676660 - DNA, 25 bp, Mus musculus
gcagctgctagcctgacctgccgag

SEQ ID NO: 676661 - DNA, 25 bp, Mus musculus
gcagctgctagcgtgacctgccgag

SEQ ID NO: 676662 - DNA, 25 bp, Mus musculus
gcagctgctctacagcaacctacag

SEQ ID NO: 676663 - DNA, 25 bp, Mus musculus
gcagctgctctagagcaacctacag

SEQ ID NO: 676664 - DNA, 25 bp, Mus musculus
gcagctgctgaaacacaggccgatg

SEQ ID NO: 676665 - DNA, 25 bp, Mus musculus
gcagctgctgaatcacaggccgatg

SEQ ID NO: 676666 - DNA, 25 bp, Mus musculus
gcagctgcttcaactagggtgttta

SEQ ID NO: 676667 - DNA, 25 bp, Mus musculus
gcagctgcttcatctagggtgttta

SEQ ID NO: 676668 - DNA, 25 bp, Mus musculus
gcagctgcttgcctagcctgatgcc

SEQ ID NO: 676669 - DNA, 25 bp, Mus musculus
gcagctgcttgcgtagcctgatgcc

SEQ ID NO: 676670 - DNA, 25 bp, Mus musculus
gcagctgcttggcaaaagtctgcaa

SEQ ID NO: 676671 - DNA, 25 bp, Mus musculus
gcagctgcttgggaaaagtctgcaa

SEQ ID NO: 676672 - DNA, 25 bp, Mus musculus
gcagctggaaacaaatctaaagaga

SEQ ID NO: 676673 - DNA, 25 bp, Mus musculus
gcagctggaaactaatctaaagaga

SEQ ID NO: 676674 - DNA, 25 bp, Mus musculus
gcagctggacctctttccggcaggt

SEQ ID NO: 676675 - DNA, 25 bp, Mus musculus
gcagctggacctgtttccggcaggt

SEQ ID NO: 676676 - DNA, 25 bp, Mus musculus
gcagctggaggcaattgtgcgcatt

SEQ ID NO: 676677 - DNA, 25 bp, Mus musculus
gcagctggaggctattgtgcgcatt

SEQ ID NO: 676678 - DNA, 25 bp, Mus musculus
gcagctggagttcgatgacgaactc

SEQ ID NO: 676679 - DNA, 25 bp, Mus musculus
gcagctggagttggatgacgaactc

SEQ ID NO: 676680 - DNA, 25 bp, Mus musculus
gcagctggatgccagaccatcctgg

SEQ ID NO: 676681 - DNA, 25 bp, Mus musculus
gcagctggatgcgagaccatcctgg

SEQ ID NO: 676682 - DNA, 25 bp, Mus musculus
gcagctggcactagtttggaccgac

SEQ ID NO: 676683 - DNA, 25 bp, Mus musculus
gcagctggcacttgtttggaccgac

SEQ ID NO: 676684 - DNA, 25 bp, Mus musculus
gcagctggcatgcttaacttcacct

SEQ ID NO: 676685 - DNA, 25 bp, Mus musculus
gcagctggcatggttaacttcacct

SEQ ID NO: 676686 - DNA, 25 bp, Mus musculus
gcagctggccatcgatctgagcaaa

SEQ ID NO: 676687 - DNA, 25 bp, Mus musculus
gcagctggccatggatctgagcaaa

SEQ ID NO: 676688 - DNA, 25 bp, Mus musculus
gcagctgggatcaacctaacttgga

SEQ ID NO: 676689 - DNA, 25 bp, Mus musculus
gcagctgggatctacctaacttgga

SEQ ID NO: 676690 - DNA, 25 bp, Mus musculus
gcagctgggcagcatttcgtacttg

SEQ ID NO: 676691 - DNA, 25 bp, Mus musculus
gcagctgggcaggatttcgtacttg

SEQ ID NO: 676692 - DNA, 25 bp, Mus musculus
gcagctgggcgcagtacgaggacga

SEQ ID NO: 676693 - DNA, 25 bp, Mus musculus
gcagctgggcgctgtacgaggacga

SEQ ID NO: 676694 - DNA, 25 bp, Mus musculus
gcagctgggtggagccaagacccac

SEQ ID NO: 676695 - DNA, 25 bp, Mus musculus
gcagctgggtggtgccaagacccac

SEQ ID NO: 676696 - DNA, 25 bp, Mus musculus
gcagctgggtttcaactgatagata

SEQ ID NO: 676697 - DNA, 25 bp, Mus musculus
gcagctgggtttgaactgatagata

SEQ ID NO: 676698 - DNA, 25 bp, Mus musculus
gcagctggtcaaattgcatattcac

SEQ ID NO: 676699 - DNA, 25 bp, Mus musculus
gcagctggtcaatttgcatattcac

SEQ ID NO: 676700 - DNA, 25 bp, Mus musculus
gcagctggtgccaaagagggaccat

SEQ ID NO: 676701 - DNA, 25 bp, Mus musculus
gcagctggtgcctaagagggaccat

SEQ ID NO: 676702 - DNA, 25 bp, Mus musculus
gcagctggtggactcagacctcaat

SEQ ID NO: 676703 - DNA, 25 bp, Mus musculus
gcagctggtggagtcagacctcaat

SEQ ID NO: 676704 - DNA, 25 bp, Mus musculus
gcagctggtgttatggagtccttcc

SEQ ID NO: 676705 - DNA, 25 bp, Mus musculus
gcagctggtgttttggagtccttcc

SEQ ID NO: 676706 - DNA, 25 bp, Mus musculus
gcagctgtacccagagaactcggag

SEQ ID NO: 676707 - DNA, 25 bp, Mus musculus
gcagctgtaccctgagaactcggag

SEQ ID NO: 676708 - DNA, 25 bp, Mus musculus
gcagctgtcactcggctcagaaaag

SEQ ID NO: 676709 - DNA, 25 bp, Mus musculus
gcagctgtcactgggctcagaaaag

SEQ ID NO: 676710 - DNA, 25 bp, Mus musculus
gcagctgtccgtatatcttcaacta

SEQ ID NO: 676711 - DNA, 25 bp, Mus musculus
gcagctgtccgtttatcttcaacta

SEQ ID NO: 676712 - DNA, 25 bp, Mus musculus
gcagctgtgcgcaccgcagtgcgca

SEQ ID NO: 676713 - DNA, 25 bp, Mus musculus
gcagctgtgcgctccgcagtgcgca

SEQ ID NO: 676714 - DNA, 25 bp, Mus musculus
gcagctgtgtgccaccctcagcgtg

SEQ ID NO: 676715 - DNA, 25 bp, Mus musculus
gcagctgtgtgcgaccctcagcgtg

SEQ ID NO: 676716 - DNA, 25 bp, Mus musculus
gcagctgttggaacctttcctaacg

SEQ ID NO: 676717 - DNA, 25 bp, Mus musculus
gcagctgttggatcctttcctaacg

SEQ ID NO: 676718 - DNA, 25 bp, Mus musculus
gcagcttacatccagcacaggtgtt

SEQ ID NO: 676719 - DNA, 25 bp, Mus musculus
gcagcttacatcgagcacaggtgtt

SEQ ID NO: 676720 - DNA, 25 bp, Mus musculus
gcagcttaccagatggcttttcgat

SEQ ID NO: 676721 - DNA, 25 bp, Mus musculus
gcagcttaccagttggcttttcgat

SEQ ID NO: 676722 - DNA, 25 bp, Mus musculus
gcagcttagcccaaagatccatact

SEQ ID NO: 676723 - DNA, 25 bp, Mus musculus
gcagcttagccctaagatccatact

SEQ ID NO: 676724 - DNA, 25 bp, Mus musculus
gcagcttatgatcccattcttgaaa

SEQ ID NO: 676725 - DNA, 25 bp, Mus musculus
gcagcttatgatgccattcttgaaa

SEQ ID NO: 676726 - DNA, 25 bp, Mus musculus
gcagcttattcaagtgatggagcac

SEQ ID NO: 676727 - DNA, 25 bp, Mus musculus
gcagcttattcatgtgatggagcac

SEQ ID NO: 676728 - DNA, 25 bp, Mus musculus
gcagcttcgccaaggtcttccagga

SEQ ID NO: 676729 - DNA, 25 bp, Mus musculus
gcagcttcgccatggtcttccagga

SEQ ID NO: 676730 - DNA, 25 bp, Mus musculus
gcagcttcggctcttcccgtgatcg

SEQ ID NO: 676731 - DNA, 25 bp, Mus musculus
gcagcttcggctgttcccgtgatcg

SEQ ID NO: 676732 - DNA, 25 bp, Mus musculus
gcagcttctataagatcatcagcga

SEQ ID NO: 676733 - DNA, 25 bp, Mus musculus
gcagcttctatatgatcatcagcga

SEQ ID NO: 676734 - DNA, 25 bp, Mus musculus
gcagcttctattcccaacattgtta

SEQ ID NO: 676735 - DNA, 25 bp, Mus musculus
gcagcttctattgccaacattgtta

SEQ ID NO: 676736 - DNA, 25 bp, Mus musculus
gcagcttctgctagaatcgcagtct

SEQ ID NO: 676737 - DNA, 25 bp, Mus musculus
gcagcttctgcttgaatcgcagtct

SEQ ID NO: 676738 - DNA, 25 bp, Mus musculus
gcagcttctgggatccgatgatata

SEQ ID NO: 676739 - DNA, 25 bp, Mus musculus
gcagcttctgggttccgatgatata

SEQ ID NO: 676740 - DNA, 25 bp, Mus musculus
gcagcttcttcgagagggcaaagtg

SEQ ID NO: 676741 - DNA, 25 bp, Mus musculus
gcagcttcttcgtgagggcaaagtg

SEQ ID NO: 676742 - DNA, 25 bp, Mus musculus
gcagcttcttggatccctggcgtac

SEQ ID NO: 676743 - DNA, 25 bp, Mus musculus
gcagcttcttggttccctggcgtac

SEQ ID NO: 676744 - DNA, 25 bp, Mus musculus
gcagcttgcaaactgacctctggga

SEQ ID NO: 676745 - DNA, 25 bp, Mus musculus
gcagcttgcaaagtgacctctggga

SEQ ID NO: 676746 - DNA, 25 bp, Mus musculus
gcagcttgcagccttgggccaaaac

SEQ ID NO: 676747 - DNA, 25 bp, Mus musculus
gcagcttgcagcgttgggccaaaac

SEQ ID NO: 676748 - DNA, 25 bp, Mus musculus
gcagcttgccacactttagccaacg

SEQ ID NO: 676749 - DNA, 25 bp, Mus musculus
gcagcttgccactctttagccaacg

SEQ ID NO: 676750 - DNA, 25 bp, Mus musculus
gcagcttgcggtctctgtgcctttt

SEQ ID NO: 676751 - DNA, 25 bp, Mus musculus
gcagcttgcggtgtctgtgcctttt

SEQ ID NO: 676752 - DNA, 25 bp, Mus musculus
gcagcttgctgtcgaattgtcatgt

SEQ ID NO: 676753 - DNA, 25 bp, Mus musculus
gcagcttgctgtggaattgtcatgt

SEQ ID NO: 676754 - DNA, 25 bp, Mus musculus
gcagcttggaccaggctagtactga

SEQ ID NO: 676755 - DNA, 25 bp, Mus musculus
gcagcttggacctggctagtactga

SEQ ID NO: 676756 - DNA, 25 bp, Mus musculus
gcagcttggctcaccatgtttgatg

SEQ ID NO: 676757 - DNA, 25 bp, Mus musculus
gcagcttggctctccatgtttgatg

SEQ ID NO: 676758 - DNA, 25 bp, Mus musculus
gcagctttaagaaagtgtacgtgga

SEQ ID NO: 676759 - DNA, 25 bp, Mus musculus
gcagctttaagatagtgtacgtgga

SEQ ID NO: 676760 - DNA, 25 bp, Mus musculus
gcagctttacttattcgaagatccc

SEQ ID NO: 676761 - DNA, 25 bp, Mus musculus
gcagctttactttttcgaagatccc

SEQ ID NO: 676762 - DNA, 25 bp, Mus musculus
gcagctttagcacaaacagacaccg

SEQ ID NO: 676763 - DNA, 25 bp, Mus musculus
gcagctttagcagaaacagacaccg

SEQ ID NO: 676764 - DNA, 25 bp, Mus musculus
gcagctttcctacatccacagcaag

SEQ ID NO: 676765 - DNA, 25 bp, Mus musculus
gcagctttcctagatccacagcaag

SEQ ID NO: 676766 - DNA, 25 bp, Mus musculus
gcagctttgaatccggctgccaaaa

SEQ ID NO: 676767 - DNA, 25 bp, Mus musculus
gcagctttgaatgcggctgccaaaa

SEQ ID NO: 676768 - DNA, 25 bp, Mus musculus
gcagcttttcttaatacgttacaag

SEQ ID NO: 676769 - DNA, 25 bp, Mus musculus
gcagcttttctttatacgttacaag

SEQ ID NO: 676770 - DNA, 25 bp, Mus musculus
gcagctttttgtcaatccattatga

SEQ ID NO: 676771 - DNA, 25 bp, Mus musculus
gcagctttttgtgaatccattatga

SEQ ID NO: 676772 - DNA, 25 bp, Mus musculus
gcaggaaaagacatcatagtcgtcc

SEQ ID NO: 676773 - DNA, 25 bp, Mus musculus
gcaggaaaagacttcatagtcgtcc

SEQ ID NO: 676774 - DNA, 25 bp, Mus musculus
gcaggaaaagctaataaaagctctg

SEQ ID NO: 676775 - DNA, 25 bp, Mus musculus
gcaggaaaagcttataaaagctctg

SEQ ID NO: 676776 - DNA, 25 bp, Mus musculus
gcaggaaacattcaccaggccaaga

SEQ ID NO: 676777 - DNA, 25 bp, Mus musculus
gcaggaaacattgaccaggccaaga

SEQ ID NO: 676778 - DNA, 25 bp, Mus musculus
gcaggaaacctacttaagaagcatc

SEQ ID NO: 676779 - DNA, 25 bp, Mus musculus
gcaggaaacctagttaagaagcatc

SEQ ID NO: 676780 - DNA, 25 bp, Mus musculus
gcaggaaactctcgcctaattcgag

SEQ ID NO: 676781 - DNA, 25 bp, Mus musculus
gcaggaaactctggcctaattcgag

SEQ ID NO: 676782 - DNA, 25 bp, Mus musculus
gcaggaaagcgcaccagatactggg

SEQ ID NO: 676783 - DNA, 25 bp, Mus musculus
gcaggaaagcgctccagatactggg

SEQ ID NO: 676784 - DNA, 25 bp, Mus musculus
gcaggaaagtaaatgccaactgatt

SEQ ID NO: 676785 - DNA, 25 bp, Mus musculus
gcaggaaagtaattgccaactgatt

SEQ ID NO: 676786 - DNA, 25 bp, Mus musculus
gcaggaacaaggcaacctgccaaga

SEQ ID NO: 676787 - DNA, 25 bp, Mus musculus
gcaggaacaagggaacctgccaaga

SEQ ID NO: 676788 - DNA, 25 bp, Mus musculus
gcaggaacaggaagtgactctactt

SEQ ID NO: 676789 - DNA, 25 bp, Mus musculus
gcaggaacaggatgtgactctactt

SEQ ID NO: 676790 - DNA, 25 bp, Mus musculus
gcaggaaccaagagaacagacttta

SEQ ID NO: 676791 - DNA, 25 bp, Mus musculus
gcaggaaccaagtgaacagacttta

SEQ ID NO: 676792 - DNA, 25 bp, Mus musculus
gcaggaaccagcaattactgggaag

SEQ ID NO: 676793 - DNA, 25 bp, Mus musculus
gcaggaaccagcacagggggcatcc

SEQ ID NO: 676794 - DNA, 25 bp, Mus musculus
gcaggaaccagctattactgggaag

SEQ ID NO: 676795 - DNA, 25 bp, Mus musculus
gcaggaaccagctcagggggcatcc

SEQ ID NO: 676796 - DNA, 25 bp, Mus musculus
gcaggaaccagtaaagactgtgatg

SEQ ID NO: 676797 - DNA, 25 bp, Mus musculus
gcaggaaccagttaagactgtgatg

SEQ ID NO: 676798 - DNA, 25 bp, Mus musculus
gcaggaacccagaatgcaggacaaa

SEQ ID NO: 676799 - DNA, 25 bp, Mus musculus
gcaggaacccagtatgcaggacaaa

SEQ ID NO: 676800 - DNA, 25 bp, Mus musculus
gcaggaactccccacttttggacag

SEQ ID NO: 676801 - DNA, 25 bp, Mus musculus
gcaggaactcccgacttttggacag

SEQ ID NO: 676802 - DNA, 25 bp, Mus musculus
gcaggaacttatctcccgccacaag

SEQ ID NO: 676803 - DNA, 25 bp, Mus musculus
gcaggaacttatgtcccgccacaag

SEQ ID NO: 676804 - DNA, 25 bp, Mus musculus
gcaggaagaagacacgatggacttc

SEQ ID NO: 676805 - DNA, 25 bp, Mus musculus
gcaggaagaagagacgatggacttc

SEQ ID NO: 676806 - DNA, 25 bp, Mus musculus
gcaggaagacacatagagcagaggc

SEQ ID NO: 676807 - DNA, 25 bp, Mus musculus
gcaggaagacacttagagcagaggc

SEQ ID NO: 676808 - DNA, 25 bp, Mus musculus
gcaggaagacctcgctactgatgac

SEQ ID NO: 676809 - DNA, 25 bp, Mus musculus
gcaggaagacctggctactgatgac

SEQ ID NO: 676810 - DNA, 25 bp, Mus musculus
gcaggaagccgcacagctggatcgc

SEQ ID NO: 676811 - DNA, 25 bp, Mus musculus
gcaggaagccgctcagctggatcgc

SEQ ID NO: 676812 - DNA, 25 bp, Mus musculus
gcaggaagccgtatcaaggaccaga

SEQ ID NO: 676813 - DNA, 25 bp, Mus musculus
gcaggaagccgtttcaaggaccaga

SEQ ID NO: 676814 - DNA, 25 bp, Mus musculus
gcaggaagcctactgtctactcagc

SEQ ID NO: 676815 - DNA, 25 bp, Mus musculus
gcaggaagcctagtgtctactcagc

SEQ ID NO: 676816 - DNA, 25 bp, Mus musculus
gcaggaagctcacctcctatctcag

SEQ ID NO: 676817 - DNA, 25 bp, Mus musculus
gcaggaagctcagctcctatctcag

SEQ ID NO: 676818 - DNA, 25 bp, Mus musculus
gcaggaaggcttcctcaggaagatc

SEQ ID NO: 676819 - DNA, 25 bp, Mus musculus
gcaggaaggcttgctcaggaagatc

SEQ ID NO: 676820 - DNA, 25 bp, Mus musculus
gcaggaagtacaacgtcaagcacaa

SEQ ID NO: 676821 - DNA, 25 bp, Mus musculus
gcaggaagtacactctcatagacaa

SEQ ID NO: 676822 - DNA, 25 bp, Mus musculus
gcaggaagtacagtctcatagacaa

SEQ ID NO: 676823 - DNA, 25 bp, Mus musculus
gcaggaagtacatcgtcaagcacaa

SEQ ID NO: 676824 - DNA, 25 bp, Mus musculus
gcaggaatatgtcaatctggtggaa

SEQ ID NO: 676825 - DNA, 25 bp, Mus musculus
gcaggaatatgtgaatctggtggaa

SEQ ID NO: 676826 - DNA, 25 bp, Mus musculus
gcaggaatattgaggatggtgaaca

SEQ ID NO: 676827 - DNA, 25 bp, Mus musculus
gcaggaatattgtggatggtgaaca

SEQ ID NO: 676828 - DNA, 25 bp, Mus musculus
gcaggaatcatcatcattgaccgga

SEQ ID NO: 676829 - DNA, 25 bp, Mus musculus
gcaggaatcatcttcattgaccgga

SEQ ID NO: 676830 - DNA, 25 bp, Mus musculus
gcaggaatccctccaagaccgtgtg

SEQ ID NO: 676831 - DNA, 25 bp, Mus musculus
gcaggaatccctgcaagaccgtgtg

SEQ ID NO: 676832 - DNA, 25 bp, Mus musculus
gcaggaatctggcataattactgtg

SEQ ID NO: 676833 - DNA, 25 bp, Mus musculus
gcaggaatctgggataattactgtg

SEQ ID NO: 676834 - DNA, 25 bp, Mus musculus
gcaggaatgctgatgctctctggga

SEQ ID NO: 676835 - DNA, 25 bp, Mus musculus
gcaggaatgctgttgctctctggga

SEQ ID NO: 676836 - DNA, 25 bp, Mus musculus
gcaggaatggcacgacctgaatgaa

SEQ ID NO: 676837 - DNA, 25 bp, Mus musculus
gcaggaatggcaggacctgaatgaa

SEQ ID NO: 676838 - DNA, 25 bp, Mus musculus
gcaggaatggcgagaccactttctg

SEQ ID NO: 676839 - DNA, 25 bp, Mus musculus
gcaggaatggcgtgaccactttctg

SEQ ID NO: 676840 - DNA, 25 bp, Mus musculus
gcaggaatgttaccaggtgaaagct

SEQ ID NO: 676841 - DNA, 25 bp, Mus musculus
gcaggaatgttagcaggtgaaagct

SEQ ID NO: 676842 - DNA, 25 bp, Mus musculus
gcaggaatttggattgctcccagaa

SEQ ID NO: 676843 - DNA, 25 bp, Mus musculus
gcaggaatttggtttgctcccagaa

SEQ ID NO: 676844 - DNA, 25 bp, Mus musculus
gcaggacaatccaaagctcatctat

SEQ ID NO: 676845 - DNA, 25 bp, Mus musculus
gcaggacaatcctaagctcatctat

SEQ ID NO: 676846 - DNA, 25 bp, Mus musculus
gcaggacaccctctatgaggaacca

SEQ ID NO: 676847 - DNA, 25 bp, Mus musculus
gcaggacaccctgtatgaggaacca

SEQ ID NO: 676848 - DNA, 25 bp, Mus musculus
gcaggacagcagacattgcttcgtt

SEQ ID NO: 676849 - DNA, 25 bp, Mus musculus
gcaggacagcagtcattgcttcgtt

SEQ ID NO: 676850 - DNA, 25 bp, Mus musculus
gcaggacaggatacgggccctccgt

SEQ ID NO: 676851 - DNA, 25 bp, Mus musculus
gcaggacaggattcgggccctccgt

SEQ ID NO: 676852 - DNA, 25 bp, Mus musculus
gcaggacatgataaatgaggtggat

SEQ ID NO: 676853 - DNA, 25 bp, Mus musculus
gcaggacatgattaatgaggtggat

SEQ ID NO: 676854 - DNA, 25 bp, Mus musculus
gcaggaccctgtaccagttgtactg

SEQ ID NO: 676855 - DNA, 25 bp, Mus musculus
gcaggaccctgttccagttgtactg

SEQ ID NO: 676856 - DNA, 25 bp, Mus musculus
gcaggacctacaccatggtaactcc

SEQ ID NO: 676857 - DNA, 25 bp, Mus musculus
gcaggacctacagcatggtaactcc

SEQ ID NO: 676858 - DNA, 25 bp, Mus musculus
gcaggacctcctcctgtgtccgaga

SEQ ID NO: 676859 - DNA, 25 bp, Mus musculus
gcaggacctcctgctgtgtccgaga

SEQ ID NO: 676860 - DNA, 25 bp, Mus musculus
gcaggacctcgcagccgacatgtct

SEQ ID NO: 676861 - DNA, 25 bp, Mus musculus
gcaggacctcgctgccgacatgtct

SEQ ID NO: 676862 - DNA, 25 bp, Mus musculus
gcaggacctgaaagaaggtcagaga

SEQ ID NO: 676863 - DNA, 25 bp, Mus musculus
gcaggacctgaatgaaggtcagaga

SEQ ID NO: 676864 - DNA, 25 bp, Mus musculus
gcaggacctgcaacgggcaattgaa

SEQ ID NO: 676865 - DNA, 25 bp, Mus musculus
gcaggacctgcatcgggcaattgaa

SEQ ID NO: 676866 - DNA, 25 bp, Mus musculus
gcaggacgcagacccctaaggagca

SEQ ID NO: 676867 - DNA, 25 bp, Mus musculus
gcaggacgcagagccctaaggagca

SEQ ID NO: 676868 - DNA, 25 bp, Mus musculus
gcaggacgtacacggcatgtctgaa

SEQ ID NO: 676869 - DNA, 25 bp, Mus musculus
gcaggacgtacagggcatgtctgaa

SEQ ID NO: 676870 - DNA, 25 bp, Mus musculus
gcaggacgtagtactcacagcatga

SEQ ID NO: 676871 - DNA, 25 bp, Mus musculus
gcaggacgtagttctcacagcatga

SEQ ID NO: 676872 - DNA, 25 bp, Mus musculus
gcaggactacgacctaggctcggaa

SEQ ID NO: 676873 - DNA, 25 bp, Mus musculus
gcaggactacgagctaggctcggaa

SEQ ID NO: 676874 - DNA, 25 bp, Mus musculus
gcaggactcgtaaggcggtgacttt

SEQ ID NO: 676875 - DNA, 25 bp, Mus musculus
gcaggactcgtatggcggtgacttt

SEQ ID NO: 676876 - DNA, 25 bp, Mus musculus
gcaggagaacaacgcgtcgaacgac

SEQ ID NO: 676877 - DNA, 25 bp, Mus musculus
gcaggagaacaaggcgtcgaacgac

SEQ ID NO: 676878 - DNA, 25 bp, Mus musculus
gcaggagaactccatcttgagggat

SEQ ID NO: 676879 - DNA, 25 bp, Mus musculus
gcaggagaactcgatcttgagggat

SEQ ID NO: 676880 - DNA, 25 bp, Mus musculus
gcaggagaatacataaaaaggagaa

SEQ ID NO: 676881 - DNA, 25 bp, Mus musculus
gcaggagaatacttaaaaaggagaa

SEQ ID NO: 676882 - DNA, 25 bp, Mus musculus
gcaggagacactcggccctcagtat

SEQ ID NO: 676883 - DNA, 25 bp, Mus musculus
gcaggagacactgggccctcagtat

SEQ ID NO: 676884 - DNA, 25 bp, Mus musculus
gcaggagacattaccctcgagagca

SEQ ID NO: 676885 - DNA, 25 bp, Mus musculus
gcaggagacatttccctcgagagca

SEQ ID NO: 676886 - DNA, 25 bp, Mus musculus
gcaggagaccaacttggatctcata

SEQ ID NO: 676887 - DNA, 25 bp, Mus musculus
gcaggagaccaagttggatctcata

SEQ ID NO: 676888 - DNA, 25 bp, Mus musculus
gcaggagacgctcacgaacatctca

SEQ ID NO: 676889 - DNA, 25 bp, Mus musculus
gcaggagacgctgacgaacatctca

SEQ ID NO: 676890 - DNA, 25 bp, Mus musculus
gcaggagacgtgattcagaacggat

SEQ ID NO: 676891 - DNA, 25 bp, Mus musculus
gcaggagacgtgtttcagaacggat

SEQ ID NO: 676892 - DNA, 25 bp, Mus musculus
gcaggagacttactgctgtttctag

SEQ ID NO: 676893 - DNA, 25 bp, Mus musculus
gcaggagacttagtgctgtttctag

SEQ ID NO: 676894 - DNA, 25 bp, Mus musculus
gcaggagaggccaccactcttctgg

SEQ ID NO: 676895 - DNA, 25 bp, Mus musculus
gcaggagaggcctccactcttctgg

SEQ ID NO: 676896 - DNA, 25 bp, Mus musculus
gcaggagagtacagacactgagcag

SEQ ID NO: 676897 - DNA, 25 bp, Mus musculus
gcaggagagtactgacactgagcag

SEQ ID NO: 676898 - DNA, 25 bp, Mus musculus
gcaggagagtatcgcaaaaaggcaa

SEQ ID NO: 676899 - DNA, 25 bp, Mus musculus
gcaggagagtatggcaaaaaggcaa

SEQ ID NO: 676900 - DNA, 25 bp, Mus musculus
gcaggagataatcaaggaaatctcc

SEQ ID NO: 676901 - DNA, 25 bp, Mus musculus
gcaggagataatgaaggaaatctcc

SEQ ID NO: 676902 - DNA, 25 bp, Mus musculus
gcaggagatagaacgctacgccagt

SEQ ID NO: 676903 - DNA, 25 bp, Mus musculus
gcaggagatagatcgctacgccagt

SEQ ID NO: 676904 - DNA, 25 bp, Mus musculus
gcaggagatccgctcactcttcgag

SEQ ID NO: 676905 - DNA, 25 bp, Mus musculus
gcaggagatccggtcactcttcgag

SEQ ID NO: 676906 - DNA, 25 bp, Mus musculus
gcaggagatgaccacaacagcaaaa

SEQ ID NO: 676907 - DNA, 25 bp, Mus musculus
gcaggagatgacgacaacagcaaaa

SEQ ID NO: 676908 - DNA, 25 bp, Mus musculus
gcaggagattgaagttttcaacaac

SEQ ID NO: 676909 - DNA, 25 bp, Mus musculus
gcaggagattgatgttttcaacaac

SEQ ID NO: 676910 - DNA, 25 bp, Mus musculus
gcaggagcacagctgatctctctgt

SEQ ID NO: 676911 - DNA, 25 bp, Mus musculus
gcaggagcacaggtgatctctctgt

SEQ ID NO: 676912 - DNA, 25 bp, Mus musculus
gcaggagcacatatccctttcatga

SEQ ID NO: 676913 - DNA, 25 bp, Mus musculus
gcaggagcacatttccctttcatga

SEQ ID NO: 676914 - DNA, 25 bp, Mus musculus
gcaggagcagatctcaacaaaacgg

SEQ ID NO: 676915 - DNA, 25 bp, Mus musculus
gcaggagcagatgtcaacaaaacgg

SEQ ID NO: 676916 - DNA, 25 bp, Mus musculus
gcaggagcatgccaagaccaacatc

SEQ ID NO: 676917 - DNA, 25 bp, Mus musculus
gcaggagcatgcgaagaccaacatc

SEQ ID NO: 676918 - DNA, 25 bp, Mus musculus
gcaggagccccacaaacacatgttg

SEQ ID NO: 676919 - DNA, 25 bp, Mus musculus
gcaggagccccagaaacacatgttg

SEQ ID NO: 676920 - DNA, 25 bp, Mus musculus
gcaggagcctacattctcagcagat

SEQ ID NO: 676921 - DNA, 25 bp, Mus musculus
gcaggagcctactttctcagcagat

SEQ ID NO: 676922 - DNA, 25 bp, Mus musculus
gcaggagcggctacaagccatcgct

SEQ ID NO: 676923 - DNA, 25 bp, Mus musculus
gcaggagcggcttcaagccatcgct

SEQ ID NO: 676924 - DNA, 25 bp, Mus musculus
gcaggagctgcacccatatgataga

SEQ ID NO: 676925 - DNA, 25 bp, Mus musculus
gcaggagctgcagccatatgataga

SEQ ID NO: 676926 - DNA, 25 bp, Mus musculus
gcaggagctgtgaatccaactgtaa

SEQ ID NO: 676927 - DNA, 25 bp, Mus musculus
gcaggagctgtgtatccaactgtaa

SEQ ID NO: 676928 - DNA, 25 bp, Mus musculus
gcaggaggcaagatgattctgtccc

SEQ ID NO: 676929 - DNA, 25 bp, Mus musculus
gcaggaggcaagttgattctgtccc

SEQ ID NO: 676930 - DNA, 25 bp, Mus musculus
gcaggaggcccactactgtaatcct

SEQ ID NO: 676931 - DNA, 25 bp, Mus musculus
gcaggaggcccagtactgtaatcct

SEQ ID NO: 676932 - DNA, 25 bp, Mus musculus
gcaggaggccttattccaatgccaa

SEQ ID NO: 676933 - DNA, 25 bp, Mus musculus
gcaggaggcctttttccaatgccaa

SEQ ID NO: 676934 - DNA, 25 bp, Mus musculus
gcaggaggctgtagtggatcttcat

SEQ ID NO: 676935 - DNA, 25 bp, Mus musculus
gcaggaggctgttgtggatcttcat

SEQ ID NO: 676936 - DNA, 25 bp, Mus musculus
gcaggaggtgttcccagaaactttc

SEQ ID NO: 676937 - DNA, 25 bp, Mus musculus
gcaggaggtgttgccagaaactttc

SEQ ID NO: 676938 - DNA, 25 bp, Mus musculus
gcaggaggttacagtgtctcaattc

SEQ ID NO: 676939 - DNA, 25 bp, Mus musculus
gcaggaggttactgtgtctcaattc

SEQ ID NO: 676940 - DNA, 25 bp, Mus musculus
gcaggagtcacaactcaattcgtct

SEQ ID NO: 676941 - DNA, 25 bp, Mus musculus
gcaggagtcacatctcaattcgtct

SEQ ID NO: 676942 - DNA, 25 bp, Mus musculus
gcaggagtctccatacctctggtcc

SEQ ID NO: 676943 - DNA, 25 bp, Mus musculus
gcaggagtctccttacctctggtcc

SEQ ID NO: 676944 - DNA, 25 bp, Mus musculus
gcaggagtgaagcttcagatccaca

SEQ ID NO: 676945 - DNA, 25 bp, Mus musculus
gcaggagtgaaggttcagatccaca

SEQ ID NO: 676946 - DNA, 25 bp, Mus musculus
gcaggagtggccatcctggccctca

SEQ ID NO: 676947 - DNA, 25 bp, Mus musculus
gcaggagtggccttcctggccctca

SEQ ID NO: 676948 - DNA, 25 bp, Mus musculus
gcaggagttagtaagcaaagagcag

SEQ ID NO: 676949 - DNA, 25 bp, Mus musculus
gcaggagttagttagcaaagagcag

SEQ ID NO: 676950 - DNA, 25 bp, Mus musculus
gcaggataatcgcttcagcaacaaa

SEQ ID NO: 676951 - DNA, 25 bp, Mus musculus
gcaggataatcggttcagcaacaaa

SEQ ID NO: 676952 - DNA, 25 bp, Mus musculus
gcaggatacacacatgcgactatga

SEQ ID NO: 676953 - DNA, 25 bp, Mus musculus
gcaggatacacagatgcgactatga

SEQ ID NO: 676954 - DNA, 25 bp, Mus musculus
gcaggataggttaaccccaaagaca

SEQ ID NO: 676955 - DNA, 25 bp, Mus musculus
gcaggataggtttaccccaaagaca

SEQ ID NO: 676956 - DNA, 25 bp, Mus musculus
gcaggatcacgaagttccggatgct

SEQ ID NO: 676957 - DNA, 25 bp, Mus musculus
gcaggatcacgatgttccggatgct

SEQ ID NO: 676958 - DNA, 25 bp, Mus musculus
gcaggatcctagcatgaatcttcag

SEQ ID NO: 676959 - DNA, 25 bp, Mus musculus
gcaggatcctaggatgaatcttcag

SEQ ID NO: 676960 - DNA, 25 bp, Mus musculus
gcaggatcctatcaccagcactgag

SEQ ID NO: 676961 - DNA, 25 bp, Mus musculus
gcaggatcctatgaccagcactgag

SEQ ID NO: 676962 - DNA, 25 bp, Mus musculus
gcaggatctaccatacccaggatgg

SEQ ID NO: 676963 - DNA, 25 bp, Mus musculus
gcaggatctaccttacccaggatgg

SEQ ID NO: 676964 - DNA, 25 bp, Mus musculus
gcaggatctgtgctgtggatgttct

SEQ ID NO: 676965 - DNA, 25 bp, Mus musculus
gcaggatctgtggtgtggatgttct

SEQ ID NO: 676966 - DNA, 25 bp, Mus musculus
gcaggatcttcaagggccatcgcta

SEQ ID NO: 676967 - DNA, 25 bp, Mus musculus
gcaggatcttcatgggccatcgcta

SEQ ID NO: 676968 - DNA, 25 bp, Mus musculus
gcaggatgcgtcactgccagcccag

SEQ ID NO: 676969 - DNA, 25 bp, Mus musculus
gcaggatgcgtctctgccagcccag

SEQ ID NO: 676970 - DNA, 25 bp, Mus musculus
gcaggatggcagaggacctaattct

SEQ ID NO: 676971 - DNA, 25 bp, Mus musculus
gcaggatggcagtggacctaattct

SEQ ID NO: 676972 - DNA, 25 bp, Mus musculus
gcaggatggctcctttaaatactcg

SEQ ID NO: 676973 - DNA, 25 bp, Mus musculus
gcaggatggctcgtttaaatactcg

SEQ ID NO: 676974 - DNA, 25 bp, Mus musculus
gcaggattatcacgatcttatagac

SEQ ID NO: 676975 - DNA, 25 bp, Mus musculus
gcaggattatcaggatcttatagac

SEQ ID NO: 676976 - DNA, 25 bp, Mus musculus
gcaggatttcgtacttgctcacaga

SEQ ID NO: 676977 - DNA, 25 bp, Mus musculus
gcaggatttcgttcttgctcacaga

SEQ ID NO: 676978 - DNA, 25 bp, Mus musculus
gcaggatttgcccacctaacccatt

SEQ ID NO: 676979 - DNA, 25 bp, Mus musculus
gcaggatttgccgacctaacccatt

SEQ ID NO: 676980 - DNA, 25 bp, Mus musculus
gcaggcaaagcactcgtacgtgtaa

SEQ ID NO: 676981 - DNA, 25 bp, Mus musculus
gcaggcaaagcagtcgtacgtgtaa

SEQ ID NO: 676982 - DNA, 25 bp, Mus musculus
gcaggcaaatccacatgacaccgag

SEQ ID NO: 676983 - DNA, 25 bp, Mus musculus
gcaggcaaatcctcatgacaccgag

SEQ ID NO: 676984 - DNA, 25 bp, Mus musculus
gcaggcaatgatactaccttgataa

SEQ ID NO: 676985 - DNA, 25 bp, Mus musculus
gcaggcaatgattctaccttgataa

SEQ ID NO: 676986 - DNA, 25 bp, Mus musculus
gcaggcacatgaccagatcacacat

SEQ ID NO: 676987 - DNA, 25 bp, Mus musculus
gcaggcacatgagcagatcacacat

SEQ ID NO: 676988 - DNA, 25 bp, Mus musculus
gcaggcacctggcaatgacaccttc

SEQ ID NO: 676989 - DNA, 25 bp, Mus musculus
gcaggcacctgggaatgacaccttc

SEQ ID NO: 676990 - DNA, 25 bp, Mus musculus
gcaggcagaattcgtcttttgtctc

SEQ ID NO: 676991 - DNA, 25 bp, Mus musculus
gcaggcagaattggtcttttgtctc

SEQ ID NO: 676992 - DNA, 25 bp, Mus musculus
gcaggcagacggaagaggcggtgct

SEQ ID NO: 676993 - DNA, 25 bp, Mus musculus
gcaggcagacggtagaggcggtgct

SEQ ID NO: 676994 - DNA, 25 bp, Mus musculus
gcaggcagcaatcaacatagtcaac

SEQ ID NO: 676995 - DNA, 25 bp, Mus musculus
gcaggcagcaatgaacatagtcaac

SEQ ID NO: 676996 - DNA, 25 bp, Mus musculus
gcaggcagcattaccgttagcggcg

SEQ ID NO: 676997 - DNA, 25 bp, Mus musculus
gcaggcagcatttccgttagcggcg

SEQ ID NO: 676998 - DNA, 25 bp, Mus musculus
gcaggcagtgaacgagccgactcca

SEQ ID NO: 676999 - DNA, 25 bp, Mus musculus
gcaggcagtgaaggagccgactcca

SEQ ID NO: 677000 - DNA, 25 bp, Mus musculus
gcaggcatgatgctgcctcccatga

SEQ ID NO: 677001 - DNA, 25 bp, Mus musculus
gcaggcatgatggtgcctcccatga

SEQ ID NO: 677002 - DNA, 25 bp, Mus musculus
gcaggcattgttagacttggccagg

SEQ ID NO: 677003 - DNA, 25 bp, Mus musculus
gcaggcattgtttgacttggccagg

SEQ ID NO: 677004 - DNA, 25 bp, Mus musculus
gcaggcatttatctccaaagctggg

SEQ ID NO: 677005 - DNA, 25 bp, Mus musculus
gcaggcatttatgtccaaagctggg

SEQ ID NO: 677006 - DNA, 25 bp, Mus musculus
gcaggcatttgacaatattgaagat

SEQ ID NO: 677007 - DNA, 25 bp, Mus musculus
gcaggcatttgagaatattgaagat

SEQ ID NO: 677008 - DNA, 25 bp, Mus musculus
gcaggccacaacctacggcatggct

SEQ ID NO: 677009 - DNA, 25 bp, Mus musculus
gcaggccacaacgtacggcatggct

SEQ ID NO: 677010 - DNA, 25 bp, Mus musculus
gcaggccatgaaccacattgtgagg

SEQ ID NO: 677011 - DNA, 25 bp, Mus musculus
gcaggccatgaagcacattgtgagg

SEQ ID NO: 677012 - DNA, 25 bp, Mus musculus
gcaggccatgcaactgtgttttgaa

SEQ ID NO: 677013 - DNA, 25 bp, Mus musculus
gcaggccatgcatctgtgttttgaa

SEQ ID NO: 677014 - DNA, 25 bp, Mus musculus
gcaggccattgtcgataaagtatcc

SEQ ID NO: 677015 - DNA, 25 bp, Mus musculus
gcaggccattgtggataaagtatcc

SEQ ID NO: 677016 - DNA, 25 bp, Mus musculus
gcaggcccaaagctacgtgcgcttc

SEQ ID NO: 677017 - DNA, 25 bp, Mus musculus
gcaggcccaaaggtacgtgcgcttc

SEQ ID NO: 677018 - DNA, 25 bp, Mus musculus
gcaggcccagatcaagggtcctgta

SEQ ID NO: 677019 - DNA, 25 bp, Mus musculus
gcaggcccagatgaagggtcctgta

SEQ ID NO: 677020 - DNA, 25 bp, Mus musculus
gcaggcccaggcagaagacctggat

SEQ ID NO: 677021 - DNA, 25 bp, Mus musculus
gcaggcccaggctgaagacctggat

SEQ ID NO: 677022 - DNA, 25 bp, Mus musculus
gcaggcccctgccatctgttcagag

SEQ ID NO: 677023 - DNA, 25 bp, Mus musculus
gcaggcccctgcgatctgttcagag

SEQ ID NO: 677024 - DNA, 25 bp, Mus musculus
gcaggcccttggagacccaatgact

SEQ ID NO: 677025 - DNA, 25 bp, Mus musculus
gcaggcccttggtgacccaatgact

SEQ ID NO: 677026 - DNA, 25 bp, Mus musculus
gcaggccgagccatagacgctttga

SEQ ID NO: 677027 - DNA, 25 bp, Mus musculus
gcaggccgagccttagacgctttga

SEQ ID NO: 677028 - DNA, 25 bp, Mus musculus
gcaggccgcactctgaccatggtat

SEQ ID NO: 677029 - DNA, 25 bp, Mus musculus
gcaggccgcactgtgaccatggtat

SEQ ID NO: 677030 - DNA, 25 bp, Mus musculus
gcaggccggagcatcacaatttgag

SEQ ID NO: 677031 - DNA, 25 bp, Mus musculus
gcaggccggagcttcacaatttgag

SEQ ID NO: 677032 - DNA, 25 bp, Mus musculus
gcaggcctcctgagaacttttccga

SEQ ID NO: 677033 - DNA, 25 bp, Mus musculus
gcaggcctcctgtgaacttttccga

SEQ ID NO: 677034 - DNA, 25 bp, Mus musculus
gcaggcctctagcacgttaacaacg

SEQ ID NO: 677035 - DNA, 25 bp, Mus musculus
gcaggcctctaggacgttaacaacg

SEQ ID NO: 677036 - DNA, 25 bp, Mus musculus
gcaggcctgagcaatgacctccaaa

SEQ ID NO: 677037 - DNA, 25 bp, Mus musculus
gcaggcctgagctatgacctccaaa

SEQ ID NO: 677038 - DNA, 25 bp, Mus musculus
gcaggcctgcatagaggccaagcac

SEQ ID NO: 677039 - DNA, 25 bp, Mus musculus
gcaggcctgcattgaggccaagcac

SEQ ID NO: 677040 - DNA, 25 bp, Mus musculus
gcaggcctgcctcttatgcttcctt

SEQ ID NO: 677041 - DNA, 25 bp, Mus musculus
gcaggcctgcctgttatgcttcctt

SEQ ID NO: 677042 - DNA, 25 bp, Mus musculus
gcaggccttgtacggccagcatttc

SEQ ID NO: 677043 - DNA, 25 bp, Mus musculus
gcaggccttgtagggccagcatttc

SEQ ID NO: 677044 - DNA, 25 bp, Mus musculus
gcaggcgatgatcgcaaaccaggcc

SEQ ID NO: 677045 - DNA, 25 bp, Mus musculus
gcaggcgatgatggcaaaccaggcc

SEQ ID NO: 677046 - DNA, 25 bp, Mus musculus
gcaggcgattcacgccttggaaaag

SEQ ID NO: 677047 - DNA, 25 bp, Mus musculus
gcaggcgattcaggccttggaaaag

SEQ ID NO: 677048 - DNA, 25 bp, Mus musculus
gcaggcgcacttccaacgtttgaga

SEQ ID NO: 677049 - DNA, 25 bp, Mus musculus
gcaggcgcacttgcaacgtttgaga

SEQ ID NO: 677050 - DNA, 25 bp, Mus musculus
gcaggcgctatgcaaatggtcaccg

SEQ ID NO: 677051 - DNA, 25 bp, Mus musculus
gcaggcgctatggaaatggtcaccg

SEQ ID NO: 677052 - DNA, 25 bp, Mus musculus
gcaggcgctcacagaagccatgtat

SEQ ID NO: 677053 - DNA, 25 bp, Mus musculus
gcaggcgctcaccattagggagctt

SEQ ID NO: 677054 - DNA, 25 bp, Mus musculus
gcaggcgctcacgattagggagctt

SEQ ID NO: 677055 - DNA, 25 bp, Mus musculus
gcaggcgctcactgaagccatgtat

SEQ ID NO: 677056 - DNA, 25 bp, Mus musculus
gcaggcgtaagtcttccctgtttgc

SEQ ID NO: 677057 - DNA, 25 bp, Mus musculus
gcaggcgtaagtgttccctgtttgc

SEQ ID NO: 677058 - DNA, 25 bp, Mus musculus
gcaggcgtacacagaagtgaagacg

SEQ ID NO: 677059 - DNA, 25 bp, Mus musculus
gcaggcgtacactgaagtgaagacg

SEQ ID NO: 677060 - DNA, 25 bp, Mus musculus
gcaggcgtccagaatctctgctgaa

SEQ ID NO: 677061 - DNA, 25 bp, Mus musculus
gcaggcgtccagtatctctgctgaa

SEQ ID NO: 677062 - DNA, 25 bp, Mus musculus
gcaggcgtctggaaaccagagccat

SEQ ID NO: 677063 - DNA, 25 bp, Mus musculus
gcaggcgtctggtaaccagagccat

SEQ ID NO: 677064 - DNA, 25 bp, Mus musculus
gcaggctaccagagccccagctgta

SEQ ID NO: 677065 - DNA, 25 bp, Mus musculus
gcaggctaccagtgccccagctgta

SEQ ID NO: 677066 - DNA, 25 bp, Mus musculus
gcaggctaccatagcaaggcggcag

SEQ ID NO: 677067 - DNA, 25 bp, Mus musculus
gcaggctaccattgcaaggcggcag

SEQ ID NO: 677068 - DNA, 25 bp, Mus musculus
gcaggctacggcctgacatcagagc

SEQ ID NO: 677069 - DNA, 25 bp, Mus musculus
gcaggctacggcgtgacatcagagc

SEQ ID NO: 677070 - DNA, 25 bp, Mus musculus
gcaggctatcctcggctccatggtg

SEQ ID NO: 677071 - DNA, 25 bp, Mus musculus
gcaggctatcctgggctccatggtg

SEQ ID NO: 677072 - DNA, 25 bp, Mus musculus
gcaggctcaacaccaatgaccgggt

SEQ ID NO: 677073 - DNA, 25 bp, Mus musculus
gcaggctcaacagcaatgaccgggt

SEQ ID NO: 677074 - DNA, 25 bp, Mus musculus
gcaggctcagaaagagactacacat

SEQ ID NO: 677075 - DNA, 25 bp, Mus musculus
gcaggctcagaatgagactacacat

SEQ ID NO: 677076 - DNA, 25 bp, Mus musculus
gcaggctccacgctgaacggttaca

SEQ ID NO: 677077 - DNA, 25 bp, Mus musculus
gcaggctccacggtgaacggttaca

SEQ ID NO: 677078 - DNA, 25 bp, Mus musculus
gcaggctcctcaatacctctacatg

SEQ ID NO: 677079 - DNA, 25 bp, Mus musculus
gcaggctcctcattacctctacatg

SEQ ID NO: 677080 - DNA, 25 bp, Mus musculus
gcaggctctaggagaagtcatccct

SEQ ID NO: 677081 - DNA, 25 bp, Mus musculus
gcaggctctaggtgaagtcatccct

SEQ ID NO: 677082 - DNA, 25 bp, Mus musculus
gcaggctctgtcacccactatggat

SEQ ID NO: 677083 - DNA, 25 bp, Mus musculus
gcaggctctgtctcccactatggat

SEQ ID NO: 677084 - DNA, 25 bp, Mus musculus
gcaggctcttctagtgttactgaaa

SEQ ID NO: 677085 - DNA, 25 bp, Mus musculus
gcaggctcttcttgtgttactgaaa

SEQ ID NO: 677086 - DNA, 25 bp, Mus musculus
gcaggctctttgatcagtttttaat

SEQ ID NO: 677087 - DNA, 25 bp, Mus musculus
gcaggctctttgttcagtttttaat

SEQ ID NO: 677088 - DNA, 25 bp, Mus musculus
gcaggcttactgagctggctgatcc

SEQ ID NO: 677089 - DNA, 25 bp, Mus musculus
gcaggcttactgcaagcaaaaccta

SEQ ID NO: 677090 - DNA, 25 bp, Mus musculus
gcaggcttactggaagcaaaaccta

SEQ ID NO: 677091 - DNA, 25 bp, Mus musculus
gcaggcttactgtgctggctgatcc

SEQ ID NO: 677092 - DNA, 25 bp, Mus musculus
gcaggcttagaaaagtggtgttacc

SEQ ID NO: 677093 - DNA, 25 bp, Mus musculus
gcaggcttagaatagtggtgttacc

SEQ ID NO: 677094 - DNA, 25 bp, Mus musculus
gcaggcttcatcatgctcattgaag

SEQ ID NO: 677095 - DNA, 25 bp, Mus musculus
gcaggcttcatcttgctcattgaag

SEQ ID NO: 677096 - DNA, 25 bp, Mus musculus
gcaggcttccttccagcttcatggg

SEQ ID NO: 677097 - DNA, 25 bp, Mus musculus
gcaggcttccttgcagcttcatggg

SEQ ID NO: 677098 - DNA, 25 bp, Mus musculus
gcaggcttcgttcttttcatacagg

SEQ ID NO: 677099 - DNA, 25 bp, Mus musculus
gcaggcttcgttgttttcatacagg

SEQ ID NO: 677100 - DNA, 25 bp, Mus musculus
gcaggctttcgacggacagttcgtt

SEQ ID NO: 677101 - DNA, 25 bp, Mus musculus
gcaggctttcgagggacagttcgtt

SEQ ID NO: 677102 - DNA, 25 bp, Mus musculus
gcaggctttgatcaagaaacgggat

SEQ ID NO: 677103 - DNA, 25 bp, Mus musculus
gcaggctttgatgaagaaacgggat

SEQ ID NO: 677104 - DNA, 25 bp, Mus musculus
gcaggctttggacatgtaactcacc

SEQ ID NO: 677105 - DNA, 25 bp, Mus musculus
gcaggctttggagatgtaactcacc

SEQ ID NO: 677106 - DNA, 25 bp, Mus musculus
gcagggaaaactacaactaagtgat

SEQ ID NO: 677107 - DNA, 25 bp, Mus musculus
gcagggaaaacttcaactaagtgat

SEQ ID NO: 677108 - DNA, 25 bp, Mus musculus
gcagggaaagacacgggacgactct

SEQ ID NO: 677109 - DNA, 25 bp, Mus musculus
gcagggaaagactcgggacgactct

SEQ ID NO: 677110 - DNA, 25 bp, Mus musculus
gcagggaagagcactctgctcaaga

SEQ ID NO: 677111 - DNA, 25 bp, Mus musculus
gcagggaagagctctctgctcaaga

SEQ ID NO: 677112 - DNA, 25 bp, Mus musculus
gcagggaatcaaccagccttccttg

SEQ ID NO: 677113 - DNA, 25 bp, Mus musculus
gcagggaatcaagcagccttccttg

SEQ ID NO: 677114 - DNA, 25 bp, Mus musculus
gcagggaatcctaacccttggctga

SEQ ID NO: 677115 - DNA, 25 bp, Mus musculus
gcagggaatccttacccttggctga

SEQ ID NO: 677116 - DNA, 25 bp, Mus musculus
gcagggacatcccaatggtgcctga

SEQ ID NO: 677117 - DNA, 25 bp, Mus musculus
gcagggacatccgaatggtgcctga

SEQ ID NO: 677118 - DNA, 25 bp, Mus musculus
gcagggaccacaaaggacctacaga

SEQ ID NO: 677119 - DNA, 25 bp, Mus musculus
gcagggaccacataggacctacaga

SEQ ID NO: 677120 - DNA, 25 bp, Mus musculus
gcagggacccctccttagtggtagc

SEQ ID NO: 677121 - DNA, 25 bp, Mus musculus
gcagggacccctgcttagtggtagc

SEQ ID NO: 677122 - DNA, 25 bp, Mus musculus
gcagggacgaccactatgtctccga

SEQ ID NO: 677123 - DNA, 25 bp, Mus musculus
gcagggacgacctctatgtctccga

SEQ ID NO: 677124 - DNA, 25 bp, Mus musculus
gcagggactctcagtctgcggacac

SEQ ID NO: 677125 - DNA, 25 bp, Mus musculus
gcagggactctctgtctgcggacac

SEQ ID NO: 677126 - DNA, 25 bp, Mus musculus
gcagggacttatctacaacttcacc

SEQ ID NO: 677127 - DNA, 25 bp, Mus musculus
gcagggacttatgtacaacttcacc

SEQ ID NO: 677128 - DNA, 25 bp, Mus musculus
gcagggagaacaccgacaaacacct

SEQ ID NO: 677129 - DNA, 25 bp, Mus musculus
gcagggagaacagcgacaaacacct

SEQ ID NO: 677130 - DNA, 25 bp, Mus musculus
gcagggagtcttaaccctgacgcct

SEQ ID NO: 677131 - DNA, 25 bp, Mus musculus
gcagggagtctttaccctgacgcct

SEQ ID NO: 677132 - DNA, 25 bp, Mus musculus
gcagggatggctcgaagcatcaaaa

SEQ ID NO: 677133 - DNA, 25 bp, Mus musculus
gcagggatggctggaagcatcaaaa

SEQ ID NO: 677134 - DNA, 25 bp, Mus musculus
gcagggatgtttactcacaggaggc

SEQ ID NO: 677135 - DNA, 25 bp, Mus musculus
gcagggatgttttctcacaggaggc

SEQ ID NO: 677136 - DNA, 25 bp, Mus musculus
gcagggcaaaaacaaggaatcttga

SEQ ID NO: 677137 - DNA, 25 bp, Mus musculus
gcagggcaaaaagaaggaatcttga

SEQ ID NO: 677138 - DNA, 25 bp, Mus musculus
gcagggcaatatcgctgttattgtt

SEQ ID NO: 677139 - DNA, 25 bp, Mus musculus
gcagggcaatatggctgttattgtt

SEQ ID NO: 677140 - DNA, 25 bp, Mus musculus
gcagggcacacacgtcccatggatt

SEQ ID NO: 677141 - DNA, 25 bp, Mus musculus
gcagggcacacaggtcccatggatt

SEQ ID NO: 677142 - DNA, 25 bp, Mus musculus
gcagggcacatgaggacctcagcat

SEQ ID NO: 677143 - DNA, 25 bp, Mus musculus
gcagggcacatgtggacctcagcat

SEQ ID NO: 677144 - DNA, 25 bp, Mus musculus
gcagggcactgaccatcaaggaaca

SEQ ID NO: 677145 - DNA, 25 bp, Mus musculus
gcagggcactgagcatcaaggaaca

SEQ ID NO: 677146 - DNA, 25 bp, Mus musculus
gcagggcaggcacaattattacatc

SEQ ID NO: 677147 - DNA, 25 bp, Mus musculus
gcagggcaggcagaattattacatc

SEQ ID NO: 677148 - DNA, 25 bp, Mus musculus
gcagggcatcctcgaactactacgg

SEQ ID NO: 677149 - DNA, 25 bp, Mus musculus
gcagggcatcctggaactactacgg

SEQ ID NO: 677150 - DNA, 25 bp, Mus musculus
gcagggccacctactcgagaagggc

SEQ ID NO: 677151 - DNA, 25 bp, Mus musculus
gcagggccaccttctcgagaagggc

SEQ ID NO: 677152 - DNA, 25 bp, Mus musculus
gcagggcccaatcaacacatcaaga

SEQ ID NO: 677153 - DNA, 25 bp, Mus musculus
gcagggcccaatgaacacatcaaga

SEQ ID NO: 677154 - DNA, 25 bp, Mus musculus
gcagggcccataattgtcttcaggg

SEQ ID NO: 677155 - DNA, 25 bp, Mus musculus
gcagggcccatatttgtcttcaggg

SEQ ID NO: 677156 - DNA, 25 bp, Mus musculus
gcagggcccttccaaggctattcga

SEQ ID NO: 677157 - DNA, 25 bp, Mus musculus
gcagggcccttcgaaggctattcga

SEQ ID NO: 677158 - DNA, 25 bp, Mus musculus
gcagggcctttgagaccacgcagag

SEQ ID NO: 677159 - DNA, 25 bp, Mus musculus
gcagggcctttgtgaccacgcagag

SEQ ID NO: 677160 - DNA, 25 bp, Mus musculus
gcagggctacgaagtcagcattcct

SEQ ID NO: 677161 - DNA, 25 bp, Mus musculus
gcagggctacgatgtcagcattcct

SEQ ID NO: 677162 - DNA, 25 bp, Mus musculus
gcagggctgaagctcactccagctg

SEQ ID NO: 677163 - DNA, 25 bp, Mus musculus
gcagggctgaaggtcactccagctg

SEQ ID NO: 677164 - DNA, 25 bp, Mus musculus
gcagggctgcctcccaacaagacag

SEQ ID NO: 677165 - DNA, 25 bp, Mus musculus
gcagggctgcctgccaacaagacag

SEQ ID NO: 677166 - DNA, 25 bp, Mus musculus
gcagggcttctactacgatggcaac

SEQ ID NO: 677167 - DNA, 25 bp, Mus musculus
gcagggcttctagtacgatggcaac

SEQ ID NO: 677168 - DNA, 25 bp, Mus musculus
gcagggctttctctggagcttttcg

SEQ ID NO: 677169 - DNA, 25 bp, Mus musculus
gcagggctttctgtggagcttttcg

SEQ ID NO: 677170 - DNA, 25 bp, Mus musculus
gcagggtaccaacgtattggtttgt

SEQ ID NO: 677171 - DNA, 25 bp, Mus musculus
gcagggtaccaaggtattggtttgt

SEQ ID NO: 677172 - DNA, 25 bp, Mus musculus
gcagggtagccgaaacacacgaatt

SEQ ID NO: 677173 - DNA, 25 bp, Mus musculus
gcagggtagccgtaacacacgaatt

SEQ ID NO: 677174 - DNA, 25 bp, Mus musculus
gcagggtcaggcattctctgcctgt

SEQ ID NO: 677175 - DNA, 25 bp, Mus musculus
gcagggtcaggctttctctgcctgt

SEQ ID NO: 677176 - DNA, 25 bp, Mus musculus
gcagggtcatgcagaacccactgaa

SEQ ID NO: 677177 - DNA, 25 bp, Mus musculus
gcagggtcatgctgaacccactgaa

SEQ ID NO: 677178 - DNA, 25 bp, Mus musculus
gcagggtcccatctggacgtttcct

SEQ ID NO: 677179 - DNA, 25 bp, Mus musculus
gcagggtcccatgtggacgtttcct

SEQ ID NO: 677180 - DNA, 25 bp, Mus musculus
gcagggtcctcaccgtgacagctgt

SEQ ID NO: 677181 - DNA, 25 bp, Mus musculus
gcagggtcctcagcgtgacagctgt

SEQ ID NO: 677182 - DNA, 25 bp, Mus musculus
gcagggtctcctagtctgccctagc

SEQ ID NO: 677183 - DNA, 25 bp, Mus musculus
gcagggtctccttgtctgccctagc

SEQ ID NO: 677184 - DNA, 25 bp, Mus musculus
gcagggtgcccactctacccaggat

SEQ ID NO: 677185 - DNA, 25 bp, Mus musculus
gcagggtgcccagtctacccaggat

SEQ ID NO: 677186 - DNA, 25 bp, Mus musculus
gcagggttagagaccaaagatttaa

SEQ ID NO: 677187 - DNA, 25 bp, Mus musculus
gcagggttagagtccaaagatttaa

SEQ ID NO: 677188 - DNA, 25 bp, Mus musculus
gcagggtttgtgacgccagcagccc

SEQ ID NO: 677189 - DNA, 25 bp, Mus musculus
gcagggtttgtgtcgccagcagccc

SEQ ID NO: 677190 - DNA, 25 bp, Mus musculus
gcaggtaatcttcacatgttcttat

SEQ ID NO: 677191 - DNA, 25 bp, Mus musculus
gcaggtaatcttgacatgttcttat

SEQ ID NO: 677192 - DNA, 25 bp, Mus musculus
gcaggtactacgaccatctcctggg

SEQ ID NO: 677193 - DNA, 25 bp, Mus musculus
gcaggtactacgtccatctcctggg

SEQ ID NO: 677194 - DNA, 25 bp, Mus musculus
gcaggtactagccaagcaacacacc

SEQ ID NO: 677195 - DNA, 25 bp, Mus musculus
gcaggtactagcgaagcaacacacc

SEQ ID NO: 677196 - DNA, 25 bp, Mus musculus
gcaggtactctcaagctcaatagcg

SEQ ID NO: 677197 - DNA, 25 bp, Mus musculus
gcaggtactctctagctcaatagcg

SEQ ID NO: 677198 - DNA, 25 bp, Mus musculus
gcaggtactgtcataaacgaatttc

SEQ ID NO: 677199 - DNA, 25 bp, Mus musculus
gcaggtactgtcttaaacgaatttc

SEQ ID NO: 677200 - DNA, 25 bp, Mus musculus
gcaggtatccatccggtgagatact

SEQ ID NO: 677201 - DNA, 25 bp, Mus musculus
gcaggtatccatgcggtgagatact

SEQ ID NO: 677202 - DNA, 25 bp, Mus musculus
gcaggtcaagaacagtatagtgcca

SEQ ID NO: 677203 - DNA, 25 bp, Mus musculus
gcaggtcaagaagagtatagtgcca

SEQ ID NO: 677204 - DNA, 25 bp, Mus musculus
gcaggtcaagttcctccgcagtgag

SEQ ID NO: 677205 - DNA, 25 bp, Mus musculus
gcaggtcaagttgctccgcagtgag

SEQ ID NO: 677206 - DNA, 25 bp, Mus musculus
gcaggtcaatcaatttcaaaaagat

SEQ ID NO: 677207 - DNA, 25 bp, Mus musculus
gcaggtcaatcattttcaaaaagat

SEQ ID NO: 677208 - DNA, 25 bp, Mus musculus
gcaggtcagaaaccacctggtacca

SEQ ID NO: 677209 - DNA, 25 bp, Mus musculus
gcaggtcagaaagcacctggtacca

SEQ ID NO: 677210 - DNA, 25 bp, Mus musculus
gcaggtcagcgtcctattactccaa

SEQ ID NO: 677211 - DNA, 25 bp, Mus musculus
gcaggtcagcgtgctattactccaa

SEQ ID NO: 677212 - DNA, 25 bp, Mus musculus
gcaggtcattctacgcatcagggag

SEQ ID NO: 677213 - DNA, 25 bp, Mus musculus
gcaggtcattcttcgcatcagggag

SEQ ID NO: 677214 - DNA, 25 bp, Mus musculus
gcaggtcccaagataaactgaatca

SEQ ID NO: 677215 - DNA, 25 bp, Mus musculus
gcaggtcccaagttaaactgaatca

SEQ ID NO: 677216 - DNA, 25 bp, Mus musculus
gcaggtccctgtagtcaaaaagcag

SEQ ID NO: 677217 - DNA, 25 bp, Mus musculus
gcaggtccctgttgtcaaaaagcag

SEQ ID NO: 677218 - DNA, 25 bp, Mus musculus
gcaggtccgcagacgcccggctttt

SEQ ID NO: 677219 - DNA, 25 bp, Mus musculus
gcaggtccgcagtcgcccggctttt

SEQ ID NO: 677220 - DNA, 25 bp, Mus musculus
gcaggtcctaaccaaagctggcacg

SEQ ID NO: 677221 - DNA, 25 bp, Mus musculus
gcaggtcctaacgaaagctggcacg

SEQ ID NO: 677222 - DNA, 25 bp, Mus musculus
gcaggtcctcctctcgctggtagaa

SEQ ID NO: 677223 - DNA, 25 bp, Mus musculus
gcaggtcctcctgtcgctggtagaa

SEQ ID NO: 677224 - DNA, 25 bp, Mus musculus
gcaggtcctcgcctagaacccggtt

SEQ ID NO: 677225 - DNA, 25 bp, Mus musculus
gcaggtcctcgcgtagaacccggtt

SEQ ID NO: 677226 - DNA, 25 bp, Mus musculus
gcaggtcggataactcggcaggaaa

SEQ ID NO: 677227 - DNA, 25 bp, Mus musculus
gcaggtcggatatctcggcaggaaa

SEQ ID NO: 677228 - DNA, 25 bp, Mus musculus
gcaggtctctgcagccgcctagtag

SEQ ID NO: 677229 - DNA, 25 bp, Mus musculus
gcaggtctctgctgccgcctagtag

SEQ ID NO: 677230 - DNA, 25 bp, Mus musculus
gcaggtgaacctccgagatgacctt

SEQ ID NO: 677231 - DNA, 25 bp, Mus musculus
gcaggtgaacctgcgagatgacctt

SEQ ID NO: 677232 - DNA, 25 bp, Mus musculus
gcaggtgaaggccaccatcatcagc

SEQ ID NO: 677233 - DNA, 25 bp, Mus musculus
gcaggtgaaggcgaccatcatcagc

SEQ ID NO: 677234 - DNA, 25 bp, Mus musculus
gcaggtgacatcaaactcaccaaag

SEQ ID NO: 677235 - DNA, 25 bp, Mus musculus
gcaggtgacatctaactcaccaaag

SEQ ID NO: 677236 - DNA, 25 bp, Mus musculus
gcaggtgaccttaagtggaactcca

SEQ ID NO: 677237 - DNA, 25 bp, Mus musculus
gcaggtgacctttagtggaactcca

SEQ ID NO: 677238 - DNA, 25 bp, Mus musculus
gcaggtgatctgaaagacagtgact

SEQ ID NO: 677239 - DNA, 25 bp, Mus musculus
gcaggtgatctgtaagacagtgact

SEQ ID NO: 677240 - DNA, 25 bp, Mus musculus
gcaggtgcaaccatggatcaacact

SEQ ID NO: 677241 - DNA, 25 bp, Mus musculus
gcaggtgcaaccttggatcaacact

SEQ ID NO: 677242 - DNA, 25 bp, Mus musculus
gcaggtgccaccagggcgagcttcc

SEQ ID NO: 677243 - DNA, 25 bp, Mus musculus
gcaggtgccacctgggcgagcttcc

SEQ ID NO: 677244 - DNA, 25 bp, Mus musculus
gcaggtgccctacattgggctgtaa

SEQ ID NO: 677245 - DNA, 25 bp, Mus musculus
gcaggtgccctagattgggctgtaa

SEQ ID NO: 677246 - DNA, 25 bp, Mus musculus
gcaggtgcttttctgtaccccgaaa

SEQ ID NO: 677247 - DNA, 25 bp, Mus musculus
gcaggtgcttttgtgtaccccgaaa

SEQ ID NO: 677248 - DNA, 25 bp, Mus musculus
gcaggtggatccaatgatgctttca

SEQ ID NO: 677249 - DNA, 25 bp, Mus musculus
gcaggtggatcctatgatgctttca

SEQ ID NO: 677250 - DNA, 25 bp, Mus musculus
gcaggtggatttcggctgtaacttc

SEQ ID NO: 677251 - DNA, 25 bp, Mus musculus
gcaggtggatttgggctgtaacttc

SEQ ID NO: 677252 - DNA, 25 bp, Mus musculus
gcaggtggtgaaaggctaccgccac

SEQ ID NO: 677253 - DNA, 25 bp, Mus musculus
gcaggtggtgaatggctaccgccac

SEQ ID NO: 677254 - DNA, 25 bp, Mus musculus
gcaggtggtggtattggctcaccca

SEQ ID NO: 677255 - DNA, 25 bp, Mus musculus
gcaggtggtggttttggctcaccca

SEQ ID NO: 677256 - DNA, 25 bp, Mus musculus
gcaggtgtacctcgactacctgagg

SEQ ID NO: 677257 - DNA, 25 bp, Mus musculus
gcaggtgtacctggactacctgagg

SEQ ID NO: 677258 - DNA, 25 bp, Mus musculus
gcaggtgtgacaatgaaagaagcaa

SEQ ID NO: 677259 - DNA, 25 bp, Mus musculus
gcaggtgtgacattgaaagaagcaa

SEQ ID NO: 677260 - DNA, 25 bp, Mus musculus
gcaggtgtgtcccttggacaacaga

SEQ ID NO: 677261 - DNA, 25 bp, Mus musculus
gcaggtgtgtccgttggacaacaga

SEQ ID NO: 677262 - DNA, 25 bp, Mus musculus
gcaggtgttgctctctcccaagagc

SEQ ID NO: 677263 - DNA, 25 bp, Mus musculus
gcaggtgttgctgtctcccaagagc

SEQ ID NO: 677264 - DNA, 25 bp, Mus musculus
gcaggttaaaggctactattccagt

SEQ ID NO: 677265 - DNA, 25 bp, Mus musculus
gcaggttaaagggtactattccagt

SEQ ID NO: 677266 - DNA, 25 bp, Mus musculus
gcaggttaagcccattttccgagag

SEQ ID NO: 677267 - DNA, 25 bp, Mus musculus
gcaggttaagccgattttccgagag

SEQ ID NO: 677268 - DNA, 25 bp, Mus musculus
gcaggttaggaaatcgacattgaat

SEQ ID NO: 677269 - DNA, 25 bp, Mus musculus
gcaggttaggaattcgacattgaat

SEQ ID NO: 677270 - DNA, 25 bp, Mus musculus
gcaggttcaccgcaccaggaaggct

SEQ ID NO: 677271 - DNA, 25 bp, Mus musculus
gcaggttcaccggaccaggaaggct

SEQ ID NO: 677272 - DNA, 25 bp, Mus musculus
gcaggttcacttaacaaaatattac

SEQ ID NO: 677273 - DNA, 25 bp, Mus musculus
gcaggttcactttacaaaatattac

SEQ ID NO: 677274 - DNA, 25 bp, Mus musculus
gcaggttcatagaaacatggttata

SEQ ID NO: 677275 - DNA, 25 bp, Mus musculus
gcaggttcatagtaacatggttata

SEQ ID NO: 677276 - DNA, 25 bp, Mus musculus
gcaggttcatcaagtcacagccgtg

SEQ ID NO: 677277 - DNA, 25 bp, Mus musculus
gcaggttcatcatgtcacagccgtg

SEQ ID NO: 677278 - DNA, 25 bp, Mus musculus
gcaggttctgaccatgctgtgaaaa

SEQ ID NO: 677279 - DNA, 25 bp, Mus musculus
gcaggttctgacgatgctgtgaaaa

SEQ ID NO: 677280 - DNA, 25 bp, Mus musculus
gcaggttctgagagccaaccagtac

SEQ ID NO: 677281 - DNA, 25 bp, Mus musculus
gcaggttctgagtgccaaccagtac

SEQ ID NO: 677282 - DNA, 25 bp, Mus musculus
gcaggttgacttagctacttcggcc

SEQ ID NO: 677283 - DNA, 25 bp, Mus musculus
gcaggttgactttgctacttcggcc

SEQ ID NO: 677284 - DNA, 25 bp, Mus musculus
gcaggttgccatcaaacttctgacc

SEQ ID NO: 677285 - DNA, 25 bp, Mus musculus
gcaggttgccatgaaacttctgacc

SEQ ID NO: 677286 - DNA, 25 bp, Mus musculus
gcaggttgtggaagccacaccccag

SEQ ID NO: 677287 - DNA, 25 bp, Mus musculus
gcaggttgtggatgccacaccccag

SEQ ID NO: 677288 - DNA, 25 bp, Mus musculus
gcaggtttcaacatcatcgcagagg

SEQ ID NO: 677289 - DNA, 25 bp, Mus musculus
gcaggtttcaacttcatcgcagagg

SEQ ID NO: 677290 - DNA, 25 bp, Mus musculus
gcaggtttctctcttgggcaggcaa

SEQ ID NO: 677291 - DNA, 25 bp, Mus musculus
gcaggtttctctgttgggcaggcaa

SEQ ID NO: 677292 - DNA, 25 bp, Mus musculus
gcaggtttgcaccatcccataccta

SEQ ID NO: 677293 - DNA, 25 bp, Mus musculus
gcaggtttgcacgatcccataccta

SEQ ID NO: 677294 - DNA, 25 bp, Mus musculus
gcaggttttcttcgtgtgtcctaca

SEQ ID NO: 677295 - DNA, 25 bp, Mus musculus
gcaggttttcttggtgtgtcctaca

SEQ ID NO: 677296 - DNA, 25 bp, Mus musculus
gcagtaaaagcacatagttcctcag

SEQ ID NO: 677297 - DNA, 25 bp, Mus musculus
gcagtaaaagcagatagttcctcag

SEQ ID NO: 677298 - DNA, 25 bp, Mus musculus
gcagtaaatatgaccttagagcaaa

SEQ ID NO: 677299 - DNA, 25 bp, Mus musculus
gcagtaaatatgtccttagagcaaa

SEQ ID NO: 677300 - DNA, 25 bp, Mus musculus
gcagtaacacccaggaggatgagct

SEQ ID NO: 677301 - DNA, 25 bp, Mus musculus
gcagtaacaccctggaggatgagct

SEQ ID NO: 677302 - DNA, 25 bp, Mus musculus
gcagtaacatgaatcctcagaccat

SEQ ID NO: 677303 - DNA, 25 bp, Mus musculus
gcagtaacatgattcctcagaccat

SEQ ID NO: 677304 - DNA, 25 bp, Mus musculus
gcagtaaccacactggtgatgtgct

SEQ ID NO: 677305 - DNA, 25 bp, Mus musculus
gcagtaaccacagtggtgatgtgct

SEQ ID NO: 677306 - DNA, 25 bp, Mus musculus
gcagtaacctgaagacactcctaga

SEQ ID NO: 677307 - DNA, 25 bp, Mus musculus
gcagtaacctgatgacactcctaga

SEQ ID NO: 677308 - DNA, 25 bp, Mus musculus
gcagtaagaaaaatttgtagtgctt

SEQ ID NO: 677309 - DNA, 25 bp, Mus musculus
gcagtaagaaaattttgtagtgctt

SEQ ID NO: 677310 - DNA, 25 bp, Mus musculus
gcagtaaggagcctggcaaaagcca

SEQ ID NO: 677311 - DNA, 25 bp, Mus musculus
gcagtaaggagcgtggcaaaagcca

SEQ ID NO: 677312 - DNA, 25 bp, Mus musculus
gcagtaattgcaaaacatggacatc

SEQ ID NO: 677313 - DNA, 25 bp, Mus musculus
gcagtaattgcataacatggacatc

SEQ ID NO: 677314 - DNA, 25 bp, Mus musculus
gcagtacaaacgagagctttaaaga

SEQ ID NO: 677315 - DNA, 25 bp, Mus musculus
gcagtacaaacgtgagctttaaaga

SEQ ID NO: 677316 - DNA, 25 bp, Mus musculus
gcagtacaaagccttctaaatcctt

SEQ ID NO: 677317 - DNA, 25 bp, Mus musculus
gcagtacaaagcgttctaaatcctt

SEQ ID NO: 677318 - DNA, 25 bp, Mus musculus
gcagtacaagcgctcaggcaccttg

SEQ ID NO: 677319 - DNA, 25 bp, Mus musculus
gcagtacaagcggtcaggcaccttg

SEQ ID NO: 677320 - DNA, 25 bp, Mus musculus
gcagtacagccacgaatccgctaac

SEQ ID NO: 677321 - DNA, 25 bp, Mus musculus
gcagtacagccaggaatccgctaac

SEQ ID NO: 677322 - DNA, 25 bp, Mus musculus
gcagtacagccccaaaatggttaag

SEQ ID NO: 677323 - DNA, 25 bp, Mus musculus
gcagtacagcccgaaaatggttaag

SEQ ID NO: 677324 - DNA, 25 bp, Mus musculus
gcagtacagtcacagcatcattacg

SEQ ID NO: 677325 - DNA, 25 bp, Mus musculus
gcagtacagtcagagcatcattacg

SEQ ID NO: 677326 - DNA, 25 bp, Mus musculus
gcagtacagtttcgcattccggaag

SEQ ID NO: 677327 - DNA, 25 bp, Mus musculus
gcagtacagtttggcattccggaag

SEQ ID NO: 677328 - DNA, 25 bp, Mus musculus
gcagtacatgacatgtgtttgtgtc

SEQ ID NO: 677329 - DNA, 25 bp, Mus musculus
gcagtacatgacttgtgtttgtgtc

SEQ ID NO: 677330 - DNA, 25 bp, Mus musculus
gcagtaccacttacggacctggcca

SEQ ID NO: 677331 - DNA, 25 bp, Mus musculus
gcagtaccactttcggacctggcca

SEQ ID NO: 677332 - DNA, 25 bp, Mus musculus
gcagtaccagtgacatcatgacgag

SEQ ID NO: 677333 - DNA, 25 bp, Mus musculus
gcagtaccagtgtcatcatgacgag

SEQ ID NO: 677334 - DNA, 25 bp, Mus musculus
gcagtaccggaaccgatgtggccta

SEQ ID NO: 677335 - DNA, 25 bp, Mus musculus
gcagtaccggaagcgatgtggccta

SEQ ID NO: 677336 - DNA, 25 bp, Mus musculus
gcagtacctttcaaccactttagca

SEQ ID NO: 677337 - DNA, 25 bp, Mus musculus
gcagtacctttctaccactttagca

SEQ ID NO: 677338 - DNA, 25 bp, Mus musculus
gcagtactacaaatccaatcctggt

SEQ ID NO: 677339 - DNA, 25 bp, Mus musculus
gcagtactacaacatcaagaagcaa

SEQ ID NO: 677340 - DNA, 25 bp, Mus musculus
gcagtactacaagatcaagaagcaa

SEQ ID NO: 677341 - DNA, 25 bp, Mus musculus
gcagtactacaattccaatcctggt

SEQ ID NO: 677342 - DNA, 25 bp, Mus musculus
gcagtactatttcaaacaatcaaga

SEQ ID NO: 677343 - DNA, 25 bp, Mus musculus
gcagtactatttgaaacaatcaaga

SEQ ID NO: 677344 - DNA, 25 bp, Mus musculus
gcagtactcttgaaaaacctacagg

SEQ ID NO: 677345 - DNA, 25 bp, Mus musculus
gcagtactcttgtaaaacctacagg

SEQ ID NO: 677346 - DNA, 25 bp, Mus musculus
gcagtactgtagatggtctcaaagc

SEQ ID NO: 677347 - DNA, 25 bp, Mus musculus
gcagtactgtagttggtctcaaagc

SEQ ID NO: 677348 - DNA, 25 bp, Mus musculus
gcagtactgtcaccagaagttcatt

SEQ ID NO: 677349 - DNA, 25 bp, Mus musculus
gcagtactgtcagcagaagttcatt

SEQ ID NO: 677350 - DNA, 25 bp, Mus musculus
gcagtacttcttctgcccagcctgg

SEQ ID NO: 677351 - DNA, 25 bp, Mus musculus
gcagtacttcttgtgcccagcctgg

SEQ ID NO: 677352 - DNA, 25 bp, Mus musculus
gcagtagagtccatccaggccgagg

SEQ ID NO: 677353 - DNA, 25 bp, Mus musculus
gcagtagagtccttccaggccgagg

SEQ ID NO: 677354 - DNA, 25 bp, Mus musculus
gcagtagattggcaaaatataggac

SEQ ID NO: 677355 - DNA, 25 bp, Mus musculus
gcagtagattgggaaaatataggac

SEQ ID NO: 677356 - DNA, 25 bp, Mus musculus
gcagtagcaaaaccttttattaagt

SEQ ID NO: 677357 - DNA, 25 bp, Mus musculus
gcagtagcaaaagcttttattaagt

SEQ ID NO: 677358 - DNA, 25 bp, Mus musculus
gcagtagcgactagctctcctcggt

SEQ ID NO: 677359 - DNA, 25 bp, Mus musculus
gcagtagcgacttgctctcctcggt

SEQ ID NO: 677360 - DNA, 25 bp, Mus musculus
gcagtagctctgatgtcacacattc

SEQ ID NO: 677361 - DNA, 25 bp, Mus musculus
gcagtagctctgttgtcacacattc

SEQ ID NO: 677362 - DNA, 25 bp, Mus musculus
gcagtagcttgcattcatcagggat

SEQ ID NO: 677363 - DNA, 25 bp, Mus musculus
gcagtagcttgctttcatcagggat

SEQ ID NO: 677364 - DNA, 25 bp, Mus musculus
gcagtaggatcaattttgatgactt

SEQ ID NO: 677365 - DNA, 25 bp, Mus musculus
gcagtaggatcatttttgatgactt

SEQ ID NO: 677366 - DNA, 25 bp, Mus musculus
gcagtaggccttcttagaagtcctc

SEQ ID NO: 677367 - DNA, 25 bp, Mus musculus
gcagtaggccttcttctagcagagc

SEQ ID NO: 677368 - DNA, 25 bp, Mus musculus
gcagtaggccttgttagaagtcctc

SEQ ID NO: 677369 - DNA, 25 bp, Mus musculus
gcagtaggccttgttctagcagagc

SEQ ID NO: 677370 - DNA, 25 bp, Mus musculus
gcagtagtgtctacacagcagccat

SEQ ID NO: 677371 - DNA, 25 bp, Mus musculus
gcagtagtgtcttcacagcagccat

SEQ ID NO: 677372 - DNA, 25 bp, Mus musculus
gcagtataaaaacagccgtattcct

SEQ ID NO: 677373 - DNA, 25 bp, Mus musculus
gcagtataaaaagagccgtattcct

SEQ ID NO: 677374 - DNA, 25 bp, Mus musculus
gcagtatactagatctccagttgta

SEQ ID NO: 677375 - DNA, 25 bp, Mus musculus
gcagtatactagttctccagttgta

SEQ ID NO: 677376 - DNA, 25 bp, Mus musculus
gcagtatcagaactcagtgttcccc

SEQ ID NO: 677377 - DNA, 25 bp, Mus musculus
gcagtatcagaagtcagtgttcccc

SEQ ID NO: 677378 - DNA, 25 bp, Mus musculus
gcagtatcatggcattacagaggag

SEQ ID NO: 677379 - DNA, 25 bp, Mus musculus
gcagtatcatgggattacagaggag

SEQ ID NO: 677380 - DNA, 25 bp, Mus musculus
gcagtatgaaaaactctccacacta

SEQ ID NO: 677381 - DNA, 25 bp, Mus musculus
gcagtatgaaaatctctccacacta

SEQ ID NO: 677382 - DNA, 25 bp, Mus musculus
gcagtatgcacaacctaatgccgcc

SEQ ID NO: 677383 - DNA, 25 bp, Mus musculus
gcagtatgcacatcctaatgccgcc

SEQ ID NO: 677384 - DNA, 25 bp, Mus musculus
gcagtatgcactagcagcagcccac

SEQ ID NO: 677385 - DNA, 25 bp, Mus musculus
gcagtatgcacttgcagcagcccac

SEQ ID NO: 677386 - DNA, 25 bp, Mus musculus
gcagtatgcattagcagcagctcag

SEQ ID NO: 677387 - DNA, 25 bp, Mus musculus
gcagtatgcatttgcagcagctcag

SEQ ID NO: 677388 - DNA, 25 bp, Mus musculus
gcagtatgctgaagcacggtttcct

SEQ ID NO: 677389 - DNA, 25 bp, Mus musculus
gcagtatgctgatgcacggtttcct

SEQ ID NO: 677390 - DNA, 25 bp, Mus musculus
gcagtattctcaacaacaagctcat

SEQ ID NO: 677391 - DNA, 25 bp, Mus musculus
gcagtattctcatcaacaagctcat

SEQ ID NO: 677392 - DNA, 25 bp, Mus musculus
gcagtcaaaacaccgatgtacataa

SEQ ID NO: 677393 - DNA, 25 bp, Mus musculus
gcagtcaaaacagcgatgtacataa

SEQ ID NO: 677394 - DNA, 25 bp, Mus musculus
gcagtcaaccccaagttcctggcag

SEQ ID NO: 677395 - DNA, 25 bp, Mus musculus
gcagtcaacccctagttcctggcag

SEQ ID NO: 677396 - DNA, 25 bp, Mus musculus
gcagtcaaggcaaggtgcacaaccc

SEQ ID NO: 677397 - DNA, 25 bp, Mus musculus
gcagtcaaggcatggtgcacaaccc

SEQ ID NO: 677398 - DNA, 25 bp, Mus musculus
gcagtcaagtacctcatggcctcag

SEQ ID NO: 677399 - DNA, 25 bp, Mus musculus
gcagtcaagtacgtcatggcctcag

SEQ ID NO: 677400 - DNA, 25 bp, Mus musculus
gcagtcaataatcatggagagaaga

SEQ ID NO: 677401 - DNA, 25 bp, Mus musculus
gcagtcaataatgatggagagaaga

SEQ ID NO: 677402 - DNA, 25 bp, Mus musculus
gcagtcaattctattaaaacagatg

SEQ ID NO: 677403 - DNA, 25 bp, Mus musculus
gcagtcaattcttttaaaacagatg

SEQ ID NO: 677404 - DNA, 25 bp, Mus musculus
gcagtcacactcatcggtagcctgt

SEQ ID NO: 677405 - DNA, 25 bp, Mus musculus
gcagtcacactcttcggtagcctgt

SEQ ID NO: 677406 - DNA, 25 bp, Mus musculus
gcagtcagagcgctcactgtgatgt

SEQ ID NO: 677407 - DNA, 25 bp, Mus musculus
gcagtcagagcggtcactgtgatgt

SEQ ID NO: 677408 - DNA, 25 bp, Mus musculus
gcagtcagcagtctgcggagctttt

SEQ ID NO: 677409 - DNA, 25 bp, Mus musculus
gcagtcagcagtgtgcggagctttt

SEQ ID NO: 677410 - DNA, 25 bp, Mus musculus
gcagtcagcctaagctgctccgagt

SEQ ID NO: 677411 - DNA, 25 bp, Mus musculus
gcagtcagcctatgctgctccgagt

SEQ ID NO: 677412 - DNA, 25 bp, Mus musculus
gcagtcatcattccaggcattgtta

SEQ ID NO: 677413 - DNA, 25 bp, Mus musculus
gcagtcatcattgcaggcattgtta

SEQ ID NO: 677414 - DNA, 25 bp, Mus musculus
gcagtcatcgacaaggccacagtgt

SEQ ID NO: 677415 - DNA, 25 bp, Mus musculus
gcagtcatcgactaggccacagtgt

SEQ ID NO: 677416 - DNA, 25 bp, Mus musculus
gcagtcatctatatcgatgtgcccg

SEQ ID NO: 677417 - DNA, 25 bp, Mus musculus
gcagtcatctatttcgatgtgcccg

SEQ ID NO: 677418 - DNA, 25 bp, Mus musculus
gcagtcatgacacagctgagcctga

SEQ ID NO: 677419 - DNA, 25 bp, Mus musculus
gcagtcatgacagagctgagcctga

SEQ ID NO: 677420 - DNA, 25 bp, Mus musculus
gcagtcatggttaccaatgtcctct

SEQ ID NO: 677421 - DNA, 25 bp, Mus musculus
gcagtcatggtttccaatgtcctct

SEQ ID NO: 677422 - DNA, 25 bp, Mus musculus
gcagtccaaggcactgactgcctga

SEQ ID NO: 677423 - DNA, 25 bp, Mus musculus
gcagtccaaggctctgactgcctga

SEQ ID NO: 677424 - DNA, 25 bp, Mus musculus
gcagtccacatgcaaccccagaaga

SEQ ID NO: 677425 - DNA, 25 bp, Mus musculus
gcagtccacatggaaccccagaaga

SEQ ID NO: 677426 - DNA, 25 bp, Mus musculus
gcagtccagaaacaagagccactta

SEQ ID NO: 677427 - DNA, 25 bp, Mus musculus
gcagtccagaaagaagagccactta

SEQ ID NO: 677428 - DNA, 25 bp, Mus musculus
gcagtccagatcagaaggcagagct

SEQ ID NO: 677429 - DNA, 25 bp, Mus musculus
gcagtccagatctgaaggcagagct

SEQ ID NO: 677430 - DNA, 25 bp, Mus musculus
gcagtccagcgtaggtacccagcac

SEQ ID NO: 677431 - DNA, 25 bp, Mus musculus
gcagtccagcgttggtacccagcac

SEQ ID NO: 677432 - DNA, 25 bp, Mus musculus
gcagtccaggcaagaaggtctcgga

SEQ ID NO: 677433 - DNA, 25 bp, Mus musculus
gcagtccaggcatgaaggtctcgga

SEQ ID NO: 677434 - DNA, 25 bp, Mus musculus
gcagtcccaagaaatgttttgaagg

SEQ ID NO: 677435 - DNA, 25 bp, Mus musculus
gcagtcccaagatatgttttgaagg

SEQ ID NO: 677436 - DNA, 25 bp, Mus musculus
gcagtccccactcgtgacgggtgaa

SEQ ID NO: 677437 - DNA, 25 bp, Mus musculus
gcagtccccactggtgacgggtgaa

SEQ ID NO: 677438 - DNA, 25 bp, Mus musculus
gcagtccccgggactggtgcgcctt

SEQ ID NO: 677439 - DNA, 25 bp, Mus musculus
gcagtccccgggtctggtgcgcctt

SEQ ID NO: 677440 - DNA, 25 bp, Mus musculus
gcagtcccctccagcgtcgaaagga

SEQ ID NO: 677441 - DNA, 25 bp, Mus musculus
gcagtcccctcctgcgtcgaaagga

SEQ ID NO: 677442 - DNA, 25 bp, Mus musculus
gcagtccctaaaaattacaagctgg

SEQ ID NO: 677443 - DNA, 25 bp, Mus musculus
gcagtccctaaatattacaagctgg

SEQ ID NO: 677444 - DNA, 25 bp, Mus musculus
gcagtccctaagcagcaaatgagca

SEQ ID NO: 677445 - DNA, 25 bp, Mus musculus
gcagtccctaaggagcaaatgagca

SEQ ID NO: 677446 - DNA, 25 bp, Mus musculus
gcagtccctcgacaggagctgtttg

SEQ ID NO: 677447 - DNA, 25 bp, Mus musculus
gcagtccctcgacctcgcgggtaaa

SEQ ID NO: 677448 - DNA, 25 bp, Mus musculus
gcagtccctcgagaggagctgtttg

SEQ ID NO: 677449 - DNA, 25 bp, Mus musculus
gcagtccctcgagctcgcgggtaaa

SEQ ID NO: 677450 - DNA, 25 bp, Mus musculus
gcagtccgatgaacgacttcagcct

SEQ ID NO: 677451 - DNA, 25 bp, Mus musculus
gcagtccgatgatcgacttcagcct

SEQ ID NO: 677452 - DNA, 25 bp, Mus musculus
gcagtcctacttccagtggctacaa

SEQ ID NO: 677453 - DNA, 25 bp, Mus musculus
gcagtcctacttgcagtggctacaa

SEQ ID NO: 677454 - DNA, 25 bp, Mus musculus
gcagtcctctgcagccggggtcaga

SEQ ID NO: 677455 - DNA, 25 bp, Mus musculus
gcagtcctctgctgccggggtcaga

SEQ ID NO: 677456 - DNA, 25 bp, Mus musculus
gcagtcctgcttcgctgacaaggaa

SEQ ID NO: 677457 - DNA, 25 bp, Mus musculus
gcagtcctgcttggctgacaaggaa

SEQ ID NO: 677458 - DNA, 25 bp, Mus musculus
gcagtcgcagctcttggctttgaag

SEQ ID NO: 677459 - DNA, 25 bp, Mus musculus
gcagtcgcagctgttggctttgaag

SEQ ID NO: 677460 - DNA, 25 bp, Mus musculus
gcagtcgcgggcacctgtgtcctgt

SEQ ID NO: 677461 - DNA, 25 bp, Mus musculus
gcagtcgcgggcattggctatgaca

SEQ ID NO: 677462 - DNA, 25 bp, Mus musculus
gcagtcgcgggctcctgtgtcctgt

SEQ ID NO: 677463 - DNA, 25 bp, Mus musculus
gcagtcgcgggctttggctatgaca

SEQ ID NO: 677464 - DNA, 25 bp, Mus musculus
gcagtcgctatgacaatgcccatat

SEQ ID NO: 677465 - DNA, 25 bp, Mus musculus
gcagtcgctatgtcaatgcccatat

SEQ ID NO: 677466 - DNA, 25 bp, Mus musculus
gcagtcgctcggaactgcggacctg

SEQ ID NO: 677467 - DNA, 25 bp, Mus musculus
gcagtcgctcggtactgcggacctg

SEQ ID NO: 677468 - DNA, 25 bp, Mus musculus
gcagtcggacgtatccggttgcacc

SEQ ID NO: 677469 - DNA, 25 bp, Mus musculus
gcagtcggacgtttccggttgcacc

SEQ ID NO: 677470 - DNA, 25 bp, Mus musculus
gcagtcgggtcgcactctgctctcg

SEQ ID NO: 677471 - DNA, 25 bp, Mus musculus
gcagtcgggtcggactctgctctcg

SEQ ID NO: 677472 - DNA, 25 bp, Mus musculus
gcagtcggtacccagaccaatggat

SEQ ID NO: 677473 - DNA, 25 bp, Mus musculus
gcagtcggtaccgagaccaatggat

SEQ ID NO: 677474 - DNA, 25 bp, Mus musculus
gcagtctaagacaagtgagcagtct

SEQ ID NO: 677475 - DNA, 25 bp, Mus musculus
gcagtctaagactagtgagcagtct

SEQ ID NO: 677476 - DNA, 25 bp, Mus musculus
gcagtctatcgaaaagaaggcaaca

SEQ ID NO: 677477 - DNA, 25 bp, Mus musculus
gcagtctatcgataagaaggcaaca

SEQ ID NO: 677478 - DNA, 25 bp, Mus musculus
gcagtctattgcaagttccattaca

SEQ ID NO: 677479 - DNA, 25 bp, Mus musculus
gcagtctattgctagttccattaca

SEQ ID NO: 677480 - DNA, 25 bp, Mus musculus
gcagtctccaggatcgagcctctca

SEQ ID NO: 677481 - DNA, 25 bp, Mus musculus
gcagtctccaggttcgagcctctca

SEQ ID NO: 677482 - DNA, 25 bp, Mus musculus
gcagtctcccctaggtaattggtcc

SEQ ID NO: 677483 - DNA, 25 bp, Mus musculus
gcagtctccccttggtaattggtcc

SEQ ID NO: 677484 - DNA, 25 bp, Mus musculus
gcagtctcctgacttatggccgccg

SEQ ID NO: 677485 - DNA, 25 bp, Mus musculus
gcagtctcctgagttatggccgccg

SEQ ID NO: 677486 - DNA, 25 bp, Mus musculus
gcagtctcggaacccaggaagtcaa

SEQ ID NO: 677487 - DNA, 25 bp, Mus musculus
gcagtctcggaagccaggaagtcaa

SEQ ID NO: 677488 - DNA, 25 bp, Mus musculus
gcagtctctatcaactgagctccag

SEQ ID NO: 677489 - DNA, 25 bp, Mus musculus
gcagtctctatctactgagctccag

SEQ ID NO: 677490 - DNA, 25 bp, Mus musculus
gcagtctcttccagggacctgctgc

SEQ ID NO: 677491 - DNA, 25 bp, Mus musculus
gcagtctcttcctgggacctgctgc

SEQ ID NO: 677492 - DNA, 25 bp, Mus musculus
gcagtctgaaatcggacctcgcgct

SEQ ID NO: 677493 - DNA, 25 bp, Mus musculus
gcagtctgaaatgggacctcgcgct

SEQ ID NO: 677494 - DNA, 25 bp, Mus musculus
gcagtctgcctcataagccatagcg

SEQ ID NO: 677495 - DNA, 25 bp, Mus musculus
gcagtctgcctcttaagccatagcg

SEQ ID NO: 677496 - DNA, 25 bp, Mus musculus
gcagtctggatgatggatgcacaca

SEQ ID NO: 677497 - DNA, 25 bp, Mus musculus
gcagtctggatgttggatgcacaca

SEQ ID NO: 677498 - DNA, 25 bp, Mus musculus
gcagtcttcccaccttcttccatga

SEQ ID NO: 677499 - DNA, 25 bp, Mus musculus
gcagtcttcccagcttcttccatga

SEQ ID NO: 677500 - DNA, 25 bp, Mus musculus
gcagtcttccttcggctctgtatgg

SEQ ID NO: 677501 - DNA, 25 bp, Mus musculus
gcagtcttccttgggctctgtatgg

SEQ ID NO: 677502 - DNA, 25 bp, Mus musculus
gcagtcttctgaccctgagttgcag

SEQ ID NO: 677503 - DNA, 25 bp, Mus musculus
gcagtcttctgagcctgagttgcag

SEQ ID NO: 677504 - DNA, 25 bp, Mus musculus
gcagtctttaaaaggagtctttccc

SEQ ID NO: 677505 - DNA, 25 bp, Mus musculus
gcagtctttaaatggagtctttccc

SEQ ID NO: 677506 - DNA, 25 bp, Mus musculus
gcagtctttgtacgtgaaatttgac

SEQ ID NO: 677507 - DNA, 25 bp, Mus musculus
gcagtctttgtaggtgaaatttgac

SEQ ID NO: 677508 - DNA, 25 bp, Mus musculus
gcagtgaaccaaccttggatgtgaa

SEQ ID NO: 677509 - DNA, 25 bp, Mus musculus
gcagtgaaccaagcttggatgtgaa

SEQ ID NO: 677510 - DNA, 25 bp, Mus musculus
gcagtgaaccttcacagcgtcatct

SEQ ID NO: 677511 - DNA, 25 bp, Mus musculus
gcagtgaaccttgacagcgtcatct

SEQ ID NO: 677512 - DNA, 25 bp, Mus musculus
gcagtgaagcctccatagaaagcaa

SEQ ID NO: 677513 - DNA, 25 bp, Mus musculus
gcagtgaagcctgcatagaaagcaa

SEQ ID NO: 677514 - DNA, 25 bp, Mus musculus
gcagtgaaggctcctcgtgcagcct

SEQ ID NO: 677515 - DNA, 25 bp, Mus musculus
gcagtgaaggctgctcgtgcagcct

SEQ ID NO: 677516 - DNA, 25 bp, Mus musculus
gcagtgaatgacctctgtctgaatg

SEQ ID NO: 677517 - DNA, 25 bp, Mus musculus
gcagtgaatgacgtctgtctgaatg

SEQ ID NO: 677518 - DNA, 25 bp, Mus musculus
gcagtgaatgctccccaggactcca

SEQ ID NO: 677519 - DNA, 25 bp, Mus musculus
gcagtgaatgctgcccaggactcca

SEQ ID NO: 677520 - DNA, 25 bp, Mus musculus
gcagtgacacaaccagaactgggtc

SEQ ID NO: 677521 - DNA, 25 bp, Mus musculus
gcagtgacacaagcagaactgggtc

SEQ ID NO: 677522 - DNA, 25 bp, Mus musculus
gcagtgacagaacgccaggccaatc

SEQ ID NO: 677523 - DNA, 25 bp, Mus musculus
gcagtgacagaaggccaggccaatc

SEQ ID NO: 677524 - DNA, 25 bp, Mus musculus
gcagtgacagctcctatgtgcgcca

SEQ ID NO: 677525 - DNA, 25 bp, Mus musculus
gcagtgacagctgctatgtgcgcca

SEQ ID NO: 677526 - DNA, 25 bp, Mus musculus
gcagtgaccaccagattgaaatggc

SEQ ID NO: 677527 - DNA, 25 bp, Mus musculus
gcagtgaccacctgattgaaatggc

SEQ ID NO: 677528 - DNA, 25 bp, Mus musculus
gcagtgaccactataggccgtaggg

SEQ ID NO: 677529 - DNA, 25 bp, Mus musculus
gcagtgaccactctgacacagtcta

SEQ ID NO: 677530 - DNA, 25 bp, Mus musculus
gcagtgaccactgtgacacagtcta

SEQ ID NO: 677531 - DNA, 25 bp, Mus musculus
gcagtgaccactttaggccgtaggg

SEQ ID NO: 677532 - DNA, 25 bp, Mus musculus
gcagtgaccctgatactggtagtga

SEQ ID NO: 677533 - DNA, 25 bp, Mus musculus
gcagtgaccctgttactggtagtga

SEQ ID NO: 677534 - DNA, 25 bp, Mus musculus
gcagtgacctcacctagccagatga

SEQ ID NO: 677535 - DNA, 25 bp, Mus musculus
gcagtgacctcactacagacctgat

SEQ ID NO: 677536 - DNA, 25 bp, Mus musculus
gcagtgacctcagctagccagatga

SEQ ID NO: 677537 - DNA, 25 bp, Mus musculus
gcagtgacctcagtacagacctgat

SEQ ID NO: 677538 - DNA, 25 bp, Mus musculus
gcagtgacgcagacaacgaaattac

SEQ ID NO: 677539 - DNA, 25 bp, Mus musculus
gcagtgacgcagtcaacgaaattac

SEQ ID NO: 677540 - DNA, 25 bp, Mus musculus
gcagtgactcttcagctgggcgccc

SEQ ID NO: 677541 - DNA, 25 bp, Mus musculus
gcagtgactcttgagctgggcgccc

SEQ ID NO: 677542 - DNA, 25 bp, Mus musculus
gcagtgactgttctacattgaggct

SEQ ID NO: 677543 - DNA, 25 bp, Mus musculus
gcagtgactgttgtacattgaggct

SEQ ID NO: 677544 - DNA, 25 bp, Mus musculus
gcagtgacttctccctgcgctcaag

SEQ ID NO: 677545 - DNA, 25 bp, Mus musculus
gcagtgacttctgcctgcgctcaag

SEQ ID NO: 677546 - DNA, 25 bp, Mus musculus
gcagtgagcgctcgcctactgacaa

SEQ ID NO: 677547 - DNA, 25 bp, Mus musculus
gcagtgagcgctggcctactgacaa

SEQ ID NO: 677548 - DNA, 25 bp, Mus musculus
gcagtgagctgaacaagttactgag

SEQ ID NO: 677549 - DNA, 25 bp, Mus musculus
gcagtgagctgatcaagttactgag

SEQ ID NO: 677550 - DNA, 25 bp, Mus musculus
gcagtgagctgtcccacagaatgct

SEQ ID NO: 677551 - DNA, 25 bp, Mus musculus
gcagtgagctgtgccacagaatgct

SEQ ID NO: 677552 - DNA, 25 bp, Mus musculus
gcagtgagtactcgctctatgacct

SEQ ID NO: 677553 - DNA, 25 bp, Mus musculus
gcagtgagtactggctctatgacct

SEQ ID NO: 677554 - DNA, 25 bp, Mus musculus
gcagtgatggtgaccctggacctaa

SEQ ID NO: 677555 - DNA, 25 bp, Mus musculus
gcagtgatggtgtccctggacctaa

SEQ ID NO: 677556 - DNA, 25 bp, Mus musculus
gcagtgattagactgcagtgaatta

SEQ ID NO: 677557 - DNA, 25 bp, Mus musculus
gcagtgattagagtgcagtgaatta

SEQ ID NO: 677558 - DNA, 25 bp, Mus musculus
gcagtgcaaaagcagctaaagtgca

SEQ ID NO: 677559 - DNA, 25 bp, Mus musculus
gcagtgcaaaaggagctaaagtgca

SEQ ID NO: 677560 - DNA, 25 bp, Mus musculus
gcagtgcacatgctgttgagatgtt

SEQ ID NO: 677561 - DNA, 25 bp, Mus musculus
gcagtgcacatggtgttgagatgtt

SEQ ID NO: 677562 - DNA, 25 bp, Mus musculus
gcagtgcaccatcatcagggcgaag

SEQ ID NO: 677563 - DNA, 25 bp, Mus musculus
gcagtgcaccatgatcagggcgaag

SEQ ID NO: 677564 - DNA, 25 bp, Mus musculus
gcagtgcagctaagaggaggccttt

SEQ ID NO: 677565 - DNA, 25 bp, Mus musculus
gcagtgcagctatgaggaggccttt

SEQ ID NO: 677566 - DNA, 25 bp, Mus musculus
gcagtgcagttgcaacacctgccag

SEQ ID NO: 677567 - DNA, 25 bp, Mus musculus
gcagtgcagttggaacacctgccag

SEQ ID NO: 677568 - DNA, 25 bp, Mus musculus
gcagtgcagtttcccatttttgccg

SEQ ID NO: 677569 - DNA, 25 bp, Mus musculus
gcagtgcagtttgccatttttgccg

SEQ ID NO: 677570 - DNA, 25 bp, Mus musculus
gcagtgcatattccttcacagcctt

SEQ ID NO: 677571 - DNA, 25 bp, Mus musculus
gcagtgcatattgcttcacagcctt

SEQ ID NO: 677572 - DNA, 25 bp, Mus musculus
gcagtgccaacaaggactggcggtc

SEQ ID NO: 677573 - DNA, 25 bp, Mus musculus
gcagtgccaacatggactggcggtc

SEQ ID NO: 677574 - DNA, 25 bp, Mus musculus
gcagtgccagctcttaatcgcacag

SEQ ID NO: 677575 - DNA, 25 bp, Mus musculus
gcagtgccagctgttaatcgcacag

SEQ ID NO: 677576 - DNA, 25 bp, Mus musculus
gcagtgcccatgctgatcacttatt

SEQ ID NO: 677577 - DNA, 25 bp, Mus musculus
gcagtgcccatggtgatcacttatt

SEQ ID NO: 677578 - DNA, 25 bp, Mus musculus
gcagtgccgccccatgtcggcaagt

SEQ ID NO: 677579 - DNA, 25 bp, Mus musculus
gcagtgccgcccgatgtcggcaagt

SEQ ID NO: 677580 - DNA, 25 bp, Mus musculus
gcagtgccgctgatgacttactttt

SEQ ID NO: 677581 - DNA, 25 bp, Mus musculus
gcagtgccgctgttgacttactttt

SEQ ID NO: 677582 - DNA, 25 bp, Mus musculus
gcagtgcctattagaacatgtttga

SEQ ID NO: 677583 - DNA, 25 bp, Mus musculus
gcagtgcctatttgaacatgtttga

SEQ ID NO: 677584 - DNA, 25 bp, Mus musculus
gcagtgcctcctctgagctgaacct

SEQ ID NO: 677585 - DNA, 25 bp, Mus musculus
gcagtgcctcctgtgagctgaacct

SEQ ID NO: 677586 - DNA, 25 bp, Mus musculus
gcagtgcctgtcctctctttataag

SEQ ID NO: 677587 - DNA, 25 bp, Mus musculus
gcagtgcctgtcgtctctttataag

SEQ ID NO: 677588 - DNA, 25 bp, Mus musculus
gcagtgccttcacggctgtgagcaa

SEQ ID NO: 677589 - DNA, 25 bp, Mus musculus
gcagtgccttcagggctgtgagcaa

SEQ ID NO: 677590 - DNA, 25 bp, Mus musculus
gcagtgcgcactcgtatctccgagg

SEQ ID NO: 677591 - DNA, 25 bp, Mus musculus
gcagtgcgcactggtatctccgagg

SEQ ID NO: 677592 - DNA, 25 bp, Mus musculus
gcagtgcggatcattctcttcggaa

SEQ ID NO: 677593 - DNA, 25 bp, Mus musculus
gcagtgcggatctttctcttcggaa

SEQ ID NO: 677594 - DNA, 25 bp, Mus musculus
gcagtgctactccaaagacatcgtg

SEQ ID NO: 677595 - DNA, 25 bp, Mus musculus
gcagtgctactcgaaagacatcgtg

SEQ ID NO: 677596 - DNA, 25 bp, Mus musculus
gcagtgctcacactgctggaggtca

SEQ ID NO: 677597 - DNA, 25 bp, Mus musculus
gcagtgctcacagtgctggaggtca

SEQ ID NO: 677598 - DNA, 25 bp, Mus musculus
gcagtgctcactcctgagatcacca

SEQ ID NO: 677599 - DNA, 25 bp, Mus musculus
gcagtgctcactgctgagatcacca

SEQ ID NO: 677600 - DNA, 25 bp, Mus musculus
gcagtgctcgccacatggtcatgca

SEQ ID NO: 677601 - DNA, 25 bp, Mus musculus
gcagtgctcgcctcatggtcatgca

SEQ ID NO: 677602 - DNA, 25 bp, Mus musculus
gcagtgctctaaaggctggcgtcac

SEQ ID NO: 677603 - DNA, 25 bp, Mus musculus
gcagtgctctaatggctggcgtcac

SEQ ID NO: 677604 - DNA, 25 bp, Mus musculus
gcagtgctctatctgcgtcatctta

SEQ ID NO: 677605 - DNA, 25 bp, Mus musculus
gcagtgctctatgtgcgtcatctta

SEQ ID NO: 677606 - DNA, 25 bp, Mus musculus
gcagtgctgattacgggtccagtga

SEQ ID NO: 677607 - DNA, 25 bp, Mus musculus
gcagtgctgatttcgggtccagtga

SEQ ID NO: 677608 - DNA, 25 bp, Mus musculus
gcagtgctgcgacctctctacatgg

SEQ ID NO: 677609 - DNA, 25 bp, Mus musculus
gcagtgctgcgagctctctacatgg

SEQ ID NO: 677610 - DNA, 25 bp, Mus musculus
gcagtgctgcgtccccagattctta

SEQ ID NO: 677611 - DNA, 25 bp, Mus musculus
gcagtgctgcgtctgtcaatgtgct

SEQ ID NO: 677612 - DNA, 25 bp, Mus musculus
gcagtgctgcgtgcccagattctta

SEQ ID NO: 677613 - DNA, 25 bp, Mus musculus
gcagtgctgcgtgtgtcaatgtgct

SEQ ID NO: 677614 - DNA, 25 bp, Mus musculus
gcagtgctgggaaaacttgtggaca

SEQ ID NO: 677615 - DNA, 25 bp, Mus musculus
gcagtgctgggataacttgtggaca

SEQ ID NO: 677616 - DNA, 25 bp, Mus musculus
gcagtgctggtccaaagaggaccca

SEQ ID NO: 677617 - DNA, 25 bp, Mus musculus
gcagtgctggtcgaaagaggaccca

SEQ ID NO: 677618 - DNA, 25 bp, Mus musculus
gcagtgcttaatatccccaaatact

SEQ ID NO: 677619 - DNA, 25 bp, Mus musculus
gcagtgcttaatttccccaaatact

SEQ ID NO: 677620 - DNA, 25 bp, Mus musculus
gcagtgctttggcaggactctttca

SEQ ID NO: 677621 - DNA, 25 bp, Mus musculus
gcagtgctttgggaggactctttca

SEQ ID NO: 677622 - DNA, 25 bp, Mus musculus
gcagtggaaaataattgtgcctcta

SEQ ID NO: 677623 - DNA, 25 bp, Mus musculus
gcagtggaaaattattgtgcctcta

SEQ ID NO: 677624 - DNA, 25 bp, Mus musculus
gcagtggatgcaatggctgcagcat

SEQ ID NO: 677625 - DNA, 25 bp, Mus musculus
gcagtggatgcattggctgcagcat

SEQ ID NO: 677626 - DNA, 25 bp, Mus musculus
gcagtggcaccgagagctacttctg

SEQ ID NO: 677627 - DNA, 25 bp, Mus musculus
gcagtggcaccgtgagctacttctg

SEQ ID NO: 677628 - DNA, 25 bp, Mus musculus
gcagtggcagccctgatggatggcc

SEQ ID NO: 677629 - DNA, 25 bp, Mus musculus
gcagtggcagccgtgatggatggcc

SEQ ID NO: 677630 - DNA, 25 bp, Mus musculus
gcagtggcaggccttatctgtcata

SEQ ID NO: 677631 - DNA, 25 bp, Mus musculus
gcagtggcaggcgttatctgtcata

SEQ ID NO: 677632 - DNA, 25 bp, Mus musculus
gcagtggcatcgacagaaacaacag

SEQ ID NO: 677633 - DNA, 25 bp, Mus musculus
gcagtggcatcgtcagaaacaacag

SEQ ID NO: 677634 - DNA, 25 bp, Mus musculus
gcagtggcgccactccctggacaag

SEQ ID NO: 677635 - DNA, 25 bp, Mus musculus
gcagtggcgccagtccctggacaag

SEQ ID NO: 677636 - DNA, 25 bp, Mus musculus
gcagtggctcagagatgcccaacac

SEQ ID NO: 677637 - DNA, 25 bp, Mus musculus
gcagtggctcagtgatgcccaacac

SEQ ID NO: 677638 - DNA, 25 bp, Mus musculus
gcagtgggacatctcctgtgcctga

SEQ ID NO: 677639 - DNA, 25 bp, Mus musculus
gcagtgggacatgtcctgtgcctga

SEQ ID NO: 677640 - DNA, 25 bp, Mus musculus
gcagtgggaggcaatatctagatgt

SEQ ID NO: 677641 - DNA, 25 bp, Mus musculus
gcagtgggaggctatatctagatgt

SEQ ID NO: 677642 - DNA, 25 bp, Mus musculus
gcagtgggatgtccgtcataagctc

SEQ ID NO: 677643 - DNA, 25 bp, Mus musculus
gcagtgggatgtgcgtcataagctc

SEQ ID NO: 677644 - DNA, 25 bp, Mus musculus
gcagtgggcatcaggacactggccc

SEQ ID NO: 677645 - DNA, 25 bp, Mus musculus
gcagtgggcatctggacactggccc

SEQ ID NO: 677646 - DNA, 25 bp, Mus musculus
gcagtgggggcaagaacaccatcac

SEQ ID NO: 677647 - DNA, 25 bp, Mus musculus
gcagtgggggcatgaacaccatcac

SEQ ID NO: 677648 - DNA, 25 bp, Mus musculus
gcagtgggtactcctaggactttta

SEQ ID NO: 677649 - DNA, 25 bp, Mus musculus
gcagtgggtactgctaggactttta

SEQ ID NO: 677650 - DNA, 25 bp, Mus musculus
gcagtggtagccacggctcatctgt

SEQ ID NO: 677651 - DNA, 25 bp, Mus musculus
gcagtggtagcctcggctcatctgt

SEQ ID NO: 677652 - DNA, 25 bp, Mus musculus
gcagtggtcacgacagtggcaaata

SEQ ID NO: 677653 - DNA, 25 bp, Mus musculus
gcagtggtcacgtcagtggcaaata

SEQ ID NO: 677654 - DNA, 25 bp, Mus musculus
gcagtggtccctcgcttcagaagaa

SEQ ID NO: 677655 - DNA, 25 bp, Mus musculus
gcagtggtccctggcttcagaagaa

SEQ ID NO: 677656 - DNA, 25 bp, Mus musculus
gcagtgtaagctccagtccctttgg

SEQ ID NO: 677657 - DNA, 25 bp, Mus musculus
gcagtgtaagctgcagtccctttgg

SEQ ID NO: 677658 - DNA, 25 bp, Mus musculus
gcagtgtaccacctcacatttactt

SEQ ID NO: 677659 - DNA, 25 bp, Mus musculus
gcagtgtaccacgtcacatttactt

SEQ ID NO: 677660 - DNA, 25 bp, Mus musculus
gcagtgtagacacgcttatgaagca

SEQ ID NO: 677661 - DNA, 25 bp, Mus musculus
gcagtgtagacaggcttatgaagca

SEQ ID NO: 677662 - DNA, 25 bp, Mus musculus
gcagtgtaggtgacctctttgtagg

SEQ ID NO: 677663 - DNA, 25 bp, Mus musculus
gcagtgtaggtgtcctctttgtagg

SEQ ID NO: 677664 - DNA, 25 bp, Mus musculus
gcagtgtatagcacctggcacggat

SEQ ID NO: 677665 - DNA, 25 bp, Mus musculus
gcagtgtatagctcctggcacggat

SEQ ID NO: 677666 - DNA, 25 bp, Mus musculus
gcagtgtcccgcaatgaagccaccg

SEQ ID NO: 677667 - DNA, 25 bp, Mus musculus
gcagtgtcccgctatgaagccaccg

SEQ ID NO: 677668 - DNA, 25 bp, Mus musculus
gcagtgtccctccagagtcctgaga

SEQ ID NO: 677669 - DNA, 25 bp, Mus musculus
gcagtgtccctcgagagtcctgaga

SEQ ID NO: 677670 - DNA, 25 bp, Mus musculus
gcagtgtccttcacggaacaaccag

SEQ ID NO: 677671 - DNA, 25 bp, Mus musculus
gcagtgtccttctcggaacaaccag

SEQ ID NO: 677672 - DNA, 25 bp, Mus musculus
gcagtgtccttgacctcgaagtctg

SEQ ID NO: 677673 - DNA, 25 bp, Mus musculus
gcagtgtccttgtcctcgaagtctg

SEQ ID NO: 677674 - DNA, 25 bp, Mus musculus
gcagtgtcgcgcacgcctgagtcac

SEQ ID NO: 677675 - DNA, 25 bp, Mus musculus
gcagtgtcgcgctcgcctgagtcac

SEQ ID NO: 677676 - DNA, 25 bp, Mus musculus
gcagtgtctaggctcctacgctgat

SEQ ID NO: 677677 - DNA, 25 bp, Mus musculus
gcagtgtctagggtcctacgctgat

SEQ ID NO: 677678 - DNA, 25 bp, Mus musculus
gcagtgtctgagaccatgattcgag

SEQ ID NO: 677679 - DNA, 25 bp, Mus musculus
gcagtgtctgagtccatgattcgag

SEQ ID NO: 677680 - DNA, 25 bp, Mus musculus
gcagtgtcttgcaatggctcttcag

SEQ ID NO: 677681 - DNA, 25 bp, Mus musculus
gcagtgtcttgctatggctcttcag

SEQ ID NO: 677682 - DNA, 25 bp, Mus musculus
gcagtgtgatgcaagcatggcagtt

SEQ ID NO: 677683 - DNA, 25 bp, Mus musculus
gcagtgtgatgctagcatggcagtt

SEQ ID NO: 677684 - DNA, 25 bp, Mus musculus
gcagtgtgcactacccgacagttgt

SEQ ID NO: 677685 - DNA, 25 bp, Mus musculus
gcagtgtgcacttcccgacagttgt

SEQ ID NO: 677686 - DNA, 25 bp, Mus musculus
gcagtgtgcatcagatggaccctgt

SEQ ID NO: 677687 - DNA, 25 bp, Mus musculus
gcagtgtgcatctgatggaccctgt

SEQ ID NO: 677688 - DNA, 25 bp, Mus musculus
gcagtgtgccccaacagaaatccta

SEQ ID NO: 677689 - DNA, 25 bp, Mus musculus
gcagtgtgcccctacagaaatccta

SEQ ID NO: 677690 - DNA, 25 bp, Mus musculus
gcagtgtggagaacctgctcagcta

SEQ ID NO: 677691 - DNA, 25 bp, Mus musculus
gcagtgtggagaccctacccgacag

SEQ ID NO: 677692 - DNA, 25 bp, Mus musculus
gcagtgtggagagcctacccgacag

SEQ ID NO: 677693 - DNA, 25 bp, Mus musculus
gcagtgtggagatcctgctcagcta

SEQ ID NO: 677694 - DNA, 25 bp, Mus musculus
gcagtgtgggaaactgcagccccga

SEQ ID NO: 677695 - DNA, 25 bp, Mus musculus
gcagtgtgggaatctgcagccccga

SEQ ID NO: 677696 - DNA, 25 bp, Mus musculus
gcagtgtgggctacctctcggagct

SEQ ID NO: 677697 - DNA, 25 bp, Mus musculus
gcagtgtgggcttcctctcggagct

SEQ ID NO: 677698 - DNA, 25 bp, Mus musculus
gcagtgttaacgactgaacaactga

SEQ ID NO: 677699 - DNA, 25 bp, Mus musculus
gcagtgttaacgtctgaacaactga

SEQ ID NO: 677700 - DNA, 25 bp, Mus musculus
gcagtgttcaccaaaaacctggaca

SEQ ID NO: 677701 - DNA, 25 bp, Mus musculus
gcagtgttcacctaaaacctggaca

SEQ ID NO: 677702 - DNA, 25 bp, Mus musculus
gcagtgtttgtcagcctcagtcagc

SEQ ID NO: 677703 - DNA, 25 bp, Mus musculus
gcagtgtttgtctgcctcagtcagc

SEQ ID NO: 677704 - DNA, 25 bp, Mus musculus
gcagtgtttgtgcaaccctgcccag

SEQ ID NO: 677705 - DNA, 25 bp, Mus musculus
gcagtgtttgtggaaccctgcccag

SEQ ID NO: 677706 - DNA, 25 bp, Mus musculus
gcagttaaacgcaacaatgactaca

SEQ ID NO: 677707 - DNA, 25 bp, Mus musculus
gcagttaaacgctacaatgactaca

SEQ ID NO: 677708 - DNA, 25 bp, Mus musculus
gcagttaagaagctgtcgagaccgt

SEQ ID NO: 677709 - DNA, 25 bp, Mus musculus
gcagttaagaaggtgtcgagaccgt

SEQ ID NO: 677710 - DNA, 25 bp, Mus musculus
gcagttaatactaggcgcttgacaa

SEQ ID NO: 677711 - DNA, 25 bp, Mus musculus
gcagttaatacttggcgcttgacaa

SEQ ID NO: 677712 - DNA, 25 bp, Mus musculus
gcagttactagaagagaccatgcat

SEQ ID NO: 677713 - DNA, 25 bp, Mus musculus
gcagttactagatgagaccatgcat

SEQ ID NO: 677714 - DNA, 25 bp, Mus musculus
gcagttagataaaaagggaccacag

SEQ ID NO: 677715 - DNA, 25 bp, Mus musculus
gcagttagataataagggaccacag

SEQ ID NO: 677716 - DNA, 25 bp, Mus musculus
gcagttaggacacgctgaaattcat

SEQ ID NO: 677717 - DNA, 25 bp, Mus musculus
gcagttaggacaggctgaaattcat

SEQ ID NO: 677718 - DNA, 25 bp, Mus musculus
gcagttatcaaacctgggtattgtg

SEQ ID NO: 677719 - DNA, 25 bp, Mus musculus
gcagttatcaaagctgggtattgtg

SEQ ID NO: 677720 - DNA, 25 bp, Mus musculus
gcagttatgccacgcttactcggag

SEQ ID NO: 677721 - DNA, 25 bp, Mus musculus
gcagttatgccaggcttactcggag

SEQ ID NO: 677722 - DNA, 25 bp, Mus musculus
gcagttatgtgtcctggttccggcc

SEQ ID NO: 677723 - DNA, 25 bp, Mus musculus
gcagttatgtgtgctggttccggcc

SEQ ID NO: 677724 - DNA, 25 bp, Mus musculus
gcagttatgttcagaccctacccgt

SEQ ID NO: 677725 - DNA, 25 bp, Mus musculus
gcagttatgttctgaccctacccgt

SEQ ID NO: 677726 - DNA, 25 bp, Mus musculus
gcagttattaacacgggaacatggc

SEQ ID NO: 677727 - DNA, 25 bp, Mus musculus
gcagttattaactcgggaacatggc

SEQ ID NO: 677728 - DNA, 25 bp, Mus musculus
gcagttcaaacaatgctgagcagca

SEQ ID NO: 677729 - DNA, 25 bp, Mus musculus
gcagttcaaacattgctgagcagca

SEQ ID NO: 677730 - DNA, 25 bp, Mus musculus
gcagttcaaccaacgtcgacatcac

SEQ ID NO: 677731 - DNA, 25 bp, Mus musculus
gcagttcaaccatcgtcgacatcac

SEQ ID NO: 677732 - DNA, 25 bp, Mus musculus
gcagttcaagaaaacaagtctccat

SEQ ID NO: 677733 - DNA, 25 bp, Mus musculus
gcagttcaagaatacaagtctccat

SEQ ID NO: 677734 - DNA, 25 bp, Mus musculus
gcagttcaagtaagggacccagttg

SEQ ID NO: 677735 - DNA, 25 bp, Mus musculus
gcagttcaagtatgggacccagttg

SEQ ID NO: 677736 - DNA, 25 bp, Mus musculus
gcagttcacacgaacggatttccga

SEQ ID NO: 677737 - DNA, 25 bp, Mus musculus
gcagttcacacgtacggatttccga

SEQ ID NO: 677738 - DNA, 25 bp, Mus musculus
gcagttcagacaagtcacagccagg

SEQ ID NO: 677739 - DNA, 25 bp, Mus musculus
gcagttcagacatgtcacagccagg

SEQ ID NO: 677740 - DNA, 25 bp, Mus musculus
gcagttcagcaaaatggagctccag

SEQ ID NO: 677741 - DNA, 25 bp, Mus musculus
gcagttcagcaatatggagctccag

SEQ ID NO: 677742 - DNA, 25 bp, Mus musculus
gcagttcaggcaatgagatgctgga

SEQ ID NO: 677743 - DNA, 25 bp, Mus musculus
gcagttcaggcattgagatgctgga

SEQ ID NO: 677744 - DNA, 25 bp, Mus musculus
gcagttcatcttcagccatcttagg

SEQ ID NO: 677745 - DNA, 25 bp, Mus musculus
gcagttcatcttgagccatcttagg

SEQ ID NO: 677746 - DNA, 25 bp, Mus musculus
gcagttccacctccaatggagacca

SEQ ID NO: 677747 - DNA, 25 bp, Mus musculus
gcagttccacctgcaatggagacca

SEQ ID NO: 677748 - DNA, 25 bp, Mus musculus
gcagttccagggatatggccaacaa

SEQ ID NO: 677749 - DNA, 25 bp, Mus musculus
gcagttccagggttatggccaacaa

SEQ ID NO: 677750 - DNA, 25 bp, Mus musculus
gcagttcctattacctgggtatcaa

SEQ ID NO: 677751 - DNA, 25 bp, Mus musculus
gcagttcctatttcctgggtatcaa

SEQ ID NO: 677752 - DNA, 25 bp, Mus musculus
gcagttcctccaagcgctatgtgct

SEQ ID NO: 677753 - DNA, 25 bp, Mus musculus
gcagttcctccatgcgctatgtgct

SEQ ID NO: 677754 - DNA, 25 bp, Mus musculus
gcagttccttccacctgtctcttgg

SEQ ID NO: 677755 - DNA, 25 bp, Mus musculus
gcagttccttcctcctgtctcttgg

SEQ ID NO: 677756 - DNA, 25 bp, Mus musculus
gcagttcgatgcctaccctaagact

SEQ ID NO: 677757 - DNA, 25 bp, Mus musculus
gcagttcgatgcgtaccctaagact

SEQ ID NO: 677758 - DNA, 25 bp, Mus musculus
gcagttcgggaaaataaaactgcgg

SEQ ID NO: 677759 - DNA, 25 bp, Mus musculus
gcagttcgggaatataaaactgcgg

SEQ ID NO: 677760 - DNA, 25 bp, Mus musculus
gcagttcgtcccagagatgaggctt

SEQ ID NO: 677761 - DNA, 25 bp, Mus musculus
gcagttcgtccctgagatgaggctt

SEQ ID NO: 677762 - DNA, 25 bp, Mus musculus
gcagttcgtgttcgcctgcatctcc

SEQ ID NO: 677763 - DNA, 25 bp, Mus musculus
gcagttcgtgttggcctgcatctcc

SEQ ID NO: 677764 - DNA, 25 bp, Mus musculus
gcagttctaaccacatcaaatatgg

SEQ ID NO: 677765 - DNA, 25 bp, Mus musculus
gcagttctaacctcatcaaatatgg

SEQ ID NO: 677766 - DNA, 25 bp, Mus musculus
gcagttctatacagcttcctgaaca

SEQ ID NO: 677767 - DNA, 25 bp, Mus musculus
gcagttctatactgcttcctgaaca

SEQ ID NO: 677768 - DNA, 25 bp, Mus musculus
gcagttctatgaccaggcccttcag

SEQ ID NO: 677769 - DNA, 25 bp, Mus musculus
gcagttctatgagcaggcccttcag

SEQ ID NO: 677770 - DNA, 25 bp, Mus musculus
gcagttctcgcgctgcaaccttgct

SEQ ID NO: 677771 - DNA, 25 bp, Mus musculus
gcagttctcgcggtgcaaccttgct

SEQ ID NO: 677772 - DNA, 25 bp, Mus musculus
gcagttctcgggagtgttttgcaca

SEQ ID NO: 677773 - DNA, 25 bp, Mus musculus
gcagttctcgggtgtgttttgcaca

SEQ ID NO: 677774 - DNA, 25 bp, Mus musculus
gcagttctctccatcgcataggcag

SEQ ID NO: 677775 - DNA, 25 bp, Mus musculus
gcagttctctccttcgcataggcag

SEQ ID NO: 677776 - DNA, 25 bp, Mus musculus
gcagttctgcaactagtagtgccac

SEQ ID NO: 677777 - DNA, 25 bp, Mus musculus
gcagttctgcaagtagtagtgccac

SEQ ID NO: 677778 - DNA, 25 bp, Mus musculus
gcagttctgccgagcactacgatgg

SEQ ID NO: 677779 - DNA, 25 bp, Mus musculus
gcagttctgccgtgcactacgatgg

SEQ ID NO: 677780 - DNA, 25 bp, Mus musculus
gcagttctgctgacttccgcctgga

SEQ ID NO: 677781 - DNA, 25 bp, Mus musculus
gcagttctgctgtcttccgcctgga

SEQ ID NO: 677782 - DNA, 25 bp, Mus musculus
gcagttctggaacttttacagccac

SEQ ID NO: 677783 - DNA, 25 bp, Mus musculus
gcagttctggaagttttacagccac

SEQ ID NO: 677784 - DNA, 25 bp, Mus musculus
gcagttctggttacaaggcaatcga

SEQ ID NO: 677785 - DNA, 25 bp, Mus musculus
gcagttctggtttcaaggcaatcga

SEQ ID NO: 677786 - DNA, 25 bp, Mus musculus
gcagttcttccacaaagtgagtgaa

SEQ ID NO: 677787 - DNA, 25 bp, Mus musculus
gcagttcttccagaaagtgagtgaa

SEQ ID NO: 677788 - DNA, 25 bp, Mus musculus
gcagttcttcgcaaagggctatggg

SEQ ID NO: 677789 - DNA, 25 bp, Mus musculus
gcagttcttcgctaagggctatggg

SEQ ID NO: 677790 - DNA, 25 bp, Mus musculus
gcagttcttctgagctatccagcag

SEQ ID NO: 677791 - DNA, 25 bp, Mus musculus
gcagttcttctgtgctatccagcag

SEQ ID NO: 677792 - DNA, 25 bp, Mus musculus
gcagttcttgaaactgggagcttaa

SEQ ID NO: 677793 - DNA, 25 bp, Mus musculus
gcagttcttgaatctgggagcttaa

SEQ ID NO: 677794 - DNA, 25 bp, Mus musculus
gcagttctttaacatcggagatggt

SEQ ID NO: 677795 - DNA, 25 bp, Mus musculus
gcagttctttaagatcggagatggt

SEQ ID NO: 677796 - DNA, 25 bp, Mus musculus
gcagttctttttcaggtggttggac

SEQ ID NO: 677797 - DNA, 25 bp, Mus musculus
gcagttctttttgaggtggttggac

SEQ ID NO: 677798 - DNA, 25 bp, Mus musculus
gcagttgaacatcgagcatattgaa

SEQ ID NO: 677799 - DNA, 25 bp, Mus musculus
gcagttgaacatggagcatattgaa

SEQ ID NO: 677800 - DNA, 25 bp, Mus musculus
gcagttgatctgcatagaggaagaa

SEQ ID NO: 677801 - DNA, 25 bp, Mus musculus
gcagttgatctggatagaggaagaa

SEQ ID NO: 677802 - DNA, 25 bp, Mus musculus
gcagttgcagtactacttcacccag

SEQ ID NO: 677803 - DNA, 25 bp, Mus musculus
gcagttgcagtagtacttcacccag

SEQ ID NO: 677804 - DNA, 25 bp, Mus musculus
gcagttgccagaatgcctcaaaggt

SEQ ID NO: 677805 - DNA, 25 bp, Mus musculus
gcagttgccagattgcctcaaaggt

SEQ ID NO: 677806 - DNA, 25 bp, Mus musculus
gcagttgctgaacctgtttgcctat

SEQ ID NO: 677807 - DNA, 25 bp, Mus musculus
gcagttgctgaagctgtttgcctat

SEQ ID NO: 677808 - DNA, 25 bp, Mus musculus
gcagttgctgtcatttgggcttact

SEQ ID NO: 677809 - DNA, 25 bp, Mus musculus
gcagttgctgtcttttgggcttact

SEQ ID NO: 677810 - DNA, 25 bp, Mus musculus
gcagttggatgtctctagcagccca

SEQ ID NO: 677811 - DNA, 25 bp, Mus musculus
gcagttggatgtgtctagcagccca

SEQ ID NO: 677812 - DNA, 25 bp, Mus musculus
gcagttggcttcagcagaaggcagg

SEQ ID NO: 677813 - DNA, 25 bp, Mus musculus
gcagttggcttctgcagaaggcagg

SEQ ID NO: 677814 - DNA, 25 bp, Mus musculus
gcagttgggcacatatattttttct

SEQ ID NO: 677815 - DNA, 25 bp, Mus musculus
gcagttgggcacttatattttttct

SEQ ID NO: 677816 - DNA, 25 bp, Mus musculus
gcagttgggtccaaagatcatcatt

SEQ ID NO: 677817 - DNA, 25 bp, Mus musculus
gcagttgggtcctaagatcatcatt

SEQ ID NO: 677818 - DNA, 25 bp, Mus musculus
gcagttgggttgaatcatggcagca

SEQ ID NO: 677819 - DNA, 25 bp, Mus musculus
gcagttgggttgtatcatggcagca

SEQ ID NO: 677820 - DNA, 25 bp, Mus musculus
gcagttggtatgaatcaaagcttaa

SEQ ID NO: 677821 - DNA, 25 bp, Mus musculus
gcagttggtatgtatcaaagcttaa

SEQ ID NO: 677822 - DNA, 25 bp, Mus musculus
gcagttggtcgaagacttggatcga

SEQ ID NO: 677823 - DNA, 25 bp, Mus musculus
gcagttggtcgatgacttggatcga

SEQ ID NO: 677824 - DNA, 25 bp, Mus musculus
gcagttggtttcatggcctgaggca

SEQ ID NO: 677825 - DNA, 25 bp, Mus musculus
gcagttggtttcttggcctgaggca

SEQ ID NO: 677826 - DNA, 25 bp, Mus musculus
gcagttgtcatcactaacgcaaagt

SEQ ID NO: 677827 - DNA, 25 bp, Mus musculus
gcagttgtcatctctaacgcaaagt

SEQ ID NO: 677828 - DNA, 25 bp, Mus musculus
gcagttgtcattatggccatcctgt

SEQ ID NO: 677829 - DNA, 25 bp, Mus musculus
gcagttgtcattttggccatcctgt

SEQ ID NO: 677830 - DNA, 25 bp, Mus musculus
gcagttgtccagaagcgctttggct

SEQ ID NO: 677831 - DNA, 25 bp, Mus musculus
gcagttgtccagtagcgctttggct

SEQ ID NO: 677832 - DNA, 25 bp, Mus musculus
gcagttgtctcaattttgcctgaat

SEQ ID NO: 677833 - DNA, 25 bp, Mus musculus
gcagttgtctcatttttgcctgaat

SEQ ID NO: 677834 - DNA, 25 bp, Mus musculus
gcagttgtgaacagcttgagtccag

SEQ ID NO: 677835 - DNA, 25 bp, Mus musculus
gcagttgtgaactgcttgagtccag

SEQ ID NO: 677836 - DNA, 25 bp, Mus musculus
gcagtttaactgcaaggcggacgta

SEQ ID NO: 677837 - DNA, 25 bp, Mus musculus
gcagtttaactggaaggcggacgta

SEQ ID NO: 677838 - DNA, 25 bp, Mus musculus
gcagtttcaaagcagcttaccagac

SEQ ID NO: 677839 - DNA, 25 bp, Mus musculus
gcagtttcaaaggagcttaccagac

SEQ ID NO: 677840 - DNA, 25 bp, Mus musculus
gcagtttcgataagataactaccgg

SEQ ID NO: 677841 - DNA, 25 bp, Mus musculus
gcagtttcgatatgataactaccgg

SEQ ID NO: 677842 - DNA, 25 bp, Mus musculus
gcagtttcgtaacatctacattggg

SEQ ID NO: 677843 - DNA, 25 bp, Mus musculus
gcagtttcgtaagatctacattggg

SEQ ID NO: 677844 - DNA, 25 bp, Mus musculus
gcagtttctctgatcggtgatcaat

SEQ ID NO: 677845 - DNA, 25 bp, Mus musculus
gcagtttctctgttcggtgatcaat

SEQ ID NO: 677846 - DNA, 25 bp, Mus musculus
gcagtttctgaaaatccttaaaaca

SEQ ID NO: 677847 - DNA, 25 bp, Mus musculus
gcagtttctgaatatccttaaaaca

SEQ ID NO: 677848 - DNA, 25 bp, Mus musculus
gcagtttgacaacgaactccggtca

SEQ ID NO: 677849 - DNA, 25 bp, Mus musculus
gcagtttgacaaggaactccggtca

SEQ ID NO: 677850 - DNA, 25 bp, Mus musculus
gcagtttgctgtcactctggagccc

SEQ ID NO: 677851 - DNA, 25 bp, Mus musculus
gcagtttgctgtgactctggagccc

SEQ ID NO: 677852 - DNA, 25 bp, Mus musculus
gcagtttggacaccaagactggaag

SEQ ID NO: 677853 - DNA, 25 bp, Mus musculus
gcagtttggacagcaagactggaag

SEQ ID NO: 677854 - DNA, 25 bp, Mus musculus
gcagtttggccacctggatcagcac

SEQ ID NO: 677855 - DNA, 25 bp, Mus musculus
gcagtttggccagctggatcagcac

SEQ ID NO: 677856 - DNA, 25 bp, Mus musculus
gcagtttgtaagacagcctgcagca

SEQ ID NO: 677857 - DNA, 25 bp, Mus musculus
gcagtttgtaagtcagcctgcagca

SEQ ID NO: 677858 - DNA, 25 bp, Mus musculus
gcagtttgtcaactatccaactcag

SEQ ID NO: 677859 - DNA, 25 bp, Mus musculus
gcagtttgtcaagtatccaactcag

SEQ ID NO: 677860 - DNA, 25 bp, Mus musculus
gcagttttcctaatttaaaagcgag

SEQ ID NO: 677861 - DNA, 25 bp, Mus musculus
gcagttttcctattttaaaagcgag

SEQ ID NO: 677862 - DNA, 25 bp, Mus musculus
gcagttttttagcaaggcccagtaa

SEQ ID NO: 677863 - DNA, 25 bp, Mus musculus
gcagttttttaggaaggcccagtaa

SEQ ID NO: 677864 - DNA, 25 bp, Mus musculus
gcataaaagtcaagtgatcaacgaa

SEQ ID NO: 677865 - DNA, 25 bp, Mus musculus
gcataaaagtcatgtgatcaacgaa

SEQ ID NO: 677866 - DNA, 25 bp, Mus musculus
gcataaaccaagagacagtatgtct

SEQ ID NO: 677867 - DNA, 25 bp, Mus musculus
gcataaaccaagtgacagtatgtct

SEQ ID NO: 677868 - DNA, 25 bp, Mus musculus
gcataaagaagccagactacgtgac

SEQ ID NO: 677869 - DNA, 25 bp, Mus musculus
gcataaagaagcgagactacgtgac

SEQ ID NO: 677870 - DNA, 25 bp, Mus musculus
gcataacgatggcaaacattggccg

SEQ ID NO: 677871 - DNA, 25 bp, Mus musculus
gcataacgatgggaaacattggccg

SEQ ID NO: 677872 - DNA, 25 bp, Mus musculus
gcataacttcctactccgtggctgg

SEQ ID NO: 677873 - DNA, 25 bp, Mus musculus
gcataacttccttctccgtggctgg

SEQ ID NO: 677874 - DNA, 25 bp, Mus musculus
gcataagacttgctctctcttcatg

SEQ ID NO: 677875 - DNA, 25 bp, Mus musculus
gcataagacttggtctctcttcatg

SEQ ID NO: 677876 - DNA, 25 bp, Mus musculus
gcataagcaccaaggtggatagcac

SEQ ID NO: 677877 - DNA, 25 bp, Mus musculus
gcataagcaccatggtggatagcac

SEQ ID NO: 677878 - DNA, 25 bp, Mus musculus
gcataagtgacccagtgactgtcaa

SEQ ID NO: 677879 - DNA, 25 bp, Mus musculus
gcataagtgaccgagtgactgtcaa

SEQ ID NO: 677880 - DNA, 25 bp, Mus musculus
gcataataatatagaaaactggtct

SEQ ID NO: 677881 - DNA, 25 bp, Mus musculus
gcataataatattgaaaactggtct

SEQ ID NO: 677882 - DNA, 25 bp, Mus musculus
gcataatacatactttatcacacag

SEQ ID NO: 677883 - DNA, 25 bp, Mus musculus
gcataatacatagtttatcacacag

SEQ ID NO: 677884 - DNA, 25 bp, Mus musculus
gcataatagtctaaccttgtgttct

SEQ ID NO: 677885 - DNA, 25 bp, Mus musculus
gcataatagtcttaccttgtgttct

SEQ ID NO: 677886 - DNA, 25 bp, Mus musculus
gcataatgaagccacatggcactgg

SEQ ID NO: 677887 - DNA, 25 bp, Mus musculus
gcataatgaagcgacatggcactgg

SEQ ID NO: 677888 - DNA, 25 bp, Mus musculus
gcataatgatgtcgctgacctggag

SEQ ID NO: 677889 - DNA, 25 bp, Mus musculus
gcataatgatgtggctgacctggag

SEQ ID NO: 677890 - DNA, 25 bp, Mus musculus
gcataatttgttctcagcaagcaaa

SEQ ID NO: 677891 - DNA, 25 bp, Mus musculus
gcataatttgttgtcagcaagcaaa

SEQ ID NO: 677892 - DNA, 25 bp, Mus musculus
gcatacaaacaaccagaccacaggg

SEQ ID NO: 677893 - DNA, 25 bp, Mus musculus
gcatacaaacaagcagaccacaggg

SEQ ID NO: 677894 - DNA, 25 bp, Mus musculus
gcatacaacactcggctcttcaagg

SEQ ID NO: 677895 - DNA, 25 bp, Mus musculus
gcatacaacactgggctcttcaagg

SEQ ID NO: 677896 - DNA, 25 bp, Mus musculus
gcatacaaggccaccactagtgact

SEQ ID NO: 677897 - DNA, 25 bp, Mus musculus
gcatacaaggcctccactagtgact

SEQ ID NO: 677898 - DNA, 25 bp, Mus musculus
gcatacacgaagcagaaagcaacag

SEQ ID NO: 677899 - DNA, 25 bp, Mus musculus
gcatacacgaaggagaaagcaacag

SEQ ID NO: 677900 - DNA, 25 bp, Mus musculus
gcatacagagaacgttctcagccgt

SEQ ID NO: 677901 - DNA, 25 bp, Mus musculus
gcatacagagaaggttctcagccgt

SEQ ID NO: 677902 - DNA, 25 bp, Mus musculus
gcatacagatccctccgtgatcaag

SEQ ID NO: 677903 - DNA, 25 bp, Mus musculus
gcatacagatccgtccgtgatcaag

SEQ ID NO: 677904 - DNA, 25 bp, Mus musculus
gcatacagatgacaagtggccccgt

SEQ ID NO: 677905 - DNA, 25 bp, Mus musculus
gcatacagatgagaagtggccccgt

SEQ ID NO: 677906 - DNA, 25 bp, Mus musculus
gcatacaggtatcttacttgaccca

SEQ ID NO: 677907 - DNA, 25 bp, Mus musculus
gcatacaggtatgttacttgaccca

SEQ ID NO: 677908 - DNA, 25 bp, Mus musculus
gcatacatataaacactctcactct

SEQ ID NO: 677909 - DNA, 25 bp, Mus musculus
gcatacatataatcactctcactct

SEQ ID NO: 677910 - DNA, 25 bp, Mus musculus
gcatacattattacctctaggccag

SEQ ID NO: 677911 - DNA, 25 bp, Mus musculus
gcatacattatttcctctaggccag

SEQ ID NO: 677912 - DNA, 25 bp, Mus musculus
gcatacccaagcctcactagttgtg

SEQ ID NO: 677913 - DNA, 25 bp, Mus musculus
gcatacccaagcgtcactagttgtg

SEQ ID NO: 677914 - DNA, 25 bp, Mus musculus
gcataccccgtcattttcaacttca

SEQ ID NO: 677915 - DNA, 25 bp, Mus musculus
gcataccccgtctttttcaacttca

SEQ ID NO: 677916 - DNA, 25 bp, Mus musculus
gcatacctcttgcagcaccctgagg

SEQ ID NO: 677917 - DNA, 25 bp, Mus musculus
gcatacctcttggagcaccctgagg

SEQ ID NO: 677918 - DNA, 25 bp, Mus musculus
gcatacctgcatcgagaactcggtc

SEQ ID NO: 677919 - DNA, 25 bp, Mus musculus
gcatacctgcatggagaactcggtc

SEQ ID NO: 677920 - DNA, 25 bp, Mus musculus
gcatacctgcttaatggcattttaa

SEQ ID NO: 677921 - DNA, 25 bp, Mus musculus
gcatacctgctttatggcattttaa

SEQ ID NO: 677922 - DNA, 25 bp, Mus musculus
gcataccttgccacttataacccag

SEQ ID NO: 677923 - DNA, 25 bp, Mus musculus
gcataccttgcctcttataacccag

SEQ ID NO: 677924 - DNA, 25 bp, Mus musculus
gcatacggatctacacagtagccca

SEQ ID NO: 677925 - DNA, 25 bp, Mus musculus
gcatacggatcttcacagtagccca

SEQ ID NO: 677926 - DNA, 25 bp, Mus musculus
gcatactaaactcggtgaagttcaa

SEQ ID NO: 677927 - DNA, 25 bp, Mus musculus
gcatactaaactgggtgaagttcaa

SEQ ID NO: 677928 - DNA, 25 bp, Mus musculus
gcatactatactcttccccgctggt

SEQ ID NO: 677929 - DNA, 25 bp, Mus musculus
gcatactatactgttccccgctggt

SEQ ID NO: 677930 - DNA, 25 bp, Mus musculus
gcatactatcctactattgcacata

SEQ ID NO: 677931 - DNA, 25 bp, Mus musculus
gcatactatccttctattgcacata

SEQ ID NO: 677932 - DNA, 25 bp, Mus musculus
gcatactcaatgctccaagccttgg

SEQ ID NO: 677933 - DNA, 25 bp, Mus musculus
gcatactcaatggtccaagccttgg

SEQ ID NO: 677934 - DNA, 25 bp, Mus musculus
gcatactcgtccctccaaacagtca

SEQ ID NO: 677935 - DNA, 25 bp, Mus musculus
gcatactcgtccgtccaaacagtca

SEQ ID NO: 677936 - DNA, 25 bp, Mus musculus
gcatactgacacctgaacgaaaccc

SEQ ID NO: 677937 - DNA, 25 bp, Mus musculus
gcatactgacacgtgaacgaaaccc

SEQ ID NO: 677938 - DNA, 25 bp, Mus musculus
gcatactgcctactacttcagacag

SEQ ID NO: 677939 - DNA, 25 bp, Mus musculus
gcatactgcctagtacttcagacag

SEQ ID NO: 677940 - DNA, 25 bp, Mus musculus
gcatactgctttcaggtggcagccc

SEQ ID NO: 677941 - DNA, 25 bp, Mus musculus
gcatactgctttgaggtggcagccc

SEQ ID NO: 677942 - DNA, 25 bp, Mus musculus
gcatagaaaaacatcttgatcctga

SEQ ID NO: 677943 - DNA, 25 bp, Mus musculus
gcatagaaaaacttcttgatcctga

SEQ ID NO: 677944 - DNA, 25 bp, Mus musculus
gcatagaatttcatccacgagcctc

SEQ ID NO: 677945 - DNA, 25 bp, Mus musculus
gcatagaatttcttccacgagcctc

SEQ ID NO: 677946 - DNA, 25 bp, Mus musculus
gcatagatgaatctttaccacagga

SEQ ID NO: 677947 - DNA, 25 bp, Mus musculus
gcatagatgaatgtttaccacagga

SEQ ID NO: 677948 - DNA, 25 bp, Mus musculus
gcatagatgagcattggaatgaatt

SEQ ID NO: 677949 - DNA, 25 bp, Mus musculus
gcatagatgagctttggaatgaatt

SEQ ID NO: 677950 - DNA, 25 bp, Mus musculus
gcatagatggtgacaaaggacctcg

SEQ ID NO: 677951 - DNA, 25 bp, Mus musculus
gcatagatggtgtcaaaggacctcg

SEQ ID NO: 677952 - DNA, 25 bp, Mus musculus
gcatagatgtgcagctggccaagtt

SEQ ID NO: 677953 - DNA, 25 bp, Mus musculus
gcatagatgtgctgctggccaagtt

SEQ ID NO: 677954 - DNA, 25 bp, Mus musculus
gcatagcatatacacactcaccagt

SEQ ID NO: 677955 - DNA, 25 bp, Mus musculus
gcatagcatatagacactcaccagt

SEQ ID NO: 677956 - DNA, 25 bp, Mus musculus
gcatagcattgccttttgtctccct

SEQ ID NO: 677957 - DNA, 25 bp, Mus musculus
gcatagcattgcgttttgtctccct

SEQ ID NO: 677958 - DNA, 25 bp, Mus musculus
gcatagccacgccacagatcgttat

SEQ ID NO: 677959 - DNA, 25 bp, Mus musculus
gcatagccacgcgacagatcgttat

SEQ ID NO: 677960 - DNA, 25 bp, Mus musculus
gcatagcctggtacctccgtgacct

SEQ ID NO: 677961 - DNA, 25 bp, Mus musculus
gcatagcctggttcctccgtgacct

SEQ ID NO: 677962 - DNA, 25 bp, Mus musculus
gcatagccttcaatatgccctgtcc

SEQ ID NO: 677963 - DNA, 25 bp, Mus musculus
gcatagccttcattatgccctgtcc

SEQ ID NO: 677964 - DNA, 25 bp, Mus musculus
gcatagcttggacccacatcaccat

SEQ ID NO: 677965 - DNA, 25 bp, Mus musculus
gcatagcttggagccacatcaccat

SEQ ID NO: 677966 - DNA, 25 bp, Mus musculus
gcataggacagactttcgccatgag

SEQ ID NO: 677967 - DNA, 25 bp, Mus musculus
gcataggacagagtttcgccatgag

SEQ ID NO: 677968 - DNA, 25 bp, Mus musculus
gcataggacgatatgagtggtccca

SEQ ID NO: 677969 - DNA, 25 bp, Mus musculus
gcataggacgatttgagtggtccca

SEQ ID NO: 677970 - DNA, 25 bp, Mus musculus
gcataggccaaaaactacaggacgg

SEQ ID NO: 677971 - DNA, 25 bp, Mus musculus
gcataggccaaatactacaggacgg

SEQ ID NO: 677972 - DNA, 25 bp, Mus musculus
gcataggctgcaacatctttgagta

SEQ ID NO: 677973 - DNA, 25 bp, Mus musculus
gcataggctgcatcatctttgagta

SEQ ID NO: 677974 - DNA, 25 bp, Mus musculus
gcatagtgaagcatgcctgcagcct

SEQ ID NO: 677975 - DNA, 25 bp, Mus musculus
gcatagtgaagcttgcctgcagcct

SEQ ID NO: 677976 - DNA, 25 bp, Mus musculus
gcatagtgcgctaccgtaggtcgcg

SEQ ID NO: 677977 - DNA, 25 bp, Mus musculus
gcatagtgcgcttccgtaggtcgcg

SEQ ID NO: 677978 - DNA, 25 bp, Mus musculus
gcatagttaccccaaatcccttagt

SEQ ID NO: 677979 - DNA, 25 bp, Mus musculus
gcatagttacccgaaatcccttagt

SEQ ID NO: 677980 - DNA, 25 bp, Mus musculus
gcatagtttacgactgtcactgcag

SEQ ID NO: 677981 - DNA, 25 bp, Mus musculus
gcatagtttacgtctgtcactgcag

SEQ ID NO: 677982 - DNA, 25 bp, Mus musculus
gcatataaggatcccatctatgtgt

SEQ ID NO: 677983 - DNA, 25 bp, Mus musculus
gcatataaggatgccatctatgtgt

SEQ ID NO: 677984 - DNA, 25 bp, Mus musculus
gcatatatagagatctcggacaaag

SEQ ID NO: 677985 - DNA, 25 bp, Mus musculus
gcatatatagagttctcggacaaag

SEQ ID NO: 677986 - DNA, 25 bp, Mus musculus
gcatatatctccaaacctttgaaga

SEQ ID NO: 677987 - DNA, 25 bp, Mus musculus
gcatatatctccagacctttgaaga

SEQ ID NO: 677988 - DNA, 25 bp, Mus musculus
gcatatatctcctaacctttgaaga

SEQ ID NO: 677989 - DNA, 25 bp, Mus musculus
gcatatatctcctgacctttgaaga

SEQ ID NO: 677990 - DNA, 25 bp, Mus musculus
gcatatatgcacatggcctggccct

SEQ ID NO: 677991 - DNA, 25 bp, Mus musculus
gcatatatgcacttggcctggccct

SEQ ID NO: 677992 - DNA, 25 bp, Mus musculus
gcatatcaagagacacaacatcgtt

SEQ ID NO: 677993 - DNA, 25 bp, Mus musculus
gcatatcaagagtcacaacatcgtt

SEQ ID NO: 677994 - DNA, 25 bp, Mus musculus
gcatatccgtggagtctttatccta

SEQ ID NO: 677995 - DNA, 25 bp, Mus musculus
gcatatccgtggtgtctttatccta

SEQ ID NO: 677996 - DNA, 25 bp, Mus musculus
gcatatcctcctaatccaagttcac

SEQ ID NO: 677997 - DNA, 25 bp, Mus musculus
gcatatcctccttatccaagttcac

SEQ ID NO: 677998 - DNA, 25 bp, Mus musculus
gcatatcggattagttttagtttaa

SEQ ID NO: 677999 - DNA, 25 bp, Mus musculus
gcatatcggatttgttttagtttaa

SEQ ID NO: 678000 - DNA, 25 bp, Mus musculus
gcatatctgtttagaatcccaacaa

SEQ ID NO: 678001 - DNA, 25 bp, Mus musculus
gcatatctgttttgaatcccaacaa

SEQ ID NO: 678002 - DNA, 25 bp, Mus musculus
gcatatcttactctcggagcagcgg

SEQ ID NO: 678003 - DNA, 25 bp, Mus musculus
gcatatcttactgtcggagcagcgg

SEQ ID NO: 678004 - DNA, 25 bp, Mus musculus
gcatatgaccgtagtgtgtgttctg

SEQ ID NO: 678005 - DNA, 25 bp, Mus musculus
gcatatgaccgttgtgtgtgttctg

SEQ ID NO: 678006 - DNA, 25 bp, Mus musculus
gcatatgagcgtcgcatctcactgt

SEQ ID NO: 678007 - DNA, 25 bp, Mus musculus
gcatatgagcgtggcatctcactgt

SEQ ID NO: 678008 - DNA, 25 bp, Mus musculus
gcatatgcatttcctccggccacat

SEQ ID NO: 678009 - DNA, 25 bp, Mus musculus
gcatatgcatttgctccggccacat

SEQ ID NO: 678010 - DNA, 25 bp, Mus musculus
gcatatgccactatactttgttctc

SEQ ID NO: 678011 - DNA, 25 bp, Mus musculus
gcatatgccactttactttgttctc

SEQ ID NO: 678012 - DNA, 25 bp, Mus musculus
gcatatgccagcctggctactcagg

SEQ ID NO: 678013 - DNA, 25 bp, Mus musculus
gcatatgccagcgtggctactcagg

SEQ ID NO: 678014 - DNA, 25 bp, Mus musculus
gcatatggccccaggagatcctggc

SEQ ID NO: 678015 - DNA, 25 bp, Mus musculus
gcatatggcccctggagatcctggc

SEQ ID NO: 678016 - DNA, 25 bp, Mus musculus
gcatatgtaacgcagcgccaaaaag

SEQ ID NO: 678017 - DNA, 25 bp, Mus musculus
gcatatgtaacggagcgccaaaaag

SEQ ID NO: 678018 - DNA, 25 bp, Mus musculus
gcatatgtccccaaggcctcttaga

SEQ ID NO: 678019 - DNA, 25 bp, Mus musculus
gcatatgtcccctaggcctcttaga

SEQ ID NO: 678020 - DNA, 25 bp, Mus musculus
gcatatgtctctactctattcactg

SEQ ID NO: 678021 - DNA, 25 bp, Mus musculus
gcatatgtctcttctctattcactg

SEQ ID NO: 678022 - DNA, 25 bp, Mus musculus
gcatattcaacgaaacgcccatcaa

SEQ ID NO: 678023 - DNA, 25 bp, Mus musculus
gcatattcaacgtaacgcccatcaa

SEQ ID NO: 678024 - DNA, 25 bp, Mus musculus
gcatattcctgaacttccacaggag

SEQ ID NO: 678025 - DNA, 25 bp, Mus musculus
gcatattcctgatcttccacaggag

SEQ ID NO: 678026 - DNA, 25 bp, Mus musculus
gcatattgcttcataactaaccagg

SEQ ID NO: 678027 - DNA, 25 bp, Mus musculus
gcatattgcttcttaactaaccagg

SEQ ID NO: 678028 - DNA, 25 bp, Mus musculus
gcatatttaaagacacttaccaagg

SEQ ID NO: 678029 - DNA, 25 bp, Mus musculus
gcatatttaaagtcacttaccaagg

SEQ ID NO: 678030 - DNA, 25 bp, Mus musculus
gcatatttggaaactgaagttgcca

SEQ ID NO: 678031 - DNA, 25 bp, Mus musculus
gcatatttggaatctgaagttgcca

SEQ ID NO: 678032 - DNA, 25 bp, Mus musculus
gcatattttggaactgggtcttctg

SEQ ID NO: 678033 - DNA, 25 bp, Mus musculus
gcatattttggatctgggtcttctg

SEQ ID NO: 678034 - DNA, 25 bp, Mus musculus
gcatcaaaaacgagccctttaaaat

SEQ ID NO: 678035 - DNA, 25 bp, Mus musculus
gcatcaaaaacgtgccctttaaaat

SEQ ID NO: 678036 - DNA, 25 bp, Mus musculus
gcatcaaaacttctgaaaaaaccag

SEQ ID NO: 678037 - DNA, 25 bp, Mus musculus
gcatcaaaacttgtgaaaaaaccag

SEQ ID NO: 678038 - DNA, 25 bp, Mus musculus
gcatcaaaattactacagccaggag

SEQ ID NO: 678039 - DNA, 25 bp, Mus musculus
gcatcaaaattagtacagccaggag

SEQ ID NO: 678040 - DNA, 25 bp, Mus musculus
gcatcaaaggagcaccaggcactgt

SEQ ID NO: 678041 - DNA, 25 bp, Mus musculus
gcatcaaaggaggaccaggcactgt

SEQ ID NO: 678042 - DNA, 25 bp, Mus musculus
gcatcaaattctacctgtaccctga

SEQ ID NO: 678043 - DNA, 25 bp, Mus musculus
gcatcaaattcttcctgtaccctga

SEQ ID NO: 678044 - DNA, 25 bp, Mus musculus
gcatcaacacccctggctccttcaa

SEQ ID NO: 678045 - DNA, 25 bp, Mus musculus
gcatcaacacccgtggctccttcaa

SEQ ID NO: 678046 - DNA, 25 bp, Mus musculus
gcatcaacagttatcagacccaagc

SEQ ID NO: 678047 - DNA, 25 bp, Mus musculus
gcatcaacagttttcagacccaagc

SEQ ID NO: 678048 - DNA, 25 bp, Mus musculus
gcatcaacctctacattggcatcaa

SEQ ID NO: 678049 - DNA, 25 bp, Mus musculus
gcatcaacctcttcattggcatcaa

SEQ ID NO: 678050 - DNA, 25 bp, Mus musculus
gcatcaacctgcctgggtggtatca

SEQ ID NO: 678051 - DNA, 25 bp, Mus musculus
gcatcaacctgcgtgggtggtatca

SEQ ID NO: 678052 - DNA, 25 bp, Mus musculus
gcatcaacgggaaacaagaagaggg

SEQ ID NO: 678053 - DNA, 25 bp, Mus musculus
gcatcaacgggatacaagaagaggg

SEQ ID NO: 678054 - DNA, 25 bp, Mus musculus
gcatcaactccgcagcttagctggg

SEQ ID NO: 678055 - DNA, 25 bp, Mus musculus
gcatcaactccggagcttagctggg

SEQ ID NO: 678056 - DNA, 25 bp, Mus musculus
gcatcaactgtcacgagggaagcca

SEQ ID NO: 678057 - DNA, 25 bp, Mus musculus
gcatcaactgtctcgagggaagcca

SEQ ID NO: 678058 - DNA, 25 bp, Mus musculus
gcatcaacttccctggtcactacaa

SEQ ID NO: 678059 - DNA, 25 bp, Mus musculus
gcatcaacttccgtggtcactacaa

SEQ ID NO: 678060 - DNA, 25 bp, Mus musculus
gcatcaactttccttacctctacat

SEQ ID NO: 678061 - DNA, 25 bp, Mus musculus
gcatcaactttcgttacctctacat

SEQ ID NO: 678062 - DNA, 25 bp, Mus musculus
gcatcaagaaaaccgtccttccttg

SEQ ID NO: 678063 - DNA, 25 bp, Mus musculus
gcatcaagaaaagcgtccttccttg

SEQ ID NO: 678064 - DNA, 25 bp, Mus musculus
gcatcaagaagtcacattaagttat

SEQ ID NO: 678065 - DNA, 25 bp, Mus musculus
gcatcaagaagtgacattaagttat

SEQ ID NO: 678066 - DNA, 25 bp, Mus musculus
gcatcaagacctatggagtaattga

SEQ ID NO: 678067 - DNA, 25 bp, Mus musculus
gcatcaagacctttggagtaattga

SEQ ID NO: 678068 - DNA, 25 bp, Mus musculus
gcatcaagcgggagctggctatcac

SEQ ID NO: 678069 - DNA, 25 bp, Mus musculus
gcatcaagcgggtgctggctatcac

SEQ ID NO: 678070 - DNA, 25 bp, Mus musculus
gcatcaagctcacagtactccaggg

SEQ ID NO: 678071 - DNA, 25 bp, Mus musculus
gcatcaagctcagagtactccaggg

SEQ ID NO: 678072 - DNA, 25 bp, Mus musculus
gcatcaagctgtcaggagctcagta

SEQ ID NO: 678073 - DNA, 25 bp, Mus musculus
gcatcaagctgtgaggagctcagta

SEQ ID NO: 678074 - DNA, 25 bp, Mus musculus
gcatcaaggaatcccagtaccagtt

SEQ ID NO: 678075 - DNA, 25 bp, Mus musculus
gcatcaaggaatgccagtaccagtt

SEQ ID NO: 678076 - DNA, 25 bp, Mus musculus
gcatcaagtgacaatatcatggtgc

SEQ ID NO: 678077 - DNA, 25 bp, Mus musculus
gcatcaagtgactatatcatggtgc

SEQ ID NO: 678078 - DNA, 25 bp, Mus musculus
gcatcaataccaatggttcctacag

SEQ ID NO: 678079 - DNA, 25 bp, Mus musculus
gcatcaataccattggttcctacag

SEQ ID NO: 678080 - DNA, 25 bp, Mus musculus
gcatcaatagctaccgccaatacaa

SEQ ID NO: 678081 - DNA, 25 bp, Mus musculus
gcatcaatagcttccgccaatacaa

SEQ ID NO: 678082 - DNA, 25 bp, Mus musculus
gcatcaatcaatcctcatcggaaca

SEQ ID NO: 678083 - DNA, 25 bp, Mus musculus
gcatcaatcaatgctcatcggaaca

SEQ ID NO: 678084 - DNA, 25 bp, Mus musculus
gcatcacaaatgatgatctttccac

SEQ ID NO: 678085 - DNA, 25 bp, Mus musculus
gcatcacaaatgttgatctttccac

SEQ ID NO: 678086 - DNA, 25 bp, Mus musculus
gcatcacaagccaaagcgttccggt

SEQ ID NO: 678087 - DNA, 25 bp, Mus musculus
gcatcacaagcctaagcgttccggt

SEQ ID NO: 678088 - DNA, 25 bp, Mus musculus
gcatcacagaaaacgagcaaggctc

SEQ ID NO: 678089 - DNA, 25 bp, Mus musculus
gcatcacagaaatcgagcaaggctc

SEQ ID NO: 678090 - DNA, 25 bp, Mus musculus
gcatcacagtgtatgagagggacca

SEQ ID NO: 678091 - DNA, 25 bp, Mus musculus
gcatcacagtgtttgagagggacca

SEQ ID NO: 678092 - DNA, 25 bp, Mus musculus
gcatcacgccgtcgtatgtggcctt

SEQ ID NO: 678093 - DNA, 25 bp, Mus musculus
gcatcacgccgtggtatgtggcctt

SEQ ID NO: 678094 - DNA, 25 bp, Mus musculus
gcatcactacaaaaaccaagtggag

SEQ ID NO: 678095 - DNA, 25 bp, Mus musculus
gcatcactacaataaccaagtggag

SEQ ID NO: 678096 - DNA, 25 bp, Mus musculus
gcatcactgactcgattcttcagga

SEQ ID NO: 678097 - DNA, 25 bp, Mus musculus
gcatcactgactggattcttcagga

SEQ ID NO: 678098 - DNA, 25 bp, Mus musculus
gcatcactggcaaagttggagacaa

SEQ ID NO: 678099 - DNA, 25 bp, Mus musculus
gcatcactggcatagttggagacaa

SEQ ID NO: 678100 - DNA, 25 bp, Mus musculus
gcatcactggtacagcctgactttg

SEQ ID NO: 678101 - DNA, 25 bp, Mus musculus
gcatcactggtagagcctgactttg

SEQ ID NO: 678102 - DNA, 25 bp, Mus musculus
gcatcactggtcctgagggccatgt

SEQ ID NO: 678103 - DNA, 25 bp, Mus musculus
gcatcactggtcgtgagggccatgt

SEQ ID NO: 678104 - DNA, 25 bp, Mus musculus
gcatcagagtctacaagccagagct

SEQ ID NO: 678105 - DNA, 25 bp, Mus musculus
gcatcagagtcttcaagccagagct

SEQ ID NO: 678106 - DNA, 25 bp, Mus musculus
gcatcagatgcaacaagaattaggg

SEQ ID NO: 678107 - DNA, 25 bp, Mus musculus
gcatcagatgcatcaagaattaggg

SEQ ID NO: 678108 - DNA, 25 bp, Mus musculus
gcatcagcaatgaggcgctggccga

SEQ ID NO: 678109 - DNA, 25 bp, Mus musculus
gcatcagcaatgtggcgctggccga

SEQ ID NO: 678110 - DNA, 25 bp, Mus musculus
gcatcagcatcaaaaaccagagaat

SEQ ID NO: 678111 - DNA, 25 bp, Mus musculus
gcatcagcatcataaaccagagaat

SEQ ID NO: 678112 - DNA, 25 bp, Mus musculus
gcatcagcggtcacaaactctatgg

SEQ ID NO: 678113 - DNA, 25 bp, Mus musculus
gcatcagcggtctcaaactctatgg

SEQ ID NO: 678114 - DNA, 25 bp, Mus musculus
gcatcagcttctccagcggcatctg

SEQ ID NO: 678115 - DNA, 25 bp, Mus musculus
gcatcagcttctgcagcggcatctg

SEQ ID NO: 678116 - DNA, 25 bp, Mus musculus
gcatcaggaaagaatctgaacttga

SEQ ID NO: 678117 - DNA, 25 bp, Mus musculus
gcatcaggaaagtatctgaacttga

SEQ ID NO: 678118 - DNA, 25 bp, Mus musculus
gcatcaggccaacgtgctgatgtgt

SEQ ID NO: 678119 - DNA, 25 bp, Mus musculus
gcatcaggccaaggtgctgatgtgt

SEQ ID NO: 678120 - DNA, 25 bp, Mus musculus
gcatcaggtggaactatgtggccaa

SEQ ID NO: 678121 - DNA, 25 bp, Mus musculus
gcatcaggtggatctatgtggccaa

SEQ ID NO: 678122 - DNA, 25 bp, Mus musculus
gcatcagtgaccatgacgaccacag

SEQ ID NO: 678123 - DNA, 25 bp, Mus musculus
gcatcagtgaccttgacgaccacag

SEQ ID NO: 678124 - DNA, 25 bp, Mus musculus
gcatcagtttgcatggccattccgg

SEQ ID NO: 678125 - DNA, 25 bp, Mus musculus
gcatcagtttgcttggccattccgg

SEQ ID NO: 678126 - DNA, 25 bp, Mus musculus
gcatcataaaccaggtgattggctg

SEQ ID NO: 678127 - DNA, 25 bp, Mus musculus
gcatcataaacctggtgattggctg

SEQ ID NO: 678128 - DNA, 25 bp, Mus musculus
gcatcatcagcacatggcggatcca

SEQ ID NO: 678129 - DNA, 25 bp, Mus musculus
gcatcatcagcagatggcggatcca

SEQ ID NO: 678130 - DNA, 25 bp, Mus musculus
gcatcatcatcaaccttgtgcagaa

SEQ ID NO: 678131 - DNA, 25 bp, Mus musculus
gcatcatcatcatccttgtgcagaa

SEQ ID NO: 678132 - DNA, 25 bp, Mus musculus
gcatcatcatggcaattgtcatcag

SEQ ID NO: 678133 - DNA, 25 bp, Mus musculus
gcatcatcatgggaattgtcatcag

SEQ ID NO: 678134 - DNA, 25 bp, Mus musculus
gcatcatcgacactacacacactga

SEQ ID NO: 678135 - DNA, 25 bp, Mus musculus
gcatcatcgacagtacacacactga

SEQ ID NO: 678136 - DNA, 25 bp, Mus musculus
gcatcatcggttccatcaccgtggt

SEQ ID NO: 678137 - DNA, 25 bp, Mus musculus
gcatcatcggttgcatcaccgtggt

SEQ ID NO: 678138 - DNA, 25 bp, Mus musculus
gcatcatctctgcagcggcacggcg

SEQ ID NO: 678139 - DNA, 25 bp, Mus musculus
gcatcatctctggagcggcacggcg

SEQ ID NO: 678140 - DNA, 25 bp, Mus musculus
gcatcatcttgccaaagatccgtga

SEQ ID NO: 678141 - DNA, 25 bp, Mus musculus
gcatcatcttgcgaaagatccgtga

SEQ ID NO: 678142 - DNA, 25 bp, Mus musculus
gcatcatgaactagaacgatccctg

SEQ ID NO: 678143 - DNA, 25 bp, Mus musculus
gcatcatgaacttgaacgatccctg

SEQ ID NO: 678144 - DNA, 25 bp, Mus musculus
gcatcatgacgtacttcgggcacct

SEQ ID NO: 678145 - DNA, 25 bp, Mus musculus
gcatcatgacgttcttcgggcacct

SEQ ID NO: 678146 - DNA, 25 bp, Mus musculus
gcatcatggcggagatgattactgg

SEQ ID NO: 678147 - DNA, 25 bp, Mus musculus
gcatcatggcggtgatgattactgg

SEQ ID NO: 678148 - DNA, 25 bp, Mus musculus
gcatcatggctgctttccacagctg

SEQ ID NO: 678149 - DNA, 25 bp, Mus musculus
gcatcatggctggtttccacagctg

SEQ ID NO: 678150 - DNA, 25 bp, Mus musculus
gcatcattcagaagtctggaagcac

SEQ ID NO: 678151 - DNA, 25 bp, Mus musculus
gcatcattcagatgtctggaagcac

SEQ ID NO: 678152 - DNA, 25 bp, Mus musculus
gcatcattggcgacacaattttatc

SEQ ID NO: 678153 - DNA, 25 bp, Mus musculus
gcatcattggcgtcacaattttatc

SEQ ID NO: 678154 - DNA, 25 bp, Mus musculus
gcatcatttctcaatggttgggaag

SEQ ID NO: 678155 - DNA, 25 bp, Mus musculus
gcatcatttctctatggttgggaag

SEQ ID NO: 678156 - DNA, 25 bp, Mus musculus
gcatcattttaacaagagttcgaga

SEQ ID NO: 678157 - DNA, 25 bp, Mus musculus
gcatcattttaagaagagttcgaga

SEQ ID NO: 678158 - DNA, 25 bp, Mus musculus
gcatcattttcaacgctgcgctgag

SEQ ID NO: 678159 - DNA, 25 bp, Mus musculus
gcatcattttcatcgctgcgctgag

SEQ ID NO: 678160 - DNA, 25 bp, Mus musculus
gcatccaagactatgaccccaacag

SEQ ID NO: 678161 - DNA, 25 bp, Mus musculus
gcatccaagactttgaccccaacag

SEQ ID NO: 678162 - DNA, 25 bp, Mus musculus
gcatccacaaacatccaagacactg

SEQ ID NO: 678163 - DNA, 25 bp, Mus musculus
gcatccacaaacttccaagacactg

SEQ ID NO: 678164 - DNA, 25 bp, Mus musculus
gcatccacccctagggaaacttcag

SEQ ID NO: 678165 - DNA, 25 bp, Mus musculus
gcatccaccccttgggaaacttcag

SEQ ID NO: 678166 - DNA, 25 bp, Mus musculus
gcatccactaaaatcgaccttggtg

SEQ ID NO: 678167 - DNA, 25 bp, Mus musculus
gcatccactaaattcgaccttggtg

SEQ ID NO: 678168 - DNA, 25 bp, Mus musculus
gcatccagacatcctggtaaccaaa

SEQ ID NO: 678169 - DNA, 25 bp, Mus musculus
gcatccagacatgctggtaaccaaa

SEQ ID NO: 678170 - DNA, 25 bp, Mus musculus
gcatccagaccgagggccatgtggt

SEQ ID NO: 678171 - DNA, 25 bp, Mus musculus
gcatccagaccgtgggccatgtggt

SEQ ID NO: 678172 - DNA, 25 bp, Mus musculus
gcatccagcattcggatgatgtcct

SEQ ID NO: 678173 - DNA, 25 bp, Mus musculus
gcatccagcattgggatgatgtcct

SEQ ID NO: 678174 - DNA, 25 bp, Mus musculus
gcatccagccacaaggtggcgccag

SEQ ID NO: 678175 - DNA, 25 bp, Mus musculus
gcatccagccactaggtggcgccag

SEQ ID NO: 678176 - DNA, 25 bp, Mus musculus
gcatccagccggaccctgagtgtgg

SEQ ID NO: 678177 - DNA, 25 bp, Mus musculus
gcatccagccggtccctgagtgtgg

SEQ ID NO: 678178 - DNA, 25 bp, Mus musculus
gcatccagctgtaggttcaagatct

SEQ ID NO: 678179 - DNA, 25 bp, Mus musculus
gcatccagctgttggttcaagatct

SEQ ID NO: 678180 - DNA, 25 bp, Mus musculus
gcatccaggtgaccagcactgagga

SEQ ID NO: 678181 - DNA, 25 bp, Mus musculus
gcatccaggtgagcagcactgagga

SEQ ID NO: 678182 - DNA, 25 bp, Mus musculus
gcatccaggttgatgggaaaacaat

SEQ ID NO: 678183 - DNA, 25 bp, Mus musculus
gcatccaggttgttgggaaaacaat

SEQ ID NO: 678184 - DNA, 25 bp, Mus musculus
gcatccagtgccatcattgacatca

SEQ ID NO: 678185 - DNA, 25 bp, Mus musculus
gcatccagtgccttcattgacatca

SEQ ID NO: 678186 - DNA, 25 bp, Mus musculus
gcatccagtggtaagaacaactcga

SEQ ID NO: 678187 - DNA, 25 bp, Mus musculus
gcatccagtggttagaacaactcga

SEQ ID NO: 678188 - DNA, 25 bp, Mus musculus
gcatccagtttaacgagagcttcgc

SEQ ID NO: 678189 - DNA, 25 bp, Mus musculus
gcatccagtttatcgagagcttcgc

SEQ ID NO: 678190 - DNA, 25 bp, Mus musculus
gcatccatcagtacacttgctggac

SEQ ID NO: 678191 - DNA, 25 bp, Mus musculus
gcatccatcagttcacttgctggac

SEQ ID NO: 678192 - DNA, 25 bp, Mus musculus
gcatccatccagaatgtcgctttca

SEQ ID NO: 678193 - DNA, 25 bp, Mus musculus
gcatccatccagtatgtcgctttca

SEQ ID NO: 678194 - DNA, 25 bp, Mus musculus
gcatccatctgcagcggaacttgct

SEQ ID NO: 678195 - DNA, 25 bp, Mus musculus
gcatccatctgctgcggaacttgct

SEQ ID NO: 678196 - DNA, 25 bp, Mus musculus
gcatccatgagcagtctgtggagca

SEQ ID NO: 678197 - DNA, 25 bp, Mus musculus
gcatccatgagctgtctgtggagca

SEQ ID NO: 678198 - DNA, 25 bp, Mus musculus
gcatccatgccacaagaggagcaag

SEQ ID NO: 678199 - DNA, 25 bp, Mus musculus
gcatccatgccagaagaggagcaag

SEQ ID NO: 678200 - DNA, 25 bp, Mus musculus
gcatccatgtggacaggcaagagct

SEQ ID NO: 678201 - DNA, 25 bp, Mus musculus
gcatccatgtggtcaggcaagagct

SEQ ID NO: 678202 - DNA, 25 bp, Mus musculus
gcatccatttgcaacatatcccagg

SEQ ID NO: 678203 - DNA, 25 bp, Mus musculus
gcatccatttgctacatatcccagg

SEQ ID NO: 678204 - DNA, 25 bp, Mus musculus
gcatcccacaaacagagtgaagagg

SEQ ID NO: 678205 - DNA, 25 bp, Mus musculus
gcatcccacaaagagagtgaagagg

SEQ ID NO: 678206 - DNA, 25 bp, Mus musculus
gcatcccagacactggtccatacgg

SEQ ID NO: 678207 - DNA, 25 bp, Mus musculus
gcatcccagacagtggtccatacgg

SEQ ID NO: 678208 - DNA, 25 bp, Mus musculus
gcatcccatctgaactcatctggag

SEQ ID NO: 678209 - DNA, 25 bp, Mus musculus
gcatcccatctgtactcatctggag

SEQ ID NO: 678210 - DNA, 25 bp, Mus musculus
gcatcccatgaaaagtttgaaccct

SEQ ID NO: 678211 - DNA, 25 bp, Mus musculus
gcatcccatgaatagtttgaaccct

SEQ ID NO: 678212 - DNA, 25 bp, Mus musculus
gcatccccaggaagatgggctccaa

SEQ ID NO: 678213 - DNA, 25 bp, Mus musculus
gcatccccaggatgatgggctccaa

SEQ ID NO: 678214 - DNA, 25 bp, Mus musculus
gcatccccatctcggtagaggacag

SEQ ID NO: 678215 - DNA, 25 bp, Mus musculus
gcatccccatctgggtagaggacag

SEQ ID NO: 678216 - DNA, 25 bp, Mus musculus
gcatcccctatgagcgacggcttct

SEQ ID NO: 678217 - DNA, 25 bp, Mus musculus
gcatcccctatgtgcgacggcttct

SEQ ID NO: 678218 - DNA, 25 bp, Mus musculus
gcatcccctgccaggaagtgaccag

SEQ ID NO: 678219 - DNA, 25 bp, Mus musculus
gcatcccctgcctggaagtgaccag

SEQ ID NO: 678220 - DNA, 25 bp, Mus musculus
gcatcccggatcattggtatcgaca

SEQ ID NO: 678221 - DNA, 25 bp, Mus musculus
gcatcccggatctttggtatcgaca

SEQ ID NO: 678222 - DNA, 25 bp, Mus musculus
gcatcccgtaccaggactacttcta

SEQ ID NO: 678223 - DNA, 25 bp, Mus musculus
gcatcccgtacctggactacttcta

SEQ ID NO: 678224 - DNA, 25 bp, Mus musculus
gcatccctggatcctgtgctgggtc

SEQ ID NO: 678225 - DNA, 25 bp, Mus musculus
gcatccctggatgctgtgctgggtc

SEQ ID NO: 678226 - DNA, 25 bp, Mus musculus
gcatccctgtttcaacaagattact

SEQ ID NO: 678227 - DNA, 25 bp, Mus musculus
gcatccctgtttgaacaagattact

SEQ ID NO: 678228 - DNA, 25 bp, Mus musculus
gcatccgaaacaccccagaaactga

SEQ ID NO: 678229 - DNA, 25 bp, Mus musculus
gcatccgaaacagcccagaaactga

SEQ ID NO: 678230 - DNA, 25 bp, Mus musculus
gcatccgaaccaccaaaatggtacc

SEQ ID NO: 678231 - DNA, 25 bp, Mus musculus
gcatccgaaccagcaaaatggtacc

SEQ ID NO: 678232 - DNA, 25 bp, Mus musculus
gcatccgaaggtctccccatgaggt

SEQ ID NO: 678233 - DNA, 25 bp, Mus musculus
gcatccgaaggtgtccccatgaggt

SEQ ID NO: 678234 - DNA, 25 bp, Mus musculus
gcatccgagactctgttgatggctc

SEQ ID NO: 678235 - DNA, 25 bp, Mus musculus
gcatccgagactgtgttgatggctc

SEQ ID NO: 678236 - DNA, 25 bp, Mus musculus
gcatccgagcaacaagacaactttg

SEQ ID NO: 678237 - DNA, 25 bp, Mus musculus
gcatccgagcaagaagacaactttg

SEQ ID NO: 678238 - DNA, 25 bp, Mus musculus
gcatccgaggctagtttaagaaggc

SEQ ID NO: 678239 - DNA, 25 bp, Mus musculus
gcatccgaggcttgtttaagaaggc

SEQ ID NO: 678240 - DNA, 25 bp, Mus musculus
gcatccgatggcctgaagaacttga

SEQ ID NO: 678241 - DNA, 25 bp, Mus musculus
gcatccgatggcgtgaagaacttga

SEQ ID NO: 678242 - DNA, 25 bp, Mus musculus
gcatccgcgagaacgagctcaagaa

SEQ ID NO: 678243 - DNA, 25 bp, Mus musculus
gcatccgcgagatcgagctcaagaa

SEQ ID NO: 678244 - DNA, 25 bp, Mus musculus
gcatccgcttgtagaaggccaccaa

SEQ ID NO: 678245 - DNA, 25 bp, Mus musculus
gcatccgcttgttgaaggccaccaa

SEQ ID NO: 678246 - DNA, 25 bp, Mus musculus
gcatccgggcacacggcaggtcgca

SEQ ID NO: 678247 - DNA, 25 bp, Mus musculus
gcatccgggcactcggcaggtcgca

SEQ ID NO: 678248 - DNA, 25 bp, Mus musculus
gcatccggttgaacaccaaggcctt

SEQ ID NO: 678249 - DNA, 25 bp, Mus musculus
gcatccggttgatcaccaaggcctt

SEQ ID NO: 678250 - DNA, 25 bp, Mus musculus
gcatccgtcgcgctagtccatacgt

SEQ ID NO: 678251 - DNA, 25 bp, Mus musculus
gcatccgtcgcggtagtccatacgt

SEQ ID NO: 678252 - DNA, 25 bp, Mus musculus
gcatccgtggcgagtactatctcaa

SEQ ID NO: 678253 - DNA, 25 bp, Mus musculus
gcatccgtggcgtgtactatctcaa

SEQ ID NO: 678254 - DNA, 25 bp, Mus musculus
gcatccgtttcccaggctacagtat

SEQ ID NO: 678255 - DNA, 25 bp, Mus musculus
gcatccgtttccgaggctacagtat

SEQ ID NO: 678256 - DNA, 25 bp, Mus musculus
gcatcctactaccagattctagacg

SEQ ID NO: 678257 - DNA, 25 bp, Mus musculus
gcatcctactacgagattctagacg

SEQ ID NO: 678258 - DNA, 25 bp, Mus musculus
gcatcctcatggctgtcttctcaaa

SEQ ID NO: 678259 - DNA, 25 bp, Mus musculus
gcatcctcatgggtgtcttctcaaa

SEQ ID NO: 678260 - DNA, 25 bp, Mus musculus
gcatcctccaagaggtacagaccgc

SEQ ID NO: 678261 - DNA, 25 bp, Mus musculus
gcatcctccaagtggtacagaccgc

SEQ ID NO: 678262 - DNA, 25 bp, Mus musculus
gcatcctcgatgagctggtcctgcc

SEQ ID NO: 678263 - DNA, 25 bp, Mus musculus
gcatcctcgatgtgctggtcctgcc

SEQ ID NO: 678264 - DNA, 25 bp, Mus musculus
gcatcctctcagcattcagccaatg

SEQ ID NO: 678265 - DNA, 25 bp, Mus musculus
gcatcctctcaggattcagccaatg

SEQ ID NO: 678266 - DNA, 25 bp, Mus musculus
gcatcctctgctaggctcgagcctt

SEQ ID NO: 678267 - DNA, 25 bp, Mus musculus
gcatcctctgcttggctcgagcctt

SEQ ID NO: 678268 - DNA, 25 bp, Mus musculus
gcatcctgaaggaactgctctcaaa

SEQ ID NO: 678269 - DNA, 25 bp, Mus musculus
gcatcctgaaggtactgctctcaaa

SEQ ID NO: 678270 - DNA, 25 bp, Mus musculus
gcatcctgcaggacggccgcatctt

SEQ ID NO: 678271 - DNA, 25 bp, Mus musculus
gcatcctgcaggtcggccgcatctt

SEQ ID NO: 678272 - DNA, 25 bp, Mus musculus
gcatcctgccttcataaacttggtg

SEQ ID NO: 678273 - DNA, 25 bp, Mus musculus
gcatcctgccttgataaacttggtg

SEQ ID NO: 678274 - DNA, 25 bp, Mus musculus
gcatcctgcggaactttagggcccg

SEQ ID NO: 678275 - DNA, 25 bp, Mus musculus
gcatcctgcggatctttagggcccg

SEQ ID NO: 678276 - DNA, 25 bp, Mus musculus
gcatcctggaacaactacggacagt

SEQ ID NO: 678277 - DNA, 25 bp, Mus musculus
gcatcctggaactactacggacagt

SEQ ID NO: 678278 - DNA, 25 bp, Mus musculus
gcatcctggaggatcaggccaagaa

SEQ ID NO: 678279 - DNA, 25 bp, Mus musculus
gcatcctggaggttcaggccaagaa

SEQ ID NO: 678280 - DNA, 25 bp, Mus musculus
gcatcctggcacagtgtgtccacca

SEQ ID NO: 678281 - DNA, 25 bp, Mus musculus
gcatcctggcactgtgtgtccacca

SEQ ID NO: 678282 - DNA, 25 bp, Mus musculus
gcatcctggcctatgtctattatca

SEQ ID NO: 678283 - DNA, 25 bp, Mus musculus
gcatcctggcctttgtctattatca

SEQ ID NO: 678284 - DNA, 25 bp, Mus musculus
gcatcctgtacaatacctgtgtctg

SEQ ID NO: 678285 - DNA, 25 bp, Mus musculus
gcatcctgtacattacctgtgtctg

SEQ ID NO: 678286 - DNA, 25 bp, Mus musculus
gcatcctgtgctcgcactgcctggg

SEQ ID NO: 678287 - DNA, 25 bp, Mus musculus
gcatcctgtgctggcactgcctggg

SEQ ID NO: 678288 - DNA, 25 bp, Mus musculus
gcatccttgctgagcactaccggga

SEQ ID NO: 678289 - DNA, 25 bp, Mus musculus
gcatccttgctgtgcactaccggga

SEQ ID NO: 678290 - DNA, 25 bp, Mus musculus
gcatccttggagcaggcaaccttag

SEQ ID NO: 678291 - DNA, 25 bp, Mus musculus
gcatccttggaggaggcaaccttag

SEQ ID NO: 678292 - DNA, 25 bp, Mus musculus
gcatccttggctagggagaccttgg

SEQ ID NO: 678293 - DNA, 25 bp, Mus musculus
gcatccttggcttgggagaccttgg

SEQ ID NO: 678294 - DNA, 25 bp, Mus musculus
gcatccttggtccaggacttcctca

SEQ ID NO: 678295 - DNA, 25 bp, Mus musculus
gcatccttggtcgaggacttcctca

SEQ ID NO: 678296 - DNA, 25 bp, Mus musculus
gcatcgaaaggcatatcaacaagaa

SEQ ID NO: 678297 - DNA, 25 bp, Mus musculus
gcatcgaaaggcttatcaacaagaa

SEQ ID NO: 678298 - DNA, 25 bp, Mus musculus
gcatcgacaacaagcgccatgcagc

SEQ ID NO: 678299 - DNA, 25 bp, Mus musculus
gcatcgacaacatgcgccatgcagc

SEQ ID NO: 678300 - DNA, 25 bp, Mus musculus
gcatcgacagccactcgctgtcaga

SEQ ID NO: 678301 - DNA, 25 bp, Mus musculus
gcatcgacagcctctcgctgtcaga

SEQ ID NO: 678302 - DNA, 25 bp, Mus musculus
gcatcgacggtccagctgctttcct

SEQ ID NO: 678303 - DNA, 25 bp, Mus musculus
gcatcgacggtcgagctgctttcct

SEQ ID NO: 678304 - DNA, 25 bp, Mus musculus
gcatcgacgtaacggaagagctctt

SEQ ID NO: 678305 - DNA, 25 bp, Mus musculus
gcatcgacgtaagggaagagctctt

SEQ ID NO: 678306 - DNA, 25 bp, Mus musculus
gcatcgagacgcaagagcggcacgt

SEQ ID NO: 678307 - DNA, 25 bp, Mus musculus
gcatcgagacgctagagcggcacgt

SEQ ID NO: 678308 - DNA, 25 bp, Mus musculus
gcatcgagagctccgagaagattcc

SEQ ID NO: 678309 - DNA, 25 bp, Mus musculus
gcatcgagagctgcgagaagattcc

SEQ ID NO: 678310 - DNA, 25 bp, Mus musculus
gcatcgagggatctggataccacca

SEQ ID NO: 678311 - DNA, 25 bp, Mus musculus
gcatcgagggatgtggataccacca

SEQ ID NO: 678312 - DNA, 25 bp, Mus musculus
gcatcgagtcggaaattgtgatcct

SEQ ID NO: 678313 - DNA, 25 bp, Mus musculus
gcatcgagtcggtaattgtgatcct

SEQ ID NO: 678314 - DNA, 25 bp, Mus musculus
gcatcgagtctcattcgcttgctag

SEQ ID NO: 678315 - DNA, 25 bp, Mus musculus
gcatcgagtctctttcgcttgctag

SEQ ID NO: 678316 - DNA, 25 bp, Mus musculus
gcatcgatcaggaggttttagaaag

SEQ ID NO: 678317 - DNA, 25 bp, Mus musculus
gcatcgatcaggtggttttagaaag

SEQ ID NO: 678318 - DNA, 25 bp, Mus musculus
gcatcgatctttcacctgtgctgta

SEQ ID NO: 678319 - DNA, 25 bp, Mus musculus
gcatcgatctttgacctgtgctgta

SEQ ID NO: 678320 - DNA, 25 bp, Mus musculus
gcatcgatggttctttcactgccag

SEQ ID NO: 678321 - DNA, 25 bp, Mus musculus
gcatcgatggttgtttcactgccag

SEQ ID NO: 678322 - DNA, 25 bp, Mus musculus
gcatcgcagatgatttgcacatgaa

SEQ ID NO: 678323 - DNA, 25 bp, Mus musculus
gcatcgcagatgttttgcacatgaa

SEQ ID NO: 678324 - DNA, 25 bp, Mus musculus
gcatcgcagctaaccttgtcaacgc

SEQ ID NO: 678325 - DNA, 25 bp, Mus musculus
gcatcgcagctatccttgtcaacgc

SEQ ID NO: 678326 - DNA, 25 bp, Mus musculus
gcatcgcaggacaagacctcaatga

SEQ ID NO: 678327 - DNA, 25 bp, Mus musculus
gcatcgcaggactagacctcaatga

SEQ ID NO: 678328 - DNA, 25 bp, Mus musculus
gcatcgcctgttagcagtacagaga

SEQ ID NO: 678329 - DNA, 25 bp, Mus musculus
gcatcgcctgtttgcagtacagaga

SEQ ID NO: 678330 - DNA, 25 bp, Mus musculus
gcatcgccttctccgatggagagcg

SEQ ID NO: 678331 - DNA, 25 bp, Mus musculus
gcatcgccttctgcgatggagagcg

SEQ ID NO: 678332 - DNA, 25 bp, Mus musculus
gcatcgcgaacaaaggagcccgcgt

SEQ ID NO: 678333 - DNA, 25 bp, Mus musculus
gcatcgcgaacataggagcccgcgt

SEQ ID NO: 678334 - DNA, 25 bp, Mus musculus
gcatcgcggaggatcgcggacatcc

SEQ ID NO: 678335 - DNA, 25 bp, Mus musculus
gcatcgcggaggttcgcggacatcc

SEQ ID NO: 678336 - DNA, 25 bp, Mus musculus
gcatcgcgggcgacaggatccccga

SEQ ID NO: 678337 - DNA, 25 bp, Mus musculus
gcatcgcgggcgtcaggatccccga

SEQ ID NO: 678338 - DNA, 25 bp, Mus musculus
gcatcgcggtcaatagtaggagaag

SEQ ID NO: 678339 - DNA, 25 bp, Mus musculus
gcatcgcggtcattagtaggagaag

SEQ ID NO: 678340 - DNA, 25 bp, Mus musculus
gcatcgctcctgaccacaggaatca

SEQ ID NO: 678341 - DNA, 25 bp, Mus musculus
gcatcgctcctgtccacaggaatca

SEQ ID NO: 678342 - DNA, 25 bp, Mus musculus
gcatcgctgcccaaaaggccttgga

SEQ ID NO: 678343 - DNA, 25 bp, Mus musculus
gcatcgctgccctaaaggccttgga

SEQ ID NO: 678344 - DNA, 25 bp, Mus musculus
gcatcgctgtctctgccaatctgct

SEQ ID NO: 678345 - DNA, 25 bp, Mus musculus
gcatcgctgtctgtgccaatctgct

SEQ ID NO: 678346 - DNA, 25 bp, Mus musculus
gcatcgcttcagcaggttctgacca

SEQ ID NO: 678347 - DNA, 25 bp, Mus musculus
gcatcgcttcaggaggttctgacca

SEQ ID NO: 678348 - DNA, 25 bp, Mus musculus
gcatcggagacacaagcacggttca

SEQ ID NO: 678349 - DNA, 25 bp, Mus musculus
gcatcggagacaccccgaaccagga

SEQ ID NO: 678350 - DNA, 25 bp, Mus musculus
gcatcggagacagaagcacggttca

SEQ ID NO: 678351 - DNA, 25 bp, Mus musculus
gcatcggagacagcccgaaccagga

SEQ ID NO: 678352 - DNA, 25 bp, Mus musculus
gcatcggaggtgagataggatccct

SEQ ID NO: 678353 - DNA, 25 bp, Mus musculus
gcatcggaggtgtgataggatccct

SEQ ID NO: 678354 - DNA, 25 bp, Mus musculus
gcatcggcaactaacttttttgaag

SEQ ID NO: 678355 - DNA, 25 bp, Mus musculus
gcatcggcaacttacttttttgaag

SEQ ID NO: 678356 - DNA, 25 bp, Mus musculus
gcatcggcaatgcaagcacgctgtt

SEQ ID NO: 678357 - DNA, 25 bp, Mus musculus
gcatcggcaatggaagcacgctgtt

SEQ ID NO: 678358 - DNA, 25 bp, Mus musculus
gcatcggcatgtctgacattgacat

SEQ ID NO: 678359 - DNA, 25 bp, Mus musculus
gcatcggcatgtgtgacattgacat

SEQ ID NO: 678360 - DNA, 25 bp, Mus musculus
gcatcggcgaccatcaggcctttgt

SEQ ID NO: 678361 - DNA, 25 bp, Mus musculus
gcatcggcgaccttcaggcctttgt

SEQ ID NO: 678362 - DNA, 25 bp, Mus musculus
gcatcgtcacctcccgagacattga

SEQ ID NO: 678363 - DNA, 25 bp, Mus musculus
gcatcgtcacctgccgagacattga

SEQ ID NO: 678364 - DNA, 25 bp, Mus musculus
gcatcgtcaggtctgcagatgaagt

SEQ ID NO: 678365 - DNA, 25 bp, Mus musculus
gcatcgtcaggtgtgcagatgaagt

SEQ ID NO: 678366 - DNA, 25 bp, Mus musculus
gcatcgtctcctacgggcaaactga

SEQ ID NO: 678367 - DNA, 25 bp, Mus musculus
gcatcgtctccttcgggcaaactga

SEQ ID NO: 678368 - DNA, 25 bp, Mus musculus
gcatcgtgatctacgcacctgcgct

SEQ ID NO: 678369 - DNA, 25 bp, Mus musculus
gcatcgtgatcttcgcacctgcgct

SEQ ID NO: 678370 - DNA, 25 bp, Mus musculus
gcatcgtggagaaaagctctttgtg

SEQ ID NO: 678371 - DNA, 25 bp, Mus musculus
gcatcgtggagataagctctttgtg

SEQ ID NO: 678372 - DNA, 25 bp, Mus musculus
gcatcgtggcatacccgaggttgga

SEQ ID NO: 678373 - DNA, 25 bp, Mus musculus
gcatcgtggcattcccgaggttgga

SEQ ID NO: 678374 - DNA, 25 bp, Mus musculus
gcatcgtggcgtccctcctcatttg

SEQ ID NO: 678375 - DNA, 25 bp, Mus musculus
gcatcgtggcgtgcctcctcatttg

SEQ ID NO: 678376 - DNA, 25 bp, Mus musculus
gcatcgtgggtgaccaagcgcagtc

SEQ ID NO: 678377 - DNA, 25 bp, Mus musculus
gcatcgtgggtgtccaagcgcagtc

SEQ ID NO: 678378 - DNA, 25 bp, Mus musculus
gcatcgtgtggcagttaagaagctg

SEQ ID NO: 678379 - DNA, 25 bp, Mus musculus
gcatcgtgtggctgttaagaagctg

SEQ ID NO: 678380 - DNA, 25 bp, Mus musculus
gcatcgttctgcctcagattatgac

SEQ ID NO: 678381 - DNA, 25 bp, Mus musculus
gcatcgttctgcgtcagattatgac

SEQ ID NO: 678382 - DNA, 25 bp, Mus musculus
gcatcgttgaggatggccttccaat

SEQ ID NO: 678383 - DNA, 25 bp, Mus musculus
gcatcgttgaggttggccttccaat

SEQ ID NO: 678384 - DNA, 25 bp, Mus musculus
gcatcgtttccaagtgttttgagcc

SEQ ID NO: 678385 - DNA, 25 bp, Mus musculus
gcatcgtttccatgtgttttgagcc

SEQ ID NO: 678386 - DNA, 25 bp, Mus musculus
gcatctaaccaaatggcctggccct

SEQ ID NO: 678387 - DNA, 25 bp, Mus musculus
gcatctaaccaattggcctggccct

SEQ ID NO: 678388 - DNA, 25 bp, Mus musculus
gcatctaagccaaactgtagcccag

SEQ ID NO: 678389 - DNA, 25 bp, Mus musculus
gcatctaagccatactgtagcccag

SEQ ID NO: 678390 - DNA, 25 bp, Mus musculus
gcatctacaagcagggccttaaatg

SEQ ID NO: 678391 - DNA, 25 bp, Mus musculus
gcatctacaagctgggccttaaatg

SEQ ID NO: 678392 - DNA, 25 bp, Mus musculus
gcatctacagagaagggaccacttg

SEQ ID NO: 678393 - DNA, 25 bp, Mus musculus
gcatctacagagtagggaccacttg

SEQ ID NO: 678394 - DNA, 25 bp, Mus musculus
gcatctacgtcacggaagcccagga

SEQ ID NO: 678395 - DNA, 25 bp, Mus musculus
gcatctacgtcagggaagcccagga

SEQ ID NO: 678396 - DNA, 25 bp, Mus musculus
gcatctactatgaacccaactgtag

SEQ ID NO: 678397 - DNA, 25 bp, Mus musculus
gcatctactatgtacccaactgtag

SEQ ID NO: 678398 - DNA, 25 bp, Mus musculus
gcatctagcccaagtgctttgaatt

SEQ ID NO: 678399 - DNA, 25 bp, Mus musculus
gcatctagcccatgtgctttgaatt

SEQ ID NO: 678400 - DNA, 25 bp, Mus musculus
gcatctagggttcaaagcttgaaca

SEQ ID NO: 678401 - DNA, 25 bp, Mus musculus
gcatctagggttgaaagcttgaaca

SEQ ID NO: 678402 - DNA, 25 bp, Mus musculus
gcatctagtcttcctggctcagcaa

SEQ ID NO: 678403 - DNA, 25 bp, Mus musculus
gcatctagtcttgctggctcagcaa

SEQ ID NO: 678404 - DNA, 25 bp, Mus musculus
gcatctcactgtacaagtggcccaa

SEQ ID NO: 678405 - DNA, 25 bp, Mus musculus
gcatctcactgttcaagtggcccaa

SEQ ID NO: 678406 - DNA, 25 bp, Mus musculus
gcatctcagacaagctgatggtgca

SEQ ID NO: 678407 - DNA, 25 bp, Mus musculus
gcatctcagacatgctgatggtgca

SEQ ID NO: 678408 - DNA, 25 bp, Mus musculus
gcatctcattagctgtccgctcggg

SEQ ID NO: 678409 - DNA, 25 bp, Mus musculus
gcatctcattaggtgtccgctcggg

SEQ ID NO: 678410 - DNA, 25 bp, Mus musculus
gcatctccaaaaaatcgagcccaga

SEQ ID NO: 678411 - DNA, 25 bp, Mus musculus
gcatctccaaaatatcgagcccaga

SEQ ID NO: 678412 - DNA, 25 bp, Mus musculus
gcatctccaacccatgtcagaatga

SEQ ID NO: 678413 - DNA, 25 bp, Mus musculus
gcatctccaaccgatgtcagaatga

SEQ ID NO: 678414 - DNA, 25 bp, Mus musculus
gcatctccacacagcttcccgatga

SEQ ID NO: 678415 - DNA, 25 bp, Mus musculus
gcatctccacactgcttcccgatga

SEQ ID NO: 678416 - DNA, 25 bp, Mus musculus
gcatctcccaatatcagagaccgaa

SEQ ID NO: 678417 - DNA, 25 bp, Mus musculus
gcatctcccaatttcagagaccgaa

SEQ ID NO: 678418 - DNA, 25 bp, Mus musculus
gcatctccccgcagtttgtgtgtga

SEQ ID NO: 678419 - DNA, 25 bp, Mus musculus
gcatctccccgctgtttgtgtgtga

SEQ ID NO: 678420 - DNA, 25 bp, Mus musculus
gcatctccccttccatgcttagtaa

SEQ ID NO: 678421 - DNA, 25 bp, Mus musculus
gcatctccccttgcatgcttagtaa

SEQ ID NO: 678422 - DNA, 25 bp, Mus musculus
gcatctccctccctgaagagtactt

SEQ ID NO: 678423 - DNA, 25 bp, Mus musculus
gcatctccctccgtgaagagtactt

SEQ ID NO: 678424 - DNA, 25 bp, Mus musculus
gcatctcgctagcaagctggtccta

SEQ ID NO: 678425 - DNA, 25 bp, Mus musculus
gcatctcgctaggaagctggtccta

SEQ ID NO: 678426 - DNA, 25 bp, Mus musculus
gcatctcggaaacgctgtgggccat

SEQ ID NO: 678427 - DNA, 25 bp, Mus musculus
gcatctcggaaaggctgtgggccat

SEQ ID NO: 678428 - DNA, 25 bp, Mus musculus
gcatctcggatacggagtatctcca

SEQ ID NO: 678429 - DNA, 25 bp, Mus musculus
gcatctcggatagggagtatctcca

SEQ ID NO: 678430 - DNA, 25 bp, Mus musculus
gcatctcggcaacatagagtttatc

SEQ ID NO: 678431 - DNA, 25 bp, Mus musculus
gcatctcggcaagatagagtttatc

SEQ ID NO: 678432 - DNA, 25 bp, Mus musculus
gcatctcggccgcttgctcatggtg

SEQ ID NO: 678433 - DNA, 25 bp, Mus musculus
gcatctcggccggttgctcatggtg

SEQ ID NO: 678434 - DNA, 25 bp, Mus musculus
gcatctcgggcaactttcgcttcgt

SEQ ID NO: 678435 - DNA, 25 bp, Mus musculus
gcatctcgggcatctttcgcttcgt

SEQ ID NO: 678436 - DNA, 25 bp, Mus musculus
gcatctcgggctcctgtgtaccgca

SEQ ID NO: 678437 - DNA, 25 bp, Mus musculus
gcatctcgggctgctgtgtaccgca

SEQ ID NO: 678438 - DNA, 25 bp, Mus musculus
gcatctctaaggaggaatgagccca

SEQ ID NO: 678439 - DNA, 25 bp, Mus musculus
gcatctctaaggtggaatgagccca

SEQ ID NO: 678440 - DNA, 25 bp, Mus musculus
gcatctctcagtcggttccagtatg

SEQ ID NO: 678441 - DNA, 25 bp, Mus musculus
gcatctctcagtgggttccagtatg

SEQ ID NO: 678442 - DNA, 25 bp, Mus musculus
gcatctctgagaactccatcatttt

SEQ ID NO: 678443 - DNA, 25 bp, Mus musculus
gcatctctgagatctccatcatttt

SEQ ID NO: 678444 - DNA, 25 bp, Mus musculus
gcatctctggcaactggcatcctct

SEQ ID NO: 678445 - DNA, 25 bp, Mus musculus
gcatctctggcatctggcatcctct

SEQ ID NO: 678446 - DNA, 25 bp, Mus musculus
gcatctcttagaaatgctgaccccg

SEQ ID NO: 678447 - DNA, 25 bp, Mus musculus
gcatctcttagatatgctgaccccg

SEQ ID NO: 678448 - DNA, 25 bp, Mus musculus
gcatctcttcctaaatctatggagg

SEQ ID NO: 678449 - DNA, 25 bp, Mus musculus
gcatctcttcctctgtggaccgagg

SEQ ID NO: 678450 - DNA, 25 bp, Mus musculus
gcatctcttcctgtgtggaccgagg

SEQ ID NO: 678451 - DNA, 25 bp, Mus musculus
gcatctcttccttaatctatggagg

SEQ ID NO: 678452 - DNA, 25 bp, Mus musculus
gcatctcttctacaaggtggctgag

SEQ ID NO: 678453 - DNA, 25 bp, Mus musculus
gcatctcttctagaaggtggctgag

SEQ ID NO: 678454 - DNA, 25 bp, Mus musculus
gcatctcttgttatgaagccatgac

SEQ ID NO: 678455 - DNA, 25 bp, Mus musculus
gcatctcttgttttgaagccatgac

SEQ ID NO: 678456 - DNA, 25 bp, Mus musculus
gcatctgaaaatcctcaacactcca

SEQ ID NO: 678457 - DNA, 25 bp, Mus musculus
gcatctgaaaatgctcaacactcca

SEQ ID NO: 678458 - DNA, 25 bp, Mus musculus
gcatctgaagataaatccattaaag

SEQ ID NO: 678459 - DNA, 25 bp, Mus musculus
gcatctgaagattaatccattaaag

SEQ ID NO: 678460 - DNA, 25 bp, Mus musculus
gcatctgaaggaattctatctcact

SEQ ID NO: 678461 - DNA, 25 bp, Mus musculus
gcatctgaaggatttctatctcact

SEQ ID NO: 678462 - DNA, 25 bp, Mus musculus
gcatctgactggaagctagaccaac

SEQ ID NO: 678463 - DNA, 25 bp, Mus musculus
gcatctgactggtagctagaccaac

SEQ ID NO: 678464 - DNA, 25 bp, Mus musculus
gcatctgatggaccctgttgtcaaa

SEQ ID NO: 678465 - DNA, 25 bp, Mus musculus
gcatctgatggagcctgttgtcaaa

SEQ ID NO: 678466 - DNA, 25 bp, Mus musculus
gcatctgcatttcaccagcttatcc

SEQ ID NO: 678467 - DNA, 25 bp, Mus musculus
gcatctgcatttgaccagcttatcc

SEQ ID NO: 678468 - DNA, 25 bp, Mus musculus
gcatctgcgaagcaatgagcgtctc

SEQ ID NO: 678469 - DNA, 25 bp, Mus musculus
gcatctgcgaaggaatgagcgtctc

SEQ ID NO: 678470 - DNA, 25 bp, Mus musculus
gcatctggaggaaacgtgaatatta

SEQ ID NO: 678471 - DNA, 25 bp, Mus musculus
gcatctggaggatacgtgaatatta

SEQ ID NO: 678472 - DNA, 25 bp, Mus musculus
gcatctggatggctctgctcaccac

SEQ ID NO: 678473 - DNA, 25 bp, Mus musculus
gcatctggatgggtctgctcaccac

SEQ ID NO: 678474 - DNA, 25 bp, Mus musculus
gcatctggcaaacatttatgccatg

SEQ ID NO: 678475 - DNA, 25 bp, Mus musculus
gcatctggcaaagatttatgccatg

SEQ ID NO: 678476 - DNA, 25 bp, Mus musculus
gcatctggcatcaatttatgagaag

SEQ ID NO: 678477 - DNA, 25 bp, Mus musculus
gcatctggcatctatttatgagaag

SEQ ID NO: 678478 - DNA, 25 bp, Mus musculus
gcatctggccccagtatctacgttt

SEQ ID NO: 678479 - DNA, 25 bp, Mus musculus
gcatctggcccctgtatctacgttt

SEQ ID NO: 678480 - DNA, 25 bp, Mus musculus
gcatctgggaaactctcgaaggaca

SEQ ID NO: 678481 - DNA, 25 bp, Mus musculus
gcatctgggaaagtctcgaaggaca

SEQ ID NO: 678482 - DNA, 25 bp, Mus musculus
gcatctgggcttcgcattggcactc

SEQ ID NO: 678483 - DNA, 25 bp, Mus musculus
gcatctgggcttggcattggcactc

SEQ ID NO: 678484 - DNA, 25 bp, Mus musculus
gcatctgtaatgaactggtgacctc

SEQ ID NO: 678485 - DNA, 25 bp, Mus musculus
gcatctgtaatgtactggtgacctc

SEQ ID NO: 678486 - DNA, 25 bp, Mus musculus
gcatctgtcgcaaaccggacatcaa

SEQ ID NO: 678487 - DNA, 25 bp, Mus musculus
gcatctgtcgcataccggacatcaa

SEQ ID NO: 678488 - DNA, 25 bp, Mus musculus
gcatctgtgaccatctctcggattt

SEQ ID NO: 678489 - DNA, 25 bp, Mus musculus
gcatctgtgaccttctctcggattt

SEQ ID NO: 678490 - DNA, 25 bp, Mus musculus
gcatctgtggcaaggcatccctcta

SEQ ID NO: 678491 - DNA, 25 bp, Mus musculus
gcatctgtggcatggcatccctcta

SEQ ID NO: 678492 - DNA, 25 bp, Mus musculus
gcatctgtggctcttgcgccatgaa

SEQ ID NO: 678493 - DNA, 25 bp, Mus musculus
gcatctgtggctgttgcgccatgaa

SEQ ID NO: 678494 - DNA, 25 bp, Mus musculus
gcatctgtgggcaacgggatcgacc

SEQ ID NO: 678495 - DNA, 25 bp, Mus musculus
gcatctgtgggctacgggatcgacc

SEQ ID NO: 678496 - DNA, 25 bp, Mus musculus
gcatctgtggtccttccagaggaaa

SEQ ID NO: 678497 - DNA, 25 bp, Mus musculus
gcatctgtggtcgttccagaggaaa

SEQ ID NO: 678498 - DNA, 25 bp, Mus musculus
gcatcttaacagaaatacagaggaa

SEQ ID NO: 678499 - DNA, 25 bp, Mus musculus
gcatcttaacagtaatacagaggaa

SEQ ID NO: 678500 - DNA, 25 bp, Mus musculus
gcatcttacatgagctcttcgcggg

SEQ ID NO: 678501 - DNA, 25 bp, Mus musculus
gcatcttacatgtgctcttcgcggg

SEQ ID NO: 678502 - DNA, 25 bp, Mus musculus
gcatcttaccatcgtgagcttggca

SEQ ID NO: 678503 - DNA, 25 bp, Mus musculus
gcatcttaccatggtgagcttggca

SEQ ID NO: 678504 - DNA, 25 bp, Mus musculus
gcatcttcagagaccggccagtgct

SEQ ID NO: 678505 - DNA, 25 bp, Mus musculus
gcatcttcagagtccggccagtgct

SEQ ID NO: 678506 - DNA, 25 bp, Mus musculus
gcatcttcatgcagctcctcatctt

SEQ ID NO: 678507 - DNA, 25 bp, Mus musculus
gcatcttcatgctgctcctcatctt

SEQ ID NO: 678508 - DNA, 25 bp, Mus musculus
gcatcttcgaaaaatgatatttcca

SEQ ID NO: 678509 - DNA, 25 bp, Mus musculus
gcatcttcgaaatatgatatttcca

SEQ ID NO: 678510 - DNA, 25 bp, Mus musculus
gcatcttgagtactgtgaactatga

SEQ ID NO: 678511 - DNA, 25 bp, Mus musculus
gcatcttgagtagtgtgaactatga

SEQ ID NO: 678512 - DNA, 25 bp, Mus musculus
gcatcttggacaacgggctgcgtgt

SEQ ID NO: 678513 - DNA, 25 bp, Mus musculus
gcatcttggacatcgggctgcgtgt

SEQ ID NO: 678514 - DNA, 25 bp, Mus musculus
gcatcttggagaacaatgggacccc

SEQ ID NO: 678515 - DNA, 25 bp, Mus musculus
gcatcttggagatcaatgggacccc

SEQ ID NO: 678516 - DNA, 25 bp, Mus musculus
gcatcttggcctctgtgaaagaaca

SEQ ID NO: 678517 - DNA, 25 bp, Mus musculus
gcatcttggcctgtgtgaaagaaca

SEQ ID NO: 678518 - DNA, 25 bp, Mus musculus
gcatcttgggcaccagcaaagtttc

SEQ ID NO: 678519 - DNA, 25 bp, Mus musculus
gcatcttgggcagcagcaaagtttc

SEQ ID NO: 678520 - DNA, 25 bp, Mus musculus
gcatcttgtttgctccaggcagcga

SEQ ID NO: 678521 - DNA, 25 bp, Mus musculus
gcatcttgtttggtccaggcagcga

SEQ ID NO: 678522 - DNA, 25 bp, Mus musculus
gcatctttaagccatcctgagtctg

SEQ ID NO: 678523 - DNA, 25 bp, Mus musculus
gcatctttaagcgatcctgagtctg

SEQ ID NO: 678524 - DNA, 25 bp, Mus musculus
gcatctttcacaacccaagacctgt

SEQ ID NO: 678525 - DNA, 25 bp, Mus musculus
gcatctttcacatcccaagacctgt

SEQ ID NO: 678526 - DNA, 25 bp, Mus musculus
gcatctttccccaaggccgactgga

SEQ ID NO: 678527 - DNA, 25 bp, Mus musculus
gcatctttcccctaggccgactgga

SEQ ID NO: 678528 - DNA, 25 bp, Mus musculus
gcatctttcctgcttagaagattta

SEQ ID NO: 678529 - DNA, 25 bp, Mus musculus
gcatctttcctggttagaagattta

SEQ ID NO: 678530 - DNA, 25 bp, Mus musculus
gcatctttggatatttcatcgtggg

SEQ ID NO: 678531 - DNA, 25 bp, Mus musculus
gcatctttggatttttcatcgtggg

SEQ ID NO: 678532 - DNA, 25 bp, Mus musculus
gcatctttggtaccgtgcagtatcg

SEQ ID NO: 678533 - DNA, 25 bp, Mus musculus
gcatctttggtagcgtgcagtatcg

SEQ ID NO: 678534 - DNA, 25 bp, Mus musculus
gcatgaaacccaaagtgttttttga

SEQ ID NO: 678535 - DNA, 25 bp, Mus musculus
gcatgaaacccatagtgttttttga

SEQ ID NO: 678536 - DNA, 25 bp, Mus musculus
gcatgaaagtcaaccgctcctgcgc

SEQ ID NO: 678537 - DNA, 25 bp, Mus musculus
gcatgaaagtcatccgctcctgcgc

SEQ ID NO: 678538 - DNA, 25 bp, Mus musculus
gcatgaacgtggagttggcctttct

SEQ ID NO: 678539 - DNA, 25 bp, Mus musculus
gcatgaacgtggtgttggcctttct

SEQ ID NO: 678540 - DNA, 25 bp, Mus musculus
gcatgaactcatcagggccgtgtct

SEQ ID NO: 678541 - DNA, 25 bp, Mus musculus
gcatgaactcatgagggccgtgtct

SEQ ID NO: 678542 - DNA, 25 bp, Mus musculus
gcatgaagaaaaccaccggcctttg

SEQ ID NO: 678543 - DNA, 25 bp, Mus musculus
gcatgaagaaaagcaccggcctttg

SEQ ID NO: 678544 - DNA, 25 bp, Mus musculus
gcatgaagcactacccagaagcagg

SEQ ID NO: 678545 - DNA, 25 bp, Mus musculus
gcatgaagcacttcccagaagcagg

SEQ ID NO: 678546 - DNA, 25 bp, Mus musculus
gcatgaagctggagacgtctcactc

SEQ ID NO: 678547 - DNA, 25 bp, Mus musculus
gcatgaagctggtgacgtctcactc

SEQ ID NO: 678548 - DNA, 25 bp, Mus musculus
gcatgaagtagtacgggacctgcct

SEQ ID NO: 678549 - DNA, 25 bp, Mus musculus
gcatgaagtagttcgggacctgcct

SEQ ID NO: 678550 - DNA, 25 bp, Mus musculus
gcatgaagtcttactcatccctcgc

SEQ ID NO: 678551 - DNA, 25 bp, Mus musculus
gcatgaagtcttcctgcagcgcctg

SEQ ID NO: 678552 - DNA, 25 bp, Mus musculus
gcatgaagtcttgctgcagcgcctg

SEQ ID NO: 678553 - DNA, 25 bp, Mus musculus
gcatgaagtctttctcatccctcgc

SEQ ID NO: 678554 - DNA, 25 bp, Mus musculus
gcatgaatatgaagagcaggtttga

SEQ ID NO: 678555 - DNA, 25 bp, Mus musculus
gcatgaatatgatgagcaggtttga

SEQ ID NO: 678556 - DNA, 25 bp, Mus musculus
gcatgaatatgcagagaagctctca

SEQ ID NO: 678557 - DNA, 25 bp, Mus musculus
gcatgaatatgctgagaagctctca

SEQ ID NO: 678558 - DNA, 25 bp, Mus musculus
gcatgaatgctgctgtccgcgctgt

SEQ ID NO: 678559 - DNA, 25 bp, Mus musculus
gcatgaatgctggtgtccgcgctgt

SEQ ID NO: 678560 - DNA, 25 bp, Mus musculus
gcatgaatgcttacatggcatatag

SEQ ID NO: 678561 - DNA, 25 bp, Mus musculus
gcatgaatgctttcatggcatatag

SEQ ID NO: 678562 - DNA, 25 bp, Mus musculus
gcatgaattcaaatgtaacagatgg

SEQ ID NO: 678563 - DNA, 25 bp, Mus musculus
gcatgaattcaattgtaacagatgg

SEQ ID NO: 678564 - DNA, 25 bp, Mus musculus
gcatgaattcctccaaacagaaata

SEQ ID NO: 678565 - DNA, 25 bp, Mus musculus
gcatgaattcctgcaaacagaaata

SEQ ID NO: 678566 - DNA, 25 bp, Mus musculus
gcatgacaaggtcttgaacctcatc

SEQ ID NO: 678567 - DNA, 25 bp, Mus musculus
gcatgacaaggtgttgaacctcatc

SEQ ID NO: 678568 - DNA, 25 bp, Mus musculus
gcatgacaggttatgtaataaactt

SEQ ID NO: 678569 - DNA, 25 bp, Mus musculus
gcatgacaggttttgtaataaactt

SEQ ID NO: 678570 - DNA, 25 bp, Mus musculus
gcatgaccatcgaaaacgcatgggt

SEQ ID NO: 678571 - DNA, 25 bp, Mus musculus
gcatgaccatcgtaaacgcatgggt

SEQ ID NO: 678572 - DNA, 25 bp, Mus musculus
gcatgacctcaacgctgctgcagct

SEQ ID NO: 678573 - DNA, 25 bp, Mus musculus
gcatgacctcaaggctgctgcagct

SEQ ID NO: 678574 - DNA, 25 bp, Mus musculus
gcatgacctgaaccatgggacccca

SEQ ID NO: 678575 - DNA, 25 bp, Mus musculus
gcatgacctgaagcatgggacccca

SEQ ID NO: 678576 - DNA, 25 bp, Mus musculus
gcatgacgaagcatggctcgcgctc

SEQ ID NO: 678577 - DNA, 25 bp, Mus musculus
gcatgacgaagcttggctcgcgctc

SEQ ID NO: 678578 - DNA, 25 bp, Mus musculus
gcatgacgtcctcctgagcaatgag

SEQ ID NO: 678579 - DNA, 25 bp, Mus musculus
gcatgacgtcctgctgagcaatgag

SEQ ID NO: 678580 - DNA, 25 bp, Mus musculus
gcatgactccaaccaaaatccacat

SEQ ID NO: 678581 - DNA, 25 bp, Mus musculus
gcatgactccaagcaaaatccacat

SEQ ID NO: 678582 - DNA, 25 bp, Mus musculus
gcatgactcctgcacagctcaagag

SEQ ID NO: 678583 - DNA, 25 bp, Mus musculus
gcatgactcctggacagctcaagag

SEQ ID NO: 678584 - DNA, 25 bp, Mus musculus
gcatgactgcaacaagaacgctaag

SEQ ID NO: 678585 - DNA, 25 bp, Mus musculus
gcatgactgcaagaagaacgctaag

SEQ ID NO: 678586 - DNA, 25 bp, Mus musculus
gcatgactgtttaaactggctgtct

SEQ ID NO: 678587 - DNA, 25 bp, Mus musculus
gcatgactgttttaactggctgtct

SEQ ID NO: 678588 - DNA, 25 bp, Mus musculus
gcatgagagcacatgtggcccagtt

SEQ ID NO: 678589 - DNA, 25 bp, Mus musculus
gcatgagagcacttgtggcccagtt

SEQ ID NO: 678590 - DNA, 25 bp, Mus musculus
gcatgagcagcgatgtggaagacaa

SEQ ID NO: 678591 - DNA, 25 bp, Mus musculus
gcatgagcagcgttgtggaagacaa

SEQ ID NO: 678592 - DNA, 25 bp, Mus musculus
gcatgagcagctccaagcgggaaga

SEQ ID NO: 678593 - DNA, 25 bp, Mus musculus
gcatgagcagctgcaagcgggaaga

SEQ ID NO: 678594 - DNA, 25 bp, Mus musculus
gcatgagcgagtagtaaaagctgct

SEQ ID NO: 678595 - DNA, 25 bp, Mus musculus
gcatgagcgagttgtaaaagctgct

SEQ ID NO: 678596 - DNA, 25 bp, Mus musculus
gcatgagctgttatgtgcttagtaa

SEQ ID NO: 678597 - DNA, 25 bp, Mus musculus
gcatgagctgttttgtgcttagtaa

SEQ ID NO: 678598 - DNA, 25 bp, Mus musculus
gcatgagctttaacagacacaatct

SEQ ID NO: 678599 - DNA, 25 bp, Mus musculus
gcatgagctttatcagacacaatct

SEQ ID NO: 678600 - DNA, 25 bp, Mus musculus
gcatgaggaacacgactgagcgcct

SEQ ID NO: 678601 - DNA, 25 bp, Mus musculus
gcatgaggaacaggactgagcgcct

SEQ ID NO: 678602 - DNA, 25 bp, Mus musculus
gcatgaggacgaagagctaaagcct

SEQ ID NO: 678603 - DNA, 25 bp, Mus musculus
gcatgaggacgatgagctaaagcct

SEQ ID NO: 678604 - DNA, 25 bp, Mus musculus
gcatgaggagctaattttctgacca

SEQ ID NO: 678605 - DNA, 25 bp, Mus musculus
gcatgaggagcttattttctgacca

SEQ ID NO: 678606 - DNA, 25 bp, Mus musculus
gcatgaggccctagttataatagaa

SEQ ID NO: 678607 - DNA, 25 bp, Mus musculus
gcatgaggcccttgttataatagaa

SEQ ID NO: 678608 - DNA, 25 bp, Mus musculus
gcatgagtgagtacatgggcctcat

SEQ ID NO: 678609 - DNA, 25 bp, Mus musculus
gcatgagtgagtacctgcgcgctct

SEQ ID NO: 678610 - DNA, 25 bp, Mus musculus
gcatgagtgagttcatgggcctcat

SEQ ID NO: 678611 - DNA, 25 bp, Mus musculus
gcatgagtgagttcctgcgcgctct

SEQ ID NO: 678612 - DNA, 25 bp, Mus musculus
gcatgagtggatcacacaagctgaa

SEQ ID NO: 678613 - DNA, 25 bp, Mus musculus
gcatgagtggatgacacaagctgaa

SEQ ID NO: 678614 - DNA, 25 bp, Mus musculus
gcatgataactgcacgagcgaattc

SEQ ID NO: 678615 - DNA, 25 bp, Mus musculus
gcatgataactggacgagcgaattc

SEQ ID NO: 678616 - DNA, 25 bp, Mus musculus
gcatgatcaacgagcagcaagtgga

SEQ ID NO: 678617 - DNA, 25 bp, Mus musculus
gcatgatcaacgtgcagcaagtgga

SEQ ID NO: 678618 - DNA, 25 bp, Mus musculus
gcatgatccaggaatccgactgcgg

SEQ ID NO: 678619 - DNA, 25 bp, Mus musculus
gcatgatccaggtatccgactgcgg

SEQ ID NO: 678620 - DNA, 25 bp, Mus musculus
gcatgatccctcagtctgccgtaga

SEQ ID NO: 678621 - DNA, 25 bp, Mus musculus
gcatgatccctctgtctgccgtaga

SEQ ID NO: 678622 - DNA, 25 bp, Mus musculus
gcatgatgcgtcagcgagcacagga

SEQ ID NO: 678623 - DNA, 25 bp, Mus musculus
gcatgatgcgtctgcgagcacagga

SEQ ID NO: 678624 - DNA, 25 bp, Mus musculus
gcatgatggagcacaccagtaaccc

SEQ ID NO: 678625 - DNA, 25 bp, Mus musculus
gcatgatggagctcaccagtaaccc

SEQ ID NO: 678626 - DNA, 25 bp, Mus musculus
gcatgatgggaacgtcatcactgca

SEQ ID NO: 678627 - DNA, 25 bp, Mus musculus
gcatgatgggaaggtcatcactgca

SEQ ID NO: 678628 - DNA, 25 bp, Mus musculus
gcatgatggtggactacaagaagag

SEQ ID NO: 678629 - DNA, 25 bp, Mus musculus
gcatgatggtggtctacaagaagag

SEQ ID NO: 678630 - DNA, 25 bp, Mus musculus
gcatgattaaccaggtcatgtccta

SEQ ID NO: 678631 - DNA, 25 bp, Mus musculus
gcatgattaacctggtcatgtccta

SEQ ID NO: 678632 - DNA, 25 bp, Mus musculus
gcatgattcaggatggtctttcaga

SEQ ID NO: 678633 - DNA, 25 bp, Mus musculus
gcatgattcaggttggtctttcaga

SEQ ID NO: 678634 - DNA, 25 bp, Mus musculus
gcatgattgcagatgcagtgaagaa

SEQ ID NO: 678635 - DNA, 25 bp, Mus musculus
gcatgattgcagttgcagtgaagaa

SEQ ID NO: 678636 - DNA, 25 bp, Mus musculus
gcatgcaagatcatcccctttctgt

SEQ ID NO: 678637 - DNA, 25 bp, Mus musculus
gcatgcaagatcttcccctttctgt

SEQ ID NO: 678638 - DNA, 25 bp, Mus musculus
gcatgcacaaggacagctagcggtg

SEQ ID NO: 678639 - DNA, 25 bp, Mus musculus
gcatgcacaaggtcagctagcggtg

SEQ ID NO: 678640 - DNA, 25 bp, Mus musculus
gcatgcacatctatcacctggactg

SEQ ID NO: 678641 - DNA, 25 bp, Mus musculus
gcatgcacatctttcacctggactg

SEQ ID NO: 678642 - DNA, 25 bp, Mus musculus
gcatgcacattgagagtatcctgga

SEQ ID NO: 678643 - DNA, 25 bp, Mus musculus
gcatgcacattgtgagtatcctgga

SEQ ID NO: 678644 - DNA, 25 bp, Mus musculus
gcatgcaccgtcctgccaggaagtt

SEQ ID NO: 678645 - DNA, 25 bp, Mus musculus
gcatgcaccgtcgtgccaggaagtt

SEQ ID NO: 678646 - DNA, 25 bp, Mus musculus
gcatgcactgacagggtggatacca
